United States Patent 10,706,955 (BIOINFORMATIC PROCESSES FOR DETERMINATION OF PEPTIDE BINDING) - sequence listing, part 52

SEQ ID NO: 1991500 - protein, 15 aa, Staphylococcus
TRNPKSKLGLATGGT

SEQ ID NO: 1991501 - protein, 8 aa, Staphylococcus
TRNSALSS

SEQ ID NO: 1991502 - protein, 7 aa, Staphylococcus
TRNSAQC

SEQ ID NO: 1991503 - protein, 7 aa, Staphylococcus
TRNSEQC

SEQ ID NO: 1991504 - protein, 8 aa, Staphylococcus
TRNSEQCA

SEQ ID NO: 1991505 - protein, 9 aa, Staphylococcus
TRNSEQCKQ

SEQ ID NO: 1991506 - protein, 8 aa, Staphylococcus
TRNSEQCR

SEQ ID NO: 1991507 - protein, 6 aa, Staphylococcus
TRPDCL

SEQ ID NO: 1991508 - protein, 8 aa, Staphylococcus
TRPDRQEL

SEQ ID NO: 1991509 - protein, 8 aa, Staphylococcus
TRPERQEL

SEQ ID NO: 1991510 - protein, 6 aa, Staphylococcus
TRPSDF

SEQ ID NO: 1991511 - protein, 9 aa, Staphylococcus
TRPSDIEKR

SEQ ID NO: 1991512 - protein, 11 aa, Staphylococcus
TRPSNVEKRNE

SEQ ID NO: 1991513 - protein, 4 aa, Staphylococcus
TRQG

SEQ ID NO: 1991514 - protein, 4 aa, Staphylococcus
TRQI

SEQ ID NO: 1991515 - protein, 4 aa, Staphylococcus
TRQL

SEQ ID NO: 1991516 - protein, 8 aa, Staphylococcus
TRQNDSSA

SEQ ID NO: 1991517 - protein, 10 aa, Staphylococcus
TRQNRQTIKT

SEQ ID NO: 1991518 - protein, 9 aa, Staphylococcus
TRQRGDGER

SEQ ID NO: 1991519 - protein, 4 aa, Staphylococcus
TRQT

SEQ ID NO: 1991520 - protein, 6 aa, Staphylococcus
TRQTGA

SEQ ID NO: 1991521 - protein, 9 aa, Staphylococcus
TRRANNKKN

SEQ ID NO: 1991522 - protein, 18 aa, Staphylococcus
TRRDGDKFKLNGSHGHKK

SEQ ID NO: 1991523 - protein, 5 aa, Staphylococcus
TRRED

SEQ ID NO: 1991524 - protein, 8 aa, Staphylococcus
TRRGQEID

SEQ ID NO: 1991525 - protein, 6 aa, Staphylococcus
TRRLSA

SEQ ID NO: 1991526 - protein, 7 aa, Staphylococcus
TRRLTSK

SEQ ID NO: 1991527 - protein, 10 aa, Staphylococcus
TRRPASFPAH

SEQ ID NO: 1991528 - protein, 29 aa, Staphylococcus
TRRQHSKHQLNSEDSLLPENNDIYERPKG

SEQ ID NO: 1991529 - protein, 5 aa, Staphylococcus
TRRRK

SEQ ID NO: 1991530 - protein, 7 aa, Staphylococcus
TRRVPDT

SEQ ID NO: 1991531 - protein, 12 aa, Staphylococcus
TRRYGAKKNKIH

SEQ ID NO: 1991532 - protein, 22 aa, Staphylococcus
TRSDFLPDKDDPSYDEKAQQVH

SEQ ID NO: 1991533 - protein, 13 aa, Staphylococcus
TRSHRSENGSITS

SEQ ID NO: 1991534 - protein, 10 aa, Staphylococcus
TRSNRQTVKT

SEQ ID NO: 1991535 - protein, 12 aa, Staphylococcus
TRSPRKITSPEV

SEQ ID NO: 1991536 - protein, 19 aa, Staphylococcus
TRSRPKQSRLGKRERFKAD

SEQ ID NO: 1991537 - protein, 8 aa, Staphylococcus
TRSTHQCT

SEQ ID NO: 1991538 - protein, 19 aa, Staphylococcus
TRSVQDDTHEGGKVQTDFS

SEQ ID NO: 1991539 - protein, 9 aa, Staphylococcus
TRTANYSQL

SEQ ID NO: 1991540 - protein, 19 aa, Staphylococcus
TRTDSTRISAGAKAETKEF

SEQ ID NO: 1991541 - protein, 13 aa, Staphylococcus
TRTGNDGQYTKKG

SEQ ID NO: 1991542 - protein, 6 aa, Staphylococcus
TRTITR

SEQ ID NO: 1991543 - protein, 6 aa, Staphylococcus
TRTKET

SEQ ID NO: 1991544 - protein, 5 aa, Staphylococcus
TRTLR

SEQ ID NO: 1991545 - protein, 11 aa, Staphylococcus
TRTNKDIAQPI

SEQ ID NO: 1991546 - protein, 6 aa, Staphylococcus
TRTQAL

SEQ ID NO: 1991547 - protein, 6 aa, Staphylococcus
TRTQET

SEQ ID NO: 1991548 - protein, 14 aa, Staphylococcus
TRTSFNTPKSVTIQ

SEQ ID NO: 1991549 - protein, 8 aa, Staphylococcus
TRTTPQCE

SEQ ID NO: 1991550 - protein, 8 aa, Staphylococcus
TRTTQQCQ

SEQ ID NO: 1991551 - protein, 11 aa, Staphylococcus
TRTVDDGDVSL

SEQ ID NO: 1991552 - protein, 8 aa, Staphylococcus
TRVSSPVQ

SEQ ID NO: 1991553 - protein, 12 aa, Staphylococcus
TRYEDTKDNQTV

SEQ ID NO: 1991554 - protein, 12 aa, Staphylococcus
TRYISNNDGEIY

SEQ ID NO: 1991555 - protein, 4 aa, Staphylococcus
TRYP

SEQ ID NO: 1991556 - protein, 23 aa, Staphylococcus
TRYQSGRTHSRDTITKNDNKKER

SEQ ID NO: 1991557 - protein, 13 aa, Staphylococcus
TRYRLQPENSTMS

SEQ ID NO: 1991558 - protein, 5 aa, Staphylococcus
TRYTK

SEQ ID NO: 1991559 - protein, 10 aa, Staphylococcus
TRYYANSDQR

SEQ ID NO: 1991560 - protein, 10 aa, Staphylococcus
TSAATTAAWD

SEQ ID NO: 1991561 - protein, 10 aa, Staphylococcus
TSAATTAEWD

SEQ ID NO: 1991562 - protein, 10 aa, Staphylococcus
TSAATTAQWD

SEQ ID NO: 1991563 - protein, 10 aa, Staphylococcus
TSAATTAQWN

SEQ ID NO: 1991564 - protein, 10 aa, Staphylococcus
TSAATTASWQ

SEQ ID NO: 1991565 - protein, 12 aa, Staphylococcus
TSACSSKKASLN

SEQ ID NO: 1991566 - protein, 10 aa, Staphylococcus
TSACSSKRGH

SEQ ID NO: 1991567 - protein, 9 aa, Staphylococcus
TSADNTNKT

SEQ ID NO: 1991568 - protein, 16 aa, Staphylococcus
TSADSKETFENKIKEE

SEQ ID NO: 1991569 - protein, 5 aa, Staphylococcus
TSAEI

SEQ ID NO: 1991570 - protein, 9 aa, Staphylococcus
TSAGLDYNK

SEQ ID NO: 1991571 - protein, 9 aa, Staphylococcus
TSAGLNNND

SEQ ID NO: 1991572 - protein, 14 aa, Staphylococcus
TSAGSQVSATLSSP

SEQ ID NO: 1991573 - protein, 6 aa, Staphylococcus
TSAIPE

SEQ ID NO: 1991574 - protein, 5 aa, Staphylococcus
TSAIR

SEQ ID NO: 1991575 - protein, 14 aa, Staphylococcus
TSALDIETENKIQK

SEQ ID NO: 1991576 - protein, 10 aa, Staphylococcus
TSALDTANKR

SEQ ID NO: 1991577 - protein, 7 aa, Staphylococcus
TSAMPDE

SEQ ID NO: 1991578 - protein, 17 aa, Staphylococcus
TSANTGGVMKVPEYLIE

SEQ ID NO: 1991579 - protein, 7 aa, Staphylococcus
TSANYGL

SEQ ID NO: 1991580 - protein, 5 aa, Staphylococcus
TSAQE

SEQ ID NO: 1991581 - protein, 5 aa, Staphylococcus
TSAQT

SEQ ID NO: 1991582 - protein, 4 aa, Staphylococcus
TSAS

SEQ ID NO: 1991583 - protein, 5 aa, Staphylococcus
TSATY

SEQ ID NO: 1991584 - protein, 4 aa, Staphylococcus
TSAV

SEQ ID NO: 1991585 - protein, 19 aa, Staphylococcus
TSAVKYTENYKPVAKSSTM

SEQ ID NO: 1991586 - protein, 6 aa, Staphylococcus
TSAYSG

SEQ ID NO: 1991587 - protein, 7 aa, Staphylococcus
TSAYTGK

SEQ ID NO: 1991588 - protein, 13 aa, Staphylococcus
TSAYYGPYKRPQR

SEQ ID NO: 1991589 - protein, 6 aa, Staphylococcus
TSDAAG

SEQ ID NO: 1991590 - protein, 7 aa, Staphylococcus
TSDAELA

SEQ ID NO: 1991591 - protein, 8 aa, Staphylococcus
TSDDGNSF

SEQ ID NO: 1991592 - protein, 7 aa, Staphylococcus
TSDDGSL

SEQ ID NO: 1991593 - protein, 7 aa, Staphylococcus
TSDDGTL

SEQ ID NO: 1991594 - protein, 6 aa, Staphylococcus
TSDDIK

SEQ ID NO: 1991595 - protein, 7 aa, Staphylococcus
TSDDSKF

SEQ ID NO: 1991596 - protein, 4 aa, Staphylococcus
TSDE

SEQ ID NO: 1991597 - protein, 6 aa, Staphylococcus
TSDEQM

SEQ ID NO: 1991598 - protein, 10 aa, Staphylococcus
TSDESGASQL

SEQ ID NO: 1991599 - protein, 7 aa, Staphylococcus
TSDGENI

SEQ ID NO: 1991600 - protein, 4 aa, Staphylococcus
TSDI

SEQ ID NO: 1991601 - protein, 8 aa, Staphylococcus
TSDIDGEI

SEQ ID NO: 1991602 - protein, 9 aa, Staphylococcus
TSDIGKDIK

SEQ ID NO: 1991603 - protein, 10 aa, Staphylococcus
TSDIQGGINA

SEQ ID NO: 1991604 - protein, 12 aa, Staphylococcus
TSDITHAGVEII

SEQ ID NO: 1991605 - protein, 12 aa, Staphylococcus
TSDITQSGVEII

SEQ ID NO: 1991606 - protein, 11 aa, Staphylococcus
TSDLPVSEEAA

SEQ ID NO: 1991607 - protein, 7 aa, Staphylococcus
TSDNAEA

SEQ ID NO: 1991608 - protein, 8 aa, Staphylococcus
TSDNAEEI

SEQ ID NO: 1991609 - protein, 6 aa, Staphylococcus
TSDNND

SEQ ID NO: 1991610 - protein, 11 aa, Staphylococcus
TSDNQALGQGG

SEQ ID NO: 1991611 - protein, 5 aa, Staphylococcus
TSDPE

SEQ ID NO: 1991612 - protein, 9 aa, Staphylococcus
TSDSEKGVT

SEQ ID NO: 1991613 - protein, 10 aa, Staphylococcus
TSDSKHTIAG

SEQ ID NO: 1991614 - protein, 9 aa, Staphylococcus
TSDSKKGVE

SEQ ID NO: 1991615 - protein, 7 aa, Staphylococcus
TSDSRKG

SEQ ID NO: 1991616 - protein, 11 aa, Staphylococcus
TSDSSSLLSDA

SEQ ID NO: 1991617 - protein, 7 aa, Staphylococcus
TSDTEST

SEQ ID NO: 1991618 - protein, 9 aa, Staphylococcus
TSDTKKGTL

SEQ ID NO: 1991619 - protein, 9 aa, Staphylococcus
TSDTKKGVD

SEQ ID NO: 1991620 - protein, 9 aa, Staphylococcus
TSDTKKGVT

SEQ ID NO: 1991621 - protein, 4 aa, Staphylococcus
TSDV

SEQ ID NO: 1991622 - protein, 6 aa, Staphylococcus
TSDVDG

SEQ ID NO: 1991623 - protein, 11 aa, Staphylococcus
TSDVLGGKNAG

SEQ ID NO: 1991624 - protein, 6 aa, Staphylococcus
TSDVPA

SEQ ID NO: 1991625 - protein, 8 aa, Staphylococcus
TSDVSGEV

SEQ ID NO: 1991626 - protein, 14 aa, Staphylococcus
TSDYEKQEQELPGL

SEQ ID NO: 1991627 - protein, 6 aa, Staphylococcus
TSEAIS

SEQ ID NO: 1991628 - protein, 22 aa, Staphylococcus
TSEAKEKGITCASAGNHAQGVA

SEQ ID NO: 1991629 - protein, 9 aa, Staphylococcus
TSEDDLENL

SEQ ID NO: 1991630 - protein, 12 aa, Staphylococcus
TSEDEKGNLNGA

SEQ ID NO: 1991631 - protein, 7 aa, Staphylococcus
TSEDGSL

SEQ ID NO: 1991632 - protein, 8 aa, Staphylococcus
TSEDGSLS

SEQ ID NO: 1991633 - protein, 7 aa, Staphylococcus
TSEDGTL

SEQ ID NO: 1991634 - protein, 7 aa, Staphylococcus
TSEDNKY

SEQ ID NO: 1991635 - protein, 14 aa, Staphylococcus
TSEEKAKAHIDAGA

SEQ ID NO: 1991636 - protein, 7 aa, Staphylococcus
TSEEQER

SEQ ID NO: 1991637 - protein, 5 aa, Staphylococcus
TSEER

SEQ ID NO: 1991638 - protein, 9 aa, Staphylococcus
TSEERIKNI

SEQ ID NO: 1991639 - protein, 7 aa, Staphylococcus
TSEGGMR

SEQ ID NO: 1991640 - protein, 16 aa, Staphylococcus
TSEGITLTEAKKKIDA

SEQ ID NO: 1991641 - protein, 14 aa, Staphylococcus
TSEGTLSEAGGPQY

SEQ ID NO: 1991642 - protein, 24 aa, Staphylococcus
TSEGVVTDKEARKRNIGGEILGYI

SEQ ID NO: 1991643 - protein, 6 aa, Staphylococcus
TSEIDG

SEQ ID NO: 1991644 - protein, 6 aa, Staphylococcus
TSEIGN

SEQ ID NO: 1991645 - protein, 15 aa, Staphylococcus
TSEIKPSGTGESPLA

SEQ ID NO: 1991646 - protein, 14 aa, Staphylococcus
TSEKPDIDYDDDGG

SEQ ID NO: 1991647 - protein, 15 aa, Staphylococcus
TSEKPDIDYDDDGGH

SEQ ID NO: 1991648 - protein, 14 aa, Staphylococcus
TSEKPDIDYEDDGG

SEQ ID NO: 1991649 - protein, 14 aa, Staphylococcus
TSEKPDIDYNDDGG

SEQ ID NO: 1991650 - protein, 10 aa, Staphylococcus
TSEKQEQHEL

SEQ ID NO: 1991651 - protein, 12 aa, Staphylococcus
TSELEDEREYAV

SEQ ID NO: 1991652 - protein, 8 aa, Staphylococcus
TSELKPET

SEQ ID NO: 1991653 - protein, 10 aa, Staphylococcus
TSENKTLPHY

SEQ ID NO: 1991654 - protein, 4 aa, Staphylococcus
TSEP

SEQ ID NO: 1991655 - protein, 5 aa, Staphylococcus
TSEPR

SEQ ID NO: 1991656 - protein, 4 aa, Staphylococcus
TSEQ

SEQ ID NO: 1991657 - protein, 5 aa, Staphylococcus
TSEQH

SEQ ID NO: 1991658 - protein, 12 aa, Staphylococcus
TSEQHTKNEVEE

SEQ ID NO: 1991659 - protein, 10 aa, Staphylococcus
TSEQTPSSVG

SEQ ID NO: 1991660 - protein, 9 aa, Staphylococcus
TSEQTSYTL

SEQ ID NO: 1991661 - protein, 5 aa, Staphylococcus
TSESA

SEQ ID NO: 1991662 - protein, 8 aa, Staphylococcus
TSESEGVP

SEQ ID NO: 1991663 - protein, 6 aa, Staphylococcus
TSESEI

SEQ ID NO: 1991664 - protein, 6 aa, Staphylococcus
TSESLT

SEQ ID NO: 1991665 - protein, 5 aa, Staphylococcus
TSESR

SEQ ID NO: 1991666 - protein, 6 aa, Staphylococcus
TSETKT

SEQ ID NO: 1991667 - protein, 15 aa, Staphylococcus
TSETLSQSVSNSISN

SEQ ID NO: 1991668 - protein, 9 aa, Staphylococcus
TSETQAAIN

SEQ ID NO: 1991669 - protein, 5 aa, Staphylococcus
TSEWK

SEQ ID NO: 1991670 - protein, 4 aa, Staphylococcus
TSEY

SEQ ID NO: 1991671 - protein, 6 aa, Staphylococcus
TSFDDD

SEQ ID NO: 1991672 - protein, 11 aa, Staphylococcus
TSFDKKTKEGH

SEQ ID NO: 1991673 - protein, 9 aa, Staphylococcus
TSFEHREPG

SEQ ID NO: 1991674 - protein, 12 aa, Staphylococcus
TSFEKKTKDGSA

SEQ ID NO: 1991675 - protein, 7 aa, Staphylococcus
TSFESAE

SEQ ID NO: 1991676 - protein, 13 aa, Staphylococcus
TSFGEKQRASVTN

SEQ ID NO: 1991677 - protein, 4 aa, Staphylococcus
TSFK

SEQ ID NO: 1991678 - protein, 6 aa, Staphylococcus
TSFNDK

SEQ ID NO: 1991679 - protein, 8 aa, Staphylococcus
TSFSEEEY

SEQ ID NO: 1991680 - protein, 8 aa, Staphylococcus
TSFTNDGQ

SEQ ID NO: 1991681 - protein, 23 aa, Staphylococcus
TSGAISKNNVYPVKDKKNNSNFK

SEQ ID NO: 1991682 - protein, 29 aa, Staphylococcus
TSGALEKQNEIEREQSELNAQRQPAGDKE

SEQ ID NO: 1991683 - protein, 11 aa, Staphylococcus
TSGAPSKVASA

SEQ ID NO: 1991684 - protein, 8 aa, Staphylococcus
TSGAQIAS

SEQ ID NO: 1991685 - protein, 7 aa, Staphylococcus
TSGCGKT

SEQ ID NO: 1991686 - protein, 4 aa, Staphylococcus
TSGD

SEQ ID NO: 1991687 - protein, 4 aa, Staphylococcus
TSGE

SEQ ID NO: 1991688 - protein, 24 aa, Staphylococcus
TSGELTDRQHKTRTLKETLEGAGL

SEQ ID NO: 1991689 - protein, 7 aa, Staphylococcus
TSGEQRL

SEQ ID NO: 1991690 - protein, 16 aa, Staphylococcus
TSGGAQAATGLTSDKS

SEQ ID NO: 1991691 - protein, 11 aa, Staphylococcus
TSGGDSPGMNA

SEQ ID NO: 1991692 - protein, 33 aa, Staphylococcus
TSGGGGDFIPNQADPYTAGEGSDMQTPAERHEP

SEQ ID NO: 1991693 - protein, 8 aa, Staphylococcus
TSGHAGQS

SEQ ID NO: 1991694 - protein, 7 aa, Staphylococcus
TSGKHYN

SEQ ID NO: 1991695 - protein, 25 aa, Staphylococcus
TSGKLTDRQYKTRTVKETLEGAGLN

SEQ ID NO: 1991696 - protein, 4 aa, Staphylococcus
TSGL

SEQ ID NO: 1991697 - protein, 18 aa, Staphylococcus
TSGLDLNGKNHIDIEEAT

SEQ ID NO: 1991698 - protein, 13 aa, Staphylococcus
TSGLDYQDKKRQI

SEQ ID NO: 1991699 - protein, 8 aa, Staphylococcus
TSGLTNTH

SEQ ID NO: 1991700 - protein, 9 aa, Staphylococcus
TSGPFPDSI

SEQ ID NO: 1991701 - protein, 11 aa, Staphylococcus
TSGPGATNAIT

SEQ ID NO: 1991702 - protein, 9 aa, Staphylococcus
TSGPGSTNV

SEQ ID NO: 1991703 - protein, 14 aa, Staphylococcus
TSGQITIDGKDVRK

SEQ ID NO: 1991704 - protein, 8 aa, Staphylococcus
TSGQITNY

SEQ ID NO: 1991705 - protein, 7 aa, Staphylococcus
TSGQRIS

SEQ ID NO: 1991706 - protein, 6 aa, Staphylococcus
TSGQVD

SEQ ID NO: 1991707 - protein, 4 aa, Staphylococcus
TSGR

SEQ ID NO: 1991708 - protein, 17 aa, Staphylococcus
TSGREAVENNLSQQIGE

SEQ ID NO: 1991709 - protein, 22 aa, Staphylococcus
TSGREEVENNLSQNIGELGKTF

SEQ ID NO: 1991710 - protein, 21 aa, Staphylococcus
TSGREEVENNLSQSIGELGKT

SEQ ID NO: 1991711 - protein, 22 aa, Staphylococcus
TSGREEVENNLSQSIGELGKTF

SEQ ID NO: 1991712 - protein, 18 aa, Staphylococcus
TSGREEVEQNASKNIGAL

SEQ ID NO: 1991713 - protein, 6 aa, Staphylococcus
TSGRET

SEQ ID NO: 1991714 - protein, 8 aa, Staphylococcus
TSGSGHLS

SEQ ID NO: 1991715 - protein, 8 aa, Staphylococcus
TSGSHANQ

SEQ ID NO: 1991716 - protein, 24 aa, Staphylococcus
TSGSLTDRQYKTRTVKETLEGAGL

SEQ ID NO: 1991717 - protein, 8 aa, Staphylococcus
TSGTPQME

SEQ ID NO: 1991718 - protein, 22 aa, Staphylococcus
TSGTQKTRGRDRTEEEKEAARQ

SEQ ID NO: 1991719 - protein, 11 aa, Staphylococcus
TSGVAAPAYAG

SEQ ID NO: 1991720 - protein, 4 aa, Staphylococcus
TSGY

SEQ ID NO: 1991721 - protein, 7 aa, Staphylococcus
TSGYETL

SEQ ID NO: 1991722 - protein, 6 aa, Staphylococcus
TSHELK

SEQ ID NO: 1991723 - protein, 7 aa, Staphylococcus
TSHGDDL

SEQ ID NO: 1991724 - protein, 7 aa, Staphylococcus
TSHHDDK

SEQ ID NO: 1991725 - protein, 9 aa, Staphylococcus
TSHHQYQDD

SEQ ID NO: 1991726 - protein, 4 aa, Staphylococcus
TSHI

SEQ ID NO: 1991727 - protein, 8 aa, Staphylococcus
TSHKGQHA

SEQ ID NO: 1991728 - protein, 4 aa, Staphylococcus
TSHL

SEQ ID NO: 1991729 - protein, 5 aa, Staphylococcus
TSHLE

SEQ ID NO: 1991730 - protein, 6 aa, Staphylococcus
TSHRMP

SEQ ID NO: 1991731 - protein, 10 aa, Staphylococcus
TSHTEEDINK

SEQ ID NO: 1991732 - protein, 5 aa, Staphylococcus
TSHTM

SEQ ID NO: 1991733 - protein, 6 aa, Staphylococcus
TSHTSN

SEQ ID NO: 1991734 - protein, 6 aa, Staphylococcus
TSIAGQ

SEQ ID NO: 1991735 - protein, 6 aa, Staphylococcus
TSIATN

SEQ ID NO: 1991736 - protein, 6 aa, Staphylococcus
TSIDTK

SEQ ID NO: 1991737 - protein, 5 aa, Staphylococcus
TSIEQ

SEQ ID NO: 1991738 - protein, 13 aa, Staphylococcus
TSIGSDDKSKELK

SEQ ID NO: 1991739 - protein, 14 aa, Staphylococcus
TSIKNNVNNIGASA

SEQ ID NO: 1991740 - protein, 6 aa, Staphylococcus
TSIKSA

SEQ ID NO: 1991741 - protein, 4 aa, Staphylococcus
TSIL

SEQ ID NO: 1991742 - protein, 5 aa, Staphylococcus
TSINS

SEQ ID NO: 1991743 - protein, 6 aa, Staphylococcus
TSIPQG

SEQ ID NO: 1991744 - protein, 14 aa, Staphylococcus
TSIRQHSAQKHNDA

SEQ ID NO: 1991745 - protein, 8 aa, Staphylococcus
TSIRTDDK

SEQ ID NO: 1991746 - protein, 23 aa, Staphylococcus
TSISDPALEPLDPEKRKDVARNI

SEQ ID NO: 1991747 - protein, 12 aa, Staphylococcus
TSISNNQTKEIK

SEQ ID NO: 1991748 - protein, 6 aa, Staphylococcus
TSISPG

SEQ ID NO: 1991749 - protein, 24 aa, Staphylococcus
TSITHSDGHTSISKTPKVTGKGQQ

SEQ ID NO: 1991750 - protein, 8 aa, Staphylococcus
TSKAGYSG

SEQ ID NO: 1991751 - protein, 9 aa, Staphylococcus
TSKDATTSL

SEQ ID NO: 1991752 - protein, 13 aa, Staphylococcus
TSKDDKYVSYKET

SEQ ID NO: 1991753 - protein, 6 aa, Staphylococcus
TSKDND

SEQ ID NO: 1991754 - protein, 7 aa, Staphylococcus
TSKEIDE

SEQ ID NO: 1991755 - protein, 7 aa, Staphylococcus
TSKEVNE

SEQ ID NO: 1991756 - protein, 8 aa, Staphylococcus
TSKGDVEQ

SEQ ID NO: 1991757 - protein, 7 aa, Staphylococcus
TSKGHEQ

SEQ ID NO: 1991758 - protein, 14 aa, Staphylococcus
TSKGRSSHSSTPFM

SEQ ID NO: 1991759 - protein, 17 aa, Staphylococcus
TSKGSEALNENTPLNPN

SEQ ID NO: 1991760 - protein, 15 aa, Staphylococcus
TSKGVPAHSSLPSLG

SEQ ID NO: 1991761 - protein, 8 aa, Staphylococcus
TSKINDDD

SEQ ID NO: 1991762 - protein, 10 aa, Staphylococcus
TSKKEMSKDG

SEQ ID NO: 1991763 - protein, 6 aa, Staphylococcus
TSKKPI

SEQ ID NO: 1991764 - protein, 10 aa, Staphylococcus
TSKNKIDDTE

SEQ ID NO: 1991765 - protein, 7 aa, Staphylococcus
TSKNRYT

SEQ ID NO: 1991766 - protein, 13 aa, Staphylococcus
TSKPSEIKKMNPD

SEQ ID NO: 1991767 - protein, 7 aa, Staphylococcus
TSKPSIL

SEQ ID NO: 1991768 - protein, 6 aa, Staphylococcus
TSKQFK

SEQ ID NO: 1991769 - protein, 7 aa, Staphylococcus
TSKQFKT

SEQ ID NO: 1991770 - protein, 7 aa, Staphylococcus
TSKQHST

SEQ ID NO: 1991771 - protein, 8 aa, Staphylococcus
TSKQNNTK

SEQ ID NO: 1991772 - protein, 15 aa, Staphylococcus
TSKSFGSAGNPSPMT

SEQ ID NO: 1991773 - protein, 14 aa, Staphylococcus
TSKSGGKSGDYHRS

SEQ ID NO: 1991774 - protein, 6 aa, Staphylococcus
TSKSHF

SEQ ID NO: 1991775 - protein, 9 aa, Staphylococcus
TSKSNLSAQ

SEQ ID NO: 1991776 - protein, 9 aa, Staphylococcus
TSKSNLSSQ

SEQ ID NO: 1991777 - protein, 8 aa, Staphylococcus
TSKTETSL

SEQ ID NO: 1991778 - protein, 6 aa, Staphylococcus
TSKTPK

SEQ ID NO: 1991779 - protein, 4 aa, Staphylococcus
TSKY

SEQ ID NO: 1991780 - protein, 8 aa, Staphylococcus
TSKYDDVR

SEQ ID NO: 1991781 - protein, 9 aa, Staphylococcus
TSLAPGSKV

SEQ ID NO: 1991782 - protein, 4 aa, Staphylococcus
TSLE

SEQ ID NO: 1991783 - protein, 4 aa, Staphylococcus
TSLG

SEQ ID NO: 1991784 - protein, 5 aa, Staphylococcus
TSLGR

SEQ ID NO: 1991785 - protein, 4 aa, Staphylococcus
TSLK

SEQ ID NO: 1991786 - protein, 11 aa, Staphylococcus
TSLLGADDKAG

SEQ ID NO: 1991787 - protein, 6 aa, Staphylococcus
TSLNDE

SEQ ID NO: 1991788 - protein, 11 aa, Staphylococcus
TSLNDEEKNEL

SEQ ID NO: 1991789 - protein, 12 aa, Staphylococcus
TSLNEKETKEFN

SEQ ID NO: 1991790 - protein, 41 aa, Staphylococcus
TSLQENPNSKKNKTKHTQIKQQYDSNERKISQTKDEIAKEG

SEQ ID NO: 1991791 - protein, 9 aa, Staphylococcus
TSLRDTEDI

SEQ ID NO: 1991792 - protein, 10 aa, Staphylococcus
TSLSGGEAQR

SEQ ID NO: 1991793 - protein, 6 aa, Staphylococcus
TSLSKA

SEQ ID NO: 1991794 - protein, 9 aa, Staphylococcus
TSLSKGEKV

SEQ ID NO: 1991795 - protein, 7 aa, Staphylococcus
TSLSPDE

SEQ ID NO: 1991796 - protein, 9 aa, Staphylococcus
TSLSQAQEM

SEQ ID NO: 1991797 - protein, 8 aa, Staphylococcus
TSLSSEQL

SEQ ID NO: 1991798 - protein, 7 aa, Staphylococcus
TSLTTSK

SEQ ID NO: 1991799 - protein, 11 aa, Staphylococcus
TSMAGRGTDIK

SEQ ID NO: 1991800 - protein, 8 aa, Staphylococcus
TSMEDDDQ

SEQ ID NO: 1991801 - protein, 10 aa, Staphylococcus
TSMKASKNTS

SEQ ID NO: 1991802 - protein, 13 aa, Staphylococcus
TSNAGTKDGGREG

SEQ ID NO: 1991803 - protein, 81 aa, Staphylococcus
TSNAKNEKVDDQADVKANPTSSEDKAKPETAPDINSKEDTKNEQQDQQSLTEDETTQEPQRIENNGDKNNLKTKTKFDTEK

SEQ ID NO: 1991804 - protein, 11 aa, Staphylococcus
TSNASKDGGFQ

SEQ ID NO: 1991805 - protein, 8 aa, Staphylococcus
TSNDLKRT

SEQ ID NO: 1991806 - protein, 12 aa, Staphylococcus
TSNEKTKDGARE

SEQ ID NO: 1991807 - protein, 14 aa, Staphylococcus
TSNGKSVHSSMPSL

SEQ ID NO: 1991808 - protein, 7 aa, Staphylococcus
TSNKIAT

SEQ ID NO: 1991809 - protein, 6 aa, Staphylococcus
TSNKSA

SEQ ID NO: 1991810 - protein, 15 aa, Staphylococcus
TSNLPNGMKARTKYH

SEQ ID NO: 1991811 - protein, 5 aa, Staphylococcus
TSNNI

SEQ ID NO: 1991812 - protein, 12 aa, Staphylococcus
TSNPKIKEIQED

SEQ ID NO: 1991813 - protein, 6 aa, Staphylococcus
TSNPNV

SEQ ID NO: 1991814 - protein, 8 aa, Staphylococcus
TSNPPYAY

SEQ ID NO: 1991815 - protein, 8 aa, Staphylococcus
TSNQQLSY

SEQ ID NO: 1991816 - protein, 4 aa, Staphylococcus
TSNR

SEQ ID NO: 1991817 - protein, 10 aa, Staphylococcus
TSNSNEALDK

SEQ ID NO: 1991818 - protein, 10 aa, Staphylococcus
TSNSNQALDR

SEQ ID NO: 1991819 - protein, 9 aa, Staphylococcus
TSNSPMNAH

SEQ ID NO: 1991820 - protein, 10 aa, Staphylococcus
TSNSTQGKKM

SEQ ID NO: 1991821 - protein, 4 aa, Staphylococcus
TSNT

SEQ ID NO: 1991822 - protein, 13 aa, Staphylococcus
TSNTRSHQIAKDA

SEQ ID NO: 1991823 - protein, 6 aa, Staphylococcus
TSNVEK

SEQ ID NO: 1991824 - protein, 4 aa, Staphylococcus
TSPA

SEQ ID NO: 1991825 - protein, 5 aa, Staphylococcus
TSPAQ

SEQ ID NO: 1991826 - protein, 8 aa, Staphylococcus
TSPDFNAS

SEQ ID NO: 1991827 - protein, 13 aa, Staphylococcus
TSPDFNASNVNPQ

SEQ ID NO: 1991828 - protein, 12 aa, Staphylococcus
TSPDFNATNVNP

SEQ ID NO: 1991829 - protein, 12 aa, Staphylococcus
TSPDFNATNVQP

SEQ ID NO: 1991830 - protein, 19 aa, Staphylococcus
TSPDGPPTNWESKFGGNAW

SEQ ID NO: 1991831 - protein, 9 aa, Staphylococcus
TSPDSPIGE

SEQ ID NO: 1991832 - protein, 10 aa, Staphylococcus
TSPDYRGQGI

SEQ ID NO: 1991833 - protein, 5 aa, Staphylococcus
TSPEG

SEQ ID NO: 1991834 - protein, 6 aa, Staphylococcus
TSPEQI

SEQ ID NO: 1991835 - protein, 7 aa, Staphylococcus
TSPGFAN

SEQ ID NO: 1991836 - protein, 6 aa, Staphylococcus
TSPHTM

SEQ ID NO: 1991837 - protein, 22 aa, Staphylococcus
TSPLTEKETHHDYPEINSDAQL

SEQ ID NO: 1991838 - protein, 9 aa, Staphylococcus
TSPLVGKPI

SEQ ID NO: 1991839 - protein, 9 aa, Staphylococcus
TSPNSAIGK

SEQ ID NO: 1991840 - protein, 5 aa, Staphylococcus
TSPQA

SEQ ID NO: 1991841 - protein, 6 aa, Staphylococcus
TSPRNT

SEQ ID NO: 1991842 - protein, 8 aa, Staphylococcus
TSPSFSAD

SEQ ID NO: 1991843 - protein, 6 aa, Staphylococcus
TSPSNA

SEQ ID NO: 1991844 - protein, 7 aa, Staphylococcus
TSPSNYL

SEQ ID NO: 1991845 - protein, 7 aa, Staphylococcus
TSPSNYM

SEQ ID NO: 1991846 - protein, 7 aa, Staphylococcus
TSPSSYI

SEQ ID NO: 1991847 - protein, 7 aa, Staphylococcus
TSPSSYL

SEQ ID NO: 1991848 - protein, 6 aa, Staphylococcus
TSPTGK

SEQ ID NO: 1991849 - protein, 8 aa, Staphylococcus
TSPTPDKV

SEQ ID NO: 1991850 - protein, 4 aa, Staphylococcus
TSPV

SEQ ID NO: 1991851 - protein, 18 aa, Staphylococcus
TSPVAAGGDSREGRWSNN

SEQ ID NO: 1991852 - protein, 17 aa, Staphylococcus
TSPVQARTMEKRGGQGP

SEQ ID NO: 1991853 - protein, 17 aa, Staphylococcus
TSPVQARTMEKRHGQGP

SEQ ID NO: 1991854 - protein, 17 aa, Staphylococcus
TSPVQARTMEKRNGEGP

SEQ ID NO: 1991855 - protein, 17 aa, Staphylococcus
TSPVQARTMEKRNGQGP

SEQ ID NO: 1991856 - protein, 16 aa, Staphylococcus
TSPVQARTMEKRNGVG

SEQ ID NO: 1991857 - protein, 8 aa, Staphylococcus
TSPYTKSK

SEQ ID NO: 1991858 - protein, 9 aa, Staphylococcus
TSPYTKSKF

SEQ ID NO: 1991859 - protein, 10 aa, Staphylococcus
TSQESGADIA

SEQ ID NO: 1991860 - protein, 8 aa, Staphylococcus
TSQGATKI

SEQ ID NO: 1991861 - protein, 12 aa, Staphylococcus
TSQGEKDTSLPG

SEQ ID NO: 1991862 - protein, 6 aa, Staphylococcus
TSQIKD

SEQ ID NO: 1991863 - protein, 16 aa, Staphylococcus
TSQLPQGMKARAKHNN

SEQ ID NO: 1991864 - protein, 8 aa, Staphylococcus
TSQNDTSS

SEQ ID NO: 1991865 - protein, 8 aa, Staphylococcus
TSQNQQMQ

SEQ ID NO: 1991866 - protein, 6 aa, Staphylococcus
TSQNYK

SEQ ID NO: 1991867 - protein, 7 aa, Staphylococcus
TSQPFKE

SEQ ID NO: 1991868 - protein, 10 aa, Staphylococcus
TSQPLTSSDL

SEQ ID NO: 1991869 - protein, 9 aa, Staphylococcus
TSQPSISRD

SEQ ID NO: 1991870 - protein, 6 aa, Staphylococcus
TSQPTI

SEQ ID NO: 1991871 - protein, 8 aa, Staphylococcus
TSQPTTPV

SEQ ID NO: 1991872 - protein, 6 aa, Staphylococcus
TSQPYP

SEQ ID NO: 1991873 - protein, 5 aa, Staphylococcus
TSQQI

SEQ ID NO: 1991874 - protein, 6 aa, Staphylococcus
TSQQSE

SEQ ID NO: 1991875 - protein, 9 aa, Staphylococcus
TSQQSHEDL

SEQ ID NO: 1991876 - protein, 8 aa, Staphylococcus
TSQQTYEA

SEQ ID NO: 1991877 - protein, 13 aa, Staphylococcus
TSQRHESADRPKS

SEQ ID NO: 1991878 - protein, 4 aa, Staphylococcus
TSQS

SEQ ID NO: 1991879 - protein, 4 aa, Staphylococcus
TSQT

SEQ ID NO: 1991880 - protein, 8 aa, Staphylococcus
TSQTGETF

SEQ ID NO: 1991881 - protein, 6 aa, Staphylococcus
TSQTPH

SEQ ID NO: 1991882 - protein, 12 aa, Staphylococcus
TSQTSTGQALNR

SEQ ID NO: 1991883 - protein, 10 aa, Staphylococcus
TSQYPDGTET

SEQ ID NO: 1991884 - protein, 11 aa, Staphylococcus
TSQYQPPSEAC

SEQ ID NO: 1991885 - protein, 9 aa, Staphylococcus
TSRDTAENF

SEQ ID NO: 1991886 - protein, 9 aa, Staphylococcus
TSREISPFK

SEQ ID NO: 1991887 - protein, 10 aa, Staphylococcus
TSRGDRKEIQ

SEQ ID NO: 1991888 - protein, 5 aa, Staphylococcus
TSRGK

SEQ ID NO: 1991889 - protein, 6 aa, Staphylococcus
TSRIDA

SEQ ID NO: 1991890 - protein, 7 aa, Staphylococcus
TSRIPTD

SEQ ID NO: 1991891 - protein, 10 aa, Staphylococcus
TSRLDAPENV

SEQ ID NO: 1991892 - protein, 8 aa, Staphylococcus
TSRNDAQL

SEQ ID NO: 1991893 - protein, 6 aa, Staphylococcus
TSRNNA

SEQ ID NO: 1991894 - protein, 5 aa, Staphylococcus
TSRNT

SEQ ID NO: 1991895 - protein, 15 aa, Staphylococcus
TSRNTSNKENEENVT

SEQ ID NO: 1991896 - protein, 4 aa, Staphylococcus
TSRP

SEQ ID NO: 1991897 - protein, 22 aa, Staphylococcus
TSRPQDNKSFASGSANSNNNNV

SEQ ID NO: 1991898 - protein, 19 aa, Staphylococcus
TSRPQENKNFSSNASTNNV

SEQ ID NO: 1991899 - protein, 27 aa, Staphylococcus
TSRPQENKNFSSNNNVTTKNNSSNNNV

SEQ ID NO: 1991900 - protein, 22 aa, Staphylococcus
TSRPSDNKSFASSNSKSANNNV

SEQ ID NO: 1991901 - protein, 22 aa, Staphylococcus
TSRPSDNKSFSSNNSSSSNNNV

SEQ ID NO: 1991902 - protein, 10 aa, Staphylococcus
TSRPVKYPTD

SEQ ID NO: 1991903 - protein, 6 aa, Staphylococcus
TSRRKI

SEQ ID NO: 1991904 - protein, 9 aa, Staphylococcus
TSRRVAKEE

SEQ ID NO: 1991905 - protein, 14 aa, Staphylococcus
TSRSYFPKDNSDYF

SEQ ID NO: 1991906 - protein, 4 aa, Staphylococcus
TSRT

SEQ ID NO: 1991907 - protein, 9 aa, Staphylococcus
TSRTPDDLN

SEQ ID NO: 1991908 - protein, 9 aa, Staphylococcus
TSRVPDDLD

SEQ ID NO: 1991909 - protein, 7 aa, Staphylococcus
TSSDTLA

SEQ ID NO: 1991910 - protein, 14 aa, Staphylococcus
TSSEKKLGKPVGSD

SEQ ID NO: 1991911 - protein, 14 aa, Staphylococcus
TSSENKLGKPVGSD

SEQ ID NO: 1991912 - protein, 19 aa, Staphylococcus
TSSFTKKGKDGRLKAKGQH

SEQ ID NO: 1991913 - protein, 14 aa, Staphylococcus
TSSFTPEESPDPGF

SEQ ID NO: 1991914 - protein, 7 aa, Staphylococcus
TSSGIGY

SEQ ID NO: 1991915 - protein, 14 aa, Staphylococcus
TSSHPGEPPRTNQE

SEQ ID NO: 1991916 - protein, 9 aa, Staphylococcus
TSSHQKALD

SEQ ID NO: 1991917 - protein, 6 aa, Staphylococcus
TSSHRE

SEQ ID NO: 1991918 - protein, 4 aa, Staphylococcus
TSSK

SEQ ID NO: 1991919 - protein, 7 aa, Staphylococcus
TSSKKEI

SEQ ID NO: 1991920 - protein, 18 aa, Staphylococcus
TSSKPQQTPRAKSEVEEA

SEQ ID NO: 1991921 - protein, 6 aa, Staphylococcus
TSSLGV

SEQ ID NO: 1991922 - protein, 8 aa, Staphylococcus
TSSLRRGA

SEQ ID NO: 1991923 - protein, 6 aa, Staphylococcus
TSSNIS

SEQ ID NO: 1991924 - protein, 7 aa, Staphylococcus
TSSNKKW

SEQ ID NO: 1991925 - protein, 12 aa, Staphylococcus
TSSNNNSIAKDS

SEQ ID NO: 1991926 - protein, 10 aa, Staphylococcus
TSSNSTNEIK

SEQ ID NO: 1991927 - protein, 20 aa, Staphylococcus
TSSPLAEFKKSKASLLTSSY

SEQ ID NO: 1991928 - protein, 6 aa, Staphylococcus
TSSQNK

SEQ ID NO: 1991929 - protein, 15 aa, Staphylococcus
TSSRLGNTNAKRTQL

SEQ ID NO: 1991930 - protein, 12 aa, Staphylococcus
TSSSEEKRKQLP

SEQ ID NO: 1991931 - protein, 4 aa, Staphylococcus
TSST

SEQ ID NO: 1991932 - protein, 6 aa, Staphylococcus
TSSTLT

SEQ ID NO: 1991933 - protein, 5 aa, Staphylococcus
TSSVA

SEQ ID NO: 1991934 - protein, 9 aa, Staphylococcus
TSSVHDETQ

SEQ ID NO: 1991935 - protein, 10 aa, Staphylococcus
TSSVKDETQI

SEQ ID NO: 1991936 - protein, 9 aa, Staphylococcus
TSSVRDDTQ

SEQ ID NO: 1991937 - protein, 6 aa, Staphylococcus
TSSWKS

SEQ ID NO: 1991938 - protein, 5 aa, Staphylococcus
TSSYK

SEQ ID NO: 1991939 - protein, 5 aa, Staphylococcus
TSSYR

SEQ ID NO: 1991940 - protein, 6 aa, Staphylococcus
TSSYRE

SEQ ID NO: 1991941 - protein, 6 aa, Staphylococcus
TSSYRQ

SEQ ID NO: 1991942 - protein, 9 aa, Staphylococcus
TSTADIDGE

SEQ ID NO: 1991943 - protein, 14 aa, Staphylococcus
TSTEKQLGKPVGSD

SEQ ID NO: 1991944 - protein, 13 aa, Staphylococcus
TSTEPKSGGMYKV

SEQ ID NO: 1991945 - protein, 6 aa, Staphylococcus
TSTEQK

SEQ ID NO: 1991946 - protein, 6 aa, Staphylococcus
TSTGCD

SEQ ID NO: 1991947 - protein, 9 aa, Staphylococcus
TSTGCDGIH

SEQ ID NO: 1991948 - protein, 6 aa, Staphylococcus
TSTGCE

SEQ ID NO: 1991949 - protein, 15 aa, Staphylococcus
TSTGFAGGGATPEDV

SEQ ID NO: 1991950 - protein, 13 aa, Staphylococcus
TSTGFAGGGATVE

SEQ ID NO: 1991951 - protein, 6 aa, Staphylococcus
TSTHNS

SEQ ID NO: 1991952 - protein, 7 aa, Staphylococcus
TSTIPQI

SEQ ID NO: 1991953 - protein, 6 aa, Staphylococcus
TSTIQA

SEQ ID NO: 1991954 - protein, 11 aa, Staphylococcus
TSTKDNPVANR

SEQ ID NO: 1991955 - protein, 7 aa, Staphylococcus
TSTKKNR

SEQ ID NO: 1991956 - protein, 8 aa, Staphylococcus
TSTKSVLY

SEQ ID NO: 1991957 - protein, 6 aa, Staphylococcus
TSTLEN

SEQ ID NO: 1991958 - protein, 6 aa, Staphylococcus
TSTLKE

SEQ ID NO: 1991959 - protein, 7 aa, Staphylococcus
TSTNDQN

SEQ ID NO: 1991960 - protein, 6 aa, Staphylococcus
TSTNEG

SEQ ID NO: 1991961 - protein, 6 aa, Staphylococcus
TSTNYN

SEQ ID NO: 1991962 - protein, 7 aa, Staphylococcus
TSTPNEV

SEQ ID NO: 1991963 - protein, 18 aa, Staphylococcus
TSTPNEVKQAIENENDTY

SEQ ID NO: 1991964 - protein, 18 aa, Staphylococcus
TSTPNEVKRAIEDENDAY

SEQ ID NO: 1991965 - protein, 18 aa, Staphylococcus
TSTPNEVKRAIENENDTY

SEQ ID NO: 1991966 - protein, 7 aa, Staphylococcus
TSTRTRA

SEQ ID NO: 1991967 - protein, 10 aa, Staphylococcus
TSTRYDNKDA

SEQ ID NO: 1991968 - protein, 9 aa, Staphylococcus
TSTSKRTQM

SEQ ID NO: 1991969 - protein, 11 aa, Staphylococcus
TSTSQHTVTGT

SEQ ID NO: 1991970 - protein, 13 aa, Staphylococcus
TSTTHKTLRGPRG

SEQ ID NO: 1991971 - protein, 5 aa, Staphylococcus
TSTTN

SEQ ID NO: 1991972 - protein, 7 aa, Staphylococcus
TSTVGDI

SEQ ID NO: 1991973 - protein, 13 aa, Staphylococcus
TSVAEAAANETAG

SEQ ID NO: 1991974 - protein, 5 aa, Staphylococcus
TSVEG

SEQ ID NO: 1991975 - protein, 6 aa, Staphylococcus
TSVENE

SEQ ID NO: 1991976 - protein, 14 aa, Staphylococcus
TSVERPEVQETTAL

SEQ ID NO: 1991977 - protein, 6 aa, Staphylococcus
TSVGYG

SEQ ID NO: 1991978 - protein, 18 aa, Staphylococcus
TSVKDQRPHALSGGQQQR

SEQ ID NO: 1991979 - protein, 36 aa, Staphylococcus
TSVNDRQNVNSQEATFTEEPKDIDQEQENEHPTEVQ

SEQ ID NO: 1991980 - protein, 6 aa, Staphylococcus
TSVPAE

SEQ ID NO: 1991981 - protein, 7 aa, Staphylococcus
TSVPNER

SEQ ID NO: 1991982 - protein, 7 aa, Staphylococcus
TSVPSER

SEQ ID NO: 1991983 - protein, 5 aa, Staphylococcus
TSVSD

SEQ ID NO: 1991984 - protein, 7 aa, Staphylococcus
TSVSPGM

SEQ ID NO: 1991985 - protein, 6 aa, Staphylococcus
TSVTTA

SEQ ID NO: 1991986 - protein, 12 aa, Staphylococcus
TSVTVDSQTDHR

SEQ ID NO: 1991987 - protein, 5 aa, Staphylococcus
TSYDS

SEQ ID NO: 1991988 - protein, 8 aa, Staphylococcus
TSYDTSSQ

SEQ ID NO: 1991989 - protein, 11 aa, Staphylococcus
TSYGPNSIEGT

SEQ ID NO: 1991990 - protein, 5 aa, Staphylococcus
TSYPK

SEQ ID NO: 1991991 - protein, 5 aa, Staphylococcus
TSYPQ

SEQ ID NO: 1991992 - protein, 4 aa, Staphylococcus
TSYS

SEQ ID NO: 1991993 - protein, 10 aa, Staphylococcus
TSYVNGDGQP

SEQ ID NO: 1991994 - protein, 6 aa, Staphylococcus
TTAANV

SEQ ID NO: 1991995 - protein, 10 aa, Staphylococcus
TTADSKETFK

SEQ ID NO: 1991996 - protein, 5 aa, Staphylococcus
TTAEL

SEQ ID NO: 1991997 - protein, 5 aa, Staphylococcus
TTAEN

SEQ ID NO: 1991998 - protein, 6 aa, Staphylococcus
TTAGEM

SEQ ID NO: 1991999 - protein, 12 aa, Staphylococcus
TTAGGGTDAGSI

SEQ ID NO: 1992000 - protein, 10 aa, Staphylococcus
TTAGNYELNT

SEQ ID NO: 1992001 - protein, 4 aa, Staphylococcus
TTAH

SEQ ID NO: 1992002 - protein, 4 aa, Staphylococcus
TTAK

SEQ ID NO: 1992003 - protein, 5 aa, Staphylococcus
TTAKA

SEQ ID NO: 1992004 - protein, 12 aa, Staphylococcus
TTAKASKHSPVA

SEQ ID NO: 1992005 - protein, 12 aa, Staphylococcus
TTAKQGQHSPVA

SEQ ID NO: 1992006 - protein, 15 aa, Staphylococcus
TTANLANGQSPKDAV

SEQ ID NO: 1992007 - protein, 7 aa, Staphylococcus
TTAPSRN

SEQ ID NO: 1992008 - protein, 9 aa, Staphylococcus
TTAQSRAEM

SEQ ID NO: 1992009 - protein, 10 aa, Staphylococcus
TTASAAAATL

SEQ ID NO: 1992010 - protein, 5 aa, Staphylococcus
TTATG

SEQ ID NO: 1992011 - protein, 9 aa, Staphylococcus
TTATSQKPL

SEQ ID NO: 1992012 - protein, 9 aa, Staphylococcus
TTATSQTPV

SEQ ID NO: 1992013 - protein, 10 aa, Staphylococcus
TTATTQITVP

SEQ ID NO: 1992014 - protein, 11 aa, Staphylococcus
TTAYNADFDGD

SEQ ID NO: 1992015 - protein, 10 aa, Staphylococcus
TTCGPNPTYP

SEQ ID NO: 1992016 - protein, 4 aa, Staphylococcus
TTCP

SEQ ID NO: 1992017 - protein, 4 aa, Staphylococcus
TTCV

SEQ ID NO: 1992018 - protein, 9 aa, Staphylococcus
TTDADHVKE

SEQ ID NO: 1992019 - protein, 6 aa, Staphylococcus
TTDADI

SEQ ID NO: 1992020 - protein, 19 aa, Staphylococcus
TTDAGTGAVHTAPGHGEDD

SEQ ID NO: 1992021 - protein, 8 aa, Staphylococcus
TTDAGTGC

SEQ ID NO: 1992022 - protein, 15 aa, Staphylococcus
TTDASSLLGDNPNNV

SEQ ID NO: 1992023 - protein, 5 aa, Staphylococcus
TTDDL

SEQ ID NO: 1992024 - protein, 5 aa, Staphylococcus
TTDDM

SEQ ID NO: 1992025 - protein, 14 aa, Staphylococcus
TTDDNIGNGESIFD

SEQ ID NO: 1992026 - protein, 10 aa, Staphylococcus
TTDEGSVNEI

SEQ ID NO: 1992027 - protein, 13 aa, Staphylococcus
TTDEGSVNEIDEN

SEQ ID NO: 1992028 - protein, 10 aa, Staphylococcus
TTDEGSVNQI

SEQ ID NO: 1992029 - protein, 14 aa, Staphylococcus
TTDEGSVNQIDDNT

SEQ ID NO: 1992030 - protein, 13 aa, Staphylococcus
TTDEGTVNEIDEN

SEQ ID NO: 1992031 - protein, 5 aa, Staphylococcus
TTDGI

SEQ ID NO: 1992032 - protein, 8 aa, Staphylococcus
TTDGTSTI

SEQ ID NO: 1992033 - protein, 8 aa, Staphylococcus
TTDGTYEA

SEQ ID NO: 1992034 - protein, 9 aa, Staphylococcus
TTDHVSSNF

SEQ ID NO: 1992035 - protein, 6 aa, Staphylococcus
TTDIDS

SEQ ID NO: 1992036 - protein, 7 aa, Staphylococcus
TTDIEDG

SEQ ID NO: 1992037 - protein, 7 aa, Staphylococcus
TTDIENG

SEQ ID NO: 1992038 - protein, 21 aa, Staphylococcus
TTDIKPKMNDSISNSKLPDDI

SEQ ID NO: 1992039 - protein, 5 aa, Staphylococcus
TTDIN

SEQ ID NO: 1992040 - protein, 7 aa, Staphylococcus
TTDIQDG

SEQ ID NO: 1992041 - protein, 11 aa, Staphylococcus
TTDKEKGALKQ

SEQ ID NO: 1992042 - protein, 19 aa, Staphylococcus
TTDKPVEMGTTKTVDPNYQ

SEQ ID NO: 1992043 - protein, 8 aa, Staphylococcus
TTDLTDEQ

SEQ ID NO: 1992044 - protein, 6 aa, Staphylococcus
TTDNEI

SEQ ID NO: 1992045 - protein, 8 aa, Staphylococcus
TTDNSEED

SEQ ID NO: 1992046 - protein, 7 aa, Staphylococcus
TTDPGMG

SEQ ID NO: 1992047 - protein, 17 aa, Staphylococcus
TTDPTKEINVETTSNLN

SEQ ID NO: 1992048 - protein, 5 aa, Staphylococcus
TTDQE

SEQ ID NO: 1992049 - protein, 8 aa, Staphylococcus
TTDRPPYT

SEQ ID NO: 1992050 - protein, 15 aa, Staphylococcus
TTDSGTNSKSSKADG

SEQ ID NO: 1992051 - protein, 11 aa, Staphylococcus
TTDSRTAKEGS

SEQ ID NO: 1992052 - protein, 5 aa, Staphylococcus
TTDTY

SEQ ID NO: 1992053 - protein, 5 aa, Staphylococcus
TTDYQ

SEQ ID NO: 1992054 - protein, 9 aa, Staphylococcus
TTEAAEKLA

SEQ ID NO: 1992055 - protein, 8 aa, Staphylococcus
TTEADVNR

SEQ ID NO: 1992056 - protein, 9 aa, Staphylococcus
TTEANGNYT

SEQ ID NO: 1992057 - protein, 4 aa, Staphylococcus
TTED

SEQ ID NO: 1992058 - protein, 6 aa, Staphylococcus
TTEDER

SEQ ID NO: 1992059 - protein, 8 aa, Staphylococcus
TTEDNKEA

SEQ ID NO: 1992060 - protein, 5 aa, Staphylococcus
TTEDP

SEQ ID NO: 1992061 - protein, 11 aa, Staphylococcus
TTEDPENDFMP

SEQ ID NO: 1992062 - protein, 6 aa, Staphylococcus
TTEDPL

SEQ ID NO: 1992063 - protein, 13 aa, Staphylococcus
TTEDPSNDFMPDS

SEQ ID NO: 1992064 - protein, 12 aa, Staphylococcus
TTEDPTNDFMPD

SEQ ID NO: 1992065 - protein, 13 aa, Staphylococcus
TTEDPTNDFMPDS

SEQ ID NO: 1992066 - protein, 13 aa, Staphylococcus
TTEDPTNNFMPDS

SEQ ID NO: 1992067 - protein, 6 aa, Staphylococcus
TTEEDI

SEQ ID NO: 1992068 - protein, 6 aa, Staphylococcus
TTEEIT

SEQ ID NO: 1992069 - protein, 5 aa, Staphylococcus
TTEEL

SEQ ID NO: 1992070 - protein, 10 aa, Staphylococcus
TTEESGANQL

SEQ ID NO: 1992071 - protein, 6 aa, Staphylococcus
TTEEYE

SEQ ID NO: 1992072 - protein, 5 aa, Staphylococcus
TTEGI

SEQ ID NO: 1992073 - protein, 14 aa, Staphylococcus
TTEGSLSEAGGPQY

SEQ ID NO: 1992074 - protein, 14 aa, Staphylococcus
TTEHKAKQHEENEM

SEQ ID NO: 1992075 - protein, 9 aa, Staphylococcus
TTEHLSTET

SEQ ID NO: 1992076 - protein, 6 aa, Staphylococcus
TTEHPK

SEQ ID NO: 1992077 - protein, 5 aa, Staphylococcus
TTEHQ

SEQ ID NO: 1992078 - protein, 5 aa, Staphylococcus
TTEHR

SEQ ID NO: 1992079 - protein, 17 aa, Staphylococcus
TTEIKNAPLPNNKVESL

SEQ ID NO: 1992080 - protein, 14 aa, Staphylococcus
TTEKDFVNNSDDYK

SEQ ID NO: 1992081 - protein, 10 aa, Staphylococcus
TTEKPPNAYR

SEQ ID NO: 1992082 - protein, 6 aa, Staphylococcus
TTEKQL

SEQ ID NO: 1992083 - protein, 6 aa, Staphylococcus
TTELPL

SEQ ID NO: 1992084 - protein, 24 aa, Staphylococcus
TTELPRDEVSTVSTKTPYVSTGSD

SEQ ID NO: 1992085 - protein, 16 aa, Staphylococcus
TTENDKKDKTPDSQKN

SEQ ID NO: 1992086 - protein, 8 aa, Staphylococcus
TTEPDKVQ

SEQ ID NO: 1992087 - protein, 20 aa, Staphylococcus
TTEPIDGRSTTYSSDIAKGY

SEQ ID NO: 1992088 - protein, 20 aa, Staphylococcus
TTEPIDGRSTTYSSDVAKGY

SEQ ID NO: 1992089 - protein, 19 aa, Staphylococcus
TTEPVDGRSTTYSTDIAKG

SEQ ID NO: 1992090 - protein, 6 aa, Staphylococcus
TTEQLT

SEQ ID NO: 1992091 - protein, 5 aa, Staphylococcus
TTERA

SEQ ID NO: 1992092 - protein, 7 aa, Staphylococcus
TTERAPY

SEQ ID NO: 1992093 - protein, 7 aa, Staphylococcus
TTEREPF

SEQ ID NO: 1992094 - protein, 11 aa, Staphylococcus
TTERPEGVEAG

SEQ ID NO: 1992095 - protein, 11 aa, Staphylococcus
TTERPEGVSAG

SEQ ID NO: 1992096 - protein, 10 aa, Staphylococcus
TTERQGEHGF

SEQ ID NO: 1992097 - protein, 7 aa, Staphylococcus
TTESEIE

SEQ ID NO: 1992098 - protein, 9 aa, Staphylococcus
TTESGETIE

SEQ ID NO: 1992099 - protein, 11 aa, Staphylococcus
TTESVQEGQTR

SEQ ID NO: 1992100 - protein, 12 aa, Staphylococcus
TTETNYKVTPEA

SEQ ID NO: 1992101 - protein, 6 aa, Staphylococcus
TTETTQ

SEQ ID NO: 1992102 - protein, 8 aa, Staphylococcus
TTETYEQL

SEQ ID NO: 1992103 - protein, 9 aa, Staphylococcus
TTEYDTSSQ

SEQ ID NO: 1992104 - protein, 4 aa, Staphylococcus
TTFD

SEQ ID NO: 1992105 - protein, 8 aa, Staphylococcus
TTFEEKEH

SEQ ID NO: 1992106 - protein, 10 aa, Staphylococcus
TTFETQKSRM

SEQ ID NO: 1992107 - protein, 4 aa, Staphylococcus
TTFN

SEQ ID NO: 1992108 - protein, 4 aa, Staphylococcus
TTFQ

SEQ ID NO: 1992109 - protein, 5 aa, Staphylococcus
TTFQQ

SEQ ID NO: 1992110 - protein, 11 aa, Staphylococcus
TTGASPASHVD

SEQ ID NO: 1992111 - protein, 5 aa, Staphylococcus
TTGDI

SEQ ID NO: 1992112 - protein, 5 aa, Staphylococcus
TTGEA

SEQ ID NO: 1992113 - protein, 13 aa, Staphylococcus
TTGEEKEQEGAKR

SEQ ID NO: 1992114 - protein, 15 aa, Staphylococcus
TTGEEMEQLGSQNLY

SEQ ID NO: 1992115 - protein, 15 aa, Staphylococcus
TTGEFPKYGNNDARV

SEQ ID NO: 1992116 - protein, 8 aa, Staphylococcus
TTGEKDTL

SEQ ID NO: 1992117 - protein, 12 aa, Staphylococcus
TTGEKEKITEKL

SEQ ID NO: 1992118 - protein, 11 aa, Staphylococcus
TTGEKEKITQK

SEQ ID NO: 1992119 - protein, 8 aa, Staphylococcus
TTGEKEQI

SEQ ID NO: 1992120 - protein, 10 aa, Staphylococcus
TTGEKEQLTA

SEQ ID NO: 1992121 - protein, 7 aa, Staphylococcus
TTGELNG

SEQ ID NO: 1992122 - protein, 6 aa, Staphylococcus
TTGERV

SEQ ID NO: 1992123 - protein, 9 aa, Staphylococcus
TTGHAGQSI

SEQ ID NO: 1992124 - protein, 6 aa, Staphylococcus
TTGHTI

SEQ ID NO: 1992125 - protein, 5 aa, Staphylococcus
TTGLH

SEQ ID NO: 1992126 - protein, 18 aa, Staphylococcus
TTGNAQNNTGWGSKEYDN

SEQ ID NO: 1992127 - protein, 9 aa, Staphylococcus
TTGNDKRQK

SEQ ID NO: 1992128 - protein, 5 aa, Staphylococcus
TTGNE

SEQ ID NO: 1992129 - protein, 16 aa, Staphylococcus
TTGNSQNNTEWSNKEY

SEQ ID NO: 1992130 - protein, 11 aa, Staphylococcus
TTGNSRAYSPR

SEQ ID NO: 1992131 - protein, 12 aa, Staphylococcus
TTGPKAKQFEEN

SEQ ID NO: 1992132 - protein, 12 aa, Staphylococcus
TTGQNALSQARS

SEQ ID NO: 1992133 - protein, 9 aa, Staphylococcus
TTGRAHMTK

SEQ ID NO: 1992134 - protein, 5 aa, Staphylococcus
TTGRE

SEQ ID NO: 1992135 - protein, 7 aa, Staphylococcus
TTGRNDL

SEQ ID NO: 1992136 - protein, 10 aa, Staphylococcus
TTGRQHMTKT

SEQ ID NO: 1992137 - protein, 10 aa, Staphylococcus
TTGSDSGKEL

SEQ ID NO: 1992138 - protein, 6 aa, Staphylococcus
TTGSHA

SEQ ID NO: 1992139 - protein, 12 aa, Staphylococcus
TTHDVKSASLSD

SEQ ID NO: 1992140 - protein, 20 aa, Staphylococcus
TTHGKFDEKVEATENGIRYK

SEQ ID NO: 1992141 - protein, 6 aa, Staphylococcus
TTHGRF

SEQ ID NO: 1992142 - protein, 15 aa, Staphylococcus
TTHGRYDKKVEPIED

SEQ ID NO: 1992143 - protein, 15 aa, Staphylococcus
TTHGRYDKRVEPIES

SEQ ID NO: 1992144 - protein, 17 aa, Staphylococcus
TTHGTYDKKVEATENGI

SEQ ID NO: 1992145 - protein, 22 aa, Staphylococcus
TTHIGGGTGASEGAKATTVAPG

SEQ ID NO: 1992146 - protein, 22 aa, Staphylococcus
TTHIGGGTGASEGAKATTVTPG

SEQ ID NO: 1992147 - protein, 5 aa, Staphylococcus
TTHND

SEQ ID NO: 1992148 - protein, 6 aa, Staphylococcus
TTHNHD

SEQ ID NO: 1992149 - protein, 10 aa, Staphylococcus
TTHNPDAYTH

SEQ ID NO: 1992150 - protein, 5 aa, Staphylococcus
TTHPG

SEQ ID NO: 1992151 - protein, 6 aa, Staphylococcus
TTHPSS

SEQ ID NO: 1992152 - protein, 13 aa, Staphylococcus
TTHRTYQTNEPLN

SEQ ID NO: 1992153 - protein, 13 aa, Staphylococcus
TTIDEALSSANVT

SEQ ID NO: 1992154 - protein, 9 aa, Staphylococcus
TTIDGPKLS

SEQ ID NO: 1992155 - protein, 12 aa, Staphylococcus
TTIESDKHFDGG

SEQ ID NO: 1992156 - protein, 9 aa, Staphylococcus
TTIGGESKK

SEQ ID NO: 1992157 - protein, 12 aa, Staphylococcus
TTILGADDKAGL

SEQ ID NO: 1992158 - protein, 17 aa, Staphylococcus
TTINGKTAHASTPNEGI

SEQ ID NO: 1992159 - protein, 13 aa, Staphylococcus
TTINNAMKNYGKK

SEQ ID NO: 1992160 - protein, 6 aa, Staphylococcus
TTIPQT

SEQ ID NO: 1992161 - protein, 5 aa, Staphylococcus
TTISA

SEQ ID NO: 1992162 - protein, 6 aa, Staphylococcus
TTITKN

SEQ ID NO: 1992163 - protein, 6 aa, Staphylococcus
TTIVEQ

SEQ ID NO: 1992164 - protein, 40 aa, Staphylococcus
TTIYAPQKTFKPHTQQTKQGDRPYGGVAPKGMTSAQYAEL

SEQ ID NO: 1992165 - protein, 4 aa, Staphylococcus
TTKA

SEQ ID NO: 1992166 - protein, 9 aa, Staphylococcus
TTKAERKKQ

SEQ ID NO: 1992167 - protein, 5 aa, Staphylococcus
TTKAH

SEQ ID NO: 1992168 - protein, 9 aa, Staphylococcus
TTKDDAQNK

SEQ ID NO: 1992169 - protein, 8 aa, Staphylococcus
TTKDDQLD

SEQ ID NO: 1992170 - protein, 6 aa, Staphylococcus
TTKDKE

SEQ ID NO: 1992171 - protein, 5 aa, Staphylococcus
TTKDV

SEQ ID NO: 1992172 - protein, 6 aa, Staphylococcus
TTKEAF

SEQ ID NO: 1992173 - protein, 6 aa, Staphylococcus
TTKEAP

SEQ ID NO: 1992174 - protein, 10 aa, Staphylococcus
TTKERSPFKT

SEQ ID NO: 1992175 - protein, 14 aa, Staphylococcus
TTKEVKETKEGLKS

SEQ ID NO: 1992176 - protein, 15 aa, Staphylococcus
TTKEVRETKEGLKSG

SEQ ID NO: 1992177 - protein, 4 aa, Staphylococcus
TTKF

SEQ ID NO: 1992178 - protein, 5 aa, Staphylococcus
TTKGI

SEQ ID NO: 1992179 - protein, 14 aa, Staphylococcus
TTKGKDIKEPLSNI

SEQ ID NO: 1992180 - protein, 19 aa, Staphylococcus
TTKGLSSIDTADDINEGQR

SEQ ID NO: 1992181 - protein, 12 aa, Staphylococcus
TTKKKKGEDEKE

SEQ ID NO: 1992182 - protein, 12 aa, Staphylococcus
TTKKKQANDEKE

SEQ ID NO: 1992183 - protein, 15 aa, Staphylococcus
TTKKSEAIQLINQLF

SEQ ID NO: 1992184 - protein, 11 aa, Staphylococcus
TTKLDANTESL

SEQ ID NO: 1992185 - protein, 8 aa, Staphylococcus
TTKLGGQA

SEQ ID NO: 1992186 - protein, 10 aa, Staphylococcus
TTKLSEDDIT

SEQ ID NO: 1992187 - protein, 9 aa, Staphylococcus
TTKPKDCKI

SEQ ID NO: 1992188 - protein, 7 aa, Staphylococcus
TTKPNDM

SEQ ID NO: 1992189 - protein, 13 aa, Staphylococcus
TTKQQSLAAQKQT

SEQ ID NO: 1992190 - protein, 14 aa, Staphylococcus
TTKQQSLAAQKQTI

SEQ ID NO: 1992191 - protein, 9 aa, Staphylococcus
TTKRNKGQV

SEQ ID NO: 1992192 - protein, 4 aa, Staphylococcus
TTKS

SEQ ID NO: 1992193 - protein, 10 aa, Staphylococcus
TTKSDAQSRL

SEQ ID NO: 1992194 - protein, 13 aa, Staphylococcus
TTKSQFKVTPEQI

SEQ ID NO: 1992195 - protein, 4 aa, Staphylococcus
TTKT

SEQ ID NO: 1992196 - protein, 6 aa, Staphylococcus
TTKTNM

SEQ ID NO: 1992197 - protein, 8 aa, Staphylococcus
TTKTTVTG

SEQ ID NO: 1992198 - protein, 4 aa, Staphylococcus
TTKV

SEQ ID NO: 1992199 - protein, 14 aa, Staphylococcus
TTKVEDVSQRLDNK

SEQ ID NO: 1992200 - protein, 9 aa, Staphylococcus
TTKVKNGPT

SEQ ID NO: 1992201 - protein, 6 aa, Staphylococcus
TTKVSE

SEQ ID NO: 1992202 - protein, 11 aa, Staphylococcus
TTLASKGDEIL

SEQ ID NO: 1992203 - protein, 7 aa, Staphylococcus
TTLGEQG

SEQ ID NO: 1992204 - protein, 28 aa, Staphylococcus
TTLKGKELDVDTTEIENAPLPNNKVESL

SEQ ID NO: 1992205 - protein, 8 aa, Staphylococcus
TTLNETKR

SEQ ID NO: 1992206 - protein, 6 aa, Staphylococcus
TTLNNQ

SEQ ID NO: 1992207 - protein, 9 aa, Staphylococcus
TTLPSEGDA

SEQ ID NO: 1992208 - protein, 11 aa, Staphylococcus
TTLQNKGPRRV

SEQ ID NO: 1992209 - protein, 7 aa, Staphylococcus
TTLSNKG

SEQ ID NO: 1992210 - protein, 9 aa, Staphylococcus
TTLTDSDQF

SEQ ID NO: 1992211 - protein, 15 aa, Staphylococcus
TTLTESDQKNYQSRL

SEQ ID NO: 1992212 - protein, 10 aa, Staphylococcus
TTLTETDKVK

SEQ ID NO: 1992213 - protein, 15 aa, Staphylococcus
TTLTKGETKIVDVTT

SEQ ID NO: 1992214 - protein, 12 aa, Staphylococcus
TTLTSADQSIYQ

SEQ ID NO: 1992215 - protein, 8 aa, Staphylococcus
TTMKEREV

SEQ ID NO: 1992216 - protein, 11 aa, Staphylococcus
TTMKPKELRTR

SEQ ID NO: 1992217 - protein, 6 aa, Staphylococcus
TTNAEV

SEQ ID NO: 1992218 - protein, 11 aa, Staphylococcus
TTNAHQPDSAT

SEQ ID NO: 1992219 - protein, 11 aa, Staphylococcus
TTNAHQPNEDT

SEQ ID NO: 1992220 - protein, 10 aa, Staphylococcus
TTNEEYRGMG

SEQ ID NO: 1992221 - protein, 10 aa, Staphylococcus
TTNEHQPDSE

SEQ ID NO: 1992222 - protein, 16 aa, Staphylococcus
TTNELNGAYTADGYAR

SEQ ID NO: 1992223 - protein, 16 aa, Staphylococcus
TTNELNGSYAADGYAR

SEQ ID NO: 1992224 - protein, 12 aa, Staphylococcus
TTNESGADDKIK

SEQ ID NO: 1992225 - protein, 6 aa, Staphylococcus
TTNGAY

SEQ ID NO: 1992226 - protein, 7 aa, Staphylococcus
TTNIKQN

SEQ ID NO: 1992227 - protein, 11 aa, Staphylococcus
TTNKDEQRKQL

SEQ ID NO: 1992228 - protein, 5 aa, Staphylococcus
TTNLT

SEQ ID NO: 1992229 - protein, 9 aa, Staphylococcus
TTNNQREPL

SEQ ID NO: 1992230 - protein, 11 aa, Staphylococcus
TTNNSSKELIQ

SEQ ID NO: 1992231 - protein, 18 aa, Staphylococcus
TTNNTARELTLTKDSKKI

SEQ ID NO: 1992232 - protein, 4 aa, Staphylococcus
TTNP

SEQ ID NO: 1992233 - protein, 10 aa, Staphylococcus
TTNPKNVASQ

SEQ ID NO: 1992234 - protein, 4 aa, Staphylococcus
TTNQ

SEQ ID NO: 1992235 - protein, 8 aa, Staphylococcus
TTNRNSRR

SEQ ID NO: 1992236 - protein, 14 aa, Staphylococcus
TTNSDVKASQKEAL

SEQ ID NO: 1992237 - protein, 8 aa, Staphylococcus
TTNVGKST

SEQ ID NO: 1992238 - protein, 4 aa, Staphylococcus
TTNY

SEQ ID NO: 1992239 - protein, 6 aa, Staphylococcus
TTPAGH

SEQ ID NO: 1992240 - protein, 13 aa, Staphylococcus
TTPAGMDKNNDSV

SEQ ID NO: 1992241 - protein, 10 aa, Staphylococcus
TTPAGMSENQ

SEQ ID NO: 1992242 - protein, 9 aa, Staphylococcus
TTPATATGV

SEQ ID NO: 1992243 - protein, 6 aa, Staphylococcus
TTPDEK

SEQ ID NO: 1992244 - protein, 9 aa, Staphylococcus
TTPEATSYT

SEQ ID NO: 1992245 - protein, 35 aa, Staphylococcus
TTPEHQEEVKAYQKEASMKSDLERTDLAKDKSGVF

SEQ ID NO: 1992246 - protein, 10 aa, Staphylococcus
TTPEKAAQDV

SEQ ID NO: 1992247 - protein, 9 aa, Staphylococcus
TTPEPHMDG

SEQ ID NO: 1992248 - protein, 5 aa, Staphylococcus
TTPEY

SEQ ID NO: 1992249 - protein, 4 aa, Staphylococcus
TTPF

SEQ ID NO: 1992250 - protein, 6 aa, Staphylococcus
TTPFKE

SEQ ID NO: 1992251 - protein, 12 aa, Staphylococcus
TTPFKQKSKEKV

SEQ ID NO: 1992252 - protein, 12 aa, Staphylococcus
TTPGGGTDAGSI

SEQ ID NO: 1992253 - protein, 7 aa, Staphylococcus
TTPGSAD

SEQ ID NO: 1992254 - protein, 5 aa, Staphylococcus
TTPHT

SEQ ID NO: 1992255 - protein, 6 aa, Staphylococcus
TTPHTM

SEQ ID NO: 1992256 - protein, 13 aa, Staphylococcus
TTPIKKVTAPQDV

SEQ ID NO: 1992257 - protein, 7 aa, Staphylococcus
TTPIQGA

SEQ ID NO: 1992258 - protein, 5 aa, Staphylococcus
TTPKR

SEQ ID NO: 1992259 - protein, 9 aa, Staphylococcus
TTPKYDVPR

SEQ ID NO: 1992260 - protein, 4 aa, Staphylococcus
TTPL

SEQ ID NO: 1992261 - protein, 15 aa, Staphylococcus
TTPLGHDSKQEIATP

SEQ ID NO: 1992262 - protein, 17 aa, Staphylococcus
TTPLGHDSKQEISTPFG

SEQ ID NO: 1992263 - protein, 5 aa, Staphylococcus
TTPLH

SEQ ID NO: 1992264 - protein, 13 aa, Staphylococcus
TTPLKKVTTPQDV

SEQ ID NO: 1992265 - protein, 5 aa, Staphylococcus
TTPLR

SEQ ID NO: 1992266 - protein, 4 aa, Staphylococcus
TTPN

SEQ ID NO: 1992267 - protein, 16 aa, Staphylococcus
TTPNQDNPITEGKTPI

SEQ ID NO: 1992268 - protein, 5 aa, Staphylococcus
TTPQT

SEQ ID NO: 1992269 - protein, 12 aa, Staphylococcus
TTPRGGTDAGSI

SEQ ID NO: 1992270 - protein, 8 aa, Staphylococcus
TTPSADGT

SEQ ID NO: 1992271 - protein, 8 aa, Staphylococcus
TTPSSSEI

SEQ ID NO: 1992272 - protein, 11 aa, Staphylococcus
TTQDKDGNLNA

SEQ ID NO: 1992273 - protein, 14 aa, Staphylococcus
TTQDKHDPISDSER

SEQ ID NO: 1992274 - protein, 5 aa, Staphylococcus
TTQDN

SEQ ID NO: 1992275 - protein, 4 aa, Staphylococcus
TTQE

SEQ ID NO: 1992276 - protein, 5 aa, Staphylococcus
TTQEQ

SEQ ID NO: 1992277 - protein, 7 aa, Staphylococcus
TTQETLN

SEQ ID NO: 1992278 - protein, 7 aa, Staphylococcus
TTQGQVN

SEQ ID NO: 1992279 - protein, 7 aa, Staphylococcus
TTQIEEA

SEQ ID NO: 1992280 - protein, 8 aa, Staphylococcus
TTQPTDAN

SEQ ID NO: 1992281 - protein, 8 aa, Staphylococcus
TTQQREAL

SEQ ID NO: 1992282 - protein, 5 aa, Staphylococcus
TTQQV

SEQ ID NO: 1992283 - protein, 4 aa, Staphylococcus
TTQT

SEQ ID NO: 1992284 - protein, 7 aa, Staphylococcus
TTQTKDI

SEQ ID NO: 1992285 - protein, 7 aa, Staphylococcus
TTQTNTR

SEQ ID NO: 1992286 - protein, 134 aa, Staphylococcus
TTQTTTAETNTSSTKDNTSKTTDSHSTKTSQSTPLTESKELTPSKTQQDSNVNQDAIKNNDVEAPSTGKTNDTVDTTETKQTVTAKQPTDPAAPTVNTLNTKDEAISIDGTTNETVGHKDAKDQKNSQAGLETL

SEQ ID NO: 1992287 - protein, 4 aa, Staphylococcus
TTQV

SEQ ID NO: 1992288 - protein, 11 aa, Staphylococcus
TTQVATEPNND

SEQ ID NO: 1992289 - protein, 5 aa, Staphylococcus
TTQYD

SEQ ID NO: 1992290 - protein, 4 aa, Staphylococcus
TTRA

SEQ ID NO: 1992291 - protein, 8 aa, Staphylococcus
TTRAAAEL

SEQ ID NO: 1992292 - protein, 11 aa, Staphylococcus
TTRAGSLTAPL

SEQ ID NO: 1992293 - protein, 13 aa, Staphylococcus
TTREDGKSPYPRD

SEQ ID NO: 1992294 - protein, 6 aa, Staphylococcus
TTREGG

SEQ ID NO: 1992295 - protein, 13 aa, Staphylococcus
TTREGGSSPYPER

SEQ ID NO: 1992296 - protein, 13 aa, Staphylococcus
TTREGGYSLYPES

SEQ ID NO: 1992297 - protein, 9 aa, Staphylococcus
TTRENGLSH

SEQ ID NO: 1992298 - protein, 23 aa, Staphylococcus
TTRKRDGLTSSNKVEDGGLSGQP

SEQ ID NO: 1992299 - protein, 6 aa, Staphylococcus
TTRKVG

SEQ ID NO: 1992300 - protein, 8 aa, Staphylococcus
TTRLTDEQ

SEQ ID NO: 1992301 - protein, 6 aa, Staphylococcus
TTRNKK

SEQ ID NO: 1992302 - protein, 23 aa, Staphylococcus
TTRPQENKNFSSNGSNNASSNNV

SEQ ID NO: 1992303 - protein, 22 aa, Staphylococcus
TTRPQENKNFSSNNGNNSSNNV

SEQ ID NO: 1992304 - protein, 23 aa, Staphylococcus
TTRQRGGLSSPNKVEDGGLSGRP

SEQ ID NO: 1992305 - protein, 23 aa, Staphylococcus
TTRRREGLSSDNKNEEGGLSGRP

SEQ ID NO: 1992306 - protein, 9 aa, Staphylococcus
TTRSDLRKE

SEQ ID NO: 1992307 - protein, 10 aa, Staphylococcus
TTSAKDIAEA

SEQ ID NO: 1992308 - protein, 10 aa, Staphylococcus
TTSASPDEIE

SEQ ID NO: 1992309 - protein, 10 aa, Staphylococcus
TTSATPDEIE

SEQ ID NO: 1992310 - protein, 9 aa, Staphylococcus
TTSATPNEI

SEQ ID NO: 1992311 - protein, 9 aa, Staphylococcus
TTSDQQLSK

SEQ ID NO: 1992312 - protein, 4 aa, Staphylococcus
TTSE

SEQ ID NO: 1992313 - protein, 17 aa, Staphylococcus
TTSEHGKQKLENAGVQP

SEQ ID NO: 1992314 - protein, 21 aa, Staphylococcus
TTSEQERNEITASPLKASVEE

SEQ ID NO: 1992315 - protein, 6 aa, Staphylococcus
TTSERI

SEQ ID NO: 1992316 - protein, 7 aa, Staphylococcus
TTSERIS

SEQ ID NO: 1992317 - protein, 8 aa, Staphylococcus
TTSGESTI

SEQ ID NO: 1992318 - protein, 9 aa, Staphylococcus
TTSGFQGNA

SEQ ID NO: 1992319 - protein, 14 aa, Staphylococcus
TTSGISQRPIPGVK

SEQ ID NO: 1992320 - protein, 13 aa, Staphylococcus
TTSGRSKFHSNEI

SEQ ID NO: 1992321 - protein, 8 aa, Staphylococcus
TTSIKIGS

SEQ ID NO: 1992322 - protein, 7 aa, Staphylococcus
TTSIPKG

SEQ ID NO: 1992323 - protein, 11 aa, Staphylococcus
TTSLSGGEAQR

SEQ ID NO: 1992324 - protein, 4 aa, Staphylococcus
TTSQ

SEQ ID NO: 1992325 - protein, 6 aa, Staphylococcus
TTSQTL

SEQ ID NO: 1992326 - protein, 15 aa, Staphylococcus
TTSQTYFPKDNSAYF

SEQ ID NO: 1992327 - protein, 16 aa, Staphylococcus
TTSSETYPTHLNEQSQ

SEQ ID NO: 1992328 - protein, 5 aa, Staphylococcus
TTSSQ

SEQ ID NO: 1992329 - protein, 9 aa, Staphylococcus
TTSSTQSLQ

SEQ ID NO: 1992330 - protein, 6 aa, Staphylococcus
TTSSYT

SEQ ID NO: 1992331 - protein, 11 aa, Staphylococcus
TTSVATRGQAP

SEQ ID NO: 1992332 - protein, 10 aa, Staphylococcus
TTSVQNTKNT

SEQ ID NO: 1992333 - protein, 7 aa, Staphylococcus
TTTDNGL

SEQ ID NO: 1992334 - protein, 4 aa, Staphylococcus
TTTE

SEQ ID NO: 1992335 - protein, 9 aa, Staphylococcus
TTTEMTNQM

SEQ ID NO: 1992336 - protein, 12 aa, Staphylococcus
TTTEPNEGDRFD

SEQ ID NO: 1992337 - protein, 7 aa, Staphylococcus
TTTGDIQ

SEQ ID NO: 1992338 - protein, 8 aa, Staphylococcus
TTTGESTL

SEQ ID NO: 1992339 - protein, 9 aa, Staphylococcus
TTTHGKTQI

SEQ ID NO: 1992340 - protein, 13 aa, Staphylococcus
TTTHKTLRGPRGG

SEQ ID NO: 1992341 - protein, 4 aa, Staphylococcus
TTTK

SEQ ID NO: 1992342 - protein, 7 aa, Staphylococcus
TTTKDTY

SEQ ID NO: 1992343 - protein, 16 aa, Staphylococcus
TTTMGPGVKIDTSSFK

SEQ ID NO: 1992344 - protein, 16 aa, Staphylococcus
TTTMGPGVKVDTASFK

SEQ ID NO: 1992345 - protein, 16 aa, Staphylococcus
TTTMGPGVKVDTSNFK

SEQ ID NO: 1992346 - protein, 5 aa, Staphylococcus
TTTNK

SEQ ID NO: 1992347 - protein, 9 aa, Staphylococcus
TTTPKYNVK

SEQ ID NO: 1992348 - protein, 15 aa, Staphylococcus
TTTPLTGVDKQPGIH

SEQ ID NO: 1992349 - protein, 12 aa, Staphylococcus
TTTQHTNNEVEE

SEQ ID NO: 1992350 - protein, 7 aa, Staphylococcus
TTTQNER

SEQ ID NO: 1992351 - protein, 6 aa, Staphylococcus
TTTRRK

SEQ ID NO: 1992352 - protein, 12 aa, Staphylococcus
TTTSDESRKQLP

SEQ ID NO: 1992353 - protein, 11 aa, Staphylococcus
TTTSQKTIDGT

SEQ ID NO: 1992354 - protein, 23 aa, Staphylococcus
TTTTFSNPQLQQDIEANPDKKGL

SEQ ID NO: 1992355 - protein, 9 aa, Staphylococcus
TTTTNGKEA

SEQ ID NO: 1992356 - protein, 8 aa, Staphylococcus
TTTTNQYY

SEQ ID NO: 1992357 - protein, 12 aa, Staphylococcus
TTTTTSKLGSET

SEQ ID NO: 1992358 - protein, 7 aa, Staphylococcus
TTTVTDG

SEQ ID NO: 1992359 - protein, 17 aa, Staphylococcus
TTTYNNNENLDEDKEHY

SEQ ID NO: 1992360 - protein, 9 aa, Staphylococcus
TTVDGPKLS

SEQ ID NO: 1992361 - protein, 8 aa, Staphylococcus
TTVEDSKK

SEQ ID NO: 1992362 - protein, 13 aa, Staphylococcus
TTVEEAIENEKAG

SEQ ID NO: 1992363 - protein, 12 aa, Staphylococcus
TTVLGADDKAGL

SEQ ID NO: 1992364 - protein, 17 aa, Staphylococcus
TTVLNDENGIKDIPQTL

SEQ ID NO: 1992365 - protein, 11 aa, Staphylococcus
TTVPKGASNKV

SEQ ID NO: 1992366 - protein, 7 aa, Staphylococcus
TTVPNVG

SEQ ID NO: 1992367 - protein, 6 aa, Staphylococcus
TTVQGT

SEQ ID NO: 1992368 - protein, 9 aa, Staphylococcus
TTVQKELPA

SEQ ID NO: 1992369 - protein, 9 aa, Staphylococcus
TTVTSPNQT

SEQ ID NO: 1992370 - protein, 17 aa, Staphylococcus
TTYDNNGRPKDDEKRYP

SEQ ID NO: 1992371 - protein, 6 aa, Staphylococcus
TTYEEI

SEQ ID NO: 1992372 - protein, 11 aa, Staphylococcus
TTYESKENLSL

SEQ ID NO: 1992373 - protein, 6 aa, Staphylococcus
TTYGTG

SEQ ID NO: 1992374 - protein, 7 aa, Staphylococcus
TTYPNGK

SEQ ID NO: 1992375 - protein, 5 aa, Staphylococcus
TTYQP

SEQ ID NO: 1992376 - protein, 11 aa, Staphylococcus
TTYQSKGVGNK

SEQ ID NO: 1992377 - protein, 6 aa, Staphylococcus
TTYTDK

SEQ ID NO: 1992378 - protein, 12 aa, Staphylococcus
TVADKKKAVTDR

SEQ ID NO: 1992379 - protein, 13 aa, Staphylococcus
TVADPISKFTSGK

SEQ ID NO: 1992380 - protein, 5 aa, Staphylococcus
TVADT

SEQ ID NO: 1992381 - protein, 8 aa, Staphylococcus
TVAEKEVS

SEQ ID NO: 1992382 - protein, 7 aa, Staphylococcus
TVAGPNA

SEQ ID NO: 1992383 - protein, 12 aa, Staphylococcus
TVAKPIDEFTSG

SEQ ID NO: 1992384 - protein, 13 aa, Staphylococcus
TVAKPIDEFTSGG

SEQ ID NO: 1992385 - protein, 13 aa, Staphylococcus
TVAKPIDQFTSGG

SEQ ID NO: 1992386 - protein, 12 aa, Staphylococcus
TVAKPISEFTTG

SEQ ID NO: 1992387 - protein, 9 aa, Staphylococcus
TVANDNDLK

SEQ ID NO: 1992388 - protein, 9 aa, Staphylococcus
TVANPDVTE

SEQ ID NO: 1992389 - protein, 14 aa, Staphylococcus
TVAPNNSEIGKPTI

SEQ ID NO: 1992390 - protein, 8 aa, Staphylococcus
TVAQKEVS

SEQ ID NO: 1992391 - protein, 7 aa, Staphylococcus
TVAQPID

SEQ ID NO: 1992392 - protein, 6 aa, Staphylococcus
TVARET

SEQ ID NO: 1992393 - protein, 10 aa, Staphylococcus
TVDDKYKARY

SEQ ID NO: 1992394 - protein, 11 aa, Staphylococcus
TVDDNQKKIDK

SEQ ID NO: 1992395 - protein, 5 aa, Staphylococcus
TVDEN

SEQ ID NO: 1992396 - protein, 5 aa, Staphylococcus
TVDEV

SEQ ID NO: 1992397 - protein, 8 aa, Staphylococcus
TVDGNDPI

SEQ ID NO: 1992398 - protein, 10 aa, Staphylococcus
TVDGPDDYKS

SEQ ID NO: 1992399 - protein, 11 aa, Staphylococcus
TVDGPDDYKSM

SEQ ID NO: 1992400 - protein, 10 aa, Staphylococcus
TVDKDSNTMK

SEQ ID NO: 1992401 - protein, 10 aa, Staphylococcus
TVDKETNTMK

SEQ ID NO: 1992402 - protein, 31 aa, Staphylococcus
TVDNDETNEKQQTELPKKMTKKERQKTIENI

SEQ ID NO: 1992403 - protein, 31 aa, Staphylococcus
TVDNDETNEKQQTEVPKKMTKKERQKTIENI

SEQ ID NO: 1992404 - protein, 10 aa, Staphylococcus
TVDNPEKVPY

SEQ ID NO: 1992405 - protein, 16 aa, Staphylococcus
TVDPKDPAKLLPEEED

SEQ ID NO: 1992406 - protein, 16 aa, Staphylococcus
TVDPQDPGKLLPEEEE

SEQ ID NO: 1992407 - protein, 14 aa, Staphylococcus
TVDTDEKADALFSA

SEQ ID NO: 1992408 - protein, 18 aa, Staphylococcus
TVDTTKPEEVEKAIKENT

SEQ ID NO: 1992409 - protein, 4 aa, Staphylococcus
TVED

SEQ ID NO: 1992410 - protein, 5 aa, Staphylococcus
TVEDV

SEQ ID NO: 1992411 - protein, 4 aa, Staphylococcus
TVEE

SEQ ID NO: 1992412 - protein, 6 aa, Staphylococcus
TVEEAI

SEQ ID NO: 1992413 - protein, 9 aa, Staphylococcus
TVEGANGDV

SEQ ID NO: 1992414 - protein, 11 aa, Staphylococcus
TVEGANGPEIT

SEQ ID NO: 1992415 - protein, 6 aa, Staphylococcus
TVEGEA

SEQ ID NO: 1992416 - protein, 11 aa, Staphylococcus
TVEGPDDYKSM

SEQ ID NO: 1992417 - protein, 26 aa, Staphylococcus
TVEGRNAKIEGKSELQGAQVKATDLR

SEQ ID NO: 1992418 - protein, 27 aa, Staphylococcus
TVEGRNAKITGKSKLQGAQVKATDLRA

SEQ ID NO: 1992419 - protein, 26 aa, Staphylococcus
TVEGRSAKIQGKSQLQGAQVKATDLR

SEQ ID NO: 1992420 - protein, 9 aa, Staphylococcus
TVEHPRYGK

SEQ ID NO: 1992421 - protein, 9 aa, Staphylococcus
TVEKGGEVK

SEQ ID NO: 1992422 - protein, 9 aa, Staphylococcus
TVEKRQDQR

SEQ ID NO: 1992423 - protein, 5 aa, Staphylococcus
TVEKS

SEQ ID NO: 1992424 - protein, 4 aa, Staphylococcus
TVEN

SEQ ID NO: 1992425 - protein, 43 aa, Staphylococcus
TVENDETNAQEQTTVPKKMTKKERQKTIENIEKEMKKAAKELD

SEQ ID NO: 1992426 - protein, 30 aa, Staphylococcus
TVENDETNEQQQTEVPKKMTKKEREKTIAN

SEQ ID NO: 1992427 - protein, 8 aa, Staphylococcus
TVENEGEI

SEQ ID NO: 1992428 - protein, 8 aa, Staphylococcus
TVENNGEI

SEQ ID NO: 1992429 - protein, 8 aa, Staphylococcus
TVENNGEV

SEQ ID NO: 1992430 - protein, 8 aa, Staphylococcus
TVENPDVT

SEQ ID NO: 1992431 - protein, 12 aa, Staphylococcus
TVENPDVTEADA

SEQ ID NO: 1992432 - protein, 8 aa, Staphylococcus
TVENYEPN

SEQ ID NO: 1992433 - protein, 14 aa, Staphylococcus
TVEQKNKTAAPIDR

SEQ ID NO: 1992434 - protein, 15 aa, Staphylococcus
TVEQPNGNRSPEGSH

SEQ ID NO: 1992435 - protein, 10 aa, Staphylococcus
TVEQRPKMDG

SEQ ID NO: 1992436 - protein, 10 aa, Staphylococcus
TVEQRPKMEG

SEQ ID NO: 1992437 - protein, 8 aa, Staphylococcus
TVEQTDRN

SEQ ID NO: 1992438 - protein, 4 aa, Staphylococcus
TVER

SEQ ID NO: 1992439 - protein, 11 aa, Staphylococcus
TVERGGAGGGV

SEQ ID NO: 1992440 - protein, 31 aa, Staphylococcus
TVESDDTNENKQTEVPKKMTKKERQKTIENI

SEQ ID NO: 1992441 - protein, 31 aa, Staphylococcus
TVESDETNDQKQTELPKKMTKKERQKTIENI

SEQ ID NO: 1992442 - protein, 13 aa, Staphylococcus
TVETANDIVKILK

SEQ ID NO: 1992443 - protein, 6 aa, Staphylococcus
TVETED

SEQ ID NO: 1992444 - protein, 12 aa, Staphylococcus
TVETKRKKSYPQ

SEQ ID NO: 1992445 - protein, 7 aa, Staphylococcus
TVETLSE

SEQ ID NO: 1992446 - protein, 5 aa, Staphylococcus
TVGDD

SEQ ID NO: 1992447 - protein, 70 aa, Staphylococcus
TVGEGSGSPSQSSSEDKKEDTSSKEDTSKSEEKSQPAASETSSKEESSSNSDQRVNATPSARKYAREKGI

SEQ ID NO: 1992448 - protein, 8 aa, Staphylococcus
TVGIDPSL

SEQ ID NO: 1992449 - protein, 10 aa, Staphylococcus
TVGKPSNDVE

SEQ ID NO: 1992450 - protein, 10 aa, Staphylococcus
TVGKSPVKEV

SEQ ID NO: 1992451 - protein, 9 aa, Staphylococcus
TVGNGDAIA

SEQ ID NO: 1992452 - protein, 11 aa, Staphylococcus
TVGNGGNVARK

SEQ ID NO: 1992453 - protein, 5 aa, Staphylococcus
TVGNR

SEQ ID NO: 1992454 - protein, 5 aa, Staphylococcus
TVGNT

SEQ ID NO: 1992455 - protein, 11 aa, Staphylococcus
TVGNTENNTYM

SEQ ID NO: 1992456 - protein, 5 aa, Staphylococcus
TVGQV

SEQ ID NO: 1992457 - protein, 7 aa, Staphylococcus
TVGRNKK

SEQ ID NO: 1992458 - protein, 9 aa, Staphylococcus
TVGTGVGPT

SEQ ID NO: 1992459 - protein, 10 aa, Staphylococcus
TVGTGVGPTY

SEQ ID NO: 1992460 - protein, 4 aa, Staphylococcus
TVHQ

SEQ ID NO: 1992461 - protein, 20 aa, Staphylococcus
TVIKEQGDNYTVSTESGLEI

SEQ ID NO: 1992462 - protein, 11 aa, Staphylococcus
TVIPDDHPYSI

SEQ ID NO: 1992463 - protein, 12 aa, Staphylococcus
TVISGGGSDGNI

SEQ ID NO: 1992464 - protein, 12 aa, Staphylococcus
TVISSGLETARE

SEQ ID NO: 1992465 - protein, 9 aa, Staphylococcus
TVKDGGRYD

SEQ ID NO: 1992466 - protein, 6 aa, Staphylococcus
TVKEKM

SEQ ID NO: 1992467 - protein, 11 aa, Staphylococcus
TVKGPDDYKSM

SEQ ID NO: 1992468 - protein, 12 aa, Staphylococcus
TVKGPGPGRESA

SEQ ID NO: 1992469 - protein, 12 aa, Staphylococcus
TVKGPKGELERT

SEQ ID NO: 1992470 - protein, 10 aa, Staphylococcus
TVKGSGKNGK

SEQ ID NO: 1992471 - protein, 9 aa, Staphylococcus
TVKGTAQDR

SEQ ID NO: 1992472 - protein, 5 aa, Staphylococcus
TVKHH

SEQ ID NO: 1992473 - protein, 13 aa, Staphylococcus
TVKNGDRPSTSGV

SEQ ID NO: 1992474 - protein, 5 aa, Staphylococcus
TVKPE

SEQ ID NO: 1992475 - protein, 4 aa, Staphylococcus
TVKS

SEQ ID NO: 1992476 - protein, 6 aa, Staphylococcus
TVKSGS

SEQ ID NO: 1992477 - protein, 16 aa, Staphylococcus
TVKSLEGNDQGDVTKV

SEQ ID NO: 1992478 - protein, 4 aa, Staphylococcus
TVKT

SEQ ID NO: 1992479 - protein, 12 aa, Staphylococcus
TVLAGGGSDGNI

SEQ ID NO: 1992480 - protein, 11 aa, Staphylococcus
TVLPDSHPYSV

SEQ ID NO: 1992481 - protein, 8 aa, Staphylococcus
TVMDGSVK

SEQ ID NO: 1992482 - protein, 6 aa, Staphylococcus
TVNANR

SEQ ID NO: 1992483 - protein, 14 aa, Staphylococcus
TVNEEKISKISNTD

SEQ ID NO: 1992484 - protein, 4 aa, Staphylococcus
TVNG

SEQ ID NO: 1992485 - protein, 13 aa, Staphylococcus
TVNPGDIEQSKGN

SEQ ID NO: 1992486 - protein, 10 aa, Staphylococcus
TVNPKDKDIS

SEQ ID NO: 1992487 - protein, 11 aa, Staphylococcus
TVNPSGRSSSV

SEQ ID NO: 1992488 - protein, 8 aa, Staphylococcus
TVNQDNPT

SEQ ID NO: 1992489 - protein, 8 aa, Staphylococcus
TVNQNGQV

SEQ ID NO: 1992490 - protein, 13 aa, Staphylococcus
TVNRTEKEQLEKR

SEQ ID NO: 1992491 - protein, 17 aa, Staphylococcus
TVNTENNEVKSSQKEAL

SEQ ID NO: 1992492 - protein, 5 aa, Staphylococcus
TVNTQ

SEQ ID NO: 1992493 - protein, 6 aa, Staphylococcus
TVNTQD

SEQ ID NO: 1992494 - protein, 17 aa, Staphylococcus
TVNTQNNDVKASQKEAL

SEQ ID NO: 1992495 - protein, 17 aa, Staphylococcus
TVNTTTDHVQASQKEAL

SEQ ID NO: 1992496 - protein, 5 aa, Staphylococcus
TVNVE

SEQ ID NO: 1992497 - protein, 20 aa, Staphylococcus
TVPEENEEVKSDKKDSQLTM

SEQ ID NO: 1992498 - protein, 9 aa, Staphylococcus
TVPGFDEEQ

SEQ ID NO: 1992499 - protein, 5 aa, Staphylococcus
TVPHQ

SEQ ID NO: 1992500 - protein, 12 aa, Staphylococcus
TVPKYDAKRTDL

SEQ ID NO: 1992501 - protein, 6 aa, Staphylococcus
TVPKYN

SEQ ID NO: 1992502 - protein, 5 aa, Staphylococcus
TVPNN

SEQ ID NO: 1992503 - protein, 4 aa, Staphylococcus
TVPS

SEQ ID NO: 1992504 - protein, 12 aa, Staphylococcus
TVPSDENANEHE

SEQ ID NO: 1992505 - protein, 7 aa, Staphylococcus
TVQEEVG

SEQ ID NO: 1992506 - protein, 10 aa, Staphylococcus
TVQESLSGAQ

SEQ ID NO: 1992507 - protein, 5 aa, Staphylococcus
TVQFG

SEQ ID NO: 1992508 - protein, 9 aa, Staphylococcus
TVQKEKGNI

SEQ ID NO: 1992509 - protein, 9 aa, Staphylococcus
TVQKTGTEV

SEQ ID NO: 1992510 - protein, 10 aa, Staphylococcus
TVQSGEAIET

SEQ ID NO: 1992511 - protein, 14 aa, Staphylococcus
TVQSLNGDEQGNVT

SEQ ID NO: 1992512 - protein, 21 aa, Staphylococcus
TVQSTDQALTKEQYDKLVARF

SEQ ID NO: 1992513 - protein, 33 aa, Staphylococcus
TVQTTAEPLSTSTSSDDTTATEPTSDAGATEPT

SEQ ID NO: 1992514 - protein, 10 aa, Staphylococcus
TVQYENKDIT

SEQ ID NO: 1992515 - protein, 11 aa, Staphylococcus
TVQYENPNISQ

SEQ ID NO: 1992516 - protein, 11 aa, Staphylococcus
TVQYSNENITQ

SEQ ID NO: 1992517 - protein, 10 aa, Staphylococcus
TVRDQGTNID

SEQ ID NO: 1992518 - protein, 6 aa, Staphylococcus
TVREAS

SEQ ID NO: 1992519 - protein, 12 aa, Staphylococcus
TVRGQGYKVEAH

SEQ ID NO: 1992520 - protein, 12 aa, Staphylococcus
TVRGQGYKVEHH

SEQ ID NO: 1992521 - protein, 5 aa, Staphylococcus
TVRQY

SEQ ID NO: 1992522 - protein, 11 aa, Staphylococcus
TVSAREKEENL

SEQ ID NO: 1992523 - protein, 8 aa, Staphylococcus
TVSDKGEA

SEQ ID NO: 1992524 - protein, 9 aa, Staphylococcus
TVSENSGDL

SEQ ID NO: 1992525 - protein, 4 aa, Staphylococcus
TVSG

SEQ ID NO: 1992526 - protein, 5 aa, Staphylococcus
TVSGK

SEQ ID NO: 1992527 - protein, 21 aa, Staphylococcus
TVSGLSSSQLQTLKDTKPARI

SEQ ID NO: 1992528 - protein, 6 aa, Staphylococcus
TVSGWS

SEQ ID NO: 1992529 - protein, 8 aa, Staphylococcus
TVSITSPI

SEQ ID NO: 1992530 - protein, 12 aa, Staphylococcus
TVSKHEKDESVD

SEQ ID NO: 1992531 - protein, 11 aa, Staphylococcus
TVSKSGTIQEV

SEQ ID NO: 1992532 - protein, 11 aa, Staphylococcus
TVSNREKEENI

SEQ ID NO: 1992533 - protein, 16 aa, Staphylococcus
TVSQEDVKKWSAEDEY

SEQ ID NO: 1992534 - protein, 11 aa, Staphylococcus
TVSQETINDSY

SEQ ID NO: 1992535 - protein, 11 aa, Staphylococcus
TVSQKTVTGTL

SEQ ID NO: 1992536 - protein, 11 aa, Staphylococcus
TVSRHEKEENI

SEQ ID NO: 1992537 - protein, 10 aa, Staphylococcus
TVSSGDAIAT

SEQ ID NO: 1992538 - protein, 4 aa, Staphylococcus
TVST

SEQ ID NO: 1992539 - protein, 5 aa, Staphylococcus
TVSTE

SEQ ID NO: 1992540 - protein, 11 aa, Staphylococcus
TVSTSGKTGVE

SEQ ID NO: 1992541 - protein, 15 aa, Staphylococcus
TVSTVSAGISYIEFI

SEQ ID NO: 1992542 - protein, 18 aa, Staphylococcus
TVSVKDYDGKYIGEHKER

SEQ ID NO: 1992543 - protein, 19 aa, Staphylococcus
TVSVKDYDGKYIGEHKERN

SEQ ID NO: 1992544 - protein, 15 aa, Staphylococcus
TVSYGSTYTAEKSEK

SEQ ID NO: 1992545 - protein, 20 aa, Staphylococcus
TVTDGEGIQTGDLLVELEKD

SEQ ID NO: 1992546 - protein, 5 aa, Staphylococcus
TVTEV

SEQ ID NO: 1992547 - protein, 13 aa, Staphylococcus
TVTGFSNSEEQAV

SEQ ID NO: 1992548 - protein, 21 aa, Staphylococcus
TVTGKPAQIKGSYSSGTAERE

SEQ ID NO: 1992549 - protein, 17 aa, Staphylococcus
TVTGKTLRENNEGKEIK

SEQ ID NO: 1992550 - protein, 4 aa, Staphylococcus
TVTK

SEQ ID NO: 1992551 - protein, 20 aa, Staphylococcus
TVTKRDPETVNPKIKTGNVE

SEQ ID NO: 1992552 - protein, 8 aa, Staphylococcus
TVTNNGDV

SEQ ID NO: 1992553 - protein, 11 aa, Staphylococcus
TVTPDAVKAEN

SEQ ID NO: 1992554 - protein, 6 aa, Staphylococcus
TVTPEQ

SEQ ID NO: 1992555 - protein, 4 aa, Staphylococcus
TVTQ

SEQ ID NO: 1992556 - protein, 10 aa, Staphylococcus
TVTQASGESA

SEQ ID NO: 1992557 - protein, 8 aa, Staphylococcus
TVTREASD

SEQ ID NO: 1992558 - protein, 10 aa, Staphylococcus
TVTRENTQLK

SEQ ID NO: 1992559 - protein, 6 aa, Staphylococcus
TVTSDL

SEQ ID NO: 1992560 - protein, 11 aa, Staphylococcus
TVTTDDGKALR

SEQ ID NO: 1992561 - protein, 7 aa, Staphylococcus
TVTTDID

SEQ ID NO: 1992562 - protein, 11 aa, Staphylococcus
TVTTEDGSEIR

SEQ ID NO: 1992563 - protein, 5 aa, Staphylococcus
TVYDG

SEQ ID NO: 1992564 - protein, 10 aa, Staphylococcus
TVYSQKDNTL

SEQ ID NO: 1992565 - protein, 4 aa, Staphylococcus
TWAL

SEQ ID NO: 1992566 - protein, 8 aa, Staphylococcus
TWDDSQTI

SEQ ID NO: 1992567 - protein, 10 aa, Staphylococcus
TWDGSAKDQI

SEQ ID NO: 1992568 - protein, 10 aa, Staphylococcus
TWDGSAKEDI

SEQ ID NO: 1992569 - protein, 5 aa, Staphylococcus
TWDNI

SEQ ID NO: 1992570 - protein, 7 aa, Staphylococcus
TWKQEDN

SEQ ID NO: 1992571 - protein, 6 aa, Staphylococcus
TWQGAT

SEQ ID NO: 1992572 - protein, 6 aa, Staphylococcus
TWSGNK

SEQ ID NO: 1992573 - protein, 8 aa, Staphylococcus
TYADAQGN

SEQ ID NO: 1992574 - protein, 6 aa, Staphylococcus
TYANKK

SEQ ID NO: 1992575 - protein, 9 aa, Staphylococcus
TYANSATKI

SEQ ID NO: 1992576 - protein, 9 aa, Staphylococcus
TYANSSTKI

SEQ ID NO: 1992577 - protein, 10 aa, Staphylococcus
TYARNQQEGA

SEQ ID NO: 1992578 - protein, 10 aa, Staphylococcus
TYASRQHKSL

SEQ ID NO: 1992579 - protein, 6 aa, Staphylococcus
TYDERY

SEQ ID NO: 1992580 - protein, 7 aa, Staphylococcus
TYDGKTY

SEQ ID NO: 1992581 - protein, 22 aa, Staphylococcus
TYDKEKEAENVYGTTEEAHPGV

SEQ ID NO: 1992582 - protein, 6 aa, Staphylococcus
TYDNET

SEQ ID NO: 1992583 - protein, 9 aa, Staphylococcus
TYDNLPTKA

SEQ ID NO: 1992584 - protein, 4 aa, Staphylococcus
TYDQ

SEQ ID NO: 1992585 - protein, 8 aa, Staphylococcus
TYDQTVSD

SEQ ID NO: 1992586 - protein, 5 aa, Staphylococcus
TYDTG

SEQ ID NO: 1992587 - protein, 12 aa, Staphylococcus
TYEAKGEEKTIE

SEQ ID NO: 1992588 - protein, 12 aa, Staphylococcus
TYEAKGEEQTIE

SEQ ID NO: 1992589 - protein, 9 aa, Staphylococcus
TYEDLETGI

SEQ ID NO: 1992590 - protein, 11 aa, Staphylococcus
TYEGGTHEEGF

SEQ ID NO: 1992591 - protein, 19 aa, Staphylococcus
TYEKQTKNEYDPQLEKDRE

SEQ ID NO: 1992592 - protein, 4 aa, Staphylococcus
TYEM

SEQ ID NO: 1992593 - protein, 7 aa, Staphylococcus
TYENEAP

SEQ ID NO: 1992594 - protein, 15 aa, Staphylococcus
TYEREDEKAMKLLET

SEQ ID NO: 1992595 - protein, 17 aa, Staphylococcus
TYERKDKDGIFHTQWTE

SEQ ID NO: 1992596 - protein, 17 aa, Staphylococcus
TYERKDKEGIFHTQWVE

SEQ ID NO: 1992597 - protein, 17 aa, Staphylococcus
TYERKDKEGVFHTQWVE

SEQ ID NO: 1992598 - protein, 13 aa, Staphylococcus
TYESENESVVTDK

SEQ ID NO: 1992599 - protein, 13 aa, Staphylococcus
TYEYKEKPYEKDY

SEQ ID NO: 1992600 - protein, 6 aa, Staphylococcus
TYFKQG

SEQ ID NO: 1992601 - protein, 10 aa, Staphylococcus
TYFPQDSGNV

SEQ ID NO: 1992602 - protein, 16 aa, Staphylococcus
TYGAAAKTSGAGGGDC

SEQ ID NO: 1992603 - protein, 9 aa, Staphylococcus
TYGAASKGI

SEQ ID NO: 1992604 - protein, 21 aa, Staphylococcus
TYGAKRAADDYDSKDEAVKRA

SEQ ID NO: 1992605 - protein, 11 aa, Staphylococcus
TYGNKQTEQEV

SEQ ID NO: 1992606 - protein, 7 aa, Staphylococcus
TYGNTPK

SEQ ID NO: 1992607 - protein, 4 aa, Staphylococcus
TYGS

SEQ ID NO: 1992608 - protein, 6 aa, Staphylococcus
TYGSLT

SEQ ID NO: 1992609 - protein, 9 aa, Staphylococcus
TYGTDDEPG

SEQ ID NO: 1992610 - protein, 8 aa, Staphylococcus
TYGTDEKH

SEQ ID NO: 1992611 - protein, 8 aa, Staphylococcus
TYGTKQTI

SEQ ID NO: 1992612 - protein, 9 aa, Staphylococcus
TYGTNDQPG

SEQ ID NO: 1992613 - protein, 9 aa, Staphylococcus
TYGTNEQPG

SEQ ID NO: 1992614 - protein, 4 aa, Staphylococcus
TYGY

SEQ ID NO: 1992615 - protein, 12 aa, Staphylococcus
TYHTGDKAKEEN

SEQ ID NO: 1992616 - protein, 6 aa, Staphylococcus
TYIPNQ

SEQ ID NO: 1992617 - protein, 7 aa, Staphylococcus
TYISGNE

SEQ ID NO: 1992618 - protein, 4 aa, Staphylococcus
TYKD

SEQ ID NO: 1992619 - protein, 15 aa, Staphylococcus
TYKEEDEKATQIISA

SEQ ID NO: 1992620 - protein, 7 aa, Staphylococcus
TYKKASK

SEQ ID NO: 1992621 - protein, 12 aa, Staphylococcus
TYKNGTVDSPYR

SEQ ID NO: 1992622 - protein, 9 aa, Staphylococcus
TYKQDESTL

SEQ ID NO: 1992623 - protein, 22 aa, Staphylococcus
TYLEDGKAVPEPFPLSSGTQAT

SEQ ID NO: 1992624 - protein, 4 aa, Staphylococcus
TYLP

SEQ ID NO: 1992625 - protein, 4 aa, Staphylococcus
TYME

SEQ ID NO: 1992626 - protein, 4 aa, Staphylococcus
TYMK

SEQ ID NO: 1992627 - protein, 4 aa, Staphylococcus
TYMN

SEQ ID NO: 1992628 - protein, 12 aa, Staphylococcus
TYNADEPEYEPA

SEQ ID NO: 1992629 - protein, 6 aa, Staphylococcus
TYNENE

SEQ ID NO: 1992630 - protein, 14 aa, Staphylococcus
TYNKENNSVTVDAT

SEQ ID NO: 1992631 - protein, 6 aa, Staphylococcus
TYNMTD

SEQ ID NO: 1992632 - protein, 13 aa, Staphylococcus
TYNPANVNAPEVK

SEQ ID NO: 1992633 - protein, 7 aa, Staphylococcus
TYNPKKV

SEQ ID NO: 1992634 - protein, 9 aa, Staphylococcus
TYNPSKGQR

SEQ ID NO: 1992635 - protein, 4 aa, Staphylococcus
TYNQ

SEQ ID NO: 1992636 - protein, 12 aa, Staphylococcus
TYNRNATETTDE

SEQ ID NO: 1992637 - protein, 4 aa, Staphylococcus
TYPD

SEQ ID NO: 1992638 - protein, 5 aa, Staphylococcus
TYPET

SEQ ID NO: 1992639 - protein, 11 aa, Staphylococcus
TYPGAPGSGGI

SEQ ID NO: 1992640 - protein, 4 aa, Staphylococcus
TYPN

SEQ ID NO: 1992641 - protein, 5 aa, Staphylococcus
TYPNA

SEQ ID NO: 1992642 - protein, 5 aa, Staphylococcus
TYPQG

SEQ ID NO: 1992643 - protein, 9 aa, Staphylococcus
TYPRTDSNF

SEQ ID NO: 1992644 - protein, 10 aa, Staphylococcus
TYPRTDSNYL

SEQ ID NO: 1992645 - protein, 10 aa, Staphylococcus
TYPTTQIEAS

SEQ ID NO: 1992646 - protein, 6 aa, Staphylococcus
TYQDLS

SEQ ID NO: 1992647 - protein, 5 aa, Staphylococcus
TYQDN

SEQ ID NO: 1992648 - protein, 9 aa, Staphylococcus
TYQKESDSE

SEQ ID NO: 1992649 - protein, 6 aa, Staphylococcus
TYQNGE

SEQ ID NO: 1992650 - protein, 6 aa, Staphylococcus
TYQNKT

SEQ ID NO: 1992651 - protein, 15 aa, Staphylococcus
TYQNSDLTQTIENDR

SEQ ID NO: 1992652 - protein, 9 aa, Staphylococcus
TYQNSTTKI

SEQ ID NO: 1992653 - protein, 9 aa, Staphylococcus
TYQQASDWK

SEQ ID NO: 1992654 - protein, 9 aa, Staphylococcus
TYQQEDDSE

SEQ ID NO: 1992655 - protein, 5 aa, Staphylococcus
TYQQG

SEQ ID NO: 1992656 - protein, 4 aa, Staphylococcus
TYQR

SEQ ID NO: 1992657 - protein, 7 aa, Staphylococcus
TYQSEGQ

SEQ ID NO: 1992658 - protein, 5 aa, Staphylococcus
TYRGY

SEQ ID NO: 1992659 - protein, 8 aa, Staphylococcus
TYRPGQKE

SEQ ID NO: 1992660 - protein, 6 aa, Staphylococcus
TYRSEV

SEQ ID NO: 1992661 - protein, 18 aa, Staphylococcus
TYRSSGAGGQHVNTTDSA

SEQ ID NO: 1992662 - protein, 5 aa, Staphylococcus
TYRYD

SEQ ID NO: 1992663 - protein, 5 aa, Staphylococcus
TYSGY

SEQ ID NO: 1992664 - protein, 10 aa, Staphylococcus
TYSKDYPELA

SEQ ID NO: 1992665 - protein, 10 aa, Staphylococcus
TYSKSKIKQR

SEQ ID NO: 1992666 - protein, 12 aa, Staphylococcus
TYSKSNTNDRYT

SEQ ID NO: 1992667 - protein, 11 aa, Staphylococcus
TYSKSSTKNRY

SEQ ID NO: 1992668 - protein, 10 aa, Staphylococcus
TYSKTSDNHR

SEQ ID NO: 1992669 - protein, 8 aa, Staphylococcus
TYSNAEDA

SEQ ID NO: 1992670 - protein, 9 aa, Staphylococcus
TYSNSATKI

SEQ ID NO: 1992671 - protein, 9 aa, Staphylococcus
TYSNSTTKV

SEQ ID NO: 1992672 - protein, 5 aa, Staphylococcus
TYSPE

SEQ ID NO: 1992673 - protein, 5 aa, Staphylococcus
TYTAS

SEQ ID NO: 1992674 - protein, 10 aa, Staphylococcus
TYTDASDEQA

SEQ ID NO: 1992675 - protein, 13 aa, Staphylococcus
TYTEDNEQLDGRL

SEQ ID NO: 1992676 - protein, 5 aa, Staphylococcus
TYTEG

SEQ ID NO: 1992677 - protein, 6 aa, Staphylococcus
TYTEQY

SEQ ID NO: 1992678 - protein, 7 aa, Staphylococcus
TYTESGK

SEQ ID NO: 1992679 - protein, 9 aa, Staphylococcus
TYTETGGEA

SEQ ID NO: 1992680 - protein, 10 aa, Staphylococcus
TYTETGGNAD

SEQ ID NO: 1992681 - protein, 9 aa, Staphylococcus
TYTETGQSK

SEQ ID NO: 1992682 - protein, 23 aa, Staphylococcus
TYTGIQSGKLEDKHGWRVIVPEY

SEQ ID NO: 1992683 - protein, 22 aa, Staphylococcus
TYTGIQSGKLEDKHGWRVVVPK

SEQ ID NO: 1992684 - protein, 23 aa, Staphylococcus
TYTGIQSGKLEDTHGWRVVVPEY

SEQ ID NO: 1992685 - protein, 9 aa, Staphylococcus
TYTKDSNEE

SEQ ID NO: 1992686 - protein, 9 aa, Staphylococcus
TYTKENSDE

SEQ ID NO: 1992687 - protein, 8 aa, Staphylococcus
TYTKESAN

SEQ ID NO: 1992688 - protein, 10 aa, Staphylococcus
TYTKTGGNAD

SEQ ID NO: 1992689 - protein, 9 aa, Staphylococcus
TYTQTGGNA

SEQ ID NO: 1992690 - protein, 5 aa, Staphylococcus
TYTSM

SEQ ID NO: 1992691 - protein, 23 aa, Staphylococcus
TYTTDTNENSGVGKAIMKLIDQK

SEQ ID NO: 1992692 - protein, 6 aa, Staphylococcus
TYVPEK

SEQ ID NO: 1992693 - protein, 12 aa, Staphylococcus
TYVPSDNKNLAY

SEQ ID NO: 1992694 - protein, 4 aa, Staphylococcus
TYVT

SEQ ID NO: 1992695 - protein, 11 aa, Staphylococcus
TYWPQNQGDYK

SEQ ID NO: 1992696 - protein, 4 aa, Staphylococcus
TYYE

SEQ ID NO: 1992697 - protein, 6 aa, Staphylococcus
TYYETN

SEQ ID NO: 1992698 - protein, 6 aa, Staphylococcus
VAAASK

SEQ ID NO: 1992699 - protein, 8 aa, Staphylococcus
VAADNDLK

SEQ ID NO: 1992700 - protein, 5 aa, Staphylococcus
VAAGD

SEQ ID NO: 1992701 - protein, 33 aa, Staphylococcus
VAAGTATAFNDDLATRDDIEKIKDQVTMTVLDG

SEQ ID NO: 1992702 - protein, 13 aa, Staphylococcus
VAASSNSKEEKME

SEQ ID NO: 1992703 - protein, 9 aa, Staphylococcus
VAATTPEKV

SEQ ID NO: 1992704 - protein, 8 aa, Staphylococcus
VADDEVRA

SEQ ID NO: 1992705 - protein, 10 aa, Staphylococcus
VADDLSKKLD

SEQ ID NO: 1992706 - protein, 8 aa, Staphylococcus
VADDSSID

SEQ ID NO: 1992707 - protein, 6 aa, Staphylococcus
VADGST

SEQ ID NO: 1992708 - protein, 11 aa, Staphylococcus
VADGTSGEAAD

SEQ ID NO: 1992709 - protein, 12 aa, Staphylococcus
VADKKKSVSDRD

SEQ ID NO: 1992710 - protein, 12 aa, Staphylococcus
VADNSDQDGTVG

SEQ ID NO: 1992711 - protein, 5 aa, Staphylococcus
VADQS

SEQ ID NO: 1992712 - protein, 9 aa, Staphylococcus
VADSASGTA

SEQ ID NO: 1992713 - protein, 9 aa, Staphylococcus
VADSQTSES

SEQ ID NO: 1992714 - protein, 10 aa, Staphylococcus
VADSTNETVT

SEQ ID NO: 1992715 - protein, 27 aa, Staphylococcus
VADVSSQDVADATRIQYGGSVKPNNVK

SEQ ID NO: 1992716 - protein, 5 aa, Staphylococcus
VAEAG

SEQ ID NO: 1992717 - protein, 5 aa, Staphylococcus
VAEDV

SEQ ID NO: 1992718 - protein, 8 aa, Staphylococcus
VAEEDTHR

SEQ ID NO: 1992719 - protein, 6 aa, Staphylococcus
VAEETL

SEQ ID NO: 1992720 - protein, 4 aa, Staphylococcus
VAEG

SEQ ID NO: 1992721 - protein, 7 aa, Staphylococcus
VAEGADV

SEQ ID NO: 1992722 - protein, 7 aa, Staphylococcus
VAEGDEV

SEQ ID NO: 1992723 - protein, 7 aa, Staphylococcus
VAEGDQV

SEQ ID NO: 1992724 - protein, 7 aa, Staphylococcus
VAEGEHD

SEQ ID NO: 1992725 - protein, 7 aa, Staphylococcus
VAEGETF

SEQ ID NO: 1992726 - protein, 13 aa, Staphylococcus
VAEGGGLSRTDEK

SEQ ID NO: 1992727 - protein, 5 aa, Staphylococcus
VAEKA

SEQ ID NO: 1992728 - protein, 8 aa, Staphylococcus
VAEKEGLE

SEQ ID NO: 1992729 - protein, 5 aa, Staphylococcus
VAENG

SEQ ID NO: 1992730 - protein, 9 aa, Staphylococcus
VAENNLGDS

SEQ ID NO: 1992731 - protein, 7 aa, Staphylococcus
VAEPAGA

SEQ ID NO: 1992732 - protein, 12 aa, Staphylococcus
VAEQNDKKPDHK

SEQ ID NO: 1992733 - protein, 12 aa, Staphylococcus
VAEQNDKKPTNK

SEQ ID NO: 1992734 - protein, 7 aa, Staphylococcus
VAEQTNL

SEQ ID NO: 1992735 - protein, 16 aa, Staphylococcus
VAEQTTENAERLFNLK

SEQ ID NO: 1992736 - protein, 4 aa, Staphylococcus
VAER

SEQ ID NO: 1992737 - protein, 11 aa, Staphylococcus
VAERLGKSRPY

SEQ ID NO: 1992738 - protein, 8 aa, Staphylococcus
VAESDTHR

SEQ ID NO: 1992739 - protein, 10 aa, Staphylococcus
VAESRPSPGY

SEQ ID NO: 1992740 - protein, 12 aa, Staphylococcus
VAESSKPEYMKS

SEQ ID NO: 1992741 - protein, 5 aa, Staphylococcus
VAETY

SEQ ID NO: 1992742 - protein, 22 aa, Staphylococcus
VAFETNQTKSNSHYSEETNGPK

SEQ ID NO: 1992743 - protein, 11 aa, Staphylococcus
VAGDAEDDVSQ

SEQ ID NO: 1992744 - protein, 14 aa, Staphylococcus
VAGDDQAFNNPTKP

SEQ ID NO: 1992745 - protein, 10 aa, Staphylococcus
VAGEAGDDVS

SEQ ID NO: 1992746 - protein, 11 aa, Staphylococcus
VAGEAGDDVSE

SEQ ID NO: 1992747 - protein, 14 aa, Staphylococcus
VAGERGAADAERDI

SEQ ID NO: 1992748 - protein, 12 aa, Staphylococcus
VAGERGAADLER

SEQ ID NO: 1992749 - protein, 7 aa, Staphylococcus
VAGFNKS

SEQ ID NO: 1992750 - protein, 14 aa, Staphylococcus
VAGFSNSEESQMGV

SEQ ID NO: 1992751 - protein, 24 aa, Staphylococcus
VAGKTGTAQVADSDNGGYVNGENP

SEQ ID NO: 1992752 - protein, 8 aa, Staphylococcus
VAGNNDNQ

SEQ ID NO: 1992753 - protein, 14 aa, Staphylococcus
VAGNPARFIREVPL

SEQ ID NO: 1992754 - protein, 14 aa, Staphylococcus
VAGNQSVEKNTKNA

SEQ ID NO: 1992755 - protein, 6 aa, Staphylococcus
VAGNYA

SEQ ID NO: 1992756 - protein, 9 aa, Staphylococcus
VAGPEDENE

SEQ ID NO: 1992757 - protein, 9 aa, Staphylococcus
VAGQTTSNH

SEQ ID NO: 1992758 - protein, 14 aa, Staphylococcus
VAGSGKNGRITKED

SEQ ID NO: 1992759 - protein, 16 aa, Staphylococcus
VAGSITDQIENMEYQG

SEQ ID NO: 1992760 - protein, 16 aa, Staphylococcus
VAGSITEDMESTEYDY

SEQ ID NO: 1992761 - protein, 12 aa, Staphylococcus
VAGSYRRYKEMS

SEQ ID NO: 1992762 - protein, 6 aa, Staphylococcus
VAGTHD

SEQ ID NO: 1992763 - protein, 17 aa, Staphylococcus
VAGTTRDAIDTEYTYDN

SEQ ID NO: 1992764 - protein, 10 aa, Staphylococcus
VAHETREHAE

SEQ ID NO: 1992765 - protein, 4 aa, Staphylococcus
VAHQ

SEQ ID NO: 1992766 - protein, 5 aa, Staphylococcus
VAHQG

SEQ ID NO: 1992767 - protein, 7 aa, Staphylococcus
VAHSKEG

SEQ ID NO: 1992768 - protein, 7 aa, Staphylococcus
VAHSKNG

SEQ ID NO: 1992769 - protein, 4 aa, Staphylococcus
VAIQ

SEQ ID NO: 1992770 - protein, 6 aa, Staphylococcus
VAKAES

SEQ ID NO: 1992771 - protein, 19 aa, Staphylococcus
VAKANEKDVDKAVQSAHEA

SEQ ID NO: 1992772 - protein, 19 aa, Staphylococcus
VAKAQASDFAKTYAEGDSF

SEQ ID NO: 1992773 - protein, 9 aa, Staphylococcus
VAKASAGAI

SEQ ID NO: 1992774 - protein, 12 aa, Staphylococcus
VAKDQLKEENLE

SEQ ID NO: 1992775 - protein, 5 aa, Staphylococcus
VAKED

SEQ ID NO: 1992776 - protein, 22 aa, Staphylococcus
VAKEDAEKLKEQLEEVGATVEL

SEQ ID NO: 1992777 - protein, 5 aa, Staphylococcus
VAKEE

SEQ ID NO: 1992778 - protein, 8 aa, Staphylococcus
VAKEEKAY

SEQ ID NO: 1992779 - protein, 14 aa, Staphylococcus
VAKEQKQPKDLTKA

SEQ ID NO: 1992780 - protein, 17 aa, Staphylococcus
VAKGNEEDVNKAVEAAD

SEQ ID NO: 1992781 - protein, 15 aa, Staphylococcus
VAKGNEKDVEKAVQA

SEQ ID NO: 1992782 - protein, 16 aa, Staphylococcus
VAKGNSNDVEKAVEAA

SEQ ID NO: 1992783 - protein, 8 aa, Staphylococcus
VAKMSDKD

SEQ ID NO: 1992784 - protein, 9 aa, Staphylococcus
VAKNDTKLD

SEQ ID NO: 1992785 - protein, 11 aa, Staphylococcus
VAKPDVTEAEA

SEQ ID NO: 1992786 - protein, 9 aa, Staphylococcus
VAKRGGNVR

SEQ ID NO: 1992787 - protein, 9 aa, Staphylococcus
VAKRGMDSK

SEQ ID NO: 1992788 - protein, 6 aa, Staphylococcus
VAKRND

SEQ ID NO: 1992789 - protein, 8 aa, Staphylococcus
VAKRNDAQ

SEQ ID NO: 1992790 - protein, 8 aa, Staphylococcus
VAKRNEAK

SEQ ID NO: 1992791 - protein, 9 aa, Staphylococcus
VAKSISQSL

SEQ ID NO: 1992792 - protein, 8 aa, Staphylococcus
VAKSNDIN

SEQ ID NO: 1992793 - protein, 19 aa, Staphylococcus
VAKTTNMSGSELNKMGNEI

SEQ ID NO: 1992794 - protein, 9 aa, Staphylococcus
VALEESNGL

SEQ ID NO: 1992795 - protein, 13 aa, Staphylococcus
VALTNSSTPPRDA

SEQ ID NO: 1992796 - protein, 13 aa, Staphylococcus
VALTSRADTPEEI

SEQ ID NO: 1992797 - protein, 7 aa, Staphylococcus
VANASQI

SEQ ID NO: 1992798 - protein, 18 aa, Staphylococcus
VANGDAIATGDLLIEIEK

SEQ ID NO: 1992799 - protein, 16 aa, Staphylococcus
VANGNEEDVNKAVEAA

SEQ ID NO: 1992800 - protein, 5 aa, Staphylococcus
VANKY

SEQ ID NO: 1992801 - protein, 7 aa, Staphylococcus
VANPDEV

SEQ ID NO: 1992802 - protein, 12 aa, Staphylococcus
VANPDVTEDDAI

SEQ ID NO: 1992803 - protein, 7 aa, Staphylococcus
VANPGDT

SEQ ID NO: 1992804 - protein, 12 aa, Staphylococcus
VANPNVTEEDAI

SEQ ID NO: 1992805 - protein, 6 aa, Staphylococcus
VANRDD

SEQ ID NO: 1992806 - protein, 7 aa, Staphylococcus
VANRGQI

SEQ ID NO: 1992807 - protein, 4 aa, Staphylococcus
VAPA

SEQ ID NO: 1992808 - protein, 6 aa, Staphylococcus
VAPDDE

SEQ ID NO: 1992809 - protein, 6 aa, Staphylococcus
VAPDEE

SEQ ID NO: 1992810 - protein, 9 aa, Staphylococcus
VAPDGTDEP

SEQ ID NO: 1992811 - protein, 10 aa, Staphylococcus
VAPDGTDQPT

SEQ ID NO: 1992812 - protein, 4 aa, Staphylococcus
VAPE

SEQ ID NO: 1992813 - protein, 6 aa, Staphylococcus
VAPEKE

SEQ ID NO: 1992814 - protein, 7 aa, Staphylococcus
VAPKPCN

SEQ ID NO: 1992815 - protein, 6 aa, Staphylococcus
VAPKTV

SEQ ID NO: 1992816 - protein, 15 aa, Staphylococcus
VAPPNQGLGDLWGTI

SEQ ID NO: 1992817 - protein, 5 aa, Staphylococcus
VAPRR

SEQ ID NO: 1992818 - protein, 10 aa, Staphylococcus
VAPSNDDQGV

SEQ ID NO: 1992819 - protein, 19 aa, Staphylococcus
VAPSNDEQGVLQIIEQEVL

SEQ ID NO: 1992820 - protein, 19 aa, Staphylococcus
VAPSNDEQGVLQVIDDVVL

SEQ ID NO: 1992821 - protein, 9 aa, Staphylococcus
VAPTNEFEK

SEQ ID NO: 1992822 - protein, 14 aa, Staphylococcus
VAPVASSEEEVEVT

SEQ ID NO: 1992823 - protein, 6 aa, Staphylococcus
VAPYKY

SEQ ID NO: 1992824 - protein, 6 aa, Staphylococcus
VAQATG

SEQ ID NO: 1992825 - protein, 8 aa, Staphylococcus
VAQDTHPD

SEQ ID NO: 1992826 - protein, 9 aa, Staphylococcus
VAQETSPDE

SEQ ID NO: 1992827 - protein, 9 aa, Staphylococcus
VAQETSPNE

SEQ ID NO: 1992828 - protein, 7 aa, Staphylococcus
VAQEVKA

SEQ ID NO: 1992829 - protein, 7 aa, Staphylococcus
VAQEVSS

SEQ ID NO: 1992830 - protein, 13 aa, Staphylococcus
VAQGGGLSRTDEK

SEQ ID NO: 1992831 - protein, 5 aa, Staphylococcus
VAQGQ

SEQ ID NO: 1992832 - protein, 7 aa, Staphylococcus
VAQNNNL

SEQ ID NO: 1992833 - protein, 8 aa, Staphylococcus
VAQNQTQR

SEQ ID NO: 1992834 - protein, 38 aa, Staphylococcus
VAQQPAPSIAQPQVAQSAPQVSDNAQAQEEVADNYETI

SEQ ID NO: 1992835 - protein, 39 aa, Staphylococcus
VAQQPAQQISQPQAAPQPQSTTQSGEETQESASDNYETI

SEQ ID NO: 1992836 - protein, 5 aa, Staphylococcus
VAQSE

SEQ ID NO: 1992837 - protein, 22 aa, Staphylococcus
VAQSKQKKAPDNIDVESKTDAQ

SEQ ID NO: 1992838 - protein, 16 aa, Staphylococcus
VARAGKEDVDKAVQAA

SEQ ID NO: 1992839 - protein, 9 aa, Staphylococcus
VARDHEGKV

SEQ ID NO: 1992840 - protein, 18 aa, Staphylococcus
VAREQKKAEEKAEEAAKL

SEQ ID NO: 1992841 - protein, 6 aa, Staphylococcus
VARKGF

SEQ ID NO: 1992842 - protein, 7 aa, Staphylococcus
VARKNKD

SEQ ID NO: 1992843 - protein, 8 aa, Staphylococcus
VARKNKDV

SEQ ID NO: 1992844 - protein, 7 aa, Staphylococcus
VARKNQD

SEQ ID NO: 1992845 - protein, 12 aa, Staphylococcus
VARPDVTEEEAI

SEQ ID NO: 1992846 - protein, 10 aa, Staphylococcus
VARTEAKKRA

SEQ ID NO: 1992847 - protein, 12 aa, Staphylococcus
VASAESKENTLE

SEQ ID NO: 1992848 - protein, 9 aa, Staphylococcus
VASDNAHQL

SEQ ID NO: 1992849 - protein, 8 aa, Staphylococcus
VASEDEAK

SEQ ID NO: 1992850 - protein, 32 aa, Staphylococcus
VASEDKSPKLNKLGGTEWKKTKAKVQQSVEDM

SEQ ID NO: 1992851 - protein, 12 aa, Staphylococcus
VASEDKTPRLNK

SEQ ID NO: 1992852 - protein, 5 aa, Staphylococcus
VASEY

SEQ ID NO: 1992853 - protein, 14 aa, Staphylococcus
VASGTATAFSDDLA

SEQ ID NO: 1992854 - protein, 10 aa, Staphylococcus
VASGTPKQVM

SEQ ID NO: 1992855 - protein, 4 aa, Staphylococcus
VASK

SEQ ID NO: 1992856 - protein, 12 aa, Staphylococcus
VASKNITKETHT

SEQ ID NO: 1992857 - protein, 9 aa, Staphylococcus
VASNHGLRT

SEQ ID NO: 1992858 - protein, 7 aa, Staphylococcus
VASNKGL

SEQ ID NO: 1992859 - protein, 9 aa, Staphylococcus
VASNKGLRE

SEQ ID NO: 1992860 - protein, 10 aa, Staphylococcus
VASNKGLRQE

SEQ ID NO: 1992861 - protein, 11 aa, Staphylococcus
VASNKGLRTSL

SEQ ID NO: 1992862 - protein, 18 aa, Staphylococcus
VASNNQGGGQDVSRQGVQ

SEQ ID NO: 1992863 - protein, 18 aa, Staphylococcus
VASNRGLRESISKQCENN

SEQ ID NO: 1992864 - protein, 11 aa, Staphylococcus
VASPGIGQDAF

SEQ ID NO: 1992865 - protein, 8 aa, Staphylococcus
VASPQDYR

SEQ ID NO: 1992866 - protein, 15 aa, Staphylococcus
VASREAVEKGSEGLQ

SEQ ID NO: 1992867 - protein, 6 aa, Staphylococcus
VASSAP

SEQ ID NO: 1992868 - protein, 15 aa, Staphylococcus
VASSNKGVLDEKNTI

SEQ ID NO: 1992869 - protein, 6 aa, Staphylococcus
VASTKE

SEQ ID NO: 1992870 - protein, 14 aa, Staphylococcus
VATAEATKALYEAG

SEQ ID NO: 1992871 - protein, 9 aa, Staphylococcus
VATAEATKD

SEQ ID NO: 1992872 - protein, 14 aa, Staphylococcus
VATAEGTKALYEAG

SEQ ID NO: 1992873 - protein, 11 aa, Staphylococcus
VATAEQSEPHA

SEQ ID NO: 1992874 - protein, 6 aa, Staphylococcus
VATEDI

SEQ ID NO: 1992875 - protein, 8 aa, Staphylococcus
VATGEATK

SEQ ID NO: 1992876 - protein, 29 aa, Staphylococcus
VATGQGKTKKESEQKAAESAYSKLKSNNN

SEQ ID NO: 1992877 - protein, 6 aa, Staphylococcus
VATHED

SEQ ID NO: 1992878 - protein, 8 aa, Staphylococcus
VATHEDNY

SEQ ID NO: 1992879 - protein, 11 aa, Staphylococcus
VATKAGVPTVE

SEQ ID NO: 1992880 - protein, 8 aa, Staphylococcus
VATNEGNY

SEQ ID NO: 1992881 - protein, 18 aa, Staphylococcus
VATNNANSGQDVSRQGVQ

SEQ ID NO: 1992882 - protein, 18 aa, Staphylococcus
VATNNQSSGQDVSRQGVQ

SEQ ID NO: 1992883 - protein, 18 aa, Staphylococcus
VATNNSNSGQDVSRQGVQ

SEQ ID NO: 1992884 - protein, 4 aa, Staphylococcus
VATP

SEQ ID NO: 1992885 - protein, 5 aa, Staphylococcus
VATPN

SEQ ID NO: 1992886 - protein, 4 aa, Staphylococcus
VATS

SEQ ID NO: 1992887 - protein, 7 aa, Staphylococcus
VATSEYD

SEQ ID NO: 1992888 - protein, 6 aa, Staphylococcus
VATTKT

SEQ ID NO: 1992889 - protein, 7 aa, Staphylococcus
VAVGDTK

SEQ ID NO: 1992890 - protein, 7 aa, Staphylococcus
VAVGETK

SEQ ID NO: 1992891 - protein, 6 aa, Staphylococcus
VAVGQT

SEQ ID NO: 1992892 - protein, 7 aa, Staphylococcus
VAVGSTK

SEQ ID NO: 1992893 - protein, 20 aa, Staphylococcus
VAYAEQSELPDVESLYKDVF

SEQ ID NO: 1992894 - protein, 16 aa, Staphylococcus
VAYESSPATSQMEEEV

SEQ ID NO: 1992895 - protein, 9 aa, Staphylococcus
VAYNGREAL

SEQ ID NO: 1992896 - protein, 8 aa, Staphylococcus
VAYSNKKM

SEQ ID NO: 1992897 - protein, 9 aa, Staphylococcus
VDAAKGFGI

SEQ ID NO: 1992898 - protein, 10 aa, Staphylococcus
VDAAKGFGIE

SEQ ID NO: 1992899 - protein, 6 aa, Staphylococcus
VDAATK

SEQ ID NO: 1992900 - protein, 8 aa, Staphylococcus
VDAETHQL

SEQ ID NO: 1992901 - protein, 5 aa, Staphylococcus
VDAGA

SEQ ID NO: 1992902 - protein, 8 aa, Staphylococcus
VDAGADGI

SEQ ID NO: 1992903 - protein, 13 aa, Staphylococcus
VDAHDSTSAPVDD

SEQ ID NO: 1992904 - protein, 12 aa, Staphylococcus
VDANNKNKEDMS

SEQ ID NO: 1992905 - protein, 8 aa, Staphylococcus
VDASDEEI

SEQ ID NO: 1992906 - protein, 14 aa, Staphylococcus
VDASGKYAKTSYET

SEQ ID NO: 1992907 - protein, 7 aa, Staphylococcus
VDASHYR

SEQ ID NO: 1992908 - protein, 6 aa, Staphylococcus
VDASNK

SEQ ID NO: 1992909 - protein, 5 aa, Staphylococcus
VDASY

SEQ ID NO: 1992910 - protein, 4 aa, Staphylococcus
VDDD

SEQ ID NO: 1992911 - protein, 7 aa, Staphylococcus
VDDDTIT

SEQ ID NO: 1992912 - protein, 5 aa, Staphylococcus
VDDDV

SEQ ID NO: 1992913 - protein, 11 aa, Staphylococcus
VDDEDATERKV

SEQ ID NO: 1992914 - protein, 8 aa, Staphylococcus
VDDGKDAV

SEQ ID NO: 1992915 - protein, 10 aa, Staphylococcus
VDDGKGDKIA

SEQ ID NO: 1992916 - protein, 23 aa, Staphylococcus
VDDGKGDKTALNYKDAERQESYT

SEQ ID NO: 1992917 - protein, 6 aa, Staphylococcus
VDDHQK

SEQ ID NO: 1992918 - protein, 15 aa, Staphylococcus
VDDITTDSRTAKEGS

SEQ ID NO: 1992919 - protein, 9 aa, Staphylococcus
VDDKSSEQF

SEQ ID NO: 1992920 - protein, 12 aa, Staphylococcus
VDDKTEEKVEDV

SEQ ID NO: 1992921 - protein, 5 aa, Staphylococcus
VDDLG

SEQ ID NO: 1992922 - protein, 7 aa, Staphylococcus
VDDMSAT

SEQ ID NO: 1992923 - protein, 5 aa, Staphylococcus
VDDNT

SEQ ID NO: 1992924 - protein, 5 aa, Staphylococcus
VDDQL

SEQ ID NO: 1992925 - protein, 15 aa, Staphylococcus
VDDRAMDSNDLERER

SEQ ID NO: 1992926 - protein, 10 aa, Staphylococcus
VDDSKKLTDA

SEQ ID NO: 1992927 - protein, 10 aa, Staphylococcus
VDDSKKLTDT

SEQ ID NO: 1992928 - protein, 11 aa, Staphylococcus
VDDSKKLTDTK

SEQ ID NO: 1992929 - protein, 4 aa, Staphylococcus
VDEA

SEQ ID NO: 1992930 - protein, 14 aa, Staphylococcus
VDEAAYDALPDPDE

SEQ ID NO: 1992931 - protein, 10 aa, Staphylococcus
VDEANTSEDY

SEQ ID NO: 1992932 - protein, 10 aa, Staphylococcus
VDEDGSDSAI

SEQ ID NO: 1992933 - protein, 7 aa, Staphylococcus
VDEDKQV

SEQ ID NO: 1992934 - protein, 4 aa, Staphylococcus
VDEE

SEQ ID NO: 1992935 - protein, 11 aa, Staphylococcus
VDEEELRNGRK

SEQ ID NO: 1992936 - protein, 10 aa, Staphylococcus
VDEEELRSGR

SEQ ID NO: 1992937 - protein, 10 aa, Staphylococcus
VDEENAKAEL

SEQ ID NO: 1992938 - protein, 8 aa, Staphylococcus
VDEENDSG

SEQ ID NO: 1992939 - protein, 9 aa, Staphylococcus
VDEENESGA

SEQ ID NO: 1992940 - protein, 10 aa, Staphylococcus
VDEENESGAY

SEQ ID NO: 1992941 - protein, 8 aa, Staphylococcus
VDEEPEVD

SEQ ID NO: 1992942 - protein, 7 aa, Staphylococcus
VDEEPLD

SEQ ID NO: 1992943 - protein, 11 aa, Staphylococcus
VDEETLRNGRQ

SEQ ID NO: 1992944 - protein, 13 aa, Staphylococcus
VDEETMQQNHANL

SEQ ID NO: 1992945 - protein, 5 aa, Staphylococcus
VDEFD

SEQ ID NO: 1992946 - protein, 4 aa, Staphylococcus
VDEG

SEQ ID NO: 1992947 - protein, 8 aa, Staphylococcus
VDEGKGDK

SEQ ID NO: 1992948 - protein, 7 aa, Staphylococcus
VDEIPDL

SEQ ID NO: 1992949 - protein, 5 aa, Staphylococcus
VDEKQ

SEQ ID NO: 1992950 - protein, 11 aa, Staphylococcus
VDEKTSKTCLS

SEQ ID NO: 1992951 - protein, 9 aa, Staphylococcus
VDELPNDES

SEQ ID NO: 1992952 - protein, 11 aa, Staphylococcus
VDEMPESDEDV

SEQ ID NO: 1992953 - protein, 4 aa, Staphylococcus
VDEN

SEQ ID NO: 1992954 - protein, 9 aa, Staphylococcus
VDEPSVEDT

SEQ ID NO: 1992955 - protein, 4 aa, Staphylococcus
VDEQ

SEQ ID NO: 1992956 - protein, 8 aa, Staphylococcus
VDEQGSEY

SEQ ID NO: 1992957 - protein, 10 aa, Staphylococcus
VDEQSKTVGA

SEQ ID NO: 1992958 - protein, 15 aa, Staphylococcus
VDERAMDSNDIERER

SEQ ID NO: 1992959 - protein, 16 aa, Staphylococcus
VDERAMDSNDLERERG

SEQ ID NO: 1992960 - protein, 6 aa, Staphylococcus
VDERSK

SEQ ID NO: 1992961 - protein, 5 aa, Staphylococcus
VDETI

SEQ ID NO: 1992962 - protein, 8 aa, Staphylococcus
VDETTVSN

SEQ ID NO: 1992963 - protein, 7 aa, Staphylococcus
VDEVEDK

SEQ ID NO: 1992964 - protein, 4 aa, Staphylococcus
VDEY

SEQ ID NO: 1992965 - protein, 11 aa, Staphylococcus
VDFGTGGPKDV

SEQ ID NO: 1992966 - protein, 17 aa, Staphylococcus
VDGAIGSTYNVNGRRAR

SEQ ID NO: 1992967 - protein, 7 aa, Staphylococcus
VDGAKGD

SEQ ID NO: 1992968 - protein, 8 aa, Staphylococcus
VDGDAEKA

SEQ ID NO: 1992969 - protein, 11 aa, Staphylococcus
VDGDFDKSSSL

SEQ ID NO: 1992970 - protein, 10 aa, Staphylococcus
VDGEETAFPD

SEQ ID NO: 1992971 - protein, 5 aa, Staphylococcus
VDGEG

SEQ ID NO: 1992972 - protein, 7 aa, Staphylococcus
VDGENQG

SEQ ID NO: 1992973 - protein, 7 aa, Staphylococcus
VDGGMSD

SEQ ID NO: 1992974 - protein, 10 aa, Staphylococcus
VDGKNYTPQE

SEQ ID NO: 1992975 - protein, 7 aa, Staphylococcus
VDGKQAD

SEQ ID NO: 1992976 - protein, 4 aa, Staphylococcus
VDGM

SEQ ID NO: 1992977 - protein, 11 aa, Staphylococcus
VDGNTDDYGTN

SEQ ID NO: 1992978 - protein, 11 aa, Staphylococcus
VDGPNTKEIAQ

SEQ ID NO: 1992979 - protein, 8 aa, Staphylococcus
VDGQNAGM

SEQ ID NO: 1992980 - protein, 15 aa, Staphylococcus
VDGRATSKVSIPSPN

SEQ ID NO: 1992981 - protein, 10 aa, Staphylococcus
VDGRHEEAEE

SEQ ID NO: 1992982 - protein, 7 aa, Staphylococcus
VDGSAGD

SEQ ID NO: 1992983 - protein, 8 aa, Staphylococcus
VDGSEGDI

SEQ ID NO: 1992984 - protein, 10 aa, Staphylococcus
VDGSEPISVA

SEQ ID NO: 1992985 - protein, 7 aa, Staphylococcus
VDGSTGN

SEQ ID NO: 1992986 - protein, 9 aa, Staphylococcus
VDGTDEYDT

SEQ ID NO: 1992987 - protein, 9 aa, Staphylococcus
VDGTGTELT

SEQ ID NO: 1992988 - protein, 9 aa, Staphylococcus
VDGTGTNLE

SEQ ID NO: 1992989 - protein, 9 aa, Staphylococcus
VDGTGTTLE

SEQ ID NO: 1992990 - protein, 7 aa, Staphylococcus
VDHKETI

SEQ ID NO: 1992991 - protein, 4 aa, Staphylococcus
VDHM

SEQ ID NO: 1992992 - protein, 7 aa, Staphylococcus
VDHRETI

SEQ ID NO: 1992993 - protein, 8 aa, Staphylococcus
VDIDTKEI

SEQ ID NO: 1992994 - protein, 10 aa, Staphylococcus
VDIENTTRNA

SEQ ID NO: 1992995 - protein, 8 aa, Staphylococcus
VDIKPEER

SEQ ID NO: 1992996 - protein, 4 aa, Staphylococcus
VDIP

SEQ ID NO: 1992997 - protein, 5 aa, Staphylococcus
VDIPS

SEQ ID NO: 1992998 - protein, 6 aa, Staphylococcus
VDISGK

SEQ ID NO: 1992999 - protein, 10 aa, Staphylococcus
VDISTKKQVG

SEQ ID NO: 1993000 - protein, 4 aa, Staphylococcus
VDKA

SEQ ID NO: 1993001 - protein, 8 aa, Staphylococcus
VDKAAQRN

SEQ ID NO: 1993002 - protein, 9 aa, Staphylococcus
VDKASQSNL

SEQ ID NO: 1993003 - protein, 7 aa, Staphylococcus
VDKATEK

SEQ ID NO: 1993004 - protein, 8 aa, Staphylococcus
VDKATETY

SEQ ID NO: 1993005 - protein, 4 aa, Staphylococcus
VDKD

SEQ ID NO: 1993006 - protein, 10 aa, Staphylococcus
VDKDAKQKVE

SEQ ID NO: 1993007 - protein, 10 aa, Staphylococcus
VDKDGKDSPI

SEQ ID NO: 1993008 - protein, 8 aa, Staphylococcus
VDKETEKI

SEQ ID NO: 1993009 - protein, 7 aa, Staphylococcus
VDKGATL

SEQ ID NO: 1993010 - protein, 7 aa, Staphylococcus
VDKGDSW

SEQ ID NO: 1993011 - protein, 10 aa, Staphylococcus
VDKGITAPHH

SEQ ID NO: 1993012 - protein, 7 aa, Staphylococcus
VDKGQLN

SEQ ID NO: 1993013 - protein, 8 aa, Staphylococcus
VDKGSGIA

SEQ ID NO: 1993014 - protein, 6 aa, Staphylococcus
VDKGTI

SEQ ID NO: 1993015 - protein, 11 aa, Staphylococcus
VDKGTSFGAST

SEQ ID NO: 1993016 - protein, 16 aa, Staphylococcus
VDKGTSFGASTLQENK

SEQ ID NO: 1993017 - protein, 9 aa, Staphylococcus
VDKGYEQSR

SEQ ID NO: 1993018 - protein, 13 aa, Staphylococcus
VDKHSTGGVGDTT

SEQ ID NO: 1993019 - protein, 9 aa, Staphylococcus
VDKKEDVEI

SEQ ID NO: 1993020 - protein, 11 aa, Staphylococcus
VDKLSEDETQI

SEQ ID NO: 1993021 - protein, 4 aa, Staphylococcus
VDKN

SEQ ID NO: 1993022 - protein, 5 aa, Staphylococcus
VDKND

SEQ ID NO: 1993023 - protein, 13 aa, Staphylococcus
VDKNDSTSAPVED

SEQ ID NO: 1993024 - protein, 5 aa, Staphylococcus
VDKNN

SEQ ID NO: 1993025 - protein, 6 aa, Staphylococcus
VDKPKS

SEQ ID NO: 1993026 - protein, 6 aa, Staphylococcus
VDKPSI

SEQ ID NO: 1993027 - protein, 8 aa, Staphylococcus
VDKQSGVT

SEQ ID NO: 1993028 - protein, 8 aa, Staphylococcus
VDKRLPKV

SEQ ID NO: 1993029 - protein, 15 aa, Staphylococcus
VDKRRAEFHPQGART

SEQ ID NO: 1993030 - protein, 18 aa, Staphylococcus
VDKRREEFHPQGTRSHKT

SEQ ID NO: 1993031 - protein, 16 aa, Staphylococcus
VDKRREEFHPSGSRSH

SEQ ID NO: 1993032 - protein, 4 aa, Staphylococcus
VDKS

SEQ ID NO: 1993033 - protein, 9 aa, Staphylococcus
VDKSENTLK

SEQ ID NO: 1993034 - protein, 9 aa, Staphylococcus
VDKSGAWYS

SEQ ID NO: 1993035 - protein, 7 aa, Staphylococcus
VDKTAQA

SEQ ID NO: 1993036 - protein, 12 aa, Staphylococcus
VDKTDRPKLIIK

SEQ ID NO: 1993037 - protein, 12 aa, Staphylococcus
VDKTIKSGVVHQ

SEQ ID NO: 1993038 - protein, 8 aa, Staphylococcus
VDKYKNSV

SEQ ID NO: 1993039 - protein, 37 aa, Staphylococcus
VDLDPNAKDSPYKAKDKVENETATPRKRADAEEVEAD

SEQ ID NO: 1993040 - protein, 10 aa, Staphylococcus
VDMTTPKPIE

SEQ ID NO: 1993041 - protein, 8 aa, Staphylococcus
VDNDINDP

SEQ ID NO: 1993042 - protein, 6 aa, Staphylococcus
VDNEHT

SEQ ID NO: 1993043 - protein, 9 aa, Staphylococcus
VDNGESLTA

SEQ ID NO: 1993044 - protein, 7 aa, Staphylococcus
VDNGRHP

SEQ ID NO: 1993045 - protein, 8 aa, Staphylococcus
VDNGSVNE

SEQ ID NO: 1993046 - protein, 15 aa, Staphylococcus
VDNGTSFGASTLQEN

SEQ ID NO: 1993047 - protein, 4 aa, Staphylococcus
VDNH

SEQ ID NO: 1993048 - protein, 12 aa, Staphylococcus
VDNINKDAATKR

SEQ ID NO: 1993049 - protein, 9 aa, Staphylococcus
VDNISSKNQ

SEQ ID NO: 1993050 - protein, 6 aa, Staphylococcus
VDNNEI

SEQ ID NO: 1993051 - protein, 10 aa, Staphylococcus
VDNNHKDNLK

SEQ ID NO: 1993052 - protein, 6 aa, Staphylococcus
VDNNRD

SEQ ID NO: 1993053 - protein, 9 aa, Staphylococcus
VDNPEKVPY

SEQ ID NO: 1993054 - protein, 7 aa, Staphylococcus
VDNPEMK

SEQ ID NO: 1993055 - protein, 17 aa, Staphylococcus
VDNPSYEQVKTGNTGHL

SEQ ID NO: 1993056 - protein, 10 aa, Staphylococcus
VDNQFDYDST

SEQ ID NO: 1993057 - protein, 7 aa, Staphylococcus
VDNQVSS

SEQ ID NO: 1993058 - protein, 9 aa, Staphylococcus
VDNTIDKKG

SEQ ID NO: 1993059 - protein, 11 aa, Staphylococcus
VDNYSSAGSFR

SEQ ID NO: 1993060 - protein, 8 aa, Staphylococcus
VDPAANPY

SEQ ID NO: 1993061 - protein, 10 aa, Staphylococcus
VDPDKVSVED

SEQ ID NO: 1993062 - protein, 7 aa, Staphylococcus
VDPDLPN

SEQ ID NO: 1993063 - protein, 24 aa, Staphylococcus
VDPDRQGIADTWPDSIDTSCSRNE

SEQ ID NO: 1993064 - protein, 4 aa, Staphylococcus
VDPE

SEQ ID NO: 1993065 - protein, 6 aa, Staphylococcus
VDPEEI

SEQ ID NO: 1993066 - protein, 6 aa, Staphylococcus
VDPEKI

SEQ ID NO: 1993067 - protein, 25 aa, Staphylococcus
VDPERQNIASTWPDSIDTSCSRGEW

SEQ ID NO: 1993068 - protein, 11 aa, Staphylococcus
VDPEVRGQGIG

SEQ ID NO: 1993069 - protein, 6 aa, Staphylococcus
VDPGES

SEQ ID NO: 1993070 - protein, 4 aa, Staphylococcus
VDPI

SEQ ID NO: 1993071 - protein, 9 aa, Staphylococcus
VDPKGGCTG

SEQ ID NO: 1993072 - protein, 5 aa, Staphylococcus
VDPKN

SEQ ID NO: 1993073 - protein, 8 aa, Staphylococcus
VDPKTASE

SEQ ID NO: 1993074 - protein, 6 aa, Staphylococcus
VDPNDG

SEQ ID NO: 1993075 - protein, 7 aa, Staphylococcus
VDPNDVS

SEQ ID NO: 1993076 - protein, 16 aa, Staphylococcus
VDPQDVYDKTMKLTDL

SEQ ID NO: 1993077 - protein, 5 aa, Staphylococcus
VDPQK

SEQ ID NO: 1993078 - protein, 15 aa, Staphylococcus
VDPQNPGQLLPEEED

SEQ ID NO: 1993079 - protein, 17 aa, Staphylococcus
VDPSYEPDISIEDSKQY

SEQ ID NO: 1993080 - protein, 16 aa, Staphylococcus
VDPSYEPEISIEDSKQ

SEQ ID NO: 1993081 - protein, 18 aa, Staphylococcus
VDPSYEPEISIEESKTYI

SEQ ID NO: 1993082 - protein, 4 aa, Staphylococcus
VDPT

SEQ ID NO: 1993083 - protein, 5 aa, Staphylococcus
VDPTE

SEQ ID NO: 1993084 - protein, 15 aa, Staphylococcus
VDPTEIKNASLPNHK

SEQ ID NO: 1993085 - protein, 21 aa, Staphylococcus
VDPVEGTKPTTKQDMTDLQST

SEQ ID NO: 1993086 - protein, 20 aa, Staphylococcus
VDQAGKYAATSYQPINASEQ

SEQ ID NO: 1993087 - protein, 5 aa, Staphylococcus
VDQAK

SEQ ID NO: 1993088 - protein, 9 aa, Staphylococcus
VDQENEQID

SEQ ID NO: 1993089 - protein, 10 aa, Staphylococcus
VDQETINDSY

SEQ ID NO: 1993090 - protein, 4 aa, Staphylococcus
VDQH

SEQ ID NO: 1993091 - protein, 10 aa, Staphylococcus
VDQKTSHNLN

SEQ ID NO: 1993092 - protein, 5 aa, Staphylococcus
VDQLE

SEQ ID NO: 1993093 - protein, 5 aa, Staphylococcus
VDQNN

SEQ ID NO: 1993094 - protein, 5 aa, Staphylococcus
VDQNV

SEQ ID NO: 1993095 - protein, 4 aa, Staphylococcus
VDQQ

SEQ ID NO: 1993096 - protein, 20 aa, Staphylococcus
VDQRIQEASIENPDNAHLKN

SEQ ID NO: 1993097 - protein, 7 aa, Staphylococcus
VDRATRL

SEQ ID NO: 1993098 - protein, 14 aa, Staphylococcus
VDRDDEAFSNPTKP

SEQ ID NO: 1993099 - protein, 15 aa, Staphylococcus
VDRDKKAIKTAPKIT

SEQ ID NO: 1993100 - protein, 14 aa, Staphylococcus
VDREKAKNKRGKIG

SEQ ID NO: 1993101 - protein, 13 aa, Staphylococcus
VDRENPGPSTLKR

SEQ ID NO: 1993102 - protein, 18 aa, Staphylococcus
VDRGNRSYFESKQSTPYA

SEQ ID NO: 1993103 - protein, 5 aa, Staphylococcus
VDRTR

SEQ ID NO: 1993104 - protein, 18 aa, Staphylococcus
VDSASPGELGGTYAGNPL

SEQ ID NO: 1993105 - protein, 8 aa, Staphylococcus
VDSDDKDI

SEQ ID NO: 1993106 - protein, 7 aa, Staphylococcus
VDSDEKD

SEQ ID NO: 1993107 - protein, 7 aa, Staphylococcus
VDSDEKQ

SEQ ID NO: 1993108 - protein, 11 aa, Staphylococcus
VDSDKPSSPCG

SEQ ID NO: 1993109 - protein, 6 aa, Staphylococcus
VDSDLA

SEQ ID NO: 1993110 - protein, 11 aa, Staphylococcus
VDSDTSSKVSL

SEQ ID NO: 1993111 - protein, 11 aa, Staphylococcus
VDSEEDVQFTQ

SEQ ID NO: 1993112 - protein, 12 aa, Staphylococcus
VDSEETVEYSQK

SEQ ID NO: 1993113 - protein, 9 aa, Staphylococcus
VDSEGGVET

SEQ ID NO: 1993114 - protein, 12 aa, Staphylococcus
VDSEKPSSPCGT

SEQ ID NO: 1993115 - protein, 7 aa, Staphylococcus
VDSGREE

SEQ ID NO: 1993116 - protein, 11 aa, Staphylococcus
VDSGSKRSSIG

SEQ ID NO: 1993117 - protein, 6 aa, Staphylococcus
VDSKDH

SEQ ID NO: 1993118 - protein, 8 aa, Staphylococcus
VDSKSEAL

SEQ ID NO: 1993119 - protein, 10 aa, Staphylococcus
VDSKSQNKKN

SEQ ID NO: 1993120 - protein, 7 aa, Staphylococcus
VDSKTGG

SEQ ID NO: 1993121 - protein, 4 aa, Staphylococcus
VDSL

SEQ ID NO: 1993122 - protein, 12 aa, Staphylococcus
VDSLATEAREKL

SEQ ID NO: 1993123 - protein, 13 aa, Staphylococcus
VDSLATEAREKLA

SEQ ID NO: 1993124 - protein, 12 aa, Staphylococcus
VDSNYGPTWYDA

SEQ ID NO: 1993125 - protein, 12 aa, Staphylococcus
VDSNYGSTWYDA

SEQ ID NO: 1993126 - protein, 7 aa, Staphylococcus
VDSSGQS

SEQ ID NO: 1993127 - protein, 12 aa, Staphylococcus
VDSSYGPTWYDA

SEQ ID NO: 1993128 - protein, 8 aa, Staphylococcus
VDSTGQSL

SEQ ID NO: 1993129 - protein, 8 aa, Staphylococcus
VDSTQLKA

SEQ ID NO: 1993130 - protein, 16 aa, Staphylococcus
VDSTQTKAKKALVGNK

SEQ ID NO: 1993131 - protein, 8 aa, Staphylococcus
VDTDDDNS

SEQ ID NO: 1993132 - protein, 5 aa, Staphylococcus
VDTDL

SEQ ID NO: 1993133 - protein, 11 aa, Staphylococcus
VDTDSKKGMRD

SEQ ID NO: 1993134 - protein, 5 aa, Staphylococcus
VDTEE

SEQ ID NO: 1993135 - protein, 8 aa, Staphylococcus
VDTEQSVE

SEQ ID NO: 1993136 - protein, 15 aa, Staphylococcus
VDTESTDSEATGEGE

SEQ ID NO: 1993137 - protein, 6 aa, Staphylococcus
VDTETF

SEQ ID NO: 1993138 - protein, 5 aa, Staphylococcus
VDTGE

SEQ ID NO: 1993139 - protein, 5 aa, Staphylococcus
VDTIG

SEQ ID NO: 1993140 - protein, 8 aa, Staphylococcus
VDTKDAMG

SEQ ID NO: 1993141 - protein, 7 aa, Staphylococcus
VDTKDDQ

SEQ ID NO: 1993142 - protein, 4 aa, Staphylococcus
VDTP

SEQ ID NO: 1993143 - protein, 6 aa, Staphylococcus
VDTPLS

SEQ ID NO: 1993144 - protein, 4 aa, Staphylococcus
VDTQ

SEQ ID NO: 1993145 - protein, 7 aa, Staphylococcus
VDTRSIT

SEQ ID NO: 1993146 - protein, 12 aa, Staphylococcus
VDTSNEEAQKVN

SEQ ID NO: 1993147 - protein, 9 aa, Staphylococcus
VDTTAAGDT

SEQ ID NO: 1993148 - protein, 8 aa, Staphylococcus
VDTTDDLK

SEQ ID NO: 1993149 - protein, 22 aa, Staphylococcus
VDTTDEAGQKLSAKLSTSYGKI

SEQ ID NO: 1993150 - protein, 11 aa, Staphylococcus
VDTTGAGDTFN

SEQ ID NO: 1993151 - protein, 16 aa, Staphylococcus
VDTTQPNNIEQAIQSN

SEQ ID NO: 1993152 - protein, 9 aa, Staphylococcus
VDTTTNENI

SEQ ID NO: 1993153 - protein, 8 aa, Staphylococcus
VDTVENTG

SEQ ID NO: 1993154 - protein, 13 aa, Staphylococcus
VDVDGKSYTPQEI

SEQ ID NO: 1993155 - protein, 6 aa, Staphylococcus
VDVDRA

SEQ ID NO: 1993156 - protein, 13 aa, Staphylococcus
VDVGTTVTGAPTQ

SEQ ID NO: 1993157 - protein, 13 aa, Staphylococcus
VDVPNAKAIRETM

SEQ ID NO: 1993158 - protein, 13 aa, Staphylococcus
VDVPNAKAIRSTM

SEQ ID NO: 1993159 - protein, 6 aa, Staphylococcus
VDYANG

SEQ ID NO: 1993160 - protein, 25 aa, Staphylococcus
VDYDKENGSVTVDASATLNEEAPYE

SEQ ID NO: 1993161 - protein, 5 aa, Staphylococcus
VDYNM

SEQ ID NO: 1993162 - protein, 6 aa, Staphylococcus
VDYQGQ

SEQ ID NO: 1993163 - protein, 8 aa, Staphylococcus
VEAADKDY

SEQ ID NO: 1993164 - protein, 9 aa, Staphylococcus
VEAAKGKDE

SEQ ID NO: 1993165 - protein, 5 aa, Staphylococcus
VEADN

SEQ ID NO: 1993166 - protein, 4 aa, Staphylococcus
VEAG

SEQ ID NO: 1993167 - protein, 6 aa, Staphylococcus
VEAGLT

SEQ ID NO: 1993168 - protein, 7 aa, Staphylococcus
VEAGRYD

SEQ ID NO: 1993169 - protein, 14 aa, Staphylococcus
VEAGVNNDGAKLGT

SEQ ID NO: 1993170 - protein, 4 aa, Staphylococcus
VEAH

SEQ ID NO: 1993171 - protein, 5 aa, Staphylococcus
VEAKG

SEQ ID NO: 1993172 - protein, 15 aa, Staphylococcus
VEAKNPEGHDVLIWK

SEQ ID NO: 1993173 - protein, 10 aa, Staphylococcus
VEAKRLQNNP

SEQ ID NO: 1993174 - protein, 10 aa, Staphylococcus
VEAKRLRNNP

SEQ ID NO: 1993175 - protein, 8 aa, Staphylococcus
VEAPASGT

SEQ ID NO: 1993176 - protein, 8 aa, Staphylococcus
VEASGGRI

SEQ ID NO: 1993177 - protein, 6 aa, Staphylococcus
VEASTE

SEQ ID NO: 1993178 - protein, 8 aa, Staphylococcus
VEASYTGK

SEQ ID NO: 1993179 - protein, 7 aa, Staphylococcus
VEATGKD

SEQ ID NO: 1993180 - protein, 8 aa, Staphylococcus
VEATPENI

SEQ ID NO: 1993181 - protein, 36 aa, Staphylococcus
VEATPGNLKQLEQQNKRAEADRQKEIDDAKALKSKL

SEQ ID NO: 1993182 - protein, 35 aa, Staphylococcus
VEATPGNLKQLEQQNKRAEADRQQEIDDAKALKEK

SEQ ID NO: 1993183 - protein, 36 aa, Staphylococcus
VEATPGNLKQLEQQNKRAEADRQQEIDDAKALKEKL

SEQ ID NO: 1993184 - protein, 36 aa, Staphylococcus
VEATPGNLKQLQQQNKHAEQEREQEIEDAKALKKKL

SEQ ID NO: 1993185 - protein, 37 aa, Staphylococcus
VEATPGNLRQLEQKNKAAEAERQQEIEDAKKLKEQLS

SEQ ID NO: 1993186 - protein, 12 aa, Staphylococcus
VEATQQIKKDLP

SEQ ID NO: 1993187 - protein, 10 aa, Staphylococcus
VEATTLESQE

SEQ ID NO: 1993188 - protein, 6 aa, Staphylococcus
VEAVGQ

SEQ ID NO: 1993189 - protein, 7 aa, Staphylococcus
VEAVKSG

SEQ ID NO: 1993190 - protein, 8 aa, Staphylococcus
VECGETPL

SEQ ID NO: 1993191 - protein, 4 aa, Staphylococcus
VEDA

SEQ ID NO: 1993192 - protein, 18 aa, Staphylococcus
VEDDNEAEQLYHQYLKSL

SEQ ID NO: 1993193 - protein, 4 aa, Staphylococcus
VEDE

SEQ ID NO: 1993194 - protein, 10 aa, Staphylococcus
VEDEDMRRGV

SEQ ID NO: 1993195 - protein, 27 aa, Staphylococcus
VEDEDTTERKVDLQQKDAPQSQQEETA

SEQ ID NO: 1993196 - protein, 14 aa, Staphylococcus
VEDEDYKPGFTIRN

SEQ ID NO: 1993197 - protein, 6 aa, Staphylococcus
VEDEEL

SEQ ID NO: 1993198 - protein, 11 aa, Staphylococcus
VEDEELRNGRK

SEQ ID NO: 1993199 - protein, 7 aa, Staphylococcus
VEDGDTF

SEQ ID NO: 1993200 - protein, 19 aa, Staphylococcus
VEDIEARKKQRNKLNSNKS

SEQ ID NO: 1993201 - protein, 8 aa, Staphylococcus
VEDKKFDE

SEQ ID NO: 1993202 - protein, 15 aa, Staphylococcus
VEDKSKARDSHTGDQ

SEQ ID NO: 1993203 - protein, 8 aa, Staphylococcus
VEDKTSWN

SEQ ID NO: 1993204 - protein, 10 aa, Staphylococcus
VEDNGTFEVT

SEQ ID NO: 1993205 - protein, 11 aa, Staphylococcus
VEDNLGQEQQF

SEQ ID NO: 1993206 - protein, 11 aa, Staphylococcus
VEDPDLRKNHP

SEQ ID NO: 1993207 - protein, 11 aa, Staphylococcus
VEDPDLRTNHP

SEQ ID NO: 1993208 - protein, 4 aa, Staphylococcus
VEDQ

SEQ ID NO: 1993209 - protein, 15 aa, Staphylococcus
VEDRGGYYESSGALK

SEQ ID NO: 1993210 - protein, 11 aa, Staphylococcus
VEDRNAPITEQ

SEQ ID NO: 1993211 - protein, 5 aa, Staphylococcus
VEDSN

SEQ ID NO: 1993212 - protein, 5 aa, Staphylococcus
VEDSS

SEQ ID NO: 1993213 - protein, 10 aa, Staphylococcus
VEDSVKEGDN

SEQ ID NO: 1993214 - protein, 7 aa, Staphylococcus
VEDTAIQ

SEQ ID NO: 1993215 - protein, 7 aa, Staphylococcus
VEDTASA

SEQ ID NO: 1993216 - protein, 7 aa, Staphylococcus
VEDTDNK

SEQ ID NO: 1993217 - protein, 16 aa, Staphylococcus
VEDTNSISTKEETEAV

SEQ ID NO: 1993218 - protein, 5 aa, Staphylococcus
VEDTQ

SEQ ID NO: 1993219 - protein, 4 aa, Staphylococcus
VEEA

SEQ ID NO: 1993220 - protein, 13 aa, Staphylococcus
VEEAARKGEYAKT

SEQ ID NO: 1993221 - protein, 8 aa, Staphylococcus
VEEAHKHD

SEQ ID NO: 1993222 - protein, 9 aa, Staphylococcus
VEEAHKHGK

SEQ ID NO: 1993223 - protein, 11 aa, Staphylococcus
VEEAKNETGAN

SEQ ID NO: 1993224 - protein, 11 aa, Staphylococcus
VEEAKQETGAN

SEQ ID NO: 1993225 - protein, 6 aa, Staphylococcus
VEEARK

SEQ ID NO: 1993226 - protein, 8 aa, Staphylococcus
VEEAVNAD

SEQ ID NO: 1993227 - protein, 10 aa, Staphylococcus
VEEDEDAGVN

SEQ ID NO: 1993228 - protein, 9 aa, Staphylococcus
VEEDEEPFE

SEQ ID NO: 1993229 - protein, 8 aa, Staphylococcus
VEEDENIG

SEQ ID NO: 1993230 - protein, 8 aa, Staphylococcus
VEEDENVG

SEQ ID NO: 1993231 - protein, 11 aa, Staphylococcus
VEEEALRNGRK

SEQ ID NO: 1993232 - protein, 7 aa, Staphylococcus
VEEEDTF

SEQ ID NO: 1993233 - protein, 5 aa, Staphylococcus
VEEEG

SEQ ID NO: 1993234 - protein, 5 aa, Staphylococcus
VEEEI

SEQ ID NO: 1993235 - protein, 8 aa, Staphylococcus
VEEENTEV

SEQ ID NO: 1993236 - protein, 5 aa, Staphylococcus
VEEES

SEQ ID NO: 1993237 - protein, 25 aa, Staphylococcus
VEEESTLEESAENPKELGRQIGIKH

SEQ ID NO: 1993238 - protein, 4 aa, Staphylococcus
VEEG

SEQ ID NO: 1993239 - protein, 6 aa, Staphylococcus
VEEGEI

SEQ ID NO: 1993240 - protein, 6 aa, Staphylococcus
VEEGTA

SEQ ID NO: 1993241 - protein, 5 aa, Staphylococcus
VEEGY

SEQ ID NO: 1993242 - protein, 5 aa, Staphylococcus
VEEIA

SEQ ID NO: 1993243 - protein, 15 aa, Staphylococcus
VEEIKAGKVEYRAEK

SEQ ID NO: 1993244 - protein, 17 aa, Staphylococcus
VEEIKAGKVEYRAEKSG

SEQ ID NO: 1993245 - protein, 12 aa, Staphylococcus
VEEIKGKDSEDI

SEQ ID NO: 1993246 - protein, 15 aa, Staphylococcus
VEEKEEDAPKSLFDE

SEQ ID NO: 1993247 - protein, 27 aa, Staphylococcus
VEEKLKEQKEEKTDDIEQTKKDVQDTL

SEQ ID NO: 1993248 - protein, 7 aa, Staphylococcus
VEEKPSI

SEQ ID NO: 1993249 - protein, 8 aa, Staphylococcus
VEEKQAED

SEQ ID NO: 1993250 - protein, 14 aa, Staphylococcus
VEEMASTENEQDLY

SEQ ID NO: 1993251 - protein, 8 aa, Staphylococcus
VEENPYQG

SEQ ID NO: 1993252 - protein, 10 aa, Staphylococcus
VEEPDEDALE

SEQ ID NO: 1993253 - protein, 5 aa, Staphylococcus
VEEPI

SEQ ID NO: 1993254 - protein, 10 aa, Staphylococcus
VEEPPISVKD

SEQ ID NO: 1993255 - protein, 6 aa, Staphylococcus
VEEPQA

SEQ ID NO: 1993256 - protein, 5 aa, Staphylococcus
VEEQA

SEQ ID NO: 1993257 - protein, 36 aa, Staphylococcus
VEEQGYDIEAKNEDMQSKEDKNTKFNSANVGEGLNP

SEQ ID NO: 1993258 - protein, 4 aa, Staphylococcus
VEER

SEQ ID NO: 1993259 - protein, 7 aa, Staphylococcus
VEERAKA

SEQ ID NO: 1993260 - protein, 10 aa, Staphylococcus
VEERAKSQHY

SEQ ID NO: 1993261 - protein, 9 aa, Staphylococcus
VEERARAEN

SEQ ID NO: 1993262 - protein, 8 aa, Staphylococcus
VEERVESE

SEQ ID NO: 1993263 - protein, 5 aa, Staphylococcus
VEESE

SEQ ID NO: 1993264 - protein, 5 aa, Staphylococcus
VEESG

SEQ ID NO: 1993265 - protein, 6 aa, Staphylococcus
VEESGY

SEQ ID NO: 1993266 - protein, 5 aa, Staphylococcus
VEESL

SEQ ID NO: 1993267 - protein, 12 aa, Staphylococcus
VEESMDDREEIS

SEQ ID NO: 1993268 - protein, 11 aa, Staphylococcus
VEESPSPILTE

SEQ ID NO: 1993269 - protein, 23 aa, Staphylococcus
VEETGDTFEANAKLKSEAAAKAL

SEQ ID NO: 1993270 - protein, 10 aa, Staphylococcus
VEETGTTFEE

SEQ ID NO: 1993271 - protein, 12 aa, Staphylococcus
VEETGTTFEENA

SEQ ID NO: 1993272 - protein, 23 aa, Staphylococcus
VEETGTTFEENARLKSEAAAKAL

SEQ ID NO: 1993273 - protein, 21 aa, Staphylococcus
VEETGTTFEENARLKSEEAAK

SEQ ID NO: 1993274 - protein, 4 aa, Staphylococcus
VEEV

SEQ ID NO: 1993275 - protein, 22 aa, Staphylococcus
VEEVDDVTDEQSNEIEGQSDES

SEQ ID NO: 1993276 - protein, 5 aa, Staphylococcus
VEEVQ

SEQ ID NO: 1993277 - protein, 12 aa, Staphylococcus
VEEVSDHRDEVD

SEQ ID NO: 1993278 - protein, 15 aa, Staphylococcus
VEEYERHSSQSQGIH

SEQ ID NO: 1993279 - protein, 6 aa, Staphylococcus
VEFEPH

SEQ ID NO: 1993280 - protein, 8 aa, Staphylococcus
VEGAHDTL

SEQ ID NO: 1993281 - protein, 7 aa, Staphylococcus
VEGAHET

SEQ ID NO: 1993282 - protein, 7 aa, Staphylococcus
VEGAPSN

SEQ ID NO: 1993283 - protein, 12 aa, Staphylococcus
VEGAQTGQTYRV

SEQ ID NO: 1993284 - protein, 5 aa, Staphylococcus
VEGDD

SEQ ID NO: 1993285 - protein, 8 aa, Staphylococcus
VEGDNSIS

SEQ ID NO: 1993286 - protein, 9 aa, Staphylococcus
VEGDTPDDL

SEQ ID NO: 1993287 - protein, 12 aa, Staphylococcus
VEGEDTRVLGKD

SEQ ID NO: 1993288 - protein, 7 aa, Staphylococcus
VEGEEGY

SEQ ID NO: 1993289 - protein, 10 aa, Staphylococcus
VEGEGDNGYA

SEQ ID NO: 1993290 - protein, 6 aa, Staphylococcus
VEGEKA

SEQ ID NO: 1993291 - protein, 7 aa, Staphylococcus
VEGENDT

SEQ ID NO: 1993292 - protein, 11 aa, Staphylococcus
VEGEPLPEAGD

SEQ ID NO: 1993293 - protein, 7 aa, Staphylococcus
VEGESGY

SEQ ID NO: 1993294 - protein, 9 aa, Staphylococcus
VEGESPDDL

SEQ ID NO: 1993295 - protein, 9 aa, Staphylococcus
VEGETPTEL

SEQ ID NO: 1993296 - protein, 5 aa, Staphylococcus
VEGGA

SEQ ID NO: 1993297 - protein, 7 aa, Staphylococcus
VEGGGKA

SEQ ID NO: 1993298 - protein, 12 aa, Staphylococcus
VEGGTEMTTEEK

SEQ ID NO: 1993299 - protein, 21 aa, Staphylococcus
VEGGTEMTTEEKIASGLNDSN

SEQ ID NO: 1993300 - protein, 13 aa, Staphylococcus
VEGINNKKILVKD

SEQ ID NO: 1993301 - protein, 7 aa, Staphylococcus
VEGKPSR

SEQ ID NO: 1993302 - protein, 11 aa, Staphylococcus
VEGLENETKRL

SEQ ID NO: 1993303 - protein, 4 aa, Staphylococcus
VEGN

SEQ ID NO: 1993304 - protein, 8 aa, Staphylococcus
VEGNGDKR

SEQ ID NO: 1993305 - protein, 4 aa, Staphylococcus
VEGP

SEQ ID NO: 1993306 - protein, 8 aa, Staphylococcus
VEGPKGAM

SEQ ID NO: 1993307 - protein, 18 aa, Staphylococcus
VEGPLAEEIEKEYNELVA

SEQ ID NO: 1993308 - protein, 9 aa, Staphylococcus
VEGQEKISQ

SEQ ID NO: 1993309 - protein, 24 aa, Staphylococcus
VEGSEENDNNLKGLPVTDEEMARK

SEQ ID NO: 1993310 - protein, 7 aa, Staphylococcus
VEGSPYK

SEQ ID NO: 1993311 - protein, 15 aa, Staphylococcus
VEGTDKAIASTIDGE

SEQ ID NO: 1993312 - protein, 10 aa, Staphylococcus
VEGTHTSAEE

SEQ ID NO: 1993313 - protein, 16 aa, Staphylococcus
VEGTNKAIASTIDGEA

SEQ ID NO: 1993314 - protein, 15 aa, Staphylococcus
VEGTNKAVASTIDGE

SEQ ID NO: 1993315 - protein, 16 aa, Staphylococcus
VEGTQKAIASTIDGEA

SEQ ID NO: 1993316 - protein, 15 aa, Staphylococcus
VEGTTPHTITGRFGS

SEQ ID NO: 1993317 - protein, 4 aa, Staphylococcus
VEGV

SEQ ID NO: 1993318 - protein, 4 aa, Staphylococcus
VEGY

SEQ ID NO: 1993319 - protein, 6 aa, Staphylococcus
VEHDGE

SEQ ID NO: 1993320 - protein, 7 aa, Staphylococcus
VEHGTEA

SEQ ID NO: 1993321 - protein, 15 aa, Staphylococcus
VEHTSNHLRETQQEM

SEQ ID NO: 1993322 - protein, 8 aa, Staphylococcus
VEHYEGRR

SEQ ID NO: 1993323 - protein, 5 aa, Staphylococcus
VEIEG

SEQ ID NO: 1993324 - protein, 17 aa, Staphylococcus
VEINSKPPKKHLNPKRL

SEQ ID NO: 1993325 - protein, 7 aa, Staphylococcus
VEIPDKP

SEQ ID NO: 1993326 - protein, 4 aa, Staphylococcus
VEKA

SEQ ID NO: 1993327 - protein, 20 aa, Staphylococcus
VEKAGKKIEMKRTEEYDMPE

SEQ ID NO: 1993328 - protein, 5 aa, Staphylococcus
VEKDG

SEQ ID NO: 1993329 - protein, 21 aa, Staphylococcus
VEKDGKDAANQAQEKAEQDGK

SEQ ID NO: 1993330 - protein, 11 aa, Staphylococcus
VEKDQQKTGLN

SEQ ID NO: 1993331 - protein, 6 aa, Staphylococcus
VEKEFD

SEQ ID NO: 1993332 - protein, 6 aa, Staphylococcus
VEKEFN

SEQ ID NO: 1993333 - protein, 21 aa, Staphylococcus
VEKEGKDAANEAQDKAEKEGK

SEQ ID NO: 1993334 - protein, 21 aa, Staphylococcus
VEKEGKDAANEAQSKAEQEGK

SEQ ID NO: 1993335 - protein, 21 aa, Staphylococcus
VEKEGKDKANAAQEQAEKDGK

SEQ ID NO: 1993336 - protein, 4 aa, Staphylococcus
VEKG

SEQ ID NO: 1993337 - protein, 8 aa, Staphylococcus
VEKGEVPL

SEQ ID NO: 1993338 - protein, 9 aa, Staphylococcus
VEKGFSNEK

SEQ ID NO: 1993339 - protein, 22 aa, Staphylococcus
VEKGTTGDGVESVTGYTGHDAA

SEQ ID NO: 1993340 - protein, 14 aa, Staphylococcus
VEKHNAKTNNPRLA

SEQ ID NO: 1993341 - protein, 4 aa, Staphylococcus
VEKI

SEQ ID NO: 1993342 - protein, 11 aa, Staphylococcus
VEKKDSSKGNI

SEQ ID NO: 1993343 - protein, 10 aa, Staphylococcus
VEKKKRDEIE

SEQ ID NO: 1993344 - protein, 10 aa, Staphylococcus
VEKKNGNQGI

SEQ ID NO: 1993345 - protein, 4 aa, Staphylococcus
VEKL

SEQ ID NO: 1993346 - protein, 15 aa, Staphylococcus
VEKNDEQINIDDNNA

SEQ ID NO: 1993347 - protein, 7 aa, Staphylococcus
VEKPESE

SEQ ID NO: 1993348 - protein, 7 aa, Staphylococcus
VEKPGAF

SEQ ID NO: 1993349 - protein, 14 aa, Staphylococcus
VEKPNYIHSQNSAA

SEQ ID NO: 1993350 - protein, 14 aa, Staphylococcus
VEKPTNKIPSSIDA

SEQ ID NO: 1993351 - protein, 6 aa, Staphylococcus
VEKQER

SEQ ID NO: 1993352 - protein, 5 aa, Staphylococcus
VEKQF

SEQ ID NO: 1993353 - protein, 8 aa, Staphylococcus
VEKQSNPL

SEQ ID NO: 1993354 - protein, 16 aa, Staphylococcus
VEKRREEFHPKGSRSH

SEQ ID NO: 1993355 - protein, 20 aa, Staphylococcus
VEKRREEFHPQGSRSQKTIQ

SEQ ID NO: 1993356 - protein, 5 aa, Staphylococcus
VEKTG

SEQ ID NO: 1993357 - protein, 10 aa, Staphylococcus
VEKTNNPKGV

SEQ ID NO: 1993358 - protein, 6 aa, Staphylococcus
VEKTNR

SEQ ID NO: 1993359 - protein, 11 aa, Staphylococcus
VEKTNTQIKRP

SEQ ID NO: 1993360 - protein, 9 aa, Staphylococcus
VEKTNTSYA

SEQ ID NO: 1993361 - protein, 10 aa, Staphylococcus
VEKTTGANKE

SEQ ID NO: 1993362 - protein, 17 aa, Staphylococcus
VEKVDRQSKTVTTSKGI

SEQ ID NO: 1993363 - protein, 10 aa, Staphylococcus
VEKYDTAKNT

SEQ ID NO: 1993364 - protein, 6 aa, Staphylococcus
VELGPK

SEQ ID NO: 1993365 - protein, 17 aa, Staphylococcus
VELNKGRVGAKEGPNAI

SEQ ID NO: 1993366 - protein, 12 aa, Staphylococcus
VELQDTQLTPEN

SEQ ID NO: 1993367 - protein, 18 aa, Staphylococcus
VELSQDEINQIDSLFPIN

SEQ ID NO: 1993368 - protein, 9 aa, Staphylococcus
VELSSETRN

SEQ ID NO: 1993369 - protein, 6 aa, Staphylococcus
VEMNDD

SEQ ID NO: 1993370 - protein, 6 aa, Staphylococcus
VEMTKS

SEQ ID NO: 1993371 - protein, 9 aa, Staphylococcus
VEMTPNNRQ

SEQ ID NO: 1993372 - protein, 4 aa, Staphylococcus
VENA

SEQ ID NO: 1993373 - protein, 5 aa, Staphylococcus
VENAA

SEQ ID NO: 1993374 - protein, 8 aa, Staphylococcus
VENASYPA

SEQ ID NO: 1993375 - protein, 11 aa, Staphylococcus
VENDAKKGLRD

SEQ ID NO: 1993376 - protein, 21 aa, Staphylococcus
VENDGKEAANKAQERAEQQGK

SEQ ID NO: 1993377 - protein, 5 aa, Staphylococcus
VENDN

SEQ ID NO: 1993378 - protein, 7 aa, Staphylococcus
VENEKGS

SEQ ID NO: 1993379 - protein, 10 aa, Staphylococcus
VENELGKEEQ

SEQ ID NO: 1993380 - protein, 4 aa, Staphylococcus
VENF

SEQ ID NO: 1993381 - protein, 5 aa, Staphylococcus
VENGD

SEQ ID NO: 1993382 - protein, 7 aa, Staphylococcus
VENGDTF

SEQ ID NO: 1993383 - protein, 6 aa, Staphylococcus
VENGHS

SEQ ID NO: 1993384 - protein, 9 aa, Staphylococcus
VENGKLEQG

SEQ ID NO: 1993385 - protein, 12 aa, Staphylococcus
VENGLQSITDGE

SEQ ID NO: 1993386 - protein, 5 aa, Staphylococcus
VENGN

SEQ ID NO: 1993387 - protein, 8 aa, Staphylococcus
VENKEPQS

SEQ ID NO: 1993388 - protein, 6 aa, Staphylococcus
VENKES

SEQ ID NO: 1993389 - protein, 6 aa, Staphylococcus
VENKGS

SEQ ID NO: 1993390 - protein, 6 aa, Staphylococcus
VENKGT

SEQ ID NO: 1993391 - protein, 10 aa, Staphylococcus
VENKGYSQQE

SEQ ID NO: 1993392 - protein, 21 aa, Staphylococcus
VENKIGEEQRYQGHLGDNAQT

SEQ ID NO: 1993393 - protein, 9 aa, Staphylococcus
VENKSDVEV

SEQ ID NO: 1993394 - protein, 10 aa, Staphylococcus
VENLTDHDQQ

SEQ ID NO: 1993395 - protein, 14 aa, Staphylococcus
VENNDLKADIASEL

SEQ ID NO: 1993396 - protein, 10 aa, Staphylococcus
VENNDNGLDK

SEQ ID NO: 1993397 - protein, 5 aa, Staphylococcus
VENNE

SEQ ID NO: 1993398 - protein, 6 aa, Staphylococcus
VENNEL

SEQ ID NO: 1993399 - protein, 20 aa, Staphylococcus
VENNNTSSASKEDAGKTINA

SEQ ID NO: 1993400 - protein, 6 aa, Staphylococcus
VENNQY

SEQ ID NO: 1993401 - protein, 6 aa, Staphylococcus
VENNRK

SEQ ID NO: 1993402 - protein, 7 aa, Staphylococcus
VENPDKP

SEQ ID NO: 1993403 - protein, 8 aa, Staphylococcus
VENPEQFN

SEQ ID NO: 1993404 - protein, 5 aa, Staphylococcus
VENPF

SEQ ID NO: 1993405 - protein, 4 aa, Staphylococcus
VENS

SEQ ID NO: 1993406 - protein, 10 aa, Staphylococcus
VENSDQCKDA

SEQ ID NO: 1993407 - protein, 11 aa, Staphylococcus
VENSGKADQYK

SEQ ID NO: 1993408 - protein, 8 aa, Staphylococcus
VENSINKH

SEQ ID NO: 1993409 - protein, 7 aa, Staphylococcus
VENSQDP

SEQ ID NO: 1993410 - protein, 15 aa, Staphylococcus
VENTEDDIQSCQYHT

SEQ ID NO: 1993411 - protein, 7 aa, Staphylococcus
VENTEHT

SEQ ID NO: 1993412 - protein, 8 aa, Staphylococcus
VENTEKEL

SEQ ID NO: 1993413 - protein, 8 aa, Staphylococcus
VENTNEND

SEQ ID NO: 1993414 - protein, 8 aa, Staphylococcus
VENTPDSW

SEQ ID NO: 1993415 - protein, 6 aa, Staphylococcus
VENTRE

SEQ ID NO: 1993416 - protein, 10 aa, Staphylococcus
VENYNTPEEM

SEQ ID NO: 1993417 - protein, 9 aa, Staphylococcus
VEPAGASSM

SEQ ID NO: 1993418 - protein, 8 aa, Staphylococcus
VEPAGGTI

SEQ ID NO: 1993419 - protein, 5 aa, Staphylococcus
VEPAS

SEQ ID NO: 1993420 - protein, 6 aa, Staphylococcus
VEPASE

SEQ ID NO: 1993421 - protein, 5 aa, Staphylococcus
VEPDD

SEQ ID NO: 1993422 - protein, 12 aa, Staphylococcus
VEPDDSKYSNVN

SEQ ID NO: 1993423 - protein, 5 aa, Staphylococcus
VEPDL

SEQ ID NO: 1993424 - protein, 14 aa, Staphylococcus
VEPGKIYNNGQPED

SEQ ID NO: 1993425 - protein, 15 aa, Staphylococcus
VEPGKIYNSGTPENV

SEQ ID NO: 1993426 - protein, 6 aa, Staphylococcus
VEPGLT

SEQ ID NO: 1993427 - protein, 7 aa, Staphylococcus
VEPGNYT

SEQ ID NO: 1993428 - protein, 7 aa, Staphylococcus
VEPGTDA

SEQ ID NO: 1993429 - protein, 6 aa, Staphylococcus
VEPIEN

SEQ ID NO: 1993430 - protein, 5 aa, Staphylococcus
VEPKL

SEQ ID NO: 1993431 - protein, 8 aa, Staphylococcus
VEPKPQHY

SEQ ID NO: 1993432 - protein, 8 aa, Staphylococcus
VEPKVEKN

SEQ ID NO: 1993433 - protein, 11 aa, Staphylococcus
VEPLKAEASIA

SEQ ID NO: 1993434 - protein, 10 aa, Staphylococcus
VEPLKEEAAI

SEQ ID NO: 1993435 - protein, 13 aa, Staphylococcus
VEPLKEEAAIAKE

SEQ ID NO: 1993436 - protein, 5 aa, Staphylococcus
VEPLR

SEQ ID NO: 1993437 - protein, 6 aa, Staphylococcus
VEPLRE

SEQ ID NO: 1993438 - protein, 6 aa, Staphylococcus
VEPNDG

SEQ ID NO: 1993439 - protein, 9 aa, Staphylococcus
VEPPIATTN

SEQ ID NO: 1993440 - protein, 8 aa, Staphylococcus
VEPPYSAT

SEQ ID NO: 1993441 - protein, 9 aa, Staphylococcus
VEPSGASSM

SEQ ID NO: 1993442 - protein, 13 aa, Staphylococcus
VEPSLSGPKRPQD

SEQ ID NO: 1993443 - protein, 7 aa, Staphylococcus
VEPSNDV

SEQ ID NO: 1993444 - protein, 9 aa, Staphylococcus
VEPSNYEED

SEQ ID NO: 1993445 - protein, 7 aa, Staphylococcus
VEPTEAQ

SEQ ID NO: 1993446 - protein, 17 aa, Staphylococcus
VEPTKAKRKNKNLITKF

SEQ ID NO: 1993447 - protein, 11 aa, Staphylococcus
VEQAKASNPQI

SEQ ID NO: 1993448 - protein, 12 aa, Staphylococcus
VEQANSGHPGLP

SEQ ID NO: 1993449 - protein, 9 aa, Staphylococcus
VEQAQQKGV

SEQ ID NO: 1993450 - protein, 7 aa, Staphylococcus
VEQDRQK

SEQ ID NO: 1993451 - protein, 6 aa, Staphylococcus
VEQERP

SEQ ID NO: 1993452 - protein, 10 aa, Staphylococcus
VEQGLKDAME

SEQ ID NO: 1993453 - protein, 7 aa, Staphylococcus
VEQGTRE

SEQ ID NO: 1993454 - protein, 8 aa, Staphylococcus
VEQHPEKP

SEQ ID NO: 1993455 - protein, 9 aa, Staphylococcus
VEQIDTPEG

SEQ ID NO: 1993456 - protein, 15 aa, Staphylococcus
VEQIDTPEGFQEHPR

SEQ ID NO: 1993457 - protein, 21 aa, Staphylococcus
VEQLTNDGKLHGTVTSNVETY

SEQ ID NO: 1993458 - protein, 4 aa, Staphylococcus
VEQN

SEQ ID NO: 1993459 - protein, 11 aa, Staphylococcus
VEQNGQSNEVT

SEQ ID NO: 1993460 - protein, 8 aa, Staphylococcus
VEQNNVSQ

SEQ ID NO: 1993461 - protein, 6 aa, Staphylococcus
VEQNRR

SEQ ID NO: 1993462 - protein, 9 aa, Staphylococcus
VEQNSSYTR

SEQ ID NO: 1993463 - protein, 6 aa, Staphylococcus
VEQPEA

SEQ ID NO: 1993464 - protein, 5 aa, Staphylococcus
VEQQI

SEQ ID NO: 1993465 - protein, 10 aa, Staphylococcus
VEQSETDDED

SEQ ID NO: 1993466 - protein, 5 aa, Staphylococcus
VEQSL

SEQ ID NO: 1993467 - protein, 4 aa, Staphylococcus
VEQV

SEQ ID NO: 1993468 - protein, 5 aa, Staphylococcus
VERAC

SEQ ID NO: 1993469 - protein, 16 aa, Staphylococcus
VERAGTKAGNKGAEAA

SEQ ID NO: 1993470 - protein, 8 aa, Staphylococcus
VERATDEA

SEQ ID NO: 1993471 - protein, 9 aa, Staphylococcus
VERCDTKSQ

SEQ ID NO: 1993472 - protein, 7 aa, Staphylococcus
VERDGKT

SEQ ID NO: 1993473 - protein, 5 aa, Staphylococcus
VERDH

SEQ ID NO: 1993474 - protein, 6 aa, Staphylococcus
VERETN

SEQ ID NO: 1993475 - protein, 4 aa, Staphylococcus
VERL

SEQ ID NO: 1993476 - protein, 4 aa, Staphylococcus
VERN

SEQ ID NO: 1993477 - protein, 12 aa, Staphylococcus
VERPEIQETTAL

SEQ ID NO: 1993478 - protein, 5 aa, Staphylococcus
VERPR

SEQ ID NO: 1993479 - protein, 4 aa, Staphylococcus
VERR

SEQ ID NO: 1993480 - protein, 10 aa, Staphylococcus
VERSRKALGE

SEQ ID NO: 1993481 - protein, 7 aa, Staphylococcus
VERTHGG

SEQ ID NO: 1993482 - protein, 23 aa, Staphylococcus
VERTKTDRYQRKQSHKSSNSKLI

SEQ ID NO: 1993483 - protein, 4 aa, Staphylococcus
VERY

SEQ ID NO: 1993484 - protein, 11 aa, Staphylococcus
VESADEEEKIN

SEQ ID NO: 1993485 - protein, 5 aa, Staphylococcus
VESAE

SEQ ID NO: 1993486 - protein, 8 aa, Staphylococcus
VESAEAGE

SEQ ID NO: 1993487 - protein, 12 aa, Staphylococcus
VESDIGKEEQFK

SEQ ID NO: 1993488 - protein, 8 aa, Staphylococcus
VESDNGSL

SEQ ID NO: 1993489 - protein, 8 aa, Staphylococcus
VESDTPAI

SEQ ID NO: 1993490 - protein, 8 aa, Staphylococcus
VESEEDAK

SEQ ID NO: 1993491 - protein, 8 aa, Staphylococcus
VESEEPAI

SEQ ID NO: 1993492 - protein, 8 aa, Staphylococcus
VESEGGDI

SEQ ID NO: 1993493 - protein, 7 aa, Staphylococcus
VESENKR

SEQ ID NO: 1993494 - protein, 6 aa, Staphylococcus
VESERD

SEQ ID NO: 1993495 - protein, 9 aa, Staphylococcus
VESETPDQL

SEQ ID NO: 1993496 - protein, 10 aa, Staphylococcus
VESGADADIK

SEQ ID NO: 1993497 - protein, 11 aa, Staphylococcus
VESGEDADIKV

SEQ ID NO: 1993498 - protein, 9 aa, Staphylococcus
VESGTPQEI

SEQ ID NO: 1993499 - protein, 18 aa, Staphylococcus
VESGTSKEVLTSPQHPYT

SEQ ID NO: 1993500 - protein, 8 aa, Staphylococcus
VESKRAEE

SEQ ID NO: 1993501 - protein, 15 aa, Staphylococcus
VESKSYNDVSELPES

SEQ ID NO: 1993502 - protein, 4 aa, Staphylococcus
VESN

SEQ ID NO: 1993503 - protein, 15 aa, Staphylococcus
VESNNKSLDKVYNQT

SEQ ID NO: 1993504 - protein, 6 aa, Staphylococcus
VESQAG

SEQ ID NO: 1993505 - protein, 7 aa, Staphylococcus
VESQDSH

SEQ ID NO: 1993506 - protein, 7 aa, Staphylococcus
VESQDSV

SEQ ID NO: 1993507 - protein, 10 aa, Staphylococcus
VESQRSEGNI

SEQ ID NO: 1993508 - protein, 14 aa, Staphylococcus
VESQYGGEVPSDPD

SEQ ID NO: 1993509 - protein, 11 aa, Staphylococcus
VESRAKEAGYN

SEQ ID NO: 1993510 - protein, 18 aa, Staphylococcus
VESSGGKVIDEPGTYQGY

SEQ ID NO: 1993511 - protein, 11 aa, Staphylococcus
VESSNKNTREI

SEQ ID NO: 1993512 - protein, 7 aa, Staphylococcus
VESSQYD

SEQ ID NO: 1993513 - protein, 12 aa, Staphylococcus
VESSYGATWYDA

SEQ ID NO: 1993514 - protein, 8 aa, Staphylococcus
VESSYTGK

SEQ ID NO: 1993515 - protein, 13 aa, Staphylococcus
VESTKESKHTDYH

SEQ ID NO: 1993516 - protein, 4 aa, Staphylococcus
VETA

SEQ ID NO: 1993517 - protein, 11 aa, Staphylococcus
VETADTPSEIG

SEQ ID NO: 1993518 - protein, 11 aa, Staphylococcus
VETANTPSEIG

SEQ ID NO: 1993519 - protein, 6 aa, Staphylococcus
VETASF

SEQ ID NO: 1993520 - protein, 10 aa, Staphylococcus
VETDKGNVFS

SEQ ID NO: 1993521 - protein, 9 aa, Staphylococcus
VETDKTDIE

SEQ ID NO: 1993522 - protein, 5 aa, Staphylococcus
VETDN

SEQ ID NO: 1993523 - protein, 17 aa, Staphylococcus
VETDQSDDLVIFKKYIN

SEQ ID NO: 1993524 - protein, 19 aa, Staphylococcus
VETDQSYANQDNGHQVASD

SEQ ID NO: 1993525 - protein, 10 aa, Staphylococcus
VETDSGQIYE

SEQ ID NO: 1993526 - protein, 11 aa, Staphylococcus
VETEALRNGRQ

SEQ ID NO: 1993527 - protein, 6 aa, Staphylococcus
VETEDQ

SEQ ID NO: 1993528 - protein, 5 aa, Staphylococcus
VETEE

SEQ ID NO: 1993529 - protein, 9 aa, Staphylococcus
VETEKGREI

SEQ ID NO: 1993530 - protein, 9 aa, Staphylococcus
VETELGNAT

SEQ ID NO: 1993531 - protein, 9 aa, Staphylococcus
VETELQPSA

SEQ ID NO: 1993532 - protein, 6 aa, Staphylococcus
VETENK

SEQ ID NO: 1993533 - protein, 5 aa, Staphylococcus
VETER

SEQ ID NO: 1993534 - protein, 11 aa, Staphylococcus
VETETLRSGRQ

SEQ ID NO: 1993535 - protein, 6 aa, Staphylococcus
VETEYG

SEQ ID NO: 1993536 - protein, 4 aa, Staphylococcus
VETF

SEQ ID NO: 1993537 - protein, 6 aa, Staphylococcus
VETGGE

SEQ ID NO: 1993538 - protein, 9 aa, Staphylococcus
VETGKPEDI

SEQ ID NO: 1993539 - protein, 8 aa, Staphylococcus
VETGKPKG

SEQ ID NO: 1993540 - protein, 10 aa, Staphylococcus
VETGRASDIL

SEQ ID NO: 1993541 - protein, 13 aa, Staphylococcus
VETGSPKAKRMKK

SEQ ID NO: 1993542 - protein, 4 aa, Staphylococcus
VETH

SEQ ID NO: 1993543 - protein, 5 aa, Staphylococcus
VETIE

SEQ ID NO: 1993544 - protein, 9 aa, Staphylococcus
VETKDTKGY

SEQ ID NO: 1993545 - protein, 28 aa, Staphylococcus
VETKEENEKDQKVVPKKLTKKEREKTIA

SEQ ID NO: 1993546 - protein, 7 aa, Staphylococcus
VETNNGR

SEQ ID NO: 1993547 - protein, 7 aa, Staphylococcus
VETNQQT

SEQ ID NO: 1993548 - protein, 7 aa, Staphylococcus
VETNQRR

SEQ ID NO: 1993549 - protein, 5 aa, Staphylococcus
VETNY

SEQ ID NO: 1993550 - protein, 5 aa, Staphylococcus
VETPN

SEQ ID NO: 1993551 - protein, 11 aa, Staphylococcus
VETPNAHTAQE

SEQ ID NO: 1993552 - protein, 9 aa, Staphylococcus
VETPNSLKN

SEQ ID NO: 1993553 - protein, 6 aa, Staphylococcus
VETQIE

SEQ ID NO: 1993554 - protein, 11 aa, Staphylococcus
VETQRSNDNIE

SEQ ID NO: 1993555 - protein, 12 aa, Staphylococcus
VETQRSNDNIEE

SEQ ID NO: 1993556 - protein, 12 aa, Staphylococcus
VETQRSNDNLES

SEQ ID NO: 1993557 - protein, 6 aa, Staphylococcus
VETRNH

SEQ ID NO: 1993558 - protein, 11 aa, Staphylococcus
VETRTSAGSAF

SEQ ID NO: 1993559 - protein, 12 aa, Staphylococcus
VETSHGKTWYDA

SEQ ID NO: 1993560 - protein, 6 aa, Staphylococcus
VETSTE

SEQ ID NO: 1993561 - protein, 13 aa, Staphylococcus
VETSTLGQDSEED

SEQ ID NO: 1993562 - protein, 13 aa, Staphylococcus
VETSTLGQNSEED

SEQ ID NO: 1993563 - protein, 12 aa, Staphylococcus
VETTEARAKELR

SEQ ID NO: 1993564 - protein, 7 aa, Staphylococcus
VETTETY

SEQ ID NO: 1993565 - protein, 9 aa, Staphylococcus
VETTTNQSI

SEQ ID NO: 1993566 - protein, 18 aa, Staphylococcus
VETVDRSAQTVTTSKGVE

SEQ ID NO: 1993567 - protein, 5 aa, Staphylococcus
VETYG

SEQ ID NO: 1993568 - protein, 10 aa, Staphylococcus
VEVENGTEAL

SEQ ID NO: 1993569 - protein, 15 aa, Staphylococcus
VEVEVPDDSTVIEPQ

SEQ ID NO: 1993570 - protein, 6 aa, Staphylococcus
VEVNGQ

SEQ ID NO: 1993571 - protein, 6 aa, Staphylococcus
VEVNQT

SEQ ID NO: 1993572 - protein, 10 aa, Staphylococcus
VEVPDDEDID

SEQ ID NO: 1993573 - protein, 13 aa, Staphylococcus
VEVPDNKKLSIEQ

SEQ ID NO: 1993574 - protein, 8 aa, Staphylococcus
VEVPDTVE

SEQ ID NO: 1993575 - protein, 13 aa, Staphylococcus
VEVPNAKAIRSTM

SEQ ID NO: 1993576 - protein, 12 aa, Staphylococcus
VEVSQSVSKENF

SEQ ID NO: 1993577 - protein, 11 aa, Staphylococcus
VEYEDGSSELL

SEQ ID NO: 1993578 - protein, 12 aa, Staphylococcus
VEYHTPKTVEIS

SEQ ID NO: 1993579 - protein, 9 aa, Staphylococcus
VEYNKEEGA

SEQ ID NO: 1993580 - protein, 15 aa, Staphylococcus
VEYTKGSLSEVQEEM

SEQ ID NO: 1993581 - protein, 11 aa, Staphylococcus
VFAEPASNASI

SEQ ID NO: 1993582 - protein, 16 aa, Staphylococcus
VFDGTKPINFDDNREW

SEQ ID NO: 1993583 - protein, 9 aa, Staphylococcus
VFENPQHDV

SEQ ID NO: 1993584 - protein, 10 aa, Staphylococcus
VFNSQADDQL

SEQ ID NO: 1993585 - protein, 14 aa, Staphylococcus
VFPKEGPLGKPNPF

SEQ ID NO: 1993586 - protein, 4 aa, Staphylococcus
VFST

SEQ ID NO: 1993587 - protein, 9 aa, Staphylococcus
VGAAATGLR

SEQ ID NO: 1993588 - protein, 9 aa, Staphylococcus
VGAAATGMR

SEQ ID NO: 1993589 - protein, 7 aa, Staphylococcus
VGAADIP

SEQ ID NO: 1993590 - protein, 6 aa, Staphylococcus
VGAETQ

SEQ ID NO: 1993591 - protein, 10 aa, Staphylococcus
VGAGADKGIN

SEQ ID NO: 1993592 - protein, 5 aa, Staphylococcus
VGAGT

SEQ ID NO: 1993593 - protein, 8 aa, Staphylococcus
VGAHGEVT

SEQ ID NO: 1993594 - protein, 6 aa, Staphylococcus
VGANNQ

SEQ ID NO: 1993595 - protein, 4 aa, Staphylococcus
VGAP

SEQ ID NO: 1993596 - protein, 26 aa, Staphylococcus
VGAPTKRNAPSISTNNASWGGPNRDS

SEQ ID NO: 1993597 - protein, 6 aa, Staphylococcus
VGAPTQ

SEQ ID NO: 1993598 - protein, 9 aa, Staphylococcus
VGAQHPKYV

SEQ ID NO: 1993599 - protein, 16 aa, Staphylococcus
VGAQHPKYVQRPSADQ

SEQ ID NO: 1993600 - protein, 14 aa, Staphylococcus
VGAQNPAYVQRPTV

SEQ ID NO: 1993601 - protein, 12 aa, Staphylococcus
VGAQNPKYVQRP

SEQ ID NO: 1993602 - protein, 16 aa, Staphylococcus
VGAQNPKYVQRPSASK

SEQ ID NO: 1993603 - protein, 14 aa, Staphylococcus
VGAQNPKYVQRPTV

SEQ ID NO: 1993604 - protein, 15 aa, Staphylococcus
VGAQNPQYVQRPSVD

SEQ ID NO: 1993605 - protein, 10 aa, Staphylococcus
VGASGIGEYH

SEQ ID NO: 1993606 - protein, 9 aa, Staphylococcus
VGASGSKGI

SEQ ID NO: 1993607 - protein, 4 aa, Staphylococcus
VGAT

SEQ ID NO: 1993608 - protein, 4 aa, Staphylococcus
VGDD

SEQ ID NO: 1993609 - protein, 5 aa, Staphylococcus
VGDDA

SEQ ID NO: 1993610 - protein, 9 aa, Staphylococcus
VGDDGIPNT

SEQ ID NO: 1993611 - protein, 16 aa, Staphylococcus
VGDDSAVIQRSTPYAS

SEQ ID NO: 1993612 - protein, 6 aa, Staphylococcus
VGDDTL

SEQ ID NO: 1993613 - protein, 16 aa, Staphylococcus
VGDDVGEKKHHGGPEK

SEQ ID NO: 1993614 - protein, 7 aa, Staphylococcus
VGDEEAS

SEQ ID NO: 1993615 - protein, 14 aa, Staphylococcus
VGDELTNELGRSPS

SEQ ID NO: 1993616 - protein, 6 aa, Staphylococcus
VGDEVK

SEQ ID NO: 1993617 - protein, 7 aa, Staphylococcus
VGDGGIP

SEQ ID NO: 1993618 - protein, 8 aa, Staphylococcus
VGDGLKEE

SEQ ID NO: 1993619 - protein, 5 aa, Staphylococcus
VGDGS

SEQ ID NO: 1993620 - protein, 37 aa, Staphylococcus
VGDKESKDKSDVKYSEVPEVEGQETQKAQDKVNSKSL

SEQ ID NO: 1993621 - protein, 10 aa, Staphylococcus
VGDKTKVGPF

SEQ ID NO: 1993622 - protein, 5 aa, Staphylococcus
VGDKV

SEQ ID NO: 1993623 - protein, 9 aa, Staphylococcus
VGDKVKSGD

SEQ ID NO: 1993624 - protein, 10 aa, Staphylococcus
VGDKVNAGES

SEQ ID NO: 1993625 - protein, 8 aa, Staphylococcus
VGDKVNVG

SEQ ID NO: 1993626 - protein, 12 aa, Staphylococcus
VGDKVTHKSWGE

SEQ ID NO: 1993627 - protein, 10 aa, Staphylococcus
VGDPLDDKTD

SEQ ID NO: 1993628 - protein, 12 aa, Staphylococcus
VGDPLDDNTDYG

SEQ ID NO: 1993629 - protein, 14 aa, Staphylococcus
VGDPLDKNTQVGPI

SEQ ID NO: 1993630 - protein, 14 aa, Staphylococcus
VGDPREDGTQVGPI

SEQ ID NO: 1993631 - protein, 20 aa, Staphylococcus
VGDPTDENTQMGSQTGQAQI

SEQ ID NO: 1993632 - protein, 12 aa, Staphylococcus
VGDPYDENTDYG

SEQ ID NO: 1993633 - protein, 6 aa, Staphylococcus
VGDQTF

SEQ ID NO: 1993634 - protein, 10 aa, Staphylococcus
VGDQTFTQKS

SEQ ID NO: 1993635 - protein, 9 aa, Staphylococcus
VGDQVKEGD

SEQ ID NO: 1993636 - protein, 7 aa, Staphylococcus
VGDREHQ

SEQ ID NO: 1993637 - protein, 9 aa, Staphylococcus
VGDRSDDKH

SEQ ID NO: 1993638 - protein, 7 aa, Staphylococcus
VGDSGHR

SEQ ID NO: 1993639 - protein, 5 aa, Staphylococcus
VGDSR

SEQ ID NO: 1993640 - protein, 9 aa, Staphylococcus
VGDSVNKGE

SEQ ID NO: 1993641 - protein, 6 aa, Staphylococcus
VGDTHR

SEQ ID NO: 1993642 - protein, 10 aa, Staphylococcus
VGDTVKEGEP

SEQ ID NO: 1993643 - protein, 5 aa, Staphylococcus
VGEAD

SEQ ID NO: 1993644 - protein, 19 aa, Staphylococcus
VGEAGGKLHTGRSRNDQVA

SEQ ID NO: 1993645 - protein, 5 aa, Staphylococcus
VGEAK

SEQ ID NO: 1993646 - protein, 7 aa, Staphylococcus
VGEDDEI

SEQ ID NO: 1993647 - protein, 12 aa, Staphylococcus
VGEDKESKEESA

SEQ ID NO: 1993648 - protein, 13 aa, Staphylococcus
VGEDKKNKKAPYK

SEQ ID NO: 1993649 - protein, 13 aa, Staphylococcus
VGEDKKNKRPPYK

SEQ ID NO: 1993650 - protein, 8 aa, Staphylococcus
VGEDNPEH

SEQ ID NO: 1993651 - protein, 8 aa, Staphylococcus
VGEDQKQH

SEQ ID NO: 1993652 - protein, 5 aa, Staphylococcus
VGEDV

SEQ ID NO: 1993653 - protein, 10 aa, Staphylococcus
VGEEQAENFG

SEQ ID NO: 1993654 - protein, 10 aa, Staphylococcus
VGEGERNQTL

SEQ ID NO: 1993655 - protein, 12 aa, Staphylococcus
VGEGESGKDAIA

SEQ ID NO: 1993656 - protein, 17 aa, Staphylococcus
VGEGKSGKDAIEKAHEL

SEQ ID NO: 1993657 - protein, 8 aa, Staphylococcus
VGEGLSPM

SEQ ID NO: 1993658 - protein, 69 aa, Staphylococcus
VGEGSGNASSSKEESSDQSQSANNDEATKELAQPTESQSNNEETQSNPNNQRVNATPSARRHARENGVD

SEQ ID NO: 1993659 - protein, 18 aa, Staphylococcus
VGEGSSGKEAIEKAHTLN

SEQ ID NO: 1993660 - protein, 12 aa, Staphylococcus
VGEGSSNQGDFH

SEQ ID NO: 1993661 - protein, 13 aa, Staphylococcus
VGEITSEAIDSTL

SEQ ID NO: 1993662 - protein, 7 aa, Staphylococcus
VGEKEGR

SEQ ID NO: 1993663 - protein, 6 aa, Staphylococcus
VGENDT

SEQ ID NO: 1993664 - protein, 5 aa, Staphylococcus
VGENR

SEQ ID NO: 1993665 - protein, 9 aa, Staphylococcus
VGENSDEVR

SEQ ID NO: 1993666 - protein, 9 aa, Staphylococcus
VGENSSPIR

SEQ ID NO: 1993667 - protein, 9 aa, Staphylococcus
VGENSSTVR

SEQ ID NO: 1993668 - protein, 8 aa, Staphylococcus
VGEPVTAS

SEQ ID NO: 1993669 - protein, 6 aa, Staphylococcus
VGEQHR

SEQ ID NO: 1993670 - protein, 8 aa, Staphylococcus
VGEQITSN

SEQ ID NO: 1993671 - protein, 8 aa, Staphylococcus
VGEQLSGS

SEQ ID NO: 1993672 - protein, 5 aa, Staphylococcus
VGERL

SEQ ID NO: 1993673 - protein, 16 aa, Staphylococcus
VGERLNAEVGTKAYGS

SEQ ID NO: 1993674 - protein, 16 aa, Staphylococcus
VGERLNAQVGTKAYGS

SEQ ID NO: 1993675 - protein, 16 aa, Staphylococcus
VGERLNATVGTKAYGS

SEQ ID NO: 1993676 - protein, 12 aa, Staphylococcus
VGESGAQNQIAS

SEQ ID NO: 1993677 - protein, 11 aa, Staphylococcus
VGESTTPSITE

SEQ ID NO: 1993678 - protein, 10 aa, Staphylococcus
VGETDKTGTV

SEQ ID NO: 1993679 - protein, 6 aa, Staphylococcus
VGETEI

SEQ ID NO: 1993680 - protein, 11 aa, Staphylococcus
VGETKSDDIPA

SEQ ID NO: 1993681 - protein, 11 aa, Staphylococcus
VGETQDDHGNR

SEQ ID NO: 1993682 - protein, 6 aa, Staphylococcus
VGETVS

SEQ ID NO: 1993683 - protein, 13 aa, Staphylococcus
VGFKEDEYKATWL

SEQ ID NO: 1993684 - protein, 21 aa, Staphylococcus
VGFSSKTTHYQTKSHEQAKHD

SEQ ID NO: 1993685 - protein, 8 aa, Staphylococcus
VGGASGPL

SEQ ID NO: 1993686 - protein, 7 aa, Staphylococcus
VGGAYDT

SEQ ID NO: 1993687 - protein, 8 aa, Staphylococcus
VGGAYSTL

SEQ ID NO: 1993688 - protein, 11 aa, Staphylococcus
VGGDSTNSLTI

SEQ ID NO: 1993689 - protein, 11 aa, Staphylococcus
VGGGNSGAEAA

SEQ ID NO: 1993690 - protein, 9 aa, Staphylococcus
VGGGPGGVT

SEQ ID NO: 1993691 - protein, 6 aa, Staphylococcus
VGGGTK

SEQ ID NO: 1993692 - protein, 10 aa, Staphylococcus
VGGGVGPTAV

SEQ ID NO: 1993693 - protein, 8 aa, Staphylococcus
VGGKDERL

SEQ ID NO: 1993694 - protein, 23 aa, Staphylococcus
VGGKGGGRPDMAQGGGSEPSKIT

SEQ ID NO: 1993695 - protein, 24 aa, Staphylococcus
VGGKGGGRPDMAQGGGTEPKNITE

SEQ ID NO: 1993696 - protein, 23 aa, Staphylococcus
VGGKGGGRPDMAQGGGTQPENIS

SEQ ID NO: 1993697 - protein, 24 aa, Staphylococcus
VGGKGGGRPDMAQGGGTQPENISE

SEQ ID NO: 1993698 - protein, 24 aa, Staphylococcus
VGGKGGGRPDMAQGGGTQPENITE

SEQ ID NO: 1993699 - protein, 6 aa, Staphylococcus
VGGKGS

SEQ ID NO: 1993700 - protein, 9 aa, Staphylococcus
VGGKGSNLL

SEQ ID NO: 1993701 - protein, 9 aa, Staphylococcus
VGGKGTNLL

SEQ ID NO: 1993702 - protein, 13 aa, Staphylococcus
VGGKKYNTKPRGL

SEQ ID NO: 1993703 - protein, 5 aa, Staphylococcus
VGGKQ

SEQ ID NO: 1993704 - protein, 6 aa, Staphylococcus
VGGKQN

SEQ ID NO: 1993705 - protein, 7 aa, Staphylococcus
VGGPEDM

SEQ ID NO: 1993706 - protein, 10 aa, Staphylococcus
VGGPYANGGM

SEQ ID NO: 1993707 - protein, 14 aa, Staphylococcus
VGGRKGHVNTDDNA

SEQ ID NO: 1993708 - protein, 14 aa, Staphylococcus
VGGRKGHVQTDDKA

SEQ ID NO: 1993709 - protein, 14 aa, Staphylococcus
VGGRKGHVQTDDNA

SEQ ID NO: 1993710 - protein, 6 aa, Staphylococcus
VGGSHV

SEQ ID NO: 1993711 - protein, 16 aa, Staphylococcus
VGGSIDETIEALNKTF

SEQ ID NO: 1993712 - protein, 5 aa, Staphylococcus
VGGTT

SEQ ID NO: 1993713 - protein, 11 aa, Staphylococcus
VGHTGTLDPEV

SEQ ID NO: 1993714 - protein, 7 aa, Staphylococcus
VGHYSEK

SEQ ID NO: 1993715 - protein, 19 aa, Staphylococcus
VGIANNQTGLYPQDSPGGW

SEQ ID NO: 1993716 - protein, 13 aa, Staphylococcus
VGIGGDAGGIDDL

SEQ ID NO: 1993717 - protein, 6 aa, Staphylococcus
VGKDET

SEQ ID NO: 1993718 - protein, 6 aa, Staphylococcus
VGKDGL

SEQ ID NO: 1993719 - protein, 6 aa, Staphylococcus
VGKDTE

SEQ ID NO: 1993720 - protein, 7 aa, Staphylococcus
VGKEEMA

SEQ ID NO: 1993721 - protein, 7 aa, Staphylococcus
VGKEGNA

SEQ ID NO: 1993722 - protein, 9 aa, Staphylococcus
VGKGSKDAR

SEQ ID NO: 1993723 - protein, 5 aa, Staphylococcus
VGKIS

SEQ ID NO: 1993724 - protein, 7 aa, Staphylococcus
VGKKGGV

SEQ ID NO: 1993725 - protein, 4 aa, Staphylococcus
VGKN

SEQ ID NO: 1993726 - protein, 9 aa, Staphylococcus
VGKPEGLEK

SEQ ID NO: 1993727 - protein, 7 aa, Staphylococcus
VGKPFSE

SEQ ID NO: 1993728 - protein, 4 aa, Staphylococcus
VGKQ

SEQ ID NO: 1993729 - protein, 6 aa, Staphylococcus
VGKQTD

SEQ ID NO: 1993730 - protein, 22 aa, Staphylococcus
VGKTANEAIQEVNRSSFKSTAF

SEQ ID NO: 1993731 - protein, 11 aa, Staphylococcus
VGKTPHSSHQK

SEQ ID NO: 1993732 - protein, 11 aa, Staphylococcus
VGKTVGDSPKV

SEQ ID NO: 1993733 - protein, 12 aa, Staphylococcus
VGKVSSTRFNEN

SEQ ID NO: 1993734 - protein, 5 aa, Staphylococcus
VGLDE

SEQ ID NO: 1993735 - protein, 5 aa, Staphylococcus
VGLDS

SEQ ID NO: 1993736 - protein, 7 aa, Staphylococcus
VGLHPED

SEQ ID NO: 1993737 - protein, 4 aa, Staphylococcus
VGLK

SEQ ID NO: 1993738 - protein, 13 aa, Staphylococcus
VGLSEQQAKDAGY

SEQ ID NO: 1993739 - protein, 13 aa, Staphylococcus
VGLSGRSNVGKST

SEQ ID NO: 1993740 - protein, 18 aa, Staphylococcus
VGLTGKDNINVRSTTIDR

SEQ ID NO: 1993741 - protein, 21 aa, Staphylococcus
VGLTGKENLLPSKLSGGQQQR

SEQ ID NO: 1993742 - protein, 10 aa, Staphylococcus
VGNADGEDPF

SEQ ID NO: 1993743 - protein, 6 aa, Staphylococcus
VGNADV

SEQ ID NO: 1993744 - protein, 5 aa, Staphylococcus
VGNEL

SEQ ID NO: 1993745 - protein, 10 aa, Staphylococcus
VGNEQKTAAI

SEQ ID NO: 1993746 - protein, 10 aa, Staphylococcus
VGNESKTAAI

SEQ ID NO: 1993747 - protein, 11 aa, Staphylococcus
VGNGEGEAAAY

SEQ ID NO: 1993748 - protein, 9 aa, Staphylococcus
VGNGLDKGV

SEQ ID NO: 1993749 - protein, 7 aa, Staphylococcus
VGNGNEA

SEQ ID NO: 1993750 - protein, 7 aa, Staphylococcus
VGNKGTV

SEQ ID NO: 1993751 - protein, 10 aa, Staphylococcus
VGNPDERFDE

SEQ ID NO: 1993752 - protein, 14 aa, Staphylococcus
VGNPREEGTQVGPI

SEQ ID NO: 1993753 - protein, 10 aa, Staphylococcus
VGNPSERFKE

SEQ ID NO: 1993754 - protein, 8 aa, Staphylococcus
VGNPYERF

SEQ ID NO: 1993755 - protein, 10 aa, Staphylococcus
VGNQARELQN

SEQ ID NO: 1993756 - protein, 29 aa, Staphylococcus
VGNRPLNDGSTTWDPSKKYIKESVKSSLK

SEQ ID NO: 1993757 - protein, 22 aa, Staphylococcus
VGNRPTEDGGTTWDPSKKYIKE

SEQ ID NO: 1993758 - protein, 6 aa, Staphylococcus
VGNYSD

SEQ ID NO: 1993759 - protein, 7 aa, Staphylococcus
VGPDVTK

SEQ ID NO: 1993760 - protein, 11 aa, Staphylococcus
VGPEKVKAKPF

SEQ ID NO: 1993761 - protein, 5 aa, Staphylococcus
VGPGN

SEQ ID NO: 1993762 - protein, 10 aa, Staphylococcus
VGPGNQKDVQ

SEQ ID NO: 1993763 - protein, 11 aa, Staphylococcus
VGPGRGSAAGS

SEQ ID NO: 1993764 - protein, 12 aa, Staphylococcus
VGPKLETDNVGA

SEQ ID NO: 1993765 - protein, 15 aa, Staphylococcus
VGPKQTVQKLSGGMK

SEQ ID NO: 1993766 - protein, 13 aa, Staphylococcus
VGPNGSGKSNVTD

SEQ ID NO: 1993767 - protein, 7 aa, Staphylococcus
VGPPGKI

SEQ ID NO: 1993768 - protein, 7 aa, Staphylococcus
VGPPGKV

SEQ ID NO: 1993769 - protein, 8 aa, Staphylococcus
VGPPTNQF

SEQ ID NO: 1993770 - protein, 10 aa, Staphylococcus
VGPSGSGKST

SEQ ID NO: 1993771 - protein, 12 aa, Staphylococcus
VGPSKDIPAPDV

SEQ ID NO: 1993772 - protein, 8 aa, Staphylococcus
VGPSPRNS

SEQ ID NO: 1993773 - protein, 12 aa, Staphylococcus
VGPTKDIPAPDV

SEQ ID NO: 1993774 - protein, 5 aa, Staphylococcus
VGQDD

SEQ ID NO: 1993775 - protein, 9 aa, Staphylococcus
VGQDDEDVR

SEQ ID NO: 1993776 - protein, 10 aa, Staphylococcus
VGQDDENVKS

SEQ ID NO: 1993777 - protein, 15 aa, Staphylococcus
VGQFNEDYGREEIQS

SEQ ID NO: 1993778 - protein, 4 aa, Staphylococcus
VGQG

SEQ ID NO: 1993779 - protein, 6 aa, Staphylococcus
VGQGDT

SEQ ID NO: 1993780 - protein, 11 aa, Staphylococcus
VGQGPEPEDVE

SEQ ID NO: 1993781 - protein, 13 aa, Staphylococcus
VGQGTAIYIEIPL

SEQ ID NO: 1993782 - protein, 7 aa, Staphylococcus
VGQPESS

SEQ ID NO: 1993783 - protein, 8 aa, Staphylococcus
VGQPGDTI

SEQ ID NO: 1993784 - protein, 9 aa, Staphylococcus
VGQPTERFE

SEQ ID NO: 1993785 - protein, 17 aa, Staphylococcus
VGQQTAKEFEEETGNKA

SEQ ID NO: 1993786 - protein, 4 aa, Staphylococcus
VGQR

SEQ ID NO: 1993787 - protein, 10 aa, Staphylococcus
VGQSSDEIKY

SEQ ID NO: 1993788 - protein, 11 aa, Staphylococcus
VGQTEDDHGNR

SEQ ID NO: 1993789 - protein, 19 aa, Staphylococcus
VGQTIENGEEADIKTGNAL

SEQ ID NO: 1993790 - protein, 5 aa, Staphylococcus
VGQTK

SEQ ID NO: 1993791 - protein, 12 aa, Staphylococcus
VGQTQDNEGNRG

SEQ ID NO: 1993792 - protein, 5 aa, Staphylococcus
VGRAE

SEQ ID NO: 1993793 - protein, 6 aa, Staphylococcus
VGRATG

SEQ ID NO: 1993794 - protein, 5 aa, Staphylococcus
VGRDI

SEQ ID NO: 1993795 - protein, 5 aa, Staphylococcus
VGREC

SEQ ID NO: 1993796 - protein, 26 aa, Staphylococcus
VGRGLPAELRETGLGGLAGTPTGEAI

SEQ ID NO: 1993797 - protein, 9 aa, Staphylococcus
VGRKAHAPD

SEQ ID NO: 1993798 - protein, 11 aa, Staphylococcus
VGRKKQAPNGN

SEQ ID NO: 1993799 - protein, 19 aa, Staphylococcus
VGRNGIKATFKGKENGPTI

SEQ ID NO: 1993800 - protein, 19 aa, Staphylococcus
VGRNGIKATFKGSENGPTI

SEQ ID NO: 1993801 - protein, 6 aa, Staphylococcus
VGRNKK

SEQ ID NO: 1993802 - protein, 5 aa, Staphylococcus
VGRPK

SEQ ID NO: 1993803 - protein, 4 aa, Staphylococcus
VGRQ

SEQ ID NO: 1993804 - protein, 5 aa, Staphylococcus
VGRSC

SEQ ID NO: 1993805 - protein, 9 aa, Staphylococcus
VGSAATGLR

SEQ ID NO: 1993806 - protein, 7 aa, Staphylococcus
VGSAGTD

SEQ ID NO: 1993807 - protein, 6 aa, Staphylococcus
VGSANM

SEQ ID NO: 1993808 - protein, 7 aa, Staphylococcus
VGSDDTT

SEQ ID NO: 1993809 - protein, 5 aa, Staphylococcus
VGSDH

SEQ ID NO: 1993810 - protein, 9 aa, Staphylococcus
VGSEEFENQ

SEQ ID NO: 1993811 - protein, 6 aa, Staphylococcus
VGSETA

SEQ ID NO: 1993812 - protein, 5 aa, Staphylococcus
VGSEV

SEQ ID NO: 1993813 - protein, 16 aa, Staphylococcus
VGSFEEQQAAASSGTG

SEQ ID NO: 1993814 - protein, 4 aa, Staphylococcus
VGSG

SEQ ID NO: 1993815 - protein, 8 aa, Staphylococcus
VGSGGTFT

SEQ ID NO: 1993816 - protein, 8 aa, Staphylococcus
VGSGGTYA

SEQ ID NO: 1993817 - protein, 21 aa, Staphylococcus
VGSGKSGQEIYNDNFYGGIFR

SEQ ID NO: 1993818 - protein, 10 aa, Staphylococcus
VGSGKTGQEV

SEQ ID NO: 1993819 - protein, 7 aa, Staphylococcus
VGSGQPV

SEQ ID NO: 1993820 - protein, 6 aa, Staphylococcus
VGSHTN

SEQ ID NO: 1993821 - protein, 8 aa, Staphylococcus
VGSHTTAL

SEQ ID NO: 1993822 - protein, 6 aa, Staphylococcus
VGSKEG

SEQ ID NO: 1993823 - protein, 9 aa, Staphylococcus
VGSKEGTTA

SEQ ID NO: 1993824 - protein, 8 aa, Staphylococcus
VGSKGARV

SEQ ID NO: 1993825 - protein, 9 aa, Staphylococcus
VGSKGTVYG

SEQ ID NO: 1993826 - protein, 17 aa, Staphylococcus
VGSKKDETQSAQYSKVP

SEQ ID NO: 1993827 - protein, 9 aa, Staphylococcus
VGSKKVGRA

SEQ ID NO: 1993828 - protein, 7 aa, Staphylococcus
VGSKKVN

SEQ ID NO: 1993829 - protein, 9 aa, Staphylococcus
VGSKPYDWN

SEQ ID NO: 1993830 - protein, 5 aa, Staphylococcus
VGSKS

SEQ ID NO: 1993831 - protein, 5 aa, Staphylococcus
VGSNV

SEQ ID NO: 1993832 - protein, 6 aa, Staphylococcus
VGSNVN

SEQ ID NO: 1993833 - protein, 5 aa, Staphylococcus
VGSQV

SEQ ID NO: 1993834 - protein, 12 aa, Staphylococcus
VGSSEQIKANHR

SEQ ID NO: 1993835 - protein, 11 aa, Staphylococcus
VGSSGNGKEAY

SEQ ID NO: 1993836 - protein, 7 aa, Staphylococcus
VGSSIEE

SEQ ID NO: 1993837 - protein, 36 aa, Staphylococcus
VGSSKDKTNKAKYSKVPNVEGDATQDAKSKLQDKSL

SEQ ID NO: 1993838 - protein, 7 aa, Staphylococcus
VGSSVNN

SEQ ID NO: 1993839 - protein, 4 aa, Staphylococcus
VGST

SEQ ID NO: 1993840 - protein, 9 aa, Staphylococcus
VGSTDKTGT

SEQ ID NO: 1993841 - protein, 9 aa, Staphylococcus
VGSTDNVDS

SEQ ID NO: 1993842 - protein, 11 aa, Staphylococcus
VGSTEQIRSNH

SEQ ID NO: 1993843 - protein, 7 aa, Staphylococcus
VGSTGNL

SEQ ID NO: 1993844 - protein, 5 aa, Staphylococcus
VGTDK

SEQ ID NO: 1993845 - protein, 12 aa, Staphylococcus
VGTFSSNHDRAT

SEQ ID NO: 1993846 - protein, 8 aa, Staphylococcus
VGTGASDI

SEQ ID NO: 1993847 - protein, 12 aa, Staphylococcus
VGTGGTLSGAGK

SEQ ID NO: 1993848 - protein, 13 aa, Staphylococcus
VGTGGTLSGAGKV

SEQ ID NO: 1993849 - protein, 10 aa, Staphylococcus
VGTGGTLTGV

SEQ ID NO: 1993850 - protein, 6 aa, Staphylococcus
VGTGGY

SEQ ID NO: 1993851 - protein, 9 aa, Staphylococcus
VGTGSDDAI

SEQ ID NO: 1993852 - protein, 10 aa, Staphylococcus
VGTGSQKINL

SEQ ID NO: 1993853 - protein, 7 aa, Staphylococcus
VGTGTSL

SEQ ID NO: 1993854 - protein, 10 aa, Staphylococcus
VGTGVGPTSV

SEQ ID NO: 1993855 - protein, 4 aa, Staphylococcus
VGTK

SEQ ID NO: 1993856 - protein, 10 aa, Staphylococcus
VGTKLTQQKA

SEQ ID NO: 1993857 - protein, 5 aa, Staphylococcus
VGTLE

SEQ ID NO: 1993858 - protein, 24 aa, Staphylococcus
VGTPEGVRELENAGADATKVGIGP

SEQ ID NO: 1993859 - protein, 25 aa, Staphylococcus
VGTPEGVRELENAGADATKVGIGPG

SEQ ID NO: 1993860 - protein, 8 aa, Staphylococcus
VGTPEQVA

SEQ ID NO: 1993861 - protein, 6 aa, Staphylococcus
VGTQTM

SEQ ID NO: 1993862 - protein, 12 aa, Staphylococcus
VGTRLNQGQASR

SEQ ID NO: 1993863 - protein, 14 aa, Staphylococcus
VGTRNEVKQSLKKG

SEQ ID NO: 1993864 - protein, 7 aa, Staphylococcus
VGTRSEV

SEQ ID NO: 1993865 - protein, 6 aa, Staphylococcus
VGTRTE

SEQ ID NO: 1993866 - protein, 7 aa, Staphylococcus
VGTRTEV

SEQ ID NO: 1993867 - protein, 19 aa, Staphylococcus
VGTRTEVKQRLKKKQVTID

SEQ ID NO: 1993868 - protein, 6 aa, Staphylococcus
VGTSKI

SEQ ID NO: 1993869 - protein, 5 aa, Staphylococcus
VGTSP

SEQ ID NO: 1993870 - protein, 7 aa, Staphylococcus
VGTTLDE

SEQ ID NO: 1993871 - protein, 19 aa, Staphylococcus
VGTYASTDKYGEKTQGGYS

SEQ ID NO: 1993872 - protein, 6 aa, Staphylococcus
VGVDPK

SEQ ID NO: 1993873 - protein, 11 aa, Staphylococcus
VGVGKSSLTRA

SEQ ID NO: 1993874 - protein, 11 aa, Staphylococcus
VGVGKSTLTQA

SEQ ID NO: 1993875 - protein, 11 aa, Staphylococcus
VGVGKSTLTRA

SEQ ID NO: 1993876 - protein, 14 aa, Staphylococcus
VGVGTTVTHAPTQM

SEQ ID NO: 1993877 - protein, 24 aa, Staphylococcus
VGVKSKQKLKGDYSQSGISEETAQ

SEQ ID NO: 1993878 - protein, 11 aa, Staphylococcus
VGYEIQTPNSY

SEQ ID NO: 1993879 - protein, 7 aa, Staphylococcus
VGYGTKA

SEQ ID NO: 1993880 - protein, 18 aa, Staphylococcus
VGYKSISENIDTSNASGE

SEQ ID NO: 1993881 - protein, 8 aa, Staphylococcus
VGYNPKTL

SEQ ID NO: 1993882 - protein, 17 aa, Staphylococcus
VGYPKRWEDQEQYKGGW

SEQ ID NO: 1993883 - protein, 7 aa, Staphylococcus
VGYQPTL

SEQ ID NO: 1993884 - protein, 13 aa, Staphylococcus
VGYSRTGKKGGPF

SEQ ID NO: 1993885 - protein, 16 aa, Staphylococcus
VHDEKAGAMEDDPFYQ

SEQ ID NO: 1993886 - protein, 4 aa, Staphylococcus
VHDY

SEQ ID NO: 1993887 - protein, 14 aa, Staphylococcus
VHEAASAENEKDLY

SEQ ID NO: 1993888 - protein, 13 aa, Staphylococcus
VHEAASAENEQAL

SEQ ID NO: 1993889 - protein, 14 aa, Staphylococcus
VHEAASAENEQDLY

SEQ ID NO: 1993890 - protein, 5 aa, Staphylococcus
VHEQG

SEQ ID NO: 1993891 - protein, 7 aa, Staphylococcus
VHGETGM

SEQ ID NO: 1993892 - protein, 33 aa, Staphylococcus
VHGGATLNQSSALEPNLADKRSTNLREKQEIGR

SEQ ID NO: 1993893 - protein, 8 aa, Staphylococcus
VHGGRTKS

SEQ ID NO: 1993894 - protein, 5 aa, Staphylococcus
VHGPN

SEQ ID NO: 1993895 - protein, 6 aa, Staphylococcus
VHGPNH

SEQ ID NO: 1993896 - protein, 5 aa, Staphylococcus
VHGPQ

SEQ ID NO: 1993897 - protein, 12 aa, Staphylococcus
VHGPYKGEPNLG

SEQ ID NO: 1993898 - protein, 8 aa, Staphylococcus
VHHSRSQQ

SEQ ID NO: 1993899 - protein, 12 aa, Staphylococcus
VHKPSGAKPGFV

SEQ ID NO: 1993900 - protein, 13 aa, Staphylococcus
VHKPSGAKPGFVT

SEQ ID NO: 1993901 - protein, 10 aa, Staphylococcus
VHNGRRVSAS

SEQ ID NO: 1993902 - protein, 8 aa, Staphylococcus
VHNNQRDA

SEQ ID NO: 1993903 - protein, 9 aa, Staphylococcus
VHNNQRDAM

SEQ ID NO: 1993904 - protein, 6 aa, Staphylococcus
VHPDDA

SEQ ID NO: 1993905 - protein, 9 aa, Staphylococcus
VHPGSAKDA

SEQ ID NO: 1993906 - protein, 7 aa, Staphylococcus
VHPNDEY

SEQ ID NO: 1993907 - protein, 10 aa, Staphylococcus
VHQGAATPLI

SEQ ID NO: 1993908 - protein, 14 aa, Staphylococcus
VHQPNGNYSPKGSH

SEQ ID NO: 1993909 - protein, 5 aa, Staphylococcus
VHQSV

SEQ ID NO: 1993910 - protein, 9 aa, Staphylococcus
VHRGASKPL

SEQ ID NO: 1993911 - protein, 9 aa, Staphylococcus
VHRGSAKPL

SEQ ID NO: 1993912 - protein, 9 aa, Staphylococcus
VHRGSSQPL

SEQ ID NO: 1993913 - protein, 4 aa, Staphylococcus
VHSR

SEQ ID NO: 1993914 - protein, 5 aa, Staphylococcus
VHTAT

SEQ ID NO: 1993915 - protein, 10 aa, Staphylococcus
VHTSPSTETQ

SEQ ID NO: 1993916 - protein, 12 aa, Staphylococcus
VIAEDEKQTKNS

SEQ ID NO: 1993917 - protein, 10 aa, Staphylococcus
VIAPNSQTSF

SEQ ID NO: 1993918 - protein, 14 aa, Staphylococcus
VIDPEGNDVTPDKV

SEQ ID NO: 1993919 - protein, 22 aa, Staphylococcus
VIDPEGNDVTPEKLKKIQEQNK

SEQ ID NO: 1993920 - protein, 24 aa, Staphylococcus
VIDPEGNDVTPEKLKKIQERKKND

SEQ ID NO: 1993921 - protein, 23 aa, Staphylococcus
VIDPEGNDVTPEKLKKIQQNKKE

SEQ ID NO: 1993922 - protein, 23 aa, Staphylococcus
VIDPEGNDVTPEKLKKIQSEKNN

SEQ ID NO: 1993923 - protein, 6 aa, Staphylococcus
VIDSAS

SEQ ID NO: 1993924 - protein, 7 aa, Staphylococcus
VIDSGEN

SEQ ID NO: 1993925 - protein, 13 aa, Staphylococcus
VIDTTGAGDTFNG

SEQ ID NO: 1993926 - protein, 9 aa, Staphylococcus
VIEETKQDG

SEQ ID NO: 1993927 - protein, 7 aa, Staphylococcus
VIEGRQK

SEQ ID NO: 1993928 - protein, 6 aa, Staphylococcus
VIENNE

SEQ ID NO: 1993929 - protein, 4 aa, Staphylococcus
VIEP

SEQ ID NO: 1993930 - protein, 10 aa, Staphylococcus
VIEPNSNKEI

SEQ ID NO: 1993931 - protein, 6 aa, Staphylococcus
VIEQGQ

SEQ ID NO: 1993932 - protein, 13 aa, Staphylococcus
VIEQKQNDKQRAL

SEQ ID NO: 1993933 - protein, 14 aa, Staphylococcus
VIEQKQQEKQKALY

SEQ ID NO: 1993934 - protein, 10 aa, Staphylococcus
VIGKPDPIRG

SEQ ID NO: 1993935 - protein, 10 aa, Staphylococcus
VIGPGGKKIN

SEQ ID NO: 1993936 - protein, 6 aa, Staphylococcus
VINDPD

SEQ ID NO: 1993937 - protein, 13 aa, Staphylococcus
VINDSKVGAYTKV

SEQ ID NO: 1993938 - protein, 22 aa, Staphylococcus
VINTADELNGYNEERAKESIEN

SEQ ID NO: 1993939 - protein, 22 aa, Staphylococcus
VINTADELNGYNETRAKESIEG

SEQ ID NO: 1993940 - protein, 4 aa, Staphylococcus
VIPG

SEQ ID NO: 1993941 - protein, 6 aa, Staphylococcus
VIPGGA

SEQ ID NO: 1993942 - protein, 13 aa, Staphylococcus
VIPGSTDAVNSVE

SEQ ID NO: 1993943 - protein, 15 aa, Staphylococcus
VIPGSTDEVKSVEEI

SEQ ID NO: 1993944 - protein, 53 aa, Staphylococcus
VIPPKDGEKSSAHVTEDNRSDSDKLNSNSREVSSGYKTQSQPEKQKSQEINHN

SEQ ID NO: 1993945 - protein, 29 aa, Staphylococcus
VIPPKQDSLQNSNNATSKSQRNQPKNAHD

SEQ ID NO: 1993946 - protein, 4 aa, Staphylococcus
VIRP

SEQ ID NO: 1993947 - protein, 4 aa, Staphylococcus
VISG

SEQ ID NO: 1993948 - protein, 8 aa, Staphylococcus
VISPEGAS

SEQ ID NO: 1993949 - protein, 4 aa, Staphylococcus
VISQ

SEQ ID NO: 1993950 - protein, 12 aa, Staphylococcus
VISRNGKEIDLE

SEQ ID NO: 1993951 - protein, 11 aa, Staphylococcus
VISSGLETARE

SEQ ID NO: 1993952 - protein, 31 aa, Staphylococcus
VISSKSKIKYGTPQDTVRSRMGKPLDSITKG

SEQ ID NO: 1993953 - protein, 5 aa, Staphylococcus
VITPD

SEQ ID NO: 1993954 - protein, 10 aa, Staphylococcus
VITPDNKGNV

SEQ ID NO: 1993955 - protein, 5 aa, Staphylococcus
VITSS

SEQ ID NO: 1993956 - protein, 14 aa, Staphylococcus
VKAAEELEKDGHSV

SEQ ID NO: 1993957 - protein, 14 aa, Staphylococcus
VKAAQGHDGAKLGT

SEQ ID NO: 1993958 - protein, 28 aa, Staphylococcus
VKADPANDGLASIPQPTESGAAETGTPV

SEQ ID NO: 1993959 - protein, 8 aa, Staphylococcus
VKADYPDV

SEQ ID NO: 1993960 - protein, 12 aa, Staphylococcus
VKAEEDKYLKLQ

SEQ ID NO: 1993961 - protein, 10 aa, Staphylococcus
VKAEKDDTDL

SEQ ID NO: 1993962 - protein, 7 aa, Staphylococcus
VKAGDYE

SEQ ID NO: 1993963 - protein, 12 aa, Staphylococcus
VKAGQDQDWAKL

SEQ ID NO: 1993964 - protein, 8 aa, Staphylococcus
VKAHEESK

SEQ ID NO: 1993965 - protein, 7 aa, Staphylococcus
VKAHGGH

SEQ ID NO: 1993966 - protein, 12 aa, Staphylococcus
VKAKIVKKNQIS

SEQ ID NO: 1993967 - protein, 12 aa, Staphylococcus
VKAKQDEQVAEK

SEQ ID NO: 1993968 - protein, 6 aa, Staphylococcus
VKANRD

SEQ ID NO: 1993969 - protein, 15 aa, Staphylococcus
VKANTLASVGSKAIE

SEQ ID NO: 1993970 - protein, 10 aa, Staphylococcus
VKASGGVRSL

SEQ ID NO: 1993971 - protein, 5 aa, Staphylococcus
VKASK

SEQ ID NO: 1993972 - protein, 23 aa, Staphylococcus
VKASKFSASAAEAIDAKGGAHEV

SEQ ID NO: 1993973 - protein, 8 aa, Staphylococcus
VKASPDHP

SEQ ID NO: 1993974 - protein, 8 aa, Staphylococcus
VKASPFDG

SEQ ID NO: 1993975 - protein, 8 aa, Staphylococcus
VKASPYEG

SEQ ID NO: 1993976 - protein, 13 aa, Staphylococcus
VKASSTNKDTWSN

SEQ ID NO: 1993977 - protein, 4 aa, Staphylococcus
VKAT

SEQ ID NO: 1993978 - protein, 8 aa, Staphylococcus
VKATNEQL

SEQ ID NO: 1993979 - protein, 10 aa, Staphylococcus
VKDAANEAEI

SEQ ID NO: 1993980 - protein, 6 aa, Staphylococcus
VKDAAT

SEQ ID NO: 1993981 - protein, 22 aa, Staphylococcus
VKDAQSYKKRDALKDIDATSPP

SEQ ID NO: 1993982 - protein, 6 aa, Staphylococcus
VKDDDA

SEQ ID NO: 1993983 - protein, 12 aa, Staphylococcus
VKDDKAKTKSLS

SEQ ID NO: 1993984 - protein, 11 aa, Staphylococcus
VKDDKEKTKAL

SEQ ID NO: 1993985 - protein, 11 aa, Staphylococcus
VKDDKEKTKEL

SEQ ID NO: 1993986 - protein, 11 aa, Staphylococcus
VKDDKQKTKEL

SEQ ID NO: 1993987 - protein, 16 aa, Staphylococcus
VKDDNNNNIHNSDLNA

SEQ ID NO: 1993988 - protein, 8 aa, Staphylococcus
VKDDSSIN

SEQ ID NO: 1993989 - protein, 10 aa, Staphylococcus
VKDEEKVAKA

SEQ ID NO: 1993990 - protein, 8 aa, Staphylococcus
VKDEKDLE

SEQ ID NO: 1993991 - protein, 7 aa, Staphylococcus
VKDERPD

SEQ ID NO: 1993992 - protein, 10 aa, Staphylococcus
VKDGDDSLKE

SEQ ID NO: 1993993 - protein, 6 aa, Staphylococcus
VKDGEK

SEQ ID NO: 1993994 - protein, 11 aa, Staphylococcus
VKDGKTTGKFE

SEQ ID NO: 1993995 - protein, 15 aa, Staphylococcus
VKDIPGAGAAGGLGT

SEQ ID NO: 1993996 - protein, 10 aa, Staphylococcus
VKDIQDDKKR

SEQ ID NO: 1993997 - protein, 6 aa, Staphylococcus
VKDKEY

SEQ ID NO: 1993998 - protein, 10 aa, Staphylococcus
VKDKYKSRYD

SEQ ID NO: 1993999 - protein, 7 aa, Staphylococcus
VKDLGRK

SEQ ID NO: 1994000 - protein, 5 aa, Staphylococcus
VKDPR

SEQ ID NO: 1994001 - protein, 6 aa, Staphylococcus
VKDPRV

SEQ ID NO: 1994002 - protein, 4 aa, Staphylococcus
VKDQ

SEQ ID NO: 1994003 - protein, 9 aa, Staphylococcus
VKDQEEINT

SEQ ID NO: 1994004 - protein, 11 aa, Staphylococcus
VKDQNEAIEKA

SEQ ID NO: 1994005 - protein, 4 aa, Staphylococcus
VKDS

SEQ ID NO: 1994006 - protein, 7 aa, Staphylococcus
VKDTDRL

SEQ ID NO: 1994007 - protein, 12 aa, Staphylococcus
VKDTGKDISVPV

SEQ ID NO: 1994008 - protein, 17 aa, Staphylococcus
VKDTGKDISVPVGDETL

SEQ ID NO: 1994009 - protein, 14 aa, Staphylococcus
VKDTIKKASIASGV

SEQ ID NO: 1994010 - protein, 6 aa, Staphylococcus
VKDTKH

SEQ ID NO: 1994011 - protein, 7 aa, Staphylococcus
VKDTNRI

SEQ ID NO: 1994012 - protein, 27 aa, Staphylococcus
VKDTTNKPVNKKRPTIPAPNPSKIKKA

SEQ ID NO: 1994013 - protein, 11 aa, Staphylococcus
VKDYEANGANA

SEQ ID NO: 1994014 - protein, 8 aa, Staphylococcus
VKDYSGEH

SEQ ID NO: 1994015 - protein, 7 aa, Staphylococcus
VKDYTKD

SEQ ID NO: 1994016 - protein, 4 aa, Staphylococcus
VKEA

SEQ ID NO: 1994017 - protein, 10 aa, Staphylococcus
VKEAADKAGV

SEQ ID NO: 1994018 - protein, 22 aa, Staphylococcus
VKEAAKATTGKVVNNTGQVCTA

SEQ ID NO: 1994019 - protein, 11 aa, Staphylococcus
VKEAGKNYAAE

SEQ ID NO: 1994020 - protein, 16 aa, Staphylococcus
VKEAKVQGIHGKDSTP

SEQ ID NO: 1994021 - protein, 8 aa, Staphylococcus
VKEDYREY

SEQ ID NO: 1994022 - protein, 4 aa, Staphylococcus
VKEE

SEQ ID NO: 1994023 - protein, 12 aa, Staphylococcus
VKEEAPVKGLVY

SEQ ID NO: 1994024 - protein, 5 aa, Staphylococcus
VKEED

SEQ ID NO: 1994025 - protein, 24 aa, Staphylococcus
VKEEEDNQADSDDTDASETATEEV

SEQ ID NO: 1994026 - protein, 12 aa, Staphylococcus
VKEESDKAALTL

SEQ ID NO: 1994027 - protein, 12 aa, Staphylococcus
VKEESDKEGLSL

SEQ ID NO: 1994028 - protein, 11 aa, Staphylococcus
VKEESDKEKLT

SEQ ID NO: 1994029 - protein, 12 aa, Staphylococcus
VKEESDKESLTL

SEQ ID NO: 1994030 - protein, 12 aa, Staphylococcus
VKEESDKKELTL

SEQ ID NO: 1994031 - protein, 8 aa, Staphylococcus
VKEESGVD

SEQ ID NO: 1994032 - protein, 6 aa, Staphylococcus
VKEETG

SEQ ID NO: 1994033 - protein, 5 aa, Staphylococcus
VKEGG

SEQ ID NO: 1994034 - protein, 11 aa, Staphylococcus
VKEGKAQGLKI

SEQ ID NO: 1994035 - protein, 12 aa, Staphylococcus
VKEGNTTKTPAK

SEQ ID NO: 1994036 - protein, 11 aa, Staphylococcus
VKEGRKNTDAL

SEQ ID NO: 1994037 - protein, 9 aa, Staphylococcus
VKEGTEKFG

SEQ ID NO: 1994038 - protein, 5 aa, Staphylococcus
VKEIA

SEQ ID NO: 1994039 - protein, 6 aa, Staphylococcus
VKEKGF

SEQ ID NO: 1994040 - protein, 23 aa, Staphylococcus
VKEKKKEVEIPRNKIAKARHAVL

SEQ ID NO: 1994041 - protein, 8 aa, Staphylococcus
VKEKNGSV

SEQ ID NO: 1994042 - protein, 6 aa, Staphylococcus
VKEKSY

SEQ ID NO: 1994043 - protein, 9 aa, Staphylococcus
VKEKTTQPF

SEQ ID NO: 1994044 - protein, 4 aa, Staphylococcus
VKEN

SEQ ID NO: 1994045 - protein, 11 aa, Staphylococcus
VKENKGYMPPE

SEQ ID NO: 1994046 - protein, 7 aa, Staphylococcus
VKENNGV

SEQ ID NO: 1994047 - protein, 8 aa, Staphylococcus
VKENPYEG

SEQ ID NO: 1994048 - protein, 7 aa, Staphylococcus
VKENQDN

SEQ ID NO: 1994049 - protein, 15 aa, Staphylococcus
VKENTFATVGSSALE

SEQ ID NO: 1994050 - protein, 7 aa, Staphylococcus
VKEPREK

SEQ ID NO: 1994051 - protein, 8 aa, Staphylococcus
VKEQEIQE

SEQ ID NO: 1994052 - protein, 8 aa, Staphylococcus
VKEQTASI

SEQ ID NO: 1994053 - protein, 6 aa, Staphylococcus
VKESEG

SEQ ID NO: 1994054 - protein, 4 aa, Staphylococcus
VKET

SEQ ID NO: 1994055 - protein, 11 aa, Staphylococcus
VKETEETLTTE

SEQ ID NO: 1994056 - protein, 5 aa, Staphylococcus
VKETN

SEQ ID NO: 1994057 - protein, 8 aa, Staphylococcus
VKETPNSR

SEQ ID NO: 1994058 - protein, 12 aa, Staphylococcus
VKETTDENPERV

SEQ ID NO: 1994059 - protein, 8 aa, Staphylococcus
VKETTFAT

SEQ ID NO: 1994060 - protein, 8 aa, Staphylococcus
VKETTMAT

SEQ ID NO: 1994061 - protein, 17 aa, Staphylococcus
VKETTREEIEQHDAENF

SEQ ID NO: 1994062 - protein, 5 aa, Staphylococcus
VKEVE

SEQ ID NO: 1994063 - protein, 6 aa, Staphylococcus
VKEVKP

SEQ ID NO: 1994064 - protein, 9 aa, Staphylococcus
VKEYQQSDL

SEQ ID NO: 1994065 - protein, 7 aa, Staphylococcus
VKGAELP

SEQ ID NO: 1994066 - protein, 8 aa, Staphylococcus
VKGAESIN

SEQ ID NO: 1994067 - protein, 15 aa, Staphylococcus
VKGASSVIKQGTKVK

SEQ ID NO: 1994068 - protein, 7 aa, Staphylococcus
VKGEENK

SEQ ID NO: 1994069 - protein, 7 aa, Staphylococcus
VKGENQH

SEQ ID NO: 1994070 - protein, 7 aa, Staphylococcus
VKGEQQH

SEQ ID NO: 1994071 - protein, 12 aa, Staphylococcus
VKGETKVIDVTM

SEQ ID NO: 1994072 - protein, 8 aa, Staphylococcus
VKGETPAI

SEQ ID NO: 1994073 - protein, 4 aa, Staphylococcus
VKGG

SEQ ID NO: 1994074 - protein, 10 aa, Staphylococcus
VKGGNTTGKF

SEQ ID NO: 1994075 - protein, 7 aa, Staphylococcus
VKGINGS

SEQ ID NO: 1994076 - protein, 19 aa, Staphylococcus
VKGNGKARKALNQANTEQE

SEQ ID NO: 1994077 - protein, 20 aa, Staphylococcus
VKGNTDNENLVTKNNEIHQR

SEQ ID NO: 1994078 - protein, 16 aa, Staphylococcus
VKGPDGLHFRFNFIEV

SEQ ID NO: 1994079 - protein, 11 aa, Staphylococcus
VKGPKGELTRT

SEQ ID NO: 1994080 - protein, 9 aa, Staphylococcus
VKGPSGTAH

SEQ ID NO: 1994081 - protein, 8 aa, Staphylococcus
VKGQDGIN

SEQ ID NO: 1994082 - protein, 12 aa, Staphylococcus
VKGQQQEEIEKA

SEQ ID NO: 1994083 - protein, 12 aa, Staphylococcus
VKGQRQSEKTSV

SEQ ID NO: 1994084 - protein, 18 aa, Staphylococcus
VKGSGYDREYSTVNGAQG

SEQ ID NO: 1994085 - protein, 7 aa, Staphylococcus
VKGSLSR

SEQ ID NO: 1994086 - protein, 4 aa, Staphylococcus
VKGT

SEQ ID NO: 1994087 - protein, 7 aa, Staphylococcus
VKGTELD

SEQ ID NO: 1994088 - protein, 9 aa, Staphylococcus
VKGTHGSDG

SEQ ID NO: 1994089 - protein, 10 aa, Staphylococcus
VKHESTPRIL

SEQ ID NO: 1994090 - protein, 5 aa, Staphylococcus
VKHET

SEQ ID NO: 1994091 - protein, 9 aa, Staphylococcus
VKHSSAQTL

SEQ ID NO: 1994092 - protein, 8 aa, Staphylococcus
VKIETGNP

SEQ ID NO: 1994093 - protein, 11 aa, Staphylococcus
VKIQRKDYTVN

SEQ ID NO: 1994094 - protein, 9 aa, Staphylococcus
VKKAERKKM

SEQ ID NO: 1994095 - protein, 9 aa, Staphylococcus
VKKAERKTM

SEQ ID NO: 1994096 - protein, 4 aa, Staphylococcus
VKKD

SEQ ID NO: 1994097 - protein, 9 aa, Staphylococcus
VKKDDSAFK

SEQ ID NO: 1994098 - protein, 10 aa, Staphylococcus
VKKDEYNNQI

SEQ ID NO: 1994099 - protein, 10 aa, Staphylococcus
VKKDGLKGGG

SEQ ID NO: 1994100 - protein, 9 aa, Staphylococcus
VKKDQPDVF

SEQ ID NO: 1994101 - protein, 11 aa, Staphylococcus
VKKDSRHKAYY

SEQ ID NO: 1994102 - protein, 13 aa, Staphylococcus
VKKEEKEALSQRL

SEQ ID NO: 1994103 - protein, 17 aa, Staphylococcus
VKKEVGKDPHKGVNPDE

SEQ ID NO: 1994104 - protein, 18 aa, Staphylococcus
VKKEVGKDPHKGVNPDEV

SEQ ID NO: 1994105 - protein, 12 aa, Staphylococcus
VKKGPDSVEHGE

SEQ ID NO: 1994106 - protein, 14 aa, Staphylococcus
VKKGSGKYFGPYPN

SEQ ID NO: 1994107 - protein, 23 aa, Staphylococcus
VKKGSGKYFGPYPNAYSAQETKK

SEQ ID NO: 1994108 - protein, 7 aa, Staphylococcus
VKKGSKA

SEQ ID NO: 1994109 - protein, 12 aa, Staphylococcus
VKKHPDQENFSK

SEQ ID NO: 1994110 - protein, 5 aa, Staphylococcus
VKKID

SEQ ID NO: 1994111 - protein, 6 aa, Staphylococcus
VKKMRE

SEQ ID NO: 1994112 - protein, 5 aa, Staphylococcus
VKKND

SEQ ID NO: 1994113 - protein, 8 aa, Staphylococcus
VKKNIESG

SEQ ID NO: 1994114 - protein, 8 aa, Staphylococcus
VKKNVENG

SEQ ID NO: 1994115 - protein, 10 aa, Staphylococcus
VKKQDKDKNI

SEQ ID NO: 1994116 - protein, 7 aa, Staphylococcus
VKKSNDS

SEQ ID NO: 1994117 - protein, 8 aa, Staphylococcus
VKKSRQTV

SEQ ID NO: 1994118 - protein, 8 aa, Staphylococcus
VKKTQSEL

SEQ ID NO: 1994119 - protein, 4 aa, Staphylococcus
VKKV

SEQ ID NO: 1994120 - protein, 7 aa, Staphylococcus
VKKVDEA

SEQ ID NO: 1994121 - protein, 24 aa, Staphylococcus
VKKVNPKRLQREVAKEQKKPKFTT

SEQ ID NO: 1994122 - protein, 4 aa, Staphylococcus
VKKY

SEQ ID NO: 1994123 - protein, 5 aa, Staphylococcus
VKKYP

SEQ ID NO: 1994124 - protein, 4 aa, Staphylococcus
VKLD

SEQ ID NO: 1994125 - protein, 8 aa, Staphylococcus
VKLGNKQN

SEQ ID NO: 1994126 - protein, 11 aa, Staphylococcus
VKLSGNSVIGE

SEQ ID NO: 1994127 - protein, 17 aa, Staphylococcus
VKMGQRGEVQVNPQLQT

SEQ ID NO: 1994128 - protein, 9 aa, Staphylococcus
VKNAESKIE

SEQ ID NO: 1994129 - protein, 7 aa, Staphylococcus
VKNDEDV

SEQ ID NO: 1994130 - protein, 7 aa, Staphylococcus
VKNDENN

SEQ ID NO: 1994131 - protein, 9 aa, Staphylococcus
VKNDNVQGE

SEQ ID NO: 1994132 - protein, 5 aa, Staphylococcus
VKNEA

SEQ ID NO: 1994133 - protein, 17 aa, Staphylococcus
VKNEPEKREAQKRLAEE

SEQ ID NO: 1994134 - protein, 15 aa, Staphylococcus
VKNETSEYNGKTYEN

SEQ ID NO: 1994135 - protein, 11 aa, Staphylococcus
VKNETSLDDEG

SEQ ID NO: 1994136 - protein, 12 aa, Staphylococcus
VKNFATEKPEYS

SEQ ID NO: 1994137 - protein, 6 aa, Staphylococcus
VKNGNS

SEQ ID NO: 1994138 - protein, 4 aa, Staphylococcus
VKNI

SEQ ID NO: 1994139 - protein, 14 aa, Staphylococcus
VKNKDGKYKAEYRQ

SEQ ID NO: 1994140 - protein, 7 aa, Staphylococcus
VKNKENI

SEQ ID NO: 1994141 - protein, 10 aa, Staphylococcus
VKNKVSQINS

SEQ ID NO: 1994142 - protein, 8 aa, Staphylococcus
VKNPDTVA

SEQ ID NO: 1994143 - protein, 12 aa, Staphylococcus
VKNQDKDKNTTL

SEQ ID NO: 1994144 - protein, 28 aa, Staphylococcus
VKNQSSEDNEDTESNNIDENKQEESSEN

SEQ ID NO: 1994145 - protein, 7 aa, Staphylococcus
VKNRKGD

SEQ ID NO: 1994146 - protein, 8 aa, Staphylococcus
VKNRLSSG

SEQ ID NO: 1994147 - protein, 9 aa, Staphylococcus
VKNRNGEKI

SEQ ID NO: 1994148 - protein, 9 aa, Staphylococcus
VKNRNGNEI

SEQ ID NO: 1994149 - protein, 10 aa, Staphylococcus
VKNRNNEEIT

SEQ ID NO: 1994150 - protein, 8 aa, Staphylococcus
VKNRNNEI

SEQ ID NO: 1994151 - protein, 10 aa, Staphylococcus
VKNSDKVPYY

SEQ ID NO: 1994152 - protein, 11 aa, Staphylococcus
VKNSGKDTSEI

SEQ ID NO: 1994153 - protein, 8 aa, Staphylococcus
VKNSPFEG

SEQ ID NO: 1994154 - protein, 14 aa, Staphylococcus
VKNTEGKYKAEYRQ

SEQ ID NO: 1994155 - protein, 8 aa, Staphylococcus
VKNTYGTG

SEQ ID NO: 1994156 - protein, 16 aa, Staphylococcus
VKNYKRNARQKLQRFF

SEQ ID NO: 1994157 - protein, 4 aa, Staphylococcus
VKPD

SEQ ID NO: 1994158 - protein, 7 aa, Staphylococcus
VKPDEEL

SEQ ID NO: 1994159 - protein, 7 aa, Staphylococcus
VKPETLK

SEQ ID NO: 1994160 - protein, 5 aa, Staphylococcus
VKPGD

SEQ ID NO: 1994161 - protein, 6 aa, Staphylococcus
VKPGLQ

SEQ ID NO: 1994162 - protein, 8 aa, Staphylococcus
VKPGTDAL

SEQ ID NO: 1994163 - protein, 6 aa, Staphylococcus
VKPKQN

SEQ ID NO: 1994164 - protein, 7 aa, Staphylococcus
VKPKQNG

SEQ ID NO: 1994165 - protein, 9 aa, Staphylococcus
VKPKRGEVE

SEQ ID NO: 1994166 - protein, 7 aa, Staphylococcus
VKPNDRV

SEQ ID NO: 1994167 - protein, 12 aa, Staphylococcus
VKPNHLDEGEYN

SEQ ID NO: 1994168 - protein, 9 aa, Staphylococcus
VKPNRRKPY

SEQ ID NO: 1994169 - protein, 12 aa, Staphylococcus
VKPNYKVKQNDN

SEQ ID NO: 1994170 - protein, 7 aa, Staphylococcus
VKPSDSV

SEQ ID NO: 1994171 - protein, 7 aa, Staphylococcus
VKPSKDG

SEQ ID NO: 1994172 - protein, 11 aa, Staphylococcus
VKPSQEKGISD

SEQ ID NO: 1994173 - protein, 10 aa, Staphylococcus
VKPSSDPGIS

SEQ ID NO: 1994174 - protein, 12 aa, Staphylococcus
VKPSVESKSETR

SEQ ID NO: 1994175 - protein, 4 aa, Staphylococcus
VKPT

SEQ ID NO: 1994176 - protein, 11 aa, Staphylococcus
VKPTKQSVSEL

SEQ ID NO: 1994177 - protein, 9 aa, Staphylococcus
VKPVEQETQ

SEQ ID NO: 1994178 - protein, 4 aa, Staphylococcus
VKQD

SEQ ID NO: 1994179 - protein, 23 aa, Staphylococcus
VKQDGETVEYDHTSKKAMKDSTS

SEQ ID NO: 1994180 - protein, 11 aa, Staphylococcus
VKQDGLKGGGY

SEQ ID NO: 1994181 - protein, 7 aa, Staphylococcus
VKQDTGV

SEQ ID NO: 1994182 - protein, 60 aa, Staphylococcus
VKQEDDADEAESDIESDNAQGESNSEEVIEGGAPGKAIQTEVTDEEQGSEDTQDGDERID

SEQ ID NO: 1994183 - protein, 10 aa, Staphylococcus
VKQEGLKGGG

SEQ ID NO: 1994184 - protein, 8 aa, Staphylococcus
VKQEKDAI

SEQ ID NO: 1994185 - protein, 14 aa, Staphylococcus
VKQEKNNPGNIHNQ

SEQ ID NO: 1994186 - protein, 12 aa, Staphylococcus
VKQESDKAGLTL

SEQ ID NO: 1994187 - protein, 12 aa, Staphylococcus
VKQESDKEGLTL

SEQ ID NO: 1994188 - protein, 4 aa, Staphylococcus
VKQG

SEQ ID NO: 1994189 - protein, 9 aa, Staphylococcus
VKQGGTNSF

SEQ ID NO: 1994190 - protein, 8 aa, Staphylococcus
VKQMNREN

SEQ ID NO: 1994191 - protein, 6 aa, Staphylococcus
VKQNDH

SEQ ID NO: 1994192 - protein, 9 aa, Staphylococcus
VKQNNNKEL

SEQ ID NO: 1994193 - protein, 7 aa, Staphylococcus
VKQPDHE

SEQ ID NO: 1994194 - protein, 7 aa, Staphylococcus
VKQPDYN

SEQ ID NO: 1994195 - protein, 4 aa, Staphylococcus
VKQR

SEQ ID NO: 1994196 - protein, 5 aa, Staphylococcus
VKQSY

SEQ ID NO: 1994197 - protein, 9 aa, Staphylococcus
VKQTEARVK

SEQ ID NO: 1994198 - protein, 18 aa, Staphylococcus
VKQTEARVKQKIGPEKVK

SEQ ID NO: 1994199 - protein, 22 aa, Staphylococcus
VKQTEARVKQKIGPEKVKAQSF

SEQ ID NO: 1994200 - protein, 20 aa, Staphylococcus
VKQTEARVKQQVGPEKVTAQ

SEQ ID NO: 1994201 - protein, 18 aa, Staphylococcus
VKQTEDKVRQKTGPEKIK

SEQ ID NO: 1994202 - protein, 19 aa, Staphylococcus
VKQTEDKVRQKTGPEKVKA

SEQ ID NO: 1994203 - protein, 7 aa, Staphylococcus
VKQTEPD

SEQ ID NO: 1994204 - protein, 6 aa, Staphylococcus
VKQYDK

SEQ ID NO: 1994205 - protein, 8 aa, Staphylococcus
VKRAEEMV

SEQ ID NO: 1994206 - protein, 12 aa, Staphylococcus
VKRAQEIEQETR

SEQ ID NO: 1994207 - protein, 9 aa, Staphylococcus
VKRATTDFE

SEQ ID NO: 1994208 - protein, 7 aa, Staphylococcus
VKRDGTP

SEQ ID NO: 1994209 - protein, 8 aa, Staphylococcus
VKRDKAAI

SEQ ID NO: 1994210 - protein, 15 aa, Staphylococcus
VKRDPRTNMRSAQNN

SEQ ID NO: 1994211 - protein, 7 aa, Staphylococcus
VKRELGQ

SEQ ID NO: 1994212 - protein, 5 aa, Staphylococcus
VKRGQ

SEQ ID NO: 1994213 - protein, 6 aa, Staphylococcus
VKRGYR

SEQ ID NO: 1994214 - protein, 8 aa, Staphylococcus
VKRHERKK

SEQ ID NO: 1994215 - protein, 4 aa, Staphylococcus
VKRK

SEQ ID NO: 1994216 - protein, 5 aa, Staphylococcus
VKRKA

SEQ ID NO: 1994217 - protein, 15 aa, Staphylococcus
VKRKMDFNEKIQNLF

SEQ ID NO: 1994218 - protein, 16 aa, Staphylococcus
VKRKMNYKEKLQNLFE

SEQ ID NO: 1994219 - protein, 13 aa, Staphylococcus
VKRRGDMEEDPAY

SEQ ID NO: 1994220 - protein, 13 aa, Staphylococcus
VKRRGDMEEDSTF

SEQ ID NO: 1994221 - protein, 9 aa, Staphylococcus
VKRSSLSNF

SEQ ID NO: 1994222 - protein, 7 aa, Staphylococcus
VKRTNSN

SEQ ID NO: 1994223 - protein, 8 aa, Staphylococcus
VKRTVKAE

SEQ ID NO: 1994224 - protein, 4 aa, Staphylococcus
VKSD

SEQ ID NO: 1994225 - protein, 11 aa, Staphylococcus
VKSDENGEVDV

SEQ ID NO: 1994226 - protein, 8 aa, Staphylococcus
VKSDEQVV

SEQ ID NO: 1994227 - protein, 9 aa, Staphylococcus
VKSDSGTAR

SEQ ID NO: 1994228 - protein, 6 aa, Staphylococcus
VKSEKE

SEQ ID NO: 1994229 - protein, 8 aa, Staphylococcus
VKSEKSGI

SEQ ID NO: 1994230 - protein, 18 aa, Staphylococcus
VKSGEADGCVSAGNTGAL

SEQ ID NO: 1994231 - protein, 10 aa, Staphylococcus
VKSGGPELAK

SEQ ID NO: 1994232 - protein, 7 aa, Staphylococcus
VKSGSKA

SEQ ID NO: 1994233 - protein, 5 aa, Staphylococcus
VKSGY

SEQ ID NO: 1994234 - protein, 4 aa, Staphylococcus
VKSI

SEQ ID NO: 1994235 - protein, 24 aa, Staphylococcus
VKSIGHETFDTDASVDTAKNGDIV

SEQ ID NO: 1994236 - protein, 4 aa, Staphylococcus
VKSK

SEQ ID NO: 1994237 - protein, 9 aa, Staphylococcus
VKSKDGTHE

SEQ ID NO: 1994238 - protein, 10 aa, Staphylococcus
VKSKDGTSEK

SEQ ID NO: 1994239 - protein, 9 aa, Staphylococcus
VKSKDGVQE

SEQ ID NO: 1994240 - protein, 12 aa, Staphylococcus
VKSKDTGPIGDT

SEQ ID NO: 1994241 - protein, 10 aa, Staphylococcus
VKSKEGTSEK

SEQ ID NO: 1994242 - protein, 17 aa, Staphylococcus
VKSKGYDRVNSKTISEA

SEQ ID NO: 1994243 - protein, 10 aa, Staphylococcus
VKSKNGTSEK

SEQ ID NO: 1994244 - protein, 4 aa, Staphylococcus
VKSN

SEQ ID NO: 1994245 - protein, 11 aa, Staphylococcus
VKSNAKKQGKL

SEQ ID NO: 1994246 - protein, 5 aa, Staphylococcus
VKSNE

SEQ ID NO: 1994247 - protein, 8 aa, Staphylococcus
VKSNFKDK

SEQ ID NO: 1994248 - protein, 8 aa, Staphylococcus
VKSNSDFT

SEQ ID NO: 1994249 - protein, 6 aa, Staphylococcus
VKSPTV

SEQ ID NO: 1994250 - protein, 4 aa, Staphylococcus
VKSQ

SEQ ID NO: 1994251 - protein, 7 aa, Staphylococcus
VKSQGRD

SEQ ID NO: 1994252 - protein, 8 aa, Staphylococcus
VKSQNDPL

SEQ ID NO: 1994253 - protein, 9 aa, Staphylococcus
VKSRMSNAK

SEQ ID NO: 1994254 - protein, 8 aa, Staphylococcus
VKSSDSVI

SEQ ID NO: 1994255 - protein, 8 aa, Staphylococcus
VKSSRHGQ

SEQ ID NO: 1994256 - protein, 7 aa, Staphylococcus
VKSTDDF

SEQ ID NO: 1994257 - protein, 7 aa, Staphylococcus
VKSTHHS

SEQ ID NO: 1994258 - protein, 9 aa, Staphylococcus
VKSTQENLA

SEQ ID NO: 1994259 - protein, 9 aa, Staphylococcus
VKSTTFATV

SEQ ID NO: 1994260 - protein, 17 aa, Staphylococcus
VKSVGHETFDTDASVDV

SEQ ID NO: 1994261 - protein, 4 aa, Staphylococcus
VKSY

SEQ ID NO: 1994262 - protein, 6 aa, Staphylococcus
VKSYEV

SEQ ID NO: 1994263 - protein, 10 aa, Staphylococcus
VKTADTPSEI

SEQ ID NO: 1994264 - protein, 7 aa, Staphylococcus
VKTAKGR

SEQ ID NO: 1994265 - protein, 10 aa, Staphylococcus
VKTAKVKKKH

SEQ ID NO: 1994266 - protein, 15 aa, Staphylococcus
VKTAQDHLSSKEGTT

SEQ ID NO: 1994267 - protein, 7 aa, Staphylococcus
VKTDDVY

SEQ ID NO: 1994268 - protein, 6 aa, Staphylococcus
VKTDEG

SEQ ID NO: 1994269 - protein, 16 aa, Staphylococcus
VKTDNNDVKSSQKEAL

SEQ ID NO: 1994270 - protein, 6 aa, Staphylococcus
VKTDRD

SEQ ID NO: 1994271 - protein, 40 aa, Staphylococcus
VKTEDAKQASDTFSTKKEAKQRAKEIADNRGTQVIEHQKD

SEQ ID NO: 1994272 - protein, 8 aa, Staphylococcus
VKTEEEAK

SEQ ID NO: 1994273 - protein, 9 aa, Staphylococcus
VKTERNEDV

SEQ ID NO: 1994274 - protein, 8 aa, Staphylococcus
VKTGEEKD

SEQ ID NO: 1994275 - protein, 9 aa, Staphylococcus
VKTGEEKDV

SEQ ID NO: 1994276 - protein, 8 aa, Staphylococcus
VKTGEEKE

SEQ ID NO: 1994277 - protein, 8 aa, Staphylococcus
VKTGEGGK

SEQ ID NO: 1994278 - protein, 6 aa, Staphylococcus
VKTGER

SEQ ID NO: 1994279 - protein, 7 aa, Staphylococcus
VKTGERI

SEQ ID NO: 1994280 - protein, 10 aa, Staphylococcus
VKTGGEELAQ

SEQ ID NO: 1994281 - protein, 16 aa, Staphylococcus
VKTGGPELAKRLEDEG

SEQ ID NO: 1994282 - protein, 16 aa, Staphylococcus
VKTGSKNVQDNIQDGK

SEQ ID NO: 1994283 - protein, 7 aa, Staphylococcus
VKTKNGL

SEQ ID NO: 1994284 - protein, 8 aa, Staphylococcus
VKTNDATR

SEQ ID NO: 1994285 - protein, 8 aa, Staphylococcus
VKTNDGTH

SEQ ID NO: 1994286 - protein, 7 aa, Staphylococcus
VKTNGGR

SEQ ID NO: 1994287 - protein, 8 aa, Staphylococcus
VKTPEEID

SEQ ID NO: 1994288 - protein, 7 aa, Staphylococcus
VKTPKED

SEQ ID NO: 1994289 - protein, 6 aa, Staphylococcus
VKTPLT

SEQ ID NO: 1994290 - protein, 8 aa, Staphylococcus
VKTQKYTI

SEQ ID NO: 1994291 - protein, 12 aa, Staphylococcus
VKTQYSNMGAES

SEQ ID NO: 1994292 - protein, 13 aa, Staphylococcus
VKTRQTQSFNQPT

SEQ ID NO: 1994293 - protein, 6 aa, Staphylococcus
VKTSDR

SEQ ID NO: 1994294 - protein, 8 aa, Staphylococcus
VKTSNGKY

SEQ ID NO: 1994295 - protein, 10 aa, Staphylococcus
VKTSNLGKPI

SEQ ID NO: 1994296 - protein, 9 aa, Staphylococcus
VKTTDSYGI

SEQ ID NO: 1994297 - protein, 12 aa, Staphylococcus
VKTTDSYGTEQR

SEQ ID NO: 1994298 - protein, 9 aa, Staphylococcus
VKTTDTYGI

SEQ ID NO: 1994299 - protein, 14 aa, Staphylococcus
VKTTEIEGHPDFSG

SEQ ID NO: 1994300 - protein, 9 aa, Staphylococcus
VKTTGSGFV

SEQ ID NO: 1994301 - protein, 12 aa, Staphylococcus
VKTTQSYGSEQR

SEQ ID NO: 1994302 - protein, 7 aa, Staphylococcus
VKVEEGQ

SEQ ID NO: 1994303 - protein, 13 aa, Staphylococcus
VKVETDGKLLTGK

SEQ ID NO: 1994304 - protein, 4 aa, Staphylococcus
VKVG

SEQ ID NO: 1994305 - protein, 25 aa, Staphylococcus
VKVGAPTVEGASVTATVNKQGRGKK

SEQ ID NO: 1994306 - protein, 9 aa, Staphylococcus
VKVKSDNQV

SEQ ID NO: 1994307 - protein, 19 aa, Staphylococcus
VKVNDGKDLSQDAHAKDLE

SEQ ID NO: 1994308 - protein, 6 aa, Staphylococcus
VKVNGE

SEQ ID NO: 1994309 - protein, 6 aa, Staphylococcus
VKVNGQ

SEQ ID NO: 1994310 - protein, 9 aa, Staphylococcus
VKVNSNSVT

SEQ ID NO: 1994311 - protein, 8 aa, Staphylococcus
VKVSSKYK

SEQ ID NO: 1994312 - protein, 8 aa, Staphylococcus
VKVTNKEE

SEQ ID NO: 1994313 - protein, 10 aa, Staphylococcus
VKYNKQKNRI

SEQ ID NO: 1994314 - protein, 15 aa, Staphylococcus
VKYPYSKETSTITQY

SEQ ID NO: 1994315 - protein, 19 aa, Staphylococcus
VKYSKKYKTHDENNSAKLG

SEQ ID NO: 1994316 - protein, 24 aa, Staphylococcus
VLDPESNDVTPDKLKKIQRDQNKR

SEQ ID NO: 1994317 - protein, 11 aa, Staphylococcus
VLDSKEEVEPM

SEQ ID NO: 1994318 - protein, 6 aa, Staphylococcus
VLDSNP

SEQ ID NO: 1994319 - protein, 11 aa, Staphylococcus
VLDSSEEIEPM

SEQ ID NO: 1994320 - protein, 13 aa, Staphylococcus
VLDSSEEKEPIYG

SEQ ID NO: 1994321 - protein, 13 aa, Staphylococcus
VLDSSEESEPIYG

SEQ ID NO: 1994322 - protein, 11 aa, Staphylococcus
VLDSSEEVEPM

SEQ ID NO: 1994323 - protein, 13 aa, Staphylococcus
VLDTSDEEPEPIY

SEQ ID NO: 1994324 - protein, 4 aa, Staphylococcus
VLES

SEQ ID NO: 1994325 - protein, 9 aa, Staphylococcus
VLESEEKNI

SEQ ID NO: 1994326 - protein, 21 aa, Staphylococcus
VLESNEELEDSPEFVNESPYE

SEQ ID NO: 1994327 - protein, 17 aa, Staphylococcus
VLGDHERKDTVKNAEET

SEQ ID NO: 1994328 - protein, 17 aa, Staphylococcus
VLGNHERKDTVKNAEET

SEQ ID NO: 1994329 - protein, 15 aa, Staphylococcus
VLGQAQTGTGKTGAF

SEQ ID NO: 1994330 - protein, 7 aa, Staphylococcus
VLKGERG

SEQ ID NO: 1994331 - protein, 10 aa, Staphylococcus
VLNEQNGQSF

SEQ ID NO: 1994332 - protein, 4 aa, Staphylococcus
VLPK

SEQ ID NO: 1994333 - protein, 18 aa, Staphylococcus
VLRDEGEAYANKLREAGV

SEQ ID NO: 1994334 - protein, 11 aa, Staphylococcus
VLSQEEAEKYL

SEQ ID NO: 1994335 - protein, 4 aa, Staphylococcus
VLST

SEQ ID NO: 1994336 - protein, 24 aa, Staphylococcus
VLSTKAVAGTIKRSNDIDEDEKNI

SEQ ID NO: 1994337 - protein, 12 aa, Staphylococcus
VLTDDEKKTQAY

SEQ ID NO: 1994338 - protein, 10 aa, Staphylococcus
VLTETAEERL

SEQ ID NO: 1994339 - protein, 5 aa, Staphylococcus
VLTQE

SEQ ID NO: 1994340 - protein, 9 aa, Staphylococcus
VLTQEGSTI

SEQ ID NO: 1994341 - protein, 8 aa, Staphylococcus
VLTSESNV

SEQ ID NO: 1994342 - protein, 8 aa, Staphylococcus
VMNETDNP

SEQ ID NO: 1994343 - protein, 6 aa, Staphylococcus
VMPEAD

SEQ ID NO: 1994344 - protein, 17 aa, Staphylococcus
VMQGETSNIAAQREIKE

SEQ ID NO: 1994345 - protein, 24 aa, Staphylococcus
VMSQASKSYEELNSKRYTRNKEKY

SEQ ID NO: 1994346 - protein, 10 aa, Staphylococcus
VNADEYEAVG

SEQ ID NO: 1994347 - protein, 8 aa, Staphylococcus
VNAEHSEA

SEQ ID NO: 1994348 - protein, 8 aa, Staphylococcus
VNAEHSED

SEQ ID NO: 1994349 - protein, 8 aa, Staphylococcus
VNAEHSES

SEQ ID NO: 1994350 - protein, 5 aa, Staphylococcus
VNAET

SEQ ID NO: 1994351 - protein, 5 aa, Staphylococcus
VNAKD

SEQ ID NO: 1994352 - protein, 17 aa, Staphylococcus
VNAKNPEGHDVLIWSPK

SEQ ID NO: 1994353 - protein, 5 aa, Staphylococcus
VNANN

SEQ ID NO: 1994354 - protein, 7 aa, Staphylococcus
VNANNTI

SEQ ID NO: 1994355 - protein, 10 aa, Staphylococcus
VNAPKRTNLP

SEQ ID NO: 1994356 - protein, 17 aa, Staphylococcus
VNAPPQKYYSTTCVKLA

SEQ ID NO: 1994357 - protein, 8 aa, Staphylococcus
VNAQTTQL

SEQ ID NO: 1994358 - protein, 16 aa, Staphylococcus
VNASTGKYTGRSPKDK

SEQ ID NO: 1994359 - protein, 16 aa, Staphylococcus
VNATEATMLKQFEGRE

SEQ ID NO: 1994360 - protein, 7 aa, Staphylococcus
VNATEEM

SEQ ID NO: 1994361 - protein, 4 aa, Staphylococcus
VNAY

SEQ ID NO: 1994362 - protein, 8 aa, Staphylococcus
VNAYGKDI

SEQ ID NO: 1994363 - protein, 10 aa, Staphylococcus
VNDANDKDLS

SEQ ID NO: 1994364 - protein, 8 aa, Staphylococcus
VNDANPEV

SEQ ID NO: 1994365 - protein, 6 aa, Staphylococcus
VNDAPF

SEQ ID NO: 1994366 - protein, 16 aa, Staphylococcus
VNDDSDTITITTKDRN

SEQ ID NO: 1994367 - protein, 8 aa, Staphylococcus
VNDDYQSE

SEQ ID NO: 1994368 - protein, 4 aa, Staphylococcus
VNDE

SEQ ID NO: 1994369 - protein, 8 aa, Staphylococcus
VNDEASYQ

SEQ ID NO: 1994370 - protein, 6 aa, Staphylococcus
VNDERA

SEQ ID NO: 1994371 - protein, 5 aa, Staphylococcus
VNDGD

SEQ ID NO: 1994372 - protein, 17 aa, Staphylococcus
VNDGSTRIKGKTLDYRK

SEQ ID NO: 1994373 - protein, 18 aa, Staphylococcus
VNDGSTRVKGKTLEYRDN

SEQ ID NO: 1994374 - protein, 5 aa, Staphylococcus
VNDGY

SEQ ID NO: 1994375 - protein, 11 aa, Staphylococcus
VNDKNQVHTPT

SEQ ID NO: 1994376 - protein, 6 aa, Staphylococcus
VNDLEG

SEQ ID NO: 1994377 - protein, 5 aa, Staphylococcus
VNDLS

SEQ ID NO: 1994378 - protein, 4 aa, Staphylococcus
VNDN

SEQ ID NO: 1994379 - protein, 5 aa, Staphylococcus
VNDND

SEQ ID NO: 1994380 - protein, 6 aa, Staphylococcus
VNDNDT

SEQ ID NO: 1994381 - protein, 7 aa, Staphylococcus
VNDNDVP

SEQ ID NO: 1994382 - protein, 6 aa, Staphylococcus
VNDNEI

SEQ ID NO: 1994383 - protein, 6 aa, Staphylococcus
VNDNEL

SEQ ID NO: 1994384 - protein, 10 aa, Staphylococcus
VNDNKRKYTF

SEQ ID NO: 1994385 - protein, 7 aa, Staphylococcus
VNDNQLD

SEQ ID NO: 1994386 - protein, 6 aa, Staphylococcus
VNDPDV

SEQ ID NO: 1994387 - protein, 11 aa, Staphylococcus
VNDPTIEESTD

SEQ ID NO: 1994388 - protein, 11 aa, Staphylococcus
VNDQDLDTDTY

SEQ ID NO: 1994389 - protein, 4 aa, Staphylococcus
VNDR

SEQ ID NO: 1994390 - protein, 11 aa, Staphylococcus
VNDTNKNMQSY

SEQ ID NO: 1994391 - protein, 14 aa, Staphylococcus
VNDTPQTFAQFLSQ

SEQ ID NO: 1994392 - protein, 19 aa, Staphylococcus
VNDTTSTDEHNDDQLSEDN

SEQ ID NO: 1994393 - protein, 11 aa, Staphylococcus
VNEALSSNNDD

SEQ ID NO: 1994394 - protein, 6 aa, Staphylococcus
VNEDDN

SEQ ID NO: 1994395 - protein, 7 aa, Staphylococcus
VNEDQNY

SEQ ID NO: 1994396 - protein, 6 aa, Staphylococcus
VNEDSV

SEQ ID NO: 1994397 - protein, 4 aa, Staphylococcus
VNEE

SEQ ID NO: 1994398 - protein, 7 aa, Staphylococcus
VNEEDQI

SEQ ID NO: 1994399 - protein, 6 aa, Staphylococcus
VNEEDT

SEQ ID NO: 1994400 - protein, 7 aa, Staphylococcus
VNEEESY

SEQ ID NO: 1994401 - protein, 5 aa, Staphylococcus
VNEEF

SEQ ID NO: 1994402 - protein, 6 aa, Staphylococcus
VNEETE

SEQ ID NO: 1994403 - protein, 16 aa, Staphylococcus
VNEETPQITLNGGSTP

SEQ ID NO: 1994404 - protein, 16 aa, Staphylococcus
VNEETPQLTLNEGNTP

SEQ ID NO: 1994405 - protein, 7 aa, Staphylococcus
VNEGDAF

SEQ ID NO: 1994406 - protein, 17 aa, Staphylococcus
VNEGDARSFKKRAEDLE

SEQ ID NO: 1994407 - protein, 9 aa, Staphylococcus
VNEGKSTQM

SEQ ID NO: 1994408 - protein, 4 aa, Staphylococcus
VNEH

SEQ ID NO: 1994409 - protein, 10 aa, Staphylococcus
VNEKDGAFYG

SEQ ID NO: 1994410 - protein, 5 aa, Staphylococcus
VNEKE

SEQ ID NO: 1994411 - protein, 9 aa, Staphylococcus
VNEKNQVPN

SEQ ID NO: 1994412 - protein, 17 aa, Staphylococcus
VNEKRGIKAEKQDAPEI

SEQ ID NO: 1994413 - protein, 17 aa, Staphylococcus
VNEKRGIKEEEPDAPEV

SEQ ID NO: 1994414 - protein, 17 aa, Staphylococcus
VNEKRGIKEETPDAPEV

SEQ ID NO: 1994415 - protein, 16 aa, Staphylococcus
VNEKRGIKEETPDVPD

SEQ ID NO: 1994416 - protein, 16 aa, Staphylococcus
VNEKRGIKEETTTPEI

SEQ ID NO: 1994417 - protein, 16 aa, Staphylococcus
VNEKRGITEETPDTPE

SEQ ID NO: 1994418 - protein, 17 aa, Staphylococcus
VNEKRGITEEVPDAPDV

SEQ ID NO: 1994419 - protein, 11 aa, Staphylococcus
VNENKKKYGFE

SEQ ID NO: 1994420 - protein, 5 aa, Staphylococcus
VNENP

SEQ ID NO: 1994421 - protein, 8 aa, Staphylococcus
VNENSEAI

SEQ ID NO: 1994422 - protein, 15 aa, Staphylococcus
VNENTPNVTLNEGQT

SEQ ID NO: 1994423 - protein, 7 aa, Staphylococcus
VNEQQAK

SEQ ID NO: 1994424 - protein, 5 aa, Staphylococcus
VNERE

SEQ ID NO: 1994425 - protein, 15 aa, Staphylococcus
VNETENEMLKQFKGR

SEQ ID NO: 1994426 - protein, 5 aa, Staphylococcus
VNETR

SEQ ID NO: 1994427 - protein, 10 aa, Staphylococcus
VNETYDTAHP

SEQ ID NO: 1994428 - protein, 15 aa, Staphylococcus
VNGDANGSIPTSEPL

SEQ ID NO: 1994429 - protein, 6 aa, Staphylococcus
VNGDGR

SEQ ID NO: 1994430 - protein, 8 aa, Staphylococcus
VNGDNEHP

SEQ ID NO: 1994431 - protein, 7 aa, Staphylococcus
VNGEERH

SEQ ID NO: 1994432 - protein, 11 aa, Staphylococcus
VNGEIGTSYDD

SEQ ID NO: 1994433 - protein, 10 aa, Staphylococcus
VNGGEHETAT

SEQ ID NO: 1994434 - protein, 7 aa, Staphylococcus
VNGGEQS

SEQ ID NO: 1994435 - protein, 8 aa, Staphylococcus
VNGGFTEG

SEQ ID NO: 1994436 - protein, 9 aa, Staphylococcus
VNGGFTEGT

SEQ ID NO: 1994437 - protein, 8 aa, Staphylococcus
VNGGGCTG

SEQ ID NO: 1994438 - protein, 18 aa, Staphylococcus
VNGKEVKSFDEPDASKLP

SEQ ID NO: 1994439 - protein, 18 aa, Staphylococcus
VNGKEVKSFEEPDASKLP

SEQ ID NO: 1994440 - protein, 19 aa, Staphylococcus
VNGKEVKSFEEPDASKLPW

SEQ ID NO: 1994441 - protein, 19 aa, Staphylococcus
VNGKEVKSYEEPDASKLPW

SEQ ID NO: 1994442 - protein, 7 aa, Staphylococcus
VNGKGYT

SEQ ID NO: 1994443 - protein, 16 aa, Staphylococcus
VNGNQNVKPETRDKVN

SEQ ID NO: 1994444 - protein, 15 aa, Staphylococcus
VNGNQNVKPETRKKV

SEQ ID NO: 1994445 - protein, 16 aa, Staphylococcus
VNGNQNVKPETRKKVN

SEQ ID NO: 1994446 - protein, 6 aa, Staphylococcus
VNGNQV

SEQ ID NO: 1994447 - protein, 18 aa, Staphylococcus
VNGPNFIKPDDPKAKSLI

SEQ ID NO: 1994448 - protein, 8 aa, Staphylococcus
VNGRGVPK

SEQ ID NO: 1994449 - protein, 5 aa, Staphylococcus
VNGRR

SEQ ID NO: 1994450 - protein, 8 aa, Staphylococcus
VNGSIDES

SEQ ID NO: 1994451 - protein, 17 aa, Staphylococcus
VNGTASLDAEKQDENMQ

SEQ ID NO: 1994452 - protein, 17 aa, Staphylococcus
VNGTASLDPETQDDNMQ

SEQ ID NO: 1994453 - protein, 17 aa, Staphylococcus
VNGTASLDSEKQDENMQ

SEQ ID NO: 1994454 - protein, 16 aa, Staphylococcus
VNGTASLESDNQDENM

SEQ ID NO: 1994455 - protein, 17 aa, Staphylococcus
VNGTASLNSEQQDENMQ

SEQ ID NO: 1994456 - protein, 17 aa, Staphylococcus
VNGTASVDSEKQDENMQ

SEQ ID NO: 1994457 - protein, 18 aa, Staphylococcus
VNGTNDSISQDDTQATFA

SEQ ID NO: 1994458 - protein, 4 aa, Staphylococcus
VNHD

SEQ ID NO: 1994459 - protein, 8 aa, Staphylococcus
VNHSKSNK

SEQ ID NO: 1994460 - protein, 17 aa, Staphylococcus
VNHTGVSGSLEGQGIGT

SEQ ID NO: 1994461 - protein, 10 aa, Staphylococcus
VNIDKTTANA

SEQ ID NO: 1994462 - protein, 5 aa, Staphylococcus
VNIPS

SEQ ID NO: 1994463 - protein, 4 aa, Staphylococcus
VNIS

SEQ ID NO: 1994464 - protein, 11 aa, Staphylococcus
VNKALKSINGT

SEQ ID NO: 1994465 - protein, 10 aa, Staphylococcus
VNKDDADLGF

SEQ ID NO: 1994466 - protein, 7 aa, Staphylococcus
VNKDELE

SEQ ID NO: 1994467 - protein, 8 aa, Staphylococcus
VNKDGELI

SEQ ID NO: 1994468 - protein, 10 aa, Staphylococcus
VNKDITPNNE

SEQ ID NO: 1994469 - protein, 8 aa, Staphylococcus
VNKDNGVT

SEQ ID NO: 1994470 - protein, 7 aa, Staphylococcus
VNKENGE

SEQ ID NO: 1994471 - protein, 6 aa, Staphylococcus
VNKESA

SEQ ID NO: 1994472 - protein, 5 aa, Staphylococcus
VNKET

SEQ ID NO: 1994473 - protein, 6 aa, Staphylococcus
VNKETQ

SEQ ID NO: 1994474 - protein, 25 aa, Staphylococcus
VNKGSEVDASVNKDERRSIQKNHSA

SEQ ID NO: 1994475 - protein, 8 aa, Staphylococcus
VNKGTTIR

SEQ ID NO: 1994476 - protein, 25 aa, Staphylococcus
VNKKEKTRNPANPFTTSTLQQEAAR

SEQ ID NO: 1994477 - protein, 25 aa, Staphylococcus
VNKKEKTRNPAQPFTTSTLQQEAAR

SEQ ID NO: 1994478 - protein, 25 aa, Staphylococcus
VNKKEKTRYPANPFTTSTLQQEAAR

SEQ ID NO: 1994479 - protein, 8 aa, Staphylococcus
VNKKPSVG

SEQ ID NO: 1994480 - protein, 4 aa, Staphylococcus
VNKN

SEQ ID NO: 1994481 - protein, 13 aa, Staphylococcus
VNKNPDQQVFSAK

SEQ ID NO: 1994482 - protein, 20 aa, Staphylococcus
VNKPGSASTPATRANSNGWK

SEQ ID NO: 1994483 - protein, 9 aa, Staphylococcus
VNKQGGQLE

SEQ ID NO: 1994484 - protein, 7 aa, Staphylococcus
VNKQNAN

SEQ ID NO: 1994485 - protein, 9 aa, Staphylococcus
VNKSENTLK

SEQ ID NO: 1994486 - protein, 24 aa, Staphylococcus
VNKSETPNKNIIGTSRAYKKLTDK

SEQ ID NO: 1994487 - protein, 6 aa, Staphylococcus
VNKSIE

SEQ ID NO: 1994488 - protein, 7 aa, Staphylococcus
VNKSSLV

SEQ ID NO: 1994489 - protein, 7 aa, Staphylococcus
VNLGPDA

SEQ ID NO: 1994490 - protein, 8 aa, Staphylococcus
VNLKDDEN

SEQ ID NO: 1994491 - protein, 6 aa, Staphylococcus
VNLKQD

SEQ ID NO: 1994492 - protein, 4 aa, Staphylococcus
VNLS

SEQ ID NO: 1994493 - protein, 6 aa, Staphylococcus
VNNDGS

SEQ ID NO: 1994494 - protein, 8 aa, Staphylococcus
VNNDSLDV

SEQ ID NO: 1994495 - protein, 7 aa, Staphylococcus
VNNEKDA

SEQ ID NO: 1994496 - protein, 8 aa, Staphylococcus
VNNENIDE

SEQ ID NO: 1994497 - protein, 8 aa, Staphylococcus
VNNEQKKI

SEQ ID NO: 1994498 - protein, 6 aa, Staphylococcus
VNNEQT

SEQ ID NO: 1994499 - protein, 7 aa, Staphylococcus
VNNGDAV

SEQ ID NO: 1994500 - protein, 10 aa, Staphylococcus
VNNGPDSVGT

SEQ ID NO: 1994501 - protein, 7 aa, Staphylococcus
VNNKTEI

SEQ ID NO: 1994502 - protein, 8 aa, Staphylococcus
VNNMGDDM

SEQ ID NO: 1994503 - protein, 6 aa, Staphylococcus
VNNNER

SEQ ID NO: 1994504 - protein, 8 aa, Staphylococcus
VNNNLGRD

SEQ ID NO: 1994505 - protein, 16 aa, Staphylococcus
VNNPLNTELLKILTKV

SEQ ID NO: 1994506 - protein, 11 aa, Staphylococcus
VNNRKEQGNFK

SEQ ID NO: 1994507 - protein, 10 aa, Staphylococcus
VNNTGTFGSV

SEQ ID NO: 1994508 - protein, 15 aa, Staphylococcus
VNPAKIKSKGIKSVR

SEQ ID NO: 1994509 - protein, 17 aa, Staphylococcus
VNPAKIKSKGIKSVRSR

SEQ ID NO: 1994510 - protein, 7 aa, Staphylococcus
VNPDEVS

SEQ ID NO: 1994511 - protein, 8 aa, Staphylococcus
VNPDEVSV

SEQ ID NO: 1994512 - protein, 7 aa, Staphylococcus
VNPDTLK

SEQ ID NO: 1994513 - protein, 4 aa, Staphylococcus [sequence omitted]

SEQ ID NO: 1994514 - protein, 7 aa, Staphylococcus
VNPERMK

SEQ ID NO: 1994515 - protein, 7 aa, Staphylococcus
VNPETQY

SEQ ID NO: 1994516 - protein, 11 aa, Staphylococcus
VNPFPSRQQND

SEQ ID NO: 1994517 - protein, 29 aa, Staphylococcus
VNPGGSMSGGGMRQSKSILAQKDELTTMK

SEQ ID NO: 1994518 - protein, 28 aa, Staphylococcus
VNPGGSMTGGGARKTKSILSQKDELTTM

SEQ ID NO: 1994519 - protein, 27 aa, Staphylococcus
VNPGGSMTGGGDRKTKSILAQKDDLAK

SEQ ID NO: 1994520 - protein, 17 aa, Staphylococcus
VNPGGSMTGGGQRQTKS

SEQ ID NO: 1994521 - protein, 12 aa, Staphylococcus
VNPLENHDKNDA

SEQ ID NO: 1994522 - protein, 6 aa, Staphylococcus
VNPNYD

SEQ ID NO: 1994523 - protein, 12 aa, Staphylococcus
VNPPKQRNDNKL

SEQ ID NO: 1994524 - protein, 7 aa, Staphylococcus
VNPPKSW

SEQ ID NO: 1994525 - protein, 5 aa, Staphylococcus
VNPPQ

SEQ ID NO: 1994526 - protein, 8 aa, Staphylococcus
VNPQASQE

SEQ ID NO: 1994527 - protein, 6 aa, Staphylococcus
VNPRGV

SEQ ID NO: 1994528 - protein, 6 aa, Staphylococcus
VNPSGV

SEQ ID NO: 1994529 - protein, 18 aa, Staphylococcus
VNPSKSLSKQKLSEVTGF

SEQ ID NO: 1994530 - protein, 7 aa, Staphylococcus
VNPTQSH

SEQ ID NO: 1994531 - protein, 8 aa, Staphylococcus
VNPTSDGE

SEQ ID NO: 1994532 - protein, 15 aa, Staphylococcus
VNPVDGKTRIRPING

SEQ ID NO: 1994533 - protein, 15 aa, Staphylococcus
VNPVDTKIRKTPVEH

SEQ ID NO: 1994534 - protein, 18 aa, Staphylococcus
VNPVDTKIRQTPIQNPPR

SEQ ID NO: 1994535 - protein, 19 aa, Staphylococcus
VNPVDTKQRLTEVKSSPRI

SEQ ID NO: 1994536 - protein, 14 aa, Staphylococcus
VNPVDTKQRQLPVS

SEQ ID NO: 1994537 - protein, 8 aa, Staphylococcus
VNQAGSLV

SEQ ID NO: 1994538 - protein, 10 aa, Staphylococcus
VNQAGSLVES

SEQ ID NO: 1994539 - protein, 6 aa, Staphylococcus
VNQAKG

SEQ ID NO: 1994540 - protein, 7 aa, Staphylococcus
VNQAKGY

SEQ ID NO: 1994541 - protein, 8 aa, Staphylococcus
VNQEIRQP

SEQ ID NO: 1994542 - protein, 7 aa, Staphylococcus
VNQENQV

SEQ ID NO: 1994543 - protein, 5 aa, Staphylococcus
VNQFD

SEQ ID NO: 1994544 - protein, 9 aa, Staphylococcus
VNQGHQEEA

SEQ ID NO: 1994545 - protein, 17 aa, Staphylococcus
VNQGKETADELKRFLEQ

SEQ ID NO: 1994546 - protein, 7 aa, Staphylococcus
VNQKELS

SEQ ID NO: 1994547 - protein, 8 aa, Staphylococcus
VNQMRSGS

SEQ ID NO: 1994548 - protein, 23 aa, Staphylococcus
VNQNPNKQDIEASQVYQTRKARI

SEQ ID NO: 1994549 - protein, 7 aa, Staphylococcus
VNQPEND

SEQ ID NO: 1994550 - protein, 7 aa, Staphylococcus
VNQPIDE

SEQ ID NO: 1994551 - protein, 26 aa, Staphylococcus
VNQPKKENQSNKRNYKQKQLASREMT

SEQ ID NO: 1994552 - protein, 10 aa, Staphylococcus
VNQPQEELYK

SEQ ID NO: 1994553 - protein, 6 aa, Staphylococcus
VNQPVN

SEQ ID NO: 1994554 - protein, 7 aa, Staphylococcus
VNQQALP

SEQ ID NO: 1994555 - protein, 8 aa, Staphylococcus
VNQQIRQP

SEQ ID NO: 1994556 - protein, 8 aa, Staphylococcus
VNQSDEEF

SEQ ID NO: 1994557 - protein, 12 aa, Staphylococcus
VNQTKEELNHRK

SEQ ID NO: 1994558 - protein, 7 aa, Staphylococcus
VNRDGQV

SEQ ID NO: 1994559 - protein, 22 aa, Staphylococcus
VNRKKDLNSKQSLTSKVKQGPT

SEQ ID NO: 1994560 - protein, 30 aa, Staphylococcus
VNRKPISASEEDLAENNRARSAKLRVAEIL

SEQ ID NO: 1994561 - protein, 30 aa, Staphylococcus; identical to SEQ ID NO: 1792357

SEQ ID NO: 1994562 - protein, 30 aa, Staphylococcus
VNRKPITATEEDLNQNNRARSAKLRVAEIL

SEQ ID NO: 1994563 - protein, 8 aa, Staphylococcus
VNRPERKH

SEQ ID NO: 1994564 - protein, 10 aa, Staphylococcus
VNRPQRENVP

SEQ ID NO: 1994565 - protein, 4 aa, Staphylococcus
VNRS

SEQ ID NO: 1994566 - protein, 5 aa, Staphylococcus
VNRSG

SEQ ID NO: 1994567 - protein, 7 aa, Staphylococcus
VNSDAQS

SEQ ID NO: 1994568 - protein, 7 aa, Staphylococcus
VNSDEDV

SEQ ID NO: 1994569 - protein, 12 aa, Staphylococcus
VNSDKSHASNYR

SEQ ID NO: 1994570 - protein, 5 aa, Staphylococcus
VNSDT

SEQ ID NO: 1994571 - protein, 14 aa, Staphylococcus
VNSDTPKLTLNEGH

SEQ ID NO: 1994572 - protein, 9 aa, Staphylococcus
VNSEDEAKQ

SEQ ID NO: 1994573 - protein, 13 aa, Staphylococcus
VNSEDSHAKNYQI

SEQ ID NO: 1994574 - protein, 12 aa, Staphylococcus
VNSEDSHAKNYR

SEQ ID NO: 1994575 - protein, 12 aa, Staphylococcus
VNSEKSHAQNYR

SEQ ID NO: 1994576 - protein, 9 aa, Staphylococcus
VNSETGEIV

SEQ ID NO: 1994577 - protein, 5 aa, Staphylococcus
VNSEV

SEQ ID NO: 1994578 - protein, 4 aa, Staphylococcus
VNSG

SEQ ID NO: 1994579 - protein, 7 aa, Staphylococcus
VNSGETL

SEQ ID NO: 1994580 - protein, 6 aa, Staphylococcus
VNSHTK

SEQ ID NO: 1994581 - protein, 7 aa, Staphylococcus
VNSHTNA

SEQ ID NO: 1994582 - protein, 12 aa, Staphylococcus
VNSKEELENQIN

SEQ ID NO: 1994583 - protein, 14 aa, Staphylococcus
VNSKELKDAYEKQF

SEQ ID NO: 1994584 - protein, 7 aa, Staphylococcus
VNSKGLT

SEQ ID NO: 1994585 - protein, 9 aa, Staphylococcus
VNSKKSHAM

SEQ ID NO: 1994586 - protein, 8 aa, Staphylococcus
VNSKQSHA

SEQ ID NO: 1994587 - protein, 5 aa, Staphylococcus
VNSLS

SEQ ID NO: 1994588 - protein, 4 aa, Staphylococcus
VNSN

SEQ ID NO: 1994589 - protein, 6 aa, Staphylococcus
VNSNGH

SEQ ID NO: 1994590 - protein, 8 aa, Staphylococcus
VNSNLGRN

SEQ ID NO: 1994591 - protein, 9 aa, Staphylococcus
VNSPKGAAA

SEQ ID NO: 1994592 - protein, 7 aa, Staphylococcus
VNSPNKL

SEQ ID NO: 1994593 - protein, 5 aa, Staphylococcus
VNSRR

SEQ ID NO: 1994594 - protein, 9 aa, Staphylococcus
VNSSDEQEL

SEQ ID NO: 1994595 - protein, 8 aa, Staphylococcus
VNSTNGSL

SEQ ID NO: 1994596 - protein, 7 aa, Staphylococcus
VNSTQSN

SEQ ID NO: 1994597 - protein, 9 aa, Staphylococcus
VNSYGKDIE

SEQ ID NO: 1994598 - protein, 10 aa, Staphylococcus
VNSYGKDIEG

SEQ ID NO: 1994599 - protein, 7 aa, Staphylococcus
VNTASQS

SEQ ID NO: 1994600 - protein, 11 aa, Staphylococcus
VNTEDAKLTKA

SEQ ID NO: 1994601 - protein, 9 aa, Staphylococcus
VNTETGEIV

SEQ ID NO: 1994602 - protein, 9 aa, Staphylococcus
VNTGDEDVE

SEQ ID NO: 1994603 - protein, 8 aa, Staphylococcus
VNTGTKEF

SEQ ID NO: 1994604 - protein, 11 aa, Staphylococcus
VNTKNQDATEI

SEQ ID NO: 1994605 - protein, 11 aa, Staphylococcus
VNTKNQDAVEE

SEQ ID NO: 1994606 - protein, 4 aa, Staphylococcus
VNTL

SEQ ID NO: 1994607 - protein, 8 aa, Staphylococcus
VNTLGDDV

SEQ ID NO: 1994608 - protein, 4 aa, Staphylococcus
VNTN

SEQ ID NO: 1994609 - protein, 8 aa, Staphylococcus
VNTNDHST

SEQ ID NO: 1994610 - protein, 8 aa, Staphylococcus
VNTNLGRD

SEQ ID NO: 1994611 - protein, 9 aa, Staphylococcus
VNTNPKPWD

SEQ ID NO: 1994612 - protein, 8 aa, Staphylococcus
VNTNPVDQ

SEQ ID NO: 1994613 - protein, 5 aa, Staphylococcus
VNTPL

SEQ ID NO: 1994614 - protein, 6 aa, Staphylococcus
VNTPQG

SEQ ID NO: 1994615 - protein, 7 aa, Staphylococcus
VNTRTDL

SEQ ID NO: 1994616 - protein, 8 aa, Staphylococcus
VNTSEELK

SEQ ID NO: 1994617 - protein, 9 aa, Staphylococcus
VNTSGHSVK

SEQ ID NO: 1994618 - protein, 7 aa, Staphylococcus
VNTVTDT

SEQ ID NO: 1994619 - protein, 8 aa, Staphylococcus
VNVKSKEI

SEQ ID NO: 1994620 - protein, 7 aa, Staphylococcus
VNVPRTE

SEQ ID NO: 1994621 - protein, 8 aa, Staphylococcus
VNVSRQTV

SEQ ID NO: 1994622 - protein, 4 aa, Staphylococcus
VNYD

SEQ ID NO: 1994623 - protein, 8 aa, Staphylococcus
VNYDDPST

SEQ ID NO: 1994624 - protein, 7 aa, Staphylococcus
VNYDDTK

SEQ ID NO: 1994625 - protein, 8 aa, Staphylococcus
VNYENAGT

SEQ ID NO: 1994626 - protein, 12 aa, Staphylococcus
VNYTEASSNDSI

SEQ ID NO: 1994627 - protein, 14 aa, Staphylococcus
VPADDENGAPKPRL

SEQ ID NO: 1994628 - protein, 6 aa, Staphylococcus
VPAETY

SEQ ID NO: 1994629 - protein, 14 aa, Staphylococcus
VPAFKAGKALKDAV

SEQ ID NO: 1994630 - protein, 7 aa, Staphylococcus
VPAGAEA

SEQ ID NO: 1994631 - protein, 14 aa, Staphylococcus
VPAKTIKKRFDDET

SEQ ID NO: 1994632 - protein, 12 aa, Staphylococcus
VPALDKNKNHTI

SEQ ID NO: 1994633 - protein, 7 aa, Staphylococcus
VPAPATA

SEQ ID NO: 1994634 - protein, 8 aa, Staphylococcus
VPAPATAE

SEQ ID NO: 1994635 - protein, 9 aa, Staphylococcus
VPAPTRAER

SEQ ID NO: 1994636 - protein, 4 aa, Staphylococcus
VPAS

SEQ ID NO: 1994637 - protein, 8 aa, Staphylococcus
VPASELTN

SEQ ID NO: 1994638 - protein, 24 aa, Staphylococcus
VPASSVKKNTTTTTNKKGSKEPTV

SEQ ID NO: 1994639 - protein, 10 aa, Staphylococcus
VPATDETVKT

SEQ ID NO: 1994640 - protein, 28 aa, Staphylococcus
VPATTDKESIEKKYEAGEGKLSTDVASY

SEQ ID NO: 1994641 - protein, 13 aa, Staphylococcus
VPDDLDPAAASSI

SEQ ID NO: 1994642 - protein, 7 aa, Staphylococcus
VPDLPPV

SEQ ID NO: 1994643 - protein, 8 aa, Staphylococcus
VPDNDLGN

SEQ ID NO: 1994644 - protein, 9 aa, Staphylococcus
VPDQKATFE

SEQ ID NO: 1994645 - protein, 9 aa, Staphylococcus
VPDQPSFKS

SEQ ID NO: 1994646 - protein, 4 aa, Staphylococcus
VPDS

SEQ ID NO: 1994647 - protein, 8 aa, Staphylococcus
VPDSTDGR

SEQ ID NO: 1994648 - protein, 4 aa, Staphylococcus
VPDV

SEQ ID NO: 1994649 - protein, 4 aa, Staphylococcus
VPDY

SEQ ID NO: 1994650 - protein, 21 aa, Staphylococcus
VPEAEPLKSIDDATKIIMRGD

SEQ ID NO: 1994651 - protein, 5 aa, Staphylococcus
VPEAP

SEQ ID NO: 1994652 - protein, 6 aa, Staphylococcus
VPEDAA

SEQ ID NO: 1994653 - protein, 10 aa, Staphylococcus
VPEDVRNERG

SEQ ID NO: 1994654 - protein, 10 aa, Staphylococcus
VPEEAESSEA

SEQ ID NO: 1994655 - protein, 10 aa, Staphylococcus
VPEEVRNERG

SEQ ID NO: 1994656 - protein, 4 aa, Staphylococcus
VPEG

SEQ ID NO: 1994657 - protein, 11 aa, Staphylococcus
VPEGATDEDNI

SEQ ID NO: 1994658 - protein, 11 aa, Staphylococcus
VPEGVDNEQQI

SEQ ID NO: 1994659 - protein, 12 aa, Staphylococcus
VPEGVDNEQQIR

SEQ ID NO: 1994660 - protein, 10 aa, Staphylococcus
VPEGVDTEQQ

SEQ ID NO: 1994661 - protein, 8 aa, Staphylococcus
VPEKELEE

SEQ ID NO: 1994662 - protein, 8 aa, Staphylococcus
VPEKELQE

SEQ ID NO: 1994663 - protein, 6 aa, Staphylococcus
VPELGP

SEQ ID NO: 1994664 - protein, 11 aa, Staphylococcus
VPELSRQSKGI

SEQ ID NO: 1994665 - protein, 12 aa, Staphylococcus
VPELSRQSKGIP

SEQ ID NO: 1994666 - protein, 4 aa, Staphylococcus
VPEN

SEQ ID NO: 1994667 - protein, 5 aa, Staphylococcus
VPENA

SEQ ID NO: 1994668 - protein, 7 aa, Staphylococcus
VPENDGA

SEQ ID NO: 1994669 - protein, 7 aa, Staphylococcus
VPENETA

SEQ ID NO: 1994670 - protein, 5 aa, Staphylococcus
VPESL

SEQ ID NO: 1994671 - protein, 6 aa, Staphylococcus
VPESQI

SEQ ID NO: 1994672 - protein, 5 aa, Staphylococcus
VPESV

SEQ ID NO: 1994673 - protein, 8 aa, Staphylococcus
VPESYESS

SEQ ID NO: 1994674 - protein, 10 aa, Staphylococcus
VPETDYKNKR

SEQ ID NO: 1994675 - protein, 13 aa, Staphylococcus
VPETLDPAAASSI

SEQ ID NO: 1994676 - protein, 9 aa, Staphylococcus
VPEYDTEKR

SEQ ID NO: 1994677 - protein, 8 aa, Staphylococcus
VPFQNDSS

SEQ ID NO: 1994678 - protein, 5 aa, Staphylococcus
VPGDK

SEQ ID NO: 1994679 - protein, 8 aa, Staphylococcus
VPGDKSMT

SEQ ID NO: 1994680 - protein, 5 aa, Staphylococcus
VPGEE

SEQ ID NO: 1994681 - protein, 9 aa, Staphylococcus
VPGKADEKN

SEQ ID NO: 1994682 - protein, 23 aa, Staphylococcus
VPGLPKKKQKQIAEQIASNQETE

SEQ ID NO: 1994683 - protein, 12 aa, Staphylococcus
VPGRHNDDSATI

SEQ ID NO: 1994684 - protein, 11 aa, Staphylococcus
VPGRHNDDTST

SEQ ID NO: 1994685 - protein, 15 aa, Staphylococcus
VPGRPGSMGKAIPGS

SEQ ID NO: 1994686 - protein, 13 aa, Staphylococcus
VPGTIDNDINGTD

SEQ ID NO: 1994687 - protein, 6 aa, Staphylococcus
VPGYER

SEQ ID NO: 1994688 - protein, 11 aa, Staphylococcus
VPHGDDTTHEI

SEQ ID NO: 1994689 - protein, 7 aa, Staphylococcus
VPHSEGY

SEQ ID NO: 1994690 - protein, 4 aa, Staphylococcus
VPHV

SEQ ID NO: 1994691 - protein, 11 aa, Staphylococcus
VPIGSTAGGIK

SEQ ID NO: 1994692 - protein, 5 aa, Staphylococcus
VPISD

SEQ ID NO: 1994693 - protein, 13 aa, Staphylococcus
VPKADTSKIKAGD

SEQ ID NO: 1994694 - protein, 13 aa, Staphylococcus
VPKDQTDKIKAGD

SEQ ID NO: 1994695 - protein, 6 aa, Staphylococcus
VPKENV

SEQ ID NO: 1994696 - protein, 13 aa, Staphylococcus
VPKEQTDKIKAGD

SEQ ID NO: 1994697 - protein, 9 aa, Staphylococcus
VPKEVREAR

SEQ ID NO: 1994698 - protein, 9 aa, Staphylococcus
VPKGASNKV

SEQ ID NO: 1994699 - protein, 6 aa, Staphylococcus
VPKIGA

SEQ ID NO: 1994700 - protein, 11 aa, Staphylococcus
VPKKEGSAERL

SEQ ID NO: 1994701 - protein, 6 aa, Staphylococcus
VPKLEE

SEQ ID NO: 1994702 - protein, 4 aa, Staphylococcus
VPKN

SEQ ID NO: 1994703 - protein, 6 aa, Staphylococcus
VPKQAV

SEQ ID NO: 1994704 - protein, 4 aa, Staphylococcus
VPKS

SEQ ID NO: 1994705 - protein, 13 aa, Staphylococcus
VPKSETDKVKAGD

SEQ ID NO: 1994706 - protein, 5 aa, Staphylococcus
VPKSI

SEQ ID NO: 1994707 - protein, 15 aa, Staphylococcus
VPKSIADDIIKKNKG

SEQ ID NO: 1994708 - protein, 15 aa, Staphylococcus
VPKSIADEIIKKNKG

SEQ ID NO: 1994709 - protein, 15 aa, Staphylococcus
VPKSIAEEIIKKNKG

SEQ ID NO: 1994710 - protein, 6 aa, Staphylococcus
VPKSKL

SEQ ID NO: 1994711 - protein, 9 aa, Staphylococcus
VPKSKLDHM

SEQ ID NO: 1994712 - protein, 6 aa, Staphylococcus
VPKTYQ

SEQ ID NO: 1994713 - protein, 7 aa, Staphylococcus
VPLPRPE

SEQ ID NO: 1994714 - protein, 8 aa, Staphylococcus
VPLSNDEL

SEQ ID NO: 1994715 - protein, 6 aa, Staphylococcus
VPLTDK

SEQ ID NO: 1994716 - protein, 14 aa, Staphylococcus
VPNDKAVDFMSLIK

SEQ ID NO: 1994717 - protein, 5 aa, Staphylococcus
VPNEE

SEQ ID NO: 1994718 - protein, 4 aa, Staphylococcus
VPNG

SEQ ID NO: 1994719 - protein, 5 aa, Staphylococcus
VPNLK

SEQ ID NO: 1994720 - protein, 9 aa, Staphylococcus
VPNQNPAKV

SEQ ID NO: 1994721 - protein, 9 aa, Staphylococcus
VPNQNPTKV

SEQ ID NO: 1994722 - protein, 10 aa, Staphylococcus
VPNQNSSKVS

SEQ ID NO: 1994723 - protein, 9 aa, Staphylococcus
VPNSDINRV

SEQ ID NO: 1994724 - protein, 7 aa, Staphylococcus
VPNSDKN

SEQ ID NO: 1994725 - protein, 10 aa, Staphylococcus
VPNSIPSDAY

SEQ ID NO: 1994726 - protein, 4 aa, Staphylococcus
VPPH

SEQ ID NO: 1994727 - protein, 6 aa, Staphylococcus
VPPKDG

SEQ ID NO: 1994728 - protein, 8 aa, Staphylococcus
VPPKGNAN

SEQ ID NO: 1994729 - protein, 12 aa, Staphylococcus
VPPNKCPNCESS

SEQ ID NO: 1994730 - protein, 12 aa, Staphylococcus
VPPPEGDPEAPL

SEQ ID NO: 1994731 - protein, 12 aa, Staphylococcus
VPPPEGDPSAPL

SEQ ID NO: 1994732 - protein, 12 aa, Staphylococcus
VPPPEGDPSEPL

SEQ ID NO: 1994733 - protein, 6 aa, Staphylococcus
VPPSND

SEQ ID NO: 1994734 - protein, 8 aa, Staphylococcus
VPPSNDID

SEQ ID NO: 1994735 - protein, 12 aa, Staphylococcus
VPQDAYTASKGA

SEQ ID NO: 1994736 - protein, 8 aa, Staphylococcus
VPQENAGA

SEQ ID NO: 1994737 - protein, 9 aa, Staphylococcus
VPQENSGAV

SEQ ID NO: 1994738 - protein, 12 aa, Staphylococcus
VPQGERDTETQA

SEQ ID NO: 1994739 - protein, 10 aa, Staphylococcus
VPQNDERINK

SEQ ID NO: 1994740 - protein, 15 aa, Staphylococcus
VPQPDPESERTRTRI

SEQ ID NO: 1994741 - protein, 12 aa, Staphylococcus
VPQPDPESERVR

SEQ ID NO: 1994742 - protein, 22 aa, Staphylococcus
VPQPKGKTATSPQEALNNAREI

SEQ ID NO: 1994743 - protein, 22 aa, Staphylococcus
VPQPNGKTATSPQEALENARSI

SEQ ID NO: 1994744 - protein, 21 aa, Staphylococcus
VPQPQGKTATSPKEALENARN

SEQ ID NO: 1994745 - protein, 21 aa, Staphylococcus
VPQPQGKTSTSPKEALENARE

SEQ ID NO: 1994746 - protein, 4 aa, Staphylococcus
VPQS

SEQ ID NO: 1994747 - protein, 10 aa, Staphylococcus
VPQSIPSDAY

SEQ ID NO: 1994748 - protein, 6 aa, Staphylococcus
VPQSKI

SEQ ID NO: 1994749 - protein, 8 aa, Staphylococcus
VPQSKKSK

SEQ ID NO: 1994750 - protein, 8 aa, Staphylococcus
VPQTGESC

SEQ ID NO: 1994751 - protein, 18 aa, Staphylococcus
VPRGTGRVRNMPTAAHTK

SEQ ID NO: 1994752 - protein, 19 aa, Staphylococcus
VPRGTGRVRNMPTAAHTKD

SEQ ID NO: 1994753 - protein, 10 aa, Staphylococcus
VPRKPGMSRD

SEQ ID NO: 1994754 - protein, 5 aa, Staphylococcus
VPRPK

SEQ ID NO: 1994755 - protein, 4 aa, Staphylococcus
VPSD

SEQ ID NO: 1994756 - protein, 5 aa, Staphylococcus
VPSDK

SEQ ID NO: 1994757 - protein, 8 aa, Staphylococcus
VPSDPENF

SEQ ID NO: 1994758 - protein, 19 aa, Staphylococcus
VPSDSGETLEVTNPANGEV

SEQ ID NO: 1994759 - protein, 8 aa, Staphylococcus
VPSEAEAL

SEQ ID NO: 1994760 - protein, 6 aa, Staphylococcus
VPSEKV

SEQ ID NO: 1994761 - protein, 9 aa, Staphylococcus
VPSENAGSV

SEQ ID NO: 1994762 - protein, 5 aa, Staphylococcus
VPSEQ

SEQ ID NO: 1994763 - protein, 19 aa, Staphylococcus
VPSESGETLEVTNPSNGEV

SEQ ID NO: 1994764 - protein, 10 aa, Staphylococcus
VPSGDQRDYE

SEQ ID NO: 1994765 - protein, 12 aa, Staphylococcus
VPSGKSNHEMEG

SEQ ID NO: 1994766 - protein, 5 aa, Staphylococcus
VPSGL

SEQ ID NO: 1994767 - protein, 13 aa, Staphylococcus
VPSHEGKIRPKEV

SEQ ID NO: 1994768 - protein, 15 aa, Staphylococcus
VPSLPKKKQKQIAEQ

SEQ ID NO: 1994769 - protein, 10 aa, Staphylococcus
VPSPVKRPQD

SEQ ID NO: 1994770 - protein, 9 aa, Staphylococcus
VPSRRKDIS

SEQ ID NO: 1994771 - protein, 6 aa, Staphylococcus
VPSSPS

SEQ ID NO: 1994772 - protein, 6 aa, Staphylococcus
VPSTAK

SEQ ID NO: 1994773 - protein, 9 aa, Staphylococcus
VPSYSPSSI

SEQ ID NO: 1994774 - protein, 16 aa, Staphylococcus
VPTAAGLASSASAYAA

SEQ ID NO: 1994775 - protein, 6 aa, Staphylococcus
VPTDDQ

SEQ ID NO: 1994776 - protein, 7 aa, Staphylococcus
VPTDEDL

SEQ ID NO: 1994777 - protein, 9 aa, Staphylococcus
VPTDIEEEA

SEQ ID NO: 1994778 - protein, 7 aa, Staphylococcus
VPTDLDE

SEQ ID NO: 1994779 - protein, 4 aa, Staphylococcus
VPTG

SEQ ID NO: 1994780 - protein, 10 aa, Staphylococcus
VPTREQGISP

SEQ ID NO: 1994781 - protein, 16 aa, Staphylococcus
VPTSNNRLYPKKPYDK

SEQ ID NO: 1994782 - protein, 5 aa, Staphylococcus
VPTTG

SEQ ID NO: 1994783 - protein, 8 aa, Staphylococcus
VPVGGGDH

SEQ ID NO: 1994784 - protein, 25 aa, Staphylococcus
VPVGSTSGKSSQEIYNENFHGGIFR

SEQ ID NO: 1994785 - protein, 7 aa, Staphylococcus
VPVKNKD

SEQ ID NO: 1994786 - protein, 11 aa, Staphylococcus
VPVQVDGKDYN

SEQ ID NO: 1994787 - protein, 10 aa, Staphylococcus
VPVTEDDGKY

SEQ ID NO: 1994788 - protein, 7 aa, Staphylococcus
VPYKSRH

SEQ ID NO: 1994789 - protein, 9 aa, Staphylococcus
VPYRSKNEG

SEQ ID NO: 1994790 - protein, 14 aa, Staphylococcus
VQAAQGHDGAKLGT

SEQ ID NO: 1994791 - protein, 18 aa, Staphylococcus
VQAENDNPYGNSKRQGEA

SEQ ID NO: 1994792 - protein, 15 aa, Staphylococcus
VQAGIAADGAKIGSG

SEQ ID NO: 1994793 - protein, 15 aa, Staphylococcus
VQAGIAGDGAKLGTS

SEQ ID NO: 1994794 - protein, 13 aa, Staphylococcus
VQAGQDKDWGKMG

SEQ ID NO: 1994795 - protein, 7 aa, Staphylococcus
VQAIENP

SEQ ID NO: 1994796 - protein, 5 aa, Staphylococcus
VQAPR

SEQ ID NO: 1994797 - protein, 13 aa, Staphylococcus
VQASREDTEEQLK

SEQ ID NO: 1994798 - protein, 12 aa, Staphylococcus
VQDAITDGETYQ

SEQ ID NO: 1994799 - protein, 9 aa, Staphylococcus
VQDDEYDNF

SEQ ID NO: 1994800 - protein, 7 aa, Staphylococcus
VQDEREL

SEQ ID NO: 1994801 - protein, 4 aa, Staphylococcus
VQDG

SEQ ID NO: 1994802 - protein, 7 aa, Staphylococcus
VQDHPGS

SEQ ID NO: 1994803 - protein, 7 aa, Staphylococcus
VQDSHSV

SEQ ID NO: 1994804 - protein, 11 aa, Staphylococcus
VQDSKQNEVPA

SEQ ID NO: 1994805 - protein, 4 aa, Staphylococcus
VQDT

SEQ ID NO: 1994806 - protein, 4 aa, Staphylococcus
VQDY

SEQ ID NO: 1994807 - protein, 4 aa, Staphylococcus
VQEA

SEQ ID NO: 1994808 - protein, 5 aa, Staphylococcus
VQEAG

SEQ ID NO: 1994809 - protein, 5 aa, Staphylococcus
VQEAK

SEQ ID NO: 1994810 - protein, 26 aa, Staphylococcus
VQEDLEDELEGTSDSETPGEGEATVS

SEQ ID NO: 1994811 - protein, 6 aa, Staphylococcus
VQEEGL

SEQ ID NO: 1994812 - protein, 9 aa, Staphylococcus
VQEESGGIT

SEQ ID NO: 1994813 - protein, 6 aa, Staphylococcus
VQEETG

SEQ ID NO: 1994814 - protein, 18 aa, Staphylococcus
VQEEVGLRGASAAAELID

SEQ ID NO: 1994815 - protein, 6 aa, Staphylococcus
VQEFDP

SEQ ID NO: 1994816 - protein, 5 aa, Staphylococcus
VQEGK

SEQ ID NO: 1994817 - protein, 8 aa, Staphylococcus
VQEGVSVT

SEQ ID NO: 1994818 - protein, 6 aa, Staphylococcus
VQEGYE

SEQ ID NO: 1994819 - protein, 7 aa, Staphylococcus
VQEIEPD

SEQ ID NO: 1994820 - protein, 6 aa, Staphylococcus
VQENDY

SEQ ID NO: 1994821 - protein, 11 aa, Staphylococcus
VQENKTYDMTK

SEQ ID NO: 1994822 - protein, 12 aa, Staphylococcus
VQENRGNSNTRS

SEQ ID NO: 1994823 - protein, 9 aa, Staphylococcus
VQEPDTGCV

SEQ ID NO: 1994824 - protein, 8 aa, Staphylococcus
VQEPKEGE

SEQ ID NO: 1994825 - protein, 157 aa, Staphylococcus
VQEPTSINEPSLKPDNQSKEEVKTQSSLQNTEDKSVKSQEGSKSLEPELKPSYTKEAPVDKTAHPNEQKSETESLEPRLTPEQPSNNKDEAEKEEEEKQEDISDTETLEESISEDEETQNEIDTHDKQENNENEVEDKSKQSADSEIKRPLRKGAKP

SEQ ID NO: 1994826 - protein, 7 aa, Staphylococcus
VQEREAL

SEQ ID NO: 1994827 - protein, 4 aa, Staphylococcus
VQFE

SEQ ID NO: 1994828 - protein, 5 aa, Staphylococcus
VQFPR

SEQ ID NO: 1994829 - protein, 10 aa, Staphylococcus
VQGAEQNERY

SEQ ID NO: 1994830 - protein, 10 aa, Staphylococcus
VQGGSDRNET

SEQ ID NO: 1994831 - protein, 5 aa, Staphylococcus
VQGNT

SEQ ID NO: 1994832 - protein, 9 aa, Staphylococcus
VQGPEARDY

SEQ ID NO: 1994833 - protein, 9 aa, Staphylococcus
VQGPKARDL

SEQ ID NO: 1994834 - protein, 7 aa, Staphylococcus
VQGSIDD

SEQ ID NO: 1994835 - protein, 8 aa, Staphylococcus
VQGSTEFE

SEQ ID NO: 1994836 - protein, 5 aa, Staphylococcus
VQGSV

SEQ ID NO: 1994837 - protein, 6 aa, Staphylococcus
VQGSVE

SEQ ID NO: 1994838 - protein, 4 aa, Staphylococcus
VQGT

SEQ ID NO: 1994839 - protein, 9 aa, Staphylococcus
VQGTESYNY

SEQ ID NO: 1994840 - protein, 10 aa, Staphylococcus
VQGTKDIDGE

SEQ ID NO: 1994841 - protein, 5 aa, Staphylococcus
VQGTT

SEQ ID NO: 1994842 - protein, 7 aa, Staphylococcus
VQHDYQD

SEQ ID NO: 1994843 - protein, 8 aa, Staphylococcus
VQHTEKGT

SEQ ID NO: 1994844 - protein, 6 aa, Staphylococcus
VQHTSY

SEQ ID NO: 1994845 - protein, 12 aa, Staphylococcus
VQIDTKEIERSY

SEQ ID NO: 1994846 - protein, 16 aa, Staphylococcus
VQIETTGTLTKGATVT

SEQ ID NO: 1994847 - protein, 10 aa, Staphylococcus
VQITEENSDT

SEQ ID NO: 1994848 - protein, 8 aa, Staphylococcus
VQKKNKER

SEQ ID NO: 1994849 - protein, 4 aa, Staphylococcus
VQKN

SEQ ID NO: 1994850 - protein, 9 aa, Staphylococcus
VQKNDDNLG

SEQ ID NO: 1994851 - protein, 7 aa, Staphylococcus
VQKNGGI

SEQ ID NO: 1994852 - protein, 7 aa, Staphylococcus
VQKQGGV

SEQ ID NO: 1994853 - protein, 5 aa, Staphylococcus
VQKSI

SEQ ID NO: 1994854 - protein, 8 aa, Staphylococcus
VQKSNDNE

SEQ ID NO: 1994855 - protein, 10 aa, Staphylococcus
VQLRETQKEL

SEQ ID NO: 1994856 - protein, 5 aa, Staphylococcus
VQNAQ

SEQ ID NO: 1994857 - protein, 8 aa, Staphylococcus
VQNDIKSG

SEQ ID NO: 1994858 - protein, 6 aa, Staphylococcus
VQNDKS

SEQ ID NO: 1994859 - protein, 9 aa, Staphylococcus
VQNEDKVPY

SEQ ID NO: 1994860 - protein, 8 aa, Staphylococcus
VQNEEEAK

SEQ ID NO: 1994861 - protein, 12 aa, Staphylococcus
VQNKNGYYTFDN

SEQ ID NO: 1994862 - protein, 6 aa, Staphylococcus
VQNNKN

SEQ ID NO: 1994863 - protein, 6 aa, Staphylococcus
VQNPSI

SEQ ID NO: 1994864 - protein, 29 aa, Staphylococcus
VQNQTDEQTNSDNVDNQTEVSNESHEPYN

SEQ ID NO: 1994865 - protein, 10 aa, Staphylococcus
VQNTGKDISV

SEQ ID NO: 1994866 - protein, 9 aa, Staphylococcus
VQNTSTPEV

SEQ ID NO: 1994867 - protein, 4 aa, Staphylococcus
VQNV

SEQ ID NO: 1994868 - protein, 11 aa, Staphylococcus
VQNYKKDTKNL

SEQ ID NO: 1994869 - protein, 6 aa, Staphylococcus
VQPAER

SEQ ID NO: 1994870 - protein, 10 aa, Staphylococcus
VQPARGTKKE

SEQ ID NO: 1994871 - protein, 12 aa, Staphylococcus
VQPDDFKEGKDS

SEQ ID NO: 1994872 - protein, 8 aa, Staphylococcus
VQPDETTL

SEQ ID NO: 1994873 - protein, 6 aa, Staphylococcus
VQPDKI

SEQ ID NO: 1994874 - protein, 8 aa, Staphylococcus
VQPDQLPG

SEQ ID NO: 1994875 - protein, 9 aa, Staphylococcus
VQPDQTATS

SEQ ID NO: 1994876 - protein, 6 aa, Staphylococcus
VQPDTL

SEQ ID NO: 1994877 - protein, 7 aa, Staphylococcus
VQPDTLK

SEQ ID NO: 1994878 - protein, 10 aa, Staphylococcus
VQPDVREQGL

SEQ ID NO: 1994879 - protein, 4 aa, Staphylococcus
VQPG

SEQ ID NO: 1994880 - protein, 7 aa, Staphylococcus
VQPGNVL

SEQ ID NO: 1994881 - protein, 9 aa, Staphylococcus
VQPHSGSQA

SEQ ID NO: 1994882 - protein, 4 aa, Staphylococcus
VQPK

SEQ ID NO: 1994883 - protein, 11 aa, Staphylococcus
VQPKLNKKNLN

SEQ ID NO: 1994884 - protein, 5 aa, Staphylococcus
VQPKQ

SEQ ID NO: 1994885 - protein, 5 aa, Staphylococcus
VQPQS

SEQ ID NO: 1994886 - protein, 5 aa, Staphylococcus
VQPQV

SEQ ID NO: 1994887 - protein, 7 aa, Staphylococcus
VQPSETH

SEQ ID NO: 1994888 - protein, 6 aa, Staphylococcus
VQPTIS

SEQ ID NO: 1994889 - protein, 6 aa, Staphylococcus
VQQGAR

SEQ ID NO: 1994890 - protein, 4 aa, Staphylococcus
VQQN

SEQ ID NO: 1994891 - protein, 9 aa, Staphylococcus
VQQNNGKGK

SEQ ID NO: 1994892 - protein, 10 aa, Staphylococcus
VQQPDGSIDI

SEQ ID NO: 1994893 - protein, 11 aa, Staphylococcus
VQQPGRSNQVN

SEQ ID NO: 1994894 - protein, 8 aa, Staphylococcus
VQQSGADQ

SEQ ID NO: 1994895 - protein, 6 aa, Staphylococcus
VQQSGV

SEQ ID NO: 1994896 - protein, 10 aa, Staphylococcus
VQQSQKDAGE

SEQ ID NO: 1994897 - protein, 9 aa, Staphylococcus
VQQVRQDDV

SEQ ID NO: 1994898 - protein, 17 aa, Staphylococcus
VQRASEDYKSAGGKGIN

SEQ ID NO: 1994899 - protein, 6 aa, Staphylococcus
VQRQQQ

SEQ ID NO: 1994900 - protein, 10 aa, Staphylococcus
VQRREKKSTY

SEQ ID NO: 1994901 - protein, 20 aa, Staphylococcus
VQRSSEDREVSEDNSNEAYD

SEQ ID NO: 1994902 - protein, 5 aa, Staphylococcus
VQRTM

SEQ ID NO: 1994903 - protein, 4 aa, Staphylococcus
VQSG

SEQ ID NO: 1994904 - protein, 6 aa, Staphylococcus
VQSGDY

SEQ ID NO: 1994905 - protein, 7 aa, Staphylococcus
VQSGSVT

SEQ ID NO: 1994906 - protein, 8 aa, Staphylococcus
VQSPDAQK

SEQ ID NO: 1994907 - protein, 10 aa, Staphylococcus
VQSQKRLRTY

SEQ ID NO: 1994908 - protein, 8 aa, Staphylococcus
VQSSPVEK

SEQ ID NO: 1994909 - protein, 6 aa, Staphylococcus
VQSTLQ

SEQ ID NO: 1994910 - protein, 21 aa, Staphylococcus
VQSVQRQNGYYDVETSQGTLQ

SEQ ID NO: 1994911 - protein, 12 aa, Staphylococcus
VQTAKNGRRIFD

SEQ ID NO: 1994912 - protein, 17 aa, Staphylococcus
VQTARRNLKSPNIKTRK

SEQ ID NO: 1994913 - protein, 4 aa, Staphylococcus
VQTE

SEQ ID NO: 1994914 - protein, 13 aa, Staphylococcus
VQTEDESTQEKIN

SEQ ID NO: 1994915 - protein, 6 aa, Staphylococcus
VQTETG

SEQ ID NO: 1994916 - protein, 4 aa, Staphylococcus
VQTF

SEQ ID NO: 1994917 - protein, 7 aa, Staphylococcus
VQTGDIE

SEQ ID NO: 1994918 - protein, 8 aa, Staphylococcus
VQTGKQQA

SEQ ID NO: 1994919 - protein, 4 aa, Staphylococcus
VQTN

SEQ ID NO: 1994920 - protein, 4 aa, Staphylococcus
VQTP

SEQ ID NO: 1994921 - protein, 10 aa, Staphylococcus
VQTPKNGELQ

SEQ ID NO: 1994922 - protein, 5 aa, Staphylococcus
VQTPL

SEQ ID NO: 1994923 - protein, 8 aa, Staphylococcus
VQTSSKQN

SEQ ID NO: 1994924 - protein, 10 aa, Staphylococcus
VQTTDKDQVV

SEQ ID NO: 1994925 - protein, 11 aa, Staphylococcus
VQTTEDYEKFS

SEQ ID NO: 1994926 - protein, 22 aa, Staphylococcus
VQTTSAVRTVSSVTTVDGPKLS

SEQ ID NO: 1994927 - protein, 10 aa, Staphylococcus
VQTTSDNVQL

SEQ ID NO: 1994928 - protein, 6 aa, Staphylococcus
VQTVGK

SEQ ID NO: 1994929 - protein, 4 aa, Staphylococcus
VQVK

SEQ ID NO: 1994930 - protein, 7 aa, Staphylococcus
VQYDTPD

SEQ ID NO: 1994931 - protein, 7 aa, Staphylococcus
VQYNEEE

SEQ ID NO: 1994932 - protein, 8 aa, Staphylococcus
VQYNGEEI

SEQ ID NO: 1994933 - protein, 7 aa, Staphylococcus
VQYNRED

SEQ ID NO: 1994934 - protein, 7 aa, Staphylococcus
VQYPQDS

SEQ ID NO: 1994935 - protein, 12 aa, Staphylococcus
VRDALNEDKGSE

SEQ ID NO: 1994936 - protein, 17 aa, Staphylococcus
VRDARHDKGEITSYSDD

SEQ ID NO: 1994937 - protein, 9 aa, Staphylococcus
VRDDHNGDH

SEQ ID NO: 1994938 - protein, 20 aa, Staphylococcus
VRDDSLASEDAPVGPGPRKA

SEQ ID NO: 1994939 - protein, 4 aa, Staphylococcus
VRDE

SEQ ID NO: 1994940 - protein, 8 aa, Staphylococcus
VRDEKGRT

SEQ ID NO: 1994941 - protein, 4 aa, Staphylococcus
VRDG

SEQ ID NO: 1994942 - protein, 7 aa, Staphylococcus
VRDNNGV

SEQ ID NO: 1994943 - protein, 6 aa, Staphylococcus
VRDNNQ

SEQ ID NO: 1994944 - protein, 4 aa, Staphylococcus
VRDY

SEQ ID NO: 1994945 - protein, 8 aa, Staphylococcus
VREATGAK

SEQ ID NO: 1994946 - protein, 8 aa, Staphylococcus
VREEDGNL

SEQ ID NO: 1994947 - protein, 7 aa, Staphylococcus
VREEGIS

SEQ ID NO: 1994948 - protein, 20 aa, Staphylococcus
VREEPNEKEIQPVDARFLVR

SEQ ID NO: 1994949 - protein, 11 aa, Staphylococcus
VREGDFPSEAY

SEQ ID NO: 1994950 - protein, 15 aa, Staphylococcus
VREGKEPVKPKEGLS

SEQ ID NO: 1994951 - protein, 16 aa, Staphylococcus
VREGKEPVKPNSDLSY

SEQ ID NO: 1994952 - protein, 8 aa, Staphylococcus
VREGNDST

SEQ ID NO: 1994953 - protein, 7 aa, Staphylococcus
VREKAGK

SEQ ID NO: 1994954 - protein, 5 aa, Staphylococcus
VREKG

SEQ ID NO: 1994955 - protein, 9 aa, Staphylococcus
VRERGEGER

SEQ ID NO: 1994956 - protein, 20 aa, Staphylococcus
VRESANEKEIKPVEDRFIIK

SEQ ID NO: 1994957 - protein, 6 aa, Staphylococcus
VRETNY

SEQ ID NO: 1994958 - protein, 14 aa, Staphylococcus
VREVEERTFSANEQ

SEQ ID NO: 1994959 - protein, 4 aa, Staphylococcus
VRGI

SEQ ID NO: 1994960 - protein, 10 aa, Staphylococcus
VRGNNVTPGY

SEQ ID NO: 1994961 - protein, 19 aa, Staphylococcus
VRGRGGPRCMSQPLYREEI

SEQ ID NO: 1994962 - protein, 11 aa, Staphylococcus
VRHGEKKSTIE

SEQ ID NO: 1994963 - protein, 12 aa, Staphylococcus
VRIEGGKNLTDA

SEQ ID NO: 1994964 - protein, 7 aa, Staphylococcus
VRIEGTK

SEQ ID NO: 1994965 - protein, 16 aa, Staphylococcus
VRKASGKKLAQENPVE

SEQ ID NO: 1994966 - protein, 17 aa, Staphylococcus
VRKASGKKLAQESPANA

SEQ ID NO: 1994967 - protein, 17 aa, Staphylococcus
VRKASGKRLAEESPAKA

SEQ ID NO: 1994968 - protein, 16 aa, Staphylococcus
VRKASGKRLAQESPVE

SEQ ID NO: 1994969 - protein, 15 aa, Staphylococcus
VRKDEQVKALEDNGI

SEQ ID NO: 1994970 - protein, 15 aa, Staphylococcus
VRKEEQESALKDQGV

SEQ ID NO: 1994971 - protein, 16 aa, Staphylococcus
VRKEEQVKELKDQDVD

SEQ ID NO: 1994972 - protein, 8 aa, Staphylococcus
VRKGKGKN

SEQ ID NO: 1994973 - protein, 10 aa, Staphylococcus
VRKNEQIETL

SEQ ID NO: 1994974 - protein, 14 aa, Staphylococcus
VRKQDNSADGLNPK

SEQ ID NO: 1994975 - protein, 18 aa, Staphylococcus
VRKQSGKQLAKESPASNA

SEQ ID NO: 1994976 - protein, 13 aa, Staphylococcus
VRKSDNGGPKRKY

SEQ ID NO: 1994977 - protein, 13 aa, Staphylococcus
VRLKEQDQTHLQH

SEQ ID NO: 1994978 - protein, 20 aa, Staphylococcus
VRLTEGDYETKEAMSRTAEE

SEQ ID NO: 1994979 - protein, 29 aa, Staphylococcus
VRNASKAQDLADKGVSVREGDFKKPETLK

SEQ ID NO: 1994980 - protein, 11 aa, Staphylococcus
VRNDNAQGEYY

SEQ ID NO: 1994981 - protein, 5 aa, Staphylococcus
VRNEQ

SEQ ID NO: 1994982 - protein, 17 aa, Staphylococcus
VRNNKGKLQLKSGSRWS

SEQ ID NO: 1994983 - protein, 7 aa, Staphylococcus
VRNREQV

SEQ ID NO: 1994984 - protein, 8 aa, Staphylococcus
VRNTPESW

SEQ ID NO: 1994985 - protein, 15 aa, Staphylococcus
VRNTSKKLASLIKED

SEQ ID NO: 1994986 - protein, 6 aa, Staphylococcus
VRNTTI

SEQ ID NO: 1994987 - protein, 4 aa, Staphylococcus
VRPD

SEQ ID NO: 1994988 - protein, 6 aa, Staphylococcus
VRPDKD

SEQ ID NO: 1994989 - protein, 5 aa, Staphylococcus
VRPDM

SEQ ID NO: 1994990 - protein, 10 aa, Staphylococcus
VRPNTDESAA

SEQ ID NO: 1994991 - protein, 9 aa, Staphylococcus
VRPPEPISQ

SEQ ID NO: 1994992 - protein, 9 aa, Staphylococcus
VRPPEPVSS

SEQ ID NO: 1994993 - protein, 10 aa, Staphylococcus
VRPRLGNSLK

SEQ ID NO: 1994994 - protein, 11 aa, Staphylococcus
VRPSLDQLSQR

SEQ ID NO: 1994995 - protein, 8 aa, Staphylococcus
VRPTENQI

SEQ ID NO: 1994996 - protein, 6 aa, Staphylococcus
VRPTVR

SEQ ID NO: 1994997 - protein, 8 aa, Staphylococcus
VRPYTDGE

SEQ ID NO: 1994998 - protein, 8 aa, Staphylococcus
VRPYTEGE

SEQ ID NO: 1994999 - protein, 7 aa, Staphylococcus
VRPYTEQ

SEQ ID NO: 1995000 - protein, 8 aa, Staphylococcus
VRPYTNNE

SEQ ID NO: 1995001 - protein, 20 aa, Staphylococcus
VRQANSNEKMTTLDNAERDL

SEQ ID NO: 1995002 - protein, 7 aa, Staphylococcus
VRQGKMD

SEQ ID NO: 1995003 - protein, 8 aa, Staphylococcus
VRQGNMDP

SEQ ID NO: 1995004 - protein, 8 aa, Staphylococcus
VRQGQRQT

SEQ ID NO: 1995005 - protein, 11 aa, Staphylococcus
VRQPDGSINIE

SEQ ID NO: 1995006 - protein, 10 aa, Staphylococcus
VRQPDGTIDI

SEQ ID NO: 1995007 - protein, 4 aa, Staphylococcus
VRQV

SEQ ID NO: 1995008 - protein, 44 aa, Staphylococcus
VRRAESAKERAESHLNNNDEDTDINRAKRALERAENRLKVSDLL

SEQ ID NO: 1995009 - protein, 28 aa, Staphylococcus
VRRGRNAKSHTKAKNTDVQTYRKSSGLE

SEQ ID NO: 1995010 - protein, 27 aa, Staphylococcus
VRRGRNAKSYTKAKNTDIQTYRKSSGL

SEQ ID NO: 1995011 - protein, 6 aa, Staphylococcus
VRRTET

SEQ ID NO: 1995012 - protein, 22 aa, Staphylococcus
VRSADGKLTKDHMNSMESQRYY

SEQ ID NO: 1995013 - protein, 26 aa, Staphylococcus
VRSAGGELISEPHSNTRYEDTEGNQT

SEQ ID NO: 1995014 - protein, 9 aa, Staphylococcus
VRSEDSNSH

SEQ ID NO: 1995015 - protein, 9 aa, Staphylococcus
VRSEQANSH

SEQ ID NO: 1995016 - protein, 7 aa, Staphylococcus
VRSGSVT

SEQ ID NO: 1995017 - protein, 6 aa, Staphylococcus
VRSGTC

SEQ ID NO: 1995018 - protein, 9 aa, Staphylococcus
VRSKASDTF

SEQ ID NO: 1995019 - protein, 9 aa, Staphylococcus
VRSNDDVKY

SEQ ID NO: 1995020 - protein, 9 aa, Staphylococcus
VRSNEDVDY

SEQ ID NO: 1995021 - protein, 17 aa, Staphylococcus
VRSNGGDYKKVKQVSKA

SEQ ID NO: 1995022 - protein, 15 aa, Staphylococcus
VRSQRAVTDTTNDLL

SEQ ID NO: 1995023 - protein, 7 aa, Staphylococcus
VRSSLTA

SEQ ID NO: 1995024 - protein, 9 aa, Staphylococcus
VRTNIGTEY

SEQ ID NO: 1995025 - protein, 6 aa, Staphylococcus
VRTNYE

SEQ ID NO: 1995026 - protein, 10 aa, Staphylococcus
VRTRNNDEIT

SEQ ID NO: 1995027 - protein, 15 aa, Staphylococcus
VRTSLSGTAEKPRLN

SEQ ID NO: 1995028 - protein, 20 aa, Staphylococcus
VRTSRQSAFKERKKAQDARL

SEQ ID NO: 1995029 - protein, 16 aa, Staphylococcus
VRVEDREPKVLKDNEV

SEQ ID NO: 1995030 - protein, 16 aa, Staphylococcus
VRVEDRKSKELQDNEV

SEQ ID NO: 1995031 - protein, 18 aa, Staphylococcus
VSAAEKAGAEHTWIEYLG

SEQ ID NO: 1995032 - protein, 9 aa, Staphylococcus
VSAALNKSK

SEQ ID NO: 1995033 - protein, 9 aa, Staphylococcus
VSAAMNPTS

SEQ ID NO: 1995034 - protein, 6 aa, Staphylococcus
VSAASD

SEQ ID NO: 1995035 - protein, 6 aa, Staphylococcus
VSADDY

SEQ ID NO: 1995036 - protein, 8 aa, Staphylococcus
VSAEHSDE

SEQ ID NO: 1995037 - protein, 8 aa, Staphylococcus
VSAEHSEE

SEQ ID NO: 1995038 - protein, 7 aa, Staphylococcus
VSAETKY

SEQ ID NO: 1995039 - protein, 6 aa, Staphylococcus
VSAETQ

SEQ ID NO: 1995040 - protein, 7 aa, Staphylococcus
VSAETQY

SEQ ID NO: 1995041 - protein, 9 aa, Staphylococcus
VSAGEPLNR

SEQ ID NO: 1995042 - protein, 9 aa, Staphylococcus
VSAGNTGAL

SEQ ID NO: 1995043 - protein, 9 aa, Staphylococcus
VSATENQKI

SEQ ID NO: 1995044 - protein, 4 aa, Staphylococcus
VSCH

SEQ ID NO: 1995045 - protein, 8 aa, Staphylococcus
VSDDAKKW

SEQ ID NO: 1995046 - protein, 7 aa, Staphylococcus
VSDDGNV

SEQ ID NO: 1995047 - protein, 9 aa, Staphylococcus
VSDDKSVQQ

SEQ ID NO: 1995048 - protein, 5 aa, Staphylococcus
VSDDL

SEQ ID NO: 1995049 - protein, 10 aa, Staphylococcus
VSDDTETSNI

SEQ ID NO: 1995050 - protein, 10 aa, Staphylococcus
VSDDTKKVSD

SEQ ID NO: 1995051 - protein, 5 aa, Staphylococcus
VSDDY

SEQ ID NO: 1995052 - protein, 4 aa, Staphylococcus
VSDE

SEQ ID NO: 1995053 - protein, 7 aa, Staphylococcus
VSDEAKA

SEQ ID NO: 1995054 - protein, 7 aa, Staphylococcus
VSDEAKK

SEQ ID NO: 1995055 - protein, 8 aa, Staphylococcus
VSDEAKKW

SEQ ID NO: 1995056 - protein, 8 aa, Staphylococcus
VSDEASYQ

SEQ ID NO: 1995057 - protein, 13 aa, Staphylococcus
VSDEELEDILLGR

SEQ ID NO: 1995058 - protein, 8 aa, Staphylococcus
VSDEESYQ

SEQ ID NO: 1995059 - protein, 7 aa, Staphylococcus
VSDEHDL

SEQ ID NO: 1995060 - protein, 16 aa, Staphylococcus
VSDELTNELERSPSIA

SEQ ID NO: 1995061 - protein, 17 aa, Staphylococcus
VSDELTNELERSPSISE

SEQ ID NO: 1995062 - protein, 17 aa, Staphylococcus
VSDELTNELERSPSITE

SEQ ID NO: 1995063 - protein, 15 aa, Staphylococcus
VSDEQSAKMTHRHNN

SEQ ID NO: 1995064 - protein, 8 aa, Staphylococcus
VSDEQSYD

SEQ ID NO: 1995065 - protein, 14 aa, Staphylococcus
VSDERSAYMTRGHN

SEQ ID NO: 1995066 - protein, 12 aa, Staphylococcus
VSDERSAYMTRS

SEQ ID NO: 1995067 - protein, 14 aa, Staphylococcus
VSDERSAYMTRSHN

SEQ ID NO: 1995068 - protein, 8 aa, Staphylococcus
VSDESSDE

SEQ ID NO: 1995069 - protein, 8 aa, Staphylococcus
VSDGCEAT

SEQ ID NO: 1995070 - protein, 10 aa, Staphylococcus
VSDGCEETNT

SEQ ID NO: 1995071 - protein, 10 aa, Staphylococcus
VSDGCEQTNT

SEQ ID NO: 1995072 - protein, 9 aa, Staphylococcus
VSDKDGDMH

SEQ ID NO: 1995073 - protein, 12 aa, Staphylococcus
VSDKGKYAKTSY

SEQ ID NO: 1995074 - protein, 8 aa, Staphylococcus
VSDKGPLA

SEQ ID NO: 1995075 - protein, 7 aa, Staphylococcus
VSDLQHT

SEQ ID NO: 1995076 - protein, 44 aa, Staphylococcus
VSDNSSSKKVYSDNSFNVSSSFKASKSQNVSSKQGVSEDEIRAM

SEQ ID NO: 1995077 - protein, 5 aa, Staphylococcus
VSDPY

SEQ ID NO: 1995078 - protein, 4 aa, Staphylococcus
VSDQ

SEQ ID NO: 1995079 - protein, 8 aa, Staphylococcus
VSDQSDRM

SEQ ID NO: 1995080 - protein, 15 aa, Staphylococcus
VSDRENSMTAGQRGP

SEQ ID NO: 1995081 - protein, 16 aa, Staphylococcus
VSDRTQAAIYAIENKL

SEQ ID NO: 1995082 - protein, 16 aa, Staphylococcus
VSDRTQAAIYAMENKL

SEQ ID NO: 1995083 - protein, 16 aa, Staphylococcus
VSDRTQAAIYAMQNNL

SEQ ID NO: 1995084 - protein, 4 aa, Staphylococcus
VSDS

SEQ ID NO: 1995085 - protein, 5 aa, Staphylococcus
VSDSE

SEQ ID NO: 1995086 - protein, 7 aa, Staphylococcus
VSDSEDD

SEQ ID NO: 1995087 - protein, 5 aa, Staphylococcus
VSDSQ

SEQ ID NO: 1995088 - protein, 13 aa, Staphylococcus
VSDSVDNAEAYQH

SEQ ID NO: 1995089 - protein, 7 aa, Staphylococcus
VSDTVDS

SEQ ID NO: 1995090 - protein, 4 aa, Staphylococcus
VSDY

SEQ ID NO: 1995091 - protein, 10 aa, Staphylococcus
VSEADAKAAM

SEQ ID NO: 1995092 - protein, 29 aa, Staphylococcus
VSEADTGSPTRGGRPATHAIKTKDGYKLN

SEQ ID NO: 1995093 - protein, 26 aa, Staphylococcus
VSEADTGSPTRGGRPATHAVKQDDGY

SEQ ID NO: 1995094 - protein, 24 aa, Staphylococcus
VSEAEKAGANIATGGKKVENSPSD

SEQ ID NO: 1995095 - protein, 22 aa, Staphylococcus
VSEAETGSPTRGGRPATHAVKE

SEQ ID NO: 1995096 - protein, 25 aa, Staphylococcus
VSEAETGSPTRGGRPATNAIKNENG

SEQ ID NO: 1995097 - protein, 21 aa, Staphylococcus
VSEAETGSPTRGGRPATNAVK

SEQ ID NO: 1995098 - protein, 26 aa, Staphylococcus
VSEAETGSPTRGGRPGTHAVKEDNGY

SEQ ID NO: 1995099 - protein, 5 aa, Staphylococcus
VSEAN

SEQ ID NO: 1995100 - protein, 7 aa, Staphylococcus
VSEDSQS

SEQ ID NO: 1995101 - protein, 4 aa, Staphylococcus
VSEE

SEQ ID NO: 1995102 - protein, 5 aa, Staphylococcus
VSEED

SEQ ID NO: 1995103 - protein, 7 aa, Staphylococcus
VSEEDVQ

SEQ ID NO: 1995104 - protein, 10 aa, Staphylococcus
VSEEEANQLE

SEQ ID NO: 1995105 - protein, 5 aa, Staphylococcus
VSEEQ

SEQ ID NO: 1995106 - protein, 11 aa, Staphylococcus
VSEGCQQTNTA

SEQ ID NO: 1995107 - protein, 12 aa, Staphylococcus
VSEGDKGFGQEA

SEQ ID NO: 1995108 - protein, 36 aa, Staphylococcus
VSEGDSASKKAPASSKAKAEDEHDAHVGTDQFNTHN

SEQ ID NO: 1995109 - protein, 12 aa, Staphylococcus
VSEGERNSTLAS

SEQ ID NO: 1995110 - protein, 8 aa, Staphylococcus
VSEGETVE

SEQ ID NO: 1995111 - protein, 8 aa, Staphylococcus
VSEGKVRS

SEQ ID NO: 1995112 - protein, 8 aa, Staphylococcus
VSEGNITI

SEQ ID NO: 1995113 - protein, 10 aa, Staphylococcus
VSEGTSHLSP

SEQ ID NO: 1995114 - protein, 15 aa, Staphylococcus
VSEKAIERKTGARGL

SEQ ID NO: 1995115 - protein, 10 aa, Staphylococcus
VSEKGGLGTI

SEQ ID NO: 1995116 - protein, 10 aa, Staphylococcus
VSEKSDRMGY

SEQ ID NO: 1995117 - protein, 7 aa, Staphylococcus
VSEKSDV

SEQ ID NO: 1995118 - protein, 4 aa, Staphylococcus
VSEM

SEQ ID NO: 1995119 - protein, 4 aa, Staphylococcus
VSEN

SEQ ID NO: 1995120 - protein, 7 aa, Staphylococcus
VSENEGD

SEQ ID NO: 1995121 - protein, 10 aa, Staphylococcus
VSENGKYAKT

SEQ ID NO: 1995122 - protein, 5 aa, Staphylococcus
VSENK

SEQ ID NO: 1995123 - protein, 7 aa, Staphylococcus
VSENYPN

SEQ ID NO: 1995124 - protein, 8 aa, Staphylococcus
VSEPDVED

SEQ ID NO: 1995125 - protein, 8 aa, Staphylococcus
VSEQANHN

SEQ ID NO: 1995126 - protein, 12 aa, Staphylococcus
VSEQPVIDVAEV

SEQ ID NO: 1995127 - protein, 18 aa, Staphylococcus
VSEQTGSVQLSERSSGEL

SEQ ID NO: 1995128 - protein, 5 aa, Staphylococcus
VSEQY

SEQ ID NO: 1995129 - protein, 9 aa, Staphylococcus
VSESAQKDG

SEQ ID NO: 1995130 - protein, 18 aa, Staphylococcus
VSESKHGGIQCFNLVKNL

SEQ ID NO: 1995131 - protein, 15 aa, Staphylococcus
VSETGDISESTEKAV

SEQ ID NO: 1995132 - protein, 9 aa, Staphylococcus
VSETGTSKI

SEQ ID NO: 1995133 - protein, 7 aa, Staphylococcus
VSETKPD

SEQ ID NO: 1995134 - protein, 8 aa, Staphylococcus
VSEWKDTD

SEQ ID NO: 1995135 - protein, 7 aa, Staphylococcus
VSFESDN

SEQ ID NO: 1995136 - protein, 11 aa, Staphylococcus
VSGDSKKKHQN

SEQ ID NO: 1995137 - protein, 10 aa, Staphylococcus
VSGDSVGGNM

SEQ ID NO: 1995138 - protein, 11 aa, Staphylococcus
VSGDTKKKHQN

SEQ ID NO: 1995139 - protein, 5 aa, Staphylococcus
VSGEE

SEQ ID NO: 1995140 - protein, 23 aa, Staphylococcus
VSGEEIKEQHSNFKDKARKFFRG

SEQ ID NO: 1995141 - protein, 15 aa, Staphylococcus
VSGEITTERKGDYGF

SEQ ID NO: 1995142 - protein, 14 aa, Staphylococcus
VSGERGAADAERDI

SEQ ID NO: 1995143 - protein, 12 aa, Staphylococcus
VSGERGAADLER

SEQ ID NO: 1995144 - protein, 11 aa, Staphylococcus
VSGESSKHGIS

SEQ ID NO: 1995145 - protein, 12 aa, Staphylococcus
VSGESSKQGVSL

SEQ ID NO: 1995146 - protein, 8 aa, Staphylococcus
VSGGDVND

SEQ ID NO: 1995147 - protein, 6 aa, Staphylococcus
VSGGKR

SEQ ID NO: 1995148 - protein, 6 aa, Staphylococcus
VSGGLD

SEQ ID NO: 1995149 - protein, 4 aa, Staphylococcus
VSGK

SEQ ID NO: 1995150 - protein, 8 aa, Staphylococcus
VSGKGGTN

SEQ ID NO: 1995151 - protein, 9 aa, Staphylococcus
VSGKGGTNF

SEQ ID NO: 1995152 - protein, 17 aa, Staphylococcus
VSGKKLKEKLENGQEDA

SEQ ID NO: 1995153 - protein, 10 aa, Staphylococcus
VSGKSDVEKN

SEQ ID NO: 1995154 - protein, 27 aa, Staphylococcus
VSGKTLAQASTQEKDLANESGSKVELS

SEQ ID NO: 1995155 - protein, 7 aa, Staphylococcus
VSGLPKE

SEQ ID NO: 1995156 - protein, 14 aa, Staphylococcus
VSGLPKEKVIGSGT

SEQ ID NO: 1995157 - protein, 7 aa, Staphylococcus
VSGNGAF

SEQ ID NO: 1995158 - protein, 8 aa, Staphylococcus
VSGNGAYS

SEQ ID NO: 1995159 - protein, 11 aa, Staphylococcus
VSGPSLDRPGD

SEQ ID NO: 1995160 - protein, 5 aa, Staphylococcus
VSGQE

SEQ ID NO: 1995161 - protein, 8 aa, Staphylococcus
VSGRESHA

SEQ ID NO: 1995162 - protein, 9 aa, Staphylococcus
VSGSGAYSK

SEQ ID NO: 1995163 - protein, 9 aa, Staphylococcus
VSGSSEAYL

SEQ ID NO: 1995164 - protein, 9 aa, Staphylococcus
VSGTAERSW

SEQ ID NO: 1995165 - protein, 9 aa, Staphylococcus
VSGTATAGI

SEQ ID NO: 1995166 - protein, 19 aa, Staphylococcus
VSGVDGAIGSTYNVNGRRA

SEQ ID NO: 1995167 - protein, 6 aa, Staphylococcus
VSHAEA

SEQ ID NO: 1995168 - protein, 8 aa, Staphylococcus
VSHDGNEI

SEQ ID NO: 1995169 - protein, 11 aa, Staphylococcus
VSHKEEKNPYY

SEQ ID NO: 1995170 - protein, 6 aa, Staphylococcus
VSHNDN

SEQ ID NO: 1995171 - protein, 7 aa, Staphylococcus
VSHQGNF

SEQ ID NO: 1995172 - protein, 9 aa, Staphylococcus
VSHQTPQAI

SEQ ID NO: 1995173 - protein, 9 aa, Staphylococcus
VSIDSRDIH

SEQ ID NO: 1995174 - protein, 77 aa, Staphylococcus
VSIEKKKPKKVNPKRLQRQVAKEQKQPKTSTYAQKAIKKEQEMKKVQGKKSKKLKKEQAKARKRQLKVQKNKQKKKG

SEQ ID NO: 1995175 - protein, 10 aa, Staphylococcus
VSIEKTTSNA

SEQ ID NO: 1995176 - protein, 7 aa, Staphylococcus
VSIGGGK

SEQ ID NO: 1995177 - protein, 7 aa, Staphylococcus
VSIGKRP

SEQ ID NO: 1995178 - protein, 8 aa, Staphylococcus
VSIGKRPM

SEQ ID NO: 1995179 - protein, 22 aa, Staphylococcus
VSKATKDDVDNAFESSNKAYDA

SEQ ID NO: 1995180 - protein, 7 aa, Staphylococcus
VSKATTN

SEQ ID NO: 1995181 - protein, 9 aa, Staphylococcus
VSKAYRDSV

SEQ ID NO: 1995182 - protein, 9 aa, Staphylococcus
VSKDCNNKT

SEQ ID NO: 1995183 - protein, 10 aa, Staphylococcus
VSKDDTYSKK

SEQ ID NO: 1995184 - protein, 14 aa, Staphylococcus
VSKDGEDNLAPYSQ

SEQ ID NO: 1995185 - protein, 14 aa, Staphylococcus
VSKDGKDNLAPYSQ

SEQ ID NO: 1995186 - protein, 12 aa, Staphylococcus
VSKDIQPNNEQV

SEQ ID NO: 1995187 - protein, 7 aa, Staphylococcus
VSKDLTE

SEQ ID NO: 1995188 - protein, 5 aa, Staphylococcus
VSKDQ

SEQ ID NO: 1995189 - protein, 5 aa, Staphylococcus
VSKEA

SEQ ID NO: 1995190 - protein, 7 aa, Staphylococcus
VSKEAEN

SEQ ID NO: 1995191 - protein, 7 aa, Staphylococcus
VSKEAQM

SEQ ID NO: 1995192 - protein, 8 aa, Staphylococcus
VSKEEAQK

SEQ ID NO: 1995193 - protein, 13 aa, Staphylococcus
VSKEMDDKLRQNV

SEQ ID NO: 1995194 - protein, 8 aa, Staphylococcus
VSKERDKI

SEQ ID NO: 1995195 - protein, 8 aa, Staphylococcus
VSKESGVT

SEQ ID NO: 1995196 - protein, 4 aa, Staphylococcus
VSKG

SEQ ID NO: 1995197 - protein, 6 aa, Staphylococcus
VSKGGH

SEQ ID NO: 1995198 - protein, 6 aa, Staphylococcus
VSKGHA

SEQ ID NO: 1995199 - protein, 5 aa, Staphylococcus
VSKGK

SEQ ID NO: 1995200 - protein, 6 aa, Staphylococcus
VSKGNA

SEQ ID NO: 1995201 - protein, 16 aa, Staphylococcus
VSKKDDTVLSGYTSKN

SEQ ID NO: 1995202 - protein, 7 aa, Staphylococcus
VSKKEYK

SEQ ID NO: 1995203 - protein, 7 aa, Staphylococcus
VSKKEYV

SEQ ID NO: 1995204 - protein, 9 aa, Staphylococcus
VSKKQREQF

SEQ ID NO: 1995205 - protein, 8 aa, Staphylococcus
VSKKSGTI

SEQ ID NO: 1995206 - protein, 10 aa, Staphylococcus
VSKNGKEIDL

SEQ ID NO: 1995207 - protein, 6 aa, Staphylococcus
VSKNGQ

SEQ ID NO: 1995208 - protein, 10 aa, Staphylococcus
VSKNPLNDTN

SEQ ID NO: 1995209 - protein, 8 aa, Staphylococcus
VSKQGGLG

SEQ ID NO: 1995210 - protein, 7 aa, Staphylococcus
VSKQSFD

SEQ ID NO: 1995211 - protein, 16 aa, Staphylococcus
VSKSDLKRVKQLLAYK

SEQ ID NO: 1995212 - protein, 16 aa, Staphylococcus
VSKSDMKRVKQLLSYK

SEQ ID NO: 1995213 - protein, 7 aa, Staphylococcus
VSKSPAQ

SEQ ID NO: 1995214 - protein, 8 aa, Staphylococcus
VSKTGLGP

SEQ ID NO: 1995215 - protein, 12 aa, Staphylococcus
VSKTVIPVEIED

SEQ ID NO: 1995216 - protein, 10 aa, Staphylococcus
VSKVTSVSTR

SEQ ID NO: 1995217 - protein, 5 aa, Staphylococcus
VSLDQ

SEQ ID NO: 1995218 - protein, 17 aa, Staphylococcus
VSLEDKTLRSLKPGEAL

SEQ ID NO: 1995219 - protein, 9 aa, Staphylococcus
VSLEKNNNL

SEQ ID NO: 1995220 - protein, 7 aa, Staphylococcus
VSLNRQG

SEQ ID NO: 1995221 - protein, 8 aa, Staphylococcus
VSLPNAKR

SEQ ID NO: 1995222 - protein, 9 aa, Staphylococcus
VSLSSETTN

SEQ ID NO: 1995223 - protein, 9 aa, Staphylococcus
VSLTDDDNK

SEQ ID NO: 1995224 - protein, 5 aa, Staphylococcus
VSLTQ

SEQ ID NO: 1995225 - protein, 5 aa, Staphylococcus
VSMEQ

SEQ ID NO: 1995226 - protein, 11 aa, Staphylococcus
VSNDAKKGLRD

SEQ ID NO: 1995227 - protein, 8 aa, Staphylococcus
VSNDDMQN

SEQ ID NO: 1995228 - protein, 7 aa, Staphylococcus
VSNDELD

SEQ ID NO: 1995229 - protein, 10 aa, Staphylococcus
VSNEATITDK

SEQ ID NO: 1995230 - protein, 6 aa, Staphylococcus
VSNEDA

SEQ ID NO: 1995231 - protein, 10 aa, Staphylococcus
VSNEDAGRAM

SEQ ID NO: 1995232 - protein, 9 aa, Staphylococcus
VSNETQNSL

SEQ ID NO: 1995233 - protein, 24 aa, Staphylococcus
VSNHKDINKKLSNEDAYKRARPSH

SEQ ID NO: 1995234 - protein, 8 aa, Staphylococcus
VSNIRNSK

SEQ ID NO: 1995235 - protein, 8 aa, Staphylococcus
VSNKGGLG

SEQ ID NO: 1995236 - protein, 8 aa, Staphylococcus
VSNKQPSI

SEQ ID NO: 1995237 - protein, 20 aa, Staphylococcus
VSNNKDVTSKTIQPKHGESV

SEQ ID NO: 1995238 - protein, 10 aa, Staphylococcus
VSNNYDASIS

SEQ ID NO: 1995239 - protein, 5 aa, Staphylococcus
VSNQA

SEQ ID NO: 1995240 - protein, 5 aa, Staphylococcus
VSNQF

SEQ ID NO: 1995241 - protein, 7 aa, Staphylococcus
VSNQSYY

SEQ ID NO: 1995242 - protein, 4 aa, Staphylococcus
VSNR

SEQ ID NO: 1995243 - protein, 9 aa, Staphylococcus
VSNSSRFNA

SEQ ID NO: 1995244 - protein, 12 aa, Staphylococcus
VSNTTSTITEKV

SEQ ID NO: 1995245 - protein, 8 aa, Staphylococcus
VSPAAQGL

SEQ ID NO: 1995246 - protein, 9 aa, Staphylococcus
VSPAAQGLH

SEQ ID NO: 1995247 - protein, 5 aa, Staphylococcus
VSPAL

SEQ ID NO: 1995248 - protein, 6 aa, Staphylococcus
VSPAST

SEQ ID NO: 1995249 - protein, 7 aa, Staphylococcus
VSPDPSM

SEQ ID NO: 1995250 - protein, 5 aa, Staphylococcus
VSPDQ

SEQ ID NO: 1995251 - protein, 11 aa, Staphylococcus
VSPEAASGGPI

SEQ ID NO: 1995252 - protein, 7 aa, Staphylococcus
VSPEEKE

SEQ ID NO: 1995253 - protein, 13 aa, Staphylococcus
VSPGDSSKWQTPP

SEQ ID NO: 1995254 - protein, 10 aa, Staphylococcus
VSPIAKDYQE

SEQ ID NO: 1995255 - protein, 4 aa, Staphylococcus
VSPK

SEQ ID NO: 1995256 - protein, 9 aa, Staphylococcus
VSPKEAGLT

SEQ ID NO: 1995257 - protein, 5 aa, Staphylococcus
VSPNN

SEQ ID NO: 1995258 - protein, 6 aa, Staphylococcus
VSPSFE

SEQ ID NO: 1995259 - protein, 9 aa, Staphylococcus
VSPSNVDEQ

SEQ ID NO: 1995260 - protein, 9 aa, Staphylococcus
VSPTDSPDT

SEQ ID NO: 1995261 - protein, 5 aa, Staphylococcus
VSPTN

SEQ ID NO: 1995262 - protein, 6 aa, Staphylococcus
VSPWDK

SEQ ID NO: 1995263 - protein, 4 aa, Staphylococcus
VSPY

SEQ ID NO: 1995264 - protein, 6 aa, Staphylococcus
VSPYQT

SEQ ID NO: 1995265 - protein, 7 aa, Staphylococcus
VSPYTGY

SEQ ID NO: 1995266 - protein, 6 aa, Staphylococcus
VSQDDA

SEQ ID NO: 1995267 - protein, 10 aa, Staphylococcus
VSQEEAEQYV

SEQ ID NO: 1995268 - protein, 4 aa, Staphylococcus
VSQG

SEQ ID NO: 1995269 - protein, 7 aa, Staphylococcus
VSQGYEK

SEQ ID NO: 1995270 - protein, 13 aa, Staphylococcus
VSQPEDLNDMNKE

SEQ ID NO: 1995271 - protein, 4 aa, Staphylococcus
VSQQ

SEQ ID NO: 1995272 - protein, 8 aa, Staphylococcus
VSQSYPDV

SEQ ID NO: 1995273 - protein, 9 aa, Staphylococcus
VSQTDNKQI

SEQ ID NO: 1995274 - protein, 11 aa, Staphylococcus
VSQTEANNLEI

SEQ ID NO: 1995275 - protein, 7 aa, Staphylococcus
VSQTEIK

SEQ ID NO: 1995276 - protein, 9 aa, Staphylococcus
VSQTGTSKI

SEQ ID NO: 1995277 - protein, 10 aa, Staphylococcus
VSRAKDPVKM

SEQ ID NO: 1995278 - protein, 7 aa, Staphylococcus
VSRDEAK

SEQ ID NO: 1995279 - protein, 8 aa, Staphylococcus
VSREKRMS

SEQ ID NO: 1995280 - protein, 10 aa, Staphylococcus
VSREKTPKWL

SEQ ID NO: 1995281 - protein, 7 aa, Staphylococcus
VSREPAY

SEQ ID NO: 1995282 - protein, 4 aa, Staphylococcus
VSRG

SEQ ID NO: 1995283 - protein, 9 aa, Staphylococcus
VSRKEAKDF

SEQ ID NO: 1995284 - protein, 10 aa, Staphylococcus
VSRKEKGDQA

SEQ ID NO: 1995285 - protein, 6 aa, Staphylococcus
VSRNEA

SEQ ID NO: 1995286 - protein, 6 aa, Staphylococcus
VSRNNI

SEQ ID NO: 1995287 - protein, 4 aa, Staphylococcus
VSRP

SEQ ID NO: 1995288 - protein, 14 aa, Staphylococcus
VSRPGTKLTTTEDG

SEQ ID NO: 1995289 - protein, 15 aa, Staphylococcus
VSRPGTTLSTTDEGE

SEQ ID NO: 1995290 - protein, 8 aa, Staphylococcus
VSRPNTSL

SEQ ID NO: 1995291 - protein, 9 aa, Staphylococcus
VSRQKRKKV

SEQ ID NO: 1995292 - protein, 5 aa, Staphylococcus
VSRQT

SEQ ID NO: 1995293 - protein, 8 aa, Staphylococcus
VSRRNPTL

SEQ ID NO: 1995294 - protein, 11 aa, Staphylococcus
VSRRNQENRVY

SEQ ID NO: 1995295 - protein, 10 aa, Staphylococcus
VSRSERPEWN

SEQ ID NO: 1995296 - protein, 8 aa, Staphylococcus
VSRSPVRD

SEQ ID NO: 1995297 - protein, 9 aa, Staphylococcus
VSRTGSSKI

SEQ ID NO: 1995298 - protein, 8 aa, Staphylococcus
VSSDDNSI

SEQ ID NO: 1995299 - protein, 7 aa, Staphylococcus
VSSDEYD

SEQ ID NO: 1995300 - protein, 6 aa, Staphylococcus
VSSDHD

SEQ ID NO: 1995301 - protein, 7 aa, Staphylococcus
VSSDQQQ

SEQ ID NO: 1995302 - protein, 7 aa, Staphylococcus
VSSDRSY

SEQ ID NO: 1995303 - protein, 4 aa, Staphylococcus
VSSE

SEQ ID NO: 1995304 - protein, 5 aa, Staphylococcus
VSSED

SEQ ID NO: 1995305 - protein, 7 aa, Staphylococcus
VSSEDAD

SEQ ID NO: 1995306 - protein, 8 aa, Staphylococcus
VSSEDEAK

SEQ ID NO: 1995307 - protein, 5 aa, Staphylococcus
VSSEK

SEQ ID NO: 1995308 - protein, 8 aa, Staphylococcus
VSSETDIP

SEQ ID NO: 1995309 - protein, 8 aa, Staphylococcus
VSSETGYK

SEQ ID NO: 1995310 - protein, 4 aa, Staphylococcus
VSSG

SEQ ID NO: 1995311 - protein, 13 aa, Staphylococcus
VSSGKISSSSYTA

SEQ ID NO: 1995312 - protein, 5 aa, Staphylococcus
VSSID

SEQ ID NO: 1995313 - protein, 7 aa, Staphylococcus
VSSIKQG

SEQ ID NO: 1995314 - protein, 5 aa, Staphylococcus
VSSKA

SEQ ID NO: 1995315 - protein, 6 aa, Staphylococcus
VSSKEQ

SEQ ID NO: 1995316 - protein, 10 aa, Staphylococcus
VSSKKGNYVR

SEQ ID NO: 1995317 - protein, 15 aa, Staphylococcus
VSSKPHNTNKLSKRE

SEQ ID NO: 1995318 - protein, 11 aa, Staphylococcus
VSSKSEKSIGV

SEQ ID NO: 1995319 - protein, 7 aa, Staphylococcus
VSSKTNR

SEQ ID NO: 1995320 - protein, 11 aa, Staphylococcus
VSSNDDGSISN

SEQ ID NO: 1995321 - protein, 21 aa, Staphylococcus
VSSNEDITKQSNHNDDDIDHS

SEQ ID NO: 1995322 - protein, 7 aa, Staphylococcus
VSSNEYD

SEQ ID NO: 1995323 - protein, 25 aa, Staphylococcus
VSSNPLDFPGYQEKVEKDQKKTGLN

SEQ ID NO: 1995324 - protein, 11 aa, Staphylococcus
VSSPHTDHSEA

SEQ ID NO: 1995325 - protein, 4 aa, Staphylococcus
VSSQ

SEQ ID NO: 1995326 - protein, 6 aa, Staphylococcus
VSSRTI

SEQ ID NO: 1995327 - protein, 12 aa, Staphylococcus
VSSSKFENLGNC

SEQ ID NO: 1995328 - protein, 6 aa, Staphylococcus
VSSTSH

SEQ ID NO: 1995329 - protein, 8 aa, Staphylococcus
VSSVGSAN

SEQ ID NO: 1995330 - protein, 10 aa, Staphylococcus
VSTAGQKGAV

SEQ ID NO: 1995331 - protein, 5 aa, Staphylococcus
VSTDD

SEQ ID NO: 1995332 - protein, 11 aa, Staphylococcus
VSTDGASPKLA

SEQ ID NO: 1995333 - protein, 11 aa, Staphylococcus
VSTDGASPKLG

SEQ ID NO: 1995334 - protein, 7 aa, Staphylococcus
VSTDGDT

SEQ ID NO: 1995335 - protein, 5 aa, Staphylococcus
VSTDS

SEQ ID NO: 1995336 - protein, 7 aa, Staphylococcus
VSTDTPS

SEQ ID NO: 1995337 - protein, 5 aa, Staphylococcus
VSTED

SEQ ID NO: 1995338 - protein, 6 aa, Staphylococcus
VSTEDY

SEQ ID NO: 1995339 - protein, 17 aa, Staphylococcus
VSTEELDARKQNVKPFK

SEQ ID NO: 1995340 - protein, 11 aa, Staphylococcus
VSTEGASPKLG

SEQ ID NO: 1995341 - protein, 5 aa, Staphylococcus
VSTGE

SEQ ID NO: 1995342 - protein, 9 aa, Staphylococcus
VSTGGGAKS

SEQ ID NO: 1995343 - protein, 10 aa, Staphylococcus
VSTGNRNQTL

SEQ ID NO: 1995344 - protein, 9 aa, Staphylococcus
VSTGQAPQF

SEQ ID NO: 1995345 - protein, 10 aa, Staphylococcus
VSTGQQPQFI

SEQ ID NO: 1995346 - protein, 13 aa, Staphylococcus
VSTGQQPQFIGKP

SEQ ID NO: 1995347 - protein, 10 aa, Staphylococcus
VSTGTADSPV

SEQ ID NO: 1995348 - protein, 8 aa, Staphylococcus
VSTKDQRS

SEQ ID NO: 1995349 - protein, 7 aa, Staphylococcus
VSTKQIA

SEQ ID NO: 1995350 - protein, 15 aa, Staphylococcus
VSTKREIESSKYYQG

SEQ ID NO: 1995351 - protein, 5 aa, Staphylococcus
VSTLN

SEQ ID NO: 1995352 - protein, 11 aa, Staphylococcus
VSTLSGGNKRK

SEQ ID NO: 1995353 - protein, 8 aa, Staphylococcus
VSTLSGGQ

SEQ ID NO: 1995354 - protein, 5 aa, Staphylococcus
VSTNY

SEQ ID NO: 1995355 - protein, 7 aa, Staphylococcus
VSTPDGR

SEQ ID NO: 1995356 - protein, 7 aa, Staphylococcus
VSTPDHR

SEQ ID NO: 1995357 - protein, 7 aa, Staphylococcus
VSTPDQR

SEQ ID NO: 1995358 - protein, 7 aa, Staphylococcus
VSTPDSR

SEQ ID NO: 1995359 - protein, 13 aa, Staphylococcus
VSTQQIAQSGRYT

SEQ ID NO: 1995360 - protein, 5 aa, Staphylococcus
VSTRE

SEQ ID NO: 1995361 - protein, 10 aa, Staphylococcus
VSTRKDGTKH

SEQ ID NO: 1995362 - protein, 10 aa, Staphylococcus
VSTRKDGTKR

SEQ ID NO: 1995363 - protein, 9 aa, Staphylococcus
VSTRPGHQE

SEQ ID NO: 1995364 - protein, 9 aa, Staphylococcus
VSTRPGYEE

SEQ ID NO: 1995365 - protein, 5 aa, Staphylococcus
VSTSG

SEQ ID NO: 1995366 - protein, 8 aa, Staphylococcus
VSTSNQYM

SEQ ID NO: 1995367 - protein, 5 aa, Staphylococcus
VSTSS

SEQ ID NO: 1995368 - protein, 8 aa, Staphylococcus
VSTSTQSL

SEQ ID NO: 1995369 - protein, 14 aa, Staphylococcus
VSTTTEDQTGDTLE

SEQ ID NO: 1995370 - protein, 12 aa, Staphylococcus
VSTWTRNTSQEL

SEQ ID NO: 1995371 - protein, 4 aa, Staphylococcus
VSTY

SEQ ID NO: 1995372 - protein, 5 aa, Staphylococcus
VSVDI

SEQ ID NO: 1995373 - protein, 6 aa, Staphylococcus
VSVEED

SEQ ID NO: 1995374 - protein, 20 aa, Staphylococcus
VSVEGNTITVKGPKGELSRT

SEQ ID NO: 1995375 - protein, 9 aa, Staphylococcus
VSVKGSGTV

SEQ ID NO: 1995376 - protein, 4 aa, Staphylococcus
VSVN

SEQ ID NO: 1995377 - protein, 4 aa, Staphylococcus
VSYK

SEQ ID NO: 1995378 - protein, 11 aa, Staphylococcus
VSYKSKNPGAM

SEQ ID NO: 1995379 - protein, 14 aa, Staphylococcus
VSYNIEKNAKHRGF

SEQ ID NO: 1995380 - protein, 24 aa, Staphylococcus
VSYNKEENAVKVDATQKLNEEAPY

SEQ ID NO: 1995381 - protein, 6 aa, Staphylococcus
VSYSTQ

SEQ ID NO: 1995382 - protein, 9 aa, Staphylococcus
VTAAGRQTA

SEQ ID NO: 1995383 - protein, 24 aa, Staphylococcus
VTAEAKDIAQSDGYQRDLQANTQF

SEQ ID NO: 1995384 - protein, 12 aa, Staphylococcus
VTAEDKENLEKR

SEQ ID NO: 1995385 - protein, 12 aa, Staphylococcus
VTAEVPSTISGT

SEQ ID NO: 1995386 - protein, 6 aa, Staphylococcus
VTAGAR

SEQ ID NO: 1995387 - protein, 8 aa, Staphylococcus
VTAGINGD

SEQ ID NO: 1995388 - protein, 8 aa, Staphylococcus
VTAGKENI

SEQ ID NO: 1995389 - protein, 10 aa, Staphylococcus
VTAKNAKERE

SEQ ID NO: 1995390 - protein, 10 aa, Staphylococcus
VTARNNQYKE

SEQ ID NO: 1995391 - protein, 8 aa, Staphylococcus
VTASGAVP

SEQ ID NO: 1995392 - protein, 4 aa, Staphylococcus
VTAT

SEQ ID NO: 1995393 - protein, 7 aa, Staphylococcus
VTATNDE

SEQ ID NO: 1995394 - protein, 6 aa, Staphylococcus
VTAYRG

SEQ ID NO: 1995395 - protein, 4 aa, Staphylococcus
VTDD

SEQ ID NO: 1995396 - protein, 5 aa, Staphylococcus
VTDDE

SEQ ID NO: 1995397 - protein, 14 aa, Staphylococcus
VTDDEIGNGDSIFD

SEQ ID NO: 1995398 - protein, 13 aa, Staphylococcus
VTDDSVDYEDITK

SEQ ID NO: 1995399 - protein, 5 aa, Staphylococcus
VTDDY

SEQ ID NO: 1995400 - protein, 13 aa, Staphylococcus
VTDEGKKFVNEHG

SEQ ID NO: 1995401 - protein, 17 aa, Staphylococcus
VTDELTNELERSPSITE

SEQ ID NO: 1995402 - protein, 13 aa, Staphylococcus
VTDEQSINKQAVE

SEQ ID NO: 1995403 - protein, 8 aa, Staphylococcus
VTDETSVQ

SEQ ID NO: 1995404 - protein, 10 aa, Staphylococcus
VTDGDGNVVS

SEQ ID NO: 1995405 - protein, 12 aa, Staphylococcus
VTDGQGTLSDAV

SEQ ID NO: 1995406 - protein, 8 aa, Staphylococcus
VTDIDTEQ

SEQ ID NO: 1995407 - protein, 20 aa, Staphylococcus
VTDKAKEKIAEEGYDPEYGA

SEQ ID NO: 1995408 - protein, 11 aa, Staphylococcus
VTDKPEKPSMS

SEQ ID NO: 1995409 - protein, 23 aa, Staphylococcus
VTDLDTNKKTITVEHDGQSSTVS

SEQ ID NO: 1995410 - protein, 5 aa, Staphylococcus
VTDLN

SEQ ID NO: 1995411 - protein, 7 aa, Staphylococcus
VTDLNTD

SEQ ID NO: 1995412 - protein, 5 aa, Staphylococcus
VTDLS

SEQ ID NO: 1995413 - protein, 8 aa, Staphylococcus
VTDNQSLG

SEQ ID NO: 1995414 - protein, 16 aa, Staphylococcus
VTDRTQAAIYAIENKL

SEQ ID NO: 1995415 - protein, 16 aa, Staphylococcus
VTDRTQAAIYAMQNNL

SEQ ID NO: 1995416 - protein, 9 aa, Staphylococcus
VTDSGEYEA

SEQ ID NO: 1995417 - protein, 6 aa, Staphylococcus
VTDSGF

SEQ ID NO: 1995418 - protein, 12 aa, Staphylococcus
VTDSNENSGVSK

SEQ ID NO: 1995419 - protein, 19 aa, Staphylococcus
VTDTESLSQAIQDKEDQIH

SEQ ID NO: 1995420 - protein, 17 aa, Staphylococcus
VTDTKGPNGGSPNYKDI

SEQ ID NO: 1995421 - protein, 13 aa, Staphylococcus
VTDTKKINTKRIK

SEQ ID NO: 1995422 - protein, 5 aa, Staphylococcus
VTDTN

SEQ ID NO: 1995423 - protein, 11 aa, Staphylococcus
VTDTNENSGVG

SEQ ID NO: 1995424 - protein, 7 aa, Staphylococcus
VTDTPKI

SEQ ID NO: 1995425 - protein, 4 aa, Staphylococcus
VTDY

SEQ ID NO: 1995426 - protein, 20 aa, Staphylococcus
VTEAAKEKIAEEGYDPEYGA

SEQ ID NO: 1995427 - protein, 7 aa, Staphylococcus
VTEADAS

SEQ ID NO: 1995428 - protein, 10 aa, Staphylococcus
VTEAHEGEVS

SEQ ID NO: 1995429 - protein, 12 aa, Staphylococcus
VTEARNKEGEFI

SEQ ID NO: 1995430 - protein, 12 aa, Staphylococcus
VTEARNKKGEFI

SEQ ID NO: 1995431 - protein, 12 aa, Staphylococcus
VTEARNREGEFI

SEQ ID NO: 1995432 - protein, 9 aa, Staphylococcus
VTEARNSMG

SEQ ID NO: 1995433 - protein, 6 aa, Staphylococcus
VTEDGG

SEQ ID NO: 1995434 - protein, 11 aa, Staphylococcus
VTEDKANELEI

SEQ ID NO: 1995435 - protein, 6 aa, Staphylococcus
VTEDPD

SEQ ID NO: 1995436 - protein, 4 aa, Staphylococcus
VTEE

SEQ ID NO: 1995437 - protein, 7 aa, Staphylococcus
VTEEAKA

SEQ ID NO: 1995438 - protein, 11 aa, Staphylococcus
VTEEEADKLEI

SEQ ID NO: 1995439 - protein, 6 aa, Staphylococcus
VTEEGL

SEQ ID NO: 1995440 - protein, 11 aa, Staphylococcus
VTEEQADAYEL

SEQ ID NO: 1995441 - protein, 5 aa, Staphylococcus
VTEFE

SEQ ID NO: 1995442 - protein, 6 aa, Staphylococcus
VTEGAR

SEQ ID NO: 1995443 - protein, 7 aa, Staphylococcus
VTEGELN

SEQ ID NO: 1995444 - protein, 6 aa, Staphylococcus
VTEGGF

SEQ ID NO: 1995445 - protein, 5 aa, Staphylococcus
VTEGI

SEQ ID NO: 1995446 - protein, 8 aa, Staphylococcus
VTEGIDAQ

SEQ ID NO: 1995447 - protein, 7 aa, Staphylococcus
VTEGPGL

SEQ ID NO: 1995448 - protein, 10 aa, Staphylococcus
VTEGRSEKDL

SEQ ID NO: 1995449 - protein, 9 aa, Staphylococcus
VTEGSLSEG

SEQ ID NO: 1995450 - protein, 7 aa, Staphylococcus
VTEHTYE

SEQ ID NO: 1995451 - protein, 20 aa, Staphylococcus
VTEKAKEKIAEEGYDPQYGA

SEQ ID NO: 1995452 - protein, 8 aa, Staphylococcus
VTEKDEAQ

SEQ ID NO: 1995453 - protein, 14 aa, Staphylococcus
VTEKVDNGNEYQHG

SEQ ID NO: 1995454 - protein, 21 aa, Staphylococcus
VTELTRENAKEMISQNQRKSS

SEQ ID NO: 1995455 - protein, 6 aa, Staphylococcus
VTENGR

SEQ ID NO: 1995456 - protein, 9 aa, Staphylococcus
VTENNAQAV

SEQ ID NO: 1995457 - protein, 12 aa, Staphylococcus
VTENPNKEDIQQ

SEQ ID NO: 1995458 - protein, 12 aa, Staphylococcus
VTENSMKDISNQ

SEQ ID NO: 1995459 - protein, 6 aa, Staphylococcus
VTENSR

SEQ ID NO: 1995460 - protein, 7 aa, Staphylococcus
VTERAEV

SEQ ID NO: 1995461 - protein, 17 aa, Staphylococcus
VTESEADKALVEEGRTN

SEQ ID NO: 1995462 - protein, 13 aa, Staphylococcus
VTESNADGFNKGD

SEQ ID NO: 1995463 - protein, 10 aa, Staphylococcus
VTESNHDEQN

SEQ ID NO: 1995464 - protein, 26 aa, Staphylococcus
VTETEPGIKGDTANGATKSATVETGY

SEQ ID NO: 1995465 - protein, 26 aa, Staphylococcus
VTETEPGIKGDTATGATKSATVETGY

SEQ ID NO: 1995466 - protein, 8 aa, Staphylococcus
VTETKGNY

SEQ ID NO: 1995467 - protein, 11 aa, Staphylococcus
VTETQANELNI

SEQ ID NO: 1995468 - protein, 13 aa, Staphylococcus
VTETTKYEEVGLD

SEQ ID NO: 1995469 - protein, 11 aa, Staphylococcus
VTETVKKYGSK

SEQ ID NO: 1995470 - protein, 4 aa, Staphylococcus
VTEY

SEQ ID NO: 1995471 - protein, 13 aa, Staphylococcus
VTFSKKAKRQLKD

SEQ ID NO: 1995472 - protein, 6 aa, Staphylococcus
VTFTSG

SEQ ID NO: 1995473 - protein, 18 aa, Staphylococcus
VTGDWTEKDYIYTQVSWI

SEQ ID NO: 1995474 - protein, 14 aa, Staphylococcus
VTGDYTIEDEPETS

SEQ ID NO: 1995475 - protein, 6 aa, Staphylococcus
VTGEQV

SEQ ID NO: 1995476 - protein, 4 aa, Staphylococcus
VTGF

SEQ ID NO: 1995477 - protein, 5 aa, Staphylococcus
VTGFS

SEQ ID NO: 1995478 - protein, 9 aa, Staphylococcus
VTGGSTMAR

SEQ ID NO: 1995479 - protein, 9 aa, Staphylococcus
VTGKEAYEA

SEQ ID NO: 1995480 - protein, 21 aa, Staphylococcus
VTGKPTEIEGEFTSGTAERSW

SEQ ID NO: 1995481 - protein, 5 aa, Staphylococcus
VTGKQ

SEQ ID NO: 1995482 - protein, 15 aa, Staphylococcus
VTGKTLKENNEGKEI

SEQ ID NO: 1995483 - protein, 16 aa, Staphylococcus
VTGKTLRENNEGKEIK

SEQ ID NO: 1995484 - protein, 18 aa, Staphylococcus
VTGKTLRENNEGKEIQNE

SEQ ID NO: 1995485 - protein, 16 aa, Staphylococcus
VTGKTLRENNQGKEIK

SEQ ID NO: 1995486 - protein, 8 aa, Staphylococcus
VTGPITGY

SEQ ID NO: 1995487 - protein, 11 aa, Staphylococcus
VTGQNESFHPE

SEQ ID NO: 1995488 - protein, 28 aa, Staphylococcus
VTGQRENINKLEKERQELTQRIKEDKVK

SEQ ID NO: 1995489 - protein, 12 aa, Staphylococcus
VTGRETNQKHQE

SEQ ID NO: 1995490 - protein, 8 aa, Staphylococcus
VTGRPRGV

SEQ ID NO: 1995491 - protein, 12 aa, Staphylococcus
VTGSNNESVAEQ

SEQ ID NO: 1995492 - protein, 9 aa, Staphylococcus
VTGSVDAKA

SEQ ID NO: 1995493 - protein, 8 aa, Staphylococcus
VTGSVDEA

SEQ ID NO: 1995494 - protein, 9 aa, Staphylococcus
VTGSVDEAA

SEQ ID NO: 1995495 - protein, 9 aa, Staphylococcus
VTGSVDEAS

SEQ ID NO: 1995496 - protein, 10 aa, Staphylococcus
VTGSVDEASL

SEQ ID NO: 1995497 - protein, 13 aa, Staphylococcus
VTGSVNYADTADS

SEQ ID NO: 1995498 - protein, 7 aa, Staphylococcus
VTGTAKL

SEQ ID NO: 1995499 - protein, 9 aa, Staphylococcus
VTGTSELDG

SEQ ID NO: 1995500 - protein, 13 aa, Staphylococcus
VTGTVQKVNGGWY

SEQ ID NO: 1995501 - protein, 4 aa, Staphylococcus
VTGV

SEQ ID NO: 1995502 - protein, 7 aa, Staphylococcus
VTHKSWG

SEQ ID NO: 1995503 - protein, 8 aa, Staphylococcus
VTHPRYGK

SEQ ID NO: 1995504 - protein, 6 aa, Staphylococcus
VTHSKA

SEQ ID NO: 1995505 - protein, 9 aa, Staphylococcus
VTHSSGEQA

SEQ ID NO: 1995506 - protein, 36 aa, Staphylococcus
VTHTNHSNKEQSSSTLSNSNLMTTDDEIGNGESIFD

SEQ ID NO: 1995507 - protein, 9 aa, Staphylococcus
VTIDSRAVQ

SEQ ID NO: 1995508 - protein, 5 aa, Staphylococcus
VTIEG

SEQ ID NO: 1995509 - protein, 11 aa, Staphylococcus
VTITEEDSESL

SEQ ID NO: 1995510 - protein, 15 aa, Staphylococcus
VTKAGAHHTWIESLG

SEQ ID NO: 1995511 - protein, 14 aa, Staphylococcus
VTKAPNGQNLHKGT

SEQ ID NO: 1995512 - protein, 18 aa, Staphylococcus
VTKATKAGNSCGKCKPQI

SEQ ID NO: 1995513 - protein, 8 aa, Staphylococcus
VTKDIGDA

SEQ ID NO: 1995514 - protein, 8 aa, Staphylococcus
VTKDINDA

SEQ ID NO: 1995515 - protein, 6 aa, Staphylococcus
VTKDIP

SEQ ID NO: 1995516 - protein, 10 aa, Staphylococcus
VTKEAEPTAS

SEQ ID NO: 1995517 - protein, 12 aa, Staphylococcus
VTKEDGNTNIDA

SEQ ID NO: 1995518 - protein, 6 aa, Staphylococcus
VTKEDV

SEQ ID NO: 1995519 - protein, 22 aa, Staphylococcus
VTKEKNQTNVRSSNKDQTVTMK

SEQ ID NO: 1995520 - protein, 10 aa, Staphylococcus
VTKELNQNTD

SEQ ID NO: 1995521 - protein, 5 aa, Staphylococcus
VTKEY

SEQ ID NO: 1995522 - protein, 26 aa, Staphylococcus
VTKKEKKRYPANPFTTSTLQQEASRK

SEQ ID NO: 1995523 - protein, 25 aa, Staphylococcus
VTKKEKTRYPANPFTTSTLQQEAAR

SEQ ID NO: 1995524 - protein, 6 aa, Staphylococcus
VTKPHR

SEQ ID NO: 1995525 - protein, 14 aa, Staphylococcus
VTKPKGYYTFDNIN

SEQ ID NO: 1995526 - protein, 7 aa, Staphylococcus
VTKQGFS

SEQ ID NO: 1995527 - protein, 17 aa, Staphylococcus
VTKQNKKVQYDVTPQNY

SEQ ID NO: 1995528 - protein, 7 aa, Staphylococcus
VTKRNEI

SEQ ID NO: 1995529 - protein, 19 aa, Staphylococcus
VTKSQPSSKKASTTKQTIS

SEQ ID NO: 1995530 - protein, 7 aa, Staphylococcus
VTKTDFP

SEQ ID NO: 1995531 - protein, 5 aa, Staphylococcus
VTLDN

SEQ ID NO: 1995532 - protein, 17 aa, Staphylococcus
VTLDNNSNGIPHALKRL

SEQ ID NO: 1995533 - protein, 6 aa, Staphylococcus
VTLGTS

SEQ ID NO: 1995534 - protein, 4 aa, Staphylococcus
VTLQ

SEQ ID NO: 1995535 - protein, 13 aa, Staphylococcus
VTLRETGKLGDLA

SEQ ID NO: 1995536 - protein, 11 aa, Staphylococcus
VTLRETGRLGD

SEQ ID NO: 1995537 - protein, 11 aa, Staphylococcus
VTLTSQGATKI

SEQ ID NO: 1995538 - protein, 11 aa, Staphylococcus
VTNAPNGQNLH

SEQ ID NO: 1995539 - protein, 8 aa, Staphylococcus
VTNAQSSI

SEQ ID NO: 1995540 - protein, 4 aa, Staphylococcus
VTND

SEQ ID NO: 1995541 - protein, 5 aa, Staphylococcus
VTNEA

SEQ ID NO: 1995542 - protein, 5 aa, Staphylococcus
VTNEE

SEQ ID NO: 1995543 - protein, 7 aa, Staphylococcus
VTNEGAL

SEQ ID NO: 1995544 - protein, 6 aa, Staphylococcus
VTNEYT

SEQ ID NO: 1995545 - protein, 18 aa, Staphylococcus
VTNGDSEFTHNWSGSPVS

SEQ ID NO: 1995546 - protein, 8 aa, Staphylococcus
VTNGPGKW

SEQ ID NO: 1995547 - protein, 7 aa, Staphylococcus
VTNGSKA

SEQ ID NO: 1995548 - protein, 23 aa, Staphylococcus
VTNHKDINQKLSNEDAYKRARPT

SEQ ID NO: 1995549 - protein, 9 aa, Staphylococcus
VTNIRKDNG

SEQ ID NO: 1995550 - protein, 6 aa, Staphylococcus
VTNKAD

SEQ ID NO: 1995551 - protein, 11 aa, Staphylococcus
VTNKENVSETV

SEQ ID NO: 1995552 - protein, 5 aa, Staphylococcus
VTNKG

SEQ ID NO: 1995553 - protein, 11 aa, Staphylococcus
VTNPANGEDLA

SEQ ID NO: 1995554 - protein, 8 aa, Staphylococcus
VTNPDDVN

SEQ ID NO: 1995555 - protein, 8 aa, Staphylococcus
VTNPEDVQ

SEQ ID NO: 1995556 - protein, 8 aa, Staphylococcus
VTNPENVS

SEQ ID NO: 1995557 - protein, 7 aa, Staphylococcus
VTNPQDV

SEQ ID NO: 1995558 - protein, 8 aa, Staphylococcus
VTNRDEVD

SEQ ID NO: 1995559 - protein, 7 aa, Staphylococcus
VTNRKEV

SEQ ID NO: 1995560 - protein, 8 aa, Staphylococcus
VTNSEGTG

SEQ ID NO: 1995561 - protein, 7 aa, Staphylococcus
VTNSKKD

SEQ ID NO: 1995562 - protein, 6 aa, Staphylococcus
VTPCGL

SEQ ID NO: 1995563 - protein, 9 aa, Staphylococcus
VTPDGEVSK

SEQ ID NO: 1995564 - protein, 7 aa, Staphylococcus
VTPEKIA

SEQ ID NO: 1995565 - protein, 9 aa, Staphylococcus
VTPEKKDEI

SEQ ID NO: 1995566 - protein, 5 aa, Staphylococcus
VTPEL

SEQ ID NO: 1995567 - protein, 5 aa, Staphylococcus
VTPER

SEQ ID NO: 1995568 - protein, 6 aa, Staphylococcus
VTPETL

SEQ ID NO: 1995569 - protein, 8 aa, Staphylococcus
VTPGSEEA

SEQ ID NO: 1995570 - protein, 7 aa, Staphylococcus
VTPGTDA

SEQ ID NO: 1995571 - protein, 12 aa, Staphylococcus
VTPGVSIGDGSV

SEQ ID NO: 1995572 - protein, 4 aa, Staphylococcus
VTPH

SEQ ID NO: 1995573 - protein, 6 aa, Staphylococcus
VTPHRI

SEQ ID NO: 1995574 - protein, 6 aa, Staphylococcus
VTPKAF

SEQ ID NO: 1995575 - protein, 5 aa, Staphylococcus
VTPKI

SEQ ID NO: 1995576 - protein, 5 aa, Staphylococcus
VTPKL

SEQ ID NO: 1995577 - protein, 4 aa, Staphylococcus
VTPL

SEQ ID NO: 1995578 - protein, 13 aa, Staphylococcus
VTPNDYRKLSKYD

SEQ ID NO: 1995579 - protein, 7 aa, Staphylococcus
VTPNGQI

SEQ ID NO: 1995580 - protein, 18 aa, Staphylococcus
VTPNNDSQKAIGENIYSP

SEQ ID NO: 1995581 - protein, 6 aa, Staphylococcus
VTPNNK

SEQ ID NO: 1995582 - protein, 7 aa, Staphylococcus
VTPNNKF

SEQ ID NO: 1995583 - protein, 4 aa, Staphylococcus
VTPP

SEQ ID NO: 1995584 - protein, 8 aa, Staphylococcus
VTPPQLNG

SEQ ID NO: 1995585 - protein, 4 aa, Staphylococcus
VTPQ

SEQ ID NO: 1995586 - protein, 12 aa, Staphylococcus
VTPQSLTEGQTN

SEQ ID NO: 1995587 - protein, 10 aa, Staphylococcus
VTPSTTPGIS

SEQ ID NO: 1995588 - protein, 8 aa, Staphylococcus
VTPTDQPD

SEQ ID NO: 1995589 - protein, 8 aa, Staphylococcus
VTPTDSPD

SEQ ID NO: 1995590 - protein, 10 aa, Staphylococcus
VTPTDSPDAW

SEQ ID NO: 1995591 - protein, 12 aa, Staphylococcus
VTQARDEVGKSI

SEQ ID NO: 1995592 - protein, 4 aa, Staphylococcus
VTQF

SEQ ID NO: 1995593 - protein, 8 aa, Staphylococcus
VTQNKDQF

SEQ ID NO: 1995594 - protein, 6 aa, Staphylococcus
VTQNNK

SEQ ID NO: 1995595 - protein, 14 aa, Staphylococcus
VTQNNLNNVKTSIP

SEQ ID NO: 1995596 - protein, 9 aa, Staphylococcus
VTQQRNGYF

SEQ ID NO: 1995597 - protein, 7 aa, Staphylococcus
VTQRDEI

SEQ ID NO: 1995598 - protein, 19 aa, Staphylococcus
VTQRDEPFKGTEVSRKSVA

SEQ ID NO: 1995599 - protein, 20 aa, Staphylococcus
VTQSAIKAGYSPHTATVQGS

SEQ ID NO: 1995600 - protein, 10 aa, Staphylococcus
VTQSASGTAH

SEQ ID NO: 1995601 - protein, 16 aa, Staphylococcus
VTQSELAKSLGKSQSF

SEQ ID NO: 1995602 - protein, 12 aa, Staphylococcus
VTQSNFKEAPKA

SEQ ID NO: 1995603 - protein, 22 aa, Staphylococcus
VTQSTIKAGYSPHTASEQGSRL

SEQ ID NO: 1995604 - protein, 8 aa, Staphylococcus
VTQTESPD

SEQ ID NO: 1995605 - protein, 13 aa, Staphylococcus
VTRATRKSKRDYE

SEQ ID NO: 1995606 - protein, 5 aa, Staphylococcus
VTRDE

SEQ ID NO: 1995607 - protein, 6 aa, Staphylococcus
VTRDEA

SEQ ID NO: 1995608 - protein, 7 aa, Staphylococcus
VTREASD

SEQ ID NO: 1995609 - protein, 6 aa, Staphylococcus
VTREGK

SEQ ID NO: 1995610 - protein, 7 aa, Staphylococcus
VTRENDG

SEQ ID NO: 1995611 - protein, 14 aa, Staphylococcus
VTRGNIDVNLKANA

SEQ ID NO: 1995612 - protein, 32 aa, Staphylococcus
VTRNKKKYGFEDTLTNSEKVKKDNSQKESKHN

SEQ ID NO: 1995613 - protein, 5 aa, Staphylococcus
VTRNN

SEQ ID NO: 1995614 - protein, 7 aa, Staphylococcus
VTRPRGT

SEQ ID NO: 1995615 - protein, 7 aa, Staphylococcus
VTRVGRG

SEQ ID NO: 1995616 - protein, 11 aa, Staphylococcus
VTSASAAAQSM

SEQ ID NO: 1995617 - protein, 9 aa, Staphylococcus
VTSDEDGEV

SEQ ID NO: 1995618 - protein, 8 aa, Staphylococcus
VTSDNTPY

SEQ ID NO: 1995619 - protein, 7 aa, Staphylococcus
VTSGGLG

SEQ ID NO: 1995620 - protein, 13 aa, Staphylococcus
VTSGTQSPATGKG

SEQ ID NO: 1995621 - protein, 27 aa, Staphylococcus
VTSGYMGGHTENPTYEDVKSGNTGHYE

SEQ ID NO: 1995622 - protein, 26 aa, Staphylococcus
VTSGYMGGSTHNPTYEDVKSGTTGHY

SEQ ID NO: 1995623 - protein, 15 aa, Staphylococcus
VTSKSIQPKDGESVG

SEQ ID NO: 1995624 - protein, 27 aa, Staphylococcus
VTSNDAAPSEASQLESDESMNENESLN

SEQ ID NO: 1995625 - protein, 7 aa, Staphylococcus
VTSNRNL

SEQ ID NO: 1995626 - protein, 16 aa, Staphylococcus
VTSNSKFARKTQPASV

SEQ ID NO: 1995627 - protein, 8 aa, Staphylococcus
VTSPNDDY

SEQ ID NO: 1995628 - protein, 7 aa, Staphylococcus
VTSPQDV

SEQ ID NO: 1995629 - protein, 6 aa, Staphylococcus
VTSQAT

SEQ ID NO: 1995630 - protein, 17 aa, Staphylococcus
VTSRRGRVDGMEARGNA

SEQ ID NO: 1995631 - protein, 18 aa, Staphylococcus
VTSRRGRVDGMEPRGNAQ

SEQ ID NO: 1995632 - protein, 21 aa, Staphylococcus
VTSRTPDDLDDFNREIVKLLE

SEQ ID NO: 1995633 - protein, 10 aa, Staphylococcus
VTSSEPNEGF

SEQ ID NO: 1995634 - protein, 20 aa, Staphylococcus
VTSSLDLNGKNNIDIEDVTV

SEQ ID NO: 1995635 - protein, 6 aa, Staphylococcus
VTSSNI

SEQ ID NO: 1995636 - protein, 9 aa, Staphylococcus
VTSSQSNQY

SEQ ID NO: 1995637 - protein, 11 aa, Staphylococcus
VTSSTATTDAS

SEQ ID NO: 1995638 - protein, 11 aa, Staphylococcus
VTSTEDPHDGL

SEQ ID NO: 1995639 - protein, 8 aa, Staphylococcus
VTSTTSTR

SEQ ID NO: 1995640 - protein, 4 aa, Staphylococcus
VTSV

SEQ ID NO: 1995641 - protein, 9 aa, Staphylococcus
VTSVDTESL

SEQ ID NO: 1995642 - protein, 12 aa, Staphylococcus
VTSVEDAIKGAQ

SEQ ID NO: 1995643 - protein, 11 aa, Staphylococcus
VTTASNGEEAL

SEQ ID NO: 1995644 - protein, 4 aa, Staphylococcus
VTTD

SEQ ID NO: 1995645 - protein, 9 aa, Staphylococcus
VTTDGNQKM

SEQ ID NO: 1995646 - protein, 8 aa, Staphylococcus
VTTDHGNE

SEQ ID NO: 1995647 - protein, 8 aa, Staphylococcus
VTTDHGTE

SEQ ID NO: 1995648 - protein, 5 aa, Staphylococcus
VTTDT

SEQ ID NO: 1995649 - protein, 6 aa, Staphylococcus
VTTDTY

SEQ ID NO: 1995650 - protein, 11 aa, Staphylococcus
VTTESARENIT

SEQ ID NO: 1995651 - protein, 5 aa, Staphylococcus
VTTFS

SEQ ID NO: 1995652 - protein, 5 aa, Staphylococcus
VTTGD

SEQ ID NO: 1995653 - protein, 7 aa, Staphylococcus
VTTGDGE

SEQ ID NO: 1995654 - protein, 7 aa, Staphylococcus
VTTGDGQ

SEQ ID NO: 1995655 - protein, 6 aa, Staphylococcus
VTTGKN

SEQ ID NO: 1995656 - protein, 7 aa, Staphylococcus
VTTGVDP

SEQ ID NO: 1995657 - protein, 4 aa, Staphylococcus
VTTK

SEQ ID NO: 1995658 - protein, 6 aa, Staphylococcus
VTTKDS

SEQ ID NO: 1995659 - protein, 7 aa, Staphylococcus
VTTKDTL

SEQ ID NO: 1995660 - protein, 27 aa, Staphylococcus
VTTKGSGYVTKQSVNNGTTLKDNSKVE

SEQ ID NO: 1995661 - protein, 7 aa, Staphylococcus
VTTKHGA

SEQ ID NO: 1995662 - protein, 13 aa, Staphylococcus
VTTKKKKAEDEKE

SEQ ID NO: 1995663 - protein, 11 aa, Staphylococcus
VTTKPETPSMS

SEQ ID NO: 1995664 - protein, 5 aa, Staphylococcus
VTTLK

SEQ ID NO: 1995665 - protein, 7 aa, Staphylococcus
VTTPEDT

SEQ ID NO: 1995666 - protein, 15 aa, Staphylococcus
VTTPNQDNPLTEGKT

SEQ ID NO: 1995667 - protein, 7 aa, Staphylococcus
VTTPSKK

SEQ ID NO: 1995668 - protein, 7 aa, Staphylococcus
VTTRTVN

SEQ ID NO: 1995669 - protein, 12 aa, Staphylococcus
VTTSEADGFQEG

SEQ ID NO: 1995670 - protein, 5 aa, Staphylococcus
VTTSK

SEQ ID NO: 1995671 - protein, 7 aa, Staphylococcus
VTTTEDD

SEQ ID NO: 1995672 - protein, 9 aa, Staphylococcus
VTTTHEGEV

SEQ ID NO: 1995673 - protein, 6 aa, Staphylococcus
VTTTQF

SEQ ID NO: 1995674 - protein, 6 aa, Staphylococcus
VTTTST

SEQ ID NO: 1995675 - protein, 9 aa, Staphylococcus
VTTVDGPKL

SEQ ID NO: 1995676 - protein, 17 aa, Staphylococcus
VTTYEELKEKDQQPTYS

SEQ ID NO: 1995677 - protein, 4 aa, Staphylococcus
VTVD

SEQ ID NO: 1995678 - protein, 7 aa, Staphylococcus
VTVEDEK

SEQ ID NO: 1995679 - protein, 6 aa, Staphylococcus
VTVEEI

SEQ ID NO: 1995680 - protein, 19 aa, Staphylococcus
VTVNDGKDLSKDPHAKDLE

SEQ ID NO: 1995681 - protein, 18 aa, Staphylococcus
VTVNDGKDLSQDPHAKDL

SEQ ID NO: 1995682 - protein, 12 aa, Staphylococcus
VTVNKNDGSYNQ

SEQ ID NO: 1995683 - protein, 4 aa, Staphylococcus
VTYE

SEQ ID NO: 1995684 - protein, 12 aa, Staphylococcus
VTYEKNGETVTI

SEQ ID NO: 1995685 - protein, 4 aa, Staphylococcus
VTYG

SEQ ID NO: 1995686 - protein, 10 aa, Staphylococcus
VTYKKDENAV

SEQ ID NO: 1995687 - protein, 5 aa, Staphylococcus
VTYPS

SEQ ID NO: 1995688 - protein, 11 aa, Staphylococcus
VTYSNNDDGIG

SEQ ID NO: 1995689 - protein, 16 aa, Staphylococcus
VTYTADDKKSQINVRK

SEQ ID NO: 1995690 - protein, 7 aa, Staphylococcus
VVDEADT

SEQ ID NO: 1995691 - protein, 8 aa, Staphylococcus
VVDSGGKG

SEQ ID NO: 1995692 - protein, 6 aa, Staphylococcus
VVDSPY

SEQ ID NO: 1995693 - protein, 6 aa, Staphylococcus
VVDTER

SEQ ID NO: 1995694 - protein, 12 aa, Staphylococcus
VVDTKKEDHEPM

SEQ ID NO: 1995695 - protein, 8 aa, Staphylococcus
VVEGDEAK

SEQ ID NO: 1995696 - protein, 10 aa, Staphylococcus
VVEGDTPEDL

SEQ ID NO: 1995697 - protein, 7 aa, Staphylococcus
VVERPGS

SEQ ID NO: 1995698 - protein, 8 aa, Staphylococcus
VVERPSSV

SEQ ID NO: 1995699 - protein, 12 aa, Staphylococcus
VVESDDPTIEKG

SEQ ID NO: 1995700 - protein, 13 aa, Staphylococcus
VVESEDPTINEGE

SEQ ID NO: 1995701 - protein, 8 aa, Staphylococcus
VVESGDTV

SEQ ID NO: 1995702 - protein, 14 aa, Staphylococcus
VVESNSSAHKPGDK

SEQ ID NO: 1995703 - protein, 8 aa, Staphylococcus
VVETKEPR

SEQ ID NO: 1995704 - protein, 5 aa, Staphylococcus
VVGEG

SEQ ID NO: 1995705 - protein, 11 aa, Staphylococcus
VVGEKTKVGPF

SEQ ID NO: 1995706 - protein, 8 aa, Staphylococcus
VVKAGAKL

SEQ ID NO: 1995707 - protein, 28 aa, Staphylococcus
VVKDKSKNVIEKAKEVGNDAVESAEDMA

SEQ ID NO: 1995708 - protein, 7 aa, Staphylococcus
VVKDPDV

SEQ ID NO: 1995709 - protein, 7 aa, Staphylococcus
VVKEGTD

SEQ ID NO: 1995710 - protein, 9 aa, Staphylococcus
VVKGDDTIS

SEQ ID NO: 1995711 - protein, 12 aa, Staphylococcus
VVKTTVDARCYY

SEQ ID NO: 1995712 - protein, 4 aa, Staphylococcus
VVND

SEQ ID NO: 1995713 - protein, 7 aa, Staphylococcus
VVNDPDV

SEQ ID NO: 1995714 - protein, 28 aa, Staphylococcus
VVNPGGSMTGGGARKSKSILSQKDELSK

SEQ ID NO: 1995715 - protein, 28 aa, Staphylococcus
VVNPGGSMTGGGARKTKSILTQKDELTT

SEQ ID NO: 1995716 - protein, 10 aa, Staphylococcus
VVNTGDEDIE

SEQ ID NO: 1995717 - protein, 5 aa, Staphylococcus
VVNYD

SEQ ID NO: 1995718 - protein, 5 aa, Staphylococcus
VVPEN

SEQ ID NO: 1995719 - protein, 7 aa, Staphylococcus
VVPKDYE

SEQ ID NO: 1995720 - protein, 7 aa, Staphylococcus
VVPPKKG

SEQ ID NO: 1995721 - protein, 6 aa, Staphylococcus
VVPSTE

SEQ ID NO: 1995722 - protein, 7 aa, Staphylococcus
VVREGED

SEQ ID NO: 1995723 - protein, 7 aa, Staphylococcus
VVREGSD

SEQ ID NO: 1995724 - protein, 4 aa, Staphylococcus
VVSE

SEQ ID NO: 1995725 - protein, 11 aa, Staphylococcus
VVSKNGKEIDL

SEQ ID NO: 1995726 - protein, 11 aa, Staphylococcus
VVSKNNKEITL

SEQ ID NO: 1995727 - protein, 7 aa, Staphylococcus
VVSPETK

SEQ ID NO: 1995728 - protein, 6 aa, Staphylococcus
VVTGRP

SEQ ID NO: 1995729 - protein, 7 aa, Staphylococcus
VVTPALN

SEQ ID NO: 1995730 - protein, 7 aa, Staphylococcus
VVTQGYS

SEQ ID NO: 1995731 - protein, 11 aa, Staphylococcus
VVTSGGPELAK

SEQ ID NO: 1995732 - protein, 15 aa, Staphylococcus
VVTSTNKVKYEGITS

SEQ ID NO: 1995733 - protein, 7 aa, Staphylococcus
VYAERTA

SEQ ID NO: 1995734 - protein, 11 aa, Staphylococcus
VYDDDSVKKKY

SEQ ID NO: 1995735 - protein, 12 aa, Staphylococcus
VYDGELQKAPEH

SEQ ID NO: 1995736 - protein, 5 aa, Staphylococcus
VYDKG

SEQ ID NO: 1995737 - protein, 12 aa, Staphylococcus
VYDSEDENADAR

SEQ ID NO: 1995738 - protein, 4 aa, Staphylococcus
VYED

SEQ ID NO: 1995739 - protein, 12 aa, Staphylococcus
VYESQKAKIGDQ

SEQ ID NO: 1995740 - protein, 10 aa, Staphylococcus
VYGDKQKYQA

SEQ ID NO: 1995741 - protein, 13 aa, Staphylococcus
VYGKEPPGTPPMT

SEQ ID NO: 1995742 - protein, 12 aa, Staphylococcus
VYGKGKKRQVPL

SEQ ID NO: 1995743 - protein, 23 aa, Staphylococcus
VYGNNKRKMKRGYNTKREAKYAE

SEQ ID NO: 1995744 - protein, 12 aa, Staphylococcus
VYGRPRKSKIGT

SEQ ID NO: 1995745 - protein, 12 aa, Staphylococcus
VYIPGSSIKGAI

SEQ ID NO: 1995746 - protein, 10 aa, Staphylococcus
VYKEGNPQTI

SEQ ID NO: 1995747 - protein, 12 aa, Staphylococcus
VYKYDNDIENSI

SEQ ID NO: 1995748 - protein, 12 aa, Staphylococcus
VYNKKQKNYNGQ

SEQ ID NO: 1995749 - protein, 14 aa, Staphylococcus
VYNKQRRKHDGNTL

SEQ ID NO: 1995750 - protein, 5 aa, Staphylococcus
VYPNE

SEQ ID NO: 1995751 - protein, 6 aa, Staphylococcus
VYPNES

SEQ ID NO: 1995752 - protein, 6 aa, Staphylococcus
VYPNGH

SEQ ID NO: 1995753 - protein, 11 aa, Staphylococcus
VYPNKSVEDAY

SEQ ID NO: 1995754 - protein, 10 aa, Staphylococcus
VYQDDNSKTI

SEQ ID NO: 1995755 - protein, 8 aa, Staphylococcus
VYQPTTTK

SEQ ID NO: 1995756 - protein, 8 aa, Staphylococcus
VYREDRGS

SEQ ID NO: 1995757 - protein, 9 aa, Staphylococcus
VYREDTGSI

SEQ ID NO: 1995758 - protein, 12 aa, Staphylococcus
VYRENKDGSIEV

SEQ ID NO: 1995759 - protein, 9 aa, Staphylococcus
VYRNETGSL

SEQ ID NO: 1995760 - protein, 13 aa, Staphylococcus
VYRPTGEDDKYAG

SEQ ID NO: 1995761 - protein, 17 aa, Staphylococcus
VYSDGTTVLGADDKAGI

SEQ ID NO: 1995762 - protein, 11 aa, Staphylococcus
VYSEERGKQNN

SEQ ID NO: 1995763 - protein, 9 aa, Staphylococcus
VYSENPDID

SEQ ID NO: 1995764 - protein, 5 aa, Staphylococcus
VYSGG

SEQ ID NO: 1995765 - protein, 10 aa, Staphylococcus
VYSGTKKRAP

SEQ ID NO: 1995766 - protein, 5 aa, Staphylococcus
VYSSP

SEQ ID NO: 1995767 - protein, 4 aa, Staphylococcus
VYST

SEQ ID NO: 1995768 - protein, 5 aa, Staphylococcus
VYSTP

SEQ ID NO: 1995769 - protein, 7 aa, Staphylococcus
VYTTDTE

SEQ ID NO: 1995770 - protein, 20 aa, Staphylococcus
VYYEETADPEVEGGRPEIDR

SEQ ID NO: 1995771 - protein, 4 aa, Staphylococcus
WADE

SEQ ID NO: 1995772 - protein, 13 aa, Staphylococcus
WADEDQDTSDLAY

SEQ ID NO: 1995773 - protein, 26 aa, Staphylococcus
WADKKDNEYQNHVTNQKNAHKSSQIK

SEQ ID NO: 1995774 - protein, 8 aa, Staphylococcus
WAEPEGME

SEQ ID NO: 1995775 - protein, 4 aa, Staphylococcus
WAFE

SEQ ID NO: 1995776 - protein, 8 aa, Staphylococcus
WAFETKDK

SEQ ID NO: 1995777 - protein, 9 aa, Staphylococcus
WAFETSDKS

SEQ ID NO: 1995778 - protein, 7 aa, Staphylococcus
WAISGGY

SEQ ID NO: 1995779 - protein, 11 aa, Staphylococcus
WANEALPDKMP

SEQ ID NO: 1995780 - protein, 6 aa, Staphylococcus
WAPQSG

SEQ ID NO: 1995781 - protein, 29 aa, Staphylococcus
WAREDQDTSDLAYEASKKAIADAGLEPSD

SEQ ID NO: 1995782 - protein, 4 aa, Staphylococcus
WASF

SEQ ID NO: 1995783 - protein, 26 aa, Staphylococcus
WASKNTQPPVDKNTFKYSSKYPNKKQ

SEQ ID NO: 1995784 - protein, 8 aa, Staphylococcus
WASSKGKG

SEQ ID NO: 1995785 - protein, 14 aa, Staphylococcus
WATRKKDVDFLIEQ

SEQ ID NO: 1995786 - protein, 14 aa, Staphylococcus
WATTEENIDKLLEL

SEQ ID NO: 1995787 - protein, 14 aa, Staphylococcus
WATTEENVDKLLEL

SEQ ID NO: 1995788 - protein, 14 aa, Staphylococcus
WATTEENVNQLLEL

SEQ ID NO: 1995789 - protein, 9 aa, Staphylococcus
WDDEKQDKF

SEQ ID NO: 1995790 - protein, 10 aa, Staphylococcus
WDDEKQSKFL

SEQ ID NO: 1995791 - protein, 6 aa, Staphylococcus
WDDPRG

SEQ ID NO: 1995792 - protein, 4 aa, Staphylococcus
WDED

SEQ ID NO: 1995793 - protein, 15 aa, Staphylococcus
WDEEDEEDKQRTLDK

SEQ ID NO: 1995794 - protein, 5 aa, Staphylococcus
WDEKK

SEQ ID NO: 1995795 - protein, 7 aa, Staphylococcus
WDEKKPA

SEQ ID NO: 1995796 - protein, 11 aa, Staphylococcus
WDETDKDTRHD

SEQ ID NO: 1995797 - protein, 9 aa, Staphylococcus
WDGSAKDDI

SEQ ID NO: 1995798 - protein, 8 aa, Staphylococcus
WDGSAKED

SEQ ID NO: 1995799 - protein, 9 aa, Staphylococcus
WDGSAKEDI

SEQ ID NO: 1995800 - protein, 4 aa, Staphylococcus
WDIT

SEQ ID NO: 1995801 - protein, 5 aa, Staphylococcus
WDKDK

SEQ ID NO: 1995802 - protein, 8 aa, Staphylococcus
WDKEEQQK

SEQ ID NO: 1995803 - protein, 6 aa, Staphylococcus
WDNEKV

SEQ ID NO: 1995804 - protein, 5 aa, Staphylococcus
WDNPE

SEQ ID NO: 1995805 - protein, 6 aa, Staphylococcus
WDNPEV

SEQ ID NO: 1995806 - protein, 7 aa, Staphylococcus
WDNTDRP

SEQ ID NO: 1995807 - protein, 18 aa, Staphylococcus
WDPGDQIQISEDGDTISL

SEQ ID NO: 1995808 - protein, 17 aa, Staphylococcus
WDPNDQVQISDEGDTLG

SEQ ID NO: 1995809 - protein, 6 aa, Staphylococcus
WDSEAR

SEQ ID NO: 1995810 - protein, 7 aa, Staphylococcus
WDSEKQT

SEQ ID NO: 1995811 - protein, 5 aa, Staphylococcus
WEDER

SEQ ID NO: 1995812 - protein, 10 aa, Staphylococcus
WEDQEHYKGG

SEQ ID NO: 1995813 - protein, 8 aa, Staphylococcus
WEDQSHYK

SEQ ID NO: 1995814 - protein, 11 aa, Staphylococcus
WEEDNEKGHIN

SEQ ID NO: 1995815 - protein, 17 aa, Staphylococcus
WEEGGETLEPGLDLVGK

SEQ ID NO: 1995816 - protein, 5 aa, Staphylococcus
WENPK

SEQ ID NO: 1995817 - protein, 9 aa, Staphylococcus
WEPKSSDFY

SEQ ID NO: 1995818 - protein, 19 aa, Staphylococcus
WEQHSPKSWAGSMGRTAKI

SEQ ID NO: 1995819 - protein, 11 aa, Staphylococcus
WESKNGTIEPG

SEQ ID NO: 1995820 - protein, 9 aa, Staphylococcus
WETNPDAKA

SEQ ID NO: 1995821 - protein, 9 aa, Staphylococcus
WETNPEAKT

SEQ ID NO: 1995822 - protein, 9 aa, Staphylococcus
WETSNGRSF

SEQ ID NO: 1995823 - protein, 8 aa, Staphylococcus
WEYDDTTK

SEQ ID NO: 1995824 - protein, 8 aa, Staphylococcus
WEYDTQTQ

SEQ ID NO: 1995825 - protein, 7 aa, Staphylococcus
WGAPEGM

SEQ ID NO: 1995826 - protein, 14 aa, Staphylococcus
WGAQTERSKRNFPV

SEQ ID NO: 1995827 - protein, 8 aa, Staphylococcus
WGATPSAL

SEQ ID NO: 1995828 - protein, 9 aa, Staphylococcus
WGDETQPAY

SEQ ID NO: 1995829 - protein, 4 aa, Staphylococcus
WGGF

SEQ ID NO: 1995830 - protein, 4 aa, Staphylococcus
WGGQ

SEQ ID NO: 1995831 - protein, 9 aa, Staphylococcus
WGGTDHVDP

SEQ ID NO: 1995832 - protein, 4 aa, Staphylococcus
WGIE

SEQ ID NO: 1995833 - protein, 12 aa, Staphylococcus
WGNMTDNPVQDM

SEQ ID NO: 1995834 - protein, 4 aa, Staphylococcus
WGPR

SEQ ID NO: 1995835 - protein, 6 aa, Staphylococcus
WGQSTV

SEQ ID NO: 1995836 - protein, 5 aa, Staphylococcus
WGTLK

SEQ ID NO: 1995837 - protein, 5 aa, Staphylococcus
WGTPR

SEQ ID NO: 1995838 - protein, 6 aa, Staphylococcus
WGTPRD

SEQ ID NO: 1995839 - protein, 6 aa, Staphylococcus
WGTPRQ

SEQ ID NO: 1995840 - protein, 8 aa, Staphylococcus
WGTSPEMG

SEQ ID NO: 1995841 - protein, 10 aa, Staphylococcus
WHSDDDDKGV

SEQ ID NO: 1995842 - protein, 4 aa, Staphylococcus
WIGG

SEQ ID NO: 1995843 - protein, 5 aa, Staphylococcus
WIGGA

SEQ ID NO: 1995844 - protein, 9 aa, Staphylococcus
WKDQNRYAP

SEQ ID NO: 1995845 - protein, 20 aa, Staphylococcus
WKGDNNSKWVDKSKSDLIDG

SEQ ID NO: 1995846 - protein, 5 aa, Staphylococcus
WKGEY

SEQ ID NO: 1995847 - protein, 8 aa, Staphylococcus
WKGKGSDF

SEQ ID NO: 1995848 - protein, 4 aa, Staphylococcus
WKGT

SEQ ID NO: 1995849 - protein, 12 aa, Staphylococcus
WKKAQEAGNEIA

SEQ ID NO: 1995850 - protein, 12 aa, Staphylococcus
WKKGESSKNYQH

SEQ ID NO: 1995851 - protein, 13 aa, Staphylococcus
WKKKGIKTAEQAY

SEQ ID NO: 1995852 - protein, 6 aa, Staphylococcus
WKNNEL

SEQ ID NO: 1995853 - protein, 26 aa, Staphylococcus
WKSDDDKPSSNNAFAGGEDINDDDLP

SEQ ID NO: 1995854 - protein, 10 aa, Staphylococcus
WKSNTSEEDI

SEQ ID NO: 1995855 - protein, 6 aa, Staphylococcus
WKTNKE

SEQ ID NO: 1995856 - protein, 11 aa, Staphylococcus
WLGTSQEKYLR

SEQ ID NO: 1995857 - protein, 5 aa, Staphylococcus
WLPED

SEQ ID NO: 1995858 - protein, 5 aa, Staphylococcus
WLPSD

SEQ ID NO: 1995859 - protein, 10 aa, Staphylococcus
WNAPSKTLEE

SEQ ID NO: 1995860 - protein, 21 aa, Staphylococcus
WNDNDKNSVRNHRPRIDTARK

SEQ ID NO: 1995861 - protein, 7 aa, Staphylococcus
WNDPDGS

SEQ ID NO: 1995862 - protein, 12 aa, Staphylococcus
WNDPDKYRTQAQ

SEQ ID NO: 1995863 - protein, 11 aa, Staphylococcus
WNEDKENEVIE

SEQ ID NO: 1995864 - protein, 32 aa, Staphylococcus
WNEDKENEVIERAKDDIKKAIKEADKVEKQKV

SEQ ID NO: 1995865 - protein, 32 aa, Staphylococcus
WNEDKENEVIERAKSDIKAAIKEADKTEKQTV

SEQ ID NO: 1995866 - protein, 9 aa, Staphylococcus
WNEDKQEKF

SEQ ID NO: 1995867 - protein, 31 aa, Staphylococcus
WNEEKENEVIERAKDDIKKAIKEADNTPKQT

SEQ ID NO: 1995868 - protein, 10 aa, Staphylococcus
WNEQTTNQRV

SEQ ID NO: 1995869 - protein, 5 aa, Staphylococcus
WNGET

SEQ ID NO: 1995870 - protein, 11 aa, Staphylococcus
WNGGRDTVGNL

SEQ ID NO: 1995871 - protein, 5 aa, Staphylococcus
WNKEY

SEQ ID NO: 1995872 - protein, 9 aa, Staphylococcus
WNKTGWGKI

SEQ ID NO: 1995873 - protein, 16 aa, Staphylococcus
WNNEENQFENPTGIDK

SEQ ID NO: 1995874 - protein, 11 aa, Staphylococcus
WNNEPLPDKMP

SEQ ID NO: 1995875 - protein, 11 aa, Staphylococcus
WNNEPLPEKMP

SEQ ID NO: 1995876 - protein, 11 aa, Staphylococcus
WNNESLPDKMP

SEQ ID NO: 1995877 - protein, 4 aa, Staphylococcus
WNNK

SEQ ID NO: 1995878 - protein, 12 aa, Staphylococcus
WNNSNETLFKAF

SEQ ID NO: 1995879 - protein, 12 aa, Staphylococcus
WNNSSDELYQAF

SEQ ID NO: 1995880 - protein, 12 aa, Staphylococcus
WNNSSEELFKAF

SEQ ID NO: 1995881 - protein, 12 aa, Staphylococcus
WNNSTEELFKAL

SEQ ID NO: 1995882 - protein, 9 aa, Staphylococcus
WNPSNYQYK

SEQ ID NO: 1995883 - protein, 4 aa, Staphylococcus
WNSP

SEQ ID NO: 1995884 - protein, 6 aa, Staphylococcus
WPANGK

SEQ ID NO: 1995885 - protein, 4 aa, Staphylococcus
WPAS

SEQ ID NO: 1995886 - protein, 9 aa, Staphylococcus
WPDTESEDF

SEQ ID NO: 1995887 - protein, 4 aa, Staphylococcus
WPED

SEQ ID NO: 1995888 - protein, 16 aa, Staphylococcus
WPEDTPSMKKKTQQSV

SEQ ID NO: 1995889 - protein, 5 aa, Staphylococcus
WPENS

SEQ ID NO: 1995890 - protein, 4 aa, Staphylococcus
WPES

SEQ ID NO: 1995891 - protein, 16 aa, Staphylococcus
WPKSTRTITPSFTTNG

SEQ ID NO: 1995892 - protein, 13 aa, Staphylococcus
WPNEEAKDYQRYY

SEQ ID NO: 1995893 - protein, 9 aa, Staphylococcus
WPNESADDF

SEQ ID NO: 1995894 - protein, 5 aa, Staphylococcus
WPQNG

SEQ ID NO: 1995895 - protein, 5 aa, Staphylococcus
WPQTG

SEQ ID NO: 1995896 - protein, 5 aa, Staphylococcus
WPSGY

SEQ ID NO: 1995897 - protein, 5 aa, Staphylococcus
WPTGE

SEQ ID NO: 1995898 - protein, 11 aa, Staphylococcus
WPTNNAKKGYF

SEQ ID NO: 1995899 - protein, 27 aa, Staphylococcus
WPTSNREQSKTKHLADKQGNPEEKPGI

SEQ ID NO: 1995900 - protein, 4 aa, Staphylococcus
WQAI

SEQ ID NO: 1995901 - protein, 10 aa, Staphylococcus
WQAPPRLQNG

SEQ ID NO: 1995902 - protein, 5 aa, Staphylococcus
WQDKN

SEQ ID NO: 1995903 - protein, 12 aa, Staphylococcus
WQGGRNEVGQVT

SEQ ID NO: 1995904 - protein, 19 aa, Staphylococcus
WQGGSQRKVDKIDQVEKDE

SEQ ID NO: 1995905 - protein, 5 aa, Staphylococcus
WQGSE

SEQ ID NO: 1995906 - protein, 10 aa, Staphylococcus
WQKLDDSELR

SEQ ID NO: 1995907 - protein, 10 aa, Staphylococcus
WQKVNEDELQ

SEQ ID NO: 1995908 - protein, 10 aa, Staphylococcus
WQKVSEDELQ

SEQ ID NO: 1995909 - protein, 10 aa, Staphylococcus
WQNAGEGDSR

SEQ ID NO: 1995910 - protein, 4 aa, Staphylococcus
WQPG

SEQ ID NO: 1995911 - protein, 4 aa, Staphylococcus
WQQN

SEQ ID NO: 1995912 - protein, 21 aa, Staphylococcus
WQQSSAYSQTHQKRGTSQGAD

SEQ ID NO: 1995913 - protein, 17 aa, Staphylococcus
WQQTKQDAGDDAPKNFA

SEQ ID NO: 1995914 - protein, 6 aa, Staphylococcus
WQRTPG

SEQ ID NO: 1995915 - protein, 17 aa, Staphylococcus
WQSTKENAGNDAPKDFA

SEQ ID NO: 1995916 - protein, 8 aa, Staphylococcus
WQTDSHKE

SEQ ID NO: 1995917 - protein, 8 aa, Staphylococcus
WRDTDTDA

SEQ ID NO: 1995918 - protein, 10 aa, Staphylococcus
WREGKSSNIK

SEQ ID NO: 1995919 - protein, 6 aa, Staphylococcus
WRETTN

SEQ ID NO: 1995920 - protein, 4 aa, Staphylococcus
WRGA

SEQ ID NO: 1995921 - protein, 12 aa, Staphylococcus
WRGGREEVGTVN

SEQ ID NO: 1995922 - protein, 9 aa, Staphylococcus
WRGTNDKYY

SEQ ID NO: 1995923 - protein, 7 aa, Staphylococcus
WRNGTPI

SEQ ID NO: 1995924 - protein, 8 aa, Staphylococcus
WRNSDADT

SEQ ID NO: 1995925 - protein, 7 aa, Staphylococcus
WRNSEAD

SEQ ID NO: 1995926 - protein, 7 aa, Staphylococcus
WRNTDAD

SEQ ID NO: 1995927 - protein, 11 aa, Staphylococcus
WRSRKDALKGK

SEQ ID NO: 1995928 - protein, 6 aa, Staphylococcus
WSAEDE

SEQ ID NO: 1995929 - protein, 8 aa, Staphylococcus
WSAEDEYA

SEQ ID NO: 1995930 - protein, 11 aa, Staphylococcus
WSDGSDKSSTE

SEQ ID NO: 1995931 - protein, 12 aa, Staphylococcus
WSDSDKYRAQAD

SEQ ID NO: 1995932 - protein, 8 aa, Staphylococcus
WSEEERDS

SEQ ID NO: 1995933 - protein, 31 aa, Staphylococcus
WSEEKENEVIERAKDDIKKAIKEADNTPKQT

SEQ ID NO: 1995934 - protein, 32 aa, Staphylococcus
WSEEKETEVMDQAKDDIKKAIKEADKVEKQTV

SEQ ID NO: 1995935 - protein, 8 aa, Staphylococcus
WSERQPNK

SEQ ID NO: 1995936 - protein, 4 aa, Staphylococcus
WSET

SEQ ID NO: 1995937 - protein, 7 aa, Staphylococcus
WSETEDE

SEQ ID NO: 1995938 - protein, 13 aa, Staphylococcus
WSETENKENMEAQ

SEQ ID NO: 1995939 - protein, 15 aa, Staphylococcus
WSGGRDEVGRAQGNV

SEQ ID NO: 1995940 - protein, 10 aa, Staphylococcus
WSGSEPTHQQ

SEQ ID NO: 1995941 - protein, 8 aa, Staphylococcus
WSKDEQDT

SEQ ID NO: 1995942 - protein, 14 aa, Staphylococcus
WSKGEIEAVPGRTM

SEQ ID NO: 1995943 - protein, 9 aa, Staphylococcus
WSKREAEDY

SEQ ID NO: 1995944 - protein, 9 aa, Staphylococcus
WSKTPKEER

SEQ ID NO: 1995945 - protein, 5 aa, Staphylococcus
WSPDT

SEQ ID NO: 1995946 - protein, 4 aa, Staphylococcus
WSRS

SEQ ID NO: 1995947 - protein, 5 aa, Staphylococcus
WSRSQ

SEQ ID NO: 1995948 - protein, 7 aa, Staphylococcus
WSSEGTD

SEQ ID NO: 1995949 - protein, 8 aa, Staphylococcus
WSSTNNSI

SEQ ID NO: 1995950 - protein, 12 aa, Staphylococcus
WSYSNPDNLSHI

SEQ ID NO: 1995951 - protein, 13 aa, Staphylococcus
WTAIEKKDSKIPM

SEQ ID NO: 1995952 - protein, 20 aa, Staphylococcus
WTEEKENEVIERAKTDIKAA

SEQ ID NO: 1995953 - protein, 12 aa, Staphylococcus
WTGGRESIGTVE

SEQ ID NO: 1995954 - protein, 4 aa, Staphylococcus
WTGQ

SEQ ID NO: 1995955 - protein, 11 aa, Staphylococcus
WTKGETSGHTQ

SEQ ID NO: 1995956 - protein, 6 aa, Staphylococcus
WTPEDS

SEQ ID NO: 1995957 - protein, 5 aa, Staphylococcus
WTSEQ

SEQ ID NO: 1995958 - protein, 6 aa, Staphylococcus
WTTKTN

SEQ ID NO: 1995959 - protein, 9 aa, Staphylococcus
WYGKDKVNS

SEQ ID NO: 1995960 - protein, 10 aa, Staphylococcus
WYGKNKVNSR

SEQ ID NO: 1995961 - protein, 5 aa, Staphylococcus
WYTPP

SEQ ID NO: 1995962 - protein, 10 aa, Staphylococcus
YAADQSETKL

SEQ ID NO: 1995963 - protein, 12 aa, Staphylococcus
YAAEIDDAGDVE

SEQ ID NO: 1995964 - protein, 8 aa, Staphylococcus
YAAESSSD

SEQ ID NO: 1995965 - protein, 5 aa, Staphylococcus
YAAHK

SEQ ID NO: 1995966 - protein, 8 aa, Staphylococcus
YAAKEDSE

SEQ ID NO: 1995967 - protein, 9 aa, Staphylococcus
YAAPPQTAV

SEQ ID NO: 1995968 - protein, 8 aa, Staphylococcus
YAAQEDSE

SEQ ID NO: 1995969 - protein, 12 aa, Staphylococcus
YADATSRAIQAG

SEQ ID NO: 1995970 - protein, 7 aa, Staphylococcus
YADDTLN

SEQ ID NO: 1995971 - protein, 4 aa, Staphylococcus
YADE

SEQ ID NO: 1995972 - protein, 6 aa, Staphylococcus
YADENT

SEQ ID NO: 1995973 - protein, 7 aa, Staphylococcus
YADGDGY

SEQ ID NO: 1995974 - protein, 7 aa, Staphylococcus
YADGEKW

SEQ ID NO: 1995975 - protein, 8 aa, Staphylococcus
YADGKYDQ

SEQ ID NO: 1995976 - protein, 9 aa, Staphylococcus
YADGNDYNR

SEQ ID NO: 1995977 - protein, 11 aa, Staphylococcus
YADGTDNPEGI

SEQ ID NO: 1995978 - protein, 9 aa, Staphylococcus
YADKNSPYR

SEQ ID NO: 1995979 - protein, 4 aa, Staphylococcus
YADM

SEQ ID NO: 1995980 - protein, 10 aa, Staphylococcus
YADNGGTPWL

SEQ ID NO: 1995981 - protein, 12 aa, Staphylococcus
YADSAEPKSIAE

SEQ ID NO: 1995982 - protein, 4 aa, Staphylococcus
YADT

SEQ ID NO: 1995983 - protein, 16 aa, Staphylococcus
YADTDNEIESTARGHK

SEQ ID NO: 1995984 - protein, 6 aa, Staphylococcus
YAEDKY

SEQ ID NO: 1995985 - protein, 9 aa, Staphylococcus
YAEDNEKSL

SEQ ID NO: 1995986 - protein, 8 aa, Staphylococcus
YAEDPANF

SEQ ID NO: 1995987 - protein, 8 aa, Staphylococcus
YAEDPDNF

SEQ ID NO: 1995988 - protein, 7 aa, Staphylococcus
YAEDPEH

SEQ ID NO: 1995989 - protein, 8 aa, Staphylococcus
YAEDPENF

SEQ ID NO: 1995990 - protein, 8 aa, Staphylococcus
YAEDPQNF

SEQ ID NO: 1995991 - protein, 4 aa, Staphylococcus
YAEE

SEQ ID NO: 1995992 - protein, 5 aa, Staphylococcus
YAEER

SEQ ID NO: 1995993 - protein, 9 aa, Staphylococcus
YAEGYPGRR

SEQ ID NO: 1995994 - protein, 10 aa, Staphylococcus
YAEHKGKPFY

SEQ ID NO: 1995995 - protein, 6 aa, Staphylococcus
YAEMEP

SEQ ID NO: 1995996 - protein, 35 aa, Staphylococcus
YAENQYSSVKEQYETTFNEYKEKKKELEELQSADQ

SEQ ID NO: 1995997 - protein, 6 aa, Staphylococcus
YAEQNA

SEQ ID NO: 1995998 - protein, 9 aa, Staphylococcus
YAEQTGATI

SEQ ID NO: 1995999 - protein, 4 aa, Staphylococcus
YAER

SEQ ID NO: 1996000 - protein, 7 aa, Staphylococcus
YAEREIN

SEQ ID NO: 1996001 - protein, 5 aa, Staphylococcus
YAERH

SEQ ID NO: 1996002 - protein, 9 aa, Staphylococcus
YAERQGGYT

SEQ ID NO: 1996003 - protein, 6 aa, Staphylococcus
YAESED

SEQ ID NO: 1996004 - protein, 9 aa, Staphylococcus
YAESNNSDV

SEQ ID NO: 1996005 - protein, 4 aa, Staphylococcus
YAET

SEQ ID NO: 1996006 - protein, 9 aa, Staphylococcus
YAETGGTPW

SEQ ID NO: 1996007 - protein, 7 aa, Staphylococcus
YAETRQS

SEQ ID NO: 1996008 - protein, 5 aa, Staphylococcus
YAETS

SEQ ID NO: 1996009 - protein, 9 aa, Staphylococcus
YAGATTGQQ

SEQ ID NO: 1996010 - protein, 17 aa, Staphylococcus
YAGEASHATLSGKHVPN

SEQ ID NO: 1996011 - protein, 7 aa, Staphylococcus
YAGEQYS

SEQ ID NO: 1996012 - protein, 6 aa, Staphylococcus
YAGESY

SEQ ID NO: 1996013 - protein, 11 aa, Staphylococcus
YAGGGDNACGA

SEQ ID NO: 1996014 - protein, 7 aa, Staphylococcus
YAGGKAI

SEQ ID NO: 1996015 - protein, 8 aa, Staphylococcus
YAGGKDIA

SEQ ID NO: 1996016 - protein, 7 aa, Staphylococcus
YAGKSSM

SEQ ID NO: 1996017 - protein, 4 aa, Staphylococcus
YAGN

SEQ ID NO: 1996018 - protein, 10 aa, Staphylococcus
YAGNENVHDV

SEQ ID NO: 1996019 - protein, 11 aa, Staphylococcus
YAGNKEKADAV

SEQ ID NO: 1996020 - protein, 12 aa, Staphylococcus
YAGNKEKAEEVV

SEQ ID NO: 1996021 - protein, 11 aa, Staphylococcus
YAGNQDKAEAV

SEQ ID NO: 1996022 - protein, 6 aa, Staphylococcus
YAGPKE

SEQ ID NO: 1996023 - protein, 12 aa, Staphylococcus
YAGREATLKTGQ

SEQ ID NO: 1996024 - protein, 5 aa, Staphylococcus
YAGRI

SEQ ID NO: 1996025 - protein, 10 aa, Staphylococcus
YAGSDEDSQL

SEQ ID NO: 1996026 - protein, 10 aa, Staphylococcus
YAGSDKDSQL

SEQ ID NO: 1996027 - protein, 9 aa, Staphylococcus
YAGSDQDTQ

SEQ ID NO: 1996028 - protein, 11 aa, Staphylococcus
YAGSKDKAEAV

SEQ ID NO: 1996029 - protein, 7 aa, Staphylococcus
YAGSSSM

SEQ ID NO: 1996030 - protein, 10 aa, Staphylococcus
YAGTDKEDLF

SEQ ID NO: 1996031 - protein, 6 aa, Staphylococcus
YAGTSS

SEQ ID NO: 1996032 - protein, 9 aa, Staphylococcus
YAHDDNETM

SEQ ID NO: 1996033 - protein, 9 aa, Staphylococcus
YAINSTSKG

SEQ ID NO: 1996034 - protein, 5 aa, Staphylococcus
YAKDN

SEQ ID NO: 1996035 - protein, 9 aa, Staphylococcus
YAKDPDGQL

SEQ ID NO: 1996036 - protein, 15 aa, Staphylococcus
YAKEAKIKYGQTDYY

SEQ ID NO: 1996037 - protein, 6 aa, Staphylococcus
YAKEGA

SEQ ID NO: 1996038 - protein, 7 aa, Staphylococcus
YAKEGAN

SEQ ID NO: 1996039 - protein, 8 aa, Staphylococcus
YAKEGKDR

SEQ ID NO: 1996040 - protein, 7 aa, Staphylococcus
YAKESQT

SEQ ID NO: 1996041 - protein, 11 aa, Staphylococcus
YAKKNKGTTIY

SEQ ID NO: 1996042 - protein, 8 aa, Staphylococcus
YAKPGETL

SEQ ID NO: 1996043 - protein, 6 aa, Staphylococcus
YAKPNT

SEQ ID NO: 1996044 - protein, 4 aa, Staphylococcus
YAKQ

SEQ ID NO: 1996045 - protein, 8 aa, Staphylococcus
YAKQAFKE

SEQ ID NO: 1996046 - protein, 7 aa, Staphylococcus
YAKQSQL

SEQ ID NO: 1996047 - protein, 11 aa, Staphylococcus
YAKRENKSLAD

SEQ ID NO: 1996048 - protein, 8 aa, Staphylococcus
YAKRHGYE

SEQ ID NO: 1996049 - protein, 7 aa, Staphylococcus
YAKRSQL

SEQ ID NO: 1996050 - protein, 9 aa, Staphylococcus
YAKTESAKD

SEQ ID NO: 1996051 - protein, 6 aa, Staphylococcus
YAKTLN

SEQ ID NO: 1996052 - protein, 11 aa, Staphylococcus
YANAKDGLKGA

SEQ ID NO: 1996053 - protein, 11 aa, Staphylococcus
YANAKNGLQGA

SEQ ID NO: 1996054 - protein, 4 aa, Staphylococcus
YANE

SEQ ID NO: 1996055 - protein, 32 aa, Staphylococcus
YANFGDEATFGGGKSIRDGMAQNPNVTRDDRN

SEQ ID NO: 1996056 - protein, 6 aa, Staphylococcus
YANKPI

SEQ ID NO: 1996057 - protein, 7 aa, Staphylococcus
YANRGAA

SEQ ID NO: 1996058 - protein, 10 aa, Staphylococcus
YANSASDQDV

SEQ ID NO: 1996059 - protein, 9 aa, Staphylococcus
YANTENYDK

SEQ ID NO: 1996060 - protein, 13 aa, Staphylococcus
YANTEYTDRNGYP

SEQ ID NO: 1996061 - protein, 9 aa, Staphylococcus
YAPDKFPNN

SEQ ID NO: 1996062 - protein, 17 aa, Staphylococcus
YAPDSELKGGSPEENRR

SEQ ID NO: 1996063 - protein, 6 aa, Staphylococcus
YAPDTP

SEQ ID NO: 1996064 - protein, 7 aa, Staphylococcus
YAPDTPV

SEQ ID NO: 1996065 - protein, 4 aa, Staphylococcus
YAPH

SEQ ID NO: 1996066 - protein, 5 aa, Staphylococcus
YAPIS

SEQ ID NO: 1996067 - protein, 4 aa, Staphylococcus
YAPK

SEQ ID NO: 1996068 - protein, 6 aa, Staphylococcus
YAPKTP

SEQ ID NO: 1996069 - protein, 8 aa, Staphylococcus
YAPKVKPE

SEQ ID NO: 1996070 - protein, 5 aa, Staphylococcus
YAPNE

SEQ ID NO: 1996071 - protein, 8 aa, Staphylococcus
YAPPQGIE

SEQ ID NO: 1996072 - protein, 7 aa, Staphylococcus
YAPPQGL

SEQ ID NO: 1996073 - protein, 5 aa, Staphylococcus
YAPRP

SEQ ID NO: 1996074 - protein, 6 aa, Staphylococcus
YAPSIQ

SEQ ID NO: 1996075 - protein, 8 aa, Staphylococcus
YAPTTDAD

SEQ ID NO: 1996076 - protein, 6 aa, Staphylococcus
YAQEAR

SEQ ID NO: 1996077 - protein, 6 aa, Staphylococcus
YAQGEL

SEQ ID NO: 1996078 - protein, 11 aa, Staphylococcus
YAQGNDNPEGH

SEQ ID NO: 1996079 - protein, 10 aa, Staphylococcus
YAQGRTSETV

SEQ ID NO: 1996080 - protein, 5 aa, Staphylococcus
YAQKG

SEQ ID NO: 1996081 - protein, 16 aa, Staphylococcus
YAQKPEGFANVLREMW

SEQ ID NO: 1996082 - protein, 12 aa, Staphylococcus
YAQPNNLTGGNK

SEQ ID NO: 1996083 - protein, 9 aa, Staphylococcus
YAQQEQQTI

SEQ ID NO: 1996084 - protein, 12 aa, Staphylococcus
YAQQGNLAKASS

SEQ ID NO: 1996085 - protein, 6 aa, Staphylococcus
YAQQQG

SEQ ID NO: 1996086 - protein, 6 aa, Staphylococcus
YAQSQG

SEQ ID NO: 1996087 - protein, 19 aa, Staphylococcus
YAQTTGHAGQSLAAYTPSG

SEQ ID NO: 1996088 - protein, 14 aa, Staphylococcus
YARAIKGTKPTFHK

SEQ ID NO: 1996089 - protein, 7 aa, Staphylococcus
YARDNGV

SEQ ID NO: 1996090 - protein, 22 aa, Staphylococcus
YAREKDIDVTNTPKASTASTAE

SEQ ID NO: 1996091 - protein, 22 aa, Staphylococcus
YAREKDIDVTNTPKASTNATAD

SEQ ID NO: 1996092 - protein, 7 aa, Staphylococcus
YAREKGV

SEQ ID NO: 1996093 - protein, 22 aa, Staphylococcus
YAREKNIDVTNTPKASTAATAE

SEQ ID NO: 1996094 - protein, 22 aa, Staphylococcus
YAREKNIDVTNTPKASTNATAE

SEQ ID NO: 1996095 - protein, 7 aa, Staphylococcus
YARKENG

SEQ ID NO: 1996096 - protein, 10 aa, Staphylococcus
YARPTFSEDK

SEQ ID NO: 1996097 - protein, 11 aa, Staphylococcus
YARRQGKTLSD

SEQ ID NO: 1996098 - protein, 11 aa, Staphylococcus
YARSGHPNREV

SEQ ID NO: 1996099 - protein, 15 aa, Staphylococcus
YARSIKGTKPTFKKE

SEQ ID NO: 1996100 - protein, 17 aa, Staphylococcus
YARSKSANAFNAKGESL

SEQ ID NO: 1996101 - protein, 18 aa, Staphylococcus
YARSKSANAFNAKGESLM

SEQ ID NO: 1996102 - protein, 18 aa, Staphylococcus
YARSKSANAYNAKGESLM

SEQ ID NO: 1996103 - protein, 14 aa, Staphylococcus
YASAKGCKSSLGFD

SEQ ID NO: 1996104 - protein, 5 aa, Staphylococcus
YASDE

SEQ ID NO: 1996105 - protein, 8 aa, Staphylococcus
YASDPENF

SEQ ID NO: 1996106 - protein, 5 aa, Staphylococcus
YASDT

SEQ ID NO: 1996107 - protein, 24 aa, Staphylococcus
YASNDKSLRAKGIGSYTERKEGIK

SEQ ID NO: 1996108 - protein, 6 aa, Staphylococcus
YASSRL

SEQ ID NO: 1996109 - protein, 11 aa, Staphylococcus
YASSSKSEQKL

SEQ ID NO: 1996110 - protein, 10 aa, Staphylococcus
YATASDKQAM

SEQ ID NO: 1996111 - protein, 8 aa, Staphylococcus
YATDPRIY

SEQ ID NO: 1996112 - protein, 9 aa, Staphylococcus
YATDPRLYK

SEQ ID NO: 1996113 - protein, 6 aa, Staphylococcus
YATEVR

SEQ ID NO: 1996114 - protein, 10 aa, Staphylococcus
YATGEAEPSL

SEQ ID NO: 1996115 - protein, 11 aa, Staphylococcus
YATGPGGSRAK

SEQ ID NO: 1996116 - protein, 20 aa, Staphylococcus
YATHTRNQIGGYKGRALKKG

SEQ ID NO: 1996117 - protein, 9 aa, Staphylococcus
YATHTRTQM

SEQ ID NO: 1996118 - protein, 6 aa, Staphylococcus
YATNEE

SEQ ID NO: 1996119 - protein, 8 aa, Staphylococcus
YATPTTQL

SEQ ID NO: 1996120 - protein, 4 aa, Staphylococcus
YATQ

SEQ ID NO: 1996121 - protein, 7 aa, Staphylococcus
YATQGSI

SEQ ID NO: 1996122 - protein, 11 aa, Staphylococcus
YATQLETGQPV

SEQ ID NO: 1996123 - protein, 6 aa, Staphylococcus
YATRSQ

SEQ ID NO: 1996124 - protein, 6 aa, Staphylococcus
YATSED

SEQ ID NO: 1996125 - protein, 14 aa, Staphylococcus
YATTSKDDANLPVG

SEQ ID NO: 1996126 - protein, 9 aa, Staphylococcus
YAVTEDRSV

SEQ ID NO: 1996127 - protein, 12 aa, Staphylococcus
YAVTEDSNGQFR

SEQ ID NO: 1996128 - protein, 7 aa, Staphylococcus
YAYASSQ

SEQ ID NO: 1996129 - protein, 8 aa, Staphylococcus
YCTGRGEK

SEQ ID NO: 1996130 - protein, 8 aa, Staphylococcus
YDADNQSI

SEQ ID NO: 1996131 - protein, 10 aa, Staphylococcus
YDADSTSIAQ

SEQ ID NO: 1996132 - protein, 9 aa, Staphylococcus
YDAKDGQTY

SEQ ID NO: 1996133 - protein, 7 aa, Staphylococcus
YDAKTKT

SEQ ID NO: 1996134 - protein, 5 aa, Staphylococcus
YDAPE

SEQ ID NO: 1996135 - protein, 4 aa, Staphylococcus
YDAS

SEQ ID NO: 1996136 - protein, 11 aa, Staphylococcus
YDASQVDSKTM

SEQ ID NO: 1996137 - protein, 4 aa, Staphylococcus
YDAY

SEQ ID NO: 1996138 - protein, 4 aa, Staphylococcus
YDDE

SEQ ID NO: 1996139 - protein, 14 aa, Staphylococcus
YDDEAQEVDMREGS

SEQ ID NO: 1996140 - protein, 6 aa, Staphylococcus
YDDEEA

SEQ ID NO: 1996141 - protein, 15 aa, Staphylococcus
YDDEEALNKLGQQSD

SEQ ID NO: 1996142 - protein, 9 aa, Staphylococcus
YDDEIPDYP

SEQ ID NO: 1996143 - protein, 14 aa, Staphylococcus
YDDENRELDAREGA

SEQ ID NO: 1996144 - protein, 15 aa, Staphylococcus
YDDEQALKELGESSD

SEQ ID NO: 1996145 - protein, 7 aa, Staphylococcus
YDDERAL

SEQ ID NO: 1996146 - protein, 12 aa, Staphylococcus
YDDGKDAKGLPK

SEQ ID NO: 1996147 - protein, 10 aa, Staphylococcus
YDDGKDPKGL

SEQ ID NO: 1996148 - protein, 8 aa, Staphylococcus
YDDGNACQ

SEQ ID NO: 1996149 - protein, 4 aa, Staphylococcus
YDDI

SEQ ID NO: 1996150 - protein, 10 aa, Staphylococcus
YDDKEKVNGI

SEQ ID NO: 1996151 - protein, 4 aa, Staphylococcus
YDDQ

SEQ ID NO: 1996152 - protein, 12 aa, Staphylococcus
YDDSHIRMRKDL

SEQ ID NO: 1996153 - protein, 14 aa, Staphylococcus
YDDTEDTNEIKLGQ

SEQ ID NO: 1996154 - protein, 9 aa, Staphylococcus
YDDTGNADR

SEQ ID NO: 1996155 - protein, 9 aa, Staphylococcus
YDDTPITKP

SEQ ID NO: 1996156 - protein, 15 aa, Staphylococcus
YDDTQALQELGEKSD

SEQ ID NO: 1996157 - protein, 8 aa, Staphylococcus
YDDTTTEP

SEQ ID NO: 1996158 - protein, 5 aa, Staphylococcus
YDDVR

SEQ ID NO: 1996159 - protein, 14 aa, Staphylococcus
YDDYTDDDDQEDEH

SEQ ID NO: 1996160 - protein, 6 aa, Staphylococcus
YDEANN

SEQ ID NO: 1996161 - protein, 5 aa, Staphylococcus
YDEDE

SEQ ID NO: 1996162 - protein, 5 aa, Staphylococcus
YDEED

SEQ ID NO: 1996163 - protein, 5 aa, Staphylococcus
YDEEK

SEQ ID NO: 1996164 - protein, 9 aa, Staphylococcus
YDEEKGGWQ

SEQ ID NO: 1996165 - protein, 9 aa, Staphylococcus
YDEELGARP

SEQ ID NO: 1996166 - protein, 6 aa, Staphylococcus
YDEENE

SEQ ID NO: 1996167 - protein, 6 aa, Staphylococcus
YDEERL

SEQ ID NO: 1996168 - protein, 8 aa, Staphylococcus
YDEETGGI

SEQ ID NO: 1996169 - protein, 17 aa, Staphylococcus
YDEEVKAGTFPAEAHTY

SEQ ID NO: 1996170 - protein, 5 aa, Staphylococcus
YDEGF

SEQ ID NO: 1996171 - protein, 75 aa, Staphylococcus
YDEIDNNDYPQTYDSATDTRRRRRRQYTNHDDTGVPSIKERPSNKRNKSLNSAQLNENNNRKTTSQYHKYTNNHS

SEQ ID NO: 1996172 - protein, 10 aa, Staphylococcus
YDENDKPKRI

SEQ ID NO: 1996173 - protein, 11 aa, Staphylococcus
YDENDKPKRID

SEQ ID NO: 1996174 - protein, 9 aa, Staphylococcus
YDENDKPVR

SEQ ID NO: 1996175 - protein, 10 aa, Staphylococcus
YDENDQPKRI

SEQ ID NO: 1996176 - protein, 10 aa, Staphylococcus
YDENKSLVQQ

SEQ ID NO: 1996177 - protein, 7 aa, Staphylococcus
YDENQQP

SEQ ID NO: 1996178 - protein, 8 aa, Staphylococcus
YDENRVSV

SEQ ID NO: 1996179 - protein, 10 aa, Staphylococcus
YDENSNFYQR

SEQ ID NO: 1996180 - protein, 7 aa, Staphylococcus
YDEPKGF

SEQ ID NO: 1996181 - protein, 8 aa, Staphylococcus
YDEPKGFG

SEQ ID NO: 1996182 - protein, 7 aa, Staphylococcus
YDEPNMN

SEQ ID NO: 1996183 - protein, 5 aa, Staphylococcus
YDEQA

SEQ ID NO: 1996184 - protein, 9 aa, Staphylococcus
YDEQDKPVR

SEQ ID NO: 1996185 - protein, 6 aa, Staphylococcus
YDEQDY

SEQ ID NO: 1996186 - protein, 10 aa, Staphylococcus
YDERDAQHMT

SEQ ID NO: 1996187 - protein, 10 aa, Staphylococcus
YDERSTSEDI

SEQ ID NO: 1996188 - protein, 11 aa, Staphylococcus
YDESDKPKRID

SEQ ID NO: 1996189 - protein, 19 aa, Staphylococcus
YDESEDSFEDIAEDLIDFD

SEQ ID NO: 1996190 - protein, 19 aa, Staphylococcus
YDESEESFEDIAEDLIDFD

SEQ ID NO: 1996191 - protein, 9 aa, Staphylococcus
YDETADRSN

SEQ ID NO: 1996192 - protein, 8 aa, Staphylococcus
YDETGKSV

SEQ ID NO: 1996193 - protein, 8 aa, Staphylococcus
YDETGTDV

SEQ ID NO: 1996194 - protein, 8 aa, Staphylococcus
YDETKGQR

SEQ ID NO: 1996195 - protein, 5 aa, Staphylococcus
YDETN

SEQ ID NO: 1996196 - protein, 7 aa, Staphylococcus
YDETTNQ

SEQ ID NO: 1996197 - protein, 4 aa, Staphylococcus
YDEV

SEQ ID NO: 1996198 - protein, 11 aa, Staphylococcus
YDGDKDKAELA

SEQ ID NO: 1996199 - protein, 11 aa, Staphylococcus
YDGDKDKANLA

SEQ ID NO: 1996200 - protein, 10 aa, Staphylococcus
YDGDKSKAEL

SEQ ID NO: 1996201 - protein, 9 aa, Staphylococcus
YDGDYPDEI

SEQ ID NO: 1996202 - protein, 18 aa, Staphylococcus
YDGEGVTEAIRTKSNMDG

SEQ ID NO: 1996203 - protein, 10 aa, Staphylococcus
YDGEPGLEKA

SEQ ID NO: 1996204 - protein, 4 aa, Staphylococcus
YDGG

SEQ ID NO: 1996205 - protein, 85 aa, Staphylococcus
YDGHTNQSNNYAKYDSSEDSRRRRRRNHINQDDTGIPSIKSRSPKSSNKYIDTRESQRFNKHQNNYSSTNVSNYSKANSNHQSRV

SEQ ID NO: 1996206 - protein, 12 aa, Staphylococcus
YDGKNEKEQQLD

SEQ ID NO: 1996207 - protein, 14 aa, Staphylococcus
YDGKPGLEKALSNT

SEQ ID NO: 1996208 - protein, 14 aa, Staphylococcus
YDGKTIKLGDTGRV

SEQ ID NO: 1996209 - protein, 13 aa, Staphylococcus
YDGNPLKLGTTDR

SEQ ID NO: 1996210 - protein, 11 aa, Staphylococcus
YDGPAEEATEE

SEQ ID NO: 1996211 - protein, 11 aa, Staphylococcus
YDGPASEATDD

SEQ ID NO: 1996212 - protein, 5 aa, Staphylococcus
YDGPL

SEQ ID NO: 1996213 - protein, 12 aa, Staphylococcus
YDGRGKSTQLTE

SEQ ID NO: 1996214 - protein, 14 aa, Staphylococcus
YDGRTGLDKALNKS

SEQ ID NO: 1996215 - protein, 10 aa, Staphylococcus
YDGTEREPEV

SEQ ID NO: 1996216 - protein, 11 aa, Staphylococcus
YDGTEREPEVL

SEQ ID NO: 1996217 - protein, 16 aa, Staphylococcus
YDGTPIQLGKTNRTLS

SEQ ID NO: 1996218 - protein, 4 aa, Staphylococcus
YDGY

SEQ ID NO: 1996219 - protein, 5 aa, Staphylococcus
YDHPD

SEQ ID NO: 1996220 - protein, 11 aa, Staphylococcus
YDIGDSETPIT

SEQ ID NO: 1996221 - protein, 63 aa, Staphylococcus
YDIKASHSKELPNSQFQNNEFGSSRTVNLSGQELPNSQSNDTENNDTDYIKTESNDTNDLNDN

SEQ ID NO: 1996222 - protein, 63 aa, Staphylococcus
YDIKSSHSKELPNSQFQNNEFGSSRTVNLSGQELPNSQSNDTENNDTDYIKTESNDTNDLNDN

SEQ ID NO: 1996223 - protein, 10 aa, Staphylococcus
YDINKQNVDD

SEQ ID NO: 1996224 - protein, 14 aa, Staphylococcus
YDISENKIKTIVLN

SEQ ID NO: 1996225 - protein, 8 aa, Staphylococcus
YDISTEDQ

SEQ ID NO: 1996226 - protein, 4 aa, Staphylococcus
YDKA

SEQ ID NO: 1996227 - protein, 18 aa, Staphylococcus
YDKAAPETEIVEEVQTTE

SEQ ID NO: 1996228 - protein, 13 aa, Staphylococcus
YDKAGDPSEKKVT

SEQ ID NO: 1996229 - protein, 12 aa, Staphylococcus
YDKASDSEKTYL

SEQ ID NO: 1996230 - protein, 4 aa, Staphylococcus
YDKD

SEQ ID NO: 1996231 - protein, 9 aa, Staphylococcus
YDKDEDRQF

SEQ ID NO: 1996232 - protein, 7 aa, Staphylococcus
YDKDGDL

SEQ ID NO: 1996233 - protein, 11 aa, Staphylococcus
YDKDGKASQVK

SEQ ID NO: 1996234 - protein, 8 aa, Staphylococcus
YDKDKGQR

SEQ ID NO: 1996235 - protein, 9 aa, Staphylococcus
YDKDNKGVE

SEQ ID NO: 1996236 - protein, 8 aa, Staphylococcus
YDKEKGQR

SEQ ID NO: 1996237 - protein, 4 aa, Staphylococcus
YDKG

SEQ ID NO: 1996238 - protein, 5 aa, Staphylococcus
YDKGE

SEQ ID NO: 1996239 - protein, 13 aa, Staphylococcus
YDKGQQLSKERRN

SEQ ID NO: 1996240 - protein, 10 aa, Staphylococcus
YDKGTNEEIV

SEQ ID NO: 1996241 - protein, 9 aa, Staphylococcus
YDKGVNEDI

SEQ ID NO: 1996242 - protein, 4 aa, Staphylococcus
YDKN

SEQ ID NO: 1996243 - protein, 5 aa, Staphylococcus
YDKPG

SEQ ID NO: 1996244 - protein, 6 aa, Staphylococcus
YDKPGL

SEQ ID NO: 1996245 - protein, 9 aa, Staphylococcus
YDKQMGARP

SEQ ID NO: 1996246 - protein, 8 aa, Staphylococcus
YDKRWPKS

SEQ ID NO: 1996247 - protein, 8 aa, Staphylococcus
YDKSKGQR

SEQ ID NO: 1996248 - protein, 5 aa, Staphylococcus
YDKSN

SEQ ID NO: 1996249 - protein, 10 aa, Staphylococcus
YDKSSVGNIE

SEQ ID NO: 1996250 - protein, 4 aa, Staphylococcus
YDKT

SEQ ID NO: 1996251 - protein, 10 aa, Staphylococcus
YDKTGSPKGL

SEQ ID NO: 1996252 - protein, 9 aa, Staphylococcus
YDKTSLSDI

SEQ ID NO: 1996253 - protein, 8 aa, Staphylococcus
YDKTSVAD

SEQ ID NO: 1996254 - protein, 9 aa, Staphylococcus
YDKTSVDDI

SEQ ID NO: 1996255 - protein, 9 aa, Staphylococcus
YDKTSVKDI

SEQ ID NO: 1996256 - protein, 17 aa, Staphylococcus
YDKVGTPVAETDEAEVT

SEQ ID NO: 1996257 - protein, 8 aa, Staphylococcus
YDLDNRTA

SEQ ID NO: 1996258 - protein, 19 aa, Staphylococcus
YDLGPGPRIPEKKRQTAYE

SEQ ID NO: 1996259 - protein, 12 aa, Staphylococcus
YDLTRGRITYRY

SEQ ID NO: 1996260 - protein, 7 aa, Staphylococcus
YDNASNV

SEQ ID NO: 1996261 - protein, 4 aa, Staphylococcus
YDNE

SEQ ID NO: 1996262 - protein, 16 aa, Staphylococcus
YDNEEDGAARYLADRF

SEQ ID NO: 1996263 - protein, 6 aa, Staphylococcus
YDNEKA

SEQ ID NO: 1996264 - protein, 11 aa, Staphylococcus
YDNETTQLSET

SEQ ID NO: 1996265 - protein, 7 aa, Staphylococcus
YDNKKKD

SEQ ID NO: 1996266 - protein, 8 aa, Staphylococcus
YDNKSGLD

SEQ ID NO: 1996267 - protein, 6 aa, Staphylococcus
YDNNEI

SEQ ID NO: 1996268 - protein, 9 aa, Staphylococcus
YDNNPNNAI

SEQ ID NO: 1996269 - protein, 7 aa, Staphylococcus
YDNPFNP

SEQ ID NO: 1996270 - protein, 8 aa, Staphylococcus
YDNPRAKK

SEQ ID NO: 1996271 - protein, 15 aa, Staphylococcus
YDNQEDKWNVIDTFQ

SEQ ID NO: 1996272 - protein, 8 aa, Staphylococcus
YDNQNTDI

SEQ ID NO: 1996273 - protein, 5 aa, Staphylococcus
YDNQT

SEQ ID NO: 1996274 - protein, 30 aa, Staphylococcus
YDNQTGVKEKERQEQQKQQQQQENQQPQFE

SEQ ID NO: 1996275 - protein, 26 aa, Staphylococcus
YDNQTGVNEKEQEQRQEQQNQQPEFT

SEQ ID NO: 1996276 - protein, 28 aa, Staphylococcus
YDNQTGVNEKERQEQQKEVQENQQPQFE

SEQ ID NO: 1996277 - protein, 28 aa, Staphylococcus
YDNQTGVNEKERQEQQKQAQQNQEPQFE

SEQ ID NO: 1996278 - protein, 8 aa, Staphylococcus
YDNTENGV

SEQ ID NO: 1996279 - protein, 7 aa, Staphylococcus
YDNTMRS

SEQ ID NO: 1996280 - protein, 8 aa, Staphylococcus
YDPEKGQR

SEQ ID NO: 1996281 - protein, 6 aa, Staphylococcus
YDPENL

SEQ ID NO: 1996282 - protein, 7 aa, Staphylococcus
YDPKELE

SEQ ID NO: 1996283 - protein, 19 aa, Staphylococcus
YDPKKDEFKEVSQDDLKGS

SEQ ID NO: 1996284 - protein, 4 aa, Staphylococcus
YDPL

SEQ ID NO: 1996285 - protein, 9 aa, Staphylococcus
YDPLISDDD

SEQ ID NO: 1996286 - protein, 10 aa, Staphylococcus
YDQDSKNYKY

SEQ ID NO: 1996287 - protein, 23 aa, Staphylococcus
YDQETGVDAIEQEKNQENSKPKF

SEQ ID NO: 1996288 - protein, 7 aa, Staphylococcus
YDQKIEE

SEQ ID NO: 1996289 - protein, 16 aa, Staphylococcus
YDQRSDQLSGGQQQRI

SEQ ID NO: 1996290 - protein, 5 aa, Staphylococcus
YDQSS

SEQ ID NO: 1996291 - protein, 7 aa, Staphylococcus
YDQTGKF

SEQ ID NO: 1996292 - protein, 8 aa, Staphylococcus
YDQTIEEK

SEQ ID NO: 1996293 - protein, 7 aa, Staphylococcus
YDQTSGD

SEQ ID NO: 1996294 - protein, 6 aa, Staphylococcus
YDQYRQ

SEQ ID NO: 1996295 - protein, 5 aa, Staphylococcus
YDRGV

SEQ ID NO: 1996296 - protein, 13 aa, Staphylococcus
YDRLSETNNFPEF

SEQ ID NO: 1996297 - protein, 4 aa, Staphylococcus
YDRN

SEQ ID NO: 1996298 - protein, 6 aa, Staphylococcus
YDRPFD

SEQ ID NO: 1996299 - protein, 5 aa, Staphylococcus
YDRPM

SEQ ID NO: 1996300 - protein, 16 aa, Staphylococcus
YDRPYDDLENGINAAT

SEQ ID NO: 1996301 - protein, 6 aa, Staphylococcus
YDRSLN

SEQ ID NO: 1996302 - protein, 4 aa, Staphylococcus
YDRT

SEQ ID NO: 1996303 - protein, 15 aa, Staphylococcus
YDRTTPSLCSDTVSE

SEQ ID NO: 1996304 - protein, 10 aa, Staphylococcus
YDSDSGYYRA

SEQ ID NO: 1996305 - protein, 10 aa, Staphylococcus
YDSDSTSVAQ

SEQ ID NO: 1996306 - protein, 4 aa, Staphylococcus
YDSE

SEQ ID NO: 1996307 - protein, 8 aa, Staphylococcus
YDSEEDLH

SEQ ID NO: 1996308 - protein, 12 aa, Staphylococcus
YDSEFKYETDNI

SEQ ID NO: 1996309 - protein, 9 aa, Staphylococcus
YDSEGKAIQ

SEQ ID NO: 1996310 - protein, 8 aa, Staphylococcus
YDSEKGGW

SEQ ID NO: 1996311 - protein, 7 aa, Staphylococcus
YDSEKGL

SEQ ID NO: 1996312 - protein, 11 aa, Staphylococcus
YDSERKGPTIG

SEQ ID NO: 1996313 - protein, 8 aa, Staphylococcus
YDSESQIQ

SEQ ID NO: 1996314 - protein, 4 aa, Staphylococcus
YDSG

SEQ ID NO: 1996315 - protein, 9 aa, Staphylococcus
YDSGQEGPV

SEQ ID NO: 1996316 - protein, 10 aa, Staphylococcus
YDSGQTGPTI

SEQ ID NO: 1996317 - protein, 11 aa, Staphylococcus
YDSKSETYELR

SEQ ID NO: 1996318 - protein, 8 aa, Staphylococcus
YDSPEKLA

SEQ ID NO: 1996319 - protein, 6 aa, Staphylococcus
YDSPGL

SEQ ID NO: 1996320 - protein, 8 aa, Staphylococcus
YDSPITQP

SEQ ID NO: 1996321 - protein, 8 aa, Staphylococcus
YDSPITSP

SEQ ID NO: 1996322 - protein, 17 aa, Staphylococcus
YDSRREAFDQSGDLKPY

SEQ ID NO: 1996323 - protein, 17 aa, Staphylococcus
YDSRREAFDSAGDLKPY

SEQ ID NO: 1996324 - protein, 17 aa, Staphylococcus
YDSRRQAFDASGDLKPY

SEQ ID NO: 1996325 - protein, 11 aa, Staphylococcus
YDSSREAFDSV

SEQ ID NO: 1996326 - protein, 12 aa, Staphylococcus
YDSTLTGKRLKD

SEQ ID NO: 1996327 - protein, 6 aa, Staphylococcus
YDSTTE

SEQ ID NO: 1996328 - protein, 13 aa, Staphylococcus
YDSYTDEEVEEDE

SEQ ID NO: 1996329 - protein, 19 aa, Staphylococcus
YDTDDDRIQTSLETAEEAG

SEQ ID NO: 1996330 - protein, 5 aa, Staphylococcus
YDTDE

SEQ ID NO: 1996331 - protein, 4 aa, Staphylococcus
YDTE

SEQ ID NO: 1996332 - protein, 13 aa, Staphylococcus
YDTEASALSAPQI

SEQ ID NO: 1996333 - protein, 6 aa, Staphylococcus
YDTEDT

SEQ ID NO: 1996334 - protein, 6 aa, Staphylococcus
YDTEST

SEQ ID NO: 1996335 - protein, 13 aa, Staphylococcus
YDTGNEPIPENSR

SEQ ID NO: 1996336 - protein, 7 aa, Staphylococcus
YDTHTIP

SEQ ID NO: 1996337 - protein, 9 aa, Staphylococcus
YDTKSHGTV

SEQ ID NO: 1996338 - protein, 4 aa, Staphylococcus
YDTN

SEQ ID NO: 1996339 - protein, 5 aa, Staphylococcus
YDTNN

SEQ ID NO: 1996340 - protein, 5 aa, Staphylococcus
YDTPD

SEQ ID NO: 1996341 - protein, 18 aa, Staphylococcus
YDTPGMAQYGSDTAIGDG

SEQ ID NO: 1996342 - protein, 18 aa, Staphylococcus
YDTPGMKGGTEQSELGKG

SEQ ID NO: 1996343 - protein, 18 aa, Staphylococcus
YDTPGMNNLGSETTLGNG

SEQ ID NO: 1996344 - protein, 4 aa, Staphylococcus
YDTQ

SEQ ID NO: 1996345 - protein, 9 aa, Staphylococcus
YDTQQDKPF

SEQ ID NO: 1996346 - protein, 5 aa, Staphylococcus
YDTSA

SEQ ID NO: 1996347 - protein, 6 aa, Staphylococcus
YDTSAE

SEQ ID NO: 1996348 - protein, 6 aa, Staphylococcus
YDTSSA

SEQ ID NO: 1996349 - protein, 10 aa, Staphylococcus
YDTSYPSKDA

SEQ ID NO: 1996350 - protein, 6 aa, Staphylococcus
YDTTAE

SEQ ID NO: 1996351 - protein, 19 aa, Staphylococcus
YDTTKEVSALSGGQQKRVG

SEQ ID NO: 1996352 - protein, 8 aa, Staphylococcus
YDTVEETR

SEQ ID NO: 1996353 - protein, 5 aa, Staphylococcus
YDVDE

SEQ ID NO: 1996354 - protein, 85 aa, Staphylococcus
YDVEGSRTKELPNSQFQNNEFGSSRTMNLSGQELPNSQSNDTDLSNTDYIETENNDTYDMNDTYNNSISHNHSGHTNHQQTEFNN

SEQ ID NO: 1996355 - protein, 4 aa, Staphylococcus
YDVR

SEQ ID NO: 1996356 - protein, 8 aa, Staphylococcus
YDYPHQKQ

SEQ ID NO: 1996357 - protein, 11 aa, Staphylococcus
YEAGGHRGSFT

SEQ ID NO: 1996358 - protein, 5 aa, Staphylococcus
YEAGR

SEQ ID NO: 1996359 - protein, 5 aa, Staphylococcus
YEAHK

SEQ ID NO: 1996360 - protein, 11 aa, Staphylococcus
YEAKGEEKSIE

SEQ ID NO: 1996361 - protein, 11 aa, Staphylococcus
YEAKGEEKTIE

SEQ ID NO: 1996362 - protein, 11 aa, Staphylococcus
YEAKGEEQTIE

SEQ ID NO: 1996363 - protein, 8 aa, Staphylococcus
YEAKNGES

SEQ ID NO: 1996364 - protein, 6 aa, Staphylococcus
YEANDD

SEQ ID NO: 1996365 - protein, 11 aa, Staphylococcus
YEANGEEQTIE

SEQ ID NO: 1996366 - protein, 4 aa, Staphylococcus
YEAP

SEQ ID NO: 1996367 - protein, 7 aa, Staphylococcus
YEAPGMP

SEQ ID NO: 1996368 - protein, 10 aa, Staphylococcus
YEASNWNKEL

SEQ ID NO: 1996369 - protein, 11 aa, Staphylococcus
YEAYQSQYKRS

SEQ ID NO: 1996370 - protein, 7 aa, Staphylococcus
YEDDEHL

SEQ ID NO: 1996371 - protein, 7 aa, Staphylococcus
YEDDEIE

SEQ ID NO: 1996372 - protein, 6 aa, Staphylococcus
YEDENQ

SEQ ID NO: 1996373 - protein, 8 aa, Staphylococcus
YEDGLSEN

SEQ ID NO: 1996374 - protein, 9 aa, Staphylococcus
YEDHASELN

SEQ ID NO: 1996375 - protein, 13 aa, Staphylococcus
YEDKGDPAEKEIT

SEQ ID NO: 1996376 - protein, 9 aa, Staphylococcus
YEDKNVKKT

SEQ ID NO: 1996377 - protein, 34 aa, Staphylococcus
YEDKQAYKKDSRSSKYANKPAEGHAKKAGTAPKR

SEQ ID NO: 1996378 - protein, 8 aa, Staphylococcus
YEDKSEVQ

SEQ ID NO: 1996379 - protein, 13 aa, Staphylococcus
YEDPLKNTTSISL

SEQ ID NO: 1996380 - protein, 5 aa, Staphylococcus
YEDPR

SEQ ID NO: 1996381 - protein, 7 aa, Staphylococcus
YEDSETV

SEQ ID NO: 1996382 - protein, 12 aa, Staphylococcus
YEDSINVVLVMV

SEQ ID NO: 1996383 - protein, 7 aa, Staphylococcus
YEDSLQQ

SEQ ID NO: 1996384 - protein, 14 aa, Staphylococcus
YEDSSNSDNKYVRN

SEQ ID NO: 1996385 - protein, 26 aa, Staphylococcus
YEDYARKHADPKKMEEHHSKKEKGQH

SEQ ID NO: 1996386 - protein, 4 aa, Staphylococcus
YEEA

SEQ ID NO: 1996387 - protein, 13 aa, Staphylococcus
YEEAEQFVDYIQN

SEQ ID NO: 1996388 - protein, 9 aa, Staphylococcus
YEEATLNEP

SEQ ID NO: 1996389 - protein, 8 aa, Staphylococcus
YEEDEERL

SEQ ID NO: 1996390 - protein, 7 aa, Staphylococcus
YEEEQPI

SEQ ID NO: 1996391 - protein, 7 aa, Staphylococcus
YEEGERR

SEQ ID NO: 1996392 - protein, 15 aa, Staphylococcus
YEEGNRFNHDPRRSR

SEQ ID NO: 1996393 - protein, 8 aa, Staphylococcus
YEEGPGMG

SEQ ID NO: 1996394 - protein, 5 aa, Staphylococcus
YEEGQ

SEQ ID NO: 1996395 - protein, 9 aa, Staphylococcus
YEEGSSYDI

SEQ ID NO: 1996396 - protein, 6 aa, Staphylococcus
YEEGTV

SEQ ID NO: 1996397 - protein, 8 aa, Staphylococcus
YEEHGGYE

SEQ ID NO: 1996398 - protein, 4 aa, Staphylococcus
YEEK

SEQ ID NO: 1996399 - protein, 8 aa, Staphylococcus
YEEKEEKI

SEQ ID NO: 1996400 - protein, 27 aa, Staphylococcus
YEEKLKEQKEEKTDDIEQTKQDVQNTL

SEQ ID NO: 1996401 - protein, 5 aa, Staphylococcus
YEENE

SEQ ID NO: 1996402 - protein, 14 aa, Staphylococcus
YEENGKSSFEPSDL

SEQ ID NO: 1996403 - protein, 13 aa, Staphylococcus
YEENGNSSYVPSD

SEQ ID NO: 1996404 - protein, 8 aa, Staphylococcus
YEENQAKI

SEQ ID NO: 1996405 - protein, 6 aa, Staphylococcus
YEENQT

SEQ ID NO: 1996406 - protein, 7 aa, Staphylococcus
YEEQKDK

SEQ ID NO: 1996407 - protein, 7 aa, Staphylococcus
YEEQKEK

SEQ ID NO: 1996408 - protein, 7 aa, Staphylococcus
YEEQQNK

SEQ ID NO: 1996409 - protein, 12 aa, Staphylococcus
YEEQSSKNAVRF

SEQ ID NO: 1996410 - protein, 22 aa, Staphylococcus
YEERLRGDNKIGTTKKGIGPAY

SEQ ID NO: 1996411 - protein, 4 aa, Staphylococcus
YEES

SEQ ID NO: 1996412 - protein, 9 aa, Staphylococcus
YEESTIPAV

SEQ ID NO: 1996413 - protein, 6 aa, Staphylococcus
YEETAE

SEQ ID NO: 1996414 - protein, 8 aa, Staphylococcus
YEETGGKI

SEQ ID NO: 1996415 - protein, 8 aa, Staphylococcus
YEETGKSV

SEQ ID NO: 1996416 - protein, 5 aa, Staphylococcus
YEETY

SEQ ID NO: 1996417 - protein, 8 aa, Staphylococcus
YEEYETSR

SEQ ID NO: 1996418 - protein, 9 aa, Staphylococcus
YEEYKNDRG

SEQ ID NO: 1996419 - protein, 8 aa, Staphylococcus
YEFEPDKD

SEQ ID NO: 1996420 - protein, 5 aa, Staphylococcus
YEFGE

SEQ ID NO: 1996421 - protein, 5 aa, Staphylococcus
YEGAL

SEQ ID NO: 1996422 - protein, 7 aa, Staphylococcus
YEGDERT

SEQ ID NO: 1996423 - protein, 4 aa, Staphylococcus
YEGE

SEQ ID NO: 1996424 - protein, 5 aa, Staphylococcus
YEGET

SEQ ID NO: 1996425 - protein, 6 aa, Staphylococcus
YEGGDI

SEQ ID NO: 1996426 - protein, 25 aa, Staphylococcus
YEGGDTLATEETPLDTQSTGDRKIT

SEQ ID NO: 1996427 - protein, 6 aa, Staphylococcus
YEGKKN

SEQ ID NO: 1996428 - protein, 5 aa, Staphylococcus
YEGKN

SEQ ID NO: 1996429 - protein, 10 aa, Staphylococcus
YEGNIPPYPV

SEQ ID NO: 1996430 - protein, 14 aa, Staphylococcus
YEGQAGLDKALSNN

SEQ ID NO: 1996431 - protein, 12 aa, Staphylococcus
YEGQGAEHSSAR

SEQ ID NO: 1996432 - protein, 12 aa, Staphylococcus
YEGQGPEHSSAR

SEQ ID NO: 1996433 - protein, 13 aa, Staphylococcus
YEGQSKNPMNGAT

SEQ ID NO: 1996434 - protein, 8 aa, Staphylococcus
YEGSHPEI

SEQ ID NO: 1996435 - protein, 8 aa, Staphylococcus
YEHEERVN

SEQ ID NO: 1996436 - protein, 20 aa, Staphylococcus
YEHTRPKIEKSVRNDLKETY

SEQ ID NO: 1996437 - protein, 6 aa, Staphylococcus
YEIGEE

SEQ ID NO: 1996438 - protein, 10 aa, Staphylococcus
YEISGGQKQR

SEQ ID NO: 1996439 - protein, 5 aa, Staphylococcus
YEKDL

SEQ ID NO: 1996440 - protein, 5 aa, Staphylococcus
YEKED

SEQ ID NO: 1996441 - protein, 9 aa, Staphylococcus
YEKKDALNW

SEQ ID NO: 1996442 - protein, 11 aa, Staphylococcus
YEKLRKDNEIQ

SEQ ID NO: 1996443 - protein, 5 aa, Staphylococcus
YEKND

SEQ ID NO: 1996444 - protein, 9 aa, Staphylococcus
YEKNDALNW

SEQ ID NO: 1996445 - protein, 8 aa, Staphylococcus
YEKNDITH

SEQ ID NO: 1996446 - protein, 9 aa, Staphylococcus
YEKNDITQE

SEQ ID NO: 1996447 - protein, 9 aa, Staphylococcus
YEKNEATLY

SEQ ID NO: 1996448 - protein, 8 aa, Staphylococcus
YEKQQEEI

SEQ ID NO: 1996449 - protein, 9 aa, Staphylococcus
YEKQRKQVD

SEQ ID NO: 1996450 - protein, 8 aa, Staphylococcus
YEKREKGV

SEQ ID NO: 1996451 - protein, 7 aa, Staphylococcus
YEKRPDL

SEQ ID NO: 1996452 - protein, 6 aa, Staphylococcus
YEKTNE

SEQ ID NO: 1996453 - protein, 21 aa, Staphylococcus
YEKTPTADLEDDKPQLPDEEA

SEQ ID NO: 1996454 - protein, 5 aa, Staphylococcus
YEKYE

SEQ ID NO: 1996455 - protein, 13 aa, Staphylococcus
YEKYEKEKKRLEK

SEQ ID NO: 1996456 - protein, 5 aa, Staphylococcus
YEKYQ

SEQ ID NO: 1996457 - protein, 6 aa, Staphylococcus
YEKYQG

SEQ ID NO: 1996458 - protein, 9 aa, Staphylococcus
YELDEENQT

SEQ ID NO: 1996459 - protein, 5 aa, Staphylococcus
YELEE

SEQ ID NO: 1996460 - protein, 17 aa, Staphylococcus
YELEEDHAMKNDSAFTQ

SEQ ID NO: 1996461 - protein, 17 aa, Staphylococcus
YELEEEHEITKDSTFSQ

SEQ ID NO: 1996462 - protein, 7 aa, Staphylococcus
YELSGGQ

SEQ ID NO: 1996463 - protein, 11 aa, Staphylococcus
YELSNEDKIDD

SEQ ID NO: 1996464 - protein, 11 aa, Staphylococcus
YELTSEDKIEN

SEQ ID NO: 1996465 - protein, 6 aa, Staphylococcus
YEMGTP

SEQ ID NO: 1996466 - protein, 4 aa, Staphylococcus
YEMP

SEQ ID NO: 1996467 - protein, 12 aa, Staphylococcus
YENDKDAANAVD

SEQ ID NO: 1996468 - protein, 36 aa, Staphylococcus
YENEAALKYGDTKYYQSYEEQQQDMNDSEKKENYKK

SEQ ID NO: 1996469 - protein, 18 aa, Staphylococcus
YENEAEYYRRDHSGKEIK

SEQ ID NO: 1996470 - protein, 9 aa, Staphylococcus
YENEDVPTW

SEQ ID NO: 1996471 - protein, 6 aa, Staphylococcus
YENEGA

SEQ ID NO: 1996472 - protein, 7 aa, Staphylococcus
YENEWKP

SEQ ID NO: 1996473 - protein, 7 aa, Staphylococcus
YENGAHR

SEQ ID NO: 1996474 - protein, 9 aa, Staphylococcus
YENGESELI

SEQ ID NO: 1996475 - protein, 17 aa, Staphylococcus
YENGKKVNIDEKAAATY

SEQ ID NO: 1996476 - protein, 7 aa, Staphylococcus
YENHGAN

SEQ ID NO: 1996477 - protein, 4 aa, Staphylococcus
YENK

SEQ ID NO: 1996478 - protein, 5 aa, Staphylococcus
YENKE

SEQ ID NO: 1996479 - protein, 22 aa, Staphylococcus
YENKKQETQTFNERKETIKDQL

SEQ ID NO: 1996480 - protein, 8 aa, Staphylococcus
YENNGAVS

SEQ ID NO: 1996481 - protein, 7 aa, Staphylococcus
YENNGAY

SEQ ID NO: 1996482 - protein, 11 aa, Staphylococcus
YENPDKKSQFP

SEQ ID NO: 1996483 - protein, 11 aa, Staphylococcus
YENPDKNSQFP

SEQ ID NO: 1996484 - protein, 10 aa, Staphylococcus
YENPDKTDDT

SEQ ID NO: 1996485 - protein, 9 aa, Staphylococcus
YENSVNGQD

SEQ ID NO: 1996486 - protein, 5 aa, Staphylococcus
YENVQ

SEQ ID NO: 1996487 - protein, 6 aa, Staphylococcus
YEPAAD

SEQ ID NO: 1996488 - protein, 25 aa, Staphylococcus
YEPGEGLATEETPLDDHSTGDRKIT

SEQ ID NO: 1996489 - protein, 23 aa, Staphylococcus
YEPKSTSKSEQQFKTIYDNLRNK

SEQ ID NO: 1996490 - protein, 12 aa, Staphylococcus
YEPKTTSKSEQQ

SEQ ID NO: 1996491 - protein, 6 aa, Staphylococcus
YEPNQF

SEQ ID NO: 1996492 - protein, 8 aa, Staphylococcus
YEPNTAGT

SEQ ID NO: 1996493 - protein, 7 aa, Staphylococcus
YEPPRVG

SEQ ID NO: 1996494 - protein, 11 aa, Staphylococcus
YEPQGDQPAAI

SEQ ID NO: 1996495 - protein, 5 aa, Staphylococcus
YEPQT

SEQ ID NO: 1996496 - protein, 4 aa, Staphylococcus
YEPR

SEQ ID NO: 1996497 - protein, 6 aa, Staphylococcus
YEPSDW

SEQ ID NO: 1996498 - protein, 4 aa, Staphylococcus
YEPV

SEQ ID NO: 1996499 - protein, 9 aa, Staphylococcus
YEQAGAKII

SEQ ID NO: 1996500 - protein, 36 aa, Staphylococcus; identical to SEQ ID NO: 1792878

SEQ ID NO: 1996501 - protein, 14 aa, Staphylococcus
YEQDGRLIEKIIEN

SEQ ID NO: 1996502 - protein, 11 aa, Staphylococcus
YEQDNLELDTS

SEQ ID NO: 1996503 - protein, 4 aa, Staphylococcus
YEQL

SEQ ID NO: 1996504 - protein, 15 aa, Staphylococcus
YEQLDDASWTITIQK

SEQ ID NO: 1996505 - protein, 8 aa, Staphylococcus
YEQLNQDA

SEQ ID NO: 1996506 - protein, 7 aa, Staphylococcus
YEQPLET

SEQ ID NO: 1996507 - protein, 13 aa, Staphylococcus
YEQQSEDYKVEHI

SEQ ID NO: 1996508 - protein, 5 aa, Staphylococcus
YEQRV

SEQ ID NO: 1996509 - protein, 11 aa, Staphylococcus
YERAGLGNYTN

SEQ ID NO: 1996510 - protein, 12 aa, Staphylococcus
YERDNESVVTDK

SEQ ID NO: 1996511 - protein, 13 aa, Staphylococcus
YEREEANPLTDDD

SEQ ID NO: 1996512 - protein, 4 aa, Staphylococcus
YERG

SEQ ID NO: 1996513 - protein, 8 aa, Staphylococcus
YERGASDV

SEQ ID NO: 1996514 - protein, 6 aa, Staphylococcus
YERGGT

SEQ ID NO: 1996515 - protein, 6 aa, Staphylococcus
YERGKT

SEQ ID NO: 1996516 - protein, 16 aa, Staphylococcus
YERKDREGVFHTQWDE

SEQ ID NO: 1996517 - protein, 16 aa, Staphylococcus
YERKDREGVFHTQWIE

SEQ ID NO: 1996518 - protein, 11 aa, Staphylococcus
YERKKEKKSVL

SEQ ID NO: 1996519 - protein, 10 aa, Staphylococcus
YERKKEKQSV

SEQ ID NO: 1996520 - protein, 7 aa, Staphylococcus
YERNNTR

SEQ ID NO: 1996521 - protein, 12 aa, Staphylococcus
YERNPDGSRGKL

SEQ ID NO: 1996522 - protein, 8 aa, Staphylococcus
YERNPKAR

SEQ ID NO: 1996523 - protein, 6 aa, Staphylococcus
YERQGN

SEQ ID NO: 1996524 - protein, 7 aa, Staphylococcus
YESDRDE

SEQ ID NO: 1996525 - protein, 10 aa, Staphylococcus
YESGDEMQKD

SEQ ID NO: 1996526 - protein, 9 aa, Staphylococcus
YESKDGQTY

SEQ ID NO: 1996527 - protein, 8 aa, Staphylococcus
YESKDNIN

SEQ ID NO: 1996528 - protein, 4 aa, Staphylococcus
YESL

SEQ ID NO: 1996529 - protein, 13 aa, Staphylococcus
YESLENSLNSLMS

SEQ ID NO: 1996530 - protein, 7 aa, Staphylococcus
YESNIEK

SEQ ID NO: 1996531 - protein, 8 aa, Staphylococcus
YESNPYNF

SEQ ID NO: 1996532 - protein, 8 aa, Staphylococcus
YESNSGFN

SEQ ID NO: 1996533 - protein, 9 aa, Staphylococcus
YESQTIEER

SEQ ID NO: 1996534 - protein, 9 aa, Staphylococcus
YESTEFPDQ

SEQ ID NO: 1996535 - protein, 8 aa, Staphylococcus
YESTEFPE

SEQ ID NO: 1996536 - protein, 14 aa, Staphylococcus
YESVSPVGGGETNN

SEQ ID NO: 1996537 - protein, 10 aa, Staphylococcus
YETALKEPGV

SEQ ID NO: 1996538 - protein, 5 aa, Staphylococcus
YETGK

SEQ ID NO: 1996539 - protein, 10 aa, Staphylococcus
YETPPTQNKI

SEQ ID NO: 1996540 - protein, 8 aa, Staphylococcus
YETPTNLN

SEQ ID NO: 1996541 - protein, 6 aa, Staphylococcus
YETSAL

SEQ ID NO: 1996542 - protein, 15 aa, Staphylococcus
YETSSKSDASAPVGP

SEQ ID NO: 1996543 - protein, 7 aa, Staphylococcus
YETTDYQ

SEQ ID NO: 1996544 - protein, 9 aa, Staphylococcus
YETTDYQTT

SEQ ID NO: 1996545 - protein, 5 aa, Staphylococcus
YETTN

SEQ ID NO: 1996546 - protein, 9 aa, Staphylococcus
YEVEERKVS

SEQ ID NO: 1996547 - protein, 5 aa, Staphylococcus
YEVGQ

SEQ ID NO: 1996548 - protein, 12 aa, Staphylococcus
YEVNDKNQIPLP

SEQ ID NO: 1996549 - protein, 5 aa, Staphylococcus
YEWRG

SEQ ID NO: 1996550 - protein, 7 aa, Staphylococcus
YEYEENE

SEQ ID NO: 1996551 - protein, 4 aa, Staphylococcus
YEYT

SEQ ID NO: 1996552 - protein, 7 aa, Staphylococcus
YFAKPGR

SEQ ID NO: 1996553 - protein, 5 aa, Staphylococcus
YFAKS

SEQ ID NO: 1996554 - protein, 16 aa, Staphylococcus
YFDDDGNVKYSNDPQF

SEQ ID NO: 1996555 - protein, 9 aa, Staphylococcus
YFGKKDAQQ

SEQ ID NO: 1996556 - protein, 4 aa, Staphylococcus
YFGS

SEQ ID NO: 1996557 - protein, 9 aa, Staphylococcus
YFKTNGKSY

SEQ ID NO: 1996558 - protein, 4 aa, Staphylococcus
YFNP

SEQ ID NO: 1996559 - protein, 4 aa, Staphylococcus
YFPK

SEQ ID NO: 1996560 - protein, 11 aa, Staphylococcus
YGADAMDASYE

SEQ ID NO: 1996561 - protein, 5 aa, Staphylococcus
YGADS

SEQ ID NO: 1996562 - protein, 11 aa, Staphylococcus
YGAPGKPRNIG

SEQ ID NO: 1996563 - protein, 4 aa, Staphylococcus
YGAQ

SEQ ID NO: 1996564 - protein, 15 aa, Staphylococcus
YGASRGKAYINGKAG

SEQ ID NO: 1996565 - protein, 11 aa, Staphylococcus
YGATASGLSDK

SEQ ID NO: 1996566 - protein, 10 aa, Staphylococcus
YGATPSQNHS

SEQ ID NO: 1996567 - protein, 16 aa, Staphylococcus
YGCGDPLGKIKEGDTV

SEQ ID NO: 1996568 - protein, 10 aa, Staphylococcus
YGDANINEGD

SEQ ID NO: 1996569 - protein, 8 aa, Staphylococcus
YGDASSRF

SEQ ID NO: 1996570 - protein, 4 aa, Staphylococcus
YGDD

SEQ ID NO: 1996571 - protein, 5 aa, Staphylococcus
YGDDY

SEQ ID NO: 1996572 - protein, 6 aa, Staphylococcus
YGDEYT

SEQ ID NO: 1996573 - protein, 6 aa, Staphylococcus
YGDKTV

SEQ ID NO: 1996574 - protein, 8 aa, Staphylococcus
YGDNDPDH

SEQ ID NO: 1996575 - protein, 6 aa, Staphylococcus
YGDNGR

SEQ ID NO: 1996576 - protein, 9 aa, Staphylococcus
YGDNPVGIQ

SEQ ID NO: 1996577 - protein, 8 aa, Staphylococcus
YGDPQDNF

SEQ ID NO: 1996578 - protein, 13 aa, Staphylococcus
YGDVTKQGLVPDN

SEQ ID NO: 1996579 - protein, 4 aa, Staphylococcus
YGDY

SEQ ID NO: 1996580 - protein, 9 aa, Staphylococcus
YGDYEREDN

SEQ ID NO: 1996581 - protein, 12 aa, Staphylococcus
YGDYPGDVTPAG

SEQ ID NO: 1996582 - protein, 4 aa, Staphylococcus
YGED

SEQ ID NO: 1996583 - protein, 7 aa, Staphylococcus
YGEDPNW

SEQ ID NO: 1996584 - protein, 11 aa, Staphylococcus
YGEEERDTEAQ

SEQ ID NO: 1996585 - protein, 5 aa, Staphylococcus
YGEEF

SEQ ID NO: 1996586 - protein, 5 aa, Staphylococcus
YGEEY

SEQ ID NO: 1996587 - protein, 17 aa, Staphylococcus
YGEGSEDVINDIVTFFQ

SEQ ID NO: 1996588 - protein, 5 aa, Staphylococcus
YGEGY

SEQ ID NO: 1996589 - protein, 19 aa, Staphylococcus
YGEKKKKDSEADNTIKAEL

SEQ ID NO: 1996590 - protein, 20 aa, Staphylococcus
YGEKQKKDSEEDNTVKAELG

SEQ ID NO: 1996591 - protein, 20 aa, Staphylococcus
YGEKQKKPTEEENSVKAELG

SEQ ID NO: 1996592 - protein, 10 aa, Staphylococcus
YGENGGTPWL

SEQ ID NO: 1996593 - protein, 12 aa, Staphylococcus
YGENGKIEPGLA

SEQ ID NO: 1996594 - protein, 9 aa, Staphylococcus
YGEPFNDET

SEQ ID NO: 1996595 - protein, 13 aa, Staphylococcus
YGEQDDDAYETSA

SEQ ID NO: 1996596 - protein, 12 aa, Staphylococcus
YGEQDDKAYSHS

SEQ ID NO: 1996597 - protein, 7 aa, Staphylococcus
YGEQQGF

SEQ ID NO: 1996598 - protein, 10 aa, Staphylococcus
YGERTTTLEA

SEQ ID NO: 1996599 - protein, 11 aa, Staphylococcus
YGERTTTLEAK

SEQ ID NO: 1996600 - protein, 22 aa, Staphylococcus
YGESEGKDFKGIYPSSANYTTD

SEQ ID NO: 1996601 - protein, 7 aa, Staphylococcus
YGESGRS

SEQ ID NO: 1996602 - protein, 4 aa, Staphylococcus
YGET

SEQ ID NO: 1996603 - protein, 8 aa, Staphylococcus
YGEVNQKG

SEQ ID NO: 1996604 - protein, 4 aa, Staphylococcus
YGEY

SEQ ID NO: 1996605 - protein, 22 aa, Staphylococcus
YGGARLQTTRTKNHAALYGALV

SEQ ID NO: 1996606 - protein, 14 aa, Staphylococcus
YGGETADEVQQRTV

SEQ ID NO: 1996607 - protein, 17 aa, Staphylococcus
YGGETAEEVQARSTDAL

SEQ ID NO: 1996608 - protein, 4 aa, Staphylococcus
YGGG

SEQ ID NO: 1996609 - protein, 7 aa, Staphylococcus
YGGGKGG

SEQ ID NO: 1996610 - protein, 11 aa, Staphylococcus
YGGGSSGKSHG

SEQ ID NO: 1996611 - protein, 12 aa, Staphylococcus
YGGGSSGKSHGV

SEQ ID NO: 1996612 - protein, 6 aa, Staphylococcus
YGGGTG

SEQ ID NO: 1996613 - protein, 5 aa, Staphylococcus
YGGGY

SEQ ID NO: 1996614 - protein, 8 aa, Staphylococcus
YGGKHESY

SEQ ID NO: 1996615 - protein, 9 aa, Staphylococcus
YGGKHGKIE

SEQ ID NO: 1996616 - protein, 23 aa, Staphylococcus
YGGKRKNYYGEGEDAIVMWVNLN

SEQ ID NO: 1996617 - protein, 22 aa, Staphylococcus
YGGKRKNYYGEGEDALVMWVDL

SEQ ID NO: 1996618 - protein, 22 aa, Staphylococcus
YGGKRKNYYGEGEDALVMWVNL

SEQ ID NO: 1996619 - protein, 23 aa, Staphylococcus
YGGKRKNYYGEGQDALVMWVNLR

SEQ ID NO: 1996620 - protein, 12 aa, Staphylococcus
YGGPGKPEGLDK

SEQ ID NO: 1996621 - protein, 12 aa, Staphylococcus
YGGPGKPEGLDT

SEQ ID NO: 1996622 - protein, 11 aa, Staphylococcus
YGGQVPHTHKD

SEQ ID NO: 1996623 - protein, 4 aa, Staphylococcus
YGGS

SEQ ID NO: 1996624 - protein, 8 aa, Staphylococcus
YGGSATNI

SEQ ID NO: 1996625 - protein, 24 aa, Staphylococcus
YGGSSVTFSKKAKKQLKEFTDNGW

SEQ ID NO: 1996626 - protein, 24 aa, Staphylococcus
YGGSSVTFSKKAKRQLKEFTDNGW

SEQ ID NO: 1996627 - protein, 10 aa, Staphylococcus
YGGSVKPNNI

SEQ ID NO: 1996628 - protein, 9 aa, Staphylococcus
YGHDPSKLP

SEQ ID NO: 1996629 - protein, 10 aa, Staphylococcus
YGHEKSVEDG

SEQ ID NO: 1996630 - protein, 9 aa, Staphylococcus
YGHGPGVVT

SEQ ID NO: 1996631 - protein, 5 aa, Staphylococcus
YGHGV

SEQ ID NO: 1996632 - protein, 5 aa, Staphylococcus
YGHKT

SEQ ID NO: 1996633 - protein, 6 aa, Staphylococcus
YGHTDT

SEQ ID NO: 1996634 - protein, 5 aa, Staphylococcus
YGIAN

SEQ ID NO: 1996635 - protein, 5 aa, Staphylococcus
YGIDD

SEQ ID NO: 1996636 - protein, 5 aa, Staphylococcus
YGIED

SEQ ID NO: 1996637 - protein, 6 aa, Staphylococcus
YGIEDE

SEQ ID NO: 1996638 - protein, 7 aa, Staphylococcus
YGISPNE

SEQ ID NO: 1996639 - protein, 8 aa, Staphylococcus
YGKAGGEI

SEQ ID NO: 1996640 - protein, 7 aa, Staphylococcus
YGKDPDA

SEQ ID NO: 1996641 - protein, 4 aa, Staphylococcus
YGKE

SEQ ID NO: 1996642 - protein, 5 aa, Staphylococcus
YGKEG

SEQ ID NO: 1996643 - protein, 8 aa, Staphylococcus
YGKETNGY

SEQ ID NO: 1996644 - protein, 36 aa, Staphylococcus
YGKEYVSKRKATGKQGDQDAHEAIRPTSTLRTPDEM

SEQ ID NO: 1996645 - protein, 8 aa, Staphylococcus
YGKGQKAY

SEQ ID NO: 1996646 - protein, 12 aa, Staphylococcus
YGKGRKRQIPED

SEQ ID NO: 1996647 - protein, 7 aa, Staphylococcus
YGKGSEE

SEQ ID NO: 1996648 - protein, 9 aa, Staphylococcus
YGKKKQYQA

SEQ ID NO: 1996649 - protein, 6 aa, Staphylococcus
YGKKPV

SEQ ID NO: 1996650 - protein, 9 aa, Staphylococcus
YGKKQKYKA

SEQ ID NO: 1996651 - protein, 7 aa, Staphylococcus
YGKPYIE

SEQ ID NO: 1996652 - protein, 5 aa, Staphylococcus
YGKQS

SEQ ID NO: 1996653 - protein, 4 aa, Staphylococcus
YGKS

SEQ ID NO: 1996654 - protein, 16 aa, Staphylococcus
YGKSAHASTPSKGVSA

SEQ ID NO: 1996655 - protein, 8 aa, Staphylococcus
YGKTENGM

SEQ ID NO: 1996656 - protein, 12 aa, Staphylococcus
YGLPASEARNKE

SEQ ID NO: 1996657 - protein, 12 aa, Staphylococcus
YGLPASEVRNKS

SEQ ID NO: 1996658 - protein, 13 aa, Staphylococcus
YGLPATKVRAKNS

SEQ ID NO: 1996659 - protein, 6 aa, Staphylococcus
YGLQPT

SEQ ID NO: 1996660 - protein, 4 aa, Staphylococcus
YGLS

SEQ ID NO: 1996661 - protein, 15 aa, Staphylococcus
YGLSDEKENDNPNSS

SEQ ID NO: 1996662 - protein, 11 aa, Staphylococcus
YGLSGSDANDG

SEQ ID NO: 1996663 - protein, 6 aa, Staphylococcus
YGLSST

SEQ ID NO: 1996664 - protein, 5 aa, Staphylococcus
YGMDE

SEQ ID NO: 1996665 - protein, 4 aa, Staphylococcus
YGMG

SEQ ID NO: 1996666 - protein, 8 aa, Staphylococcus
YGMNDTKD

SEQ ID NO: 1996667 - protein, 8 aa, Staphylococcus
YGMNDTKE

SEQ ID NO: 1996668 - protein, 4 aa, Staphylococcus
YGMT

SEQ ID NO: 1996669 - protein, 14 aa, Staphylococcus
YGMTPGQARKKQFA

SEQ ID NO: 1996670 - protein, 14 aa, Staphylococcus
YGMTPKQYQKYHHT

SEQ ID NO: 1996671 - protein, 16 aa, Staphylococcus
YGNDDEITFSHPQFKS

SEQ ID NO: 1996672 - protein, 4 aa, Staphylococcus
YGNE

SEQ ID NO: 1996673 - protein, 5 aa, Staphylococcus
YGNED

SEQ ID NO: 1996674 - protein, 5 aa, Staphylococcus
YGNEV

SEQ ID NO: 1996675 - protein, 13 aa, Staphylococcus
YGNGSPSNLQGER

SEQ ID NO: 1996676 - protein, 6 aa, Staphylococcus
YGNHNI

SEQ ID NO: 1996677 - protein, 4 aa, Staphylococcus
YGNP

SEQ ID NO: 1996678 - protein, 17 aa, Staphylococcus
YGNPSSIHSVGRDARQY

SEQ ID NO: 1996679 - protein, 6 aa, Staphylococcus
YGNQRQ

SEQ ID NO: 1996680 - protein, 8 aa, Staphylococcus
YGNSNEEL

SEQ ID NO: 1996681 - protein, 5 aa, Staphylococcus
YGNTI

SEQ ID NO: 1996682 - protein, 8 aa, Staphylococcus
YGNTSDKL

SEQ ID NO: 1996683 - protein, 10 aa, Staphylococcus
YGPAKDKRAG

SEQ ID NO: 1996684 - protein, 6 aa, Staphylococcus
YGPITT

SEQ ID NO: 1996685 - protein, 11 aa, Staphylococcus
YGPQKGATEKM

SEQ ID NO: 1996686 - protein, 12 aa, Staphylococcus
YGPQTRDFDSEQ

SEQ ID NO: 1996687 - protein, 4 aa, Staphylococcus
YGPR

SEQ ID NO: 1996688 - protein, 8 aa, Staphylococcus
YGPSESTV

SEQ ID NO: 1996689 - protein, 7 aa, Staphylococcus
YGPSETL

SEQ ID NO: 1996690 - protein, 7 aa, Staphylococcus
YGPTEST

SEQ ID NO: 1996691 - protein, 5 aa, Staphylococcus
YGPTI

SEQ ID NO: 1996692 - protein, 8 aa, Staphylococcus
YGPYSGEE

SEQ ID NO: 1996693 - protein, 10 aa, Staphylococcus
YGQARKIQQA

SEQ ID NO: 1996694 - protein, 7 aa, Staphylococcus
YGQARNL

SEQ ID NO: 1996695 - protein, 5 aa, Staphylococcus
YGQEA

SEQ ID NO: 1996696 - protein, 34 aa, Staphylococcus
YGQELKKQTAQPTGQPVRSKRGGSWMSRLKESFR

SEQ ID NO: 1996697 - protein, 16 aa, Staphylococcus
YGQELKKRSAQPSGMP

SEQ ID NO: 1996698 - protein, 5 aa, Staphylococcus
YGQGY

SEQ ID NO: 1996699 - protein, 16 aa, Staphylococcus
YGQKNEQIRRYNRGEV

SEQ ID NO: 1996700 - protein, 8 aa, Staphylococcus
YGQPIGSK

SEQ ID NO: 1996701 - protein, 14 aa, Staphylococcus
YGQQLKEDNTRPQV

SEQ ID NO: 1996702 - protein, 7 aa, Staphylococcus
YGQTEQG

SEQ ID NO: 1996703 - protein, 10 aa, Staphylococcus
YGQTEQGTTV

SEQ ID NO: 1996704 - protein, 4 aa, Staphylococcus
YGQY

SEQ ID NO: 1996705 - protein, 11 aa, Staphylococcus
YGRGLNSTTAL

SEQ ID NO: 1996706 - protein, 4 aa, Staphylococcus
YGSG

SEQ ID NO: 1996707 - protein, 9 aa, Staphylococcus
YGSGSIKNG

SEQ ID NO: 1996708 - protein, 9 aa, Staphylococcus
YGSKDMQQE

SEQ ID NO: 1996709 - protein, 12 aa, Staphylococcus
YGSKGDALKGKN

SEQ ID NO: 1996710 - protein, 18 aa, Staphylococcus
YGSKGLDKKLKNRSYSRD

SEQ ID NO: 1996711 - protein, 8 aa, Staphylococcus
YGSKQKYK

SEQ ID NO: 1996712 - protein, 7 aa, Staphylococcus
YGSNADT

SEQ ID NO: 1996713 - protein, 9 aa, Staphylococcus
YGSPEKKDI

SEQ ID NO: 1996714 - protein, 22 aa, Staphylococcus
YGSPNKKGTNGVHGAPLGAEER

SEQ ID NO: 1996715 - protein, 18 aa, Staphylococcus
YGSSPANWEGQDIPSIES

SEQ ID NO: 1996716 - protein, 18 aa, Staphylococcus
YGSSPANWEGQDVPSIET

SEQ ID NO: 1996717 - protein, 16 aa, Staphylococcus
YGSSPEKWGDSDVPTI

SEQ ID NO: 1996718 - protein, 4 aa, Staphylococcus
YGST

SEQ ID NO: 1996719 - protein, 7 aa, Staphylococcus
YGSTPPC

SEQ ID NO: 1996720 - protein, 12 aa, Staphylococcus
YGSYTDEEGLDG

SEQ ID NO: 1996721 - protein, 4 aa, Staphylococcus
YGTE

SEQ ID NO: 1996722 - protein, 10 aa, Staphylococcus
YGTEAQSNMS

SEQ ID NO: 1996723 - protein, 7 aa, Staphylococcus
YGTGKSH

SEQ ID NO: 1996724 - protein, 5 aa, Staphylococcus
YGTKQ

SEQ ID NO: 1996725 - protein, 5 aa, Staphylococcus
YGTND

SEQ ID NO: 1996726 - protein, 11 aa, Staphylococcus
YGTNEMTSQYP

SEQ ID NO: 1996727 - protein, 9 aa, Staphylococcus
YGTNGRSLY

SEQ ID NO: 1996728 - protein, 7 aa, Staphylococcus
YGTPADN

SEQ ID NO: 1996729 - protein, 7 aa, Staphylococcus
YGTPETL

SEQ ID NO: 1996730 - protein, 6 aa, Staphylococcus
YGTPTE

SEQ ID NO: 1996731 - protein, 4 aa, Staphylococcus
YGTS

SEQ ID NO: 1996732 - protein, 5 aa, Staphylococcus
YGTYE

SEQ ID NO: 1996733 - protein, 13 aa, Staphylococcus
YGVNKDGSPNNKL

SEQ ID NO: 1996734 - protein, 11 aa, Staphylococcus
YGVNPRNEDTY

SEQ ID NO: 1996735 - protein, 11 aa, Staphylococcus
YGVQKDAAEVD

SEQ ID NO: 1996736 - protein, 11 aa, Staphylococcus
YGVQSDADEVE

SEQ ID NO: 1996737 - protein, 13 aa, Staphylococcus
YGYDTNPIGGFDK

SEQ ID NO: 1996738 - protein, 18 aa, Staphylococcus
YGYGNNTVNQYLEYKTSL

SEQ ID NO: 1996739 - protein, 6 aa, Staphylococcus
YGYNGN

SEQ ID NO: 1996740 - protein, 5 aa, Staphylococcus
YGYNN

SEQ ID NO: 1996741 - protein, 13 aa, Staphylococcus
YGYSTENSKADLY

SEQ ID NO: 1996742 - protein, 24 aa, Staphylococcus
YHADEQVNEAAKEKHRLGEEKLQQ

SEQ ID NO: 1996743 - protein, 24 aa, Staphylococcus
YHADEQVNEAAKEKHRLGEEQLQQ

SEQ ID NO: 1996744 - protein, 31 aa, Staphylococcus
YHADEQVNEAAKERHRIGEEKLGNEIGTDTN

SEQ ID NO: 1996745 - protein, 25 aa, Staphylococcus
YHADEQVNEAAKERHRLGEKQLNHQ

SEQ ID NO: 1996746 - protein, 23 aa, Staphylococcus
YHADEQVNEAAKERQRQGEEQLN

SEQ ID NO: 1996747 - protein, 8 aa, Staphylococcus
YHANEKKE

SEQ ID NO: 1996748 - protein, 9 aa, Staphylococcus
YHDADATAF

SEQ ID NO: 1996749 - protein, 9 aa, Staphylococcus
YHEPTKGLG

SEQ ID NO: 1996750 - protein, 11 aa, Staphylococcus
YHESPSEYTRE

SEQ ID NO: 1996751 - protein, 10 aa, Staphylococcus
YHETNRDIEG

SEQ ID NO: 1996752 - protein, 4 aa, Staphylococcus
YHGG

SEQ ID NO: 1996753 - protein, 8 aa, Staphylococcus
YHGSTYGS

SEQ ID NO: 1996754 - protein, 6 aa, Staphylococcus
YHKPRK

SEQ ID NO: 1996755 - protein, 7 aa, Staphylococcus
YHNQPNS

SEQ ID NO: 1996756 - protein, 4 aa, Staphylococcus
YHNS

SEQ ID NO: 1996757 - protein, 12 aa, Staphylococcus
YHNVPGAEEYTH

SEQ ID NO: 1996758 - protein, 14 aa, Staphylococcus
YHPDKTGKTDVSDY

SEQ ID NO: 1996759 - protein, 6 aa, Staphylococcus
YHPEPP

SEQ ID NO: 1996760 - protein, 4 aa, Staphylococcus
YHPQ

SEQ ID NO: 1996761 - protein, 11 aa, Staphylococcus
YHQAQSGQTTF

SEQ ID NO: 1996762 - protein, 5 aa, Staphylococcus
YHQGY

SEQ ID NO: 1996763 - protein, 18 aa, Staphylococcus
YHQHSKEVQNLKNDIDTL

SEQ ID NO: 1996764 - protein, 4 aa, Staphylococcus
YHRP

SEQ ID NO: 1996765 - protein, 10 aa, Staphylococcus
YHSPEANSLE

SEQ ID NO: 1996766 - protein, 6 aa, Staphylococcus
YHSTEH

SEQ ID NO: 1996767 - protein, 8 aa, Staphylococcus
YHTGDTGL

SEQ ID NO: 1996768 - protein, 4 aa, Staphylococcus
YHTQ

SEQ ID NO: 1996769 - protein, 4 aa, Staphylococcus
YIAD

SEQ ID NO: 1996770 - protein, 13 aa, Staphylococcus
YIANEDKEPGYDG

SEQ ID NO: 1996771 - protein, 5 aa, Staphylococcus
YIDDG

SEQ ID NO: 1996772 - protein, 4 aa, Staphylococcus
YIDE

SEQ ID NO: 1996773 - protein, 9 aa, Staphylococcus
YIDEQRKKV

SEQ ID NO: 1996774 - protein, 5 aa, Staphylococcus
YIDET

SEQ ID NO: 1996775 - protein, 6 aa, Staphylococcus
YIEEQN

SEQ ID NO: 1996776 - protein, 7 aa, Staphylococcus
YIEEQRK

SEQ ID NO: 1996777 - protein, 4 aa, Staphylococcus
YIEG

SEQ ID NO: 1996778 - protein, 11 aa, Staphylococcus
YIEGDKSLANN

SEQ ID NO: 1996779 - protein, 11 aa, Staphylococcus
YIEHPKENGYR

SEQ ID NO: 1996780 - protein, 6 aa, Staphylococcus
YIETQS

SEQ ID NO: 1996781 - protein, 14 aa, Staphylococcus
YIGEKDRKYIPIEE

SEQ ID NO: 1996782 - protein, 14 aa, Staphylococcus
YIGEKDRKYVPIEE

SEQ ID NO: 1996783 - protein, 14 aa, Staphylococcus
YIGETNRKYVPIEE

SEQ ID NO: 1996784 - protein, 14 aa, Staphylococcus
YIGETNRVYVPIEE

SEQ ID NO: 1996785 - protein, 10 aa, Staphylococcus
YIGNEKPMLK

SEQ ID NO: 1996786 - protein, 15 aa, Staphylococcus
YIGNTNDNSNSNTQN

SEQ ID NO: 1996787 - protein, 22 aa, Staphylococcus
YIGTKDRAAHGYNGKRTPKVES

SEQ ID NO: 1996788 - protein, 14 aa, Staphylococcus
YIKEGNKTKTPGKL

SEQ ID NO: 1996789 - protein, 5 aa, Staphylococcus
YIKEH

SEQ ID NO: 1996790 - protein, 11 aa, Staphylococcus
YIKNPKENGYR

SEQ ID NO: 1996791 - protein, 7 aa, Staphylococcus
YIKPEPY

SEQ ID NO: 1996792 - protein, 24 aa, Staphylococcus
YIKRTSTRSFNASGVSEIGLKQGD

SEQ ID NO: 1996793 - protein, 6 aa, Staphylococcus
YIKSNG

SEQ ID NO: 1996794 - protein, 5 aa, Staphylococcus
YINEE

SEQ ID NO: 1996795 - protein, 6 aa, Staphylococcus
YINERE

SEQ ID NO: 1996796 - protein, 4 aa, Staphylococcus
YINN

SEQ ID NO: 1996797 - protein, 11 aa, Staphylococcus
YINNTKESGYR

SEQ ID NO: 1996798 - protein, 11 aa, Staphylococcus
YINNTKQSGYR

SEQ ID NO: 1996799 - protein, 13 aa, Staphylococcus
YIPEGEERPLPTT

SEQ ID NO: 1996800 - protein, 6 aa, Staphylococcus
YIPNTD

SEQ ID NO: 1996801 - protein, 11 aa, Staphylococcus
YIQHPKENGYR

SEQ ID NO: 1996802 - protein, 6 aa, Staphylococcus
YIQSGD

SEQ ID NO: 1996803 - protein, 11 aa, Staphylococcus
YIRKDKAEFPE

SEQ ID NO: 1996804 - protein, 4 aa, Staphylococcus
YISE

SEQ ID NO: 1996805 - protein, 5 aa, Staphylococcus
YISEN

SEQ ID NO: 1996806 - protein, 12 aa, Staphylococcus
YISETQKKEGIH

SEQ ID NO: 1996807 - protein, 7 aa, Staphylococcus
YISPKEG

SEQ ID NO: 1996808 - protein, 10 aa, Staphylococcus
YISQETKDKV

SEQ ID NO: 1996809 - protein, 12 aa, Staphylococcus
YITPENAQSEIP

SEQ ID NO: 1996810 - protein, 12 aa, Staphylococcus
YITPENATTEIP

SEQ ID NO: 1996811 - protein, 16 aa, Staphylococcus
YITPGLGDAGDRLFGT

SEQ ID NO: 1996812 - protein, 11 aa, Staphylococcus
YITPNETESNA

SEQ ID NO: 1996813 - protein, 5 aa, Staphylococcus
YITTN

SEQ ID NO: 1996814 - protein, 6 aa, Staphylococcus
YITTPS

SEQ ID NO: 1996815 - protein, 9 aa, Staphylococcus
YKADNFSEA

SEQ ID NO: 1996816 - protein, 31 aa, Staphylococcus
YKAEKNPPKPSGGSDTSNTTTKDNNKTVTIK

SEQ ID NO: 1996817 - protein, 9 aa, Staphylococcus
YKAGASDVR

SEQ ID NO: 1996818 - protein, 10 aa, Staphylococcus
YKAKGRKKQL

SEQ ID NO: 1996819 - protein, 8 aa, Staphylococcus
YKANSCKN

SEQ ID NO: 1996820 - protein, 8 aa, Staphylococcus
YKAQYPEG

SEQ ID NO: 1996821 - protein, 5 aa, Staphylococcus
YKASQ

SEQ ID NO: 1996822 - protein, 4 aa, Staphylococcus
YKAT

SEQ ID NO: 1996823 - protein, 17 aa, Staphylococcus
YKAWGNAKDFPNNKFPT

SEQ ID NO: 1996824 - protein, 4 aa, Staphylococcus
YKAY

SEQ ID NO: 1996825 - protein, 4 aa, Staphylococcus
YKDA

SEQ ID NO: 1996826 - protein, 8 aa, Staphylococcus
YKDEEREI

SEQ ID NO: 1996827 - protein, 15 aa, Staphylococcus
YKDENAVEEHNQSEH

SEQ ID NO: 1996828 - protein, 9 aa, Staphylococcus
YKDEQAQYH

SEQ ID NO: 1996829 - protein, 8 aa, Staphylococcus
YKDERESD

SEQ ID NO: 1996830 - protein, 39 aa, Staphylococcus
YKDGDGYKSYNDVTKKDRKALSDAVNSLGEPLSKMAVVT

SEQ ID NO: 1996831 - protein, 10 aa, Staphylococcus
YKDGEKWTNE

SEQ ID NO: 1996832 - protein, 6 aa, Staphylococcus
YKDGKW

SEQ ID NO: 1996833 - protein, 8 aa, Staphylococcus
YKDGNTTV

SEQ ID NO: 1996834 - protein, 7 aa, Staphylococcus
YKDGQFE

SEQ ID NO: 1996835 - protein, 9 aa, Staphylococcus
YKDHASELN

SEQ ID NO: 1996836 - protein, 7 aa, Staphylococcus
YKDIKQD

SEQ ID NO: 1996837 - protein, 11 aa, Staphylococcus
YKDNERQEQYT

SEQ ID NO: 1996838 - protein, 9 aa, Staphylococcus
YKDNNGDLH

SEQ ID NO: 1996839 - protein, 16 aa, Staphylococcus
YKDPERTAEPRKGEYY

SEQ ID NO: 1996840 - protein, 19 aa, Staphylococcus
YKDPQLIESTNRAISLYQL

SEQ ID NO: 1996841 - protein, 4 aa, Staphylococcus
YKDQ

SEQ ID NO: 1996842 - protein, 12 aa, Staphylococcus
YKDQDAVEAHNH

SEQ ID NO: 1996843 - protein, 13 aa, Staphylococcus
YKDQEAVQAHNHS

SEQ ID NO: 1996844 - protein, 12 aa, Staphylococcus
YKDQEKHYDGHA

SEQ ID NO: 1996845 - protein, 10 aa, Staphylococcus
YKDQQKHYDG

SEQ ID NO: 1996846 - protein, 11 aa, Staphylococcus
YKDQQKHYDGH

SEQ ID NO: 1996847 - protein, 11 aa, Staphylococcus
YKDQQKHYDSH

SEQ ID NO: 1996848 - protein, 15 aa, Staphylococcus
YKDQQKNYDGHDYEN

SEQ ID NO: 1996849 - protein, 5 aa, Staphylococcus
YKDTT

SEQ ID NO: 1996850 - protein, 7 aa, Staphylococcus
YKDYENE

SEQ ID NO: 1996851 - protein, 12 aa, Staphylococcus
YKEAGADIVSEA

SEQ ID NO: 1996852 - protein, 10 aa, Staphylococcus
YKEAGAEIVS

SEQ ID NO: 1996853 - protein, 8 aa, Staphylococcus
YKEATDWK

SEQ ID NO: 1996854 - protein, 7 aa, Staphylococcus
YKEDEQE

SEQ ID NO: 1996855 - protein, 6 aa, Staphylococcus
YKEDGK

SEQ ID NO: 1996856 - protein, 7 aa, Staphylococcus
YKEDTFE

SEQ ID NO: 1996857 - protein, 6 aa, Staphylococcus
YKEEDI

SEQ ID NO: 1996858 - protein, 9 aa, Staphylococcus
YKEGEGDRT

SEQ ID NO: 1996859 - protein, 13 aa, Staphylococcus
YKEGKGVKNYNHY

SEQ ID NO: 1996860 - protein, 5 aa, Staphylococcus
YKEGT

SEQ ID NO: 1996861 - protein, 9 aa, Staphylococcus
YKEKERLSS

SEQ ID NO: 1996862 - protein, 9 aa, Staphylococcus
YKEKMRKAE

SEQ ID NO: 1996863 - protein, 16 aa, Staphylococcus
YKENAEENPNRSLQEI

SEQ ID NO: 1996864 - protein, 7 aa, Staphylococcus
YKENEKL

SEQ ID NO: 1996865 - protein, 9 aa, Staphylococcus
YKENESNYE

SEQ ID NO: 1996866 - protein, 4 aa, Staphylococcus
YKEQ

SEQ ID NO: 1996867 - protein, 8 aa, Staphylococcus
YKEQGDFE

SEQ ID NO: 1996868 - protein, 8 aa, Staphylococcus
YKEQPDIK

SEQ ID NO: 1996869 - protein, 7 aa, Staphylococcus
YKESNTV

SEQ ID NO: 1996870 - protein, 15 aa, Staphylococcus
YKESRRAHPLNENGQ

SEQ ID NO: 1996871 - protein, 17 aa, Staphylococcus
YKESRRAHPLNENGQRS

SEQ ID NO: 1996872 - protein, 18 aa, Staphylococcus
YKESYTKEDLFNKILNDA

SEQ ID NO: 1996873 - protein, 4 aa, Staphylococcus
YKET

SEQ ID NO: 1996874 - protein, 14 aa, Staphylococcus
YKETDQNLDGYMFY

SEQ ID NO: 1996875 - protein, 14 aa, Staphylococcus
YKETNEDLDGYMFY

SEQ ID NO: 1996876 - protein, 13 aa, Staphylococcus
YKETNNLDGYMFY

SEQ ID NO: 1996877 - protein, 17 aa, Staphylococcus
YKETRRAHPLNDNGQRS

SEQ ID NO: 1996878 - protein, 7 aa, Staphylococcus
YKEVESS

SEQ ID NO: 1996879 - protein, 5 aa, Staphylococcus
YKEYF

SEQ ID NO: 1996880 - protein, 14 aa, Staphylococcus
YKEYQQQIDDIDIR

SEQ ID NO: 1996881 - protein, 10 aa, Staphylococcus
YKFAGGKGIN

SEQ ID NO: 1996882 - protein, 7 aa, Staphylococcus
YKFPSIE

SEQ ID NO: 1996883 - protein, 8 aa, Staphylococcus
YKGALKSY

SEQ ID NO: 1996884 - protein, 12 aa, Staphylococcus
YKGARLTKEGLD

SEQ ID NO: 1996885 - protein, 9 aa, Staphylococcus
YKGGPHNGN

SEQ ID NO: 1996886 - protein, 5 aa, Staphylococcus
YKGHG

SEQ ID NO: 1996887 - protein, 4 aa, Staphylococcus
YKGK

SEQ ID NO: 1996888 - protein, 8 aa, Staphylococcus
YKGKDVTK

SEQ ID NO: 1996889 - protein, 5 aa, Staphylococcus
YKGKE

SEQ ID NO: 1996890 - protein, 11 aa, Staphylococcus
YKGKERLEDVT

SEQ ID NO: 1996891 - protein, 10 aa, Staphylococcus
YKGKKPLAEV

SEQ ID NO: 1996892 - protein, 5 aa, Staphylococcus
YKGKN

SEQ ID NO: 1996893 - protein, 7 aa, Staphylococcus
YKGMGKG

SEQ ID NO: 1996894 - protein, 5 aa, Staphylococcus
YKGNE

SEQ ID NO: 1996895 - protein, 8 aa, Staphylococcus
YKGQLNPG

SEQ ID NO: 1996896 - protein, 11 aa, Staphylococcus
YKGQRQELDQS

SEQ ID NO: 1996897 - protein, 6 aa, Staphylococcus
YKGSLN

SEQ ID NO: 1996898 - protein, 7 aa, Staphylococcus
YKGSLQD

SEQ ID NO: 1996899 - protein, 5 aa, Staphylococcus
YKGSN

SEQ ID NO: 1996900 - protein, 11 aa, Staphylococcus
YKGSTDDLEPN

SEQ ID NO: 1996901 - protein, 12 aa, Staphylococcus
YKGSTLREHLDL

SEQ ID NO: 1996902 - protein, 5 aa, Staphylococcus
YKGTD

SEQ ID NO: 1996903 - protein, 5 aa, Staphylococcus
YKGTN

SEQ ID NO: 1996904 - protein, 4 aa, Staphylococcus
YKGV

SEQ ID NO: 1996905 - protein, 4 aa, Staphylococcus
YKHE

SEQ ID NO: 1996906 - protein, 10 aa, Staphylococcus
YKHEQSGAQQ

SEQ ID NO: 1996907 - protein, 10 aa, Staphylococcus
YKHKDRDFKN

SEQ ID NO: 1996908 - protein, 6 aa, Staphylococcus
YKHNGE

SEQ ID NO: 1996909 - protein, 8 aa, Staphylococcus
YKHNPETG

SEQ ID NO: 1996910 - protein, 8 aa, Staphylococcus
YKHPNAQQ

SEQ ID NO: 1996911 - protein, 4 aa, Staphylococcus
YKHQ

SEQ ID NO: 1996912 - protein, 4 aa, Staphylococcus
YKHS

SEQ ID NO: 1996913 - protein, 8 aa, Staphylococcus
YKHSEQNG

SEQ ID NO: 1996914 - protein, 8 aa, Staphylococcus
YKISKEQA

SEQ ID NO: 1996915 - protein, 4 aa, Staphylococcus
YKKA

SEQ ID NO: 1996916 - protein, 8 aa, Staphylococcus
YKKAGNQN

SEQ ID NO: 1996917 - protein, 11 aa, Staphylococcus
YKKAKSDPKFQ

SEQ ID NO: 1996918 - protein, 7 aa, Staphylococcus
YKKDARG

SEQ ID NO: 1996919 - protein, 6 aa, Staphylococcus
YKKDID

SEQ ID NO: 1996920 - protein, 7 aa, Staphylococcus
YKKDTRG

SEQ ID NO: 1996921 - protein, 5 aa, Staphylococcus
YKKEI

SEQ ID NO: 1996922 - protein, 6 aa, Staphylococcus
YKKEID

SEQ ID NO: 1996923 - protein, 10 aa, Staphylococcus
YKKEVSQDET

SEQ ID NO: 1996924 - protein, 7 aa, Staphylococcus
YKKGFSS

SEQ ID NO: 1996925 - protein, 19 aa, Staphylococcus
YKKGKAGGTPKSTESKYYN

SEQ ID NO: 1996926 - protein, 13 aa, Staphylococcus
YKKGNKPNKFTDK

SEQ ID NO: 1996927 - protein, 8 aa, Staphylococcus
YKKGTSGH

SEQ ID NO: 1996928 - protein, 9 aa, Staphylococcus
YKKKNPKIQ

SEQ ID NO: 1996929 - protein, 13 aa, Staphylococcus
YKKLEGLKKEYEN

SEQ ID NO: 1996930 - protein, 16 aa, Staphylococcus
YKKNDRGYFEKNGRDL

SEQ ID NO: 1996931 - protein, 29 aa, Staphylococcus
YKKNPQHYERYQQGSGRKGFIESHWGGQN

SEQ ID NO: 1996932 - protein, 4 aa, Staphylococcus
YKKP

SEQ ID NO: 1996933 - protein, 21 aa, Staphylococcus
YKKPRDRKTVDDRATQLSKDL

SEQ ID NO: 1996934 - protein, 5 aa, Staphylococcus
YKKQI

SEQ ID NO: 1996935 - protein, 14 aa, Staphylococcus
YKKRTGGKRSETWS

SEQ ID NO: 1996936 - protein, 8 aa, Staphylococcus
YKKRYPKG

SEQ ID NO: 1996937 - protein, 10 aa, Staphylococcus
YKKTDKGQFT

SEQ ID NO: 1996938 - protein, 11 aa, Staphylococcus
YKLKESGDYPF

SEQ ID NO: 1996939 - protein, 19 aa, Staphylococcus
YKLKGTKGYIQTPYPTYNT

SEQ ID NO: 1996940 - protein, 10 aa, Staphylococcus
YKNADDKIGN

SEQ ID NO: 1996941 - protein, 11 aa, Staphylococcus
YKNDADTEKYK

SEQ ID NO: 1996942 - protein, 7 aa, Staphylococcus
YKNDDLA

SEQ ID NO: 1996943 - protein, 7 aa, Staphylococcus
YKNDPND

SEQ ID NO: 1996944 - protein, 4 aa, Staphylococcus
YKNG

SEQ ID NO: 1996945 - protein, 7 aa, Staphylococcus
YKNGEGI

SEQ ID NO: 1996946 - protein, 8 aa, Staphylococcus
YKNGSNNY

SEQ ID NO: 1996947 - protein, 9 aa, Staphylococcus
YKNKGYGQS

SEQ ID NO: 1996948 - protein, 9 aa, Staphylococcus
YKNNADRAL

SEQ ID NO: 1996949 - protein, 16 aa, Staphylococcus
YKNNANTEDYKDRLTE

SEQ ID NO: 1996950 - protein, 12 aa, Staphylococcus
YKNNASTDDYSD

SEQ ID NO: 1996951 - protein, 5 aa, Staphylococcus
YKNND

SEQ ID NO: 1996952 - protein, 14 aa, Staphylococcus
YKNNTNTEDYKDKL

SEQ ID NO: 1996953 - protein, 9 aa, Staphylococcus
YKNPDNKKE

SEQ ID NO: 1996954 - protein, 9 aa, Staphylococcus
YKNPNNKKE

SEQ ID NO: 1996955 - protein, 9 aa, Staphylococcus
YKNRETLDK

SEQ ID NO: 1996956 - protein, 7 aa, Staphylococcus
YKNRKED

SEQ ID NO: 1996957 - protein, 7 aa, Staphylococcus
YKNRKQD

SEQ ID NO: 1996958 - protein, 7 aa, Staphylococcus
YKNRNRD

SEQ ID NO: 1996959 - protein, 8 aa, Staphylococcus
YKNSSREV

SEQ ID NO: 1996960 - protein, 5 aa, Staphylococcus
YKNST

SEQ ID NO: 1996961 - protein, 10 aa, Staphylococcus
YKNTENTEKY

SEQ ID NO: 1996962 - protein, 6 aa, Staphylococcus
YKPEEI

SEQ ID NO: 1996963 - protein, 73 aa, Staphylococcus
YKPEKAEQSEKSQQKNTQNKQQTTHNKGNQSNKGNQNNKPNNKKNNKNNKNNKNNKNNKQPKQEEPKEMPSKI

SEQ ID NO: 1996964 - protein, 9 aa, Staphylococcus
YKPIQNIGN

SEQ ID NO: 1996965 - protein, 7 aa, Staphylococcus
YKPLKSS

SEQ ID NO: 1996966 - protein, 7 aa, Staphylococcus
YKPNKDN

SEQ ID NO: 1996967 - protein, 7 aa, Staphylococcus
YKPQTLA

SEQ ID NO: 1996968 - protein, 7 aa, Staphylococcus
YKPSERG

SEQ ID NO: 1996969 - protein, 12 aa, Staphylococcus
YKPSKEGPSRKY

SEQ ID NO: 1996970 - protein, 10 aa, Staphylococcus
YKPTDRDLKD

SEQ ID NO: 1996971 - protein, 10 aa, Staphylococcus
YKPTDRDLKE

SEQ ID NO: 1996972 - protein, 7 aa, Staphylococcus
YKPTDRI

SEQ ID NO: 1996973 - protein, 10 aa, Staphylococcus
YKPTDRNLKD

SEQ ID NO: 1996974 - protein, 7 aa, Staphylococcus
YKPTDRV

SEQ ID NO: 1996975 - protein, 9 aa, Staphylococcus
YKPTEKNEK

SEQ ID NO: 1996976 - protein, 15 aa, Staphylococcus
YKPTNQGPGVIFSIK

SEQ ID NO: 1996977 - protein, 10 aa, Staphylococcus
YKPTNRDLKD

SEQ ID NO: 1996978 - protein, 11 aa, Staphylococcus
YKQASEDELEE

SEQ ID NO: 1996979 - protein, 8 aa, Staphylococcus
YKQDNDPV

SEQ ID NO: 1996980 - protein, 11 aa, Staphylococcus
YKQGDVDRRRA

SEQ ID NO: 1996981 - protein, 6 aa, Staphylococcus
YKQGGT

SEQ ID NO: 1996982 - protein, 10 aa, Staphylococcus
YKQGKPSEIY

SEQ ID NO: 1996983 - protein, 4 aa, Staphylococcus
YKQK

SEQ ID NO: 1996984 - protein, 7 aa, Staphylococcus
YKQKGIP

SEQ ID NO: 1996985 - protein, 7 aa, Staphylococcus
YKQKGNA

SEQ ID NO: 1996986 - protein, 12 aa, Staphylococcus
YKQKKKEYHDST

SEQ ID NO: 1996987 - protein, 9 aa, Staphylococcus
YKQNKEDID

SEQ ID NO: 1996988 - protein, 23 aa, Staphylococcus
YKQPSDRITVDERATKLSKSLKS

SEQ ID NO: 1996989 - protein, 13 aa, Staphylococcus
YKQQADGSNISSA

SEQ ID NO: 1996990 - protein, 9 aa, Staphylococcus
YKQQGTPHR

SEQ ID NO: 1996991 - protein, 10 aa, Staphylococcus
YKQSGIGREW

SEQ ID NO: 1996992 - protein, 4 aa, Staphylococcus
YKQT

SEQ ID NO: 1996993 - protein, 9 aa, Staphylococcus
YKRDDYAEK

SEQ ID NO: 1996994 - protein, 9 aa, Staphylococcus
YKREDYAEK

SEQ ID NO: 1996995 - protein, 17 aa, Staphylococcus
YKRGASDVKVEYSDDKL

SEQ ID NO: 1996996 - protein, 9 aa, Staphylococcus
YKRGVYSGG

SEQ ID NO: 1996997 - protein, 4 aa, Staphylococcus
YKRI

SEQ ID NO: 1996998 - protein, 8 aa, Staphylococcus
YKRPFSED

SEQ ID NO: 1996999 - protein, 16 aa, Staphylococcus
YKSAREKALSNNHIPE

SEQ ID NO: 1997000 - protein, 8 aa, Staphylococcus
YKSDKFAP

SEQ ID NO: 1997001 - protein, 12 aa, Staphylococcus
YKSDKKAPYQPS

SEQ ID NO: 1997002 - protein, 7 aa, Staphylococcus
YKSDKQI

SEQ ID NO: 1997003 - protein, 12 aa, Staphylococcus
YKSDKRAPYQPD

SEQ ID NO: 1997004 - protein, 17 aa, Staphylococcus
YKSIEESAFYIEKFLMQ

SEQ ID NO: 1997005 - protein, 17 aa, Staphylococcus
YKSIEESAFYIEKYLNK

SEQ ID NO: 1997006 - protein, 9 aa, Staphylococcus
YKSKREEVA

SEQ ID NO: 1997007 - protein, 16 aa, Staphylococcus
YKSKTKELEELESADQ

SEQ ID NO: 1997008 - protein, 9 aa, Staphylococcus
YKSLEEGQK

SEQ ID NO: 1997009 - protein, 9 aa, Staphylococcus
YKSLQDNTI

SEQ ID NO: 1997010 - protein, 9 aa, Staphylococcus
YKSNDESPL

SEQ ID NO: 1997011 - protein, 9 aa, Staphylococcus
YKSNKSTRY

SEQ ID NO: 1997012 - protein, 8 aa, Staphylococcus
YKSQKEKI

SEQ ID NO: 1997013 - protein, 16 aa, Staphylococcus
YKSRSDELSGGQQQRI

SEQ ID NO: 1997014 - protein, 14 aa, Staphylococcus
YKTAEQTLANDDEA

SEQ ID NO: 1997015 - protein, 7 aa, Staphylococcus
YKTASEK

SEQ ID NO: 1997016 - protein, 9 aa, Staphylococcus
YKTDIPKTH

SEQ ID NO: 1997017 - protein, 11 aa, Staphylococcus
YKTDKKGAQKI

SEQ ID NO: 1997018 - protein, 10 aa, Staphylococcus
YKTDKSAPYQ

SEQ ID NO: 1997019 - protein, 6 aa, Staphylococcus
YKTDST

SEQ ID NO: 1997020 - protein, 30 aa, Staphylococcus
YKTKTQSRSTQSPTLEKKKVTVKKKRKARK

SEQ ID NO: 1997021 - protein, 8 aa, Staphylococcus
YKTMPTPY

SEQ ID NO: 1997022 - protein, 6 aa, Staphylococcus
YKTNKS

SEQ ID NO: 1997023 - protein, 5 aa, Staphylococcus
YKTNN

SEQ ID NO: 1997024 - protein, 10 aa, Staphylococcus
YKTPADRITV

SEQ ID NO: 1997025 - protein, 7 aa, Staphylococcus
YKTPQDY

SEQ ID NO: 1997026 - protein, 11 aa, Staphylococcus
YKTQDISQWPK

SEQ ID NO: 1997027 - protein, 18 aa, Staphylococcus
YKTRVNRKNRDNGEPEPF

SEQ ID NO: 1997028 - protein, 6 aa, Staphylococcus
YKTTQE

SEQ ID NO: 1997029 - protein, 10 aa, Staphylococcus
YKTYADSRSE

SEQ ID NO: 1997030 - protein, 13 aa, Staphylococcus
YKVRQRSDSFKDY

SEQ ID NO: 1997031 - protein, 7 aa, Staphylococcus
YKVTTED

SEQ ID NO: 1997032 - protein, 20 aa, Staphylococcus
YKYEEHSSNNSTKTSSQIDD

SEQ ID NO: 1997033 - protein, 7 aa, Staphylococcus
YKYEGNK

SEQ ID NO: 1997034 - protein, 9 aa, Staphylococcus
YKYETDYRN

SEQ ID NO: 1997035 - protein, 7 aa, Staphylococcus
YKYTQEE

SEQ ID NO: 1997036 - protein, 17 aa, Staphylococcus
YLDEEKQKEFKRWLQSQ

SEQ ID NO: 1997037 - protein, 5 aa, Staphylococcus
YLDTE

SEQ ID NO: 1997038 - protein, 8 aa, Staphylococcus
YLENNEQD

SEQ ID NO: 1997039 - protein, 12 aa, Staphylococcus
YLGDETADYIPK

SEQ ID NO: 1997040 - protein, 7 aa, Staphylococcus
YLGPARE

SEQ ID NO: 1997041 - protein, 26 aa, Staphylococcus
YLGPAREAIKATVKGKIKEFGTSNRA

SEQ ID NO: 1997042 - protein, 6 aa, Staphylococcus
YLGTED

SEQ ID NO: 1997043 - protein, 5 aa, Staphylococcus
YLKDG

SEQ ID NO: 1997044 - protein, 19 aa, Staphylococcus
YLKPGASITTTSSVQGYKP

SEQ ID NO: 1997045 - protein, 11 aa, Staphylococcus
YLKQDISKSAL

SEQ ID NO: 1997046 - protein, 10 aa, Staphylococcus
YLNDESKAYY

SEQ ID NO: 1997047 - protein, 5 aa, Staphylococcus
YLNEG

SEQ ID NO: 1997048 - protein, 19 aa, Staphylococcus
YLNNQSDDNDIDKEGLEER

SEQ ID NO: 1997049 - protein, 9 aa, Staphylococcus
YLNPEDADT

SEQ ID NO: 1997050 - protein, 18 aa, Staphylococcus
YLNPGDSVSYGSTFTATE

SEQ ID NO: 1997051 - protein, 4 aa, Staphylococcus
YLPD

SEQ ID NO: 1997052 - protein, 7 aa, Staphylococcus
YLPDGQG

SEQ ID NO: 1997053 - protein, 5 aa, Staphylococcus
YLPGT

SEQ ID NO: 1997054 - protein, 6 aa, Staphylococcus
YLPGTY

SEQ ID NO: 1997055 - protein, 5 aa, Staphylococcus
YLPKG

SEQ ID NO: 1997056 - protein, 6 aa, Staphylococcus
YLPPNY

SEQ ID NO: 1997057 - protein, 6 aa, Staphylococcus
YLRPSN

SEQ ID NO: 1997058 - protein, 6 aa, Staphylococcus
YLSEEE

SEQ ID NO: 1997059 - protein, 14 aa, Staphylococcus
YLSEEEVTYSPKSN

SEQ ID NO: 1997060 - protein, 5 aa, Staphylococcus
YLSES

SEQ ID NO: 1997061 - protein, 5 aa, Staphylococcus
YLSHA

SEQ ID NO: 1997062 - protein, 7 aa, Staphylococcus
YLSPKDA

SEQ ID NO: 1997063 - protein, 11 aa, Staphylococcus
YLTADSSKIDE

SEQ ID NO: 1997064 - protein, 5 aa, Staphylococcus
YLTSD

SEQ ID NO: 1997065 - protein, 5 aa, Staphylococcus
YMGTE

SEQ ID NO: 1997066 - protein, 9 aa, Staphylococcus
YMNQSTENT

SEQ ID NO: 1997067 - protein, 15 aa, Staphylococcus
YMPDGKQEKISNAQR

SEQ ID NO: 1997068 - protein, 7 aa, Staphylococcus
YMSKPDA

SEQ ID NO: 1997069 - protein, 4 aa, Staphylococcus
YNAE

SEQ ID NO: 1997070 - protein, 6 aa, Staphylococcus
YNAETD

SEQ ID NO: 1997071 - protein, 16 aa, Staphylococcus
YNAETKFKTLEKEAHH

SEQ ID NO: 1997072 - protein, 22 aa, Staphylococcus
YNAGEAIQHRGETVTEGASSNV

SEQ ID NO: 1997073 - protein, 8 aa, Staphylococcus
YNAKDSLT

SEQ ID NO: 1997074 - protein, 5 aa, Staphylococcus
YNANY

SEQ ID NO: 1997075 - protein, 8 aa, Staphylococcus
YNAPNYSA

SEQ ID NO: 1997076 - protein, 6 aa, Staphylococcus
YNAPVQ

SEQ ID NO: 1997077 - protein, 8 aa, Staphylococcus
YNAQNAKL

SEQ ID NO: 1997078 - protein, 13 aa, Staphylococcus
YNASKPKLQGDQG

SEQ ID NO: 1997079 - protein, 11 aa, Staphylococcus
YNASPTSMKAS

SEQ ID NO: 1997080 - protein, 4 aa, Staphylococcus
YNAT

SEQ ID NO: 1997081 - protein, 23 aa, Staphylococcus
YNATEAIQHRGDTVTEGASSNVY

SEQ ID NO: 1997082 - protein, 8 aa, Staphylococcus
YNATTTGE

SEQ ID NO: 1997083 - protein, 7 aa, Staphylococcus
YNDDPES

SEQ ID NO: 1997084 - protein, 5 aa, Staphylococcus
YNDDV

SEQ ID NO: 1997085 - protein, 6 aa, Staphylococcus
YNDDVD

SEQ ID NO: 1997086 - protein, 8 aa, Staphylococcus
YNDEDQSF

SEQ ID NO: 1997087 - protein, 10 aa, Staphylococcus
YNDEKGKPCI

SEQ ID NO: 1997088 - protein, 10 aa, Staphylococcus
YNDEKNPSHH

SEQ ID NO: 1997089 - protein, 14 aa, Staphylococcus
YNDGEMYNKTSSVQ

SEQ ID NO: 1997090 - protein, 9 aa, Staphylococcus
YNDKEFEDV

SEQ ID NO: 1997091 - protein, 8 aa, Staphylococcus
YNDKKETI

SEQ ID NO: 1997092 - protein, 8 aa, Staphylococcus
YNDLNNSA

SEQ ID NO: 1997093 - protein, 9 aa, Staphylococcus
YNDLNSSAP

SEQ ID NO: 1997094 - protein, 12 aa, Staphylococcus
YNDLSDEDKQIM

SEQ ID NO: 1997095 - protein, 5 aa, Staphylococcus
YNDNI

SEQ ID NO: 1997096 - protein, 13 aa, Staphylococcus
YNDNNKKTELSKR

SEQ ID NO: 1997097 - protein, 5 aa, Staphylococcus
YNDNV

SEQ ID NO: 1997098 - protein, 6 aa, Staphylococcus
YNDNVD

SEQ ID NO: 1997099 - protein, 7 aa, Staphylococcus
YNDNVDT

SEQ ID NO: 1997100 - protein, 7 aa, Staphylococcus
YNDPERL

SEQ ID NO: 1997101 - protein, 6 aa, Staphylococcus
YNDPTI

SEQ ID NO: 1997102 - protein, 11 aa, Staphylococcus
YNDQPREGEEV

SEQ ID NO: 1997103 - protein, 5 aa, Staphylococcus
YNDQV

SEQ ID NO: 1997104 - protein, 9 aa, Staphylococcus
YNDSQGFKT

SEQ ID NO: 1997105 - protein, 17 aa, Staphylococcus
YNDSQGIKTTYLSPKDA

SEQ ID NO: 1997106 - protein, 5 aa, Staphylococcus
YNDYY

SEQ ID NO: 1997107 - protein, 13 aa, Staphylococcus
YNEAQAKEEGLDY

SEQ ID NO: 1997108 - protein, 8 aa, Staphylococcus
YNEDLAQQ

SEQ ID NO: 1997109 - protein, 8 aa, Staphylococcus
YNEDVERD

SEQ ID NO: 1997110 - protein, 5 aa, Staphylococcus
YNEEH

SEQ ID NO: 1997111 - protein, 7 aa, Staphylococcus
YNEEKVQ

SEQ ID NO: 1997112 - protein, 10 aa, Staphylococcus
YNEETRSTEI

SEQ ID NO: 1997113 - protein, 14 aa, Staphylococcus
YNEKAQNFKYGETF

SEQ ID NO: 1997114 - protein, 6 aa, Staphylococcus
YNEKEI

SEQ ID NO: 1997115 - protein, 14 aa, Staphylococcus
YNEKELEKASFKEK

SEQ ID NO: 1997116 - protein, 9 aa, Staphylococcus
YNEKNKKGL

SEQ ID NO: 1997117 - protein, 9 aa, Staphylococcus
YNEKSKEGL

SEQ ID NO: 1997118 - protein, 5 aa, Staphylococcus
YNELG

SEQ ID NO: 1997119 - protein, 6 aa, Staphylococcus
YNENQK

SEQ ID NO: 1997120 - protein, 6 aa, Staphylococcus
YNERQA

SEQ ID NO: 1997121 - protein, 12 aa, Staphylococcus
YNERQEKGELNT

SEQ ID NO: 1997122 - protein, 7 aa, Staphylococcus
YNERQKM

SEQ ID NO: 1997123 - protein, 10 aa, Staphylococcus
YNERQRAGWS

SEQ ID NO: 1997124 - protein, 10 aa, Staphylococcus
YNESKKAKYS

SEQ ID NO: 1997125 - protein, 16 aa, Staphylococcus
YNESPDAPVWNETSAS

SEQ ID NO: 1997126 - protein, 8 aa, Staphylococcus
YNESTKKG

SEQ ID NO: 1997127 - protein, 9 aa, Staphylococcus
YNESTTNDT

SEQ ID NO: 1997128 - protein, 5 aa, Staphylococcus
YNETH

SEQ ID NO: 1997129 - protein, 10 aa, Staphylococcus
YNETKGTSIF

SEQ ID NO: 1997130 - protein, 7 aa, Staphylococcus
YNETPNI

SEQ ID NO: 1997131 - protein, 9 aa, Staphylococcus
YNETRETSI

SEQ ID NO: 1997132 - protein, 12 aa, Staphylococcus
YNEYTNKTETIH

SEQ ID NO: 1997133 - protein, 7 aa, Staphylococcus
YNFSNED

SEQ ID NO: 1997134 - protein, 14 aa, Staphylococcus
YNFSSGESKSRSNI

SEQ ID NO: 1997135 - protein, 5 aa, Staphylococcus
YNGAH

SEQ ID NO: 1997136 - protein, 6 aa, Staphylococcus
YNGEII

SEQ ID NO: 1997137 - protein, 6 aa, Staphylococcus
YNGKGI

SEQ ID NO: 1997138 - protein, 19 aa, Staphylococcus
YNGNDESNYREYAEQQENI

SEQ ID NO: 1997139 - protein, 6 aa, Staphylococcus
YNGNGG

SEQ ID NO: 1997140 - protein, 11 aa, Staphylococcus
YNGQERNNTTY

SEQ ID NO: 1997141 - protein, 20 aa, Staphylococcus
YNGQMTKNSNFNDEKRQSTK

SEQ ID NO: 1997142 - protein, 14 aa, Staphylococcus
YNGQPIKLGQTNRV

SEQ ID NO: 1997143 - protein, 19 aa, Staphylococcus
YNGRQKRQQAERELSQLEN

SEQ ID NO: 1997144 - protein, 22 aa, Staphylococcus
YNGSIESIEEKERKRLSDIKKP

SEQ ID NO: 1997145 - protein, 4 aa, Staphylococcus
YNHS

SEQ ID NO: 1997146 - protein, 12 aa, Staphylococcus
YNIPSDTQFTNN

SEQ ID NO: 1997147 - protein, 5 aa, Staphylococcus
YNKER

SEQ ID NO: 1997148 - protein, 8 aa, Staphylococcus
YNKETALG

SEQ ID NO: 1997149 - protein, 8 aa, Staphylococcus
YNKGGLDK

SEQ ID NO: 1997150 - protein, 5 aa, Staphylococcus
YNKGS

SEQ ID NO: 1997151 - protein, 9 aa, Staphylococcus
YNKNHTDKI

SEQ ID NO: 1997152 - protein, 7 aa, Staphylococcus
YNKNNDD

SEQ ID NO: 1997153 - protein, 7 aa, Staphylococcus
YNKPSYF

SEQ ID NO: 1997154 - protein, 7 aa, Staphylococcus
YNKQNQK

SEQ ID NO: 1997155 - protein, 12 aa, Staphylococcus
YNKQQRKYEGQQ

SEQ ID NO: 1997156 - protein, 5 aa, Staphylococcus
YNKTI

SEQ ID NO: 1997157 - protein, 8 aa, Staphylococcus
YNKTPNIL

SEQ ID NO: 1997158 - protein, 9 aa, Staphylococcus
YNKTSKKLF

SEQ ID NO: 1997159 - protein, 9 aa, Staphylococcus
YNLPDDAAK

SEQ ID NO: 1997160 - protein, 9 aa, Staphylococcus
YNLSDRDKR

SEQ ID NO: 1997161 - protein, 10 aa, Staphylococcus
YNLSSEDKIE

SEQ ID NO: 1997162 - protein, 11 aa, Staphylococcus
YNLTDEDKFDN

SEQ ID NO: 1997163 - protein, 6 aa, Staphylococcus
YNNEGK

SEQ ID NO: 1997164 - protein, 10 aa, Staphylococcus
YNNEIKDPNF

SEQ ID NO: 1997165 - protein, 6 aa, Staphylococcus
YNNEKA

SEQ ID NO: 1997166 - protein, 5 aa, Staphylococcus
YNNGE

SEQ ID NO: 1997167 - protein, 9 aa, Staphylococcus
YNNGERNSS

SEQ ID NO: 1997168 - protein, 7 aa, Staphylococcus
YNNGMSD

SEQ ID NO: 1997169 - protein, 10 aa, Staphylococcus
YNNIKDADAA

SEQ ID NO: 1997170 - protein, 4 aa, Staphylococcus
YNNK

SEQ ID NO: 1997171 - protein, 7 aa, Staphylococcus
YNNKEAL

SEQ ID NO: 1997172 - protein, 17 aa, Staphylococcus
YNNKTETKISIILDNHK

SEQ ID NO: 1997173 - protein, 8 aa, Staphylococcus
YNNNPIQQ

SEQ ID NO: 1997174 - protein, 33 aa, Staphylococcus
YNNQTGVNEKEREERQEQAQQYREERQNNQQHF

SEQ ID NO: 1997175 - protein, 11 aa, Staphylococcus
YNNSAGKEVGF

SEQ ID NO: 1997176 - protein, 14 aa, Staphylococcus
YNNSEVKASIDTKE

SEQ ID NO: 1997177 - protein, 10 aa, Staphylococcus
YNNSNKKELI

SEQ ID NO: 1997178 - protein, 10 aa, Staphylococcus
YNNSQGIPTR

SEQ ID NO: 1997179 - protein, 19 aa, Staphylococcus
YNNSQGIPTRYVSPGEAGI

SEQ ID NO: 1997180 - protein, 13 aa, Staphylococcus
YNNTGQVCTAGTR

SEQ ID NO: 1997181 - protein, 17 aa, Staphylococcus
YNNTQGVPTTYLSPEDA

SEQ ID NO: 1997182 - protein, 8 aa, Staphylococcus
YNNVDQKE

SEQ ID NO: 1997183 - protein, 4 aa, Staphylococcus
YNPA

SEQ ID NO: 1997184 - protein, 10 aa, Staphylococcus
YNPETKETNV

SEQ ID NO: 1997185 - protein, 8 aa, Staphylococcus
YNPETKVT

SEQ ID NO: 1997186 - protein, 5 aa, Staphylococcus
YNPNH

SEQ ID NO: 1997187 - protein, 5 aa, Staphylococcus
YNPNN

SEQ ID NO: 1997188 - protein, 11 aa, Staphylococcus
YNPNNNSVTSS

SEQ ID NO: 1997189 - protein, 8 aa, Staphylococcus
YNPNQGEA

SEQ ID NO: 1997190 - protein, 10 aa, Staphylococcus
YNPNSPHYAG

SEQ ID NO: 1997191 - protein, 6 aa, Staphylococcus
YNPRYS

SEQ ID NO: 1997192 - protein, 4 aa, Staphylococcus
YNPS

SEQ ID NO: 1997193 - protein, 15 aa, Staphylococcus
YNPVDNSGENKVTID

SEQ ID NO: 1997194 - protein, 8 aa, Staphylococcus
YNQDANDF

SEQ ID NO: 1997195 - protein, 8 aa, Staphylococcus
YNQKPNIL

SEQ ID NO: 1997196 - protein, 11 aa, Staphylococcus
YNQLTKSEKKI

SEQ ID NO: 1997197 - protein, 10 aa, Staphylococcus
YNQNGKKTFV

SEQ ID NO: 1997198 - protein, 12 aa, Staphylococcus
YNQQGTNDWPKQ

SEQ ID NO: 1997199 - protein, 8 aa, Staphylococcus
YNQTHDKK

SEQ ID NO: 1997200 - protein, 14 aa, Staphylococcus
YNQYKSDSNVTFPD

SEQ ID NO: 1997201 - protein, 9 aa, Staphylococcus
YNRARQAAI

SEQ ID NO: 1997202 - protein, 11 aa, Staphylococcus
YNRARQAEITQ

SEQ ID NO: 1997203 - protein, 5 aa, Staphylococcus
YNRDG

SEQ ID NO: 1997204 - protein, 8 aa, Staphylococcus
YNREDSVR

SEQ ID NO: 1997205 - protein, 25 aa, Staphylococcus
YNREGDEDDDDAGMEPVTNDDNGEI

SEQ ID NO: 1997206 - protein, 25 aa, Staphylococcus
YNRGEGEDDDDGGNFEPQSNDENGE

SEQ ID NO: 1997207 - protein, 10 aa, Staphylococcus
YNRKQTLSNA

SEQ ID NO: 1997208 - protein, 7 aa, Staphylococcus
YNRLDSD

SEQ ID NO: 1997209 - protein, 11 aa, Staphylococcus
YNRRDAVKRAK

SEQ ID NO: 1997210 - protein, 11 aa, Staphylococcus
YNRRDDEWGED

SEQ ID NO: 1997211 - protein, 8 aa, Staphylococcus
YNRSRELQ

SEQ ID NO: 1997212 - protein, 9 aa, Staphylococcus
YNRSSDKTD

SEQ ID NO: 1997213 - protein, 4 aa, Staphylococcus
YNSA

SEQ ID NO: 1997214 - protein, 7 aa, Staphylococcus
YNSEKSL

SEQ ID NO: 1997215 - protein, 11 aa, Staphylococcus
YNSHGRDRSGV

SEQ ID NO: 1997216 - protein, 12 aa, Staphylococcus
YNSNAKEQREAI

SEQ ID NO: 1997217 - protein, 18 aa, Staphylococcus
YNSNKAHQKETLNTYDQR

SEQ ID NO: 1997218 - protein, 20 aa, Staphylococcus
YNSQMTQNNDFNDEKKHATK

SEQ ID NO: 1997219 - protein, 15 aa, Staphylococcus
YNSSPKVGIASGGGI

SEQ ID NO: 1997220 - protein, 5 aa, Staphylococcus
YNSTQ

SEQ ID NO: 1997221 - protein, 4 aa, Staphylococcus
YNTF

SEQ ID NO: 1997222 - protein, 11 aa, Staphylococcus
YNTHGRDRSGV

SEQ ID NO: 1997223 - protein, 5 aa, Staphylococcus
YNTLN

SEQ ID NO: 1997224 - protein, 6 aa, Staphylococcus
YNTLNK

SEQ ID NO: 1997225 - protein, 15 aa, Staphylococcus
YNTNELSDTGLRAAG

SEQ ID NO: 1997226 - protein, 6 aa, Staphylococcus
YNTPAE

SEQ ID NO: 1997227 - protein, 7 aa, Staphylococcus
YNTPITK

SEQ ID NO: 1997228 - protein, 6 aa, Staphylococcus
YNTSAE

SEQ ID NO: 1997229 - protein, 5 aa, Staphylococcus
YNTTA

SEQ ID NO: 1997230 - protein, 6 aa, Staphylococcus
YNTTAE

SEQ ID NO: 1997231 - protein, 6 aa, Staphylococcus
YNTVNE

SEQ ID NO: 1997232 - protein, 11 aa, Staphylococcus
YNVNGKSKPIY

SEQ ID NO: 1997233 - protein, 5 aa, Staphylococcus
YNVTT

SEQ ID NO: 1997234 - protein, 11 aa, Staphylococcus
YNYHSSNDFAN

SEQ ID NO: 1997235 - protein, 4 aa, Staphylococcus
YNYP

SEQ ID NO: 1997236 - protein, 10 aa, Staphylococcus
YNYPQSRVTD

SEQ ID NO: 1997237 - protein, 5 aa, Staphylococcus
YNYPY

SEQ ID NO: 1997238 - protein, 8 aa, Staphylococcus
YNYQEASV

SEQ ID NO: 1997239 - protein, 5 aa, Staphylococcus
YNYSE

SEQ ID NO: 1997240 - protein, 16 aa, Staphylococcus
YNYSEAELEDLLASMN

SEQ ID NO: 1997241 - protein, 15 aa, Staphylococcus
YNYSETELNQLLESM

SEQ ID NO: 1997242 - protein, 7 aa, Staphylococcus
YNYSTNL

SEQ ID NO: 1997243 - protein, 6 aa, Staphylococcus
YPAARS

SEQ ID NO: 1997244 - protein, 9 aa, Staphylococcus
YPADDQNSA

SEQ ID NO: 1997245 - protein, 9 aa, Staphylococcus
YPADDQSAS

SEQ ID NO: 1997246 - protein, 9 aa, Staphylococcus
YPADDQSSA

SEQ ID NO: 1997247 - protein, 21 aa, Staphylococcus
YPADNIDKAISSALDKTVGKI

SEQ ID NO: 1997248 - protein, 6 aa, Staphylococcus
YPAEMG

SEQ ID NO: 1997249 - protein, 15 aa, Staphylococcus
YPALNSEFDEENGEV

SEQ ID NO: 1997250 - protein, 13 aa, Staphylococcus
YPARLSGGESQRV

SEQ ID NO: 1997251 - protein, 5 aa, Staphylococcus
YPATR

SEQ ID NO: 1997252 - protein, 12 aa, Staphylococcus
YPAVNAEIDGDE

SEQ ID NO: 1997253 - protein, 17 aa, Staphylococcus
YPDAQTAIRSGQSFEGQ

SEQ ID NO: 1997254 - protein, 6 aa, Staphylococcus
YPDDKD

SEQ ID NO: 1997255 - protein, 7 aa, Staphylococcus
YPDDMGT

SEQ ID NO: 1997256 - protein, 13 aa, Staphylococcus
YPDDPDALTYQET

SEQ ID NO: 1997257 - protein, 6 aa, Staphylococcus
YPDDPT

SEQ ID NO: 1997258 - protein, 5 aa, Staphylococcus
YPDDS

SEQ ID NO: 1997259 - protein, 4 aa, Staphylococcus
YPDE

SEQ ID NO: 1997260 - protein, 6 aa, Staphylococcus
YPDEMG

SEQ ID NO: 1997261 - protein, 5 aa, Staphylococcus
YPDGY

SEQ ID NO: 1997262 - protein, 5 aa, Staphylococcus
YPDIE

SEQ ID NO: 1997263 - protein, 11 aa, Staphylococcus
YPDKSIESLTS

SEQ ID NO: 1997264 - protein, 4 aa, Staphylococcus
YPDL

SEQ ID NO: 1997265 - protein, 12 aa, Staphylococcus
YPDMPSGANTIN

SEQ ID NO: 1997266 - protein, 5 aa, Staphylococcus
YPDNN

SEQ ID NO: 1997267 - protein, 4 aa, Staphylococcus
YPDP

SEQ ID NO: 1997268 - protein, 6 aa, Staphylococcus
YPDQMG

SEQ ID NO: 1997269 - protein, 4 aa, Staphylococcus
YPDR

SEQ ID NO: 1997270 - protein, 5 aa, Staphylococcus
YPDYG

SEQ ID NO: 1997271 - protein, 9 aa, Staphylococcus
YPEAIDEKQ

SEQ ID NO: 1997272 - protein, 7 aa, Staphylococcus
YPEAQQY

SEQ ID NO: 1997273 - protein, 4 aa, Staphylococcus
YPED

SEQ ID NO: 1997274 - protein, 13 aa, Staphylococcus
YPEEFSKDNVRQD

SEQ ID NO: 1997275 - protein, 5 aa, Staphylococcus
YPEEH

SEQ ID NO: 1997276 - protein, 6 aa, Staphylococcus
YPEGQY

SEQ ID NO: 1997277 - protein, 4 aa, Staphylococcus
YPEH

SEQ ID NO: 1997278 - protein, 11 aa, Staphylococcus
YPEHDSSIIEN

SEQ ID NO: 1997279 - protein, 8 aa, Staphylococcus
YPENGNVE

SEQ ID NO: 1997280 - protein, 7 aa, Staphylococcus
YPENQID

SEQ ID NO: 1997281 - protein, 5 aa, Staphylococcus
YPENR

SEQ ID NO: 1997282 - protein, 8 aa, Staphylococcus
YPEPSFEE

SEQ ID NO: 1997283 - protein, 4 aa, Staphylococcus
YPER

SEQ ID NO: 1997284 - protein, 5 aa, Staphylococcus
YPESK

SEQ ID NO: 1997285 - protein, 8 aa, Staphylococcus
YPETGSPL

SEQ ID NO: 1997286 - protein, 5 aa, Staphylococcus
YPETK

SEQ ID NO: 1997287 - protein, 7 aa, Staphylococcus
YPETQTE

SEQ ID NO: 1997288 - protein, 6 aa, Staphylococcus
YPFEEE

SEQ ID NO: 1997289 - protein, 4 aa, Staphylococcus
YPFQ

SEQ ID NO: 1997290 - protein, 4 aa, Staphylococcus
YPGA

SEQ ID NO: 1997291 - protein, 6 aa, Staphylococcus
YPGEGS

SEQ ID NO: 1997292 - protein, 9 aa, Staphylococcus
YPGERHRAN

SEQ ID NO: 1997293 - protein, 5 aa, Staphylococcus
YPGFK

SEQ ID NO: 1997294 - protein, 6 aa, Staphylococcus
YPGFKI

SEQ ID NO: 1997295 - protein, 20 aa, Staphylococcus
YPGHGPSTTVNNEQMNPYLH

SEQ ID NO: 1997296 - protein, 5 aa, Staphylococcus
YPGNH

SEQ ID NO: 1997297 - protein, 6 aa, Staphylococcus
YPGNSD

SEQ ID NO: 1997298 - protein, 6 aa, Staphylococcus
YPGNSS

SEQ ID NO: 1997299 - protein, 4 aa, Staphylococcus
YPGQ

SEQ ID NO: 1997300 - protein, 5 aa, Staphylococcus
YPGSN

SEQ ID NO: 1997301 - protein, 12 aa, Staphylococcus
YPGYSEQNPDEW

SEQ ID NO: 1997302 - protein, 15 aa, Staphylococcus
YPHGTISESLNGTEL

SEQ ID NO: 1997303 - protein, 9 aa, Staphylococcus
YPHNSENGF

SEQ ID NO: 1997304 - protein, 5 aa, Staphylococcus
YPIKN

SEQ ID NO: 1997305 - protein, 6 aa, Staphylococcus
YPKANW

SEQ ID NO: 1997306 - protein, 6 aa, Staphylococcus
YPKAQG

SEQ ID NO: 1997307 - protein, 6 aa, Staphylococcus
YPKAYR

SEQ ID NO: 1997308 - protein, 16 aa, Staphylococcus
YPKDSEAKVFIPKSND

SEQ ID NO: 1997309 - protein, 10 aa, Staphylococcus
YPKDSEATLF

SEQ ID NO: 1997310 - protein, 7 aa, Staphylococcus
YPKETRK

SEQ ID NO: 1997311 - protein, 8 aa, Staphylococcus
YPKPEHVN

SEQ ID NO: 1997312 - protein, 8 aa, Staphylococcus
YPKRSKAV

SEQ ID NO: 1997313 - protein, 14 aa, Staphylococcus
YPKSSLKTRENIER

SEQ ID NO: 1997314 - protein, 4 aa, Staphylococcus
YPKT

SEQ ID NO: 1997315 - protein, 10 aa, Staphylococcus
YPLADGAERR

SEQ ID NO: 1997316 - protein, 7 aa, Staphylococcus
YPLNDGK

SEQ ID NO: 1997317 - protein, 12 aa, Staphylococcus
YPMTLSGGEAQR

SEQ ID NO: 1997318 - protein, 6 aa, Staphylococcus
YPNAKR

SEQ ID NO: 1997319 - protein, 5 aa, Staphylococcus
YPNAY

SEQ ID NO: 1997320 - protein, 4 aa, Staphylococcus
YPNE

SEQ ID NO: 1997321 - protein, 10 aa, Staphylococcus
YPNETDEQFE

SEQ ID NO: 1997322 - protein, 10 aa, Staphylococcus
YPNETEDQFE

SEQ ID NO: 1997323 - protein, 10 aa, Staphylococcus
YPNETEEQFE

SEQ ID NO: 1997324 - protein, 10 aa, Staphylococcus
YPNEVSGGQL

SEQ ID NO: 1997325 - protein, 20 aa, Staphylococcus
YPNGQAYKNVTDISSANEKG

SEQ ID NO: 1997326 - protein, 7 aa, Staphylococcus
YPNGQKK

SEQ ID NO: 1997327 - protein, 5 aa, Staphylococcus
YPNHT

SEQ ID NO: 1997328 - protein, 5 aa, Staphylococcus
YPNPF

SEQ ID NO: 1997329 - protein, 4 aa, Staphylococcus
YPNS

SEQ ID NO: 1997330 - protein, 8 aa, Staphylococcus
YPNSEGHG

SEQ ID NO: 1997331 - protein, 6 aa, Staphylococcus
YPNSIQ

SEQ ID NO: 1997332 - protein, 8 aa, Staphylococcus
YPNTAHEA

SEQ ID NO: 1997333 - protein, 4 aa, Staphylococcus
YPNV

SEQ ID NO: 1997334 - protein, 13 aa, Staphylococcus
YPPDNEAELFTPS

SEQ ID NO: 1997335 - protein, 5 aa, Staphylococcus
YPPGI

SEQ ID NO: 1997336 - protein, 8 aa, Staphylococcus
YPPGPTKK

SEQ ID NO: 1997337 - protein, 7 aa, Staphylococcus
YPPHSPI

SEQ ID NO: 1997338 - protein, 4 aa, Staphylococcus
YPPI

SEQ ID NO: 1997339 - protein, 12 aa, Staphylococcus
YPPQTLKQEEMT

SEQ ID NO: 1997340 - protein, 13 aa, Staphylococcus
YPPQTLSDEEIKT

SEQ ID NO: 1997341 - protein, 11 aa, Staphylococcus
YPPQTLSEEDI

SEQ ID NO: 1997342 - protein, 13 aa, Staphylococcus
YPPQTLSQEDIDT

SEQ ID NO: 1997343 - protein, 13 aa, Staphylococcus
YPPQTLSQEEIET

SEQ ID NO: 1997344 - protein, 13 aa, Staphylococcus
YPPQTLSQEELDT

SEQ ID NO: 1997345 - protein, 13 aa, Staphylococcus
YPPQTLTKEEIDT

SEQ ID NO: 1997346 - protein, 6 aa, Staphylococcus
YPQEPR

SEQ ID NO: 1997347 - protein, 4 aa, Staphylococcus
YPQI

SEQ ID NO: 1997348 - protein, 5 aa, Staphylococcus
YPQIG

SEQ ID NO: 1997349 - protein, 8 aa, Staphylococcus
YPQKTKND

SEQ ID NO: 1997350 - protein, 9 aa, Staphylococcus
YPQNERERK

SEQ ID NO: 1997351 - protein, 7 aa, Staphylococcus
YPQNRVT

SEQ ID NO: 1997352 - protein, 9 aa, Staphylococcus
YPRPDTGLT

SEQ ID NO: 1997353 - protein, 8 aa, Staphylococcus
YPRPNTGL

SEQ ID NO: 1997354 - protein, 5 aa, Staphylococcus
YPRRD

SEQ ID NO: 1997355 - protein, 18 aa, Staphylococcus
YPRTDSNYLSNDMTDTIQ

SEQ ID NO: 1997356 - protein, 8 aa, Staphylococcus
YPSDKTEV

SEQ ID NO: 1997357 - protein, 6 aa, Staphylococcus
YPSDSL

SEQ ID NO: 1997358 - protein, 8 aa, Staphylococcus
YPSEQLTT

SEQ ID NO: 1997359 - protein, 9 aa, Staphylococcus
YPSGTIYSR

SEQ ID NO: 1997360 - protein, 6 aa, Staphylococcus
YPSHEQ

SEQ ID NO: 1997361 - protein, 11 aa, Staphylococcus
YPSLTKSEKKI

SEQ ID NO: 1997362 - protein, 5 aa, Staphylococcus
YPSRS

SEQ ID NO: 1997363 - protein, 7 aa, Staphylococcus
YPSSINQ

SEQ ID NO: 1997364 - protein, 8 aa, Staphylococcus
YPTDKSEV

SEQ ID NO: 1997365 - protein, 7 aa, Staphylococcus
YPTDKTE

SEQ ID NO: 1997366 - protein, 6 aa, Staphylococcus
YPTEED

SEQ ID NO: 1997367 - protein, 6 aa, Staphylococcus
YPTGQA

SEQ ID NO: 1997368 - protein, 9 aa, Staphylococcus
YPTGTIYSR

SEQ ID NO: 1997369 - protein, 16 aa, Staphylococcus
YPTGTIYSRPGPIMAS

SEQ ID NO: 1997370 - protein, 4 aa, Staphylococcus
YPTK

SEQ ID NO: 1997371 - protein, 5 aa, Staphylococcus
YPTQY

SEQ ID NO: 1997372 - protein, 8 aa, Staphylococcus
YPVNPRTV

SEQ ID NO: 1997373 - protein, 9 aa, Staphylococcus
YPYNSETPI

SEQ ID NO: 1997374 - protein, 8 aa, Staphylococcus
YPYPDGNK

SEQ ID NO: 1997375 - protein, 8 aa, Staphylococcus
YPYPDKPV

SEQ ID NO: 1997376 - protein, 8 aa, Staphylococcus
YPYPDSNK

SEQ ID NO: 1997377 - protein, 9 aa, Staphylococcus
YPYPDSNKK

SEQ ID NO: 1997378 - protein, 8 aa, Staphylococcus
YPYPESNK

SEQ ID NO: 1997379 - protein, 8 aa, Staphylococcus
YPYPNSNK

SEQ ID NO: 1997380 - protein, 8 aa, Staphylococcus
YQAAGKLK

SEQ ID NO: 1997381 - protein, 9 aa, Staphylococcus
YQADRDEVR

SEQ ID NO: 1997382 - protein, 24 aa, Staphylococcus
YQAETKPKPKPKPKPDEKPTKPVV

SEQ ID NO: 1997383 - protein, 4 aa, Staphylococcus
YQAS

SEQ ID NO: 1997384 - protein, 9 aa, Staphylococcus
YQASRETVR

SEQ ID NO: 1997385 - protein, 6 aa, Staphylococcus
YQASYQ

SEQ ID NO: 1997386 - protein, 8 aa, Staphylococcus
YQATDDWK

SEQ ID NO: 1997387 - protein, 9 aa, Staphylococcus
YQDAERQKK

SEQ ID NO: 1997388 - protein, 9 aa, Staphylococcus
YQDDQGNLK

SEQ ID NO: 1997389 - protein, 16 aa, Staphylococcus
YQDDTLKPSKQSVSEL

SEQ ID NO: 1997390 - protein, 9 aa, Staphylococcus
YQDEDENGQ

SEQ ID NO: 1997391 - protein, 9 aa, Staphylococcus
YQDEEGNLK

SEQ ID NO: 1997392 - protein, 16 aa, Staphylococcus
YQDGRSSERLVRNVFG

SEQ ID NO: 1997393 - protein, 4 aa, Staphylococcus
YQDH

SEQ ID NO: 1997394 - protein, 9 aa, Staphylococcus
YQDHANELN

SEQ ID NO: 1997395 - protein, 8 aa, Staphylococcus
YQDKGYGS

SEQ ID NO: 1997396 - protein, 11 aa, Staphylococcus
YQDKLKDTGVE

SEQ ID NO: 1997397 - protein, 8 aa, Staphylococcus
YQDKPKDT

SEQ ID NO: 1997398 - protein, 6 aa, Staphylococcus
YQDLSK

SEQ ID NO: 1997399 - protein, 11 aa, Staphylococcus
YQDMNKEPLDS

SEQ ID NO: 1997400 - protein, 4 aa, Staphylococcus
YQDP

SEQ ID NO: 1997401 - protein, 8 aa, Staphylococcus
YQDTNQVQ

SEQ ID NO: 1997402 - protein, 8 aa, Staphylococcus
YQDTNRAQ

SEQ ID NO: 1997403 - protein, 13 aa, Staphylococcus
YQEAGRAGRDGLK

SEQ ID NO: 1997404 - protein, 6 aa, Staphylococcus
YQEDGI

SEQ ID NO: 1997405 - protein, 13 aa, Staphylococcus
YQEDLDDLKQQIN

SEQ ID NO: 1997406 - protein, 24 aa, Staphylococcus
YQEEASKKSDLERTDLAKDKSGVF

SEQ ID NO: 1997407 - protein, 9 aa, Staphylococcus
YQEEQLGTA

SEQ ID NO: 1997408 - protein, 7 aa, Staphylococcus
YQEGDNI

SEQ ID NO: 1997409 - protein, 4 aa, Staphylococcus
YQEH

SEQ ID NO: 1997410 - protein, 7 aa, Staphylococcus
YQEKREN

SEQ ID NO: 1997411 - protein, 7 aa, Staphylococcus
YQEQSKI

SEQ ID NO: 1997412 - protein, 5 aa, Staphylococcus
YQERH

SEQ ID NO: 1997413 - protein, 8 aa, Staphylococcus
YQERQTVQ

SEQ ID NO: 1997414 - protein, 8 aa, Staphylococcus
YQESHPDD

SEQ ID NO: 1997415 - protein, 8 aa, Staphylococcus
YQESYTKE

SEQ ID NO: 1997416 - protein, 5 aa, Staphylococcus
YQETD

SEQ ID NO: 1997417 - protein, 6 aa, Staphylococcus
YQETKG

SEQ ID NO: 1997418 - protein, 4 aa, Staphylococcus
YQEV

SEQ ID NO: 1997419 - protein, 14 aa, Staphylococcus
YQEYQQQLEDVDIR

SEQ ID NO: 1997420 - protein, 4 aa, Staphylococcus
YQFN

SEQ ID NO: 1997421 - protein, 10 aa, Staphylococcus
YQGDDSKQDF

SEQ ID NO: 1997422 - protein, 16 aa, Staphylococcus
YQGDYTKFKPQQFETG

SEQ ID NO: 1997423 - protein, 9 aa, Staphylococcus
YQGEDTNQA

SEQ ID NO: 1997424 - protein, 8 aa, Staphylococcus
YQGGGRGK

SEQ ID NO: 1997425 - protein, 8 aa, Staphylococcus
YQGGGRGQ

SEQ ID NO: 1997426 - protein, 17 aa, Staphylococcus
YQGKQKKLDQNAKTMQK

SEQ ID NO: 1997427 - protein, 5 aa, Staphylococcus
YQGNS

SEQ ID NO: 1997428 - protein, 6 aa, Staphylococcus
YQGQKQ

SEQ ID NO: 1997429 - protein, 9 aa, Staphylococcus
YQGQTPQSF

SEQ ID NO: 1997430 - protein, 7 aa, Staphylococcus
YQGRGYA

SEQ ID NO: 1997431 - protein, 4 aa, Staphylococcus
YQGS

SEQ ID NO: 1997432 - protein, 12 aa, Staphylococcus
YQGSHTKFTPQR

SEQ ID NO: 1997433 - protein, 5 aa, Staphylococcus
YQGSK

SEQ ID NO: 1997434 - protein, 5 aa, Staphylococcus
YQGYD

SEQ ID NO: 1997435 - protein, 6 aa, Staphylococcus
YQGYDS

SEQ ID NO: 1997436 - protein, 13 aa, Staphylococcus
YQHDATKPYNNQY

SEQ ID NO: 1997437 - protein, 18 aa, Staphylococcus
YQHTTAATYNQHVQQEKI

SEQ ID NO: 1997438 - protein, 6 aa, Staphylococcus
YQIDGE

SEQ ID NO: 1997439 - protein, 6 aa, Staphylococcus
YQIEGE

SEQ ID NO: 1997440 - protein, 8 aa, Staphylococcus
YQKAREGV

SEQ ID NO: 1997441 - protein, 9 aa, Staphylococcus
YQKDGVGQT

SEQ ID NO: 1997442 - protein, 6 aa, Staphylococcus
YQKDHE

SEQ ID NO: 1997443 - protein, 10 aa, Staphylococcus
YQKDKDTSVE

SEQ ID NO: 1997444 - protein, 11 aa, Staphylococcus
YQKGDFKSDTM

SEQ ID NO: 1997445 - protein, 19 aa, Staphylococcus
YQKGSGRKDFIEKHWGNQD

SEQ ID NO: 1997446 - protein, 9 aa, Staphylococcus
YQKGTPYEY

SEQ ID NO: 1997447 - protein, 4 aa, Staphylococcus
YQLK

SEQ ID NO: 1997448 - protein, 15 aa, Staphylococcus
YQNARKTKCNDVQII

SEQ ID NO: 1997449 - protein, 10 aa, Staphylococcus
YQNATSYESI

SEQ ID NO: 1997450 - protein, 6 aa, Staphylococcus
YQNDER

SEQ ID NO: 1997451 - protein, 10 aa, Staphylococcus
YQNEDGSITI

SEQ ID NO: 1997452 - protein, 10 aa, Staphylococcus
YQNEDGSVTI

SEQ ID NO: 1997453 - protein, 10 aa, Staphylococcus
YQNEDGTITI

SEQ ID NO: 1997454 - protein, 10 aa, Staphylococcus
YQNEDGTVTI

SEQ ID NO: 1997455 - protein, 12 aa, Staphylococcus
YQNENTKFRPKR

SEQ ID NO: 1997456 - protein, 9 aa, Staphylococcus
YQNEQLGTA

SEQ ID NO: 1997457 - protein, 9 aa, Staphylococcus
YQNKGVGQK

SEQ ID NO: 1997458 - protein, 9 aa, Staphylococcus
YQNKGVGQS

SEQ ID NO: 1997459 - protein, 13 aa, Staphylococcus
YQNKNTKFKPQRF

SEQ ID NO: 1997460 - protein, 5 aa, Staphylococcus
YQNKP

SEQ ID NO: 1997461 - protein, 7 aa, Staphylococcus
YQNNSNS

SEQ ID NO: 1997462 - protein, 12 aa, Staphylococcus
YQNQRYALFMNN

SEQ ID NO: 1997463 - protein, 7 aa, Staphylococcus
YQNRGYS

SEQ ID NO: 1997464 - protein, 4 aa, Staphylococcus
YQNT

SEQ ID NO: 1997465 - protein, 6 aa, Staphylococcus
YQPARS

SEQ ID NO: 1997466 - protein, 6 aa, Staphylococcus
YQPDDS

SEQ ID NO: 1997467 - protein, 4 aa, Staphylococcus
YQPE

SEQ ID NO: 1997468 - protein, 6 aa, Staphylococcus
YQPGDF

SEQ ID NO: 1997469 - protein, 8 aa, Staphylococcus
YQPKPGTD

SEQ ID NO: 1997470 - protein, 13 aa, Staphylococcus
YQPKRAKQGGNVT

SEQ ID NO: 1997471 - protein, 12 aa, Staphylococcus
YQPKRAQDGKRI

SEQ ID NO: 1997472 - protein, 6 aa, Staphylococcus
YQPNHA

SEQ ID NO: 1997473 - protein, 5 aa, Staphylococcus
YQPNY

SEQ ID NO: 1997474 - protein, 8 aa, Staphylococcus
YQPQTAIS

SEQ ID NO: 1997475 - protein, 8 aa, Staphylococcus
YQPQTTIS

SEQ ID NO: 1997476 - protein, 13 aa, Staphylococcus
YQPRRSSKETPVT

SEQ ID NO: 1997477 - protein, 15 aa, Staphylococcus
YQPSQKDLDMTNNQA

SEQ ID NO: 1997478 - protein, 10 aa, Staphylococcus
YQPSQSSKLS

SEQ ID NO: 1997479 - protein, 9 aa, Staphylococcus
YQPSSWNEA

SEQ ID NO: 1997480 - protein, 15 aa, Staphylococcus
YQPTARDKARMQASH

SEQ ID NO: 1997481 - protein, 10 aa, Staphylococcus
YQQAAKEIDT

SEQ ID NO: 1997482 - protein, 38 aa, Staphylococcus
YQQAQQAQQQAQDGAQQTQNDSNVEDAEFKEVNDDEDK

SEQ ID NO: 1997483 - protein, 37 aa, Staphylococcus
YQQAQQAQQQAQDNSQQSNDSNVEDAEFKEVKDDEDK

SEQ ID NO: 1997484 - protein, 35 aa, Staphylococcus
YQQAQQQAQGATGEQNQDSTVEDAEFKEVKDDEDK

SEQ ID NO: 1997485 - protein, 38 aa, Staphylococcus
YQQAQQQAQQAQGAEGNQQNDSTVEDAEFKEVKDDEDK

SEQ ID NO: 1997486 - protein, 5 aa, Staphylococcus
YQQEA

SEQ ID NO: 1997487 - protein, 11 aa, Staphylococcus
YQQEERESSEV

SEQ ID NO: 1997488 - protein, 9 aa, Staphylococcus
YQQGTPYEY

SEQ ID NO: 1997489 - protein, 9 aa, Staphylococcus
YQQTASYDK

SEQ ID NO: 1997490 - protein, 5 aa, Staphylococcus
YQQTI

SEQ ID NO: 1997491 - protein, 5 aa, Staphylococcus
YQQTK

SEQ ID NO: 1997492 - protein, 7 aa, Staphylococcus
YQQTPDN

SEQ ID NO: 1997493 - protein, 11 aa, Staphylococcus
YQREKAANKYF

SEQ ID NO: 1997494 - protein, 17 aa, Staphylococcus
YQRKDQEGTFHTHWAEE

SEQ ID NO: 1997495 - protein, 7 aa, Staphylococcus
YQRSKED

SEQ ID NO: 1997496 - protein, 8 aa, Staphylococcus
YQRSSGVD

SEQ ID NO: 1997497 - protein, 9 aa, Staphylococcus
YQRSSTQDV

SEQ ID NO: 1997498 - protein, 14 aa, Staphylococcus
YQSDIPKDLKRNEK

SEQ ID NO: 1997499 - protein, 6 aa, Staphylococcus
YQSEGT

SEQ ID NO: 1997500 - protein, 7 aa, Staphylococcus
YQSEQAQ

SEQ ID NO: 1997501 - protein, 7 aa, Staphylococcus
YQSGTEY

SEQ ID NO: 1997502 - protein, 11 aa, Staphylococcus
YQSHGRDRSGV

SEQ ID NO: 1997503 - protein, 13 aa, Staphylococcus
YQSHTLKSHLDIN

SEQ ID NO: 1997504 - protein, 5 aa, Staphylococcus
YQSLG

SEQ ID NO: 1997505 - protein, 14 aa, Staphylococcus
YQSMTQLESETVEG

SEQ ID NO: 1997506 - protein, 6 aa, Staphylococcus
YQSNHL

SEQ ID NO: 1997507 - protein, 6 aa, Staphylococcus
YQSNKL

SEQ ID NO: 1997508 - protein, 4 aa, Staphylococcus
YQSP

SEQ ID NO: 1997509 - protein, 7 aa, Staphylococcus
YQSPITA

SEQ ID NO: 1997510 - protein, 4 aa, Staphylococcus
YQSQ

SEQ ID NO: 1997511 - protein, 14 aa, Staphylococcus
YQSSDFKGEEKVGP

SEQ ID NO: 1997512 - protein, 11 aa, Staphylococcus
YQSSGGEQQRV

SEQ ID NO: 1997513 - protein, 8 aa, Staphylococcus
YQSSPTYD

SEQ ID NO: 1997514 - protein, 15 aa, Staphylococcus
YQSSYSKFKPQRFET

SEQ ID NO: 1997515 - protein, 9 aa, Staphylococcus
YQSTSDIQE

SEQ ID NO: 1997516 - protein, 8 aa, Staphylococcus
YQSTTGIA

SEQ ID NO: 1997517 - protein, 7 aa, Staphylococcus
YQTAGTF

SEQ ID NO: 1997518 - protein, 10 aa, Staphylococcus
YQTATQAGEM

SEQ ID NO: 1997519 - protein, 9 aa, Staphylococcus
YQTDDVTTR

SEQ ID NO: 1997520 - protein, 5 aa, Staphylococcus
YQTED

SEQ ID NO: 1997521 - protein, 5 aa, Staphylococcus
YQTGR

SEQ ID NO: 1997522 - protein, 10 aa, Staphylococcus
YQTIDDERGI

SEQ ID NO: 1997523 - protein, 5 aa, Staphylococcus
YQTIQ

SEQ ID NO: 1997524 - protein, 11 aa, Staphylococcus
YQTPDNSSSKT

SEQ ID NO: 1997525 - protein, 5 aa, Staphylococcus
YQTPF

SEQ ID NO: 1997526 - protein, 15 aa, Staphylococcus
YQTPSKSDASTPVGP

SEQ ID NO: 1997527 - protein, 4 aa, Staphylococcus
YQTR

SEQ ID NO: 1997528 - protein, 13 aa, Staphylococcus
YQTRRNIKRTEEM

SEQ ID NO: 1997529 - protein, 11 aa, Staphylococcus
YQTSAKEKSVL

SEQ ID NO: 1997530 - protein, 5 aa, Staphylococcus
YQTTK

SEQ ID NO: 1997531 - protein, 10 aa, Staphylococcus
YQVSGGEQQR

SEQ ID NO: 1997532 - protein, 11 aa, Staphylococcus
YQYANANDFAN

SEQ ID NO: 1997533 - protein, 5 aa, Staphylococcus
YQYDS

SEQ ID NO: 1997534 - protein, 12 aa, Staphylococcus
YQYGDQIPSENE

SEQ ID NO: 1997535 - protein, 7 aa, Staphylococcus
YQYSEAE

SEQ ID NO: 1997536 - protein, 4 aa, Staphylococcus
YRAD

SEQ ID NO: 1997537 - protein, 8 aa, Staphylococcus
YRADRDEV

SEQ ID NO: 1997538 - protein, 13 aa, Staphylococcus
YRAQGSQGYGGEY

SEQ ID NO: 1997539 - protein, 11 aa, Staphylococcus
YRDKEKNYDMS

SEQ ID NO: 1997540 - protein, 19 aa, Staphylococcus
YRDQPTSKIFEGKKGQQEI

SEQ ID NO: 1997541 - protein, 25 aa, Staphylococcus
YRDSNDDIGSYRPHSSNDHSSYDSF

SEQ ID NO: 1997542 - protein, 6 aa, Staphylococcus
YREASQ

SEQ ID NO: 1997543 - protein, 9 aa, Staphylococcus
YREDRDEVR

SEQ ID NO: 1997544 - protein, 7 aa, Staphylococcus
YREDRDH

SEQ ID NO: 1997545 - protein, 11 aa, Staphylococcus
YREGSENNRQI

SEQ ID NO: 1997546 - protein, 5 aa, Staphylococcus
YRENN

SEQ ID NO: 1997547 - protein, 6 aa, Staphylococcus
YREQEQ

SEQ ID NO: 1997548 - protein, 7 aa, Staphylococcus
YRESIKG

SEQ ID NO: 1997549 - protein, 10 aa, Staphylococcus
YRESKDEIAN

SEQ ID NO: 1997550 - protein, 18 aa, Staphylococcus
YRESYTKEDLFNKILKDA

SEQ ID NO: 1997551 - protein, 11 aa, Staphylococcus
YRETGTSSTLK

SEQ ID NO: 1997552 - protein, 5 aa, Staphylococcus
YRGAA

SEQ ID NO: 1997553 - protein, 12 aa, Staphylococcus
YRGGKNNQATLS

SEQ ID NO: 1997554 - protein, 5 aa, Staphylococcus
YRGHG

SEQ ID NO: 1997555 - protein, 7 aa, Staphylococcus
YRGMGKE

SEQ ID NO: 1997556 - protein, 8 aa, Staphylococcus
YRGNKTSL

SEQ ID NO: 1997557 - protein, 11 aa, Staphylococcus
YRGNLKDSEAF

SEQ ID NO: 1997558 - protein, 15 aa, Staphylococcus
YRGNNGSEGKDEFYR

SEQ ID NO: 1997559 - protein, 6 aa, Staphylococcus
YRGNPY

SEQ ID NO: 1997560 - protein, 10 aa, Staphylococcus
YRGRIGSGQI

SEQ ID NO: 1997561 - protein, 4 aa, Staphylococcus
YRGS

SEQ ID NO: 1997562 - protein, 13 aa, Staphylococcus
YRGSNGSEGKDEF

SEQ ID NO: 1997563 - protein, 16 aa, Staphylococcus
YRGSNGSEGRDEFANA

SEQ ID NO: 1997564 - protein, 6 aa, Staphylococcus
YRGYDS

SEQ ID NO: 1997565 - protein, 7 aa, Staphylococcus
YRGYDSA

SEQ ID NO: 1997566 - protein, 6 aa, Staphylococcus
YRHTGN

SEQ ID NO: 1997567 - protein, 8 aa, Staphylococcus
YRIDTEDD

SEQ ID NO: 1997568 - protein, 10 aa, Staphylococcus
YRIEGQKTGA

SEQ ID NO: 1997569 - protein, 4 aa, Staphylococcus
YRIS

SEQ ID NO: 1997570 - protein, 18 aa, Staphylococcus
YRKAAQSLEIDERSLDEI

SEQ ID NO: 1997571 - protein, 11 aa, Staphylococcus
YRKAAQSLEMD

SEQ ID NO: 1997572 - protein, 16 aa, Staphylococcus
YRKAAQSLEMDERPLE

SEQ ID NO: 1997573 - protein, 16 aa, Staphylococcus
YRKAAQSLEVDERPLD

SEQ ID NO: 1997574 - protein, 8 aa, Staphylococcus
YRKDGYGK

SEQ ID NO: 1997575 - protein, 10 aa, Staphylococcus
YRKKDTANEI

SEQ ID NO: 1997576 - protein, 7 aa, Staphylococcus
YRKRDTA

SEQ ID NO: 1997577 - protein, 5 aa, Staphylococcus
YRKRY

SEQ ID NO: 1997578 - protein, 9 aa, Staphylococcus
YRKRYDERY

SEQ ID NO: 1997579 - protein, 13 aa, Staphylococcus
YRKSTSAEAIQSH

SEQ ID NO: 1997580 - protein, 9 aa, Staphylococcus
YRKTGESSY

SEQ ID NO: 1997581 - protein, 9 aa, Staphylococcus
YRKTNGEEA

SEQ ID NO: 1997582 - protein, 11 aa, Staphylococcus
YRLDGDNVRHG

SEQ ID NO: 1997583 - protein, 9 aa, Staphylococcus
YRNGENNQI

SEQ ID NO: 1997584 - protein, 10 aa, Staphylococcus
YRNGRNNDVT

SEQ ID NO: 1997585 - protein, 4 aa, Staphylococcus
YRNH

SEQ ID NO: 1997586 - protein, 7 aa, Staphylococcus
YRNKGFG

SEQ ID NO: 1997587 - protein, 7 aa, Staphylococcus
YRNKGLG

SEQ ID NO: 1997588 - protein, 7 aa, Staphylococcus
YRNMGQG

SEQ ID NO: 1997589 - protein, 10 aa, Staphylococcus
YRNNPPRTIN

SEQ ID NO: 1997590 - protein, 8 aa, Staphylococcus
YRNNTDKK

SEQ ID NO: 1997591 - protein, 9 aa, Staphylococcus
YRNQDGEIV

SEQ ID NO: 1997592 - protein, 6 aa, Staphylococcus
YRNQGL

SEQ ID NO: 1997593 - protein, 24 aa, Staphylococcus
YRNQTGDDTEPYTIGGGTYARNLD

SEQ ID NO: 1997594 - protein, 24 aa, Staphylococcus
YRNQTGDLSEPYTIGGGTYARNLD

SEQ ID NO: 1997595 - protein, 23 aa, Staphylococcus
YRNQTGDMSEPYTIGGGTYARNL

SEQ ID NO: 1997596 - protein, 24 aa, Staphylococcus
YRNQTGDMTEPYTIGGGTYARNLD

SEQ ID NO: 1997597 - protein, 10 aa, Staphylococcus
YRNVSNKNAS

SEQ ID NO: 1997598 - protein, 14 aa, Staphylococcus
YRPGFQEVKYLKSE

SEQ ID NO: 1997599 - protein, 4 aa, Staphylococcus
YRPH

SEQ ID NO: 1997600 - protein, 5 aa, Staphylococcus
YRPHS

SEQ ID NO: 1997601 - protein, 5 aa, Staphylococcus
YRPNA

SEQ ID NO: 1997602 - protein, 18 aa, Staphylococcus
YRPNAVARGLASKRTTTV

SEQ ID NO: 1997603 - protein, 11 aa, Staphylococcus
YRPSSPSRSAT

SEQ ID NO: 1997604 - protein, 6 aa, Staphylococcus
YRQDSV

SEQ ID NO: 1997605 - protein, 8 aa, Staphylococcus
YRQGQTHT

SEQ ID NO: 1997606 - protein, 6 aa, Staphylococcus
YRQKDT

SEQ ID NO: 1997607 - protein, 10 aa, Staphylococcus
YRQKDTKVTV

SEQ ID NO: 1997608 - protein, 11 aa, Staphylococcus
YRQNGQSTALE

SEQ ID NO: 1997609 - protein, 8 aa, Staphylococcus
YRQQDGSS

SEQ ID NO: 1997610 - protein, 11 aa, Staphylococcus
YRQQDTEVSVE

SEQ ID NO: 1997611 - protein, 7 aa, Staphylococcus
YRQRETI

SEQ ID NO: 1997612 - protein, 11 aa, Staphylococcus
YRQSGQSSALE

SEQ ID NO: 1997613 - protein, 10 aa, Staphylococcus
YRQSKRGTLK

SEQ ID NO: 1997614 - protein, 10 aa, Staphylococcus
YRQTGESEVL

SEQ ID NO: 1997615 - protein, 4 aa, Staphylococcus
YRRG

SEQ ID NO: 1997616 - protein, 7 aa, Staphylococcus
YRRKTGS

SEQ ID NO: 1997617 - protein, 9 aa, Staphylococcus
YRRPATDRR

SEQ ID NO: 1997618 - protein, 10 aa, Staphylococcus
YRRSQLDEEM

SEQ ID NO: 1997619 - protein, 7 aa, Staphylococcus
YRSEDLP

SEQ ID NO: 1997620 - protein, 6 aa, Staphylococcus
YRSEVA

SEQ ID NO: 1997621 - protein, 4 aa, Staphylococcus
YRSG

SEQ ID NO: 1997622 - protein, 12 aa, Staphylococcus
YRSGKNNDIEMS

SEQ ID NO: 1997623 - protein, 9 aa, Staphylococcus
YRSGTQAQK

SEQ ID NO: 1997624 - protein, 5 aa, Staphylococcus
YRSID

SEQ ID NO: 1997625 - protein, 7 aa, Staphylococcus
YRSQGKT

SEQ ID NO: 1997626 - protein, 9 aa, Staphylococcus
YRSSDGDTI

SEQ ID NO: 1997627 - protein, 9 aa, Staphylococcus
YRSYQNKAK

SEQ ID NO: 1997628 - protein, 4 aa, Staphylococcus
YRTG

SEQ ID NO: 1997629 - protein, 5 aa, Staphylococcus
YRVEE

SEQ ID NO: 1997630 - protein, 4 aa, Staphylococcus
YRVS

SEQ ID NO: 1997631 - protein, 11 aa, Staphylococcus
YRYANSNDFAN

SEQ ID NO: 1997632 - protein, 11 aa, Staphylococcus
YRYANSNEFAN

SEQ ID NO: 1997633 - protein, 10 aa, Staphylococcus
YSAKARKNQL

SEQ ID NO: 1997634 - protein, 8 aa, Staphylococcus
YSASKHAV

SEQ ID NO: 1997635 - protein, 5 aa, Staphylococcus
YSATL

SEQ ID NO: 1997636 - protein, 9 aa, Staphylococcus
YSATTDINQ

SEQ ID NO: 1997637 - protein, 9 aa, Staphylococcus
YSATTDINT

SEQ ID NO: 1997638 - protein, 6 aa, Staphylococcus
YSCSPK

SEQ ID NO: 1997639 - protein, 5 aa, Staphylococcus
YSDAA

SEQ ID NO: 1997640 - protein, 6 aa, Staphylococcus
YSDAAG

SEQ ID NO: 1997641 - protein, 7 aa, Staphylococcus
YSDDDEI

SEQ ID NO: 1997642 - protein, 12 aa, Staphylococcus
YSDEEITDLEGS

SEQ ID NO: 1997643 - protein, 9 aa, Staphylococcus
YSDEHIKEA

SEQ ID NO: 1997644 - protein, 4 aa, Staphylococcus
YSDI

SEQ ID NO: 1997645 - protein, 10 aa, Staphylococcus
YSDKTKQIFT

SEQ ID NO: 1997646 - protein, 11 aa, Staphylococcus
YSDNATDASYE

SEQ ID NO: 1997647 - protein, 6 aa, Staphylococcus
YSDNGY

SEQ ID NO: 1997648 - protein, 14 aa, Staphylococcus
YSDNIKTYESHGDE

SEQ ID NO: 1997649 - protein, 6 aa, Staphylococcus
YSDNNV

SEQ ID NO: 1997650 - protein, 7 aa, Staphylococcus
YSDNQPF

SEQ ID NO: 1997651 - protein, 5 aa, Staphylococcus
YSDQL

SEQ ID NO: 1997652 - protein, 12 aa, Staphylococcus
YSDRAKDRFAEV

SEQ ID NO: 1997653 - protein, 5 aa, Staphylococcus
YSDSD

SEQ ID NO: 1997654 - protein, 5 aa, Staphylococcus
YSDTL

SEQ ID NO: 1997655 - protein, 17 aa, Staphylococcus
YSEATKRLEKADGFIRN

SEQ ID NO: 1997656 - protein, 6 aa, Staphylococcus
YSEEAA

SEQ ID NO: 1997657 - protein, 16 aa, Staphylococcus
YSEEDDKWTVVETFEL

SEQ ID NO: 1997658 - protein, 7 aa, Staphylococcus
YSEEDLK

SEQ ID NO: 1997659 - protein, 6 aa, Staphylococcus
YSEEEL

SEQ ID NO: 1997660 - protein, 5 aa, Staphylococcus
YSEGD

SEQ ID NO: 1997661 - protein, 12 aa, Staphylococcus
YSEGDKDALHTQ

SEQ ID NO: 1997662 - protein, 14 aa, Staphylococcus
YSEGQKQAYTDEVN

SEQ ID NO: 1997663 - protein, 9 aa, Staphylococcus
YSENATNDT

SEQ ID NO: 1997664 - protein, 6 aa, Staphylococcus
YSENYN

SEQ ID NO: 1997665 - protein, 4 aa, Staphylococcus
YSES

SEQ ID NO: 1997666 - protein, 7 aa, Staphylococcus
YSESLYK

SEQ ID NO: 1997667 - protein, 6 aa, Staphylococcus
YSETDQ

SEQ ID NO: 1997668 - protein, 5 aa, Staphylococcus
YSETE

SEQ ID NO: 1997669 - protein, 9 aa, Staphylococcus
YSETKKERI

SEQ ID NO: 1997670 - protein, 17 aa, Staphylococcus
YSEYKGGRQSTPPELSE

SEQ ID NO: 1997671 - protein, 8 aa, Staphylococcus
YSFNSPKG

SEQ ID NO: 1997672 - protein, 13 aa, Staphylococcus
YSFSDDATALGAP

SEQ ID NO: 1997673 - protein, 15 aa, Staphylococcus
YSFSDDQTALGAPSD

SEQ ID NO: 1997674 - protein, 15 aa, Staphylococcus
YSFSDDQTALGAPTD

SEQ ID NO: 1997675 - protein, 15 aa, Staphylococcus
YSFTDDATELGAPEG

SEQ ID NO: 1997676 - protein, 15 aa, Staphylococcus
YSFTDDKDRLGAPDD

SEQ ID NO: 1997677 - protein, 7 aa, Staphylococcus
YSFTTKQ

SEQ ID NO: 1997678 - protein, 8 aa, Staphylococcus
YSGAGKST

SEQ ID NO: 1997679 - protein, 9 aa, Staphylococcus
YSGDAKSHA

SEQ ID NO: 1997680 - protein, 7 aa, Staphylococcus
YSGETIE

SEQ ID NO: 1997681 - protein, 7 aa, Staphylococcus
YSGETRE

SEQ ID NO: 1997682 - protein, 5 aa, Staphylococcus
YSGGD

SEQ ID NO: 1997683 - protein, 4 aa, Staphylococcus
YSGH

SEQ ID NO: 1997684 - protein, 4 aa, Staphylococcus
YSGK

SEQ ID NO: 1997685 - protein, 8 aa, Staphylococcus
YSGKDSDY

SEQ ID NO: 1997686 - protein, 7 aa, Staphylococcus
YSGNDDN

SEQ ID NO: 1997687 - protein, 12 aa, Staphylococcus
YSGPHTDDYEAK

SEQ ID NO: 1997688 - protein, 13 aa, Staphylococcus
YSGPHTDKYDAEQ

SEQ ID NO: 1997689 - protein, 5 aa, Staphylococcus
YSHTP

SEQ ID NO: 1997690 - protein, 15 aa, Staphylococcus
YSIGNSLDSTLKPAQ

SEQ ID NO: 1997691 - protein, 4 aa, Staphylococcus
YSKE

SEQ ID NO: 1997692 - protein, 22 aa, Staphylococcus
YSKEKLKIPSSSDEQKKIGTSL

SEQ ID NO: 1997693 - protein, 8 aa, Staphylococcus
YSKEKLRT

SEQ ID NO: 1997694 - protein, 10 aa, Staphylococcus
YSKEREKGEH

SEQ ID NO: 1997695 - protein, 14 aa, Staphylococcus
YSKGRMKEADYEQV

SEQ ID NO: 1997696 - protein, 14 aa, Staphylococcus
YSKGRMKKEDHEKV

SEQ ID NO: 1997697 - protein, 9 aa, Staphylococcus
YSKGTGKWN

SEQ ID NO: 1997698 - protein, 9 aa, Staphylococcus
YSKKTISAI

SEQ ID NO: 1997699 - protein, 7 aa, Staphylococcus
YSKLNKS

SEQ ID NO: 1997700 - protein, 9 aa, Staphylococcus
YSKNKNLDI

SEQ ID NO: 1997701 - protein, 13 aa, Staphylococcus
YSKQDDEDSAVAS

SEQ ID NO: 1997702 - protein, 21 aa, Staphylococcus
YSKQDNNDIKGKVSNTPSRRV

SEQ ID NO: 1997703 - protein, 11 aa, Staphylococcus
YSKQGEKRSYK

SEQ ID NO: 1997704 - protein, 13 aa, Staphylococcus
YSKQNSEDSAIAS

SEQ ID NO: 1997705 - protein, 15 aa, Staphylococcus
YSKREISKVEKTLQQ

SEQ ID NO: 1997706 - protein, 9 aa, Staphylococcus
YSKRELNKV

SEQ ID NO: 1997707 - protein, 33 aa, Staphylococcus
YSKRELTKVEKSLSKETFDSVDDAVKRGLQLLI

SEQ ID NO: 1997708 - protein, 8 aa, Staphylococcus
YSKRETID

SEQ ID NO: 1997709 - protein, 9 aa, Staphylococcus
YSKRSEEFK

SEQ ID NO: 1997710 - protein, 10 aa, Staphylococcus
YSKSEAKKRA

SEQ ID NO: 1997711 - protein, 9 aa, Staphylococcus
YSKSENDYG

SEQ ID NO: 1997712 - protein, 20 aa, Staphylococcus
YSKSISDAARKHSQDTVENS

SEQ ID NO: 1997713 - protein, 12 aa, Staphylococcus
YSKSITANKEAI

SEQ ID NO: 1997714 - protein, 13 aa, Staphylococcus
YSKSITSTKQEAI

SEQ ID NO: 1997715 - protein, 12 aa, Staphylococcus
YSKSITTHKEAI

SEQ ID NO: 1997716 - protein, 4 aa, Staphylococcus
YSKT

SEQ ID NO: 1997717 - protein, 10 aa, Staphylococcus
YSKTATNDRY

SEQ ID NO: 1997718 - protein, 15 aa, Staphylococcus
YSKTGSHIVPFISKE

SEQ ID NO: 1997719 - protein, 15 aa, Staphylococcus
YSKTGTHIIPNGKEE

SEQ ID NO: 1997720 - protein, 17 aa, Staphylococcus
YSKTGTHVVPYIKKEMK

SEQ ID NO: 1997721 - protein, 8 aa, Staphylococcus
YSKTNKLD

SEQ ID NO: 1997722 - protein, 7 aa, Staphylococcus
YSKTRRG

SEQ ID NO: 1997723 - protein, 7 aa, Staphylococcus
YSLGGPE

SEQ ID NO: 1997724 - protein, 13 aa, Staphylococcus
YSLNESEAYHTQD

SEQ ID NO: 1997725 - protein, 4 aa, Staphylococcus
YSLT

SEQ ID NO: 1997726 - protein, 16 aa, Staphylococcus
YSLTPKQFQIKYAKYL

SEQ ID NO: 1997727 - protein, 18 aa, Staphylococcus
YSNEDKSSLHRYKADESY

SEQ ID NO: 1997728 - protein, 9 aa, Staphylococcus
YSNEETQQF

SEQ ID NO: 1997729 - protein, 22 aa, Staphylococcus
YSNEIKKNKITKYNLKQSKKNI

SEQ ID NO: 1997730 - protein, 10 aa, Staphylococcus
YSNEKPQYTK

SEQ ID NO: 1997731 - protein, 6 aa, Staphylococcus
YSNEND

SEQ ID NO: 1997732 - protein, 7 aa, Staphylococcus
YSNENNL

SEQ ID NO: 1997733 - protein, 4 aa, Staphylococcus
YSNG

SEQ ID NO: 1997734 - protein, 13 aa, Staphylococcus
YSNHTRSKETIAF

SEQ ID NO: 1997735 - protein, 9 aa, Staphylococcus
YSNNDDGIG

SEQ ID NO: 1997736 - protein, 9 aa, Staphylococcus
YSNNEDGIG

SEQ ID NO: 1997737 - protein, 7 aa, Staphylococcus
YSNPEED

SEQ ID NO: 1997738 - protein, 11 aa, Staphylococcus
YSNPGKNGGYT

SEQ ID NO: 1997739 - protein, 9 aa, Staphylococcus
YSNQEIASA

SEQ ID NO: 1997740 - protein, 6 aa, Staphylococcus
YSNQEK

SEQ ID NO: 1997741 - protein, 6 aa, Staphylococcus
YSNSGK

SEQ ID NO: 1997742 - protein, 9 aa, Staphylococcus
YSNSPNAIT

SEQ ID NO: 1997743 - protein, 8 aa, Staphylococcus
YSNSRGHL

SEQ ID NO: 1997744 - protein, 8 aa, Staphylococcus
YSNTHSDK

SEQ ID NO: 1997745 - protein, 8 aa, Staphylococcus
YSNYKNAT

SEQ ID NO: 1997746 - protein, 4 aa, Staphylococcus
YSPA

SEQ ID NO: 1997747 - protein, 9 aa, Staphylococcus
YSPDTPDLY

SEQ ID NO: 1997748 - protein, 4 aa, Staphylococcus
YSPE

SEQ ID NO: 1997749 - protein, 6 aa, Staphylococcus
YSPEEV

SEQ ID NO: 1997750 - protein, 9 aa, Staphylococcus
YSPEKQLEQ

SEQ ID NO: 1997751 - protein, 9 aa, Staphylococcus
YSPKSYGGS

SEQ ID NO: 1997752 - protein, 4 aa, Staphylococcus
YSPL

SEQ ID NO: 1997753 - protein, 4 aa, Staphylococcus
YSPN

SEQ ID NO: 1997754 - protein, 6 aa, Staphylococcus
YSPNTQ

SEQ ID NO: 1997755 - protein, 7 aa, Staphylococcus
YSPQATY

SEQ ID NO: 1997756 - protein, 12 aa, Staphylococcus
YSPQIPRSLGNN

SEQ ID NO: 1997757 - protein, 7 aa, Staphylococcus
YSPTTFQ

SEQ ID NO: 1997758 - protein, 8 aa, Staphylococcus
YSPYPEEM

SEQ ID NO: 1997759 - protein, 6 aa, Staphylococcus
YSQKSQ

SEQ ID NO: 1997760 - protein, 16 aa, Staphylococcus
YSQPAQEVNDASNEIT

SEQ ID NO: 1997761 - protein, 16 aa, Staphylococcus
YSQPAQEVNDATNEIS

SEQ ID NO: 1997762 - protein, 16 aa, Staphylococcus
YSQPAQEVNNASNEIT

SEQ ID NO: 1997763 - protein, 15 aa, Staphylococcus
YSQPAQEVSGATNEI

SEQ ID NO: 1997764 - protein, 15 aa, Staphylococcus
YSQPAQEVSGTTNEI

SEQ ID NO: 1997765 - protein, 4 aa, Staphylococcus
YSQR

SEQ ID NO: 1997766 - protein, 6 aa, Staphylococcus
YSQTKM

SEQ ID NO: 1997767 - protein, 5 aa, Staphylococcus
YSQTS

SEQ ID NO: 1997768 - protein, 12 aa, Staphylococcus
YSQVSDQAKKDG

SEQ ID NO: 1997769 - protein, 5 aa, Staphylococcus
YSRES

SEQ ID NO: 1997770 - protein, 5 aa, Staphylococcus
YSRKL

SEQ ID NO: 1997771 - protein, 4 aa, Staphylococcus
YSRN

SEQ ID NO: 1997772 - protein, 10 aa, Staphylococcus
YSRPTPEDSA

SEQ ID NO: 1997773 - protein, 5 aa, Staphylococcus
YSRQE

SEQ ID NO: 1997774 - protein, 9 aa, Staphylococcus
YSSDESQQF

SEQ ID NO: 1997775 - protein, 4 aa, Staphylococcus
YSSE

SEQ ID NO: 1997776 - protein, 15 aa, Staphylococcus
YSSEELSDTGLRAAG

SEQ ID NO: 1997777 - protein, 8 aa, Staphylococcus
YSSEGLEK

SEQ ID NO: 1997778 - protein, 5 aa, Staphylococcus
YSSEK

SEQ ID NO: 1997779 - protein, 4 aa, Staphylococcus
YSSF

SEQ ID NO: 1997780 - protein, 5 aa, Staphylococcus
YSSKS

SEQ ID NO: 1997781 - protein, 7 aa, Staphylococcus
YSSKSIT

SEQ ID NO: 1997782 - protein, 4 aa, Staphylococcus
YSSN

SEQ ID NO: 1997783 - protein, 9 aa, Staphylococcus
YSSNDGACE

SEQ ID NO: 1997784 - protein, 16 aa, Staphylococcus
YSSNISNTARKHSEDM

SEQ ID NO: 1997785 - protein, 5 aa, Staphylococcus
YSSQG

SEQ ID NO: 1997786 - protein, 11 aa, Staphylococcus
YSSQKQDLDGN

SEQ ID NO: 1997787 - protein, 13 aa, Staphylococcus
YSSQKQDLNEDKT

SEQ ID NO: 1997788 - protein, 10 aa, Staphylococcus
YSSSETQQRL

SEQ ID NO: 1997789 - protein, 18 aa, Staphylococcus
YSSSQSKTSTSKQSSIQY

SEQ ID NO: 1997790 - protein, 9 aa, Staphylococcus
YSSSSERAC

SEQ ID NO: 1997791 - protein, 9 aa, Staphylococcus
YSSTEYDDE

SEQ ID NO: 1997792 - protein, 5 aa, Staphylococcus
YSSTL

SEQ ID NO: 1997793 - protein, 6 aa, Staphylococcus
YSSTSR

SEQ ID NO: 1997794 - protein, 14 aa, Staphylococcus
YSTDELSSTGLRAA

SEQ ID NO: 1997795 - protein, 5 aa, Staphylococcus
YSTDQ

SEQ ID NO: 1997796 - protein, 6 aa, Staphylococcus
YSTDTF

SEQ ID NO: 1997797 - protein, 15 aa, Staphylococcus
YSTEELSDTGLRAAG

SEQ ID NO: 1997798 - protein, 8 aa, Staphylococcus
YSTELTNK

SEQ ID NO: 1997799 - protein, 11 aa, Staphylococcus
YSTGGKNGGYK

SEQ ID NO: 1997800 - protein, 19 aa, Staphylococcus
YSTGGTKGALEDASVPVKS

SEQ ID NO: 1997801 - protein, 19 aa, Staphylococcus
YSTGGTKRALDEAGVPVKS

SEQ ID NO: 1997802 - protein, 13 aa, Staphylococcus
YSTGGTKRALEDA

SEQ ID NO: 1997803 - protein, 14 aa, Staphylococcus
YSTGGTKRALEEAN

SEQ ID NO: 1997804 - protein, 9 aa, Staphylococcus
YSTGGTKRI

SEQ ID NO: 1997805 - protein, 9 aa, Staphylococcus
YSTGGTKRV

SEQ ID NO: 1997806 - protein, 9 aa, Staphylococcus
YSTGGTMRE

SEQ ID NO: 1997807 - protein, 7 aa, Staphylococcus
YSTGSEE

SEQ ID NO: 1997808 - protein, 7 aa, Staphylococcus
YSTGYSQ

SEQ ID NO: 1997809 - protein, 8 aa, Staphylococcus
YSTHPQGG

SEQ ID NO: 1997810 - protein, 20 aa, Staphylococcus
YSTHTRSNMGGYKGRSLKKD

SEQ ID NO: 1997811 - protein, 9 aa, Staphylococcus
YSTKMGKRN

SEQ ID NO: 1997812 - protein, 14 aa, Staphylococcus
YSTNELSDTGLRAA

SEQ ID NO: 1997813 - protein, 6 aa, Staphylococcus
YSTNLK

SEQ ID NO: 1997814 - protein, 10 aa, Staphylococcus
YSTNLNADTE

SEQ ID NO: 1997815 - protein, 6 aa, Staphylococcus
YSTNNE

SEQ ID NO: 1997816 - protein, 9 aa, Staphylococcus
YSTNPKGGV

SEQ ID NO: 1997817 - protein, 7 aa, Staphylococcus
YSTNPLG

SEQ ID NO: 1997818 - protein, 14 aa, Staphylococcus
YSTNRRDAKPFDGL

SEQ ID NO: 1997819 - protein, 4 aa, Staphylococcus
YSTP

SEQ ID NO: 1997820 - protein, 10 aa, Staphylococcus
YSTPEKANDL

SEQ ID NO: 1997821 - protein, 6 aa, Staphylococcus
YSTQEI

SEQ ID NO: 1997822 - protein, 7 aa, Staphylococcus
YSTQKGD

SEQ ID NO: 1997823 - protein, 8 aa, Staphylococcus
YSTQPQGG

SEQ ID NO: 1997824 - protein, 14 aa, Staphylococcus
YSTSELSDTGLRAA

SEQ ID NO: 1997825 - protein, 5 aa, Staphylococcus
YSTTT

SEQ ID NO: 1997826 - protein, 12 aa, Staphylococcus
YSTTTEDQTGEV

SEQ ID NO: 1997827 - protein, 21 aa, Staphylococcus
YSTVSKALKNSQLVKPNTKQM

SEQ ID NO: 1997828 - protein, 9 aa, Staphylococcus
YSVNNNNQV

SEQ ID NO: 1997829 - protein, 13 aa, Staphylococcus
YSVPNQPKKEEIQ

SEQ ID NO: 1997830 - protein, 13 aa, Staphylococcus
YSYEANRENWLYE

SEQ ID NO: 1997831 - protein, 16 aa, Staphylococcus
YSYESGYVSAKNKLTK

SEQ ID NO: 1997832 - protein, 4 aa, Staphylococcus
YTAD

SEQ ID NO: 1997833 - protein, 9 aa, Staphylococcus
YTADEKTKI

SEQ ID NO: 1997834 - protein, 10 aa, Staphylococcus
YTAEDVGTSE

SEQ ID NO: 1997835 - protein, 15 aa, Staphylococcus
YTAEEAVEKAKELDS

SEQ ID NO: 1997836 - protein, 5 aa, Staphylococcus
YTAEF

SEQ ID NO: 1997837 - protein, 11 aa, Staphylococcus
YTAENGKIELD

SEQ ID NO: 1997838 - protein, 29 aa, Staphylococcus
YTAEQKNEFSKEVDEAIEEATHGNHQPAE

SEQ ID NO: 1997839 - protein, 6 aa, Staphylococcus
YTAETN

SEQ ID NO: 1997840 - protein, 9 aa, Staphylococcus
YTARKGLRT

SEQ ID NO: 1997841 - protein, 14 aa, Staphylococcus
YTASKPKLKGDQGM

SEQ ID NO: 1997842 - protein, 7 aa, Staphylococcus
YTDDEGY

SEQ ID NO: 1997843 - protein, 31 aa, Staphylococcus
YTDDNGDGKPETINGSPAGDVGQGGVPGETV

SEQ ID NO: 1997844 - protein, 4 aa, Staphylococcus
YTDK

SEQ ID NO: 1997845 - protein, 7 aa, Staphylococcus
YTDKSTV

SEQ ID NO: 1997846 - protein, 12 aa, Staphylococcus
YTDNKTGEKHQI

SEQ ID NO: 1997847 - protein, 14 aa, Staphylococcus
YTDSEKKPSKNFNQ

SEQ ID NO: 1997848 - protein, 10 aa, Staphylococcus
YTDSTKAKEI

SEQ ID NO: 1997849 - protein, 4 aa, Staphylococcus
YTEA

SEQ ID NO: 1997850 - protein, 5 aa, Staphylococcus
YTEDD

SEQ ID NO: 1997851 - protein, 7 aa, Staphylococcus
YTEDENT

SEQ ID NO: 1997852 - protein, 5 aa, Staphylococcus
YTEDK

SEQ ID NO: 1997853 - protein, 8 aa, Staphylococcus
YTEDPQRD

SEQ ID NO: 1997854 - protein, 8 aa, Staphylococcus
YTEDPTKD

SEQ ID NO: 1997855 - protein, 5 aa, Staphylococcus
YTEDT

SEQ ID NO: 1997856 - protein, 9 aa, Staphylococcus
YTEEDADNM

SEQ ID NO: 1997857 - protein, 7 aa, Staphylococcus
YTEEQTI

SEQ ID NO: 1997858 - protein, 11 aa, Staphylococcus
YTEKEDEKRNA

SEQ ID NO: 1997859 - protein, 9 aa, Staphylococcus
YTEKGTPRL

SEQ ID NO: 1997860 - protein, 11 aa, Staphylococcus
YTEKNIKNNQY

SEQ ID NO: 1997861 - protein, 11 aa, Staphylococcus
YTEKNVSNSTF

SEQ ID NO: 1997862 - protein, 9 aa, Staphylococcus
YTENEPRQF

SEQ ID NO: 1997863 - protein, 8 aa, Staphylococcus
YTENPQRD

SEQ ID NO: 1997864 - protein, 6 aa, Staphylococcus
YTEQDV

SEQ ID NO: 1997865 - protein, 7 aa, Staphylococcus
YTEQEVD

SEQ ID NO: 1997866 - protein, 12 aa, Staphylococcus
YTEQSTEGLQEA

SEQ ID NO: 1997867 - protein, 20 aa, Staphylococcus
YTESGKIARGKMKTKYLNGE

SEQ ID NO: 1997868 - protein, 10 aa, Staphylococcus
YTESTKAKDI

SEQ ID NO: 1997869 - protein, 8 aa, Staphylococcus
YTETETIE

SEQ ID NO: 1997870 - protein, 5 aa, Staphylococcus
YTETS

SEQ ID NO: 1997871 - protein, 10 aa, Staphylococcus
YTEVSPSGNG

SEQ ID NO: 1997872 - protein, 14 aa, Staphylococcus
YTGATYGKYKRPQR

SEQ ID NO: 1997873 - protein, 6 aa, Staphylococcus
YTGEGK

SEQ ID NO: 1997874 - protein, 8 aa, Staphylococcus
YTGEGLAT

SEQ ID NO: 1997875 - protein, 17 aa, Staphylococcus
YTGESTRPTLLGKQKSD

SEQ ID NO: 1997876 - protein, 21 aa, Staphylococcus
YTGIQSGKLEDKYGWRVEVPN

SEQ ID NO: 1997877 - protein, 5 aa, Staphylococcus
YTGKQ

SEQ ID NO: 1997878 - protein, 5 aa, Staphylococcus
YTGKS

SEQ ID NO: 1997879 - protein, 6 aa, Staphylococcus
YTGNQV

SEQ ID NO: 1997880 - protein, 7 aa, Staphylococcus
YTGNSDA

SEQ ID NO: 1997881 - protein, 12 aa, Staphylococcus
YTGNTPSKKQSM

SEQ ID NO: 1997882 - protein, 8 aa, Staphylococcus
YTGPTIPN

SEQ ID NO: 1997883 - protein, 7 aa, Staphylococcus
YTGRGIT

SEQ ID NO: 1997884 - protein, 18 aa, Staphylococcus
YTGRKENINSSPKNEVYT

SEQ ID NO: 1997885 - protein, 9 aa, Staphylococcus
YTGRPNVTS

SEQ ID NO: 1997886 - protein, 8 aa, Staphylococcus
YTGSERNE

SEQ ID NO: 1997887 - protein, 7 aa, Staphylococcus
YTGSSSM

SEQ ID NO: 1997888 - protein, 4 aa, Staphylococcus
YTGT

SEQ ID NO: 1997889 - protein, 8 aa, Staphylococcus
YTHDSPRI

SEQ ID NO: 1997890 - protein, 4 aa, Staphylococcus
YTHE

SEQ ID NO: 1997891 - protein, 13 aa, Staphylococcus
YTHEHEPNAFQQR

SEQ ID NO: 1997892 - protein, 10 aa, Staphylococcus
YTHERASNSI

SEQ ID NO: 1997893 - protein, 5 aa, Staphylococcus
YTHGT

SEQ ID NO: 1997894 - protein, 9 aa, Staphylococcus
YTHSSKAQD

SEQ ID NO: 1997895 - protein, 6 aa, Staphylococcus
YTIETA

SEQ ID NO: 1997896 - protein, 5 aa, Staphylococcus
YTIST

SEQ ID NO: 1997897 - protein, 10 aa, Staphylococcus
YTITDEGKKF

SEQ ID NO: 1997898 - protein, 8 aa, Staphylococcus
YTKAPEEI

SEQ ID NO: 1997899 - protein, 9 aa, Staphylococcus
YTKAPEEIT

SEQ ID NO: 1997900 - protein, 10 aa, Staphylococcus
YTKDVGEAAY

SEQ ID NO: 1997901 - protein, 4 aa, Staphylococcus
YTKE

SEQ ID NO: 1997902 - protein, 8 aa, Staphylococcus
YTKEAHAG

SEQ ID NO: 1997903 - protein, 5 aa, Staphylococcus
YTKED

SEQ ID NO: 1997904 - protein, 7 aa, Staphylococcus
YTKEGKD

SEQ ID NO: 1997905 - protein, 5 aa, Staphylococcus
YTKEN

SEQ ID NO: 1997906 - protein, 15 aa, Staphylococcus
YTKESIEDTLKPPGI

SEQ ID NO: 1997907 - protein, 15 aa, Staphylococcus
YTKESMEPTLKPPGI

SEQ ID NO: 1997908 - protein, 5 aa, Staphylococcus
YTKGA

SEQ ID NO: 1997909 - protein, 11 aa, Staphylococcus
YTKGEPIPSTI

SEQ ID NO: 1997910 - protein, 8 aa, Staphylococcus
YTKHNQPN

SEQ ID NO: 1997911 - protein, 7 aa, Staphylococcus
YTKKEMQ

SEQ ID NO: 1997912 - protein, 7 aa, Staphylococcus
YTKKGSL

SEQ ID NO: 1997913 - protein, 5 aa, Staphylococcus
YTKQN

SEQ ID NO: 1997914 - protein, 9 aa, Staphylococcus
YTKQPEAIE

SEQ ID NO: 1997915 - protein, 9 aa, Staphylococcus
YTKQPEEIT

SEQ ID NO: 1997916 - protein, 15 aa, Staphylococcus
YTKQRALNSPNAKPV

SEQ ID NO: 1997917 - protein, 11 aa, Staphylococcus
YTKQRRKYDGQ

SEQ ID NO: 1997918 - protein, 14 aa, Staphylococcus
YTKTASDWPIPGTD

SEQ ID NO: 1997919 - protein, 9 aa, Staphylococcus
YTKTGGNAD

SEQ ID NO: 1997920 - protein, 8 aa, Staphylococcus
YTLDQQSA

SEQ ID NO: 1997921 - protein, 10 aa, Staphylococcus
YTLEEPTNLE

SEQ ID NO: 1997922 - protein, 14 aa, Staphylococcus
YTLPSSFSNLSTQL

SEQ ID NO: 1997923 - protein, 4 aa, Staphylococcus
YTLY

SEQ ID NO: 1997924 - protein, 9 aa, Staphylococcus
YTNAGKSSW

SEQ ID NO: 1997925 - protein, 7 aa, Staphylococcus
YTNEYDV

SEQ ID NO: 1997926 - protein, 7 aa, Staphylococcus
YTNRPLN

SEQ ID NO: 1997927 - protein, 5 aa, Staphylococcus
YTNST

SEQ ID NO: 1997928 - protein, 10 aa, Staphylococcus
YTNSTKARDV

SEQ ID NO: 1997929 - protein, 21 aa, Staphylococcus
YTNTPDLNDENFSGVQSGESM

SEQ ID NO: 1997930 - protein, 9 aa, Staphylococcus
YTNYDETNK

SEQ ID NO: 1997931 - protein, 5 aa, Staphylococcus
YTPAQ

SEQ ID NO: 1997932 - protein, 14 aa, Staphylococcus
YTPDHEKYVTERGV

SEQ ID NO: 1997933 - protein, 5 aa, Staphylococcus
YTPKL

SEQ ID NO: 1997934 - protein, 4 aa, Staphylococcus
YTPN

SEQ ID NO: 1997935 - protein, 7 aa, Staphylococcus
YTPNNAE

SEQ ID NO: 1997936 - protein, 5 aa, Staphylococcus
YTPNT

SEQ ID NO: 1997937 - protein, 13 aa, Staphylococcus
YTPQIPRSLGNNN

SEQ ID NO: 1997938 - protein, 8 aa, Staphylococcus
YTPQVPRS

SEQ ID NO: 1997939 - protein, 12 aa, Staphylococcus
YTPQVPRSLGNN

SEQ ID NO: 1997940 - protein, 12 aa, Staphylococcus
YTPQVPRSLGTN

SEQ ID NO: 1997941 - protein, 7 aa, Staphylococcus
YTPQYTI

SEQ ID NO: 1997942 - protein, 7 aa, Staphylococcus
YTPREQK

SEQ ID NO: 1997943 - protein, 12 aa, Staphylococcus
YTPRMDGANEEI

SEQ ID NO: 1997944 - protein, 14 aa, Staphylococcus
YTPRNSDKRGAGIF

SEQ ID NO: 1997945 - protein, 10 aa, Staphylococcus
YTPRRDEPRV

SEQ ID NO: 1997946 - protein, 6 aa, Staphylococcus
YTPSEI

SEQ ID NO: 1997947 - protein, 8 aa, Staphylococcus
YTPSSSVS

SEQ ID NO: 1997948 - protein, 4 aa, Staphylococcus
YTPT

SEQ ID NO: 1997949 - protein, 9 aa, Staphylococcus
YTQDEIDNR

SEQ ID NO: 1997950 - protein, 6 aa, Staphylococcus
YTQRLG

SEQ ID NO: 1997951 - protein, 12 aa, Staphylococcus
YTQRVPQGENYQ

SEQ ID NO: 1997952 - protein, 11 aa, Staphylococcus
YTQSFNDHTKL

SEQ ID NO: 1997953 - protein, 10 aa, Staphylococcus
YTQSQQNEFT

SEQ ID NO: 1997954 - protein, 9 aa, Staphylococcus
YTQSTKAAA

SEQ ID NO: 1997955 - protein, 4 aa, Staphylococcus
YTQT

SEQ ID NO: 1997956 - protein, 12 aa, Staphylococcus
YTQTDVSNQLNK

SEQ ID NO: 1997957 - protein, 9 aa, Staphylococcus
YTQTETYDK

SEQ ID NO: 1997958 - protein, 7 aa, Staphylococcus
YTRDGQQ

SEQ ID NO: 1997959 - protein, 10 aa, Staphylococcus
YTRDRKPVTV

SEQ ID NO: 1997960 - protein, 9 aa, Staphylococcus
YTRERKPIT

SEQ ID NO: 1997961 - protein, 4 aa, Staphylococcus
YTRN

SEQ ID NO: 1997962 - protein, 14 aa, Staphylococcus
YTRNEYNNHNVKGT

SEQ ID NO: 1997963 - protein, 13 aa, Staphylococcus
YTRNKQNDKLTTI

SEQ ID NO: 1997964 - protein, 20 aa, Staphylococcus
YTRPQFSENKTLNLENSRHP

SEQ ID NO: 1997965 - protein, 8 aa, Staphylococcus
YTRPREYK

SEQ ID NO: 1997966 - protein, 9 aa, Staphylococcus
YTRPREYKD

SEQ ID NO: 1997967 - protein, 10 aa, Staphylococcus
YTRPREYKGM

SEQ ID NO: 1997968 - protein, 9 aa, Staphylococcus
YTRPREYNG

SEQ ID NO: 1997969 - protein, 6 aa, Staphylococcus
YTRSQE

SEQ ID NO: 1997970 - protein, 10 aa, Staphylococcus
YTRSRKPVTV

SEQ ID NO: 1997971 - protein, 4 aa, Staphylococcus
YTSA

SEQ ID NO: 1997972 - protein, 4 aa, Staphylococcus
YTSC

SEQ ID NO: 1997973 - protein, 8 aa, Staphylococcus
YTSDNGRM

SEQ ID NO: 1997974 - protein, 10 aa, Staphylococcus
YTSDTQKKDK

SEQ ID NO: 1997975 - protein, 11 aa, Staphylococcus
YTSENKDGTID

SEQ ID NO: 1997976 - protein, 14 aa, Staphylococcus
YTSETTAKQQIEKA

SEQ ID NO: 1997977 - protein, 8 aa, Staphylococcus
YTSHQPRV

SEQ ID NO: 1997978 - protein, 4 aa, Staphylococcus
YTSN

SEQ ID NO: 1997979 - protein, 9 aa, Staphylococcus
YTSPERQEL

SEQ ID NO: 1997980 - protein, 7 aa, Staphylococcus
YTSQLAQ

SEQ ID NO: 1997981 - protein, 10 aa, Staphylococcus
YTSQPSVSRD

SEQ ID NO: 1997982 - protein, 42 aa, Staphylococcus
YTSSDNQTSVQDRHEASNAQVLSSQRKESNQSNHNKNQVSAA

SEQ ID NO: 1997983 - protein, 7 aa, Staphylococcus
YTSSNFR

SEQ ID NO: 1997984 - protein, 4 aa, Staphylococcus
YTST

SEQ ID NO: 1997985 - protein, 16 aa, Staphylococcus
YTSTGKLQRNKMINRG

SEQ ID NO: 1997986 - protein, 12 aa, Staphylococcus
YTSVGSRLEPDA

SEQ ID NO: 1997987 - protein, 6 aa, Staphylococcus
YTTAKA

SEQ ID NO: 1997988 - protein, 21 aa, Staphylococcus
YTTASERITVDDRAKQLSKDL

SEQ ID NO: 1997989 - protein, 9 aa, Staphylococcus
YTTDDNPKD

SEQ ID NO: 1997990 - protein, 7 aa, Staphylococcus
YTTEEGE

SEQ ID NO: 1997991 - protein, 7 aa, Staphylococcus
YTTHKKG

SEQ ID NO: 1997992 - protein, 23 aa, Staphylococcus
YTTKDLTQKAKDLKLSNYSKLNK

SEQ ID NO: 1997993 - protein, 16 aa, Staphylococcus
YTTKDLTQKAKSLKLT

SEQ ID NO: 1997994 - protein, 16 aa, Staphylococcus
YTTKELTQKAKSLKLT

SEQ ID NO: 1997995 - protein, 15 aa, Staphylococcus
YTTKELTQKAKTLKL

SEQ ID NO: 1997996 - protein, 6 aa, Staphylococcus
YTTKSK

SEQ ID NO: 1997997 - protein, 12 aa, Staphylococcus
YTTNKKAFSSEF

SEQ ID NO: 1997998 - protein, 13 aa, Staphylococcus
YTTNKKAFSSEFY

SEQ ID NO: 1997999 - protein, 10 aa, Staphylococcus
YTTNKQVPSL

SEQ ID NO: 1998000 - protein, 5 aa, Staphylococcus
YTTPL

SEQ ID NO: 1998001 - protein, 8 aa, Staphylococcus
YTTQAETA

SEQ ID NO: 1998002 - protein, 8 aa, Staphylococcus
YTTQTYPE

SEQ ID NO: 1998003 - protein, 4 aa, Staphylococcus
YTTS

SEQ ID NO: 1998004 - protein, 5 aa, Staphylococcus
YTTSD

SEQ ID NO: 1998005 - protein, 6 aa, Staphylococcus
YTTSEC

SEQ ID NO: 1998006 - protein, 14 aa, Staphylococcus
YTTSSKDDANAPVG

SEQ ID NO: 1998007 - protein, 11 aa, Staphylococcus
YTTSTGGKPFE

SEQ ID NO: 1998008 - protein, 7 aa, Staphylococcus
YTTTAGD

SEQ ID NO: 1998009 - protein, 20 aa, Staphylococcus
YTTTREETADSTPEGGETDE

SEQ ID NO: 1998010 - protein, 7 aa, Staphylococcus
YTTTTGI

SEQ ID NO: 1998011 - protein, 20 aa, Staphylococcus
YTTTTSGHRASQETSQDDIM

SEQ ID NO: 1998012 - protein, 5 aa, Staphylococcus
YTVEG

SEQ ID NO: 1998013 - protein, 10 aa, Staphylococcus
YTVGYSQKSQ

SEQ ID NO: 1998014 - protein, 9 aa, Staphylococcus
YTYEQDGAT

SEQ ID NO: 1998015 - protein, 11 aa, Staphylococcus
YTYTETGGKAD

SEQ ID NO: 1998016 - protein, 12 aa, Staphylococcus
YTYTQTGGKADY

SEQ ID NO: 1998017 - protein, 7 aa, Staphylococcus
YVDQDDD

SEQ ID NO: 1998018 - protein, 8 aa, Staphylococcus
YVDSDNSV

SEQ ID NO: 1998019 - protein, 12 aa, Staphylococcus
YVEEQTNAELYP

SEQ ID NO: 1998020 - protein, 11 aa, Staphylococcus
YVEHPKENGYR

SEQ ID NO: 1998021 - protein, 15 aa, Staphylococcus
YVGEDKKNKKPPYKH

SEQ ID NO: 1998022 - protein, 14 aa, Staphylococcus
YVGETNRKYLPIEE

SEQ ID NO: 1998023 - protein, 14 aa, Staphylococcus
YVGETNRKYVPVEE

SEQ ID NO: 1998024 - protein, 11 aa, Staphylococcus
YVGKDQSNQYN

SEQ ID NO: 1998025 - protein, 7 aa, Staphylococcus
YVKPEPE

SEQ ID NO: 1998026 - protein, 8 aa, Staphylococcus
YVKTPKED

SEQ ID NO: 1998027 - protein, 24 aa, Staphylococcus
YVNENPDKFKGSKGEPGKDGNVSF

SEQ ID NO: 1998028 - protein, 4 aa, Staphylococcus
YVPG

SEQ ID NO: 1998029 - protein, 6 aa, Staphylococcus
YVPNDC

SEQ ID NO: 1998030 - protein, 11 aa, Staphylococcus
YVPNDSKNLAY

SEQ ID NO: 1998031 - protein, 11 aa, Staphylococcus
YVPRENPCGRY

SEQ ID NO: 1998032 - protein, 5 aa, Staphylococcus
YVQAN

SEQ ID NO: 1998033 - protein, 7 aa, Staphylococcus
YVQDGRW

SEQ ID NO: 1998034 - protein, 10 aa, Staphylococcus
YVQEDSGTFN

SEQ ID NO: 1998035 - protein, 7 aa, Staphylococcus
YVQNGEW

SEQ ID NO: 1998036 - protein, 6 aa, Staphylococcus
YVQPTD

SEQ ID NO: 1998037 - protein, 4 aa, Staphylococcus
YVQQ

SEQ ID NO: 1998038 - protein, 5 aa, Staphylococcus
YVSGG

SEQ ID NO: 1998039 - protein, 10 aa, Staphylococcus
YVSGRESQAL

SEQ ID NO: 1998040 - protein, 5 aa, Staphylococcus
YVSPE

SEQ ID NO: 1998041 - protein, 7 aa, Staphylococcus
YVSQEDN

SEQ ID NO: 1998042 - protein, 7 aa, Staphylococcus
YVSQKSN

SEQ ID NO: 1998043 - protein, 4 aa, Staphylococcus
YVSR

SEQ ID NO: 1998044 - protein, 5 aa, Staphylococcus
YVSRR

SEQ ID NO: 1998045 - protein, 4 aa, Staphylococcus
YVSS

SEQ ID NO: 1998046 - protein, 7 aa, Staphylococcus
YVSSDKN

SEQ ID NO: 1998047 - protein, 8 aa, Staphylococcus
YVTNPQTH

SEQ ID NO: 1998048 - protein, 7 aa, Staphylococcus
YVTPDSS

SEQ ID NO: 1998049 - protein, 5 aa, Staphylococcus
YVTSG

SEQ ID NO: 1998050 - protein, 7 aa, Staphylococcus
YWDPSAR

SEQ ID NO: 1998051 - protein, 7 aa, Staphylococcus
YWDSDAR

SEQ ID NO: 1998052 - protein, 9 aa, Staphylococcus
YWRGDSDNK

SEQ ID NO: 1998053 - protein, 10 aa, Staphylococcus
YWRGDSDNKM

SEQ ID NO: 1998054 - protein, 9 aa, Staphylococcus
YWRGNSDNK

SEQ ID NO: 1998055 - protein, 7 aa, Staphylococcus
YYATTGD

SEQ ID NO: 1998056 - protein, 30 aa, Staphylococcus; identical to SEQ ID NO: 1765297

SEQ ID NO: 1998057 - protein, 13 aa, Staphylococcus
YYDDDITVDFFLT

SEQ ID NO: 1998058 - protein, 16 aa, Staphylococcus
YYDDEGQPIDTRKGAE

SEQ ID NO: 1998059 - protein, 5 aa, Staphylococcus
YYDES

SEQ ID NO: 1998060 - protein, 29 aa, Staphylococcus
YYDGNNPAFKPKKRPDKKAALTKLEEDQI

SEQ ID NO: 1998061 - protein, 16 aa, Staphylococcus
YYDKDGNVKRSKGASV

SEQ ID NO: 1998062 - protein, 5 aa, Staphylococcus
YYDKE

SEQ ID NO: 1998063 - protein, 5 aa, Staphylococcus
YYDKG

SEQ ID NO: 1998064 - protein, 5 aa, Staphylococcus
YYDNE

SEQ ID NO: 1998065 - protein, 10 aa, Staphylococcus
YYEENGGYEI

SEQ ID NO: 1998066 - protein, 10 aa, Staphylococcus
YYESSVEGEK

SEQ ID NO: 1998067 - protein, 16 aa, Staphylococcus
YYESSVKGEAVKKAYQ

SEQ ID NO: 1998068 - protein, 16 aa, Staphylococcus
YYESSVKGEDVKKAYK

SEQ ID NO: 1998069 - protein, 4 aa, Staphylococcus
YYGE

SEQ ID NO: 1998070 - protein, 7 aa, Staphylococcus
YYGNNED

SEQ ID NO: 1998071 - protein, 5 aa, Staphylococcus
YYGQH

SEQ ID NO: 1998072 - protein, 8 aa, Staphylococcus
YYGYSGDT

SEQ ID NO: 1998073 - protein, 6 aa, Staphylococcus
YYKPRK

SEQ ID NO: 1998074 - protein, 11 aa, Staphylococcus
YYNEPKQIDID

SEQ ID NO: 1998075 - protein, 4 aa, Staphylococcus
YYNK

SEQ ID NO: 1998076 - protein, 10 aa, Staphylococcus
YYNPDTKVTD

SEQ ID NO: 1998077 - protein, 10 aa, Staphylococcus
YYNPNNNKKH

SEQ ID NO: 1998078 - protein, 11 aa, Staphylococcus
YYNPNNNKKNY

SEQ ID NO: 1998079 - protein, 4 aa, Staphylococcus
YYNQ

SEQ ID NO: 1998080 - protein, 27 aa, Staphylococcus
YYNRGDGEEDDDSTQFEPQSNDDNGEI

SEQ ID NO: 1998081 - protein, 27 aa, Staphylococcus
YYNRGDGEEDEDGGNFEPQTNDDNGEI

SEQ ID NO: 1998082 - protein, 26 aa, Staphylococcus
YYNRGEDEDDDDDAGFEPQTNDDNGE

SEQ ID NO: 1998083 - protein, 27 aa, Staphylococcus
YYNRGEDEDDDDDSNYEPQTNDDNGEI

SEQ ID NO: 1998084 - protein, 26 aa, Staphylococcus
YYNRGEDEDDDDDSSFEPQTNDDNGE

SEQ ID NO: 1998085 - protein, 15 aa, Staphylococcus
YYPEDSEAEVFIPRK

SEQ ID NO: 1998086 - protein, 4 aa, Staphylococcus
YYPG

SEQ ID NO: 1998087 - protein, 13 aa, Staphylococcus
YYPKDSESEVFIP

SEQ ID NO: 1998088 - protein, 14 aa, Staphylococcus
YYPNDSEANVFIPG

SEQ ID NO: 1998089 - protein, 9 aa, Staphylococcus
YYPNETART

SEQ ID NO: 1998090 - protein, 5 aa, Staphylococcus
YYPNL

SEQ ID NO: 1998091 - protein, 10 aa, Staphylococcus
YYPPDINRSY

SEQ ID NO: 1998092 - protein, 17 aa, Staphylococcus
YYPPDSEADVFIPNKID

SEQ ID NO: 1998093 - protein, 5 aa, Staphylococcus
YYPSY

SEQ ID NO: 1998094 - protein, 14 aa, Staphylococcus
YYQEAGRVGRDGLK

SEQ ID NO: 1998095 - protein, 13 aa, Staphylococcus
YYQPSSEGPSRKY

SEQ ID NO: 1998096 - protein, 4 aa, Staphylococcus
YYSD

SEQ ID NO: 1998097 - protein, 8 aa, Staphylococcus
YYSENDYY

SEQ ID NO: 1998098 - protein, 9 aa, Staphylococcus
YYSEPTKQH

SEQ ID NO: 1998099 - protein, 8 aa, Staphylococcus
YYSESDIE

SEQ ID NO: 1998100 - protein, 28 aa, Staphylococcus
YYSGDNPAFKPKKRPDKEASLTQREEHQ

SEQ ID NO: 1998101 - protein, 12 aa, Staphylococcus
YYSGNENAPDVP

SEQ ID NO: 1998102 - protein, 13 aa, Staphylococcus
YYSGSPKYQGSNQ

SEQ ID NO: 1998103 - protein, 13 aa, Staphylococcus
YYSKGKKTLDEYT

SEQ ID NO: 1998104 - protein, 5 aa, Staphylococcus
YYSSN

SEQ ID NO: 1998105 - protein, 10 aa, Staphylococcus
YYTSGKQYQV

SEQ ID NO: 1998106 - protein, 13 aa, Staphylococcus
YYYPEDSESNVFI

SEQ ID NO: 1998107 - protein, 22 aa, Staphylococcus
IAKSCLVSSMTVSRVINQAASD

SEQ ID NO: 1998108 - protein, 25 aa, Staphylococcus
LKSLKDHFYRYSLKLRQKVKTVTID

SEQ ID NO: 1998109 - protein, 23 aa, Staphylococcus
EKKHKGRMSLFYYAELTYQPTHC

SEQ ID NO: 1998110 - protein, 34 aa, Staphylococcus
TLEAFNYHKVHLFKEWKTEKGIINYLLGVDVELF

SEQ ID NO: 1998111 - protein, 19 aa, Staphylococcus
VIGKMSFIYADAVSHRIVD

SEQ ID NO: 1998112 - protein, 24 aa, Staphylococcus
IEANANRYTFVWKKSIQNHESKMN

SEQ ID NO: 1998113 - protein, 21 aa, Staphylococcus
YKSYWKLFLKPFETLEAFNYH

SEQ ID NO: 1998114 - protein, 17 aa, Staphylococcus
CHIAIGITKDGDREIIG

SEQ ID NO: 1998115 - protein, 20 aa, Staphylococcus
KNGQLKPGYNLQIATNSQFV

SEQ ID NO: 1998116 - protein, 23 aa, Staphylococcus
SANRLIGAVLMDLHDEWIYSSRK

SEQ ID NO: 1998117 - protein, 18 aa, Staphylococcus
SEETWTTFFEYLKERGLQ

SEQ ID NO: 1998118 - protein, 24 aa, Staphylococcus
TLKGIECIYALYKKNRRSLQIYGF

SEQ ID NO: 1998119 - protein, 25 aa, Staphylococcus
VCPKLRPVIRTLRRLAAFIENTMTY

SEQ ID NO: 1998120 - protein, 24 aa, Staphylococcus
RDNHSAYAFIKRLIKQFGKPQKVI

SEQ ID NO: 1998121 - protein, 20 aa, Staphylococcus
RRSLQIYGFSPCHEISIMLA

SEQ ID NO: 1998122 - protein, 18 aa, Staphylococcus
ATNSQFVLSYNVYQNPTD

SEQ ID NO: 1998123 - protein, 20 aa, Staphylococcus
KKIMKNYNWEYFKSQINKKL

SEQ ID NO: 1998124 - protein, 24 aa, Staphylococcus
VCPKLRPVIRTLRRLATFIENTMT

SEQ ID NO: 1998125 - protein, 19 aa, Staphylococcus
AVGYYLRYALSYRDISEIL

SEQ ID NO: 1998126 - protein, 24 aa, Staphylococcus
EFICPNNKRLGFKRYAYRHDKYGY

SEQ ID NO: 1998127 - protein, 18 aa, Staphylococcus
WKTEKGIVNYLLDVDEEL

SEQ ID NO: 1998128 - protein, 28 aa, Staphylococcus
AGLKDPKRPIGSFIFLGPTGVGKTELAR

SEQ ID NO: 1998129 - protein, 25 aa, Staphylococcus
AQKARACGIHMLVATQRPSVNVITG

SEQ ID NO: 1998130 - protein, 24 aa, Staphylococcus
CNTRHGVCEKCYGKNLATGEKVEV

SEQ ID NO: 1998131 - protein, 18 aa, Staphylococcus
DAHVRYTTIQNWANNVYN

SEQ ID NO: 1998132 - protein, 24 aa, Staphylococcus
DQARTIRIPVHMVETINKLIRVQR

SEQ ID NO: 1998133 - protein, 21 aa, Staphylococcus
DVHYSHYGRMCPIETPEGPNI

SEQ ID NO: 1998134 - protein, 20 aa, Staphylococcus
EAARRIGEGAAMLRTKGEPG

SEQ ID NO: 1998135 - protein, 23 aa, Staphylococcus
EDFTGNLSLEFVDYRLGEPKYDL

SEQ ID NO: 1998136 - protein, 23 aa, Staphylococcus
EKKYKGRMSLFYYAELTYQPTYC

SEQ ID NO: 1998137 - protein, 18 aa, Staphylococcus
ERLLHAIFGEKAREVRDT

SEQ ID NO: 1998138 - protein, 24 aa, Staphylococcus
ESKRPSVQIGDPFVGKKLMEATLE

SEQ ID NO: 1998139 - protein, 25 aa, Staphylococcus
EVDERAKAGLFLAMQYPSEITGVTN

SEQ ID NO: 1998140 - protein, 24 aa, Staphylococcus
FFELACAMSGYQLGVNPFNQPGVE

SEQ ID NO: 1998141 - protein, 20 aa, Staphylococcus
FGARPLKRFVQRQIETPLAR

SEQ ID NO: 1998142 - protein, 26 aa, Staphylococcus
FKLYECDDCSECPLKNQCMNFNSKTN

SEQ ID NO: 1998143 - protein, 25 aa, Staphylococcus
FNCPEFTSLCPITGQPDFATIYISY

SEQ ID NO: 1998144 - protein, 20 aa, Staphylococcus
FRATLFRQTMFAEFEHKIHQ

SEQ ID NO: 1998145 - protein, 17 aa, Staphylococcus
FTARHHTFFEMLGNFSI

SEQ ID NO: 1998146 - protein, 18 aa, Staphylococcus
GKWSYLYRAIDAEGHTLD

SEQ ID NO: 1998147 - protein, 28 aa, Staphylococcus
GNALSWSSAGALGFKGSKKSTPFAAQMA

SEQ ID NO: 1998148 - protein, 17 aa, Staphylococcus
GPTKDWECSCGKYKRVR

SEQ ID NO: 1998149 - protein, 26 aa, Staphylococcus
GRAPIGRPSPMSPWGKPTLGKKTRRG

SEQ ID NO: 1998150 - protein, 24 aa, Staphylococcus
GTEFLMDHRHLWLRSKKQHAVMKI

SEQ ID NO: 1998151 - protein, 25 aa, Staphylococcus
IEFARSGDTIVVWRLDRLGRNMEDL

SEQ ID NO: 1998152 - protein, 25 aa, Staphylococcus
IKDPNRPIGSFLFLGPTGVGKTELA

SEQ ID NO: 1998153 - protein, 22 aa, Staphylococcus
IPPEIRPMVQLDGGRFATSDLN

SEQ ID NO: 1998154 - protein, 19 aa, Staphylococcus
IYRNFGMAHPEGYRKALRL

SEQ ID NO: 1998155 - protein, 19 aa, Staphylococcus
KPFMMPVEDVFSITGRGTV

SEQ ID NO: 1998156 - protein, 18 aa, Staphylococcus
KQQHGFIDSVGFDLYSQM

SEQ ID NO: 1998157 - protein, 25 aa, Staphylococcus
KVRRKPYSVILFDEIEKAHPDVFNI

SEQ ID NO: 1998158 - protein, 18 aa, Staphylococcus
KWVHYGLTSTDVVDTALS

SEQ ID NO: 1998159 - protein, 20 aa, Staphylococcus
LEKIRKALYMSKICSYAQGF

SEQ ID NO: 1998160 - protein, 20 aa, Staphylococcus
LFAAFAEFERNLILERSSAG

SEQ ID NO: 1998161 - protein, 21 aa, Staphylococcus
LHATFMPKPLFGVNGSGMHFN

SEQ ID NO: 1998162 - protein, 17 aa, Staphylococcus
LHLGMAAKNLGIHVASP

SEQ ID NO: 1998163 - protein, 19 aa, Staphylococcus
LKRLLDLGAPGIIVQNEKR

SEQ ID NO: 1998164 - protein, 17 aa, Staphylococcus
LLEAGVHFGHQTRRWNP

SEQ ID NO: 1998165 - protein, 21 aa, Staphylococcus
LWTGKYSSLFGKRAMTTFERY

SEQ ID NO: 1998166 - protein, 32 aa, Staphylococcus; identical to SEQ ID NO: 1796011

SEQ ID NO: 1998167 - protein, 17 aa, Staphylococcus
MSTKNGRKVLARRRRKG

SEQ ID NO: 1998168 - protein, 19 aa, Staphylococcus
NFIMSRYQMYWQIYFHPVS

SEQ ID NO: 1998169 - protein, 20 aa, Staphylococcus
NIGQVLELHLGMAAKNLGIH

SEQ ID NO: 1998170 - protein, 18 aa, Staphylococcus
NRISVGVMYMLKLAHMVD

SEQ ID NO: 1998171 - protein, 23 aa, Staphylococcus
NSMNCLMEVLGLALPYNGTALAV

SEQ ID NO: 1998172 - protein, 18 aa, Staphylococcus
PGNRPLKSLSHMLKGKQG

SEQ ID NO: 1998173 - protein, 18 aa, Staphylococcus
PKMMLKVILYAYTQSVFS

SEQ ID NO: 1998174 - protein, 22 aa, Staphylococcus
QDIPFETFLGFKGDKVPDIDLN

SEQ ID NO: 1998175 - protein, 25 aa, Staphylococcus
QFGGQRFGEMEVWALEAYGAAYTLQ

SEQ ID NO: 1998176 - protein, 17 aa, Staphylococcus
QIHAGGRGKAGGVKIAK

SEQ ID NO: 1998177 - protein, 20 aa, Staphylococcus
QKGTGKWTSINALELGIPLT

SEQ ID NO: 1998178 - protein, 29 aa, Staphylococcus
QRTNYDLEMMREMGFCSGIENYSVHLTLR

SEQ ID NO: 1998179 - protein, 22 aa, Staphylococcus
RDVSLKVIRALGIEGGCNVQLA

SEQ ID NO: 1998180 - protein, 23 aa, Staphylococcus
RISEVLELPNLIEIQTKSYDWFL

SEQ ID NO: 1998181 - protein, 25 aa, Staphylococcus
TATPIPRTLAISVFGEMDVSSIKQL

SEQ ID NO: 1998182 - protein, 19 aa, Staphylococcus
TLNVPFAIADATSLTEAGY

SEQ ID NO: 1998183 - protein, 17 aa, Staphylococcus
VEDVFSITGRGTVATGR

SEQ ID NO: 1998184 - protein, 24 aa, Staphylococcus
VGAGLPLWLPNGATIRREIERYIV

SEQ ID NO: 1998185 - protein, 17 aa, Staphylococcus
VGYYLRYALSYRDISEI

SEQ ID NO: 1998186 - protein, 24 aa, Staphylococcus
VKNVTGKMSFIYADAVSHRIVDVV

SEQ ID NO: 1998187 - protein, 20 aa, Staphylococcus
VLRLRFGLDDGRTRTLEEVG

SEQ ID NO: 1998188 - protein, 24 aa, Staphylococcus
VQKRKIHVGDKMCGRHGNKGVISK

SEQ ID NO: 1998189 - protein, 23 aa, Staphylococcus
VRSGAKISMPGMMDTILNLGLND

SEQ ID NO: 1998190 - protein, 17 aa, Staphylococcus
WALEAYGAAYTLQEILT

SEQ ID NO: 1998191 - protein, 18 aa, Staphylococcus
WRQPFPGPGLGIRVLGEI

SEQ ID NO: 1998192 - protein, 18 aa, Staphylococcus
WVQEYAPILYQIWKKKHK

SEQ ID NO: 1998193 - protein, 19 aa, Staphylococcus
WVQEYAPILYQIWKKKHKK

SEQ ID NO: 1998194 - protein, 26 aa, Staphylococcus
YKRVRYKGMVCDRCGVEVTKSKVRRE

SEQ ID NO: 1998195 - protein, 19 aa, Staphylococcus
AELEGEFAEMNGWNAEADA

SEQ ID NO: 1998196 - protein, 20 aa, Staphylococcus
AGGHAVMLGSLLAGTEESPG

SEQ ID NO: 1998197 - protein, 19 aa, Staphylococcus
AGIKFPDDNLLGIDYVIPD

SEQ ID NO: 1998198 - protein, 19 aa, Staphylococcus
AGLKAIVVIPEGKIALGKL

SEQ ID NO: 1998199 - protein, 19 aa, Staphylococcus
AGNMLKPMLARGELHCIGA

SEQ ID NO: 1998200 - protein, 20 aa, Staphylococcus
ALRRFKRSVSKSGTIQEVRK

SEQ ID NO: 1998201 - protein, 19 aa, Staphylococcus
APFANYWMHNGFINIDNEK

SEQ ID NO: 1998202 - protein, 24 aa, Staphylococcus
ATNEVNAAMGIICATPTAGSSGTI

SEQ ID NO: 1998203 - protein, 22 aa, Staphylococcus
CMTGCPYKKVYFNWKTNKAEKC

SEQ ID NO: 1998204 - protein, 26 aa, Staphylococcus
DEFICPNNKRLGFKRYAYRHDKYGYK

SEQ ID NO: 1998205 - protein, 19 aa, Staphylococcus
DRFLPDKAIDLIDEASSKV

SEQ ID NO: 1998206 - protein, 19 aa, Staphylococcus
DVHQPELAIVFGRTKRRVD

SEQ ID NO: 1998207 - protein, 21 aa, Staphylococcus
EGKDFKGIYPSSANYTTDLHS

SEQ ID NO: 1998208 - protein, 25 aa, Staphylococcus
EGTMPQTRFVLKKALEQNLKPVVVV

SEQ ID NO: 1998209 - protein, 20 aa, Staphylococcus
EHMLFIGAGAFHVSKPSDLI

SEQ ID NO: 1998210 - protein, 22 aa, Staphylococcus
EMALGRNVVVGFMTWDGYNYED

SEQ ID NO: 1998211 - protein, 17 aa, Staphylococcus
EMEEIGASTGLPLVLHG

SEQ ID NO: 1998212 - protein, 18 aa, Staphylococcus
ENLKCSFCGKDQDQVKKL

SEQ ID NO: 1998213 - protein, 20 aa, Staphylococcus
ERGLHHLVWEIVDNSIDEAL

SEQ ID NO: 1998214 - protein, 20 aa, Staphylococcus
ERIEREFGIELIATAPSVIY

SEQ ID NO: 1998215 - protein, 23 aa, Staphylococcus
ESMEFPEPVIHLSVEPKSKADQD

SEQ ID NO: 1998216 - protein, 23 aa, Staphylococcus
ETFLRGFLGRMLFSGEEVKKKAS

SEQ ID NO: 1998217 - protein, 18 aa, Staphylococcus
FEDVRIVRDMRNSVNRLV

SEQ ID NO: 1998218 - protein, 21 aa, Staphylococcus
FHPERMASRILGMGDVLSLIE

SEQ ID NO: 1998219 - protein, 17 aa, Staphylococcus
FLFYSGFYYPLYLAGQG

SEQ ID NO: 1998220 - protein, 20 aa, Staphylococcus
FLSPETMWYYKSAFNTDQMK

SEQ ID NO: 1998221 - protein, 19 aa, Staphylococcus
FNAEKGFGFIEVEGENDVF

SEQ ID NO: 1998222 - protein, 17 aa, Staphylococcus
FNLMFKTFQGVTEDSTN

SEQ ID NO: 1998223 - protein, 19 aa, Staphylococcus
GDNIGALLRGVAREDVQRG

SEQ ID NO: 1998224 - protein, 18 aa, Staphylococcus
GGCTFCSAAGSGDFAGNR

SEQ ID NO: 1998225 - protein, 21 aa, Staphylococcus
GHGPFSHSFEKIFNTDHEAFT

SEQ ID NO: 1998226 - protein, 18 aa, Staphylococcus
GNSLRRILLSSLPGAAVK

SEQ ID NO: 1998227 - protein, 22 aa, Staphylococcus
GPVRAVLELAGITDILSKSLGS

SEQ ID NO: 1998228 - protein, 19 aa, Staphylococcus
GSVTAGFAIYDTIQHIKPD

SEQ ID NO: 1998229 - protein, 39 aa, Staphylococcus; identical to SEQ ID NO: 1646257

SEQ ID NO: 1998230 - protein, 19 aa, Staphylococcus
HGAGCTFAAATTAYLANGK

SEQ ID NO: 1998231 - protein, 17 aa, Staphylococcus
HGARKGLADTALKTADS

SEQ ID NO: 1998232 - protein, 28 aa, Staphylococcus
HGPYKGEPKLGFKEMEEIGASTGLPLVL

SEQ ID NO: 1998233 - protein, 19 aa, Staphylococcus
HPFGGFKMSGTDAKTGSPD

SEQ ID NO: 1998234 - protein, 20 aa, Staphylococcus
HPKMMLKVILYAYTQSVFSG

SEQ ID NO: 1998235 - protein, 23 aa, Staphylococcus
HRDRIAFMRVVSGAFERGMDVTL

SEQ ID NO: 1998236 - protein, 22 aa, Staphylococcus
HSGFGLGLERTVAWISGVEHVR

SEQ ID NO: 1998237 - protein, 26 aa, Staphylococcus
HSYRELPIRIAELGTMHRYEASGAVS

SEQ ID NO: 1998238 - protein, 31 aa, Staphylococcus; identical to SEQ ID NO: 1649464

SEQ ID NO: 1998239 - protein, 20 aa, Staphylococcus
IKVTRLAQGLSVGGDLEYAD

SEQ ID NO: 1998240 - protein, 19 aa, Staphylococcus
IKVVKAVKEATGLGLKDAK

SEQ ID NO: 1998241 - protein, 20 aa, Staphylococcus
KERYEVYHGVRIQDRALVAA

SEQ ID NO: 1998242 - protein, 19 aa, Staphylococcus
KIDTYRSSGAGGQHVNTTD

SEQ ID NO: 1998243 - protein, 26 aa, Staphylococcus
KLEDRLRSRFEWGLIVDITPPDYETR

SEQ ID NO: 1998244 - protein, 23 aa, Staphylococcus
KLKHWLPVDLYIGGVEHAVLHLL

SEQ ID NO: 1998245 - protein, 19 aa, Staphylococcus
KLYLFSFRNHGDFHEDCMN

SEQ ID NO: 1998246 - protein, 22 aa, Staphylococcus
KPMPGRFKDYIAMPKQNMYQSL

SEQ ID NO: 1998247 - protein, 17 aa, Staphylococcus
KPVKGMLTGPVTILNWS

SEQ ID NO: 1998248 - protein, 24 aa, Staphylococcus
KSIAKSCLISSMTVSRVINQAASD

SEQ ID NO: 1998249 - protein, 21 aa, Staphylococcus
KTIPVRPGRNVAVIIEVAAMN

SEQ ID NO: 1998250 - protein, 21 aa, Staphylococcus
LAESERLVLVDSLNDVLVLVE

SEQ ID NO: 1998251 - protein, 18 aa, Staphylococcus
LEAVRKRPGMYIGSTDKR

SEQ ID NO: 1998252 - protein, 18 aa, Staphylococcus
LEAVRKRPGMYIGSTSER

SEQ ID NO: 1998253 - protein, 18 aa, Staphylococcus
LGKYWASLGDVFVNDAFG

SEQ ID NO: 1998254 - protein, 22 aa, Staphylococcus
LGQRPGAGAVYLNIFHYDVEEF

SEQ ID NO: 1998255 - protein, 17 aa, Staphylococcus
LIDEARTPLIISGEAEK

SEQ ID NO: 1998256 - protein, 20 aa, Staphylococcus
LITRRIREMGVYSELHDHEI

SEQ ID NO: 1998257 - protein, 25 aa, Staphylococcus
LKPALARGELQCIGATTLDEYRKNI

SEQ ID NO: 1998258 - protein, 22 aa, Staphylococcus
LMNLKHVVITAVARDDLRDAGS

SEQ ID NO: 1998259 - protein, 27 aa, Staphylococcus
LPKEMALELFKPFVMKELVQREIATNI

SEQ ID NO: 1998260 - protein, 18 aa, Staphylococcus
LRASYYMMGAMLGRFKKC

SEQ ID NO: 1998261 - protein, 18 aa, Staphylococcus
LVDEVGMLMAYEVTRDLE

SEQ ID NO: 1998262 - protein, 25 aa, Staphylococcus
MDTCIACGACGAAAPDIYDYDDEGI

SEQ ID NO: 1998263 - protein, 17 aa, Staphylococcus
NGAVLVRYGDTVVLSTA

SEQ ID NO: 1998264 - protein, 24 aa, Staphylococcus
NLNIKRLMEISSYRGIRHRRGLPV

SEQ ID NO: 1998265 - protein, 25 aa, Staphylococcus
NVEMTVELIAPIAIEDGTRFSIREG

SEQ ID NO: 1998266 - protein, 17 aa, Staphylococcus
PDCSPEMAAMIGSSMAL

SEQ ID NO: 1998267 - protein, 25 aa, Staphylococcus
PEDPRFTDRFELFIVGREHANAFTE

SEQ ID NO: 1998268 - protein, 17 aa, Staphylococcus
PETAQGIFVNYKNVQRS

SEQ ID NO: 1998269 - protein, 26 aa, Staphylococcus
PHKFKMGVSGCPRSCVESGVKDFGVI

SEQ ID NO: 1998270 - protein, 25 aa, Staphylococcus
PPSVREIGEAVGLASSSTVHGHLSR

SEQ ID NO: 1998271 - protein, 19 aa, Staphylococcus
PRGTRIFGPVARELREGNF

SEQ ID NO: 1998272 - protein, 27 aa, Staphylococcus
QAIKEFTELGSGFKIAMRDLNIRGAGN

SEQ ID NO: 1998273 - protein, 18 aa, Staphylococcus
QALLKFEDVRIVRDMRNS

SEQ ID NO: 1998274 - protein, 24 aa, Staphylococcus
QGLEIAEAFVRSGAVDIVVVDSVA

SEQ ID NO: 1998275 - protein, 20 aa, Staphylococcus
QTKFKMVRIEAGYTQDTMAQ

SEQ ID NO: 1998276 - protein, 23 aa, Staphylococcus
QTRRWNPKMKKYIFTERNGIYII

SEQ ID NO: 1998277 - protein, 17 aa, Staphylococcus
RGVCTRVGTMTPKKPNS

SEQ ID NO: 1998278 - protein, 20 aa, Staphylococcus
RKLESAGVIESRSLGMKGTF

SEQ ID NO: 1998279 - protein, 18 aa, Staphylococcus
RNPYSVILLDEVEKAHSD

SEQ ID NO: 1998280 - protein, 17 aa, Staphylococcus
RPDEKRVTERAYENPRF

SEQ ID NO: 1998281 - protein, 20 aa, Staphylococcus
RRFEIKRGDKVTGKVRKPKD

SEQ ID NO: 1998282 - protein, 20 aa, Staphylococcus
RSDAYIGVLIDDLVTKGTNE

SEQ ID NO: 1998283 - protein, 22 aa, Staphylococcus
SEITPLTTIRVFELMEEVGFPK

SEQ ID NO: 1998284 - protein, 17 aa, Staphylococcus
SIASGVDIKEVFLKLPI

SEQ ID NO: 1998285 - protein, 17 aa, Staphylococcus
SKIKEFKLLSTAGAYWR

SEQ ID NO: 1998286 - protein, 22 aa, Staphylococcus
SRNVGVPALVVFLNKVDMVDDE

SEQ ID NO: 1998287 - protein, 27 aa, Staphylococcus
SVRSYNCLKRAGINSVQELADKSEADM

SEQ ID NO: 1998288 - protein, 21 aa, Staphylococcus
TERILYYTGRIHKIGETHEGA

SEQ ID NO: 1998289 - protein, 25 aa, Staphylococcus
TETVWRQATTYGVPRIVFVNKMDKL

SEQ ID NO: 1998290 - protein, 20 aa, Staphylococcus
TFSPELVDFSIYIIDVAQGE

SEQ ID NO: 1998291 - protein, 20 aa, Staphylococcus
TFYPMPFLSPETMWYYKSAF

SEQ ID NO: 1998292 - protein, 29 aa, Staphylococcus
TLEAFNYRKVHLFKEWKTEKGIVNYLLDV

SEQ ID NO: 1998293 - protein, 19 aa, Staphylococcus
TLVDELLKQSGIFRENEHV

SEQ ID NO: 1998294 - protein, 17 aa, Staphylococcus
TMASITFQNYFRMYNKL

SEQ ID NO: 1998295 - protein, 20 aa, Staphylococcus
TPLSLGIEIMGGRMNTLIER

SEQ ID NO: 1998296 - protein, 18 aa, Staphylococcus
TQLAGMRGLMAAPSGKII

SEQ ID NO: 1998297 - protein, 25 aa, Staphylococcus
TSETRPVLTGVNWLIQDNELICTAT

SEQ ID NO: 1998298 - protein, 21 aa, Staphylococcus
VALQLGDDVVRTIAMDSTDGV

SEQ ID NO: 1998299 - protein, 19 aa, Staphylococcus
VEGDLRREQNLNIKRLMEI

SEQ ID NO: 1998300 - protein, 26 aa, Staphylococcus
VERARRIQFFLSQNFHVAEQFTGQKG

SEQ ID NO: 1998301 - protein, 18 aa, Staphylococcus
VGHKKAREIWYLCRQYNA

SEQ ID NO: 1998302 - protein, 18 aa, Staphylococcus
VLGICYGMQLTTKLLGGK

SEQ ID NO: 1998303 - protein, 24 aa, Staphylococcus
VLTEFKEWVGDAIFVAHNASFDMG

SEQ ID NO: 1998304 - protein, 20 aa, Staphylococcus
VNLKSIMGVMSLGVGKDAEI

SEQ ID NO: 1998305 - protein, 25 aa, Staphylococcus
VNPDEVVAMGAAIQGGVITGDVKDV

SEQ ID NO: 1998306 - protein, 26 aa, Staphylococcus
VQNIEVLRFANAMFEPLWNNKYISNI

SEQ ID NO: 1998307 - protein, 20 aa, Staphylococcus
VTTLCPCSKEISEYSAHNQR

SEQ ID NO: 1998308 - protein, 17 aa, Staphylococcus
YRYEFQKSILKDRNSYS

SEQ ID NO: 1998309 - protein, 21 aa, Staphylococcus
ACPTCGSCAGMFTANSMNCLM

SEQ ID NO: 1998310 - protein, 20 aa, Staphylococcus
ADKGLIYKGKKPVYWSPSSE

SEQ ID NO: 1998311 - protein, 26 aa, Staphylococcus
AGRARRGELVSCFLLEVDDSLNSINF

SEQ ID NO: 1998312 - protein, 17 aa, Staphylococcus
ALKKYPALNTSFNEEAG

SEQ ID NO: 1998313 - protein, 20 aa, Staphylococcus
ALRKYARVRLSNNIEINAYI

SEQ ID NO: 1998314 - protein, 23 aa, Staphylococcus
ARELECPVIALSQLSRGVEQRQD

SEQ ID NO: 1998315 - protein, 21 aa, Staphylococcus
ARRMAKIVGAPFIKVEATKFT

SEQ ID NO: 1998316 - protein, 18 aa, Staphylococcus
ARTTPSVVAFKNGETQVG

SEQ ID NO: 1998317 - protein, 24 aa, Staphylococcus
AVKEVELTLPLVVRLEGTNVERGK

SEQ ID NO: 1998318 - protein, 22 aa, Staphylococcus
AVSRLVGAPPGYVGHDDGGQLT

SEQ ID NO: 1998319 - protein, 19 aa, Staphylococcus
CGGIHKLIQSGFETLVEAG

SEQ ID NO: 1998320 - protein, 21 aa, Staphylococcus
CPRGASFSWYEYSPLRVKYPY

SEQ ID NO: 1998321 - protein, 17 aa, Staphylococcus
DDNLLGIDYVIPDYTYL

SEQ ID NO: 1998322 - protein, 21 aa, Staphylococcus
DKFKLTVLVDMFGRETPVEVE

SEQ ID NO: 1998323 - protein, 26 aa, Staphylococcus
DLEKLIRLPGKFKYFEHNVAAHSFKV

SEQ ID NO: 1998324 - protein, 24 aa, Staphylococcus
DPASLHKPKAFFGAARNIEAGGSL

SEQ ID NO: 1998325 - protein, 24 aa, Staphylococcus
DPEYYKWTQWIFIQLYNKGLAYVD

SEQ ID NO: 1998326 - protein, 19 aa, Staphylococcus
DRKARSREPITAKLVANLI

SEQ ID NO: 1998327 - protein, 21 aa, Staphylococcus
DRLKVQHLEQLRAIYDEHNLA

SEQ ID NO: 1998328 - protein, 28 aa, Staphylococcus
DTTYGKLGVKVWIYRGEVLPTKNTSEGG

SEQ ID NO: 1998329 - protein, 18 aa, Staphylococcus
DVQTICIGMAASMGSFLL

SEQ ID NO: 1998330 - protein, 24 aa, Staphylococcus
DYIGMPAVCFTEPELAQVGYTEAQ

SEQ ID NO: 1998331 - protein, 24 aa, Staphylococcus
EAIREAGAIPFEFNTIGVDDGIAM

SEQ ID NO: 1998332 - protein, 22 aa, Staphylococcus
ECMACGYQSPKWMGKCPNCGAW

SEQ ID NO: 1998333 - protein, 20 aa, Staphylococcus
EDARQAMLRGVDKLANAVKV

SEQ ID NO: 1998334 - protein, 20 aa, Staphylococcus
EEIEDLFLGLGYEIVDGYEV

SEQ ID NO: 1998335 - protein, 25 aa, Staphylococcus
EEVENFPGFEMITGPDLSTKMFEHA

SEQ ID NO: 1998336 - protein, 28 aa, Staphylococcus
EFCDACIKYQYIGICYGQPGVGKTLSSR

SEQ ID NO: 1998337 - protein, 17 aa, Staphylococcus
EGPKGGPGMPEMLAPTS

SEQ ID NO: 1998338 - protein, 19 aa, Staphylococcus
EINAYIPGIGHNLQEHSVV

SEQ ID NO: 1998339 - protein, 21 aa, Staphylococcus
EIYRIDHYLGKDMVQNIEVLR

SEQ ID NO: 1998340 - protein, 19 aa, Staphylococcus
ELAIVFGRTKRRVDELTSA

SEQ ID NO: 1998341 - protein, 21 aa, Staphylococcus
EMRLDGPTIVAGFLHDVIEDT

SEQ ID NO: 1998342 - protein, 17 aa, Staphylococcus
EPRGCPRGASFSWYEYS

SEQ ID NO: 1998343 - protein, 20 aa, Staphylococcus
EPYIRRRAIRHLEKKRVVIF

SEQ ID NO: 1998344 - protein, 18 aa, Staphylococcus
ERKRPATAKPVLLGITKA

SEQ ID NO: 1998345 - protein, 25 aa, Staphylococcus
ESFLDYAMSVIVSRALPDVRDGLKP

SEQ ID NO: 1998346 - protein, 24 aa, Staphylococcus
EVIERLRPFLLRDGGDCTLVDVED

SEQ ID NO: 1998347 - protein, 17 aa, Staphylococcus
EVPKVLNGLGIALVSTS

SEQ ID NO: 1998348 - protein, 17 aa, Staphylococcus
FHFLPIAVRYDGQKAPV

SEQ ID NO: 1998349 - protein, 25 aa, Staphylococcus
FKLYECDDCSECPLKNQCMNFNSKT

SEQ ID NO: 1998350 - protein, 20 aa, Staphylococcus
FKNTYGHLAGAWRGKKPIQR

SEQ ID NO: 1998351 - protein, 17 aa, Staphylococcus
FQAILPLRGKVINTEKA

SEQ ID NO: 1998352 - protein, 19 aa, Staphylococcus
FQFDETFMMYLPRLCEHCL

SEQ ID NO: 1998353 - protein, 17 aa, Staphylococcus
FYEFYSYLMEPWDGPTM

SEQ ID NO: 1998354 - protein, 18 aa, Staphylococcus
GDVQGSVEALAASLMKID

SEQ ID NO: 1998355 - protein, 24 aa, Staphylococcus
GGYARHGGGCFSGKDPTKVDRSAA

SEQ ID NO: 1998356 - protein, 26 aa, Staphylococcus
GIELGIPEHLVWRQPFPGPGLGIRVL

SEQ ID NO: 1998357 - protein, 20 aa, Staphylococcus
GKDFYMFAPHTVKQEYGVTL

SEQ ID NO: 1998358 - protein, 20 aa, Staphylococcus
GKEGIAVTFVNPIEMDYIRQ

SEQ ID NO: 1998359 - protein, 21 aa, Staphylococcus
GKGKAMGFLVGQIMKASKGQA

SEQ ID NO: 1998360 - protein, 25 aa, Staphylococcus
GKVKMYVCGPTVYNYIHIGNARPAI

SEQ ID NO: 1998361 - protein, 20 aa, Staphylococcus
GNINRPWLTIIMDDYSRAIA

SEQ ID NO: 1998362 - protein, 25 aa, Staphylococcus
GNSLSFRAFYALPLLSNKAGIHTNA

SEQ ID NO: 1998363 - protein, 20 aa, Staphylococcus
GPLDAAIAWSENGLDGSRRF

SEQ ID NO: 1998364 - protein, 18 aa, Staphylococcus
GQVFYLYNKVQSIYEKRE

SEQ ID NO: 1998365 - protein, 20 aa, Staphylococcus
GRDTRGLIRLHQFDKVEMVR

SEQ ID NO: 1998366 - protein, 26 aa, Staphylococcus
GSGKSNITDAIKWVLGEQSAKSLRGS

SEQ ID NO: 1998367 - protein, 17 aa, Staphylococcus
GTGKTSIAKVFAKAINC

SEQ ID NO: 1998368 - protein, 27 aa, Staphylococcus
GTIIAYRSSGGFGVRLDAGDGFQGAEI

SEQ ID NO: 1998369 - protein, 18 aa, Staphylococcus
GTTTGRPRRVGWFDSVVL

SEQ ID NO: 1998370 - protein, 29 aa, Staphylococcus
GVVSINAFKGVSFGEGFKAAEKPGSEIQD

SEQ ID NO: 1998371 - protein, 18 aa, Staphylococcus
GYIHKKGHVGVVSRSGTL

SEQ ID NO: 1998372 - protein, 17 aa, Staphylococcus
HFIRATLESLCYQTRDV

SEQ ID NO: 1998373 - protein, 20 aa, Staphylococcus
HGADTLRLYEMFMGPLDAAI

SEQ ID NO: 1998374 - protein, 29 aa, Staphylococcus
HIQVLLLTFFFKYMKPLVQAGRVFIALPP

SEQ ID NO: 1998375 - protein, 28 aa, Staphylococcus
IEKKLSRYPQLYSRIGFAHEFDNLSKDE

SEQ ID NO: 1998376 - protein, 25 aa, Staphylococcus
IENRPMMYIALSYDHRIIDGKEAVG

SEQ ID NO: 1998377 - protein, 23 aa, Staphylococcus
IGKGIPAALAMSMIKFGMDSYGH

SEQ ID NO: 1998378 - protein, 25 aa, Staphylococcus
INLSEPKALIGFAGRRVIEQTINEK

SEQ ID NO: 1998379 - protein, 24 aa, Staphylococcus
INVKEIRLSPTIEEHDFQTKLKNG

SEQ ID NO: 1998380 - protein, 25 aa, Staphylococcus
IPAISWLEDFLINFENTVIVVSHDR

SEQ ID NO: 1998381 - protein, 18 aa, Staphylococcus
IQKAIPYGTAKINVNTEN

SEQ ID NO: 1998382 - protein, 23 aa, Staphylococcus
ISEDAKFGKFVVEPLERGYGTTL

SEQ ID NO: 1998383 - protein, 23 aa, Staphylococcus
ISPVLWKKVKKGLSAGRVQSVAL

SEQ ID NO: 1998384 - protein, 33 aa, Staphylococcus; identical to SEQ ID NO: 1658613

SEQ ID NO: 1998385 - protein, 19 aa, Staphylococcus
KAYYKWRIDETYIKIKGKW

SEQ ID NO: 1998386 - protein, 20 aa, Staphylococcus
KAYYKWRIDETYIKIKGKWS

SEQ ID NO: 1998387 - protein, 21 aa, Staphylococcus
KDAGKIAGLEVERIINEPTAA

SEQ ID NO: 1998388 - protein, 19 aa, Staphylococcus
KDDEFDRVLGLELGADDYM

SEQ ID NO: 1998389 - protein, 21 aa, Staphylococcus
KDSEIDKVLGLELGADDYVTK

SEQ ID NO: 1998390 - protein, 37 aa, Staphylococcus; identical to SEQ ID NO: 1793739

SEQ ID NO: 1998391 - protein, 18 aa, Staphylococcus
KEVNRLINDMIYFVRDTI

SEQ ID NO: 1998392 - protein, 18 aa, Staphylococcus
KIEGRMKSIHYIATVVSV

SEQ ID NO: 1998393 - protein, 22 aa, Staphylococcus
KIFRNCKGRIIFATFASNIYRV

SEQ ID NO: 1998394 - protein, 20 aa, Staphylococcus
KKAREIWYLCRQYNAQEALD

SEQ ID NO: 1998395 - protein, 22 aa, Staphylococcus
KKDNFYIISIEIVFFSLIQELY

SEQ ID NO: 1998396 - protein, 17 aa, Staphylococcus
KLLSTAGAYWRGDSNNK

SEQ ID NO: 1998397 - protein, 17 aa, Staphylococcus
KMLNDSIRMMWLSQNQK

SEQ ID NO: 1998398 - protein, 19 aa, Staphylococcus
KNGRVGFGTGKAQEVPEAI

SEQ ID NO: 1998399 - protein, 21 aa, Staphylococcus
KRGMAEMQKGGVIMDVVNAEQ

SEQ ID NO: 1998400 - protein, 26 aa, Staphylococcus
KRMQGYNVLHPMGWDAFGLPAEQYAL

SEQ ID NO: 1998401 - protein, 20 aa, Staphylococcus
KRRLGEKVIGFASNEADKYD

SEQ ID NO: 1998402 - protein, 26 aa, Staphylococcus
KVVKGGRRFRFTALVVVGDKNGRVGF

SEQ ID NO: 1998403 - protein, 17 aa, Staphylococcus
LAGGVAVIKVGAASETE

SEQ ID NO: 1998404 - protein, 21 aa, Staphylococcus
LAPSKFEAWFLTTEHTEEDID

SEQ ID NO: 1998405 - protein, 17 aa, Staphylococcus
LDFPVVYASAVNGTASL

SEQ ID NO: 1998406 - protein, 18 aa, Staphylococcus
LDGLNYLAGKTIDEVNTK

SEQ ID NO: 1998407 - protein, 20 aa, Staphylococcus
LDIAELVMELEDEFGTEIPD

SEQ ID NO: 1998408 - protein, 23 aa, Staphylococcus
LEKRGRNYIGLCPFHDEKTPSFT

SEQ ID NO: 1998409 - protein, 22 aa, Staphylococcus
LERKLTEMGIYPAVDPLASTSR

SEQ ID NO: 1998410 - protein, 17 aa, Staphylococcus
LETFLFYSGFYYPLYLA

SEQ ID NO: 1998411 - protein, 17 aa, Staphylococcus
LFKEIFKASTDLQKSEN

SEQ ID NO: 1998412 - protein, 19 aa, Staphylococcus
LGIPLTIITESVFARFISS

SEQ ID NO: 1998413 - protein, 26 aa, Staphylococcus
LIKANIPTRIAFMVSSSVDSRTILDS

SEQ ID NO: 1998414 - protein, 19 aa, Staphylococcus
LKAPIRMHRLLQGDVGSGK

SEQ ID NO: 1998415 - protein, 20 aa, Staphylococcus
LKPMLARGELHCIGATTLNE

SEQ ID NO: 1998416 - protein, 19 aa, Staphylococcus
LKTLIPRQQFEVPVQAAIG

SEQ ID NO: 1998417 - protein, 17 aa, Staphylococcus
LLRGVAREDVQRGQVLA

SEQ ID NO: 1998418 - protein, 20 aa, Staphylococcus
LMEKEIKFIGGVVNDPHKPV

SEQ ID NO: 1998419 - protein, 20 aa, Staphylococcus
LNERFIITRGLDKCLFGYTL

SEQ ID NO: 1998420 - protein, 24 aa, Staphylococcus
LPLPKKVFAHGWILMKDGKMSKSK

SEQ ID NO: 1998421 - protein, 19 aa, Staphylococcus
LPRPFFILAPMEDVTDIVF

SEQ ID NO: 1998422 - protein, 18 aa, Staphylococcus
LQESTGLEAMTIHRLIGW

SEQ ID NO: 1998423 - protein, 19 aa, Staphylococcus
LREGMPIGAKVTLRGERMY

SEQ ID NO: 1998424 - protein, 20 aa, Staphylococcus
LRKPDWLKIKLNTNENYTGL

SEQ ID NO: 1998425 - protein, 19 aa, Staphylococcus
LRSGEVRMILSTCRATIGQ

SEQ ID NO: 1998426 - protein, 19 aa, Staphylococcus
LSYEAGRIPVKYTAQASSP

SEQ ID NO: 1998427 - protein, 19 aa, Staphylococcus
LVQAGRVFIALPPLYKLEK

SEQ ID NO: 1998428 - protein, 25 aa, Staphylococcus
MENNIKIGMELGYIKAPPETFVEPN

SEQ ID NO: 1998429 - protein, 38 aa, Staphylococcus; identical to SEQ ID NO: 1645887

SEQ ID NO: 1998430 - protein, 20 aa, Staphylococcus
MKLEFERNYERYQFLNWATK

SEQ ID NO: 1998431 - protein, 25 aa, Staphylococcus
MTNMFWRQNISQMWVETEFKVSKDI

SEQ ID NO: 1998432 - protein, 18 aa, Staphylococcus
MVRIEAGYTQDTMAQTIG

SEQ ID NO: 1998433 - protein, 20 aa, Staphylococcus
NAITKAGALAANYPFATIDP

SEQ ID NO: 1998434 - protein, 24 aa, Staphylococcus
NDYGMGSSRDWAAKGTNLLGVKTV

SEQ ID NO: 1998435 - protein, 18 aa, Staphylococcus
NKVESLRASYYMMGAMLG

SEQ ID NO: 1998436 - protein, 28 aa, Staphylococcus
NNVKPNWCPGCGDFSVQAAIQKAAANVG

SEQ ID NO: 1998437 - protein, 24 aa, Staphylococcus
NTPARLKYIKSLYTELGKITDIVN

SEQ ID NO: 1998438 - protein, 21 aa, Staphylococcus
PEEIKRTFDKLGIPEAEQKYL

SEQ ID NO: 1998439 - protein, 21 aa, Staphylococcus
PEILEEAYLSKAMVVEVWSKE

SEQ ID NO: 1998440 - protein, 20 aa, Staphylococcus
PFVCGCRNLGEAARRIGEGA

SEQ ID NO: 1998441 - protein, 18 aa, Staphylococcus
PGLPMGAAPMAYTLWTRH

SEQ ID NO: 1998442 - protein, 21 aa, Staphylococcus
PHGGIALGLDRLVMLLTNRTN

SEQ ID NO: 1998443 - protein, 20 aa, Staphylococcus
PHKLRHTFATHLLNQGADLR

SEQ ID NO: 1998444 - protein, 24 aa, Staphylococcus
PKRSKAVINEAYFRTPSTTDYNGV

SEQ ID NO: 1998445 - protein, 21 aa, Staphylococcus
PLLQASWKIAPALATGCSLVM

SEQ ID NO: 1998446 - protein, 24 aa, Staphylococcus
PNVTGKLHLGHAWDTTLQDIITRM

SEQ ID NO: 1998447 - protein, 18 aa, Staphylococcus
PSVPESFRVLMKELQSLG

SEQ ID NO: 1998448 - protein, 19 aa, Staphylococcus
PTAAFVAARAGAMAKHTEH

SEQ ID NO: 1998449 - protein, 24 aa, Staphylococcus
QEKMGRPAVEVILTVLHAGGKFGG

SEQ ID NO: 1998450 - protein, 21 aa, Staphylococcus
QEVPGKLVVVGGGYIGSELGT

SEQ ID NO: 1998451 - protein, 24 aa, Staphylococcus
QLSKIGGGVAINLSKLRARGEAIK

SEQ ID NO: 1998452 - protein, 25 aa, Staphylococcus
QRNGPTGTVKLHFMKQYNKFTDIDY

SEQ ID NO: 1998453 - protein, 19 aa, Staphylococcus
QVNHRGWEDLASKTTDDIL

SEQ ID NO: 1998454 - protein, 18 aa, Staphylococcus
RAHGSGLFTRGQTQALSV

SEQ ID NO: 1998455 - protein, 26 aa, Staphylococcus
RDQHRLYKLIWERFVASQMAPAILDT

SEQ ID NO: 1998456 - protein, 20 aa, Staphylococcus
REIRLRPSYFPFTEPSVEVD

SEQ ID NO: 1998457 - protein, 22 aa, Staphylococcus
RELEAKTGAGFIVALTGAIMTM

SEQ ID NO: 1998458 - protein, 18 aa, Staphylococcus
RIIFATFASNIYRVQQAV

SEQ ID NO: 1998459 - protein, 18 aa, Staphylococcus
RMICSSGNVDSNRLRTGT

SEQ ID NO: 1998460 - protein, 18 aa, Staphylococcus
RPATMLVQTASKFDSDIQ

SEQ ID NO: 1998461 - protein, 18 aa, Staphylococcus
RVTERAYENPRFVEDLIR

SEQ ID NO: 1998462 - protein, 20 aa, Staphylococcus
RWYAVHTYSGYENKVKKNLE

SEQ ID NO: 1998463 - protein, 19 aa, Staphylococcus
SALIKWFNTNYHYIVPEWD

SEQ ID NO: 1998464 - protein, 17 aa, Staphylococcus
SCAGMFTANSMNCLMEV

SEQ ID NO: 1998465 - protein, 24 aa, Staphylococcus
SEMAFKIAASLALKEAAKKCDPVI

SEQ ID NO: 1998466 - protein, 18 aa, Staphylococcus
SIIDGCRLSKAKIIRVNH

SEQ ID NO: 1998467 - protein, 24 aa, Staphylococcus
SKSKRPGLDKAIEFARSGDTIVVW

SEQ ID NO: 1998468 - protein, 19 aa, Staphylococcus
SLKIFSLKGNEPLAQEVAD

SEQ ID NO: 1998469 - protein, 25 aa, Staphylococcus
SPQLFKQLLMISGFDKYYQIVKCFR

SEQ ID NO: 1998470 - protein, 17 aa, Staphylococcus
SRKTFAIISHPDAGKTT

SEQ ID NO: 1998471 - protein, 24 aa, Staphylococcus
TAMYISRLVKPIGIKVTRLAQGLS

SEQ ID NO: 1998472 - protein, 34 aa, Staphylococcus; identical to SEQ ID NO: 1649292

SEQ ID NO: 1998473 - protein, 21 aa, Staphylococcus
TESKMAIAMARQGGLGVIHKN

SEQ ID NO: 1998474 - protein, 18 aa, Staphylococcus
TFDKLGIPEAEQKYLAGV

SEQ ID NO: 1998475 - protein, 26 aa, Staphylococcus
TKKPVIFRATPQWFASINKVRQDILD

SEQ ID NO: 1998476 - protein, 18 aa, Staphylococcus
TLQPAAGAHGEWTALMIF

SEQ ID NO: 1998477 - protein, 29 aa, Staphylococcus
TLYMRIAIELHLKRLIVGGLEKVYEIGRV

SEQ ID NO: 1998478 - protein, 18 aa, Staphylococcus
TNHLDFESINWLINYVKQ

SEQ ID NO: 1998479 - protein, 22 aa, Staphylococcus
TPHTKFKADVYVLSKDEGGRHT

SEQ ID NO: 1998480 - protein, 20 aa, Staphylococcus
TRASLKIQEGCNNFCTFCII

SEQ ID NO: 1998481 - protein, 21 aa, Staphylococcus
TSSDLILYVSYFNHSFTDNDK

SEQ ID NO: 1998482 - protein, 19 aa, Staphylococcus
TTLVLAPLVAAVGVPVAKM

SEQ ID NO: 1998483 - protein, 24 aa, Staphylococcus
TTTECPTCGKFMIKVKTKNGQMLV

SEQ ID NO: 1998484 - protein, 24 aa, Staphylococcus
VADLKVEGALAMILKDAIKPNLVQ

SEQ ID NO: 1998485 - protein, 25 aa, Staphylococcus
VAIDLKINLMFSKVGVPRGRGKIER

SEQ ID NO: 1998486 - protein, 20 aa, Staphylococcus
VAVNWCPALGTVLSNEEVVD

SEQ ID NO: 1998487 - protein, 19 aa, Staphylococcus
VGAEVKDGDILVGKVTPKG

SEQ ID NO: 1998488 - protein, 27 aa, Staphylococcus
VGCRIGCTFCASTLGGLKRNLEAGEIV

SEQ ID NO: 1998489 - protein, 18 aa, Staphylococcus
VGITRSVIVNALRKLESA

SEQ ID NO: 1998490 - protein, 21 aa, Staphylococcus
VKPGKGSAFVRSKLRNLRTGA

SEQ ID NO: 1998491 - protein, 24 aa, Staphylococcus
VRGVPLRLVDTAGIRDTEDIVEKI

SEQ ID NO: 1998492 - protein, 18 aa, Staphylococcus
VVVGGGYIGSELGTAFAN

SEQ ID NO: 1998493 - protein, 18 aa, Staphylococcus
VYLELWVKVQKDWRNKVN

SEQ ID NO: 1998494 - protein, 27 aa, Staphylococcus
WKIAPALATGCSLVMKPSEITPLTTIR

SEQ ID NO: 1998495 - protein, 17 aa, Staphylococcus
WKKSRRLGISLSGTGKE

SEQ ID NO: 1998496 - protein, 17 aa, Staphylococcus
YDLASVGRYKANKKLHL

SEQ ID NO: 1998497 - protein, 17 aa, Staphylococcus
YDYTKFEGEHGAKRSAA

SEQ ID NO: 1998498 - protein, 17 aa, Staphylococcus
YGLTLMISLAKREGQGC

SEQ ID NO: 1998499 - protein, 21 aa, Staphylococcus
YKSYWKLFLKPFETLEAFNYR

SEQ ID NO: 1998500 - protein, 25 aa, Staphylococcus
YPVYEMRWDIGYVLQQIALFPHMTI

SEQ ID NO: 1998501 - protein, 22 aa, Staphylococcus
AEGIVPKLVWTKRIETGEVVTA

SEQ ID NO: 1998502 - protein, 18 aa, Staphylococcus
AGAYGGEVKDCIDYALCV

SEQ ID NO: 1998503 - protein, 23 aa, Staphylococcus
AGIEAGLASARRGAKTLMLTINL

SEQ ID NO: 1998504 - protein, 24 aa, Staphylococcus
AGSEVSALLGRMPSAVGYQPTLAT

SEQ ID NO: 1998505 - protein, 18 aa, Staphylococcus
AIKGIKGVAKGVLPVAKS

SEQ ID NO: 1998506 - protein, 19 aa, Staphylococcus
AKELDEMGADYIAVHTGYD

SEQ ID NO: 1998507 - protein, 20 aa, Staphylococcus
AKGGIVLAIRNELHIPVKYV

SEQ ID NO: 1998508 - protein, 21 aa, Staphylococcus
AKKSLAVAVYNHYKRIQQLGP

SEQ ID NO: 1998509 - protein, 20 aa, Staphylococcus
AKRLVEIGEDVIILMDSITR

SEQ ID NO: 1998510 - protein, 18 aa, Staphylococcus
ARGFIIGCPVAYSMGIGF

SEQ ID NO: 1998511 - protein, 22 aa, Staphylococcus
ARKFMRMFFSGAVEVELDKQGR

SEQ ID NO: 1998512 - protein, 22 aa, Staphylococcus
ARKQVLVDHGFRLPSALDNRPL

SEQ ID NO: 1998513 - protein, 17 aa, Staphylococcus
ARTPLIISGEAEKSTSL

SEQ ID NO: 1998514 - protein, 19 aa, Staphylococcus
ASDGVGLGHQFLRHVERTK

SEQ ID NO: 1998515 - protein, 26 aa, Staphylococcus
ATVSKGGHLKIRLVANKGRGYALAEQ

SEQ ID NO: 1998516 - protein, 17 aa, Staphylococcus
AYENLLFDCLKGDATNF

SEQ ID NO: 1998517 - protein, 20 aa, Staphylococcus
CDPVILEPMMKVTIEMPEEY

SEQ ID NO: 1998518 - protein, 17 aa, Staphylococcus
CGLPKEMALELFKPFVM

SEQ ID NO: 1998519 - protein, 18 aa, Staphylococcus
CKVIKRKGKVMVICDNPK

SEQ ID NO: 1998520 - protein, 18 aa, Staphylococcus
CTIQRRMQKLVEEAPSPI

SEQ ID NO: 1998521 - protein, 19 aa, Staphylococcus
CVRILRRDADRIGIERNFT

SEQ ID NO: 1998522 - protein, 19 aa, Staphylococcus
DDIRVNIVYEIPLSEVVFD

SEQ ID NO: 1998523 - protein, 17 aa, Staphylococcus
DGATWLRTSDFKDDKDR

SEQ ID NO: 1998524 - protein, 22 aa, Staphylococcus
DGRETPRKPRIVNSQKAIRTND

SEQ ID NO: 1998525 - protein, 22 aa, Staphylococcus
DGTKLGFMSFFTKAAVAALKKY

SEQ ID NO: 1998526 - protein, 17 aa, Staphylococcus
DGVVKFERKGRDKKQVS

SEQ ID NO: 1998527 - protein, 25 aa, Staphylococcus
DINKEMFKRQGGYGRGRRMQIEKDA

SEQ ID NO: 1998528 - protein, 23 aa, Staphylococcus
DKINFGDGVARFDLRKEGAKHFH

SEQ ID NO: 1998529 - protein, 24 aa, Staphylococcus
DKMIAELERPYILVTDKKISSFQD

SEQ ID NO: 1998530 - protein, 18 aa, Staphylococcus
DLATSLIVSERIETTEAR

SEQ ID NO: 1998531 - protein, 25 aa, Staphylococcus
DLAVSRTSFDWGVRVPSNPKHVVYV

SEQ ID NO: 1998532 - protein, 25 aa, Staphylococcus
DPHYIEVWGKFTPRGGISIDPYTNY

SEQ ID NO: 1998533 - protein, 17 aa, Staphylococcus
DPLEIVQTISRNHCAYP

SEQ ID NO: 1998534 - protein, 25 aa, Staphylococcus
DPVLSRVSVHLANFLEIPFDVYPQD

SEQ ID NO: 1998535 - protein, 17 aa, Staphylococcus
DPYLRPLYDGLNTVLGR

SEQ ID NO: 1998536 - protein, 22 aa, Staphylococcus
DQLTCIFVDHGLLRKGEGDMVM

SEQ ID NO: 1998537 - protein, 17 aa, Staphylococcus
DRIAGFTPIPAMSMISY

SEQ ID NO: 1998538 - protein, 18 aa, Staphylococcus
DTSMGFTPLAGVTMGTRS

SEQ ID NO: 1998539 - protein, 26 aa, Staphylococcus
DVEFYPVLCGTAFKNKGVQLMLNAVI

SEQ ID NO: 1998540 - protein, 23 aa, Staphylococcus
EATRILTERGILLVPDVLASAGG

SEQ ID NO: 1998541 - protein, 28 aa, Staphylococcus
EDGMPGLTICGGYQFLGTKYITPDGTEL

SEQ ID NO: 1998542 - protein, 21 aa, Staphylococcus
EEAKCPNIHECWGARRTATFM

SEQ ID NO: 1998543 - protein, 21 aa, Staphylococcus
EEAKMSGQVILLLDEIHRLDK

SEQ ID NO: 1998544 - protein, 21 aa, Staphylococcus
EEFKVAIEGVIFDINLKELKS

SEQ ID NO: 1998545 - protein, 19 aa, Staphylococcus
EERVMRPLHFAIIDEVDSI

SEQ ID NO: 1998546 - protein, 20 aa, Staphylococcus
EFRPRVKAQIGGRRNGALIS

SEQ ID NO: 1998547 - protein, 22 aa, Staphylococcus
EGEVPFKPSRVILQDFTGVPAV

SEQ ID NO: 1998548 - protein, 17 aa, Staphylococcus
EGLPLPDLIIVDGGKGH

SEQ ID NO: 1998549 - protein, 24 aa, Staphylococcus
EHAYQLLLDEGFIYSKPRSGYYVS

SEQ ID NO: 1998550 - protein, 21 aa, Staphylococcus
EIEGRTAIIIDDIIDTAGTIT

SEQ ID NO: 1998551 - protein, 29 aa, Staphylococcus
EKAGYKPGEDVFLGFDCASSEFYENGVYD

SEQ ID NO: 1998552 - protein, 22 aa, Staphylococcus
EKGVHRLVRISPFDSSGRRHTS

SEQ ID NO: 1998553 - protein, 20 aa, Staphylococcus
ELFNAMVMTPYFPKPDVLIY

SEQ ID NO: 1998554 - protein, 18 aa, Staphylococcus
ELNHEVQRLYVFTKAASS

SEQ ID NO: 1998555 - protein, 23 aa, Staphylococcus
ELPYGAVPIDFAYAIHSEVGNKM

SEQ ID NO: 1998556 - protein, 17 aa, Staphylococcus
EMKRNLKRFKEVRKEIE

SEQ ID NO: 1998557 - protein, 19 aa, Staphylococcus
EMRELSYAGFSVFHDEALQ

SEQ ID NO: 1998558 - protein, 25 aa, Staphylococcus
EPEILKPRLVPLLQMSNKEFKNTYG

SEQ ID NO: 1998559 - protein, 21 aa, Staphylococcus
ETKGAFPTWLAPKQVEIIPVN

SEQ ID NO: 1998560 - protein, 25 aa, Staphylococcus
EVIREREHFAIFPASHFVTREEKMK

SEQ ID NO: 1998561 - protein, 33 aa, Staphylococcus; identical to SEQ ID NO: 1646178

SEQ ID NO: 1998562 - protein, 20 aa, Staphylococcus
EVTPSMMVFTNFFRDQMDRF

SEQ ID NO: 1998563 - protein, 21 aa, Staphylococcus
FAVVGDTLFNNGIGRTDLYRG

SEQ ID NO: 1998564 - protein, 20 aa, Staphylococcus
FEDYFLIVSDLIHYAKTHDV

SEQ ID NO: 1998565 - protein, 27 aa, Staphylococcus
FERELGFLALHGFLHLLGYDHMNEEDE

SEQ ID NO: 1998566 - protein, 31 aa, Staphylococcus; identical to SEQ ID NO: 1794852

SEQ ID NO: 1998567 - protein, 17 aa, Staphylococcus
FKGQKMPGRMGGNTVTV

SEQ ID NO: 1998568 - protein, 18 aa, Staphylococcus
FMKAILGFTRMSVRGLNK

SEQ ID NO: 1998569 - protein, 18 aa, Staphylococcus
FNTNYHYIVPEWDNVEPK

SEQ ID NO: 1998570 - protein, 18 aa, Staphylococcus
FPYPSGAGLHVGHPEGYT

SEQ ID NO: 1998571 - protein, 18 aa, Staphylococcus
FQEHGHRPIVLIGGGTGM

SEQ ID NO: 1998572 - protein, 23 aa, Staphylococcus
FSLEAFNLYGALSMANAGPNTNG

SEQ ID NO: 1998573 - protein, 18 aa, Staphylococcus
GDSFTFDKVLFVGGDSVK

SEQ ID NO: 1998574 - protein, 18 aa, Staphylococcus
GEEFFWSMMDEINEEEDF

SEQ ID NO: 1998575 - protein, 24 aa, Staphylococcus
GEVSEGRGIISYEMGSDGSGGKYL

SEQ ID NO: 1998576 - protein, 26 aa, Staphylococcus
GGQQQRVCIARCLAIEPDVILMDEPT

SEQ ID NO: 1998577 - protein, 25 aa, Staphylococcus
GKSLSRLGGGIGTRGPGETKLEMDR

SEQ ID NO: 1998578 - protein, 19 aa, Staphylococcus
GKTPILGLDVWEHAYYLKY

SEQ ID NO: 1998579 - protein, 23 aa, Staphylococcus
GLGRFGGSIVRELNALDMDVMAI

SEQ ID NO: 1998580 - protein, 24 aa, Staphylococcus
GLYEEMNHLLYCSSAGHEPGYIYR

SEQ ID NO: 1998581 - protein, 18 aa, Staphylococcus
GMLMAYEVTRDLELQDVE

SEQ ID NO: 1998582 - protein, 24 aa, Staphylococcus
GNIIAEVFNRFSITDTSMMLDRMK

SEQ ID NO: 1998583 - protein, 20 aa, Staphylococcus
GRASKRLQESTGLEAMTIHR

SEQ ID NO: 1998584 - protein, 20 aa, Staphylococcus
GRSRWKGIRPTVRGSVMNPN

SEQ ID NO: 1998585 - protein, 29 aa, Staphylococcus
GSGKSVCINSILMSLLYKNHPEELRLLLI

SEQ ID NO: 1998586 - protein, 24 aa, Staphylococcus
GSGKTVVAAICMYALKTAGYQSAL

SEQ ID NO: 1998587 - protein, 19 aa, Staphylococcus
GSHFHRAPGSVGMASDASR

SEQ ID NO: 1998588 - protein, 23 aa, Staphylococcus
GSHYIWMARKFRSYNPRHLLFSN

SEQ ID NO: 1998589 - protein, 27 aa, Staphylococcus
GTMTEEDWNRFTIAVGKLSRTKIFIDD

SEQ ID NO: 1998590 - protein, 19 aa, Staphylococcus
GVYICNECIELCSEIVEEE

SEQ ID NO: 1998591 - protein, 25 aa, Staphylococcus
HADFGGEVERIMKMVDGVVLVVDAY

SEQ ID NO: 1998592 - protein, 17 aa, Staphylococcus
HIGEVNGTISIGCSSLI

SEQ ID NO: 1998593 - protein, 17 aa, Staphylococcus
HIPFCVRICTYCDFNKY

SEQ ID NO: 1998594 - protein, 25 aa, Staphylococcus
HLDRKLSERRIFPAIDIGRSSTRKE

SEQ ID NO: 1998595 - protein, 18 aa, Staphylococcus
HPNKRRISNTGQRAITHI

SEQ ID NO: 1998596 - protein, 25 aa, Staphylococcus
HTTDLRKKAVYSFMAMMEQIHAKSY

SEQ ID NO: 1998597 - protein, 19 aa, Staphylococcus
IADEVGAKLMVDMAHIAGL

SEQ ID NO: 1998598 - protein, 18 aa, Staphylococcus
IAGFKEIEYEVMRDKNDN

SEQ ID NO: 1998599 - protein, 23 aa, Staphylococcus
ICIGMAASMGSFLLAAGAKGKRF

SEQ ID NO: 1998600 - protein, 19 aa, Staphylococcus
IDEGCLIEDGHCIRTIHAE

SEQ ID NO: 1998601 - protein, 18 aa, Staphylococcus
IDHLYGIPGDSIDAVVDS

SEQ ID NO: 1998602 - protein, 23 aa, Staphylococcus
IFNHLFKQAITFAKKAHNETDIA

SEQ ID NO: 1998603 - protein, 17 aa, Staphylococcus
IGEGAAMLRTKGEPGTG

SEQ ID NO: 1998604 - protein, 17 aa, Staphylococcus
IHRLIGWNQDTQPEDIL

SEQ ID NO: 1998605 - protein, 19 aa, Staphylococcus
IIRGLRAVSDFEYELRLTS

SEQ ID NO: 1998606 - protein, 20 aa, Staphylococcus
IKGTGPRYCPSIEDKFVRFN

SEQ ID NO: 1998607 - protein, 25 aa, Staphylococcus
IKSLKISFNKVFGYFIEITRANLQG

SEQ ID NO: 1998608 - protein, 18 aa, Staphylococcus
ILMISRAVLTPGDKIVTS

SEQ ID NO: 1998609 - protein, 33 aa, Staphylococcus; identical to SEQ ID NO: 1793694

SEQ ID NO: 1998610 - protein, 18 aa, Staphylococcus
IQAGLGRSGKLFATDWDN

SEQ ID NO: 1998611 - protein, 26 aa, Staphylococcus
IQGPDFPTAGLILGKSGIRRAYETGR

SEQ ID NO: 1998612 - protein, 25 aa, Staphylococcus
IQPGDDVGRAFSFETTEYILDQLPC

SEQ ID NO: 1998613 - protein, 24 aa, Staphylococcus
IRHLEKKRVVIFAAGIGNPYFSTD

SEQ ID NO: 1998614 - protein, 17 aa, Staphylococcus
IRNELHIPVKYVGLGEK

SEQ ID NO: 1998615 - protein, 25 aa, Staphylococcus
ISGKELRDTLHFEMLWDTSKIDVII

SEQ ID NO: 1998616 - protein, 23 aa, Staphylococcus
ISKIPRFPFDKFEKGERELGTQM

SEQ ID NO: 1998617 - protein, 23 aa, Staphylococcus
ISRQRVWGVPLPVFYAENGDIIM

SEQ ID NO: 1998618 - protein, 25 aa, Staphylococcus
ISTGASWRKLNIPGEDRLINKGVAF

SEQ ID NO: 1998619 - protein, 23 aa, Staphylococcus
ITLDEAFVIHDLRVIEGNSGLFV

SEQ ID NO: 1998620 - protein, 18 aa, Staphylococcus
ITPGNFIFRTREFEQMEL

SEQ ID NO: 1998621 - protein, 19 aa, Staphylococcus
IVAAPVLALSLSFDHRQID

SEQ ID NO: 1998622 - protein, 26 aa, Staphylococcus
IVKKFPIPHISTGDMFRKAIKDETDL

SEQ ID NO: 1998623 - protein, 18 aa, Staphylococcus
IYDGTVIVKSVAREAGDR

SEQ ID NO: 1998624 - protein, 23 aa, Staphylococcus
KARDKKLGLDDMVNGSFTITNGG

SEQ ID NO: 1998625 - protein, 19 aa, Staphylococcus
KASEGGMRDALSIMDQAIA

SEQ ID NO: 1998626 - protein, 26 aa, Staphylococcus
KAVAEMKLAVGLLVDKKLSHMRIHSI

SEQ ID NO: 1998627 - protein, 34 aa, Staphylococcus; identical to SEQ ID NO: 1793728

SEQ ID NO: 1998628 - protein, 18 aa, Staphylococcus
KDFGRVGAQAAKQAVMQR

SEQ ID NO: 1998629 - protein, 25 aa, Staphylococcus
KEFFPENRVEYFVSYYDYYQPEAYV

SEQ ID NO: 1998630 - protein, 18 aa, Staphylococcus
KEMSVLELNDLVKAIEEE

SEQ ID NO: 1998631 - protein, 34 aa, Staphylococcus; identical to SEQ ID NO: 1647346

SEQ ID NO: 1998632 - protein, 25 aa, Staphylococcus
KGDKCKVSIRFRGRAITHKEIGQRV

SEQ ID NO: 1998633 - protein, 18 aa, Staphylococcus
KGRQAYVICPLIESSEHL

SEQ ID NO: 1998634 - protein, 18 aa, Staphylococcus
KIQQGWFDFDVVVATPDM

SEQ ID NO: 1998635 - protein, 17 aa, Staphylococcus
KLFLKRNSNPFIAALSA

SEQ ID NO: 1998636 - protein, 17 aa, Staphylococcus
KLHLVPSGIFYKDKLAV

SEQ ID NO: 1998637 - protein, 18 aa, Staphylococcus
KLPHLKEAEILFFIDNID

SEQ ID NO: 1998638 - protein, 18 aa, Staphylococcus
KQEHGLDMIVIDYLQLIQ

SEQ ID NO: 1998639 - protein, 19 aa, Staphylococcus
KQGVIRLFLKYGQNNERVI

SEQ ID NO: 1998640 - protein, 22 aa, Staphylococcus
KQVIKTWSRRSTIFPNFIGHTF

SEQ ID NO: 1998641 - protein, 19 aa, Staphylococcus
KRMFEYGGGFIQDRSIYED

SEQ ID NO: 1998642 - protein, 18 aa, Staphylococcus
KRPGMYIGSTDKRGLHHL

SEQ ID NO: 1998643 - protein, 17 aa, Staphylococcus
KRRGGGISETFTVRKIS

SEQ ID NO: 1998644 - protein, 29 aa, Staphylococcus
KSIAYPRQIAMYLSRELTDFSLPKIGEEF

SEQ ID NO: 1998645 - protein, 19 aa, Staphylococcus
KSILSERGLETAVGDEGGF

SEQ ID NO: 1998646 - protein, 24 aa, Staphylococcus
KSLKDHFYRYSLKLRQKVKTVTID

SEQ ID NO: 1998647 - protein, 25 aa, Staphylococcus
KSLTGGCPMGPYIVTKDELPTPENV

SEQ ID NO: 1998648 - protein, 23 aa, Staphylococcus
LALKEEGYRVILVNSNPATIMTD

SEQ ID NO: 1998649 - protein, 19 aa, Staphylococcus
LAMTDCLNYGSPEKKEIYQ

SEQ ID NO: 1998650 - protein, 17 aa, Staphylococcus
LATLKVIGVGGGGNNAV

SEQ ID NO: 1998651 - protein, 24 aa, Staphylococcus
LDGDTRGGAALSIRSVTQKPIKFV

SEQ ID NO: 1998652 - protein, 23 aa, Staphylococcus
LDMAKRLLDFGVHPPTIYFPLNV

SEQ ID NO: 1998653 - protein, 26 aa, Staphylococcus
LEEVCGACSMVINGRARQSCSAIVDQ

SEQ ID NO: 1998654 - protein, 19 aa, Staphylococcus
LERTVAWISGVEHVRETSP

SEQ ID NO: 1998655 - protein, 18 aa, Staphylococcus
LESVLRQEDDFVITDDHI

SEQ ID NO: 1998656 - protein, 23 aa, Staphylococcus
LFKIVSASLVKYYYRTPRIPRSL

SEQ ID NO: 1998657 - protein, 18 aa, Staphylococcus
LGFPRLGRKREWKKAIES

SEQ ID NO: 1998658 - protein, 19 aa, Staphylococcus
LGGVGEIAKNMYIVEVDDE

SEQ ID NO: 1998659 - protein, 20 aa, Staphylococcus
LLESIYTLALAKSHRTSNDK

SEQ ID NO: 1998660 - protein, 18 aa, Staphylococcus
LLNSLRFGELSVKQNQRL

SEQ ID NO: 1998661 - protein, 18 aa, Staphylococcus
LLSSVLMLEHLGWQEAAD

SEQ ID NO: 1998662 - protein, 20 aa, Staphylococcus
LPYSIRVLLESVLRQEDDFV

SEQ ID NO: 1998663 - protein, 20 aa, Staphylococcus
LRDWLFSRQRYWGEPIPIIH

SEQ ID NO: 1998664 - protein, 23 aa, Staphylococcus
LRVPHGAGGIVLDVKVFNREEGD

SEQ ID NO: 1998665 - protein, 25 aa, Staphylococcus
LSGTVRNVVDFGAFVDIGVKQDGLV

SEQ ID NO: 1998666 - protein, 19 aa, Staphylococcus
LSSVIGCRDDIMVYLMYAG

SEQ ID NO: 1998667 - protein, 18 aa, Staphylococcus
LTNKRSSGKIAFLQLRDG

SEQ ID NO: 1998668 - protein, 18 aa, Staphylococcus
LVDAPCSGLGVLRHKPEI

SEQ ID NO: 1998669 - protein, 18 aa, Staphylococcus
LVGYNISPVLWKKVKKGL

SEQ ID NO: 1998670 - protein, 29 aa, Staphylococcus
LVPGYEAPCYIAWSGKNRSPLVRVPSSRG

SEQ ID NO: 1998671 - protein, 25 aa, Staphylococcus
MAEPGEYTKRAFLNGRIDLSQAEAV

SEQ ID NO: 1998672 - protein, 18 aa, Staphylococcus
MAIYPCLTSGGTLNLVDK

SEQ ID NO: 1998673 - protein, 20 aa, Staphylococcus
MAKEIVRFHSIIWPILLMAL

SEQ ID NO: 1998674 - protein, 18 aa, Staphylococcus
MEHIERAGVHSGDSIAVY

SEQ ID NO: 1998675 - protein, 17 aa, Staphylococcus
MGKGAGTVKHFGLQDKI

SEQ ID NO: 1998676 - protein, 26 aa, Staphylococcus
MHSAKGLEFPIVFIMGMEESLFPHIR

SEQ ID NO: 1998677 - protein, 19 aa, Staphylococcus
MKGKQILGVDPAFRTGCKL

SEQ ID NO: 1998678 - protein, 24 aa, Staphylococcus
MNPVELRRSIGYVIQQIGLMPHMT

SEQ ID NO: 1998679 - protein, 17 aa, Staphylococcus
MQKGGVIMDVVNAEQAK

SEQ ID NO: 1998680 - protein, 26 aa, Staphylococcus
MSPRALEEVIYFASYVVVDPGPTGLE

SEQ ID NO: 1998681 - protein, 24 aa, Staphylococcus
MSYGIKYASSFFGPFRDAADSAPS

SEQ ID NO: 1998682 - protein, 17 aa, Staphylococcus
MTMTDAIVRLIPGVLGN

SEQ ID NO: 1998683 - protein, 18 aa, Staphylococcus
MTPYFPKPDVLIYLECDY

SEQ ID NO: 1998684 - protein, 21 aa, Staphylococcus
MTTIRVARAYTKRNKIIKFAG

SEQ ID NO: 1998685 - protein, 18 aa, Staphylococcus
MVIDCAKGIEPQTLKLFK

SEQ ID NO: 1998686 - protein, 19 aa, Staphylococcus
MWYYKSAFNTDQMKLIDLI

SEQ ID NO: 1998687 - protein, 28 aa, Staphylococcus
NESSCVSCGQCATVCPCNAMMEVNMEGN

SEQ ID NO: 1998688 - protein, 24 aa, Staphylococcus
NGLKRNIVHMGHFEAGEAINTVPS

SEQ ID NO: 1998689 - protein, 19 aa, Staphylococcus
NKGRVYKLKGYEVPELSRQ

SEQ ID NO: 1998690 - protein, 17 aa, Staphylococcus
NNIPKHELLILCTGSQG

SEQ ID NO: 1998691 - protein, 20 aa, Staphylococcus
NQFRIGLSRMERVVRERMSI

SEQ ID NO: 1998692 - protein, 24 aa, Staphylococcus
NQTSLKLAAAFAAGSPVVLKPSEE

SEQ ID NO: 1998693 - protein, 17 aa, Staphylococcus
NRPEVRNAFTPKTVAEM

SEQ ID NO: 1998694 - protein, 17 aa, Staphylococcus
NSADSFRDLIKVLVELE

SEQ ID NO: 1998695 - protein, 25 aa, Staphylococcus
NTELEVVEGMQFDRGYQSPYMVTDS

SEQ ID NO: 1998696 - protein, 23 aa, Staphylococcus
PAVEAGESLGFLPGDLKEKVDPY

SEQ ID NO: 1998697 - protein, 20 aa, Staphylococcus
PCGRSLCCSTFLGDFEPVSI

SEQ ID NO: 1998698 - protein, 19 aa, Staphylococcus
PCLITIFGATGDLSHRKLF

SEQ ID NO: 1998699 - protein, 19 aa, Staphylococcus
PDYETRMAILQKKIEEENL

SEQ ID NO: 1998700 - protein, 22 aa, Staphylococcus
PGREAYPGDVFYLHSRLLERAA

SEQ ID NO: 1998701 - protein, 17 aa, Staphylococcus
PKNRRIAAGPEIQSRGF

SEQ ID NO: 1998702 - protein, 20 aa, Staphylococcus
PLEKLGRYLMDSFVNIEGTG

SEQ ID NO: 1998703 - protein, 17 aa, Staphylococcus
PLGPRPIDQHIKGFKAL

SEQ ID NO: 1998704 - protein, 17 aa, Staphylococcus
PMAYTLWTRHLNFNPQS

SEQ ID NO: 1998705 - protein, 26 aa, Staphylococcus
PNEPIIPFIIGDGIGPDIWKAASRVI

SEQ ID NO: 1998706 - protein, 18 aa, Staphylococcus
PNIFTGCGNFHGPFEYAS

SEQ ID NO: 1998707 - protein, 22 aa, Staphylococcus
PNKEHMEMPGLHSLEHLMAENI

SEQ ID NO: 1998708 - protein, 19 aa, Staphylococcus
PQFTPEIFMKVSAKNVMKQ

SEQ ID NO: 1998709 - protein, 22 aa, Staphylococcus
PSDIRAAGGVARSANPKIVEEV

SEQ ID NO: 1998710 - protein, 20 aa, Staphylococcus
PSGIFYKDKLAVIGNGVVVD

SEQ ID NO: 1998711 - protein, 18 aa, Staphylococcus
PVMKFFKYFYSNRGPVID

SEQ ID NO: 1998712 - protein, 18 aa, Staphylococcus
PVYRRPMKQWVLKITEYA

SEQ ID NO: 1998713 - protein, 18 aa, Staphylococcus
PYQARRIAFNINIPKESI

SEQ ID NO: 1998714 - protein, 25 aa, Staphylococcus
QDIFIPKGQSLGAVDGHKVLVQITK

SEQ ID NO: 1998715 - protein, 20 aa, Staphylococcus
QEMYQGFFLAPHVVSQSLKG

SEQ ID NO: 1998716 - protein, 17 aa, Staphylococcus
QERLAKLAGGVAVIKVG

SEQ ID NO: 1998717 - protein, 19 aa, Staphylococcus
QGYDVIGIFMKNWDDTDEN

SEQ ID NO: 1998718 - protein, 22 aa, Staphylococcus
QHIKVRVTGIQPYGAFVETPDH

SEQ ID NO: 1998719 - protein, 23 aa, Staphylococcus
QLMMLEPKFAILDEIDSGLDIDA

SEQ ID NO: 1998720 - protein, 19 aa, Staphylococcus
QLQSGYPYLMFKDNANKVH

SEQ ID NO: 1998721 - protein, 23 aa, Staphylococcus
QPAAYCGVVGMKPTYGRVSRFGL

SEQ ID NO: 1998722 - protein, 18 aa, Staphylococcus
QRVLLALINKGMVREEAY

SEQ ID NO: 1998723 - protein, 17 aa, Staphylococcus
QTFLKRVIAEMGGKDAI

SEQ ID NO: 1998724 - protein, 25 aa, Staphylococcus
QYTTRLGIRLEKTFEYIDTPHKFKM

SEQ ID NO: 1998725 - protein, 18 aa, Staphylococcus
REEVDAFLDDIITDYQKM

SEQ ID NO: 1998726 - protein, 23 aa, Staphylococcus
RKNHPKTLFVWRSNLISSSAKGQ

SEQ ID NO: 1998727 - protein, 17 aa, Staphylococcus
RKREFYEKPSVKRKKKS

SEQ ID NO: 1998728 - protein, 17 aa, Staphylococcus
RKTMFVRTAGCDYRCSW

SEQ ID NO: 1998729 - protein, 37 aa, Staphylococcus; identical to SEQ ID NO: 1648709

SEQ ID NO: 1998730 - protein, 17 aa, Staphylococcus
RLRTGTMTEEDWNRFTI

SEQ ID NO: 1998731 - protein, 18 aa, Staphylococcus
RNGREFALGPTHEEVVTS

SEQ ID NO: 1998732 - protein, 21 aa, Staphylococcus
RPEDLQSYGLIPEFIGRVPIV

SEQ ID NO: 1998733 - protein, 19 aa, Staphylococcus
RPRRVGWFDSVVLRHSRRV

SEQ ID NO: 1998734 - protein, 20 aa, Staphylococcus
RQRQSILEILAQVEVNIDYP

SEQ ID NO: 1998735 - protein, 19 aa, Staphylococcus
RRILLSSLPGAAVKYIEIE

SEQ ID NO: 1998736 - protein, 19 aa, Staphylococcus
RRLIDSPKVATYDLKPEMS

SEQ ID NO: 1998737 - protein, 25 aa, Staphylococcus
RRQAKAVNFGIVYGISDYGLSQSLG

SEQ ID NO: 1998738 - protein, 20 aa, Staphylococcus
RRVSPFFVPMLIPDMATGQV

SEQ ID NO: 1998739 - protein, 20 aa, Staphylococcus
RSAAYAARYVAKNIVAAGLA

SEQ ID NO: 1998740 - protein, 21 aa, Staphylococcus
RSYVFHPYSMVKDHRTNEETG

SEQ ID NO: 1998741 - protein, 28 aa, Staphylococcus
RTNVPAIFCSGGPMKAGLSAQGKALTLS

SEQ ID NO: 1998742 - protein, 25 aa, Staphylococcus
SCGDCTICVDRCPTGALVGNGQLNS

SEQ ID NO: 1998743 - protein, 25 aa, Staphylococcus
SCGDIAVSVYSGWLAYSTFDHDWVK

SEQ ID NO: 1998744 - protein, 20 aa, Staphylococcus
SDKNLVPILMLTAKDDEFDR

SEQ ID NO: 1998745 - protein, 17 aa, Staphylococcus
SELKKGRQAYVICPLIE

SEQ ID NO: 1998746 - protein, 29 aa, Staphylococcus
SENHACPICGFSIGELEPRMFSFNSPFGA

SEQ ID NO: 1998747 - protein, 26 aa, Staphylococcus
SGGEKARLQLALLMLQRDNVLILDEP

SEQ ID NO: 1998748 - protein, 18 aa, Staphylococcus
SGMIKGTGPRYCPSIEDK

SEQ ID NO: 1998749 - protein, 25 aa, Staphylococcus
SIRLKSKKGTLLWLMDETKTPMGAR

SEQ ID NO: 1998750 - protein, 21 aa, Staphylococcus
SKIQIGEKLTRGLGAGANPEI

SEQ ID NO: 1998751 - protein, 22 aa, Staphylococcus
SKQPLEYPSCGSVFQRPPGHFA

SEQ ID NO: 1998752 - protein, 27 aa, Staphylococcus
SKVCLANLLRICARYDNLDIIEDAYGI

SEQ ID NO: 1998753 - protein, 19 aa, Staphylococcus
SNIPYTMVGGQKFYDRKEI

SEQ ID NO: 1998754 - protein, 17 aa, Staphylococcus
SPIRRYPDLTVHRLIRK

SEQ ID NO: 1998755 - protein, 22 aa, Staphylococcus
SRYQMYWQIYFHPVSRGGEVLL

SEQ ID NO: 1998756 - protein, 24 aa, Staphylococcus
STIFPNFIGHTFAVYDGRKHVPVY

SEQ ID NO: 1998757 - protein, 23 aa, Staphylococcus
SVIKSKHFEISFYLTTHSIPEAY

SEQ ID NO: 1998758 - protein, 21 aa, Staphylococcus
SVRIPEELLQFEGQTKSKLGT

SEQ ID NO: 1998759 - protein, 24 aa, Staphylococcus
SYCGPGRRKTFAFVNNRPLAALTE

SEQ ID NO: 1998760 - protein, 35 aa, Staphylococcus; identical to SEQ ID NO: 1794091

SEQ ID NO: 1998761 - protein, 18 aa, Staphylococcus
TEAAIAYQSGFNCNMAAI

SEQ ID NO: 1998762 - protein, 24 aa, Staphylococcus
TEVPACNEVQCGWAASHSLEGAKE

SEQ ID NO: 1998763 - protein, 19 aa, Staphylococcus
TFVPARNLLFLSFAGALAY

SEQ ID NO: 1998764 - protein, 17 aa, Staphylococcus
TGLTISVDNGIWKVIDF

SEQ ID NO: 1998765 - protein, 24 aa, Staphylococcus
TRELSRLYVYAHHKGLKSLYYTRN

SEQ ID NO: 1998766 - protein, 17 aa, Staphylococcus
TYLNALAGRGVHVITVN

SEQ ID NO: 1998767 - protein, 26 aa, Staphylococcus
VDAMISRSEFYTAYTPYQPEISQGEL

SEQ ID NO: 1998768 - protein, 20 aa, Staphylococcus
VDEVEFIKVIREVGRNGVID

SEQ ID NO: 1998769 - protein, 22 aa, Staphylococcus
VDKKLSHMRIHSINIKEFETNC

SEQ ID NO: 1998770 - protein, 25 aa, Staphylococcus
VDVGQRGFVPASLISTDFIEDFSVF

SEQ ID NO: 1998771 - protein, 25 aa, Staphylococcus
VEERSAVSIGRRVQDPLSELVKIDP

SEQ ID NO: 1998772 - protein, 18 aa, Staphylococcus
VGNKMIGAKVNGKIVPID

SEQ ID NO: 1998773 - protein, 21 aa, Staphylococcus
VHDTIPWPNYVNYAASKGGLK

SEQ ID NO: 1998774 - protein, 26 aa, Staphylococcus
VHSRFSTNTFPSWKRAHPNRLLMHNG

SEQ ID NO: 1998775 - protein, 24 aa, Staphylococcus
VKQKGADIARLWVSSTDYLADVRI

SEQ ID NO: 1998776 - protein, 17 aa, Staphylococcus
VPAGGALAVDRHDFAGY

SEQ ID NO: 1998777 - protein, 21 aa, Staphylococcus
VPEFGTGFVRQMLEDTKPTTF

SEQ ID NO: 1998778 - protein, 18 aa, Staphylococcus
VRNMFGYTGTYKGKEISV

SEQ ID NO: 1998779 - protein, 17 aa, Staphylococcus
VSGTANWTDIRQFNLMF

SEQ ID NO: 1998780 - protein, 25 aa, Staphylococcus
VSVATFTLAVNRTFTNAQGEREADF

SEQ ID NO: 1998781 - protein, 22 aa, Staphylococcus
VTAARLGWLPSYPQFNKNSLLF

SEQ ID NO: 1998782 - protein, 26 aa, Staphylococcus
VTIPPWNFPFAIMAGTTLAPVVAGNT

SEQ ID NO: 1998783 - protein, 17 aa, Staphylococcus
VVARGMGKCCVTGCSDL

SEQ ID NO: 1998784 - protein, 17 aa, Staphylococcus
VVLRHSRRVSGITDLSI

SEQ ID NO: 1998785 - protein, 17 aa, Staphylococcus
VYECKFLTVATGYYGQH

SEQ ID NO: 1998786 - protein, 22 aa, Staphylococcus
WEESGRWGAYGPELMRLKDRNG

SEQ ID NO: 1998787 - protein, 25 aa, Staphylococcus
WQGPPRLQNGTSWFYFATDQWKYEE

SEQ ID NO: 1998788 - protein, 21 aa, Staphylococcus
WSRIPHFYMNYYVYQYATGYS

SEQ ID NO: 1998789 - protein, 18 aa, Staphylococcus
WYANSGHVITIDKEKEQV

SEQ ID NO: 1998790 - protein, 20 aa, Staphylococcus
YAIGMGHTIHALRRNMNMTY

SEQ ID NO: 1998791 - protein, 25 aa, Staphylococcus
YALEKEDFILPGYRDVPQIIWHGLP

SEQ ID NO: 1998792 - protein, 17 aa, Staphylococcus
YEIPLSEVVFDFFDQLK

SEQ ID NO: 1998793 - protein, 18 aa, Staphylococcus
YENVPLWHERDISHSSAE

SEQ ID NO: 1998794 - protein, 18 aa, Staphylococcus
YEYDLEYGTNVLTMHKDA

SEQ ID NO: 1998795 - protein, 25 aa, Staphylococcus
YFGGIKLGGGGLIRAYSGAVRDVIY

SEQ ID NO: 1998796 - protein, 18 aa, Staphylococcus
YGARPLIRAIQKTVEDNL

SEQ ID NO: 1998797 - protein, 23 aa, Staphylococcus
YGCDKFCTYCIVPFTRGKERSRR

SEQ ID NO: 1998798 - protein, 19 aa, Staphylococcus
YHPEARPGPSDSNYLFDEF

SEQ ID NO: 1998799 - protein, 19 aa, Staphylococcus
YIDSVQYFRIVNLMKKKRS

SEQ ID NO: 1998800 - protein, 23 aa, Staphylococcus
YKAAELQGRLRAERFIHLMQNEI

SEQ ID NO: 1998801 - protein, 20 aa, Staphylococcus
YKKSARIVGDVMGKYHPHGD

SEQ ID NO: 1998802 - protein, 17 aa, Staphylococcus
YPHDWRTKKPVIFRATP

SEQ ID NO: 1998803 - protein, 17 aa, Staphylococcus
YPNCVLLGEGAKGSTLS

SEQ ID NO: 1998804 - protein, 22 aa, Staphylococcus
YPTLLKRVCEVYKINMDKPYKK

SEQ ID NO: 1998805 - protein, 17 aa, Staphylococcus
YTILQAIDFGHLNRELN

SEQ ID NO: 1998806 - protein, 20 aa, Staphylococcus
YVGLKTGRDGIHGATFASEE

SEQ ID NO: 1998807 - protein, 18 aa, Staphylococcus
AARVAVGAVSKILLEQLD

SEQ ID NO: 1998808 - protein, 22 aa, Staphylococcus
ADASINWALGLMNEGSQIIDNT

SEQ ID NO: 1998809 - protein, 18 aa, Staphylococcus
ADSLRYFLATGSSPGHDL

SEQ ID NO: 1998810 - protein, 21 aa, Staphylococcus
AEGIVPKLVWTKRIETGEVVT

SEQ ID NO: 1998811 - protein, 23 aa, Staphylococcus
AERIGLLKIDFLGLRNLSIIHQI

SEQ ID NO: 1998812 - protein, 19 aa, Staphylococcus
AEYYTHFTSPIRRYPDLTV

SEQ ID NO: 1998813 - protein, 25 aa, Staphylococcus
AFGIKKRGKKAVAITYTGDGGSSQG

SEQ ID NO: 1998814 - protein, 19 aa, Staphylococcus
AGIEAGLASARRGAKTLML

SEQ ID NO: 1998815 - protein, 17 aa, Staphylococcus
AGINHWFNSDTIYRSIL

SEQ ID NO: 1998816 - protein, 28 aa, Staphylococcus
AGNIGYKIAQRLGGFDAVGPVLQGLNSP

SEQ ID NO: 1998817 - protein, 18 aa, Staphylococcus
AGSEVSALLGRMPSAVGY

SEQ ID NO: 1998818 - protein, 19 aa, Staphylococcus
AGVHSGDSIAVYPPQTLSQ

SEQ ID NO: 1998819 - protein, 30 aa, Staphylococcus; identical to SEQ ID NO: 1656101

SEQ ID NO: 1998820 - protein, 18 aa, Staphylococcus
AHPVIASRMKRAQKLFGQ

SEQ ID NO: 1998821 - protein, 18 aa, Staphylococcus
AIKGIKGVAKGVLPVAKA

SEQ ID NO: 1998822 - protein, 19 aa, Staphylococcus
AINRFDLSFDRKFEAFLVP

SEQ ID NO: 1998823 - protein, 24 aa, Staphylococcus
AIRIFRAATELNIKTVAIYSNEDK

SEQ ID NO: 1998824 - protein, 25 aa, Staphylococcus
AITLREIMDEVGIDAARYFLTMRSP

SEQ ID NO: 1998825 - protein, 29 aa, Staphylococcus
AIYTARKGLRTGIVADRIGGQVNDTAGIE

SEQ ID NO: 1998826 - protein, 19 aa, Staphylococcus
AKDRAHILEGLRIALDHID

SEQ ID NO: 1998827 - protein, 25 aa, Staphylococcus
AKKRALEILNLVGLPNAEKRFKAYP

SEQ ID NO: 1998828 - protein, 21 aa, Staphylococcus
AKQLRKGSVKRIVLTRPAVEA

SEQ ID NO: 1998829 - protein, 33 aa, Staphylococcus
AKVGGRLPGGIKIKRAKLRGERSEGMICSLQEI

SEQ ID NO: 1998830 - protein, 22 aa, Staphylococcus
ALARSEADWIVGINATRALTTK

SEQ ID NO: 1998831 - protein, 17 aa, Staphylococcus
ALGHPIGASGARLVTTL

SEQ ID NO: 1998832 - protein, 20 aa, Staphylococcus
ALTDRNGLRPGRYTITKDNF

SEQ ID NO: 1998833 - protein, 25 aa, Staphylococcus
AMVRMAQTFSYRYPLVDGQGNFGSM

SEQ ID NO: 1998834 - protein, 17 aa, Staphylococcus
ANKLLKDNDELIASFSR

SEQ ID NO: 1998835 - protein, 19 aa, Staphylococcus
APLRVKVRLIIKETGEVKE

SEQ ID NO: 1998836 - protein, 22 aa, Staphylococcus
APRGVPQIEVTFDIDKNGIVNV

SEQ ID NO: 1998837 - protein, 18 aa, Staphylococcus
ARTPLIISGEAEKSTSLY

SEQ ID NO: 1998838 - protein, 19 aa, Staphylococcus
ARVSVYERRGNYQIYVNKM

SEQ ID NO: 1998839 - protein, 26 aa, Staphylococcus
ATGIDHNRLSLLMAVLEKKENYLLQQ

SEQ ID NO: 1998840 - protein, 18 aa, Staphylococcus
AWLEVEILACEAWSELGY

SEQ ID NO: 1998841 - protein, 18 aa, Staphylococcus
AYSKLKFENGAHRVQRVP

SEQ ID NO: 1998842 - protein, 19 aa, Staphylococcus
CCTHPVLSGPAKERIENSA

SEQ ID NO: 1998843 - protein, 24 aa, Staphylococcus
CDIQKEYYVGFVIDRATDRITLMA

SEQ ID NO: 1998844 - protein, 17 aa, Staphylococcus
CMEELKMMINIMKPEYF

SEQ ID NO: 1998845 - protein, 21 aa, Staphylococcus
CTGRMRYLGVLLYDADRVHEA

SEQ ID NO: 1998846 - protein, 18 aa, Staphylococcus
CTIQRRMQKLVEESPSPI

SEQ ID NO: 1998847 - protein, 25 aa, Staphylococcus
CTQATEAIPNWAAEQGYPVTNYEQL

SEQ ID NO: 1998848 - protein, 17 aa, Staphylococcus
CTSCRKAKAWLQEHDIP

SEQ ID NO: 1998849 - protein, 29 aa, Staphylococcus
DAEVLAMVMHIYESFGLKHLKLVINSIGD

SEQ ID NO: 1998850 - protein, 18 aa, Staphylococcus
DALPGLGHACGHNIIGTA

SEQ ID NO: 1998851 - protein, 29 aa, Staphylococcus
DAMVRLSQDWKLRHVLIEMHGNNGSIDND

SEQ ID NO: 1998852 - protein, 24 aa, Staphylococcus
DASVEVAFRLGIDTRKNDQQIRGA

SEQ ID NO: 1998853 - protein, 28 aa, Staphylococcus
DEGLRTLLDFRYQRHFKAKKGENGQSSN

SEQ ID NO: 1998854 - protein, 24 aa, Staphylococcus
DETAIPLLLGLGLDEFSMSATSIL

SEQ ID NO: 1998855 - protein, 23 aa, Staphylococcus
DEVITAFRFHYGAAQDLLNVYPD

SEQ ID NO: 1998856 - protein, 28 aa, Staphylococcus
DEVKDMYRRVNFLFGDIVKVTPSSKVVG

SEQ ID NO: 1998857 - protein, 18 aa, Staphylococcus
DFGALMITHYQRLLNYIT

SEQ ID NO: 1998858 - protein, 18 aa, Staphylococcus
DFKEEFFEQYGLNVENPK

SEQ ID NO: 1998859 - protein, 20 aa, Staphylococcus
DFQDALGLNSADSFRDLIKV

SEQ ID NO: 1998860 - protein, 26 aa, Staphylococcus
DFVVEGPLWIQVHAFEKGVEVTISKS

SEQ ID NO: 1998861 - protein, 25 aa, Staphylococcus
DFYPPRFENTFNRWMEEIRDWTISR

SEQ ID NO: 1998862 - protein, 25 aa, Staphylococcus
DGTIKFLFELQDGYTIETVLMRHDY

SEQ ID NO: 1998863 - protein, 24 aa, Staphylococcus
DHFKALSVGKWVRAQGRIEEDTFV

SEQ ID NO: 1998864 - protein, 18 aa, Staphylococcus
DISKARYHKIVIMTDADV

SEQ ID NO: 1998865 - protein, 27 aa, Staphylococcus
DKNTSRIYAKFGKEIYVAAKSGEPDPE

SEQ ID NO: 1998866 - protein, 19 aa, Staphylococcus
DKRIYDLQLSRQIAIQTAP

SEQ ID NO: 1998867 - protein, 20 aa, Staphylococcus
DKSNVRYVIHYNMPGDLESY

SEQ ID NO: 1998868 - protein, 19 aa, Staphylococcus
DLIRKCNKLGKPVITATQM

SEQ ID NO: 1998869 - protein, 24 aa, Staphylococcus
DLSRLARRGSGSASRSIYGGFAEW

SEQ ID NO: 1998870 - protein, 25 aa, Staphylococcus
DPLTNKWRRVSVVLNKNGKQSQKEA

SEQ ID NO: 1998871 - protein, 20 aa, Staphylococcus
DQLTCIFVDHGLLRKGEGDM

SEQ ID NO: 1998872 - protein, 33 aa, Staphylococcus
DRAELMLRVAAIIRRRKEEISAVMVYEAGKPWD

SEQ ID NO: 1998873 - protein, 17 aa, Staphylococcus
DRFELSIQNEWVDKNNN

SEQ ID NO: 1998874 - protein, 23 aa, Staphylococcus
DSAEFAALAFKVMTDPYVGKLTF

SEQ ID NO: 1998875 - protein, 34 aa, Staphylococcus; identical to SEQ ID NO: 1803596

SEQ ID NO: 1998876 - protein, 17 aa, Staphylococcus
DTIRLSIIGRPNVGKSS

SEQ ID NO: 1998877 - protein, 25 aa, Staphylococcus
DTNWPVCGIPEKFYTDHGSDFTSHH

SEQ ID NO: 1998878 - protein, 18 aa, Staphylococcus
DTVIRFAPPLVITKEELD

SEQ ID NO: 1998879 - protein, 22 aa, Staphylococcus
DVILRRNVDILQQWIEQKKGPF

SEQ ID NO: 1998880 - protein, 19 aa, Staphylococcus
DYDAIILAAAGLKRMGWSD

SEQ ID NO: 1998881 - protein, 28 aa, Staphylococcus
EAEDPFTCPHGRPIIINFSNYELEKLFK

SEQ ID NO: 1998882 - protein, 19 aa, Staphylococcus
EARGFIIGCPVAYSMGIGF

SEQ ID NO: 1998883 - protein, 24 aa, Staphylococcus
EDDAKKGFLLDGFPRTIDQAEALN

SEQ ID NO: 1998884 - protein, 20 aa, Staphylococcus
EDVLSEMKEQLSGSCTVEVA

SEQ ID NO: 1998885 - protein, 19 aa, Staphylococcus
EDVYEPFLIQKGFIERTPR

SEQ ID NO: 1998886 - protein, 24 aa, Staphylococcus
EDYGVYRFKRGFNVQIEELIGDFY

SEQ ID NO: 1998887 - protein, 20 aa, Staphylococcus
EEAKCPNIHECWGERRTATF

SEQ ID NO: 1998888 - protein, 27 aa, Staphylococcus
EEAQVIWMSTFHSMCVRILRRDADRIG

SEQ ID NO: 1998889 - protein, 18 aa, Staphylococcus
EEMMEMSALGAGVLETRS

SEQ ID NO: 1998890 - protein, 18 aa, Staphylococcus
EESLFPHIRAIKSDDDHE

SEQ ID NO: 1998891 - protein, 21 aa, Staphylococcus
EFLGDAVLELTVSRYLFDKHP

SEQ ID NO: 1998892 - protein, 18 aa, Staphylococcus
EFMFNGKHVLIVYDDLTK

SEQ ID NO: 1998893 - protein, 24 aa, Staphylococcus
EGKLPREVIRYEYDLEYGTNVLTM

SEQ ID NO: 1998894 - protein, 19 aa, Staphylococcus
EGNSVIYVGLKTGRDGIHG

SEQ ID NO: 1998895 - protein, 21 aa, Staphylococcus
EGSIEPKNFLAVAGLNATESY

SEQ ID NO: 1998896 - protein, 18 aa, Staphylococcus
EHQSYCVLIASPKTETGI

SEQ ID NO: 1998897 - protein, 28 aa, Staphylococcus
EIVEKSLRGAAIWDELKDRLHTNAYGLS

SEQ ID NO: 1998898 - protein, 19 aa, Staphylococcus
EKADFIKRVIKSEEERFHE

SEQ ID NO: 1998899 - protein, 22 aa, Staphylococcus
EKESFGLTLLEAMKTGVVPIGS

SEQ ID NO: 1998900 - protein, 24 aa, Staphylococcus
EKHGIKMIYGMEGMLVDDGVPIAY

SEQ ID NO: 1998901 - protein, 24 aa, Staphylococcus
EKNGIKMIYGMEGMLVDDGVPIAY

SEQ ID NO: 1998902 - protein, 25 aa, Staphylococcus
EKYIPYCIEPSLGADRVTLAFLCDA

SEQ ID NO: 1998903 - protein, 25 aa, Staphylococcus
EKYLGKRYKVIASMGHVRDLPRSQM

SEQ ID NO: 1998904 - protein, 21 aa, Staphylococcus
ELLRKSDLVVTIGYDPIEYEA

SEQ ID NO: 1998905 - protein, 18 aa, Staphylococcus
EMFDGVLNHSILKRAQDK

SEQ ID NO: 1998906 - protein, 20 aa, Staphylococcus
EMKEACYAATPAIQLAKDYL

SEQ ID NO: 1998907 - protein, 17 aa, Staphylococcus
ENAGAVIESLGARKGEM

SEQ ID NO: 1998908 - protein, 24 aa, Staphylococcus
ENKGKIALFAGIDKCRFKKQVTPG

SEQ ID NO: 1998909 - protein, 19 aa, Staphylococcus
ENLEICIFAESLGGTETFI

SEQ ID NO: 1998910 - protein, 19 aa, Staphylococcus
ENLNVIACLMEIRRNPVNS

SEQ ID NO: 1998911 - protein, 21 aa, Staphylococcus
ENVKFADNWLAPNPGTDAAVA

SEQ ID NO: 1998912 - protein, 17 aa, Staphylococcus
EREAVGIQDLPSTLYTA

SEQ ID NO: 1998913 - protein, 25 aa, Staphylococcus
ERSGLTLFLPHAFEGQGPEHSSARL

SEQ ID NO: 1998914 - protein, 17 aa, Staphylococcus
ESGTGAGVRRIEALTGK

SEQ ID NO: 1998915 - protein, 19 aa, Staphylococcus
ESVFARFISSIKEERVNAS

SEQ ID NO: 1998916 - protein, 21 aa, Staphylococcus
ETGRGSIQMRARAEIEERGGG

SEQ ID NO: 1998917 - protein, 19 aa, Staphylococcus
ETKRIGITRLHMEEDAGKS

SEQ ID NO: 1998918 - protein, 17 aa, Staphylococcus
ETTSEKNAMGWYLDGRV

SEQ ID NO: 1998919 - protein, 20 aa, Staphylococcus
ETYESFKLFESTFFDHQLLR

SEQ ID NO: 1998920 - protein, 25 aa, Staphylococcus
EVAEACLKLGATMINDQWAGLYDPK

SEQ ID NO: 1998921 - protein, 26 aa, Staphylococcus
EVIFPRETMIGSMAYYISHAKNEKNF

SEQ ID NO: 1998922 - protein, 18 aa, Staphylococcus
EVILVGGSTRIPAVQEAV

SEQ ID NO: 1998923 - protein, 24 aa, Staphylococcus
EVLLEARVSVYERRGNYQIYVNKM

SEQ ID NO: 1998924 - protein, 18 aa, Staphylococcus
EVRNAFTPKTVAEMIDAF

SEQ ID NO: 1998925 - protein, 19 aa, Staphylococcus
FARCFEMKEACYAATPAIQ

SEQ ID NO: 1998926 - protein, 25 aa, Staphylococcus
FDASVEVAFRLGIDTRKNDQQIRGA

SEQ ID NO: 1998927 - protein, 23 aa, Staphylococcus
FDLGHFRGAIRPDITRFRDLPDW

SEQ ID NO: 1998928 - protein, 18 aa, Staphylococcus
FDLILKFADYGFPRAHAV

SEQ ID NO: 1998929 - protein, 21 aa, Staphylococcus
FDLSFDRKFEAFLVPTVIGEI

SEQ ID NO: 1998930 - protein, 19 aa, Staphylococcus
FEEKLRYFLIEDYNQKEHS

SEQ ID NO: 1998931 - protein, 18 aa, Staphylococcus
FELLDEIEETLNIDTYPM

SEQ ID NO: 1998932 - protein, 31 aa, Staphylococcus; identical to SEQ ID NO: 1649699

SEQ ID NO: 1998933 - protein, 18 aa, Staphylococcus
FFEMYSWAQIGIHQKPIG

SEQ ID NO: 1998934 - protein, 23 aa, Staphylococcus
FFSNYRPQFYFRTTDVTGVVNLP

SEQ ID NO: 1998935 - protein, 18 aa, Staphylococcus
FFVLIGPSGCGKTTTLKM

SEQ ID NO: 1998936 - protein, 23 aa, Staphylococcus
FGCGSSREHAAWALKDYGFNIII

SEQ ID NO: 1998937 - protein, 17 aa, Staphylococcus
FGKRAMTTFERYFIEDK

SEQ ID NO: 1998938 - protein, 23 aa, Staphylococcus
FINRDLFKYIPFDGSIITITELQ

SEQ ID NO: 1998939 - protein, 18 aa, Staphylococcus
FIVHRDFAYERGKALVEK

SEQ ID NO: 1998940 - protein, 17 aa, Staphylococcus
FKGNNAITFLLQNIQPH

SEQ ID NO: 1998941 - protein, 20 aa, Staphylococcus
FKKLNATVINTEYKSIEESA

SEQ ID NO: 1998942 - protein, 19 aa, Staphylococcus
FLCTAICPEIADYSIDIKD

SEQ ID NO: 1998943 - protein, 17 aa, Staphylococcus
FMGPLDAAIAWSENGLD

SEQ ID NO: 1998944 - protein, 17 aa, Staphylococcus
FMHHYNFPNFSVGETGP

SEQ ID NO: 1998945 - protein, 21 aa, Staphylococcus
FMLDAGLMFPEDEMLGVDIVI

SEQ ID NO: 1998946 - protein, 29 aa, Staphylococcus
FNLDRAAIEFGKMDFNTHLDLKAYSDNIK

SEQ ID NO: 1998947 - protein, 17 aa, Staphylococcus
FNLLNGIGYTDDIDHLG

SEQ ID NO: 1998948 - protein, 17 aa, Staphylococcus
FPGIFRGALDVEATHIN

SEQ ID NO: 1998949 - protein, 19 aa, Staphylococcus
FPPGIKYDFAKVFQSHHNM

SEQ ID NO: 1998950 - protein, 28 aa, Staphylococcus
FSDYLKPALRLSAIMGLNSTFIFTHDSI

SEQ ID NO: 1998951 - protein, 18 aa, Staphylococcus
FSETSREGFLLAQDISSY

SEQ ID NO: 1998952 - protein, 19 aa, Staphylococcus
FSRQRYWGEPIPIIHWEDG

SEQ ID NO: 1998953 - protein, 25 aa, Staphylococcus
FTEVGIFSVMWSEHCSYKHSKPFLK

SEQ ID NO: 1998954 - protein, 21 aa, Staphylococcus
FTITNGGIFGSMMSTPIINGS

SEQ ID NO: 1998955 - protein, 18 aa, Staphylococcus
GAGTVKHFGLQDKIDFQI

SEQ ID NO: 1998956 - protein, 31 aa, Staphylococcus; identical to SEQ ID NO: 1650701

SEQ ID NO: 1998957 - protein, 26 aa, Staphylococcus
GAKGKRFALPNAEVMIHQPLGGAQGQ

SEQ ID NO: 1998958 - protein, 25 aa, Staphylococcus
GARDTLRLEAGLPLHGQDLTESITP

SEQ ID NO: 1998959 - protein, 33 aa, Staphylococcus; identical to SEQ ID NO: 1794964

SEQ ID NO: 1998960 - protein, 18 aa, Staphylococcus
GCGAPLQSEDKNAPGYVP

SEQ ID NO: 1998961 - protein, 18 aa, Staphylococcus
GDIQRVGTDIFLCTPDNV

SEQ ID NO: 1998962 - protein, 18 aa, Staphylococcus
GDLPGVIEKLDYLKDLGI

SEQ ID NO: 1998963 - protein, 20 aa, Staphylococcus
GDTVRPALQIIKTKPGVSKT

SEQ ID NO: 1998964 - protein, 23 aa, Staphylococcus
GEIAVRIIRACHDLGIQTVAIYS

SEQ ID NO: 1998965 - protein, 31 aa, Staphylococcus
GERAYDIYSRLLKDRIIMLGSAIDDNVANSI

SEQ ID NO: 1998966 - protein, 31 aa, Staphylococcus; identical to SEQ ID NO: 1646225

SEQ ID NO: 1998967 - protein, 22 aa, Staphylococcus
GERFKYHRHFFVPDNVGHDGFL

SEQ ID NO: 1998968 - protein, 24 aa, Staphylococcus
GERMYEFLDKLIAVSLPRVRDFQG

SEQ ID NO: 1998969 - protein, 17 aa, Staphylococcus
GEVNGTISIGCSSLIGQ

SEQ ID NO: 1998970 - protein, 18 aa, Staphylococcus
GEYKLSHRVCKNCGSYNG

SEQ ID NO: 1998971 - protein, 24 aa, Staphylococcus
GFGRIGRLAFRRIQDVEGIEVVAV

SEQ ID NO: 1998972 - protein, 27 aa, Staphylococcus
GFQTHLKWGAQKEVIRLIPGLENVDIV

SEQ ID NO: 1998973 - protein, 23 aa, Staphylococcus
GGEQKRLYLLRLLVHQPNVLLLD

SEQ ID NO: 1998974 - protein, 17 aa, Staphylococcus
GGGLPIGGYGGRQDIME

SEQ ID NO: 1998975 - protein, 21 aa, Staphylococcus
GGLRYLKQLQVGVVAETGKER

SEQ ID NO: 1998976 - protein, 19 aa, Staphylococcus
GGQGTRLGYKGPKGSFEIE

SEQ ID NO: 1998977 - protein, 25 aa, Staphylococcus
GHTLRMLELPSAWTDYLNTTSNDAS

SEQ ID NO: 1998978 - protein, 25 aa, Staphylococcus
GINGEIRPGIVHRIDKDTSGLLMVA

SEQ ID NO: 1998979 - protein, 25 aa, Staphylococcus
GIYYYCNLSSPFVCDEEALKYIDYD

SEQ ID NO: 1998980 - protein, 24 aa, Staphylococcus
GKKFGKSESGAVWLDADKTSPYEF

SEQ ID NO: 1998981 - protein, 47 aa, Staphylococcus; identical to SEQ ID NO: 1805726

SEQ ID NO: 1998982 - protein, 20 aa, Staphylococcus
GKLDEIIDALTLSEQTEKLK

SEQ ID NO: 1998983 - protein, 17 aa, Staphylococcus
GKMTETFVLAHELGHAG

SEQ ID NO: 1998984 - protein, 18 aa, Staphylococcus
GKTFSKGLLMGARGNSGV

SEQ ID NO: 1998985 - protein, 18 aa, Staphylococcus
GLASARRGAKTLMLTINL

SEQ ID NO: 1998986 - protein, 21 aa, Staphylococcus
GLEAMTIHRLIGWNQDTQPED

SEQ ID NO: 1998987 - protein, 25 aa, Staphylococcus
GMAHPEGYRKALRLMKQAEKFNRPI

SEQ ID NO: 1998988 - protein, 20 aa, Staphylococcus
GMPPTGGLGIGIDRLVMLLT

SEQ ID NO: 1998989 - protein, 21 aa, Staphylococcus
GMPPTGGLGIGIDRLVMLLTD

SEQ ID NO: 1998990 - protein, 21 aa, Staphylococcus
GNETRVAWEVALESEQTPTSL

SEQ ID NO: 1998991 - protein, 18 aa, Staphylococcus
GNNAITFLLQNIQPHQNL

SEQ ID NO: 1998992 - protein, 21 aa, Staphylococcus
GQAEVRQTFKVSKVGTIAGSY

SEQ ID NO: 1998993 - protein, 24 aa, Staphylococcus
GQFYVNQRWLGGILTNYKTISKRI

SEQ ID NO: 1998994 - protein, 17 aa, Staphylococcus
GQLYSEFKEFFPENRVE

SEQ ID NO: 1998995 - protein, 18 aa, Staphylococcus
GQTIKFKGFMTLYVEAKD

SEQ ID NO: 1998996 - protein, 21 aa, Staphylococcus
GRLSDLIKRQRQSILEILAQV

SEQ ID NO: 1998997 - protein, 18 aa, Staphylococcus
GRPAMKRLLQDVKDNKIE

SEQ ID NO: 1998998 - protein, 18 aa, Staphylococcus
GRTRPSLVSDAFEAFVGA

SEQ ID NO: 1998999 - protein, 23 aa, Staphylococcus
GSEFPIVIMPIVKQYFRMLQRPI

SEQ ID NO: 1999000 - protein, 19 aa, Staphylococcus
GSVGMASDASRVFKGQKMP

SEQ ID NO: 1999001 - protein, 25 aa, Staphylococcus
GTDQFKRIRIGVGRPTNGMSVPDYV

SEQ ID NO: 1999002 - protein, 17 aa, Staphylococcus
GTFTSPFIETFNERISL

SEQ ID NO: 1999003 - protein, 26 aa, Staphylococcus
GTIEPLKDLRVMGKFGDSVTTDHISP

SEQ ID NO: 1999004 - protein, 20 aa, Staphylococcus
GTKLTFLPYVVKALVSALKK

SEQ ID NO: 1999005 - protein, 18 aa, Staphylococcus
GVDILICDTAGRLQNKSN

SEQ ID NO: 1999006 - protein, 24 aa, Staphylococcus
GVIDRVDHRYVYVNLGRIEAVLSE

SEQ ID NO: 1999007 - protein, 23 aa, Staphylococcus
GVIIPKRRSVALTQTVAKASTGA

SEQ ID NO: 1999008 - protein, 32 aa, Staphylococcus; identical to SEQ ID NO: 1793642

SEQ ID NO: 1999009 - protein, 23 aa, Staphylococcus
GVLKETYPSVFIVELDQDKHNFE

SEQ ID NO: 1999010 - protein, 19 aa, Staphylococcus
GVPIKAPVAGIAMGLVTRE

SEQ ID NO: 1999011 - protein, 24 aa, Staphylococcus
HADFGGEVERIMKMVDGVVLVVDA

SEQ ID NO: 1999012 - protein, 25 aa, Staphylococcus
HAGVIGLKVHEDWGATPSALSHALD

SEQ ID NO: 1999013 - protein, 26 aa, Staphylococcus
HDIVCAGASAVLFGSVNAIMGLTSEK

SEQ ID NO: 1999014 - protein, 18 aa, Staphylococcus
HEALLCLDATTGQNALSQ

SEQ ID NO: 1999015 - protein, 20 aa, Staphylococcus
HFIERDTLRGYLNQVYDIER

SEQ ID NO: 1999016 - protein, 20 aa, Staphylococcus
HKEGKWTGMCGEMAGDETAI

SEQ ID NO: 1999017 - protein, 18 aa, Staphylococcus
HLATLKVIGVGGGGNNAV

SEQ ID NO: 1999018 - protein, 25 aa, Staphylococcus
HLEQSRLTQYVGHLNVVLFAPEDLN

SEQ ID NO: 1999019 - protein, 18 aa, Staphylococcus
HLSGLLFDDIPYLKVAQE

SEQ ID NO: 1999020 - protein, 19 aa, Staphylococcus
HRHLLKGNVVFIFQYGEEI

SEQ ID NO: 1999021 - protein, 24 aa, Staphylococcus
HYDKLPDRLVTVFAGQDKEATQQA

SEQ ID NO: 1999022 - protein, 20 aa, Staphylococcus
IAGSYAERVPVIAITGAPTR

SEQ ID NO: 1999023 - protein, 25 aa, Staphylococcus
IALRTEPKLSLPTARSIIAIAVGYP

SEQ ID NO: 1999024 - protein, 18 aa, Staphylococcus
IANDVRWLASGPRAGLAE

SEQ ID NO: 1999025 - protein, 17 aa, Staphylococcus
IAVKCVFFNQPYLKKKI

SEQ ID NO: 1999026 - protein, 23 aa, Staphylococcus
IDIGEDLTQIAFYERGELVDADS

SEQ ID NO: 1999027 - protein, 24 aa, Staphylococcus
IDLTRTWEILGEIIGESASDELID

SEQ ID NO: 1999028 - protein, 19 aa, Staphylococcus
IDSGLDIDALKVVSKGINQ

SEQ ID NO: 1999029 - protein, 23 aa, Staphylococcus
IDYCTEHRLPFILFSASGGARMQ

SEQ ID NO: 1999030 - protein, 17 aa, Staphylococcus
IEGRTAYKGPLQDTIYQ

SEQ ID NO: 1999031 - protein, 18 aa, Staphylococcus
IEIPEGFEVIADSPSTNY

SEQ ID NO: 1999032 - protein, 24 aa, Staphylococcus
IEYDAIVPTQLWPTLETKMIKNLY

SEQ ID NO: 1999033 - protein, 17 aa, Staphylococcus
IFAESLGGTETFITFPY

SEQ ID NO: 1999034 - protein, 24 aa, Staphylococcus
IFAVSRTSGWIAHILEQYRDNRIM

SEQ ID NO: 1999035 - protein, 17 aa, Staphylococcus
IFDEVMTGFRVGYNCAQ

SEQ ID NO: 1999036 - protein, 22 aa, Staphylococcus
IGNMIIDGFILRDPGNYKDVID

SEQ ID NO: 1999037 - protein, 22 aa, Staphylococcus
IGPDIWKAASRVIDAAVEKAYN

SEQ ID NO: 1999038 - protein, 21 aa, Staphylococcus
IGQLIGMRASSDYVRHGEKKA

SEQ ID NO: 1999039 - protein, 23 aa, Staphylococcus
IIEINCHGGILTINRILELTMTH

SEQ ID NO: 1999040 - protein, 18 aa, Staphylococcus
IIIDAIGQLIGMRASSDF

SEQ ID NO: 1999041 - protein, 18 aa, Staphylococcus
IKAAQYVRQHPGEVCPAK

SEQ ID NO: 1999042 - protein, 19 aa, Staphylococcus
IKEMSVLELNDLVKAIEEE

SEQ ID NO: 1999043 - protein, 20 aa, Staphylococcus
IKMKTAKTFLNKLYGGDMKS

SEQ ID NO: 1999044 - protein, 19 aa, Staphylococcus
IKMSNLCTEIFQLQETSII

SEQ ID NO: 1999045 - protein, 19 aa, Staphylococcus
ILNLYFPFIDVETMLTLLD

SEQ ID NO: 1999046 - protein, 20 aa, Staphylococcus
ILVDMTKLLAPILVHTAEEV

SEQ ID NO: 1999047 - protein, 18 aa, Staphylococcus
IMDEVGVDAARYFLTMRS

SEQ ID NO: 1999048 - protein, 17 aa, Staphylococcus
IMGCYGIGVSRTLSAIV

SEQ ID NO: 1999049 - protein, 24 aa, Staphylococcus
INFASAYKAPAIFVIQNNNYAIST

SEQ ID NO: 1999050 - protein, 17 aa, Staphylococcus
INGRPKHIYSIYRKMMK

SEQ ID NO: 1999051 - protein, 24 aa, Staphylococcus
INKNGKIAIGFKEDDELIAVRLTD

SEQ ID NO: 1999052 - protein, 19 aa, Staphylococcus
IPEVIGVRLTNSLPQGSTA

SEQ ID NO: 1999053 - protein, 19 aa, Staphylococcus
IPSKALLHASHRFVEAQHS

SEQ ID NO: 1999054 - protein, 21 aa, Staphylococcus
IQPKYFLPIHGEYRMLKAHGQ

SEQ ID NO: 1999055 - protein, 23 aa, Staphylococcus
IRAPQWRGGGIVFGPTPRSYSYK

SEQ ID NO: 1999056 - protein, 18 aa, Staphylococcus
IRDQLLLIGGLSKSHSAT

SEQ ID NO: 1999057 - protein, 23 aa, Staphylococcus
IRDVSKRVLAHILGVELPNPSMI

SEQ ID NO: 1999058 - protein, 22 aa, Staphylococcus
IRVFYRDEFLCTAICPEIADYS

SEQ ID NO: 1999059 - protein, 19 aa, Staphylococcus
ISAGSRFMAAYPITPASEI

SEQ ID NO: 1999060 - protein, 20 aa, Staphylococcus
ITAFGTGIGGEFDISKARYH

SEQ ID NO: 1999061 - protein, 20 aa, Staphylococcus
IVTMAGLINALRIVDKDLSD

SEQ ID NO: 1999062 - protein, 18 aa, Staphylococcus
IVVADARSPRDGRIIEQI

SEQ ID NO: 1999063 - protein, 17 aa, Staphylococcus
IYGGPLALGLIRNKLEE

SEQ ID NO: 1999064 - protein, 19 aa, Staphylococcus
IYSLIKRIFNVEVEILVRK

SEQ ID NO: 1999065 - protein, 29 aa, Staphylococcus
IYSQRKIDVEPVFGFMKAILGFTRMSVRG

SEQ ID NO: 1999066 - protein, 21 aa, Staphylococcus
KAELSALIRMNGALSLSNQQF

SEQ ID NO: 1999067 - protein, 18 aa, Staphylococcus
KAHVKGVSVLVESKEVKQ

SEQ ID NO: 1999068 - protein, 24 aa, Staphylococcus
KAKGLKPRAIRAMIVGIPNVGKST

SEQ ID NO: 1999069 - protein, 34 aa, Staphylococcus; identical to SEQ ID NO: 1648434

SEQ ID NO: 1999070 - protein, 17 aa, Staphylococcus
KDADLVVITAGAPQKPG

SEQ ID NO: 1999071 - protein, 18 aa, Staphylococcus
KDKRVVVRTLDIGGDKEL

SEQ ID NO: 1999072 - protein, 26 aa, Staphylococcus
KEEKIKELQDFIARFSANASKSKQAT

SEQ ID NO: 1999073 - protein, 31 aa, Staphylococcus; identical to SEQ ID NO: 1795511

SEQ ID NO: 1999074 - protein, 17 aa, Staphylococcus
KEQLSGSCTVEVAAFNE

SEQ ID NO: 1999075 - protein, 28 aa, Staphylococcus
KEVKESDGRIILFIDEIHMLVGAGKTDG

SEQ ID NO: 1999076 - protein, 23 aa, Staphylococcus
KEYDRLIKFLGGIRDMKSMPQAL

SEQ ID NO: 1999077 - protein, 24 aa, Staphylococcus
KEYDRLIKFLGGIRDMKSMPQALF

SEQ ID NO: 1999078 - protein, 23 aa, Staphylococcus
KFEVMSIPTLIVFKDGEPVDKVV

SEQ ID NO: 1999079 - protein, 23 aa, Staphylococcus
KGDKRRARAAAENIIPNSTGAAK

SEQ ID NO: 1999080 - protein, 17 aa, Staphylococcus
KGKQLFMPIRVAVTGQM

SEQ ID NO: 1999081 - protein, 20 aa, Staphylococcus
KGKVTGIKKFGAFVELPEGK

SEQ ID NO: 1999082 - protein, 22 aa, Staphylococcus
KHALKRKLIQTADSIANDGYND

SEQ ID NO: 1999083 - protein, 19 aa, Staphylococcus
KHSKPFLKQFPTTGEHVLM

SEQ ID NO: 1999084 - protein, 31 aa, Staphylococcus; identical to SEQ ID NO: 1807951

SEQ ID NO: 1999085 - protein, 20 aa, Staphylococcus
KIDMRLAAYIVGIKRTAEAA

SEQ ID NO: 1999086 - protein, 19 aa, Staphylococcus
KIMTEHLNIFVGLTDEAQN

SEQ ID NO: 1999087 - protein, 23 aa, Staphylococcus
KIPAEQRQTMLFSATMPKAIQTL

SEQ ID NO: 1999088 - protein, 18 aa, Staphylococcus
KIQLIIRGICCLKPGIPG

SEQ ID NO: 1999089 - protein, 26 aa, Staphylococcus
KIQTDGRMKALVSITLDEAFVIHDLR

SEQ ID NO: 1999090 - protein, 24 aa, Staphylococcus
KKDGLKGGGYYVEYRTDDARLTIE

SEQ ID NO: 1999091 - protein, 21 aa, Staphylococcus
KKFYALDMFPYPSGAGLHVGH

SEQ ID NO: 1999092 - protein, 22 aa, Staphylococcus
KKFYALDMFPYPSGAGLHVGHP

SEQ ID NO: 1999093 - protein, 17 aa, Staphylococcus
KKIVICASTGNTSASAA

SEQ ID NO: 1999094 - protein, 23 aa, Staphylococcus
KKMSAEAKIMYALLKDRFELSIQ

SEQ ID NO: 1999095 - protein, 19 aa, Staphylococcus
KKNPKVIVYAGMSLAQKND

SEQ ID NO: 1999096 - protein, 18 aa, Staphylococcus
KKVIDKMAAVFILQGYLD

SEQ ID NO: 1999097 - protein, 17 aa, Staphylococcus
KLLMGVPGRSNAFDISK

SEQ ID NO: 1999098 - protein, 17 aa, Staphylococcus
KLMKAGMNVARLNFSHG

SEQ ID NO: 1999099 - protein, 17 aa, Staphylococcus
KLNLSLKDNDYFKNYER

SEQ ID NO: 1999100 - protein, 25 aa, Staphylococcus
KLYECDDCSECPLKNQCMNFNSKTN

SEQ ID NO: 1999101 - protein, 19 aa, Staphylococcus
KLYYNGPMFRYERKQKGRY

SEQ ID NO: 1999102 - protein, 20 aa, Staphylococcus
KNDVPAFAICHGPQILIDTD

SEQ ID NO: 1999103 - protein, 21 aa, Staphylococcus
KNNVKKAWWQKFITQSPYNVG

SEQ ID NO: 1999104 - protein, 23 aa, Staphylococcus
KPEIRMPKVGGRVMSLQDPTKKM

SEQ ID NO: 1999105 - protein, 18 aa, Staphylococcus
KPPVARIMDYGKYKFEQQ

SEQ ID NO: 1999106 - protein, 24 aa, Staphylococcus
KQVNDIRVGKVLYMTVDEATDEAV

SEQ ID NO: 1999107 - protein, 18 aa, Staphylococcus
KRKIIGNEFVYVFDDEAA

SEQ ID NO: 1999108 - protein, 19 aa, Staphylococcus
KRLGINATIRREQGSDIDA

SEQ ID NO: 1999109 - protein, 24 aa, Staphylococcus
KSALEIVDGLLLNPLVGETKSDDI

SEQ ID NO: 1999110 - protein, 18 aa, Staphylococcus
KSLGNFILVHDIIKEIDP

SEQ ID NO: 1999111 - protein, 17 aa, Staphylococcus
KTLSSRYYTNWNTIEKQ

SEQ ID NO: 1999112 - protein, 20 aa, Staphylococcus
KTRIIDCLETAHTRLKLLSK

SEQ ID NO: 1999113 - protein, 19 aa, Staphylococcus
KVAELLLERAKRLVEIGED

SEQ ID NO: 1999114 - protein, 21 aa, Staphylococcus
KVDALSFIVHRDFAYERGKAL

SEQ ID NO: 1999115 - protein, 23 aa, Staphylococcus
KVRRAKLYYLRSLRGKAARIQEI

SEQ ID NO: 1999116 - protein, 24 aa, Staphylococcus
KWNIIRPPFNVTRISEYAAIAALE

SEQ ID NO: 1999117 - protein, 19 aa, Staphylococcus
LCGEVLDIHGYTGGYNITS

SEQ ID NO: 1999118 - protein, 21 aa, Staphylococcus
LDGEMKFRIACTNHHHHHFIC

SEQ ID NO: 1999119 - protein, 22 aa, Staphylococcus
LDIESGEFIAFIGTSGSGKTTA

SEQ ID NO: 1999120 - protein, 21 aa, Staphylococcus
LDLKGKVVLERADFNVPLKDG

SEQ ID NO: 1999121 - protein, 27 aa, Staphylococcus
LDVKRMPWIGLQWIFARKGAAASNHFE

SEQ ID NO: 1999122 - protein, 18 aa, Staphylococcus
LECPSIISQVKFYHVPEG

SEQ ID NO: 1999123 - protein, 24 aa, Staphylococcus
LEKNWPGLHIEPLQAPENMEVLIG

SEQ ID NO: 1999124 - protein, 25 aa, Staphylococcus
LEMLRRLDHRGGVGADGITGDGAGI

SEQ ID NO: 1999125 - protein, 17 aa, Staphylococcus
LFHLFAAFAEFERNLIL

SEQ ID NO: 1999126 - protein, 26 aa, Staphylococcus
LFTGYEVLNTFTFRITRNADLTIHED

SEQ ID NO: 1999127 - protein, 24 aa, Staphylococcus
LGKEAFSIISQGRVDEILNAKPID

SEQ ID NO: 1999128 - protein, 26 aa, Staphylococcus
LGLPYRRVILCTGDIGFSASKTYDLE

SEQ ID NO: 1999129 - protein, 22 aa, Staphylococcus
LGQAGVNIMGFCKEFNARTQEQ

SEQ ID NO: 1999130 - protein, 23 aa, Staphylococcus
LGQAGVNIMGFCKEFNARTQEQA

SEQ ID NO: 1999131 - protein, 20 aa, Staphylococcus
LGTKYSEAMNATFLDNQGKA

SEQ ID NO: 1999132 - protein, 18 aa, Staphylococcus
LGVCICGTGVGISNAANK

SEQ ID NO: 1999133 - protein, 19 aa, Staphylococcus
LHMGGRIGVLTVVEGSTDE

SEQ ID NO: 1999134 - protein, 28 aa, Staphylococcus
LINKGVAFCPHCDGPLFENKDVAVIGGG

SEQ ID NO: 1999135 - protein, 25 aa, Staphylococcus
LKAISPRTTLPILTGIKIDAKDNEV

SEQ ID NO: 1999136 - protein, 19 aa, Staphylococcus
LKAYSYNREGVMNASVEFD

SEQ ID NO: 1999137 - protein, 22 aa, Staphylococcus
LKKGEIVGLIGLNGAGKSTTIK

SEQ ID NO: 1999138 - protein, 20 aa, Staphylococcus
LKPTQLVGGYAQISYHFNYY

SEQ ID NO: 1999139 - protein, 21 aa, Staphylococcus
LKSFHACGVYGMAAITSIVAQ

SEQ ID NO: 1999140 - protein, 18 aa, Staphylococcus
LKVRRRIEAIFKSENLTT

SEQ ID NO: 1999141 - protein, 17 aa, Staphylococcus
LLKQSGIFRENEHVDER

SEQ ID NO: 1999142 - protein, 20 aa, Staphylococcus
LLSPACASWDQYKTFEERGE

SEQ ID NO: 1999143 - protein, 18 aa, Staphylococcus
LMERMVWTRILDQRSISL

SEQ ID NO: 1999144 - protein, 18 aa, Staphylococcus
LNGSFLPLAHERLDDDGQ

SEQ ID NO: 1999145 - protein, 17 aa, Staphylococcus
LNHPEALALISDELLEG

SEQ ID NO: 1999146 - protein, 33 aa, Staphylococcus
LNQGAKMRYMFGGKAKIPLVVRTVHGAGAGAAA

SEQ ID NO: 1999147 - protein, 23 aa, Staphylococcus
LNSAVWSGGSFIYVPKNVKLDTP

SEQ ID NO: 1999148 - protein, 17 aa, Staphylococcus
LNVILMVGVNGVGKTTT

SEQ ID NO: 1999149 - protein, 23 aa, Staphylococcus
LPEIVEIAEEFGLITYVDDAHGS

SEQ ID NO: 1999150 - protein, 18 aa, Staphylococcus
LPLPDLIIVDGGKGHMSG

SEQ ID NO: 1999151 - protein, 18 aa, Staphylococcus
LPLTVLLRALGFSSDQEI

SEQ ID NO: 1999152 - protein, 18 aa, Staphylococcus
LPYVEAIGEAAFYGPKLD

SEQ ID NO: 1999153 - protein, 27 aa, Staphylococcus
LRDKTWSVHVPRRIKEIGPRIKKVSDE

SEQ ID NO: 1999154 - protein, 20 aa, Staphylococcus
LRDWLFSRQRYWGEPIPVIH

SEQ ID NO: 1999155 - protein, 21 aa, Staphylococcus
LREKTGAGMMDCKKALTETDG

SEQ ID NO: 1999156 - protein, 22 aa, Staphylococcus
LRVIEGNSGLFVAMPSKRTPDG

SEQ ID NO: 1999157 - protein, 21 aa, Staphylococcus
LRYLTPHGKWNIHSTYQDNER

SEQ ID NO: 1999158 - protein, 17 aa, Staphylococcus
LSSRYYTNWNTIEKQVN

SEQ ID NO: 1999159 - protein, 21 aa, Staphylococcus
LTEREMEILLLIAKGYSNQEI

SEQ ID NO: 1999160 - protein, 22 aa, Staphylococcus
LTESGAFGRALVPSGASTGEHE

SEQ ID NO: 1999161 - protein, 19 aa, Staphylococcus
LTGDIFHSQRCDCGAQLEA

SEQ ID NO: 1999162 - protein, 19 aa, Staphylococcus
LTIITESVFARFISSIKEE

SEQ ID NO: 1999163 - protein, 22 aa, Staphylococcus
LTKDPKYLIGRIIARPYVGEPG

SEQ ID NO: 1999164 - protein, 17 aa, Staphylococcus
LTMKISREQSIVSRWIK

SEQ ID NO: 1999165 - protein, 21 aa, Staphylococcus
LVHITCRDRNLIGLQSHLLGL

SEQ ID NO: 1999166 - protein, 23 aa, Staphylococcus
LVQELKENYSIIMVTHNMQQAAR

SEQ ID NO: 1999167 - protein, 25 aa, Staphylococcus
LYDRKIPLILVFEGMDAAGKGGNIK

SEQ ID NO: 1999168 - protein, 24 aa, Staphylococcus
LYIAALKLGIAIIPSSEMLRTKDL

SEQ ID NO: 1999169 - protein, 29 aa, Staphylococcus
LYKNHPEELRLLLIDPKMVELAPYNDLPH

SEQ ID NO: 1999170 - protein, 20 aa, Staphylococcus
LYNMVRVLVAFLIEVGKGKR

SEQ ID NO: 1999171 - protein, 17 aa, Staphylococcus
LYTELGKITDIVNRMAM

SEQ ID NO: 1999172 - protein, 20 aa, Staphylococcus
MASDASRVFKGQKMPGRMGG

SEQ ID NO: 1999173 - protein, 17 aa, Staphylococcus
MEHIERAGVHSGDSIAV

SEQ ID NO: 1999174 - protein, 24 aa, Staphylococcus
MGIANKRSIGFGVAKVLDQLGAKL

SEQ ID NO: 1999175 - protein, 21 aa, Staphylococcus
MGVSKAFKPIMENTLKYLNVG

SEQ ID NO: 1999176 - protein, 17 aa, Staphylococcus
MIDACKRASAANINIVV

SEQ ID NO: 1999177 - protein, 21 aa, Staphylococcus
MKLFSEDRFNVDVLKVEVPVN

SEQ ID NO: 1999178 - protein, 19 aa, Staphylococcus
MKSKTIQVVVEFKEVPMNL

SEQ ID NO: 1999179 - protein, 25 aa, Staphylococcus
MLAKLKVLYEMFGLKMVDNELSDYL

SEQ ID NO: 1999180 - protein, 18 aa, Staphylococcus
MLPSSRLGEKQGKKLFVY

SEQ ID NO: 1999181 - protein, 19 aa, Staphylococcus
MPGLPKKPAALNMDVTDDG

SEQ ID NO: 1999182 - protein, 18 aa, Staphylococcus
MQDSFYITDEILMRTHTS

SEQ ID NO: 1999183 - protein, 18 aa, Staphylococcus
MRAGAKARTTKQQARINR

SEQ ID NO: 1999184 - protein, 32 aa, Staphylococcus
MSRSEGFGAEVKRRIFLGTFALSSGYYDAYYK

SEQ ID NO: 1999185 - protein, 18 aa, Staphylococcus
MVWYCPPLSPIMSYFEGK

SEQ ID NO: 1999186 - protein, 19 aa, Staphylococcus
NCDGILRQSMKHIFNSETD

SEQ ID NO: 1999187 - protein, 25 aa, Staphylococcus
NEPFMYKLVDIVAEIMEPYYPNVKE

SEQ ID NO: 1999188 - protein, 24 aa, Staphylococcus
NETETYMPLPIFLSHQLAKRLSDV

SEQ ID NO: 1999189 - protein, 18 aa, Staphylococcus
NHFTEWLNNNHAYYVPYK

SEQ ID NO: 1999190 - protein, 19 aa, Staphylococcus
NIEHRRWGAPFPVIEIVKR

SEQ ID NO: 1999191 - protein, 17 aa, Staphylococcus
NKSFVFGPCSVESQEQV

SEQ ID NO: 1999192 - protein, 21 aa, Staphylococcus
NLEGHSVALLAQDYYYKDQSH

SEQ ID NO: 1999193 - protein, 24 aa, Staphylococcus
NLEKLKIAVHYGADAVFLGGQEYG

SEQ ID NO: 1999194 - protein, 18 aa, Staphylococcus
NLKRFKEVRKEIEVGKMS

SEQ ID NO: 1999195 - protein, 21 aa, Staphylococcus
NLRELGFEVVRFKTGTPPRVN

SEQ ID NO: 1999196 - protein, 24 aa, Staphylococcus
NNRIKRYIAKYTINPAITHGISDY

SEQ ID NO: 1999197 - protein, 17 aa, Staphylococcus
NNTVPFIARYRKEATGG

SEQ ID NO: 1999198 - protein, 19 aa, Staphylococcus
NPTGSFKDRGMVMAVTKAK

SEQ ID NO: 1999199 - protein, 20 aa, Staphylococcus
NPTGSFKDRGMVMAVTKAKE

SEQ ID NO: 1999200 - protein, 21 aa, Staphylococcus
NQFRIGLSRMERVVRERMSIQ

SEQ ID NO: 1999201 - protein, 17 aa, Staphylococcus
NRLKRLLDLGAPGIIVQ

SEQ ID NO: 1999202 - protein, 23 aa, Staphylococcus
NRPVFQEALNFVRMGDRFVVESI

SEQ ID NO: 1999203 - protein, 17 aa, Staphylococcus
NSLGFGGHNAVLVFKKF

SEQ ID NO: 1999204 - protein, 18 aa, Staphylococcus
NSLQEMYQGFFLAPHVVS

SEQ ID NO: 1999205 - protein, 17 aa, Staphylococcus
NSPGGSVTAGFAIYDTI

SEQ ID NO: 1999206 - protein, 17 aa, Staphylococcus
NVLNLPVVVIRKDNKVT

SEQ ID NO: 1999207 - protein, 25 aa, Staphylococcus
NVVTRPVMEEWLFNTVAFIGGPSEI

SEQ ID NO: 1999208 - protein, 25 aa, Staphylococcus
NYEPSMQYFNEWWKQLFGESEGKDF

SEQ ID NO: 1999209 - protein, 25 aa, Staphylococcus
NYEPSMQYFNEWWKQLYGESEGKDF

SEQ ID NO: 1999210 - protein, 18 aa, Staphylococcus
PAILRLVKQVIEASHKEG

SEQ ID NO: 1999211 - protein, 20 aa, Staphylococcus
PATQCLIEKSIAGFKEIEYE

SEQ ID NO: 1999212 - protein, 19 aa, Staphylococcus
PATQCLIEKSIAGYKEIEY

SEQ ID NO: 1999213 - protein, 17 aa, Staphylococcus
PEGAAALLWKDSSLAKM

SEQ ID NO: 1999214 - protein, 23 aa, Staphylococcus
PEQMVISTMMLRSMQQAHYDDVN

SEQ ID NO: 1999215 - protein, 26 aa, Staphylococcus
PESSLRAGAFGLPITYAIIGGNPRRF

SEQ ID NO: 1999216 - protein, 20 aa, Staphylococcus
PFYYPFSFEEIKQYYFDIIE

SEQ ID NO: 1999217 - protein, 21 aa, Staphylococcus
PGAAVKYIEIEGVLHEFSAID

SEQ ID NO: 1999218 - protein, 17 aa, Staphylococcus
PKKKRMGRYQGYTNKRR

SEQ ID NO: 1999219 - protein, 24 aa, Staphylococcus
PLRFLQVRIPVRMDDGTVKTFTGY

SEQ ID NO: 1999220 - protein, 17 aa, Staphylococcus
PPVARIMDYGKYKFEQQ

SEQ ID NO: 1999221 - protein, 19 aa, Staphylococcus
PSFDTIVASGYRGALPHGV

SEQ ID NO: 1999222 - protein, 24 aa, Staphylococcus
PSSLEQLDLLLLEIPKSRKVHSDG

SEQ ID NO: 1999223 - protein, 25 aa, Staphylococcus
PVGNAGNITAYWKGFKEYHEKKGSQ

SEQ ID NO: 1999224 - protein, 19 aa, Staphylococcus
PYEGGKMVVAEAYRNLIAV

SEQ ID NO: 1999225 - protein, 19 aa, Staphylococcus
PYKGKGIRYQGEYVRRKEG

SEQ ID NO: 1999226 - protein, 25 aa, Staphylococcus
PYNDLPHLVSPVITDVKAATQSLKW

SEQ ID NO: 1999227 - protein, 18 aa, Staphylococcus
PYTLLDYFGDDWLVMIDE

SEQ ID NO: 1999228 - protein, 20 aa, Staphylococcus
PYVGKLTFFRVYSGTLSSGS

SEQ ID NO: 1999229 - protein, 20 aa, Staphylococcus
PYVGKLTFFRVYSGTLTSGS

SEQ ID NO: 1999230 - protein, 17 aa, Staphylococcus
QACFDRGDVKNTYGTGG

SEQ ID NO: 1999231 - protein, 22 aa, Staphylococcus
QALKEIGYICAKVRDTMQEATK

SEQ ID NO: 1999232 - protein, 26 aa, Staphylococcus
QDDLKGSWSVVCFYPADFSFVCPTEL

SEQ ID NO: 1999233 - protein, 21 aa, Staphylococcus
QEVADRVGIELGKCSVKRFSD

SEQ ID NO: 1999234 - protein, 23 aa, Staphylococcus
QFDQIFDLLAIRVIVNSINDCYA

SEQ ID NO: 1999235 - protein, 23 aa, Staphylococcus
QFYVNQRWLGGILTNYKTISKRI

SEQ ID NO: 1999236 - protein, 19 aa, Staphylococcus
QISRIPLIVLTSDRPHELR

SEQ ID NO: 1999237 - protein, 19 aa, Staphylococcus
QMGIIKMKLPIEDLEKTKK

SEQ ID NO: 1999238 - protein, 24 aa, Staphylococcus
QPIRLEPMSTFPVIRDLQVDRTRM

SEQ ID NO: 1999239 - protein, 18 aa, Staphylococcus
QPNHFLVAFDAGKTTFRH

SEQ ID NO: 1999240 - protein, 20 aa, Staphylococcus
QRFDCVPSQLNYVIKTRFTN

SEQ ID NO: 1999241 - protein, 17 aa, Staphylococcus
QRRKHLKQNIASPSTTD

SEQ ID NO: 1999242 - protein, 24 aa, Staphylococcus
QRSMRKKLPFGIGQIGKSFRNEIT

SEQ ID NO: 1999243 - protein, 18 aa, Staphylococcus
RATYEFFNENGFTKIDPP

SEQ ID NO: 1999244 - protein, 24 aa, Staphylococcus
RDETSLRTGVRVVIDIRKDANASV

SEQ ID NO: 1999245 - protein, 19 aa, Staphylococcus
RDISCNLGSLNIVNVMETG

SEQ ID NO: 1999246 - protein, 24 aa, Staphylococcus
REKALKVLKARLYDMKLQEEQQKY

SEQ ID NO: 1999247 - protein, 26 aa, Staphylococcus
REKLKQPRSSVCFDAPSWYELVVEGR

SEQ ID NO: 1999248 - protein, 19 aa, Staphylococcus
RELTYCSVCGHITENDPCY

SEQ ID NO: 1999249 - protein, 17 aa, Staphylococcus
REMGDYLIVALSTDEFN

SEQ ID NO: 1999250 - protein, 19 aa, Staphylococcus
RERTGAGMMDCKKALTETD

SEQ ID NO: 1999251 - protein, 17 aa, Staphylococcus
REVEPPKKGFWSRFFGN

SEQ ID NO: 1999252 - protein, 18 aa, Staphylococcus
REVTRRKSALEISSLPGK

SEQ ID NO: 1999253 - protein, 27 aa, Staphylococcus
RGQAPYKFLLSHGFVMDGEGKKMSKSL

SEQ ID NO: 1999254 - protein, 24 aa, Staphylococcus
RGQNARLAAKLTGWKIDIKSESDA

SEQ ID NO: 1999255 - protein, 24 aa, Staphylococcus
RGQNARLAAKLTGWKIDIKSETDA

SEQ ID NO: 1999256 - protein, 20 aa, Staphylococcus
RHGTMPLTMFITKKGKQVKV

SEQ ID NO: 1999257 - protein, 17 aa, Staphylococcus
RIAQGVVSINAFKGVSF

SEQ ID NO: 1999258 - protein, 27 aa, Staphylococcus
RIDKVSAKRIIDFLSGTVYAIGGDIQR

SEQ ID NO: 1999259 - protein, 18 aa, Staphylococcus
RIHLKPTQLVGGYAQISY

SEQ ID NO: 1999260 - protein, 19 aa, Staphylococcus
RIIVEKGIMASRARVAAKK

SEQ ID NO: 1999261 - protein, 22 aa, Staphylococcus
RITDLRSKCRRLKQEHGLDMIV

SEQ ID NO: 1999262 - protein, 21 aa, Staphylococcus
RKIDMRLAAYIVGIKRTAEAA

SEQ ID NO: 1999263 - protein, 19 aa, Staphylococcus
RKKAKAFIDDYLASFPGVK

SEQ ID NO: 1999264 - protein, 17 aa, Staphylococcus
RKLKISGGGRCNVTNRL

SEQ ID NO: 1999265 - protein, 19 aa, Staphylococcus
RKNYGCTHFIVGRDHAGVG

SEQ ID NO: 1999266 - protein, 18 aa, Staphylococcus
RLALLEADVNFKVVKDFV

SEQ ID NO: 1999267 - protein, 18 aa, Staphylococcus
RLIDSPKVATYDLKPEMS

SEQ ID NO: 1999268 - protein, 21 aa, Staphylococcus
RLMKQAEKFNRPIFTFIDTKG

SEQ ID NO: 1999269 - protein, 18 aa, Staphylococcus
RLNVILMVGVNGVGKTTT

SEQ ID NO: 1999270 - protein, 18 aa, Staphylococcus
RLQFTDILGTIKNVEVPV

SEQ ID NO: 1999271 - protein, 23 aa, Staphylococcus
RMNRIAQTINRFGFTIRGIYGEG

SEQ ID NO: 1999272 - protein, 20 aa, Staphylococcus
RNMALEAFKATDCSGLVRAD

SEQ ID NO: 1999273 - protein, 24 aa, Staphylococcus
RPAVEAGESLGFLPGDLKEKVDPY

SEQ ID NO: 1999274 - protein, 23 aa, Staphylococcus
RPPEPYKGKGIRYQGEYVRRKEG

SEQ ID NO: 1999275 - protein, 20 aa, Staphylococcus
RRLYEGKVLAGFAGSVADAF

SEQ ID NO: 1999276 - protein, 18 aa, Staphylococcus
RRNQALVYYREVVKHHQL

SEQ ID NO: 1999277 - protein, 18 aa, Staphylococcus
RRVAKEEGILAGISSGAA

SEQ ID NO: 1999278 - protein, 23 aa, Staphylococcus
RSFKEVTNVSGIVLTKLDGTAKG

SEQ ID NO: 1999279 - protein, 19 aa, Staphylococcus
RSLLNEYREGILVGTACDE

SEQ ID NO: 1999280 - protein, 20 aa, Staphylococcus
RSQMAEGWGKEILGEDWNVY

SEQ ID NO: 1999281 - protein, 19 aa, Staphylococcus
RTTGHLMSMLVTLKGLPLA

SEQ ID NO: 1999282 - protein, 25 aa, Staphylococcus
RVLPNWTTCVSICALFRDSDVLNST

SEQ ID NO: 1999283 - protein, 21 aa, Staphylococcus
RYQMYWQIYFHPVSRGGEVLL

SEQ ID NO: 1999284 - protein, 17 aa, Staphylococcus
SARLERFLQLAAENNST

SEQ ID NO: 1999285 - protein, 29 aa, Staphylococcus
SDGEAFAKFFKLMLNQGINLAPSKFEAWF

SEQ ID NO: 1999286 - protein, 20 aa, Staphylococcus
SEHCSYKHSKPFLKQFPTTG

SEQ ID NO: 1999287 - protein, 28 aa, Staphylococcus
SENHACPICGFSIGELEPRMFSFNSPFG

SEQ ID NO: 1999288 - protein, 20 aa, Staphylococcus
SESKYKVYIIDEVHMLTTGA

SEQ ID NO: 1999289 - protein, 28 aa, Staphylococcus
SFNNPKGMCETCSGLGYVEDIDLNELLD

SEQ ID NO: 1999290 - protein, 21 aa, Staphylococcus
SGACGRLMCCLKYENDYYEEA

SEQ ID NO: 1999291 - protein, 24 aa, Staphylococcus
SGEQRISNFLIWQVSYSEFIFNEK

SEQ ID NO: 1999292 - protein, 18 aa, Staphylococcus
SGGETFQASLALALGLSE

SEQ ID NO: 1999293 - protein, 24 aa, Staphylococcus
SHKKEHMIRAALEGVLYNLYTVYL

SEQ ID NO: 1999294 - protein, 20 aa, Staphylococcus
SHVPVLIDEAYFEFVTAEDY

SEQ ID NO: 1999295 - protein, 30 aa, Staphylococcus; identical to SEQ ID NO: 1794067

SEQ ID NO: 1999296 - protein, 24 aa, Staphylococcus
SIVGRLLEHSRIYYFHNNGDERIY

SEQ ID NO: 1999297 - protein, 17 aa, Staphylococcus
SKSLKLYLFSFRNHGDF

SEQ ID NO: 1999298 - protein, 20 aa, Staphylococcus
SMAEWDVMNIIWGKKSVSAN

SEQ ID NO: 1999299 - protein, 20 aa, Staphylococcus
SNKHLCEYLGYAEQKIIKLK

SEQ ID NO: 1999300 - protein, 24 aa, Staphylococcus
SNQALRLVLERAKTYSVPNHIIDR

SEQ ID NO: 1999301 - protein, 20 aa, Staphylococcus
SRAGIEDIIIVTGKHKRAIE

SEQ ID NO: 1999302 - protein, 21 aa, Staphylococcus
SRAVKPPVIYGDVKWTEPLTV

SEQ ID NO: 1999303 - protein, 19 aa, Staphylococcus
SRGSLKIKSKDPFEKPSIV

SEQ ID NO: 1999304 - protein, 22 aa, Staphylococcus
SRPGLEMAGYFSHYASDRIQLL

SEQ ID NO: 1999305 - protein, 20 aa, Staphylococcus
SRRYPYVKFTPEREIGNDLL

SEQ ID NO: 1999306 - protein, 17 aa, Staphylococcus
SRYYTNWNTIEKQVNHR

SEQ ID NO: 1999307 - protein, 21 aa, Staphylococcus
STEKVESVWNFINKIWNAARF

SEQ ID NO: 1999308 - protein, 21 aa, Staphylococcus
STEKVESVWNFINKIWNGARF

SEQ ID NO: 1999309 - protein, 20 aa, Staphylococcus
SVATFRLREGMPIGAKVTLR

SEQ ID NO: 1999310 - protein, 26 aa, Staphylococcus
SVGKDLSCNVVRTWIHQHTVILGIHD

SEQ ID NO: 1999311 - protein, 22 aa, Staphylococcus
SVKDRIALAMIEKAEKEGKIKP

SEQ ID NO: 1999312 - protein, 26 aa, Staphylococcus
SYLMEPWDGPTMISFCNGDKIGALTD

SEQ ID NO: 1999313 - protein, 19 aa, Staphylococcus
TAFGTGIGGEFDISKARYH

SEQ ID NO: 1999314 - protein, 20 aa, Staphylococcus
TCKNYSRAYIRHLIKAEETF

SEQ ID NO: 1999315 - protein, 23 aa, Staphylococcus
TDFNLGPEPEFFLFKLDEKGEPT

SEQ ID NO: 1999316 - protein, 22 aa, Staphylococcus
TDTYMPLPIFLSHQLAKRLSDV

SEQ ID NO: 1999317 - protein, 36 aa, Staphylococcus
TDYSSVMFDYGILKRPQFFFAYDIEKYDKGLRGFYM

SEQ ID NO: 1999318 - protein, 22 aa, Staphylococcus
TELDRMVQEFGQRIQQQGLDLQ

SEQ ID NO: 1999319 - protein, 18 aa, Staphylococcus
TFLRGEIILGNMKYSSGP

SEQ ID NO: 1999320 - protein, 19 aa, Staphylococcus
TGFGTGGWQLAALNICSKA

SEQ ID NO: 1999321 - protein, 22 aa, Staphylococcus
TGSCSWKVFVKNGVITWENQQT

SEQ ID NO: 1999322 - protein, 26 aa, Staphylococcus
THAQMKMFLTRLGFGSKMVVTGDQTQ

SEQ ID NO: 1999323 - protein, 19 aa, Staphylococcus
TIHPHIKIGSRNLVGHTHR

SEQ ID NO: 1999324 - protein, 19 aa, Staphylococcus
TIPTTFEFTDIAGIVKGAS

SEQ ID NO: 1999325 - protein, 25 aa, Staphylococcus
TIRIAPRKVRLVLDLIRGKNAGEAI

SEQ ID NO: 1999326 - protein, 17 aa, Staphylococcus
TKDPEYRTTPSGVSVAT

SEQ ID NO: 1999327 - protein, 21 aa, Staphylococcus
TKLKNGRKFLSKGDKCKVSIR

SEQ ID NO: 1999328 - protein, 18 aa, Staphylococcus
TKNLEDFYDKEGFRDQEF

SEQ ID NO: 1999329 - protein, 19 aa, Staphylococcus
TKSIAGFDIESFNVSHDAI

SEQ ID NO: 1999330 - protein, 22 aa, Staphylococcus
TLEEPPAHAIFILATTEPHKIP

SEQ ID NO: 1999331 - protein, 23 aa, Staphylococcus
TLLIKGHNAYGYLKAEKGVHRLV

SEQ ID NO: 1999332 - protein, 20 aa, Staphylococcus
TMARGYRREEVDAFLDDIIT

SEQ ID NO: 1999333 - protein, 17 aa, Staphylococcus
TMEPTRQALKDAGLSTS

SEQ ID NO: 1999334 - protein, 18 aa, Staphylococcus
TMMKELKNAFRPEFLNRV

SEQ ID NO: 1999335 - protein, 18 aa, Staphylococcus
TMMKELKNSFRPEFLNRV

SEQ ID NO: 1999336 - protein, 23 aa, Staphylococcus
TMRKEVLGGLGGFGATFDLSQLN

SEQ ID NO: 1999337 - protein, 24 aa, Staphylococcus
TNEPTRVGYKFVDGKKVRIAKKSG

SEQ ID NO: 1999338 - protein, 25 aa, Staphylococcus
TNKAEKCTFCFPRIEAGMPTVCSET

SEQ ID NO: 1999339 - protein, 22 aa, Staphylococcus
TNRRITFEYGLFGGVNDQLEHA

SEQ ID NO: 1999340 - protein, 22 aa, Staphylococcus
TPDLTCLGKVIGGGLPVGAFGG

SEQ ID NO: 1999341 - protein, 20 aa, Staphylococcus
TPGHPEFRHTDGVEVTTGPL

SEQ ID NO: 1999342 - protein, 28 aa, Staphylococcus
TPQMVLRFKRRFGDDVAVLHSGLSNGER

SEQ ID NO: 1999343 - protein, 23 aa, Staphylococcus
TPVPGGVGPLTITMVLNNTLLAE

SEQ ID NO: 1999344 - protein, 23 aa, Staphylococcus
TQFGGPHCGYFATTKKLMRKVPG

SEQ ID NO: 1999345 - protein, 20 aa, Staphylococcus
TQLQSGYPYLMFKDNANKVH

SEQ ID NO: 1999346 - protein, 21 aa, Staphylococcus
TRAAYPIHHIDNIVLPSKAAH

SEQ ID NO: 1999347 - protein, 17 aa, Staphylococcus
TRELAMQVAEQLREFSR

SEQ ID NO: 1999348 - protein, 19 aa, Staphylococcus
TRLEHGISYTEFTYTILQA

SEQ ID NO: 1999349 - protein, 22 aa, Staphylococcus
TRLVEMVRPQLSSVIQPLYDIG

SEQ ID NO: 1999350 - protein, 20 aa, Staphylococcus
TRPLSATKRFRLVEIVEESV

SEQ ID NO: 1999351 - protein, 18 aa, Staphylococcus
TTMRARGAQVTDITILVV

SEQ ID NO: 1999352 - protein, 20 aa, Staphylococcus
TVFFLNGFQMKGVIEDFDKY

SEQ ID NO: 1999353 - protein, 18 aa, Staphylococcus
TVIIPGIMEHIERAGVHS

SEQ ID NO: 1999354 - protein, 28 aa, Staphylococcus
TVKRPEVVEKIKVARSFGDLSENSEYDA

SEQ ID NO: 1999355 - protein, 18 aa, Staphylococcus
VAGSGVYICNECIELCSE

SEQ ID NO: 1999356 - protein, 18 aa, Staphylococcus
VAIVYKPKGMVVHPSPGH

SEQ ID NO: 1999357 - protein, 19 aa, Staphylococcus
VALDGGFDCPNRDGTVAHG

SEQ ID NO: 1999358 - protein, 17 aa, Staphylococcus
VALRLVIDRENEIRNFK

SEQ ID NO: 1999359 - protein, 19 aa, Staphylococcus
VAVALELIHMATLVHDDVI

SEQ ID NO: 1999360 - protein, 25 aa, Staphylococcus
VDAMISRSEFYTAYTPYQPEISQGE

SEQ ID NO: 1999361 - protein, 20 aa, Staphylococcus
VDFSYEVSRSLAACEGAILV

SEQ ID NO: 1999362 - protein, 17 aa, Staphylococcus
VDMRLHRVIYNVIEEIE

SEQ ID NO: 1999363 - protein, 19 aa, Staphylococcus
VDWGKTRIYNMIRDRGEWV

SEQ ID NO: 1999364 - protein, 23 aa, Staphylococcus
VEERSAVSIGRRVQDPLSELVKI

SEQ ID NO: 1999365 - protein, 18 aa, Staphylococcus
VEGLYPYHIYTYIINELM

SEQ ID NO: 1999366 - protein, 20 aa, Staphylococcus
VEIPCVMRNAIGSGNALISA

SEQ ID NO: 1999367 - protein, 23 aa, Staphylococcus
VETKRLSSMIFYGPPGIGKTSIA

SEQ ID NO: 1999368 - protein, 18 aa, Staphylococcus
VFDRGGYLYHGRVKALAE

SEQ ID NO: 1999369 - protein, 23 aa, Staphylococcus
VFYIPNCDKITPGMLLAAVRTNV

SEQ ID NO: 1999370 - protein, 18 aa, Staphylococcus
VGIKSREIYETPGAEVIL

SEQ ID NO: 1999371 - protein, 22 aa, Staphylococcus
VGMGYSLHAGMVVVADGSERAD

SEQ ID NO: 1999372 - protein, 19 aa, Staphylococcus
VGNLGRALLTYNFSIHDEM

SEQ ID NO: 1999373 - protein, 19 aa, Staphylococcus
VGPNCPGVITADECKIGIM

SEQ ID NO: 1999374 - protein, 20 aa, Staphylococcus
VGSPDALIECSIRGMDMFDC

SEQ ID NO: 1999375 - protein, 22 aa, Staphylococcus
VHNRRDLGGLIFVDLRDREGIV

SEQ ID NO: 1999376 - protein, 18 aa, Staphylococcus
VHSDGIHFQGFRYSNTNL

SEQ ID NO: 1999377 - protein, 23 aa, Staphylococcus
VIDGEFQFDAAIVPSVAEKKAPG

SEQ ID NO: 1999378 - protein, 19 aa, Staphylococcus
VKALSMWMTLKCGIVNLPY

SEQ ID NO: 1999379 - protein, 25 aa, Staphylococcus
VKATDLRAAAALILAGLVADGTTQV

SEQ ID NO: 1999380 - protein, 19 aa, Staphylococcus
VKMALWYTEMKRNLKRFKE

SEQ ID NO: 1999381 - protein, 30 aa, Staphylococcus; identical to SEQ ID NO: 1794163

SEQ ID NO: 1999382 - protein, 28 aa, Staphylococcus
VLHLLYARFWHKVLYDLGVVPTKEPFQK

SEQ ID NO: 1999383 - protein, 23 aa, Staphylococcus
VLTESGAFGRALVPSGASTGEHE

SEQ ID NO: 1999384 - protein, 17 aa, Staphylococcus
VMNCYRALNRPLYNKYK

SEQ ID NO: 1999385 - protein, 28 aa, Staphylococcus
VNAKGRLPDCLVEWSAKRLKEQGANAVK

SEQ ID NO: 1999386 - protein, 18 aa, Staphylococcus
VNGTISIGCSSLIGQTLL

SEQ ID NO: 1999387 - protein, 20 aa, Staphylococcus
VPEFGTGFVRQMLEDTKPTT

SEQ ID NO: 1999388 - protein, 23 aa, Staphylococcus
VQEVRAWTFRQGMTAPQCAGIIH

SEQ ID NO: 1999389 - protein, 21 aa, Staphylococcus
VRQHPGEVCPAKWEEGSETLQ

SEQ ID NO: 1999390 - protein, 18 aa, Staphylococcus
VRVYERFSTLDAVSNGRA

SEQ ID NO: 1999391 - protein, 20 aa, Staphylococcus
VSALLGRMPSAVGYQPTLAT

SEQ ID NO: 1999392 - protein, 22 aa, Staphylococcus
VSEMSFDTMVLFGDHAASPHGT

SEQ ID NO: 1999393 - protein, 17 aa, Staphylococcus
VSMKRAGADMIITYFAK

SEQ ID NO: 1999394 - protein, 18 aa, Staphylococcus
VSRLVKRRTLAKEISDQG

SEQ ID NO: 1999395 - protein, 26 aa, Staphylococcus
VSSHGLSLGRLRGVEFDVAIFSNLTQ

SEQ ID NO: 1999396 - protein, 19 aa, Staphylococcus
VSSVFLETFLFYSGFYYPL

SEQ ID NO: 1999397 - protein, 20 aa, Staphylococcus
VSSVFLETFLFYSGFYYPLY

SEQ ID NO: 1999398 - protein, 19 aa, Staphylococcus
VTMGEEFMFNGKHVLIVYD

SEQ ID NO: 1999399 - protein, 21 aa, Staphylococcus
VVANLPYYITTPILLNLMQQD

SEQ ID NO: 1999400 - protein, 18 aa, Staphylococcus
VVDISNYVLLEYGQPLHM

SEQ ID NO: 1999401 - protein, 32 aa, Staphylococcus; identical to SEQ ID NO: 1796975

SEQ ID NO: 1999402 - protein, 17 aa, Staphylococcus
VVMLTSFIEDKEVYRAL

SEQ ID NO: 1999403 - protein, 26 aa, Staphylococcus
VVVPDYQLSLAIGKRGQNARLAAKLT

SEQ ID NO: 1999404 - protein, 25 aa, Staphylococcus
VYLEHMKLYRSFREEVPEEEYTIDI

SEQ ID NO: 1999405 - protein, 18 aa, Staphylococcus
WEIMGLNIMQPFKVYPNG

SEQ ID NO: 1999406 - protein, 22 aa, Staphylococcus
WLEVYNRNGVVTARAVTSHRMP

SEQ ID NO: 1999407 - protein, 23 aa, Staphylococcus
WLRCDIKSLNLLGNVLAKEYAVK

SEQ ID NO: 1999408 - protein, 17 aa, Staphylococcus
WLTHEFNIIDTGGIEIG

SEQ ID NO: 1999409 - protein, 34 aa, Staphylococcus
WNYHLKNKFGRKIFKVALDGGFDCPNRDGTVAHG

SEQ ID NO: 1999410 - protein, 22 aa, Staphylococcus
WSRIPHFYMNYYVYQYATGYSA

SEQ ID NO: 1999411 - protein, 25 aa, Staphylococcus
WTISRQLWWGHQIPAWYHKETGEIY

SEQ ID NO: 1999412 - protein, 34 aa, Staphylococcus; identical to SEQ ID NO: 1794201

SEQ ID NO: 1999413 - protein, 18 aa, Staphylococcus
YEGFGPSGSMLIVDALTN

SEQ ID NO: 1999414 - protein, 18 aa, Staphylococcus
YEGGKMVVAEAYRNLIAV

SEQ ID NO: 1999415 - protein, 19 aa, Staphylococcus
YEVNKSSLVKRIDELRADK

SEQ ID NO: 1999416 - protein, 20 aa, Staphylococcus
YEYSPLRVKYPYIRGKLLDL

SEQ ID NO: 1999417 - protein, 20 aa, Staphylococcus
YFNRDRFILSAGHGSALLYS

SEQ ID NO: 1999418 - protein, 24 aa, Staphylococcus
YGCDKFCTYCIVPFTRGKERSRRP

SEQ ID NO: 1999419 - protein, 18 aa, Staphylococcus
YGNKEIAEKLFVSVKTVE

SEQ ID NO: 1999420 - protein, 18 aa, Staphylococcus
YIEIEGVLHEFSAIDNVV

SEQ ID NO: 1999421 - protein, 23 aa, Staphylococcus
YIGSELGTAFANFGSEVTILEGA

SEQ ID NO: 1999422 - protein, 18 aa, Staphylococcus
YIRHLIKAEETFGIRLTT

SEQ ID NO: 1999423 - protein, 23 aa, Staphylococcus
YITPDKVHVMYGGKVVKSGGPEL

SEQ ID NO: 1999424 - protein, 19 aa, Staphylococcus
YKNEIVIIDAGIKFPDDNL

SEQ ID NO: 1999425 - protein, 28 aa, Staphylococcus
YKNHPEELRLLLIDPKMVELAPYNDLPH

SEQ ID NO: 1999426 - protein, 20 aa, Staphylococcus
YKRHPMIKLMNAMQYDASGI

SEQ ID NO: 1999427 - protein, 18 aa, Staphylococcus
YLDDLGFNLVGYGCTTCI

SEQ ID NO: 1999428 - protein, 19 aa, Staphylococcus
YLKEIGRVNLLSAQEEIEL

SEQ ID NO: 1999429 - protein, 19 aa, Staphylococcus
YLLPKATVVTPNLFEAGQL

SEQ ID NO: 1999430 - protein, 25 aa, Staphylococcus
YLPEALFNFITLLGWSPEGEEEIFS

SEQ ID NO: 1999431 - protein, 21 aa, Staphylococcus
YLRPLYDGLNTVLGREQTARF

SEQ ID NO: 1999432 - protein, 19 aa, Staphylococcus
YNISYASKAFTCIQMVKLV

SEQ ID NO: 1999433 - protein, 26 aa, Staphylococcus
YNMIRDRGEWVISRQRVWGVPLPVFY

SEQ ID NO: 1999434 - protein, 25 aa, Staphylococcus
YQRSADIFLGVPFNIASYALLTHLI

SEQ ID NO: 1999435 - protein, 20 aa, Staphylococcus
YSTDLANIFYVRQKEQKGLG

SEQ ID NO: 1999436 - protein, 17 aa, Staphylococcus
YVDMAKLAEARQVDPNK

SEQ ID NO: 1999437 - protein, 25 aa, Staphylococcus
YVFISWTGKMAETFVLAHELGHAGH

SEQ ID NO: 1999438 - protein, 23 aa, Staphylococcus
YVKGENPYFVSFIGDAPKKNPKV

SEQ ID NO: 1999439 - protein, 27 aa, Staphylococcus
YVLMAVRIAYFKVHHPLYYYAAYFTIR

SEQ ID NO: 1999440 - protein, 22 aa, Staphylococcus
YVTEFPLTIMVNGEEFATVICS

SEQ ID NO: 1999441 - protein, 20 aa, Staphylococcus
AAAGLRRMGWSDDIVTTYLD

SEQ ID NO: 1999442 - protein, 19 aa, Staphylococcus
AAEKAGIEGLDEFLTGPTA

SEQ ID NO: 1999443 - protein, 19 aa, Staphylococcus
AAEWIKANMTKPVVGFVGG

SEQ ID NO: 1999444 - protein, 19 aa, Staphylococcus
AAGLGTRFLPATKAMPKEM

SEQ ID NO: 1999445 - protein, 21 aa, Staphylococcus
AAHGGLHPYGATFFVFSDYLK

SEQ ID NO: 1999446 - protein, 22 aa, Staphylococcus
AAHGGLHPYGATFFVFSDYLKP

SEQ ID NO: 1999447 - protein, 23 aa, Staphylococcus
AAIIAENCLFDLDAPIMRLAGPD

SEQ ID NO: 1999448 - protein, 23 aa, Staphylococcus
AAKILTEHLNIFVGLTDEAQNAE

SEQ ID NO: 1999449 - protein, 19 aa, Staphylococcus
AAKRIVPATLELGGKSANI

SEQ ID NO: 1999450 - protein, 22 aa, Staphylococcus
AALHSRCPEAMVIDINDTKMLT

SEQ ID NO: 1999451 - protein, 20 aa, Staphylococcus
AAVRAVVRTAIYNNIEVYGI

SEQ ID NO: 1999452 - protein, 20 aa, Staphylococcus
ACCTHPVLSGPAKERIENSA

SEQ ID NO: 1999453 - protein, 17 aa, Staphylococcus
ACRGWRYCMTGCPYKKV

SEQ ID NO: 1999454 - protein, 18 aa, Staphylococcus
ADGQFVTGGSILFRQRGT

SEQ ID NO: 1999455 - protein, 18 aa, Staphylococcus
ADISKTYMDPMAKIIRNK

SEQ ID NO: 1999456 - protein, 27 aa, Staphylococcus
ADKAAARFGSGWAWLVVNNGQLEIVTT

SEQ ID NO: 1999457 - protein, 25 aa, Staphylococcus
ADKGELPHNVVFIFQPAEETGGGAN

SEQ ID NO: 1999458 - protein, 25 aa, Staphylococcus
ADLIKRIDTHLSIDFMDVSSYHGGT

SEQ ID NO: 1999459 - protein, 23 aa, Staphylococcus
ADQAICIGEANPLDSYLNIERII

SEQ ID NO: 1999460 - protein, 29 aa, Staphylococcus
ADSLHIGHLLPFLTLRRFQEHGHRPIVLI

SEQ ID NO: 1999461 - protein, 17 aa, Staphylococcus
ADSLRYFLATGSSPGHD

SEQ ID NO: 1999462 - protein, 23 aa, Staphylococcus
ADVNFKVVKEFVKTVSDRALGSD

SEQ ID NO: 1999463 - protein, 22 aa, Staphylococcus
ADWSNFAVVDGRIVTGQNPQSG

SEQ ID NO: 1999464 - protein, 18 aa, Staphylococcus
ADYGFPRAHAVSYSKIAY

SEQ ID NO: 1999465 - protein, 26 aa, Staphylococcus
AEHFNKLEVPFIYRVHEQPKSDRLRQ

SEQ ID NO: 1999466 - protein, 20 aa, Staphylococcus
AEIFHNLKSILSERGLETAV

SEQ ID NO: 1999467 - protein, 17 aa, Staphylococcus
AEIGHPVIGDPLYGDST

SEQ ID NO: 1999468 - protein, 22 aa, Staphylococcus
AEILEWFDAIGRRRGLLQKGNE

SEQ ID NO: 1999469 - protein, 19 aa, Staphylococcus
AEIQIRTLAMNFWATIEHT

SEQ ID NO: 1999470 - protein, 24 aa, Staphylococcus
AEKGVHRLVRISPFDSSGRRHTSF

SEQ ID NO: 1999471 - protein, 26 aa, Staphylococcus
AELGDNLFVLLCIANSLDIDMTESFN

SEQ ID NO: 1999472 - protein, 30 aa, Staphylococcus
AELHEFIHGRKAPKLEGVRFSVLALGDQTY

SEQ ID NO: 1999473 - protein, 21 aa, Staphylococcus
AERAGLGFAGRNGFIINPDLG

SEQ ID NO: 1999474 - protein, 23 aa, Staphylococcus
AERLGLLKIDFLGLRNLSIIHQI

SEQ ID NO: 1999475 - protein, 18 aa, Staphylococcus
AFRKLFTGENFGKQVVKV

SEQ ID NO: 1999476 - protein, 17 aa, Staphylococcus
AFSEALFEHQIYQRERI

SEQ ID NO: 1999477 - protein, 25 aa, Staphylococcus
AGIMTKCPKCKKIMYTKELAENLNV

SEQ ID NO: 1999478 - protein, 17 aa, Staphylococcus
AGINHWFNSDTIYRAVL

SEQ ID NO: 1999479 - protein, 26 aa, Staphylococcus
AGIVPWNAPILVLMRKVIPAIVTGCS

SEQ ID NO: 1999480 - protein, 18 aa, Staphylococcus
AGLKRMGWSDDIVTTYLD

SEQ ID NO: 1999481 - protein, 18 aa, Staphylococcus
AGMNVARLNFSHGSHEEH

SEQ ID NO: 1999482 - protein, 39 aa, Staphylococcus
AGRSDYPWDLFIQMPAALMFPSGNPFYDWRYQTEEEPHM

SEQ ID NO: 1999483 - protein, 17 aa, Staphylococcus
AGYFSPLANLARLTEEV

SEQ ID NO: 1999484 - protein, 17 aa, Staphylococcus
AHCISKWGHDFRPSYQS

SEQ ID NO: 1999485 - protein, 23 aa, Staphylococcus
AHILEGLRIALDHIDEIISTIRE

SEQ ID NO: 1999486 - protein, 25 aa, Staphylococcus
AHLAARKGLPYVFAGHFAPQQMKEA

SEQ ID NO: 1999487 - protein, 24 aa, Staphylococcus
AIEKSKHAQLEWEKVPAPTRAEHV

SEQ ID NO: 1999488 - protein, 18 aa, Staphylococcus
AIEPPTFVVFVNDVELMH

SEQ ID NO: 1999489 - protein, 19 aa, Staphylococcus
AILDKGFKIDIITDQTSAH

SEQ ID NO: 1999490 - protein, 20 aa, Staphylococcus
AINGVLPPIVSIVASYEVAE

SEQ ID NO: 1999491 - protein, 21 aa, Staphylococcus
AIQLSVKVLKNIIAQTNFAVS

SEQ ID NO: 1999492 - protein, 22 aa, Staphylococcus
AIQLSVKVLKNIIAQTNFAVST

SEQ ID NO: 1999493 - protein, 32 aa, Staphylococcus
AISDEVFKYLNRFARVPVCGAISAYNNEKDDI

SEQ ID NO: 1999494 - protein, 26 aa, Staphylococcus
AITPWNFPAAMITRKMAPALAAGCTI

SEQ ID NO: 1999495 - protein, 28 aa, Staphylococcus
AIVRMEKRYKGPIAFEYTHINNNKERVW

SEQ ID NO: 1999496 - protein, 28 aa, Staphylococcus
AIYTARKGLRTGIIADRIGGQVNDTAGI

SEQ ID NO: 1999497 - protein, 29 aa, Staphylococcus
AKAFVASAIKNGWKMNDFVGPVDHGAYNR

SEQ ID NO: 1999498 - protein, 17 aa, Staphylococcus
AKEGSIFVASKGYTVDS

SEQ ID NO: 1999499 - protein, 19 aa, Staphylococcus
AKELDEMGADYIAVHIGYD

SEQ ID NO: 1999500 - protein, 25 aa, Staphylococcus
AKELEREGFHILAIKDMAGLLKPKA

SEQ ID NO: 1999501 - protein, 19 aa, Staphylococcus
AKFKAGLEKSRQNFQEQLN

SEQ ID NO: 1999502 - protein, 23 aa, Staphylococcus
AKKAGTAPKRFIREFRNVNVDEY

SEQ ID NO: 1999503 - protein, 22 aa, Staphylococcus
AKLRTHMRTEIIKLHKKMGATT

SEQ ID NO: 1999504 - protein, 23 aa, Staphylococcus
AKNGYYDGITFHRVINDFMIQGG

SEQ ID NO: 1999505 - protein, 20 aa, Staphylococcus
AKNIRFMCLIAAPEGVEKMQ

SEQ ID NO: 1999506 - protein, 20 aa, Staphylococcus
AKSEVWRQMMADIFDTDLIV

SEQ ID NO: 1999507 - protein, 24 aa, Staphylococcus
ALAKRVKLPIVIHNREATQDCVDI

SEQ ID NO: 1999508 - protein, 26 aa, Staphylococcus
ALKPMNCPGHMLIFKNELRSYKDLPL

SEQ ID NO: 1999509 - protein, 18 aa, Staphylococcus
ALLTYNFSIHDEMTITEA

SEQ ID NO: 1999510 - protein, 24 aa, Staphylococcus
ALNSAVWSGGSFIYVPKNIKLDTP

SEQ ID NO: 1999511 - protein, 17 aa, Staphylococcus
ALPGLGHACGHNIIGTA

SEQ ID NO: 1999512 - protein, 24 aa, Staphylococcus
ALRPPHRKEVLKAREDDIKEKVQN

SEQ ID NO: 1999513 - protein, 19 aa, Staphylococcus
ALSAHDSWTLAKHLKTLPV

SEQ ID NO: 1999514 - protein, 21 aa, Staphylococcus
ALSAPVRQIAENAGLEGSVIV

SEQ ID NO: 1999515 - protein, 21 aa, Staphylococcus
ALSTLYRWNKLYKEEGLTGLI

SEQ ID NO: 1999516 - protein, 23 aa, Staphylococcus
ALTYAERYFLMKFFNIPTDEDDA

SEQ ID NO: 1999517 - protein, 25 aa, Staphylococcus
ALVKALQAWDIDHLYGIPGDSIDAV

SEQ ID NO: 1999518 - protein, 19 aa, Staphylococcus
AMLTYPEDFHVLKKLNKVL

SEQ ID NO: 1999519 - protein, 20 aa, Staphylococcus
AMMREVRLALLEADVNFKVV

SEQ ID NO: 1999520 - protein, 18 aa, Staphylococcus
AMTDCLNYGSPEKKEIYQ

SEQ ID NO: 1999521 - protein, 17 aa, Staphylococcus
ANDIRWLASGPRAGLAE

SEQ ID NO: 1999522 - protein, 18 aa, Staphylococcus
ANIVKYIFESYAKGHGYR

SEQ ID NO: 1999523 - protein, 25 aa, Staphylococcus
ANKLRLLKLAPKVIVRLREGKITER

SEQ ID NO: 1999524 - protein, 20 aa, Staphylococcus
ANKRGIPFDRLREEMYDIAG

SEQ ID NO: 1999525 - protein, 19 aa, Staphylococcus
ANLSTVMIERGMPGGQMAN

SEQ ID NO: 1999526 - protein, 24 aa, Staphylococcus
ANQLSCDSIWLGVWEKNDNAIIFY

SEQ ID NO: 1999527 - protein, 18 aa, Staphylococcus
ANQNCKINYGVTFPIHEK

SEQ ID NO: 1999528 - protein, 23 aa, Staphylococcus
APFGATIPYYFTGHEGPDSCCID

SEQ ID NO: 1999529 - protein, 23 aa, Staphylococcus
APGDYEKRVTFGLSGSDANDGII

SEQ ID NO: 1999530 - protein, 18 aa, Staphylococcus
APLQGLIMRGFEIDCRIK

SEQ ID NO: 1999531 - protein, 23 aa, Staphylococcus
APSESKFKVYIIDEVHMLTTGAF

SEQ ID NO: 1999532 - protein, 24 aa, Staphylococcus
APVIWRGPMLGKMLTNFFTEVKWG

SEQ ID NO: 1999533 - protein, 19 aa, Staphylococcus
APVIWRGPMLGKMLTNFFV

SEQ ID NO: 1999534 - protein, 19 aa, Staphylococcus
AQERIKYEYFREKIGEVTN

SEQ ID NO: 1999535 - protein, 21 aa, Staphylococcus
AQHGIKAIIQPGGSIKDQDSI

SEQ ID NO: 1999536 - protein, 19 aa, Staphylococcus
AQLDYLLPRLQGHGKSLSR

SEQ ID NO: 1999537 - protein, 23 aa, Staphylococcus
AQLIEGLIHFVSRQAMNIDGLGT

SEQ ID NO: 1999538 - protein, 23 aa, Staphylococcus
AQLVEGLIHFVSRQAMNIDGLGT

SEQ ID NO: 1999539 - protein, 23 aa, Staphylococcus
AQRFDCVPSQLNYVIKTRFTNEH

SEQ ID NO: 1999540 - protein, 17 aa, Staphylococcus
ARCFEMKEACYAATPAI

SEQ ID NO: 1999541 - protein, 24 aa, Staphylococcus
ARDTLRLEAGLPLHGQDLTESITP

SEQ ID NO: 1999542 - protein, 21 aa, Staphylococcus
ARKFMRMFFSGAIEVELDKQG

SEQ ID NO: 1999543 - protein, 18 aa, Staphylococcus
ARLGHAIVALPGGCAIGA

SEQ ID NO: 1999544 - protein, 18 aa, Staphylococcus
ARLGHAIVALPGGCAIGS

SEQ ID NO: 1999545 - protein, 19 aa, Staphylococcus
ARVALDLFASKIHKYIGSY

SEQ ID NO: 1999546 - protein, 17 aa, Staphylococcus
ARVPAGGALAVDRHDFA

SEQ ID NO: 1999547 - protein, 23 aa, Staphylococcus
ASDLRAGACLIIAGLLAEGVTTI

SEQ ID NO: 1999548 - protein, 18 aa, Staphylococcus
ASEGGMRDALSIMDQAIA

SEQ ID NO: 1999549 - protein, 21 aa, Staphylococcus
ASKAFTCIQMVKLVQEEDLQL

SEQ ID NO: 1999550 - protein, 26 aa, Staphylococcus
ASKSFKPGRPIGGDFYLRGLIKCPEC

SEQ ID NO: 1999551 - protein, 23 aa, Staphylococcus
ATEHSIAMILAMARNIPQAHQSL

SEQ ID NO: 1999552 - protein, 17 aa, Staphylococcus
ATGCHYHVCHVSTKESV

SEQ ID NO: 1999553 - protein, 25 aa, Staphylococcus
ATGIDHNRLSLLMAVLEKKENYLLQ

SEQ ID NO: 1999554 - protein, 34 aa, Staphylococcus; identical to SEQ ID NO: 1794377

SEQ ID NO: 1999555 - protein, 17 aa, Staphylococcus
ATIRRDFSYFGELGKKG

SEQ ID NO: 1999556 - protein, 18 aa, Staphylococcus
ATKVGIGPGRVCITKIKT

SEQ ID NO: 1999557 - protein, 20 aa, Staphylococcus
ATKVGIGPGRVCITKIKTGF

SEQ ID NO: 1999558 - protein, 21 aa, Staphylococcus
ATKVGIGPGRVCITKIKTGFG

SEQ ID NO: 1999559 - protein, 19 aa, Staphylococcus
ATQKYNIIKPFILGNQSLS

SEQ ID NO: 1999560 - protein, 25 aa, Staphylococcus
ATVSKGGHLKVRLVANKGRGYALAE

SEQ ID NO: 1999561 - protein, 18 aa, Staphylococcus
AVALELIHMATLVHDDVI

SEQ ID NO: 1999562 - protein, 18 aa, Staphylococcus
AVEKGLKVPEFVKTSLAP

SEQ ID NO: 1999563 - protein, 25 aa, Staphylococcus
AVETALKAARRWAYDVKGIEPNQAE

SEQ ID NO: 1999564 - protein, 17 aa, Staphylococcus
AVHGLKYWFNYTSDDLV

SEQ ID NO: 1999565 - protein, 29 aa, Staphylococcus
AVKPLLDKEIEGFGELFRYLSYTEDVGTK

SEQ ID NO: 1999566 - protein, 17 aa, Staphylococcus
AVPYFRMFNPIRQSERF

SEQ ID NO: 1999567 - protein, 29 aa, Staphylococcus
AVSSCGKCYYCKKGIYAHCENDGGWILGH

SEQ ID NO: 1999568 - protein, 23 aa, Staphylococcus
AVTLNCHPEVNILIGENAQGKTN

SEQ ID NO: 1999569 - protein, 17 aa, Staphylococcus
AYIAMTIAQDTDYILLD

SEQ ID NO: 1999570 - protein, 17 aa, Staphylococcus
AYIAMTIAQDTEYILLD

SEQ ID NO: 1999571 - protein, 17 aa, Staphylococcus
AYILSKRQLETEKSYEY

SEQ ID NO: 1999572 - protein, 18 aa, Staphylococcus
AYQLAQRGVKVNLIEMRP

SEQ ID NO: 1999573 - protein, 21 aa, Staphylococcus
AYYRYVSKRIGVIVESTLKAL

SEQ ID NO: 1999574 - protein, 23 aa, Staphylococcus
CASPYFTHSYVFISWTGKMAETF

SEQ ID NO: 1999575 - protein, 24 aa, Staphylococcus
CDIQKEYYVGFVIDRATDKVTLMA

SEQ ID NO: 1999576 - protein, 17 aa, Staphylococcus
CEHVVAFELAKALLEEF

SEQ ID NO: 1999577 - protein, 21 aa, Staphylococcus
CENDGGWILGHLINGTQAEYV

SEQ ID NO: 1999578 - protein, 36 aa, Staphylococcus; identical to SEQ ID NO: 1800866

SEQ ID NO: 1999579 - protein, 17 aa, Staphylococcus
CFDAPSWYELVVEGRKI

SEQ ID NO: 1999580 - protein, 18 aa, Staphylococcus
CFDAPSWYELVVEGRKIA

SEQ ID NO: 1999581 - protein, 19 aa, Staphylococcus
CFDAPSWYELVVEGRKIAG

SEQ ID NO: 1999582 - protein, 19 aa, Staphylococcus
CFELLAMVTYADKLKGIIK

SEQ ID NO: 1999583 - protein, 19 aa, Staphylococcus
CKEPVSLQPSLDVKRMPWI

SEQ ID NO: 1999584 - protein, 17 aa, Staphylococcus
CLQKGAFVSDKDGDMHY

SEQ ID NO: 1999585 - protein, 22 aa, Staphylococcus
CMEELKMMINIMKPEYFIPVQG

SEQ ID NO: 1999586 - protein, 19 aa, Staphylococcus
CNCTGEWTMENFIEIEIEK

SEQ ID NO: 1999587 - protein, 22 aa, Staphylococcus
CNFRCDYCMPKEIFGDDFVFLP

SEQ ID NO: 1999588 - protein, 27 aa, Staphylococcus
CNLFKPGDEVLVAFDLYGGTFRLFDFY

SEQ ID NO: 1999589 - protein, 31 aa, Staphylococcus; identical to SEQ ID NO: 1646838

SEQ ID NO: 1999590 - protein, 31 aa, Staphylococcus
CNNFCTFCIIPWARGLMRSRDPEKVVEQATT

SEQ ID NO: 1999591 - protein, 20 aa, Staphylococcus
CPKLRPVIRTLRRLATFIEN

SEQ ID NO: 1999592 - protein, 18 aa, Staphylococcus
CPNCKKKMTLFGRGKEAV

SEQ ID NO: 1999593 - protein, 24 aa, Staphylococcus
CPNGCARPALAEIAFIGKAPGKYN

SEQ ID NO: 1999594 - protein, 18 aa, Staphylococcus
CREVRKKYEMPIIMLTAK

SEQ ID NO: 1999595 - protein, 17 aa, Staphylococcus
CSGLVRADFFVTEDNQI

SEQ ID NO: 1999596 - protein, 19 aa, Staphylococcus
CTYCGVGCSFEVWTKDREV

SEQ ID NO: 1999597 - protein, 23 aa, Staphylococcus
CVDNLPPILLPKFVELMEQGNPS

SEQ ID NO: 1999598 - protein, 23 aa, Staphylococcus
DAAKDLNDFLGINYYMSDWMRGY

SEQ ID NO: 1999599 - protein, 19 aa, Staphylococcus
DAAKDVWINGFTPKYSMSV

SEQ ID NO: 1999600 - protein, 22 aa, Staphylococcus
DADLDMVICITEHIPVVDMVKV

SEQ ID NO: 1999601 - protein, 25 aa, Staphylococcus
DAIAAKAKDGASCVEYIGPNGAGHY

SEQ ID NO: 1999602 - protein, 25 aa, Staphylococcus
DAIAAKAQDGASCVTYIGPNGAGHY

SEQ ID NO: 1999603 - protein, 24 aa, Staphylococcus
DAKPETYDALLIPGGFSPDHLRGD

SEQ ID NO: 1999604 - protein, 20 aa, Staphylococcus
DAPLKALIFDSEYDPYRGVI

SEQ ID NO: 1999605 - protein, 23 aa, Staphylococcus
DAPYSGLCVESFTGDYPAGLFDY

SEQ ID NO: 1999606 - protein, 25 aa, Staphylococcus
DAVKIVRKRGQLMAQAFPNGVGSMA

SEQ ID NO: 1999607 - protein, 17 aa, Staphylococcus
DDAYFKKIDAIEFAVKY

SEQ ID NO: 1999608 - protein, 24 aa, Staphylococcus
DDEMKRSYLRGAFLAGGSVNNPET

SEQ ID NO: 1999609 - protein, 26 aa, Staphylococcus
DDFERWSFHLQIYFLAERFKEQKRMF

SEQ ID NO: 1999610 - protein, 18 aa, Staphylococcus
DDPYKLELIDAIPEDENV

SEQ ID NO: 1999611 - protein, 17 aa, Staphylococcus
DDYLDVFQIGARNMQNF

SEQ ID NO: 1999612 - protein, 24 aa, Staphylococcus
DEEGRYGTFTKYFTQNDVPTFAIC

SEQ ID NO: 1999613 - protein, 24 aa, Staphylococcus
DEGTFKWGVTTSLSYFPKDNSEFF

SEQ ID NO: 1999614 - protein, 24 aa, Staphylococcus
DELDKCFYKYYGLNKLINLLLKEK

SEQ ID NO: 1999615 - protein, 23 aa, Staphylococcus
DESRILFGAGLDEVILMISRAVL

SEQ ID NO: 1999616 - protein, 23 aa, Staphylococcus
DESRTIKAIEELGERMGIQTPIR

SEQ ID NO: 1999617 - protein, 18 aa, Staphylococcus
DFARAVLEGITFSLYDSI

SEQ ID NO: 1999618 - protein, 22 aa, Staphylococcus
DFEAIFRLSGERPTIVRLLDPP

SEQ ID NO: 1999619 - protein, 28 aa, Staphylococcus
DFESINWLINYVKQYPHTVLFVTHDRYF

SEQ ID NO: 1999620 - protein, 31 aa, Staphylococcus
DFESINWLINYVKQYPYTVLFVTHDRYFLNE

SEQ ID NO: 1999621 - protein, 17 aa, Staphylococcus
DFFTFFRNFFTKKWERE

SEQ ID NO: 1999622 - protein, 23 aa, Staphylococcus
DFKDWLQSDVFRKAHQHVRHQSQ

SEQ ID NO: 1999623 - protein, 30 aa, Staphylococcus; identical to SEQ ID NO: 1797288

SEQ ID NO: 1999624 - protein, 19 aa, Staphylococcus
DGFHPSNIGKLYIDEQTFV

SEQ ID NO: 1999625 - protein, 26 aa, Staphylococcus
DGLKSFKGSIIFTSYDFEFINTIANR

SEQ ID NO: 1999626 - protein, 23 aa, Staphylococcus
DGNQHLPGWGLDALKFLIEERGV

SEQ ID NO: 1999627 - protein, 18 aa, Staphylococcus
DGRLFTCYLGDFESTGGI

SEQ ID NO: 1999628 - protein, 25 aa, Staphylococcus
DGTIKFLFELQDGYTIETVLMRHEY

SEQ ID NO: 1999629 - protein, 17 aa, Staphylococcus
DGWYSLHLFYAVDWATF

SEQ ID NO: 1999630 - protein, 19 aa, Staphylococcus
DGYLKIKVNGGGCTGLTYG

SEQ ID NO: 1999631 - protein, 24 aa, Staphylococcus
DHIDKKEARRMDRFTQYAVVAARE

SEQ ID NO: 1999632 - protein, 26 aa, Staphylococcus
DHRIIDGKEAVGFLKTIKDLIENPED

SEQ ID NO: 1999633 - protein, 18 aa, Staphylococcus
DHVAWIAEVERYYEQQDQ

SEQ ID NO: 1999634 - protein, 18 aa, Staphylococcus
DIAELVMELEDEFGTEIP

SEQ ID NO: 1999635 - protein, 25 aa, Staphylococcus
DIAKSIRFGASMVMIGSLFAAHEES

SEQ ID NO: 1999636 - protein, 18 aa, Staphylococcus
DIDMYIIVSYGVKISEVA

SEQ ID NO: 1999637 - protein, 23 aa, Staphylococcus
DIEARGFSREDLWTNRKRGEEFF

SEQ ID NO: 1999638 - protein, 21 aa, Staphylococcus
DIEGRTAIIIDDIIDTAGTIT

SEQ ID NO: 1999639 - protein, 23 aa, Staphylococcus
DIGDLRQGYEYSRTANPTRASLE

SEQ ID NO: 1999640 - protein, 24 aa, Staphylococcus
DILKKRYILKNVVEKIEKIYDFDY

SEQ ID NO: 1999641 - protein, 24 aa, Staphylococcus
DKINFGDGVARFDLRKEGAKHFHH

SEQ ID NO: 1999642 - protein, 21 aa, Staphylococcus
DKIYGTHLWSGYPTGTIYSRP

SEQ ID NO: 1999643 - protein, 17 aa, Staphylococcus
DKLKNRIYYEPKTTSKS

SEQ ID NO: 1999644 - protein, 27 aa, Staphylococcus
DKNTSRIYAKFGKEIYVAAKSGEPNPE

SEQ ID NO: 1999645 - protein, 19 aa, Staphylococcus
DKNTVPFIARYRKEQTGGL

SEQ ID NO: 1999646 - protein, 18 aa, Staphylococcus
DKRRARAAAQNIVPNSTG

SEQ ID NO: 1999647 - protein, 19 aa, Staphylococcus
DKRRGRLTISKKWDQTTAI

SEQ ID NO: 1999648 - protein, 22 aa, Staphylococcus
DLEIGSGSFIPGFEDQLVGVKT

SEQ ID NO: 1999649 - protein, 19 aa, Staphylococcus
DLEYLKYAKDYGFSDKVIA

SEQ ID NO: 1999650 - protein, 20 aa, Staphylococcus
DLIRKCNKLGKPVITATQML

SEQ ID NO: 1999651 - protein, 21 aa, Staphylococcus
DLLIMAGTNYPYVDYLPKKNI

SEQ ID NO: 1999652 - protein, 24 aa, Staphylococcus
DLNITIPVAIHLDHGSSFEKCKEA

SEQ ID NO: 1999653 - protein, 17 aa, Staphylococcus
DLPGVRYHIVRGALDTS

SEQ ID NO: 1999654 - protein, 17 aa, Staphylococcus
DLPTKFEAGTPLIAQAI

SEQ ID NO: 1999655 - protein, 22 aa, Staphylococcus
DLQKKLGKTFIFVTHDMDEAIK

SEQ ID NO: 1999656 - protein, 19 aa, Staphylococcus
DLVEELKMADFERAAKVSG

SEQ ID NO: 1999657 - protein, 18 aa, Staphylococcus
DLVTPIGLGQRGLIVAPP

SEQ ID NO: 1999658 - protein, 17 aa, Staphylococcus
DNLKTFGVEKIFTEKQS

SEQ ID NO: 1999659 - protein, 22 aa, Staphylococcus
DNNMKDLARMSVGQVLNEHDID

SEQ ID NO: 1999660 - protein, 18 aa, Staphylococcus
DNPVEFIAIASGKGGVGK

SEQ ID NO: 1999661 - protein, 19 aa, Staphylococcus
DPVILEPMMKVTIEMPEEY

SEQ ID NO: 1999662 - protein, 17 aa, Staphylococcus
DPVLAIGGQVKRNDLLR

SEQ ID NO: 1999663 - protein, 24 aa, Staphylococcus
DPVLSRVSVHLANFLEIPFDVYPQ

SEQ ID NO: 1999664 - protein, 19 aa, Staphylococcus
DPYASLNPRLKVMDIVAEG

SEQ ID NO: 1999665 - protein, 17 aa, Staphylococcus
DPYKLELIDAIPEDESV

SEQ ID NO: 1999666 - protein, 17 aa, Staphylococcus
DQAVCIGEANPLDSYLN

SEQ ID NO: 1999667 - protein, 22 aa, Staphylococcus
DQLPTRGAIIYAISPKPKDAPG

SEQ ID NO: 1999668 - protein, 21 aa, Staphylococcus
DQLPTRGAVIYAISPKPKDAP

SEQ ID NO: 1999669 - protein, 23 aa, Staphylococcus
DQSKFPLRQAVYFDTEKDGRMIF

SEQ ID NO: 1999670 - protein, 24 aa, Staphylococcus
DQSVFHLHFHFLPRYKDDIDGFGY

SEQ ID NO: 1999671 - protein, 21 aa, Staphylococcus
DRGEWVISRQRVWGVPLPVFY

SEQ ID NO: 1999672 - protein, 20 aa, Staphylococcus
DRLVKGCTGVKRTTGQHPGG

SEQ ID NO: 1999673 - protein, 24 aa, Staphylococcus
DRPIRPLFPKGYRHDVQIMNTVLS

SEQ ID NO: 1999674 - protein, 18 aa, Staphylococcus
DSIIGNGFSVIYLISQRL

SEQ ID NO: 1999675 - protein, 24 aa, Staphylococcus
DSRLKLTVINELAWHNLFAHNMFI

SEQ ID NO: 1999676 - protein, 24 aa, Staphylococcus
DSYIPYPVEVEVGGATVFVMPIEA

SEQ ID NO: 1999677 - protein, 25 aa, Staphylococcus
DTELEVVEGMQFDRGYQSPYMVTDS

SEQ ID NO: 1999678 - protein, 17 aa, Staphylococcus
DTGELNGALGVEKIFNS

SEQ ID NO: 1999679 - protein, 22 aa, Staphylococcus
DTLAKNVVKGFVNGHYDGGRHQ

SEQ ID NO: 1999680 - protein, 24 aa, Staphylococcus
DTMALPPCHTMFQFYVQDGKLSCQ

SEQ ID NO: 1999681 - protein, 17 aa, Staphylococcus
DTVPIYLKRNPNFKFPK

SEQ ID NO: 1999682 - protein, 17 aa, Staphylococcus
DTVRPALQIIKTKPGVS

SEQ ID NO: 1999683 - protein, 22 aa, Staphylococcus
DTYCGIGTIGLYMAPVAKHVYG

SEQ ID NO: 1999684 - protein, 17 aa, Staphylococcus
DVGNLYLNRGCTAAVVG

SEQ ID NO: 1999685 - protein, 18 aa, Staphylococcus
DVGNLYLNRGCTAAVVGY

SEQ ID NO: 1999686 - protein, 28 aa, Staphylococcus
DVIKEGIPAKARRKGGHPAKRVFQAIRI

SEQ ID NO: 1999687 - protein, 20 aa, Staphylococcus
DVNAALHYLARLIEAGDLPT

SEQ ID NO: 1999688 - protein, 17 aa, Staphylococcus
DVPAGIMTKCPKCKKIM

SEQ ID NO: 1999689 - protein, 22 aa, Staphylococcus
DVPQAGDRFVVFKDEKQARRIG

SEQ ID NO: 1999690 - protein, 17 aa, Staphylococcus
DVPQIIWHGLPLTEAFL

SEQ ID NO: 1999691 - protein, 22 aa, Staphylococcus
DVPTFAICHGPLLLVDTDDLNG

SEQ ID NO: 1999692 - protein, 22 aa, Staphylococcus
DVRAKEGITDGLVRLSIGIEDT

SEQ ID NO: 1999693 - protein, 20 aa, Staphylococcus
DVSGRGGTNFVDIENERRSN

SEQ ID NO: 1999694 - protein, 19 aa, Staphylococcus
DVSIPKERGFLPGNGAITS

SEQ ID NO: 1999695 - protein, 18 aa, Staphylococcus
DVTLELKLLADVGLVGFP

SEQ ID NO: 1999696 - protein, 24 aa, Staphylococcus
DVVKRTCGYLGNPVQRPVIEGRQK

SEQ ID NO: 1999697 - protein, 24 aa, Staphylococcus
DWGKRRLAYEINDFKEGFYNIVRI

SEQ ID NO: 1999698 - protein, 21 aa, Staphylococcus
DYDAIILAAAGLRRMGWSDDI

SEQ ID NO: 1999699 - protein, 20 aa, Staphylococcus
DYLKDLGIDVIWLSPMYKSP

SEQ ID NO: 1999700 - protein, 20 aa, Staphylococcus
DYNLNIPRYVDTFEEEEPID

SEQ ID NO: 1999701 - protein, 27 aa, Staphylococcus
DYQAIYFAGGHGAIWDLRNNKELNDIA

SEQ ID NO: 1999702 - protein, 24 aa, Staphylococcus
DYSEYGGSVLLGLDGTVVKAHGSS

SEQ ID NO: 1999703 - protein, 23 aa, Staphylococcus
EADKYVFVSPMWNLSFPPVLKAY

SEQ ID NO: 1999704 - protein, 20 aa, Staphylococcus
EAELTYALKSMLNKYEAHRE

SEQ ID NO: 1999705 - protein, 18 aa, Staphylococcus
EAKTIFLEQNYRSTKNIL

SEQ ID NO: 1999706 - protein, 25 aa, Staphylococcus
EALELAEQMGIIFIDEIDKVATNNQ

SEQ ID NO: 1999707 - protein, 18 aa, Staphylococcus
EALKADGIDATYIDVAKQ

SEQ ID NO: 1999708 - protein, 22 aa, Staphylococcus
EALKEKGLLCKETHDTVIRFAP

SEQ ID NO: 1999709 - protein, 30 aa, Staphylococcus; identical to SEQ ID NO: 1646913

SEQ ID NO: 1999710 - protein, 25 aa, Staphylococcus
EAPAEAYNPLFIYGGVGLGKTHLMH

SEQ ID NO: 1999711 - protein, 24 aa, Staphylococcus
EDDAKKGFLLDGFPRTIEQAEALN

SEQ ID NO: 1999712 - protein, 17 aa, Staphylococcus
EDEIKRDISCNLGSLNI

SEQ ID NO: 1999713 - protein, 18 aa, Staphylococcus
EDFHVLKKLNKVLEKRRE

SEQ ID NO: 1999714 - protein, 27 aa, Staphylococcus
EDFVVEGPLWIQVHAFEKGVEVTISKS

SEQ ID NO: 1999715 - protein, 18 aa, Staphylococcus
EDIDEWIGLLDQLEEKVK

SEQ ID NO: 1999716 - protein, 27 aa, Staphylococcus
EDLIEEVARIYGYDEIPSTLPVFEDVT

SEQ ID NO: 1999717 - protein, 18 aa, Staphylococcus
EDMEIEILHVLKRFKAML

SEQ ID NO: 1999718 - protein, 17 aa, Staphylococcus
EDMKLPKSYIFEIASNW

SEQ ID NO: 1999719 - protein, 24 aa, Staphylococcus
EDYGVYRFKRGFNVYIEELIGDFY

SEQ ID NO: 1999720 - protein, 21 aa, Staphylococcus
EEAKGADLLLHVVDASHPEYR

SEQ ID NO: 1999721 - protein, 22 aa, Staphylococcus
EEGKKSVAIRLNYLDTENTLTD

SEQ ID NO: 1999722 - protein, 18 aa, Staphylococcus
EEKLRYFLIEDYNQKEHS

SEQ ID NO: 1999723 - protein, 22 aa, Staphylococcus
EELGAKGIRVNCVAPGPFWSPL

SEQ ID NO: 1999724 - protein, 17 aa, Staphylococcus
EEMRLIYVALTRAKEQL

SEQ ID NO: 1999725 - protein, 18 aa, Staphylococcus
EEREAVGIQDLPSTLYTA

SEQ ID NO: 1999726 - protein, 25 aa, Staphylococcus
EETIKEAAMLAGYFSKAGNSGQIPV

SEQ ID NO: 1999727 - protein, 22 aa, Staphylococcus
EETKAVVMIGEIGGTAEEEAAE

SEQ ID NO: 1999728 - protein, 17 aa, Staphylococcus
EEVDGYNAIQVGFEDKQ

SEQ ID NO: 1999729 - protein, 18 aa, Staphylococcus
EEVLKAELKKGLDALNDD

SEQ ID NO: 1999730 - protein, 24 aa, Staphylococcus
EEVLYPAMEDFFLDIIIGKGDEAR

SEQ ID NO: 1999731 - protein, 19 aa, Staphylococcus
EEVYEIFQTTMLKRANEHE

SEQ ID NO: 1999732 - protein, 27 aa, Staphylococcus
EEYPQLTIRVSGYAVNFIKLTREQQLD

SEQ ID NO: 1999733 - protein, 26 aa, Staphylococcus
EFACGIPGSIGGAVFMNAGAYGGEVK

SEQ ID NO: 1999734 - protein, 25 aa, Staphylococcus
EFETRAATLLRYFTGLCESSYKLPF

SEQ ID NO: 1999735 - protein, 25 aa, Staphylococcus
EFICPNNKRLGFKRYAYRHDKYGYK

SEQ ID NO: 1999736 - protein, 21 aa, Staphylococcus
EFLGDAVLELTVSRYLFDKYP

SEQ ID NO: 1999737 - protein, 26 aa, Staphylococcus
EGELDRYPLAKFKRSNSGTCYNQRPI

SEQ ID NO: 1999738 - protein, 21 aa, Staphylococcus
EGFELPYMQLVVITERELFKT

SEQ ID NO: 1999739 - protein, 20 aa, Staphylococcus
EGKTPILGLDVWEHAYYLKY

SEQ ID NO: 1999740 - protein, 26 aa, Staphylococcus
EGKVARLTNFGAFVDIGGVDGLVHVS

SEQ ID NO: 1999741 - protein, 24 aa, Staphylococcus
EGPKVIEFNARFGDPEAQVLLTRL

SEQ ID NO: 1999742 - protein, 19 aa, Staphylococcus
EGSLRCDANISLRPYGQEE

SEQ ID NO: 1999743 - protein, 20 aa, Staphylococcus
EGSLRCDANISLRPYGQEEF

SEQ ID NO: 1999744 - protein, 21 aa, Staphylococcus
EHDACGIGFYANMDNKRSHDI

SEQ ID NO: 1999745 - protein, 27 aa, Staphylococcus
EHGNELPISAGFFFINPFEVVYYAGGT

SEQ ID NO: 1999746 - protein, 18 aa, Staphylococcus
EHIDGVKVLADMKIMDAA

SEQ ID NO: 1999747 - protein, 23 aa, Staphylococcus
EHNLSIMCEADWIIDVGPGPGLD

SEQ ID NO: 1999748 - protein, 24 aa, Staphylococcus
EIESKRGGGGYIRITKIENKDETG

SEQ ID NO: 1999749 - protein, 24 aa, Staphylococcus
EIGCPTMNSGLFAQMLHSGNIEGM

SEQ ID NO: 1999750 - protein, 20 aa, Staphylococcus
EIGGAVAKRARAFDMDVLYT

SEQ ID NO: 1999751 - protein, 18 aa, Staphylococcus
EILNRMDDIVLFKPLSIN

SEQ ID NO: 1999752 - protein, 18 aa, Staphylococcus
EILNRMDDIVLFKPLSVS

SEQ ID NO: 1999753 - protein, 18 aa, Staphylococcus
EIPCVMRNAIGSGNALIS

SEQ ID NO: 1999754 - protein, 21 aa, Staphylococcus
EIPRLNVLDLQRLIRVIPKPV

SEQ ID NO: 1999755 - protein, 17 aa, Staphylococcus
EISKRFSSIQDYILEYC

SEQ ID NO: 1999756 - protein, 29 aa, Staphylococcus
EIVEKSLRGAAIWDELKDRLHMNAYGLSG

SEQ ID NO: 1999757 - protein, 17 aa, Staphylococcus
EIVKWFVKAGDTIEEDD

SEQ ID NO: 1999758 - protein, 22 aa, Staphylococcus
EKAMKVLKARLYDMKLQEEQQK

SEQ ID NO: 1999759 - protein, 19 aa, Staphylococcus
EKELKRLGINATIRREQGS

SEQ ID NO: 1999760 - protein, 23 aa, Staphylococcus
EKGPDVPRGLPIIPEAYTPKLKR

SEQ ID NO: 1999761 - protein, 24 aa, Staphylococcus
EKGPEVPRGLPIIPEEYTPKLKRV

SEQ ID NO: 1999762 - protein, 23 aa, Staphylococcus
EKIPKGLALDYVYGYTIINDITD

SEQ ID NO: 1999763 - protein, 23 aa, Staphylococcus
EKKEIFLYLMYVYKQIVKNDIEY

SEQ ID NO: 1999764 - protein, 23 aa, Staphylococcus
EKKHKGRMSLFYYAELTYQPTHS

SEQ ID NO: 1999765 - protein, 17 aa, Staphylococcus
EKKIPREVLIDAIEAAL

SEQ ID NO: 1999766 - protein, 20 aa, Staphylococcus
EKKPACTVITMYPHLDGVLS

SEQ ID NO: 1999767 - protein, 17 aa, Staphylococcus
EKLIRHAYLDVFENEPL

SEQ ID NO: 1999768 - protein, 24 aa, Staphylococcus
EKLYKQLLRDGVDFMTMGNHTYGQ

SEQ ID NO: 1999769 - protein, 17 aa, Staphylococcus
EKQKLRYLYGMTERQFR

SEQ ID NO: 1999770 - protein, 19 aa, Staphylococcus
EKSDFIKRVIKSEEERFHE

SEQ ID NO: 1999771 - protein, 21 aa, Staphylococcus
EKTYYSYRMDNLIVSYLIQAH

SEQ ID NO: 1999772 - protein, 17 aa, Staphylococcus
EKVRCMLSKMMLSSANV

SEQ ID NO: 1999773 - protein, 24 aa, Staphylococcus
EKYIPYCIEPSLGADRVTLAFLCD

SEQ ID NO: 1999774 - protein, 21 aa, Staphylococcus
ELADSLIRRTMEPTRQALKDA

SEQ ID NO: 1999775 - protein, 26 aa, Staphylococcus
ELDAALWGARAAYIGGFNSTSNVRAG

SEQ ID NO: 1999776 - protein, 21 aa, Staphylococcus
ELDEHFPLVVWQTGSGTQSNM

SEQ ID NO: 1999777 - protein, 27 aa, Staphylococcus
ELDLFTCLRPVRWFKGVPSPVKRPQDV

SEQ ID NO: 1999778 - protein, 26 aa, Staphylococcus
ELDLFTCLRPVRWFQGVPSPVKRPED

SEQ ID NO: 1999779 - protein, 31 aa, Staphylococcus
ELDLSALVAGAKFRGEFEERLKAVLKEVKES

SEQ ID NO: 1999780 - protein, 17 aa, Staphylococcus
ELDSLWQLRNMFTDSTD

SEQ ID NO: 1999781 - protein, 27 aa, Staphylococcus
ELESIIGNGFSVIYLISQRLVKKSLND

SEQ ID NO: 1999782 - protein, 22 aa, Staphylococcus
ELFELDCDILVPAAISNQITED

SEQ ID NO: 1999783 - protein, 24 aa, Staphylococcus
ELFKRTLPDVLIKLERAGYETSAY

SEQ ID NO: 1999784 - protein, 18 aa, Staphylococcus
ELGDNLFVLLCIANSLDI

SEQ ID NO: 1999785 - protein, 20 aa, Staphylococcus
ELIELFKSYDQILFSVGSGG

SEQ ID NO: 1999786 - protein, 19 aa, Staphylococcus
ELIGATKLIHCVNGETHIV

SEQ ID NO: 1999787 - protein, 20 aa, Staphylococcus
ELKAYSYNREGVMNASVEFD

SEQ ID NO: 1999788 - protein, 25 aa, Staphylococcus
ELKNRRATLVNLQRIDKVSAKRIID

SEQ ID NO: 1999789 - protein, 20 aa, Staphylococcus
ELMERMVWTRILDQRSISLN

SEQ ID NO: 1999790 - protein, 29 aa, Staphylococcus
ELMNRLTGRRICEKCGTTYHLVFNPPKVD

SEQ ID NO: 1999791 - protein, 22 aa, Staphylococcus
ELNLKGGQKMYFDQKIETYVPV

SEQ ID NO: 1999792 - protein, 26 aa, Staphylococcus
ELRELQKRLGITFIFVTHDQEEALAL

SEQ ID NO: 1999793 - protein, 25 aa, Staphylococcus
ELRELQSRLGITFIFVTHDQEEALA

SEQ ID NO: 1999794 - protein, 25 aa, Staphylococcus
ELSPTPKWQISRYKGLGEMNADQLW

SEQ ID NO: 1999795 - protein, 17 aa, Staphylococcus
EMKCFKYTNDLGTEIDE

SEQ ID NO: 1999796 - protein, 19 aa, Staphylococcus
EMRELSYAGFGVFHDEALQ

SEQ ID NO: 1999797 - protein, 25 aa, Staphylococcus
ENERYLEVWNLVFSEFNHNKDHTYT

SEQ ID NO: 1999798 - protein, 37 aa, Staphylococcus
ENEWNLKLGDLAMIWREGCIIRAQFLQKIKDAYDNNS

SEQ ID NO: 1999799 - protein, 32 aa, Staphylococcus
ENGDLLFGTIDSWLVWKLSGKAAHITDYTNAS

SEQ ID NO: 1999800 - protein, 22 aa, Staphylococcus
ENIVLVPKLLKWSKEKKDAKAK

SEQ ID NO: 1999801 - protein, 30 aa, Staphylococcus
ENNYRIRWSTAMSNEIPWYVHEVPTVFTSL

SEQ ID NO: 1999802 - protein, 23 aa, Staphylococcus
ENQEGRRIFVTEVVADSVQFLEP

SEQ ID NO: 1999803 - protein, 22 aa, Staphylococcus
ENRGRIRISYSIHDRPQIINDR

SEQ ID NO: 1999804 - protein, 32 aa, Staphylococcus; identical to SEQ ID NO: 1804399

SEQ ID NO: 1999805 - protein, 22 aa, Staphylococcus
ENRVKYNSALEKLRNQDDTTMM

SEQ ID NO: 1999806 - protein, 22 aa, Staphylococcus
EPEGIAAKVLESFNITEDKVIE

SEQ ID NO: 1999807 - protein, 23 aa, Staphylococcus
EPEGIAAKVLESFNITEDKVIEE

SEQ ID NO: 1999808 - protein, 25 aa, Staphylococcus
EPEILKPRLIPLLQMSNKEFKNTYG

SEQ ID NO: 1999809 - protein, 25 aa, Staphylococcus
EPEVLPSRFPNLLVNGASGIAVGMA

SEQ ID NO: 1999810 - protein, 21 aa, Staphylococcus
EPKDVIIVEGIFALENKTLRD

SEQ ID NO: 1999811 - protein, 22 aa, Staphylococcus
EPKDVIIVEGIFALENKTLRDM

SEQ ID NO: 1999812 - protein, 25 aa, Staphylococcus
EPMVLPARFPNLLVNGSTGISAGYA

SEQ ID NO: 1999813 - protein, 18 aa, Staphylococcus
EPPYTRLIDSARRQPEET

SEQ ID NO: 1999814 - protein, 18 aa, Staphylococcus
EPSMAFKTMEFVRKGRGL

SEQ ID NO: 1999815 - protein, 21 aa, Staphylococcus
EPTTYLDICHQLEILELVQKL

SEQ ID NO: 1999816 - protein, 20 aa, Staphylococcus
EQAAREWLRTTGYKNIDDLN

SEQ ID NO: 1999817 - protein, 24 aa, Staphylococcus
EQLEEIDGLILPGGESTTLRRLMN

SEQ ID NO: 1999818 - protein, 30 aa, Staphylococcus; identical to SEQ ID NO: 1801017

SEQ ID NO: 1999819 - protein, 21 aa, Staphylococcus
EQLYYLMSRGISQKEAERLVI

SEQ ID NO: 1999820 - protein, 22 aa, Staphylococcus
ERAAKVSGARFVYLTKDGALLE

SEQ ID NO: 1999821 - protein, 23 aa, Staphylococcus
EREDGSDVFVHFSAIAEEGYKSL

SEQ ID NO: 1999822 - protein, 21 aa, Staphylococcus
EREIRLRPSYFPFTEPSVEVD

SEQ ID NO: 1999823 - protein, 17 aa, Staphylococcus
ERGFLPGNGAITSVVSV

SEQ ID NO: 1999824 - protein, 25 aa, Staphylococcus
ERSGLTLFLPHSFEGQGPEHSSARL

SEQ ID NO: 1999825 - protein, 18 aa, Staphylococcus
ERSLLFGPFAGFSPKFLK

SEQ ID NO: 1999826 - protein, 25 aa, Staphylococcus
ERTIKRYYICSLFNRSGSSACHSNA

SEQ ID NO: 1999827 - protein, 20 aa, Staphylococcus
ESAPKIFRKVTDLVKEQVKY

SEQ ID NO: 1999828 - protein, 25 aa, Staphylococcus
ESDLKEGADMMIVKPALSYLDIVRD

SEQ ID NO: 1999829 - protein, 20 aa, Staphylococcus
ESDLKEGCDMMIVKPALSYL

SEQ ID NO: 1999830 - protein, 26 aa, Staphylococcus
ESDLPFELVGAVPVLIKKNGRVDKQI

SEQ ID NO: 1999831 - protein, 20 aa, Staphylococcus
ESGCGKSTTGKAIIKLNDIT

SEQ ID NO: 1999832 - protein, 23 aa, Staphylococcus
ESHKRFGGVVPEVASRHHVEGIT

SEQ ID NO: 1999833 - protein, 19 aa, Staphylococcus
ESINTNHIILRFTNDDRDI

SEQ ID NO: 1999834 - protein, 23 aa, Staphylococcus
ESITPYEGGIAFAAKPLIEEDFI

SEQ ID NO: 1999835 - protein, 25 aa, Staphylococcus
ESLGARKGEMLDMMTTDNGLTRLIF

SEQ ID NO: 1999836 - protein, 20 aa, Staphylococcus
ESLLRALKDNGLEEIESEGQ

SEQ ID NO: 1999837 - protein, 26 aa, Staphylococcus
ESLQFSVALSTVWKFISRTNKYIDET

SEQ ID NO: 1999838 - protein, 36 aa, Staphylococcus; identical to SEQ ID NO: 1804560

SEQ ID NO: 1999839 - protein, 22 aa, Staphylococcus
ESQDWASMLLRMYQRYGEQQGF

SEQ ID NO: 1999840 - protein, 18 aa, Staphylococcus
ESVFARFISSIKQERVNA

SEQ ID NO: 1999841 - protein, 18 aa, Staphylococcus
ETAFPLLYTHFVKNGDWS

SEQ ID NO: 1999842 - protein, 24 aa, Staphylococcus
ETIGCPIGNYIPEWNDLVYHQDFK

SEQ ID NO: 1999843 - protein, 25 aa, Staphylococcus
ETIKKLKQLILRWKQAGKTVIIAEH

SEQ ID NO: 1999844 - protein, 22 aa, Staphylococcus
ETKGAFPTWLAPKQVEIIPVNV

SEQ ID NO: 1999845 - protein, 18 aa, Staphylococcus
ETKRIGITRLHMEEDAGK

SEQ ID NO: 1999846 - protein, 19 aa, Staphylococcus
ETPYVCGTSKSFGSAGNPS

SEQ ID NO: 1999847 - protein, 22 aa, Staphylococcus
ETRPLSATKRFRLVEIVEESVI

SEQ ID NO: 1999848 - protein, 18 aa, Staphylococcus
ETSYFKKTVNPFDHTAVP

SEQ ID NO: 1999849 - protein, 25 aa, Staphylococcus
EVAEACLRLGATMINDQWAGLYDPH

SEQ ID NO: 1999850 - protein, 23 aa, Staphylococcus
EVAEHPEELVVYGGIGKAARNWK

SEQ ID NO: 1999851 - protein, 35 aa, Staphylococcus; identical to SEQ ID NO: 1799161

SEQ ID NO: 1999852 - protein, 35 aa, Staphylococcus; identical to SEQ ID NO: 1646176

SEQ ID NO: 1999853 - protein, 35 aa, Staphylococcus; identical to SEQ ID NO: 1794804

SEQ ID NO: 1999854 - protein, 21 aa, Staphylococcus
EVFQGEALLFLLGLTNSMAGF

SEQ ID NO: 1999855 - protein, 26 aa, Staphylococcus
EVIAACLLTAVPVMKFFKYFYSNRGP

SEQ ID NO: 1999856 - protein, 25 aa, Staphylococcus
EVLDPSLPIDLIIDYAHTADGMNKL

SEQ ID NO: 1999857 - protein, 22 aa, Staphylococcus
EVNPRASRTVPFLSKITDIQMA

SEQ ID NO: 1999858 - protein, 33 aa, Staphylococcus
EVRPERRTTLGLRWLVNYSRLRGEKTMEERLAN

SEQ ID NO: 1999859 - protein, 18 aa, Staphylococcus
EVSDGLMVARGDMGVEIP

SEQ ID NO: 1999860 - protein, 20 aa, Staphylococcus
EVSDPKELIARHSLKVDAGV

SEQ ID NO: 1999861 - protein, 25 aa, Staphylococcus
EYEFKSEPKHLILKTHAYVGYSVDA

SEQ ID NO: 1999862 - protein, 18 aa, Staphylococcus
EYLGMIRGQVLHTFSTMK

SEQ ID NO: 1999863 - protein, 24 aa, Staphylococcus
FAAGDARRGQSLVVWAIKEGRAVA

SEQ ID NO: 1999864 - protein, 18 aa, Staphylococcus
FAALAFKVMTDPYVGKLT

SEQ ID NO: 1999865 - protein, 20 aa, Staphylococcus
FACGIPGSVGGAVYMNAGAY

SEQ ID NO: 1999866 - protein, 18 aa, Staphylococcus
FANIFFMMMNYYSIERSM

SEQ ID NO: 1999867 - protein, 18 aa, Staphylococcus
FARIDWEVLQKISSRIVN

SEQ ID NO: 1999868 - protein, 19 aa, Staphylococcus
FASRIHKYIGSYATRMHGV

SEQ ID NO: 1999869 - protein, 17 aa, Staphylococcus
FDFEPKAHWDLVEELKM

SEQ ID NO: 1999870 - protein, 20 aa, Staphylococcus
FDISKARYHKIVIMTDADVD

SEQ ID NO: 1999871 - protein, 18 aa, Staphylococcus
FDMDVLYTGPHRKEEKER

SEQ ID NO: 1999872 - protein, 19 aa, Staphylococcus
FDNAFLLRTFSKAYGLAGL

SEQ ID NO: 1999873 - protein, 18 aa, Staphylococcus
FDNLKRMKAWIPIDGTYD

SEQ ID NO: 1999874 - protein, 17 aa, Staphylococcus
FDRVLGLELGADDYMTK

SEQ ID NO: 1999875 - protein, 25 aa, Staphylococcus
FDVDVPRTDWDWMIYPKGLYDQIMR

SEQ ID NO: 1999876 - protein, 17 aa, Staphylococcus
FEERLKAVLKEVKESDG

SEQ ID NO: 1999877 - protein, 19 aa, Staphylococcus
FEFKIHGKGAHAAKPEQGN

SEQ ID NO: 1999878 - protein, 19 aa, Staphylococcus
FEHNALNLGIRSENIQFST

SEQ ID NO: 1999879 - protein, 26 aa, Staphylococcus
FEIITTMMFLYFGEIHPVDFVIIEAG

SEQ ID NO: 1999880 - protein, 26 aa, Staphylococcus
FEIITTMMFLYFGEIHPVDFVIVEAG

SEQ ID NO: 1999881 - protein, 17 aa, Staphylococcus
FEKTMARGYRREEVDAF

SEQ ID NO: 1999882 - protein, 29 aa, Staphylococcus
FEMPYEEAKSWMLKALEPMGEEYLNVVKE

SEQ ID NO: 1999883 - protein, 31 aa, Staphylococcus
FEPESSQALGFGFRTGFLGMLHMEIIQERIE

SEQ ID NO: 1999884 - protein, 17 aa, Staphylococcus
FEPRMFIGAISNLKNEL

SEQ ID NO: 1999885 - protein, 24 aa, Staphylococcus
FEQTEVRLVLSFLRTIDNPLQDIY

SEQ ID NO: 1999886 - protein, 25 aa, Staphylococcus
FEQTEVRLVLSFLRTVDNPLQDIYL

SEQ ID NO: 1999887 - protein, 21 aa, Staphylococcus
FETASPLYYRAEPVGCTATIL

SEQ ID NO: 1999888 - protein, 17 aa, Staphylococcus
FFAGFSGGPKGIMPGIA

SEQ ID NO: 1999889 - protein, 27 aa, Staphylococcus
FFFEEGKRAVLLLHGFTGNSSDVRQLG

SEQ ID NO: 1999890 - protein, 18 aa, Staphylococcus
FFGSALANFGVQNFLNAY

SEQ ID NO: 1999891 - protein, 30 aa, Staphylococcus
FGFATAPLVVLGCIMMRVCHNDTCPVGIAT

SEQ ID NO: 1999892 - protein, 17 aa, Staphylococcus
FGGVVPEVASRHHVEGI

SEQ ID NO: 1999893 - protein, 27 aa, Staphylococcus
FGHQLRFDLSKGFPLLTTKKVSFKLVA

SEQ ID NO: 1999894 - protein, 19 aa, Staphylococcus
FGHSAHSYFSRQNQPSNLS

SEQ ID NO: 1999895 - protein, 17 aa, Staphylococcus
FGVPGDFNLAFLDDIIS

SEQ ID NO: 1999896 - protein, 25 aa, Staphylococcus
FHSEYWFNVICMFREDGIYYYCNLS

SEQ ID NO: 1999897 - protein, 25 aa, Staphylococcus
FHSEYWFNVICMFREDGVYYYCNLS

SEQ ID NO: 1999898 - protein, 18 aa, Staphylococcus
FHTKDIPGSHVVILNDAP

SEQ ID NO: 1999899 - protein, 24 aa, Staphylococcus
FHWYVKGPNFFSLHEKFEELYNEA

SEQ ID NO: 1999900 - protein, 22 aa, Staphylococcus
FHWYVKGPNFFSLHTKFEELYD

SEQ ID NO: 1999901 - protein, 17 aa, Staphylococcus
FIECSGIAEPLAVVDAC

SEQ ID NO: 1999902 - protein, 18 aa, Staphylococcus
FIEMNARIQVEHTVTEMR

SEQ ID NO: 1999903 - protein, 19 aa, Staphylococcus
FIERGIIEIAPLAYMRGRT

SEQ ID NO: 1999904 - protein, 32 aa, Staphylococcus
FIKSELGSRMRLRIVPELFFEYDESIEYGNKI

SEQ ID NO: 1999905 - protein, 23 aa, Staphylococcus
FINRDLFKYIPFDGSIITISELQ

SEQ ID NO: 1999906 - protein, 21 aa, Staphylococcus
FKDKHVITISLEIVNERYLKD

SEQ ID NO: 1999907 - protein, 21 aa, Staphylococcus
FKEASEQLAQWVSEGKIKFEV

SEQ ID NO: 1999908 - protein, 26 aa, Staphylococcus
FKEFFPENRVEYFVSYYDYYQPEAYV

SEQ ID NO: 1999909 - protein, 24 aa, Staphylococcus
FKGTELKHFIPREHIEGRDIQDIC

SEQ ID NO: 1999910 - protein, 18 aa, Staphylococcus
FKIYENDYVYAFLDISQV

SEQ ID NO: 1999911 - protein, 18 aa, Staphylococcus
FKKFKEIADEVGAKLMVD

SEQ ID NO: 1999912 - protein, 22 aa, Staphylococcus
FKLIATELLWFIKGDTNIKYLL

SEQ ID NO: 1999913 - protein, 25 aa, Staphylococcus
FKNPSRILGSFFIKHHGYRVRIDDI

SEQ ID NO: 1999914 - protein, 18 aa, Staphylococcus
FKSLQKGVQMVHESLLRA

SEQ ID NO: 1999915 - protein, 19 aa, Staphylococcus
FKTDNRGLFAYSLESMSQF

SEQ ID NO: 1999916 - protein, 17 aa, Staphylococcus
FKTKEEFEALIQEDQFI

SEQ ID NO: 1999917 - protein, 17 aa, Staphylococcus
FLIEERGVKSIGHETFD

SEQ ID NO: 1999918 - protein, 20 aa, Staphylococcus
FLQLRDGSGFMQGVVVKSEV

SEQ ID NO: 1999919 - protein, 17 aa, Staphylococcus
FLSGTVYAIGGDIQRVG

SEQ ID NO: 1999920 - protein, 19 aa, Staphylococcus
FLTAKARYARSIKGTKPTF

SEQ ID NO: 1999921 - protein, 24 aa, Staphylococcus
FMNKYPGIILFTSHDTRFVKHVSD

SEQ ID NO: 1999922 - protein, 17 aa, Staphylococcus
FNADFAYTMDGSEFGEL

SEQ ID NO: 1999923 - protein, 18 aa, Staphylococcus
FNDFEMHFYRYVFPYYDT

SEQ ID NO: 1999924 - protein, 17 aa, Staphylococcus
FNGLYIITPFQKVDYSL

SEQ ID NO: 1999925 - protein, 28 aa, Staphylococcus
FNGVLCGRATWSGAVKVYIEQGEQAARE

SEQ ID NO: 1999926 - protein, 19 aa, Staphylococcus
FNSEKGFGFIEREDGSDVF

SEQ ID NO: 1999927 - protein, 18 aa, Staphylococcus
FNTNYHYIVPEWDNAEPK

SEQ ID NO: 1999928 - protein, 21 aa, Staphylococcus
FNYPVQLVFEPLIGAIAAGNT

SEQ ID NO: 1999929 - protein, 27 aa, Staphylococcus
FPENRARLVIYPAAMRYAGPREAILHA

SEQ ID NO: 1999930 - protein, 20 aa, Staphylococcus
FPGIGKKTARQIVLDLKGKV

SEQ ID NO: 1999931 - protein, 20 aa, Staphylococcus
FPIVELDASYYAIQPERNIM

SEQ ID NO: 1999932 - protein, 20 aa, Staphylococcus
FPLLYTHFVKNGDWSLQQLV

SEQ ID NO: 1999933 - protein, 21 aa, Staphylococcus
FPYSSRIGTPAARMDNQIDED

SEQ ID NO: 1999934 - protein, 19 aa, Staphylococcus
FQDALGLNSADSFRDLIKV

SEQ ID NO: 1999935 - protein, 22 aa, Staphylococcus
FRLENELKVFPSHFSKGMKQKV

SEQ ID NO: 1999936 - protein, 17 aa, Staphylococcus
FRLPSAMDNRPLKFEEF

SEQ ID NO: 1999937 - protein, 17 aa, Staphylococcus
FSALDPISREKLQDDLI

SEQ ID NO: 1999938 - protein, 30 aa, Staphylococcus
FSAVKISGTFKKMHVRMMPKQEPPYTRLID

SEQ ID NO: 1999939 - protein, 17 aa, Staphylococcus
FSGHKMLGPTGIGVLYG

SEQ ID NO: 1999940 - protein, 17 aa, Staphylococcus
FSYKRYLENQIRHAFGF

SEQ ID NO: 1999941 - protein, 21 aa, Staphylococcus
FTGDIKTPVKYASRELKMLFS

SEQ ID NO: 1999942 - protein, 17 aa, Staphylococcus
FTGKRPFNDVLLHGLVR

SEQ ID NO: 1999943 - protein, 26 aa, Staphylococcus
FTGRVCPAPCEQSCVMKINRESVAIK

SEQ ID NO: 1999944 - protein, 24 aa, Staphylococcus
FTKVKGRLIVSCYASNFIRIQQVL

SEQ ID NO: 1999945 - protein, 17 aa, Staphylococcus
FTPIPAMSMISYAAGAR

SEQ ID NO: 1999946 - protein, 23 aa, Staphylococcus
FTSDKILGAILFEQTMDREVEGK

SEQ ID NO: 1999947 - protein, 18 aa, Staphylococcus
FTTFEHIEVSPLIVVKKD

SEQ ID NO: 1999948 - protein, 24 aa, Staphylococcus
FTTYWPTDEVMPIYDAAMKYKEDG

SEQ ID NO: 1999949 - protein, 18 aa, Staphylococcus
FTVMYLLIAKMFEDEDVD

SEQ ID NO: 1999950 - protein, 17 aa, Staphylococcus
FTYPLIGNYGINRDDFE

SEQ ID NO: 1999951 - protein, 27 aa, Staphylococcus
FVAGKGRSGFVANSFAMRLNQLGKQAF

SEQ ID NO: 1999952 - protein, 20 aa, Staphylococcus
FVGEHSRYDLMLVQTDRHYG

SEQ ID NO: 1999953 - protein, 18 aa, Staphylococcus
FVRRVCNCTGEWTMENFI

SEQ ID NO: 1999954 - protein, 17 aa, Staphylococcus
FYISLGGPVTFKNAKQP

SEQ ID NO: 1999955 - protein, 18 aa, Staphylococcus
FYQPKPGTDLVWLGAVTK

SEQ ID NO: 1999956 - protein, 17 aa, Staphylococcus
FYTNDVRFLDQFKAVED

SEQ ID NO: 1999957 - protein, 17 aa, Staphylococcus
GAAEFLKVLAKYIENPY

SEQ ID NO: 1999958 - protein, 19 aa, Staphylococcus
GACPTCDGLGQRLTVDLDL

SEQ ID NO: 1999959 - protein, 32 aa, Staphylococcus
GAESFKEALRWGAEIFHNLKSILSERGLETAV

SEQ ID NO: 1999960 - protein, 18 aa, Staphylococcus
GAKLMVDMAHIAGLVAAG

SEQ ID NO: 1999961 - protein, 29 aa, Staphylococcus
GARCMDCGTPFCQTGLPFGRETIGCPIGN

SEQ ID NO: 1999962 - protein, 17 aa, Staphylococcus
GATIGIIGGGQLGKMMA

SEQ ID NO: 1999963 - protein, 26 aa, Staphylococcus
GCAGGIARPAASHALHYDKLPDRLVT

SEQ ID NO: 1999964 - protein, 30 aa, Staphylococcus
GCGKTTLLRLFNGLIPYFFNGKLTGEIIIN

SEQ ID NO: 1999965 - protein, 25 aa, Staphylococcus
GCHRTSPHLQDWAREGVLLLNTVLT

SEQ ID NO: 1999966 - protein, 25 aa, Staphylococcus
GCPNGCARPALAEIAFIGKAPGKYN

SEQ ID NO: 1999967 - protein, 30 aa, Staphylococcus
GDAEGRYGTFAKYFTKNDVPAFAICHGPQI

SEQ ID NO: 1999968 - protein, 27 aa, Staphylococcus
GDAEGRYGTFAKYFTKNDVPTFAICHG

SEQ ID NO: 1999969 - protein, 26 aa, Staphylococcus
GDELLRKADLVVAIGYDPIEYEASNW

SEQ ID NO: 1999970 - protein, 18 aa, Staphylococcus
GDGSYRGAQRISEECKEI

SEQ ID NO: 1999971 - protein, 18 aa, Staphylococcus
GDGSYRGAQRISEECPEI

SEQ ID NO: 1999972 - protein, 17 aa, Staphylococcus
GDLPTIVRRLLVISYED

SEQ ID NO: 1999973 - protein, 19 aa, Staphylococcus
GDLTPVFFGSALANFGVQN

SEQ ID NO: 1999974 - protein, 18 aa, Staphylococcus
GDPVLAIGGQVKRNDLLR

SEQ ID NO: 1999975 - protein, 18 aa, Staphylococcus
GDPVLALGGQVKRNDLLR

SEQ ID NO: 1999976 - protein, 17 aa, Staphylococcus
GDVALFFGLSGTGKTTL

SEQ ID NO: 1999977 - protein, 20 aa, Staphylococcus
GDVVFRKGDKVLQLVNRPND

SEQ ID NO: 1999978 - protein, 17 aa, Staphylococcus
GDYKNILVVGADKLSKI

SEQ ID NO: 1999979 - protein, 22 aa, Staphylococcus
GDYPKWKMYIQVMTEEQAKNHP

SEQ ID NO: 1999980 - protein, 19 aa, Staphylococcus
GEELIKEIAPMTYFIHDEY

SEQ ID NO: 1999981 - protein, 17 aa, Staphylococcus
GEGPTLIECDTYRKYGH

SEQ ID NO: 1999982 - protein, 25 aa, Staphylococcus
GEHLDLLSKIAITFSEEENVDRIVN

SEQ ID NO: 1999983 - protein, 25 aa, Staphylococcus
GEIAVRIIRACREMGIETVAIYAKG

SEQ ID NO: 1999984 - protein, 24 aa, Staphylococcus
GEKAKYKLANVISNYSPILLLDEP

SEQ ID NO: 1999985 - protein, 22 aa, Staphylococcus
GELDEHFPLVVWQTGSGTQSNM

SEQ ID NO: 1999986 - protein, 25 aa, Staphylococcus
GELDRYPLAKFKRSNTGTCYNQRPI

SEQ ID NO: 1999987 - protein, 17 aa, Staphylococcus
GELGIVIGKSGEKIPKG

SEQ ID NO: 1999988 - protein, 26 aa, Staphylococcus
GENERYLEVWNLVFSEFNHNKDNTYT

SEQ ID NO: 1999989 - protein, 18 aa, Staphylococcus
GENLKIIANYGAGFNNVD

SEQ ID NO: 1999990 - protein, 18 aa, Staphylococcus
GEPIPVIHWEDGTMTTVP

SEQ ID NO: 1999991 - protein, 26 aa, Staphylococcus
GERVIVYWHHYLRPEVKFDGIDPLVE

SEQ ID NO: 1999992 - protein, 17 aa, Staphylococcus
GEVICFTGASGCGKTTL

SEQ ID NO: 1999993 - protein, 24 aa, Staphylococcus
GEVIKAAPGFNVIAAINEGYVGTL

SEQ ID NO: 1999994 - protein, 17 aa, Staphylococcus
GEYSDCKDADLVVITAG

SEQ ID NO: 1999995 - protein, 19 aa, Staphylococcus
GFELPYMQLVVITERELFK

SEQ ID NO: 1999996 - protein, 21 aa, Staphylococcus
GFQTHLKWGAQKEVIQLIPGL

SEQ ID NO: 1999997 - protein, 23 aa, Staphylococcus
GGEQKRLYLLRLLVHKPNVLLLD

SEQ ID NO: 1999998 - protein, 24 aa, Staphylococcus
GGERTKLSLAVLFSTKANMLILDE

SEQ ID NO: 1999999 - protein, 18 aa, Staphylococcus
GGGLPIGGYGGRQDIMEH

SEQ ID NO: 2000000 - protein, 17 aa, Staphylococcus
GGLRYLKQAQIKVVAET

SEQ ID NO: 2000001 - protein, 19 aa, Staphylococcus
GGNIVPHIHLPVQSGNNAV

SEQ ID NO: 2000002 - protein, 26 aa, Staphylococcus
GGNMGVSGSVAYMFDHTATFGIEGKS

SEQ ID NO: 2000003 - protein, 25 aa, Staphylococcus
GGQQQRVCIARCLAIEPDVILMDEP

SEQ ID NO: 2000004 - protein, 18 aa, Staphylococcus
GGVGEIAKNMYIVEVDDE

SEQ ID NO: 2000005 - protein, 26 aa, Staphylococcus
GHQLRFDLSKGFPLLTTKKVSFKLIA

SEQ ID NO: 2000006 - protein, 20 aa, Staphylococcus
GHRELPIRADFVGKNIPTAR

SEQ ID NO: 2000007 - protein, 27 aa, Staphylococcus
GIELTRPARALKLWITLQVIGEDEIIE

SEQ ID NO: 2000008 - protein, 20 aa, Staphylococcus
GIIWPKSVTPFDLHLITINP

SEQ ID NO: 2000009 - protein, 20 aa, Staphylococcus
GIPGKRIIREGDLVNIDVSA

SEQ ID NO: 2000010 - protein, 19 aa, Staphylococcus
GIPGKRKIREGDLVNIDVS

SEQ ID NO: 2000011 - protein, 20 aa, Staphylococcus
GIPLGHEFNSLVLAILQVSG

SEQ ID NO: 2000012 - protein, 25 aa, Staphylococcus
GITSFAEACILAFNHTKKNKIVVSK

SEQ ID NO: 2000013 - protein, 17 aa, Staphylococcus
GKDYLKNILKYYYGTLI

SEQ ID NO: 2000014 - protein, 25 aa, Staphylococcus
GKEGLRLSQFYKELMVSTGSLEIEH

SEQ ID NO: 2000015 - protein, 23 aa, Staphylococcus
GKITRNAGVRVIRDGIVQFEGEL

SEQ ID NO: 2000016 - protein, 26 aa, Staphylococcus
GKKIPDEFVVGYGLDYAEHYRNLPYI

SEQ ID NO: 2000017 - protein, 17 aa, Staphylococcus
GKLDLLVSLDFRMTATP

SEQ ID NO: 2000018 - protein, 19 aa, Staphylococcus
GKLDLLVSLDFRMTATPLY

SEQ ID NO: 2000019 - protein, 23 aa, Staphylococcus
GKSTFARCLCGLERHFKGTVVEA

SEQ ID NO: 2000020 - protein, 25 aa, Staphylococcus
GKSTLLLQICASLSQKLNVLYITGE

SEQ ID NO: 2000021 - protein, 25 aa, Staphylococcus
GLASFKGSIIFTSYDFEFINTIANR

SEQ ID NO: 2000022 - protein, 26 aa, Staphylococcus
GLCESSYKLPFAFKIYNDPFNVVYLV

SEQ ID NO: 2000023 - protein, 23 aa, Staphylococcus
GLEAMTIHRLIGWNQETQPEDIL

SEQ ID NO: 2000024 - protein, 17 aa, Staphylococcus
GLGKALFNQALTLANQL

SEQ ID NO: 2000025 - protein, 22 aa, Staphylococcus
GLGRFGGSIVRELNALDMDVMA

SEQ ID NO: 2000026 - protein, 24 aa, Staphylococcus
GLIPEDWGGDTIFVPLSALSGDGI

SEQ ID NO: 2000027 - protein, 24 aa, Staphylococcus
GLLLEIQNKLGIEVSIMDFDRDEW

SEQ ID NO: 2000028 - protein, 17 aa, Staphylococcus
GLNVTRVLSEFGENVLA

SEQ ID NO: 2000029 - protein, 21 aa, Staphylococcus
GLPKADIVLIGISRTSKTPLS

SEQ ID NO: 2000030 - protein, 22 aa, Staphylococcus
GLPKADIVLLGISRTSKTPLSQ

SEQ ID NO: 2000031 - protein, 17 aa, Staphylococcus
GLQEYLDDLGFNLVGYG

SEQ ID NO: 2000032 - protein, 17 aa, Staphylococcus
GLRVGVIRDWEAKWYAE

SEQ ID NO: 2000033 - protein, 19 aa, Staphylococcus
GLTELALRFNQGINTDGDA

SEQ ID NO: 2000034 - protein, 21 aa, Staphylococcus
GLTRCIPMIFLNPAPGQELEN

SEQ ID NO: 2000035 - protein, 23 aa, Staphylococcus
GMGKCCVTGCSDLEINTSAKTVY

SEQ ID NO: 2000036 - protein, 17 aa, Staphylococcus
GMIKGTGPRYCPSIEDK

SEQ ID NO: 2000037 - protein, 21 aa, Staphylococcus
GMKFYGYHGALTAENEIGQIF

SEQ ID NO: 2000038 - protein, 19 aa, Staphylococcus
GMLMAYEVTRDLELQDVEI

SEQ ID NO: 2000039 - protein, 25 aa, Staphylococcus
GMQTLGVALPWAIAAALVRPNTQVV

SEQ ID NO: 2000040 - protein, 28 aa, Staphylococcus
GMQTLGVALPWAISAALVRPNTQVVSVA

SEQ ID NO: 2000041 - protein, 24 aa, Staphylococcus
GMSEKMDGLELFHPERMASRILGM

SEQ ID NO: 2000042 - protein, 29 aa, Staphylococcus
GMSRLVKDKCDFYIKIPMVGHVNSLNASV

SEQ ID NO: 2000043 - protein, 21 aa, Staphylococcus
GNGFSVIYLISQRLVKKSLDD

SEQ ID NO: 2000044 - protein, 23 aa, Staphylococcus
GNIGRGFIGYILADNNIKVTFAD

SEQ ID NO: 2000045 - protein, 25 aa, Staphylococcus
GNLEKLKIAVHYGADAVFLGGQEYG

SEQ ID NO: 2000046 - protein, 19 aa, Staphylococcus
GNNTPVFFFRDPKLFASLN

SEQ ID NO: 2000047 - protein, 19 aa, Staphylococcus
GNNTPVFFFRDPKLFVSLN

SEQ ID NO: 2000048 - protein, 17 aa, Staphylococcus
GNPRVIFEHCLPSFHNT

SEQ ID NO: 2000049 - protein, 18 aa, Staphylococcus
GNVNFISRLLEGHYPDTT

SEQ ID NO: 2000050 - protein, 21 aa, Staphylococcus
GNYTLGVKEQLIFPEIDYDKV

SEQ ID NO: 2000051 - protein, 20 aa, Staphylococcus
GPDVPRGLPVIPEAYTPKLK

SEQ ID NO: 2000052 - protein, 17 aa, Staphylococcus
GPFNYPVQLVFEPLIGA

SEQ ID NO: 2000053 - protein, 24 aa, Staphylococcus
GPKGRNVVLDKEYVAPLITNDGVT

SEQ ID NO: 2000054 - protein, 23 aa, Staphylococcus
GPSLERPGDLAAILSGLQPGDVL

SEQ ID NO: 2000055 - protein, 18 aa, Staphylococcus
GQTIKFKGFMTLYVETKD

SEQ ID NO: 2000056 - protein, 25 aa, Staphylococcus
GRDGLKSECILLFSERDKGLHEYFI

SEQ ID NO: 2000057 - protein, 25 aa, Staphylococcus
GRIGAATAKIYAGFGAKVVGYDAYP

SEQ ID NO: 2000058 - protein, 25 aa, Staphylococcus
GRIGAATGKIYAGFGAKVVGYDAYP

SEQ ID NO: 2000059 - protein, 28 aa, Staphylococcus
GRPKHIYSIYRKMMKQKKQFDQIFDLLA

SEQ ID NO: 2000060 - protein, 20 aa, Staphylococcus
GRPNVGKSTIFNRVVGERVS

SEQ ID NO: 2000061 - protein, 25 aa, Staphylococcus
GRSLSRLGGGIGTRGPGETKLEMDR

SEQ ID NO: 2000062 - protein, 25 aa, Staphylococcus
GSDAFKLYDTYGFPIELTEELASQE

SEQ ID NO: 2000063 - protein, 17 aa, Staphylococcus
GSDVLYTDVWVSMGEPD

SEQ ID NO: 2000064 - protein, 22 aa, Staphylococcus
GSEAAYQLAQRGIKVNLIEMRP

SEQ ID NO: 2000065 - protein, 18 aa, Staphylococcus
GSEAAYQLAQRGVKVNLI

SEQ ID NO: 2000066 - protein, 23 aa, Staphylococcus
GSFIESFPLFGYNLNDYEDLFNE

SEQ ID NO: 2000067 - protein, 28 aa, Staphylococcus
GSGKSVCINSILMSLLYKNHPEELRLLL

SEQ ID NO: 2000068 - protein, 22 aa, Staphylococcus
GSHYIWMARKFRSYNPRHLLFS

SEQ ID NO: 2000069 - protein, 29 aa, Staphylococcus
GSNAIYEFLTLRIPMLLIPLGLDQSRGDQ

SEQ ID NO: 2000070 - protein, 23 aa, Staphylococcus
GSRPIEIPNFEFGKRVIDSTGAL

SEQ ID NO: 2000071 - protein, 18 aa, Staphylococcus
GSVGGAVYMNAGAYGGEI

SEQ ID NO: 2000072 - protein, 24 aa, Staphylococcus
GSVGMASDASRVFKGQKMPGRMGG

SEQ ID NO: 2000073 - protein, 28 aa, Staphylococcus
GSVKNFRVTKIFGYFGLKREEIEEAQAG

SEQ ID NO: 2000074 - protein, 22 aa, Staphylococcus
GSYLTKIRTGAISGVATKYLAR

SEQ ID NO: 2000075 - protein, 29 aa, Staphylococcus
GTEREPAVLPARFPNLLVNGASGIAVGMA

SEQ ID NO: 2000076 - protein, 20 aa, Staphylococcus
GTFLRGEIILGNMKYSSGPN

SEQ ID NO: 2000077 - protein, 18 aa, Staphylococcus
GTIAEWLKNVGDSVEKGE

SEQ ID NO: 2000078 - protein, 24 aa, Staphylococcus
GTIKFLFELQDGYTIETVLMRHEY

SEQ ID NO: 2000079 - protein, 25 aa, Staphylococcus
GTKKRIRYYSCSNFRNKGSKVCSAN

SEQ ID NO: 2000080 - protein, 17 aa, Staphylococcus
GTKYSESMNATFLDNQG

SEQ ID NO: 2000081 - protein, 24 aa, Staphylococcus
GTLSKAIGVVGGYVAGTKELIDWL

SEQ ID NO: 2000082 - protein, 25 aa, Staphylococcus
GTNTHLHLIKPLGFSTDDKMLKRAG

SEQ ID NO: 2000083 - protein, 17 aa, Staphylococcus
GTPRVANRLLKRVRDFQ

SEQ ID NO: 2000084 - protein, 30 aa, Staphylococcus; identical to SEQ ID NO: 1736983

SEQ ID NO: 2000085 - protein, 17 aa, Staphylococcus
GTVDAILFQNNDNFYTV

SEQ ID NO: 2000086 - protein, 17 aa, Staphylococcus
GTYFKSVAVTTTMGPGV

SEQ ID NO: 2000087 - protein, 18 aa, Staphylococcus
GTYFKSVAVTTTMGPGVK

SEQ ID NO: 2000088 - protein, 24 aa, Staphylococcus
GVDFRLIEPAAFYHTLQHFTGSKD

SEQ ID NO: 2000089 - protein, 19 aa, Staphylococcus
GVFALKLSLNRDVKGIITM

SEQ ID NO: 2000090 - protein, 19 aa, Staphylococcus
GVFALKLSLNRPVKGIITM

SEQ ID NO: 2000091 - protein, 17 aa, Staphylococcus
GVGKTTISSFIALNLAE

SEQ ID NO: 2000092 - protein, 20 aa, Staphylococcus
GVGNSVIYVGLKTGRDGIHG

SEQ ID NO: 2000093 - protein, 22 aa, Staphylococcus
GVGSPDALIECSIRGMDMFDCV

SEQ ID NO: 2000094 - protein, 17 aa, Staphylococcus
GVLETRPELSFPADLYF

SEQ ID NO: 2000095 - protein, 20 aa, Staphylococcus
GVPIKAPVAGIAMGLVTRDD

SEQ ID NO: 2000096 - protein, 20 aa, Staphylococcus
GVSKAFKPIMENTLKYLNVG

SEQ ID NO: 2000097 - protein, 21 aa, Staphylococcus
GVTCPKCKDGDVVERKSKKNR

SEQ ID NO: 2000098 - protein, 24 aa, Staphylococcus
GVVTRPFGFEGRKRQTQAAAGVEA

SEQ ID NO: 2000099 - protein, 23 aa, Staphylococcus
GVVTRPFGFEGRKRSTQAAAGVE

SEQ ID NO: 2000100 - protein, 25 aa, Staphylococcus
GVYYYCNLSSPFVCDDEALKYIDYD

SEQ ID NO: 2000101 - protein, 21 aa, Staphylococcus
GYQQCPFKHYASHGLRLNERT

SEQ ID NO: 2000102 - protein, 18 aa, Staphylococcus
GYSFIGLGSDGGFAEFTN

SEQ ID NO: 2000103 - protein, 25 aa, Staphylococcus
GYSVKPEYNKLIVAPFDIRDVFIDR

SEQ ID NO: 2000104 - protein, 17 aa, Staphylococcus
GYTATDIISRYKRMQGY

SEQ ID NO: 2000105 - protein, 17 aa, Staphylococcus
GYTATDIVSRYKRMQGY

SEQ ID NO: 2000106 - protein, 24 aa, Staphylococcus
GYTRILKVGPRRGDGAESVIIELV

SEQ ID NO: 2000107 - protein, 32 aa, Staphylococcus; identical to SEQ ID NO: 1653118

SEQ ID NO: 2000108 - protein, 25 aa, Staphylococcus
HAGQVCSAGSRILVHNDIKDKFEKA

SEQ ID NO: 2000109 - protein, 25 aa, Staphylococcus
HAKKAGAAPKRFIREFRNVNVDEYE

SEQ ID NO: 2000110 - protein, 18 aa, Staphylococcus
HANLKYTIVHPGALTNEH

SEQ ID NO: 2000111 - protein, 17 aa, Staphylococcus
HARPEDQALFGIIQGGE

SEQ ID NO: 2000112 - protein, 21 aa, Staphylococcus
HASLIRFAETSLRPLGRTAAG

SEQ ID NO: 2000113 - protein, 26 aa, Staphylococcus
HASLLPKYRGGAPIHQAIIDGEKETG

SEQ ID NO: 2000114 - protein, 17 aa, Staphylococcus
HEEFEFEKNDGYQSEKS

SEQ ID NO: 2000115 - protein, 28 aa, Staphylococcus
HEVKDMYRRVNFLFGDIVKVTPSSKVVG

SEQ ID NO: 2000116 - protein, 36 aa, Staphylococcus
HEWNLKLGELAMIWREGCIIRAQFLQKIKDAYDNNP

SEQ ID NO: 2000117 - protein, 20 aa, Staphylococcus
HFDNEIGFYNILRHSSSTYA

SEQ ID NO: 2000118 - protein, 23 aa, Staphylococcus
HFPCLNCTKSIIQAGIKTIYYAE

SEQ ID NO: 2000119 - protein, 18 aa, Staphylococcus
HFSYKRYLENQIRDAFGF

SEQ ID NO: 2000120 - protein, 21 aa, Staphylococcus
HFYDMSVAICHNGNLINAQTL

SEQ ID NO: 2000121 - protein, 19 aa, Staphylococcus
HGAGGIVLDVKVFNREEGD

SEQ ID NO: 2000122 - protein, 25 aa, Staphylococcus
HGNELPISAGYFFINPFEVVYYAGG

SEQ ID NO: 2000123 - protein, 22 aa, Staphylococcus
HGVEWVLRLPRRPDVYKRTKPE

SEQ ID NO: 2000124 - protein, 18 aa, Staphylococcus
HIDDCVNLTIGQPDFPMP

SEQ ID NO: 2000125 - protein, 23 aa, Staphylococcus
HIGEVNGTISIGCSSLIGQTLLP

SEQ ID NO: 2000126 - protein, 18 aa, Staphylococcus
HIPFCVRICTYCDFNKYF

SEQ ID NO: 2000127 - protein, 20 aa, Staphylococcus
HKIPPTIISRAQRFDFKAIS

SEQ ID NO: 2000128 - protein, 24 aa, Staphylococcus
HKTLRGPRGGLILCKEEYKKDIDK

SEQ ID NO: 2000129 - protein, 24 aa, Staphylococcus
HLDRKLAERRVFPAIDIGRSSTRK

SEQ ID NO: 2000130 - protein, 26 aa, Staphylococcus
HLEQSRLTQYIGHLNVVLFAPEDLNI

SEQ ID NO: 2000131 - protein, 24 aa, Staphylococcus
HLKKERPDCLIGVCGCMSQEESVV

SEQ ID NO: 2000132 - protein, 28 aa, Staphylococcus
HLLARAVARDVGRIMGFEEITLNEISKL

SEQ ID NO: 2000133 - protein, 24 aa, Staphylococcus
HLMNLKELFLVSLQERAIPFELNG

SEQ ID NO: 2000134 - protein, 24 aa, Staphylococcus
HLMQLKELFLVSLQERAIPFEVNG

SEQ ID NO: 2000135 - protein, 17 aa, Staphylococcus
HLPESLIAQTPLKNRDQ

SEQ ID NO: 2000136 - protein, 18 aa, Staphylococcus
HLPGLSIMKRMNRIAQTI

SEQ ID NO: 2000137 - protein, 18 aa, Staphylococcus
HLTYGTDEHPGWWREIID

SEQ ID NO: 2000138 - protein, 25 aa, Staphylococcus
HNPANLMGIRAFKKLLPNIPHVAVF

SEQ ID NO: 2000139 - protein, 25 aa, Staphylococcus
HNPANLMGIRAFRKLLPEIPHVAVF

SEQ ID NO: 2000140 - protein, 17 aa, Staphylococcus
HQSYCVLIASPKTETGI

SEQ ID NO: 2000141 - protein, 18 aa, Staphylococcus
HRELPIRADFVGKNIPTA

SEQ ID NO: 2000142 - protein, 22 aa, Staphylococcus
HTGRYAYVITMLRRNGYHVIMG

SEQ ID NO: 2000143 - protein, 19 aa, Staphylococcus
HTINKIWIQEGIRKQQIND

SEQ ID NO: 2000144 - protein, 22 aa, Staphylococcus
HVERVSKRLGINRWKDNVRQVE

SEQ ID NO: 2000145 - protein, 17 aa, Staphylococcus
HVTELINEVSLLQFMNG

SEQ ID NO: 2000146 - protein, 20 aa, Staphylococcus
HYYNVRIEDFSAKKRTKSIA

SEQ ID NO: 2000147 - protein, 18 aa, Staphylococcus
IAAGPEIQSRGFVYVRES

SEQ ID NO: 2000148 - protein, 26 aa, Staphylococcus
IAALKLKLSPNEVWNAVTVNAAKAID

SEQ ID NO: 2000149 - protein, 22 aa, Staphylococcus
IAARARGRYGGRPEKLNKQDLN

SEQ ID NO: 2000150 - protein, 22 aa, Staphylococcus
IAARARGRYGGRPEKLNQKDLN

SEQ ID NO: 2000151 - protein, 26 aa, Staphylococcus
IADLEHGKHGFAFGSGMAAISAVIML

SEQ ID NO: 2000152 - protein, 18 aa, Staphylococcus
IAENAGLEGSVIVERLKH

SEQ ID NO: 2000153 - protein, 18 aa, Staphylococcus
IAGERGSGKICLNGAASR

SEQ ID NO: 2000154 - protein, 19 aa, Staphylococcus
IAKGLDFPNITLVGVLNAD

SEQ ID NO: 2000155 - protein, 24 aa, Staphylococcus
IAKSIRFGASMVMIGSLFAAHEES

SEQ ID NO: 2000156 - protein, 26 aa, Staphylococcus
IANLENGKHGFAFGSGMAAISAVIML

SEQ ID NO: 2000157 - protein, 18 aa, Staphylococcus
IANTVAFLASDKAKYITG

SEQ ID NO: 2000158 - protein, 24 aa, Staphylococcus
IARELECPVIALSQLSRGVEQRQD

SEQ ID NO: 2000159 - protein, 17 aa, Staphylococcus
IARQVASKLSMIYVDTG

SEQ ID NO: 2000160 - protein, 21 aa, Staphylococcus
IASGGELSRIMLALKSIFVQS

SEQ ID NO: 2000161 - protein, 24 aa, Staphylococcus
IDAKGNLIAPGFVDVHVHLREPGG

SEQ ID NO: 2000162 - protein, 17 aa, Staphylococcus
IDALVNYISSLGYLSDD

SEQ ID NO: 2000163 - protein, 20 aa, Staphylococcus
IDKQVKIRGFRIELSEIEKA

SEQ ID NO: 2000164 - protein, 23 aa, Staphylococcus
IDLTRTWELLGEIIGESASDELI

SEQ ID NO: 2000165 - protein, 24 aa, Staphylococcus
IDQSKFPLGQAVYFDTEKDGRMIF

SEQ ID NO: 2000166 - protein, 21 aa, Staphylococcus
IDRLVKGCTGVKRTTGQHPGG

SEQ ID NO: 2000167 - protein, 19 aa, Staphylococcus
IDSGLDIDALKVVSKGINE

SEQ ID NO: 2000168 - protein, 25 aa, Staphylococcus
IDTELPQHITICSGLIKADKYEWMI

SEQ ID NO: 2000169 - protein, 17 aa, Staphylococcus
IDVIWLSPMYKSPNDDN

SEQ ID NO: 2000170 - protein, 23 aa, Staphylococcus
IECDTYRKYGHFEGDEQKVKSPD

SEQ ID NO: 2000171 - protein, 25 aa, Staphylococcus
IEEIEQFPKLLFISGEDDEIIPYTD

SEQ ID NO: 2000172 - protein, 17 aa, Staphylococcus
IEGRTAYKGPLQDTVYQ

SEQ ID NO: 2000173 - protein, 17 aa, Staphylococcus
IEHRRWGAPFPVIEIVK

SEQ ID NO: 2000174 - protein, 18 aa, Staphylococcus
IEIAPLAYMRGRTLDDAF

SEQ ID NO: 2000175 - protein, 23 aa, Staphylococcus
IEIGPGKVLSGLIKKINRDVKIT

SEQ ID NO: 2000176 - protein, 23 aa, Staphylococcus
IEIGPGKVLSGLIKKINRDVKLT

SEQ ID NO: 2000177 - protein, 17 aa, Staphylococcus
IEITGSELVRGRGGPRC

SEQ ID NO: 2000178 - protein, 22 aa, Staphylococcus
IELPKNKLIVMTGLSGSGKSSL

SEQ ID NO: 2000179 - protein, 25 aa, Staphylococcus
IELTKYLFFTGKGGVGKTTISSFIA

SEQ ID NO: 2000180 - protein, 22 aa, Staphylococcus
IELVKVNGRISVITFHSLEDRL

SEQ ID NO: 2000181 - protein, 25 aa, Staphylococcus
IEQKKGPFAPDFIKVWKERYKKIRD

SEQ ID NO: 2000182 - protein, 17 aa, Staphylococcus
IERSNVVLIVIDAEEGI

SEQ ID NO: 2000183 - protein, 22 aa, Staphylococcus
IERVPSIEKVRMVSSGTEATLA

SEQ ID NO: 2000184 - protein, 22 aa, Staphylococcus
IESKRGGGGYIRITKIENKDAT

SEQ ID NO: 2000185 - protein, 18 aa, Staphylococcus
IETGRYSYQRLFKKDLRK

SEQ ID NO: 2000186 - protein, 22 aa, Staphylococcus
IEVRGRVLGVSQHTRYSQQEIP

SEQ ID NO: 2000187 - protein, 23 aa, Staphylococcus
IEYDAIVPTQLWPTLETKKIKNL

SEQ ID NO: 2000188 - protein, 24 aa, Staphylococcus
IFDEKRLSKSPAFFDKQKLAWVNN

SEQ ID NO: 2000189 - protein, 24 aa, Staphylococcus
IFDEKRLSKSPAMFDRQKLAWVNN

SEQ ID NO: 2000190 - protein, 18 aa, Staphylococcus
IFESYAKGHGYRKIANAL

SEQ ID NO: 2000191 - protein, 17 aa, Staphylococcus
IFQGLEFTDRRPFNDVL

SEQ ID NO: 2000192 - protein, 23 aa, Staphylococcus
IFSDGKIPGFVHLYVGEEAVATG

SEQ ID NO: 2000193 - protein, 23 aa, Staphylococcus
IFSDGQIPGFVHLYVGEEAVATG

SEQ ID NO: 2000194 - protein, 19 aa, Staphylococcus
IFVQSRGQTAILFDEVDSG

SEQ ID NO: 2000195 - protein, 17 aa, Staphylococcus
IGALCGEAIVFTKNNEP

SEQ ID NO: 2000196 - protein, 18 aa, Staphylococcus
IGALKDGRFEDVQKDIEG

SEQ ID NO: 2000197 - protein, 18 aa, Staphylococcus
IGASGARLVTTLVNALEQ

SEQ ID NO: 2000198 - protein, 23 aa, Staphylococcus
IGNARPAINYDVVRRYFEYKGYE

SEQ ID NO: 2000199 - protein, 25 aa, Staphylococcus
IGQLIGMRASSDFVRHGEKKAIIEG

SEQ ID NO: 2000200 - protein, 19 aa, Staphylococcus
IGTRLLKFNTLPISHLVYL

SEQ ID NO: 2000201 - protein, 17 aa, Staphylococcus
IGYDNVIFHKGKIQNLK

SEQ ID NO: 2000202 - protein, 21 aa, Staphylococcus
IHEDPRTVYDYTIKRNTVAVV

SEQ ID NO: 2000203 - protein, 19 aa, Staphylococcus
IIEVAPLAYMRGRTLDDAF

SEQ ID NO: 2000204 - protein, 18 aa, Staphylococcus
IIIDAIGQLIGMRASSDY

SEQ ID NO: 2000205 - protein, 17 aa, Staphylococcus
IIIPCHRVVGKDGSLTG

SEQ ID NO: 2000206 - protein, 23 aa, Staphylococcus
IIKEALHKLGFDDGMYDLIKEPL

SEQ ID NO: 2000207 - protein, 18 aa, Staphylococcus
IIPIIWIAFKTGLRISDV

SEQ ID NO: 2000208 - protein, 19 aa, Staphylococcus
IIRDLRMGTYDAIVGINLL

SEQ ID NO: 2000209 - protein, 18 aa, Staphylococcus
IIRDLRMGTYDAVVGINL

SEQ ID NO: 2000210 - protein, 18 aa, Staphylococcus
IIRDLRMGTYDVIVGINL

SEQ ID NO: 2000211 - protein, 24 aa, Staphylococcus
IKADGKMLVIDGGFSKAYQKTTGI

SEQ ID NO: 2000212 - protein, 17 aa, Staphylococcus
IKALKRGPQIVVGTPGR

SEQ ID NO: 2000213 - protein, 18 aa, Staphylococcus
IKEQLIFPEIDYDKVSKV

SEQ ID NO: 2000214 - protein, 18 aa, Staphylococcus
IKEVMGLPKDFKTHPHYK

SEQ ID NO: 2000215 - protein, 27 aa, Staphylococcus
IKGKVARLTNFGAFVDIGGVDGLVHVS

SEQ ID NO: 2000216 - protein, 19 aa, Staphylococcus
IKGVARPALVVTLPTIDGK

SEQ ID NO: 2000217 - protein, 18 aa, Staphylococcus
IKKELSYAEEVFKKLNAT

SEQ ID NO: 2000218 - protein, 18 aa, Staphylococcus
IKKFGAFVELPEGKSGLV

SEQ ID NO: 2000219 - protein, 17 aa, Staphylococcus
IKLGQNASFIFAVCEYL

SEQ ID NO: 2000220 - protein, 22 aa, Staphylococcus
IKNIQIGMAHRGRLNVLTHVLE

SEQ ID NO: 2000221 - protein, 19 aa, Staphylococcus
IKSYQNIAGQSIFEIGRRL

SEQ ID NO: 2000222 - protein, 23 aa, Staphylococcus
IKYIIEQGGKLVLFSHLGKVKQE

SEQ ID NO: 2000223 - protein, 21 aa, Staphylococcus
IKYIIEQGGKVVLFSHLGKVK

SEQ ID NO: 2000224 - protein, 18 aa, Staphylococcus
ILACEAWSELGYIPKDDV

SEQ ID NO: 2000225 - protein, 21 aa, Staphylococcus
ILDQLPCWLTYTNDRTHKVID

SEQ ID NO: 2000226 - protein, 17 aa, Staphylococcus
ILNDSGLAIEPAATMAE

SEQ ID NO: 2000227 - protein, 21 aa, Staphylococcus
ILVDMTKLLAPILVHTAEEVW

SEQ ID NO: 2000228 - protein, 21 aa, Staphylococcus
IMKPEYFIPVQGEFKMQIAHA

SEQ ID NO: 2000229 - protein, 17 aa, Staphylococcus
IMQPFKVYPDGFPDELV

SEQ ID NO: 2000230 - protein, 24 aa, Staphylococcus
INAMKRNDLVFGIGPAGTGKTFLA

SEQ ID NO: 2000231 - protein, 27 aa, Staphylococcus
INEELGITILINLHFVDLALEYGTRII

SEQ ID NO: 2000232 - protein, 23 aa, Staphylococcus
INFASAYKAPAIFVIQNNNYAIS

SEQ ID NO: 2000233 - protein, 23 aa, Staphylococcus
INGEIRPGIVHRIDKDTSGLLMV

SEQ ID NO: 2000234 - protein, 23 aa, Staphylococcus
INGGKFNGIIPISQLSTHHIENP

SEQ ID NO: 2000235 - protein, 21 aa, Staphylococcus
INKGEFLAIVGPNGAGKSTLL

SEQ ID NO: 2000236 - protein, 17 aa, Staphylococcus
INPFEVVYYAGGTSNKY

SEQ ID NO: 2000237 - protein, 25 aa, Staphylococcus
INVPEARLLVISPYDKSSVADIEKA

SEQ ID NO: 2000238 - protein, 17 aa, Staphylococcus
IPAAGLGTRFLPATKAM

SEQ ID NO: 2000239 - protein, 21 aa, Staphylococcus
IPAAGLGTRFLPATKAMPKEM

SEQ ID NO: 2000240 - protein, 25 aa, Staphylococcus
IPAISWLEDFLINFDNTVIVVSHDR

SEQ ID NO: 2000241 - protein, 18 aa, Staphylococcus
IPDASISFEVFADDLETM

SEQ ID NO: 2000242 - protein, 22 aa, Staphylococcus
IPDLTCLGKVIGGGLPVGAFGG

SEQ ID NO: 2000243 - protein, 22 aa, Staphylococcus
IPDSLGICIHTSYGSIVYTGEF

SEQ ID NO: 2000244 - protein, 18 aa, Staphylococcus
IPGKRVIREGDLVNIDVS

SEQ ID NO: 2000245 - protein, 21 aa, Staphylococcus
IPGNGKFLYSPFSVFDNESII

SEQ ID NO: 2000246 - protein, 19 aa, Staphylococcus
IPLGHEFNSLVLAILQVSG

SEQ ID NO: 2000247 - protein, 23 aa, Staphylococcus
IPREKRVVISLTYVYGIGTSTAK

SEQ ID NO: 2000248 - protein, 18 aa, Staphylococcus
IPSKALLHASHRFVEAQH

SEQ ID NO: 2000249 - protein, 17 aa, Staphylococcus
IQAGRLSYEAGRIPVKY

SEQ ID NO: 2000250 - protein, 25 aa, Staphylococcus
IQEKMGRPAVEVILTVLHAGGKFGG

SEQ ID NO: 2000251 - protein, 18 aa, Staphylococcus
IQEKTFRAGEKVEQAMIE

SEQ ID NO: 2000252 - protein, 17 aa, Staphylococcus
IQETTALGAAYLAGLAV

SEQ ID NO: 2000253 - protein, 19 aa, Staphylococcus
IQFSDGLTVLSGETGSGKS

SEQ ID NO: 2000254 - protein, 19 aa, Staphylococcus
IQHECKEPVSLQPSLDVKR

SEQ ID NO: 2000255 - protein, 17 aa, Staphylococcus
IQIGMAHRGRLNVLTHV

SEQ ID NO: 2000256 - protein, 26 aa, Staphylococcus
IQSEVPAHVQAGWMLTTISSVGELER

SEQ ID NO: 2000257 - protein, 17 aa, Staphylococcus
IQSRGFVYVRESEELMK

SEQ ID NO: 2000258 - protein, 18 aa, Staphylococcus
IQSSILTSIPLWKNQMAI

SEQ ID NO: 2000259 - protein, 18 aa, Staphylococcus
IQVPGAFPKFGTTDGTIT

SEQ ID NO: 2000260 - protein, 23 aa, Staphylococcus
IRAPQWRGGGIVFGPTPRSYAYK

SEQ ID NO: 2000261 - protein, 32 aa, Staphylococcus; identical to SEQ ID NO: 1795396

SEQ ID NO: 2000262 - protein, 20 aa, Staphylococcus
IREVNYLTGEVIREREHFAI

SEQ ID NO: 2000263 - protein, 24 aa, Staphylococcus
IRGICCLKPGIPGVSENIEVVSIV

SEQ ID NO: 2000264 - protein, 21 aa, Staphylococcus
IRHLGVKASQVLAEKYETMDR

SEQ ID NO: 2000265 - protein, 17 aa, Staphylococcus
IRHLIKAEETFGIRLTT

SEQ ID NO: 2000266 - protein, 24 aa, Staphylococcus
IRLKSKKGTLLWLMDETKTPMGAR

SEQ ID NO: 2000267 - protein, 28 aa, Staphylococcus
IRNFKPEEYWSIEGEFRYKKSKFTAKFL

SEQ ID NO: 2000268 - protein, 17 aa, Staphylococcus
IRQQWAKLGLGLDYSRE

SEQ ID NO: 2000269 - protein, 28 aa, Staphylococcus
IRVFYRDEFLCTAISPDLADYSIDIKDI

SEQ ID NO: 2000270 - protein, 17 aa, Staphylococcus
ISAVMVYEAGKPWDEAV

SEQ ID NO: 2000271 - protein, 18 aa, Staphylococcus
ISELGLAIEAGMNAEDIA

SEQ ID NO: 2000272 - protein, 17 aa, Staphylococcus
ISELGLAIESGMNAEDI

SEQ ID NO: 2000273 - protein, 17 aa, Staphylococcus
ISKFKVIINNYIEESHG

SEQ ID NO: 2000274 - protein, 25 aa, Staphylococcus
ISKIPRFPFDKFEKGERVLGTQMKA

SEQ ID NO: 2000275 - protein, 18 aa, Staphylococcus
ISLIGSGMRDMSGVASKA

SEQ ID NO: 2000276 - protein, 18 aa, Staphylococcus
ISSEILIKAAKIGVGVIL

SEQ ID NO: 2000277 - protein, 18 aa, Staphylococcus
ITEHIPVVDMVKVKRYLQ

SEQ ID NO: 2000278 - protein, 20 aa, Staphylococcus
ITGAQAWVGTLLKMKPVLRF

SEQ ID NO: 2000279 - protein, 23 aa, Staphylococcus
ITMYPHLDGVLSLDLTTVLILNQ

SEQ ID NO: 2000280 - protein, 17 aa, Staphylococcus
ITPGNFIFRTREFEQME

SEQ ID NO: 2000281 - protein, 18 aa, Staphylococcus
IVALPEIFNKVDVFESDL

SEQ ID NO: 2000282 - protein, 20 aa, Staphylococcus
IVASGYRGALPHGVASDKVI

SEQ ID NO: 2000283 - protein, 25 aa, Staphylococcus
IVKKFPIPHISTGDMFRKAIKDETD

SEQ ID NO: 2000284 - protein, 17 aa, Staphylococcus
IVSESLVTYYYRTPRIP

SEQ ID NO: 2000285 - protein, 18 aa, Staphylococcus
IVTFGHLLARAVARDVGR

SEQ ID NO: 2000286 - protein, 17 aa, Staphylococcus
IVTILGVAEDASIKAAV

SEQ ID NO: 2000287 - protein, 25 aa, Staphylococcus
IVVGNTYGRIRAMVNDLGQRIKSAG

SEQ ID NO: 2000288 - protein, 17 aa, Staphylococcus
IVYANPLALGLLTPPGS

SEQ ID NO: 2000289 - protein, 18 aa, Staphylococcus
IVYANPLALGLLTPPGSF

SEQ ID NO: 2000290 - protein, 38 aa, Staphylococcus
IWHGLPLTEAFLFSRGHFKGNQFPEGVNAFSPQIIIGA

SEQ ID NO: 2000291 - protein, 19 aa, Staphylococcus
IYCDNRVTLGYPLVRNAIR

SEQ ID NO: 2000292 - protein, 17 aa, Staphylococcus
IYERLRPGEPPTVENAK

SEQ ID NO: 2000293 - protein, 20 aa, Staphylococcus
IYGAKGLAWVKVVDDGLSGP

SEQ ID NO: 2000294 - protein, 17 aa, Staphylococcus
IYGGPLALGLIRNKLDE

SEQ ID NO: 2000295 - protein, 22 aa, Staphylococcus
IYGMKVAKDLVHITGDTSDYHL

SEQ ID NO: 2000296 - protein, 18 aa, Staphylococcus
IYLAVTMWTAGLRGPGQL

SEQ ID NO: 2000297 - protein, 17 aa, Staphylococcus
IYLNFSDPWPKKRHAKR

SEQ ID NO: 2000298 - protein, 19 aa, Staphylococcus
KAAKFLISLYNVFIEKDCS

SEQ ID NO: 2000299 - protein, 26 aa, Staphylococcus
KAFDGRGNYTLGIKEQLIFPEIDYDK

SEQ ID NO: 2000300 - protein, 24 aa, Staphylococcus
KAFDRLKLNIFISLAELESDNIGE

SEQ ID NO: 2000301 - protein, 20 aa, Staphylococcus
KAGDIIKNMAPIVGGKGGGR

SEQ ID NO: 2000302 - protein, 29 aa, Staphylococcus
KAGVIMLTKSLAMEWSKYGIKVNTIAPGY

SEQ ID NO: 2000303 - protein, 17 aa, Staphylococcus
KALRKLRHPSRSKRLKD

SEQ ID NO: 2000304 - protein, 18 aa, Staphylococcus
KALVSALKKYPALNTSFN

SEQ ID NO: 2000305 - protein, 19 aa, Staphylococcus
KASLETFGVDSDRLEIQIM

SEQ ID NO: 2000306 - protein, 22 aa, Staphylococcus
KAVESYGIVGMASRQQVRDGIA

SEQ ID NO: 2000307 - protein, 18 aa, Staphylococcus
KAYLKYVNPKVIAVTGSN

SEQ ID NO: 2000308 - protein, 23 aa, Staphylococcus
KCPECGNNMVCRRTYYKTKKSKE

SEQ ID NO: 2000309 - protein, 25 aa, Staphylococcus
KCRPIEGWNTVAFAKDWQGPPRLQN

SEQ ID NO: 2000310 - protein, 22 aa, Staphylococcus
KDAGKIAGLEVERIINEPTAAA

SEQ ID NO: 2000311 - protein, 24 aa, Staphylococcus
KDAKAKELIKLVDLPEDYLDRYPS

SEQ ID NO: 2000312 - protein, 17 aa, Staphylococcus
KDDEFDRVLGLELGADD

SEQ ID NO: 2000313 - protein, 19 aa, Staphylococcus
KDEIVIIDAGIKFPDDNLL

SEQ ID NO: 2000314 - protein, 19 aa, Staphylococcus
KDKGIKNVHGYGYGDLFVN

SEQ ID NO: 2000315 - protein, 21 aa, Staphylococcus
KDLIRQCNKLGKPVITATQML

SEQ ID NO: 2000316 - protein, 18 aa, Staphylococcus
KDNSEFFDGVDMNLVDWL

SEQ ID NO: 2000317 - protein, 19 aa, Staphylococcus
KDPRVGFITITDVELTNDL

SEQ ID NO: 2000318 - protein, 17 aa, Staphylococcus
KDSEIDKVLGLELGADD

SEQ ID NO: 2000319 - protein, 19 aa, Staphylococcus
KDSRTEVILNMLNTSGLNA

SEQ ID NO: 2000320 - protein, 22 aa, Staphylococcus
KDYATISFLNWFLDEQVEEEST

SEQ ID NO: 2000321 - protein, 17 aa, Staphylococcus
KEAILSVILPQYVESLI

SEQ ID NO: 2000322 - protein, 18 aa, Staphylococcus
KEARRMLDEAGFKDAKII

SEQ ID NO: 2000323 - protein, 22 aa, Staphylococcus
KECGLEVGEFVHTFGDAHIYSN

SEQ ID NO: 2000324 - protein, 25 aa, Staphylococcus
KEEKIKELQDFVARFSANASKSKQA

SEQ ID NO: 2000325 - protein, 20 aa, Staphylococcus
KEEYASFIRQQWAKLGLGLD

SEQ ID NO: 2000326 - protein, 21 aa, Staphylococcus
KEIFRSMGVAVPEGRVAFTAE

SEQ ID NO: 2000327 - protein, 22 aa, Staphylococcus
KEILEVSDGLMVARGDMGVEIP

SEQ ID NO: 2000328 - protein, 18 aa, Staphylococcus
KEIMKHSPTALRFLKAAM

SEQ ID NO: 2000329 - protein, 17 aa, Staphylococcus
KEINEQFEISKQFWGHL

SEQ ID NO: 2000330 - protein, 24 aa, Staphylococcus
KEISFSVSGSGAYSKLKFENGAHR

SEQ ID NO: 2000331 - protein, 19 aa, Staphylococcus
KEKLRTNVGMVFQQPNPFP

SEQ ID NO: 2000332 - protein, 23 aa, Staphylococcus
KELEELRLRVATTRPQENKNFSS

SEQ ID NO: 2000333 - protein, 24 aa, Staphylococcus
KELEKEGFHILAIKDMAGLLKPKA

SEQ ID NO: 2000334 - protein, 20 aa, Staphylococcus
KELHGANIFLDMVSVGATIN

SEQ ID NO: 2000335 - protein, 17 aa, Staphylococcus
KELKRLGINATIRREQG

SEQ ID NO: 2000336 - protein, 21 aa, Staphylococcus
KELQQKLGKTFIFVTHDMDEA

SEQ ID NO: 2000337 - protein, 17 aa, Staphylococcus
KEQGCTIIMVLHDINQA

SEQ ID NO: 2000338 - protein, 18 aa, Staphylococcus
KFVPEGIEGRTAYKGPLQ

SEQ ID NO: 2000339 - protein, 27 aa, Staphylococcus
KFYDRKEIKDLLSYLRIVANSNDDISL

SEQ ID NO: 2000340 - protein, 26 aa, Staphylococcus
KFYDRKEIKDLLSYLRVIANSNDDIS

SEQ ID NO: 2000341 - protein, 20 aa, Staphylococcus
KGAVMKLGDNKGRRVSSVSS

SEQ ID NO: 2000342 - protein, 17 aa, Staphylococcus
KGAWNVYERAGFMHTAT

SEQ ID NO: 2000343 - protein, 17 aa, Staphylococcus
KGGLKLMMETMSMEYAQ

SEQ ID NO: 2000344 - protein, 22 aa, Staphylococcus
KGKQLFMPIRVAVTGQMHGPEL

SEQ ID NO: 2000345 - protein, 21 aa, Staphylococcus
KGLDTICIYVAIGQKDSTVRA

SEQ ID NO: 2000346 - protein, 23 aa, Staphylococcus
KGNPFSISAVTYILSNPFYIGKI

SEQ ID NO: 2000347 - protein, 18 aa, Staphylococcus
KGPFRFAALSGDPKDIER

SEQ ID NO: 2000348 - protein, 19 aa, Staphylococcus
KGTGPRYCPSIEDKFVRFN

SEQ ID NO: 2000349 - protein, 20 aa, Staphylococcus
KGTMEFSDRLYGVTMQESGV

SEQ ID NO: 2000350 - protein, 17 aa, Staphylococcus
KGVGQLLFKKIPKLPFT

SEQ ID NO: 2000351 - protein, 17 aa, Staphylococcus
KGYVRLRVDGEIVDVNE

SEQ ID NO: 2000352 - protein, 17 aa, Staphylococcus
KHFEVSFYLTTHSIPEA

SEQ ID NO: 2000353 - protein, 24 aa, Staphylococcus
KHLDIPAGAAVRFEPGDEKKVQLV

SEQ ID NO: 2000354 - protein, 23 aa, Staphylococcus
KIAEGDIGWRKVIDNFYGSFKLD

SEQ ID NO: 2000355 - protein, 33 aa, Staphylococcus
KIDIPRVRFTTSHPWDFTDRMIEVIAKGGNIVP

SEQ ID NO: 2000356 - protein, 17 aa, Staphylococcus
KIDYLFNALEDDGPELI

SEQ ID NO: 2000357 - protein, 23 aa, Staphylococcus
KIGKEIYDKYGLKEMEVTDEVFE

SEQ ID NO: 2000358 - protein, 18 aa, Staphylococcus
KIGKRLFIDHGMGVVIGE

SEQ ID NO: 2000359 - protein, 22 aa, Staphylococcus
KIHGGARSNSAFQIKEKSHQEK

SEQ ID NO: 2000360 - protein, 19 aa, Staphylococcus
KIHLLHLLKGTPMVKQYEK

SEQ ID NO: 2000361 - protein, 19 aa, Staphylococcus
KILLCDEATSALDPATTSS

SEQ ID NO: 2000362 - protein, 24 aa, Staphylococcus
KILSKRELEILPLIAKGYGNKEIA

SEQ ID NO: 2000363 - protein, 21 aa, Staphylococcus
KINEGEFFVLIGPSGCGKTTT

SEQ ID NO: 2000364 - protein, 18 aa, Staphylococcus
KKALFIVYANPLALGLLT

SEQ ID NO: 2000365 - protein, 19 aa, Staphylococcus
KKALFIVYANPLALGLLTP

SEQ ID NO: 2000366 - protein, 23 aa, Staphylococcus
KKDFKRLGVRGDFNDPYITLKPE

SEQ ID NO: 2000367 - protein, 22 aa, Staphylococcus
KKDNFYIISIEIVFFHLSKNFM

SEQ ID NO: 2000368 - protein, 22 aa, Staphylococcus
KKFPDALFIFLAPPSLDHLKER

SEQ ID NO: 2000369 - protein, 22 aa, Staphylococcus
KKFPDALFIFLAPPSLDHLRER

SEQ ID NO: 2000370 - protein, 19 aa, Staphylococcus
KKGRVGFGTGKAQEVPEAI

SEQ ID NO: 2000371 - protein, 17 aa, Staphylococcus
KKGSIAYLKEAEKISDF

SEQ ID NO: 2000372 - protein, 25 aa, Staphylococcus
KKGSQLPQLFGFQAEGASPIVQNKV

SEQ ID NO: 2000373 - protein, 21 aa, Staphylococcus
KKIMKNYNWEYFKSQINKKLS

SEQ ID NO: 2000374 - protein, 22 aa, Staphylococcus
KKLQHLSLLSGGERALSAIALL

SEQ ID NO: 2000375 - protein, 20 aa, Staphylococcus
KKSGIGREVYKDAIKNYQQV

SEQ ID NO: 2000376 - protein, 21 aa, Staphylococcus
KKSGIGREVYKDAIKNYQQVK

SEQ ID NO: 2000377 - protein, 21 aa, Staphylococcus
KLKKELISFNLLTQERVGLNK

SEQ ID NO: 2000378 - protein, 21 aa, Staphylococcus
KLKMIGHYIGMSFQIVDDILD

SEQ ID NO: 2000379 - protein, 20 aa, Staphylococcus
KLNDEYFKRIEAIEYSVKYD

SEQ ID NO: 2000380 - protein, 18 aa, Staphylococcus
KLNLSLKDNDYFKNYERK

SEQ ID NO: 2000381 - protein, 24 aa, Staphylococcus
KLNTRPRKRFDWKTPAELFNDKVL

SEQ ID NO: 2000382 - protein, 18 aa, Staphylococcus
KLPDLSERERKVISKHTK

SEQ ID NO: 2000383 - protein, 24 aa, Staphylococcus
KLPEIVKIAEEFGLLTYVDDAHGS

SEQ ID NO: 2000384 - protein, 27 aa, Staphylococcus
KLVMKQLFEHRGLPQLPYISFLRSEYE

SEQ ID NO: 2000385 - protein, 26 aa, Staphylococcus
KLYLKHGQCKVLLGVARGKKIHDKRQ

SEQ ID NO: 2000386 - protein, 24 aa, Staphylococcus
KMEETIKGVVLFHETLKALNVKHE

SEQ ID NO: 2000387 - protein, 17 aa, Staphylococcus
KMMLKVILYAYTQSVFS

SEQ ID NO: 2000388 - protein, 18 aa, Staphylococcus
KMSNLCTEIFQLQETSII

SEQ ID NO: 2000389 - protein, 18 aa, Staphylococcus
KMSNLCTEIFQLQETSVI

SEQ ID NO: 2000390 - protein, 20 aa, Staphylococcus
KMSRRKKTAAKKLLEVSNNT

SEQ ID NO: 2000391 - protein, 17 aa, Staphylococcus
KNASLKFIPMTDEGELR

SEQ ID NO: 2000392 - protein, 18 aa, Staphylococcus
KNDVRIQKVIDLLRDNAK

SEQ ID NO: 2000393 - protein, 25 aa, Staphylococcus
KNETVEAMQGYLMQSIKAELEEIHA

SEQ ID NO: 2000394 - protein, 25 aa, Staphylococcus
KNGKKRISHQMDMIFTHFGVSGPAA

SEQ ID NO: 2000395 - protein, 20 aa, Staphylococcus
KNTMVRRAAEQAGIEGLDEF

SEQ ID NO: 2000396 - protein, 21 aa, Staphylococcus
KNVHKPSGAKPGFVTYDNQKT

SEQ ID NO: 2000397 - protein, 23 aa, Staphylococcus
KNVIRKMSFIYADAVSHRIVDVV

SEQ ID NO: 2000398 - protein, 17 aa, Staphylococcus
KNYKYTLMMGRTHGVHA

SEQ ID NO: 2000399 - protein, 22 aa, Staphylococcus
KPDAKLFILLVGERPEEVTDIE

SEQ ID NO: 2000400 - protein, 19 aa, Staphylococcus
KPDKKGYRKYKIKTVEGPD

SEQ ID NO: 2000401 - protein, 20 aa, Staphylococcus
KPFSPREVVARVKAILRRSK

SEQ ID NO: 2000402 - protein, 21 aa, Staphylococcus
KPFSPREVVARVKAILRRSQF

SEQ ID NO: 2000403 - protein, 20 aa, Staphylococcus
KPGKGSAFVRSKLRNLRTGA

SEQ ID NO: 2000404 - protein, 19 aa, Staphylococcus
KPMLARGELHCIGATTLNE

SEQ ID NO: 2000405 - protein, 27 aa, Staphylococcus
KPMLVAADIYRPAAINQLQTVGKQLDV

SEQ ID NO: 2000406 - protein, 27 aa, Staphylococcus
KPMLVAGDIYRPAAIDQLQTVGKQLDV

SEQ ID NO: 2000407 - protein, 26 aa, Staphylococcus
KPNPLLPEEMRFILKQMGLKEKTIDV

SEQ ID NO: 2000408 - protein, 31 aa, Staphylococcus; identical to SEQ ID NO: 1801450

SEQ ID NO: 2000409 - protein, 19 aa, Staphylococcus
KPRMYRLLEDDALINRMGF

SEQ ID NO: 2000410 - protein, 18 aa, Staphylococcus
KQIRLNINLENWNKEKLY

SEQ ID NO: 2000411 - protein, 20 aa, Staphylococcus
KQLFMPIRVAVTGQMHGPEL

SEQ ID NO: 2000412 - protein, 19 aa, Staphylococcus
KQPLEYPSCGSVFQRPPGH

SEQ ID NO: 2000413 - protein, 24 aa, Staphylococcus
KQQEDYCIILGYFVDGEPKLSYIY

SEQ ID NO: 2000414 - protein, 21 aa, Staphylococcus
KQSYIEYALFHYHFKSRISVW

SEQ ID NO: 2000415 - protein, 36 aa, Staphylococcus
KQYFRMLQRPILYTGLTRAKQSLVLLGDPQAFDIGL

SEQ ID NO: 2000416 - protein, 18 aa, Staphylococcus
KRFNVPEEVYEIFQTTML

SEQ ID NO: 2000417 - protein, 21 aa, Staphylococcus
KRGIEGLVVVGGDGSYRGAQR

SEQ ID NO: 2000418 - protein, 20 aa, Staphylococcus
KRGYPIGQILMPGRDEGKML

SEQ ID NO: 2000419 - protein, 17 aa, Staphylococcus
KRIEAIEYSVKYDDGKH

SEQ ID NO: 2000420 - protein, 17 aa, Staphylococcus
KRIIYHRVVEMLEEGQA

SEQ ID NO: 2000421 - protein, 20 aa, Staphylococcus
KRINDSLARLEMPKVDEELL

SEQ ID NO: 2000422 - protein, 18 aa, Staphylococcus
KRKIIGNEFVYVFDDEAS

SEQ ID NO: 2000423 - protein, 20 aa, Staphylococcus
KRLNQKKAFQVEFGQKGTNL

SEQ ID NO: 2000424 - protein, 25 aa, Staphylococcus
KRPEVVEKIKVARSFGDLSENSEYD

SEQ ID NO: 2000425 - protein, 21 aa, Staphylococcus
KRPIAEIQFADFILPATNQII

SEQ ID NO: 2000426 - protein, 20 aa, Staphylococcus
KRRVYDLLETVGLSKEHANR

SEQ ID NO: 2000427 - protein, 23 aa, Staphylococcus
KRSSGKIAFLQLRDGSGFMQGVV

SEQ ID NO: 2000428 - protein, 26 aa, Staphylococcus
KRSSGKIAFLQLRDGTGFMQGVVVKS

SEQ ID NO: 2000429 - protein, 20 aa, Staphylococcus
KRTYPEFKEESLSFINMLKS

SEQ ID NO: 2000430 - protein, 21 aa, Staphylococcus
KRYLLEETFELFEAIDNEDDW

SEQ ID NO: 2000431 - protein, 24 aa, Staphylococcus
KSALEIVDGLLLNPLVGETKADDI

SEQ ID NO: 2000432 - protein, 18 aa, Staphylococcus
KSIAIAAASIISRYAFVK

SEQ ID NO: 2000433 - protein, 23 aa, Staphylococcus
KSKRPGLDKAIEFARSGDTIVVW

SEQ ID NO: 2000434 - protein, 17 aa, Staphylococcus
KSMTHRAIMLASLATGQ

SEQ ID NO: 2000435 - protein, 18 aa, Staphylococcus
KSQAFDFIIEGDTLIPPF

SEQ ID NO: 2000436 - protein, 25 aa, Staphylococcus
KSRLTGRLSGNIGYVASKVAQETSP

SEQ ID NO: 2000437 - protein, 18 aa, Staphylococcus
KSTTLRMIAGLEEISEGE

SEQ ID NO: 2000438 - protein, 25 aa, Staphylococcus
KTKELSLRLSKELIDTVHEYFNGLY

SEQ ID NO: 2000439 - protein, 18 aa, Staphylococcus
KTKKCLEATIVHYFEPNE

SEQ ID NO: 2000440 - protein, 17 aa, Staphylococcus
KTLTATMPLYLNALTGK

SEQ ID NO: 2000441 - protein, 19 aa, Staphylococcus
KVAELLLERAKRLVEIGQD

SEQ ID NO: 2000442 - protein, 18 aa, Staphylococcus
KVARLICDVFKTDGTPFE

SEQ ID NO: 2000443 - protein, 21 aa, Staphylococcus
KVEEAYNFLKQVSEDGGKVLF

SEQ ID NO: 2000444 - protein, 18 aa, Staphylococcus
KVGNALPLQNIPVGTVIH

SEQ ID NO: 2000445 - protein, 20 aa, Staphylococcus
KVIEIPEGFEVIADSPSTNY

SEQ ID NO: 2000446 - protein, 24 aa, Staphylococcus
KVKVSWAGICGTDLHEYLEGPVFI

SEQ ID NO: 2000447 - protein, 22 aa, Staphylococcus
KVLAGFAGSVADAFTLFEKFET

SEQ ID NO: 2000448 - protein, 23 aa, Staphylococcus
KVLKEKYPNVEIVAIEPEGSPVL

SEQ ID NO: 2000449 - protein, 20 aa, Staphylococcus
KVQKDWRNKVNFIRQIGYIE

SEQ ID NO: 2000450 - protein, 26 aa, Staphylococcus
KVVKGGRRFRFTALVVVGDKKGRVGF

SEQ ID NO: 2000451 - protein, 19 aa, Staphylococcus
KVYRNLIEFLNQFDTSIAT

SEQ ID NO: 2000452 - protein, 18 aa, Staphylococcus
KWYAEKDFASLLHEDLKI

SEQ ID NO: 2000453 - protein, 18 aa, Staphylococcus
KWYAEKDFASLLHEDLRI

SEQ ID NO: 2000454 - protein, 23 aa, Staphylococcus
KYEVMSIPTLIVFKDGQPVDKVV

SEQ ID NO: 2000455 - protein, 21 aa, Staphylococcus
KYKKRSVLEGSFVINMTPFFK

SEQ ID NO: 2000456 - protein, 18 aa, Staphylococcus
KYLFEDAYFKKMSAEAKI

SEQ ID NO: 2000457 - protein, 26 aa, Staphylococcus
KYVKGPDFPTGGIIQGIDGIKKAYET

SEQ ID NO: 2000458 - protein, 26 aa, Staphylococcus
KYYVSHQWFPLGAVHGLKYWFNYTSD

SEQ ID NO: 2000459 - protein, 19 aa, Staphylococcus
LAACSGFMYSMITAKQYIQ

SEQ ID NO: 2000460 - protein, 18 aa, Staphylococcus
LAACSGFMYSMITAKQYV

SEQ ID NO: 2000461 - protein, 20 aa, Staphylococcus
LAEIQIRTLAMNFWATIEHT

SEQ ID NO: 2000462 - protein, 26 aa, Staphylococcus
LAEMKRLGLPVPDGFTITTEACIEYL

SEQ ID NO: 2000463 - protein, 17 aa, Staphylococcus
LAGLRAIPNMNVIRPAD

SEQ ID NO: 2000464 - protein, 19 aa, Staphylococcus
LAGQLYSEFKEFFPENRVE

SEQ ID NO: 2000465 - protein, 17 aa, Staphylococcus
LAGVGRKTANVVMSVAF

SEQ ID NO: 2000466 - protein, 22 aa, Staphylococcus
LALKEEGYRVILVNSNPATIMT

SEQ ID NO: 2000467 - protein, 18 aa, Staphylococcus
LANILIAAGYDVTREYYI

SEQ ID NO: 2000468 - protein, 18 aa, Staphylococcus
LANILIAAGYNVTREYYI

SEQ ID NO: 2000469 - protein, 17 aa, Staphylococcus
LCGGGRYNGLLELLDGP

SEQ ID NO: 2000470 - protein, 18 aa, Staphylococcus
LCGLERHFKGTVVEAQLT

SEQ ID NO: 2000471 - protein, 18 aa, Staphylococcus
LDAVVLDLMEIFNIDETA

SEQ ID NO: 2000472 - protein, 23 aa, Staphylococcus
LDERFFRCHNSFVVNRHNIESID

SEQ ID NO: 2000473 - protein, 27 aa, Staphylococcus
LDGSRRFLDRVWRLFINEDGSLSNKIV

SEQ ID NO: 2000474 - protein, 20 aa, Staphylococcus
LDIKTLEALEMFMNKYPGII

SEQ ID NO: 2000475 - protein, 18 aa, Staphylococcus
LDKDSVILLEQIRTLDKN

SEQ ID NO: 2000476 - protein, 24 aa, Staphylococcus
LDKERLADMEVWMAFRNDIHEYGQ

SEQ ID NO: 2000477 - protein, 18 aa, Staphylococcus
LDKMKRVISRAVPDAPHE

SEQ ID NO: 2000478 - protein, 17 aa, Staphylococcus
LDLLVSLDFRMTATPLY

SEQ ID NO: 2000479 - protein, 24 aa, Staphylococcus
LDMAKRLLDFGVHPPTIYFPLNVE

SEQ ID NO: 2000480 - protein, 24 aa, Staphylococcus
LDNEIKAKLIIIDEMSMVDTWLFH

SEQ ID NO: 2000481 - protein, 23 aa, Staphylococcus
LDPNLPIDLIIDYAHTADGMNKL

SEQ ID NO: 2000482 - protein, 23 aa, Staphylococcus
LDQIMRMLHPFMPFVTEKIWQSL

SEQ ID NO: 2000483 - protein, 17 aa, Staphylococcus
LDTEAEIAYIKESMQPP

SEQ ID NO: 2000484 - protein, 18 aa, Staphylococcus
LDYLKYAKDYGFSDRVIA

SEQ ID NO: 2000485 - protein, 17 aa, Staphylococcus
LEAITFDELVGIQDMGA

SEQ ID NO: 2000486 - protein, 17 aa, Staphylococcus
LEAYQLMTSKEGVFSEP

SEQ ID NO: 2000487 - protein, 17 aa, Staphylococcus
LEDGRLNVILMVGVNGV

SEQ ID NO: 2000488 - protein, 21 aa, Staphylococcus
LEEPPAHAIFILATTEPHKIP

SEQ ID NO: 2000489 - protein, 18 aa, Staphylococcus
LEEPPENTIAILLSTKPE

SEQ ID NO: 2000490 - protein, 20 aa, Staphylococcus
LEEQLKFLLIPKDPNDEKDV

SEQ ID NO: 2000491 - protein, 21 aa, Staphylococcus
LEGALTRLLAYSKLQGKPITT

SEQ ID NO: 2000492 - protein, 26 aa, Staphylococcus
LEHTGRYAYVITMLRRNGYHVIMGDL

SEQ ID NO: 2000493 - protein, 17 aa, Staphylococcus
LEIVQTISRNHCAYPNH

SEQ ID NO: 2000494 - protein, 23 aa, Staphylococcus
LEKKVASGMSYFITQPVYSKEKI

SEQ ID NO: 2000495 - protein, 22 aa, Staphylococcus
LENDELWPRHATMIHGDLHPGH

SEQ ID NO: 2000496 - protein, 19 aa, Staphylococcus
LERDFKLTILPTLTPLGID

SEQ ID NO: 2000497 - protein, 19 aa, Staphylococcus
LERTVAWISGVEHVRETAP

SEQ ID NO: 2000498 - protein, 17 aa, Staphylococcus
LESLAGVGRKTANVVMS

SEQ ID NO: 2000499 - protein, 19 aa, Staphylococcus
LESRMNLLNNLKRKYGKDI

SEQ ID NO: 2000500 - protein, 19 aa, Staphylococcus
LESRMNLLNNLKRKYGKDV

SEQ ID NO: 2000501 - protein, 33 aa, Staphylococcus
LETTKWLEDYLKYFKGAIIIISHDRYFLDKIVT

SEQ ID NO: 2000502 - protein, 18 aa, Staphylococcus
LFDMELIVFMGREDIKRQ

SEQ ID NO: 2000503 - protein, 17 aa, Staphylococcus
LFEPSDVLSEPYVIVCL

SEQ ID NO: 2000504 - protein, 18 aa, Staphylococcus
LFGGPLYTFHKILSIVNL

SEQ ID NO: 2000505 - protein, 20 aa, Staphylococcus
LFHDLGWKTVVGFQTRNPVH

SEQ ID NO: 2000506 - protein, 17 aa, Staphylococcus
LFIDEIHRLSSVVEEVL

SEQ ID NO: 2000507 - protein, 18 aa, Staphylococcus
LFIDHGMGVVIGETCTIG

SEQ ID NO: 2000508 - protein, 24 aa, Staphylococcus
LFILGETLYNFGLTPQGLEVFRTL

SEQ ID NO: 2000509 - protein, 25 aa, Staphylococcus
LFILGETLYNFGLTPQGLEVFRTLY

SEQ ID NO: 2000510 - protein, 19 aa, Staphylococcus
LFVLLCIANSLDIDMTESF

SEQ ID NO: 2000511 - protein, 19 aa, Staphylococcus
LGAHDGVGIVYGRDITGKK

SEQ ID NO: 2000512 - protein, 27 aa, Staphylococcus
LGAIPYEHPLFLGMGGMHGSYASNMAL

SEQ ID NO: 2000513 - protein, 24 aa, Staphylococcus
LGFRGEALASISSVAKVTLKTCTD

SEQ ID NO: 2000514 - protein, 37 aa, Staphylococcus; identical to SEQ ID NO: 1800419

SEQ ID NO: 2000515 - protein, 17 aa, Staphylococcus
LGGVCLNVGCIPSKALL

SEQ ID NO: 2000516 - protein, 20 aa, Staphylococcus
LGHACGHNIIGTASVLAGSA

SEQ ID NO: 2000517 - protein, 19 aa, Staphylococcus
LGIHAGRLSYEAGRIPVKY

SEQ ID NO: 2000518 - protein, 20 aa, Staphylococcus
LGKEGVLCLLSDSTNALVPD

SEQ ID NO: 2000519 - protein, 18 aa, Staphylococcus
LGKSQSFIANKLRLLKLA

SEQ ID NO: 2000520 - protein, 19 aa, Staphylococcus
LGKTFSKGLLMGARGNSGV

SEQ ID NO: 2000521 - protein, 18 aa, Staphylococcus
LGVEGLKILKNVKDKFNL

SEQ ID NO: 2000522 - protein, 18 aa, Staphylococcus
LGVGQFASVSGRYYAMDR

SEQ ID NO: 2000523 - protein, 22 aa, Staphylococcus
LGYGDMLYLGSGMNKPIRVQGT

SEQ ID NO: 2000524 - protein, 19 aa, Staphylococcus
LHAFFKPEILNRMDDIVLF

SEQ ID NO: 2000525 - protein, 19 aa, Staphylococcus
LHAYFKPEILNRMDDIVLF

SEQ ID NO: 2000526 - protein, 21 aa, Staphylococcus
LIARHSLKVDAGVIAIQKSIL

SEQ ID NO: 2000527 - protein, 18 aa, Staphylococcus
LIDDLSLEYNRARQAAIT

SEQ ID NO: 2000528 - protein, 17 aa, Staphylococcus
LIGALLIGINAAKALAF

SEQ ID NO: 2000529 - protein, 18 aa, Staphylococcus
LIGGKGRRANLYGLFNKA

SEQ ID NO: 2000530 - protein, 26 aa, Staphylococcus
LIKANIPTRIAFMVSSSVDSRTIIDS

SEQ ID NO: 2000531 - protein, 28 aa, Staphylococcus
LINKGVAFCPHCDGPLFENKNVAVIGGG

SEQ ID NO: 2000532 - protein, 21 aa, Staphylococcus
LISEEMRLMYVALTRAKEQLI

SEQ ID NO: 2000533 - protein, 17 aa, Staphylococcus
LKDGAKVSHLSYIGDAE

SEQ ID NO: 2000534 - protein, 21 aa, Staphylococcus
LKIDLHIAREMEIEQAPSLVF

SEQ ID NO: 2000535 - protein, 17 aa, Staphylococcus
LKIPTIIHESDLTPGLA

SEQ ID NO: 2000536 - protein, 17 aa, Staphylococcus
LKISFNSKYMMDALKAI

SEQ ID NO: 2000537 - protein, 21 aa, Staphylococcus
LKKANAFGMLNAMEHQTGHIN

SEQ ID NO: 2000538 - protein, 20 aa, Staphylococcus
LKLQKERGITFLFIAHDLSM

SEQ ID NO: 2000539 - protein, 20 aa, Staphylococcus
LKLTTRQTFQFHGILKRNLK

SEQ ID NO: 2000540 - protein, 20 aa, Staphylococcus
LKNILKYYYGTLIIVSHDRA

SEQ ID NO: 2000541 - protein, 25 aa, Staphylococcus
LKNNIKKAWWQKFITQSPYNVGIDA

SEQ ID NO: 2000542 - protein, 18 aa, Staphylococcus
LKPGETIHLGMQLADCHL

SEQ ID NO: 2000543 - protein, 17 aa, Staphylococcus
LKPKSGQIFLQDKLLNQ

SEQ ID NO: 2000544 - protein, 25 aa, Staphylococcus
LKQKIKCPYCHSTLTNMTVRKPDHS

SEQ ID NO: 2000545 - protein, 21 aa, Staphylococcus
LKSFHSCGVYGMAAITSIVAQ

SEQ ID NO: 2000546 - protein, 26 aa, Staphylococcus
LKSLKDHFYRYSLKLRQKVKTITIDM

SEQ ID NO: 2000547 - protein, 19 aa, Staphylococcus
LKTFRQLGVDYEMDKLKKD

SEQ ID NO: 2000548 - protein, 19 aa, Staphylococcus
LKYTIVHPGALTNEHETQQ

SEQ ID NO: 2000549 - protein, 24 aa, Staphylococcus
LLASKFKNLCVVGDSDQSIYGWRG

SEQ ID NO: 2000550 - protein, 17 aa, Staphylococcus
LLCAKKIGATFIGTLTG

SEQ ID NO: 2000551 - protein, 17 aa, Staphylococcus
LLKGVVRGIGGYGNCIG

SEQ ID NO: 2000552 - protein, 17 aa, Staphylococcus
LLPNIPHVAVFDTSFHQ

SEQ ID NO: 2000553 - protein, 27 aa, Staphylococcus
LLRTFSKAYGLAGLRVGYVVATNEAIE

SEQ ID NO: 2000554 - protein, 24 aa, Staphylococcus
LLVEKKLSHMRIHSINIKEFETNC

SEQ ID NO: 2000555 - protein, 26 aa, Staphylococcus
LMAGAAIMGMRFHLVCPKELNPTDEL

SEQ ID NO: 2000556 - protein, 19 aa, Staphylococcus
LNDYAKIIMSHNVTAQVRR

SEQ ID NO: 2000557 - protein, 21 aa, Staphylococcus
LNEFDKIIGVDRIKVVHVNDS

SEQ ID NO: 2000558 - protein, 18 aa, Staphylococcus
LNGSFLPLAHERLDEDGQ

SEQ ID NO: 2000559 - protein, 18 aa, Staphylococcus
LNIMGINTAEEFNERLNA

SEQ ID NO: 2000560 - protein, 18 aa, Staphylococcus
LNIMGINTAEEFNQRLNE

SEQ ID NO: 2000561 - protein, 20 aa, Staphylococcus
LNKGSLAGVDGRLQSRSYEN

SEQ ID NO: 2000562 - protein, 24 aa, Staphylococcus
LNKLLENQQILALESNKKIQKLES

SEQ ID NO: 2000563 - protein, 23 aa, Staphylococcus
LNKRMKWYTVIQSIGMVQWYEEQ

SEQ ID NO: 2000564 - protein, 21 aa, Staphylococcus
LNPDYCIPGPFDKRVAPSVAR

SEQ ID NO: 2000565 - protein, 18 aa, Staphylococcus
LNTPFFIGIMPIASYNNA

SEQ ID NO: 2000566 - protein, 18 aa, Staphylococcus
LNVGCIPSKALLHASHRF

SEQ ID NO: 2000567 - protein, 20 aa, Staphylococcus
LNVGCIPSKALLHASHRFVE

SEQ ID NO: 2000568 - protein, 25 aa, Staphylococcus
LPDAVTRFRQGLGRLIRNEDDKGLI

SEQ ID NO: 2000569 - protein, 17 aa, Staphylococcus
LPDFEKQSIYSLRYDEM

SEQ ID NO: 2000570 - protein, 18 aa, Staphylococcus
LPHAIKTGMIATHETMEL

SEQ ID NO: 2000571 - protein, 18 aa, Staphylococcus
LPHIKVVMLTSFIEDKEV

SEQ ID NO: 2000572 - protein, 18 aa, Staphylococcus
LPKKEVVELKKEYDRLIK

SEQ ID NO: 2000573 - protein, 21 aa, Staphylococcus
LPKYDGFYWCRKMRQVSNVPI

SEQ ID NO: 2000574 - protein, 18 aa, Staphylococcus
LPLTVLLRALGFSTDQEI

SEQ ID NO: 2000575 - protein, 20 aa, Staphylococcus
LPLVKKGGQFIALKSSKGEE

SEQ ID NO: 2000576 - protein, 19 aa, Staphylococcus
LPNHAPLIVAEQFGTMETL

SEQ ID NO: 2000577 - protein, 19 aa, Staphylococcus
LPNHAPLVVAEQFGTLETI

SEQ ID NO: 2000578 - protein, 18 aa, Staphylococcus
LPRIEKMARQKDKTAEME

SEQ ID NO: 2000579 - protein, 17 aa, Staphylococcus
LPSIEIIMWDERLSTMA

SEQ ID NO: 2000580 - protein, 28 aa, Staphylococcus
LPVVNRRAVDWAMRASMALNMDIATNSK

SEQ ID NO: 2000581 - protein, 20 aa, Staphylococcus
LQIPEGVDWNGEEVKVVVGI

SEQ ID NO: 2000582 - protein, 25 aa, Staphylococcus
LQPLYKHRIPVVIKNTNRPQDKGTF

SEQ ID NO: 2000583 - protein, 19 aa, Staphylococcus
LQPPMKGKQILGVDPAFRT

SEQ ID NO: 2000584 - protein, 17 aa, Staphylococcus
LRAVSDFEYELRLTSMN

SEQ ID NO: 2000585 - protein, 17 aa, Staphylococcus
LRHKTLPAFSVQYHPEA

SEQ ID NO: 2000586 - protein, 18 aa, Staphylococcus
LRHKTLPAFSVQYHPEAR

SEQ ID NO: 2000587 - protein, 23 aa, Staphylococcus
LRKRGIEGLVVIGGDGSYRGAQR

SEQ ID NO: 2000588 - protein, 20 aa, Staphylococcus
LRLTDVGYELGMISEERYAR

SEQ ID NO: 2000589 - protein, 18 aa, Staphylococcus
LRLTKGVHIVIDQSKFPL

SEQ ID NO: 2000590 - protein, 20 aa, Staphylococcus
LRPLYDGLNTVLGREQTARF

SEQ ID NO: 2000591 - protein, 20 aa, Staphylococcus
LRRILLSSLPGAAVKYIEIE

SEQ ID NO: 2000592 - protein, 19 aa, Staphylococcus
LRRINRKTALLIQLATEVG

SEQ ID NO: 2000593 - protein, 22 aa, Staphylococcus
LRRTNPERLLETSIKGMLPSSR

SEQ ID NO: 2000594 - protein, 18 aa, Staphylococcus
LRSKCRRLKQEHGLDMIV

SEQ ID NO: 2000595 - protein, 17 aa, Staphylococcus
LRTGAIQEKTFRAGEKV

SEQ ID NO: 2000596 - protein, 19 aa, Staphylococcus
LRVPHGAGGIVLDVKVFNR

SEQ ID NO: 2000597 - protein, 18 aa, Staphylococcus
LSAKELKEGFKDVPQVEL

SEQ ID NO: 2000598 - protein, 18 aa, Staphylococcus
LSAQDSWTLAKHLKTLPV

SEQ ID NO: 2000599 - protein, 25 aa, Staphylococcus
LSDFESLCFHVPFTKMGKKALDSII

SEQ ID NO: 2000600 - protein, 26 aa, Staphylococcus
LSEMKRLGLPVPDGFTITTEACIDYL

SEQ ID NO: 2000601 - protein, 19 aa, Staphylococcus
LSEQFPYIRQLLDAYHIKH

SEQ ID NO: 2000602 - protein, 19 aa, Staphylococcus
LSFPPVLKAYIDAITVAGK

SEQ ID NO: 2000603 - protein, 19 aa, Staphylococcus
LSGGETFQASLALALGLSE

SEQ ID NO: 2000604 - protein, 25 aa, Staphylococcus
LSGPKRPQDLIFLSDMKKEFEKSVT

SEQ ID NO: 2000605 - protein, 29 aa, Staphylococcus
LSGRVGYHPTWKMILGLFPKEDKIKAMDA

SEQ ID NO: 2000606 - protein, 28 aa, Staphylococcus
LSHALDVADEFDVQIALHADTLNEAGFM

SEQ ID NO: 2000607 - protein, 29 aa, Staphylococcus
LSKGYNMSGFRVGFAVGNKDMIQALKKYQ

SEQ ID NO: 2000608 - protein, 23 aa, Staphylococcus
LSLLDTPTFFFGMRNGETVEIEI

SEQ ID NO: 2000609 - protein, 22 aa, Staphylococcus
LSLLDTPTFLFGMRNGETVEIE

SEQ ID NO: 2000610 - protein, 30 aa, Staphylococcus
LSLLLRRPPGREAYPGDVFYLHSRLLERAA

SEQ ID NO: 2000611 - protein, 22 aa, Staphylococcus
LSNEKYRTWEWNYGRNPKYNFE

SEQ ID NO: 2000612 - protein, 23 aa, Staphylococcus
LSNYKAVEFWKEEGLDRVVLARE

SEQ ID NO: 2000613 - protein, 17 aa, Staphylococcus
LSPYEIETLNQWIDVDQ

SEQ ID NO: 2000614 - protein, 22 aa, Staphylococcus
LSRGCSTEDVYNLSIITAAQTL

SEQ ID NO: 2000615 - protein, 17 aa, Staphylococcus
LSSRYYTNWDTIEKQVN

SEQ ID NO: 2000616 - protein, 21 aa, Staphylococcus
LSTLYRWNKSYKEQGLKGLIY

SEQ ID NO: 2000617 - protein, 25 aa, Staphylococcus
LSVELRPSSLDDLGLEAAFKSYFKQ

SEQ ID NO: 2000618 - protein, 17 aa, Staphylococcus
LSVILPQYVESLIYGTI

SEQ ID NO: 2000619 - protein, 18 aa, Staphylococcus
LSVILPQYVESLIYGTIL

SEQ ID NO: 2000620 - protein, 19 aa, Staphylococcus
LTALYLNDQVMEFDLTPNR

SEQ ID NO: 2000621 - protein, 31 aa, Staphylococcus; identical to SEQ ID NO: 1660774

SEQ ID NO: 2000622 - protein, 20 aa, Staphylococcus
LTEREMEILLLIAKGYSNQE

SEQ ID NO: 2000623 - protein, 19 aa, Staphylococcus
LTIITESVFARFISSIKQE

SEQ ID NO: 2000624 - protein, 23 aa, Staphylococcus
LTKFPGIGKKTARQIVLDLKGKV

SEQ ID NO: 2000625 - protein, 22 aa, Staphylococcus
LTLKIAELFRDSTIPAGLIQIV

SEQ ID NO: 2000626 - protein, 18 aa, Staphylococcus
LVDFVRYEVGEGMEKREE

SEQ ID NO: 2000627 - protein, 25 aa, Staphylococcus
LVMKQLFEHRGLPQLPYISFLRSEY

SEQ ID NO: 2000628 - protein, 29 aa, Staphylococcus
LVPGYEAPCYIAWSGKNRSPLVRVPTSRG

SEQ ID NO: 2000629 - protein, 18 aa, Staphylococcus
LWDKLEISNDDFIRTTEE

SEQ ID NO: 2000630 - protein, 23 aa, Staphylococcus
LYDTCKTLESIGVNLLVIRHSQN

SEQ ID NO: 2000631 - protein, 20 aa, Staphylococcus
LYFNYLISVLRLQRWIPPLQ

SEQ ID NO: 2000632 - protein, 18 aa, Staphylococcus
LYGTMVFEGSMTLDEMRE

SEQ ID NO: 2000633 - protein, 17 aa, Staphylococcus
LYHAYRLAIAPTQSISY

SEQ ID NO: 2000634 - protein, 17 aa, Staphylococcus
LYIYKLAVIANMKLQSL

SEQ ID NO: 2000635 - protein, 17 aa, Staphylococcus
LYIYKLAVISNMRLQSL

SEQ ID NO: 2000636 - protein, 23 aa, Staphylococcus
LYMSKICSYAQGFAQMRKASEDH

SEQ ID NO: 2000637 - protein, 24 aa, Staphylococcus
LYPELPHSEYICFYPMDKRRNETY

SEQ ID NO: 2000638 - protein, 19 aa, Staphylococcus
LYVDEEWKERVRQTIPELP

SEQ ID NO: 2000639 - protein, 18 aa, Staphylococcus
LYYLYDIVDRLVVMEQGA

SEQ ID NO: 2000640 - protein, 18 aa, Staphylococcus
LYYTRNKLLSVEECTSCA

SEQ ID NO: 2000641 - protein, 26 aa, Staphylococcus
MAAFHFDVPCLFAKKAKPSTLKDGFY

SEQ ID NO: 2000642 - protein, 26 aa, Staphylococcus
MADLIKRIDTHLAIDFMDVSSYHGGT

SEQ ID NO: 2000643 - protein, 22 aa, Staphylococcus
MALAAKDIRIEAPIPGTSLVGI

SEQ ID NO: 2000644 - protein, 17 aa, Staphylococcus
MDGRDIGTVVLPDAELK

SEQ ID NO: 2000645 - protein, 25 aa, Staphylococcus
MDYAEYGGSVLLGLDGTVVKAHGGS

SEQ ID NO: 2000646 - protein, 22 aa, Staphylococcus
MDYVKMKPVGLIGNSGGIVSSE

SEQ ID NO: 2000647 - protein, 18 aa, Staphylococcus
MFDCVLPTRIARNGTCMT

SEQ ID NO: 2000648 - protein, 17 aa, Staphylococcus
MGGRIGVSLKQAGYDVT

SEQ ID NO: 2000649 - protein, 38 aa, Staphylococcus
MGHIELAAPVSHIWYFKGIPSRMGLLLDMSPRSLEEVI

SEQ ID NO: 2000650 - protein, 24 aa, Staphylococcus
MGIANKRSIGFGVAKVLDKLGAKL

SEQ ID NO: 2000651 - protein, 22 aa, Staphylococcus
MGKCPNCGAWNQMEEIVEKAAN

SEQ ID NO: 2000652 - protein, 35 aa, Staphylococcus
MGSRISDWNKTGWGEIPMSLGFTYSSNTLMMHLQD

SEQ ID NO: 2000653 - protein, 18 aa, Staphylococcus
MGTYDAIVGINLLREGID

SEQ ID NO: 2000654 - protein, 20 aa, Staphylococcus
MGTYDVIVGINLLREGIDIP

SEQ ID NO: 2000655 - protein, 24 aa, Staphylococcus
MHGDHIFGLPGLLTSRSFQGGEDK

SEQ ID NO: 2000656 - protein, 25 aa, Staphylococcus
MHGDHIFGLPGLLTSRSFQGGENKP

SEQ ID NO: 2000657 - protein, 19 aa, Staphylococcus
MHLDGPTIVAGFLHDVIED

SEQ ID NO: 2000658 - protein, 17 aa, Staphylococcus
MIEAGILDGDKVIVRSQ

SEQ ID NO: 2000659 - protein, 20 aa, Staphylococcus
MIRKEILIVEDIVKPINDMT

SEQ ID NO: 2000660 - protein, 17 aa, Staphylococcus
MIYDRRKDLIISGGENI

SEQ ID NO: 2000661 - protein, 18 aa, Staphylococcus
MKDLLGGKGANLSEMKRL

SEQ ID NO: 2000662 - protein, 18 aa, Staphylococcus
MKEACYAATPAIQLAKDY

SEQ ID NO: 2000663 - protein, 20 aa, Staphylococcus
MKGKNIALIFEKDSTRTRCA

SEQ ID NO: 2000664 - protein, 19 aa, Staphylococcus
MKRIRNLDFQFVIASDLAS

SEQ ID NO: 2000665 - protein, 20 aa, Staphylococcus
MKRIRNLEFQFVIASDLASR

SEQ ID NO: 2000666 - protein, 25 aa, Staphylococcus
MLCGCQGVNGGGWAHYVGQEKCRPI

SEQ ID NO: 2000667 - protein, 28 aa, Staphylococcus
MLDFRLKALKLFYKMPMPQWGGDLSELN

SEQ ID NO: 2000668 - protein, 17 aa, Staphylococcus
MLESIRYVDLVIPENDW

SEQ ID NO: 2000669 - protein, 18 aa, Staphylococcus
MMYLPQYVQALFPDFNHL

SEQ ID NO: 2000670 - protein, 25 aa, Staphylococcus
MNEKDIRAVLGRFLFVQEDVKKIIN

SEQ ID NO: 2000671 - protein, 20 aa, Staphylococcus
MNFTEIVPISALEGLNVDHF

SEQ ID NO: 2000672 - protein, 19 aa, Staphylococcus
MPGLPKKPAALNMDVTEDG

SEQ ID NO: 2000673 - protein, 21 aa, Staphylococcus
MPKTDFPMRGGLPNKEPKIQE

SEQ ID NO: 2000674 - protein, 21 aa, Staphylococcus
MPKTDFPMRGGLPNKEPQIQE

SEQ ID NO: 2000675 - protein, 26 aa, Staphylococcus
MQEGELCFGNEPLLRVEAPLIQAQLI

SEQ ID NO: 2000676 - protein, 17 aa, Staphylococcus
MQKGGVIMDVVNAEQAR

SEQ ID NO: 2000677 - protein, 21 aa, Staphylococcus
MSAGLFIVGRIKGVARPALVV

SEQ ID NO: 2000678 - protein, 23 aa, Staphylococcus
MSMLMTLKGLPLAYNKDMQEDKE

SEQ ID NO: 2000679 - protein, 17 aa, Staphylococcus
MTELRKKALKLTETLEM

SEQ ID NO: 2000680 - protein, 23 aa, Staphylococcus
MTFPHQMMRVVLIEQVYRAFKIM

SEQ ID NO: 2000681 - protein, 22 aa, Staphylococcus
MTRNMIKRVEILFPVEDKEIGK

SEQ ID NO: 2000682 - protein, 25 aa, Staphylococcus
MVFDSKGGFYFTDFRGYSTNPKGGV

SEQ ID NO: 2000683 - protein, 20 aa, Staphylococcus
MVKTTICGTDLHIIKGDTPE

SEQ ID NO: 2000684 - protein, 19 aa, Staphylococcus
MWYYKSAFNTDQMKLIDLV

SEQ ID NO: 2000685 - protein, 19 aa, Staphylococcus
MYLGGGFKGERLNKLYKEN

SEQ ID NO: 2000686 - protein, 19 aa, Staphylococcus
NAITKAGALAANYPFATID

SEQ ID NO: 2000687 - protein, 18 aa, Staphylococcus
NAKDVFKVLKGVLDARKI

SEQ ID NO: 2000688 - protein, 19 aa, Staphylococcus
NCFPVFQILFEKRSLNFKV

SEQ ID NO: 2000689 - protein, 21 aa, Staphylococcus
NDCYAILGLVHTLWKPMPGRF

SEQ ID NO: 2000690 - protein, 22 aa, Staphylococcus
NDCYAILGLVHTLWKPMPGRFK

SEQ ID NO: 2000691 - protein, 25 aa, Staphylococcus
NDFERWSFHLQIYFLAERFKEQKRM

SEQ ID NO: 2000692 - protein, 18 aa, Staphylococcus
NDKRRKGLNDKPVIAEGK

SEQ ID NO: 2000693 - protein, 18 aa, Staphylococcus
NDLLRNFVRRVCNCTGEW

SEQ ID NO: 2000694 - protein, 23 aa, Staphylococcus
NDPRAEGNIELVIMIIEDGTYEM

SEQ ID NO: 2000695 - protein, 25 aa, Staphylococcus
NDRARLKDIIDLFLDSGLGKEAFSI

SEQ ID NO: 2000696 - protein, 21 aa, Staphylococcus
NDTKYGLAGYVIGKDKETLQK

SEQ ID NO: 2000697 - protein, 25 aa, Staphylococcus
NDTTVCILEAMKLFNEIQAEISGEI

SEQ ID NO: 2000698 - protein, 23 aa, Staphylococcus
NDYGMGSSRDWAAKGTNLLGVKT

SEQ ID NO: 2000699 - protein, 24 aa, Staphylococcus
NEDEIRRFLPRKVRTFQLQEAQRL

SEQ ID NO: 2000700 - protein, 24 aa, Staphylococcus
NEGHISTSLVQRHFQIGYNRAARI

SEQ ID NO: 2000701 - protein, 22 aa, Staphylococcus
NEIGIRLKQPIDLQYGDILYQD

SEQ ID NO: 2000702 - protein, 21 aa, Staphylococcus
NEINARLIIIDEMSMVDTWLF

SEQ ID NO: 2000703 - protein, 17 aa, Staphylococcus
NEKLKSRIDSLATQEED

SEQ ID NO: 2000704 - protein, 28 aa, Staphylococcus
NEREPSVLPARFPNLLVNGAAGIAVGMA

SEQ ID NO: 2000705 - protein, 26 aa, Staphylococcus
NESKYCPNCGRLLQYDYIHYNQIGHY

SEQ ID NO: 2000706 - protein, 23 aa, Staphylococcus
NETNAMPGFTAFSMYPSLWENMG

SEQ ID NO: 2000707 - protein, 22 aa, Staphylococcus
NETNAMPGFTSFSMYPSLWENM

SEQ ID NO: 2000708 - protein, 23 aa, Staphylococcus
NFMIRDGRMQKLIAPEKEPITPF

SEQ ID NO: 2000709 - protein, 24 aa, Staphylococcus
NGGLYLEKFIENFRHIEIQIIGDQ

SEQ ID NO: 2000710 - protein, 22 aa, Staphylococcus
NGIIWPKSVTPFDLHLITINPK

SEQ ID NO: 2000711 - protein, 20 aa, Staphylococcus
NGPLDLLLHLIHKYEIDIYD

SEQ ID NO: 2000712 - protein, 23 aa, Staphylococcus
NGYEKRYGLFYVDFDTQERYPKK

SEQ ID NO: 2000713 - protein, 23 aa, Staphylococcus
NGYEKRYGLFYVDFETQERYPKK

SEQ ID NO: 2000714 - protein, 20 aa, Staphylococcus
NGYYDGVTFHRVINDFMVQG

SEQ ID NO: 2000715 - protein, 25 aa, Staphylococcus
NHSFPTPEVKPVIMAFAKSYDRPYD

SEQ ID NO: 2000716 - protein, 17 aa, Staphylococcus
NIDGVYHSIAFANMEDL

SEQ ID NO: 2000717 - protein, 19 aa, Staphylococcus
NIMQPFKVYPNGFPDELIQ

SEQ ID NO: 2000718 - protein, 24 aa, Staphylococcus
NISPVLWKKVKKGLSAGRVQSVAL

SEQ ID NO: 2000719 - protein, 21 aa, Staphylococcus
NKHYISIFINGRYIKNFVLNK

SEQ ID NO: 2000720 - protein, 25 aa, Staphylococcus
NKKKCGRKLLLKSKILFDKVKFLFL

SEQ ID NO: 2000721 - protein, 20 aa, Staphylococcus
NKPILLKRGLSATIEEFTFA

SEQ ID NO: 2000722 - protein, 20 aa, Staphylococcus
NKPILLKRGLSATIEEFTYA

SEQ ID NO: 2000723 - protein, 23 aa, Staphylococcus
NKVAGELLCQYYFTKFGVDTRSV

SEQ ID NO: 2000724 - protein, 18 aa, Staphylococcus
NLGGVCLNVGCIPSKALL

SEQ ID NO: 2000725 - protein, 21 aa, Staphylococcus
NLLESIYTLALAKSHRTSNDK

SEQ ID NO: 2000726 - protein, 25 aa, Staphylococcus
NMAPEYGATCGFFPVDEESLKYMKL

SEQ ID NO: 2000727 - protein, 23 aa, Staphylococcus
NMAPFSIELCGGIHVDNTAEIGL

SEQ ID NO: 2000728 - protein, 18 aa, Staphylococcus
NMAVFSMSVVCKLTELTA

SEQ ID NO: 2000729 - protein, 18 aa, Staphylococcus
NMAVFSMSVVSKLTELSP

SEQ ID NO: 2000730 - protein, 18 aa, Staphylococcus
NMMKLHLVGDEIAKGQGV

SEQ ID NO: 2000731 - protein, 25 aa, Staphylococcus
NNEDRPLALCAALLHDLGHGPFSHS

SEQ ID NO: 2000732 - protein, 21 aa, Staphylococcus
NNGYKVAICEQMEDPKQTKGM

SEQ ID NO: 2000733 - protein, 22 aa, Staphylococcus
NNLRVFKDIGIVKELTYGDASS

SEQ ID NO: 2000734 - protein, 23 aa, Staphylococcus
NNRFKGIIGLVTMKKVREPLEVT

SEQ ID NO: 2000735 - protein, 19 aa, Staphylococcus
NNVDYVFGIPGAKIDYLFN

SEQ ID NO: 2000736 - protein, 39 aa, Staphylococcus
NNVPDWYLDSCLKIKYMFPKAHAAAYVLMAVRIAYFKVH

SEQ ID NO: 2000737 - protein, 20 aa, Staphylococcus
NPLSMKAGIALLEVLEQDGV

SEQ ID NO: 2000738 - protein, 25 aa, Staphylococcus
NPNLKAFAPVREWAWSREEEIDYAI

SEQ ID NO: 2000739 - protein, 21 aa, Staphylococcus
NPNYCGRVINQYGQYENMFPA

SEQ ID NO: 2000740 - protein, 17 aa, Staphylococcus
NPSACFTGFELFVKPAI

SEQ ID NO: 2000741 - protein, 24 aa, Staphylococcus
NPSVIISFYPKFAVHPDHEATAEA

SEQ ID NO: 2000742 - protein, 26 aa, Staphylococcus
NQPYLKKKIELHGTVTVKGKWNRAKQ

SEQ ID NO: 2000743 - protein, 36 aa, Staphylococcus
NQTLKQIKGVIGFKIKVNRLEAAYKLSQTRSEKEKE

SEQ ID NO: 2000744 - protein, 20 aa, Staphylococcus
NRFMHVAEFRRMNANITVEG

SEQ ID NO: 2000745 - protein, 24 aa, Staphylococcus
NRLIPLSEGYIYFKDKPISDYPVY

SEQ ID NO: 2000746 - protein, 19 aa, Staphylococcus
NSIGFRGEASLQYKEKLQE

SEQ ID NO: 2000747 - protein, 18 aa, Staphylococcus
NSINDCYAILGLVHTLWK

SEQ ID NO: 2000748 - protein, 24 aa, Staphylococcus
NSKGACPNCGGKGYIETELAFMGE

SEQ ID NO: 2000749 - protein, 20 aa, Staphylococcus
NTDAMIKYLLPKATVVTPNL

SEQ ID NO: 2000750 - protein, 19 aa, Staphylococcus
NTEDIYAGIEFKEGTEEVK

SEQ ID NO: 2000751 - protein, 19 aa, Staphylococcus
NTEDIYAGIEFKEGTPEVK

SEQ ID NO: 2000752 - protein, 28 aa, Staphylococcus
NTGIGLAFVCAAKGYKAVFTMPETMSQE

SEQ ID NO: 2000753 - protein, 28 aa, Staphylococcus
NTGIGLAFVCAAKGYKAVFTMPETMSSE

SEQ ID NO: 2000754 - protein, 25 aa, Staphylococcus
NTNWPVCGIPEKFYTDHGSDFTSHH

SEQ ID NO: 2000755 - protein, 17 aa, Staphylococcus
NTRNIGIMAHIDAGKTT

SEQ ID NO: 2000756 - protein, 21 aa, Staphylococcus
NVGENQWGLRDWYSVDDIEEK

SEQ ID NO: 2000757 - protein, 18 aa, Staphylococcus
NVQYYTDIVFKHALKRKL

SEQ ID NO: 2000758 - protein, 23 aa, Staphylococcus
NYHLKNKFGQKIFKVALDGGFDC

SEQ ID NO: 2000759 - protein, 24 aa, Staphylococcus
NYLYRPNHPRSFSFIPGPASRLSW

SEQ ID NO: 2000760 - protein, 25 aa, Staphylococcus
PAFIADECRLWITVHYLPNESYEDV

SEQ ID NO: 2000761 - protein, 20 aa, Staphylococcus
PALFDPAPLYGDREFDLGIT

SEQ ID NO: 2000762 - protein, 31 aa, Staphylococcus
PANEGRGYVLRRLLRRAVRFSQSLDINEPFM

SEQ ID NO: 2000763 - protein, 32 aa, Staphylococcus; identical to SEQ ID NO: 1793943

SEQ ID NO: 2000764 - protein, 23 aa, Staphylococcus
PAPRGVPQIEVTFDIDKNGIVNV

SEQ ID NO: 2000765 - protein, 23 aa, Staphylococcus
PAQAYNPLFIYGGVGLGKTHLMH

SEQ ID NO: 2000766 - protein, 24 aa, Staphylococcus
PAQFGGPHCGYFATTKKLMRKVPG

SEQ ID NO: 2000767 - protein, 24 aa, Staphylococcus
PDDVWKERIELLKPYQVNQEMIEK

SEQ ID NO: 2000768 - protein, 21 aa, Staphylococcus
PDHSLRYYVCPQNMNNARFVC

SEQ ID NO: 2000769 - protein, 24 aa, Staphylococcus
PDNSIKAAGGFIIQVMPGAKDETV

SEQ ID NO: 2000770 - protein, 25 aa, Staphylococcus
PDPEIFKATTSFNFDVLSERLQESA

SEQ ID NO: 2000771 - protein, 25 aa, Staphylococcus
PDSLGICIHTSYGAIVYTGEFKFDQ

SEQ ID NO: 2000772 - protein, 20 aa, Staphylococcus
PELEGKLHGMALRVPTKNVS

SEQ ID NO: 2000773 - protein, 17 aa, Staphylococcus
PELPNTIEVLGKDKVLS

SEQ ID NO: 2000774 - protein, 30 aa, Staphylococcus; identical to SEQ ID NO: 1811051

SEQ ID NO: 2000775 - protein, 19 aa, Staphylococcus
PESYLRKFDYLVFPDNVAI

SEQ ID NO: 2000776 - protein, 18 aa, Staphylococcus
PETLKNKRVMSLDMGTVV

SEQ ID NO: 2000777 - protein, 24 aa, Staphylococcus
PFDDEFSGFIFKIQANMDPKHRDR

SEQ ID NO: 2000778 - protein, 18 aa, Staphylococcus
PFDKGLDRVCTNIRIDDR

SEQ ID NO: 2000779 - protein, 24 aa, Staphylococcus
PFDTDFSGFIFKIQANMDPKHRDR

SEQ ID NO: 2000780 - protein, 18 aa, Staphylococcus
PFNDVLLHGLVRAEDGRK

SEQ ID NO: 2000781 - protein, 17 aa, Staphylococcus
PFNGWYMVTEIAVRNFT

SEQ ID NO: 2000782 - protein, 17 aa, Staphylococcus
PFQARRIAFNINIPKES

SEQ ID NO: 2000783 - protein, 19 aa, Staphylococcus
PFQEGRDGFVMGEGAGIVV

SEQ ID NO: 2000784 - protein, 24 aa, Staphylococcus
PFVKQKLIFLIGMAGERDLTKTPE

SEQ ID NO: 2000785 - protein, 23 aa, Staphylococcus
PFVKQKLIFLVGMAGERDMTKTP

SEQ ID NO: 2000786 - protein, 24 aa, Staphylococcus
PGAAVKYIEIEGVLHEFSAIDNVV

SEQ ID NO: 2000787 - protein, 20 aa, Staphylococcus
PGAEGLIFHPYLAGERAPLW

SEQ ID NO: 2000788 - protein, 17 aa, Staphylococcus
PGGSVTAGFAIYDTIQH

SEQ ID NO: 2000789 - protein, 18 aa, Staphylococcus
PGHADLIGGMKYNHRDLR

SEQ ID NO: 2000790 - protein, 26 aa, Staphylococcus
PGKVKMYVCGPTVYNYIHIGNARPAI

SEQ ID NO: 2000791 - protein, 23 aa, Staphylococcus
PGSTFKSYGLAAAIQEGKFKPNE

SEQ ID NO: 2000792 - protein, 17 aa, Staphylococcus
PHLNVYDNIAFGLKLKK

SEQ ID NO: 2000793 - protein, 22 aa, Staphylococcus
PHQKEWERLSGIPIEEQTYERN

SEQ ID NO: 2000794 - protein, 25 aa, Staphylococcus
PIPIKALTSHLGFGNYELRLPLLPL

SEQ ID NO: 2000795 - protein, 20 aa, Staphylococcus
PISGEIIGIMGPNGAGKSSL

SEQ ID NO: 2000796 - protein, 25 aa, Staphylococcus
PIVEKELIQRIGFVIEPENLFSNLK

SEQ ID NO: 2000797 - protein, 19 aa, Staphylococcus
PKDVIIVEGIFALENKTLR

SEQ ID NO: 2000798 - protein, 17 aa, Staphylococcus
PKFLKTGSYLDLIKSVK

SEQ ID NO: 2000799 - protein, 19 aa, Staphylococcus
PKHHTCLITPVNHDTIRTT

SEQ ID NO: 2000800 - protein, 20 aa, Staphylococcus
PKKDRVVVEGVNVIKKHQKP

SEQ ID NO: 2000801 - protein, 21 aa, Staphylococcus
PKKDRVVVEGVNVIKKHQKPT

SEQ ID NO: 2000802 - protein, 18 aa, Staphylococcus
PKKKRMGRYQGYTNKRRK

SEQ ID NO: 2000803 - protein, 29 aa, Staphylococcus
PKLIEHLLEIRGLGIINVMTLFGAGSILT

SEQ ID NO: 2000804 - protein, 19 aa, Staphylococcus
PKMMLKVILYAYTQSVFSG

SEQ ID NO: 2000805 - protein, 18 aa, Staphylococcus
PKNLKNVEDLFIITSTQG

SEQ ID NO: 2000806 - protein, 18 aa, Staphylococcus
PKSGQIFLQDKLLNQYSQ

SEQ ID NO: 2000807 - protein, 22 aa, Staphylococcus
PKWKVHAKDLIAYPKLTGKPAA

SEQ ID NO: 2000808 - protein, 29 aa, Staphylococcus
PLNDVLALAEFERLVLVDSLNDVLVLVES

SEQ ID NO: 2000809 - protein, 24 aa, Staphylococcus
PLRDRFGVHLRLEYYNENDLKEII

SEQ ID NO: 2000810 - protein, 33 aa, Staphylococcus
PLTVDRLTGIVSRGGSIIAQWCLAHHEESFLYT

SEQ ID NO: 2000811 - protein, 26 aa, Staphylococcus
PLVENGRLEGLITIKDIEKVLEFPHA

SEQ ID NO: 2000812 - protein, 18 aa, Staphylococcus
PMCGVPYHSANSYIETLI

SEQ ID NO: 2000813 - protein, 19 aa, Staphylococcus
PMFGTCAGLIVLAKDVEGE

SEQ ID NO: 2000814 - protein, 19 aa, Staphylococcus
PNKEGQFPVVMSADTYGKD

SEQ ID NO: 2000815 - protein, 24 aa, Staphylococcus
PNVTGKLHLGHAWDTTLQDILTRM

SEQ ID NO: 2000816 - protein, 35 aa, Staphylococcus
PPEEWRKSAKYVGLIPRFRRIFLGDKEFNKKRYAK

SEQ ID NO: 2000817 - protein, 22 aa, Staphylococcus
PPGKRMGHAGAIISGGKGTAAE

SEQ ID NO: 2000818 - protein, 27 aa, Staphylococcus
PQDSYLLVRGIKTLGLRMEQINRNVEA

SEQ ID NO: 2000819 - protein, 20 aa, Staphylococcus
PRDGDFFPLMVNYEEKMYAA

SEQ ID NO: 2000820 - protein, 21 aa, Staphylococcus
PRRVSPFFVPMLIPDMATGQV

SEQ ID NO: 2000821 - protein, 24 aa, Staphylococcus
PRSLEEVIYFASYVVVDPGPTGLE

SEQ ID NO: 2000822 - protein, 20 aa, Staphylococcus
PRVSGTSGLQLFDYKFGQTG

SEQ ID NO: 2000823 - protein, 17 aa, Staphylococcus
PRVVSRFGDDSTEENRQ

SEQ ID NO: 2000824 - protein, 19 aa, Staphylococcus
PSCEFFPMEAVKTNIIGTE

SEQ ID NO: 2000825 - protein, 18 aa, Staphylococcus
PSGCGKSTTLRMIAGLEE

SEQ ID NO: 2000826 - protein, 18 aa, Staphylococcus
PSILRLVKQVIEASHKEG

SEQ ID NO: 2000827 - protein, 25 aa, Staphylococcus
PSQMGIRKPEFSSAISTISSSITFD

SEQ ID NO: 2000828 - protein, 24 aa, Staphylococcus
PSSLEQLDLLLLEIPKSRKIHSDG

SEQ ID NO: 2000829 - protein, 22 aa, Staphylococcus
PSSRRYPFVKFTPEREIGNDLL

SEQ ID NO: 2000830 - protein, 18 aa, Staphylococcus
PSYKQVYSIIKAMPKSVI

SEQ ID NO: 2000831 - protein, 21 aa, Staphylococcus
PSYSLKPGQVITVREKSQNLD

SEQ ID NO: 2000832 - protein, 19 aa, Staphylococcus
PTKEIRIAGGREVNLRSLQ

SEQ ID NO: 2000833 - protein, 17 aa, Staphylococcus
PTMKGKNIALIFEKDST

SEQ ID NO: 2000834 - protein, 18 aa, Staphylococcus
PVGRLDYDTSGLLLLTND

SEQ ID NO: 2000835 - protein, 19 aa, Staphylococcus
PVNNGGVILRWLRDEILAS

SEQ ID NO: 2000836 - protein, 17 aa, Staphylococcus
PVVRELPIEDVKRQLRE

SEQ ID NO: 2000837 - protein, 26 aa, Staphylococcus
PYEQRMPKIVIVIDELADLMMMAPQE

SEQ ID NO: 2000838 - protein, 21 aa, Staphylococcus
PYFAGTKVKWILDNVEGAREK

SEQ ID NO: 2000839 - protein, 24 aa, Staphylococcus
PYNDLPHLVSPVITDVKAATQSLK

SEQ ID NO: 2000840 - protein, 29 aa, Staphylococcus
QAFAFKEQVGYPLIVRPAFTMGGTGGGIC

SEQ ID NO: 2000841 - protein, 24 aa, Staphylococcus
QALKDFEGTILFVSHDRYFINQLA

SEQ ID NO: 2000842 - protein, 18 aa, Staphylococcus
QASSLAMAIFFQDMNEEE

SEQ ID NO: 2000843 - protein, 18 aa, Staphylococcus
QCGLPKEMALELFKPFVM

SEQ ID NO: 2000844 - protein, 21 aa, Staphylococcus
QDAHEFCPYSKATRGNIDVDL

SEQ ID NO: 2000845 - protein, 19 aa, Staphylococcus
QDDVFRFETIETREPHAGE

SEQ ID NO: 2000846 - protein, 22 aa, Staphylococcus
QDDYNCFFCIVDQHAITVPQDR

SEQ ID NO: 2000847 - protein, 31 aa, Staphylococcus
QDGRSTADIFGRCLHTYLIKDAIHDGNVLGF

SEQ ID NO: 2000848 - protein, 18 aa, Staphylococcus
QDTICIYVAIGQKDSTVR

SEQ ID NO: 2000849 - protein, 17 aa, Staphylococcus
QDVLLFIDNIFRFTQAG

SEQ ID NO: 2000850 - protein, 26 aa, Staphylococcus
QEAIELAEQMGIIFIDEIDKVATNNQ

SEQ ID NO: 2000851 - protein, 20 aa, Staphylococcus
QEATQIGMAYAMKEGDISSP

SEQ ID NO: 2000852 - protein, 18 aa, Staphylococcus
QEGKRIGKTFDHRNLPDP

SEQ ID NO: 2000853 - protein, 23 aa, Staphylococcus
QEGRRFLFETVVKVNHPKHDLTI

SEQ ID NO: 2000854 - protein, 20 aa, Staphylococcus
QEGRRFLFETVVKVNNPKHD

SEQ ID NO: 2000855 - protein, 19 aa, Staphylococcus
QEKERLLPGGYLFLSDLVG

SEQ ID NO: 2000856 - protein, 17 aa, Staphylococcus
QELAWMRAGAKARTTKQ

SEQ ID NO: 2000857 - protein, 30 aa, Staphylococcus; identical to SEQ ID NO: 1645941

SEQ ID NO: 2000858 - protein, 26 aa, Staphylococcus
QFAEGIEVGQVFKLGTKYSEAMNATF

SEQ ID NO: 2000859 - protein, 29 aa, Staphylococcus
QGDRGDSRFYLSLQDELMVRFGSERLQKM

SEQ ID NO: 2000860 - protein, 27 aa, Staphylococcus
QGFGNAGSFLAKFLYDLGAKVVGISDA

SEQ ID NO: 2000861 - protein, 19 aa, Staphylococcus
QGKYLGVSFHPELTDDYRV

SEQ ID NO: 2000862 - protein, 17 aa, Staphylococcus
QGLFEVLDLPYVGNGVL

SEQ ID NO: 2000863 - protein, 21 aa, Staphylococcus
QGTKLTFLPYVVKALVSALKK

SEQ ID NO: 2000864 - protein, 20 aa, Staphylococcus
QGTLPVGLLPKIIVDDKEYV

SEQ ID NO: 2000865 - protein, 25 aa, Staphylococcus
QIEGRLSDMIKRQRQSILEILAQVE

SEQ ID NO: 2000866 - protein, 19 aa, Staphylococcus
QIFEQRFGVEALYQDAVDI

SEQ ID NO: 2000867 - protein, 18 aa, Staphylococcus
QIGGRRNGALISMDQGQA

SEQ ID NO: 2000868 - protein, 19 aa, Staphylococcus
QIGGRRNGALISMDQGQAT

SEQ ID NO: 2000869 - protein, 20 aa, Staphylococcus
QIHQRLYLEQSLLVERIKKY

SEQ ID NO: 2000870 - protein, 24 aa, Staphylococcus
QIIKEALHKLGFDDGMYDLVKEPL

SEQ ID NO: 2000871 - protein, 22 aa, Staphylococcus
QKEHMIRAALEGVLYNLYTVYL

SEQ ID NO: 2000872 - protein, 23 aa, Staphylococcus
QKIIARTNIKSMGKNVLSKCYGG

SEQ ID NO: 2000873 - protein, 26 aa, Staphylococcus
QKYRELQDIIAILGMDELSEEDKLTV

SEQ ID NO: 2000874 - protein, 26 aa, Staphylococcus
QKYRELQDIIAILGMDELSEEDKQTV

SEQ ID NO: 2000875 - protein, 18 aa, Staphylococcus
QLAYAIGVAEPVSISIDT

SEQ ID NO: 2000876 - protein, 23 aa, Staphylococcus
QLDEIDGLILPGGESTTLRRLMD

SEQ ID NO: 2000877 - protein, 18 aa, Staphylococcus
QLDYLLPRLQGHGKSLSR

SEQ ID NO: 2000878 - protein, 17 aa, Staphylococcus
QLERALMNYMITKHTTQ

SEQ ID NO: 2000879 - protein, 18 aa, Staphylococcus
QLERVYIASVLMLDPKLI

SEQ ID NO: 2000880 - protein, 24 aa, Staphylococcus
QLREAGVEYKVYKNTMVRRAAEQA

SEQ ID NO: 2000881 - protein, 28 aa, Staphylococcus
QLTLKRKARLKNVFMVFQDVHRQLFAED

SEQ ID NO: 2000882 - protein, 24 aa, Staphylococcus
QNHMLQMVALLAMEAPISLKSEDI

SEQ ID NO: 2000883 - protein, 24 aa, Staphylococcus
QNHMLQMVALLAMEAPISLNSEDI

SEQ ID NO: 2000884 - protein, 24 aa, Staphylococcus
QNLLLDPYFKGIVTEYQDALRDVV

SEQ ID NO: 2000885 - protein, 23 aa, Staphylococcus
QNYWKTFASQWLKDLNINEENMR

SEQ ID NO: 2000886 - protein, 17 aa, Staphylococcus
QPDLCMFTGDQIWSQGV

SEQ ID NO: 2000887 - protein, 24 aa, Staphylococcus
QPIRLEPMSTFPVIRDLQVDRSRM

SEQ ID NO: 2000888 - protein, 30 aa, Staphylococcus; identical to SEQ ID NO: 1647747

SEQ ID NO: 2000889 - protein, 30 aa, Staphylococcus; identical to SEQ ID NO: 1671869

SEQ ID NO: 2000890 - protein, 18 aa, Staphylococcus
QPPMKGKQILGVDPAFRT

SEQ ID NO: 2000891 - protein, 19 aa, Staphylococcus
QQLAKRKNASLKFIPMTDE

SEQ ID NO: 2000892 - protein, 25 aa, Staphylococcus
QQLNVFRMELLGAKVVSVEEGQGTL

SEQ ID NO: 2000893 - protein, 23 aa, Staphylococcus
QRQRVALGRAIVRDAKIFLMDEP

SEQ ID NO: 2000894 - protein, 17 aa, Staphylococcus
QRRKHLKQNIASPSTTE

SEQ ID NO: 2000895 - protein, 31 aa, Staphylococcus; identical to SEQ ID NO: 1647752

SEQ ID NO: 2000896 - protein, 32 aa, Staphylococcus
QRVANKLKLGTVWINDFHPYFAQAPWGGYKQS

SEQ ID NO: 2000897 - protein, 17 aa, Staphylococcus
QSAERLGFPEARIPLSQ

SEQ ID NO: 2000898 - protein, 18 aa, Staphylococcus
QSAFDIIGPVMMGPSSSH

SEQ ID NO: 2000899 - protein, 19 aa, Staphylococcus
QSIDELIELFKSYDQILFS

SEQ ID NO: 2000900 - protein, 23 aa, Staphylococcus
QSLKVANGLQVERLLRQNEEIKK

SEQ ID NO: 2000901 - protein, 17 aa, Staphylococcus
QSLYNMFAAIPGVKVVV

SEQ ID NO: 2000902 - protein, 22 aa, Staphylococcus
QSQVQFVGFVGEHSRYDLMLVQ

SEQ ID NO: 2000903 - protein, 19 aa, Staphylococcus
QSYSYLIFVEETWSMLHEN

SEQ ID NO: 2000904 - protein, 24 aa, Staphylococcus
QTFKRQIQELGFSYDWDREVNTTD

SEQ ID NO: 2000905 - protein, 25 aa, Staphylococcus
QTHELGIPVMILFEGVPASGKTRLS

SEQ ID NO: 2000906 - protein, 25 aa, Staphylococcus
QTYNFKNAIIATGSRPIEIPNFEFG

SEQ ID NO: 2000907 - protein, 23 aa, Staphylococcus
QVNDIRVGKVLYMTVDEATDEAV

SEQ ID NO: 2000908 - protein, 18 aa, Staphylococcus
RAAAGGDEAAIFAGDLLR

SEQ ID NO: 2000909 - protein, 18 aa, Staphylococcus
RAAAGGDEAAIFAGDLMR

SEQ ID NO: 2000910 - protein, 17 aa, Staphylococcus
RAFKSVDTPAIFMDHAE

SEQ ID NO: 2000911 - protein, 17 aa, Staphylococcus
RAFKSVDTPAIFMDHGE

SEQ ID NO: 2000912 - protein, 20 aa, Staphylococcus
RAIATYELYIAALKLGIAII

SEQ ID NO: 2000913 - protein, 26 aa, Staphylococcus
RAIRIQAKIASLVTAFARVREGKEPV

SEQ ID NO: 2000914 - protein, 18 aa, Staphylococcus
RAKYAGIEQPTMKGKNIA

SEQ ID NO: 2000915 - protein, 20 aa, Staphylococcus
RANIGHNWWVVNQSLVTLNQ

SEQ ID NO: 2000916 - protein, 18 aa, Staphylococcus
RATYEFFNDNGFTKIDPP

SEQ ID NO: 2000917 - protein, 20 aa, Staphylococcus
RAVKPPVIYGDVKWTEPLTV

SEQ ID NO: 2000918 - protein, 24 aa, Staphylococcus
RCNFRCDYCMPKEIFGDDFVFLPK

SEQ ID NO: 2000919 - protein, 28 aa, Staphylococcus
RDETDRTGLRIAIELKKDVNSESIKNYL

SEQ ID NO: 2000920 - protein, 23 aa, Staphylococcus
RDETSLRTGVRVVIDVRKDANAN

SEQ ID NO: 2000921 - protein, 23 aa, Staphylococcus
RDGEISAPIVIGRDHLDSGSVAS

SEQ ID NO: 2000922 - protein, 18 aa, Staphylococcus
RDHLEEIYAHTFKAEDAL

SEQ ID NO: 2000923 - protein, 19 aa, Staphylococcus
RDISCNLGSLNIVNVMESG

SEQ ID NO: 2000924 - protein, 24 aa, Staphylococcus
RDNHSAYAFIKRLIKQFGKPQKVV

SEQ ID NO: 2000925 - protein, 19 aa, Staphylococcus
RDTSWIYDADFEKLSNQDI

SEQ ID NO: 2000926 - protein, 24 aa, Staphylococcus
READFINCVVFRKQAENVNNYLFK

SEQ ID NO: 2000927 - protein, 17 aa, Staphylococcus
REEEIDYAIKHNIPVSI

SEQ ID NO: 2000928 - protein, 19 aa, Staphylococcus
REEPLDHVLLFGPPGLGKT

SEQ ID NO: 2000929 - protein, 18 aa, Staphylococcus
REEVDAFLDDIIADYQKM

SEQ ID NO: 2000930 - protein, 23 aa, Staphylococcus
REGELVARLILDKVGNKKPIQRL

SEQ ID NO: 2000931 - protein, 19 aa, Staphylococcus
REIFSSGKSICRINNQIVT

SEQ ID NO: 2000932 - protein, 25 aa, Staphylococcus
REKLKQPRSAVCFDAPSWYELVVEG

SEQ ID NO: 2000933 - protein, 19 aa, Staphylococcus
RERGCSNGDIVRILGGEFE

SEQ ID NO: 2000934 - protein, 24 aa, Staphylococcus
RERPMDRLLCGDVGYGKTEVAVRA

SEQ ID NO: 2000935 - protein, 19 aa, Staphylococcus
RFGDPEAQVLLSRLESDLM

SEQ ID NO: 2000936 - protein, 22 aa, Staphylococcus
RFGSERLQKMMGRLGMDDSTPI

SEQ ID NO: 2000937 - protein, 18 aa, Staphylococcus
RFLKERKSGSAVRLEVDG

SEQ ID NO: 2000938 - protein, 19 aa, Staphylococcus
RFSIEGVDTLVPMLQHTLK

SEQ ID NO: 2000939 - protein, 25 aa, Staphylococcus
RGAEVDRLVKGCTGVKRTTGQHPGG

SEQ ID NO: 2000940 - protein, 21 aa, Staphylococcus
RGGHIDLAILGGMEVSETGDL

SEQ ID NO: 2000941 - protein, 20 aa, Staphylococcus
RGGRGNSRFATPRNPAPDFS

SEQ ID NO: 2000942 - protein, 21 aa, Staphylococcus
RGGRGNSRFATPRNPAPDFSE

SEQ ID NO: 2000943 - protein, 22 aa, Staphylococcus
RGICCLKPGIPGISENIEVVSI

SEQ ID NO: 2000944 - protein, 20 aa, Staphylococcus
RGICCLKPGVPGISENIEVV

SEQ ID NO: 2000945 - protein, 18 aa, Staphylococcus
RGQTAILFDEVDSGVSGQ

SEQ ID NO: 2000946 - protein, 19 aa, Staphylococcus
RGSGKICLNGAASRLVEVD

SEQ ID NO: 2000947 - protein, 21 aa, Staphylococcus
RHGQTMFNLRGKVQGASDSPL

SEQ ID NO: 2000948 - protein, 25 aa, Staphylococcus
RIASPEFMFPSFYGIDVSTTAELIS

SEQ ID NO: 2000949 - protein, 26 aa, Staphylococcus
RIASPEFMFPSFYGIDVSTTAELISA

SEQ ID NO: 2000950 - protein, 19 aa, Staphylococcus
RIEWKEVLAGQKAYDETGE

SEQ ID NO: 2000951 - protein, 21 aa, Staphylococcus
RIREVNYLTGEVIREREHFAI

SEQ ID NO: 2000952 - protein, 19 aa, Staphylococcus
RKALSEADLILFVLNNNEP

SEQ ID NO: 2000953 - protein, 17 aa, Staphylococcus
RKCIISNEMHPKKDMIR

SEQ ID NO: 2000954 - protein, 19 aa, Staphylococcus
RKDMDALTEFVNIYGAKGL

SEQ ID NO: 2000955 - protein, 19 aa, Staphylococcus
RKDMDGLTEFVNIYGAKGL

SEQ ID NO: 2000956 - protein, 21 aa, Staphylococcus
RKIIEGFKHLTPNTNQYRTVM

SEQ ID NO: 2000957 - protein, 20 aa, Staphylococcus
RKKYEMPIIMLTAKDSEIDK

SEQ ID NO: 2000958 - protein, 25 aa, Staphylococcus
RKQKLEPAYSFMIRVRVPGGKATPE

SEQ ID NO: 2000959 - protein, 19 aa, Staphylococcus
RKREFYEKPSVKRKKKSEA

SEQ ID NO: 2000960 - protein, 18 aa, Staphylococcus
RLALLEADVNFKVVKEFV

SEQ ID NO: 2000961 - protein, 20 aa, Staphylococcus
RLFIDHGMGVVIGETCTIGD

SEQ ID NO: 2000962 - protein, 31 aa, Staphylococcus; identical to SEQ ID NO: 1794023

SEQ ID NO: 2000963 - protein, 20 aa, Staphylococcus
RLQPEHFEDIVAVTSLYRPG

SEQ ID NO: 2000964 - protein, 26 aa, Staphylococcus
RLREEMYDIAGLRMMCQFVDDIDVVV

SEQ ID NO: 2000965 - protein, 18 aa, Staphylococcus
RLTKPLVRKNGEFHEVEW

SEQ ID NO: 2000966 - protein, 18 aa, Staphylococcus
RLVEIGQDVIILMDSITR

SEQ ID NO: 2000967 - protein, 19 aa, Staphylococcus
RLVGYNISPVLWKKVKKGL

SEQ ID NO: 2000968 - protein, 17 aa, Staphylococcus
RMFEYGGGFVQDRSIYE

SEQ ID NO: 2000969 - protein, 21 aa, Staphylococcus
RMHAKGSGAFGTFTVTNDITK

SEQ ID NO: 2000970 - protein, 21 aa, Staphylococcus
RMHAKGSGAFGTFTVTNDITQ

SEQ ID NO: 2000971 - protein, 23 aa, Staphylococcus
RMKRAQKLFGQKSHVFDIRKHEM

SEQ ID NO: 2000972 - protein, 19 aa, Staphylococcus
RNGKKYSDMAILYRTNAQS

SEQ ID NO: 2000973 - protein, 18 aa, Staphylococcus
RNGKVLAEDVERYKVVAV

SEQ ID NO: 2000974 - protein, 24 aa, Staphylococcus
RNGPTGTVKLHFMKQYNKFTDIDY

SEQ ID NO: 2000975 - protein, 24 aa, Staphylococcus
RNLDKGVAFGAMFSDSEDLMHQKN

SEQ ID NO: 2000976 - protein, 17 aa, Staphylococcus
RNMKLEFERNYERYQFL

SEQ ID NO: 2000977 - protein, 19 aa, Staphylococcus
RNNPIRTFMCDDCKSRLDT

SEQ ID NO: 2000978 - protein, 21 aa, Staphylococcus
RNVHKPSGAKPGFVTYDNQKT

SEQ ID NO: 2000979 - protein, 26 aa, Staphylococcus
RPAENFKEAVQWLYLAYLAAIKEQNG

SEQ ID NO: 2000980 - protein, 19 aa, Staphylococcus
RPGHADLIGGMKYNHRDLR

SEQ ID NO: 2000981 - protein, 27 aa, Staphylococcus
RPKHIYSIYRKMMKQKKQFDQIFDLLA

SEQ ID NO: 2000982 - protein, 19 aa, Staphylococcus
RPLSASKRFRLVEIVEESV

SEQ ID NO: 2000983 - protein, 17 aa, Staphylococcus
RPPEPYKGKGIRYQGEY

SEQ ID NO: 2000984 - protein, 19 aa, Staphylococcus
RPPVSNIDGLVIVMSAVEP

SEQ ID NO: 2000985 - protein, 19 aa, Staphylococcus
RPQSIPQDDVFRFETIETR

SEQ ID NO: 2000986 - protein, 17 aa, Staphylococcus
RPTHSSIYEIQRAQQEL

SEQ ID NO: 2000987 - protein, 20 aa, Staphylococcus
RPVIRTLRRLAAFIENTMTY

SEQ ID NO: 2000988 - protein, 26 aa, Staphylococcus
RQQLNVFRMELLGAKVEAVDEGQGTL

SEQ ID NO: 2000989 - protein, 24 aa, Staphylococcus
RQVREFCTKIAWIEGGKLKEFGEL

SEQ ID NO: 2000990 - protein, 17 aa, Staphylococcus
RRIKQLGTLYLSFHTAE

SEQ ID NO: 2000991 - protein, 20 aa, Staphylococcus
RRLYDGKVLAGFAGSVADAF

SEQ ID NO: 2000992 - protein, 25 aa, Staphylococcus
RRQAKAVNFGIVYGISDYGLSQSLN

SEQ ID NO: 2000993 - protein, 22 aa, Staphylococcus
RRSHNQRFLIVFSDGEPSAYNY

SEQ ID NO: 2000994 - protein, 19 aa, Staphylococcus
RRSLQIYGFSPCQEISIML

SEQ ID NO: 2000995 - protein, 21 aa, Staphylococcus
RRWGAPFPVIEIVKRGINKAR

SEQ ID NO: 2000996 - protein, 23 aa, Staphylococcus
RSAFYKYRETIFPVDEKMLDHRE

SEQ ID NO: 2000997 - protein, 17 aa, Staphylococcus
RSELLRKLVDVQYSRND

SEQ ID NO: 2000998 - protein, 18 aa, Staphylococcus
RSLQWGNDAYTMILDRLN

SEQ ID NO: 2000999 - protein, 23 aa, Staphylococcus
RSMRKKLPFGIGQIGKSFRNEIT

SEQ ID NO: 2001000 - protein, 19 aa, Staphylococcus
RSNTGTCYNQRPIVSVGDV

SEQ ID NO: 2001001 - protein, 19 aa, Staphylococcus
RSRWKGIRPTVRGSVMNPN

SEQ ID NO: 2001002 - protein, 24 aa, Staphylococcus
RSVKSCVGKEFCRFGTQYTTRLGI

SEQ ID NO: 2001003 - protein, 25 aa, Staphylococcus
RSVKSCVGKEFCRFGTQYTTRLGIR

SEQ ID NO: 2001004 - protein, 29 aa, Staphylococcus
RTNVPAIFCSGGPMKAGLSAHGKALTLSS

SEQ ID NO: 2001005 - protein, 24 aa, Staphylococcus
RTRTYNNLVNLEWIYKERPQDDER

SEQ ID NO: 2001006 - protein, 23 aa, Staphylococcus
RTTVENGVPCLTSLDTANALTNV

SEQ ID NO: 2001007 - protein, 23 aa, Staphylococcus
RTTVENGVPCLTSLDTASALTNV

SEQ ID NO: 2001008 - protein, 25 aa, Staphylococcus
RVLPNWTTCVSICALFRDSDVLNNT

SEQ ID NO: 2001009 - protein, 18 aa, Staphylococcus
RVQDPLSELVKIDPKSIG

SEQ ID NO: 2001010 - protein, 18 aa, Staphylococcus
RYDLMLVQTDRHYGKTLV

SEQ ID NO: 2001011 - protein, 20 aa, Staphylococcus
RYDPNQCILCGRCVEACQDI

SEQ ID NO: 2001012 - protein, 19 aa, Staphylococcus
RYPSIPFYLQVGNPYLEDE

SEQ ID NO: 2001013 - protein, 21 aa, Staphylococcus
SAAIKPWILPNFESLVNHEKI

SEQ ID NO: 2001014 - protein, 19 aa, Staphylococcus
SAGLFIVGRIKGVARPALV

SEQ ID NO: 2001015 - protein, 20 aa, Staphylococcus
SALIKWFNTNYHYIVPEWDN

SEQ ID NO: 2001016 - protein, 24 aa, Staphylococcus
SALQHAASVAAMFLTTEAVVANIP

SEQ ID NO: 2001017 - protein, 24 aa, Staphylococcus
SALQHAASVAAMFLTTEAVVATIP

SEQ ID NO: 2001018 - protein, 20 aa, Staphylococcus
SAPLKALIFDSEYDPYRGVI

SEQ ID NO: 2001019 - protein, 22 aa, Staphylococcus
SDAPIAFQEFMILPVGAESFKE

SEQ ID NO: 2001020 - protein, 28 aa, Staphylococcus
SDDYRYFPEPDIVPLYVDDEWKERVRQT

SEQ ID NO: 2001021 - protein, 29 aa, Staphylococcus
SDDYRYFPEPDIVPLYVDEEWKERVRQTI

SEQ ID NO: 2001022 - protein, 19 aa, Staphylococcus
SDELICLGNKGLLAQGRPK

SEQ ID NO: 2001023 - protein, 18 aa, Staphylococcus
SDGEVIRISVPALTEERR

SEQ ID NO: 2001024 - protein, 19 aa, Staphylococcus
SDIKVVLNGAGAAGIAIVK

SEQ ID NO: 2001025 - protein, 18 aa, Staphylococcus
SDKTAFFLNGYVNEYDDT

SEQ ID NO: 2001026 - protein, 20 aa, Staphylococcus
SDKTAFFLNGYVNEYDDTDK

SEQ ID NO: 2001027 - protein, 29 aa, Staphylococcus
SDLIPELQGRFPIRVELESLTVNDFYRIL

SEQ ID NO: 2001028 - protein, 17 aa, Staphylococcus
SDLPFSWVYDENGITET

SEQ ID NO: 2001029 - protein, 18 aa, Staphylococcus
SDMKTEFEKSVTAPAGNQ

SEQ ID NO: 2001030 - protein, 28 aa, Staphylococcus
SDMYLHPDLDTWVIFPWTAGQGKVARLI

SEQ ID NO: 2001031 - protein, 25 aa, Staphylococcus
SEGVIKVMAKMGISTVQSYQGAQIF

SEQ ID NO: 2001032 - protein, 19 aa, Staphylococcus
SEIDKVLGLELGADDYVTK

SEQ ID NO: 2001033 - protein, 20 aa, Staphylococcus
SELTYLTFVYKVAAMDFIFK

SEQ ID NO: 2001034 - protein, 19 aa, Staphylococcus
SELTYLTFVYKVSAMDFIF

SEQ ID NO: 2001035 - protein, 20 aa, Staphylococcus
SEMYREMAKEGVFLPPSQFE

SEQ ID NO: 2001036 - protein, 23 aa, Staphylococcus
SEQHAIFGAGAYRVSSREMWRDL

SEQ ID NO: 2001037 - protein, 18 aa, Staphylococcus
SESGTGAGVRRIEALTGK

SEQ ID NO: 2001038 - protein, 31 aa, Staphylococcus; identical to SEQ ID NO: 1646614

SEQ ID NO: 2001039 - protein, 22 aa, Staphylococcus
SEWNAKNLFTGWEDVQLSEQGR

SEQ ID NO: 2001040 - protein, 29 aa, Staphylococcus
SFCSTCTRARLSSDGKFYGCLFSTVDGFN

SEQ ID NO: 2001041 - protein, 29 aa, Staphylococcus
SFGGKVAGELFIFDIVDAFIKAEYKPTEE

SEQ ID NO: 2001042 - protein, 19 aa, Staphylococcus
SFISYHIFFETLLRKYNER

SEQ ID NO: 2001043 - protein, 24 aa, Staphylococcus
SFLDYAMSVIVSRALPDVRDGLKP

SEQ ID NO: 2001044 - protein, 24 aa, Staphylococcus
SFSPDKILGAILFEQTMDREVEGK

SEQ ID NO: 2001045 - protein, 24 aa, Staphylococcus
SGAKIVEFGGWAMPVQFTSIKEEH

SEQ ID NO: 2001046 - protein, 17 aa, Staphylococcus
SGATAFVYNGKFNPSRY

SEQ ID NO: 2001047 - protein, 17 aa, Staphylococcus
SGEWLTHEFNIIDTGGI

SEQ ID NO: 2001048 - protein, 26 aa, Staphylococcus
SGGEKARLQLALLMLERNNVLILDEP

SEQ ID NO: 2001049 - protein, 18 aa, Staphylococcus
SGGIMLPNHAPLIVAEQF

SEQ ID NO: 2001050 - protein, 19 aa, Staphylococcus
SGGIMLPNHAPLIVAEQFG

SEQ ID NO: 2001051 - protein, 20 aa, Staphylococcus
SGGIMLPNHAPLVVAEQFGT

SEQ ID NO: 2001052 - protein, 26 aa, Staphylococcus
SGGKVRPGFEGGQLPLFRRLPKRGFT

SEQ ID NO: 2001053 - protein, 29 aa, Staphylococcus
SGGQRQRVWIAMALAQRTDIIFLDEPTTY

SEQ ID NO: 2001054 - protein, 18 aa, Staphylococcus
SGICDLSSVIGCRDDIMV

SEQ ID NO: 2001055 - protein, 21 aa, Staphylococcus
SGKSLAYLLAALMYNIETGRH

SEQ ID NO: 2001056 - protein, 17 aa, Staphylococcus
SGLDFQVAFGKDKHGVE

SEQ ID NO: 2001057 - protein, 18 aa, Staphylococcus
SGLQEYLDDLGFNLVGYG

SEQ ID NO: 2001058 - protein, 19 aa, Staphylococcus
SGQFDLIIILTKAMQSEKM

SEQ ID NO: 2001059 - protein, 23 aa, Staphylococcus
SGQKCSACSRAIVHKDVYDEVLE

SEQ ID NO: 2001060 - protein, 25 aa, Staphylococcus
SGQKCSACSRAIVHSSVYDEVLEKA

SEQ ID NO: 2001061 - protein, 21 aa, Staphylococcus
SGSAIQWLRDGLRMINSAPQT

SEQ ID NO: 2001062 - protein, 19 aa, Staphylococcus
SGSTQFKFRQLNAVTNTKK

SEQ ID NO: 2001063 - protein, 24 aa, Staphylococcus
SGTVRNVVDFGAFVDIGVKQDGLV

SEQ ID NO: 2001064 - protein, 18 aa, Staphylococcus
SGVIGCRDDIMVYLMYAG

SEQ ID NO: 2001065 - protein, 18 aa, Staphylococcus
SHFHRAPGSVGMASDASR

SEQ ID NO: 2001066 - protein, 19 aa, Staphylococcus
SHKRFGGVVPEVASRHHVE

SEQ ID NO: 2001067 - protein, 18 aa, Staphylococcus
SHNLKPKSGQIFLQDKLL

SEQ ID NO: 2001068 - protein, 21 aa, Staphylococcus
SHRKLFPSIFHLFQQDNLDEH

SEQ ID NO: 2001069 - protein, 21 aa, Staphylococcus
SHYRLYGVFLLNQLNGKEILM

SEQ ID NO: 2001070 - protein, 19 aa, Staphylococcus
SIAKAISGSTQFKFRQLNA

SEQ ID NO: 2001071 - protein, 24 aa, Staphylococcus
SIFVKSRGQTAILFDEVDSGVSGQ

SEQ ID NO: 2001072 - protein, 24 aa, Staphylococcus
SIGIYSYELYNFFDVDTIIRIGSC

SEQ ID NO: 2001073 - protein, 24 aa, Staphylococcus
SIIKEALHKLGFDDGMYDLIKEPL

SEQ ID NO: 2001074 - protein, 25 aa, Staphylococcus
SILVKDRYDNFVFLFENEFATRWFE

SEQ ID NO: 2001075 - protein, 17 aa, Staphylococcus
SINDCYAILGLVHTLWK

SEQ ID NO: 2001076 - protein, 25 aa, Staphylococcus
SKDVPLHLYLSVLGMPGMTAYTGLL

SEQ ID NO: 2001077 - protein, 34 aa, Staphylococcus; identical to SEQ ID NO: 1796611

SEQ ID NO: 2001078 - protein, 19 aa, Staphylococcus
SKGSLAGVDGRIQSRSYEN

SEQ ID NO: 2001079 - protein, 18 aa, Staphylococcus
SKNAFSMQQIAKVLDKAN

SEQ ID NO: 2001080 - protein, 18 aa, Staphylococcus
SKNDGFMHACGHDGHTAI

SEQ ID NO: 2001081 - protein, 19 aa, Staphylococcus
SKPFFLEFMAKDVSKGNAI

SEQ ID NO: 2001082 - protein, 21 aa, Staphylococcus
SKYMTELPCETCHGKRLSQEA

SEQ ID NO: 2001083 - protein, 19 aa, Staphylococcus
SLGFGDPYPISGSHGLGLG

SEQ ID NO: 2001084 - protein, 18 aa, Staphylococcus
SLGFHVIDSHIFYMGDEK

SEQ ID NO: 2001085 - protein, 25 aa, Staphylococcus
SLLFEEMKHYFILNFPQRPGALREF

SEQ ID NO: 2001086 - protein, 19 aa, Staphylococcus
SLLLRRPPGREAYPGDVFY

SEQ ID NO: 2001087 - protein, 25 aa, Staphylococcus
SLNPEVDRLTLSCRMEINARGEVVN

SEQ ID NO: 2001088 - protein, 24 aa, Staphylococcus
SLNPEVDRLTLSCRMEINERGEVV

SEQ ID NO: 2001089 - protein, 26 aa, Staphylococcus
SLNPPHLKAMIPWEGLNDMYREVAFH

SEQ ID NO: 2001090 - protein, 18 aa, Staphylococcus
SNIGKLYIDEQTFVPCTP

SEQ ID NO: 2001091 - protein, 19 aa, Staphylococcus
SNLPYTMVGGQKFYDRKEI

SEQ ID NO: 2001092 - protein, 24 aa, Staphylococcus
SNQALRLVLERAKTYSVPNHIIDK

SEQ ID NO: 2001093 - protein, 20 aa, Staphylococcus
SNTAEFGDYVSGPRVITPEV

SEQ ID NO: 2001094 - protein, 24 aa, Staphylococcus
SNTLCIRPGVVVTYDRNYVSNQLL

SEQ ID NO: 2001095 - protein, 24 aa, Staphylococcus
SQKLLTQVRFQIPYGKNIALVGAN

SEQ ID NO: 2001096 - protein, 19 aa, Staphylococcus
SQMYREMAKEGVFLPPSQF

SEQ ID NO: 2001097 - protein, 30 aa, Staphylococcus
SQYQDCLLFFRLGDFYEMFFEDAKEASRVL

SEQ ID NO: 2001098 - protein, 21 aa, Staphylococcus
SRFGHSLGVYEIVRRMIDESF

SEQ ID NO: 2001099 - protein, 18 aa, Staphylococcus
SRKTFAIISHPDAGKTTL

SEQ ID NO: 2001100 - protein, 38 aa, Staphylococcus; identical to SEQ ID NO: 1794080

SEQ ID NO: 2001101 - protein, 17 aa, Staphylococcus
SRPESEVNYIMNLPVNF

SEQ ID NO: 2001102 - protein, 18 aa, Staphylococcus
SRQRYWGEPIPVIHWEDG

SEQ ID NO: 2001103 - protein, 30 aa, Staphylococcus
SRTQGFDGWAPLFFRGREVSGKTIGIIGLG

SEQ ID NO: 2001104 - protein, 17 aa, Staphylococcus
SRYYTNWDTIEKQVNHR

SEQ ID NO: 2001105 - protein, 22 aa, Staphylococcus
SSDVFKSIWSKATLNSVLNPLC

SEQ ID NO: 2001106 - protein, 18 aa, Staphylococcus
SSGEWLTHEFNIIDTGGI

SEQ ID NO: 2001107 - protein, 23 aa, Staphylococcus
STDNVYFVPAFVGLGTPYWDSEA

SEQ ID NO: 2001108 - protein, 20 aa, Staphylococcus
STLHSFCLKLIQQHYDVLDI

SEQ ID NO: 2001109 - protein, 21 aa, Staphylococcus
STLHSFCLKLIQQHYDVLDID

SEQ ID NO: 2001110 - protein, 20 aa, Staphylococcus
STQNLDLWYGDNHALQNINL

SEQ ID NO: 2001111 - protein, 24 aa, Staphylococcus
STSEIDEVILVGGSTRIPAVQEAV

SEQ ID NO: 2001112 - protein, 23 aa, Staphylococcus
STTLRRLMDLYGFKEKLQQSDLP

SEQ ID NO: 2001113 - protein, 24 aa, Staphylococcus
STTLRRLMDLYGFKEKLQQSDLPM

SEQ ID NO: 2001114 - protein, 20 aa, Staphylococcus
STYYGIALALLRISKALLNN

SEQ ID NO: 2001115 - protein, 23 aa, Staphylococcus
SVRPGFEGGQLPLFRRLPKRGFT

SEQ ID NO: 2001116 - protein, 25 aa, Staphylococcus
SYCGPGRRKTFAFVNNRPLAALTEE

SEQ ID NO: 2001117 - protein, 23 aa, Staphylococcus
SYEALVKIFYRYGEEKFSKQIAR

SEQ ID NO: 2001118 - protein, 26 aa, Staphylococcus
SYGLIPEFIGRVPIVANLETLDVDAL

SEQ ID NO: 2001119 - protein, 25 aa, Staphylococcus
SYLMEPWDGPTMISFCNGDKIGALT

SEQ ID NO: 2001120 - protein, 19 aa, Staphylococcus
SYWKLFLKPFETLEAFNYR

SEQ ID NO: 2001121 - protein, 27 aa, Staphylococcus
TADSLHIGHLLPFMTLRRFQEHGHRPI

SEQ ID NO: 2001122 - protein, 27 aa, Staphylococcus
TAFDGRGNYTLGIKEQLIFPEIDYDKV

SEQ ID NO: 2001123 - protein, 17 aa, Staphylococcus
TAFNAGFPASVKEVVLS

SEQ ID NO: 2001124 - protein, 18 aa, Staphylococcus
TAGFDMYDLDLAKKHGIV

SEQ ID NO: 2001125 - protein, 18 aa, Staphylococcus
TAGFDMYDLELAKKHGII

SEQ ID NO: 2001126 - protein, 18 aa, Staphylococcus
TAQRLAFHTLDMKEDDVV

SEQ ID NO: 2001127 - protein, 19 aa, Staphylococcus
TAVQYDLPMTIFVMNNKQL

SEQ ID NO: 2001128 - protein, 23 aa, Staphylococcus
TDADLRILRRLVRDTKERGRSME

SEQ ID NO: 2001129 - protein, 23 aa, Staphylococcus
TDDARLTIEVMKKAAEKGAEIIN

SEQ ID NO: 2001130 - protein, 20 aa, Staphylococcus
TDDGLLVPFVRDCDKKNFAE

SEQ ID NO: 2001131 - protein, 24 aa, Staphylococcus
TDFNLGPEPEFFLFKLDEKGEPTL

SEQ ID NO: 2001132 - protein, 31 aa, Staphylococcus
TDIEYKFPFGWGELWGIASRTDFDLKKHSEH

SEQ ID NO: 2001133 - protein, 18 aa, Staphylococcus
TDILDLVSEYVKLEKRGR

SEQ ID NO: 2001134 - protein, 17 aa, Staphylococcus
TDKGQFTERIFGLENRQ

SEQ ID NO: 2001135 - protein, 22 aa, Staphylococcus
TDKGRRLNVFYATQVAIEPPTF

SEQ ID NO: 2001136 - protein, 19 aa, Staphylococcus
TDPMKFLPEDGSLELTAGW

SEQ ID NO: 2001137 - protein, 24 aa, Staphylococcus
TDVKAATQSLKWAVEEMERRYKLF

SEQ ID NO: 2001138 - protein, 35 aa, Staphylococcus; identical to SEQ ID NO: 1800685

SEQ ID NO: 2001139 - protein, 17 aa, Staphylococcus
TEADASINWALGLMNEG

SEQ ID NO: 2001140 - protein, 21 aa, Staphylococcus
TEDVYDFWRPTGHKYPLVAGA

SEQ ID NO: 2001141 - protein, 17 aa, Staphylococcus
TEIKSYQNIAGQSIFEI

SEQ ID NO: 2001142 - protein, 23 aa, Staphylococcus
TEKYSVLRALKAIERSNVVLIVI

SEQ ID NO: 2001143 - protein, 19 aa, Staphylococcus
TFSTMKVVDPLGQDVTPDK

SEQ ID NO: 2001144 - protein, 21 aa, Staphylococcus
TGIGFALSIERLLLALEEEGI

SEQ ID NO: 2001145 - protein, 17 aa, Staphylococcus
TGIGGEFDISKARYHKI

SEQ ID NO: 2001146 - protein, 17 aa, Staphylococcus
TGLPEALHQVTILMSDR

SEQ ID NO: 2001147 - protein, 21 aa, Staphylococcus
TGQKRRLSVATALSSKAEIVL

SEQ ID NO: 2001148 - protein, 19 aa, Staphylococcus
TGRGSIQMRSRAEIEERGG

SEQ ID NO: 2001149 - protein, 21 aa, Staphylococcus
TGRMLPGTKLQSGLHQAIEAK

SEQ ID NO: 2001150 - protein, 24 aa, Staphylococcus
TGSDLSVVLLDFGKKQNIVRELNM

SEQ ID NO: 2001151 - protein, 23 aa, Staphylococcus
TIDFKQSLMGGGFQIDNPNAIAS

SEQ ID NO: 2001152 - protein, 25 aa, Staphylococcus
TIENRPMMYLALSYDHRIIDGKEAV

SEQ ID NO: 2001153 - protein, 18 aa, Staphylococcus
TIKRVMRLIDNIRQYGHL

SEQ ID NO: 2001154 - protein, 25 aa, Staphylococcus
TIRIAPRKVRLVLDLIRGKNAAEAI

SEQ ID NO: 2001155 - protein, 23 aa, Staphylococcus
TISDMMASFMFDNDYFMYGLETF

SEQ ID NO: 2001156 - protein, 24 aa, Staphylococcus
TIYPNRVDLGLGRAPGTDMMTASA

SEQ ID NO: 2001157 - protein, 20 aa, Staphylococcus
TKLKNGRKFLTKGDKCKVSI

SEQ ID NO: 2001158 - protein, 17 aa, Staphylococcus
TKNGRKVLARRRRKGRK

SEQ ID NO: 2001159 - protein, 27 aa, Staphylococcus
TKRVAIEMASPLGWHKYVGTEGKVIGI

SEQ ID NO: 2001160 - protein, 24 aa, Staphylococcus
TKVNELEKQIEIFETRAKNDEKYI

SEQ ID NO: 2001161 - protein, 19 aa, Staphylococcus
TLHYTPRAKKVIELSMDEA

SEQ ID NO: 2001162 - protein, 24 aa, Staphylococcus
TLQDRRKAFQFAYLSLMQEENIQA

SEQ ID NO: 2001163 - protein, 21 aa, Staphylococcus
TLRMNYLFDFYQALLTKKQRN

SEQ ID NO: 2001164 - protein, 25 aa, Staphylococcus
TLWKKAKPGEISWDSPFGKGRPGWH

SEQ ID NO: 2001165 - protein, 26 aa, Staphylococcus
TLWKKAKPGEISWESPFGEGRPGWHI

SEQ ID NO: 2001166 - protein, 28 aa, Staphylococcus
TLYMRIAIELHLKRLIVGGLEKVYEIGR

SEQ ID NO: 2001167 - protein, 17 aa, Staphylococcus
TLYRVAYQYETQFNLHD

SEQ ID NO: 2001168 - protein, 21 aa, Staphylococcus
TMAGKGSEVGRTFEEIAQIID

SEQ ID NO: 2001169 - protein, 17 aa, Staphylococcus
TMRARGAQVTDITILVV

SEQ ID NO: 2001170 - protein, 25 aa, Staphylococcus
TNKAEKCTFCFPRIEAGLPTVCSET

SEQ ID NO: 2001171 - protein, 24 aa, Staphylococcus
TNMFWRQNISQMWVETEFKVSKDI

SEQ ID NO: 2001172 - protein, 26 aa, Staphylococcus
TNRDLRFIEDFSIKISDVMTKEDLIT

SEQ ID NO: 2001173 - protein, 17 aa, Staphylococcus
TNSQFVLSYNVYQNPTD

SEQ ID NO: 2001174 - protein, 24 aa, Staphylococcus
TNTHLHLIKPLGFSTDDKMLKRAG

SEQ ID NO: 2001175 - protein, 19 aa, Staphylococcus
TNTNARIEPGAFIREQAII

SEQ ID NO: 2001176 - protein, 20 aa, Staphylococcus
TPEGKNIWFGVREFAMGAAV

SEQ ID NO: 2001177 - protein, 17 aa, Staphylococcus
TPFAAIILAEIFDKVGV

SEQ ID NO: 2001178 - protein, 25 aa, Staphylococcus
TPFFTNYRPQFYFRTTDVTGVVNLP

SEQ ID NO: 2001179 - protein, 22 aa, Staphylococcus
TPHTKFKAEVYVLSKDEGGRHT

SEQ ID NO: 2001180 - protein, 18 aa, Staphylococcus
TPIFPRLDTEAEIAYIKE

SEQ ID NO: 2001181 - protein, 26 aa, Staphylococcus
TPSQMGIRKPEFTSAISTISSSITFD

SEQ ID NO: 2001182 - protein, 22 aa, Staphylococcus
TPVFFGSALANFGVQNFLNAYV

SEQ ID NO: 2001183 - protein, 20 aa, Staphylococcus
TPVIGTSTCHLMLDPKQEPI

SEQ ID NO: 2001184 - protein, 25 aa, Staphylococcus
TQKSPRWAIAYKFPAEEVVTELLDI

SEQ ID NO: 2001185 - protein, 29 aa, Staphylococcus
TQLAGLGLRATRLDLLPGKSHQRHIDSEN

SEQ ID NO: 2001186 - protein, 19 aa, Staphylococcus
TQLLERFLFPSSTHGKKIY

SEQ ID NO: 2001187 - protein, 23 aa, Staphylococcus
TRAIKRLEVVESFRNSGNNPSWM

SEQ ID NO: 2001188 - protein, 24 aa, Staphylococcus
TRELSRLYVYAHYKGLKSLYYTRN

SEQ ID NO: 2001189 - protein, 25 aa, Staphylococcus
TRESDGFKDIRDVLGQVYETAEELD

SEQ ID NO: 2001190 - protein, 17 aa, Staphylococcus
TRGVIVLTDPDFPGDKI

SEQ ID NO: 2001191 - protein, 19 aa, Staphylococcus
TRIHLKPTQLVGGYAQISY

SEQ ID NO: 2001192 - protein, 25 aa, Staphylococcus
TSEEIPHAIGVNVDRMIKEDEDRVR

SEQ ID NO: 2001193 - protein, 29 aa, Staphylococcus
TSEKNAMGWYLDGRVSAVVGTHTHIQTSD

SEQ ID NO: 2001194 - protein, 17 aa, Staphylococcus
TSLLFNIIPERFQGREV

SEQ ID NO: 2001195 - protein, 18 aa, Staphylococcus
TSLPEALHQVTILMTDRG

SEQ ID NO: 2001196 - protein, 20 aa, Staphylococcus
TSTPVLRPLLTLDKEDIVKK

SEQ ID NO: 2001197 - protein, 32 aa, Staphylococcus
TTDIEYRFPFGWGELWGIASRTDFDLKKHSEH

SEQ ID NO: 2001198 - protein, 24 aa, Staphylococcus
TTIDFKQSLMGGGFQIDNPNAIAS

SEQ ID NO: 2001199 - protein, 17 aa, Staphylococcus
TTLLRMINALEIPTEGN

SEQ ID NO: 2001200 - protein, 18 aa, Staphylococcus
TTLLTLKIAELFRDSTIP

SEQ ID NO: 2001201 - protein, 22 aa, Staphylococcus
TTLSNKGYRVLLATTDPTKEIN

SEQ ID NO: 2001202 - protein, 17 aa, Staphylococcus
TTVKLFITYSDIEARGF

SEQ ID NO: 2001203 - protein, 26 aa, Staphylococcus
TVEGFRPVMEIQFLGFVFEVFDEVAG

SEQ ID NO: 2001204 - protein, 18 aa, Staphylococcus
TVTLKTLGLIIVMAQSGL

SEQ ID NO: 2001205 - protein, 22 aa, Staphylococcus
TVVAGTKYRGEFEERLKKVMEE

SEQ ID NO: 2001206 - protein, 24 aa, Staphylococcus
TVVRRRTEYNLKKAKDRAHILEGL

SEQ ID NO: 2001207 - protein, 17 aa, Staphylococcus
TYGTGGFMLMNTGEEAV

SEQ ID NO: 2001208 - protein, 23 aa, Staphylococcus
TYVSLTCQKCPDVVQALNLMSVI

SEQ ID NO: 2001209 - protein, 23 aa, Staphylococcus
VAGSGVYICNECIELCSEIVEEE

SEQ ID NO: 2001210 - protein, 20 aa, Staphylococcus
VAGTKYRGEFEERLKKVMEE

SEQ ID NO: 2001211 - protein, 18 aa, Staphylococcus
VAKHVPMDRLLVETDAPY

SEQ ID NO: 2001212 - protein, 23 aa, Staphylococcus
VAKIPYDCCKDGISNTFSIVPKS

SEQ ID NO: 2001213 - protein, 30 aa, Staphylococcus
VANKELTPELAFKLGRYGGYVLAHNEGEKH

SEQ ID NO: 2001214 - protein, 24 aa, Staphylococcus
VAPARAMGMVSVWFKQEDAEIEPL

SEQ ID NO: 2001215 - protein, 17 aa, Staphylococcus
VAVGNIFASPSPIPIQA

SEQ ID NO: 2001216 - protein, 25 aa, Staphylococcus
VCREVRKKFEMPIIMLTAKDSEIDK

SEQ ID NO: 2001217 - protein, 26 aa, Staphylococcus
VCREVRKKFEMPIIMLTAKDSEIDKV

SEQ ID NO: 2001218 - protein, 19 aa, Staphylococcus
VCTCPERIFVHEDVHDDFI

SEQ ID NO: 2001219 - protein, 19 aa, Staphylococcus
VDELTSALISKGYKAEGLH

SEQ ID NO: 2001220 - protein, 19 aa, Staphylococcus
VDELTSALLSKGYKAEGLH

SEQ ID NO: 2001221 - protein, 20 aa, Staphylococcus
VDEVEFIKVIREVGRNGVIE

SEQ ID NO: 2001222 - protein, 18 aa, Staphylococcus
VDLVKLFPGDLLGANFIK

SEQ ID NO: 2001223 - protein, 20 aa, Staphylococcus
VDTDIKKRLNQMALDKDTSI

SEQ ID NO: 2001224 - protein, 17 aa, Staphylococcus
VDTPAIFMDHAEGSKIY

SEQ ID NO: 2001225 - protein, 19 aa, Staphylococcus
VDVGLPREVLIPWEDLPKV

SEQ ID NO: 2001226 - protein, 25 aa, Staphylococcus
VDVGQRGFVPASLISTDFIEDFSDF

SEQ ID NO: 2001227 - protein, 18 aa, Staphylococcus
VDWGKTRIYNMIRDRGEW

SEQ ID NO: 2001228 - protein, 18 aa, Staphylococcus
VDYFFKTKEEFEALIQED

SEQ ID NO: 2001229 - protein, 26 aa, Staphylococcus
VEADIFAPCALGGILNDDTIPQLKVK

SEQ ID NO: 2001230 - protein, 23 aa, Staphylococcus
VEIKAEDGITFAVEKNTTVKVSG

SEQ ID NO: 2001231 - protein, 17 aa, Staphylococcus
VEIKSMVDTGVLSDRAV

SEQ ID NO: 2001232 - protein, 19 aa, Staphylococcus
VEKRLPRIEKMARQKDKTA

SEQ ID NO: 2001233 - protein, 18 aa, Staphylococcus
VEMTEAFAAQSIPVKDNL

SEQ ID NO: 2001234 - protein, 21 aa, Staphylococcus
VETKPGVGYPKRWEDQEHYKG

SEQ ID NO: 2001235 - protein, 36 aa, Staphylococcus
VEVDVSCFKCKGEGCNVCKHTGWIEILGAGMVHPNV

SEQ ID NO: 2001236 - protein, 26 aa, Staphylococcus
VEVGEKQAAIDLKVILEYGESAPKIF

SEQ ID NO: 2001237 - protein, 20 aa, Staphylococcus
VFGIPGAKIDYLFNALEDDG

SEQ ID NO: 2001238 - protein, 21 aa, Staphylococcus
VFGIPGAKIDYLFNALEDDGP

SEQ ID NO: 2001239 - protein, 18 aa, Staphylococcus
VFNKRGYPIGQILMPGRD

SEQ ID NO: 2001240 - protein, 30 aa, Staphylococcus
VFNLDRAAVEFGKMDFNTHLDLKAYSDNIK

SEQ ID NO: 2001241 - protein, 23 aa, Staphylococcus
VFQGEALLFLLGLTNSMAGFEKL

SEQ ID NO: 2001242 - protein, 22 aa, Staphylococcus
VFYIPNCDKITPGMILAAVRTN

SEQ ID NO: 2001243 - protein, 28 aa, Staphylococcus
VGCRIGCTFCASTLGGLKRNLEAGEIVS

SEQ ID NO: 2001244 - protein, 23 aa, Staphylococcus
VGDRQLVKVAAWYDNEMSYTSQL

SEQ ID NO: 2001245 - protein, 22 aa, Staphylococcus
VGEKGDVALFFGLSGTGKTTLS

SEQ ID NO: 2001246 - protein, 20 aa, Staphylococcus
VGGLGLDFVHDNGYNLKQIE

SEQ ID NO: 2001247 - protein, 17 aa, Staphylococcus
VGIGPGRVCITKIKTGF

SEQ ID NO: 2001248 - protein, 17 aa, Staphylococcus
VGITRSVIVNALRKLES

SEQ ID NO: 2001249 - protein, 17 aa, Staphylococcus
VGLKTGRDGIHGATFAS

SEQ ID NO: 2001250 - protein, 18 aa, Staphylococcus
VGLLPRAHGSGLFTRGQT

SEQ ID NO: 2001251 - protein, 19 aa, Staphylococcus
VGLLPRAHGSGLFTRGQTQ

SEQ ID NO: 2001252 - protein, 25 aa, Staphylococcus
VGMSEKLDGLELFHPERMASRILGM

SEQ ID NO: 2001253 - protein, 19 aa, Staphylococcus
VGNSVIYVGLKTGRDGIHG

SEQ ID NO: 2001254 - protein, 20 aa, Staphylococcus
VGPNCPGVITADECKIGIMP

SEQ ID NO: 2001255 - protein, 19 aa, Staphylococcus
VGVPRGRGKIERFFQTVNQ

SEQ ID NO: 2001256 - protein, 20 aa, Staphylococcus
VHITCRDRNLIGLQSHLLGL

SEQ ID NO: 2001257 - protein, 24 aa, Staphylococcus
VHNRRDLGGLIFIDLRDREGIVQI

SEQ ID NO: 2001258 - protein, 18 aa, Staphylococcus
VIAYEPIWAIGTGKSATS

SEQ ID NO: 2001259 - protein, 17 aa, Staphylococcus
VIIPGIMEHIERAGVHS

SEQ ID NO: 2001260 - protein, 17 aa, Staphylococcus
VILAEIFDKVGVPKGVF

SEQ ID NO: 2001261 - protein, 21 aa, Staphylococcus
VILEYGESAPKIFRKVTDLVK

SEQ ID NO: 2001262 - protein, 18 aa, Staphylococcus
VIVGINLLREGIDIPEVS

SEQ ID NO: 2001263 - protein, 17 aa, Staphylococcus
VIVGIRPGHSFDKAKED

SEQ ID NO: 2001264 - protein, 25 aa, Staphylococcus
VKATDLRAAAALILAGLVAEGTTQV

SEQ ID NO: 2001265 - protein, 17 aa, Staphylococcus
VKEELTDLLAITDTVVS

SEQ ID NO: 2001266 - protein, 19 aa, Staphylococcus
VKEQLIFPEIDYDKVSKVR

SEQ ID NO: 2001267 - protein, 19 aa, Staphylococcus
VKFADNWLAPHPGTDAAVA

SEQ ID NO: 2001268 - protein, 19 aa, Staphylococcus
VKFEKVFADHFMSLYDKTK

SEQ ID NO: 2001269 - protein, 26 aa, Staphylococcus
VKGYFIWSLMDVFSWSNGYEKRYGLF

SEQ ID NO: 2001270 - protein, 21 aa, Staphylococcus
VKIIPLEVVVRNIATGSITKR

SEQ ID NO: 2001271 - protein, 20 aa, Staphylococcus
VKLFKGNAIVNGRKSPYTLY

SEQ ID NO: 2001272 - protein, 21 aa, Staphylococcus
VKLYYNGPMFRYERKQKGRYR

SEQ ID NO: 2001273 - protein, 18 aa, Staphylococcus
VKNGDWSLQQLVDYLTIK

SEQ ID NO: 2001274 - protein, 18 aa, Staphylococcus
VKSLLQMLLLHAIPEPVI

SEQ ID NO: 2001275 - protein, 19 aa, Staphylococcus
VKTKNGQMLVCQDPSCKTK

SEQ ID NO: 2001276 - protein, 19 aa, Staphylococcus
VKTTICGTDLHIIKGDTPE

SEQ ID NO: 2001277 - protein, 21 aa, Staphylococcus
VLAGFAGSVADAFTLFEKFET

SEQ ID NO: 2001278 - protein, 23 aa, Staphylococcus
VLAKRLEELGVHAVMPLASPIGT

SEQ ID NO: 2001279 - protein, 18 aa, Staphylococcus
VLDIIKWLHEEYQMTIIM

SEQ ID NO: 2001280 - protein, 17 aa, Staphylococcus
VLEGITFSLYDSIQLMR

SEQ ID NO: 2001281 - protein, 31 aa, Staphylococcus
VLFLNRRGYASFMLCRDCGYVPQCPHCDISL

SEQ ID NO: 2001282 - protein, 19 aa, Staphylococcus
VLKETYPSVFVVELDQDKH

SEQ ID NO: 2001283 - protein, 19 aa, Staphylococcus
VLLEARVSVYERRGNYQIY

SEQ ID NO: 2001284 - protein, 18 aa, Staphylococcus
VLSELCLPLVKKGGQFIA

SEQ ID NO: 2001285 - protein, 18 aa, Staphylococcus
VMAKMGISTVQSYQGAQI

SEQ ID NO: 2001286 - protein, 25 aa, Staphylococcus
VMGRDCGDLALWAGLSVGAETILVP

SEQ ID NO: 2001287 - protein, 25 aa, Staphylococcus
VMGRDCGDLALWAGLSVGAETIVVP

SEQ ID NO: 2001288 - protein, 22 aa, Staphylococcus
VMQELTEYGLIPEDWGGDTIFV

SEQ ID NO: 2001289 - protein, 19 aa, Staphylococcus
VMTDYRLQKNWITPNSHRY

SEQ ID NO: 2001290 - protein, 18 aa, Staphylococcus
VNAALHYLARLIEAGDLP

SEQ ID NO: 2001291 - protein, 28 aa, Staphylococcus
VNAKGRLPDCLVEWSAKRLKEQGADAVK

SEQ ID NO: 2001292 - protein, 22 aa, Staphylococcus
VNCVAPGPFWSPLQITGGQPQS

SEQ ID NO: 2001293 - protein, 22 aa, Staphylococcus
VNEVIKRLNYRPNAVARGLASK

SEQ ID NO: 2001294 - protein, 23 aa, Staphylococcus
VNNCVTIEPGIYVDGLGGVRIED

SEQ ID NO: 2001295 - protein, 20 aa, Staphylococcus
VNPRSSRTVPFLSKITDIQM

SEQ ID NO: 2001296 - protein, 22 aa, Staphylococcus
VNQPEFKRGIIANPNCSTIQSV

SEQ ID NO: 2001297 - protein, 18 aa, Staphylococcus
VPAGDGWDSDPFNPVVTD

SEQ ID NO: 2001298 - protein, 18 aa, Staphylococcus
VPEGVLIRAIEPEDGIEA

SEQ ID NO: 2001299 - protein, 19 aa, Staphylococcus
VPETLKGKRVMSLDMGTVV

SEQ ID NO: 2001300 - protein, 20 aa, Staphylococcus
VPVVEELVKLNVQISIDTYR

SEQ ID NO: 2001301 - protein, 20 aa, Staphylococcus
VQAIHELPFDKGLDRVCTNI

SEQ ID NO: 2001302 - protein, 17 aa, Staphylococcus
VQDPLSELVKIDPKSIG

SEQ ID NO: 2001303 - protein, 25 aa, Staphylococcus
VQEGRKDIFGKLSYVGSTVKTLMNP

SEQ ID NO: 2001304 - protein, 19 aa, Staphylococcus
VQLAYAIGVAEPVSIAIDT

SEQ ID NO: 2001305 - protein, 19 aa, Staphylococcus
VQLAYAIGVAEPVSISIDT

SEQ ID NO: 2001306 - protein, 20 aa, Staphylococcus
VQPNAKFPPSLRNMYQELED

SEQ ID NO: 2001307 - protein, 23 aa, Staphylococcus
VQQAEFSRNLFIKMEEHDKKMKE

SEQ ID NO: 2001308 - protein, 25 aa, Staphylococcus
VQTFKRQIQELGFSYDWDREVNTTD

SEQ ID NO: 2001309 - protein, 19 aa, Staphylococcus
VRDGLKPVQRRILFAMYSS

SEQ ID NO: 2001310 - protein, 17 aa, Staphylococcus
VRDGLKPVQRRILYAMY

SEQ ID NO: 2001311 - protein, 27 aa, Staphylococcus
VRKHFDLRPAGIIKMLDLKHPIYKQTA

SEQ ID NO: 2001312 - protein, 17 aa, Staphylococcus
VRLEVRRAEQLKQGQDI

SEQ ID NO: 2001313 - protein, 21 aa, Staphylococcus
VRQHPGEVCPAKWEEGSESLQ

SEQ ID NO: 2001314 - protein, 19 aa, Staphylococcus
VRTGFSMILNFQEDMEVVA

SEQ ID NO: 2001315 - protein, 23 aa, Staphylococcus
VSDELWNRWKQWLENDELWPRHA

SEQ ID NO: 2001316 - protein, 17 aa, Staphylococcus
VSDGLMVARGDMGVEIP

SEQ ID NO: 2001317 - protein, 25 aa, Staphylococcus
VSDRIGRLFDITGLKDLMHVNEGTE

SEQ ID NO: 2001318 - protein, 26 aa, Staphylococcus
VSLIRLTLSGVFSRAGASYDDIEDAK

SEQ ID NO: 2001319 - protein, 27 aa, Staphylococcus
VSLIRLTLSGVFSRAGASYDDIEDSKI

SEQ ID NO: 2001320 - protein, 17 aa, Staphylococcus
VSRLVKRRTLAKEISDQ

SEQ ID NO: 2001321 - protein, 22 aa, Staphylococcus
VSVATFTLAVNRTFTNAQGERE

SEQ ID NO: 2001322 - protein, 17 aa, Staphylococcus
VSYEEMMEMSALGAGVL

SEQ ID NO: 2001323 - protein, 23 aa, Staphylococcus
VTAYRGSGHLIDYSATKGAIVSF

SEQ ID NO: 2001324 - protein, 25 aa, Staphylococcus
VTEELRKKGVVGKFVEFFGPGVQHL

SEQ ID NO: 2001325 - protein, 23 aa, Staphylococcus
VTGILPWKKINTVNGDDVTPVPS

SEQ ID NO: 2001326 - protein, 29 aa, Staphylococcus
VTGYDIIFFWVARMIFQGLEFTDRRPFND

SEQ ID NO: 2001327 - protein, 28 aa, Staphylococcus
VTGYDIIFFWVARMIFQGLEFTGKRPFN

SEQ ID NO: 2001328 - protein, 18 aa, Staphylococcus
VTHRDFSSSVAFVTAVNK

SEQ ID NO: 2001329 - protein, 17 aa, Staphylococcus
VTLELKLLADVGLVGFP

SEQ ID NO: 2001330 - protein, 24 aa, Staphylococcus
VTQPIFKGIEWIIVSLGGDGAFAK

SEQ ID NO: 2001331 - protein, 19 aa, Staphylococcus
VVDISNYVLLEYGQPLHMF

SEQ ID NO: 2001332 - protein, 17 aa, Staphylococcus
VVETFQGAGVISRDLEN

SEQ ID NO: 2001333 - protein, 32 aa, Staphylococcus
VVGDSDQSIYGWRGADIQNILSFEEDYPDAKT

SEQ ID NO: 2001334 - protein, 20 aa, Staphylococcus
VVNLMLKLQKERGITFLFIA

SEQ ID NO: 2001335 - protein, 25 aa, Staphylococcus
VVVPDYQLSLAIGKRGQNARLAAKL

SEQ ID NO: 2001336 - protein, 25 aa, Staphylococcus
VVYLVSKGKMYAHVLIKDCEVRKTF

SEQ ID NO: 2001337 - protein, 26 aa, Staphylococcus
VWATAAPGWQKWVWSPFLSIMGSGAT

SEQ ID NO: 2001338 - protein, 19 aa, Staphylococcus
VWGDRVGVEVIRQSEGSDP

SEQ ID NO: 2001339 - protein, 18 aa, Staphylococcus
VWMGGTFLEKGNVEEPEH

SEQ ID NO: 2001340 - protein, 25 aa, Staphylococcus
VYDPRKYLGPAREAIKETVKGKIRE

SEQ ID NO: 2001341 - protein, 25 aa, Staphylococcus
VYLEHMKLYRSFREEVPEEEYTIEI

SEQ ID NO: 2001342 - protein, 26 aa, Staphylococcus
VYLKREDLQWVRSFKLRGAYNAISVL

SEQ ID NO: 2001343 - protein, 26 aa, Staphylococcus
VYLVDRVIPMIPHRLSNGICSLNPEV

SEQ ID NO: 2001344 - protein, 17 aa, Staphylococcus
VYRGMGSLGAMEKGSND

SEQ ID NO: 2001345 - protein, 18 aa, Staphylococcus
WAERCLKAHARPEDQALF

SEQ ID NO: 2001346 - protein, 30 aa, Staphylococcus
WAVEEMERRYKLFAQYHVRNITAFNKKASY

SEQ ID NO: 2001347 - protein, 18 aa, Staphylococcus
WEIMGLNIMQPFKVYPDG

SEQ ID NO: 2001348 - protein, 17 aa, Staphylococcus
WFIQGRIDFQIKLNGYR

SEQ ID NO: 2001349 - protein, 19 aa, Staphylococcus
WGLDALKFLIEERGVKSIG

SEQ ID NO: 2001350 - protein, 30 aa, Staphylococcus
WGYAHLQMAPKHWLCIKEDDLVWATAAPGW

SEQ ID NO: 2001351 - protein, 17 aa, Staphylococcus
WIDGFDIECRNEESIHQ

SEQ ID NO: 2001352 - protein, 26 aa, Staphylococcus
WLGYEERAKMGLALNKLVRDGEISAP

SEQ ID NO: 2001353 - protein, 17 aa, Staphylococcus
WLTIIMDDYSRAIAGYF

SEQ ID NO: 2001354 - protein, 19 aa, Staphylococcus
WLTNKRSSGKIAFLQLRDG

SEQ ID NO: 2001355 - protein, 18 aa, Staphylococcus
WNKSYKEQGLKGLIYATR

SEQ ID NO: 2001356 - protein, 30 aa, Staphylococcus; identical to SEQ ID NO: 1661089

SEQ ID NO: 2001357 - protein, 19 aa, Staphylococcus
WQYHDHWLGYCTNELVQIN

SEQ ID NO: 2001358 - protein, 21 aa, Staphylococcus
WRPTGHKYPLVAGALSKDAYI

SEQ ID NO: 2001359 - protein, 19 aa, Staphylococcus
WRTMPRNGMTIHYSGMTLE

SEQ ID NO: 2001360 - protein, 18 aa, Staphylococcus
WSKYGIKVNTIAPGYMKT

SEQ ID NO: 2001361 - protein, 24 aa, Staphylococcus
WTISRQLWWGHQIPAWYHNETGEV

SEQ ID NO: 2001362 - protein, 22 aa, Staphylococcus
WVTESIGGVGIDGRPLVTKNSF

SEQ ID NO: 2001363 - protein, 26 aa, Staphylococcus
WVVAGRGELHLSILIENMRREGFELQ

SEQ ID NO: 2001364 - protein, 18 aa, Staphylococcus
YAALLVPFDENGQVKEEG

SEQ ID NO: 2001365 - protein, 21 aa, Staphylococcus
YACCTHPVLSGPAKERIENSA

SEQ ID NO: 2001366 - protein, 21 aa, Staphylococcus
YADIKYQLGLIGKNENEKLLK

SEQ ID NO: 2001367 - protein, 20 aa, Staphylococcus
YAIGMGHTIHALRRNMNITY

SEQ ID NO: 2001368 - protein, 19 aa, Staphylococcus
YAKELNLKSKEIIDELKSM

SEQ ID NO: 2001369 - protein, 17 aa, Staphylococcus
YALKTAGYQSALMVPTE

SEQ ID NO: 2001370 - protein, 17 aa, Staphylococcus
YAVSIGFHVKVNVVIQK

SEQ ID NO: 2001371 - protein, 20 aa, Staphylococcus
YCDSLPLVVFTGQVATPGIG

SEQ ID NO: 2001372 - protein, 27 aa, Staphylococcus
YDAFAKVKGRLIVSCYASNFIRIQQVL

SEQ ID NO: 2001373 - protein, 19 aa, Staphylococcus
YDETGEWLPQETLDTIKEY

SEQ ID NO: 2001374 - protein, 18 aa, Staphylococcus
YDIELAYEAGLLSRNEEN

SEQ ID NO: 2001375 - protein, 19 aa, Staphylococcus
YDIGAVGMRLLTKYMNEEE

SEQ ID NO: 2001376 - protein, 17 aa, Staphylococcus
YDIQPVITLSHFEMPLH

SEQ ID NO: 2001377 - protein, 18 aa, Staphylococcus
YDKEGFRDQEFEKGDKGT

SEQ ID NO: 2001378 - protein, 17 aa, Staphylococcus
YDLTMKISREQSIVSRW

SEQ ID NO: 2001379 - protein, 17 aa, Staphylococcus
YEAIVRMEKRYKGPIAF

SEQ ID NO: 2001380 - protein, 17 aa, Staphylococcus
YEFFEGIAKVTINRPEV

SEQ ID NO: 2001381 - protein, 25 aa, Staphylococcus
YELSKCMTCGVCLEVCPNVTPNNKF

SEQ ID NO: 2001382 - protein, 20 aa, Staphylococcus
YEVVNEWSYEALVKIFYRYG

SEQ ID NO: 2001383 - protein, 19 aa, Staphylococcus
YFIEMNARIQVEHTVTEMR

SEQ ID NO: 2001384 - protein, 17 aa, Staphylococcus
YGARPLIRAIQKTVEDN

SEQ ID NO: 2001385 - protein, 25 aa, Staphylococcus
YGHFGRTDVLLPWEKLDKVNVLKDA

SEQ ID NO: 2001386 - protein, 17 aa, Staphylococcus
YHLEGFVAKPEHSRSNK

SEQ ID NO: 2001387 - protein, 24 aa, Staphylococcus
YHPDYDFLESIGIEINTNEYGTAP

SEQ ID NO: 2001388 - protein, 28 aa, Staphylococcus
YHTLLTIGRYPICYINIEMDPILVDVNV

SEQ ID NO: 2001389 - protein, 21 aa, Staphylococcus
YIKRLPVSTYRAQNRGGRGVQ

SEQ ID NO: 2001390 - protein, 21 aa, Staphylococcus
YIKRLPVSTYRSQNRGGRGVQ

SEQ ID NO: 2001391 - protein, 26 aa, Staphylococcus
YILFTQGCLLRCLYCHNPDTWKINEP

SEQ ID NO: 2001392 - protein, 18 aa, Staphylococcus
YINAYRLAERYSNIATNC

SEQ ID NO: 2001393 - protein, 20 aa, Staphylococcus
YIQAEGFAGGELKHGTIALI

SEQ ID NO: 2001394 - protein, 27 aa, Staphylococcus
YKDLVVSVRVGMEMDRSELLRKLVDVQ

SEQ ID NO: 2001395 - protein, 18 aa, Staphylococcus
YKDYGIRKYGFHGTSHKY

SEQ ID NO: 2001396 - protein, 25 aa, Staphylococcus
YKLAIEYKLAFPLHPEYRTMPMVWY

SEQ ID NO: 2001397 - protein, 17 aa, Staphylococcus
YKNILVVGADKLSKITD

SEQ ID NO: 2001398 - protein, 20 aa, Staphylococcus
YKTKTVYTDLLFLYLERAFL

SEQ ID NO: 2001399 - protein, 19 aa, Staphylococcus
YKTMQGFYAPYVPGWDTHG

SEQ ID NO: 2001400 - protein, 17 aa, Staphylococcus
YKYTLMMGRTHGVHAEP

SEQ ID NO: 2001401 - protein, 17 aa, Staphylococcus
YLAGLAVGFWDSKDEIA

SEQ ID NO: 2001402 - protein, 19 aa, Staphylococcus
YLDDLGFNLVGYGCTTCIG

SEQ ID NO: 2001403 - protein, 23 aa, Staphylococcus
YLFKGSLAGVDGRIQSRSYENQE

SEQ ID NO: 2001404 - protein, 23 aa, Staphylococcus
YLGKKYKVIASMGHVRDLPRSQM

SEQ ID NO: 2001405 - protein, 32 aa, Staphylococcus
YLNLPKEMNPFLGYRAIRLCLDQQDIFRTQLR

SEQ ID NO: 2001406 - protein, 17 aa, Staphylococcus
YLTLYAFSTENWSRPES

SEQ ID NO: 2001407 - protein, 25 aa, Staphylococcus
YLVDRVIPMIPHRLSNGICSLNPEV

SEQ ID NO: 2001408 - protein, 17 aa, Staphylococcus
YLYTGLFDNDKKLKDYT

SEQ ID NO: 2001409 - protein, 21 aa, Staphylococcus
YNLTYPQFLVLTILWDESPVN

SEQ ID NO: 2001410 - protein, 20 aa, Staphylococcus
YNMIRDRGEWVISRQRVWGV

SEQ ID NO: 2001411 - protein, 17 aa, Staphylococcus
YNMYLGGGFKGERLNKL

SEQ ID NO: 2001412 - protein, 22 aa, Staphylococcus
YNSVIATFCYKIARDEEIQVND

SEQ ID NO: 2001413 - protein, 21 aa, Staphylococcus
YPGRRYYGGCEYVDVTETIAI

SEQ ID NO: 2001414 - protein, 17 aa, Staphylococcus
YPLRGHNNVQGCSDMGS

SEQ ID NO: 2001415 - protein, 18 aa, Staphylococcus
YPLVAGALSKDAYIKSFQ

SEQ ID NO: 2001416 - protein, 24 aa, Staphylococcus
YQNKRPDYISAFWNVVNWEKVDEL

SEQ ID NO: 2001417 - protein, 25 aa, Staphylococcus
YQNKRPDYISAFWNVVNWEKVDELY

SEQ ID NO: 2001418 - protein, 24 aa, Staphylococcus
YQRSADIFLGVPFNIASYSLLTHL

SEQ ID NO: 2001419 - protein, 19 aa, Staphylococcus
YQSAFDIIGPVMMGPSSSH

SEQ ID NO: 2001420 - protein, 24 aa, Staphylococcus
YQYFKEGLILFTYLHLANEEKLTQ

SEQ ID NO: 2001421 - protein, 19 aa, Staphylococcus
YQYQPRLNYLKAVDKLILD

SEQ ID NO: 2001422 - protein, 25 aa, Staphylococcus
YRKLGKYPPYYFLINFTISHKEMKK

SEQ ID NO: 2001423 - protein, 19 aa, Staphylococcus
YRLQKNWITPNSHRYYVAT

SEQ ID NO: 2001424 - protein, 20 aa, Staphylococcus
YSLGFGDPYPISGSHGLGLG

SEQ ID NO: 2001425 - protein, 28 aa, Staphylococcus
YSQRKIDVEPVFGFMKAILGFTRMSVRG

SEQ ID NO: 2001426 - protein, 21 aa, Staphylococcus
YSSFISYHIFFETLLRKYNER

SEQ ID NO: 2001427 - protein, 24 aa, Staphylococcus
YSSGMRAKLGFSINVTVNPDILVI

SEQ ID NO: 2001428 - protein, 22 aa, Staphylococcus
YSTQNLDLWYGENHALQNINLD

SEQ ID NO: 2001429 - protein, 32 aa, Staphylococcus
YTAPNFFLLERIRKAFPNKLILSGFDEMLVQA

SEQ ID NO: 2001430 - protein, 27 aa, Staphylococcus
YTTIRHIDFEKAMEFIGNLELVNMPQH

SEQ ID NO: 2001431 - protein, 20 aa, Staphylococcus
YVFISWTGKMTETFVLAHEL

SEQ ID NO: 2001432 - protein, 29 aa, Staphylococcus
YVGRIGVGRVFRGKMRVGDNVSLIKLDGS

SEQ ID NO: 2001433 - protein, 24 aa, Staphylococcus
YVSGGKRPLVCYFSNDLNIHRTKT

SEQ ID NO: 2001434 - protein, 39 aa, Staphylococcus
YVSRSHPGLLKRLFEQEVPEIFDGTVIVKSVAREAGDRS

SEQ ID NO: 2001435 - protein, 34 aa, Staphylococcus; identical to SEQ ID NO: 1797144

SEQ ID NO: 2001436 - protein, 24 aa, Staphylococcus
YWDSEARGAIFGLTRGTEKEHFIR

SEQ ID NO: 2001437 - protein, 17 aa, Staphylococcus
YWKLFLKPFETLEAFNY

SEQ ID NO: 2001438 - protein, 20 aa, Staphylococcus
YYRPEMPNTNPLFIGAIVDE

SEQ ID NO: 2001439 - protein, 19 aa, Staphylococcus
YYSVRIEDFSAKKRTKSIA

SEQ ID NO: 2001440 - protein, 17 aa, Staphylococcus
YYYGTLIIVSHDRALID

SEQ ID NO: 2001441 - protein, 17 aa, Staphylococcus
AAAENGIGKIIYISGSR

SEQ ID NO: 2001442 - protein, 17 aa, Staphylococcus
AAAFPEPYFTEMTSYYK

SEQ ID NO: 2001443 - protein, 25 aa, Staphylococcus
AAAIDFPRAHWVFPIQTHENKVAEV

SEQ ID NO: 2001444 - protein, 27 aa, Staphylococcus
AAAKAGFQDIQFDYVRFPEGFENQADS

SEQ ID NO: 2001445 - protein, 23 aa, Staphylococcus
AAALEMIHTYSLIHDDLPAMDDD

SEQ ID NO: 2001446 - protein, 17 aa, Staphylococcus
AAAMMLGFEDDFSHIST

SEQ ID NO: 2001447 - protein, 17 aa, Staphylococcus
AAAREWLQTEGIKNLKA

SEQ ID NO: 2001448 - protein, 23 aa, Staphylococcus
AAAREWLRTTGFKNIDDLNKVLT

SEQ ID NO: 2001449 - protein, 18 aa, Staphylococcus
AACDTTLKEAEQKVNDLM

SEQ ID NO: 2001450 - protein, 17 aa, Staphylococcus
AACKVITPLSPISIFAA

SEQ ID NO: 2001451 - protein, 20 aa, Staphylococcus
AADCKKAINEFIPKANIVKV

SEQ ID NO: 2001452 - protein, 22 aa, Staphylococcus
AADGYARMKGISAMVTTFGVGE

SEQ ID NO: 2001453 - protein, 38 aa, Staphylococcus
AADIKFGIKEDIDYIAASFVRRPSDVLDIREILEQENN

SEQ ID NO: 2001454 - protein, 21 aa, Staphylococcus
AADKFIKLDIDIHDKSNITVH

SEQ ID NO: 2001455 - protein, 27 aa, Staphylococcus
AAEALKEFPMLNSSWQGSEIKIHKDIN

SEQ ID NO: 2001456 - protein, 23 aa, Staphylococcus
AAEAQTGIVYAYFINSDLSELEN

SEQ ID NO: 2001457 - protein, 27 aa, Staphylococcus
AAEAYPSIIERGGGYRRIEIDTFPENQ

SEQ ID NO: 2001458 - protein, 26 aa, Staphylococcus
AAEEALKICNYCFEHGVVIIAVAGNV

SEQ ID NO: 2001459 - protein, 17 aa, Staphylococcus
AAEIRLGIIKGDIQAET

SEQ ID NO: 2001460 - protein, 18 aa, Staphylococcus
AAENIPLPEYGAVDQIEI

SEQ ID NO: 2001461 - protein, 24 aa, Staphylococcus
AAEQGIKLTFLPYVVKALVSALKK

SEQ ID NO: 2001462 - protein, 21 aa, Staphylococcus
AAERAGAAAISLHGRTRVQMY

SEQ ID NO: 2001463 - protein, 25 aa, Staphylococcus
AAEREVEGILDFYGYSRFHIPQFLR

SEQ ID NO: 2001464 - protein, 42 aa, Staphylococcus
AAESFKDIDRALVWGFNWKQGPFQLWDLMGFERVKARMKEEV

SEQ ID NO: 2001465 - protein, 24 aa, Staphylococcus
AAEWIKANMTKPVIGFIGGQTAPP

SEQ ID NO: 2001466 - protein, 19 aa, Staphylococcus
AAEWIKANMTKPVVGFIGG

SEQ ID NO: 2001467 - protein, 18 aa, Staphylococcus
AAFHKFYNAEKVLTDDIE

SEQ ID NO: 2001468 - protein, 17 aa, Staphylococcus
AAFSSIYFLLTSNDISH

SEQ ID NO: 2001469 - protein, 19 aa, Staphylococcus
AAFSYRLIGSCGLDSVRVI

SEQ ID NO: 2001470 - protein, 27 aa, Staphylococcus
AAGAHGEWTALMIFKAFHQKNGEGHRD

SEQ ID NO: 2001471 - protein, 27 aa, Staphylococcus
AAGAHGEWTALMIFKAYHEKNGEGHRN

SEQ ID NO: 2001472 - protein, 26 aa, Staphylococcus
AAGAHGEWTALMIFKAYHENNGQGHR

SEQ ID NO: 2001473 - protein, 28 aa, Staphylococcus
AAGAHGEWTALMIFKAYHIKNGEGHRNE

SEQ ID NO: 2001474 - protein, 28 aa, Staphylococcus
AAGAHGEWTALMIFKAYHLDNGEGHRDE

SEQ ID NO: 2001475 - protein, 27 aa, Staphylococcus
AAGAHGEWTALMIFKAYHQKNGEGHRD

SEQ ID NO: 2001476 - protein, 26 aa, Staphylococcus
AAGAHGEWTALMIFKAYHQNNGEGHR

SEQ ID NO: 2001477 - protein, 23 aa, Staphylococcus
AAGDARRGQSLVVWAIKEGRAVA

SEQ ID NO: 2001478 - protein, 24 aa, Staphylococcus
AAGDVKGGLQFTYISLDDFRILKS

SEQ ID NO: 2001479 - protein, 24 aa, Staphylococcus
AAGDVKGGLQFTYISLDDFRILRS

SEQ ID NO: 2001480 - protein, 20 aa, Staphylococcus
AAGFNKRITMRDIINNYPFP

SEQ ID NO: 2001481 - protein, 19 aa, Staphylococcus
AAGFPLSGVVGRKEIVDSA

SEQ ID NO: 2001482 - protein, 27 aa, Staphylococcus
AAGIAICKLLDAYGVRHMIMCDSKGAI

SEQ ID NO: 2001483 - protein, 19 aa, Staphylococcus
AAGIPKDFLSFKYILPSQR

SEQ ID NO: 2001484 - protein, 19 aa, Staphylococcus
AAGKTRLSNELLLTLDAKY

SEQ ID NO: 2001485 - protein, 21 aa, Staphylococcus
AAGQLSLFTSPVVILFNQGKE

SEQ ID NO: 2001486 - protein, 21 aa, Staphylococcus
AAGQPECIDLHITQDDLEELA

SEQ ID NO: 2001487 - protein, 28 aa, Staphylococcus
AAGYKPGEEVFLGFDCASSEFYENGVYD

SEQ ID NO: 2001488 - protein, 24 aa, Staphylococcus
AAGYSLNWLKRTFFDNDTFDEIVK

SEQ ID NO: 2001489 - protein, 20 aa, Staphylococcus
AAGYSLNWLKTTFFENDSFA

SEQ ID NO: 2001490 - protein, 25 aa, Staphylococcus
AAHSSMPFLGKNAVDTLVQFINHLN

SEQ ID NO: 2001491 - protein, 17 aa, Staphylococcus
AAHWAYKEGKKVTEKSQ

SEQ ID NO: 2001492 - protein, 18 aa, Staphylococcus
AAHWAYKEGKTINSKTQD

SEQ ID NO: 2001493 - protein, 22 aa, Staphylococcus
AAIKHNRKIVTFGRSMENNIKI

SEQ ID NO: 2001494 - protein, 19 aa, Staphylococcus
AAIKKGMILTAPPFYYDRV

SEQ ID NO: 2001495 - protein, 20 aa, Staphylococcus
AAIMGMRFNLVCPKELNPTD

SEQ ID NO: 2001496 - protein, 21 aa, Staphylococcus
AAIRAVVRTAIYNGIEVYGVY

SEQ ID NO: 2001497 - protein, 22 aa, Staphylococcus
AAISNFTQWLSVYFSKTNIRVN

SEQ ID NO: 2001498 - protein, 23 aa, Staphylococcus
AAISNFTQWLSVYFSKTNIRVNA

SEQ ID NO: 2001499 - protein, 19 aa, Staphylococcus
AAISRRVKKLINLDLIQWE

SEQ ID NO: 2001500 - protein, 21 aa, Staphylococcus
AAKEMKARVETLVGEQAQVLW

SEQ ID NO: 2001501 - protein, 19 aa, Staphylococcus
AAKGFGIDEDVAYRLASKY

SEQ ID NO: 2001502 - protein, 24 aa, Staphylococcus
AAKGGSGLHLRLEQVPTREQGISP

SEQ ID NO: 2001503 - protein, 24 aa, Staphylococcus
AAKILTEHLNIFVGLTDEAKNAEI

SEQ ID NO: 2001504 - protein, 19 aa, Staphylococcus
AAKIPGLKWIEIDVAITED

SEQ ID NO: 2001505 - protein, 25 aa, Staphylococcus
AAKKQGVRHIVFMSGLIPNEDKLSA

SEQ ID NO: 2001506 - protein, 22 aa, Staphylococcus
AAKPRIHVFIATSPIHRDSKLM

SEQ ID NO: 2001507 - protein, 23 aa, Staphylococcus
AAKQLRKGKVKRIVLTRPAVEAG

SEQ ID NO: 2001508 - protein, 19 aa, Staphylococcus
AAKQTRWFPLVGQAISASI

SEQ ID NO: 2001509 - protein, 26 aa, Staphylococcus
AAKRVFECGVCINVFGLDVTHQVLAT

SEQ ID NO: 2001510 - protein, 20 aa, Staphylococcus
AALADIPFFVTGGIGGVHKG

SEQ ID NO: 2001511 - protein, 23 aa, Staphylococcus
AALARSEADWIVGINATRALTTK

SEQ ID NO: 2001512 - protein, 23 aa, Staphylococcus
AALARSEADWVVGINATRALTTK

SEQ ID NO: 2001513 - protein, 17 aa, Staphylococcus
AALAYKHKKPIIFNKAA

SEQ ID NO: 2001514 - protein, 18 aa, Staphylococcus
AALCREHGILIAVDDIQQ

SEQ ID NO: 2001515 - protein, 25 aa, Staphylococcus
AALHFQVPCLFAKKAKPSTLKDGFF

SEQ ID NO: 2001516 - protein, 19 aa, Staphylococcus
AALHHDIIFSIGHTVADFD

SEQ ID NO: 2001517 - protein, 24 aa, Staphylococcus
AALHSRCPEAMVIDINDTKMLTKM

SEQ ID NO: 2001518 - protein, 18 aa, Staphylococcus
AALKAAVEAIDIDPSTIQ

SEQ ID NO: 2001519 - protein, 24 aa, Staphylococcus
AALKTGHIKVRFHNGSEYLAVSGG

SEQ ID NO: 2001520 - protein, 18 aa, Staphylococcus
AALQRFSLQDSNHLVQLG

SEQ ID NO: 2001521 - protein, 25 aa, Staphylococcus
AALRLGFTYEGMFRQAVIYKGRNRD

SEQ ID NO: 2001522 - protein, 25 aa, Staphylococcus
AALSAEMLDCDFFFFNPKDVDINHK

SEQ ID NO: 2001523 - protein, 25 aa, Staphylococcus
AALWGARAAIIGGFDSTSNVRAGKL

SEQ ID NO: 2001524 - protein, 24 aa, Staphylococcus
AAMAPCPYVYAVIAKRAIKDPKLN

SEQ ID NO: 2001525 - protein, 23 aa, Staphylococcus
AAMAPCPYVYEVVAKMALDDQNL

SEQ ID NO: 2001526 - protein, 23 aa, Staphylococcus
AAMAPCPYVYQFIAQEALRDKEL

SEQ ID NO: 2001527 - protein, 17 aa, Staphylococcus
AAMDFIFKDDPSELKTR

SEQ ID NO: 2001528 - protein, 17 aa, Staphylococcus
AAMIAAVGLNWFESIED

SEQ ID NO: 2001529 - protein, 17 aa, Staphylococcus
AAMKIAVDLVDEGVITK

SEQ ID NO: 2001530 - protein, 18 aa, Staphylococcus
AAMKLGATMINDQWAGLN

SEQ ID NO: 2001531 - protein, 24 aa, Staphylococcus
AANEYKGELIFLHKVKDGAVDDSY

SEQ ID NO: 2001532 - protein, 20 aa, Staphylococcus
AANGELLFGTIDSWLVWKLS

SEQ ID NO: 2001533 - protein, 21 aa, Staphylococcus
AANHYGLRCVIYAPEGFAAEK

SEQ ID NO: 2001534 - protein, 19 aa, Staphylococcus
AANINGMFNVLEQQIIHSK

SEQ ID NO: 2001535 - protein, 19 aa, Staphylococcus
AANLIKPDLAIAVDVGVAY

SEQ ID NO: 2001536 - protein, 25 aa, Staphylococcus
AANRYHLKCVIFAPEGFSEEKISIM

SEQ ID NO: 2001537 - protein, 26 aa, Staphylococcus
AANRYHLKCVIFAPEGFSEEKISIMR

SEQ ID NO: 2001538 - protein, 22 aa, Staphylococcus
AAPHRYKLKLIGETSHSGSTPM

SEQ ID NO: 2001539 - protein, 20 aa, Staphylococcus
AAPLRVKVRLIIKETGEVKE

SEQ ID NO: 2001540 - protein, 22 aa, Staphylococcus
AAPLRVKVRLVIKETGEVKEQE

SEQ ID NO: 2001541 - protein, 25 aa, Staphylococcus
AAQAKKCKKVIVASSISIYADPDTL

SEQ ID NO: 2001542 - protein, 23 aa, Staphylococcus
AAQKGLPFVIAFMGQSQTKINSL

SEQ ID NO: 2001543 - protein, 24 aa, Staphylococcus
AAQMLKFGLPRLVDYQQQDMIKRQ

SEQ ID NO: 2001544 - protein, 19 aa, Staphylococcus
AAQQAGIDGLDEFLVGPTA

SEQ ID NO: 2001545 - protein, 19 aa, Staphylococcus
AAQRLGFTFEGVFRQAVIY

SEQ ID NO: 2001546 - protein, 17 aa, Staphylococcus
AAQRLSDLMAYMQLDTK

SEQ ID NO: 2001547 - protein, 20 aa, Staphylococcus
AARARGRYGGRPEKLNKRDL

SEQ ID NO: 2001548 - protein, 21 aa, Staphylococcus
AARARGRYGGRPEKLNQKDLN

SEQ ID NO: 2001549 - protein, 23 aa, Staphylococcus
AARDHVLTGLEFACGIPGSVGGA

SEQ ID NO: 2001550 - protein, 23 aa, Staphylococcus
AAREIEVGELFTVEDIQYTEKGT

SEQ ID NO: 2001551 - protein, 19 aa, Staphylococcus
AARHLLKQGGRFIMVHRAE

SEQ ID NO: 2001552 - protein, 28 aa, Staphylococcus
AARKARAAQLCQEFNAIPATELAQQESK

SEQ ID NO: 2001553 - protein, 17 aa, Staphylococcus
AARVAVGAVSKILLSQL

SEQ ID NO: 2001554 - protein, 24 aa, Staphylococcus
AASAHGIHVAEHLAGMQPKTIKQE

SEQ ID NO: 2001555 - protein, 25 aa, Staphylococcus
AASEVEGINWLELDVAITKDEQLII

SEQ ID NO: 2001556 - protein, 19 aa, Staphylococcus
AASFAKLWLDKHPNETIGL

SEQ ID NO: 2001557 - protein, 17 aa, Staphylococcus
AASFCMDNNIPLNVFSI

SEQ ID NO: 2001558 - protein, 20 aa, Staphylococcus
AASIAHIRLRVKINDDYVFT

SEQ ID NO: 2001559 - protein, 21 aa, Staphylococcus
AASIELANGILKLAEQIAQQK

SEQ ID NO: 2001560 - protein, 25 aa, Staphylococcus
AASIISRYAFVKHMDQIGSELHTTV

SEQ ID NO: 2001561 - protein, 24 aa, Staphylococcus
AASMKYIAEHGGMILYLPQEGRGI

SEQ ID NO: 2001562 - protein, 32 aa, Staphylococcus
AASSCYIISLAAALERARFTSVSINQQSIGTA

SEQ ID NO: 2001563 - protein, 24 aa, Staphylococcus
AASSCYIISLAATLERAGYKDIRI

SEQ ID NO: 2001564 - protein, 23 aa, Staphylococcus
AASSCYIISLAATLERAKFTNIH

SEQ ID NO: 2001565 - protein, 26 aa, Staphylococcus
AATDERIIFCAKRLSGYDSEIFHYGK

SEQ ID NO: 2001566 - protein, 27 aa, Staphylococcus
AATGLRPIAELMFNDFIGFGLDPILNQ

SEQ ID NO: 2001567 - protein, 28 aa, Staphylococcus
AATGLRPIAELMFNDFIGFGLDPILNQG

SEQ ID NO: 2001568 - protein, 29 aa, Staphylococcus
AATGLRPIAELMFNDFLGFGLDPILNQGA

SEQ ID NO: 2001569 - protein, 19 aa, Staphylococcus
AATIKMTRIIEAFDGEMNQ

SEQ ID NO: 2001570 - protein, 19 aa, Staphylococcus
AATLPSTFFYSGAAPKDGK

SEQ ID NO: 2001571 - protein, 19 aa, Staphylococcus
AATTAAWDGHRVNIIDTPG

SEQ ID NO: 2001572 - protein, 18 aa, Staphylococcus
AATVFYGPHWERLSKAKA

SEQ ID NO: 2001573 - protein, 21 aa, Staphylococcus
AAVADEIICVFDAYEQEGNES

SEQ ID NO: 2001574 - protein, 19 aa, Staphylococcus
AAVCGEVFTSPTPDKILEA

SEQ ID NO: 2001575 - protein, 18 aa, Staphylococcus
AAVDLKVILEYGESAPKI

SEQ ID NO: 2001576 - protein, 19 aa, Staphylococcus
AAVDLKVILEYGESAPKIF

SEQ ID NO: 2001577 - protein, 19 aa, Staphylococcus
AAVLGRIAAKLAKVPTIIY

SEQ ID NO: 2001578 - protein, 20 aa, Staphylococcus
AAVQLHRLLGIQPFARCFEM

SEQ ID NO: 2001579 - protein, 18 aa, Staphylococcus
AAVQLICNLFKPGDEILV

SEQ ID NO: 2001580 - protein, 21 aa, Staphylococcus
AAVRAVVRKAIYNNIEVFGVY

SEQ ID NO: 2001581 - protein, 21 aa, Staphylococcus
AAVRAVVRKAIYNNIEVYGIY

SEQ ID NO: 2001582 - protein, 20 aa, Staphylococcus
AAVRAVVRKAIYNNIEVYGV

SEQ ID NO: 2001583 - protein, 19 aa, Staphylococcus
AAWAIKDYGFDIIIAGSYS

SEQ ID NO: 2001584 - protein, 30 aa, Staphylococcus
AAWALKDFGFNIIIAGGFSDIFYMNCTKNG

SEQ ID NO: 2001585 - protein, 26 aa, Staphylococcus
AAYEEIIKSFNLFSMLDNVEKQLEVV

SEQ ID NO: 2001586 - protein, 17 aa, Staphylococcus
AAYKNKEVDGFTTNPSL

SEQ ID NO: 2001587 - protein, 18 aa, Staphylococcus
AAYQRKVYQLVDEGESLT

SEQ ID NO: 2001588 - protein, 24 aa, Staphylococcus
ACADRVFRELPFVVNQAKVDQLEL

SEQ ID NO: 2001589 - protein, 25 aa, Staphylococcus
ACDYIFCKAFGKTATNIESYTDQGT

SEQ ID NO: 2001590 - protein, 23 aa, Staphylococcus
ACEALYRTGIRPDKIANSLSHQQ

SEQ ID NO: 2001591 - protein, 19 aa, Staphylococcus
ACFHIPNYHKTLMLSDSAF

SEQ ID NO: 2001592 - protein, 17 aa, Staphylococcus
ACGVSYSTVSKALKNSQ

SEQ ID NO: 2001593 - protein, 19 aa, Staphylococcus
ACHMAEILAPTGSVDATDI

SEQ ID NO: 2001594 - protein, 24 aa, Staphylococcus
ACIAANIHPIFGMTINLTDGLSEL

SEQ ID NO: 2001595 - protein, 19 aa, Staphylococcus
ACIHSGMDEHERAQNIKQL

SEQ ID NO: 2001596 - protein, 21 aa, Staphylococcus
ACILLDLMLPEMDGIEVASKL

SEQ ID NO: 2001597 - protein, 17 aa, Staphylococcus
ACKDHIHMLVSIPPKIG

SEQ ID NO: 2001598 - protein, 27 aa, Staphylococcus
ACLIADQLAQHCDFFSFGTNDLTQLTY

SEQ ID NO: 2001599 - protein, 23 aa, Staphylococcus
ACLNKHLHFHGSAKAFKSLDQVE

SEQ ID NO: 2001600 - protein, 22 aa, Staphylococcus
ACNTWRLVYQRLQAIEKATYRH

SEQ ID NO: 2001601 - protein, 24 aa, Staphylococcus
ACPTCGSCAGMFTANSMNCLMEVL

SEQ ID NO: 2001602 - protein, 21 aa, Staphylococcus
ACPTCGSCSGMFTANSMNCLM

SEQ ID NO: 2001603 - protein, 17 aa, Staphylococcus
ACQLKFIGPNYESIQKM

SEQ ID NO: 2001604 - protein, 17 aa, Staphylococcus
ACQLKFIGPSYESIQKM

SEQ ID NO: 2001605 - protein, 17 aa, Staphylococcus
ADAALSLVKKFEEPTTI

SEQ ID NO: 2001606 - protein, 20 aa, Staphylococcus
ADAATLIFENFEIIEAKLRG

SEQ ID NO: 2001607 - protein, 19 aa, Staphylococcus
ADAATLIFENFEILEAKSK

SEQ ID NO: 2001608 - protein, 18 aa, Staphylococcus
ADAATLLSGLGIPAELHD

SEQ ID NO: 2001609 - protein, 24 aa, Staphylococcus
ADAEILEWFDAIGRRRGLLQRGNE

SEQ ID NO: 2001610 - protein, 18 aa, Staphylococcus
ADAFGFFGNYGGQYVPET

SEQ ID NO: 2001611 - protein, 20 aa, Staphylococcus
ADAIKFLLYYDVDEPDEINQ

SEQ ID NO: 2001612 - protein, 27 aa, Staphylococcus
ADAKPEDFDGLLIPGGFSPDHLRGDAE

SEQ ID NO: 2001613 - protein, 17 aa, Staphylococcus
ADAPGFPVRAFAITPEK

SEQ ID NO: 2001614 - protein, 22 aa, Staphylococcus
ADASINWALGLMNEGNQIIDNT

SEQ ID NO: 2001615 - protein, 21 aa, Staphylococcus
ADASLAMLLYRDDYYNHDEVD

SEQ ID NO: 2001616 - protein, 27 aa, Staphylococcus
ADASYLREFANIYALLIPIMPDLESVR

SEQ ID NO: 2001617 - protein, 24 aa, Staphylococcus
ADAVEAIICGIGINLNHQEEDFSD

SEQ ID NO: 2001618 - protein, 20 aa, Staphylococcus
ADAVGLPVVLYNVPSRTNMT

SEQ ID NO: 2001619 - protein, 26 aa, Staphylococcus
ADAVIPYLRKCFRISQDRKDIGIAGA

SEQ ID NO: 2001620 - protein, 20 aa, Staphylococcus
ADCKKVLEALSQRFTNKTSH

SEQ ID NO: 2001621 - protein, 19 aa, Staphylococcus
ADCNIRFKNHLLDLGIIDD

SEQ ID NO: 2001622 - protein, 20 aa, Staphylococcus
ADDAPYLWDEILKNDVTPCG

SEQ ID NO: 2001623 - protein, 24 aa, Staphylococcus
ADDFKRYYPTNALITGYDIIFFWV

SEQ ID NO: 2001624 - protein, 24 aa, Staphylococcus
ADDFKRYYPTNALVTGYDIIFFWV

SEQ ID NO: 2001625 - protein, 31 aa, Staphylococcus
ADDNIMFRRIYRLPIGFEWQHQSNVTLIGDA

SEQ ID NO: 2001626 - protein, 22 aa, Staphylococcus
ADDRLKKVAKHLVANHHKKTRN

SEQ ID NO: 2001627 - protein, 18 aa, Staphylococcus
ADDVLKDTYLVQIQLIDD

SEQ ID NO: 2001628 - protein, 21 aa, Staphylococcus
ADEAICIGEANPLDSYLNIER

SEQ ID NO: 2001629 - protein, 24 aa, Staphylococcus
ADEAYPSIKARGGGYQKIEIDSFP

SEQ ID NO: 2001630 - protein, 17 aa, Staphylococcus
ADECFRDELAKAPVKYF

SEQ ID NO: 2001631 - protein, 21 aa, Staphylococcus
ADEIKAGDIIRLLEGPISFVE

SEQ ID NO: 2001632 - protein, 21 aa, Staphylococcus
ADEIKAGDIIRLLEGPITIVE

SEQ ID NO: 2001633 - protein, 28 aa, Staphylococcus
ADEIYKPYIEGFVTMLAPIAPHIGEELW

SEQ ID NO: 2001634 - protein, 22 aa, Staphylococcus
ADELDMIINIGALKDGRYDEVR

SEQ ID NO: 2001635 - protein, 18 aa, Staphylococcus
ADELLKVKLDTSLIKQID

SEQ ID NO: 2001636 - protein, 18 aa, Staphylococcus
ADEMIEWFEKEACDGFML

SEQ ID NO: 2001637 - protein, 29 aa, Staphylococcus
ADESYPSMIARGGGYRRLDIDTFPQDGFL

SEQ ID NO: 2001638 - protein, 17 aa, Staphylococcus
ADEVGAKLMVDMAHIAG

SEQ ID NO: 2001639 - protein, 25 aa, Staphylococcus
ADEVPACNEVQCGWAASHSLEGAKE

SEQ ID NO: 2001640 - protein, 18 aa, Staphylococcus
ADEYLDVFQIGARNMQNF

SEQ ID NO: 2001641 - protein, 23 aa, Staphylococcus
ADFADIFCETGVFSVEESKRYME

SEQ ID NO: 2001642 - protein, 23 aa, Staphylococcus
ADFADIFCETGVFSVEESRHYMQ

SEQ ID NO: 2001643 - protein, 23 aa, Staphylococcus
ADFADIFCETGVFSVEESRKYMQ

SEQ ID NO: 2001644 - protein, 18 aa, Staphylococcus
ADFARAVIEGITYSLYDS

SEQ ID NO: 2001645 - protein, 24 aa, Staphylococcus
ADFESLCFHVPFTKMGKKALESII

SEQ ID NO: 2001646 - protein, 23 aa, Staphylococcus
ADFINGYCFGHAVQVQTEDESTQ

SEQ ID NO: 2001647 - protein, 24 aa, Staphylococcus
ADFKLKDHYSALRIRVKDNTYEMT

SEQ ID NO: 2001648 - protein, 19 aa, Staphylococcus
ADFNTHFDGWFSETTLYDK

SEQ ID NO: 2001649 - protein, 19 aa, Staphylococcus
ADFSRAVIEGVTYSLYDSI

SEQ ID NO: 2001650 - protein, 21 aa, Staphylococcus
ADGEIGWKKVISDFYSSFKQD

SEQ ID NO: 2001651 - protein, 18 aa, Staphylococcus
ADGFIDIGPFAGKHGGQL

SEQ ID NO: 2001652 - protein, 17 aa, Staphylococcus
ADGFPRMMQGTNVEVNG

SEQ ID NO: 2001653 - protein, 25 aa, Staphylococcus
ADGHIRINLAVPRTVLQQGLTKIKA

SEQ ID NO: 2001654 - protein, 25 aa, Staphylococcus
ADGIIIVSPVFKAAYSGIVKTYLDL

SEQ ID NO: 2001655 - protein, 23 aa, Staphylococcus
ADGKSPMEVELVFQLKDKQFKVV

SEQ ID NO: 2001656 - protein, 24 aa, Staphylococcus
ADGKSPMSVEYEFKINDKKFKISR

SEQ ID NO: 2001657 - protein, 17 aa, Staphylococcus
ADGLIFHPYLAGERAPL

SEQ ID NO: 2001658 - protein, 20 aa, Staphylococcus
ADGTIEFTGLIMSPDGKERY

SEQ ID NO: 2001659 - protein, 18 aa, Staphylococcus
ADGVFIYIGMKPLTTPFT

SEQ ID NO: 2001660 - protein, 18 aa, Staphylococcus
ADGVFVYIGMKPLTAPFI

SEQ ID NO: 2001661 - protein, 25 aa, Staphylococcus
ADGYARINGLGALVITFGVGELSAV

SEQ ID NO: 2001662 - protein, 18 aa, Staphylococcus
ADGYARINGLGVLVTTFG

SEQ ID NO: 2001663 - protein, 24 aa, Staphylococcus
ADGYARLKGVSALVTTFGVGELSA

SEQ ID NO: 2001664 - protein, 17 aa, Staphylococcus
ADGYLRIMQGHFVNVKG

SEQ ID NO: 2001665 - protein, 21 aa, Staphylococcus
ADGYPRMMKGFSVNVNGKQCE

SEQ ID NO: 2001666 - protein, 22 aa, Staphylococcus
ADHLKHPVSYYFKNNFYMTPSG

SEQ ID NO: 2001667 - protein, 26 aa, Staphylococcus
ADHLLEFKDKLKGELQNAGQDVKLTV

SEQ ID NO: 2001668 - protein, 17 aa, Staphylococcus
ADIAAAVHTYLNDCEKI

SEQ ID NO: 2001669 - protein, 17 aa, Staphylococcus
ADIAHYITEHLTDCEKI

SEQ ID NO: 2001670 - protein, 17 aa, Staphylococcus
ADIATAVNEHLKDCDKI

SEQ ID NO: 2001671 - protein, 25 aa, Staphylococcus
ADIFEKCLHTYLIKDAIRDGNVLGF

SEQ ID NO: 2001672 - protein, 21 aa, Staphylococcus
ADIFPQHAITLEHAFSVLSDE

SEQ ID NO: 2001673 - protein, 19 aa, Staphylococcus
ADIFYLKEEDLLPLERMGN

SEQ ID NO: 2001674 - protein, 20 aa, Staphylococcus
ADIGTPCLIQPSKTAHQSQH

SEQ ID NO: 2001675 - protein, 19 aa, Staphylococcus
ADIIKLAMVKFYEKVKDTN

SEQ ID NO: 2001676 - protein, 21 aa, Staphylococcus
ADIKGLKIWMFGVDEGDQIRC

SEQ ID NO: 2001677 - protein, 19 aa, Staphylococcus
ADIKGLKIWVFAVDEGEQI

SEQ ID NO: 2001678 - protein, 17 aa, Staphylococcus
ADIKHYVMVSTYDSRRE

SEQ ID NO: 2001679 - protein, 26 aa, Staphylococcus
ADIKTYIFYQLFDKYVIDYSMASATG

SEQ ID NO: 2001680 - protein, 30 aa, Staphylococcus
ADILFYVAEWPKARLNHWRTLLQSRAIEND

SEQ ID NO: 2001681 - protein, 19 aa, Staphylococcus
ADILKFGIQADGHFVVINA

SEQ ID NO: 2001682 - protein, 19 aa, Staphylococcus
ADILRKVLFGPTITVKALL

SEQ ID NO: 2001683 - protein, 18 aa, Staphylococcus
ADILYIGFISSKGAIEEG

SEQ ID NO: 2001684 - protein, 17 aa, Staphylococcus
ADINGLERLGQYWDTVR

SEQ ID NO: 2001685 - protein, 19 aa, Staphylococcus
ADIPGLKWIELDVAITKDE

SEQ ID NO: 2001686 - protein, 19 aa, Staphylococcus
ADIPILINCFNDLIEQNNT

SEQ ID NO: 2001687 - protein, 19 aa, Staphylococcus
ADIPILINCFNNLIEQNNT

SEQ ID NO: 2001688 - protein, 23 aa, Staphylococcus
ADIPVLMKCFDDLMSRNNTVILI

SEQ ID NO: 2001689 - protein, 17 aa, Staphylococcus
ADIQAGYQFDASGIGLV

SEQ ID NO: 2001690 - protein, 19 aa, Staphylococcus
ADIYSVSSRRSLKEGDEGI

SEQ ID NO: 2001691 - protein, 28 aa, Staphylococcus
ADKAAARFGSGWAWLVVNNGKLEIVTTP

SEQ ID NO: 2001692 - protein, 28 aa, Staphylococcus
ADKAAARFGSGWAWLVVNNGQLEIVTTP

SEQ ID NO: 2001693 - protein, 28 aa, Staphylococcus
ADKAAGRFGSGWAWLVVNNGKLEIVTTP

SEQ ID NO: 2001694 - protein, 22 aa, Staphylococcus
ADKDLKENLPFIQKLSQKYHVT

SEQ ID NO: 2001695 - protein, 20 aa, Staphylococcus
ADKDPVNAFYSWKKNANDII

SEQ ID NO: 2001696 - protein, 32 aa, Staphylococcus
ADKEMKIAILPVGYADGYLRAMQGAYVNVNGH

SEQ ID NO: 2001697 - protein, 17 aa, Staphylococcus
ADKIIENYHKLWGKEAS

SEQ ID NO: 2001698 - protein, 27 aa, Staphylococcus
ADKILIGGGMAYTFIKAQGHEIGKSLL

SEQ ID NO: 2001699 - protein, 26 aa, Staphylococcus
ADKILIGGGMAYTFLKAQGKEIGLSL

SEQ ID NO: 2001700 - protein, 26 aa, Staphylococcus
ADKILIGGGMAYTFMKAQGKEIGLSL

SEQ ID NO: 2001701 - protein, 23 aa, Staphylococcus
ADKLEIGDDIALYGEDGELYGTL

SEQ ID NO: 2001702 - protein, 23 aa, Staphylococcus
ADKLGKLRPAFKKDGSVTAGNAS

SEQ ID NO: 2001703 - protein, 23 aa, Staphylococcus
ADKLRSASQPVIITGHEINSFHL

SEQ ID NO: 2001704 - protein, 24 aa, Staphylococcus
ADKMKDWYEKFGFGKSTNGMFDGE

SEQ ID NO: 2001705 - protein, 24 aa, Staphylococcus
ADKMKSWYEKFGFGKKTGGLFDGE

SEQ ID NO: 2001706 - protein, 24 aa, Staphylococcus
ADKMKSWYERFGFGKKTDGMFDGE

SEQ ID NO: 2001707 - protein, 25 aa, Staphylococcus
ADKMKSWYERFGFGKSTNGMFDGEL

SEQ ID NO: 2001708 - protein, 25 aa, Staphylococcus
ADKMKSWYERFGFGKTTGGMFDGEA

SEQ ID NO: 2001709 - protein, 29 aa, Staphylococcus
ADKMKSWYERFGFSKPTGGLFDGEAEGNI

SEQ ID NO: 2001710 - protein, 20 aa, Staphylococcus
ADKNSLILFDELGAGTDPSE

SEQ ID NO: 2001711 - protein, 23 aa, Staphylococcus
ADKPFYEGLVSFITSAPVFAMVV

SEQ ID NO: 2001712 - protein, 21 aa, Staphylococcus
ADKYANWEWNYGHSPRYEYNR

SEQ ID NO: 2001713 - protein, 19 aa, Staphylococcus
ADKYIKAFYEDVGALNVKK

SEQ ID NO: 2001714 - protein, 24 aa, Staphylococcus
ADLAHQYPRLHIHVHLDNSEHVIE

SEQ ID NO: 2001715 - protein, 17 aa, Staphylococcus
ADLDDVKGVEECEAQPP

SEQ ID NO: 2001716 - protein, 21 aa, Staphylococcus
ADLDVLKARIAKRNRNFEHTI

SEQ ID NO: 2001717 - protein, 21 aa, Staphylococcus
ADLESLAGVGRKTANVVMSVA

SEQ ID NO: 2001718 - protein, 19 aa, Staphylococcus
ADLGIKNGYIMKYGKAGNP

SEQ ID NO: 2001719 - protein, 18 aa, Staphylococcus
ADLGVKYVIIGHSERREL

SEQ ID NO: 2001720 - protein, 17 aa, Staphylococcus
ADLGVKYVVIGHSERRD

SEQ ID NO: 2001721 - protein, 17 aa, Staphylococcus
ADLGVKYVVIGHSERRE

SEQ ID NO: 2001722 - protein, 17 aa, Staphylococcus
ADLGYDLFMRTTKDIKI

SEQ ID NO: 2001723 - protein, 17 aa, Staphylococcus
ADLIIGEVVMYHINEDV

SEQ ID NO: 2001724 - protein, 25 aa, Staphylococcus
ADLIKRIDTHLAIDFMDVSSYHGGT

SEQ ID NO: 2001725 - protein, 18 aa, Staphylococcus
ADLILTMGSSHKRIIKEL

SEQ ID NO: 2001726 - protein, 17 aa, Staphylococcus
ADLKEIIIRTAEVLGTD

SEQ ID NO: 2001727 - protein, 19 aa, Staphylococcus
ADLKVHRMVTVVLDRAAAD

SEQ ID NO: 2001728 - protein, 22 aa, Staphylococcus
ADLLIDLGLIEDVDYIAARLDE

SEQ ID NO: 2001729 - protein, 23 aa, Staphylococcus
ADLLIMIGTNFPFVKYLPKKNIK

SEQ ID NO: 2001730 - protein, 17 aa, Staphylococcus
ADLLKQWFMTSQRTNKS

SEQ ID NO: 2001731 - protein, 20 aa, Staphylococcus
ADLLLWFLRPEMKDLNKIEN

SEQ ID NO: 2001732 - protein, 19 aa, Staphylococcus
ADLLLWFLRPEMKELNSIE

SEQ ID NO: 2001733 - protein, 20 aa, Staphylococcus
ADLMIDLGLIEDVDHIAARL

SEQ ID NO: 2001734 - protein, 17 aa, Staphylococcus
ADLNYRGQRLLDFIHEA

SEQ ID NO: 2001735 - protein, 17 aa, Staphylococcus
ADLRPFYETILGFEVIT

SEQ ID NO: 2001736 - protein, 21 aa, Staphylococcus
ADLSPKFVVGYVETKEKHPDA

SEQ ID NO: 2001737 - protein, 20 aa, Staphylococcus
ADLSPKFVVGYVETKEKHPN

SEQ ID NO: 2001738 - protein, 22 aa, Staphylococcus
ADLTIGLILSVARRIVEGDELS

SEQ ID NO: 2001739 - protein, 19 aa, Staphylococcus
ADLVELDWAEGFDIECRNE

SEQ ID NO: 2001740 - protein, 20 aa, Staphylococcus
ADLYLEGSDQYRGWFNSSIT

SEQ ID NO: 2001741 - protein, 20 aa, Staphylococcus
ADMAFANDLAFWTARDASKM

SEQ ID NO: 2001742 - protein, 17 aa, Staphylococcus
ADMEAVGIISPVTDLNV

SEQ ID NO: 2001743 - protein, 17 aa, Staphylococcus
ADMYRKQFEEILVDEYQ

SEQ ID NO: 2001744 - protein, 18 aa, Staphylococcus
ADNEGVDMRLHRVIYNVI

SEQ ID NO: 2001745 - protein, 21 aa, Staphylococcus
ADNFRPIRLDRHFPDWHETYS

SEQ ID NO: 2001746 - protein, 26 aa, Staphylococcus
ADNGIKFFGADGFKLSDAQEEEIETL

SEQ ID NO: 2001747 - protein, 26 aa, Staphylococcus
ADNGIKFFGADGFKLSDKQEEEIEQL

SEQ ID NO: 2001748 - protein, 26 aa, Staphylococcus
ADNGIKFFGSDGFKLSDDQEEEIEAL

SEQ ID NO: 2001749 - protein, 26 aa, Staphylococcus
ADNGIKFFGSDGFKLSDDQENEIEAL

SEQ ID NO: 2001750 - protein, 26 aa, Staphylococcus
ADNGIKFFGSDGFKLSDDQENEIEEL

SEQ ID NO: 2001751 - protein, 26 aa, Staphylococcus
ADNGIKFFGSDGFKLSDDQESEIEAL

SEQ ID NO: 2001752 - protein, 18 aa, Staphylococcus
ADNIKLMASGGVSFSGET

SEQ ID NO: 2001753 - protein, 28 aa, Staphylococcus
ADNLKSLMLEFLRFAGYNTPININKMNY

SEQ ID NO: 2001754 - protein, 23 aa, Staphylococcus
ADNLRGLGFEVVRFKTGTPPRVN

SEQ ID NO: 2001755 - protein, 25 aa, Staphylococcus
ADNLRGLGFEVVRFKTGTPPRVNSK

SEQ ID NO: 2001756 - protein, 19 aa, Staphylococcus
ADNPLNWQYVKPIKTQLTD

SEQ ID NO: 2001757 - protein, 24 aa, Staphylococcus
ADNPMKQKVCDVAIMAFENAMKKV

SEQ ID NO: 2001758 - protein, 21 aa, Staphylococcus
ADPAIDIGMLLYNYVPERKWS

SEQ ID NO: 2001759 - protein, 21 aa, Staphylococcus
ADPAIDIGMLLYNYVPKQQWS

SEQ ID NO: 2001760 - protein, 20 aa, Staphylococcus
ADPAIDIGMLLYNYVPQSEW

SEQ ID NO: 2001761 - protein, 21 aa, Staphylococcus
ADPAIDLGMLLYNYVPENKWP

SEQ ID NO: 2001762 - protein, 24 aa, Staphylococcus
ADPDYRVKPPFFIQWDENEQKRNE

SEQ ID NO: 2001763 - protein, 17 aa, Staphylococcus
ADPTPAVIHWFNKLNEL

SEQ ID NO: 2001764 - protein, 18 aa, Staphylococcus
ADPYYIWLSEVMLQQTQV

SEQ ID NO: 2001765 - protein, 18 aa, Staphylococcus
ADQALLQRLDLLKFQHEE

SEQ ID NO: 2001766 - protein, 17 aa, Staphylococcus
ADQALLQRLDLMKFQFE

SEQ ID NO: 2001767 - protein, 17 aa, Staphylococcus
ADQALLQRLDLMKFQLE

SEQ ID NO: 2001768 - protein, 25 aa, Staphylococcus
ADQSVFHIHFHFLPRYENDIDGFGY

SEQ ID NO: 2001769 - protein, 24 aa, Staphylococcus
ADQVKRISLELGGNAPVIVLNDAD

SEQ ID NO: 2001770 - protein, 18 aa, Staphylococcus
ADRLYFLKRHTIINQLDF

SEQ ID NO: 2001771 - protein, 23 aa, Staphylococcus
ADSIKFILVKGSDVPTYVEEGIA

SEQ ID NO: 2001772 - protein, 19 aa, Staphylococcus
ADSIYLLIEGYISREQLNE

SEQ ID NO: 2001773 - protein, 26 aa, Staphylococcus
ADSKKRFDEMLGWFKYEIRQYTESDI

SEQ ID NO: 2001774 - protein, 17 aa, Staphylococcus
ADSLGIDGTEVISVDID

SEQ ID NO: 2001775 - protein, 29 aa, Staphylococcus
ADSLHIGHLLPFLTLRRFQEHGHRPLVLI

SEQ ID NO: 2001776 - protein, 19 aa, Staphylococcus
ADSLIKRTMEPTRQALKDA

SEQ ID NO: 2001777 - protein, 18 aa, Staphylococcus
ADSLIKRTMEPTRQAMKD

SEQ ID NO: 2001778 - protein, 17 aa, Staphylococcus
ADSLRYFLATGSAPGQD

SEQ ID NO: 2001779 - protein, 28 aa, Staphylococcus
ADSMHIGHLLPLLTLRRFQNHGHKPIVL

SEQ ID NO: 2001780 - protein, 19 aa, Staphylococcus
ADSMLDPKAREDLFELVKR

SEQ ID NO: 2001781 - protein, 22 aa, Staphylococcus
ADSRMGYKAALEDFNLNMDERL

SEQ ID NO: 2001782 - protein, 20 aa, Staphylococcus
ADSRQLLKLVNRKFDVTSTT

SEQ ID NO: 2001783 - protein, 25 aa, Staphylococcus
ADSYIPYPVEVEVGGATVFVMPVEA

SEQ ID NO: 2001784 - protein, 27 aa, Staphylococcus
ADTDVIDVFPIRFIVDGDNEVSDPKEL

SEQ ID NO: 2001785 - protein, 19 aa, Staphylococcus
ADTGISFVVGEADNPMKQK

SEQ ID NO: 2001786 - protein, 24 aa, Staphylococcus
ADTKKLTGWYSRRIAVGENGEIKG

SEQ ID NO: 2001787 - protein, 17 aa, Staphylococcus
ADTLFNLVDQSRSYLAE

SEQ ID NO: 2001788 - protein, 25 aa, Staphylococcus
ADTNYMIGMSFNQLGAFKEAMPFLM

SEQ ID NO: 2001789 - protein, 21 aa, Staphylococcus
ADTQFTGLLFGFIHVPFIPEQ

SEQ ID NO: 2001790 - protein, 19 aa, Staphylococcus
ADTRWKELGQHVSQLVAIE

SEQ ID NO: 2001791 - protein, 20 aa, Staphylococcus
ADTSFYCWNIGLPDATDYVN

SEQ ID NO: 2001792 - protein, 20 aa, Staphylococcus
ADTTPKRFIREFRNVNVDEY

SEQ ID NO: 2001793 - protein, 18 aa, Staphylococcus
ADVAIDFSNPNLLLPLLD

SEQ ID NO: 2001794 - protein, 19 aa, Staphylococcus
ADVFIGVSVADLLTKDMVK

SEQ ID NO: 2001795 - protein, 19 aa, Staphylococcus
ADVFIGVSVANALSQDMVK

SEQ ID NO: 2001796 - protein, 25 aa, Staphylococcus
ADVFKRSGIDFCCGGQVSIEEAAEE

SEQ ID NO: 2001797 - protein, 20 aa, Staphylococcus
ADVIKFLKYFTFLDKEEIER

SEQ ID NO: 2001798 - protein, 17 aa, Staphylococcus
ADVKITGDFTIENDPED

SEQ ID NO: 2001799 - protein, 24 aa, Staphylococcus
ADVNFKVVKSFIKTVSERALGSDV

SEQ ID NO: 2001800 - protein, 23 aa, Staphylococcus
ADVNLKISLPFITNLAQRYQVDI

SEQ ID NO: 2001801 - protein, 17 aa, Staphylococcus
ADVPIYYYGLNKNDDIY

SEQ ID NO: 2001802 - protein, 18 aa, Staphylococcus
ADVPVWLDRNSPFNIEGG

SEQ ID NO: 2001803 - protein, 21 aa, Staphylococcus
ADVRYQAYQSWCEKHDVEEIV

SEQ ID NO: 2001804 - protein, 29 aa, Staphylococcus
ADVTIALMSGQFVMRGEPAIFNKFIRAEM

SEQ ID NO: 2001805 - protein, 20 aa, Staphylococcus
ADWCPDCKVIEPDLPKLENK

SEQ ID NO: 2001806 - protein, 20 aa, Staphylococcus
ADWCPDCKVIEPELPQLEEK

SEQ ID NO: 2001807 - protein, 18 aa, Staphylococcus
ADYAFVQHMIHYLDDEGT

SEQ ID NO: 2001808 - protein, 22 aa, Staphylococcus
ADYDITCPFDVPSEYFMVKFLW

SEQ ID NO: 2001809 - protein, 21 aa, Staphylococcus
ADYEGWWLFSDWTDKIIEQYQ

SEQ ID NO: 2001810 - protein, 22 aa, Staphylococcus
ADYEGWWLFSDWTEKIVEQHHY

SEQ ID NO: 2001811 - protein, 18 aa, Staphylococcus
ADYGDYGHDIVCAGASAV

SEQ ID NO: 2001812 - protein, 25 aa, Staphylococcus
ADYLFIATGDFAFPYQPFQYGRHYS

SEQ ID NO: 2001813 - protein, 17 aa, Staphylococcus
ADYLLEISRRIHEKAEH

SEQ ID NO: 2001814 - protein, 22 aa, Staphylococcus
AEAAEQFSMFLFQNNIPNNLLI

SEQ ID NO: 2001815 - protein, 18 aa, Staphylococcus
AEAAEYFSSELFNRHIPN

SEQ ID NO: 2001816 - protein, 19 aa, Staphylococcus
AEAAIKYGYDYFGSAITLS

SEQ ID NO: 2001817 - protein, 22 aa, Staphylococcus
AEADAASLLSGLGISADLHDKQ

SEQ ID NO: 2001818 - protein, 22 aa, Staphylococcus
AEADAASLLSGLGISTDLHDKK

SEQ ID NO: 2001819 - protein, 22 aa, Staphylococcus
AEADAASLLSGLGITPDLHDKQ

SEQ ID NO: 2001820 - protein, 25 aa, Staphylococcus
AEADAGSLLSGLGIKADLQDKTMSE

SEQ ID NO: 2001821 - protein, 23 aa, Staphylococcus
AEAELDMVICITEHIPVVDMVKV

SEQ ID NO: 2001822 - protein, 26 aa, Staphylococcus
AEAFAICMKNMLGLVCDPVAGLVEVP

SEQ ID NO: 2001823 - protein, 17 aa, Staphylococcus
AEAFEIVLIEIDYPQKF

SEQ ID NO: 2001824 - protein, 24 aa, Staphylococcus
AEAFYKVAQALLINIGTLTKANEE

SEQ ID NO: 2001825 - protein, 28 aa, Staphylococcus
AEAGIDVFRIFDSLNWLDQMKVANEAVQ

SEQ ID NO: 2001826 - protein, 21 aa, Staphylococcus
AEAGVYKRYALSDLPFSNKTK

SEQ ID NO: 2001827 - protein, 19 aa, Staphylococcus
AEAHGIILNNAHRADEDAA

SEQ ID NO: 2001828 - protein, 25 aa, Staphylococcus
AEAIEYRKRILLDIQGKLTFDGQKL

SEQ ID NO: 2001829 - protein, 23 aa, Staphylococcus
AEAIRYIEKLGFEAIHQHEKELT

SEQ ID NO: 2001830 - protein, 23 aa, Staphylococcus
AEAIRYLQNIGFEAIHQHESELT

SEQ ID NO: 2001831 - protein, 23 aa, Staphylococcus
AEAKIQIGEKLTRGLGAGANPEI

SEQ ID NO: 2001832 - protein, 25 aa, Staphylococcus
AEAKQKAGYYVALYIAYEAAPYFNS

SEQ ID NO: 2001833 - protein, 24 aa, Staphylococcus
AEALAHAMVRIGNNVGRNTMAIIS

SEQ ID NO: 2001834 - protein, 17 aa, Staphylococcus
AEALMFKGIPYQIKLTT

SEQ ID NO: 2001835 - protein, 18 aa, Staphylococcus
AEAMKLGIEAGRLSYEAG

SEQ ID NO: 2001836 - protein, 19 aa, Staphylococcus
AEAMKLGIHAGRLSYEAGR

SEQ ID NO: 2001837 - protein, 17 aa, Staphylococcus
AEAPLSIHVHPDDSYAY

SEQ ID NO: 2001838 - protein, 26 aa, Staphylococcus
AEAVGSWRLEDCTLYVTLEPCVMCSG

SEQ ID NO: 2001839 - protein, 18 aa, Staphylococcus
AEAYDRLRTQGELFVVIQ

SEQ ID NO: 2001840 - protein, 18 aa, Staphylococcus
AEAYKKLLEIGGTTQSEL

SEQ ID NO: 2001841 - protein, 32 aa, Staphylococcus
AEAYQYASDWSEIRPEWGLAKNAEFIIGKRSI

SEQ ID NO: 2001842 - protein, 17 aa, Staphylococcus
AECVPTFNTRPEEVVGI

SEQ ID NO: 2001843 - protein, 20 aa, Staphylococcus
AEDAFYLTIEAFNLAEEYQC

SEQ ID NO: 2001844 - protein, 20 aa, Staphylococcus
AEDAFYLTIEAFNLAEIYQC

SEQ ID NO: 2001845 - protein, 20 aa, Staphylococcus
AEDAFYLTMEAFNLAEEYQC

SEQ ID NO: 2001846 - protein, 20 aa, Staphylococcus
AEDAFYLTMEAFNLAEQYQC

SEQ ID NO: 2001847 - protein, 21 aa, Staphylococcus
AEDAGIHFVVYSTAGGVNRDR

SEQ ID NO: 2001848 - protein, 17 aa, Staphylococcus
AEDFKKVSLELGGKSPY

SEQ ID NO: 2001849 - protein, 26 aa, Staphylococcus
AEDFKWEVVDAFQLTGFDAFYQELED

SEQ ID NO: 2001850 - protein, 21 aa, Staphylococcus
AEDFQDWICDVLVELRQATGL

SEQ ID NO: 2001851 - protein, 24 aa, Staphylococcus
AEDHISTSLIQRHFQIGYNRAARI

SEQ ID NO: 2001852 - protein, 20 aa, Staphylococcus
AEDIEGVFIRAPHIANVEEG

SEQ ID NO: 2001853 - protein, 20 aa, Staphylococcus
AEDIEGVFIRAPHIASVEDG

SEQ ID NO: 2001854 - protein, 24 aa, Staphylococcus
AEDILKADVILLNTCAIRENAENK

SEQ ID NO: 2001855 - protein, 24 aa, Staphylococcus
AEDINRLATRLIFIKNGEVLLQIA

SEQ ID NO: 2001856 - protein, 17 aa, Staphylococcus
AEDKLKEEKESAKDNTE

SEQ ID NO: 2001857 - protein, 17 aa, Staphylococcus
AEDLPINVGFTGKGQAV

SEQ ID NO: 2001858 - protein, 21 aa, Staphylococcus
AEDNLKLIIMIIEDGTYEMAN

SEQ ID NO: 2001859 - protein, 25 aa, Staphylococcus
AEDPRFTDRFELFIVGREHGNAFTE

SEQ ID NO: 2001860 - protein, 18 aa, Staphylococcus
AEDRAHILEGLRIALDHI

SEQ ID NO: 2001861 - protein, 21 aa, Staphylococcus
AEDSFYLTVEAFNLAEEYQCP

SEQ ID NO: 2001862 - protein, 21 aa, Staphylococcus
AEDSLNYFIEIMHKSEWIKHA

SEQ ID NO: 2001863 - protein, 24 aa, Staphylococcus
AEDWKAQLRMLKSFPTPTKDDYPL

SEQ ID NO: 2001864 - protein, 17 aa, Staphylococcus
AEDYLKEHPDLVDMDGR

SEQ ID NO: 2001865 - protein, 17 aa, Staphylococcus
AEDYLKEHPDLVDMDGS

SEQ ID NO: 2001866 - protein, 17 aa, Staphylococcus
AEDYLKEHPDLVDMDGT

SEQ ID NO: 2001867 - protein, 26 aa, Staphylococcus
AEEAGQPESWGWKQFTDQIALGKLSQ

SEQ ID NO: 2001868 - protein, 19 aa, Staphylococcus
AEEAIHFYNKVFKNSEPGD

SEQ ID NO: 2001869 - protein, 18 aa, Staphylococcus
AEEARAALVEAVAETDDE

SEQ ID NO: 2001870 - protein, 26 aa, Staphylococcus
AEECAKAESVAICWAMGVTQQDIGSD

SEQ ID NO: 2001871 - protein, 17 aa, Staphylococcus
AEEITAGDIIRLLEGPI

SEQ ID NO: 2001872 - protein, 17 aa, Staphylococcus
AEEKGHQIVGVIDRENS

SEQ ID NO: 2001873 - protein, 25 aa, Staphylococcus
AEELIKLVDLPVEYLDRYPAELSGG

SEQ ID NO: 2001874 - protein, 17 aa, Staphylococcus
AEELLNMDAKSFNMGDY

SEQ ID NO: 2001875 - protein, 25 aa, Staphylococcus
AEELREVLAELGLKTVEELVGRTDL

SEQ ID NO: 2001876 - protein, 26 aa, Staphylococcus
AEELREVLASLGLRTVEELVGRTDLL

SEQ ID NO: 2001877 - protein, 18 aa, Staphylococcus
AEEMPPGGALGMIRDGVL

SEQ ID NO: 2001878 - protein, 24 aa, Staphylococcus
AEENIKFIGPHLEHLDMFGDKVKA

SEQ ID NO: 2001879 - protein, 24 aa, Staphylococcus
AEESRLPYEMGLVKNQYVARTFIQ

SEQ ID NO: 2001880 - protein, 19 aa, Staphylococcus
AEFEEIRDQLLLIGGLSKS

SEQ ID NO: 2001881 - protein, 19 aa, Staphylococcus
AEFEEIVFLLKNYRLPTEE

SEQ ID NO: 2001882 - protein, 19 aa, Staphylococcus
AEFEKHIYAIHTLTSLVSD

SEQ ID NO: 2001883 - protein, 19 aa, Staphylococcus
AEFEKHMYAIHTLTSLYTS

SEQ ID NO: 2001884 - protein, 18 aa, Staphylococcus
AEFKRMNAKISVEGRSAK

SEQ ID NO: 2001885 - protein, 23 aa, Staphylococcus
AEFPEIRDQLLLISGLSKSHSAT

SEQ ID NO: 2001886 - protein, 17 aa, Staphylococcus
AEFVDALAELKAVALKP

SEQ ID NO: 2001887 - protein, 21 aa, Staphylococcus
AEGDIATGINIVLKALEAPVR

SEQ ID NO: 2001888 - protein, 25 aa, Staphylococcus
AEGDMKWRKVIDDFYNSFKLDVARA

SEQ ID NO: 2001889 - protein, 23 aa, Staphylococcus
AEGEVPFKPSRVILQDFTGVPAV

SEQ ID NO: 2001890 - protein, 24 aa, Staphylococcus
AEGHIRINIAVPREIMIKGLQKIK

SEQ ID NO: 2001891 - protein, 25 aa, Staphylococcus
AEGHIRINIAVPREVMKKGLQKIKA

SEQ ID NO: 2001892 - protein, 17 aa, Staphylococcus
AEGIVEWVGDYNSLLVI

SEQ ID NO: 2001893 - protein, 20 aa, Staphylococcus
AEGKMIVIDGGFSKAYQSTT

SEQ ID NO: 2001894 - protein, 22 aa, Staphylococcus
AEGRKCEFIAVKLPYGVQKDAA

SEQ ID NO: 2001895 - protein, 23 aa, Staphylococcus
AEGRKPAIRFRVPKDKTYTFDDM

SEQ ID NO: 2001896 - protein, 22 aa, Staphylococcus
AEGRLVLGDAVFHASQYQPSVI

SEQ ID NO: 2001897 - protein, 22 aa, Staphylococcus
AEGRLVLGDAVFYANQFQPKLI

SEQ ID NO: 2001898 - protein, 23 aa, Staphylococcus
AEGRLVLGDAVFYASQFQPNAIL

SEQ ID NO: 2001899 - protein, 22 aa, Staphylococcus
AEGRRPSIRFRVPQDQTYTFND

SEQ ID NO: 2001900 - protein, 20 aa, Staphylococcus
AEGVIKVMAKMGISTVQSYQ

SEQ ID NO: 2001901 - protein, 21 aa, Staphylococcus
AEGVSICWAMGVTQQDIGSDT

SEQ ID NO: 2001902 - protein, 21 aa, Staphylococcus
AEGYARISGKTGVVVVTSGPG

SEQ ID NO: 2001903 - protein, 21 aa, Staphylococcus
AEGYLKALPRKGYYICDIEEE

SEQ ID NO: 2001904 - protein, 17 aa, Staphylococcus
AEHFKQFIFTVNGTLSI

SEQ ID NO: 2001905 - protein, 26 aa, Staphylococcus
AEHFNKLEVPFIYRVHEQPKSERLRQ

SEQ ID NO: 2001906 - protein, 25 aa, Staphylococcus
AEHFSKMEVPFIYRVHEQPKSDRLT

SEQ ID NO: 2001907 - protein, 23 aa, Staphylococcus
AEHGIKAIIQPGGSIKDQESIDM

SEQ ID NO: 2001908 - protein, 24 aa, Staphylococcus
AEHHIPFEIVPGITSGVAAPAYAG

SEQ ID NO: 2001909 - protein, 25 aa, Staphylococcus
AEHKTSIDELEWIYVPSLTSEAKKA

SEQ ID NO: 2001910 - protein, 24 aa, Staphylococcus
AEHKTSVDELEWIYVPELTESAKQ

SEQ ID NO: 2001911 - protein, 19 aa, Staphylococcus
AEHLDRYDEITGYLNDNGF

SEQ ID NO: 2001912 - protein, 20 aa, Staphylococcus
AEHPKRPKIGVIPMGTVNDF

SEQ ID NO: 2001913 - protein, 17 aa, Staphylococcus
AEHRKPQNFAEVKLKLD

SEQ ID NO: 2001914 - protein, 25 aa, Staphylococcus
AEHRLHYLMDVVDRFIILAQGTMRK

SEQ ID NO: 2001915 - protein, 19 aa, Staphylococcus
AEHVLPLGNVIFYKTPEHF

SEQ ID NO: 2001916 - protein, 22 aa, Staphylococcus
AEIASRMRFFFPDVQARGYYPG

SEQ ID NO: 2001917 - protein, 19 aa, Staphylococcus
AEICVKNGATMLVTGSYFF

SEQ ID NO: 2001918 - protein, 21 aa, Staphylococcus
AEIDMVINIGALKDKRFNDVK

SEQ ID NO: 2001919 - protein, 19 aa, Staphylococcus
AEIFHNLKSILKNRGLETA

SEQ ID NO: 2001920 - protein, 17 aa, Staphylococcus
AEIFHNLKSILSKRGLE

SEQ ID NO: 2001921 - protein, 21 aa, Staphylococcus
AEIGHGEPCIAVRTDIDALPI

SEQ ID NO: 2001922 - protein, 18 aa, Staphylococcus
AEIGHPVIGDPLYGDATL

SEQ ID NO: 2001923 - protein, 18 aa, Staphylococcus
AEIGHPVIGDPLYGDSKL

SEQ ID NO: 2001924 - protein, 18 aa, Staphylococcus
AEIGHPVIGDPLYGDSTL

SEQ ID NO: 2001925 - protein, 18 aa, Staphylococcus
AEIGHPVIGDPLYGNSTL

SEQ ID NO: 2001926 - protein, 24 aa, Staphylococcus
AEIGQGLPCIAVRTDIDALPIDEQ

SEQ ID NO: 2001927 - protein, 28 aa, Staphylococcus
AEIKAHNDWVNMLGVVPVIRALREKAMT

SEQ ID NO: 2001928 - protein, 19 aa, Staphylococcus
AEIKRLETFVEKNIARAST

SEQ ID NO: 2001929 - protein, 20 aa, Staphylococcus
AEIQIRTLAMNFWATIEHTL

SEQ ID NO: 2001930 - protein, 19 aa, Staphylococcus
AEIQYHQSLLPQFKTPDNS

SEQ ID NO: 2001931 - protein, 19 aa, Staphylococcus
AEISKRFSSIQDYIQEYCN

SEQ ID NO: 2001932 - protein, 19 aa, Staphylococcus
AEISKRFSSIQDYLLEYCN

SEQ ID NO: 2001933 - protein, 18 aa, Staphylococcus
AEISKRFSTIQDYILEYC

SEQ ID NO: 2001934 - protein, 24 aa, Staphylococcus
AEITPKLPDFSNWQQYQFTNSDGA

SEQ ID NO: 2001935 - protein, 24 aa, Staphylococcus
AEIYGIKVAKDLVHISGDTSDYHL

SEQ ID NO: 2001936 - protein, 22 aa, Staphylococcus
AEKDFFTFFGNFFSQKRNREIK

SEQ ID NO: 2001937 - protein, 22 aa, Staphylococcus
AEKDVYELLSLPNRVNQQALPH

SEQ ID NO: 2001938 - protein, 24 aa, Staphylococcus
AEKECLRLELCGVNVSQYDIIVSS

SEQ ID NO: 2001939 - protein, 17 aa, Staphylococcus
AEKEWRENDGLISTISA

SEQ ID NO: 2001940 - protein, 18 aa, Staphylococcus
AEKFDLPIIEVIEGGDVQ

SEQ ID NO: 2001941 - protein, 25 aa, Staphylococcus
AEKFSKEGIEVFVIDNLSSGFLDNI

SEQ ID NO: 2001942 - protein, 17 aa, Staphylococcus
AEKGFGFIEVEGENDVF

SEQ ID NO: 2001943 - protein, 23 aa, Staphylococcus
AEKGHLQFDYVFSAIGGGGLISG

SEQ ID NO: 2001944 - protein, 24 aa, Staphylococcus
AEKGHPVTIISVFRGNDQPYFNLH

SEQ ID NO: 2001945 - protein, 21 aa, Staphylococcus
AEKGITPKAVIAVNLYGQSAK

SEQ ID NO: 2001946 - protein, 24 aa, Staphylococcus
AEKKRSRNVLDFSDYEHFALQILT

SEQ ID NO: 2001947 - protein, 24 aa, Staphylococcus
AEKLSDRALGYGMYGEQVDGNDPI

SEQ ID NO: 2001948 - protein, 17 aa, Staphylococcus
AEKNLIKYSNWLNQLFH

SEQ ID NO: 2001949 - protein, 24 aa, Staphylococcus
AEKNVVKYSHWVNQIFHAIEYRMK

SEQ ID NO: 2001950 - protein, 32 aa, Staphylococcus
AEKRLEFYRLYLFMVHLVKFGGMYASSVNRSM

SEQ ID NO: 2001951 - protein, 17 aa, Staphylococcus
AEKRMHIVEGLMKALSI

SEQ ID NO: 2001952 - protein, 19 aa, Staphylococcus
AEKSLTVLVDASMQPTISL

SEQ ID NO: 2001953 - protein, 19 aa, Staphylococcus
AEKYGISYGQLYQWVQNIK

SEQ ID NO: 2001954 - protein, 20 aa, Staphylococcus
AEKYPNVPFYDNYIDMLESG

SEQ ID NO: 2001955 - protein, 25 aa, Staphylococcus
AELAETLHAIFLEVVIAPRFTDEAL

SEQ ID NO: 2001956 - protein, 18 aa, Staphylococcus
AELAGVLHDYCKYDDLSS

SEQ ID NO: 2001957 - protein, 19 aa, Staphylococcus
AELDDLFDGRVNTIMSNPL

SEQ ID NO: 2001958 - protein, 19 aa, Staphylococcus
AELDSLWQLRNLFTDSTDF

SEQ ID NO: 2001959 - protein, 20 aa, Staphylococcus
AELEDYCYIINVNPVEEDIT

SEQ ID NO: 2001960 - protein, 18 aa, Staphylococcus
AELEGEFAEMDGWNAEAD

SEQ ID NO: 2001961 - protein, 27 aa, Staphylococcus
AELEPTPKWSISRYKGLGEMNADQLWE

SEQ ID NO: 2001962 - protein, 17 aa, Staphylococcus
AELESKMLRLGASGPSF

SEQ ID NO: 2001963 - protein, 22 aa, Staphylococcus
AELESLAGVGRKTANVVMSVAF

SEQ ID NO: 2001964 - protein, 17 aa, Staphylococcus
AELFYGGPGKPEGLDVG

SEQ ID NO: 2001965 - protein, 27 aa, Staphylococcus
AELGAPLWKKWLMAFAARKINKAAEEH

SEQ ID NO: 2001966 - protein, 31 aa, Staphylococcus
AELGDNLFVLLCIANSLGIDMTESFNDTMDK

SEQ ID NO: 2001967 - protein, 18 aa, Staphylococcus
AELGVKKLRITGGEPLLR

SEQ ID NO: 2001968 - protein, 19 aa, Staphylococcus
AELGVKKLRITGGEPLLRR

SEQ ID NO: 2001969 - protein, 21 aa, Staphylococcus
AELHDLAFLLLVYPLSEAEGA

SEQ ID NO: 2001970 - protein, 17 aa, Staphylococcus
AELHKFMHHITNIIPES

SEQ ID NO: 2001971 - protein, 21 aa, Staphylococcus
AELIGYPREQWVFPIQTHETK

SEQ ID NO: 2001972 - protein, 17 aa, Staphylococcus
AELKTRIIDCLETAHTR

SEQ ID NO: 2001973 - protein, 19 aa, Staphylococcus
AELLARMGAHHLAIVDMDI

SEQ ID NO: 2001974 - protein, 17 aa, Staphylococcus
AELLARMGAHQITIVDM

SEQ ID NO: 2001975 - protein, 32 aa, Staphylococcus
AELNEVNPMLGHRGCRLAITYPELYEMQVEAI

SEQ ID NO: 2001976 - protein, 27 aa, Staphylococcus
AELNPTPKWSIARYKGLGEMNADQLWE

SEQ ID NO: 2001977 - protein, 27 aa, Staphylococcus
AELNPTPKWSISRYKGLGEMNADQLWE

SEQ ID NO: 2001978 - protein, 25 aa, Staphylococcus
AELQIKVAQLLGEPKAIYLTHGHVD

SEQ ID NO: 2001979 - protein, 38 aa, Staphylococcus
AELRRKRQKVSMVFQHFNLLWSRTVLRNITFPLEIAGY

SEQ ID NO: 2001980 - protein, 30 aa, Staphylococcus; identical to SEQ ID NO: 1802307

SEQ ID NO: 2001981 - protein, 19 aa, Staphylococcus
AELSALIRMNGALSLSNQQ

SEQ ID NO: 2001982 - protein, 20 aa, Staphylococcus
AELSALIRMNGALSLSNQQF

SEQ ID NO: 2001983 - protein, 23 aa, Staphylococcus
AELTCLNPVQLRRVMSQLNNSNY

SEQ ID NO: 2001984 - protein, 23 aa, Staphylococcus
AELTCLNPVQLRRVTTTLNNQQY

SEQ ID NO: 2001985 - protein, 21 aa, Staphylococcus
AELTMGILLAVARRIPEGDQL

SEQ ID NO: 2001986 - protein, 17 aa, Staphylococcus
AELVARACISQFNPKEC

SEQ ID NO: 2001987 - protein, 17 aa, Staphylococcus
AELVARACISQFNPKQC

SEQ ID NO: 2001988 - protein, 17 aa, Staphylococcus
AELVARACVSQFNPKQC

SEQ ID NO: 2001989 - protein, 18 aa, Staphylococcus
AELYKDFFTAKRNSIPEL

SEQ ID NO: 2001990 - protein, 17 aa, Staphylococcus
AELYQHCDIYLDINQGN

SEQ ID NO: 2001991 - protein, 25 aa, Staphylococcus
AEMLNHGIISYGYRIETPTTPGTID

SEQ ID NO: 2001992 - protein, 19 aa, Staphylococcus
AEMLVRMGVGSLTVIDMDI

SEQ ID NO: 2001993 - protein, 23 aa, Staphylococcus
AEMSELIAFITFTTCQQYFGAIM

SEQ ID NO: 2001994 - protein, 19 aa, Staphylococcus
AEMYLKTTFDSVKKIPFEN

SEQ ID NO: 2001995 - protein, 18 aa, Staphylococcus
AENFRMLEAFYPGRVDLG

SEQ ID NO: 2001996 - protein, 23 aa, Staphylococcus
AENLGRLGEKVTFLTASGNDSEW

SEQ ID NO: 2001997 - protein, 18 aa, Staphylococcus
AENMEWFDAIGRRRGALQ

SEQ ID NO: 2001998 - protein, 19 aa, Staphylococcus
AENQITFVPYFPLASGILA

SEQ ID NO: 2001999 - protein, 18 aa, Staphylococcus
AENVWLPNKNDIIERANA

SEQ ID NO: 2002000 - protein, 25 aa, Staphylococcus
AENYDVIYFAGGHGTIWDFKDNEDL

SEQ ID NO: 2002001 - protein, 25 aa, Staphylococcus
AEPEGAFYIFPSLAPFGIDDDFQFC

SEQ ID NO: 2002002 - protein, 18 aa, Staphylococcus
AEPFMWPTYLEVQKNLVE

SEQ ID NO: 2002003 - protein, 17 aa, Staphylococcus
AEPGDLVMFVADKPNVV

SEQ ID NO: 2002004 - protein, 21 aa, Staphylococcus
AEPVMKDRVLAQMSGHEHKSK

SEQ ID NO: 2002005 - protein, 21 aa, Staphylococcus
AEPYIRRRAIRHLEKKRVVIF

SEQ ID NO: 2002006 - protein, 21 aa, Staphylococcus
AEPYIRRRAIRHLEKNRVVIF

SEQ ID NO: 2002007 - protein, 17 aa, Staphylococcus
AEQAGIEGLDEFLTGPT

SEQ ID NO: 2002008 - protein, 25 aa, Staphylococcus
AEQAKSLGCQFAFYGHTHVAKHENI

SEQ ID NO: 2002009 - protein, 22 aa, Staphylococcus
AEQCGWLKDPFGVSWQIVPEHV

SEQ ID NO: 2002010 - protein, 24 aa, Staphylococcus
AEQFKGKIIGLSISNIDEYKTSNL

SEQ ID NO: 2002011 - protein, 29 aa, Staphylococcus
AEQFRQLFILPQGEFKKFLVSNSTDKQGI

SEQ ID NO: 2002012 - protein, 35 aa, Staphylococcus
AEQFRQLFILPQGEFKRFLLSKSVEKQDILRTLFN

SEQ ID NO: 2002013 - protein, 31 aa, Staphylococcus
AEQFRQLFILPQGEFKRFLVSSSSDKQSILR

SEQ ID NO: 2002014 - protein, 20 aa, Staphylococcus
AEQGEKVILMRPETSPEDIE

SEQ ID NO: 2002015 - protein, 20 aa, Staphylococcus
AEQGHRVIVAGLDMDFKGRP

SEQ ID NO: 2002016 - protein, 23 aa, Staphylococcus
AEQGIKLTFLPYVVKALVSALKK

SEQ ID NO: 2002017 - protein, 17 aa, Staphylococcus
AEQLFKLVDSNRDYLGE

SEQ ID NO: 2002018 - protein, 33 aa, Staphylococcus
AEQLYKPYVEGFVKMLAPIAPHLGEELWSKLGH

SEQ ID NO: 2002019 - protein, 24 aa, Staphylococcus
AEQQGFKVEFADYLPGDEAGVKSV

SEQ ID NO: 2002020 - protein, 21 aa, Staphylococcus
AEQRIKTNLTLSAIADKENIE

SEQ ID NO: 2002021 - protein, 24 aa, Staphylococcus
AEQRQSGVLPEMVRLSIGTENAED

SEQ ID NO: 2002022 - protein, 20 aa, Staphylococcus
AEQSRLDVLINHAIDHLSDD

SEQ ID NO: 2002023 - protein, 23 aa, Staphylococcus
AEQSYRLAIPTIQYQATLNDVLK

SEQ ID NO: 2002024 - protein, 27 aa, Staphylococcus
AEQSYRLIIPNIIFKSNLNEIYDTINH

SEQ ID NO: 2002025 - protein, 23 aa, Staphylococcus
AEQSYRLIIPTFEFISNLKQVYV

SEQ ID NO: 2002026 - protein, 27 aa, Staphylococcus
AEQSYRLTIPNIYFKSNLQEIYDIISH

SEQ ID NO: 2002027 - protein, 27 aa, Staphylococcus
AEQSYRLVIPDVKFQSNLKVIYDTINN

SEQ ID NO: 2002028 - protein, 20 aa, Staphylococcus
AERAGLGFIGRNGFVINPKL

SEQ ID NO: 2002029 - protein, 22 aa, Staphylococcus
AERALADVVLLEIPKNEKPARG

SEQ ID NO: 2002030 - protein, 25 aa, Staphylococcus
AERASGLELAFPIMIGDHVWIGAGA

SEQ ID NO: 2002031 - protein, 20 aa, Staphylococcus
AERFKDKIIGLSIGNEKEYY

SEQ ID NO: 2002032 - protein, 19 aa, Staphylococcus
AERFKDWFDHLPSNIVRAK

SEQ ID NO: 2002033 - protein, 18 aa, Staphylococcus
AERILAAGGNPVATLKES

SEQ ID NO: 2002034 - protein, 22 aa, Staphylococcus
AERKIAAVAFLTFVALDEKKKP

SEQ ID NO: 2002035 - protein, 21 aa, Staphylococcus
AERKRAIIAPSYFEPTEGDFE

SEQ ID NO: 2002036 - protein, 20 aa, Staphylococcus
AERKRGLIAPNYFEPGEADF

SEQ ID NO: 2002037 - protein, 19 aa, Staphylococcus
AERLFRKYANEIRNWEDNK

SEQ ID NO: 2002038 - protein, 24 aa, Staphylococcus
AERLIEMRRFILASDHEARIGALE

SEQ ID NO: 2002039 - protein, 23 aa, Staphylococcus
AERLVEMRRFILASNYDERVEAL

SEQ ID NO: 2002040 - protein, 25 aa, Staphylococcus
AERLVEMRRFILASSYDERVDALNA

SEQ ID NO: 2002041 - protein, 25 aa, Staphylococcus
AERLVEMRRFILSSSREDRLEALNH

SEQ ID NO: 2002042 - protein, 18 aa, Staphylococcus
AERMFKIDNLYDVNNVDV

SEQ ID NO: 2002043 - protein, 18 aa, Staphylococcus
AERMFKIENLYDVQNVDV

SEQ ID NO: 2002044 - protein, 18 aa, Staphylococcus
AERMFKIENLYDVQNVEV

SEQ ID NO: 2002045 - protein, 33 aa, Staphylococcus
AERRIEFYKLYLLLVHLVKFGLMYESSVETSMD

SEQ ID NO: 2002046 - protein, 20 aa, Staphylococcus
AERTLKEFAKILFWTLKTKP

SEQ ID NO: 2002047 - protein, 18 aa, Staphylococcus
AESATQLGAHHTWIEYLG

SEQ ID NO: 2002048 - protein, 18 aa, Staphylococcus
AESCAINGVIPPVIMQVV

SEQ ID NO: 2002049 - protein, 22 aa, Staphylococcus
AESCFKNWLKSDVFKNAHKNVR

SEQ ID NO: 2002050 - protein, 19 aa, Staphylococcus
AESCGGVGYTLKDPNRIDE

SEQ ID NO: 2002051 - protein, 24 aa, Staphylococcus
AESDEIYRELPFVVNQNEVDHNKH

SEQ ID NO: 2002052 - protein, 21 aa, Staphylococcus
AESFKQRILKAYPNLEVTVTD

SEQ ID NO: 2002053 - protein, 20 aa, Staphylococcus
AESHVTIAGRLMTKRGKGKA

SEQ ID NO: 2002054 - protein, 27 aa, Staphylococcus
AESKKPMVVEFEFKLRNQYFKIQRQGA

SEQ ID NO: 2002055 - protein, 17 aa, Staphylococcus
AESLGHSITELFPTEVP

SEQ ID NO: 2002056 - protein, 17 aa, Staphylococcus
AESMGAKGMRVTTQEEL

SEQ ID NO: 2002057 - protein, 17 aa, Staphylococcus
AESQKKFVLGSVSHKVA

SEQ ID NO: 2002058 - protein, 23 aa, Staphylococcus
AESRSGTFPQITFSEVKNLKLDL

SEQ ID NO: 2002059 - protein, 18 aa, Staphylococcus
AESSKDCVEIMEATIEAA

SEQ ID NO: 2002060 - protein, 25 aa, Staphylococcus
AESTKIWMQYELRQYMDYEVDLGQL

SEQ ID NO: 2002061 - protein, 32 aa, Staphylococcus
AESYKTHLLELFKRANVIAMSGSLPKGLNTNY

SEQ ID NO: 2002062 - protein, 32 aa, Staphylococcus
AESYKTHLLELFKRANVIAMSGSLPKGLNTSY

SEQ ID NO: 2002063 - protein, 17 aa, Staphylococcus
AESYRNKILMKQLLYDS

SEQ ID NO: 2002064 - protein, 19 aa, Staphylococcus
AETALRIPMNDNIRSLNLS

SEQ ID NO: 2002065 - protein, 19 aa, Staphylococcus
AETAPLYALSAISFEKELM

SEQ ID NO: 2002066 - protein, 17 aa, Staphylococcus
AETAPLYALSAMSYENE

SEQ ID NO: 2002067 - protein, 17 aa, Staphylococcus
AETAPLYALSAVSFEKE

SEQ ID NO: 2002068 - protein, 19 aa, Staphylococcus
AETAPLYVLSALSFEKDLH

SEQ ID NO: 2002069 - protein, 18 aa, Staphylococcus
AETAVKLADIYDGDKDKA

SEQ ID NO: 2002070 - protein, 26 aa, Staphylococcus
AETDLCVPFICLNGAEVRDETFNILH

SEQ ID NO: 2002071 - protein, 19 aa, Staphylococcus
AETDYKLKSSYMDKQLILE

SEQ ID NO: 2002072 - protein, 23 aa, Staphylococcus
AETEKFPHVTYFMSGGRNAEFEG

SEQ ID NO: 2002073 - protein, 23 aa, Staphylococcus
AETEKFPHVTYFMSGGRNEEFEG

SEQ ID NO: 2002074 - protein, 17 aa, Staphylococcus
AETEWFEELDIPEHVEH

SEQ ID NO: 2002075 - protein, 21 aa, Staphylococcus
AETFLKQIIKAEQVFVSGKGR

SEQ ID NO: 2002076 - protein, 19 aa, Staphylococcus
AETGFFVTILRSFSHFSHS

SEQ ID NO: 2002077 - protein, 26 aa, Staphylococcus
AETHKARFIYISTISVGTVFDSHAED

SEQ ID NO: 2002078 - protein, 20 aa, Staphylococcus
AETLGNMGFEEPTPIQTDSI

SEQ ID NO: 2002079 - protein, 19 aa, Staphylococcus
AETPEEMIAGAILVQNTAW

SEQ ID NO: 2002080 - protein, 17 aa, Staphylococcus
AETPNLYTLYLITKDEV

SEQ ID NO: 2002081 - protein, 19 aa, Staphylococcus
AETQRIAGITSKPPILLTP

SEQ ID NO: 2002082 - protein, 25 aa, Staphylococcus
AETRKELKSLLSVESGGIVFTTMQK

SEQ ID NO: 2002083 - protein, 31 aa, Staphylococcus
AETVVIPTKWIPQGIGALFQYLPDASLEDNK

SEQ ID NO: 2002084 - protein, 20 aa, Staphylococcus
AEVCDRFVLLKEGKLQNIDF

SEQ ID NO: 2002085 - protein, 24 aa, Staphylococcus
AEVDRYGIKQVIKETIDYLKEKTD

SEQ ID NO: 2002086 - protein, 33 aa, Staphylococcus; identical to SEQ ID NO: 1665145

SEQ ID NO: 2002087 - protein, 22 aa, Staphylococcus
AEVEFKFELPDMNNFLKHGTIN

SEQ ID NO: 2002088 - protein, 19 aa, Staphylococcus
AEVGYWIAEGYTGKQIVTK

SEQ ID NO: 2002089 - protein, 19 aa, Staphylococcus
AEVIAGWTGIPLTKINETE

SEQ ID NO: 2002090 - protein, 19 aa, Staphylococcus
AEVIAGWTGIPLTRINETE

SEQ ID NO: 2002091 - protein, 19 aa, Staphylococcus
AEVIKRLGYAKEIITADSA

SEQ ID NO: 2002092 - protein, 20 aa, Staphylococcus
AEVIRYLSGNGFSKQMITID

SEQ ID NO: 2002093 - protein, 17 aa, Staphylococcus
AEVLAMVMHIYQSFGLK

SEQ ID NO: 2002094 - protein, 18 aa, Staphylococcus
AEVLRYLSGEGFSKKLIT

SEQ ID NO: 2002095 - protein, 17 aa, Staphylococcus
AEVMPIIKLDGEAVNDG

SEQ ID NO: 2002096 - protein, 19 aa, Staphylococcus
AEVNALIELITQFQHTIVN

SEQ ID NO: 2002097 - protein, 21 aa, Staphylococcus
AEVPSSYAGTIREIIVNEGTT

SEQ ID NO: 2002098 - protein, 19 aa, Staphylococcus
AEYEEIRDQLLLIGGLSKS

SEQ ID NO: 2002099 - protein, 21 aa, Staphylococcus
AEYFPLNLFRKYAKEAFEDNE

SEQ ID NO: 2002100 - protein, 20 aa, Staphylococcus
AEYLPKEVIIPSAHIETQDL

SEQ ID NO: 2002101 - protein, 21 aa, Staphylococcus
AEYSVAAALNLVRHFPQIEKR

SEQ ID NO: 2002102 - protein, 19 aa, Staphylococcus
AEYYTHFTSPIRRYPDLIV

SEQ ID NO: 2002103 - protein, 24 aa, Staphylococcus
AFAEALSKEGFRIVSGGTDNHLIA

SEQ ID NO: 2002104 - protein, 21 aa, Staphylococcus
AFAHIKGRYLISRNVHKSVFN

SEQ ID NO: 2002105 - protein, 20 aa, Staphylococcus
AFAKAKGRIIVSCYASNFIR

SEQ ID NO: 2002106 - protein, 25 aa, Staphylococcus
AFAKFFKLMLNQGINLAPSKFEAWF

SEQ ID NO: 2002107 - protein, 23 aa, Staphylococcus
AFALAGLRIGIVISTPETIQQLN

SEQ ID NO: 2002108 - protein, 24 aa, Staphylococcus
AFANIPLSLVKDGKEIATGLSNEV

SEQ ID NO: 2002109 - protein, 18 aa, Staphylococcus
AFARRLKGFNTRILYHNR

SEQ ID NO: 2002110 - protein, 18 aa, Staphylococcus
AFDALWMGVLKLQGNSNQ

SEQ ID NO: 2002111 - protein, 19 aa, Staphylococcus
AFDEAHCISKWGHDFRPSY

SEQ ID NO: 2002112 - protein, 18 aa, Staphylococcus
AFDGEVRAYAALTTESVQ

SEQ ID NO: 2002113 - protein, 22 aa, Staphylococcus
AFDHPTKPIGVFFNEEEAKRLE

SEQ ID NO: 2002114 - protein, 24 aa, Staphylococcus
AFDNYPIEAVFGIHVNPFSDEGTV

SEQ ID NO: 2002115 - protein, 26 aa, Staphylococcus
AFDQFPIEAVFGIHVMPFNDEGTVTI

SEQ ID NO: 2002116 - protein, 23 aa, Staphylococcus
AFDRIDMEGPFYFSDLNDDGNLE

SEQ ID NO: 2002117 - protein, 18 aa, Staphylococcus
AFEGFKVERVNDLFYATF

SEQ ID NO: 2002118 - protein, 18 aa, Staphylococcus
AFEGLRIQKRPLRRPDLT

SEQ ID NO: 2002119 - protein, 20 aa, Staphylococcus
AFEIDQRLIPVLDYTLAPYE

SEQ ID NO: 2002120 - protein, 23 aa, Staphylococcus
AFEKGFKQGLGIELKPLTLTDEQ

SEQ ID NO: 2002121 - protein, 18 aa, Staphylococcus
AFELLKKQFIGEFISSLN

SEQ ID NO: 2002122 - protein, 24 aa, Staphylococcus
AFENIKVGDPFAEDTKMGAQTGPE

SEQ ID NO: 2002123 - protein, 18 aa, Staphylococcus
AFENIKVGDPFDEDVKMS

SEQ ID NO: 2002124 - protein, 18 aa, Staphylococcus
AFESWREVDAHTRSQKLW

SEQ ID NO: 2002125 - protein, 18 aa, Staphylococcus
AFEYKDARNYLSYLYSKN

SEQ ID NO: 2002126 - protein, 23 aa, Staphylococcus
AFGADLILLNGLDAFDPKVVNVD

SEQ ID NO: 2002127 - protein, 19 aa, Staphylococcus
AFGDFRFILEGEPLSDGSG

SEQ ID NO: 2002128 - protein, 24 aa, Staphylococcus
AFGLKKRGKNAVAITYTGDGGSSQ

SEQ ID NO: 2002129 - protein, 25 aa, Staphylococcus
AFGLKKRGKNAVAITYTGDGGSSQG

SEQ ID NO: 2002130 - protein, 24 aa, Staphylococcus
AFIADECRLWITVHYLPNERYEDV

SEQ ID NO: 2002131 - protein, 34 aa, Staphylococcus
AFIDSRKPLAAQFKFRGKQVIAIANHWNSKNGDD

SEQ ID NO: 2002132 - protein, 18 aa, Staphylococcus
AFIETAKIVMNWLNDQQI

SEQ ID NO: 2002133 - protein, 17 aa, Staphylococcus
AFIGAVINRILNTELTD

SEQ ID NO: 2002134 - protein, 18 aa, Staphylococcus
AFIGCNTNLVAPVTVGDG

SEQ ID NO: 2002135 - protein, 22 aa, Staphylococcus
AFIRELIFREFYYVLMTQYPET

SEQ ID NO: 2002136 - protein, 17 aa, Staphylococcus
AFIRELLFREFYYVLMV

SEQ ID NO: 2002137 - protein, 20 aa, Staphylococcus
AFIYKDCVIGLQFHLETTSQ

SEQ ID NO: 2002138 - protein, 24 aa, Staphylococcus
AFKKEVPQYLVLIGKNIQYDDYRQ

SEQ ID NO: 2002139 - protein, 17 aa, Staphylococcus
AFKRNPYIIQFQYKGYR

SEQ ID NO: 2002140 - protein, 18 aa, Staphylococcus
AFKTWRNVAPEVRADILF

SEQ ID NO: 2002141 - protein, 17 aa, Staphylococcus
AFLATPAIDAIKGVTHY

SEQ ID NO: 2002142 - protein, 22 aa, Staphylococcus
AFLDPRGQYILEVIVGSYEMLK

SEQ ID NO: 2002143 - protein, 17 aa, Staphylococcus
AFLKEIGVDKVLMTTNP

SEQ ID NO: 2002144 - protein, 26 aa, Staphylococcus
AFLKPTRLYVKPVLAVKSSIKIYAMT

SEQ ID NO: 2002145 - protein, 26 aa, Staphylococcus
AFMAPGDRDLGMVFQDFALWPHMTVF

SEQ ID NO: 2002146 - protein, 19 aa, Staphylococcus
AFNFMCFQSVIPTEEDVAL

SEQ ID NO: 2002147 - protein, 24 aa, Staphylococcus
AFNGEKILGAILFEQTMDREVEGK

SEQ ID NO: 2002148 - protein, 28 aa, Staphylococcus
AFNLAEEYQCPVIILSDLQLSLGKQTVK

SEQ ID NO: 2002149 - protein, 22 aa, Staphylococcus
AFNLMYELICKMFEDENVQIDT

SEQ ID NO: 2002150 - protein, 19 aa, Staphylococcus
AFNPDLEKINAIGAELSAI

SEQ ID NO: 2002151 - protein, 25 aa, Staphylococcus
AFNQYPIEAVFGIHVNPFAEEGQVV

SEQ ID NO: 2002152 - protein, 21 aa, Staphylococcus
AFNYIPYFQNFEMHLLNIDEP

SEQ ID NO: 2002153 - protein, 23 aa, Staphylococcus
AFPSHKLDILPIGYPRVNYLLNK

SEQ ID NO: 2002154 - protein, 26 aa, Staphylococcus
AFQECARLLKKWGLPANRNTIRLHCE

SEQ ID NO: 2002155 - protein, 18 aa, Staphylococcus
AFQEKWKYLNSGMNNLFG

SEQ ID NO: 2002156 - protein, 20 aa, Staphylococcus
AFQGCEHINRAITIEREHFN

SEQ ID NO: 2002157 - protein, 25 aa, Staphylococcus
AFQGLPSRIAWLGYEERAKMGLALN

SEQ ID NO: 2002158 - protein, 24 aa, Staphylococcus
AFQGLPSRIAWLGYGDRAKMGLKL

SEQ ID NO: 2002159 - protein, 24 aa, Staphylococcus
AFRKEFNKDVVIDLVGYRRYGHNE

SEQ ID NO: 2002160 - protein, 25 aa, Staphylococcus
AFSMYPNLWENMGLSYSDLITKLID

SEQ ID NO: 2002161 - protein, 20 aa, Staphylococcus
AFSVGIIYGIMKQWDLKDTV

SEQ ID NO: 2002162 - protein, 19 aa, Staphylococcus
AFSVMYLLICKMFEDDDVE

SEQ ID NO: 2002163 - protein, 19 aa, Staphylococcus
AFTKVNGRLIVSCYASNFI

SEQ ID NO: 2002164 - protein, 19 aa, Staphylococcus
AFTVMYLLICKIFENENVD

SEQ ID NO: 2002165 - protein, 19 aa, Staphylococcus
AFTVMYLLICKMFEDEDVD

SEQ ID NO: 2002166 - protein, 19 aa, Staphylococcus
AFTVMYLLICKMFENEDVE

SEQ ID NO: 2002167 - protein, 17 aa, Staphylococcus
AFVAYFIQQLHLTHNDI

SEQ ID NO: 2002168 - protein, 18 aa, Staphylococcus
AFVDLTWEDYQQQIDGTL

SEQ ID NO: 2002169 - protein, 25 aa, Staphylococcus
AFVDPAKIGRFWFSSSSERWETGKT

SEQ ID NO: 2002170 - protein, 34 aa, Staphylococcus
AFVEAFRLVSKLVLRLKAFDEFDFTKANIGMNEQ

SEQ ID NO: 2002171 - protein, 24 aa, Staphylococcus
AFVEIKPGVQGLVHISEISHSHIG

SEQ ID NO: 2002172 - protein, 20 aa, Staphylococcus
AFVRQLALDYAKFKGNKNSK

SEQ ID NO: 2002173 - protein, 21 aa, Staphylococcus
AFWKLFLKLRESLEIFNYKKV

SEQ ID NO: 2002174 - protein, 19 aa, Staphylococcus
AFYEDVGALNVKRATSNPR

SEQ ID NO: 2002175 - protein, 20 aa, Staphylococcus
AFYEDWRTVLDFCDTKILHL

SEQ ID NO: 2002176 - protein, 22 aa, Staphylococcus
AFYKYKDTIFPLDEKVEETKEF

SEQ ID NO: 2002177 - protein, 25 aa, Staphylococcus
AFYLTRPALDVVIPGAKRAEQVIEN

SEQ ID NO: 2002178 - protein, 25 aa, Staphylococcus
AFYLTRPALDVVIPGAKRVEQVKEN

SEQ ID NO: 2002179 - protein, 24 aa, Staphylococcus
AFYLTRPSLDVVIPGAKRADQVVE

SEQ ID NO: 2002180 - protein, 22 aa, Staphylococcus
AFYQVCPIHKITALITDHHEDI

SEQ ID NO: 2002181 - protein, 24 aa, Staphylococcus
AFYRPKAVIYDLNFLATLPYDEIL

SEQ ID NO: 2002182 - protein, 17 aa, Staphylococcus
AGADIILVPSIGTVPGF

SEQ ID NO: 2002183 - protein, 18 aa, Staphylococcus
AGADMIITYFAKDICHYL

SEQ ID NO: 2002184 - protein, 18 aa, Staphylococcus
AGADMIITYFSKDICRYL

SEQ ID NO: 2002185 - protein, 18 aa, Staphylococcus
AGAEVVGVVAIFTYGLAK

SEQ ID NO: 2002186 - protein, 17 aa, Staphylococcus
AGAFPAEAHTYKKKVLD

SEQ ID NO: 2002187 - protein, 25 aa, Staphylococcus
AGAGFPSIPLKIIFPELKVTIVDSL

SEQ ID NO: 2002188 - protein, 26 aa, Staphylococcus
AGAGFPSIPLKIIFPNLKVTIVDSLN

SEQ ID NO: 2002189 - protein, 25 aa, Staphylococcus
AGAGFPSIPLKIVFPELKVTIVDSL

SEQ ID NO: 2002190 - protein, 26 aa, Staphylococcus
AGAGFPSIPLKIVFPQLKVTIVDSLN

SEQ ID NO: 2002191 - protein, 19 aa, Staphylococcus
AGAGRLNLRAGKSSVIGTM

SEQ ID NO: 2002192 - protein, 19 aa, Staphylococcus
AGAICRIERGQFTNIQLNY

SEQ ID NO: 2002193 - protein, 22 aa, Staphylococcus
AGAKFDSSVFPFILRGVSIIGI

SEQ ID NO: 2002194 - protein, 18 aa, Staphylococcus
AGALEGWKGMSLPLEDVE

SEQ ID NO: 2002195 - protein, 17 aa, Staphylococcus
AGALSVAALENYRAKIK

SEQ ID NO: 2002196 - protein, 29 aa, Staphylococcus
AGANAIYEFLTLRIPMLLIPLGLDQSRGD

SEQ ID NO: 2002197 - protein, 17 aa, Staphylococcus
AGAQGGFGSQGFGGGDF

SEQ ID NO: 2002198 - protein, 17 aa, Staphylococcus
AGARFISLLGGEMLSFY

SEQ ID NO: 2002199 - protein, 17 aa, Staphylococcus
AGAYGGEIKDCIDYALC

SEQ ID NO: 2002200 - protein, 18 aa, Staphylococcus
AGAYGGEIKDCIDYALCV

SEQ ID NO: 2002201 - protein, 18 aa, Staphylococcus
AGCRDRAILFKLIKKYKI

SEQ ID NO: 2002202 - protein, 24 aa, Staphylococcus
AGDAFIGAIIFQLLKEDRKHLTEN

SEQ ID NO: 2002203 - protein, 19 aa, Staphylococcus
AGDIIKNMAPVVGGKGGGR

SEQ ID NO: 2002204 - protein, 18 aa, Staphylococcus
AGDMFLLERGMEVEYKPS

SEQ ID NO: 2002205 - protein, 18 aa, Staphylococcus
AGDPRTNLKRILKEMEDL

SEQ ID NO: 2002206 - protein, 23 aa, Staphylococcus
AGDTFRAGAIDQLQVWGDRVGVE

SEQ ID NO: 2002207 - protein, 21 aa, Staphylococcus
AGDTFRAGAIEQLKVWGERVG

SEQ ID NO: 2002208 - protein, 24 aa, Staphylococcus
AGDTFRAGAIEQLQVWGDRVGVEV

SEQ ID NO: 2002209 - protein, 27 aa, Staphylococcus
AGDTFRAGAINQLKVWGERVGVDVVSQ

SEQ ID NO: 2002210 - protein, 26 aa, Staphylococcus
AGDTFRAGAIQQLKVWGDRVGVEVVS

SEQ ID NO: 2002211 - protein, 27 aa, Staphylococcus
AGDTFRAGAIQQLKVWGERVGVDVMSQ

SEQ ID NO: 2002212 - protein, 26 aa, Staphylococcus
AGDTFRAGAIQQLKVWGERVGVDVVS

SEQ ID NO: 2002213 - protein, 25 aa, Staphylococcus
AGDYERVRLALGLKNDDILLHVIRA

SEQ ID NO: 2002214 - protein, 18 aa, Staphylococcus
AGEAFTESGAKYFVVDPV

SEQ ID NO: 2002215 - protein, 18 aa, Staphylococcus
AGESLPIHSSPNCVVVVP

SEQ ID NO: 2002216 - protein, 31 aa, Staphylococcus
AGEVVKIGKYVTAFRVGEKVYGMKLGAFAEY

SEQ ID NO: 2002217 - protein, 28 aa, Staphylococcus
AGEYFAEFGVKVADYMNADALVFGSESG

SEQ ID NO: 2002218 - protein, 18 aa, Staphylococcus
AGEYRWITVVSPENPDGT

SEQ ID NO: 2002219 - protein, 17 aa, Staphylococcus
AGFNIIWANDFEKDAVT

SEQ ID NO: 2002220 - protein, 25 aa, Staphylococcus
AGFNKAEAMIILFPKLFKQQDNTMK

SEQ ID NO: 2002221 - protein, 25 aa, Staphylococcus
AGFNKSEALLLLFPYIYKEQESAMK

SEQ ID NO: 2002222 - protein, 25 aa, Staphylococcus
AGFNKSEAVLLLFPILFKEQDNTMR

SEQ ID NO: 2002223 - protein, 19 aa, Staphylococcus
AGFTPIPAMSMVSYAAGAR

SEQ ID NO: 2002224 - protein, 21 aa, Staphylococcus
AGFYYDFNQPLTLCDVGAGAG

SEQ ID NO: 2002225 - protein, 21 aa, Staphylococcus
AGGCFWCMTKPFDQFDGIETV

SEQ ID NO: 2002226 - protein, 22 aa, Staphylococcus
AGGCFWCMTKPFDQFEGIESVT

SEQ ID NO: 2002227 - protein, 22 aa, Staphylococcus
AGGCFWCMTKPFDSYDGIEKVT

SEQ ID NO: 2002228 - protein, 22 aa, Staphylococcus
AGGCFWCMTKPFDTFDGIEKVT

SEQ ID NO: 2002229 - protein, 21 aa, Staphylococcus
AGGCFWCMTKPFDTFDGIEQV

SEQ ID NO: 2002230 - protein, 22 aa, Staphylococcus
AGGCFWCMTKPFDTFEGIEKVT

SEQ ID NO: 2002231 - protein, 19 aa, Staphylococcus
AGGELKHGTIALIEDNTPV

SEQ ID NO: 2002232 - protein, 19 aa, Staphylococcus
AGGIEFIKGYLIKENNAMT

SEQ ID NO: 2002233 - protein, 24 aa, Staphylococcus
AGGKRIRPVLLLLTLDMLNEDYRQ

SEQ ID NO: 2002234 - protein, 23 aa, Staphylococcus
AGGKRIRPVLLLLTLEMLTDQYK

SEQ ID NO: 2002235 - protein, 24 aa, Staphylococcus
AGGKRIRPVLLLLTLNMLNEDYHK

SEQ ID NO: 2002236 - protein, 17 aa, Staphylococcus
AGGKTMMEAAIKGLRQH

SEQ ID NO: 2002237 - protein, 22 aa, Staphylococcus
AGGLFALLGPFWGYGASIATSL

SEQ ID NO: 2002238 - protein, 19 aa, Staphylococcus
AGHAWALQHFKNTLGAEVE

SEQ ID NO: 2002239 - protein, 18 aa, Staphylococcus
AGIALKEVIDEVGGKVVV

SEQ ID NO: 2002240 - protein, 17 aa, Staphylococcus
AGIARIYQLNKDTGEII

SEQ ID NO: 2002241 - protein, 26 aa, Staphylococcus
AGIDVFRIFDSLNWVDQMKVANEAVQ

SEQ ID NO: 2002242 - protein, 25 aa, Staphylococcus
AGIGTCWKSPAYIFTPEIRELFGVK

SEQ ID NO: 2002243 - protein, 19 aa, Staphylococcus
AGIGTCWKTPHYIFEPKVR

SEQ ID NO: 2002244 - protein, 20 aa, Staphylococcus
AGIGTCWKTPPYIFEPKVRK

SEQ ID NO: 2002245 - protein, 25 aa, Staphylococcus
AGIIIDWLRRGCVESPKVIAEVLLA

SEQ ID NO: 2002246 - protein, 18 aa, Staphylococcus
AGIINMFLNWLHPENHIP

SEQ ID NO: 2002247 - protein, 19 aa, Staphylococcus
AGIKDLWGKLEISNDDFIR

SEQ ID NO: 2002248 - protein, 23 aa, Staphylococcus
AGIKFPDDNLLGIDYVIPDYSYL

SEQ ID NO: 2002249 - protein, 18 aa, Staphylococcus
AGIKRIIEGLNEVLTNDN

SEQ ID NO: 2002250 - protein, 22 aa, Staphylococcus
AGIKVGMIHGGLTPRERKQQMK

SEQ ID NO: 2002251 - protein, 19 aa, Staphylococcus
AGIMTEIPFEFFKKHTHFD

SEQ ID NO: 2002252 - protein, 25 aa, Staphylococcus
AGIMTEVPYAYFSRHLDFDIPEEGQ

SEQ ID NO: 2002253 - protein, 26 aa, Staphylococcus
AGIMTKCPKCKKIMYTKELDENLNVC

SEQ ID NO: 2002254 - protein, 25 aa, Staphylococcus
AGIMTKCPKCKKIMYTKELNENLNV

SEQ ID NO: 2002255 - protein, 17 aa, Staphylococcus
AGINHWFNSDTIYRAIL

SEQ ID NO: 2002256 - protein, 25 aa, Staphylococcus
AGIRHFGENRLEGFKEKKAALPDDV

SEQ ID NO: 2002257 - protein, 24 aa, Staphylococcus
AGIRVPRNKAIVGQNAFSHESGIH

SEQ ID NO: 2002258 - protein, 18 aa, Staphylococcus
AGITTYSPLNHWKAYEGK

SEQ ID NO: 2002259 - protein, 32 aa, Staphylococcus
AGIVPWNAPILVLLRKVIPAIVTGCSVIIKPS

SEQ ID NO: 2002260 - protein, 23 aa, Staphylococcus
AGIVPWNAPIMVLMRKVIPALVT

SEQ ID NO: 2002261 - protein, 24 aa, Staphylococcus
AGIVPWNAPIMVLMRKVIPAVITG

SEQ ID NO: 2002262 - protein, 25 aa, Staphylococcus
AGKGRSGYVANSFAMRLNQLGKASH

SEQ ID NO: 2002263 - protein, 24 aa, Staphylococcus
AGKISEGTICYTGDILNPERSNVF

SEQ ID NO: 2002264 - protein, 20 aa, Staphylococcus
AGKLPRLSYHKARMERSAAR

SEQ ID NO: 2002265 - protein, 21 aa, Staphylococcus
AGKPYEWGMEQFSKNIALKRL

SEQ ID NO: 2002266 - protein, 25 aa, Staphylococcus
AGKTEIAFIGDSWIQGGEFRGGDRL

SEQ ID NO: 2002267 - protein, 20 aa, Staphylococcus
AGKTLAKFAASQGKRVAMIE

SEQ ID NO: 2002268 - protein, 23 aa, Staphylococcus
AGKVFYKKCEEILALYDNIPNEI

SEQ ID NO: 2002269 - protein, 21 aa, Staphylococcus
AGLELAQPITIGNNIWFGGNV

SEQ ID NO: 2002270 - protein, 21 aa, Staphylococcus
AGLFGGPLYTFHKIFSIITMS

SEQ ID NO: 2002271 - protein, 20 aa, Staphylococcus
AGLFGGPLYTFHKILSIVTL

SEQ ID NO: 2002272 - protein, 33 aa, Staphylococcus
AGLFKATVDSLLFRGVHYEICCVDRKGYEWVIQ

SEQ ID NO: 2002273 - protein, 23 aa, Staphylococcus
AGLGNPSAPGFEKWAENFNKNSF

SEQ ID NO: 2002274 - protein, 19 aa, Staphylococcus
AGLITNLAPMVFMLGELNV

SEQ ID NO: 2002275 - protein, 18 aa, Staphylococcus
AGLKRMGWSDDIVTSYLD

SEQ ID NO: 2002276 - protein, 22 aa, Staphylococcus
AGLKTDVLLAAYGYQHMDIDIV

SEQ ID NO: 2002277 - protein, 24 aa, Staphylococcus
AGLKTDVMLAAYGYKMMDEAIVNE

SEQ ID NO: 2002278 - protein, 23 aa, Staphylococcus
AGLKTDVMLAAYGYQMMDVDIVN

SEQ ID NO: 2002279 - protein, 19 aa, Staphylococcus
AGLLKPKAAYELIGELKSA

SEQ ID NO: 2002280 - protein, 19 aa, Staphylococcus
AGLLKPKAAYELIGELRAA

SEQ ID NO: 2002281 - protein, 20 aa, Staphylococcus
AGLLKPKAAYELIGHLRAAV

SEQ ID NO: 2002282 - protein, 20 aa, Staphylococcus
AGLLKPRAAYELVGELKAAV

SEQ ID NO: 2002283 - protein, 31 aa, Staphylococcus
AGLLSRNEENFSYFDRFRDRIMFPLNNAQGR

SEQ ID NO: 2002284 - protein, 32 aa, Staphylococcus
AGLREDMQLLIKRLIKTYGMTAIFVTHDQYEA

SEQ ID NO: 2002285 - protein, 27 aa, Staphylococcus
AGLRHFGENRLEGFLEKKAALPEDAVM

SEQ ID NO: 2002286 - protein, 27 aa, Staphylococcus
AGLRHFGENRVEGFLEKKQALPKDVTM

SEQ ID NO: 2002287 - protein, 25 aa, Staphylococcus
AGLRTRHKYAPFPEEVNRQMVSNLA

SEQ ID NO: 2002288 - protein, 22 aa, Staphylococcus
AGLSELFFKNIIIQELDTDESE

SEQ ID NO: 2002289 - protein, 23 aa, Staphylococcus
AGLVGVMLSQLWDLCAGVKTDRD

SEQ ID NO: 2002290 - protein, 18 aa, Staphylococcus
AGLYASFYAGLRGMSVRL

SEQ ID NO: 2002291 - protein, 18 aa, Staphylococcus
AGLYLLKFLSSLNLDKSA

SEQ ID NO: 2002292 - protein, 20 aa, Staphylococcus
AGMMDCKKALEATDGDIEKA

SEQ ID NO: 2002293 - protein, 17 aa, Staphylococcus
AGMNVARLNFSHGDHAE

SEQ ID NO: 2002294 - protein, 17 aa, Staphylococcus
AGMNVARLNFSHGDQAE

SEQ ID NO: 2002295 - protein, 26 aa, Staphylococcus
AGMRYAKARYGGRMLSTIGVGGPYAN

SEQ ID NO: 2002296 - protein, 17 aa, Staphylococcus
AGMTAAVYASRADLKTL

SEQ ID NO: 2002297 - protein, 17 aa, Staphylococcus
AGMTAAVYASRANLNTV

SEQ ID NO: 2002298 - protein, 18 aa, Staphylococcus
AGMTMEIDNIDALSKGLN

SEQ ID NO: 2002299 - protein, 30 aa, Staphylococcus
AGNIGYKIAQRLGGFEAIGPVLQGLNSPVN

SEQ ID NO: 2002300 - protein, 26 aa, Staphylococcus
AGNIGYKIAQRLGGYDAVGPVLQGLN

SEQ ID NO: 2002301 - protein, 30 aa, Staphylococcus
AGNIGYKIAQRLGGYEAIGPVLQGLNSPVN

SEQ ID NO: 2002302 - protein, 21 aa, Staphylococcus
AGNVCGMMPHPERAMESLLGT

SEQ ID NO: 2002303 - protein, 23 aa, Staphylococcus
AGNVLRFQPPLVISYDQLDYALS

SEQ ID NO: 2002304 - protein, 21 aa, Staphylococcus
AGNVLRFQPPLVITDEELDQA

SEQ ID NO: 2002305 - protein, 23 aa, Staphylococcus
AGNVLRFQPPLVITYEQLDEALA

SEQ ID NO: 2002306 - protein, 17 aa, Staphylococcus
AGPGGLMLGLLLQQQGH

SEQ ID NO: 2002307 - protein, 17 aa, Staphylococcus
AGPILYQRLNDIPENKR

SEQ ID NO: 2002308 - protein, 25 aa, Staphylococcus
AGPRGPLLMQDWYFLEQMAHFDREV

SEQ ID NO: 2002309 - protein, 20 aa, Staphylococcus
AGQERLPLIHRWIDGRMPLI

SEQ ID NO: 2002310 - protein, 18 aa, Staphylococcus
AGQKAVLIPGDIRDEQFN

SEQ ID NO: 2002311 - protein, 17 aa, Staphylococcus
AGQLFKLVDSNRKYLAE

SEQ ID NO: 2002312 - protein, 25 aa, Staphylococcus
AGQYRGVATWQYHRQRQKLIGTIEV

SEQ ID NO: 2002313 - protein, 19 aa, Staphylococcus
AGRALRMGLSAALPETVEY

SEQ ID NO: 2002314 - protein, 26 aa, Staphylococcus
AGRARRGELVSCFLLEADDSLNSINF

SEQ ID NO: 2002315 - protein, 21 aa, Staphylococcus
AGRDTRGLIRLHQFDKVELVR

SEQ ID NO: 2002316 - protein, 21 aa, Staphylococcus
AGRDTRGLIRLHQFDKVEMVR

SEQ ID NO: 2002317 - protein, 27 aa, Staphylococcus
AGREIKSDMYINLGIGMPTLVANAMPE

SEQ ID NO: 2002318 - protein, 23 aa, Staphylococcus
AGRFSNQAIRNFGEVYGPSPMSL

SEQ ID NO: 2002319 - protein, 26 aa, Staphylococcus
AGRGPRGFGNFGGFGGRHGGRDRFFK

SEQ ID NO: 2002320 - protein, 18 aa, Staphylococcus
AGRMSAQIGAEFLQKING

SEQ ID NO: 2002321 - protein, 40 aa, Staphylococcus
AGRSDYPWDLFIQMPAALMFPSGNRFYDWIYQTEEEPHMG

SEQ ID NO: 2002322 - protein, 34 aa, Staphylococcus
AGRSDYPWDLLIQMPAALMYPAGNKLYDWIYETT

SEQ ID NO: 2002323 - protein, 21 aa, Staphylococcus
AGRTKALLKRIDFIQDKLKRK

SEQ ID NO: 2002324 - protein, 25 aa, Staphylococcus
AGSIFYKKCKEILTLYNDVPKEINS

SEQ ID NO: 2002325 - protein, 28 aa, Staphylococcus
AGSKQLIDWLKAQSRPFLFSTSLAPGDT

SEQ ID NO: 2002326 - protein, 23 aa, Staphylococcus
AGSLLRNFELCNAVRLGISLYGY

SEQ ID NO: 2002327 - protein, 25 aa, Staphylococcus
AGSLPNDTLYKWAHHQQLLPNQLNN

SEQ ID NO: 2002328 - protein, 20 aa, Staphylococcus
AGSLSEYYQNLWGLSSNVQI

SEQ ID NO: 2002329 - protein, 30 aa, Staphylococcus
AGSNAIYEFLTLRIPMLLIPLGLDQSRGDQ

SEQ ID NO: 2002330 - protein, 25 aa, Staphylococcus
AGSPEYKGAATALFDFAVKRALDHD

SEQ ID NO: 2002331 - protein, 17 aa, Staphylococcus
AGSRFMAAYPITPASEI

SEQ ID NO: 2002332 - protein, 19 aa, Staphylococcus
AGSTQFKFRQLNAVTNTKK

SEQ ID NO: 2002333 - protein, 19 aa, Staphylococcus
AGSYAERVPVVAITGAPTR

SEQ ID NO: 2002334 - protein, 20 aa, Staphylococcus
AGTCTNYGCNAKILLEGPYE

SEQ ID NO: 2002335 - protein, 20 aa, Staphylococcus
AGTCTNYGCNAKILLENPYE

SEQ ID NO: 2002336 - protein, 18 aa, Staphylococcus
AGTDEVYIRLTANADTKE

SEQ ID NO: 2002337 - protein, 17 aa, Staphylococcus
AGTKILPHSKVMLLTDG

SEQ ID NO: 2002338 - protein, 17 aa, Staphylococcus
AGTPITVIQKYLGHQSL

SEQ ID NO: 2002339 - protein, 18 aa, Staphylococcus
AGTSDLPVAEEAAITAEV

SEQ ID NO: 2002340 - protein, 20 aa, Staphylococcus
AGTYSDCKDADLVVITAGAP

SEQ ID NO: 2002341 - protein, 25 aa, Staphylococcus
AGVAYKLSQCLIDHPPEYFIVLATI

SEQ ID NO: 2002342 - protein, 19 aa, Staphylococcus
AGVAYKLSQVLLDNPPNYF

SEQ ID NO: 2002343 - protein, 20 aa, Staphylococcus
AGVCNSAFRLTVKEFGAGLV

SEQ ID NO: 2002344 - protein, 19 aa, Staphylococcus
AGVDAIHPGYGFLSENKQF

SEQ ID NO: 2002345 - protein, 17 aa, Staphylococcus
AGVDKIFGVPGDFNLAF

SEQ ID NO: 2002346 - protein, 18 aa, Staphylococcus
AGVDKIFGVPGDFNLAFL

SEQ ID NO: 2002347 - protein, 26 aa, Staphylococcus
AGVDVFRIFDSLNWVDQMKIANEAVQ

SEQ ID NO: 2002348 - protein, 26 aa, Staphylococcus
AGVDVFRIFDSLNWVDQMKVANEAVQ

SEQ ID NO: 2002349 - protein, 18 aa, Staphylococcus
AGVHSGDSIAVYPPQTLK

SEQ ID NO: 2002350 - protein, 19 aa, Staphylococcus
AGVHSGDSIAVYPPQTLSD

SEQ ID NO: 2002351 - protein, 19 aa, Staphylococcus
AGVHSGDSIAVYPPQTLSE

SEQ ID NO: 2002352 - protein, 19 aa, Staphylococcus
AGVHSGDSIAVYPPQTLTK

SEQ ID NO: 2002353 - protein, 21 aa, Staphylococcus
AGVIPCGALDTLGHEIANRLV

SEQ ID NO: 2002354 - protein, 23 aa, Staphylococcus
AGVKDMRFNLGIEPEHLTRNEEV

SEQ ID NO: 2002355 - protein, 32 aa, Staphylococcus
AGVQEVRAWTFIKGMTAPQCAGIIHTDFERGF

SEQ ID NO: 2002356 - protein, 19 aa, Staphylococcus
AGVQKLPFICVIENNEYAI

SEQ ID NO: 2002357 - protein, 30 aa, Staphylococcus
AGVSKGGLLYHFKNKFALIQGLVDHADELY

SEQ ID NO: 2002358 - protein, 17 aa, Staphylococcus
AGVSLGGLFTLRLAENV

SEQ ID NO: 2002359 - protein, 25 aa, Staphylococcus
AGVTRVMEPGCKFDYMLTLYGPQGV

SEQ ID NO: 2002360 - protein, 25 aa, Staphylococcus
AGVVEIMEALKYLTSHPEIKHGKIR

SEQ ID NO: 2002361 - protein, 28 aa, Staphylococcus
AGVYNYFGIGAYDWNPNYAITYARNRGW

SEQ ID NO: 2002362 - protein, 19 aa, Staphylococcus
AGYKFDQWLDLTFYQLDLY

SEQ ID NO: 2002363 - protein, 17 aa, Staphylococcus
AGYQSGTEYLNFDEQPA

SEQ ID NO: 2002364 - protein, 19 aa, Staphylococcus
AGYSLNWLKHTFFEEESFD

SEQ ID NO: 2002365 - protein, 19 aa, Staphylococcus
AGYSLNWLKQTFFEHESFE

SEQ ID NO: 2002366 - protein, 17 aa, Staphylococcus
AGYYLFKAGVTADMALN

SEQ ID NO: 2002367 - protein, 22 aa, Staphylococcus
AGYYLYRAGITSGLDLNGKNHI

SEQ ID NO: 2002368 - protein, 21 aa, Staphylococcus
AHAALNRKDFIEFGRLLNASH

SEQ ID NO: 2002369 - protein, 18 aa, Staphylococcus
AHAERYGHERYGKTYEGV

SEQ ID NO: 2002370 - protein, 19 aa, Staphylococcus
AHANIIEFVDKVKKHFSEE

SEQ ID NO: 2002371 - protein, 19 aa, Staphylococcus
AHANSRVVVISAKTDVEEK

SEQ ID NO: 2002372 - protein, 18 aa, Staphylococcus
AHCSHLFVNKIDCCETEA

SEQ ID NO: 2002373 - protein, 34 aa, Staphylococcus
AHDKGCAYAKAHAMFKCDNRFDVVIASNSGYPLD

SEQ ID NO: 2002374 - protein, 19 aa, Staphylococcus
AHEFPVVKEKLGLRNYERL

SEQ ID NO: 2002375 - protein, 25 aa, Staphylococcus
AHELREILAELGLRTVDELIGRSDL

SEQ ID NO: 2002376 - protein, 27 aa, Staphylococcus
AHEVAKAESVAICWAMGITQQDIGSDS

SEQ ID NO: 2002377 - protein, 21 aa, Staphylococcus
AHFCHDFLKQKGYDIELAYEA

SEQ ID NO: 2002378 - protein, 18 aa, Staphylococcus
AHFPKTITLRDIVKAIEL

SEQ ID NO: 2002379 - protein, 24 aa, Staphylococcus
AHFRRETLGFVFQDFNMLPTMSNK

SEQ ID NO: 2002380 - protein, 18 aa, Staphylococcus
AHGCNHRAYIPAMYHDQP

SEQ ID NO: 2002381 - protein, 23 aa, Staphylococcus
AHGEIHLDINFGLYANKGTSLDD

SEQ ID NO: 2002382 - protein, 19 aa, Staphylococcus
AHGGHAIGIMPQFLADREI

SEQ ID NO: 2002383 - protein, 20 aa, Staphylococcus
AHGGLHPYAATFFVFSDYLK

SEQ ID NO: 2002384 - protein, 20 aa, Staphylococcus
AHGGLHPYGATFFVFSDYLK

SEQ ID NO: 2002385 - protein, 24 aa, Staphylococcus
AHGGSRLKDGILAIDLLRRPEMTY

SEQ ID NO: 2002386 - protein, 18 aa, Staphylococcus
AHGQTGVDCGVKEENVFI

SEQ ID NO: 2002387 - protein, 17 aa, Staphylococcus
AHGYDILGIVGDYAEVG

SEQ ID NO: 2002388 - protein, 28 aa, Staphylococcus
AHHKLAMVLVQFPPWFDCTAQNINYILY

SEQ ID NO: 2002389 - protein, 20 aa, Staphylococcus
AHHVMTYFWMLERDKGRFKD

SEQ ID NO: 2002390 - protein, 19 aa, Staphylococcus
AHHVMTYFWMLERDKNRFE

SEQ ID NO: 2002391 - protein, 20 aa, Staphylococcus
AHHVMTYFWMLERDYSRFVD

SEQ ID NO: 2002392 - protein, 17 aa, Staphylococcus
AHIKERINEDILVDKMN

SEQ ID NO: 2002393 - protein, 23 aa, Staphylococcus
AHILEGLRIALDHIDEIITTIRE

SEQ ID NO: 2002394 - protein, 34 aa, Staphylococcus
AHIRTLLLTFFYRFMRPLLEAGYVYIAQPPLFKL

SEQ ID NO: 2002395 - protein, 22 aa, Staphylococcus
AHISWLKDVHKATLDQYGYVPQ

SEQ ID NO: 2002396 - protein, 23 aa, Staphylococcus
AHKAGVSELEYLDEMISGIKSLW

SEQ ID NO: 2002397 - protein, 22 aa, Staphylococcus
AHKEVIEDLIARDKNHACVVMW

SEQ ID NO: 2002398 - protein, 22 aa, Staphylococcus
AHKFGGPKGVGILLVKNNTPIE

SEQ ID NO: 2002399 - protein, 24 aa, Staphylococcus
AHKKEHMIRAALEGVLYNLYTVYL

SEQ ID NO: 2002400 - protein, 34 aa, Staphylococcus; identical to SEQ ID NO: 1802381

SEQ ID NO: 2002401 - protein, 25 aa, Staphylococcus
AHKLISLLTQRHFTLSITLKDLQVK

SEQ ID NO: 2002402 - protein, 19 aa, Staphylococcus
AHKLKKWGLPANRNTVRLH

SEQ ID NO: 2002403 - protein, 24 aa, Staphylococcus
AHKLYNKKHYVLARMISQVSRFFT

SEQ ID NO: 2002404 - protein, 24 aa, Staphylococcus
AHKNGKELLVDMIAVQDLQKRAKE

SEQ ID NO: 2002405 - protein, 25 aa, Staphylococcus
AHLAARKGLPYVFAGHFAPQQMKDA

SEQ ID NO: 2002406 - protein, 25 aa, Staphylococcus
AHLAARKGLPYVFAGHFASQQMKDA

SEQ ID NO: 2002407 - protein, 22 aa, Staphylococcus
AHLESRFLPGRHYAKFNLQGEI

SEQ ID NO: 2002408 - protein, 22 aa, Staphylococcus
AHLESRLLPGRHYAKFNLQGQV

SEQ ID NO: 2002409 - protein, 23 aa, Staphylococcus
AHLPVEVINRVQVILDAFEQSNN

SEQ ID NO: 2002410 - protein, 20 aa, Staphylococcus
AHLTAFIRKATQIGIPVMAH

SEQ ID NO: 2002411 - protein, 21 aa, Staphylococcus
AHMKNEFPNRDVLMSILSNHA

SEQ ID NO: 2002412 - protein, 32 aa, Staphylococcus
AHMREHIAGYKIPRLYLKLTHIPLNSTSKPDK

SEQ ID NO: 2002413 - protein, 23 aa, Staphylococcus
AHNVKKAIIAWGDDDHLRQLKAD

SEQ ID NO: 2002414 - protein, 23 aa, Staphylococcus
AHNYCPYSKALKESIDIEIQVSV

SEQ ID NO: 2002415 - protein, 21 aa, Staphylococcus
AHPEFGNKVAKFISENTGYNF

SEQ ID NO: 2002416 - protein, 37 aa, Staphylococcus
AHPILTSICKKWYINSFRYFRNMYKNFYYSRPDQLDK

SEQ ID NO: 2002417 - protein, 23 aa, Staphylococcus
AHPYRVKLALGQIRHYQLNDILD

SEQ ID NO: 2002418 - protein, 24 aa, Staphylococcus
AHPYRVKLALNQARYYQLNDLLNI

SEQ ID NO: 2002419 - protein, 19 aa, Staphylococcus
AHQFCPYSKVTRGNIDVNL

SEQ ID NO: 2002420 - protein, 24 aa, Staphylococcus
AHQKPHIMPVWSIKNRAEKVRNQD

SEQ ID NO: 2002421 - protein, 27 aa, Staphylococcus
AHQLAIKLSSSWSFLVPEILQIDEDKI

SEQ ID NO: 2002422 - protein, 24 aa, Staphylococcus
AHQRLTESITWADNRASHYAERLN

SEQ ID NO: 2002423 - protein, 20 aa, Staphylococcus
AHRLALPINIVGVIASAENM

SEQ ID NO: 2002424 - protein, 22 aa, Staphylococcus
AHRRERFGVCSVQLADRTSVGD

SEQ ID NO: 2002425 - protein, 29 aa, Staphylococcus
AHSKEGVKLLWASCRELFNVIQADEIGAD

SEQ ID NO: 2002426 - protein, 28 aa, Staphylococcus
AHSKEGVKLLWASCRELLNVIQADEIGA

SEQ ID NO: 2002427 - protein, 17 aa, Staphylococcus
AHSSIEFQVKHLMVSKV

SEQ ID NO: 2002428 - protein, 25 aa, Staphylococcus
AHSSMPIFGVNAIKPLIEFIQDIDN

SEQ ID NO: 2002429 - protein, 25 aa, Staphylococcus
AHSTVVVPTHIAIDLAYGYEAQVRP

SEQ ID NO: 2002430 - protein, 18 aa, Staphylococcus
AHSYQLHPSILVTKRDLA

SEQ ID NO: 2002431 - protein, 22 aa, Staphylococcus
AHTFKNKVIEIIKQLDETIQSY

SEQ ID NO: 2002432 - protein, 19 aa, Staphylococcus
AHTNIALIKYWGKADESYI

SEQ ID NO: 2002433 - protein, 25 aa, Staphylococcus
AHVAARRGLPYVFAGHFAPQQMKDA

SEQ ID NO: 2002434 - protein, 25 aa, Staphylococcus
AHVAARRGLPYVFAGHFAPQQMKEA

SEQ ID NO: 2002435 - protein, 23 aa, Staphylococcus
AHVCKELEYQLLLNYTGLDLSEE

SEQ ID NO: 2002436 - protein, 17 aa, Staphylococcus
AHVIGEKKLNLMPMDDL

SEQ ID NO: 2002437 - protein, 17 aa, Staphylococcus
AHVLRLLAEHVDKMSSN

SEQ ID NO: 2002438 - protein, 20 aa, Staphylococcus
AHVNHFPIVAIGGINVENTR

SEQ ID NO: 2002439 - protein, 22 aa, Staphylococcus
AIADGYRPGDFESITVTVDADE

SEQ ID NO: 2002440 - protein, 17 aa, Staphylococcus
AIAEMKDATTIIGGGDS

SEQ ID NO: 2002441 - protein, 23 aa, Staphylococcus
AIAFQAYCGTWVQILKHFINMTT

SEQ ID NO: 2002442 - protein, 19 aa, Staphylococcus
AIAGEGAFVNGQQLMPPNE

SEQ ID NO: 2002443 - protein, 25 aa, Staphylococcus
AIAIDLRGQEFFKSLVKEVDLLRSQ

SEQ ID NO: 2002444 - protein, 18 aa, Staphylococcus
AIALCQKPSLGVPSEQNV

SEQ ID NO: 2002445 - protein, 18 aa, Staphylococcus
AIALCQKPTLGVPSLQDI

SEQ ID NO: 2002446 - protein, 24 aa, Staphylococcus
AIAMKARKLILMTDVKGVIEHGTL

SEQ ID NO: 2002447 - protein, 30 aa, Staphylococcus
AIAQTCFQFNVPFIVTRAVSDLANGEADIS

SEQ ID NO: 2002448 - protein, 30 aa, Staphylococcus
AIAQVCYQFKVPFIITRAVSDLANGEADMT

SEQ ID NO: 2002449 - protein, 22 aa, Staphylococcus
AIARKTGARGLRSIIEEALIDI

SEQ ID NO: 2002450 - protein, 24 aa, Staphylococcus
AIATGRPRTETIVPFETIGIKSYF

SEQ ID NO: 2002451 - protein, 24 aa, Staphylococcus
AIATGRPRTETLVPFESLGLKAFF

SEQ ID NO: 2002452 - protein, 28 aa, Staphylococcus
AIATGRPRTETLVPFQTLNLLSYFDEKH

SEQ ID NO: 2002453 - protein, 18 aa, Staphylococcus
AIAYSFKGANHINESKKL

SEQ ID NO: 2002454 - protein, 18 aa, Staphylococcus
AICGIDFAGPEVGFPTEA

SEQ ID NO: 2002455 - protein, 25 aa, Staphylococcus
AIDCDRAPYAICLMLALEQHGIPFV

SEQ ID NO: 2002456 - protein, 23 aa, Staphylococcus
AIDDMKANGTGFLSEPNASDMEF

SEQ ID NO: 2002457 - protein, 24 aa, Staphylococcus
AIDEIPIVALLCTQANGSSVIKDA

SEQ ID NO: 2002458 - protein, 24 aa, Staphylococcus
AIDELPIIALLCTQASGTSIIKDA

SEQ ID NO: 2002459 - protein, 24 aa, Staphylococcus
AIDELPVVALLCTQASSTCIIKDA

SEQ ID NO: 2002460 - protein, 17 aa, Staphylococcus
AIDETYRGYGLGQLLLK

SEQ ID NO: 2002461 - protein, 24 aa, Staphylococcus
AIDFYKKQGFEITGHHDFINGNVI

SEQ ID NO: 2002462 - protein, 17 aa, Staphylococcus
AIDGGFDCPNRDGTVAH

SEQ ID NO: 2002463 - protein, 24 aa, Staphylococcus
AIDLGKYGIRVNCVAPGLVYPTNN

SEQ ID NO: 2002464 - protein, 22 aa, Staphylococcus
AIDLKPGVVGTVISAQKLSNEL

SEQ ID NO: 2002465 - protein, 22 aa, Staphylococcus
AIDLKSGVVGTVVPAQKVIDQL

SEQ ID NO: 2002466 - protein, 18 aa, Staphylococcus
AIDRNNSKIFAFERTLNE

SEQ ID NO: 2002467 - protein, 28 aa, Staphylococcus
AIDVPLDLLPYLFFQFAKDGKRLYEDNA

SEQ ID NO: 2002468 - protein, 19 aa, Staphylococcus
AIEAIICGIGINMNHVEAD

SEQ ID NO: 2002469 - protein, 17 aa, Staphylococcus
AIEAIRAGVPLQDIDKI

SEQ ID NO: 2002470 - protein, 33 aa, Staphylococcus
AIEEKNRWLGYYGFNVSSEWMIPKIMEVNDKAP

SEQ ID NO: 2002471 - protein, 17 aa, Staphylococcus
AIEEMRLPIEYLANLFT

SEQ ID NO: 2002472 - protein, 17 aa, Staphylococcus
AIEEMRLPIEYLANLLT

SEQ ID NO: 2002473 - protein, 17 aa, Staphylococcus
AIEEMRLPIEYLANMFT

SEQ ID NO: 2002474 - protein, 27 aa, Staphylococcus
AIEGLKDDALCFYDLGSAEMNLDMAIE

SEQ ID NO: 2002475 - protein, 25 aa, Staphylococcus
AIEHELKLAIIMNDFGKTSVDRYLV

SEQ ID NO: 2002476 - protein, 27 aa, Staphylococcus
AIEIPVELLPYLFFQFAKDGKRLYSDN

SEQ ID NO: 2002477 - protein, 25 aa, Staphylococcus
AIEKDGQWFIQGRIDFQIKLNGYRM

SEQ ID NO: 2002478 - protein, 24 aa, Staphylococcus
AIEKSKCAQLEWEKVPAPTRAERV

SEQ ID NO: 2002479 - protein, 19 aa, Staphylococcus
AIENGFSCMVEKGREIGEW

SEQ ID NO: 2002480 - protein, 18 aa, Staphylococcus
AIEQLKVWGERVGVEVIS

SEQ ID NO: 2002481 - protein, 32 aa, Staphylococcus
AIERAAKVIGSWRLEDCTLYVTLEPCVMCAGT

SEQ ID NO: 2002482 - protein, 31 aa, Staphylococcus
AIERAAKVLGSWRLEDCTLYVTLEPCVMCAG

SEQ ID NO: 2002483 - protein, 29 aa, Staphylococcus
AIERASEVLGSWRLEACTLYVTLEPCVMC

SEQ ID NO: 2002484 - protein, 29 aa, Staphylococcus
AIERASKVLGSWRLEGCTLYVTLEPCVMC

SEQ ID NO: 2002485 - protein, 31 aa, Staphylococcus
AIERASKVVGSWRLEECTLYVTLEPCVMCAG

SEQ ID NO: 2002486 - protein, 23 aa, Staphylococcus
AIEREIGYRMKIVSGGNSSMLPL

SEQ ID NO: 2002487 - protein, 18 aa, Staphylococcus
AIERPAVVTIMGHVDHGK

SEQ ID NO: 2002488 - protein, 18 aa, Staphylococcus
AIERSNVILIVIDAEQGI

SEQ ID NO: 2002489 - protein, 18 aa, Staphylococcus
AIERSNVVLLVIDAEEGI

SEQ ID NO: 2002490 - protein, 19 aa, Staphylococcus
AIESAFGVDVFIRTKKQLI

SEQ ID NO: 2002491 - protein, 18 aa, Staphylococcus
AIESQIIYGVKPGDILEI

SEQ ID NO: 2002492 - protein, 17 aa, Staphylococcus
AIFDYLSVEGIIVLVIY

SEQ ID NO: 2002493 - protein, 23 aa, Staphylococcus
AIFGVVPKPLWTKRYAVNEKNQV

SEQ ID NO: 2002494 - protein, 24 aa, Staphylococcus
AIFKVETLFPYITLSHFCDEENAN

SEQ ID NO: 2002495 - protein, 24 aa, Staphylococcus
AIFSALSIRDSRIAPTIHADSPDP

SEQ ID NO: 2002496 - protein, 22 aa, Staphylococcus
AIGDFRPEIIINQITDLKNVDM

SEQ ID NO: 2002497 - protein, 18 aa, Staphylococcus
AIGEGEMDEAPMLYIGEK

SEQ ID NO: 2002498 - protein, 19 aa, Staphylococcus
AIGITDLRKMGLRDKTVEF

SEQ ID NO: 2002499 - protein, 26 aa, Staphylococcus
AIGQLIGMRASSDFVRHGEKKSTIEG

SEQ ID NO: 2002500 - protein, 17 aa, Staphylococcus
AIGTSALITPWNYPANQ

SEQ ID NO: 2002501 - protein, 17 aa, Staphylococcus
AIGVSGLITPWNFPTNQ

SEQ ID NO: 2002502 - protein, 17 aa, Staphylococcus
AIGYGRGLQAVNILRNQ

SEQ ID NO: 2002503 - protein, 19 aa, Staphylococcus
AIHFPGVFACADNNNDIKA

SEQ ID NO: 2002504 - protein, 21 aa, Staphylococcus
AIHLIRIVLSGTFDKYPDLKI

SEQ ID NO: 2002505 - protein, 18 aa, Staphylococcus
AIHMANKMKKGFIDKGYR

SEQ ID NO: 2002506 - protein, 17 aa, Staphylococcus
AIHNARELLKYKIETYD

SEQ ID NO: 2002507 - protein, 25 aa, Staphylococcus
AIHPQLKICACLGLVDDEQATQLKE

SEQ ID NO: 2002508 - protein, 21 aa, Staphylococcus
AIHSRCPEAMVIDINDTKMLT

SEQ ID NO: 2002509 - protein, 21 aa, Staphylococcus
AIHSRCPEAMVIDINDTKQLT

SEQ ID NO: 2002510 - protein, 24 aa, Staphylococcus
AIIERAIELGITYFDTADMYDKGI

SEQ ID NO: 2002511 - protein, 17 aa, Staphylococcus
AIIGWHPVDAIDYTEEC

SEQ ID NO: 2002512 - protein, 20 aa, Staphylococcus
AIIKAHHIRFNESLRIFTDM

SEQ ID NO: 2002513 - protein, 19 aa, Staphylococcus
AIIKRIISWLEPRHNEKKA

SEQ ID NO: 2002514 - protein, 17 aa, Staphylococcus
AIISYLSSDLFKGIGKK

SEQ ID NO: 2002515 - protein, 27 aa, Staphylococcus
AIISYLSSDLFKGIGKKTAQNIVNTLG

SEQ ID NO: 2002516 - protein, 25 aa, Staphylococcus
AIISYLSSDLFKGIGKKTAQSIVNK

SEQ ID NO: 2002517 - protein, 21 aa, Staphylococcus
AIKAGCGYVPIDTSVPAERVN

SEQ ID NO: 2002518 - protein, 21 aa, Staphylococcus
AIKAGCGYVPIDTSVPEERVK

SEQ ID NO: 2002519 - protein, 22 aa, Staphylococcus
AIKAGCGYVPIDTSVPEERVKM

SEQ ID NO: 2002520 - protein, 21 aa, Staphylococcus
AIKAGCGYVPIDTSVPSERVN

SEQ ID NO: 2002521 - protein, 33 aa, Staphylococcus
AIKAKDGFNTTVLPAFRPDDVFKVGDPAFTDLL

SEQ ID NO: 2002522 - protein, 24 aa, Staphylococcus
AIKDRGFQLGILEFYIIEGTELAQ

SEQ ID NO: 2002523 - protein, 21 aa, Staphylococcus
AIKEHMASLVYKLEEMGVNLD

SEQ ID NO: 2002524 - protein, 19 aa, Staphylococcus
AIKILPFVNLEALREHPKI

SEQ ID NO: 2002525 - protein, 26 aa, Staphylococcus
AIKKGWPSMMRKIWKNPEKYDSYFIG

SEQ ID NO: 2002526 - protein, 24 aa, Staphylococcus
AIKKGWPSMMVSIWKNPEKYDSYF

SEQ ID NO: 2002527 - protein, 25 aa, Staphylococcus
AIKKGWPSMMYEIWDNPEKYRSYFI

SEQ ID NO: 2002528 - protein, 19 aa, Staphylococcus
AIKLPLPKIEHFVNESAVK

SEQ ID NO: 2002529 - protein, 23 aa, Staphylococcus
AIKNLRGVKGINIMELDQSDVVR

SEQ ID NO: 2002530 - protein, 20 aa, Staphylococcus
AIKRISYKVLQVAKRAQRGI

SEQ ID NO: 2002531 - protein, 19 aa, Staphylococcus
AILEMAKAGLINIEQSNNF

SEQ ID NO: 2002532 - protein, 23 aa, Staphylococcus
AILKAEGNMNIFIIENDEASDDI

SEQ ID NO: 2002533 - protein, 27 aa, Staphylococcus
AILKDQKRLLPSIAYLEGEYGFSDICL

SEQ ID NO: 2002534 - protein, 17 aa, Staphylococcus
AILKELLGYEAKQLSIS

SEQ ID NO: 2002535 - protein, 20 aa, Staphylococcus
AILKEYRGLGLGLKLLTFIE

SEQ ID NO: 2002536 - protein, 25 aa, Staphylococcus
AILKRCGKDTLLKNGRRFKSYYGYN

SEQ ID NO: 2002537 - protein, 19 aa, Staphylococcus
AILNLVLLCGCQGVNGGGW

SEQ ID NO: 2002538 - protein, 24 aa, Staphylococcus
AILNQWAAYVAEGIAQIQIMYDPG

SEQ ID NO: 2002539 - protein, 18 aa, Staphylococcus
AILQTFPDDFVFYGALNS

SEQ ID NO: 2002540 - protein, 25 aa, Staphylococcus
AILRKESACNILFKNAIIKAHQIQF

SEQ ID NO: 2002541 - protein, 23 aa, Staphylococcus
AIMRHLGICTAHLVGHEMGGMVA

SEQ ID NO: 2002542 - protein, 25 aa, Staphylococcus
AINACKAYKVNRLIVAGGVASNKGL

SEQ ID NO: 2002543 - protein, 26 aa, Staphylococcus
AINEFIKPKISVPIHYNTFPLIEQDP

SEQ ID NO: 2002544 - protein, 34 aa, Staphylococcus; identical to SEQ ID NO: 1802422

SEQ ID NO: 2002545 - protein, 23 aa, Staphylococcus
AINFFNYLSGYSVKPEYNKLIVA

SEQ ID NO: 2002546 - protein, 33 aa, Staphylococcus
AINFPSFRPDSWRGKRYLYTGLFDNDKKLKDYT

SEQ ID NO: 2002547 - protein, 24 aa, Staphylococcus
AINLACRLIQSRAGSIYLAGGVES

SEQ ID NO: 2002548 - protein, 17 aa, Staphylococcus
AINPELDAQGLAEVAVE

SEQ ID NO: 2002549 - protein, 22 aa, Staphylococcus
AINSAIIMAEFEKLNGNDSAKA

SEQ ID NO: 2002550 - protein, 23 aa, Staphylococcus
AINSTKFKPGFTLQDTPGVDSNI

SEQ ID NO: 2002551 - protein, 28 aa, Staphylococcus
AIPDEMPNRIPIGQPINGTTVYVMQGEH

SEQ ID NO: 2002552 - protein, 21 aa, Staphylococcus
AIPGEVKMLVDVRGKESESRE

SEQ ID NO: 2002553 - protein, 19 aa, Staphylococcus
AIPSLKKMRFVNSGTEAVM

SEQ ID NO: 2002554 - protein, 25 aa, Staphylococcus
AIPVCGFPWIHWAVANVSVNSDTID

SEQ ID NO: 2002555 - protein, 25 aa, Staphylococcus
AIPYDNPLFLGMGGMHGSYASNMAL

SEQ ID NO: 2002556 - protein, 20 aa, Staphylococcus
AIQAEVLFNKIAMRPGSVTT

SEQ ID NO: 2002557 - protein, 25 aa, Staphylococcus
AIQKGYCLLVGIGKNSTEADVQTIA

SEQ ID NO: 2002558 - protein, 19 aa, Staphylococcus
AIRDLTFTFTRNIPKSIKD

SEQ ID NO: 2002559 - protein, 29 aa, Staphylococcus
AIRFPSFRPDSWRGKRYLYSGLFDNDKKL

SEQ ID NO: 2002560 - protein, 18 aa, Staphylococcus
AIRIFRAAAELNINTVAI

SEQ ID NO: 2002561 - protein, 24 aa, Staphylococcus
AIRIFRAATELDIKTVAIYSNEDK

SEQ ID NO: 2002562 - protein, 19 aa, Staphylococcus
AIRIFRAATELNIQTVAIY

SEQ ID NO: 2002563 - protein, 24 aa, Staphylococcus
AIRNELKIPVKYVGLGEKLDDLQP

SEQ ID NO: 2002564 - protein, 23 aa, Staphylococcus
AISDGRPKLMGIRQIIDSYLNHQ

SEQ ID NO: 2002565 - protein, 24 aa, Staphylococcus
AISDGRPKLMGIRQIIDSYLNHQI

SEQ ID NO: 2002566 - protein, 26 aa, Staphylococcus
AISDLELIAIGGFSPLTGFMGQEDYN

SEQ ID NO: 2002567 - protein, 24 aa, Staphylococcus
AISEGYRPGDFESITVTVDAEHPS

SEQ ID NO: 2002568 - protein, 24 aa, Staphylococcus
AISEGYRPGDFESITVTVDSEKPS

SEQ ID NO: 2002569 - protein, 17 aa, Staphylococcus
AISIGPDAIKTGMLGTQ

SEQ ID NO: 2002570 - protein, 17 aa, Staphylococcus
AISKARFEFRWIDQFNL

SEQ ID NO: 2002571 - protein, 25 aa, Staphylococcus
AISMLKNLHIDKAFIGVNGIMDDEA

SEQ ID NO: 2002572 - protein, 21 aa, Staphylococcus
AISSVLSNVAWFWHTSYSHRN

SEQ ID NO: 2002573 - protein, 25 aa, Staphylococcus
AISYENPLFLGMGGMHGSYASNMAL

SEQ ID NO: 2002574 - protein, 27 aa, Staphylococcus
AITALCKKLDISLEEVVAFGDSLNDQS

SEQ ID NO: 2002575 - protein, 17 aa, Staphylococcus
AITESMRGYGLGQLIVK

SEQ ID NO: 2002576 - protein, 23 aa, Staphylococcus
AITLAELYSQFVLDKTHTQRLFT

SEQ ID NO: 2002577 - protein, 19 aa, Staphylococcus
AITLREIMDEVGIDAARYF

SEQ ID NO: 2002578 - protein, 25 aa, Staphylococcus
AITPWNFPAAMITRKIAPALAAGCT

SEQ ID NO: 2002579 - protein, 18 aa, Staphylococcus
AIVAEGAADQYTRKDMDS

SEQ ID NO: 2002580 - protein, 25 aa, Staphylococcus
AIVAHQVVIRCCFVYLGYDSEATVI

SEQ ID NO: 2002581 - protein, 20 aa, Staphylococcus
AIVGDTLFNNGIGRTDLYRG

SEQ ID NO: 2002582 - protein, 17 aa, Staphylococcus
AIVKAYKAYEAILDLPF

SEQ ID NO: 2002583 - protein, 18 aa, Staphylococcus
AIVNFLIQHFIHQFEDNQ

SEQ ID NO: 2002584 - protein, 24 aa, Staphylococcus
AIVNNALVGFKFDPVQQQAFVDLT

SEQ ID NO: 2002585 - protein, 18 aa, Staphylococcus
AIVPNRFQVIKIAKSKLE

SEQ ID NO: 2002586 - protein, 28 aa, Staphylococcus
AIVRMEKRYKGPIAFEYTHINNNRERVW

SEQ ID NO: 2002587 - protein, 20 aa, Staphylococcus
AIVYSCSFGAESMVLIDLIY

SEQ ID NO: 2002588 - protein, 18 aa, Staphylococcus
AIYKKLLVYMKFKSGLDV

SEQ ID NO: 2002589 - protein, 20 aa, Staphylococcus
AIYQEWYLGTTLYEKVEKLT

SEQ ID NO: 2002590 - protein, 22 aa, Staphylococcus
AIYRRFAEPYGLAYAQESIQMI

SEQ ID NO: 2002591 - protein, 29 aa, Staphylococcus
AIYTARKGLRTGIVADRIGGQVNETADIE

SEQ ID NO: 2002592 - protein, 22 aa, Staphylococcus
AKAAHGYLAYAGKYELDEENQT

SEQ ID NO: 2002593 - protein, 18 aa, Staphylococcus
AKAFKVPFKAIGKAVIEN

SEQ ID NO: 2002594 - protein, 24 aa, Staphylococcus
AKAFNFKSICINPTHVKYAAEQLK

SEQ ID NO: 2002595 - protein, 23 aa, Staphylococcus
AKAGIKAIIQPGGSIKDQDSIDM

SEQ ID NO: 2002596 - protein, 28 aa, Staphylococcus
AKAGVDVFRIFDSLNWVDQMKVANAAVQ

SEQ ID NO: 2002597 - protein, 18 aa, Staphylococcus
AKAHWDLIEELGMANFDR

SEQ ID NO: 2002598 - protein, 19 aa, Staphylococcus
AKAISRMKLGQIDDYTTAN

SEQ ID NO: 2002599 - protein, 19 aa, Staphylococcus
AKAIYCYLSSYAGGKDIAF

SEQ ID NO: 2002600 - protein, 20 aa, Staphylococcus
AKAKLIEFLREIELSEDDQT

SEQ ID NO: 2002601 - protein, 31 aa, Staphylococcus
AKAKSEITLGLKPGGLFIYDGDEPLLEPYAN

SEQ ID NO: 2002602 - protein, 20 aa, Staphylococcus
AKALILQLATLYGLTVEAMK

SEQ ID NO: 2002603 - protein, 21 aa, Staphylococcus
AKALLERYANNFTLNNKQSIL

SEQ ID NO: 2002604 - protein, 24 aa, Staphylococcus
AKALNLKAVIFMPVTTPLQKVNQV

SEQ ID NO: 2002605 - protein, 21 aa, Staphylococcus
AKAMHSMGFRVVLAGRNRKRL

SEQ ID NO: 2002606 - protein, 17 aa, Staphylococcus
AKANIIIVHGVAEHLDR

SEQ ID NO: 2002607 - protein, 26 aa, Staphylococcus
AKAQELKPDLILMDLLMEDMDGVEAT

SEQ ID NO: 2002608 - protein, 20 aa, Staphylococcus
AKAYGLRVITTASRNETIEW

SEQ ID NO: 2002609 - protein, 19 aa, Staphylococcus
AKAYLEFVNPQVIAVTGSN

SEQ ID NO: 2002610 - protein, 19 aa, Staphylococcus
AKDASGPYHKGLREQLVEL

SEQ ID NO: 2002611 - protein, 19 aa, Staphylococcus
AKDASGPYHKKLRQHLTQL

SEQ ID NO: 2002612 - protein, 20 aa, Staphylococcus
AKDEYGRLLAAAAIGTSKDT

SEQ ID NO: 2002613 - protein, 17 aa, Staphylococcus
AKDFVEFNNRYLFDSHF

SEQ ID NO: 2002614 - protein, 25 aa, Staphylococcus
AKDGDEWVALLCQYAKTHVTRLDEN

SEQ ID NO: 2002615 - protein, 23 aa, Staphylococcus
AKDGYYNGITFHRVINDFMVQGG

SEQ ID NO: 2002616 - protein, 24 aa, Staphylococcus
AKDIKRKIIRNLCLSILTFDKSDD

SEQ ID NO: 2002617 - protein, 25 aa, Staphylococcus
AKDILKIRKLIPIYINNHTIVFPIK

SEQ ID NO: 2002618 - protein, 20 aa, Staphylococcus
AKDIPYFKLNSSIKIKHLVD

SEQ ID NO: 2002619 - protein, 19 aa, Staphylococcus
AKDKIVIISTHIVSDIEST

SEQ ID NO: 2002620 - protein, 23 aa, Staphylococcus
AKDKRAGVITFNMVDVHAHDVAT

SEQ ID NO: 2002621 - protein, 20 aa, Staphylococcus
AKDLGAPFEVLKQIKDNGRL

SEQ ID NO: 2002622 - protein, 21 aa, Staphylococcus
AKDLIEGLVMTNSIFNGGSQV

SEQ ID NO: 2002623 - protein, 26 aa, Staphylococcus
AKDLIELKIPIAYFYIEDNDFFNCFF

SEQ ID NO: 2002624 - protein, 17 aa, Staphylococcus
AKDLKPDNLHDIKKVIH

SEQ ID NO: 2002625 - protein, 19 aa, Staphylococcus
AKDLLPEGFTHPGSPNGEF

SEQ ID NO: 2002626 - protein, 27 aa, Staphylococcus
AKDRAHILEGLRIALDHIDEIISIIRE

SEQ ID NO: 2002627 - protein, 27 aa, Staphylococcus
AKDRAHILEGLRIALDHIDEIITTIRE

SEQ ID NO: 2002628 - protein, 23 aa, Staphylococcus
AKDTEAIVVYTLVKPEIRKYMEA

SEQ ID NO: 2002629 - protein, 19 aa, Staphylococcus
AKDVLEAKVKGLIRSNISS

SEQ ID NO: 2002630 - protein, 25 aa, Staphylococcus
AKDVPFRKAHEIVGKIVFECIQQGI

SEQ ID NO: 2002631 - protein, 18 aa, Staphylococcus
AKDYKYTLMMGRTHGVHA

SEQ ID NO: 2002632 - protein, 28 aa, Staphylococcus
AKDYQEGLCAAGIPVTMFGVDNLDGEHQ

SEQ ID NO: 2002633 - protein, 29 aa, Staphylococcus
AKDYWKYHDHWLGYCTNELVQINPEAKYF

SEQ ID NO: 2002634 - protein, 19 aa, Staphylococcus
AKEDGLWFIQGRIDFQIKL

SEQ ID NO: 2002635 - protein, 21 aa, Staphylococcus
AKEDIRFNEIMTFIQSDLYMN

SEQ ID NO: 2002636 - protein, 21 aa, Staphylococcus
AKEDNGLWFIQGRIDFQIKMN

SEQ ID NO: 2002637 - protein, 18 aa, Staphylococcus
AKEEYRHQLGKVKSKLLV

SEQ ID NO: 2002638 - protein, 19 aa, Staphylococcus
AKEGHVWIMDPIDGTTNLV

SEQ ID NO: 2002639 - protein, 24 aa, Staphylococcus
AKEGKDRFLRISIDKEGGVDLNDC

SEQ ID NO: 2002640 - protein, 18 aa, Staphylococcus
AKEHGFEVLATLGDYAEV

SEQ ID NO: 2002641 - protein, 25 aa, Staphylococcus
AKEHGVRIALTEVWEKGGKGGVELA

SEQ ID NO: 2002642 - protein, 20 aa, Staphylococcus
AKEILLKTVWYAEVENAGGY

SEQ ID NO: 2002643 - protein, 19 aa, Staphylococcus
AKEIVRFHSIIWPILLMAL

SEQ ID NO: 2002644 - protein, 25 aa, Staphylococcus
AKEKQRLRTLFPLIKEASENHKKRV

SEQ ID NO: 2002645 - protein, 26 aa, Staphylococcus
AKEKSDAVIVSAHWGNEGKTKPNETQ

SEQ ID NO: 2002646 - protein, 20 aa, Staphylococcus
AKELDELGADYIAVHTGYDL

SEQ ID NO: 2002647 - protein, 25 aa, Staphylococcus
AKELEREGFHILAIKDMAGLLKPRA

SEQ ID NO: 2002648 - protein, 18 aa, Staphylococcus
AKELGKFNINVVAIAPGI

SEQ ID NO: 2002649 - protein, 19 aa, Staphylococcus
AKELIKLVDLPEEYLDRYP

SEQ ID NO: 2002650 - protein, 17 aa, Staphylococcus
AKELIKVLLKSVDYYPV

SEQ ID NO: 2002651 - protein, 23 aa, Staphylococcus
AKELKGANIFLDMVSVGATINIM

SEQ ID NO: 2002652 - protein, 18 aa, Staphylococcus
AKELVIIEKPMRAFSENS

SEQ ID NO: 2002653 - protein, 41 aa, Staphylococcus
AKENGFEILAFVGAHAEIGCDPELMGYAPYHAVTKLLNQAD

SEQ ID NO: 2002654 - protein, 19 aa, Staphylococcus
AKEPMSVTFEFEINQRQFK

SEQ ID NO: 2002655 - protein, 24 aa, Staphylococcus
AKEQLRLKTLFPYIKEASENHKKR

SEQ ID NO: 2002656 - protein, 25 aa, Staphylococcus
AKERLIPYFIYHNYWFLYYHDHQYF

SEQ ID NO: 2002657 - protein, 25 aa, Staphylococcus
AKERLRLKTLFPYIREASENHKKRV

SEQ ID NO: 2002658 - protein, 24 aa, Staphylococcus
AKERQRLRTLFPYINEASENHKKR

SEQ ID NO: 2002659 - protein, 27 aa, Staphylococcus
AKFAEGIEVGQVFKLGTKYSEAMNAKF

SEQ ID NO: 2002660 - protein, 24 aa, Staphylococcus
AKFAIGISNPEYWNKGIGTNVTKA

SEQ ID NO: 2002661 - protein, 20 aa, Staphylococcus
AKFASLRFDEDVVFCEEHTF

SEQ ID NO: 2002662 - protein, 20 aa, Staphylococcus
AKFDLSFIIEEDRDDYVVNI

SEQ ID NO: 2002663 - protein, 20 aa, Staphylococcus
AKFDLSFIIEEDYNDYTVNI

SEQ ID NO: 2002664 - protein, 17 aa, Staphylococcus
AKFDPSRIHFHGNNKTK

SEQ ID NO: 2002665 - protein, 20 aa, Staphylococcus
AKFNTLRFDEDVVFCEEHTF

SEQ ID NO: 2002666 - protein, 18 aa, Staphylococcus
AKFVKQYADFSVGVDGLK

SEQ ID NO: 2002667 - protein, 19 aa, Staphylococcus
AKFYLDDNFETFTINVTSF

SEQ ID NO: 2002668 - protein, 21 aa, Staphylococcus
AKFYSKEAFVAYFIEQLALTS

SEQ ID NO: 2002669 - protein, 22 aa, Staphylococcus
AKGDEIFIMMDLHYENDENHPE

SEQ ID NO: 2002670 - protein, 18 aa, Staphylococcus
AKGEPRVTENVRIHSACL

SEQ ID NO: 2002671 - protein, 21 aa, Staphylococcus
AKGFKDSTELLLISSNAVGHE

SEQ ID NO: 2002672 - protein, 19 aa, Staphylococcus
AKGGIVLAIRNELHIPVKY

SEQ ID NO: 2002673 - protein, 21 aa, Staphylococcus
AKGGIVLAIRNELKIPVKYVG

SEQ ID NO: 2002674 - protein, 21 aa, Staphylococcus
AKGGIVLAIRNELRIPVKYVG

SEQ ID NO: 2002675 - protein, 17 aa, Staphylococcus
AKGGSGLHLKLDQVPTR

SEQ ID NO: 2002676 - protein, 17 aa, Staphylococcus
AKGGSGLHLRLDQVPTR

SEQ ID NO: 2002677 - protein, 25 aa, Staphylococcus
AKGKRFALPNAEVMIHQPLGGAQGQ

SEQ ID NO: 2002678 - protein, 26 aa, Staphylococcus
AKGKRFALPNAEVMIHQPLGGAQGQA

SEQ ID NO: 2002679 - protein, 25 aa, Staphylococcus
AKGKRYALPNAEVMIHQPLGGAQGQ

SEQ ID NO: 2002680 - protein, 22 aa, Staphylococcus
AKGLKPRAIRAMIVGIPNVGKS

SEQ ID NO: 2002681 - protein, 18 aa, Staphylococcus
AKGLNIVGLINIQFVIAH

SEQ ID NO: 2002682 - protein, 19 aa, Staphylococcus
AKGLNIVGLINIQFVIAHD

SEQ ID NO: 2002683 - protein, 17 aa, Staphylococcus
AKGNIKETVGNATDNKD

SEQ ID NO: 2002684 - protein, 19 aa, Staphylococcus
AKGPGSYTGLRIGVTTAKT

SEQ ID NO: 2002685 - protein, 19 aa, Staphylococcus
AKGSARSIEQVSMYDILDK

SEQ ID NO: 2002686 - protein, 18 aa, Staphylococcus
AKGVESFAIQANVAEGDE

SEQ ID NO: 2002687 - protein, 20 aa, Staphylococcus
AKGYAMLQGQGFDLKAEDMP

SEQ ID NO: 2002688 - protein, 23 aa, Staphylococcus
AKHGIKAIIQPGGSIKDQDSIDM

SEQ ID NO: 2002689 - protein, 21 aa, Staphylococcus
AKHGIKVILNPAPYRELDKEV

SEQ ID NO: 2002690 - protein, 21 aa, Staphylococcus
AKHIQGYAGDVWYPQPAPADH

SEQ ID NO: 2002691 - protein, 17 aa, Staphylococcus
AKHSVRFSFNEQTTEQE

SEQ ID NO: 2002692 - protein, 18 aa, Staphylococcus
AKHTKSLIAEWRYQDVPK

SEQ ID NO: 2002693 - protein, 18 aa, Staphylococcus
AKIDYLFNALEDDGPELI

SEQ ID NO: 2002694 - protein, 25 aa, Staphylococcus
AKIGTLHLKSIRISEVKPYYFNYFG

SEQ ID NO: 2002695 - protein, 17 aa, Staphylococcus
AKIGTYCFDIFKEMKRD

SEQ ID NO: 2002696 - protein, 17 aa, Staphylococcus
AKIIALMGLELIENKGM

SEQ ID NO: 2002697 - protein, 17 aa, Staphylococcus
AKIIALMGLELIENKKL

SEQ ID NO: 2002698 - protein, 24 aa, Staphylococcus
AKIIRRKLKKLGITKGIPVVFSDE

SEQ ID NO: 2002699 - protein, 20 aa, Staphylococcus
AKIISELDCLQSFAEIAQKY

SEQ ID NO: 2002700 - protein, 21 aa, Staphylococcus
AKIISELDCLQSFAEIAQKYN

SEQ ID NO: 2002701 - protein, 21 aa, Staphylococcus
AKIISELDCLQSFAEIAQRYN

SEQ ID NO: 2002702 - protein, 17 aa, Staphylococcus
AKIKEFKLLSTAGAYWR

SEQ ID NO: 2002703 - protein, 17 aa, Staphylococcus
AKIPFYTLSNYNELIDV

SEQ ID NO: 2002704 - protein, 23 aa, Staphylococcus
AKITQQLKFKYPNVINTTKPSKQ

SEQ ID NO: 2002705 - protein, 22 aa, Staphylococcus
AKIVEFGGWAMPVQFSSIKEEH

SEQ ID NO: 2002706 - protein, 18 aa, Staphylococcus
AKIVKAMIGRDLDNQYPE

SEQ ID NO: 2002707 - protein, 19 aa, Staphylococcus
AKIVLNWLSENDIKVELLN

SEQ ID NO: 2002708 - protein, 19 aa, Staphylococcus
AKIVLNWLSEQQIQVELLN

SEQ ID NO: 2002709 - protein, 18 aa, Staphylococcus
AKIVMNWLNDQQIHVDLL

SEQ ID NO: 2002710 - protein, 23 aa, Staphylococcus
AKKADTAPKRFIREFRNVNVDEY

SEQ ID NO: 2002711 - protein, 18 aa, Staphylococcus
AKKAEDKLKEEKESAKDN

SEQ ID NO: 2002712 - protein, 24 aa, Staphylococcus
AKKAGTAPKRFIREFKNINVDEYE

SEQ ID NO: 2002713 - protein, 21 aa, Staphylococcus
AKKALSVAVYNHYKRIQQLGP

SEQ ID NO: 2002714 - protein, 17 aa, Staphylococcus
AKKAYKLSPEVEKVLAS

SEQ ID NO: 2002715 - protein, 17 aa, Staphylococcus
AKKDIKLLSNFDIDRYV

SEQ ID NO: 2002716 - protein, 22 aa, Staphylococcus
AKKDVLYSIVPVNYFTYRHMSD

SEQ ID NO: 2002717 - protein, 22 aa, Staphylococcus
AKKEGQGCVSLKSIAAENSLSD

SEQ ID NO: 2002718 - protein, 21 aa, Staphylococcus
AKKEGQGCVSLKSIAEENNLS

SEQ ID NO: 2002719 - protein, 20 aa, Staphylococcus
AKKEMLEMISNGKIKMKLNN

SEQ ID NO: 2002720 - protein, 17 aa, Staphylococcus
AKKFDLPIIEVIEGGNV

SEQ ID NO: 2002721 - protein, 18 aa, Staphylococcus
AKKFDLPIIEVIKGGDVQ

SEQ ID NO: 2002722 - protein, 17 aa, Staphylococcus
AKKFVKNPMDIVSVGDI

SEQ ID NO: 2002723 - protein, 21 aa, Staphylococcus
AKKGLPHACFNITIYEESTLI

SEQ ID NO: 2002724 - protein, 21 aa, Staphylococcus
AKKKVAIALRNRYRRSQLDEE

SEQ ID NO: 2002725 - protein, 21 aa, Staphylococcus
AKKLKLSPIVKKVLESKNLVQ

SEQ ID NO: 2002726 - protein, 24 aa, Staphylococcus
AKKLNLKAVIFMPVTTPLQKINQV

SEQ ID NO: 2002727 - protein, 23 aa, Staphylococcus
AKKLNLRAVIFMPVTTPLQKINQ

SEQ ID NO: 2002728 - protein, 21 aa, Staphylococcus
AKKLYERLGFKWTEDIELYDH

SEQ ID NO: 2002729 - protein, 25 aa, Staphylococcus
AKKMKVFDLCLINWIPRAQNKEANH

SEQ ID NO: 2002730 - protein, 19 aa, Staphylococcus
AKKPVLLVGAGVRHSQSGP

SEQ ID NO: 2002731 - protein, 38 aa, Staphylococcus
AKKRAPKFFRKLNIEWIYRLLIDWKRLGRLKSIPKFMF

SEQ ID NO: 2002732 - protein, 26 aa, Staphylococcus
AKKSKNGLRFTTLFEGDWTQFYDSQS

SEQ ID NO: 2002733 - protein, 21 aa, Staphylococcus
AKKSLAVAVYNHYKRVQQLGP

SEQ ID NO: 2002734 - protein, 20 aa, Staphylococcus
AKKSTPLKVYINGDFENITF

SEQ ID NO: 2002735 - protein, 20 aa, Staphylococcus
AKKSTPLKVYVNGNFDGVTF

SEQ ID NO: 2002736 - protein, 20 aa, Staphylococcus
AKKSTPLKVYVNGQFNDVTF

SEQ ID NO: 2002737 - protein, 19 aa, Staphylococcus
AKKSTPLKVYVNGTFDGVN

SEQ ID NO: 2002738 - protein, 20 aa, Staphylococcus
AKKSTPLKVYVNGVLGQVTF

SEQ ID NO: 2002739 - protein, 28 aa, Staphylococcus
AKKTFGSWKSWLDKTLGWIKNIKKDFGS

SEQ ID NO: 2002740 - protein, 17 aa, Staphylococcus
AKKVIELSMDEARKLHH

SEQ ID NO: 2002741 - protein, 18 aa, Staphylococcus
AKKVMSFEIDHRLIPVLK

SEQ ID NO: 2002742 - protein, 18 aa, Staphylococcus
AKKVMSFEIDQRLIPVLE

SEQ ID NO: 2002743 - protein, 19 aa, Staphylococcus
AKKVVAFEIDQRLIPVLED

SEQ ID NO: 2002744 - protein, 21 aa, Staphylococcus
AKKYGLRSGVGIAAPQLNISK

SEQ ID NO: 2002745 - protein, 23 aa, Staphylococcus
AKKYGLRSGVGLAAPQINISKKM

SEQ ID NO: 2002746 - protein, 22 aa, Staphylococcus
AKKYKYTLMMGRTHGVHAEPTT

SEQ ID NO: 2002747 - protein, 24 aa, Staphylococcus
AKKYQFKSVCINPTHVSYASQQLL

SEQ ID NO: 2002748 - protein, 20 aa, Staphylococcus
AKLACLTIDTSMRHLDGITD

SEQ ID NO: 2002749 - protein, 24 aa, Staphylococcus
AKLAGRIGLPFVIAQMGQEPQQLQ

SEQ ID NO: 2002750 - protein, 17 aa, Staphylococcus
AKLDCEIAVIVGGGNIW

SEQ ID NO: 2002751 - protein, 19 aa, Staphylococcus
AKLETRNGYNLSAMSIDPE

SEQ ID NO: 2002752 - protein, 19 aa, Staphylococcus
AKLETRNGYNLSAMSIEPE

SEQ ID NO: 2002753 - protein, 23 aa, Staphylococcus
AKLGEEGVLCLLSDSTNALVPDF

SEQ ID NO: 2002754 - protein, 22 aa, Staphylococcus
AKLGEEGVLCLLSDSTNSLVPD

SEQ ID NO: 2002755 - protein, 23 aa, Staphylococcus
AKLGEEGVLCLLSDSTNSLVPDF

SEQ ID NO: 2002756 - protein, 21 aa, Staphylococcus
AKLGFKRVIIPKTNIGGWTFP

SEQ ID NO: 2002757 - protein, 20 aa, Staphylococcus
AKLGFKRVIIPQTNIGGWTF

SEQ ID NO: 2002758 - protein, 17 aa, Staphylococcus
AKLGLPAHMSLLTRVQS

SEQ ID NO: 2002759 - protein, 32 aa, Staphylococcus
AKLKEAKLPFVHSKGGIYSWLRTPPGYNSEQF

SEQ ID NO: 2002760 - protein, 20 aa, Staphylococcus
AKLKGAHVVGIAGGKEKTNY

SEQ ID NO: 2002761 - protein, 25 aa, Staphylococcus
AKLKSIFGERAMYFVAENGAVIYEG

SEQ ID NO: 2002762 - protein, 20 aa, Staphylococcus
AKLLAETTMELTIITNGLEN

SEQ ID NO: 2002763 - protein, 20 aa, Staphylococcus
AKLLKFHGSYMQDDRDLRDE

SEQ ID NO: 2002764 - protein, 17 aa, Staphylococcus
AKLLRQLNRNIKFIFLD

SEQ ID NO: 2002765 - protein, 17 aa, Staphylococcus
AKLNLPFDITHAKIKLH

SEQ ID NO: 2002766 - protein, 22 aa, Staphylococcus
AKLNMGFRMPAKYGDAAYFTMV

SEQ ID NO: 2002767 - protein, 24 aa, Staphylococcus
AKLRANELLDEIGLTHRVKSYPYM

SEQ ID NO: 2002768 - protein, 20 aa, Staphylococcus
AKLRKGMNSSETFKYSPEFA

SEQ ID NO: 2002769 - protein, 19 aa, Staphylococcus
AKLSRISEELLRDINKETV

SEQ ID NO: 2002770 - protein, 18 aa, Staphylococcus
AKLSTSLYRRIQDIMPSV

SEQ ID NO: 2002771 - protein, 17 aa, Staphylococcus
AKLTDGFHLHTISADTE

SEQ ID NO: 2002772 - protein, 26 aa, Staphylococcus
AKLYFEGVSVFDMLDIVENITLDSIN

SEQ ID NO: 2002773 - protein, 25 aa, Staphylococcus
AKLYFEGVSVFDMLNIVENITLESV

SEQ ID NO: 2002774 - protein, 17 aa, Staphylococcus
AKLYPLTFDNFFKEDEV

SEQ ID NO: 2002775 - protein, 20 aa, Staphylococcus
AKMDGLHPGRTANVLLNGDV

SEQ ID NO: 2002776 - protein, 25 aa, Staphylococcus
AKMIPKLDTALCHYHDKIKLQLDKD

SEQ ID NO: 2002777 - protein, 17 aa, Staphylococcus
AKMPVHLKAWRKFSKKL

SEQ ID NO: 2002778 - protein, 20 aa, Staphylococcus
AKMRMKEIGFILQATNLVPF

SEQ ID NO: 2002779 - protein, 18 aa, Staphylococcus
AKMSELADAFILAPGGAG

SEQ ID NO: 2002780 - protein, 18 aa, Staphylococcus
AKMSGQVILLLDEIHRLD

SEQ ID NO: 2002781 - protein, 19 aa, Staphylococcus
AKNALDAMISYFNGVAQLR

SEQ ID NO: 2002782 - protein, 23 aa, Staphylococcus
AKNGAKIAFYVAQWPSARLNHWL

SEQ ID NO: 2002783 - protein, 23 aa, Staphylococcus
AKNGKLDCVMVYKTNRLARNTSD

SEQ ID NO: 2002784 - protein, 21 aa, Staphylococcus
AKNIRFMCLIAALEGVEKLQE

SEQ ID NO: 2002785 - protein, 20 aa, Staphylococcus
AKNIRFMCLIAAPEGVEKMK

SEQ ID NO: 2002786 - protein, 19 aa, Staphylococcus
AKNKRGKIGVEHAQLSDIK

SEQ ID NO: 2002787 - protein, 24 aa, Staphylococcus
AKNLSDRAIGYGMEGVQVDGNDPI

SEQ ID NO: 2002788 - protein, 25 aa, Staphylococcus
AKNRALELLNLVGIDKSEEIFNSYP

SEQ ID NO: 2002789 - protein, 25 aa, Staphylococcus
AKNYDIPIYLGRTLSNVKGTWIMPN

SEQ ID NO: 2002790 - protein, 25 aa, Staphylococcus
AKNYDIPLYLGRTLSNEKGTWIMSR

SEQ ID NO: 2002791 - protein, 25 aa, Staphylococcus
AKNYDIPLYLGRTLSNVKGTWIMPR

SEQ ID NO: 2002792 - protein, 25 aa, Staphylococcus
AKNYDIPLYLGRTLSNVKGTWIMSR

SEQ ID NO: 2002793 - protein, 25 aa, Staphylococcus
AKNYEIPLYLGRTLSNVKGTWIMSR

SEQ ID NO: 2002794 - protein, 19 aa, Staphylococcus
AKPAALICEIMDEDGTMAK

SEQ ID NO: 2002795 - protein, 23 aa, Staphylococcus
AKPEGAFYIFPSIQRFTENDFDF

SEQ ID NO: 2002796 - protein, 17 aa, Staphylococcus
AKPGTKFFYCGKDPNRH

SEQ ID NO: 2002797 - protein, 18 aa, Staphylococcus
AKPILDHIKHHGFEAYFV

SEQ ID NO: 2002798 - protein, 27 aa, Staphylococcus
AKPLRHCETCGSPIRPDIVLYGEMLDQ

SEQ ID NO: 2002799 - protein, 21 aa, Staphylococcus
AKPSGICSCTELTRDQIVTQI

SEQ ID NO: 2002800 - protein, 20 aa, Staphylococcus
AKPTGICACTDLTRDEIVTQ

SEQ ID NO: 2002801 - protein, 21 aa, Staphylococcus
AKPTGICACTDLTRDQIVTQI

SEQ ID NO: 2002802 - protein, 19 aa, Staphylococcus
AKQAFDLLESVMPQVSYKS

SEQ ID NO: 2002803 - protein, 19 aa, Staphylococcus
AKQAIKDTIKKASIASGVD

SEQ ID NO: 2002804 - protein, 21 aa, Staphylococcus
AKQAIKDTLKKASIASGVDIK

SEQ ID NO: 2002805 - protein, 17 aa, Staphylococcus
AKQFIDDYLDSFPGVKQ

SEQ ID NO: 2002806 - protein, 22 aa, Staphylococcus
AKQIKPEIKIGVCGELGGDAKS

SEQ ID NO: 2002807 - protein, 18 aa, Staphylococcus
AKQILKLDPSNHVARNAL

SEQ ID NO: 2002808 - protein, 23 aa, Staphylococcus
AKQLAEYIVTFILDDYKNMRKSY

SEQ ID NO: 2002809 - protein, 19 aa, Staphylococcus
AKQLEKWGVDIIEAGFPAS

SEQ ID NO: 2002810 - protein, 17 aa, Staphylococcus
AKQLGAMALFGEKYGEI

SEQ ID NO: 2002811 - protein, 23 aa, Staphylococcus
AKQLKGANIFLDMVSVGATINIM

SEQ ID NO: 2002812 - protein, 22 aa, Staphylococcus
AKQLRKGNVKRIVLTRPAVEAG

SEQ ID NO: 2002813 - protein, 21 aa, Staphylococcus
AKQLRKGTVKRIVLTRPAVEA

SEQ ID NO: 2002814 - protein, 24 aa, Staphylococcus
AKQLSEFIMTFILDDYKKMRTSYE

SEQ ID NO: 2002815 - protein, 23 aa, Staphylococcus
AKQMSQFIFAYILDDYKKMAVSR

SEQ ID NO: 2002816 - protein, 25 aa, Staphylococcus
AKQRALEILNLVGLPNAEKRFKAYP

SEQ ID NO: 2002817 - protein, 26 aa, Staphylococcus
AKQRALELVELVGLKGREDAYPSELS

SEQ ID NO: 2002818 - protein, 21 aa, Staphylococcus
AKQYPGYDFEKNVGYGTKAHL

SEQ ID NO: 2002819 - protein, 24 aa, Staphylococcus
AKRAEAAGFSFVFVADGLYIHEKS

SEQ ID NO: 2002820 - protein, 22 aa, Staphylococcus
AKRAQRGITLLKELKKNPHRIV

SEQ ID NO: 2002821 - protein, 20 aa, Staphylococcus
AKREISLWFEPNELSVYTAN

SEQ ID NO: 2002822 - protein, 20 aa, Staphylococcus
AKRGRKIEWLEFTFDAEKRI

SEQ ID NO: 2002823 - protein, 17 aa, Staphylococcus
AKRIILLAFGEKKKDAI

SEQ ID NO: 2002824 - protein, 17 aa, Staphylococcus
AKRIILLAFGERKRDAI

SEQ ID NO: 2002825 - protein, 21 aa, Staphylococcus
AKRLEELGVHAVMPLASPIGT

SEQ ID NO: 2002826 - protein, 22 aa, Staphylococcus
AKRPEGIPSNDVFKYETVEVGM

SEQ ID NO: 2002827 - protein, 20 aa, Staphylococcus
AKRQLRCGVTLTCREALVSL

SEQ ID NO: 2002828 - protein, 23 aa, Staphylococcus
AKRTPVGKFRGKLRDYSAVQLGT

SEQ ID NO: 2002829 - protein, 25 aa, Staphylococcus
AKRVLPLNVSGPFHSSMMQVIEKDF

SEQ ID NO: 2002830 - protein, 18 aa, Staphylococcus
AKRVYGRTIPANSPSKKI

SEQ ID NO: 2002831 - protein, 18 aa, Staphylococcus
AKRWIRYIHEIEEPDFLI

SEQ ID NO: 2002832 - protein, 24 aa, Staphylococcus
AKSEGVNQFIFFSIMSVFGLDGEV

SEQ ID NO: 2002833 - protein, 21 aa, Staphylococcus
AKSEIWRQMMADIFDTDLIVP

SEQ ID NO: 2002834 - protein, 21 aa, Staphylococcus
AKSEIWRQMMADIFDTHLSVP

SEQ ID NO: 2002835 - protein, 23 aa, Staphylococcus
AKSEVWRQMMADIFATDVIVPES

SEQ ID NO: 2002836 - protein, 21 aa, Staphylococcus
AKSEVWRQMMADIFDTDVIVP

SEQ ID NO: 2002837 - protein, 20 aa, Staphylococcus
AKSEVWRQMMADIFDTKLIV

SEQ ID NO: 2002838 - protein, 19 aa, Staphylococcus
AKSGQIPEITMKVSVSLDG

SEQ ID NO: 2002839 - protein, 17 aa, Staphylococcus
AKSGSIFVASKGYTVDS

SEQ ID NO: 2002840 - protein, 19 aa, Staphylococcus
AKSKIKGFFKKQDRSSNIE

SEQ ID NO: 2002841 - protein, 18 aa, Staphylococcus
AKSKNVRSVKNFVREELK

SEQ ID NO: 2002842 - protein, 18 aa, Staphylococcus
AKSLGIPVTACLFNTSEL

SEQ ID NO: 2002843 - protein, 27 aa, Staphylococcus
AKSLLDMVIPLLVKYGIALEAHLQNAI

SEQ ID NO: 2002844 - protein, 24 aa, Staphylococcus
AKSLNKLTIFRVFIIDSQALSRSI

SEQ ID NO: 2002845 - protein, 23 aa, Staphylococcus
AKSLNTLTIFRVFIIDSQALTRS

SEQ ID NO: 2002846 - protein, 20 aa, Staphylococcus
AKSNFWLQLQADVFNAEIYK

SEQ ID NO: 2002847 - protein, 21 aa, Staphylococcus
AKSQGCQFAFYGHTHVAKYEY

SEQ ID NO: 2002848 - protein, 21 aa, Staphylococcus
AKSSFWLQMQADIFNATIRKL

SEQ ID NO: 2002849 - protein, 24 aa, Staphylococcus
AKSVKRKYTALVHGNIPHDYGTVD

SEQ ID NO: 2002850 - protein, 20 aa, Staphylococcus
AKSVKRKYVALVHGNIPHDY

SEQ ID NO: 2002851 - protein, 20 aa, Staphylococcus
AKSVSIAWAMGVTQQDIGSD

SEQ ID NO: 2002852 - protein, 26 aa, Staphylococcus
AKTGALLKFAVMAAVDIAEPENEVSN

SEQ ID NO: 2002853 - protein, 20 aa, Staphylococcus
AKTGALLQFAVLSAADIAKV

SEQ ID NO: 2002854 - protein, 17 aa, Staphylococcus
AKTGALLTFAVMAAVDI

SEQ ID NO: 2002855 - protein, 17 aa, Staphylococcus
AKTIIALQHLLLNYNDY

SEQ ID NO: 2002856 - protein, 22 aa, Staphylococcus
AKTKALELLEKVGLTHVKDQRP

SEQ ID NO: 2002857 - protein, 25 aa, Staphylococcus
AKTLLQRFPSAYIYNTYGPTEATVA

SEQ ID NO: 2002858 - protein, 28 aa, Staphylococcus
AKTNNPRLAKEILLSLPNDFDREVQTEL

SEQ ID NO: 2002859 - protein, 33 aa, Staphylococcus; identical to SEQ ID NO: 1802510

SEQ ID NO: 2002860 - protein, 20 aa, Staphylococcus
AKVISELDCLQSFAEIAQKY

SEQ ID NO: 2002861 - protein, 19 aa, Staphylococcus
AKVKGVLGIIGDADEATDN

SEQ ID NO: 2002862 - protein, 24 aa, Staphylococcus
AKVKRIEKYGAFVEIFSGKDALLH

SEQ ID NO: 2002863 - protein, 24 aa, Staphylococcus
AKVKRIEKYGAFVELFPGKDALLH

SEQ ID NO: 2002864 - protein, 20 aa, Staphylococcus
AKVLFELNKNILLKGPTGSG

SEQ ID NO: 2002865 - protein, 20 aa, Staphylococcus
AKWYAEKDFASLLHEDLKIR

SEQ ID NO: 2002866 - protein, 25 aa, Staphylococcus
AKYANRYNVPVVFIGGSIDVDIDQF

SEQ ID NO: 2002867 - protein, 17 aa, Staphylococcus
AKYCDIFYIGGTKIGAL

SEQ ID NO: 2002868 - protein, 19 aa, Staphylococcus
AKYDHLFGKQFEKVSNYMN

SEQ ID NO: 2002869 - protein, 25 aa, Staphylococcus
AKYEVMSIPTLIVFKDGEAVDKVVG

SEQ ID NO: 2002870 - protein, 19 aa, Staphylococcus
AKYGYDFQTMAVLTAIDEQ

SEQ ID NO: 2002871 - protein, 25 aa, Staphylococcus
AKYIDLRLDTRLAFTDSQINVYKTK

SEQ ID NO: 2002872 - protein, 25 aa, Staphylococcus
AKYKPDFLIMIPTMYYSTIRQDNFN

SEQ ID NO: 2002873 - protein, 18 aa, Staphylococcus
AKYLKEMSRKITAETGQS

SEQ ID NO: 2002874 - protein, 23 aa, Staphylococcus
AKYNEWNNHRFENELNAFVKSDT

SEQ ID NO: 2002875 - protein, 21 aa, Staphylococcus
AKYNKAFEIIKGNDLSKTILK

SEQ ID NO: 2002876 - protein, 19 aa, Staphylococcus
AKYPRVTFAHHHGYINLED

SEQ ID NO: 2002877 - protein, 18 aa, Staphylococcus
ALAAALVPMEKWAQDYIE

SEQ ID NO: 2002878 - protein, 19 aa, Staphylococcus
ALAAKDIRIEAPIPGTSLV

SEQ ID NO: 2002879 - protein, 18 aa, Staphylococcus
ALADEVAEALDWDKNHIK

SEQ ID NO: 2002880 - protein, 19 aa, Staphylococcus
ALADLGVKYVVIGHSERRD

SEQ ID NO: 2002881 - protein, 19 aa, Staphylococcus
ALADLGVKYVVIGHSERRE

SEQ ID NO: 2002882 - protein, 20 aa, Staphylococcus
ALADLGVKYVVIGHSERREL

SEQ ID NO: 2002883 - protein, 19 aa, Staphylococcus
ALADTLIEEGFRVVSGGTD

SEQ ID NO: 2002884 - protein, 19 aa, Staphylococcus
ALAELLYFDGQYLRATTEY

SEQ ID NO: 2002885 - protein, 20 aa, Staphylococcus
ALAFDGEIRAYATLTTESVQ

SEQ ID NO: 2002886 - protein, 24 aa, Staphylococcus
ALAKRVKLPIIIHNREATQDCVDI

SEQ ID NO: 2002887 - protein, 23 aa, Staphylococcus
ALAKRVNLPIVIHNREATQDCID

SEQ ID NO: 2002888 - protein, 18 aa, Staphylococcus
ALAPLCATPESLFETLNN

SEQ ID NO: 2002889 - protein, 25 aa, Staphylococcus
ALAQLNASGYVFKWVHIGDGPDAEK

SEQ ID NO: 2002890 - protein, 20 aa, Staphylococcus
ALAYGGEIRAYAALTTESVQ

SEQ ID NO: 2002891 - protein, 22 aa, Staphylococcus
ALDALKHAGYQIGILTSDTKKG

SEQ ID NO: 2002892 - protein, 25 aa, Staphylococcus
ALDEANVIRYARYLNELSDETQFIV

SEQ ID NO: 2002893 - protein, 23 aa, Staphylococcus
ALDEIHLNIQFALYGLKDTDLSQ

SEQ ID NO: 2002894 - protein, 22 aa, Staphylococcus
ALDGVKAVLGFHNYPTMDIGDF

SEQ ID NO: 2002895 - protein, 18 aa, Staphylococcus
ALDHFKVDAPTLLNDDLE

SEQ ID NO: 2002896 - protein, 24 aa, Staphylococcus
ALDILESGPIFGFDTNVQGSVEIE

SEQ ID NO: 2002897 - protein, 24 aa, Staphylococcus
ALDKGMVIGETYLLTKSGGKSGDY

SEQ ID NO: 2002898 - protein, 22 aa, Staphylococcus
ALDKLYGFCLERHIPVRDKVLI

SEQ ID NO: 2002899 - protein, 23 aa, Staphylococcus
ALDKLYGFCLERRIPVRNKVLIF

SEQ ID NO: 2002900 - protein, 24 aa, Staphylococcus
ALDKYGEFFKGFTAVPADKVANAF

SEQ ID NO: 2002901 - protein, 24 aa, Staphylococcus
ALDNFKGTILFVSHDRYFINQLAN

SEQ ID NO: 2002902 - protein, 36 aa, Staphylococcus
ALDNKSRWLGYYGFNVSSEWMIPKIMEVMNKAPEVL

SEQ ID NO: 2002903 - protein, 27 aa, Staphylococcus
ALDPELKVFAPVREWAWSREEEIDYAI

SEQ ID NO: 2002904 - protein, 18 aa, Staphylococcus
ALDSFEFEEQRGDDLVVK

SEQ ID NO: 2002905 - protein, 17 aa, Staphylococcus
ALDSFEFEERRGDDLVT

SEQ ID NO: 2002906 - protein, 30 aa, Staphylococcus
ALDSFKQPIIWLCGGLDRGNDFDELIPHMK

SEQ ID NO: 2002907 - protein, 17 aa, Staphylococcus
ALEAFEAAMTRVKPGAK

SEQ ID NO: 2002908 - protein, 19 aa, Staphylococcus
ALEALYFNDQVMEFDLTPN

SEQ ID NO: 2002909 - protein, 19 aa, Staphylococcus
ALEAVWDYAYDKVGYLGTN

SEQ ID NO: 2002910 - protein, 23 aa, Staphylococcus
ALEDFSNHMGLMFQIKDDLLDVY

SEQ ID NO: 2002911 - protein, 18 aa, Staphylococcus
ALEDIRDALLHVSSPFEE

SEQ ID NO: 2002912 - protein, 18 aa, Staphylococcus
ALEDYGIDYDQIIVRGNP

SEQ ID NO: 2002913 - protein, 17 aa, Staphylococcus
ALEEIANQLGIDMKDVM

SEQ ID NO: 2002914 - protein, 18 aa, Staphylococcus
ALEFIAKASEGGMRDALS

SEQ ID NO: 2002915 - protein, 20 aa, Staphylococcus
ALEFLVLLIIKGEDQYGYSL

SEQ ID NO: 2002916 - protein, 17 aa, Staphylococcus
ALEGVLYNLYTVYLALV

SEQ ID NO: 2002917 - protein, 22 aa, Staphylococcus
ALEHKPKLIVAGASAYSRTIDF

SEQ ID NO: 2002918 - protein, 23 aa, Staphylococcus
ALEHLQQLLPIPVIGVIEPGART

SEQ ID NO: 2002919 - protein, 17 aa, Staphylococcus
ALEHLQTLLPIPVIGVI

SEQ ID NO: 2002920 - protein, 19 aa, Staphylococcus
ALEIYKVPKYKAIIQSFDE

SEQ ID NO: 2002921 - protein, 18 aa, Staphylococcus
ALEKAGVDGVHFDVMDGQ

SEQ ID NO: 2002922 - protein, 19 aa, Staphylococcus
ALEKFKTFISHQGGDSSIV

SEQ ID NO: 2002923 - protein, 22 aa, Staphylococcus
ALEKLCREHGILLAVDDIQQGM

SEQ ID NO: 2002924 - protein, 19 aa, Staphylococcus
ALELIVLLIIKKEDQYGYS

SEQ ID NO: 2002925 - protein, 20 aa, Staphylococcus
ALELIVLLIIKREDQYGYSL

SEQ ID NO: 2002926 - protein, 24 aa, Staphylococcus
ALEMKARLDKGVIVTIFPDGSDRY

SEQ ID NO: 2002927 - protein, 18 aa, Staphylococcus
ALENLGFGALELGGITPK

SEQ ID NO: 2002928 - protein, 24 aa, Staphylococcus
ALEPLDLIKNLALKSIVKDGDDSL

SEQ ID NO: 2002929 - protein, 23 aa, Staphylococcus
ALERYPNKLIITLGDKGAMYHNG

SEQ ID NO: 2002930 - protein, 26 aa, Staphylococcus
ALESEILCPFHYFGVTDYSLNGEINE

SEQ ID NO: 2002931 - protein, 26 aa, Staphylococcus
ALESKGDMEAFWKIFHQRMAIMHDAL

SEQ ID NO: 2002932 - protein, 18 aa, Staphylococcus
ALESQGDMTTFWKIFYHK

SEQ ID NO: 2002933 - protein, 32 aa, Staphylococcus
ALESTNRVPLTWDIRQAWANERHYPGVDFLGV

SEQ ID NO: 2002934 - protein, 19 aa, Staphylococcus
ALETGEIFDYFPIPNSQEN

SEQ ID NO: 2002935 - protein, 27 aa, Staphylococcus
ALETLRRYCFDRAFIGMNGMDSKYGFT

SEQ ID NO: 2002936 - protein, 22 aa, Staphylococcus
ALETSRFKTIIADHYQIDPNNV

SEQ ID NO: 2002937 - protein, 24 aa, Staphylococcus
ALEYYLKRFDEYGVEHEGIQTLFG

SEQ ID NO: 2002938 - protein, 17 aa, Staphylococcus
ALFELNKNILLKGPTGS

SEQ ID NO: 2002939 - protein, 20 aa, Staphylococcus
ALFESLKAWLDDELVAETWL

SEQ ID NO: 2002940 - protein, 31 aa, Staphylococcus
ALFHYHFKSRISVWLLNYIKASDKMLSQIHF

SEQ ID NO: 2002941 - protein, 17 aa, Staphylococcus
ALFKDIVGMNIVDKNNA

SEQ ID NO: 2002942 - protein, 19 aa, Staphylococcus
ALFKQTLPLGRDMKVGVED

SEQ ID NO: 2002943 - protein, 19 aa, Staphylococcus
ALFPCGSITGAPKLNTMSY

SEQ ID NO: 2002944 - protein, 18 aa, Staphylococcus
ALFPCGSITGAPKLSTMK

SEQ ID NO: 2002945 - protein, 24 aa, Staphylococcus
ALGDVKGGMQFTYISLDDFRIVKD

SEQ ID NO: 2002946 - protein, 23 aa, Staphylococcus
ALGERALRYIIPDTADFPYTIRI

SEQ ID NO: 2002947 - protein, 23 aa, Staphylococcus
ALGERALRYIIPDTKDFPYTVRI

SEQ ID NO: 2002948 - protein, 22 aa, Staphylococcus
ALGERALRYIIPDTTEFPYTIR

SEQ ID NO: 2002949 - protein, 17 aa, Staphylococcus
ALGHPIGASGTRLVTTL

SEQ ID NO: 2002950 - protein, 25 aa, Staphylococcus
ALGIKKRGKKAVAITYTGDGGSSQG

SEQ ID NO: 2002951 - protein, 25 aa, Staphylococcus
ALGIKKRGKQAVAITYTGDGGSSQG

SEQ ID NO: 2002952 - protein, 20 aa, Staphylococcus
ALGIPTVILGIGYENIHTTE

SEQ ID NO: 2002953 - protein, 20 aa, Staphylococcus
ALGIQIGTDIPFCIYNKTAV

SEQ ID NO: 2002954 - protein, 18 aa, Staphylococcus
ALGKKLASEMGIEADIVI

SEQ ID NO: 2002955 - protein, 24 aa, Staphylococcus
ALGREILLDYDFVGKIKEGRESEI

SEQ ID NO: 2002956 - protein, 23 aa, Staphylococcus
ALGREILLDYDFVGKIKNGQEDE

SEQ ID NO: 2002957 - protein, 17 aa, Staphylococcus
ALGRELALDYQFISKIE

SEQ ID NO: 2002958 - protein, 18 aa, Staphylococcus
ALGRTMTATAMMGAMLKG

SEQ ID NO: 2002959 - protein, 24 aa, Staphylococcus
ALGSIPFTGTNGFENAGGMSQDMT

SEQ ID NO: 2002960 - protein, 18 aa, Staphylococcus
ALHLPTDILKAVDVIIEG

SEQ ID NO: 2002961 - protein, 24 aa, Staphylococcus
ALHMVWSDLIFPESEIAFIVLHFG

SEQ ID NO: 2002962 - protein, 31 aa, Staphylococcus
ALHPEWHKFVYALNFVCHYLAKSIAKDGEGA

SEQ ID NO: 2002963 - protein, 20 aa, Staphylococcus
ALHSRCPEAMVIDINDTKML

SEQ ID NO: 2002964 - protein, 17 aa, Staphylococcus
ALHTFNFNTNVPFEHYL

SEQ ID NO: 2002965 - protein, 28 aa, Staphylococcus
ALICTPKNPLCMFCPVQENCEAYDKGTV

SEQ ID NO: 2002966 - protein, 19 aa, Staphylococcus
ALICTPKSPLCLFCPVQDN

SEQ ID NO: 2002967 - protein, 17 aa, Staphylococcus
ALIDFIPNVVNSELKDV

SEQ ID NO: 2002968 - protein, 26 aa, Staphylococcus
ALIDMELEGLLQLINPVIKSYSDEEI

SEQ ID NO: 2002969 - protein, 19 aa, Staphylococcus
ALIESPGIYPFMSGYDNLK

SEQ ID NO: 2002970 - protein, 29 aa, Staphylococcus
ALINKGVAFCPHCDGPLFENKNVAVIGGG

SEQ ID NO: 2002971 - protein, 24 aa, Staphylococcus
ALISESYCSNLFVRILNINFKDYY

SEQ ID NO: 2002972 - protein, 18 aa, Staphylococcus
ALITGIGCSGRLSGYINA

SEQ ID NO: 2002973 - protein, 18 aa, Staphylococcus
ALITGIGCSGRLSGYINS

SEQ ID NO: 2002974 - protein, 18 aa, Staphylococcus
ALKAHPLLNSTWQGDEII

SEQ ID NO: 2002975 - protein, 21 aa, Staphylococcus
ALKDFAEQLGVNYSYDDEALL

SEQ ID NO: 2002976 - protein, 17 aa, Staphylococcus
ALKDMKYIIELFHKPTT

SEQ ID NO: 2002977 - protein, 27 aa, Staphylococcus
ALKDNGVNEFLLWNAGNDYTEGVNYNP

SEQ ID NO: 2002978 - protein, 21 aa, Staphylococcus
ALKDWKYPRRILWLRKVQSTI

SEQ ID NO: 2002979 - protein, 21 aa, Staphylococcus
ALKEKGLLCKETHDTVIRFAP

SEQ ID NO: 2002980 - protein, 19 aa, Staphylococcus
ALKIFSLKGNEPLAQEVAD

SEQ ID NO: 2002981 - protein, 24 aa, Staphylococcus
ALKKCWMLHQMSSFLELREEAIIL

SEQ ID NO: 2002982 - protein, 21 aa, Staphylococcus
ALKNFAEELGVEYSYDDEKLL

SEQ ID NO: 2002983 - protein, 23 aa, Staphylococcus
ALKNRFIVIEVDYIDGDILKIVI

SEQ ID NO: 2002984 - protein, 21 aa, Staphylococcus
ALKNRFIVIQVDYIGGDILKD

SEQ ID NO: 2002985 - protein, 26 aa, Staphylococcus
ALKPMNCPGHMLIYKNHLHSYRDLPI

SEQ ID NO: 2002986 - protein, 19 aa, Staphylococcus
ALKQVPSCEFFPMEAVKTN

SEQ ID NO: 2002987 - protein, 22 aa, Staphylococcus
ALKRGSGVLITGGFKTTQKIID

SEQ ID NO: 2002988 - protein, 20 aa, Staphylococcus
ALKSCMNCFMDTTQPTDANF

SEQ ID NO: 2002989 - protein, 18 aa, Staphylococcus
ALKSLKGLFVATTQLPVE

SEQ ID NO: 2002990 - protein, 28 aa, Staphylococcus
ALKSNPLLNSSWDGNEIIIHKDINISIA

SEQ ID NO: 2002991 - protein, 25 aa, Staphylococcus
ALKVGDRVSIAWMYAACGRCEYCTS

SEQ ID NO: 2002992 - protein, 24 aa, Staphylococcus
ALLAKGRLTGIQFLELFTDDLYFK

SEQ ID NO: 2002993 - protein, 17 aa, Staphylococcus
ALLALEALGYSKREISK

SEQ ID NO: 2002994 - protein, 25 aa, Staphylococcus
ALLDDEIKGVFSFIGGEESMRIVPY

SEQ ID NO: 2002995 - protein, 17 aa, Staphylococcus
ALLDRRLTLRRDKHVDY

SEQ ID NO: 2002996 - protein, 25 aa, Staphylococcus
ALLECFKHELYEFIEHMRGQYSQSK

SEQ ID NO: 2002997 - protein, 19 aa, Staphylococcus
ALLERALMNYMITKHTTQH

SEQ ID NO: 2002998 - protein, 18 aa, Staphylococcus
ALLERALMNYMLTKHTTQ

SEQ ID NO: 2002999 - protein, 17 aa, Staphylococcus
ALLFAASRREHLVGKVI

SEQ ID NO: 2003000 - protein, 22 aa, Staphylococcus
ALLHEHVDFIFGYPGGAVLPLY

SEQ ID NO: 2003001 - protein, 18 aa, Staphylococcus
ALLKEWHNNDVFKPFMHP

SEQ ID NO: 2003002 - protein, 22 aa, Staphylococcus
ALLKVGCITRPFPTGVRITVGF

SEQ ID NO: 2003003 - protein, 18 aa, Staphylococcus
ALLKYLDAPAHLYKKTPT

SEQ ID NO: 2003004 - protein, 29 aa, Staphylococcus
ALLNFVSRGEIDPVIRFYTWDPATLSIGY

SEQ ID NO: 2003005 - protein, 30 aa, Staphylococcus
ALLNFVSRGEIDPVIRFYTWDPATLSIGYF

SEQ ID NO: 2003006 - protein, 28 aa, Staphylococcus
ALLNFVSRGEIDPVVRFYTWNPATLSVG

SEQ ID NO: 2003007 - protein, 30 aa, Staphylococcus
ALLQTWPDFTFPDSEIAFIVLHFGGAIQSQ

SEQ ID NO: 2003008 - protein, 25 aa, Staphylococcus
ALLTERSFEMIISMVAAIKVGASYV

SEQ ID NO: 2003009 - protein, 18 aa, Staphylococcus
ALLTYNFSIHDEMTITAA

SEQ ID NO: 2003010 - protein, 18 aa, Staphylococcus
ALMEYCYGVAGTVGVLLI

SEQ ID NO: 2003011 - protein, 19 aa, Staphylococcus
ALMGKYRISGVPIVKDEES

SEQ ID NO: 2003012 - protein, 19 aa, Staphylococcus
ALMGKYRISGVPIVNNKED

SEQ ID NO: 2003013 - protein, 19 aa, Staphylococcus
ALMGKYRISGVPIVNNLDD

SEQ ID NO: 2003014 - protein, 18 aa, Staphylococcus
ALMNFPVFNKDVVIKQTD

SEQ ID NO: 2003015 - protein, 19 aa, Staphylococcus
ALMQKGYSFEIIKVVMDEM

SEQ ID NO: 2003016 - protein, 23 aa, Staphylococcus
ALMRYGGGISYQLIDDHSQYIAL

SEQ ID NO: 2003017 - protein, 20 aa, Staphylococcus
ALMTKLNISSAHLIGHDMGG

SEQ ID NO: 2003018 - protein, 19 aa, Staphylococcus
ALNHGYSAFYIGSKAGIEK

SEQ ID NO: 2003019 - protein, 21 aa, Staphylococcus
ALNILNEWSNYVAEGIAQIQI

SEQ ID NO: 2003020 - protein, 25 aa, Staphylococcus
ALNKRAQGLFTKFGFSKVGEAKIDY

SEQ ID NO: 2003021 - protein, 24 aa, Staphylococcus
ALNKYKLQVKLERPVPYINELLAL

SEQ ID NO: 2003022 - protein, 20 aa, Staphylococcus
ALNLPYLLEQDIPFLINTDN

SEQ ID NO: 2003023 - protein, 24 aa, Staphylococcus
ALNSAVWSGGSFIYVPKNVKLDTP

SEQ ID NO: 2003024 - protein, 25 aa, Staphylococcus
ALNSAVWSGGSFIYVPKNVKLDTPL

SEQ ID NO: 2003025 - protein, 30 aa, Staphylococcus
ALNSFKQPIIWLCGGLDRGNGFDELIPYMK

SEQ ID NO: 2003026 - protein, 27 aa, Staphylococcus
ALPDKHRWEPKSGITLIGDAAHLMAPS

SEQ ID NO: 2003027 - protein, 18 aa, Staphylococcus
ALPEEPLHSSFIMSKMAL

SEQ ID NO: 2003028 - protein, 24 aa, Staphylococcus
ALPETVGIRLVIKYNQSPNNILTR

SEQ ID NO: 2003029 - protein, 17 aa, Staphylococcus
ALPFLMTAAEKDQNQDT

SEQ ID NO: 2003030 - protein, 21 aa, Staphylococcus
ALPHYELGEVLIAYYESTETL

SEQ ID NO: 2003031 - protein, 22 aa, Staphylococcus
ALPVRPDKDIPYIFKYNDAPAI

SEQ ID NO: 2003032 - protein, 18 aa, Staphylococcus
ALQHLAKAYLEFVNPQVI

SEQ ID NO: 2003033 - protein, 26 aa, Staphylococcus
ALQHTRSSKAFIHFKNINELFQFVFN

SEQ ID NO: 2003034 - protein, 17 aa, Staphylococcus
ALQKMAMMRSYMRAQVT

SEQ ID NO: 2003035 - protein, 24 aa, Staphylococcus
ALQRLLEEWHMATSDLMAFGDANN

SEQ ID NO: 2003036 - protein, 26 aa, Staphylococcus
ALRFGDADLSPGTRIHFVEVPNPEYE

SEQ ID NO: 2003037 - protein, 19 aa, Staphylococcus
ALRFYDFLNTQSFKVGDKE

SEQ ID NO: 2003038 - protein, 20 aa, Staphylococcus
ALRPIEAWARDYVTLEHNDS

SEQ ID NO: 2003039 - protein, 23 aa, Staphylococcus
ALRQGRKKQLMKLIDEALINKNE

SEQ ID NO: 2003040 - protein, 26 aa, Staphylococcus
ALRQSFNIPALKAWQQTKQDAGDDAP

SEQ ID NO: 2003041 - protein, 19 aa, Staphylococcus
ALRSYGLNVKTGEFGTHMN

SEQ ID NO: 2003042 - protein, 22 aa, Staphylococcus
ALRYAKEEHLDFVIIDTAGRLH

SEQ ID NO: 2003043 - protein, 17 aa, Staphylococcus
ALSDLPFSNKTKFETKG

SEQ ID NO: 2003044 - protein, 22 aa, Staphylococcus
ALSEAGYNVGIYKPFQTEEQEP

SEQ ID NO: 2003045 - protein, 27 aa, Staphylococcus
ALSERKFCKSFERYLDKSWKVERPRYY

SEQ ID NO: 2003046 - protein, 17 aa, Staphylococcus
ALSERKTHFPINLLIKL

SEQ ID NO: 2003047 - protein, 24 aa, Staphylococcus
ALSGTITPQGFFAVIEKPNYDVTH

SEQ ID NO: 2003048 - protein, 22 aa, Staphylococcus
ALSKRIQKSFSDDGALLLVSVR

SEQ ID NO: 2003049 - protein, 26 aa, Staphylococcus
ALSKRLKVSDSYLKKIVKALVKENLV

SEQ ID NO: 2003050 - protein, 20 aa, Staphylococcus
ALSQCVQPKLTIANRTMSRF

SEQ ID NO: 2003051 - protein, 20 aa, Staphylococcus
ALSSDELREGFKDVPQAEVS

SEQ ID NO: 2003052 - protein, 21 aa, Staphylococcus
ALTDRNGLRPGRYTITKDNFI

SEQ ID NO: 2003053 - protein, 20 aa, Staphylococcus
ALTDRNGLRPGRYTITKDNY

SEQ ID NO: 2003054 - protein, 21 aa, Staphylococcus
ALTDRNGLRPGRYTITKDNYI

SEQ ID NO: 2003055 - protein, 20 aa, Staphylococcus
ALTDRNGLRPGRYTITNDNH

SEQ ID NO: 2003056 - protein, 33 aa, Staphylococcus
ALTQIKGIGRWTAEVFLLFTLQRKNILPIYDVG

SEQ ID NO: 2003057 - protein, 24 aa, Staphylococcus
ALTRAKEQLFLIGRVKDEKTLSQF

SEQ ID NO: 2003058 - protein, 24 aa, Staphylococcus
ALTRAKEQLFLVGRVKAEKELDKM

SEQ ID NO: 2003059 - protein, 24 aa, Staphylococcus
ALTRAKEQLILIGRLKSTKKLEEY

SEQ ID NO: 2003060 - protein, 24 aa, Staphylococcus
ALTRAKEQLILIGRVKDEKELGKL

SEQ ID NO: 2003061 - protein, 24 aa, Staphylococcus
ALTRAKEQLILIGRVKKEQELTEL

SEQ ID NO: 2003062 - protein, 23 aa, Staphylococcus
ALTRAKEQLILIGTIDKEEALEK

SEQ ID NO: 2003063 - protein, 23 aa, Staphylococcus
ALTRAKEQLILIGTVDKEEKLRK

SEQ ID NO: 2003064 - protein, 27 aa, Staphylococcus
ALVDRSVLRLLKLIDRYTLEGEMPNYN

SEQ ID NO: 2003065 - protein, 25 aa, Staphylococcus
ALVKALEAWDIDHLYGIPGDSIDAV

SEQ ID NO: 2003066 - protein, 28 aa, Staphylococcus
ALVKALQAWDIDHIYGIPGDSIDAVVDS

SEQ ID NO: 2003067 - protein, 28 aa, Staphylococcus
ALVKALQAWDIDHLWGIPGDSVDAVVDN

SEQ ID NO: 2003068 - protein, 25 aa, Staphylococcus
ALVPMPRAQFLTAIKDATACFITLS

SEQ ID NO: 2003069 - protein, 19 aa, Staphylococcus
ALVPNRFQIIKIKKEFMER

SEQ ID NO: 2003070 - protein, 25 aa, Staphylococcus
ALVRALQAWDIDHLYGIPGDSIDAV

SEQ ID NO: 2003071 - protein, 20 aa, Staphylococcus
ALVYYREVVKHHQLNVHAFE

SEQ ID NO: 2003072 - protein, 24 aa, Staphylococcus
ALWLHLKLDTGMGRLGMKDVEEYK

SEQ ID NO: 2003073 - protein, 32 aa, Staphylococcus
ALYDIVNYWIKFGVDGFRFDVINLISKGEFKD

SEQ ID NO: 2003074 - protein, 20 aa, Staphylococcus
ALYKDFFKAKSGQIPEITMK

SEQ ID NO: 2003075 - protein, 22 aa, Staphylococcus
ALYKEREMSVGYQFGEDTAEQQ

SEQ ID NO: 2003076 - protein, 24 aa, Staphylococcus
ALYLRVDPYLAYQYRNHDGEVLAN

SEQ ID NO: 2003077 - protein, 17 aa, Staphylococcus
ALYNLGLATYMQTEDTA

SEQ ID NO: 2003078 - protein, 26 aa, Staphylococcus
ALYPQAMSLKAFKALTLFDDAQLNQM

SEQ ID NO: 2003079 - protein, 24 aa, Staphylococcus
ALYQEARYGGAIFDLYQDTEGQLY

SEQ ID NO: 2003080 - protein, 17 aa, Staphylococcus
AMAIAALKLKLSPNEVW

SEQ ID NO: 2003081 - protein, 18 aa, Staphylococcus
AMAMHIYQSFGLKHLKLV

SEQ ID NO: 2003082 - protein, 23 aa, Staphylococcus
AMAPCPYVYEVIAKWGLEDSNLN

SEQ ID NO: 2003083 - protein, 20 aa, Staphylococcus
AMEALIRFTKDEGIIPAIES

SEQ ID NO: 2003084 - protein, 19 aa, Staphylococcus
AMEALVRFTKAEGIIPAIE

SEQ ID NO: 2003085 - protein, 20 aa, Staphylococcus
AMEALVRFTKIEGIIPAIES

SEQ ID NO: 2003086 - protein, 18 aa, Staphylococcus
AMEDFDFYHYFGDIEKEA

SEQ ID NO: 2003087 - protein, 19 aa, Staphylococcus
AMFPCGSITGAPKQSTMTY

SEQ ID NO: 2003088 - protein, 17 aa, Staphylococcus
AMFSHEFIKKIKTMNQT

SEQ ID NO: 2003089 - protein, 17 aa, Staphylococcus
AMGAAVNGMAAHGGLHP

SEQ ID NO: 2003090 - protein, 25 aa, Staphylococcus
AMHIIPYPPGIPVYLKGERITKNMI

SEQ ID NO: 2003091 - protein, 18 aa, Staphylococcus
AMIADPAIDIGMLLYNYV

SEQ ID NO: 2003092 - protein, 24 aa, Staphylococcus
AMIADPAIDIGMLLYNYVPEKNWS

SEQ ID NO: 2003093 - protein, 24 aa, Staphylococcus
AMIADPAIDIGMLLYNYVPENKWS

SEQ ID NO: 2003094 - protein, 24 aa, Staphylococcus
AMIADPAIDIGMLLYNYVPQSKWS

SEQ ID NO: 2003095 - protein, 18 aa, Staphylococcus
AMIADPAIDLGMLLYNYV

SEQ ID NO: 2003096 - protein, 22 aa, Staphylococcus
AMIETAKLVLHWLSENEIKVEL

SEQ ID NO: 2003097 - protein, 33 aa, Staphylococcus
AMIQFKLEMPIIKRRPSFEMDDRLVLEKINYDT

SEQ ID NO: 2003098 - protein, 33 aa, Staphylococcus
AMIQFKLEMPIIKRRPSFEMEERLVLEKIDFDN

SEQ ID NO: 2003099 - protein, 33 aa, Staphylococcus; identical to SEQ ID NO: 1794328

SEQ ID NO: 2003100 - protein, 25 aa, Staphylococcus
AMIQFKLEMPIIKRRPTFEMEDRLV

SEQ ID NO: 2003101 - protein, 19 aa, Staphylococcus
AMKSWETKTPFRELIEQDS

SEQ ID NO: 2003102 - protein, 18 aa, Staphylococcus
AMLADPAIDIGMLLYNYV

SEQ ID NO: 2003103 - protein, 20 aa, Staphylococcus
AMLFRGVHYEITCIDQEGYE

SEQ ID NO: 2003104 - protein, 25 aa, Staphylococcus
AMLYDFSFKRLNNITDFSQVSFSTM

SEQ ID NO: 2003105 - protein, 29 aa, Staphylococcus
AMLYKEGFHICKGELFGKHRQGEDCLLCL

SEQ ID NO: 2003106 - protein, 25 aa, Staphylococcus
AMMFRDEATWFALMDHLVDMSITYA

SEQ ID NO: 2003107 - protein, 23 aa, Staphylococcus
AMMKKRKGLIIVGDMQHQDVDQI

SEQ ID NO: 2003108 - protein, 19 aa, Staphylococcus
AMMREVRLALLEADVNFKV

SEQ ID NO: 2003109 - protein, 30 aa, Staphylococcus
AMMYRDEATWFALMDHLVAISIDYVNAQIE

SEQ ID NO: 2003110 - protein, 24 aa, Staphylococcus
AMNISQNEVLTWVLGYHQSIEELC

SEQ ID NO: 2003111 - protein, 22 aa, Staphylococcus
AMPEVKAIAKLVTDTNEHSGVG

SEQ ID NO: 2003112 - protein, 20 aa, Staphylococcus
AMPSVRKYAREKGVNIKAVA

SEQ ID NO: 2003113 - protein, 20 aa, Staphylococcus
AMPSVRKYARENGVNIKAVS

SEQ ID NO: 2003114 - protein, 27 aa, Staphylococcus
AMQEGELCFGNEPLLRVEAPLIQAQLI

SEQ ID NO: 2003115 - protein, 17 aa, Staphylococcus
AMQPLRELEVIEATYDD

SEQ ID NO: 2003116 - protein, 24 aa, Staphylococcus
AMRMLEKFPDLIVGAAIHEPLNAT

SEQ ID NO: 2003117 - protein, 24 aa, Staphylococcus
AMSDTVPGVFAFIGSESEYDLHHP

SEQ ID NO: 2003118 - protein, 17 aa, Staphylococcus
AMSHPNVRFTLTSDDKV

SEQ ID NO: 2003119 - protein, 24 aa, Staphylococcus
AMSHVHQCLIREGLRMETSLVAKS

SEQ ID NO: 2003120 - protein, 19 aa, Staphylococcus
AMSPKDLKLIESIPNMMDL

SEQ ID NO: 2003121 - protein, 19 aa, Staphylococcus
AMSPKDLKLIESIPQMMEL

SEQ ID NO: 2003122 - protein, 18 aa, Staphylococcus
AMTDCLNYGSPEKKDIYQ

SEQ ID NO: 2003123 - protein, 20 aa, Staphylococcus
AMTNAICDRCEGYSNEFELQ

SEQ ID NO: 2003124 - protein, 21 aa, Staphylococcus
AMTNAICNRCEGYSNEFALQS

SEQ ID NO: 2003125 - protein, 17 aa, Staphylococcus
AMYFKNPERILGSFFIK

SEQ ID NO: 2003126 - protein, 24 aa, Staphylococcus
AMYHYRRCNKLGALKSFKKALYTF

SEQ ID NO: 2003127 - protein, 18 aa, Staphylococcus
AMYPEMADSITLVNPTLL

SEQ ID NO: 2003128 - protein, 17 aa, Staphylococcus
ANAFGYALLAEKFPQVK

SEQ ID NO: 2003129 - protein, 17 aa, Staphylococcus
ANAGHDWIFDKMKQLGY

SEQ ID NO: 2003130 - protein, 17 aa, Staphylococcus
ANAKLQLMSDFSSRLYG

SEQ ID NO: 2003131 - protein, 18 aa, Staphylococcus
ANALKLKQFFNSSVPVFK

SEQ ID NO: 2003132 - protein, 19 aa, Staphylococcus
ANALKRLYGNVQFGVGPVI

SEQ ID NO: 2003133 - protein, 22 aa, Staphylococcus
ANASPYGLAAYFFSNNVNTVYQ

SEQ ID NO: 2003134 - protein, 27 aa, Staphylococcus
ANCAHMMIWEGIELLPVTTPSKKLIGV

SEQ ID NO: 2003135 - protein, 23 aa, Staphylococcus
ANCHPPKSLSKVMAIIRDLKTKQ

SEQ ID NO: 2003136 - protein, 18 aa, Staphylococcus
ANDIGVKYLTLYAFSTEN

SEQ ID NO: 2003137 - protein, 19 aa, Staphylococcus
ANDLLQMMIHTMSDRLNKH

SEQ ID NO: 2003138 - protein, 19 aa, Staphylococcus
ANDLLQMMINTMENRLNEH

SEQ ID NO: 2003139 - protein, 19 aa, Staphylococcus
ANDSIMILVIIYNSGHVEH

SEQ ID NO: 2003140 - protein, 23 aa, Staphylococcus
ANDTFCRPQEAIEYIGKITNGEA

SEQ ID NO: 2003141 - protein, 19 aa, Staphylococcus
ANEIWENLDNLLLQHYPQV

SEQ ID NO: 2003142 - protein, 29 aa, Staphylococcus
ANEIYKPYIEGFVKMLAPIAPHIGEELWS

SEQ ID NO: 2003143 - protein, 19 aa, Staphylococcus
ANEKGIWQVLPVKKDWDHM

SEQ ID NO: 2003144 - protein, 25 aa, Staphylococcus
ANELEIGESIALYGEDNHLYGVLEL

SEQ ID NO: 2003145 - protein, 18 aa, Staphylococcus
ANEMSAFIRKTVAELSNQ

SEQ ID NO: 2003146 - protein, 21 aa, Staphylococcus
ANEPPTFVVFVNDVELMHFSY

SEQ ID NO: 2003147 - protein, 18 aa, Staphylococcus
ANEVNELGFELDLGKVQR

SEQ ID NO: 2003148 - protein, 24 aa, Staphylococcus
ANEWKNYFHPFKASNRFTIVPSWE

SEQ ID NO: 2003149 - protein, 21 aa, Staphylococcus
ANEYGLKWYTYHNQYHSFIMV

SEQ ID NO: 2003150 - protein, 17 aa, Staphylococcus
ANFEKLKVFGLEHKVKE

SEQ ID NO: 2003151 - protein, 22 aa, Staphylococcus
ANFEKLRRFGLEHKVKDIHKAA

SEQ ID NO: 2003152 - protein, 17 aa, Staphylococcus
ANFRIAVQRPFKNKQTD

SEQ ID NO: 2003153 - protein, 18 aa, Staphylococcus
ANFSECIILLTSNIGTSD

SEQ ID NO: 2003154 - protein, 19 aa, Staphylococcus
ANFYPLTFDNFFKVNEEYD

SEQ ID NO: 2003155 - protein, 18 aa, Staphylococcus
ANGAVLVRYGDTVVLSTA

SEQ ID NO: 2003156 - protein, 24 aa, Staphylococcus
ANGDYSTNIAMVLTKIAKRNPREI

SEQ ID NO: 2003157 - protein, 19 aa, Staphylococcus
ANGELLQFNSEAEIYEHFG

SEQ ID NO: 2003158 - protein, 18 aa, Staphylococcus
ANGFCIYNDVAITAQYLV

SEQ ID NO: 2003159 - protein, 19 aa, Staphylococcus
ANGGIAGFVTSAAVELKHG

SEQ ID NO: 2003160 - protein, 21 aa, Staphylococcus
ANGKADISFEEFLGEAAKSSS

SEQ ID NO: 2003161 - protein, 21 aa, Staphylococcus
ANGKRTSICSVGMVKVIDNQI

SEQ ID NO: 2003162 - protein, 34 aa, Staphylococcus
ANGLIPYEINEIFRAGGPPGKIFKRSTVIDNQIK

SEQ ID NO: 2003163 - protein, 20 aa, Staphylococcus
ANHDKLNLVHFVSGKIKQHH

SEQ ID NO: 2003164 - protein, 17 aa, Staphylococcus
ANHQPVVYCLDKIAKDY

SEQ ID NO: 2003165 - protein, 17 aa, Staphylococcus
ANIAKGYEFMVITDHSQ

SEQ ID NO: 2003166 - protein, 20 aa, Staphylococcus
ANIEPKRIVFIYSKHGKSAV

SEQ ID NO: 2003167 - protein, 17 aa, Staphylococcus
ANILIAAGYHVTREYYI

SEQ ID NO: 2003168 - protein, 19 aa, Staphylococcus
ANILQIRRFMSLLETDLYF

SEQ ID NO: 2003169 - protein, 17 aa, Staphylococcus
ANILRYVFQEYEKGISF

SEQ ID NO: 2003170 - protein, 19 aa, Staphylococcus
ANIPYTMVGGHKFYDRKEI

SEQ ID NO: 2003171 - protein, 20 aa, Staphylococcus
ANIRKGYNIHERLLSKESSV

SEQ ID NO: 2003172 - protein, 21 aa, Staphylococcus
ANITSEWPDNVSVFSNKVETY

SEQ ID NO: 2003173 - protein, 21 aa, Staphylococcus
ANKALKFEREKAYGKHLDIPA

SEQ ID NO: 2003174 - protein, 17 aa, Staphylococcus
ANKAVSTAFGYKKMIVK

SEQ ID NO: 2003175 - protein, 30 aa, Staphylococcus
ANKFKDFGTRVVLGRFGLILSDTGGALQTM

SEQ ID NO: 2003176 - protein, 24 aa, Staphylococcus
ANKGKIALFAGIDKCRFKKQVTPG

SEQ ID NO: 2003177 - protein, 20 aa, Staphylococcus
ANKGLKFDREKAYGKHLDIP

SEQ ID NO: 2003178 - protein, 27 aa, Staphylococcus
ANKIASCVKGKFSWGHINSDQRITKPL

SEQ ID NO: 2003179 - protein, 27 aa, Staphylococcus
ANKIASCVKGKFSWGHINSDQRLTKPL

SEQ ID NO: 2003180 - protein, 27 aa, Staphylococcus
ANKIATCVKGKFSWGHINSDQRLTKPL

SEQ ID NO: 2003181 - protein, 17 aa, Staphylococcus
ANKIGINEKAVYNALHR

SEQ ID NO: 2003182 - protein, 18 aa, Staphylococcus
ANKKLLPNSKVLLLTDGD

SEQ ID NO: 2003183 - protein, 26 aa, Staphylococcus
ANKKPSLRWDNYYGLTHFIVPPVAKE

SEQ ID NO: 2003184 - protein, 20 aa, Staphylococcus
ANKKSGPWLKETLREVEYAI

SEQ ID NO: 2003185 - protein, 27 aa, Staphylococcus
ANKLKRIGHYIGMSFQIVDDVLDFTST

SEQ ID NO: 2003186 - protein, 23 aa, Staphylococcus
ANKLRLLKLAPKVINRLREGKIT

SEQ ID NO: 2003187 - protein, 18 aa, Staphylococcus
ANKMKKGFLEKGYQLYFD

SEQ ID NO: 2003188 - protein, 19 aa, Staphylococcus
ANKRGIPFDRLQQEMYDIA

SEQ ID NO: 2003189 - protein, 32 aa, Staphylococcus
ANKRIEFYRLYLLMVHLVKFGNMYAGSVNRSM

SEQ ID NO: 2003190 - protein, 27 aa, Staphylococcus
ANKTFLHRFYFETFKIPNIINNIKPDL

SEQ ID NO: 2003191 - protein, 23 aa, Staphylococcus
ANKYLKMKWPFVVITISVEIIYN

SEQ ID NO: 2003192 - protein, 18 aa, Staphylococcus
ANLAGVLHDYCKYDDLST

SEQ ID NO: 2003193 - protein, 22 aa, Staphylococcus
ANLEGLWYARNIKSLPLAMKEC

SEQ ID NO: 2003194 - protein, 19 aa, Staphylococcus
ANLGGAIIMAARACVYSGS

SEQ ID NO: 2003195 - protein, 23 aa, Staphylococcus
ANLGHRFNINVGILGDSKVAFHQ

SEQ ID NO: 2003196 - protein, 18 aa, Staphylococcus
ANLKRVLKEMEDMGFTDF

SEQ ID NO: 2003197 - protein, 20 aa, Staphylococcus
ANMGGAIMLAARACVYSGSG

SEQ ID NO: 2003198 - protein, 29 aa, Staphylococcus
ANMLDLKLNIEVRGLIKLSNLVEENVYRM

SEQ ID NO: 2003199 - protein, 25 aa, Staphylococcus
ANMPIKDVDRLGSTVVALGNSTATT

SEQ ID NO: 2003200 - protein, 23 aa, Staphylococcus
ANNDIKVAVVMHMCDTSRNDAQL

SEQ ID NO: 2003201 - protein, 19 aa, Staphylococcus
ANNEINVPIFLKLTSDMDE

SEQ ID NO: 2003202 - protein, 18 aa, Staphylococcus
ANNLKIIANYGAGFNNVD

SEQ ID NO: 2003203 - protein, 18 aa, Staphylococcus
ANNLKIITNYGAGFNNVD

SEQ ID NO: 2003204 - protein, 25 aa, Staphylococcus
ANNLPNILQHQLWQLVSEREQEQTK

SEQ ID NO: 2003205 - protein, 25 aa, Staphylococcus
ANNNIKWQLGHLILLNDFLVFETIN

SEQ ID NO: 2003206 - protein, 23 aa, Staphylococcus
ANNVKKAIIAWGDDEHLRKLNVD

SEQ ID NO: 2003207 - protein, 25 aa, Staphylococcus
ANNYNIPLYLGRTLSNVKGTWIMPQ

SEQ ID NO: 2003208 - protein, 25 aa, Staphylococcus
ANNYNIPLYLGRTLSNVKGTWIMSQ

SEQ ID NO: 2003209 - protein, 29 aa, Staphylococcus
ANPDKKGLRLALDWSNRVNQLIQRLPSIG

SEQ ID NO: 2003210 - protein, 23 aa, Staphylococcus
ANPEEREAFDLAIQQAHDLEANL

SEQ ID NO: 2003211 - protein, 23 aa, Staphylococcus
ANPFPKDWRMHAFFMDALPILNE

SEQ ID NO: 2003212 - protein, 19 aa, Staphylococcus
ANPNLPFGGVGMSGIGQYH

SEQ ID NO: 2003213 - protein, 26 aa, Staphylococcus
ANQFQPRLICDFATLTGAAIAALGED

SEQ ID NO: 2003214 - protein, 20 aa, Staphylococcus
ANQLANWGVDGIFTDNADKM

SEQ ID NO: 2003215 - protein, 19 aa, Staphylococcus
ANQNWLDYYGHSVNSEWMI

SEQ ID NO: 2003216 - protein, 24 aa, Staphylococcus
ANQRYIVTWALGHLVTNAQPEHYD

SEQ ID NO: 2003217 - protein, 19 aa, Staphylococcus
ANRIELCDNLSVGGTTPSF

SEQ ID NO: 2003218 - protein, 17 aa, Staphylococcus
ANRIGVWIGSGIGGMET

SEQ ID NO: 2003219 - protein, 23 aa, Staphylococcus
ANRKVKFPFSFTYKNRTYDFSSK

SEQ ID NO: 2003220 - protein, 17 aa, Staphylococcus
ANRTMKRFESWDLDVNQ

SEQ ID NO: 2003221 - protein, 21 aa, Staphylococcus
ANRYGLNHMMEYYHLDFHGHH

SEQ ID NO: 2003222 - protein, 17 aa, Staphylococcus
ANSEKQALVSFREIYEM

SEQ ID NO: 2003223 - protein, 23 aa, Staphylococcus
ANSLQHRLEKMIGVDEVIVELND

SEQ ID NO: 2003224 - protein, 18 aa, Staphylococcus
ANTALAFVSLKADGQRDF

SEQ ID NO: 2003225 - protein, 18 aa, Staphylococcus
ANTALAFVSLTKEGERDF

SEQ ID NO: 2003226 - protein, 26 aa, Staphylococcus
ANTDLSPVCKIEIYSFFDPFSKDCFK

SEQ ID NO: 2003227 - protein, 18 aa, Staphylococcus
ANTEIKVNSAIERLLKEN

SEQ ID NO: 2003228 - protein, 19 aa, Staphylococcus
ANTEVNVPIFLKLTSDLEL

SEQ ID NO: 2003229 - protein, 20 aa, Staphylococcus
ANTGLKFDREKAYGKHLDIP

SEQ ID NO: 2003230 - protein, 25 aa, Staphylococcus
ANTKVKEALTWVNLPSEEILTRYSF

SEQ ID NO: 2003231 - protein, 21 aa, Staphylococcus
ANVEEVYKTLVLENANHDHYV

SEQ ID NO: 2003232 - protein, 20 aa, Staphylococcus
ANVIPKEFQALYDAKQNGKE

SEQ ID NO: 2003233 - protein, 17 aa, Staphylococcus
ANVKFAAPGEWVDESLD

SEQ ID NO: 2003234 - protein, 17 aa, Staphylococcus
ANVKGYFIWSLMDVFSW

SEQ ID NO: 2003235 - protein, 17 aa, Staphylococcus
ANVKRCLITHLSNRYNH

SEQ ID NO: 2003236 - protein, 18 aa, Staphylococcus
ANVLKRLVTDIKQKHNDS

SEQ ID NO: 2003237 - protein, 26 aa, Staphylococcus
ANVSRAMHLLPFNVFFVPARGGLGEN

SEQ ID NO: 2003238 - protein, 27 aa, Staphylococcus
ANVSRAMHLLPFNVFFVPARGGLGENV

SEQ ID NO: 2003239 - protein, 17 aa, Staphylococcus
ANVTQVWVNSHELTQAG

SEQ ID NO: 2003240 - protein, 17 aa, Staphylococcus
ANYAGVRAFTASAGPGL

SEQ ID NO: 2003241 - protein, 18 aa, Staphylococcus
ANYCDIFYIGGTKIGALC

SEQ ID NO: 2003242 - protein, 18 aa, Staphylococcus
ANYIKARLKDAFEIPYSQ

SEQ ID NO: 2003243 - protein, 17 aa, Staphylococcus
ANYKQVYFFGVTEEDKA

SEQ ID NO: 2003244 - protein, 23 aa, Staphylococcus
ANYMAHFYKQYGIKKDRIQRDFY

SEQ ID NO: 2003245 - protein, 18 aa, Staphylococcus
ANYREGFKTVEHLKETDK

SEQ ID NO: 2003246 - protein, 19 aa, Staphylococcus
ANYVELRLSVDTADEEGQK

SEQ ID NO: 2003247 - protein, 17 aa, Staphylococcus
ANYYFGVMQSFLNDLRQ

SEQ ID NO: 2003248 - protein, 19 aa, Staphylococcus
ANYYLKNMLMILANNRHLA

SEQ ID NO: 2003249 - protein, 19 aa, Staphylococcus
ANYYLKNMLMILANNRHLV

SEQ ID NO: 2003250 - protein, 24 aa, Staphylococcus
APAARATVVMAVFQMYQTLPIINV

SEQ ID NO: 2003251 - protein, 24 aa, Staphylococcus
APAEAYNPLFIYGGVGLGKTHLMH

SEQ ID NO: 2003252 - protein, 28 aa, Staphylococcus
APAILNWMAEGAYMWMQEGLAMPEKLKE

SEQ ID NO: 2003253 - protein, 24 aa, Staphylococcus
APAKAYNPLFIYGGVGLGKTHLMH

SEQ ID NO: 2003254 - protein, 25 aa, Staphylococcus
APAKAYNPLFIYGGVGLGKTHLMHA

SEQ ID NO: 2003255 - protein, 23 aa, Staphylococcus
APAKGDVKTIVFNTNHKDLDGSE

SEQ ID NO: 2003256 - protein, 23 aa, Staphylococcus
APAKGDVKTIVFNTNHNDLDGSE

SEQ ID NO: 2003257 - protein, 21 aa, Staphylococcus
APCSGLGVLRHKPEIKYTQSK

SEQ ID NO: 2003258 - protein, 21 aa, Staphylococcus
APCSGLGVLRHKPEIKYVQTQ

SEQ ID NO: 2003259 - protein, 17 aa, Staphylococcus
APCSNWSSPSRPAAGTE

SEQ ID NO: 2003260 - protein, 18 aa, Staphylococcus
APDFPIVIEENFTFYNVD

SEQ ID NO: 2003261 - protein, 18 aa, Staphylococcus
APDGMVLYLHQGVSLSMI

SEQ ID NO: 2003262 - protein, 21 aa, Staphylococcus
APDHLKSLITHFVENKHVEEP

SEQ ID NO: 2003263 - protein, 20 aa, Staphylococcus
APDLIKSASYPNVLPSSTNP

SEQ ID NO: 2003264 - protein, 20 aa, Staphylococcus
APEFPIIIEENFSFYNVDLD

SEQ ID NO: 2003265 - protein, 18 aa, Staphylococcus
APEFPIIIEENFTFYNVD

SEQ ID NO: 2003266 - protein, 19 aa, Staphylococcus
APEGKKYAPAFDVDMNQPG

SEQ ID NO: 2003267 - protein, 19 aa, Staphylococcus
APEHWLCIKEDDLVWATAA

SEQ ID NO: 2003268 - protein, 21 aa, Staphylococcus
APEIKYLKAFIENKLKSLIEE

SEQ ID NO: 2003269 - protein, 19 aa, Staphylococcus
APEILCEKCREGWKQCLLF

SEQ ID NO: 2003270 - protein, 24 aa, Staphylococcus
APERLIEMRRFILFDTQDKRIAAL

SEQ ID NO: 2003271 - protein, 21 aa, Staphylococcus
APESIRMKVSYLMQQSEMIGT

SEQ ID NO: 2003272 - protein, 18 aa, Staphylococcus
APFANYWMHNGFINIDNE

SEQ ID NO: 2003273 - protein, 19 aa, Staphylococcus
APFDTFGGFKSYRLLRPLE

SEQ ID NO: 2003274 - protein, 17 aa, Staphylococcus
APFGATIPYYFTGHEGP

SEQ ID NO: 2003275 - protein, 23 aa, Staphylococcus
APFGATIPYYFTGHEGPDSVCID

SEQ ID NO: 2003276 - protein, 26 aa, Staphylococcus
APFPRISYDDAIKFLKEEGFNDIEWG

SEQ ID NO: 2003277 - protein, 26 aa, Staphylococcus
APFPRITYDDAVKFLKEEGFDDIEWG

SEQ ID NO: 2003278 - protein, 23 aa, Staphylococcus
APGDFEKRVTFGLTGSDANDGII

SEQ ID NO: 2003279 - protein, 31 aa, Staphylococcus
APGIEIPDARYKDWFPNFTLGDLISDNTATG

SEQ ID NO: 2003280 - protein, 24 aa, Staphylococcus
APGIVSGRMSDIWSEDDLAEILQN

SEQ ID NO: 2003281 - protein, 21 aa, Staphylococcus
APGKYNFYLGGSFKGDRLNKL

SEQ ID NO: 2003282 - protein, 25 aa, Staphylococcus
APGYRVKESPVHFECEYVQTIRIPT

SEQ ID NO: 2003283 - protein, 23 aa, Staphylococcus
APHATIFLMNAVYEFDTVREYEI

SEQ ID NO: 2003284 - protein, 17 aa, Staphylococcus
APHILGMLTPFYEGQYV

SEQ ID NO: 2003285 - protein, 19 aa, Staphylococcus
APHMKGLAIQRVHAHHHDA

SEQ ID NO: 2003286 - protein, 21 aa, Staphylococcus
APIAASALFDLSRGFKGEVTM

SEQ ID NO: 2003287 - protein, 17 aa, Staphylococcus
APIAPHIGEELWSKLGH

SEQ ID NO: 2003288 - protein, 17 aa, Staphylococcus
APIFGLNKRQGRQLLVF

SEQ ID NO: 2003289 - protein, 19 aa, Staphylococcus
APIHEWEKEGLLTIVDEPS

SEQ ID NO: 2003290 - protein, 23 aa, Staphylococcus
APILGTKMLEEWFEKYKSQHKGS

SEQ ID NO: 2003291 - protein, 17 aa, Staphylococcus
APIRRGPNIKLPSLDLL

SEQ ID NO: 2003292 - protein, 22 aa, Staphylococcus
APKEIFKQLNINNSDLYELSSL

SEQ ID NO: 2003293 - protein, 20 aa, Staphylococcus
APKGAHIENVKWTSMVNHYQ

SEQ ID NO: 2003294 - protein, 18 aa, Staphylococcus
APKKLVVVGGGYIGSELG

SEQ ID NO: 2003295 - protein, 19 aa, Staphylococcus
APKLEWHVENLRNYAFLSP

SEQ ID NO: 2003296 - protein, 19 aa, Staphylococcus
APLDYKTITARSILSKVLV

SEQ ID NO: 2003297 - protein, 24 aa, Staphylococcus
APLFYEMTDQYGFYVMSEADLETH

SEQ ID NO: 2003298 - protein, 23 aa, Staphylococcus
APLKDEVIKYLGIFQTSSPSYLV

SEQ ID NO: 2003299 - protein, 17 aa, Staphylococcus
APLKFDDQLPCQFCNFQ

SEQ ID NO: 2003300 - protein, 30 aa, Staphylococcus
APLKFEDKLPCEFCSFQSVCHVDSLIDSKH

SEQ ID NO: 2003301 - protein, 17 aa, Staphylococcus
APLKFFDQTIETINQLK

SEQ ID NO: 2003302 - protein, 24 aa, Staphylococcus
APLKRGAATIAMLGKAPILPAAYV

SEQ ID NO: 2003303 - protein, 18 aa, Staphylococcus
APLKRGASTIALLSKSPI

SEQ ID NO: 2003304 - protein, 18 aa, Staphylococcus
APLLAPMSAIAGRRSMLM

SEQ ID NO: 2003305 - protein, 17 aa, Staphylococcus
APLLFKLVDSNREYLSE

SEQ ID NO: 2003306 - protein, 21 aa, Staphylococcus
APLRRQAIVLIGMIEEKEILP

SEQ ID NO: 2003307 - protein, 24 aa, Staphylococcus
APMDYGSGVKFAIFDDTCGNLVQI

SEQ ID NO: 2003308 - protein, 19 aa, Staphylococcus
APNKPVIREKMSRRKKTAA

SEQ ID NO: 2003309 - protein, 25 aa, Staphylococcus
APNKRGYKMLPHFQIGLFRDQLFIM

SEQ ID NO: 2003310 - protein, 21 aa, Staphylococcus
APNLEGARFSVLALGDQSYEF

SEQ ID NO: 2003311 - protein, 18 aa, Staphylococcus
APNLFKYDVEDIAYACLD

SEQ ID NO: 2003312 - protein, 18 aa, Staphylococcus
APPFKVAEVDIMYGQGIS

SEQ ID NO: 2003313 - protein, 23 aa, Staphylococcus
APPGKRMGHAGAIISGGKGTADE

SEQ ID NO: 2003314 - protein, 26 aa, Staphylococcus
APQARKLKEGFFFAALTPTLRHLGKL

SEQ ID NO: 2003315 - protein, 18 aa, Staphylococcus
APQFPIVIEENFTFYNVD

SEQ ID NO: 2003316 - protein, 22 aa, Staphylococcus
APQYIKDKIGFVYSDIYANPDW

SEQ ID NO: 2003317 - protein, 21 aa, Staphylococcus
APREIKVTFNGDVAKQETDLI

SEQ ID NO: 2003318 - protein, 23 aa, Staphylococcus
APRWKCILNVIKRYFKLLKNEDT

SEQ ID NO: 2003319 - protein, 17 aa, Staphylococcus
APSIRQFSSRISGIKDC

SEQ ID NO: 2003320 - protein, 19 aa, Staphylococcus
APSKFEAWFLTTEHTEEDI

SEQ ID NO: 2003321 - protein, 27 aa, Staphylococcus
APSNLAIMGRYVLSPQIFNYLENQGIG

SEQ ID NO: 2003322 - protein, 18 aa, Staphylococcus
APSNLAIMGRYVLTANIF

SEQ ID NO: 2003323 - protein, 18 aa, Staphylococcus
APSNLAIMGRYVLTPEIF

SEQ ID NO: 2003324 - protein, 22 aa, Staphylococcus
APSPIWMQMRLIKAGIRPINNV

SEQ ID NO: 2003325 - protein, 19 aa, Staphylococcus
APSQYPECNLIEFNNQKLN

SEQ ID NO: 2003326 - protein, 17 aa, Staphylococcus
APTNIIPGLDFSPDKML

SEQ ID NO: 2003327 - protein, 24 aa, Staphylococcus
APVIWRGPMLGKMLTNFFTDVKWG

SEQ ID NO: 2003328 - protein, 24 aa, Staphylococcus
APVIWRGPMLGKMLTNFFTEVQWG

SEQ ID NO: 2003329 - protein, 36 aa, Staphylococcus
APVIWRGPMLGKMLTNFFVEVRWGDLDYLILDLPPG

SEQ ID NO: 2003330 - protein, 19 aa, Staphylococcus
APVNFGANLGVIIDLYDQY

SEQ ID NO: 2003331 - protein, 18 aa, Staphylococcus
APVNFGANLGYVLDLYDI

SEQ ID NO: 2003332 - protein, 20 aa, Staphylococcus
APWLERLGFENVKEVLLDPE

SEQ ID NO: 2003333 - protein, 21 aa, Staphylococcus
APWLERMGFENVKEYVLDPER

SEQ ID NO: 2003334 - protein, 24 aa, Staphylococcus
APWNFKRTKFPQVNHEWKSDDDKP

SEQ ID NO: 2003335 - protein, 17 aa, Staphylococcus
APYEWIIEYKDEFIGQV

SEQ ID NO: 2003336 - protein, 25 aa, Staphylococcus
APYLFKEHLHGFFLEYDDERSGDFE

SEQ ID NO: 2003337 - protein, 25 aa, Staphylococcus
APYLFKENLNGFFLEYDDERSGDFE

SEQ ID NO: 2003338 - protein, 18 aa, Staphylococcus
APYWDKGVRSVRVYWEGP

SEQ ID NO: 2003339 - protein, 24 aa, Staphylococcus
AQAATIFEFLKYSPGRYAQEINNP

SEQ ID NO: 2003340 - protein, 25 aa, Staphylococcus
AQADEVYRELPFVVNQARVDEIPDL

SEQ ID NO: 2003341 - protein, 22 aa, Staphylococcus
AQADVWLKDNPLEFEWGGTSMI

SEQ ID NO: 2003342 - protein, 21 aa, Staphylococcus
AQAGDRFYLRLNDNKSSFFGY

SEQ ID NO: 2003343 - protein, 20 aa, Staphylococcus
AQAHKLCPNGYYVTPRFEAY

SEQ ID NO: 2003344 - protein, 24 aa, Staphylococcus
AQAILDMRLRRLTGLERDKIEAEY

SEQ ID NO: 2003345 - protein, 24 aa, Staphylococcus
AQAILDMRLRRLTGLERDKIESEY

SEQ ID NO: 2003346 - protein, 19 aa, Staphylococcus
AQALCSIGTSGVVLTCSQE

SEQ ID NO: 2003347 - protein, 27 aa, Staphylococcus
AQALIDLALPLYVKYGIALEAHLQNSI

SEQ ID NO: 2003348 - protein, 31 aa, Staphylococcus
AQALKRLYGDVKFGVGPVIDGGFYYDFDMDE

SEQ ID NO: 2003349 - protein, 31 aa, Staphylococcus
AQALKRLYGDVKFGVGPVIDGGFYYDFDTDV

SEQ ID NO: 2003350 - protein, 30 aa, Staphylococcus
AQALKRLYGDVKFGVGPVIEGGFYYDFDTD

SEQ ID NO: 2003351 - protein, 30 aa, Staphylococcus
AQALKRLYGDVKFGVGPVVEGGFYYDFDMD

SEQ ID NO: 2003352 - protein, 17 aa, Staphylococcus
AQALTCYHGGDVIQSEF

SEQ ID NO: 2003353 - protein, 26 aa, Staphylococcus
AQAMAKEGYSFFGVLYIGAIITKDGP

SEQ ID NO: 2003354 - protein, 25 aa, Staphylococcus
AQAQIKVLFIPGNHDFWSADTNATS

SEQ ID NO: 2003355 - protein, 23 aa, Staphylococcus
AQARGAEIYAEIVGYGSTGDAYH

SEQ ID NO: 2003356 - protein, 20 aa, Staphylococcus
AQARGANIYAEIVGYGTTGD

SEQ ID NO: 2003357 - protein, 20 aa, Staphylococcus
AQARGAQIYAEIVGYGSTGD

SEQ ID NO: 2003358 - protein, 24 aa, Staphylococcus
AQASIKGGVHLNELTADRSKDLQP

SEQ ID NO: 2003359 - protein, 25 aa, Staphylococcus
AQASIRAGVHLDKLCEDRDKGLAKT

SEQ ID NO: 2003360 - protein, 32 aa, Staphylococcus
AQAYRAKLLRNFKHPLKFVFIDLIQNENIQTY

SEQ ID NO: 2003361 - protein, 18 aa, Staphylococcus
AQCEKKTFKIIVPIHDAI

SEQ ID NO: 2003362 - protein, 18 aa, Staphylococcus
AQCFNHVNDLAEFQDDLY

SEQ ID NO: 2003363 - protein, 18 aa, Staphylococcus
AQCIVQAIGGEGFVYIKG

SEQ ID NO: 2003364 - protein, 28 aa, Staphylococcus
AQDLKEVLKPGGVYYASFADLTNNPSRQ

SEQ ID NO: 2003365 - protein, 21 aa, Staphylococcus
AQDRIDMAFALKELDADSIPI

SEQ ID NO: 2003366 - protein, 22 aa, Staphylococcus
AQDVNLLFELINIGALSQLTAS

SEQ ID NO: 2003367 - protein, 19 aa, Staphylococcus
AQEARKFYDELARLASDET

SEQ ID NO: 2003368 - protein, 17 aa, Staphylococcus
AQEEIFGPVLVVEKFDD

SEQ ID NO: 2003369 - protein, 20 aa, Staphylococcus
AQEFKKWVKQVIKELRQSIG

SEQ ID NO: 2003370 - protein, 19 aa, Staphylococcus
AQEGCQFAFYGHTHVAKYE

SEQ ID NO: 2003371 - protein, 26 aa, Staphylococcus
AQEHLLKFYGSFGFERTSETYLEDGI

SEQ ID NO: 2003372 - protein, 25 aa, Staphylococcus
AQENGCLYCKAKGSPSNEYQDEKSL

SEQ ID NO: 2003373 - protein, 19 aa, Staphylococcus
AQENIFMFWMEFDDSGKKD

SEQ ID NO: 2003374 - protein, 17 aa, Staphylococcus
AQFEMMKPTSYLINASR

SEQ ID NO: 2003375 - protein, 18 aa, Staphylococcus
AQFGISILGGAFSDSYTF

SEQ ID NO: 2003376 - protein, 27 aa, Staphylococcus
AQFKPGDLIRFKWSTIEESAKVQEQYL

SEQ ID NO: 2003377 - protein, 19 aa, Staphylococcus
AQFLQKFYGGKGILLSGIP

SEQ ID NO: 2003378 - protein, 23 aa, Staphylococcus
AQFTDGVLLFGEISNETNIPGYG

SEQ ID NO: 2003379 - protein, 17 aa, Staphylococcus
AQGGQLIYSTWKDGMNP

SEQ ID NO: 2003380 - protein, 23 aa, Staphylococcus
AQGIGFKIAERLFNDGFNVAIVD

SEQ ID NO: 2003381 - protein, 17 aa, Staphylococcus
AQGKTPQTVRQWQDIPA

SEQ ID NO: 2003382 - protein, 27 aa, Staphylococcus
AQGLGFRGDIFGGYILYKMGYIESEAR

SEQ ID NO: 2003383 - protein, 27 aa, Staphylococcus
AQGLGFRGDIFGGYILYNLGFIESESR

SEQ ID NO: 2003384 - protein, 20 aa, Staphylococcus
AQGVFKTAISKRISKLQQMG

SEQ ID NO: 2003385 - protein, 20 aa, Staphylococcus
AQGYECGITIDKYNDLKEGD

SEQ ID NO: 2003386 - protein, 19 aa, Staphylococcus
AQGYECGITIEKYNDLKEG

SEQ ID NO: 2003387 - protein, 17 aa, Staphylococcus
AQHFFELAYPTLKSQSE

SEQ ID NO: 2003388 - protein, 17 aa, Staphylococcus
AQHLGWQGQYTHFDILP

SEQ ID NO: 2003389 - protein, 19 aa, Staphylococcus
AQHLTEFKKDVKVSLFIGG

SEQ ID NO: 2003390 - protein, 33 aa, Staphylococcus
AQIEFRLILVGGDCPKIKARPCMHQMEYSLEFL

SEQ ID NO: 2003391 - protein, 17 aa, Staphylococcus
AQIGAQFLQKFYGGKGI

SEQ ID NO: 2003392 - protein, 27 aa, Staphylococcus
AQIGDEIKQRWPGTITTIVHRIGPLQI

SEQ ID NO: 2003393 - protein, 21 aa, Staphylococcus
AQKGLPHACFNVTLYDEATLV

SEQ ID NO: 2003394 - protein, 30 aa, Staphylococcus
AQKLIKEITHRGRVPIIVGGTGLYIQSLIY

SEQ ID NO: 2003395 - protein, 18 aa, Staphylococcus
AQKLKKWGLPANRNTVRL

SEQ ID NO: 2003396 - protein, 18 aa, Staphylococcus
AQKMGFNVACLDPNPDSP

SEQ ID NO: 2003397 - protein, 34 aa, Staphylococcus
AQKMHSCIHKRFYLFVALMTEFQALNGMRIGEML

SEQ ID NO: 2003398 - protein, 18 aa, Staphylococcus
AQKSHIWFHTKDIPGSHV

SEQ ID NO: 2003399 - protein, 18 aa, Staphylococcus
AQKSHLWFHTKDIPGSHV

SEQ ID NO: 2003400 - protein, 22 aa, Staphylococcus
AQKSIWDFNGIYATSRHVPGVE

SEQ ID NO: 2003401 - protein, 17 aa, Staphylococcus
AQKTAYLAQAFGMKVIG

SEQ ID NO: 2003402 - protein, 30 aa, Staphylococcus
AQLADRLRFKRFWITEHHNVPAFACSSPEL

SEQ ID NO: 2003403 - protein, 20 aa, Staphylococcus
AQLALDVFASRIHKYIGSYA

SEQ ID NO: 2003404 - protein, 22 aa, Staphylococcus
AQLDFLLPERFELTYIGQDGEQ

SEQ ID NO: 2003405 - protein, 22 aa, Staphylococcus
AQLDFLLPERFELTYIGSDGEQ

SEQ ID NO: 2003406 - protein, 22 aa, Staphylococcus
AQLDFLLPERFELTYIGSDGEY

SEQ ID NO: 2003407 - protein, 19 aa, Staphylococcus
AQLDYLLPRLQGHGRSLSR

SEQ ID NO: 2003408 - protein, 25 aa, Staphylococcus
AQLEDYFRINMHLPNKLANKAKKDG

SEQ ID NO: 2003409 - protein, 17 aa, Staphylococcus
AQLFANEDVDVVIGTHP

SEQ ID NO: 2003410 - protein, 17 aa, Staphylococcus
AQLFANEGVDVVIGTHP

SEQ ID NO: 2003411 - protein, 25 aa, Staphylococcus
AQLFAVQLLFQFLFSQGRLEQAKSY

SEQ ID NO: 2003412 - protein, 18 aa, Staphylococcus
AQLFAVQLLFQYLFAQGR

SEQ ID NO: 2003413 - protein, 25 aa, Staphylococcus
AQLFMINVLYYRYLSLDFSNSLDLV

SEQ ID NO: 2003414 - protein, 21 aa, Staphylococcus
AQLKDALKLFFKEMNETTHSK

SEQ ID NO: 2003415 - protein, 19 aa, Staphylococcus
AQLKLTYRPQQLYLSEIIL

SEQ ID NO: 2003416 - protein, 22 aa, Staphylococcus
AQLKPGETIRFEWISTEEAFKQ

SEQ ID NO: 2003417 - protein, 24 aa, Staphylococcus
AQLMSVVVLLKCMTKFGFNAVFDR

SEQ ID NO: 2003418 - protein, 20 aa, Staphylococcus
AQLQFKDIFDGVFISEETGY

SEQ ID NO: 2003419 - protein, 24 aa, Staphylococcus
AQLREAGVEYKVYKNTLVRRAAEK

SEQ ID NO: 2003420 - protein, 27 aa, Staphylococcus
AQLSNKIGGYFLKKLNLNMINSNDELY

SEQ ID NO: 2003421 - protein, 18 aa, Staphylococcus
AQLTEAFQSIIQKGADAA

SEQ ID NO: 2003422 - protein, 23 aa, Staphylococcus
AQLVEGLIHFVSRQAMNIDGLGN

SEQ ID NO: 2003423 - protein, 24 aa, Staphylococcus
AQLVEGLIHFVSRQAMNIDGLGTK

SEQ ID NO: 2003424 - protein, 24 aa, Staphylococcus
AQLVEGMIHFVSRQAMNIDGLGTK

SEQ ID NO: 2003425 - protein, 21 aa, Staphylococcus
AQLYLLMHDKLPFAQQDITFN

SEQ ID NO: 2003426 - protein, 20 aa, Staphylococcus
AQLYNFLGLSVGLNLNSKST

SEQ ID NO: 2003427 - protein, 20 aa, Staphylococcus
AQLYNFLGLSVGLNLNSKTT

SEQ ID NO: 2003428 - protein, 17 aa, Staphylococcus
AQMAELNLSLATEAFPL

SEQ ID NO: 2003429 - protein, 17 aa, Staphylococcus
AQMHSLIAMDASHQRLT

SEQ ID NO: 2003430 - protein, 17 aa, Staphylococcus
AQMHSLVAMDEQHQRLT

SEQ ID NO: 2003431 - protein, 21 aa, Staphylococcus
AQMVRAFVPLSEMFGYATSLR

SEQ ID NO: 2003432 - protein, 25 aa, Staphylococcus
AQNDFLYDRVEVVVATNAFGMGIDK

SEQ ID NO: 2003433 - protein, 25 aa, Staphylococcus
AQNDFLYDRVNVVIATNAFGMGIDK

SEQ ID NO: 2003434 - protein, 25 aa, Staphylococcus
AQNDFVYDRIKVVIATNAFGMGIDK

SEQ ID NO: 2003435 - protein, 19 aa, Staphylococcus
AQNDFVYDRVRVVVATNAF

SEQ ID NO: 2003436 - protein, 23 aa, Staphylococcus
AQNGIKAIIQPGGSIKDQDSIDM

SEQ ID NO: 2003437 - protein, 24 aa, Staphylococcus
AQNHGCAYCKAKGQPSGKFTDEKS

SEQ ID NO: 2003438 - protein, 20 aa, Staphylococcus
AQNIKDVFVLNQLPKKDYDL

SEQ ID NO: 2003439 - protein, 23 aa, Staphylococcus
AQNKIRVEFKFNEELKPLTTDYL

SEQ ID NO: 2003440 - protein, 23 aa, Staphylococcus
AQNKIRVEFKFNELLKPLTTDYL

SEQ ID NO: 2003441 - protein, 25 aa, Staphylococcus
AQNLFARWRKEETLYKEDEKEAEKN

SEQ ID NO: 2003442 - protein, 34 aa, Staphylococcus
AQPDIFRPQLRALLRASVYGKLNIMFPMVATIKE

SEQ ID NO: 2003443 - protein, 18 aa, Staphylococcus
AQPFEPMPQLMAVSEDVT

SEQ ID NO: 2003444 - protein, 26 aa, Staphylococcus
AQPQKRGVYSGGIGYINCNHDLDFAL

SEQ ID NO: 2003445 - protein, 19 aa, Staphylococcus
AQPSIVIHYDIRHLSAEFA

SEQ ID NO: 2003446 - protein, 19 aa, Staphylococcus
AQQGITFLISSHMLSELVK

SEQ ID NO: 2003447 - protein, 18 aa, Staphylococcus
AQQMKAELTENGFESLET

SEQ ID NO: 2003448 - protein, 18 aa, Staphylococcus
AQQPLLLVEHGHQTKIHL

SEQ ID NO: 2003449 - protein, 23 aa, Staphylococcus
AQQRAYVPYSHFKVGAYLKTKDG

SEQ ID NO: 2003450 - protein, 25 aa, Staphylococcus
AQREFKQYFPKSGWVEHDANEIWTS

SEQ ID NO: 2003451 - protein, 18 aa, Staphylococcus
AQRGIKLLKELKSRPHRI

SEQ ID NO: 2003452 - protein, 22 aa, Staphylococcus
AQSLGALRIKIAKELGLIDENK

SEQ ID NO: 2003453 - protein, 23 aa, Staphylococcus
AQSLGALRIKIAKELKLIDESKL

SEQ ID NO: 2003454 - protein, 23 aa, Staphylococcus
AQSLGALRIKLAKELGLIDESKL

SEQ ID NO: 2003455 - protein, 23 aa, Staphylococcus
AQSLGALRIKLAKELGLIDETKL

SEQ ID NO: 2003456 - protein, 25 aa, Staphylococcus
AQSLGALRLKLARELDLIDESKLNF

SEQ ID NO: 2003457 - protein, 28 aa, Staphylococcus
AQTCYQFKVPFIITRAVSDLANGEANMT

SEQ ID NO: 2003458 - protein, 17 aa, Staphylococcus
AQTERLDKAISMLQEKI

SEQ ID NO: 2003459 - protein, 17 aa, Staphylococcus
AQTESKRQFMLNQLQAL

SEQ ID NO: 2003460 - protein, 18 aa, Staphylococcus
AQTFKMIINAVDLAETNE

SEQ ID NO: 2003461 - protein, 20 aa, Staphylococcus
AQTIPVMTVNGIKVSLLSYT

SEQ ID NO: 2003462 - protein, 17 aa, Staphylococcus
AQVKGVSVLVESKEVKQ

SEQ ID NO: 2003463 - protein, 19 aa, Staphylococcus
AQVKSAILFASIFSNESSS

SEQ ID NO: 2003464 - protein, 20 aa, Staphylococcus
AQVKSAILFASLFANEPTKI

SEQ ID NO: 2003465 - protein, 21 aa, Staphylococcus
AQVKSAILFASLFSKEASQIT

SEQ ID NO: 2003466 - protein, 22 aa, Staphylococcus
AQVKSAILFASLFSKTASTITE

SEQ ID NO: 2003467 - protein, 20 aa, Staphylococcus
AQVKSAILLASLFANDSTTV

SEQ ID NO: 2003468 - protein, 27 aa, Staphylococcus
AQVSVGARSSIFAPFKNLGLIIIDEEH

SEQ ID NO: 2003469 - protein, 17 aa, Staphylococcus
AQVTEVWVNSHEITQAG

SEQ ID NO: 2003470 - protein, 25 aa, Staphylococcus
AQVYLRYVPECVMIIDVQNNNKNEV

SEQ ID NO: 2003471 - protein, 25 aa, Staphylococcus
AQWPTPRLNHWRVLLQARAIENDMF

SEQ ID NO: 2003472 - protein, 25 aa, Staphylococcus
AQWPTVRLNHWLALLKARAIENDMF

SEQ ID NO: 2003473 - protein, 30 aa, Staphylococcus
AQYNDCLLFFRLGDFYEMFFDDAKEASRVL

SEQ ID NO: 2003474 - protein, 19 aa, Staphylococcus
AQYSFLNLLKYMFKDEPYR

SEQ ID NO: 2003475 - protein, 17 aa, Staphylococcus
ARACISQFNPKECKHEF

SEQ ID NO: 2003476 - protein, 21 aa, Staphylococcus
ARAEVATEWDLEYGDRHTQFV

SEQ ID NO: 2003477 - protein, 19 aa, Staphylococcus
ARAEVEKGVKWITDKESVE

SEQ ID NO: 2003478 - protein, 18 aa, Staphylococcus
ARAFDMDVLYTGPHRKEE

SEQ ID NO: 2003479 - protein, 24 aa, Staphylococcus
ARAFITRPAIIFADEPTGALDSKS

SEQ ID NO: 2003480 - protein, 20 aa, Staphylococcus
ARAGIEDIIIVTGKHKRAIE

SEQ ID NO: 2003481 - protein, 25 aa, Staphylococcus
ARAGIYKWYIDIIAGTCAYIDKENQ

SEQ ID NO: 2003482 - protein, 19 aa, Staphylococcus
ARASEKISFLNITSQPREV

SEQ ID NO: 2003483 - protein, 18 aa, Staphylococcus
ARASFYVYNTKEDVDQLV

SEQ ID NO: 2003484 - protein, 23 aa, Staphylococcus
ARAVELFKAAGFNIEGELKDKLY

SEQ ID NO: 2003485 - protein, 17 aa, Staphylococcus
ARAYTGRPYIISFVNAY

SEQ ID NO: 2003486 - protein, 22 aa, Staphylococcus
ARCMDCGTPFCQSGLSYGFETI

SEQ ID NO: 2003487 - protein, 23 aa, Staphylococcus
ARCMDCGTPFCQTGEPFGRETIG

SEQ ID NO: 2003488 - protein, 18 aa, Staphylococcus
ARDADLLLHVVDASNEDY

SEQ ID NO: 2003489 - protein, 20 aa, Staphylococcus
ARDHALTGLEFACGIPGSIG

SEQ ID NO: 2003490 - protein, 17 aa, Staphylococcus
ARDIIEFNHLVIDNDAH

SEQ ID NO: 2003491 - protein, 20 aa, Staphylococcus
ARDIKKFLGKDIGYISQNYA

SEQ ID NO: 2003492 - protein, 22 aa, Staphylococcus
ARDKKLGLDDMVNGSFTITNGG

SEQ ID NO: 2003493 - protein, 17 aa, Staphylococcus
ARDLIEFDHLVIDNDAH

SEQ ID NO: 2003494 - protein, 19 aa, Staphylococcus
ARDLIEFKHLVIDNDAHRV

SEQ ID NO: 2003495 - protein, 17 aa, Staphylococcus
ARDSYGFIGGIHEHDFD

SEQ ID NO: 2003496 - protein, 24 aa, Staphylococcus
ARDTLRLEAGLPLHGQDLSEDITP

SEQ ID NO: 2003497 - protein, 24 aa, Staphylococcus
ARDTLRLEAGLPLHGQDLSETITP

SEQ ID NO: 2003498 - protein, 17 aa, Staphylococcus
ARDVKRSGYLIITSDKG

SEQ ID NO: 2003499 - protein, 24 aa, Staphylococcus
AREGAQVIKFIRRIDFSAIPQNFK

SEQ ID NO: 2003500 - protein, 20 aa, Staphylococcus
AREKTIISLRGFKYPLDQES

SEQ ID NO: 2003501 - protein, 18 aa, Staphylococcus
ARELDLLYFFISNKNQIL

SEQ ID NO: 2003502 - protein, 19 aa, Staphylococcus
ARELLKYKIETYDDHIAKI

SEQ ID NO: 2003503 - protein, 18 aa, Staphylococcus
AREMGDYLIVALSSDEFN

SEQ ID NO: 2003504 - protein, 20 aa, Staphylococcus
ARESHELLDICLGEDSPHRL

SEQ ID NO: 2003505 - protein, 18 aa, Staphylococcus
AREVILIITGSDKKEVVH

SEQ ID NO: 2003506 - protein, 19 aa, Staphylococcus
AREVTRRKSALDVSSLPGK

SEQ ID NO: 2003507 - protein, 19 aa, Staphylococcus
AREVTRRKSALEISSLPGK

SEQ ID NO: 2003508 - protein, 19 aa, Staphylococcus
AREVTRRKSALEVSSLPGK

SEQ ID NO: 2003509 - protein, 22 aa, Staphylococcus
ARFDSKEAFVAYFIQQLHLTHN

SEQ ID NO: 2003510 - protein, 17 aa, Staphylococcus
ARFECIDAQFPDWQYTN

SEQ ID NO: 2003511 - protein, 19 aa, Staphylococcus
ARFEFRWIDQFNLSLDPER

SEQ ID NO: 2003512 - protein, 22 aa, Staphylococcus
ARFIERGTIEIAPLAYMRGRTL

SEQ ID NO: 2003513 - protein, 24 aa, Staphylococcus
ARFRRETLGFVFQDFNVLNTMTNK

SEQ ID NO: 2003514 - protein, 17 aa, Staphylococcus
ARFVNEYIRTLNVTQSA

SEQ ID NO: 2003515 - protein, 18 aa, Staphylococcus
ARGAIFGLTRGTEKEHFI

SEQ ID NO: 2003516 - protein, 22 aa, Staphylococcus
ARGGFTTVCPMPNTKPVPDSEE

SEQ ID NO: 2003517 - protein, 23 aa, Staphylococcus
ARGGFTTVCPMPNTRPVPDSVEH

SEQ ID NO: 2003518 - protein, 30 aa, Staphylococcus
ARGNSGVILSQIFRGFCKNIEDAETIDAKT

SEQ ID NO: 2003519 - protein, 17 aa, Staphylococcus
ARGPMGHGSHFHRAPGS

SEQ ID NO: 2003520 - protein, 20 aa, Staphylococcus
ARGSLVDTHALLSCLDSGQI

SEQ ID NO: 2003521 - protein, 19 aa, Staphylococcus
ARGVKCYPSQIVIGSGTQT

SEQ ID NO: 2003522 - protein, 20 aa, Staphylococcus
ARHFLWSTAKGYNYSENQPH

SEQ ID NO: 2003523 - protein, 20 aa, Staphylococcus
ARHFLWSTARGYNQYNETLN

SEQ ID NO: 2003524 - protein, 25 aa, Staphylococcus
ARHHTFFEMLGNFSIGDYFKKEAIE

SEQ ID NO: 2003525 - protein, 25 aa, Staphylococcus
ARHHTFFEMLGNFSIGDYFKKEAIH

SEQ ID NO: 2003526 - protein, 24 aa, Staphylococcus
ARHHTFFEMLGNFSIGDYFKNEAI

SEQ ID NO: 2003527 - protein, 24 aa, Staphylococcus
ARHHTFFEMLGNFSIGDYFKQEAI

SEQ ID NO: 2003528 - protein, 26 aa, Staphylococcus
ARHHTFFEMLGNFSIGDYFKREAIEF

SEQ ID NO: 2003529 - protein, 17 aa, Staphylococcus
ARIAVLKRIIKTCETAL

SEQ ID NO: 2003530 - protein, 26 aa, Staphylococcus
ARIFKQMKNGMFLRMSVITHILAEKE

SEQ ID NO: 2003531 - protein, 23 aa, Staphylococcus
ARIFKQMTNGMYLRMSVINKLLS

SEQ ID NO: 2003532 - protein, 30 aa, Staphylococcus
ARIKNHVILRYGWLYGPGTWYGEDGMIYSQ

SEQ ID NO: 2003533 - protein, 20 aa, Staphylococcus
ARIMPHITIKSHFEINDDEL

SEQ ID NO: 2003534 - protein, 19 aa, Staphylococcus
ARIPEWTNHHYLPNREIVS

SEQ ID NO: 2003535 - protein, 26 aa, Staphylococcus
ARIPKGRGMVKWQAFKTVPEQYEILE

SEQ ID NO: 2003536 - protein, 25 aa, Staphylococcus
ARIQSYQESIKWTKQQGTSDCYELY

SEQ ID NO: 2003537 - protein, 17 aa, Staphylococcus
ARIVGGALNLADCIMDG

SEQ ID NO: 2003538 - protein, 17 aa, Staphylococcus
ARKASRAVGKRGTDLPG

SEQ ID NO: 2003539 - protein, 22 aa, Staphylococcus
ARKFMRMFFSGAIEVELDKQGR

SEQ ID NO: 2003540 - protein, 20 aa, Staphylococcus
ARKGRLAIMDHMLQTIDHPR

SEQ ID NO: 2003541 - protein, 18 aa, Staphylococcus
ARKIKRPLLEQGGTLFKL

SEQ ID NO: 2003542 - protein, 26 aa, Staphylococcus
ARKKFGEDQVHIWRRSYDVAPPKQDE

SEQ ID NO: 2003543 - protein, 29 aa, Staphylococcus
ARKKSGLSYKEKREYETLMERIEQTETRL

SEQ ID NO: 2003544 - protein, 17 aa, Staphylococcus
ARKLFALEEDGNIYTRI

SEQ ID NO: 2003545 - protein, 20 aa, Staphylococcus
ARKLLKVLIEQELLIITQGE

SEQ ID NO: 2003546 - protein, 30 aa, Staphylococcus
ARKLSDMKQPVWIRHVLVPGISDDKEDLIQ

SEQ ID NO: 2003547 - protein, 22 aa, Staphylococcus
ARKMIKVIEELGLNRFMLHIPV

SEQ ID NO: 2003548 - protein, 19 aa, Staphylococcus
ARKNFRSLIKQVNENSEAI

SEQ ID NO: 2003549 - protein, 17 aa, Staphylococcus
ARKPFPQEPLKQLEEAI

SEQ ID NO: 2003550 - protein, 25 aa, Staphylococcus
ARKQVLVDHGFRLPSAMDNRPLKFE

SEQ ID NO: 2003551 - protein, 17 aa, Staphylococcus
ARKRLKNGELDYLKESD

SEQ ID NO: 2003552 - protein, 26 aa, Staphylococcus
ARKVRREVMDMLLLVKEKAYYSYRMD

SEQ ID NO: 2003553 - protein, 21 aa, Staphylococcus
ARLEECGQCSNCIQQNKTYDM

SEQ ID NO: 2003554 - protein, 18 aa, Staphylococcus
ARLKDAFEIPYSQYCKHE

SEQ ID NO: 2003555 - protein, 18 aa, Staphylococcus
ARLKFQFIDVETAEKNVV

SEQ ID NO: 2003556 - protein, 21 aa, Staphylococcus
ARLKYIKSLYTELGKITDIVN

SEQ ID NO: 2003557 - protein, 21 aa, Staphylococcus
ARLKYVKSLYTELGKITDIVN

SEQ ID NO: 2003558 - protein, 22 aa, Staphylococcus
ARLLCKLKTDLLQSVLHTKVIS

SEQ ID NO: 2003559 - protein, 19 aa, Staphylococcus
ARLNFGFSELNLHKIYLKV

SEQ ID NO: 2003560 - protein, 21 aa, Staphylococcus
ARLNFPSAHAKALERRIAVIP

SEQ ID NO: 2003561 - protein, 20 aa, Staphylococcus
ARLQISDAFYSDKTKQIFTD

SEQ ID NO: 2003562 - protein, 26 aa, Staphylococcus
ARLRDITELFLDSGLGKEAFSIISQG

SEQ ID NO: 2003563 - protein, 25 aa, Staphylococcus
ARLSEFKKYKDYVAKSVVKQNNEDK

SEQ ID NO: 2003564 - protein, 22 aa, Staphylococcus
ARLYPELPRTEYICFYPMDKRR

SEQ ID NO: 2003565 - protein, 20 aa, Staphylococcus
ARNALPDTFSHEKAVQNSAI

SEQ ID NO: 2003566 - protein, 20 aa, Staphylococcus
ARNGEIKGFTGINAPYEEPN

SEQ ID NO: 2003567 - protein, 24 aa, Staphylococcus
ARNIPQAHASLKNKEWNRKAFKGV

SEQ ID NO: 2003568 - protein, 27 aa, Staphylococcus
ARNLLFLSFAGALAYQIKARHIITGVC

SEQ ID NO: 2003569 - protein, 26 aa, Staphylococcus
ARNLLFLSFAGALAYQLNAKHIITGV

SEQ ID NO: 2003570 - protein, 22 aa, Staphylococcus
ARNLLFLSFAGALAYQRNAKHI

SEQ ID NO: 2003571 - protein, 17 aa, Staphylococcus
ARPGEYLDDVNFDAVRK

SEQ ID NO: 2003572 - protein, 20 aa, Staphylococcus
ARPLRRVVEREVRDRITDYY

SEQ ID NO: 2003573 - protein, 18 aa, Staphylococcus
ARPLYYEHSTLKFYLNVD

SEQ ID NO: 2003574 - protein, 26 aa, Staphylococcus
ARQCYQCIRKVFHVIHRPFYLRKLNK

SEQ ID NO: 2003575 - protein, 32 aa, Staphylococcus
ARQLRYEWFDEMMKRLDADVLLTAHHLDDQLE

SEQ ID NO: 2003576 - protein, 21 aa, Staphylococcus
ARQMDEFVFELPMTSTEQKLI

SEQ ID NO: 2003577 - protein, 17 aa, Staphylococcus
ARQSMLRGVDQLANAVK

SEQ ID NO: 2003578 - protein, 22 aa, Staphylococcus
ARRCNEEGITFIGPHLDHLDMF

SEQ ID NO: 2003579 - protein, 21 aa, Staphylococcus
ARRMAKVVGAPFIKVEATKFT

SEQ ID NO: 2003580 - protein, 17 aa, Staphylococcus
ARRMERASVLAQVDIHR

SEQ ID NO: 2003581 - protein, 19 aa, Staphylococcus
ARRPMILPVIMKVNEDKGN

SEQ ID NO: 2003582 - protein, 18 aa, Staphylococcus
ARRPMILPVIMKVNEDKK

SEQ ID NO: 2003583 - protein, 18 aa, Staphylococcus
ARRTYAFTELFMFELRMQ

SEQ ID NO: 2003584 - protein, 25 aa, Staphylococcus
ARRVIAIECIIALQAVELKGVNQLS

SEQ ID NO: 2003585 - protein, 20 aa, Staphylococcus
ARRVLAIETIIALQAVEYKD

SEQ ID NO: 2003586 - protein, 23 aa, Staphylococcus
ARSARAYGSAALEIIHVATGKLG

SEQ ID NO: 2003587 - protein, 24 aa, Staphylococcus
ARSARAYGSAALEIVNVARGKLAA

SEQ ID NO: 2003588 - protein, 24 aa, Staphylococcus
ARSARAYGSAALEIVSVAKGQLDA

SEQ ID NO: 2003589 - protein, 19 aa, Staphylococcus
ARSEADWIVGINATRALTT

SEQ ID NO: 2003590 - protein, 21 aa, Staphylococcus
ARSGEAITGRVLGYKLSLNPL

SEQ ID NO: 2003591 - protein, 18 aa, Staphylococcus
ARSGEIKEFTGINAPYEA

SEQ ID NO: 2003592 - protein, 21 aa, Staphylococcus
ARSIPIFVFLNDNFEQETVWG

SEQ ID NO: 2003593 - protein, 20 aa, Staphylococcus
ARSLKELKLLSLNDIMKVKG

SEQ ID NO: 2003594 - protein, 20 aa, Staphylococcus
ARTDYIRKLGFSYADMEKEG

SEQ ID NO: 2003595 - protein, 19 aa, Staphylococcus
ARTDYIRKLGFSYADMEKT

SEQ ID NO: 2003596 - protein, 21 aa, Staphylococcus
ARTGIKVTSILPGMVDTPMTE

SEQ ID NO: 2003597 - protein, 18 aa, Staphylococcus
ARTILDWASKQTYIALGN

SEQ ID NO: 2003598 - protein, 22 aa, Staphylococcus
ARTLAFIYHSKIRVIAPDNLLQ

SEQ ID NO: 2003599 - protein, 18 aa, Staphylococcus
ARTPMQWDDSVNGGFTEG

SEQ ID NO: 2003600 - protein, 18 aa, Staphylococcus
ARTPMQWDSTKNAGFTDS

SEQ ID NO: 2003601 - protein, 18 aa, Staphylococcus
ARTPMQWNNEKNAGFTDG

SEQ ID NO: 2003602 - protein, 18 aa, Staphylococcus
ARTTPSVVAFKNDETQVG

SEQ ID NO: 2003603 - protein, 24 aa, Staphylococcus
ARVDLSLNVRKVFFSTYNKKELSD

SEQ ID NO: 2003604 - protein, 26 aa, Staphylococcus
ARVDLSLNVRRVFFSTFDRSELNDSY

SEQ ID NO: 2003605 - protein, 26 aa, Staphylococcus
ARVDLSLNVRRVYFSTFNREELNDSY

SEQ ID NO: 2003606 - protein, 21 aa, Staphylococcus
ARVLEGLEFMGVYWDPKKNSQ

SEQ ID NO: 2003607 - protein, 21 aa, Staphylococcus
ARVPAGGALAVDRHDFAGYVT

SEQ ID NO: 2003608 - protein, 17 aa, Staphylococcus
ARVPAGGALAVDRHDFS

SEQ ID NO: 2003609 - protein, 26 aa, Staphylococcus
ARVSEAMHLLPFNVFFVPARGGLGEN

SEQ ID NO: 2003610 - protein, 17 aa, Staphylococcus
ARVSVLGHIQRGGSPSG

SEQ ID NO: 2003611 - protein, 21 aa, Staphylococcus
ARYGEFGSFYIGHILELDQLD

SEQ ID NO: 2003612 - protein, 19 aa, Staphylococcus
ARYYRSFLKELSRIKSKLT

SEQ ID NO: 2003613 - protein, 18 aa, Staphylococcus
ASAKGCKSSLGFDSTTIW

SEQ ID NO: 2003614 - protein, 18 aa, Staphylococcus
ASAKSGFNKYVIPKATDK

SEQ ID NO: 2003615 - protein, 18 aa, Staphylococcus
ASALGCRESLGFNEKTKW

SEQ ID NO: 2003616 - protein, 18 aa, Staphylococcus
ASALISILSTNVDKEVID

SEQ ID NO: 2003617 - protein, 20 aa, Staphylococcus
ASAMGIPVVSHLGLTPQSVG

SEQ ID NO: 2003618 - protein, 24 aa, Staphylococcus
ASANEKYDLFVLVVTDIINSNSKI

SEQ ID NO: 2003619 - protein, 25 aa, Staphylococcus
ASCAHIMIWEGIEILPVTQNKRAIG

SEQ ID NO: 2003620 - protein, 25 aa, Staphylococcus
ASCAHMMIWEGIEILPVTTTNKKIL

SEQ ID NO: 2003621 - protein, 24 aa, Staphylococcus
ASCHLAIGSAYGFNVEGGTEMTTE

SEQ ID NO: 2003622 - protein, 22 aa, Staphylococcus
ASCKSYVEAHAKYVANTKVEEG

SEQ ID NO: 2003623 - protein, 31 aa, Staphylococcus
ASDDLLLRRIYKLPIGFKWDNQANLTLIGDA

SEQ ID NO: 2003624 - protein, 36 aa, Staphylococcus
ASDDVMCRRIYKLPIGFKWDNHPHITLIGDAAHVMS

SEQ ID NO: 2003625 - protein, 24 aa, Staphylococcus
ASDKLRTVVIDWVGPMDRFRLIHL

SEQ ID NO: 2003626 - protein, 17 aa, Staphylococcus
ASDSIVYYGMKAHAHEF

SEQ ID NO: 2003627 - protein, 22 aa, Staphylococcus
ASDSQKGTVFVDLKGAVEHPDV

SEQ ID NO: 2003628 - protein, 25 aa, Staphylococcus
ASDWKEKLRMLKSFPTPTFDDIPLL

SEQ ID NO: 2003629 - protein, 23 aa, Staphylococcus
ASDYFAFEACEYRRHFLSYHPDY

SEQ ID NO: 2003630 - protein, 17 aa, Staphylococcus
ASECGFTPQFEGLQALY

SEQ ID NO: 2003631 - protein, 18 aa, Staphylococcus
ASECGFTPQFEGLQELYN

SEQ ID NO: 2003632 - protein, 18 aa, Staphylococcus
ASECGFTPQFEGLQKLYE

SEQ ID NO: 2003633 - protein, 32 aa, Staphylococcus
ASEEALKICNYCFDHGLVLIAVAGNVLRFQPP

SEQ ID NO: 2003634 - protein, 23 aa, Staphylococcus
ASEGNYKYCFFSSKGNGQFKPTG

SEQ ID NO: 2003635 - protein, 17 aa, Staphylococcus
ASEIARAEFPDFQVEER

SEQ ID NO: 2003636 - protein, 22 aa, Staphylococcus
ASEIDMVINIGALKDGRYDDVK

SEQ ID NO: 2003637 - protein, 22 aa, Staphylococcus
ASEIDMVINIGALKDGRYEDVQ

SEQ ID NO: 2003638 - protein, 22 aa, Staphylococcus
ASEIDMVINIGALKDQRYDEVQ

SEQ ID NO: 2003639 - protein, 18 aa, Staphylococcus
ASEIEYFTPILNVGETGI

SEQ ID NO: 2003640 - protein, 22 aa, Staphylococcus
ASEKHVDWIALAVIKARKALPE

SEQ ID NO: 2003641 - protein, 17 aa, Staphylococcus
ASEKMTGQSIIDLDIRA

SEQ ID NO: 2003642 - protein, 23 aa, Staphylococcus
ASEMKLTPIVRKILESKNITDKQ

SEQ ID NO: 2003643 - protein, 22 aa, Staphylococcus
ASEMLRSFLQRHHFSKRTISAI

SEQ ID NO: 2003644 - protein, 29 aa, Staphylococcus
ASFCSSCTRARLSSDGKFYGCLFSTAEGF

SEQ ID NO: 2003645 - protein, 30 aa, Staphylococcus
ASFCSTCTRARLSSDGKFYGCLFSTVEGFN

SEQ ID NO: 2003646 - protein, 18 aa, Staphylococcus
ASFCSTCTRERLSSDGKF

SEQ ID NO: 2003647 - protein, 19 aa, Staphylococcus
ASFDLLFVKWVPRDKNKEA

SEQ ID NO: 2003648 - protein, 22 aa, Staphylococcus
ASFEGVKRGRIVNKQDLTIEGH

SEQ ID NO: 2003649 - protein, 17 aa, Staphylococcus
ASFGGKLAIDFYLENPE

SEQ ID NO: 2003650 - protein, 17 aa, Staphylococcus
ASFLKVFGTLFQYLKKE

SEQ ID NO: 2003651 - protein, 18 aa, Staphylococcus
ASFNILIAQHAPMKCEKI

SEQ ID NO: 2003652 - protein, 25 aa, Staphylococcus
ASFRLSEVKLGIDLNYISLEDFKFN

SEQ ID NO: 2003653 - protein, 21 aa, Staphylococcus
ASFVECFKKTVTPVVKSYQPD

SEQ ID NO: 2003654 - protein, 17 aa, Staphylococcus
ASGARFINLMGGEMLSF

SEQ ID NO: 2003655 - protein, 17 aa, Staphylococcus
ASGEHRIEFEVIDHIGA

SEQ ID NO: 2003656 - protein, 21 aa, Staphylococcus
ASGETVLFCPKMEVEEVKASP

SEQ ID NO: 2003657 - protein, 21 aa, Staphylococcus
ASGGELSRIMLALKTIFVKAR

SEQ ID NO: 2003658 - protein, 17 aa, Staphylococcus
ASGGVRNLEDFKAMIDA

SEQ ID NO: 2003659 - protein, 25 aa, Staphylococcus
ASGIPDFRSIGGLYDEISKKGLSPE

SEQ ID NO: 2003660 - protein, 24 aa, Staphylococcus
ASGIPDFRSMGGLFDEILKEGYSP

SEQ ID NO: 2003661 - protein, 23 aa, Staphylococcus
ASGIPDFRSMGGLFDEISKDGQS

SEQ ID NO: 2003662 - protein, 23 aa, Staphylococcus
ASGIPDFRSMGGLFDEISKEGYS

SEQ ID NO: 2003663 - protein, 24 aa, Staphylococcus
ASGIPDFRSSGGLYDDVSKDGYAP

SEQ ID NO: 2003664 - protein, 19 aa, Staphylococcus
ASGKTRLSNELLLNLDAKY

SEQ ID NO: 2003665 - protein, 25 aa, Staphylococcus
ASGKTRLSNELLLTFDAKYTQFIST

SEQ ID NO: 2003666 - protein, 21 aa, Staphylococcus
ASGLPSFTYTFLGFLPRKDKE

SEQ ID NO: 2003667 - protein, 20 aa, Staphylococcus
ASGLPSFTYTFLGFLPRKEK

SEQ ID NO: 2003668 - protein, 21 aa, Staphylococcus
ASGLPSFTYTFLGFLPRKEKE

SEQ ID NO: 2003669 - protein, 21 aa, Staphylococcus
ASGLPSYTYTFLGFLPRKEKD

SEQ ID NO: 2003670 - protein, 21 aa, Staphylococcus
ASGPLYGFSFVKMAEVVKDDI

SEQ ID NO: 2003671 - protein, 21 aa, Staphylococcus
ASGPLYGFSFVKMANVVNDEM

SEQ ID NO: 2003672 - protein, 30 aa, Staphylococcus
ASGTLEFFDYTYSGWRGVTLNSGMGVVALK

SEQ ID NO: 2003673 - protein, 23 aa, Staphylococcus
ASGVPDFRSMGGLFDEISKEGYA

SEQ ID NO: 2003674 - protein, 23 aa, Staphylococcus
ASGVPDFRSMGGLFDEISKEGYS

SEQ ID NO: 2003675 - protein, 21 aa, Staphylococcus
ASGYLKGALVTKGLTELSDDN

SEQ ID NO: 2003676 - protein, 19 aa, Staphylococcus
ASGYQIAIATGRPRTETLV

SEQ ID NO: 2003677 - protein, 21 aa, Staphylococcus
ASHDVDYCIVINFSSRFANVT

SEQ ID NO: 2003678 - protein, 18 aa, Staphylococcus
ASHGLRLNERTKYELQNF

SEQ ID NO: 2003679 - protein, 19 aa, Staphylococcus
ASHGLRLNERTKYKLENFD

SEQ ID NO: 2003680 - protein, 18 aa, Staphylococcus
ASHGLRLNERTKYQLQNF

SEQ ID NO: 2003681 - protein, 22 aa, Staphylococcus
ASHIKPNFTIVSAPHFKANPDV

SEQ ID NO: 2003682 - protein, 18 aa, Staphylococcus
ASIASGVDIKEVFLKLPI

SEQ ID NO: 2003683 - protein, 20 aa, Staphylococcus
ASIEPKRVVFIYSKIDKSAV

SEQ ID NO: 2003684 - protein, 25 aa, Staphylococcus
ASIGTVWPDNVSVFSENVETYQTIT

SEQ ID NO: 2003685 - protein, 21 aa, Staphylococcus
ASIISRYAFIKHMNSISKMMH

SEQ ID NO: 2003686 - protein, 24 aa, Staphylococcus
ASIISRYAFVKHMDHISHKMKQDI

SEQ ID NO: 2003687 - protein, 21 aa, Staphylococcus
ASIISRYAFVKHMDQMSKSIK

SEQ ID NO: 2003688 - protein, 25 aa, Staphylococcus
ASIISRYAFVKHMDRLTQSVKTDIP

SEQ ID NO: 2003689 - protein, 21 aa, Staphylococcus
ASIISRYAFVKHMNQITQQIK

SEQ ID NO: 2003690 - protein, 17 aa, Staphylococcus
ASIKAGVHLDKITEERS

SEQ ID NO: 2003691 - protein, 24 aa, Staphylococcus
ASIKFLKKEIAEFVENHKIKSIGI

SEQ ID NO: 2003692 - protein, 21 aa, Staphylococcus
ASILSGTKFRGHYNLCNEQRD

SEQ ID NO: 2003693 - protein, 17 aa, Staphylococcus
ASIRVKYTPTLKPITIE

SEQ ID NO: 2003694 - protein, 24 aa, Staphylococcus
ASISPKISEFIAFDMGALGDGQAS

SEQ ID NO: 2003695 - protein, 20 aa, Staphylococcus
ASIYKSWRASEIKPLPFHVY

SEQ ID NO: 2003696 - protein, 21 aa, Staphylococcus
ASKAFTCIQMVKLVQEENLQL

SEQ ID NO: 2003697 - protein, 19 aa, Staphylococcus
ASKATHCHIFMTATPPRHL

SEQ ID NO: 2003698 - protein, 24 aa, Staphylococcus
ASKGRSGYVSNSFAMRLNQLGKAS

SEQ ID NO: 2003699 - protein, 23 aa, Staphylococcus
ASKHLYLKGIHFHVGSQIEGTEA

SEQ ID NO: 2003700 - protein, 20 aa, Staphylococcus
ASKLEIGDHIALYGEDGALY

SEQ ID NO: 2003701 - protein, 27 aa, Staphylococcus
ASKLPWGDLGVDVVLECTGFYTDKEKA

SEQ ID NO: 2003702 - protein, 25 aa, Staphylococcus
ASKNNPWSYYWARMSGKQVMTYLSR

SEQ ID NO: 2003703 - protein, 29 aa, Staphylococcus
ASKRLKRPLARRIPGIELMDQCLKMANIK

SEQ ID NO: 2003704 - protein, 26 aa, Staphylococcus
ASKSFKPGRPIGGDFYLRSLIKCPEC

SEQ ID NO: 2003705 - protein, 24 aa, Staphylococcus
ASKYRSAGTIEFLVTEDAHYFIEM

SEQ ID NO: 2003706 - protein, 21 aa, Staphylococcus
ASLDCGACGGAASGFNAKVLA

SEQ ID NO: 2003707 - protein, 17 aa, Staphylococcus
ASLETFGVDSDRLEIQI

SEQ ID NO: 2003708 - protein, 18 aa, Staphylococcus
ASLETFGVDSNRLEIQIM

SEQ ID NO: 2003709 - protein, 17 aa, Staphylococcus
ASLETFGVNSDRLEIQI

SEQ ID NO: 2003710 - protein, 20 aa, Staphylococcus
ASLFKSTGMTLMSNIGGASG

SEQ ID NO: 2003711 - protein, 17 aa, Staphylococcus
ASLISFYEQYSYINYGV

SEQ ID NO: 2003712 - protein, 17 aa, Staphylococcus
ASLKVASEICVFTNDNI

SEQ ID NO: 2003713 - protein, 17 aa, Staphylococcus
ASLKVPVIGVVIGEGGS

SEQ ID NO: 2003714 - protein, 17 aa, Staphylococcus
ASLLQIYSSLVIEGPGL

SEQ ID NO: 2003715 - protein, 18 aa, Staphylococcus
ASLLQIYSSLVIEGPGLT

SEQ ID NO: 2003716 - protein, 18 aa, Staphylococcus
ASLLTSKYEGFGLTVMES

SEQ ID NO: 2003717 - protein, 17 aa, Staphylococcus
ASLPRLNKQVNIAGTFN

SEQ ID NO: 2003718 - protein, 22 aa, Staphylococcus
ASLPYRAKRHYSIVEGDSETLT

SEQ ID NO: 2003719 - protein, 27 aa, Staphylococcus
ASLQQGAWNRKAFRGVELYQKTLGVIG

SEQ ID NO: 2003720 - protein, 23 aa, Staphylococcus
ASLSRLNYPVTFIEIDDQLHYHH

SEQ ID NO: 2003721 - protein, 27 aa, Staphylococcus
ASLTKYLRKLKCIYVLVDPYLLESIRE

SEQ ID NO: 2003722 - protein, 22 aa, Staphylococcus
ASLYISNIIDFLIKEAKVTLNT

SEQ ID NO: 2003723 - protein, 25 aa, Staphylococcus
ASMKREDYVPLAIAAGCDMFLFFND

SEQ ID NO: 2003724 - protein, 21 aa, Staphylococcus
ASNLKIGYLSQHEFERDGNDT

SEQ ID NO: 2003725 - protein, 20 aa, Staphylococcus
ASNLKIIANYGAGFNNVDVK

SEQ ID NO: 2003726 - protein, 18 aa, Staphylococcus
ASNPAQFAPNAKIVHVDI

SEQ ID NO: 2003727 - protein, 24 aa, Staphylococcus
ASNYRSAGTIEFLVTEDAYYFIEM

SEQ ID NO: 2003728 - protein, 20 aa, Staphylococcus
ASPEMTLRYAKLLDDTKRKA

SEQ ID NO: 2003729 - protein, 19 aa, Staphylococcus
ASPEQVFKTLLFINNNHDP

SEQ ID NO: 2003730 - protein, 23 aa, Staphylococcus
ASPHEGLMLLKLVHYDKDDQPIL

SEQ ID NO: 2003731 - protein, 23 aa, Staphylococcus
ASPYASHSYVFISWTGKMTETFV

SEQ ID NO: 2003732 - protein, 28 aa, Staphylococcus
ASQFTFSRKGLREGYAMNIISERYPTEF

SEQ ID NO: 2003733 - protein, 23 aa, Staphylococcus
ASQIICYDLRYPEVARASIKNDA

SEQ ID NO: 2003734 - protein, 24 aa, Staphylococcus
ASQIRRFEIKLGDKVTGKVRKPKD

SEQ ID NO: 2003735 - protein, 30 aa, Staphylococcus
ASQKNQFPWVVAAFPSKAWAHRVYPDLSIE

SEQ ID NO: 2003736 - protein, 30 aa, Staphylococcus
ASQKNQFPWVVAAFPSKAWAQRVYPNKSVE

SEQ ID NO: 2003737 - protein, 23 aa, Staphylococcus
ASQKNQFPWVVAAFPTKDWARRV

SEQ ID NO: 2003738 - protein, 24 aa, Staphylococcus
ASQSFNHIACFDLPQYYKTLVLSD

SEQ ID NO: 2003739 - protein, 21 aa, Staphylococcus
ASREEICIRVEFFGDEIDRIS

SEQ ID NO: 2003740 - protein, 22 aa, Staphylococcus
ASRELKKLFSQVEEEMVDTFIK

SEQ ID NO: 2003741 - protein, 24 aa, Staphylococcus
ASRETVRRALNLLVGEGMIQKIRG

SEQ ID NO: 2003742 - protein, 18 aa, Staphylococcus
ASRIHKYIGSYAAKMHGV

SEQ ID NO: 2003743 - protein, 17 aa, Staphylococcus
ASRIHKYIGSYAARMHG

SEQ ID NO: 2003744 - protein, 24 aa, Staphylococcus
ASRLATEKHVDWLVKAVLKAKASV

SEQ ID NO: 2003745 - protein, 19 aa, Staphylococcus
ASRSIEASMLQDLRKGRAT

SEQ ID NO: 2003746 - protein, 21 aa, Staphylococcus
ASRYVAIELIKLLQDKPDAIL

SEQ ID NO: 2003747 - protein, 25 aa, Staphylococcus
ASSGRSPSIKGFRYYVDQLLENTSP

SEQ ID NO: 2003748 - protein, 24 aa, Staphylococcus
ASSHTRLMSGIFPEYAKNYPENKY

SEQ ID NO: 2003749 - protein, 25 aa, Staphylococcus
ASSIALDLFEQWKVMDVDGKWRFTS

SEQ ID NO: 2003750 - protein, 18 aa, Staphylococcus
ASSIFKDNFDKLALSQFF

SEQ ID NO: 2003751 - protein, 28 aa, Staphylococcus
ASSISQLWRKTQLQHMFLKQIMQRYITF

SEQ ID NO: 2003752 - protein, 20 aa, Staphylococcus
ASSISRPIVTNALTHGLSLV

SEQ ID NO: 2003753 - protein, 27 aa, Staphylococcus
ASSKSDMPAFWFDPLVNLAAISQVTQH

SEQ ID NO: 2003754 - protein, 24 aa, Staphylococcus
ASSLAAGCPIILKPSEITPLASII

SEQ ID NO: 2003755 - protein, 21 aa, Staphylococcus
ASSLLRGVAFIQVPTTILAHD

SEQ ID NO: 2003756 - protein, 19 aa, Staphylococcus
ASSMADLGVKVTIVEVADD

SEQ ID NO: 2003757 - protein, 18 aa, Staphylococcus
ASSQFYKQMGFQITSVLP

SEQ ID NO: 2003758 - protein, 24 aa, Staphylococcus
ASSVPILGICLGFQLIYEYYGGEI

SEQ ID NO: 2003759 - protein, 18 aa, Staphylococcus
ASVAAMFLTTEAVVATIP

SEQ ID NO: 2003760 - protein, 25 aa, Staphylococcus
ASVEIAIKMAYQYWKNKNPEKYAAK

SEQ ID NO: 2003761 - protein, 18 aa, Staphylococcus
ASVIWMSTFHSMCVKILR

SEQ ID NO: 2003762 - protein, 17 aa, Staphylococcus
ASVKSNYILKYVFANGI

SEQ ID NO: 2003763 - protein, 26 aa, Staphylococcus
ASVQFLKKEVSAFIGDKNVKSIGIAH

SEQ ID NO: 2003764 - protein, 26 aa, Staphylococcus
ASVVGGKAVECYGIVGMASRQQVRDG

SEQ ID NO: 2003765 - protein, 21 aa, Staphylococcus
ASVVIHFDTRFLSKAFSQEMA

SEQ ID NO: 2003766 - protein, 27 aa, Staphylococcus
ASYEQRLPKIVIVIDELADLMMMAPQE

SEQ ID NO: 2003767 - protein, 20 aa, Staphylococcus
ASYINEFEWHDAKFPVVQNF

SEQ ID NO: 2003768 - protein, 19 aa, Staphylococcus
ASYLECLELSLNAIIEAFK

SEQ ID NO: 2003769 - protein, 26 aa, Staphylococcus
ASYLKEFANLYALLIPKVHNMDDVKF

SEQ ID NO: 2003770 - protein, 24 aa, Staphylococcus
ASYLKEFTNLYALLIPKAPTMKEV

SEQ ID NO: 2003771 - protein, 26 aa, Staphylococcus
ASYLKEFTNLYALLIPKVHTMQDVKF

SEQ ID NO: 2003772 - protein, 25 aa, Staphylococcus
ASYLNEFANIYALLIPKMGNLNDVR

SEQ ID NO: 2003773 - protein, 20 aa, Staphylococcus
ASYQPKHQFKFIESNQQMKE

SEQ ID NO: 2003774 - protein, 20 aa, Staphylococcus
ASYQRFKIGPKETLNILQSL

SEQ ID NO: 2003775 - protein, 27 aa, Staphylococcus
ASYRLSEIKLGIDLGYLNLSNFKFNEL

SEQ ID NO: 2003776 - protein, 26 aa, Staphylococcus
ASYRLSEVKLGIDLGYLTLSDFKFNE

SEQ ID NO: 2003777 - protein, 25 aa, Staphylococcus
ASYRLSEVKLGIDLGYVQLQDFNFN

SEQ ID NO: 2003778 - protein, 24 aa, Staphylococcus
ASYVKHVPCVVVSVDYRLAPEHPY

SEQ ID NO: 2003779 - protein, 24 aa, Staphylococcus
ASYWKAYDFNSGYFMALKVYDVDP

SEQ ID NO: 2003780 - protein, 18 aa, Staphylococcus
ATAAFRAGLDVIVNTNYM

SEQ ID NO: 2003781 - protein, 23 aa, Staphylococcus
ATAEILKGIPLANFDVHSELTTP

SEQ ID NO: 2003782 - protein, 23 aa, Staphylococcus
ATAELTFGLVLAIARRIVEGDKL

SEQ ID NO: 2003783 - protein, 17 aa, Staphylococcus
ATAFPKIKFGFIHVPFV

SEQ ID NO: 2003784 - protein, 24 aa, Staphylococcus
ATAFYEAMEAFDLPSQLMTDRDTL

SEQ ID NO: 2003785 - protein, 23 aa, Staphylococcus
ATAFYETMEAFDLPKYLMTHRDQ

SEQ ID NO: 2003786 - protein, 23 aa, Staphylococcus
ATAIRIGNPASWDKATNALEESN

SEQ ID NO: 2003787 - protein, 24 aa, Staphylococcus
ATAIRIGNPASWDKAVTALDESNG

SEQ ID NO: 2003788 - protein, 24 aa, Staphylococcus
ATAIRIGNPASWEKATNALNESNG

SEQ ID NO: 2003789 - protein, 25 aa, Staphylococcus
ATAIRIGNPASWKKATVALEESNGL

SEQ ID NO: 2003790 - protein, 24 aa, Staphylococcus
ATAIRIGNPASWQKAVKALEESNG

SEQ ID NO: 2003791 - protein, 18 aa, Staphylococcus
ATAIRIGNPASWTKATNA

SEQ ID NO: 2003792 - protein, 17 aa, Staphylococcus
ATAKVSIPSPNQLFHPN

SEQ ID NO: 2003793 - protein, 18 aa, Staphylococcus
ATALSIGWHLSVVGQLYE

SEQ ID NO: 2003794 - protein, 21 aa, Staphylococcus
ATAQIPFGYGRIVRDEQRRLQ

SEQ ID NO: 2003795 - protein, 17 aa, Staphylococcus
ATAVFAINDEMAIGIMR

SEQ ID NO: 2003796 - protein, 17 aa, Staphylococcus
ATAVQWTLRDVKYLKQM

SEQ ID NO: 2003797 - protein, 19 aa, Staphylococcus
ATAYIFIKMIQQMTELGVH

SEQ ID NO: 2003798 - protein, 18 aa, Staphylococcus
ATAYIFIKMLKQVEELGV

SEQ ID NO: 2003799 - protein, 20 aa, Staphylococcus
ATAYIFIKMVQQMKELGVAN

SEQ ID NO: 2003800 - protein, 20 aa, Staphylococcus
ATAYIFIKMVQQMKELGVTN

SEQ ID NO: 2003801 - protein, 19 aa, Staphylococcus
ATAYMFIKMLKQLEALGVH

SEQ ID NO: 2003802 - protein, 18 aa, Staphylococcus
ATAYRLGDVSAETQFALD

SEQ ID NO: 2003803 - protein, 17 aa, Staphylococcus
ATAYRLGEVGPETQYAL

SEQ ID NO: 2003804 - protein, 18 aa, Staphylococcus
ATCKEMLISGVGVTILPE

SEQ ID NO: 2003805 - protein, 18 aa, Staphylococcus
ATCKEMLLNGVGVTILPE

SEQ ID NO: 2003806 - protein, 19 aa, Staphylococcus
ATCKEMLVGGVGVTVLPEI

SEQ ID NO: 2003807 - protein, 19 aa, Staphylococcus
ATCKEMLVSGVGVTILPEI

SEQ ID NO: 2003808 - protein, 27 aa, Staphylococcus
ATDDWKERLRMLKAFPTPTERDFPLLG

SEQ ID NO: 2003809 - protein, 24 aa, Staphylococcus
ATDIGKALGLPAHMSKLTRTQSGG

SEQ ID NO: 2003810 - protein, 29 aa, Staphylococcus
ATDLRMMMAALKISTDFERMGDNAASIAH

SEQ ID NO: 2003811 - protein, 24 aa, Staphylococcus
ATDMTRPILTNALTHGLSLVADMF

SEQ ID NO: 2003812 - protein, 19 aa, Staphylococcus
ATDPLAFVRWHYDKKKRII

SEQ ID NO: 2003813 - protein, 26 aa, Staphylococcus
ATEAKRKGLEPFAQWLQQTNIDTSVE

SEQ ID NO: 2003814 - protein, 28 aa, Staphylococcus
ATEAKRKGLEPFATWLLQPKLNENVESK

SEQ ID NO: 2003815 - protein, 28 aa, Staphylococcus
ATEAKRKGLEPFVDWLLLPKLDVDITTK

SEQ ID NO: 2003816 - protein, 26 aa, Staphylococcus
ATEAKRKGLEPLAKWLKQSEINEKPE

SEQ ID NO: 2003817 - protein, 18 aa, Staphylococcus
ATEARIQEELNYFDELVN

SEQ ID NO: 2003818 - protein, 20 aa, Staphylococcus
ATEFARFANAANMPIKDVDR

SEQ ID NO: 2003819 - protein, 20 aa, Staphylococcus
ATEHRLPFILFSASGGARMQ

SEQ ID NO: 2003820 - protein, 25 aa, Staphylococcus
ATEHSMAMILSMARNIPQAHQSLKD

SEQ ID NO: 2003821 - protein, 24 aa, Staphylococcus
ATEHSVAMILAMARNIPQAHASLK

SEQ ID NO: 2003822 - protein, 24 aa, Staphylococcus
ATEHSVAMLLAMARNIPNAHASLQ

SEQ ID NO: 2003823 - protein, 22 aa, Staphylococcus
ATEIDMVINIGALKDGRFEDVQ

SEQ ID NO: 2003824 - protein, 20 aa, Staphylococcus
ATEKEWRENDGLVSVISSQH

SEQ ID NO: 2003825 - protein, 23 aa, Staphylococcus
ATEKLKFGEVYANCEAEEVVNGF

SEQ ID NO: 2003826 - protein, 18 aa, Staphylococcus
ATEKMAGQTIINLDIRAQ

SEQ ID NO: 2003827 - protein, 32 aa, Staphylococcus
ATEKMKIAVLPIGYADGFLRAMQGFAVNVNQH

SEQ ID NO: 2003828 - protein, 25 aa, Staphylococcus
ATELKECIKEFTFPVIIKPMDFGGS

SEQ ID NO: 2003829 - protein, 18 aa, Staphylococcus
ATEPWFAAMVTRQQQAIE

SEQ ID NO: 2003830 - protein, 18 aa, Staphylococcus
ATEQRIEEELNYFHELVD

SEQ ID NO: 2003831 - protein, 28 aa, Staphylococcus
ATETYKFAGGKGINVSRVLKTLDVSSTA

SEQ ID NO: 2003832 - protein, 25 aa, Staphylococcus
ATEYMIKTGIKFKYVIGDVQNLPYP

SEQ ID NO: 2003833 - protein, 18 aa, Staphylococcus
ATFLPLNVIKSRQLSNNI

SEQ ID NO: 2003834 - protein, 19 aa, Staphylococcus
ATFNMKIAGDFNAYNALAA

SEQ ID NO: 2003835 - protein, 19 aa, Staphylococcus
ATFPEYRGQGIATQLMTYL

SEQ ID NO: 2003836 - protein, 24 aa, Staphylococcus
ATFVTEGKNEWAFETKDKSFVAQI

SEQ ID NO: 2003837 - protein, 17 aa, Staphylococcus
ATFWQKVIRKLIYDNEV

SEQ ID NO: 2003838 - protein, 18 aa, Staphylococcus
ATGDRAFEFPAFKVDESA

SEQ ID NO: 2003839 - protein, 22 aa, Staphylococcus
ATGGRLDHFMGVIQILLKSEYI

SEQ ID NO: 2003840 - protein, 22 aa, Staphylococcus
ATGGRLDHFMGVLQILQKPEYL

SEQ ID NO: 2003841 - protein, 22 aa, Staphylococcus
ATGGRLDHFMGVLQILQKPKYI

SEQ ID NO: 2003842 - protein, 23 aa, Staphylococcus
ATGIPKERLIKFAEEAAKAETVA

SEQ ID NO: 2003843 - protein, 18 aa, Staphylococcus
ATGIRIGFLIGPEYLIEK

SEQ ID NO: 2003844 - protein, 22 aa, Staphylococcus
ATGIRIGFLIGPEYLIEKLTFM

SEQ ID NO: 2003845 - protein, 22 aa, Staphylococcus
ATGIRIGFLLGPAYLIEKLTFM

SEQ ID NO: 2003846 - protein, 18 aa, Staphylococcus
ATGIRIGFLLGPEYLIEK

SEQ ID NO: 2003847 - protein, 27 aa, Staphylococcus
ATGMRPIAELMFNDFIGFGLDPILNQG

SEQ ID NO: 2003848 - protein, 18 aa, Staphylococcus
ATGSFEWENSFDNGYWTY

SEQ ID NO: 2003849 - protein, 20 aa, Staphylococcus
ATGVSLGGLFTLRLAEQFDL

SEQ ID NO: 2003850 - protein, 17 aa, Staphylococcus
ATHAIKTKDGYKLNGVK

SEQ ID NO: 2003851 - protein, 22 aa, Staphylococcus
ATHFLLDLVSYILLGDPYMHKL

SEQ ID NO: 2003852 - protein, 19 aa, Staphylococcus
ATHKDGVLHPIEIIESMQK

SEQ ID NO: 2003853 - protein, 18 aa, Staphylococcus
ATHKDGVMHPVEIIESMQ

SEQ ID NO: 2003854 - protein, 18 aa, Staphylococcus
ATHTPVWFMRQAGRSQPE

SEQ ID NO: 2003855 - protein, 34 aa, Staphylococcus
ATIEAIDIAMEFRKEFHKDFVIDLVGYRRYGHNE

SEQ ID NO: 2003856 - protein, 35 aa, Staphylococcus
ATIEAIDIAMEFRKEFHKDVVIDLVGYRRYGHNEM

SEQ ID NO: 2003857 - protein, 23 aa, Staphylococcus
ATIEAIEIAMAFRKEFNKDVVID

SEQ ID NO: 2003858 - protein, 17 aa, Staphylococcus
ATIEGFTVRLLNKYNTE

SEQ ID NO: 2003859 - protein, 20 aa, Staphylococcus
ATIFLMNAVYDFDIVRHNRI

SEQ ID NO: 2003860 - protein, 20 aa, Staphylococcus
ATIFLMNAVYDFETVRENEI

SEQ ID NO: 2003861 - protein, 22 aa, Staphylococcus
ATIFLMNAVYEFDKIRENQIQM

SEQ ID NO: 2003862 - protein, 18 aa, Staphylococcus
ATIGDIYGSPLITINDKN

SEQ ID NO: 2003863 - protein, 17 aa, Staphylococcus
ATIIFNGIGYIKHGGSK

SEQ ID NO: 2003864 - protein, 25 aa, Staphylococcus
ATIIRLAIDGLWLSEIFGLDAIDEK

SEQ ID NO: 2003865 - protein, 23 aa, Staphylococcus
ATIIRLAVDGLWLSEIFGLDGLD

SEQ ID NO: 2003866 - protein, 35 aa, Staphylococcus
ATILYKMYKERGFEIKPEIAGLMISAIISDSLLFK

SEQ ID NO: 2003867 - protein, 34 aa, Staphylococcus; identical to SEQ ID NO: 1802796

SEQ ID NO: 2003868 - protein, 34 aa, Staphylococcus
ATILYKMYKERGFEIKREIAGLMVSAIISDSLLF

SEQ ID NO: 2003869 - protein, 18 aa, Staphylococcus
ATIRRDFSYFGELGKKGY

SEQ ID NO: 2003870 - protein, 20 aa, Staphylococcus
ATIVAFKGSQDLNLLKTKSV

SEQ ID NO: 2003871 - protein, 26 aa, Staphylococcus
ATIYRRWKDKASIIIDMFVTHTRDIT

SEQ ID NO: 2003872 - protein, 26 aa, Staphylococcus
ATIYRRWKDKESMIVDMFVDQSRIIE

SEQ ID NO: 2003873 - protein, 27 aa, Staphylococcus
ATIYRRWKDKSSIIVDMFVSRIHVFEN

SEQ ID NO: 2003874 - protein, 28 aa, Staphylococcus
ATIYRRWKDKSSIIVDMFVSRTQIFENE

SEQ ID NO: 2003875 - protein, 22 aa, Staphylococcus
ATKEGYTILVLDDSALINTTQS

SEQ ID NO: 2003876 - protein, 23 aa, Staphylococcus
ATKEIKDDMLVTVDAANGKVFEG

SEQ ID NO: 2003877 - protein, 23 aa, Staphylococcus
ATKEIKNDMLVTVDAAQGKIFEG

SEQ ID NO: 2003878 - protein, 23 aa, Staphylococcus
ATKELKDGILVTVDAAQGKIFEG

SEQ ID NO: 2003879 - protein, 17 aa, Staphylococcus
ATKELKISGGDVGGSKN

SEQ ID NO: 2003880 - protein, 23 aa, Staphylococcus
ATKELKNDLLVTVDANQGRIFEG

SEQ ID NO: 2003881 - protein, 23 aa, Staphylococcus
ATKGAYEILEWAYRTYGDSIVYS

SEQ ID NO: 2003882 - protein, 24 aa, Staphylococcus
ATKGAYEILKWAYTTYGEDIVYSC

SEQ ID NO: 2003883 - protein, 20 aa, Staphylococcus
ATKQAESWYKDASEKELESL

SEQ ID NO: 2003884 - protein, 26 aa, Staphylococcus
ATKVACLNKHLHFHGSTEEFKSLDEV

SEQ ID NO: 2003885 - protein, 23 aa, Staphylococcus
ATLAAKQGLSFVIANMGQNKNQI

SEQ ID NO: 2003886 - protein, 24 aa, Staphylococcus
ATLAETLHSIFLEVVIAPLFTKEA

SEQ ID NO: 2003887 - protein, 18 aa, Staphylococcus
ATLARKVASIYSIYNQTD

SEQ ID NO: 2003888 - protein, 20 aa, Staphylococcus
ATLAVRKGAKFISTNPDVSI

SEQ ID NO: 2003889 - protein, 25 aa, Staphylococcus
ATLEAERALACNYDMIIAAGGDGTL

SEQ ID NO: 2003890 - protein, 22 aa, Staphylococcus
ATLEAITFPELVGIQDMGAAGL

SEQ ID NO: 2003891 - protein, 26 aa, Staphylococcus
ATLFGIKYPQEVLGFVSCGGLSPTGQ

SEQ ID NO: 2003892 - protein, 17 aa, Staphylococcus
ATLIAKRINSHYNRVLE

SEQ ID NO: 2003893 - protein, 20 aa, Staphylococcus
ATLILQRYFEGEAMNQLIAK

SEQ ID NO: 2003894 - protein, 18 aa, Staphylococcus
ATLLRGVDFIQVPTTILA

SEQ ID NO: 2003895 - protein, 29 aa, Staphylococcus
ATLNVPVDYYVRVDMDAFVQAVDELGGIY

SEQ ID NO: 2003896 - protein, 17 aa, Staphylococcus
ATLPELFIQCGTEDFLY

SEQ ID NO: 2003897 - protein, 19 aa, Staphylococcus
ATLSFRTMALLNRPYHIKL

SEQ ID NO: 2003898 - protein, 19 aa, Staphylococcus
ATLSPLDCYLLQRGLKTLH

SEQ ID NO: 2003899 - protein, 25 aa, Staphylococcus
ATLYPNRIDLGLGRAPGTDMMTASA

SEQ ID NO: 2003900 - protein, 17 aa, Staphylococcus
ATMLEKAKNDEHFDKIE

SEQ ID NO: 2003901 - protein, 18 aa, Staphylococcus
ATMNLYDIIDEFRSLGGY

SEQ ID NO: 2003902 - protein, 24 aa, Staphylococcus
ATNAHLGLAIGVLSGIATREELTN

SEQ ID NO: 2003903 - protein, 19 aa, Staphylococcus
ATNEAWYYIESSLQLTLPY

SEQ ID NO: 2003904 - protein, 24 aa, Staphylococcus
ATNYPSVRPYPGAKPMIKVDVNIT

SEQ ID NO: 2003905 - protein, 19 aa, Staphylococcus
ATPAFTLNKVCGSGLKAIQ

SEQ ID NO: 2003906 - protein, 18 aa, Staphylococcus
ATPAGIKLSVLPIEKAAT

SEQ ID NO: 2003907 - protein, 25 aa, Staphylococcus
ATPIKLGQEISGWRYMLDKCEELLA

SEQ ID NO: 2003908 - protein, 32 aa, Staphylococcus; identical to SEQ ID NO: 1802804

SEQ ID NO: 2003909 - protein, 23 aa, Staphylococcus
ATPLPKLFSDILIYSAERNVMSV

SEQ ID NO: 2003910 - protein, 19 aa, Staphylococcus
ATPMISYLNAQPVGIVDII

SEQ ID NO: 2003911 - protein, 22 aa, Staphylococcus
ATPSARRHARANGVDLSEVAGK

SEQ ID NO: 2003912 - protein, 17 aa, Staphylococcus
ATPYDHRADLVIHDDMT

SEQ ID NO: 2003913 - protein, 24 aa, Staphylococcus
ATPYRLGDINPETKFALDHFEVKA

SEQ ID NO: 2003914 - protein, 20 aa, Staphylococcus
ATPYRLGEVSAETKYALDHF

SEQ ID NO: 2003915 - protein, 39 aa, Staphylococcus
ATQIICYDLRFPELLRYPARNGAQIAFFVAQWPTPRLNH

SEQ ID NO: 2003916 - protein, 18 aa, Staphylococcus
ATQIPVIIVDPFLSLAAR

SEQ ID NO: 2003917 - protein, 20 aa, Staphylococcus
ATQLLFQFLFSQGRLNDARA

SEQ ID NO: 2003918 - protein, 18 aa, Staphylococcus
ATQLQQWLSQLIQNVNET

SEQ ID NO: 2003919 - protein, 22 aa, Staphylococcus
ATRILTERGVLIIPDVLASAGG

SEQ ID NO: 2003920 - protein, 22 aa, Staphylococcus
ATRMGIPIVSHLGLTPQSVGVM

SEQ ID NO: 2003921 - protein, 17 aa, Staphylococcus
ATRSMLVMACYQMFHVL

SEQ ID NO: 2003922 - protein, 25 aa, Staphylococcus
ATRTELPFLLKCVQTAVDVGASIIN

SEQ ID NO: 2003923 - protein, 27 aa, Staphylococcus
ATRTHHFDIQKALAIIEPVPLFNKTKQ

SEQ ID NO: 2003924 - protein, 17 aa, Staphylococcus
ATRYPDIKFGFIHVPFI

SEQ ID NO: 2003925 - protein, 18 aa, Staphylococcus
ATSLITLKIAELLRASTI

SEQ ID NO: 2003926 - protein, 21 aa, Staphylococcus
ATSRKGGPGWVRANRSSLWDR

SEQ ID NO: 2003927 - protein, 27 aa, Staphylococcus
ATTEFDWKHHRAMHDYTAYMLSEVLKG

SEQ ID NO: 2003928 - protein, 24 aa, Staphylococcus
ATTEIPRLINAAIQERRPVHLHLP

SEQ ID NO: 2003929 - protein, 18 aa, Staphylococcus
ATTFKVDELHPIATAAIR

SEQ ID NO: 2003930 - protein, 23 aa, Staphylococcus
ATTLGEQGVKVVLAGRNTDKLNA

SEQ ID NO: 2003931 - protein, 17 aa, Staphylococcus
ATTSFNFDTLSERLQES

SEQ ID NO: 2003932 - protein, 18 aa, Staphylococcus
ATTYAGLHAVWSHLVAHK

SEQ ID NO: 2003933 - protein, 28 aa, Staphylococcus
ATVDSMLFRGVHYEICCIDRKGYELVIQ

SEQ ID NO: 2003934 - protein, 28 aa, Staphylococcus
ATVDSMLFRGVHYEICCIDRKGYEWVIQ

SEQ ID NO: 2003935 - protein, 23 aa, Staphylococcus
ATVKRFFKEKAHYRLQPENSSMD

SEQ ID NO: 2003936 - protein, 17 aa, Staphylococcus
ATVRFLVGGTQTNQVVI

SEQ ID NO: 2003937 - protein, 23 aa, Staphylococcus
ATYERPRFMRHVTKRKANEVGTL

SEQ ID NO: 2003938 - protein, 21 aa, Staphylococcus
ATYGSFRDWPAYLYSIEHSIY

SEQ ID NO: 2003939 - protein, 26 aa, Staphylococcus
ATYQCIDDVKGIYAFTLQNISPQIER

SEQ ID NO: 2003940 - protein, 21 aa, Staphylococcus
ATYTWRYFKNDVIKTLQYAFG

SEQ ID NO: 2003941 - protein, 24 aa, Staphylococcus
AVAAARLGDDVYMVGRIGDDDFGN

SEQ ID NO: 2003942 - protein, 25 aa, Staphylococcus
AVAAARLGDHVHMVGCIGDDMLGKQ

SEQ ID NO: 2003943 - protein, 24 aa, Staphylococcus
AVAEGLKAYPLLNSSWQDSEIVMH

SEQ ID NO: 2003944 - protein, 17 aa, Staphylococcus
AVAIISFELLEGARDGK

SEQ ID NO: 2003945 - protein, 23 aa, Staphylococcus
AVAKRMERASVLAQVDIHRAATH

SEQ ID NO: 2003946 - protein, 25 aa, Staphylococcus
AVALEHLQHILSIPVIGVIEPGART

SEQ ID NO: 2003947 - protein, 19 aa, Staphylococcus
AVALGLKGDTCIAGGGSDG

SEQ ID NO: 2003948 - protein, 19 aa, Staphylococcus
AVAVEPNDGFTLLDGTALE

SEQ ID NO: 2003949 - protein, 18 aa, Staphylococcus
AVAWNFNQASAFKNKLNQ

SEQ ID NO: 2003950 - protein, 25 aa, Staphylococcus
AVAYTADVYDFWRPTGYKYPLVAGA

SEQ ID NO: 2003951 - protein, 17 aa, Staphylococcus
AVCGEIFTSPTPDKILE

SEQ ID NO: 2003952 - protein, 29 aa, Staphylococcus
AVDEMEKRYKLFAQFHVRNITAFNKKAPY

SEQ ID NO: 2003953 - protein, 19 aa, Staphylococcus
AVDIKDMFIDIGARSREDV

SEQ ID NO: 2003954 - protein, 17 aa, Staphylococcus
AVDLKVVLEYGESAPKI

SEQ ID NO: 2003955 - protein, 18 aa, Staphylococcus
AVDLKVVLEYGESAPKIF

SEQ ID NO: 2003956 - protein, 19 aa, Staphylococcus
AVDRACYLLEHYASGEVLE

SEQ ID NO: 2003957 - protein, 24 aa, Staphylococcus
AVDRELPYHLAIKKLKQLDEDFGV

SEQ ID NO: 2003958 - protein, 24 aa, Staphylococcus
AVDRELPYHLAIKNLKQLDEDFGV

SEQ ID NO: 2003959 - protein, 19 aa, Staphylococcus
AVDRKDWINMWRTLESQAR

SEQ ID NO: 2003960 - protein, 19 aa, Staphylococcus
AVDTLKHVDLIACEDTRVT

SEQ ID NO: 2003961 - protein, 28 aa, Staphylococcus
AVDVPYYFMAYSWWGNILNITRDYYKVG

SEQ ID NO: 2003962 - protein, 27 aa, Staphylococcus
AVDYIFCKAYGKIAINIAKYTKKGSLV

SEQ ID NO: 2003963 - protein, 20 aa, Staphylococcus
AVEELRKGNSVIVVDNEDRE

SEQ ID NO: 2003964 - protein, 29 aa, Staphylococcus
AVEEMERRYKVFAKYHVRNITAFNKKATY

SEQ ID NO: 2003965 - protein, 23 aa, Staphylococcus
AVEIKNKIGFVYSETYFNDKWTI

SEQ ID NO: 2003966 - protein, 19 aa, Staphylococcus
AVEKGLKVPEFVKTSLAPG

SEQ ID NO: 2003967 - protein, 19 aa, Staphylococcus
AVESGKCVFEAAAGNKKFK

SEQ ID NO: 2003968 - protein, 25 aa, Staphylococcus
AVETAIKMARKWGADIKNIDESSSE

SEQ ID NO: 2003969 - protein, 25 aa, Staphylococcus
AVETALKAARRWAYDVKGIEPNKAE

SEQ ID NO: 2003970 - protein, 26 aa, Staphylococcus
AVETALKAARRWAYDVKGLEPDKAEI

SEQ ID NO: 2003971 - protein, 25 aa, Staphylococcus
AVETALKAARRWAYDVKNIQPDKAE

SEQ ID NO: 2003972 - protein, 27 aa, Staphylococcus
AVETAVKAARRWAYEHKDIEPDKAEII

SEQ ID NO: 2003973 - protein, 18 aa, Staphylococcus
AVEYWKEEGLDRVVLARE

SEQ ID NO: 2003974 - protein, 18 aa, Staphylococcus
AVEYWKEEGLNRVVLARE

SEQ ID NO: 2003975 - protein, 17 aa, Staphylococcus
AVFAKLKSFGIKQIAQR

SEQ ID NO: 2003976 - protein, 20 aa, Staphylococcus
AVFEEIRDQLLLIGGLSKSH

SEQ ID NO: 2003977 - protein, 24 aa, Staphylococcus
AVGDVKGGLQFTYISLDDFRILKS

SEQ ID NO: 2003978 - protein, 20 aa, Staphylococcus
AVGGAYRPTVTKVIDGLTAD

SEQ ID NO: 2003979 - protein, 19 aa, Staphylococcus
AVGIPSISLDLMYHLPKQT

SEQ ID NO: 2003980 - protein, 18 aa, Staphylococcus
AVGKRLNLTYQTIFNNLK

SEQ ID NO: 2003981 - protein, 25 aa, Staphylococcus
AVGLLFRSGDDYIWKTHSFARKEFL

SEQ ID NO: 2003982 - protein, 19 aa, Staphylococcus
AVGMSRPFLEQVENNGITQ

SEQ ID NO: 2003983 - protein, 20 aa, Staphylococcus
AVGMSRPFLNQVENYGITET

SEQ ID NO: 2003984 - protein, 19 aa, Staphylococcus
AVGPPGKIIKASIIKENDI

SEQ ID NO: 2003985 - protein, 19 aa, Staphylococcus
AVGQFKFVLNENVTTQLGF

SEQ ID NO: 2003986 - protein, 22 aa, Staphylococcus
AVGRIIVEKGVMASRARVAAKK

SEQ ID NO: 2003987 - protein, 20 aa, Staphylococcus
AVGYYLRYALSYRDMSEILR

SEQ ID NO: 2003988 - protein, 17 aa, Staphylococcus
AVHGLKYWFNYTSKDLV

SEQ ID NO: 2003989 - protein, 19 aa, Staphylococcus
AVHGLKYWFNYTSKDLVSF

SEQ ID NO: 2003990 - protein, 18 aa, Staphylococcus
AVHSFKLATSSVRDDTQI

SEQ ID NO: 2003991 - protein, 33 aa, Staphylococcus
AVIAAKAFVASAIKNGWKMNDFVGPVDHGAYNR

SEQ ID NO: 2003992 - protein, 33 aa, Staphylococcus
AVIAAKAFVASAIKNGWKMNEFVGPVDHGAYHR

SEQ ID NO: 2003993 - protein, 25 aa, Staphylococcus
AVIYRGKDLYNYRSFNQVEYKEVVD

SEQ ID NO: 2003994 - protein, 24 aa, Staphylococcus
AVKEGNLLFGDKVAVFGAGPIGLL

SEQ ID NO: 2003995 - protein, 24 aa, Staphylococcus
AVKEVDLTLPLVVRLEGTNVELGK

SEQ ID NO: 2003996 - protein, 25 aa, Staphylococcus
AVKEVELTLPLVVRLEGTNVKRGKE

SEQ ID NO: 2003997 - protein, 24 aa, Staphylococcus
AVKHPEYTDGLVLVNPTTVQKELP

SEQ ID NO: 2003998 - protein, 20 aa, Staphylococcus
AVKHVLKNNVQFNKEIEQNI

SEQ ID NO: 2003999 - protein, 21 aa, Staphylococcus
AVKLAYQLKGHEHFYLITDAM

SEQ ID NO: 2004000 - protein, 17 aa, Staphylococcus
AVKMGWEALLPPRTPEC

SEQ ID NO: 2004001 - protein, 25 aa, Staphylococcus
AVKRLEKKVAAGMNYFITQPVYSKE

SEQ ID NO: 2004002 - protein, 27 aa, Staphylococcus
AVKRLEKKVAAGMSYFITQPVYSKEKI

SEQ ID NO: 2004003 - protein, 22 aa, Staphylococcus
AVKWFKDEFELPQSDKAIKFFV

SEQ ID NO: 2004004 - protein, 23 aa, Staphylococcus
AVKYFYEYLKSVKVNKVAVIGEK

SEQ ID NO: 2004005 - protein, 23 aa, Staphylococcus
AVLAETYPAVFIVELDQDKHNFE

SEQ ID NO: 2004006 - protein, 24 aa, Staphylococcus
AVLDAFRILDSVSIPKGAVRPSED

SEQ ID NO: 2004007 - protein, 17 aa, Staphylococcus
AVLGIYPHTVFELAKRI

SEQ ID NO: 2004008 - protein, 23 aa, Staphylococcus
AVLKWVAHFIKYFGGDPDNVTLW

SEQ ID NO: 2004009 - protein, 18 aa, Staphylococcus
AVLLSKFANYEEFLEKKV

SEQ ID NO: 2004010 - protein, 26 aa, Staphylococcus
AVLNDRPESLFNYFKQLFAQVTNPPI

SEQ ID NO: 2004011 - protein, 19 aa, Staphylococcus
AVLNLDYRGQFSSTPIPSQ

SEQ ID NO: 2004012 - protein, 27 aa, Staphylococcus
AVLTEPLKRFGIPKTLHASRVDNVLSQ

SEQ ID NO: 2004013 - protein, 18 aa, Staphylococcus
AVLYDLDFLTTLPYSEVL

SEQ ID NO: 2004014 - protein, 25 aa, Staphylococcus
AVMPDIKEGLLIAPVMDARREAVYT

SEQ ID NO: 2004015 - protein, 18 aa, Staphylococcus
AVNEAWHYIETRLQLTLP

SEQ ID NO: 2004016 - protein, 24 aa, Staphylococcus
AVNGAKFNGIIPISQLSTHHIDNP

SEQ ID NO: 2004017 - protein, 20 aa, Staphylococcus
AVNLHWPGNVNVREIFSEFI

SEQ ID NO: 2004018 - protein, 22 aa, Staphylococcus
AVNLHWPGSVNVRQIFSEFINC

SEQ ID NO: 2004019 - protein, 18 aa, Staphylococcus
AVNLHWTGNVNVREIFQK

SEQ ID NO: 2004020 - protein, 19 aa, Staphylococcus
AVNLNWPGDVNIREILSQF

SEQ ID NO: 2004021 - protein, 23 aa, Staphylococcus
AVNYDLPYHLAIKNLKQLDEDFG

SEQ ID NO: 2004022 - protein, 17 aa, Staphylococcus
AVPADKVANAFVKSVEG

SEQ ID NO: 2004023 - protein, 26 aa, Staphylococcus
AVPIVDRLSLEMIKQLIRIHRAKNIL

SEQ ID NO: 2004024 - protein, 18 aa, Staphylococcus
AVPKEVREARNITFGLFR

SEQ ID NO: 2004025 - protein, 18 aa, Staphylococcus
AVPKPLWSRKLEPNDKNQ

SEQ ID NO: 2004026 - protein, 24 aa, Staphylococcus
AVPKVKEALNLKSEDKLWHLIRYR

SEQ ID NO: 2004027 - protein, 18 aa, Staphylococcus
AVPSDLAAEISDKLDIPV

SEQ ID NO: 2004028 - protein, 17 aa, Staphylococcus
AVQEGYETLAITDTNVL

SEQ ID NO: 2004029 - protein, 20 aa, Staphylococcus
AVQLLFQYLFAQGRLQEART

SEQ ID NO: 2004030 - protein, 17 aa, Staphylococcus
AVQPRHYEWKSRVDYQG

SEQ ID NO: 2004031 - protein, 17 aa, Staphylococcus
AVQYDLPMTVFVLNNKQ

SEQ ID NO: 2004032 - protein, 18 aa, Staphylococcus
AVQYDLPMTVFVLNNKQL

SEQ ID NO: 2004033 - protein, 19 aa, Staphylococcus
AVQYNMPMVIFVMNNKELA

SEQ ID NO: 2004034 - protein, 20 aa, Staphylococcus
AVRDVIFAVGRVELRDAIPV

SEQ ID NO: 2004035 - protein, 19 aa, Staphylococcus
AVRIIRAAHDLGIQTVAIY

SEQ ID NO: 2004036 - protein, 20 aa, Staphylococcus
AVRLVKEEKKALVKDEAIAK

SEQ ID NO: 2004037 - protein, 22 aa, Staphylococcus
AVRTAFDYNLLILGYKETAHHL

SEQ ID NO: 2004038 - protein, 18 aa, Staphylococcus
AVRTFLEAGIHTFSTTSL

SEQ ID NO: 2004039 - protein, 17 aa, Staphylococcus
AVRVGISLYGYYPSAYV

SEQ ID NO: 2004040 - protein, 26 aa, Staphylococcus
AVSAKRLKIPVFHMEAGNRCFDQNVP

SEQ ID NO: 2004041 - protein, 27 aa, Staphylococcus
AVSAKRLKIPVFHMEAGNRCFDQNVPE

SEQ ID NO: 2004042 - protein, 18 aa, Staphylococcus
AVSFLKEKGFTVATIKHH

SEQ ID NO: 2004043 - protein, 23 aa, Staphylococcus
AVSIDTSPAFTFKEEHLSGSTYS

SEQ ID NO: 2004044 - protein, 17 aa, Staphylococcus
AVSLPLTGITAYETLFD

SEQ ID NO: 2004045 - protein, 24 aa, Staphylococcus
AVSLSRFQWLSANIEFALTKEPYF

SEQ ID NO: 2004046 - protein, 21 aa, Staphylococcus
AVSNGRAEIMIGRGSFIESFP

SEQ ID NO: 2004047 - protein, 22 aa, Staphylococcus
AVSRLVGAPPGYIGHDDGGQLT

SEQ ID NO: 2004048 - protein, 22 aa, Staphylococcus
AVSRLVGAPPGYVGHDEGGQLT

SEQ ID NO: 2004049 - protein, 21 aa, Staphylococcus
AVSSSDWKVGDKVMHKSWGEG

SEQ ID NO: 2004050 - protein, 27 aa, Staphylococcus
AVTGMSIPEGITLIVGGGYHGKSTLLE

SEQ ID NO: 2004051 - protein, 26 aa, Staphylococcus
AVTGYRPVMEIQFLGFVFEVFDEVAG

SEQ ID NO: 2004052 - protein, 20 aa, Staphylococcus
AVTHSHGWGYAHMKMAPEHW

SEQ ID NO: 2004053 - protein, 20 aa, Staphylococcus
AVTHTHGWGYAHLQMAPKHW

SEQ ID NO: 2004054 - protein, 21 aa, Staphylococcus
AVTPLKWKDTFIAHNHFISCA

SEQ ID NO: 2004055 - protein, 27 aa, Staphylococcus
AVTSLYRPGPMEEIPTYISRRHHPEKV

SEQ ID NO: 2004056 - protein, 27 aa, Staphylococcus
AVTSLYRPGPMEEIPTYISRRHNESEI

SEQ ID NO: 2004057 - protein, 26 aa, Staphylococcus
AVTSLYRPGPMEEIPTYITRRHDPSK

SEQ ID NO: 2004058 - protein, 26 aa, Staphylococcus
AVTSLYRPGPMEEIPTYITRRHEPSK

SEQ ID NO: 2004059 - protein, 25 aa, Staphylococcus
AVTSLYRPGPMEEIPTYITRRQDPS

SEQ ID NO: 2004060 - protein, 33 aa, Staphylococcus
AVTSLYRPGPMQEIPTYISRRHRQSDIKYLHPD

SEQ ID NO: 2004061 - protein, 22 aa, Staphylococcus
AVTTPEVFDLIASTTPLHQVTS

SEQ ID NO: 2004062 - protein, 20 aa, Staphylococcus
AVTVIEWSQFISDLLPYQHL

SEQ ID NO: 2004063 - protein, 18 aa, Staphylococcus
AVVARGMGKCCVTGCSDV

SEQ ID NO: 2004064 - protein, 18 aa, Staphylococcus
AVVARGMGKCCVTGCSNL

SEQ ID NO: 2004065 - protein, 32 aa, Staphylococcus
AVVAWNFPFLLSSWKLAPALAAGNTVVIQPSS

SEQ ID NO: 2004066 - protein, 27 aa, Staphylococcus
AVVAWNFPMLLATWKVAPALAAGDTVV

SEQ ID NO: 2004067 - protein, 18 aa, Staphylococcus
AVVDACLTPILAPFTSIK

SEQ ID NO: 2004068 - protein, 18 aa, Staphylococcus
AVVDACLTPVLAPITTIR

SEQ ID NO: 2004069 - protein, 18 aa, Staphylococcus
AVVDACLTPVLSPIVRID

SEQ ID NO: 2004070 - protein, 17 aa, Staphylococcus
AVVGFEYGYNVENKGSF

SEQ ID NO: 2004071 - protein, 17 aa, Staphylococcus
AVVGFEYGYNVENKGTM

SEQ ID NO: 2004072 - protein, 24 aa, Staphylococcus
AVVLPHGVLFRGAAEGVIREYLIK

SEQ ID NO: 2004073 - protein, 24 aa, Staphylococcus
AVVLPHGVLFRGAAEGVIRKYLIE

SEQ ID NO: 2004074 - protein, 32 aa, Staphylococcus
AVVNSNFKGVNWSTRLWQDMALVQKEVETTTS

SEQ ID NO: 2004075 - protein, 21 aa, Staphylococcus
AVVRTGFSMILNFQDDMEVVD

SEQ ID NO: 2004076 - protein, 18 aa, Staphylococcus
AVVTRYFGGIKLGTGGLI

SEQ ID NO: 2004077 - protein, 19 aa, Staphylococcus
AVVYDLDFLQTLPYEEVLS

SEQ ID NO: 2004078 - protein, 18 aa, Staphylococcus
AVVYQIYPRSFKDSNNDG

SEQ ID NO: 2004079 - protein, 17 aa, Staphylococcus
AVYDFDSSLILVGLSNT

SEQ ID NO: 2004080 - protein, 23 aa, Staphylococcus
AVYLPGGHGAVFDFAHNQQLADI

SEQ ID NO: 2004081 - protein, 22 aa, Staphylococcus
AVYQLRMAHQIKPVYKMVDTCA

SEQ ID NO: 2004082 - protein, 20 aa, Staphylococcus
AWASVCKPPINQSEVNNTFK

SEQ ID NO: 2004083 - protein, 26 aa, Staphylococcus
AWDDADRPLALCAALLHDLGHGPFSH

SEQ ID NO: 2004084 - protein, 18 aa, Staphylococcus
AWHPTQMLADYMTVKENF

SEQ ID NO: 2004085 - protein, 27 aa, Staphylococcus
AWIVAGRGELHLSILIENMRREGFELQ

SEQ ID NO: 2004086 - protein, 18 aa, Staphylococcus
AWKLYCVLNGINKNNYGK

SEQ ID NO: 2004087 - protein, 18 aa, Staphylococcus
AWLDEEIVADTWIDAYQV

SEQ ID NO: 2004088 - protein, 18 aa, Staphylococcus
AWLEVEILACEAWSELGH

SEQ ID NO: 2004089 - protein, 18 aa, Staphylococcus
AWLEVEILACEAWSKLGD

SEQ ID NO: 2004090 - protein, 18 aa, Staphylococcus
AWLEVEILACEAWSKLGF

SEQ ID NO: 2004091 - protein, 21 aa, Staphylococcus
AWPKVNEALVFDDSKETMQQL

SEQ ID NO: 2004092 - protein, 19 aa, Staphylococcus
AWRDVRYLYDYSTAELESL

SEQ ID NO: 2004093 - protein, 21 aa, Staphylococcus
AWTSDVKYHLGGIKTTDTYGT

SEQ ID NO: 2004094 - protein, 27 aa, Staphylococcus
AWVSTPSFMEMCLLLPNLNESSYPSLN

SEQ ID NO: 2004095 - protein, 21 aa, Staphylococcus
AWYYIETSLQMTLPYEHNSLY

SEQ ID NO: 2004096 - protein, 17 aa, Staphylococcus
AYADRNGIWEAIDESCI

SEQ ID NO: 2004097 - protein, 17 aa, Staphylococcus
AYADRNGIWEAISEDRI

SEQ ID NO: 2004098 - protein, 19 aa, Staphylococcus
AYAETGGTPWLDQKHTVFG

SEQ ID NO: 2004099 - protein, 20 aa, Staphylococcus
AYAFIKRLIKQFGKPQMIIT

SEQ ID NO: 2004100 - protein, 17 aa, Staphylococcus
AYALFRKLIESYPEYKC

SEQ ID NO: 2004101 - protein, 22 aa, Staphylococcus
AYARVYLNKMMNWFDEDLIYTD

SEQ ID NO: 2004102 - protein, 19 aa, Staphylococcus
AYASSRLSKHWNNHNMAWS

SEQ ID NO: 2004103 - protein, 22 aa, Staphylococcus
AYCDSLPLVVFTGQVASPGIGQ

SEQ ID NO: 2004104 - protein, 18 aa, Staphylococcus
AYDAGLRHFGENRVEGFL

SEQ ID NO: 2004105 - protein, 26 aa, Staphylococcus
AYDDVEFKLYLGLKHISPYIEEAVES

SEQ ID NO: 2004106 - protein, 26 aa, Staphylococcus
AYDIKEQPDFISVFLGTNDWGLVGDK

SEQ ID NO: 2004107 - protein, 19 aa, Staphylococcus
AYDILKWAYDTYGESIVYA

SEQ ID NO: 2004108 - protein, 23 aa, Staphylococcus
AYDMVSLFKGLIREIAKDETPKI

SEQ ID NO: 2004109 - protein, 18 aa, Staphylococcus
AYEAIVRMEKRYKGPIAF

SEQ ID NO: 2004110 - protein, 24 aa, Staphylococcus
AYEDFKASELFNDNFSKVALSQFF

SEQ ID NO: 2004111 - protein, 24 aa, Staphylococcus
AYEDLCAFREIIMNYSLSEIKAIY

SEQ ID NO: 2004112 - protein, 23 aa, Staphylococcus
AYEKKGVAVVICPNDLLNDKIKD

SEQ ID NO: 2004113 - protein, 24 aa, Staphylococcus
AYEKKGVAVVICPNDLLTQKIKDT

SEQ ID NO: 2004114 - protein, 25 aa, Staphylococcus
AYEKKGVAVVICPNDLLTQPIKDTT

SEQ ID NO: 2004115 - protein, 26 aa, Staphylococcus
AYEKMDWFRKGFDNMGKLVKQVGDSM

SEQ ID NO: 2004116 - protein, 19 aa, Staphylococcus
AYELIKVRQPQVAILDIEM

SEQ ID NO: 2004117 - protein, 23 aa, Staphylococcus
AYENIKIVGLMTMAPFTDDTQYI

SEQ ID NO: 2004118 - protein, 21 aa, Staphylococcus
AYENIKVIGLMTMAPLTDDSV

SEQ ID NO: 2004119 - protein, 26 aa, Staphylococcus
AYENPRFVEDLIRLIAADLVDFDWID

SEQ ID NO: 2004120 - protein, 26 aa, Staphylococcus
AYENPRFVEDLIRLIAADLVDFEWID

SEQ ID NO: 2004121 - protein, 36 aa, Staphylococcus; identical to SEQ ID NO: 1794396

SEQ ID NO: 2004122 - protein, 18 aa, Staphylococcus
AYEPGLSPEALKKEYGIE

SEQ ID NO: 2004123 - protein, 17 aa, Staphylococcus
AYESLICDALIGNQTNF

SEQ ID NO: 2004124 - protein, 20 aa, Staphylococcus
AYFGIRFFYEGDKLDLYLSK

SEQ ID NO: 2004125 - protein, 17 aa, Staphylococcus
AYFKGMFNENCPHFDEI

SEQ ID NO: 2004126 - protein, 18 aa, Staphylococcus
AYFKGMFNETCPRFDEIF

SEQ ID NO: 2004127 - protein, 19 aa, Staphylococcus
AYFQLDIMTYFYKIVKWLM

SEQ ID NO: 2004128 - protein, 28 aa, Staphylococcus
AYGEKGGTPWLDQKHTVFGQIIEGEDTL

SEQ ID NO: 2004129 - protein, 28 aa, Staphylococcus
AYGEKGGTPWLDQKHTVFGQLIDGESTL

SEQ ID NO: 2004130 - protein, 17 aa, Staphylococcus
AYGHAKSLLFSQLGEDL

SEQ ID NO: 2004131 - protein, 19 aa, Staphylococcus
AYGIHTCIDTSAGCANDTI

SEQ ID NO: 2004132 - protein, 20 aa, Staphylococcus
AYGKVFSFGPTFRAEKSKTR

SEQ ID NO: 2004133 - protein, 19 aa, Staphylococcus
AYGLVLWSSLGREIGVETP

SEQ ID NO: 2004134 - protein, 21 aa, Staphylococcus
AYGMAKWAKANWDIHTKADLD

SEQ ID NO: 2004135 - protein, 18 aa, Staphylococcus
AYGTILYFEDEDVIKGLQ

SEQ ID NO: 2004136 - protein, 20 aa, Staphylococcus
AYHAPWELGTNIINDQFNLK

SEQ ID NO: 2004137 - protein, 20 aa, Staphylococcus
AYHFKSICVNPTHVKYASEQ

SEQ ID NO: 2004138 - protein, 29 aa, Staphylococcus
AYHILMKLMLKFDFVYDGDKLTDRFQNRG

SEQ ID NO: 2004139 - protein, 17 aa, Staphylococcus
AYIAMTIAQNTDYILLD

SEQ ID NO: 2004140 - protein, 18 aa, Staphylococcus
AYIDTVFTLEEFDSVKEI

SEQ ID NO: 2004141 - protein, 24 aa, Staphylococcus
AYIFTPEIRELFGVKDDEKLVGLL

SEQ ID NO: 2004142 - protein, 19 aa, Staphylococcus
AYIKQHYPRINEITLAVNT

SEQ ID NO: 2004143 - protein, 17 aa, Staphylococcus
AYILSKRQLETEKSYEF

SEQ ID NO: 2004144 - protein, 17 aa, Staphylococcus
AYILSKRQLETEQSYDY

SEQ ID NO: 2004145 - protein, 24 aa, Staphylococcus
AYINGRAGERFCIRNSGVNVVVEG

SEQ ID NO: 2004146 - protein, 17 aa, Staphylococcus
AYIREGQGFPVILIHGL

SEQ ID NO: 2004147 - protein, 28 aa, Staphylococcus
AYITEFQVLNGLRIGELLALQPENIDFK

SEQ ID NO: 2004148 - protein, 24 aa, Staphylococcus
AYKAAELQGRIRAERFIHLVQNEI

SEQ ID NO: 2004149 - protein, 21 aa, Staphylococcus
AYKAQSVLTDILPTIDNIERA

SEQ ID NO: 2004150 - protein, 28 aa, Staphylococcus
AYKEWKLEDLPIIPKRMQTVVIGKTSKQ

SEQ ID NO: 2004151 - protein, 19 aa, Staphylococcus
AYKSNVIGVENIMKFANNK

SEQ ID NO: 2004152 - protein, 25 aa, Staphylococcus
AYLEHLRNLNISYVFGGPNKNLDLK

SEQ ID NO: 2004153 - protein, 20 aa, Staphylococcus
AYLIEHPKGLILIDTGWHTD

SEQ ID NO: 2004154 - protein, 31 aa, Staphylococcus
AYLIYMLGFMPGFPYLGGLDKRIHTPRRSEP

SEQ ID NO: 2004155 - protein, 17 aa, Staphylococcus
AYLIYNLDTEEIEEEKN

SEQ ID NO: 2004156 - protein, 18 aa, Staphylococcus
AYLKIEVSKLKRVFENEP

SEQ ID NO: 2004157 - protein, 17 aa, Staphylococcus
AYLKREGKTVIEEYLET

SEQ ID NO: 2004158 - protein, 23 aa, Staphylococcus
AYLSGCNFPQFILNNLQGKTNKS

SEQ ID NO: 2004159 - protein, 17 aa, Staphylococcus
AYLSRLGDYPGDITPYG

SEQ ID NO: 2004160 - protein, 20 aa, Staphylococcus
AYLVKLWQHKWLKKPETHLT

SEQ ID NO: 2004161 - protein, 28 aa, Staphylococcus
AYMDMKSDVLKFYSEQNVDGIVIEALGQ

SEQ ID NO: 2004162 - protein, 26 aa, Staphylococcus
AYMGAYKLQWEMIKFAKNHNIDRYNF

SEQ ID NO: 2004163 - protein, 19 aa, Staphylococcus
AYMPRRSFMRLNDEREKNE

SEQ ID NO: 2004164 - protein, 24 aa, Staphylococcus
AYMYRFDAKTGYYFFPNQTGKSNE

SEQ ID NO: 2004165 - protein, 17 aa, Staphylococcus
AYNFIKQVSEDGGKVLF

SEQ ID NO: 2004166 - protein, 20 aa, Staphylococcus
AYNLPCRYVLHTVGPQIRKY

SEQ ID NO: 2004167 - protein, 26 aa, Staphylococcus
AYNNFLESEIARWIKIQEDIGLDVLV

SEQ ID NO: 2004168 - protein, 17 aa, Staphylococcus
AYNPLPVGVSRPNTSLF

SEQ ID NO: 2004169 - protein, 18 aa, Staphylococcus
AYQFIAGILKNARGFTAV

SEQ ID NO: 2004170 - protein, 22 aa, Staphylococcus
AYQFLKKEGYEVINAAGVSLGG

SEQ ID NO: 2004171 - protein, 17 aa, Staphylococcus
AYQPNGTVIQLWHGTPI

SEQ ID NO: 2004172 - protein, 17 aa, Staphylococcus
AYQRSKRDLPYGRALII

SEQ ID NO: 2004173 - protein, 21 aa, Staphylococcus
AYRAVASLLQRLKTFDEFEFT

SEQ ID NO: 2004174 - protein, 25 aa, Staphylococcus
AYRDLKLKAFEAHASQTGPFLKQLA

SEQ ID NO: 2004175 - protein, 19 aa, Staphylococcus
AYRFKNELWFINFSSNSYR

SEQ ID NO: 2004176 - protein, 18 aa, Staphylococcus
AYRRFKMGPKDTLNTLQN

SEQ ID NO: 2004177 - protein, 18 aa, Staphylococcus
AYRRFKMGPKETLNTLQN

SEQ ID NO: 2004178 - protein, 17 aa, Staphylococcus
AYSDRAKDRFAEVETPR

SEQ ID NO: 2004179 - protein, 20 aa, Staphylococcus
AYSPRSFVLGSGMSSKAYGS

SEQ ID NO: 2004180 - protein, 21 aa, Staphylococcus
AYTADGYARMNGLGVLVTTFG

SEQ ID NO: 2004181 - protein, 23 aa, Staphylococcus
AYTGGKWKVLMIAAEERYVLLEN

SEQ ID NO: 2004182 - protein, 17 aa, Staphylococcus
AYVEKLIDCLTLTLENK

SEQ ID NO: 2004183 - protein, 20 aa, Staphylococcus
AYVNQAAAWGHKAIAVTDHN

SEQ ID NO: 2004184 - protein, 17 aa, Staphylococcus
AYVPFLQKYNSHIIDGT

SEQ ID NO: 2004185 - protein, 22 aa, Staphylococcus
AYVQRPTVAKVEQFQTTANNQI

SEQ ID NO: 2004186 - protein, 24 aa, Staphylococcus
AYYHGYCSDITRTFGIGKPKAQLK

SEQ ID NO: 2004187 - protein, 24 aa, Staphylococcus
AYYRNELSWIYSYEETEKLMKTEI

SEQ ID NO: 2004188 - protein, 18 aa, Staphylococcus
CAEELGMSKTSIIKSKEV

SEQ ID NO: 2004189 - protein, 24 aa, Staphylococcus
CAGGIARPAAEHALHYDKMPDRLV

SEQ ID NO: 2004190 - protein, 25 aa, Staphylococcus
CAGGIARPAASHALHYDKLPNRLVT

SEQ ID NO: 2004191 - protein, 20 aa, Staphylococcus
CAIDAIGVCDTLRVPIKINA

SEQ ID NO: 2004192 - protein, 19 aa, Staphylococcus
CAIEHGITYFDTADMYDRG

SEQ ID NO: 2004193 - protein, 17 aa, Staphylococcus
CAIKRQLDLLIIAGDIS

SEQ ID NO: 2004194 - protein, 19 aa, Staphylococcus
CAINPELDAQGLAEIAEES

SEQ ID NO: 2004195 - protein, 19 aa, Staphylococcus
CAPAIKILLPNDLREEVRR

SEQ ID NO: 2004196 - protein, 18 aa, Staphylococcus
CAPTIQLDALITAVKDGK

SEQ ID NO: 2004197 - protein, 18 aa, Staphylococcus
CAPTIQLDALVTLVNDGK

SEQ ID NO: 2004198 - protein, 26 aa, Staphylococcus
CAQAHIRFVFCTGKQCERVENIVGDL

SEQ ID NO: 2004199 - protein, 27 aa, Staphylococcus
CARLKQSRTVFIFGFGASYVAARDLFQ

SEQ ID NO: 2004200 - protein, 23 aa, Staphylococcus
CASPYLSHSYVFISWTGKMTETF

SEQ ID NO: 2004201 - protein, 21 aa, Staphylococcus
CASVCCSPETFAHLLRTIATH

SEQ ID NO: 2004202 - protein, 22 aa, Staphylococcus
CATEKFTQFDFESVPTTHFVTS

SEQ ID NO: 2004203 - protein, 23 aa, Staphylococcus
CATKPRVHVFIATSPIHLEHKLK

SEQ ID NO: 2004204 - protein, 20 aa, Staphylococcus
CATPDKFDLFESMGVTSMFN

SEQ ID NO: 2004205 - protein, 17 aa, Staphylococcus
CAVLLNDVIKFVIFDME

SEQ ID NO: 2004206 - protein, 18 aa, Staphylococcus
CAYNFNFATEPTINIRPQ

SEQ ID NO: 2004207 - protein, 23 aa, Staphylococcus
CCTPTEYRMMAKLDNLQEYNLEH

SEQ ID NO: 2004208 - protein, 23 aa, Staphylococcus
CCTPTEYRMMAKLQNLDDYHLEH

SEQ ID NO: 2004209 - protein, 24 aa, Staphylococcus
CCTPTEYRMMAKLSNLNDYHLEHL

SEQ ID NO: 2004210 - protein, 19 aa, Staphylococcus
CDCGAQLEASMKYIDEHGG

SEQ ID NO: 2004211 - protein, 19 aa, Staphylococcus
CDCGAQLEASMKYINDHGG

SEQ ID NO: 2004212 - protein, 18 aa, Staphylococcus
CDCGAQLEASMNYIEQHR

SEQ ID NO: 2004213 - protein, 19 aa, Staphylococcus
CDCGAQLESAMKYINEHGG

SEQ ID NO: 2004214 - protein, 17 aa, Staphylococcus
CDCYTCRNYSRAYIRHL

SEQ ID NO: 2004215 - protein, 17 aa, Staphylococcus
CDDVCILNHGELVVSGD

SEQ ID NO: 2004216 - protein, 25 aa, Staphylococcus
CDEEGIKFIGPHIEHLDMFGDKVKA

SEQ ID NO: 2004217 - protein, 17 aa, Staphylococcus
CDFGLAFDGDGDRLIAI

SEQ ID NO: 2004218 - protein, 18 aa, Staphylococcus
CDFSEGIFKNVHTVSNTK

SEQ ID NO: 2004219 - protein, 19 aa, Staphylococcus
CDFYIKIPMVGHINSLNAS

SEQ ID NO: 2004220 - protein, 19 aa, Staphylococcus
CDFYIKIPMVGHVNSLNAS

SEQ ID NO: 2004221 - protein, 20 aa, Staphylococcus
CDFYIKIPMVGHVNSLNASV

SEQ ID NO: 2004222 - protein, 17 aa, Staphylococcus
CDIDEAYLEHQIKGVTI

SEQ ID NO: 2004223 - protein, 19 aa, Staphylococcus
CDILRRVMLENKKAVQWEI

SEQ ID NO: 2004224 - protein, 24 aa, Staphylococcus
CDIQKEYYVGFVIDRATDRVTLMA

SEQ ID NO: 2004225 - protein, 25 aa, Staphylococcus
CDISKHIAQIMARYRDEEIQLILNF

SEQ ID NO: 2004226 - protein, 18 aa, Staphylococcus
CDITYCTNNELGFDYLRD

SEQ ID NO: 2004227 - protein, 27 aa, Staphylococcus
CDIYPLLNRSLLYSGIILHDIGKVKEL

SEQ ID NO: 2004228 - protein, 18 aa, Staphylococcus
CDKIGLIVEGRLFAIGTP

SEQ ID NO: 2004229 - protein, 18 aa, Staphylococcus
CDKIMVVANLPYYITTPI

SEQ ID NO: 2004230 - protein, 18 aa, Staphylococcus
CDLFGFRPDGQIFFIEVK

SEQ ID NO: 2004231 - protein, 17 aa, Staphylococcus
CDLNGMMAEIMGKKTGL

SEQ ID NO: 2004232 - protein, 18 aa, Staphylococcus
CDLNGMMAEIMGKRDGLG

SEQ ID NO: 2004233 - protein, 19 aa, Staphylococcus
CDLNGMMAEIMGKRDGLGH

SEQ ID NO: 2004234 - protein, 19 aa, Staphylococcus
CDMLNELGLYLELREEAII

SEQ ID NO: 2004235 - protein, 19 aa, Staphylococcus
CDNAPKRRVMLDFLIGSAL

SEQ ID NO: 2004236 - protein, 17 aa, Staphylococcus
CDNRIYFTQTVHKDLEN

SEQ ID NO: 2004237 - protein, 23 aa, Staphylococcus
CDPQYMGYAPFYAVEKLLDKTDS

SEQ ID NO: 2004238 - protein, 23 aa, Staphylococcus
CDPQYMGYAPFYAVEKLLEKTHQ

SEQ ID NO: 2004239 - protein, 23 aa, Staphylococcus
CDPQYMGYAPFYAVEKLLEKTQR

SEQ ID NO: 2004240 - protein, 27 aa, Staphylococcus
CDTMKRARTIFLFGYGASLVIVTDLFQ

SEQ ID NO: 2004241 - protein, 28 aa, Staphylococcus
CDVLCCYRLNRLHRNLKNALKLMKLCQK

SEQ ID NO: 2004242 - protein, 27 aa, Staphylococcus
CDVLVELRQATGLKDYEAFRMTDKQIQ

SEQ ID NO: 2004243 - protein, 25 aa, Staphylococcus
CDYLYCKAFGKTATNIEKFTSQGSL

SEQ ID NO: 2004244 - protein, 18 aa, Staphylococcus
CDYMREWIDHDEKIVPTI

SEQ ID NO: 2004245 - protein, 19 aa, Staphylococcus
CDYRKQAIYYAIQKKDYKT

SEQ ID NO: 2004246 - protein, 19 aa, Staphylococcus
CEACQLKFIGPSFESIQKM

SEQ ID NO: 2004247 - protein, 17 aa, Staphylococcus
CEACQLKFIGPSYESIQ

SEQ ID NO: 2004248 - protein, 25 aa, Staphylococcus
CEAGARWLLDPNKIYEMVSAVTEKV

SEQ ID NO: 2004249 - protein, 17 aa, Staphylococcus
CEAKKDLGLKEGTTIWF

SEQ ID NO: 2004250 - protein, 23 aa, Staphylococcus
CEALFRAGILPSRLTQDLTQQEK

SEQ ID NO: 2004251 - protein, 19 aa, Staphylococcus
CEALFRAGVLPERKVKDVS

SEQ ID NO: 2004252 - protein, 24 aa, Staphylococcus
CEALFRSGIHPARLPKDLNHQERE

SEQ ID NO: 2004253 - protein, 18 aa, Staphylococcus
CEAWSKLGDIPAEDVKKI

SEQ ID NO: 2004254 - protein, 23 aa, Staphylococcus
CECGKELKYQYILRSKSKDTIMK

SEQ ID NO: 2004255 - protein, 18 aa, Staphylococcus
CECTGEWTMENFIDIEVE

SEQ ID NO: 2004256 - protein, 17 aa, Staphylococcus
CEDPEYLSHIKHIGSLV

SEQ ID NO: 2004257 - protein, 17 aa, Staphylococcus
CEDYEFHIGAITEMSAK

SEQ ID NO: 2004258 - protein, 21 aa, Staphylococcus
CEEDLQIFYSFIVLNNKEVYY

SEQ ID NO: 2004259 - protein, 19 aa, Staphylococcus
CEEDLQIFYSFIVLNNNEV

SEQ ID NO: 2004260 - protein, 23 aa, Staphylococcus
CEEQQFYPLISFTAPRIENLLEM

SEQ ID NO: 2004261 - protein, 17 aa, Staphylococcus
CEESLRFFGGLSGLNKT

SEQ ID NO: 2004262 - protein, 21 aa, Staphylococcus
CEFLGRMSPRTFAYMNELDYP

SEQ ID NO: 2004263 - protein, 17 aa, Staphylococcus
CEGGIRFLAVKDGKNAK

SEQ ID NO: 2004264 - protein, 17 aa, Staphylococcus
CEIENEFMDHGIKGVSI

SEQ ID NO: 2004265 - protein, 19 aa, Staphylococcus
CEIGPKADLALVLDTSDNM

SEQ ID NO: 2004266 - protein, 25 aa, Staphylococcus
CEILNRYDIAVSLGDGLRPGSIYDA

SEQ ID NO: 2004267 - protein, 18 aa, Staphylococcus
CEILSKYDVAISLGDGLR

SEQ ID NO: 2004268 - protein, 17 aa, Staphylococcus
CEISREIGHTMSNFHKR

SEQ ID NO: 2004269 - protein, 21 aa, Staphylococcus
CEKDGGWILGHLIDGTQAEYV

SEQ ID NO: 2004270 - protein, 17 aa, Staphylococcus
CELCGGTRYRPEVLEAK

SEQ ID NO: 2004271 - protein, 23 aa, Staphylococcus
CELIEARCQCLSESEIENLNQLL

SEQ ID NO: 2004272 - protein, 17 aa, Staphylococcus
CELIEARCQCLSKEEIQ

SEQ ID NO: 2004273 - protein, 17 aa, Staphylococcus
CELIEARCQCLTEEEIN

SEQ ID NO: 2004274 - protein, 26 aa, Staphylococcus
CELLMKLRHLFVVNGRPPFGTCVIEF

SEQ ID NO: 2004275 - protein, 18 aa, Staphylococcus
CEMIDSYEALIVRSQTQV

SEQ ID NO: 2004276 - protein, 17 aa, Staphylococcus
CEMMINHQIEYFFEHNH

SEQ ID NO: 2004277 - protein, 22 aa, Staphylococcus
CENDGGWILGHLIDGTQAEYVK

SEQ ID NO: 2004278 - protein, 19 aa, Staphylococcus
CENELKLADNADLLVHEAT

SEQ ID NO: 2004279 - protein, 21 aa, Staphylococcus
CENGGGWILGHLVDGTQAEYV

SEQ ID NO: 2004280 - protein, 31 aa, Staphylococcus
CEQFNDFSHRISMPYLRSPIVHHIHPNPFHL

SEQ ID NO: 2004281 - protein, 25 aa, Staphylococcus
CERLKKEILEETGIHCTVGIGSNML

SEQ ID NO: 2004282 - protein, 26 aa, Staphylococcus
CERLKKEIYEETGIMCTVGIGSNMLL

SEQ ID NO: 2004283 - protein, 27 aa, Staphylococcus
CESDFKPDAFYILATRHGMIKRSNVSM

SEQ ID NO: 2004284 - protein, 19 aa, Staphylococcus
CETAFDLMAAILLFHKVKV

SEQ ID NO: 2004285 - protein, 28 aa, Staphylococcus
CETIKPLDNESLLAFGANLQQKMSQFSH

SEQ ID NO: 2004286 - protein, 19 aa, Staphylococcus
CETKELKISGGDVGGSANY

SEQ ID NO: 2004287 - protein, 25 aa, Staphylococcus
CEVAKCPKNYLANVLNKYGFAVRKE

SEQ ID NO: 2004288 - protein, 24 aa, Staphylococcus
CEVARCPKNYLAHVLSKHGFTVRK

SEQ ID NO: 2004289 - protein, 26 aa, Staphylococcus
CEVARCPKNYLAHVLSKYGFNVKKEK

SEQ ID NO: 2004290 - protein, 27 aa, Staphylococcus
CEVARCPRPYLARVLRKYGFEVKEEAP

SEQ ID NO: 2004291 - protein, 36 aa, Staphylococcus
CEVCGAPMVIKMGRYGKFMACSNFPDCRNTKAIVKT

SEQ ID NO: 2004292 - protein, 36 aa, Staphylococcus
CEVCGSPMVIKMGRYGKFMACSNFPDCRNTKAIVKS

SEQ ID NO: 2004293 - protein, 17 aa, Staphylococcus
CEVCGTTYHLVFNPPKV

SEQ ID NO: 2004294 - protein, 18 aa, Staphylococcus
CEVPKALENLGFGALELG

SEQ ID NO: 2004295 - protein, 18 aa, Staphylococcus
CEYAHAMGNSPGGLEAYH

SEQ ID NO: 2004296 - protein, 18 aa, Staphylococcus
CEYCTSGRETLCRDVQNA

SEQ ID NO: 2004297 - protein, 18 aa, Staphylococcus
CFDGLDFFRFGRIQREYE

SEQ ID NO: 2004298 - protein, 20 aa, Staphylococcus
CFELLAMITYADKLKNIIKK

SEQ ID NO: 2004299 - protein, 20 aa, Staphylococcus
CFELLAMITYADKLKSIIKK

SEQ ID NO: 2004300 - protein, 19 aa, Staphylococcus
CFELLAMVTYADKLKSIIK

SEQ ID NO: 2004301 - protein, 19 aa, Staphylococcus
CFELLAMVTYADRLKSIIK

SEQ ID NO: 2004302 - protein, 19 aa, Staphylococcus
CFNCLIPQLPSMTLTCDTV

SEQ ID NO: 2004303 - protein, 19 aa, Staphylococcus
CFNCLMPQLPAINLTCDTV

SEQ ID NO: 2004304 - protein, 19 aa, Staphylococcus
CFNESFDAQPSQMLCSGLP

SEQ ID NO: 2004305 - protein, 19 aa, Staphylococcus
CFTGFELFVKPAIQHMMGA

SEQ ID NO: 2004306 - protein, 24 aa, Staphylococcus
CFTGFELFVKPAIYHMMGADAFYP

SEQ ID NO: 2004307 - protein, 18 aa, Staphylococcus
CFTGFELFVKPAVQHMMQ

SEQ ID NO: 2004308 - protein, 17 aa, Staphylococcus
CGACRQVLKELCDDDMP

SEQ ID NO: 2004309 - protein, 19 aa, Staphylococcus
CGATLKNRVLMAPMTIQAG

SEQ ID NO: 2004310 - protein, 23 aa, Staphylococcus
CGCAAGLARPAAVAVADQNDKKP

SEQ ID NO: 2004311 - protein, 24 aa, Staphylococcus
CGCAAGLARPAAVAVAEQNDKKPD

SEQ ID NO: 2004312 - protein, 27 aa, Staphylococcus
CGCAGGVARPAASHALHYDKLPQRLVT

SEQ ID NO: 2004313 - protein, 18 aa, Staphylococcus
CGDESKMAKDVHQAIRNV

SEQ ID NO: 2004314 - protein, 21 aa, Staphylococcus
CGDRIHLTFDIEDGFIKDAKF

SEQ ID NO: 2004315 - protein, 21 aa, Staphylococcus
CGDRIHLTFDIEDGIIQDAKF

SEQ ID NO: 2004316 - protein, 17 aa, Staphylococcus
CGDTPLITAETLQALIE

SEQ ID NO: 2004317 - protein, 19 aa, Staphylococcus
CGETSYVGHGRLKGYKMLV

SEQ ID NO: 2004318 - protein, 18 aa, Staphylococcus
CGETSYVGHGRLQGYNML

SEQ ID NO: 2004319 - protein, 26 aa, Staphylococcus
CGEVIIKEAFPLLDSNVVINLKVKDG

SEQ ID NO: 2004320 - protein, 18 aa, Staphylococcus
CGEVLDIHGYTGGYNITS

SEQ ID NO: 2004321 - protein, 19 aa, Staphylococcus
CGFTPQFEGLQALYDKYKD

SEQ ID NO: 2004322 - protein, 19 aa, Staphylococcus
CGFTPQFEGLQALYEKYKD

SEQ ID NO: 2004323 - protein, 17 aa, Staphylococcus
CGFYTATHPLNFEERNK

SEQ ID NO: 2004324 - protein, 18 aa, Staphylococcus
CGIGKPFSEEVALVMMVL

SEQ ID NO: 2004325 - protein, 25 aa, Staphylococcus
CGIHPEWLYCAKANMVLEPAYTGEG

SEQ ID NO: 2004326 - protein, 26 aa, Staphylococcus
CGIILPTDRLELFDGHRYDLSKSHIV

SEQ ID NO: 2004327 - protein, 20 aa, Staphylococcus
CGIPEYSIAAIKARGTKRLT

SEQ ID NO: 2004328 - protein, 17 aa, Staphylococcus
CGISLGGILSLKLAESK

SEQ ID NO: 2004329 - protein, 24 aa, Staphylococcus
CGKTTTIKCLLGMEKLNSGSATIF

SEQ ID NO: 2004330 - protein, 18 aa, Staphylococcus
CGKVPKKKSEFVKQKIVD

SEQ ID NO: 2004331 - protein, 19 aa, Staphylococcus
CGLEVGEFIHTFGDAHIYS

SEQ ID NO: 2004332 - protein, 19 aa, Staphylococcus
CGLHPEWLYNAKANMILVP

SEQ ID NO: 2004333 - protein, 17 aa, Staphylococcus
CGLPKEMALELFKPFIM

SEQ ID NO: 2004334 - protein, 18 aa, Staphylococcus
CGLPSINANLEWLPNLFV

SEQ ID NO: 2004335 - protein, 18 aa, Staphylococcus
CGLYTAVHPLEYKERNIG

SEQ ID NO: 2004336 - protein, 19 aa, Staphylococcus
CGSESPTTGIISWKKNIKI

SEQ ID NO: 2004337 - protein, 17 aa, Staphylococcus
CGTGGDKSNSFNISTTV

SEQ ID NO: 2004338 - protein, 17 aa, Staphylococcus
CGTSGLNAVERFIVGSV

SEQ ID NO: 2004339 - protein, 17 aa, Staphylococcus
CGVGKPFSEEVALVMMV

SEQ ID NO: 2004340 - protein, 17 aa, Staphylococcus
CHARLKGNCPYMEAPPC

SEQ ID NO: 2004341 - protein, 25 aa, Staphylococcus
CHFENVKIKDCIFKHVTINNSSIPE

SEQ ID NO: 2004342 - protein, 23 aa, Staphylococcus
CHIALGAGYPFTIKDGTSMSREE

SEQ ID NO: 2004343 - protein, 21 aa, Staphylococcus
CHIALGSAYGFNVEGGTEMTT

SEQ ID NO: 2004344 - protein, 22 aa, Staphylococcus
CHLAIGSAYAFNLKGGTEMSTD

SEQ ID NO: 2004345 - protein, 17 aa, Staphylococcus
CHLFYRTSKGIFLNEEG

SEQ ID NO: 2004346 - protein, 17 aa, Staphylococcus
CHLPNRLEQLGIDPKDV

SEQ ID NO: 2004347 - protein, 29 aa, Staphylococcus
CHLSGGQFQRLWIAKALLVNPDILILDEA

SEQ ID NO: 2004348 - protein, 17 aa, Staphylococcus
CHNYYPRPDTGLSATFV

SEQ ID NO: 2004349 - protein, 27 aa, Staphylococcus
CHNYYPRPDTGLSYSFIEYKNQLIKTY

SEQ ID NO: 2004350 - protein, 25 aa, Staphylococcus
CHQFHVPFIVTRAVSDLANGKADIS

SEQ ID NO: 2004351 - protein, 23 aa, Staphylococcus
CHRTSPHLQDWAREGVLLLNTVL

SEQ ID NO: 2004352 - protein, 17 aa, Staphylococcus
CHTMFQFYVQDGKLSCQ

SEQ ID NO: 2004353 - protein, 26 aa, Staphylococcus
CHYTEFELKFGPVLLENKNECFYNKW

SEQ ID NO: 2004354 - protein, 17 aa, Staphylococcus
CIAEELLQHDISITQLS

SEQ ID NO: 2004355 - protein, 17 aa, Staphylococcus
CIAGESLTAGYLNRPEL

SEQ ID NO: 2004356 - protein, 19 aa, Staphylococcus
CIAQMKYTLEFIGGELAGY

SEQ ID NO: 2004357 - protein, 18 aa, Staphylococcus
CIEIGVAYLKEGVEEREV

SEQ ID NO: 2004358 - protein, 18 aa, Staphylococcus
CIFAESLGGTETFITFPY

SEQ ID NO: 2004359 - protein, 20 aa, Staphylococcus
CIGCGAPLQSEDLDAPGYVP

SEQ ID NO: 2004360 - protein, 20 aa, Staphylococcus
CIGSCGLDSIRVIKGQFGAH

SEQ ID NO: 2004361 - protein, 17 aa, Staphylococcus
CILVVIPDINWSAELDI

SEQ ID NO: 2004362 - protein, 17 aa, Staphylococcus
CINNAGIDYQVFKEDLQ

SEQ ID NO: 2004363 - protein, 17 aa, Staphylococcus
CINYDIMGIPSFLVFCD

SEQ ID NO: 2004364 - protein, 17 aa, Staphylococcus
CISGFSVVNQGHCHPKI

SEQ ID NO: 2004365 - protein, 19 aa, Staphylococcus
CISNAGLDYEVFKEDLNSS

SEQ ID NO: 2004366 - protein, 19 aa, Staphylococcus
CITDYSSVMFDFANTKKPL

SEQ ID NO: 2004367 - protein, 19 aa, Staphylococcus
CITQMKYSVEFLGGELKGY

SEQ ID NO: 2004368 - protein, 19 aa, Staphylococcus
CITQVKYSLEFLGASLGGY

SEQ ID NO: 2004369 - protein, 24 aa, Staphylococcus
CIYGRAMKARWKKWCCSQQGFIDF

SEQ ID NO: 2004370 - protein, 20 aa, Staphylococcus
CIYTRLEAASVGLSAEQAEA

SEQ ID NO: 2004371 - protein, 17 aa, Staphylococcus
CIYTRVESASIGLSEAQ

SEQ ID NO: 2004372 - protein, 18 aa, Staphylococcus
CKAGGRSAQVVQYLEQNG

SEQ ID NO: 2004373 - protein, 20 aa, Staphylococcus
CKAITFEAFNDYELSIFGNV

SEQ ID NO: 2004374 - protein, 19 aa, Staphylococcus
CKALKDFKANTEVNVPIFL

SEQ ID NO: 2004375 - protein, 19 aa, Staphylococcus
CKAMDMWIDPIVDKYNDYK

SEQ ID NO: 2004376 - protein, 19 aa, Staphylococcus
CKAMDMWIDPIVEKYKDYE

SEQ ID NO: 2004377 - protein, 23 aa, Staphylococcus
CKANNLKGRILVSTEGINGTLSG

SEQ ID NO: 2004378 - protein, 18 aa, Staphylococcus
CKAVAPKLEIHLSTQQSL

SEQ ID NO: 2004379 - protein, 18 aa, Staphylococcus
CKAYIEAHAKYISETQKK

SEQ ID NO: 2004380 - protein, 21 aa, Staphylococcus
CKAYVEAHAKYALNHPTALLQ

SEQ ID NO: 2004381 - protein, 19 aa, Staphylococcus
CKAYVEAHAKYASEINKKE

SEQ ID NO: 2004382 - protein, 24 aa, Staphylococcus
CKENNLKGRILVSTEGINGTLSGT

SEQ ID NO: 2004383 - protein, 18 aa, Staphylococcus
CKEPVSLQPSLDIKRMPF

SEQ ID NO: 2004384 - protein, 26 aa, Staphylococcus
CKESLGFDQNTKWLSVLPIYHISGLS

SEQ ID NO: 2004385 - protein, 17 aa, Staphylococcus
CKFILKSVVQVEDDIER

SEQ ID NO: 2004386 - protein, 18 aa, Staphylococcus
CKIINRFSNKSLQVAPSY

SEQ ID NO: 2004387 - protein, 23 aa, Staphylococcus
CKKSIKANHYLKINEMADLIDQL

SEQ ID NO: 2004388 - protein, 19 aa, Staphylococcus
CKKSIKANHYLKKNEMADL

SEQ ID NO: 2004389 - protein, 20 aa, Staphylococcus
CKKSIKANHYLKNNEMADLI

SEQ ID NO: 2004390 - protein, 22 aa, Staphylococcus
CKKSIKANHYLKNNEMADLIDQ

SEQ ID NO: 2004391 - protein, 20 aa, Staphylococcus
CKKSIKANHYLKNNEMADLV

SEQ ID NO: 2004392 - protein, 20 aa, Staphylococcus
CKKSIKANHYLKNNEMSDLI

SEQ ID NO: 2004393 - protein, 24 aa, Staphylococcus
CKLKPDIPTCRVIFTPHQKEWERL

SEQ ID NO: 2004394 - protein, 17 aa, Staphylococcus
CKLYEDVGFKKDPIKSL

SEQ ID NO: 2004395 - protein, 25 aa, Staphylococcus
CKNEFLRYPYIESFENIDEVIQVAH

SEQ ID NO: 2004396 - protein, 19 aa, Staphylococcus
CKNHDDIFVTLFEKLNNEL

SEQ ID NO: 2004397 - protein, 17 aa, Staphylococcus
CKPDFMLNVALNKSKEI

SEQ ID NO: 2004398 - protein, 24 aa, Staphylococcus
CKQIYQRKKHVILGISPFTSKYNE

SEQ ID NO: 2004399 - protein, 27 aa, Staphylococcus
CKQSLGFDQHTKWLSVLPIYHISGLSV

SEQ ID NO: 2004400 - protein, 18 aa, Staphylococcus
CKRCFRLKNYNEVQDVGL

SEQ ID NO: 2004401 - protein, 19 aa, Staphylococcus
CKRIGFYPKTVANISQINF

SEQ ID NO: 2004402 - protein, 19 aa, Staphylococcus
CKRIGFYPKTVANISQISF

SEQ ID NO: 2004403 - protein, 24 aa, Staphylococcus
CKSIRSDKNLVPILMLTAKDDEFD

SEQ ID NO: 2004404 - protein, 17 aa, Staphylococcus
CKSRRGQGIASLMLQEA

SEQ ID NO: 2004405 - protein, 20 aa, Staphylococcus
CKSSLGFDSTTIWLSVLPIY

SEQ ID NO: 2004406 - protein, 21 aa, Staphylococcus
CKTFNIPLYIDGARLGYGLVS

SEQ ID NO: 2004407 - protein, 23 aa, Staphylococcus
CKTKNKWRAYITIQKKRKHLGYF

SEQ ID NO: 2004408 - protein, 19 aa, Staphylococcus
CKVIKRKGKVMIICENPKH

SEQ ID NO: 2004409 - protein, 18 aa, Staphylococcus
CKVIKRKGKVMVICENPK

SEQ ID NO: 2004410 - protein, 28 aa, Staphylococcus
CKVYLKREDLQWVRSFKLRGAYNAISVL

SEQ ID NO: 2004411 - protein, 19 aa, Staphylococcus
CLAGLAFNFMCFQDIAPTE

SEQ ID NO: 2004412 - protein, 19 aa, Staphylococcus
CLALGASAVGMSRPFLNQV

SEQ ID NO: 2004413 - protein, 18 aa, Staphylococcus
CLDACGVNGLYINQCKFL

SEQ ID NO: 2004414 - protein, 18 aa, Staphylococcus
CLDIAALPHSLTYTLKDE

SEQ ID NO: 2004415 - protein, 19 aa, Staphylococcus
CLDYIPNKDFNDFKKLKAL

SEQ ID NO: 2004416 - protein, 19 aa, Staphylococcus
CLELAKLIYEAGFLTGIYH

SEQ ID NO: 2004417 - protein, 23 aa, Staphylococcus
CLERMGADVLHFGEGERREIYDL

SEQ ID NO: 2004418 - protein, 19 aa, Staphylococcus
CLGACVLGLLALGEIEDFS

SEQ ID NO: 2004419 - protein, 20 aa, Staphylococcus
CLGVPTILSKKGIEKIVEVN

SEQ ID NO: 2004420 - protein, 19 aa, Staphylococcus
CLHISKPLYELEEILPHYF

SEQ ID NO: 2004421 - protein, 19 aa, Staphylococcus
CLIAQQLAQHCDFFSFGTN

SEQ ID NO: 2004422 - protein, 26 aa, Staphylococcus
CLISDELAKHCDFFSFGTNDLTQLSF

SEQ ID NO: 2004423 - protein, 22 aa, Staphylococcus
CLIYCSGVALYGMLQDMTDDDM

SEQ ID NO: 2004424 - protein, 21 aa, Staphylococcus
CLNCGKKYTKSYVIEHDLIYC

SEQ ID NO: 2004425 - protein, 25 aa, Staphylococcus
CLNNCGLCSSGLYALVDGEVVEGDT

SEQ ID NO: 2004426 - protein, 25 aa, Staphylococcus
CLNNCSVCSCGLYALVDGDTVEGDT

SEQ ID NO: 2004427 - protein, 29 aa, Staphylococcus
CLNRTHFKLPHWLFKMIQNHFVKKHQNMS

SEQ ID NO: 2004428 - protein, 27 aa, Staphylococcus
CLNVGCIPSKTLLEFGSQVHQIHAAND

SEQ ID NO: 2004429 - protein, 20 aa, Staphylococcus
CLNVGCIPSKTLLEHGTKAH

SEQ ID NO: 2004430 - protein, 22 aa, Staphylococcus
CLPLVKKGGQFIALKSSKGGEE

SEQ ID NO: 2004431 - protein, 18 aa, Staphylococcus
CLQKGAFVSDKDGDMHYD

SEQ ID NO: 2004432 - protein, 19 aa, Staphylococcus
CLQLAKLIYQHGYLTGIYH

SEQ ID NO: 2004433 - protein, 25 aa, Staphylococcus
CLQNCGICSSGLYALVNGDIVEGES

SEQ ID NO: 2004434 - protein, 25 aa, Staphylococcus
CLQNCGICSSGLYALVNGDIVEGET

SEQ ID NO: 2004435 - protein, 26 aa, Staphylococcus
CLQNCGMCSSGLYVLFDGDIVEGDSP

SEQ ID NO: 2004436 - protein, 29 aa, Staphylococcus
CLSSYLYQRLNFYLIDLFRKENLKPELVE

SEQ ID NO: 2004437 - protein, 20 aa, Staphylococcus
CLTGDIFHSQRCDCGAQLES

SEQ ID NO: 2004438 - protein, 19 aa, Staphylococcus
CLTIAFKTFEIRDADILDY

SEQ ID NO: 2004439 - protein, 18 aa, Staphylococcus
CLTLGTGIGGAFYNKSIG

SEQ ID NO: 2004440 - protein, 26 aa, Staphylococcus
CLVADELAKHCDFFSFGTNDLTQLTF

SEQ ID NO: 2004441 - protein, 28 aa, Staphylococcus
CMIGIARLNLPAVFVYGGTILPGKLDGK

SEQ ID NO: 2004442 - protein, 17 aa, Staphylococcus
CNAEIQYHQSLLPQFKT

SEQ ID NO: 2004443 - protein, 19 aa, Staphylococcus
CNALKEFKAQTDIQVPIYL

SEQ ID NO: 2004444 - protein, 19 aa, Staphylococcus
CNCTGEWTMENFIDIEIDK

SEQ ID NO: 2004445 - protein, 24 aa, Staphylococcus
CNFKKFKGDHFFINNIFQDPKLTF

SEQ ID NO: 2004446 - protein, 23 aa, Staphylococcus
CNFRCDYCMPKEIFGDDFVFLPK

SEQ ID NO: 2004447 - protein, 22 aa, Staphylococcus
CNFRCDYCMPKEIFGDDYVFLP

SEQ ID NO: 2004448 - protein, 21 aa, Staphylococcus
CNGSLVAAFKKCGFKIDKVVF

SEQ ID NO: 2004449 - protein, 21 aa, Staphylococcus
CNHNLDFALSIRTMLIDDKQV

SEQ ID NO: 2004450 - protein, 17 aa, Staphylococcus
CNHYDIKTPLKSYHEHN

SEQ ID NO: 2004451 - protein, 20 aa, Staphylococcus
CNISESYCSNLFGRYLHMNF

SEQ ID NO: 2004452 - protein, 22 aa, Staphylococcus
CNIYPLLNRSLLYSSIILHDLG

SEQ ID NO: 2004453 - protein, 27 aa, Staphylococcus
CNKVIRDGCPIEYVLSVLGKKWNGVII

SEQ ID NO: 2004454 - protein, 17 aa, Staphylococcus
CNLKFKDYLLEKEIINQ

SEQ ID NO: 2004455 - protein, 31 aa, Staphylococcus; identical to SEQ ID NO: 1802944

SEQ ID NO: 2004456 - protein, 31 aa, Staphylococcus
CNNFCTFCIIPWARGLMRSRDPKKVVEQATT

SEQ ID NO: 2004457 - protein, 26 aa, Staphylococcus
CNRYAVPYLPGCGSVTEIVQAMESGV

SEQ ID NO: 2004458 - protein, 17 aa, Staphylococcus
CNRYKQFQDLALIENGI

SEQ ID NO: 2004459 - protein, 18 aa, Staphylococcus
CNVINFNSPYVIFGHSMG

SEQ ID NO: 2004460 - protein, 25 aa, Staphylococcus
CNVKFKSYLLDTGIIDQTWLDKIEN

SEQ ID NO: 2004461 - protein, 23 aa, Staphylococcus
CNYWGKRGAKRAVLARELSLEEI

SEQ ID NO: 2004462 - protein, 21 aa, Staphylococcus
CPAPCEQSCVMNINRDPVAIK

SEQ ID NO: 2004463 - protein, 24 aa, Staphylococcus
CPASIKAILKQAGYNDVITEETIG

SEQ ID NO: 2004464 - protein, 22 aa, Staphylococcus
CPECGNNMVCRRTYYKTKKSKE

SEQ ID NO: 2004465 - protein, 19 aa, Staphylococcus
CPHATVRFLVGGTQTNQVV

SEQ ID NO: 2004466 - protein, 19 aa, Staphylococcus
CPHRSMVLHTGLDPLYHSI

SEQ ID NO: 2004467 - protein, 24 aa, Staphylococcus
CPIQIKALLNQAGYNDTINEETVG

SEQ ID NO: 2004468 - protein, 21 aa, Staphylococcus
CPKLRPVIRTLRRLAAFIENT

SEQ ID NO: 2004469 - protein, 21 aa, Staphylococcus
CPLDEGVELFVGVPSERYPAH

SEQ ID NO: 2004470 - protein, 19 aa, Staphylococcus
CPNCKKKMTLFGRGKDATY

SEQ ID NO: 2004471 - protein, 18 aa, Staphylococcus
CPNCKKKMTLFGRGKDAV

SEQ ID NO: 2004472 - protein, 25 aa, Staphylococcus
CPNFVKGHVPELYIDNNRIKIRYNM

SEQ ID NO: 2004473 - protein, 19 aa, Staphylococcus
CPNFVKGHVPELYIENERI

SEQ ID NO: 2004474 - protein, 21 aa, Staphylococcus
CPRGASFSWYEYSPLRVRYPY

SEQ ID NO: 2004475 - protein, 20 aa, Staphylococcus
CPTCGKTPHYPFLKNRQRQY

SEQ ID NO: 2004476 - protein, 23 aa, Staphylococcus
CPVAVKALLKQAGYNDDITEETI

SEQ ID NO: 2004477 - protein, 19 aa, Staphylococcus
CPVSGVLQPGQTVRYDTVC

SEQ ID NO: 2004478 - protein, 19 aa, Staphylococcus
CPYGPRPGDEVKAFTTELA

SEQ ID NO: 2004479 - protein, 19 aa, Staphylococcus
CPYGPRPGDEVKQFTTQLA

SEQ ID NO: 2004480 - protein, 19 aa, Staphylococcus
CPYGPRPGEEVKTFTTQLA

SEQ ID NO: 2004481 - protein, 20 aa, Staphylococcus
CPYSKATRGNIDVDLNLQVV

SEQ ID NO: 2004482 - protein, 20 aa, Staphylococcus
CPYSKATRGNIEVDLNVAVV

SEQ ID NO: 2004483 - protein, 19 aa, Staphylococcus
CQAEACAIYVSLVKQKNLD

SEQ ID NO: 2004484 - protein, 20 aa, Staphylococcus
CQDKATGLKAIICIHDTTLG

SEQ ID NO: 2004485 - protein, 17 aa, Staphylococcus
CQEFRKYLMDNIPSTNT

SEQ ID NO: 2004486 - protein, 25 aa, Staphylococcus
CQEIRKISNVPIIFISSRTDNMDQI

SEQ ID NO: 2004487 - protein, 25 aa, Staphylococcus
CQEIRKSSNVPIIFISSRTDNMDQI

SEQ ID NO: 2004488 - protein, 22 aa, Staphylococcus
CQLIAQEVLKDFYILEKLFEMI

SEQ ID NO: 2004489 - protein, 18 aa, Staphylococcus
CQNIKSLGEFFKKENNKE

SEQ ID NO: 2004490 - protein, 25 aa, Staphylococcus
CQQHTEGLWRLKVMLGQDGTLTHQI

SEQ ID NO: 2004491 - protein, 17 aa, Staphylococcus
CQRCFRLKNYNEIQDVG

SEQ ID NO: 2004492 - protein, 18 aa, Staphylococcus
CQRCFRLKNYNEIQDVGM

SEQ ID NO: 2004493 - protein, 18 aa, Staphylococcus
CQSKRIHYFNGISDSSYL

SEQ ID NO: 2004494 - protein, 21 aa, Staphylococcus
CQTGKDFDKKLAELGAERLYE

SEQ ID NO: 2004495 - protein, 17 aa, Staphylococcus
CQTGKDFDNRLAELGAE

SEQ ID NO: 2004496 - protein, 19 aa, Staphylococcus
CRAHFKHNQINSISSHCSD

SEQ ID NO: 2004497 - protein, 20 aa, Staphylococcus
CRAKYQYSEAELKGLIEELN

SEQ ID NO: 2004498 - protein, 18 aa, Staphylococcus
CREGRPALCENGAAANEK

SEQ ID NO: 2004499 - protein, 17 aa, Staphylococcus
CRFGTQYTTRLGIRLEK

SEQ ID NO: 2004500 - protein, 23 aa, Staphylococcus
CRIEAWIAQIARKVDMMLNDVAV

SEQ ID NO: 2004501 - protein, 17 aa, Staphylococcus
CRIFEEILHVDRVGIKD

SEQ ID NO: 2004502 - protein, 18 aa, Staphylococcus
CRKMRQVSNVPILFLSSR

SEQ ID NO: 2004503 - protein, 21 aa, Staphylococcus
CRLAIRFLKKRNIVYETEKID

SEQ ID NO: 2004504 - protein, 17 aa, Staphylococcus
CRLGIRPEDLHLITNDD

SEQ ID NO: 2004505 - protein, 17 aa, Staphylococcus
CRLLSKDGVNLIVTDIN

SEQ ID NO: 2004506 - protein, 17 aa, Staphylococcus
CRNKYQFSEEELQQLLD

SEQ ID NO: 2004507 - protein, 24 aa, Staphylococcus
CRPIEGWNTVAFAKDWQGPPRLQN

SEQ ID NO: 2004508 - protein, 18 aa, Staphylococcus
CRQTLKRINIEPSYRQAL

SEQ ID NO: 2004509 - protein, 18 aa, Staphylococcus
CRSTTVPHVGSWRYKFFK

SEQ ID NO: 2004510 - protein, 20 aa, Staphylococcus
CRYFGKTYINFEDWVQNINL

SEQ ID NO: 2004511 - protein, 18 aa, Staphylococcus
CSDELAAIAKHRAPSNDE

SEQ ID NO: 2004512 - protein, 18 aa, Staphylococcus
CSEFKPYYLTKALQKLKD

SEQ ID NO: 2004513 - protein, 24 aa, Staphylococcus
CSEHHPARCHRLIVSNYLAAHGWR

SEQ ID NO: 2004514 - protein, 25 aa, Staphylococcus
CSFEVAELKLGLKQVSFETSTSSVK

SEQ ID NO: 2004515 - protein, 24 aa, Staphylococcus
CSFSEFVPICIFKKQGFKPCSYLV

SEQ ID NO: 2004516 - protein, 20 aa, Staphylococcus
CSGLLRADFFVTEDNQIFIN

SEQ ID NO: 2004517 - protein, 25 aa, Staphylococcus
CSICNKESRVALFMRKTRTGNDGQY

SEQ ID NO: 2004518 - protein, 26 aa, Staphylococcus
CSLASRIPYGEALSFTKVNKVNEAEK

SEQ ID NO: 2004519 - protein, 19 aa, Staphylococcus
CSRELHFSLSQEAFDMSDS

SEQ ID NO: 2004520 - protein, 17 aa, Staphylococcus
CSRHFGYSDRWCDKMIN

SEQ ID NO: 2004521 - protein, 17 aa, Staphylococcus
CSYAQGFAQMRKASEEN

SEQ ID NO: 2004522 - protein, 17 aa, Staphylococcus
CSYAQGFAQMRKASNEN

SEQ ID NO: 2004523 - protein, 21 aa, Staphylococcus
CSYDVTNKVFKIWQNNDNTIN

SEQ ID NO: 2004524 - protein, 20 aa, Staphylococcus
CTAGTRVLVPNSIKEDFLKA

SEQ ID NO: 2004525 - protein, 19 aa, Staphylococcus
CTGIIGGKFGEWLTNNLDE

SEQ ID NO: 2004526 - protein, 21 aa, Staphylococcus
CTGRMRYLGVLLYDADRVEEM

SEQ ID NO: 2004527 - protein, 21 aa, Staphylococcus
CTGRMRYLGVLLYDADRVHEV

SEQ ID NO: 2004528 - protein, 22 aa, Staphylococcus
CTGRMRYLGVMLYDADRVQEAA

SEQ ID NO: 2004529 - protein, 18 aa, Staphylococcus
CTHVDGVLHPLEIIETMQ

SEQ ID NO: 2004530 - protein, 20 aa, Staphylococcus
CTHYPLLYKPINDYFGGEKK

SEQ ID NO: 2004531 - protein, 19 aa, Staphylococcus
CTISPKFEGLTGRQKMDDL

SEQ ID NO: 2004532 - protein, 19 aa, Staphylococcus
CTKAIKINEQFQISKQFWA

SEQ ID NO: 2004533 - protein, 20 aa, Staphylococcus
CTKCENMATAKTCPHDKKYH

SEQ ID NO: 2004534 - protein, 18 aa, Staphylococcus
CTKIRKQIRLKRTKLKNT

SEQ ID NO: 2004535 - protein, 18 aa, Staphylococcus
CTPRDLFAKDKYITNWHI

SEQ ID NO: 2004536 - protein, 25 aa, Staphylococcus
CTQATEALPNWAAENGYPVTNYEQL

SEQ ID NO: 2004537 - protein, 25 aa, Staphylococcus
CTQATEALPNWAAEQGYPVTNYEQL

SEQ ID NO: 2004538 - protein, 20 aa, Staphylococcus
CTSIGLKVSFCPKDYSQEGF

SEQ ID NO: 2004539 - protein, 24 aa, Staphylococcus
CTTCKKAAKFLDEYGVSYEPIDIV

SEQ ID NO: 2004540 - protein, 20 aa, Staphylococcus
CTTEACDFRDNMAMFNDLDI

SEQ ID NO: 2004541 - protein, 17 aa, Staphylococcus
CTTEIEYHQPLLPQYQT

SEQ ID NO: 2004542 - protein, 25 aa, Staphylococcus
CTVDHICITSGALQGLKLIADGLLI

SEQ ID NO: 2004543 - protein, 22 aa, Staphylococcus
CVAAASMYNCEFFYFTPDDIDY

SEQ ID NO: 2004544 - protein, 20 aa, Staphylococcus
CVCCDLKIDLVNQIESLVQG

SEQ ID NO: 2004545 - protein, 28 aa, Staphylococcus
CVDNLPPILLPKFVELMGQGNPSLQKVA

SEQ ID NO: 2004546 - protein, 22 aa, Staphylococcus
CVDNLPPVLLPKFVELMEQGNP

SEQ ID NO: 2004547 - protein, 17 aa, Staphylococcus
CVDRKGYEWVIQTTKKA

SEQ ID NO: 2004548 - protein, 25 aa, Staphylococcus
CVNEGIKPIFGMTVMVSDEISTIET

SEQ ID NO: 2004549 - protein, 18 aa, Staphylococcus
CVNERGEIVTLTRDELEL

SEQ ID NO: 2004550 - protein, 17 aa, Staphylococcus
CVNYCLQAADILAADGI

SEQ ID NO: 2004551 - protein, 24 aa, Staphylococcus
CVQKFSNVRFRIHEGSEQELAQLI

SEQ ID NO: 2004552 - protein, 21 aa, Staphylococcus
CVRICTYCDFNKYFIDKQPVD

SEQ ID NO: 2004553 - protein, 18 aa, Staphylococcus
CVRILRRDADRIGIERNF

SEQ ID NO: 2004554 - protein, 23 aa, Staphylococcus
CVSANIKPIFGMTVYITDGLSSV

SEQ ID NO: 2004555 - protein, 21 aa, Staphylococcus
CVTVEPGIYIEGLGGIRIEDD

SEQ ID NO: 2004556 - protein, 20 aa, Staphylococcus
CVVNNAFRPFEFNAETRQVA

SEQ ID NO: 2004557 - protein, 18 aa, Staphylococcus
CVVTEKFDQTTVTMAGVA

SEQ ID NO: 2004558 - protein, 19 aa, Staphylococcus
CVYFCNSGAEANEAAIKLA

SEQ ID NO: 2004559 - protein, 17 aa, Staphylococcus
CWYAVHTYSGYENKVKK

SEQ ID NO: 2004560 - protein, 17 aa, Staphylococcus
CYCGCVFAAMEQGIDFK

SEQ ID NO: 2004561 - protein, 20 aa, Staphylococcus
CYEGDEWRTVILPSSDREAS

SEQ ID NO: 2004562 - protein, 19 aa, Staphylococcus
CYENADFIYESAVEQGMMP

SEQ ID NO: 2004563 - protein, 33 aa, Staphylococcus
CYFDPAHVADLMIRVEVVLGEFSNLDILNITSH

SEQ ID NO: 2004564 - protein, 36 aa, Staphylococcus
CYHFRRGNCKGASTLFKRAYRVANLILKNIENLGLS

SEQ ID NO: 2004565 - protein, 20 aa, Staphylococcus
CYIAMTRAREKVTFSYSLMG

SEQ ID NO: 2004566 - protein, 19 aa, Staphylococcus
CYKYLRKLIFEETELEETY

SEQ ID NO: 2004567 - protein, 18 aa, Staphylococcus
CYLLEHYASGEVLENRVA

SEQ ID NO: 2004568 - protein, 19 aa, Staphylococcus
CYREIGLAYKKSHYFTEVA

SEQ ID NO: 2004569 - protein, 17 aa, Staphylococcus
CYTLLRPDGKTMFYLHS

SEQ ID NO: 2004570 - protein, 23 aa, Staphylococcus
CYVSDRFLPDKAIDLIDEASSKV

SEQ ID NO: 2004571 - protein, 26 aa, Staphylococcus
DAAAISLGLCHPEFDVKMITTVNGNV

SEQ ID NO: 2004572 - protein, 17 aa, Staphylococcus
DAAESTPSFGDRKTYQM

SEQ ID NO: 2004573 - protein, 25 aa, Staphylococcus
DAAFFNCHFDAHLLQSSYFIKSIIL

SEQ ID NO: 2004574 - protein, 23 aa, Staphylococcus
DAAKDLNDFLGINYYMSDWMKAY

SEQ ID NO: 2004575 - protein, 19 aa, Staphylococcus
DAALARRFNEVVVNEPSAQ

SEQ ID NO: 2004576 - protein, 22 aa, Staphylococcus
DAANLLSGLGIDASLQDKKMSE

SEQ ID NO: 2004577 - protein, 22 aa, Staphylococcus
DAANLLSGLGIQADLHDRKMSE

SEQ ID NO: 2004578 - protein, 24 aa, Staphylococcus
DAAPKLKIIANLAVGYDNIDIPLA

SEQ ID NO: 2004579 - protein, 27 aa, Staphylococcus
DAARLSEVLVLIEFDAAIELLLLSDVL

SEQ ID NO: 2004580 - protein, 18 aa, Staphylococcus
DAATFKAWLQLFLDEQLT

SEQ ID NO: 2004581 - protein, 18 aa, Staphylococcus
DAATLIFENFEILEAKSK

SEQ ID NO: 2004582 - protein, 20 aa, Staphylococcus
DAAVCGEVFTSPTPDKILSA

SEQ ID NO: 2004583 - protein, 20 aa, Staphylococcus
DAAVCGEVFTSPTPDKVLEA

SEQ ID NO: 2004584 - protein, 26 aa, Staphylococcus
DACIAKDIHPIFGMTISLTDGLYTVE

SEQ ID NO: 2004585 - protein, 19 aa, Staphylococcus
DACRAIGITDLRKMGLRDK

SEQ ID NO: 2004586 - protein, 18 aa, Staphylococcus
DACRGWRYCMTGCPYKKV

SEQ ID NO: 2004587 - protein, 25 aa, Staphylococcus
DADEVWYYHAGESLTIHMITPQGNY

SEQ ID NO: 2004588 - protein, 24 aa, Staphylococcus
DADEVWYYHAGVSLEIHMLTEDGQ

SEQ ID NO: 2004589 - protein, 17 aa, Staphylococcus
DADGYFWFEGRKDDIII

SEQ ID NO: 2004590 - protein, 22 aa, Staphylococcus
DADIPVWLDRTSPFNIEGGDEL

SEQ ID NO: 2004591 - protein, 21 aa, Staphylococcus
DADIRILRRLIRDTKERGRSM

SEQ ID NO: 2004592 - protein, 17 aa, Staphylococcus
DADKGWHDLKIVPYAPF

SEQ ID NO: 2004593 - protein, 20 aa, Staphylococcus
DADLPGALQREQCQFMHEGS

SEQ ID NO: 2004594 - protein, 20 aa, Staphylococcus
DADLRILRRLLRDTEERGRT

SEQ ID NO: 2004595 - protein, 21 aa, Staphylococcus
DADLRILRRLMRDTKERGRSM

SEQ ID NO: 2004596 - protein, 17 aa, Staphylococcus
DADLVICGTSGLNAVER

SEQ ID NO: 2004597 - protein, 23 aa, Staphylococcus
DADNKLNIVSAFEEGEIEPQAVK

SEQ ID NO: 2004598 - protein, 17 aa, Staphylococcus
DADPGWLGPKNMKYFSQ

SEQ ID NO: 2004599 - protein, 21 aa, Staphylococcus
DADVFIGVSIADLLSKEMVES

SEQ ID NO: 2004600 - protein, 24 aa, Staphylococcus
DADVPVWLDRDCPFNIEGGDELVL

SEQ ID NO: 2004601 - protein, 19 aa, Staphylococcus
DADVPVWLDRNSPYNIEGG

SEQ ID NO: 2004602 - protein, 17 aa, Staphylococcus
DADYSGGFVKGEAPQFP

SEQ ID NO: 2004603 - protein, 21 aa, Staphylococcus
DAEDAFYLTVEAFNLAEEYQC

SEQ ID NO: 2004604 - protein, 18 aa, Staphylococcus
DAEGEGFEVINRDEYQRQ

SEQ ID NO: 2004605 - protein, 20 aa, Staphylococcus
DAEGFPKLLQQALDTQNDIL

SEQ ID NO: 2004606 - protein, 23 aa, Staphylococcus
DAEGRLVLGDAVFYANQFQPKII

SEQ ID NO: 2004607 - protein, 24 aa, Staphylococcus
DAEGRLVLGDGVFYANQFQPRLIC

SEQ ID NO: 2004608 - protein, 23 aa, Staphylococcus
DAEILEWFDAIGRRRGLLQKGNE

SEQ ID NO: 2004609 - protein, 19 aa, Staphylococcus
DAEKIFVDFVKTYDVELIA

SEQ ID NO: 2004610 - protein, 22 aa, Staphylococcus
DAELDMVICITEHIPVVDMIKV

SEQ ID NO: 2004611 - protein, 22 aa, Staphylococcus
DAELDMVICITEHIPVVDMVKV

SEQ ID NO: 2004612 - protein, 19 aa, Staphylococcus
DAERARHVVAMIKEQISDK

SEQ ID NO: 2004613 - protein, 27 aa, Staphylococcus
DAESKKRFEEMLGWFKYEIRQYTESDI

SEQ ID NO: 2004614 - protein, 28 aa, Staphylococcus
DAEVLAMVMQIYQSFGLKHLKLVINSIG

SEQ ID NO: 2004615 - protein, 19 aa, Staphylococcus
DAEYNKVCEILGREPNFTE

SEQ ID NO: 2004616 - protein, 26 aa, Staphylococcus
DAFAKVKGRLIVSCYASNFIRIQQVL

SEQ ID NO: 2004617 - protein, 18 aa, Staphylococcus
DAFEAWGGIAGVQNNVDI

SEQ ID NO: 2004618 - protein, 18 aa, Staphylococcus
DAFGDRLVVFDGESKNEV

SEQ ID NO: 2004619 - protein, 24 aa, Staphylococcus
DAFGEAALAFKIRTTLLRDTGACL

SEQ ID NO: 2004620 - protein, 17 aa, Staphylococcus
DAFGRYLANVFYDTGNE

SEQ ID NO: 2004621 - protein, 19 aa, Staphylococcus
DAFHFVAGILKNARGFTGV

SEQ ID NO: 2004622 - protein, 23 aa, Staphylococcus
DAFIGCNTNLIAPVTVGDGALIA

SEQ ID NO: 2004623 - protein, 24 aa, Staphylococcus
DAFIGCNTNLIAPVTVGDGSLIAA

SEQ ID NO: 2004624 - protein, 24 aa, Staphylococcus
DAFIGCNTNLIAPVTVGDHSLIAA

SEQ ID NO: 2004625 - protein, 24 aa, Staphylococcus
DAFIGCNTNLIAPVTVNDHTLIAA

SEQ ID NO: 2004626 - protein, 19 aa, Staphylococcus
DAFKLLKQDQLICLERMGA

SEQ ID NO: 2004627 - protein, 17 aa, Staphylococcus
DAFPITPHVSYEMSAND

SEQ ID NO: 2004628 - protein, 32 aa, Staphylococcus
DAFSLEMWGGATFDVAYNFLKENPWERLEKLR

SEQ ID NO: 2004629 - protein, 24 aa, Staphylococcus
DAGERVWVKYHFRTQQGIENYTDE

SEQ ID NO: 2004630 - protein, 25 aa, Staphylococcus
DAGIEEMYIRSAFTCNTRHGVCEKC

SEQ ID NO: 2004631 - protein, 24 aa, Staphylococcus
DAGKIFYKKCEEIIALYDNIPFEI

SEQ ID NO: 2004632 - protein, 24 aa, Staphylococcus
DAGLPREVLIPWEDLPKVKSLWPQ

SEQ ID NO: 2004633 - protein, 20 aa, Staphylococcus
DAGNMLKPMLARGELHCIGA

SEQ ID NO: 2004634 - protein, 24 aa, Staphylococcus
DAGSDVKHAFNFTTTEHPKNIYVF

SEQ ID NO: 2004635 - protein, 19 aa, Staphylococcus
DAHAKWLKLMSGQYSETYH

SEQ ID NO: 2004636 - protein, 20 aa, Staphylococcus
DAHEFCPYSKATRGNIEVDL

SEQ ID NO: 2004637 - protein, 19 aa, Staphylococcus
DAHIGHLQGIMDLLAQKQM

SEQ ID NO: 2004638 - protein, 18 aa, Staphylococcus
DAHRAVEVTQMIRDRITN

SEQ ID NO: 2004639 - protein, 25 aa, Staphylococcus
DAIAAKAKDGAACVEYIGPNGAGHY

SEQ ID NO: 2004640 - protein, 25 aa, Staphylococcus
DAIAAKAKDGASCVTYIGPNGAGHY

SEQ ID NO: 2004641 - protein, 22 aa, Staphylococcus
DAIEKARRLSFQTEDMKRQSKV

SEQ ID NO: 2004642 - protein, 18 aa, Staphylococcus
DAIERPAVVTIMGHVDHG

SEQ ID NO: 2004643 - protein, 19 aa, Staphylococcus
DAIHPMKSLAPRDITSRAL

SEQ ID NO: 2004644 - protein, 19 aa, Staphylococcus
DAIIYACDLILKGELDGHF

SEQ ID NO: 2004645 - protein, 17 aa, Staphylococcus
DAIKYLKSMEGNAYNPD

SEQ ID NO: 2004646 - protein, 31 aa, Staphylococcus
DAILECADADLDLAICITEHIPVLDMVKVVR

SEQ ID NO: 2004647 - protein, 19 aa, Staphylococcus
DAILRQVIREEGLEREIWQ

SEQ ID NO: 2004648 - protein, 19 aa, Staphylococcus
DAINFFNYLSGYSLKPHYN

SEQ ID NO: 2004649 - protein, 25 aa, Staphylococcus
DAINFFNYLSGYSVKPEYNKLIVAP

SEQ ID NO: 2004650 - protein, 35 aa, Staphylococcus
DAINFFNYLSGYSVKPEYNKLIVAPFDIRDVFLAR

SEQ ID NO: 2004651 - protein, 19 aa, Staphylococcus
DAINFFNYLSGYSVKPVYN

SEQ ID NO: 2004652 - protein, 20 aa, Staphylococcus
DAIQIVPLIIKYASELKNEG

SEQ ID NO: 2004653 - protein, 20 aa, Staphylococcus
DAIQIVPLIIKYTSILKNEG

SEQ ID NO: 2004654 - protein, 23 aa, Staphylococcus
DAIQLPIKVLKNVIAQTNFAVST

SEQ ID NO: 2004655 - protein, 18 aa, Staphylococcus
DAIQMIPLVVKYKNQLTE

SEQ ID NO: 2004656 - protein, 18 aa, Staphylococcus
DAIQMVPLLVKYKNLLDK

SEQ ID NO: 2004657 - protein, 19 aa, Staphylococcus
DAIRATEITTHFKNVHGTP

SEQ ID NO: 2004658 - protein, 18 aa, Staphylococcus
DAISSMIYPSHWSNGDFG

SEQ ID NO: 2004659 - protein, 18 aa, Staphylococcus
DAIVYACDLILKGELDEH

SEQ ID NO: 2004660 - protein, 21 aa, Staphylococcus
DAKAALTLCHDFIKQLELDMR

SEQ ID NO: 2004661 - protein, 19 aa, Staphylococcus
DAKACAMITYRLLKHYDSL

SEQ ID NO: 2004662 - protein, 23 aa, Staphylococcus
DAKDWEKDLAMIFIVINKQSKKV

SEQ ID NO: 2004663 - protein, 18 aa, Staphylococcus
DAKFPVVQNYNAEGETDA

SEQ ID NO: 2004664 - protein, 25 aa, Staphylococcus
DAKGIKRLILIAAPGIYDELPEAFN

SEQ ID NO: 2004665 - protein, 23 aa, Staphylococcus
DAKHFPSHLFKKYAKEVFEEDQL

SEQ ID NO: 2004666 - protein, 26 aa, Staphylococcus
DAKIPSKFKFSRLVIDADQEKTAVIY

SEQ ID NO: 2004667 - protein, 36 aa, Staphylococcus
DAKKHWIGIPLWVHRRCLKPMFTIANQIAYDNKMVL

SEQ ID NO: 2004668 - protein, 30 aa, Staphylococcus
DAKKLDAIVILSDFNRRYLSGFTGTSGALI

SEQ ID NO: 2004669 - protein, 32 aa, Staphylococcus
DAKLAETLHSIFLEVVIAPKFTEEALEILTQK

SEQ ID NO: 2004670 - protein, 20 aa, Staphylococcus
DAKLHFAAIYVDVQAKKKFE

SEQ ID NO: 2004671 - protein, 21 aa, Staphylococcus
DAKLLKFHGSYMQDDRDLRDE

SEQ ID NO: 2004672 - protein, 25 aa, Staphylococcus
DAKPEDYDALLIPGGFSPDHLRGDA

SEQ ID NO: 2004673 - protein, 25 aa, Staphylococcus
DAKPEDYDGLLIPGGFAPDHLRGDA

SEQ ID NO: 2004674 - protein, 24 aa, Staphylococcus
DAKPEDYDGLLIPGGFSPDHLRGD

SEQ ID NO: 2004675 - protein, 24 aa, Staphylococcus
DAKPENYDALLIPGGFSPDHLRGD

SEQ ID NO: 2004676 - protein, 24 aa, Staphylococcus
DAKPENYDALLIPGGFSPDNLRGD

SEQ ID NO: 2004677 - protein, 24 aa, Staphylococcus
DAKRKVAIALRNRYRRSLLDEETK

SEQ ID NO: 2004678 - protein, 22 aa, Staphylococcus
DAKSIHQFNQWSIDYVSCSPFR

SEQ ID NO: 2004679 - protein, 17 aa, Staphylococcus
DALDIRLEPKFKSDIVP

SEQ ID NO: 2004680 - protein, 24 aa, Staphylococcus
DALETFYRSKVDGIIFMATDITDK

SEQ ID NO: 2004681 - protein, 20 aa, Staphylococcus
DALGVPVEFEDRGSFNIDSM

SEQ ID NO: 2004682 - protein, 27 aa, Staphylococcus
DALKRARTNLEFGLSGITARDPLDPNI

SEQ ID NO: 2004683 - protein, 18 aa, Staphylococcus
DALLHCIDVTYANDDYYY

SEQ ID NO: 2004684 - protein, 20 aa, Staphylococcus
DALQLRFIMDWNSQSKREHL

SEQ ID NO: 2004685 - protein, 29 aa, Staphylococcus
DALSRDYIKAHGYGNEFGHSLGHGIGLDI

SEQ ID NO: 2004686 - protein, 17 aa, Staphylococcus
DALYLNDQVMEFDLTPN

SEQ ID NO: 2004687 - protein, 23 aa, Staphylococcus
DAMAKEGHHFFGLLYIGAILTQE

SEQ ID NO: 2004688 - protein, 18 aa, Staphylococcus
DAMCAIDAIGVCDTLRVP

SEQ ID NO: 2004689 - protein, 19 aa, Staphylococcus
DAMLNYPEDFHVFRKLNKV

SEQ ID NO: 2004690 - protein, 28 aa, Staphylococcus
DAMVRLSQDWKLRHVLIEMHGNNGSIDN

SEQ ID NO: 2004691 - protein, 29 aa, Staphylococcus
DAMVRLSQDWKLRHVLVEMHGNNGSIDND

SEQ ID NO: 2004692 - protein, 29 aa, Staphylococcus
DAMVRLSQEWKLRHVLIEMHGNNGSIDND

SEQ ID NO: 2004693 - protein, 24 aa, Staphylococcus
DANAFPTPAIFDWLQEQGNISTDE

SEQ ID NO: 2004694 - protein, 28 aa, Staphylococcus
DANEFKNYILGLIFYRFLSEKVEEQSER

SEQ ID NO: 2004695 - protein, 28 aa, Staphylococcus
DANEFKNYILGLIFYRFLSEKVEETSAR

SEQ ID NO: 2004696 - protein, 25 aa, Staphylococcus
DANEGARLYCWNIGLPNVTEYINFT

SEQ ID NO: 2004697 - protein, 19 aa, Staphylococcus
DANFGRIVTAIGYASRYIE

SEQ ID NO: 2004698 - protein, 25 aa, Staphylococcus
DANKKRILGKFSYVFTTLKVIANPK

SEQ ID NO: 2004699 - protein, 29 aa, Staphylococcus
DANPEDYDALLIPGGFSPDYLRGDTEGRY

SEQ ID NO: 2004700 - protein, 24 aa, Staphylococcus
DANSFKEWLELFLNEQLTYSDGLA

SEQ ID NO: 2004701 - protein, 28 aa, Staphylococcus
DANVRECMKLQSPRIMLGFKNTPGDLSP

SEQ ID NO: 2004702 - protein, 25 aa, Staphylococcus
DAPIYPGTIFYRWYDFEQDCKPWGV

SEQ ID NO: 2004703 - protein, 24 aa, Staphylococcus
DAPYSGLCLESFTGDYPAGLYDYE

SEQ ID NO: 2004704 - protein, 28 aa, Staphylococcus
DAQAQFGLPGRYLWSVYEPESDDSNMTD

SEQ ID NO: 2004705 - protein, 18 aa, Staphylococcus
DAQLRGVDSSGMVCSMKE

SEQ ID NO: 2004706 - protein, 23 aa, Staphylococcus
DAQWEAMLLGWKVIPSVKSNAII

SEQ ID NO: 2004707 - protein, 19 aa, Staphylococcus
DAQWLYHHFSESFQEVSSF

SEQ ID NO: 2004708 - protein, 28 aa, Staphylococcus
DARFAYDCYRRLLQMFGDVVYGVAMTHF

SEQ ID NO: 2004709 - protein, 37 aa, Staphylococcus
DARFAYDCYRRLLQMFGEVVYGIPMLAFDTYFDDFKN

SEQ ID NO: 2004710 - protein, 19 aa, Staphylococcus
DARFIEMVIYFNHKGDGNL

SEQ ID NO: 2004711 - protein, 18 aa, Staphylococcus
DARIQDVFNAYTTKSKFE

SEQ ID NO: 2004712 - protein, 23 aa, Staphylococcus
DARRRREILGRKLHIGHSNGKQL

SEQ ID NO: 2004713 - protein, 25 aa, Staphylococcus
DARSCRAYGSAALEIISVAKGQLAA

SEQ ID NO: 2004714 - protein, 19 aa, Staphylococcus
DASEIFIKNFKHFLNDGDV

SEQ ID NO: 2004715 - protein, 25 aa, Staphylococcus
DASHQRLTENLTWADNRASRYAEAI

SEQ ID NO: 2004716 - protein, 26 aa, Staphylococcus
DASIKAGIKPVFGMTIYLSDGLTELE

SEQ ID NO: 2004717 - protein, 25 aa, Staphylococcus
DASYLKEFMNIYALLIPKVTDIESI

SEQ ID NO: 2004718 - protein, 25 aa, Staphylococcus
DASYLKEFTNLYALLIPKAPSMKDV

SEQ ID NO: 2004719 - protein, 20 aa, Staphylococcus
DATCGNGFDTLFLAQHVPKG

SEQ ID NO: 2004720 - protein, 22 aa, Staphylococcus
DATDAWLAFLGLDVQTIETLDY

SEQ ID NO: 2004721 - protein, 20 aa, Staphylococcus
DATMDDFRKLNALYEQLDSE

SEQ ID NO: 2004722 - protein, 33 aa, Staphylococcus
DATPIRLGQEISGWRYMLDKCEQLLAESKQHIL

SEQ ID NO: 2004723 - protein, 23 aa, Staphylococcus
DATVEVAFRLVIDTRKNDQQIRG

SEQ ID NO: 2004724 - protein, 25 aa, Staphylococcus
DATVYMLGGNGLRTALTEAGLTVKD

SEQ ID NO: 2004725 - protein, 17 aa, Staphylococcus
DAVGDWAVLNALINTAA

SEQ ID NO: 2004726 - protein, 17 aa, Staphylococcus
DAVITMPEFIKEFLNIE

SEQ ID NO: 2004727 - protein, 26 aa, Staphylococcus
DAVKIVRKRGELMAQAFPNGVGSMAA

SEQ ID NO: 2004728 - protein, 26 aa, Staphylococcus
DAVKIVRKRGELMTQAFPNGVGSMAA

SEQ ID NO: 2004729 - protein, 25 aa, Staphylococcus
DAVKIVRKRGLLMAQAFPNGVGSMA

SEQ ID NO: 2004730 - protein, 25 aa, Staphylococcus
DAVKIVRKRGQLMAEAFPDGVGSMA

SEQ ID NO: 2004731 - protein, 17 aa, Staphylococcus
DAVKLKQIFSRKQSEFL

SEQ ID NO: 2004732 - protein, 25 aa, Staphylococcus
DAVKRAKELVQLVGLSGREKAYPSE

SEQ ID NO: 2004733 - protein, 18 aa, Staphylococcus
DAVLCAKQFIGNEPFAIL

SEQ ID NO: 2004734 - protein, 19 aa, Staphylococcus
DAVPYFRMFNPIKQSERFD

SEQ ID NO: 2004735 - protein, 20 aa, Staphylococcus
DAVQIVPLIIKYASQLKNEG

SEQ ID NO: 2004736 - protein, 17 aa, Staphylococcus
DAVRFRLPAHSFDYASD

SEQ ID NO: 2004737 - protein, 22 aa, Staphylococcus
DAVTKSGFVKRFQVLEPSIQDI

SEQ ID NO: 2004738 - protein, 18 aa, Staphylococcus
DAVVGFFASLGFSIDYRQ

SEQ ID NO: 2004739 - protein, 17 aa, Staphylococcus
DAVVYSLGLARTRRQAR

SEQ ID NO: 2004740 - protein, 22 aa, Staphylococcus
DAVWQFSEEVIFPHVEDDELMG

SEQ ID NO: 2004741 - protein, 24 aa, Staphylococcus
DAVYAAGVDKVFGVPGDFNLAFLD

SEQ ID NO: 2004742 - protein, 33 aa, Staphylococcus
DAWTHLWSGQAPRLAIDSHVAGLFDKLLTEIEA

SEQ ID NO: 2004743 - protein, 18 aa, Staphylococcus
DAYCIERAKQLKVAVNIN

SEQ ID NO: 2004744 - protein, 22 aa, Staphylococcus
DAYELGSKIALYGEDDKLYGVL

SEQ ID NO: 2004745 - protein, 18 aa, Staphylococcus
DAYENLLFDCLKGDATNF

SEQ ID NO: 2004746 - protein, 17 aa, Staphylococcus
DAYKAIDYVKDFAEELG

SEQ ID NO: 2004747 - protein, 19 aa, Staphylococcus
DAYLTPRLQPWDYAGGLMI

SEQ ID NO: 2004748 - protein, 25 aa, Staphylococcus
DAYNLWLHVDGAYGLSHILSDDAQH

SEQ ID NO: 2004749 - protein, 19 aa, Staphylococcus
DAYQLAAKVIERLNQQLDV

SEQ ID NO: 2004750 - protein, 24 aa, Staphylococcus
DAYRPEVHDVRNFPEQSAVADRML

SEQ ID NO: 2004751 - protein, 20 aa, Staphylococcus
DAYSRIFKRAGINARPVVAD

SEQ ID NO: 2004752 - protein, 23 aa, Staphylococcus
DAYTKKELFEQWFHPKGASIEVY

SEQ ID NO: 2004753 - protein, 17 aa, Staphylococcus
DCARIEADLTYQNKTRI

SEQ ID NO: 2004754 - protein, 25 aa, Staphylococcus
DCDAPYSGLCVESFTGDYPAGLYDY

SEQ ID NO: 2004755 - protein, 19 aa, Staphylococcus
DCEAAGVYGLIIPDLPFEL

SEQ ID NO: 2004756 - protein, 17 aa, Staphylococcus
DCGAQLEASMKYIDEND

SEQ ID NO: 2004757 - protein, 20 aa, Staphylococcus
DCGEESYIGHGRLEGLKMLV

SEQ ID NO: 2004758 - protein, 20 aa, Staphylococcus
DCKIPGFGQIGLKSIYVKKI

SEQ ID NO: 2004759 - protein, 17 aa, Staphylococcus
DCLLKGVHDRGMKLILD

SEQ ID NO: 2004760 - protein, 18 aa, Staphylococcus
DCLVKKQLVNRVKDDKDK

SEQ ID NO: 2004761 - protein, 20 aa, Staphylococcus
DCNVCKKHEYALLNDKYDNK

SEQ ID NO: 2004762 - protein, 17 aa, Staphylococcus
DCQFLAKNFKLMEQLYC

SEQ ID NO: 2004763 - protein, 18 aa, Staphylococcus
DCSGLVRADFFVTEDNQI

SEQ ID NO: 2004764 - protein, 23 aa, Staphylococcus
DCSIKEGTAFFLADAYAQQGNLA

SEQ ID NO: 2004765 - protein, 19 aa, Staphylococcus
DCVKNAGIDYDVFKEDLQK

SEQ ID NO: 2004766 - protein, 20 aa, Staphylococcus
DCYAILGLVHTLWKPMPGRF

SEQ ID NO: 2004767 - protein, 23 aa, Staphylococcus
DCYELYHPLERVGVYVPGGKASY

SEQ ID NO: 2004768 - protein, 23 aa, Staphylococcus
DDADFAALAFKVMTDPYVGKLTF

SEQ ID NO: 2004769 - protein, 17 aa, Staphylococcus
DDADLGFGQSFKHKSKN

SEQ ID NO: 2004770 - protein, 18 aa, Staphylococcus
DDAFTYQNIETLKKILQR

SEQ ID NO: 2004771 - protein, 19 aa, Staphylococcus
DDAILGFHGTELLSADPEG

SEQ ID NO: 2004772 - protein, 26 aa, Staphylococcus
DDAIQEWYRVLPLINELPIKDLDKGL

SEQ ID NO: 2004773 - protein, 18 aa, Staphylococcus
DDAKDCLQKGAFVSDKDG

SEQ ID NO: 2004774 - protein, 25 aa, Staphylococcus
DDAKRKVAIALRNRYRRSLLDEEAK

SEQ ID NO: 2004775 - protein, 25 aa, Staphylococcus
DDAKRKVAIALRNRYRRSLLDEESK

SEQ ID NO: 2004776 - protein, 25 aa, Staphylococcus
DDAKRKVAIALRNRYRRSLLDEETK

SEQ ID NO: 2004777 - protein, 25 aa, Staphylococcus
DDAKRKVAIALRNRYRRSLLTEEEK

SEQ ID NO: 2004778 - protein, 20 aa, Staphylococcus
DDALCFYDLGSSEMNIDLAI

SEQ ID NO: 2004779 - protein, 17 aa, Staphylococcus
DDALRLANEDLFETKAI

SEQ ID NO: 2004780 - protein, 18 aa, Staphylococcus
DDAPDLVNLLTFIVNQKL

SEQ ID NO: 2004781 - protein, 26 aa, Staphylococcus
DDAPEVYYLKAFIKHKLLQYIDEGLE

SEQ ID NO: 2004782 - protein, 25 aa, Staphylococcus
DDAPEVYYLKEFIKHKIKQLLDEGL

SEQ ID NO: 2004783 - protein, 25 aa, Staphylococcus
DDAPEVYYLKQFIRHKLINYLDEGL

SEQ ID NO: 2004784 - protein, 17 aa, Staphylococcus
DDARLTIEVIKKAAEQG

SEQ ID NO: 2004785 - protein, 25 aa, Staphylococcus
DDATKRATYTFTVFVDTHSNVTGTL

SEQ ID NO: 2004786 - protein, 21 aa, Staphylococcus
DDATLEFKDVHGLSLALVEGE

SEQ ID NO: 2004787 - protein, 29 aa, Staphylococcus
DDDLELLESVAFQIGSAIKRILLTNKEKE

SEQ ID NO: 2004788 - protein, 24 aa, Staphylococcus
DDEFQLRAKLFVDQIVSFANNSPY

SEQ ID NO: 2004789 - protein, 19 aa, Staphylococcus
DDEIIGFANFIYGEELYLA

SEQ ID NO: 2004790 - protein, 17 aa, Staphylococcus
DDEIKRDISCNLGSLNI

SEQ ID NO: 2004791 - protein, 20 aa, Staphylococcus
DDEKGCPWDKVQTHQTLKRY

SEQ ID NO: 2004792 - protein, 20 aa, Staphylococcus
DDEKRTSIENVVRNIINKNV

SEQ ID NO: 2004793 - protein, 25 aa, Staphylococcus
DDELKARFPNTIKLVSSGHDSIDII

SEQ ID NO: 2004794 - protein, 18 aa, Staphylococcus
DDEMFKLVHDMRTRVVTS

SEQ ID NO: 2004795 - protein, 24 aa, Staphylococcus
DDERFKLGIILSYLKQYEASQKLL

SEQ ID NO: 2004796 - protein, 26 aa, Staphylococcus
DDESFKSLKKGVQMIHESLLRALKDN

SEQ ID NO: 2004797 - protein, 23 aa, Staphylococcus
DDETKAVVMIGEIGGTAEEEAAE

SEQ ID NO: 2004798 - protein, 25 aa, Staphylococcus
DDEVIWLYQYFSDIKIAPTTYTLDD

SEQ ID NO: 2004799 - protein, 25 aa, Staphylococcus
DDEVIWLYQYFSDIPIAPTTYTVDD

SEQ ID NO: 2004800 - protein, 19 aa, Staphylococcus
DDEVWDVLEDVITEHPVLL

SEQ ID NO: 2004801 - protein, 19 aa, Staphylococcus
DDEVWDVLEEVIVEHPVLL

SEQ ID NO: 2004802 - protein, 18 aa, Staphylococcus
DDEWREFGINHFVIPQVL

SEQ ID NO: 2004803 - protein, 20 aa, Staphylococcus
DDEWREFGINHFVVPEVLIS

SEQ ID NO: 2004804 - protein, 17 aa, Staphylococcus
DDEWREFSINHFIVPEV

SEQ ID NO: 2004805 - protein, 18 aa, Staphylococcus
DDFADFIDQFEWSDAQFP

SEQ ID NO: 2004806 - protein, 17 aa, Staphylococcus
DDFEPGKNYTIFTHTYN

SEQ ID NO: 2004807 - protein, 25 aa, Staphylococcus
DDFERWSFHLQIYFLAERFKEQKRM

SEQ ID NO: 2004808 - protein, 19 aa, Staphylococcus
DDFGDFRFILEGEMLSDGS

SEQ ID NO: 2004809 - protein, 28 aa, Staphylococcus
DDFGFMWECPDYFNLNGYDMLLFCPQGI

SEQ ID NO: 2004810 - protein, 20 aa, Staphylococcus
DDFKGWLKSDAFKEAHEGKS

SEQ ID NO: 2004811 - protein, 23 aa, Staphylococcus
DDFKLMKNKIIFDTKNVVKSNFN

SEQ ID NO: 2004812 - protein, 22 aa, Staphylococcus
DDFTHWRNIMGIEPISDEAREN

SEQ ID NO: 2004813 - protein, 19 aa, Staphylococcus
DDFTHWRNIMGVEPITAKE

SEQ ID NO: 2004814 - protein, 19 aa, Staphylococcus
DDFVSYAIKGNLMYENSYP

SEQ ID NO: 2004815 - protein, 20 aa, Staphylococcus
DDGFLPFNIFSPYRYFTKEK

SEQ ID NO: 2004816 - protein, 23 aa, Staphylococcus
DDGIWRRLVLIPFDVQIPEEKVD

SEQ ID NO: 2004817 - protein, 22 aa, Staphylococcus
DDGLCSICEGIISISNDLRDKA

SEQ ID NO: 2004818 - protein, 19 aa, Staphylococcus
DDGSTFWDPSKAYIKEAVK

SEQ ID NO: 2004819 - protein, 24 aa, Staphylococcus
DDGYRIGYGGGYYDRFLSDSNANT

SEQ ID NO: 2004820 - protein, 17 aa, Staphylococcus
DDHDFPKMIAFSNGQDV

SEQ ID NO: 2004821 - protein, 18 aa, Staphylococcus
DDHIKALSHFGGENNEGE

SEQ ID NO: 2004822 - protein, 26 aa, Staphylococcus
DDHMELIESPPLLMSMFKKARGNFFG

SEQ ID NO: 2004823 - protein, 18 aa, Staphylococcus
DDIAHLYVKEQGKIIAQA

SEQ ID NO: 2004824 - protein, 21 aa, Staphylococcus
DDIDLSVGIVLNKKVGDKVNA

SEQ ID NO: 2004825 - protein, 21 aa, Staphylococcus
DDIDLSVGIVLNKKVGDKVNV

SEQ ID NO: 2004826 - protein, 17 aa, Staphylococcus
DDIEMLQDLVIAATNEA

SEQ ID NO: 2004827 - protein, 17 aa, Staphylococcus
DDIEWPVNREGAYVIHR

SEQ ID NO: 2004828 - protein, 19 aa, Staphylococcus
DDIGPRIQGTLVKKQAMMR

SEQ ID NO: 2004829 - protein, 22 aa, Staphylococcus
DDIHAATAMKVFGVEKDQVNDL

SEQ ID NO: 2004830 - protein, 19 aa, Staphylococcus
DDIIRLSIIGRPNVGKSSL

SEQ ID NO: 2004831 - protein, 23 aa, Staphylococcus
DDIISRDDIEWVGNTNELNASYA

SEQ ID NO: 2004832 - protein, 23 aa, Staphylococcus
DDIISRDDMEWIGNTNELNASYA

SEQ ID NO: 2004833 - protein, 20 aa, Staphylococcus
DDIKALVSLLTHAKKPLILA

SEQ ID NO: 2004834 - protein, 18 aa, Staphylococcus
DDILTPYAFFANNPETTS

SEQ ID NO: 2004835 - protein, 17 aa, Staphylococcus
DDIPELLLKRFNKEGYY

SEQ ID NO: 2004836 - protein, 22 aa, Staphylococcus
DDIPFSGFKRFNTPSQVAGDIV

SEQ ID NO: 2004837 - protein, 18 aa, Staphylococcus
DDIPRIVHEAFYLANTGR

SEQ ID NO: 2004838 - protein, 27 aa, Staphylococcus
DDIPSEYPKFILGFGGIKQRELADYVK

SEQ ID NO: 2004839 - protein, 24 aa, Staphylococcus
DDIQRLLEDLGFTIQREVLYPNDS

SEQ ID NO: 2004840 - protein, 35 aa, Staphylococcus
DDIRFGIDEHVDFIAASFVRRPSDVLDIRKILEEE

SEQ ID NO: 2004841 - protein, 36 aa, Staphylococcus
DDIRFGIKEDVDFIAASFVRRPSDVLDIREILEQEK

SEQ ID NO: 2004842 - protein, 36 aa, Staphylococcus; identical to SEQ ID NO: 1793450

SEQ ID NO: 2004843 - protein, 17 aa, Staphylococcus
DDIRVNIVYEIPLSEVV

SEQ ID NO: 2004844 - protein, 18 aa, Staphylococcus
DDISEFDLVLVYKLDRLT

SEQ ID NO: 2004845 - protein, 25 aa, Staphylococcus
DDISKWSFQTEMFFLCNRYKQAKDI

SEQ ID NO: 2004846 - protein, 28 aa, Staphylococcus
DDITGRRGEIVMKILAYDADVEKIERVS

SEQ ID NO: 2004847 - protein, 18 aa, Staphylococcus
DDIYKLEGHIFIFGGQSL

SEQ ID NO: 2004848 - protein, 17 aa, Staphylococcus
DDIYLPIHQLYRQLTTE

SEQ ID NO: 2004849 - protein, 21 aa, Staphylococcus
DDKASVAMIMDFLKENKEHGK

SEQ ID NO: 2004850 - protein, 24 aa, Staphylococcus
DDKDIFCKPQEAIEYIGKITNGDA

SEQ ID NO: 2004851 - protein, 26 aa, Staphylococcus
DDKEIKSSMVGTFFLQDSKELTDPQI

SEQ ID NO: 2004852 - protein, 19 aa, Staphylococcus
DDKFEAWVHGPVIPEVYQT

SEQ ID NO: 2004853 - protein, 32 aa, Staphylococcus
DDKLRLKAELIREFLDKVIPHLDKDAVIEDAY

SEQ ID NO: 2004854 - protein, 17 aa, Staphylococcus
DDKPLCIETSYFNKALV

SEQ ID NO: 2004855 - protein, 23 aa, Staphylococcus
DDKYKRIAVSDFLTRAVHNKVRE

SEQ ID NO: 2004856 - protein, 17 aa, Staphylococcus
DDLDHVIAIMKKLHTTL

SEQ ID NO: 2004857 - protein, 26 aa, Staphylococcus
DDLDPVFMWHLAHAFGQEERDKEAQH

SEQ ID NO: 2004858 - protein, 17 aa, Staphylococcus
DDLEVIPTPGHTPGTTI

SEQ ID NO: 2004859 - protein, 23 aa, Staphylococcus
DDLIAQRTNLGWQGWPANGKIGH

SEQ ID NO: 2004860 - protein, 19 aa, Staphylococcus
DDLIRLWIADMDFATPDVV

SEQ ID NO: 2004861 - protein, 25 aa, Staphylococcus
DDLKEMKVIYSYMITMIKAAQKMPI

SEQ ID NO: 2004862 - protein, 17 aa, Staphylococcus
DDLKLVFHRHATSKLHE

SEQ ID NO: 2004863 - protein, 25 aa, Staphylococcus
DDLKRLYLSRLSRYNEIAFSRIDTN

SEQ ID NO: 2004864 - protein, 18 aa, Staphylococcus
DDLKSYRLARDIKTQIED

SEQ ID NO: 2004865 - protein, 17 aa, Staphylococcus
DDLKTLGKEMEQISEEN

SEQ ID NO: 2004866 - protein, 24 aa, Staphylococcus
DDLLKFICDAVHKKSNSMQTSFTS

SEQ ID NO: 2004867 - protein, 18 aa, Staphylococcus
DDLLPGKLLMDLQKAIVN

SEQ ID NO: 2004868 - protein, 22 aa, Staphylococcus
DDLLRSLPYTDVRYKKKLSTRL

SEQ ID NO: 2004869 - protein, 22 aa, Staphylococcus
DDLPGPVCHHIEEVIDAIQQQS

SEQ ID NO: 2004870 - protein, 26 aa, Staphylococcus
DDLQFSVALSTIWKFISRTNKYIDET

SEQ ID NO: 2004871 - protein, 24 aa, Staphylococcus
DDLRERICEAAIQLMENIEYVNAG

SEQ ID NO: 2004872 - protein, 23 aa, Staphylococcus
DDLTKVNIFFGRNGSGKSSLSEW

SEQ ID NO: 2004873 - protein, 17 aa, Staphylococcus
DDLYIVAAEESWIDITD

SEQ ID NO: 2004874 - protein, 19 aa, Staphylococcus
DDMLPRNIIVIARHPAKDM

SEQ ID NO: 2004875 - protein, 23 aa, Staphylococcus
DDNAARIGVWIGSGIGGMETFEY

SEQ ID NO: 2004876 - protein, 24 aa, Staphylococcus
DDNDLKWLIDIMATRMKERQVVKS

SEQ ID NO: 2004877 - protein, 19 aa, Staphylococcus
DDNGRFLIDHKSITGFSNV

SEQ ID NO: 2004878 - protein, 21 aa, Staphylococcus
DDPAGKPWSEFQRVRDEIKTA

SEQ ID NO: 2004879 - protein, 24 aa, Staphylococcus
DDPEGFINFCHKRLMYIDKAPNTV

SEQ ID NO: 2004880 - protein, 26 aa, Staphylococcus
DDPHKIVRWRAAMFIFDEGGPEQLDA

SEQ ID NO: 2004881 - protein, 18 aa, Staphylococcus
DDPYKLELIDAIPEDESV

SEQ ID NO: 2004882 - protein, 24 aa, Staphylococcus
DDPYKLELIDAIPQDEMVTLYSQG

SEQ ID NO: 2004883 - protein, 30 aa, Staphylococcus
DDQFLRTGLPRLVPYTRLDVVKRQNELKKQ

SEQ ID NO: 2004884 - protein, 24 aa, Staphylococcus
DDQGPRGLADWVRAQEDVLITDTT

SEQ ID NO: 2004885 - protein, 27 aa, Staphylococcus
DDQLKHLPFISGFIGTCSFDLVRHEFP

SEQ ID NO: 2004886 - protein, 24 aa, Staphylococcus
DDQNSAWMTTHFDFHSIHDNVLKL

SEQ ID NO: 2004887 - protein, 21 aa, Staphylococcus
DDRFFRCHNSFVINRRNIESI

SEQ ID NO: 2004888 - protein, 22 aa, Staphylococcus
DDRFFRCHNSFVVNRHNIDSVD

SEQ ID NO: 2004889 - protein, 21 aa, Staphylococcus
DDRFFRCHNSFVVNRHNISSI

SEQ ID NO: 2004890 - protein, 19 aa, Staphylococcus
DDRGRKVVTDYFKDIETRI

SEQ ID NO: 2004891 - protein, 19 aa, Staphylococcus
DDRGRKVVTDYFKQIKTRI

SEQ ID NO: 2004892 - protein, 29 aa, Staphylococcus
DDRIAIFLDRGIKNIALMIALAKMNIPFL

SEQ ID NO: 2004893 - protein, 17 aa, Staphylococcus
DDRIFPFICKLDDPKEV

SEQ ID NO: 2004894 - protein, 21 aa, Staphylococcus
DDRLPTRVLKLAVDEPYLPDR

SEQ ID NO: 2004895 - protein, 18 aa, Staphylococcus
DDRPEILSMLSTLGQSMF

SEQ ID NO: 2004896 - protein, 18 aa, Staphylococcus
DDSIHAWFNTLDDIIPKL

SEQ ID NO: 2004897 - protein, 23 aa, Staphylococcus
DDSIKPFILLVVEQREEGLKAAN

SEQ ID NO: 2004898 - protein, 23 aa, Staphylococcus
DDSLKPFILLVVDRKEEGLKAAN

SEQ ID NO: 2004899 - protein, 17 aa, Staphylococcus
DDSTIVFESLGDQKHYF

SEQ ID NO: 2004900 - protein, 17 aa, Staphylococcus
DDSYFLFYVNRPSIIIG

SEQ ID NO: 2004901 - protein, 26 aa, Staphylococcus
DDTEIYVCGGKSFIQSMIKSLKELNV

SEQ ID NO: 2004902 - protein, 20 aa, Staphylococcus
DDTFKLEGNRLFYLAMAPQF

SEQ ID NO: 2004903 - protein, 26 aa, Staphylococcus
DDTLKQIHGVVGFRIEITEVYAANKL

SEQ ID NO: 2004904 - protein, 23 aa, Staphylococcus
DDVAHLRSQFQFLHALDNDVVEL

SEQ ID NO: 2004905 - protein, 24 aa, Staphylococcus
DDVDKFNAFFAWYNSGAKLLTKPN

SEQ ID NO: 2004906 - protein, 17 aa, Staphylococcus
DDVEMLQDLVLAATNEA

SEQ ID NO: 2004907 - protein, 21 aa, Staphylococcus
DDVFMINKFVSAIEREIGYRM

SEQ ID NO: 2004908 - protein, 19 aa, Staphylococcus
DDVLNRWNQFNLYEITRGI

SEQ ID NO: 2004909 - protein, 28 aa, Staphylococcus
DDVRSALSIQLPMNWTLDQMVEYYFNWL

SEQ ID NO: 2004910 - protein, 18 aa, Staphylococcus
DDVTLYIAAAQRKKQQIQ

SEQ ID NO: 2004911 - protein, 23 aa, Staphylococcus
DDVTRIVAYYLHKPVGILDVIVT

SEQ ID NO: 2004912 - protein, 17 aa, Staphylococcus
DDVVFHFIGSLQSRKVK

SEQ ID NO: 2004913 - protein, 20 aa, Staphylococcus
DDVYWCTADPGWVTGTSYGI

SEQ ID NO: 2004914 - protein, 20 aa, Staphylococcus
DDYDCFFCIVDQHAITVPQD

SEQ ID NO: 2004915 - protein, 20 aa, Staphylococcus
DDYFKAWVNIMYGCDKFCTY

SEQ ID NO: 2004916 - protein, 29 aa, Staphylococcus
DDYFLRTLLRERTNFCFLPASMCKELELP

SEQ ID NO: 2004917 - protein, 20 aa, Staphylococcus
DDYFNRVGIHPNIIMESDRF

SEQ ID NO: 2004918 - protein, 17 aa, Staphylococcus
DDYHVMIVHPWQYDEVL

SEQ ID NO: 2004919 - protein, 18 aa, Staphylococcus
DDYLKLLALDGTLVNVGA

SEQ ID NO: 2004920 - protein, 24 aa, Staphylococcus
DDYNQVGMINLCFEIFDDKIKIII

SEQ ID NO: 2004921 - protein, 24 aa, Staphylococcus
DDYPDLDFDFINWLVTGVKDHEAV

SEQ ID NO: 2004922 - protein, 24 aa, Staphylococcus
DDYPDLDFDFINWLVTGVKDHEPV

SEQ ID NO: 2004923 - protein, 24 aa, Staphylococcus
DDYPDLDFEFIHWLVTGVKDHEQV

SEQ ID NO: 2004924 - protein, 23 aa, Staphylococcus
DDYPFGGGQGMVLKPEPVFNAMK

SEQ ID NO: 2004925 - protein, 23 aa, Staphylococcus
DDYPYGGGQGMVLKPEPVFNAMQ

SEQ ID NO: 2004926 - protein, 25 aa, Staphylococcus
DDYQAGLKVGEWVGQRQPRRVVFFS

SEQ ID NO: 2004927 - protein, 18 aa, Staphylococcus
DDYVKIAFNINRTTHPTL

SEQ ID NO: 2004928 - protein, 26 aa, Staphylococcus
DEAAIFAGDLLRMYSKYAESQNFKTE

SEQ ID NO: 2004929 - protein, 26 aa, Staphylococcus
DEAAIFAGDLLRMYTKYAESQNFKTE

SEQ ID NO: 2004930 - protein, 35 aa, Staphylococcus
DEAAIFAGDLYRMYTRFSEGLGYKTGVIEMNDSDH

SEQ ID NO: 2004931 - protein, 17 aa, Staphylococcus
DEAAVVVGHVMLSKINI

SEQ ID NO: 2004932 - protein, 17 aa, Staphylococcus
DEADLMIDLGLIEDVDH

SEQ ID NO: 2004933 - protein, 23 aa, Staphylococcus
DEADLMIDLGLIEDVDYIAARLN

SEQ ID NO: 2004934 - protein, 18 aa, Staphylococcus
DEAFKGLKPIFGTKNEVL

SEQ ID NO: 2004935 - protein, 18 aa, Staphylococcus
DEAFVCYIAMSRATSKVT

SEQ ID NO: 2004936 - protein, 24 aa, Staphylococcus
DEAFVCYIAMTRACEQMTFSYSLM

SEQ ID NO: 2004937 - protein, 19 aa, Staphylococcus
DEAFVCYIAMTRAREKVTF

SEQ ID NO: 2004938 - protein, 18 aa, Staphylococcus
DEAFVCYIAMTRASTHVT

SEQ ID NO: 2004939 - protein, 18 aa, Staphylococcus
DEAFVCYIAMTRATQQVT

SEQ ID NO: 2004940 - protein, 19 aa, Staphylococcus
DEAFVCYIAMTRGSEQVTF

SEQ ID NO: 2004941 - protein, 23 aa, Staphylococcus
DEAINYGKWAYRSITEDKKLDLD

SEQ ID NO: 2004942 - protein, 23 aa, Staphylococcus
DEAKSMGAMALFGEKYGDIVRVV

SEQ ID NO: 2004943 - protein, 18 aa, Staphylococcus
DEALDISLGLHDEVKTQN

SEQ ID NO: 2004944 - protein, 23 aa, Staphylococcus
DEALKAGITMYQFREKGPSSLIG

SEQ ID NO: 2004945 - protein, 18 aa, Staphylococcus
DEALKFQLLEELPQSIQR

SEQ ID NO: 2004946 - protein, 18 aa, Staphylococcus
DEALKLGATHAINIKEEG

SEQ ID NO: 2004947 - protein, 18 aa, Staphylococcus
DEALKYIRDLAVSENAKP

SEQ ID NO: 2004948 - protein, 27 aa, Staphylococcus
DEALVERLELVASEALVEIEVLAALLS

SEQ ID NO: 2004949 - protein, 22 aa, Staphylococcus
DEANVIRYANYLKQLSEKTQFI

SEQ ID NO: 2004950 - protein, 22 aa, Staphylococcus
DEANVIRYAQFLNDLSEKTQFI

SEQ ID NO: 2004951 - protein, 18 aa, Staphylococcus
DEAPGIGMRFIQINEDKL

SEQ ID NO: 2004952 - protein, 24 aa, Staphylococcus
DEAVYKYVMKWKETNIFYEKLIDL

SEQ ID NO: 2004953 - protein, 22 aa, Staphylococcus
DEDFLLVKREIFSSGKSICRIN

SEQ ID NO: 2004954 - protein, 21 aa, Staphylococcus
DEDFLLVKREIFSTGKSMCRV

SEQ ID NO: 2004955 - protein, 22 aa, Staphylococcus
DEDIYRLAITDITTFRTQHKTV

SEQ ID NO: 2004956 - protein, 19 aa, Staphylococcus
DEDLQIFYCFIVLKNNEVY

SEQ ID NO: 2004957 - protein, 22 aa, Staphylococcus
DEDLQIFYSFIILKNNEVYFNL

SEQ ID NO: 2004958 - protein, 20 aa, Staphylococcus
DEDLQIFYSFIVLNNKEVYY

SEQ ID NO: 2004959 - protein, 28 aa, Staphylococcus
DEDRIRRLLKLYLERESFEIHEANDGNE

SEQ ID NO: 2004960 - protein, 28 aa, Staphylococcus
DEDRIRRLLKLYLERESFEIHEASDGKE

SEQ ID NO: 2004961 - protein, 28 aa, Staphylococcus
DEDRIRRLLKLYLERESFETHEARDGKE

SEQ ID NO: 2004962 - protein, 28 aa, Staphylococcus
DEDRIRRLLKLYLERESFNIHEASDGKE

SEQ ID NO: 2004963 - protein, 28 aa, Staphylococcus
DEDRIRRLLKLYLERESFTIHEASDGKE

SEQ ID NO: 2004964 - protein, 28 aa, Staphylococcus
DEDRIRRLLKLYLKRESFTIHEASNGKE

SEQ ID NO: 2004965 - protein, 24 aa, Staphylococcus
DEDSDVLLAFEFFRSDEAKDNHYS

SEQ ID NO: 2004966 - protein, 23 aa, Staphylococcus
DEDTKAVVMIGEIGGTAEEEAAE

SEQ ID NO: 2004967 - protein, 20 aa, Staphylococcus
DEDTWMLFGTLPIYPCINDE

SEQ ID NO: 2004968 - protein, 18 aa, Staphylococcus
DEDYRPVLEQEFISRIGY

SEQ ID NO: 2004969 - protein, 25 aa, Staphylococcus
DEEAMEALIRFSRAEGIIPAIESAH

SEQ ID NO: 2004970 - protein, 18 aa, Staphylococcus
DEEGRYGTFTKYFTQNDV

SEQ ID NO: 2004971 - protein, 25 aa, Staphylococcus
DEEGWAHCLTIPRVLTVENGKLKQR

SEQ ID NO: 2004972 - protein, 23 aa, Staphylococcus
DEEKRLVGADIYGVDAADLVNLL

SEQ ID NO: 2004973 - protein, 26 aa, Staphylococcus
DEELKDLPFISGFIGSCSFDLVRHEF

SEQ ID NO: 2004974 - protein, 25 aa, Staphylococcus
DEEMIEFGFWFGGGDFEGPTYFVLP

SEQ ID NO: 2004975 - protein, 28 aa, Staphylococcus
DEERIRRLLKLYLERESFDIEEAQDGKE

SEQ ID NO: 2004976 - protein, 25 aa, Staphylococcus
DEESFKEWLRLFLSEQLTYADGLAI

SEQ ID NO: 2004977 - protein, 21 aa, Staphylococcus
DEESVGFVMDLNFLGTFIPSQ

SEQ ID NO: 2004978 - protein, 24 aa, Staphylococcus
DEETIGFIIGPRLNAVGRLEDASL

SEQ ID NO: 2004979 - protein, 17 aa, Staphylococcus
DEFDRVLGLELGADDYM

SEQ ID NO: 2004980 - protein, 17 aa, Staphylococcus
DEFEDFIVLTTEYYWHW

SEQ ID NO: 2004981 - protein, 17 aa, Staphylococcus
DEFEMGREVLVQIRKRQ

SEQ ID NO: 2004982 - protein, 27 aa, Staphylococcus
DEFICPNNKRLGFKRYAYRHDKYGYKR

SEQ ID NO: 2004983 - protein, 21 aa, Staphylococcus
DEFIEHVFYFKNDVNEEESYH

SEQ ID NO: 2004984 - protein, 19 aa, Staphylococcus
DEFKRVVNMIQEVYSDFGF

SEQ ID NO: 2004985 - protein, 21 aa, Staphylococcus
DEFSMLCNALETFKANNEINV

SEQ ID NO: 2004986 - protein, 26 aa, Staphylococcus
DEGAILLKFFLCLDKDEQLKRFKDRE

SEQ ID NO: 2004987 - protein, 20 aa, Staphylococcus
DEGAVCSTILDLYSKQAIVA

SEQ ID NO: 2004988 - protein, 18 aa, Staphylococcus
DEGAVCSTILDMYSKQAI

SEQ ID NO: 2004989 - protein, 23 aa, Staphylococcus
DEGEGIPIILIHGLDGNSAGFQD

SEQ ID NO: 2004990 - protein, 24 aa, Staphylococcus
DEGERVWVKYHFRTQQGIENYTDD

SEQ ID NO: 2004991 - protein, 21 aa, Staphylococcus
DEGIVCPVSGTANWTDIRQFN

SEQ ID NO: 2004992 - protein, 25 aa, Staphylococcus
DEGKLADIILWEPAFFGVKPDVIVK

SEQ ID NO: 2004993 - protein, 21 aa, Staphylococcus
DEGLQLEGLVFDRDHNLFLCE

SEQ ID NO: 2004994 - protein, 28 aa, Staphylococcus
DEGLRTLLDFRYQRQFKAKRGEGGQGSN

SEQ ID NO: 2004995 - protein, 26 aa, Staphylococcus
DEGLRTLLDFRYQTHFKAKKGENGQS

SEQ ID NO: 2004996 - protein, 25 aa, Staphylococcus
DEGLRTLLDFRYQTHFKAKRGDGGQ

SEQ ID NO: 2004997 - protein, 22 aa, Staphylococcus
DEGREVLSGVVIDLNKEGQTKN

SEQ ID NO: 2004998 - protein, 17 aa, Staphylococcus
DEGSAYSLLNITIKQIE

SEQ ID NO: 2004999 - protein, 19 aa, Staphylococcus
DEGSDCEISREIGHTMSNF

SEQ ID NO: 2005000 - protein, 24 aa, Staphylococcus
DEGSFKWGVTTSLSYFPKDNSDFF

SEQ ID NO: 2005001 - protein, 24 aa, Staphylococcus
DEGSVRWGVTTSRSYFPKDNSDYF

SEQ ID NO: 2005002 - protein, 24 aa, Staphylococcus
DEGTFKVVARKSVVEEVSDHRDEV

SEQ ID NO: 2005003 - protein, 20 aa, Staphylococcus
DEHNRLFLFVSEGLLKGYLY

SEQ ID NO: 2005004 - protein, 20 aa, Staphylococcus
DEHRLLVPIFDARREAVYTG

SEQ ID NO: 2005005 - protein, 18 aa, Staphylococcus
DEHRWQRRQGVTLIGDAA

SEQ ID NO: 2005006 - protein, 17 aa, Staphylococcus
DEHYFGGSYERLQDLTL

SEQ ID NO: 2005007 - protein, 25 aa, Staphylococcus
DEIANRYGLRSGVGLAAPQIDISKK

SEQ ID NO: 2005008 - protein, 18 aa, Staphylococcus
DEIARLTPSYAGVSYDRL

SEQ ID NO: 2005009 - protein, 21 aa, Staphylococcus
DEIDLSVGIVLNKKVGDVVKE

SEQ ID NO: 2005010 - protein, 23 aa, Staphylococcus
DEIDLSVGLVLHKKVGDSVNKGE

SEQ ID NO: 2005011 - protein, 24 aa, Staphylococcus
DEIDPRQGHVWIMDPIDGTANLVK

SEQ ID NO: 2005012 - protein, 17 aa, Staphylococcus
DEIDVDRLLVVTFTNLS

SEQ ID NO: 2005013 - protein, 23 aa, Staphylococcus
DEIEARWPGTITTIVHRIGPLQI

SEQ ID NO: 2005014 - protein, 18 aa, Staphylococcus
DEIEIVPVIADVQDRERI

SEQ ID NO: 2005015 - protein, 19 aa, Staphylococcus
DEIEKRLNQKKAFQVEFGQ

SEQ ID NO: 2005016 - protein, 23 aa, Staphylococcus
DEIEVGIGIHGERGLKREIIKPV

SEQ ID NO: 2005017 - protein, 19 aa, Staphylococcus
DEIGVALKVGKLAEVLEGA

SEQ ID NO: 2005018 - protein, 17 aa, Staphylococcus
DEIIASFANRFKNKIIG

SEQ ID NO: 2005019 - protein, 18 aa, Staphylococcus
DEIIGFANFIYGKELYLS

SEQ ID NO: 2005020 - protein, 18 aa, Staphylococcus
DEIILSFKKGIPVKLNDK

SEQ ID NO: 2005021 - protein, 17 aa, Staphylococcus
DEIILSFKNGVPVQVDG

SEQ ID NO: 2005022 - protein, 22 aa, Staphylococcus
DEIIWIYQYFTDIKIAPTTYTI

SEQ ID NO: 2005023 - protein, 18 aa, Staphylococcus
DEIKEAISAIKAQYPNVI

SEQ ID NO: 2005024 - protein, 17 aa, Staphylococcus
DEIKELAEEIGYPVVLK

SEQ ID NO: 2005025 - protein, 22 aa, Staphylococcus
DEIKGRTDLRDELTITIDGADA

SEQ ID NO: 2005026 - protein, 21 aa, Staphylococcus
DEIKKLCVDLAQDFKPGETFK

SEQ ID NO: 2005027 - protein, 18 aa, Staphylococcus
DEIKNLKLNYAPCEYLSM

SEQ ID NO: 2005028 - protein, 23 aa, Staphylococcus
DEIKYPAIPSVLYSLPRLSQIGV

SEQ ID NO: 2005029 - protein, 17 aa, Staphylococcus
DEILARIGEYYYGSDDI

SEQ ID NO: 2005030 - protein, 19 aa, Staphylococcus
DEILCKTGTFGVPEFGTGF

SEQ ID NO: 2005031 - protein, 18 aa, Staphylococcus
DEIMRFGKYHPDYQSVML

SEQ ID NO: 2005032 - protein, 25 aa, Staphylococcus
DEINNLPIVEEFRSAQYDANDLLQM

SEQ ID NO: 2005033 - protein, 17 aa, Staphylococcus
DEINRFYVRYATSEGIT

SEQ ID NO: 2005034 - protein, 24 aa, Staphylococcus
DEIPIKFSGIRPGEKMYEELLNEN

SEQ ID NO: 2005035 - protein, 21 aa, Staphylococcus
DEIQRAIIIGFHYEDVDKRRE

SEQ ID NO: 2005036 - protein, 20 aa, Staphylococcus
DEISGYKLLNSTVREVEERT

SEQ ID NO: 2005037 - protein, 19 aa, Staphylococcus
DEISQKWPGTKTAIVHRIG

SEQ ID NO: 2005038 - protein, 20 aa, Staphylococcus
DEISVIIAPVVDDHFNRPNL

SEQ ID NO: 2005039 - protein, 21 aa, Staphylococcus
DEITHALNLSMIGHRSSDFEA

SEQ ID NO: 2005040 - protein, 19 aa, Staphylococcus
DEIVCVFDAYEQSGIEREY

SEQ ID NO: 2005041 - protein, 25 aa, Staphylococcus
DEKCSNNCLIHYYLQGYEEPMYTRQ

SEQ ID NO: 2005042 - protein, 24 aa, Staphylococcus
DEKDKRIAVSDFLTRAFGHQTSAF

SEQ ID NO: 2005043 - protein, 19 aa, Staphylococcus
DEKDRLLPGGYLFLSDLVG

SEQ ID NO: 2005044 - protein, 19 aa, Staphylococcus
DEKEMFGRQDAILNAYGLT

SEQ ID NO: 2005045 - protein, 18 aa, Staphylococcus
DEKFVVIPHFIKTSSNST

SEQ ID NO: 2005046 - protein, 18 aa, Staphylococcus
DEKGCPWDKVQTHETLKR

SEQ ID NO: 2005047 - protein, 21 aa, Staphylococcus
DEKILKVDGFLNHQIDAKLMH

SEQ ID NO: 2005048 - protein, 21 aa, Staphylococcus
DEKILKVDGFLNHQIDAKLMN

SEQ ID NO: 2005049 - protein, 21 aa, Staphylococcus
DEKILKVDGFLNHQIDAQLMH

SEQ ID NO: 2005050 - protein, 21 aa, Staphylococcus
DEKILKVDGFLNHQIDATLMN

SEQ ID NO: 2005051 - protein, 18 aa, Staphylococcus
DEKINRYEFLKLLLENIK

SEQ ID NO: 2005052 - protein, 17 aa, Staphylococcus
DEKLIYYHHSLNAFINN

SEQ ID NO: 2005053 - protein, 25 aa, Staphylococcus
DEKLKQLPFISGFMGTCSFDLVRHE

SEQ ID NO: 2005054 - protein, 21 aa, Staphylococcus
DEKRVEFHLHTAMSQMDGIPN

SEQ ID NO: 2005055 - protein, 24 aa, Staphylococcus
DEKYKEILGAFIVGPHATDLIGEL

SEQ ID NO: 2005056 - protein, 30 aa, Staphylococcus
DELAMNAAIKGARGYLFFGHPLDVPEVAGS

SEQ ID NO: 2005057 - protein, 20 aa, Staphylococcus
DELARLITLEGGKPLAEAKG

SEQ ID NO: 2005058 - protein, 21 aa, Staphylococcus
DELCIELDPGMAFGTGDHPTT

SEQ ID NO: 2005059 - protein, 24 aa, Staphylococcus
DELCIELDPGMAFGTGDHPTTSMC

SEQ ID NO: 2005060 - protein, 17 aa, Staphylococcus
DELDLPGYHLADAPEPS

SEQ ID NO: 2005061 - protein, 24 aa, Staphylococcus
DELEIHFSDGLTVLSGETGAGKSI

SEQ ID NO: 2005062 - protein, 24 aa, Staphylococcus
DELEIHFSDGLTVLSGETGSGKSI

SEQ ID NO: 2005063 - protein, 18 aa, Staphylococcus
DELFKDDYIRNLISRHKT

SEQ ID NO: 2005064 - protein, 21 aa, Staphylococcus
DELHGADSYDCLITSRDHLLE

SEQ ID NO: 2005065 - protein, 22 aa, Staphylococcus
DELIESGCEVIALDATKQKRPK

SEQ ID NO: 2005066 - protein, 24 aa, Staphylococcus
DELIPYMKHVRVMVVFGETQDKFA

SEQ ID NO: 2005067 - protein, 24 aa, Staphylococcus
DELIPYMKHVRVMVVFGETQEKFV

SEQ ID NO: 2005068 - protein, 23 aa, Staphylococcus
DELIPYMKNVRVMVVFGQTQEKF

SEQ ID NO: 2005069 - protein, 23 aa, Staphylococcus
DELIQFKSLNSMQTKDIIKAIPQ

SEQ ID NO: 2005070 - protein, 23 aa, Staphylococcus
DELKAKGVNLAFITLHVGLGTFR

SEQ ID NO: 2005071 - protein, 19 aa, Staphylococcus
DELKELLLNELKKYRGQLV

SEQ ID NO: 2005072 - protein, 22 aa, Staphylococcus
DELKGANIFLDMVSVGATINIM

SEQ ID NO: 2005073 - protein, 32 aa, Staphylococcus
DELKQLNNWCVWKFEKRNGKRTKIPFNAETGE

SEQ ID NO: 2005074 - protein, 17 aa, Staphylococcus
DELKRIVTWTKRNYDIP

SEQ ID NO: 2005075 - protein, 22 aa, Staphylococcus
DELKRNRITSISPLIVNDQTVT

SEQ ID NO: 2005076 - protein, 19 aa, Staphylococcus
DELKSFSTIASRLIGEPAW

SEQ ID NO: 2005077 - protein, 17 aa, Staphylococcus
DELLKYRFNDNHPFNQM

SEQ ID NO: 2005078 - protein, 19 aa, Staphylococcus
DELLSFKLDDTLIQQLETK

SEQ ID NO: 2005079 - protein, 24 aa, Staphylococcus
DELPKVWKDLGMRSASAYGKKTRS

SEQ ID NO: 2005080 - protein, 23 aa, Staphylococcus
DELRAQKILQDRAFKNDKVNFIW

SEQ ID NO: 2005081 - protein, 35 aa, Staphylococcus
DELRAQKILQDRAFKNEKIDFIWSHTLKSINEKDG

SEQ ID NO: 2005082 - protein, 35 aa, Staphylococcus
DELRAQKILQDRAFKNEKIDFIWSHTLKTINDKDG

SEQ ID NO: 2005083 - protein, 22 aa, Staphylococcus
DELRAQNILQERAFKNEKVDFI

SEQ ID NO: 2005084 - protein, 18 aa, Staphylococcus
DELREFVEMAKIPVIHTL

SEQ ID NO: 2005085 - protein, 26 aa, Staphylococcus
DELRELRLIKTLKHFDIDISHAEANK

SEQ ID NO: 2005086 - protein, 22 aa, Staphylococcus
DELRPDYCIPDPFDKRVAPSVA

SEQ ID NO: 2005087 - protein, 21 aa, Staphylococcus
DELRQKMGMVFQNFNLFPHKK

SEQ ID NO: 2005088 - protein, 21 aa, Staphylococcus
DELSEYLLYLDKHREAMETYV

SEQ ID NO: 2005089 - protein, 17 aa, Staphylococcus
DELTSALLSKGYKAEGL

SEQ ID NO: 2005090 - protein, 17 aa, Staphylococcus
DELTYRQLIEESSKLAH

SEQ ID NO: 2005091 - protein, 21 aa, Staphylococcus
DELVGFAIVTTGNFERTRHEA

SEQ ID NO: 2005092 - protein, 18 aa, Staphylococcus
DELVKEIEDMTGRKVVAN

SEQ ID NO: 2005093 - protein, 24 aa, Staphylococcus
DELVKEIEEMTGRKVVANRPASGT

SEQ ID NO: 2005094 - protein, 19 aa, Staphylococcus
DEMGELDLEVFIIGKDELS

SEQ ID NO: 2005095 - protein, 18 aa, Staphylococcus
DEMPELKTAFESLTPGRQ

SEQ ID NO: 2005096 - protein, 17 aa, Staphylococcus
DEMPLTIVMIGEQIDEN

SEQ ID NO: 2005097 - protein, 18 aa, Staphylococcus
DEMRRSYLRGAFLAGGSV

SEQ ID NO: 2005098 - protein, 17 aa, Staphylococcus
DEMRYELQMSKPSMSAG

SEQ ID NO: 2005099 - protein, 23 aa, Staphylococcus
DEMVKGPSVEWLIKNKRLADYDY

SEQ ID NO: 2005100 - protein, 22 aa, Staphylococcus
DENDIRIALERALSEKDRGLAD

SEQ ID NO: 2005101 - protein, 26 aa, Staphylococcus
DENFFKCYFDRHLLQSSGFVKNIILQ

SEQ ID NO: 2005102 - protein, 24 aa, Staphylococcus
DENIPGLVHRHFRVTIKALDIDGN

SEQ ID NO: 2005103 - protein, 21 aa, Staphylococcus
DENKVSILIGHLTIKGGKTSD

SEQ ID NO: 2005104 - protein, 18 aa, Staphylococcus
DENLKEWFISRYQKEVPT

SEQ ID NO: 2005105 - protein, 20 aa, Staphylococcus
DENNRLVGVVVRGSVIGAMT

SEQ ID NO: 2005106 - protein, 17 aa, Staphylococcus
DENPYQLVYDIKGIGFN

SEQ ID NO: 2005107 - protein, 22 aa, Staphylococcus
DENRAKITYALCQDEELCVCDI

SEQ ID NO: 2005108 - protein, 23 aa, Staphylococcus
DENTYWPLAMPVFKMDYAHKEYE

SEQ ID NO: 2005109 - protein, 20 aa, Staphylococcus
DENVWMLFGTLPIYPCINDE

SEQ ID NO: 2005110 - protein, 29 aa, Staphylococcus
DEPEGGLRCSACFEMRLDLVADAAQRFGY

SEQ ID NO: 2005111 - protein, 23 aa, Staphylococcus
DEPELDFDFIHWLVTGVKDHEPV

SEQ ID NO: 2005112 - protein, 19 aa, Staphylococcus
DEPLYLWLGDITTLDIDGI

SEQ ID NO: 2005113 - protein, 22 aa, Staphylococcus
DEPRAGQFVERVLGIEKGAKII

SEQ ID NO: 2005114 - protein, 23 aa, Staphylococcus
DEPRKGPEVERMLGLSKGSAIVK

SEQ ID NO: 2005115 - protein, 20 aa, Staphylococcus
DEPRVRIDAGSVGIANNQTG

SEQ ID NO: 2005116 - protein, 25 aa, Staphylococcus
DEQFKSLKKGVEMVHESLLNALKNN

SEQ ID NO: 2005117 - protein, 20 aa, Staphylococcus
DEQILLIAVERLYPFPEDEI

SEQ ID NO: 2005118 - protein, 20 aa, Staphylococcus
DEQIRWIAIEEIMPNPYQPR

SEQ ID NO: 2005119 - protein, 20 aa, Staphylococcus
DEQLIIPIDMTLPYYAGLSF

SEQ ID NO: 2005120 - protein, 17 aa, Staphylococcus
DEQRKAAILKKQQIDEQ

SEQ ID NO: 2005121 - protein, 17 aa, Staphylococcus
DEQRTKLYKGWKKAVEA

SEQ ID NO: 2005122 - protein, 19 aa, Staphylococcus
DEQRTKLYKGWKKAVEATQ

SEQ ID NO: 2005123 - protein, 28 aa, Staphylococcus
DEQRVLVKRAFIGSFLFGGNFDSPKFKL

SEQ ID NO: 2005124 - protein, 23 aa, Staphylococcus
DEQSRQFIFKNIDTNAIKATMDD

SEQ ID NO: 2005125 - protein, 23 aa, Staphylococcus
DERKILEGFKHLTPNTNQYRTVM

SEQ ID NO: 2005126 - protein, 25 aa, Staphylococcus
DERLKIAQQLERWGVDVIEAGFPAS

SEQ ID NO: 2005127 - protein, 23 aa, Staphylococcus
DERLKVFRQLGVDYEMEKLKKDL

SEQ ID NO: 2005128 - protein, 17 aa, Staphylococcus
DERLWLLNRAGKIPFVV

SEQ ID NO: 2005129 - protein, 17 aa, Staphylococcus
DERMWLLNRAGKIPFVI

SEQ ID NO: 2005130 - protein, 19 aa, Staphylococcus
DERNDWFCYTHGGKQPTDI

SEQ ID NO: 2005131 - protein, 18 aa, Staphylococcus
DERNELYVFNGYAGSDKD

SEQ ID NO: 2005132 - protein, 21 aa, Staphylococcus
DERRVCIKLNMSKKEEIHYIL

SEQ ID NO: 2005133 - protein, 19 aa, Staphylococcus
DESCIAWHCADGINPGSGN

SEQ ID NO: 2005134 - protein, 22 aa, Staphylococcus
DESETYLNMSIRNISDMQRAAE

SEQ ID NO: 2005135 - protein, 22 aa, Staphylococcus
DESFKLGIVLSYLKQYDASQQI

SEQ ID NO: 2005136 - protein, 23 aa, Staphylococcus
DESFKLGIVLSYLKQYHASQKLL

SEQ ID NO: 2005137 - protein, 23 aa, Staphylococcus
DESFKLGIVLSYLKQYKASQQLL

SEQ ID NO: 2005138 - protein, 22 aa, Staphylococcus
DESFKLGIVLSYLKQYQASQNL

SEQ ID NO: 2005139 - protein, 28 aa, Staphylococcus
DESFSAFEFKKRAEACIEDITNRGKLPI

SEQ ID NO: 2005140 - protein, 20 aa, Staphylococcus
DESHVSIAGRLMTKRGKGKA

SEQ ID NO: 2005141 - protein, 21 aa, Staphylococcus
DESHVSIAGRLMTKRGKGKAG

SEQ ID NO: 2005142 - protein, 22 aa, Staphylococcus
DESKEAISILEALDIDIDEDFL

SEQ ID NO: 2005143 - protein, 21 aa, Staphylococcus
DESKLNFLWVTDWPLLEYDED

SEQ ID NO: 2005144 - protein, 22 aa, Staphylococcus
DESKRVKAMPSVRKYARENGVN

SEQ ID NO: 2005145 - protein, 23 aa, Staphylococcus
DESKSGMVPRSRLNDKNAEIEEL

SEQ ID NO: 2005146 - protein, 27 aa, Staphylococcus
DESKWLKRAEIYIDGFHNFSTLEYQII

SEQ ID NO: 2005147 - protein, 23 aa, Staphylococcus
DESLKGLVQYDAFEKVTKLKRLP

SEQ ID NO: 2005148 - protein, 20 aa, Staphylococcus
DESRTIKAIEELGERMGIQT

SEQ ID NO: 2005149 - protein, 18 aa, Staphylococcus
DESRTVKAIEELGEQMGI

SEQ ID NO: 2005150 - protein, 19 aa, Staphylococcus
DESRTVKAIEELGERMGIQ

SEQ ID NO: 2005151 - protein, 20 aa, Staphylococcus
DESYEYFCQTGKDFDAKLLE

SEQ ID NO: 2005152 - protein, 22 aa, Staphylococcus
DESYRKSLMIKVFEHTNEYDHA

SEQ ID NO: 2005153 - protein, 23 aa, Staphylococcus
DETAIPLLLGLGLDEFSMSATSI

SEQ ID NO: 2005154 - protein, 19 aa, Staphylococcus
DETDWLAAHVDSYDSEDYK

SEQ ID NO: 2005155 - protein, 23 aa, Staphylococcus
DETFKLGIVLSYLKKYEASQKLL

SEQ ID NO: 2005156 - protein, 17 aa, Staphylococcus
DETFLAFIKETFDEFLK

SEQ ID NO: 2005157 - protein, 22 aa, Staphylococcus
DETFRKSLMIKVFEHTNDYDNA

SEQ ID NO: 2005158 - protein, 25 aa, Staphylococcus
DETIKEAAMLAGYFSKAGNSGQIPV

SEQ ID NO: 2005159 - protein, 22 aa, Staphylococcus
DETIKGVVLFHETLKELNVKHE

SEQ ID NO: 2005160 - protein, 23 aa, Staphylococcus
DETIKGVVLFHETLKSLNIKHEI

SEQ ID NO: 2005161 - protein, 17 aa, Staphylococcus
DETKLNFLWVTDWPLLE

SEQ ID NO: 2005162 - protein, 19 aa, Staphylococcus
DETLCEHKVISARQTNNII

SEQ ID NO: 2005163 - protein, 18 aa, Staphylococcus
DETLLREIVEELYANIEE

SEQ ID NO: 2005164 - protein, 24 aa, Staphylococcus
DETLRGAWNVIVFYPADFSFVCPT

SEQ ID NO: 2005165 - protein, 20 aa, Staphylococcus
DETQEHCDLMTYFQATATIT

SEQ ID NO: 2005166 - protein, 17 aa, Staphylococcus
DEVAFKEVALIISTALK

SEQ ID NO: 2005167 - protein, 17 aa, Staphylococcus
DEVAKCLMNSNASHNEN

SEQ ID NO: 2005168 - protein, 23 aa, Staphylococcus
DEVFNSPYSIVFKQAENRLHSIK

SEQ ID NO: 2005169 - protein, 27 aa, Staphylococcus
DEVHIKFRINDYLELYEIFNLDVYQKL

SEQ ID NO: 2005170 - protein, 22 aa, Staphylococcus
DEVIDRIDIVMLLRVQHERHED

SEQ ID NO: 2005171 - protein, 18 aa, Staphylococcus
DEVIGPLLHYRMVQELPT

SEQ ID NO: 2005172 - protein, 20 aa, Staphylococcus
DEVILAWGAYAKKPIVEMRV

SEQ ID NO: 2005173 - protein, 23 aa, Staphylococcus
DEVITAFRFHYGAAQDLLGVIPD

SEQ ID NO: 2005174 - protein, 23 aa, Staphylococcus
DEVITAFRFHYGAAQDLLGVKPD

SEQ ID NO: 2005175 - protein, 22 aa, Staphylococcus
DEVITAFRFHYGAAQDLLNVYP

SEQ ID NO: 2005176 - protein, 25 aa, Staphylococcus
DEVITAFRFHYGGAQDLYKVYPDLT

SEQ ID NO: 2005177 - protein, 17 aa, Staphylococcus
DEVKALSMWMTMKCGIV

SEQ ID NO: 2005178 - protein, 21 aa, Staphylococcus
DEVKARIIYKANYKHRIVERV

SEQ ID NO: 2005179 - protein, 22 aa, Staphylococcus
DEVKEALTVLVNAVRKKREENN

SEQ ID NO: 2005180 - protein, 19 aa, Staphylococcus
DEVKLEFMISYSQRQLTEK

SEQ ID NO: 2005181 - protein, 20 aa, Staphylococcus
DEVLEYYGLKVLVDKDDAPV

SEQ ID NO: 2005182 - protein, 20 aa, Staphylococcus
DEVLICGDLFISEEDALHPP

SEQ ID NO: 2005183 - protein, 24 aa, Staphylococcus
DEVLKACVDLSIQYIPQRLLPDKA

SEQ ID NO: 2005184 - protein, 18 aa, Staphylococcus
DEVLVRMLNRLNISDKQL

SEQ ID NO: 2005185 - protein, 23 aa, Staphylococcus
DEVMKQDGYIWVGYTAYNGKRVY

SEQ ID NO: 2005186 - protein, 18 aa, Staphylococcus
DEVMSLFKRQRATISIGY

SEQ ID NO: 2005187 - protein, 27 aa, Staphylococcus
DEVMTGFRVGYNCAQGYFGVTPDLTCL

SEQ ID NO: 2005188 - protein, 23 aa, Staphylococcus
DEVNARLAATQSYSYSDYLEQEC

SEQ ID NO: 2005189 - protein, 24 aa, Staphylococcus
DEVNKRYDIILLLTKQVFNQQVIP

SEQ ID NO: 2005190 - protein, 18 aa, Staphylococcus
DEVNRYVYNNGKMIIISY

SEQ ID NO: 2005191 - protein, 19 aa, Staphylococcus
DEVPEIDADVFSGWGKLQN

SEQ ID NO: 2005192 - protein, 18 aa, Staphylococcus
DEVRELGIELGIPEHLVW

SEQ ID NO: 2005193 - protein, 17 aa, Staphylococcus
DEVRKEFQFLDYAEIAF

SEQ ID NO: 2005194 - protein, 17 aa, Staphylococcus
DEVRVPLPNGGEINVKI

SEQ ID NO: 2005195 - protein, 24 aa, Staphylococcus
DEVSVKDIDEWIGLLDQLEEKVKL

SEQ ID NO: 2005196 - protein, 23 aa, Staphylococcus
DEVVCRRAKHAISENERTKLAHK

SEQ ID NO: 2005197 - protein, 18 aa, Staphylococcus
DEVVCVFDAYEQSGIERE

SEQ ID NO: 2005198 - protein, 24 aa, Staphylococcus
DEVWYSPIVCMALSKAHNINFYDS

SEQ ID NO: 2005199 - protein, 18 aa, Staphylococcus
DEVYHMVNNFVLDIKEYI

SEQ ID NO: 2005200 - protein, 25 aa, Staphylococcus
DEWADSMKFPLAVVQEVLQAKQKYA

SEQ ID NO: 2005201 - protein, 19 aa, Staphylococcus
DEWFERYKLTSGSKQSTIT

SEQ ID NO: 2005202 - protein, 17 aa, Staphylococcus
DEWKNIFMESEVTEDGG

SEQ ID NO: 2005203 - protein, 23 aa, Staphylococcus
DEWMFRFNHGIRLPEKHIYFHSL

SEQ ID NO: 2005204 - protein, 18 aa, Staphylococcus
DEWRQGRVTIGHHTLIGA

SEQ ID NO: 2005205 - protein, 19 aa, Staphylococcus
DEYASFIRQQWAKLGLGLD

SEQ ID NO: 2005206 - protein, 25 aa, Staphylococcus
DEYDKGYILKWLVTNSNEYDMEPLM

SEQ ID NO: 2005207 - protein, 30 aa, Staphylococcus
DEYESAQDWKARLRMLKAFPTPTFDDIPLL

SEQ ID NO: 2005208 - protein, 17 aa, Staphylococcus
DEYEWLQQSTFNFPDKE

SEQ ID NO: 2005209 - protein, 19 aa, Staphylococcus
DEYLNCLIKELSQPNKKEL

SEQ ID NO: 2005210 - protein, 20 aa, Staphylococcus
DEYPGYEFEKNVGYGTKAHL

SEQ ID NO: 2005211 - protein, 17 aa, Staphylococcus
DEYWRHIVLKTRLDQAF

SEQ ID NO: 2005212 - protein, 18 aa, Staphylococcus
DFAAVGLLFRSGDDYIWK

SEQ ID NO: 2005213 - protein, 22 aa, Staphylococcus
DFADIFCETGVFTVEESKKYME

SEQ ID NO: 2005214 - protein, 20 aa, Staphylococcus
DFAFEFNGIPTVVPRHYQYQ

SEQ ID NO: 2005215 - protein, 20 aa, Staphylococcus
DFANVFFMMMNYYSLERSMQ

SEQ ID NO: 2005216 - protein, 25 aa, Staphylococcus
DFDALERHVKFLLENNTQAIIVNGT

SEQ ID NO: 2005217 - protein, 26 aa, Staphylococcus
DFDALRRHVKYLLDNNAKSIVVNGTT

SEQ ID NO: 2005218 - protein, 18 aa, Staphylococcus
DFDALSFNTAISQLMVFI

SEQ ID NO: 2005219 - protein, 19 aa, Staphylococcus
DFDFAVYIIDHLVDDEKGC

SEQ ID NO: 2005220 - protein, 21 aa, Staphylococcus
DFDFPNVLRVIQFETQSKKQD

SEQ ID NO: 2005221 - protein, 24 aa, Staphylococcus
DFDHKRVHFFLKMFNQEGVQTAAY

SEQ ID NO: 2005222 - protein, 18 aa, Staphylococcus
DFDSIFRRMMQDMQNADG

SEQ ID NO: 2005223 - protein, 18 aa, Staphylococcus
DFDSRKSLYAGIIDGRNV

SEQ ID NO: 2005224 - protein, 24 aa, Staphylococcus
DFDSYKDLFSYFIKGIRMSNPESE

SEQ ID NO: 2005225 - protein, 22 aa, Staphylococcus
DFEDYKLPQLVQIGEADLINKG

SEQ ID NO: 2005226 - protein, 23 aa, Staphylococcus
DFEKLKEKVLYPYSDEIEYKRLV

SEQ ID NO: 2005227 - protein, 25 aa, Staphylococcus
DFEKTMARGYRREEVDAFLDDIITD

SEQ ID NO: 2005228 - protein, 19 aa, Staphylococcus
DFEKVLILLQVIPKRLPQK

SEQ ID NO: 2005229 - protein, 18 aa, Staphylococcus
DFELPLVIATTGEKEQLT

SEQ ID NO: 2005230 - protein, 19 aa, Staphylococcus
DFEPLRFFNDNAYAVLGLI

SEQ ID NO: 2005231 - protein, 25 aa, Staphylococcus
DFESLSLYPIVPMNFYERYQYLLTR

SEQ ID NO: 2005232 - protein, 22 aa, Staphylococcus
DFFNFFRNFFTQKWEREVDTNL

SEQ ID NO: 2005233 - protein, 26 aa, Staphylococcus
DFFTIVKWEISGTLNYMKPREFCLIS

SEQ ID NO: 2005234 - protein, 26 aa, Staphylococcus
DFFTMVKWEVSGTLNYMKPREFCLVS

SEQ ID NO: 2005235 - protein, 22 aa, Staphylococcus
DFGIPEMADFVSMKQDELKTLQ

SEQ ID NO: 2005236 - protein, 18 aa, Staphylococcus
DFGNFEMYGFDSTLTQDE

SEQ ID NO: 2005237 - protein, 24 aa, Staphylococcus
DFGTSFKPIVTWIQSLVSDEDKVN

SEQ ID NO: 2005238 - protein, 27 aa, Staphylococcus
DFGYMWECPDYFSLNGQDVIIFSPQGI

SEQ ID NO: 2005239 - protein, 24 aa, Staphylococcus
DFHKPGHLFPLIAKDNGVLEREGH

SEQ ID NO: 2005240 - protein, 25 aa, Staphylococcus
DFHKPGHLFPLIAKENGVLERTGHT

SEQ ID NO: 2005241 - protein, 33 aa, Staphylococcus
DFIELKRILMEWQIGIHDGNGWNAIFWCNHDQP

SEQ ID NO: 2005242 - protein, 29 aa, Staphylococcus
DFIESFLEPCHIAKMISRYMIINETDKIL

SEQ ID NO: 2005243 - protein, 23 aa, Staphylococcus
DFIFSDQVLNSWKKTDELYEIWC

SEQ ID NO: 2005244 - protein, 24 aa, Staphylococcus
DFIKDMLNMIDIHFDNQSNGIFMG

SEQ ID NO: 2005245 - protein, 24 aa, Staphylococcus
DFINECRTSHAFWASLDTFDIKKI

SEQ ID NO: 2005246 - protein, 17 aa, Staphylococcus
DFIPELRSLNVVLKDVT

SEQ ID NO: 2005247 - protein, 26 aa, Staphylococcus
DFIQIYKNNLFYRAFKSEKELFQYYF

SEQ ID NO: 2005248 - protein, 25 aa, Staphylococcus
DFIYIKDLLQAIWIVIQDDATNGKV

SEQ ID NO: 2005249 - protein, 26 aa, Staphylococcus
DFKARVQDWTFPFVIKPGDDLPTAGG

SEQ ID NO: 2005250 - protein, 26 aa, Staphylococcus
DFKGEAKPGPIIAIFGDTKPCDNEYV

SEQ ID NO: 2005251 - protein, 22 aa, Staphylococcus
DFKHGYIYNEVVLRPVSEIKQL

SEQ ID NO: 2005252 - protein, 31 aa, Staphylococcus
DFKINATLIKSKRDYIALGLISQILEEESSN

SEQ ID NO: 2005253 - protein, 21 aa, Staphylococcus
DFKKGFIYEEVILKPQEEIQL

SEQ ID NO: 2005254 - protein, 25 aa, Staphylococcus
DFKKVEKYEGVFDFSEMIERAVNNV

SEQ ID NO: 2005255 - protein, 18 aa, Staphylococcus
DFKSNLKSILMMKKAFEI

SEQ ID NO: 2005256 - protein, 26 aa, Staphylococcus
DFLILDWTSIWILLKSFESAYFNEND

SEQ ID NO: 2005257 - protein, 20 aa, Staphylococcus
DFLIRRTGMLYFDIEDVKKY

SEQ ID NO: 2005258 - protein, 34 aa, Staphylococcus
DFLKLKEILMDWQIGIFEGGGWNAIFWCNHDQPR

SEQ ID NO: 2005259 - protein, 26 aa, Staphylococcus
DFLSPCKLAKMISRYMIINETDKVLM

SEQ ID NO: 2005260 - protein, 24 aa, Staphylococcus
DFLTAKARYASSIKGTKPQFTKDR

SEQ ID NO: 2005261 - protein, 23 aa, Staphylococcus
DFMKIAEAYGIKGYLIDNPAQLE

SEQ ID NO: 2005262 - protein, 22 aa, Staphylococcus
DFMKVTPGIRPEGAAQNDQKRI

SEQ ID NO: 2005263 - protein, 20 aa, Staphylococcus
DFMTLKEEWGTLKGKTLTYI

SEQ ID NO: 2005264 - protein, 19 aa, Staphylococcus
DFNDFQWSQPLKTLEGNQM

SEQ ID NO: 2005265 - protein, 18 aa, Staphylococcus
DFNEPILLDVLQNSKVMR

SEQ ID NO: 2005266 - protein, 27 aa, Staphylococcus
DFNFKYKPRLPLSINIPKIELNKGKVT

SEQ ID NO: 2005267 - protein, 24 aa, Staphylococcus
DFNKPGHLFPLIAQDNGVLSRRGH

SEQ ID NO: 2005268 - protein, 24 aa, Staphylococcus
DFNRPGHLFPLIAKDNGVLERNGH

SEQ ID NO: 2005269 - protein, 28 aa, Staphylococcus
DFNRPGHLFPLIARTGGVLVRNGHTEAA

SEQ ID NO: 2005270 - protein, 24 aa, Staphylococcus
DFNVKIGGFRGRKLENGDEVELKR

SEQ ID NO: 2005271 - protein, 19 aa, Staphylococcus
DFNYIKGYLPLHNHQQAYE

SEQ ID NO: 2005272 - protein, 26 aa, Staphylococcus
DFPLEPKTLFYNWIYINALNQNEEVA

SEQ ID NO: 2005273 - protein, 26 aa, Staphylococcus
DFQDALGLSSADSFRELIKVLVELEQ

SEQ ID NO: 2005274 - protein, 19 aa, Staphylococcus
DFQGYGYGTKMMMYLPRYV

SEQ ID NO: 2005275 - protein, 28 aa, Staphylococcus
DFQQLKKILMDWQLGIYEGGGWNAIFWC

SEQ ID NO: 2005276 - protein, 24 aa, Staphylococcus
DFRASEVPSAIFGTKQRRPIENGV

SEQ ID NO: 2005277 - protein, 19 aa, Staphylococcus
DFRDIKFVIQGGSHPLPSI

SEQ ID NO: 2005278 - protein, 23 aa, Staphylococcus
DFRPGLKARDEFGVRSVLQEAHL

SEQ ID NO: 2005279 - protein, 24 aa, Staphylococcus
DFRPGLKARDEFKVRSVLQEAKLY

SEQ ID NO: 2005280 - protein, 24 aa, Staphylococcus
DFRPGLKARTEFNVRSILQEAELF

SEQ ID NO: 2005281 - protein, 24 aa, Staphylococcus
DFSNISFPDSFKVFGSNNSKIIFC

SEQ ID NO: 2005282 - protein, 23 aa, Staphylococcus
DFSTQLLDRFLVIAHSYDLEPSI

SEQ ID NO: 2005283 - protein, 21 aa, Staphylococcus
DFSTQLVDRFLVIAHSYGLNP

SEQ ID NO: 2005284 - protein, 18 aa, Staphylococcus
DFTQLCHLEDLTAVVVDK

SEQ ID NO: 2005285 - protein, 19 aa, Staphylococcus
DFTQLCHLEDLTAVVVDKN

SEQ ID NO: 2005286 - protein, 18 aa, Staphylococcus
DFTVSPASTRLCIAINSE

SEQ ID NO: 2005287 - protein, 17 aa, Staphylococcus
DFVAVRFGNVLGSRGSV

SEQ ID NO: 2005288 - protein, 19 aa, Staphylococcus
DFVVCLKKKDLQHISYEVM

SEQ ID NO: 2005289 - protein, 26 aa, Staphylococcus
DFVVEGPLWIQVHAFEKGVEVVISKS

SEQ ID NO: 2005290 - protein, 19 aa, Staphylococcus
DFYFMKLNQFYDDVTEYDS

SEQ ID NO: 2005291 - protein, 18 aa, Staphylococcus
DFYPEFPAEEIVEADGVR

SEQ ID NO: 2005292 - protein, 17 aa, Staphylococcus
DFYPEFPEEQFITHHDV

SEQ ID NO: 2005293 - protein, 18 aa, Staphylococcus
DFYPEFPNEELISSDDIK

SEQ ID NO: 2005294 - protein, 24 aa, Staphylococcus
DFYPTLLKRVCEVYKIKMDKPFKK

SEQ ID NO: 2005295 - protein, 17 aa, Staphylococcus
DGAFFKNKNLFVIGGGD

SEQ ID NO: 2005296 - protein, 25 aa, Staphylococcus
DGAGVGRLNLRAGKSSVIGTMGYLL

SEQ ID NO: 2005297 - protein, 17 aa, Staphylococcus
DGAIYIDKTRSIKAQNP

SEQ ID NO: 2005298 - protein, 19 aa, Staphylococcus
DGAKIGSGVLDIISNGASL

SEQ ID NO: 2005299 - protein, 18 aa, Staphylococcus
DGAPAYFSNLPIKSMTEA

SEQ ID NO: 2005300 - protein, 21 aa, Staphylococcus
DGCGECPACHLRARGLQQYLN

SEQ ID NO: 2005301 - protein, 21 aa, Staphylococcus
DGCGECPACQLRSRGLEKYLA

SEQ ID NO: 2005302 - protein, 17 aa, Staphylococcus
DGDAFAKFFKLMLNQGI

SEQ ID NO: 2005303 - protein, 23 aa, Staphylococcus
DGDDIYYDLNISFPQAALGDEVK

SEQ ID NO: 2005304 - protein, 21 aa, Staphylococcus
DGDDIYYNLNISFPQAALGDE

SEQ ID NO: 2005305 - protein, 19 aa, Staphylococcus
DGDDIYYNLNVSFPQAALG

SEQ ID NO: 2005306 - protein, 18 aa, Staphylococcus
DGDDIYYSLDISIAQATL

SEQ ID NO: 2005307 - protein, 21 aa, Staphylococcus
DGDDLFYELNISFPQASLGDE

SEQ ID NO: 2005308 - protein, 19 aa, Staphylococcus
DGDDLYYNLDVSFPQASLG

SEQ ID NO: 2005309 - protein, 20 aa, Staphylococcus
DGDELKNCLKIYQSRQRRFG

SEQ ID NO: 2005310 - protein, 23 aa, Staphylococcus
DGDESYLTFGVRRDVTEAHEGEV

SEQ ID NO: 2005311 - protein, 20 aa, Staphylococcus
DGDHGVNMLRGFESLKDKLD

SEQ ID NO: 2005312 - protein, 23 aa, Staphylococcus
DGDHGVNMVRGFKALPDNIDDSS

SEQ ID NO: 2005313 - protein, 20 aa, Staphylococcus
DGDIGPFIEAFLRSQMDQHE

SEQ ID NO: 2005314 - protein, 18 aa, Staphylococcus
DGDKWIINGQKKWIGGAN

SEQ ID NO: 2005315 - protein, 24 aa, Staphylococcus
DGEDEFFKKVFVGYTDSLKNSDEE

SEQ ID NO: 2005316 - protein, 20 aa, Staphylococcus
DGEELKQCIKIYQSRQRRFG

SEQ ID NO: 2005317 - protein, 21 aa, Staphylococcus
DGEHAVLSRFHLNDEELEKYK

SEQ ID NO: 2005318 - protein, 18 aa, Staphylococcus
DGEIAGAGLDVFREEPIS

SEQ ID NO: 2005319 - protein, 22 aa, Staphylococcus
DGEISAPIVIGRDHLDSGSVAS

SEQ ID NO: 2005320 - protein, 31 aa, Staphylococcus
DGEITFCGGIEMPGWIDLRVNVIKNGMEKYQ

SEQ ID NO: 2005321 - protein, 23 aa, Staphylococcus
DGEIYKSHMFYWSDKENNRINTL

SEQ ID NO: 2005322 - protein, 23 aa, Staphylococcus
DGEIYKSHMFYWSDKNNKRINTL

SEQ ID NO: 2005323 - protein, 19 aa, Staphylococcus
DGEMKFRIACAHHHHHHFI

SEQ ID NO: 2005324 - protein, 26 aa, Staphylococcus
DGEPMFQFCLGIPWGADNDPETIEYF

SEQ ID NO: 2005325 - protein, 22 aa, Staphylococcus
DGEVIGLELPKTVELQVTETEP

SEQ ID NO: 2005326 - protein, 24 aa, Staphylococcus
DGEVSRLYLNFSDPWPKKRHTKRR

SEQ ID NO: 2005327 - protein, 17 aa, Staphylococcus
DGFELCQQIKLDFDLPV

SEQ ID NO: 2005328 - protein, 18 aa, Staphylococcus
DGFHPSNIGKLYIDEQTF

SEQ ID NO: 2005329 - protein, 23 aa, Staphylococcus
DGFHPSNIGKLYIDEQTFVPCTP

SEQ ID NO: 2005330 - protein, 22 aa, Staphylococcus
DGFTLTFKDGVIVDFKADKGED

SEQ ID NO: 2005331 - protein, 18 aa, Staphylococcus
DGGCYYFVVLINENGESQ

SEQ ID NO: 2005332 - protein, 24 aa, Staphylococcus
DGGKAANIIPDFTHARFYTRATSR

SEQ ID NO: 2005333 - protein, 24 aa, Staphylococcus
DGGKAANIIPDFTHARFYTRATTR

SEQ ID NO: 2005334 - protein, 24 aa, Staphylococcus
DGGLPKRPFAPFNEAHRATLDNLI

SEQ ID NO: 2005335 - protein, 19 aa, Staphylococcus
DGGSVYFFYTLKKEEGFFY

SEQ ID NO: 2005336 - protein, 22 aa, Staphylococcus
DGGWPEPIAKAYADKGGTPWLD

SEQ ID NO: 2005337 - protein, 22 aa, Staphylococcus
DGGWPEPIAKAYADNGGTPWLD

SEQ ID NO: 2005338 - protein, 18 aa, Staphylococcus
DGHALTEEEIEFFINGYT

SEQ ID NO: 2005339 - protein, 22 aa, Staphylococcus
DGHKGSYIRIYEMNPDGTRGKL

SEQ ID NO: 2005340 - protein, 22 aa, Staphylococcus
DGHLLIQWYSKGIYKFRYNVIE

SEQ ID NO: 2005341 - protein, 18 aa, Staphylococcus
DGHLRFRNNDLNRSVYIS

SEQ ID NO: 2005342 - protein, 17 aa, Staphylococcus
DGHTGVIAFEVKDTEAA

SEQ ID NO: 2005343 - protein, 28 aa, Staphylococcus
DGHTTALMLFVKRCKAMADKGELPHNVV

SEQ ID NO: 2005344 - protein, 31 aa, Staphylococcus
DGHTTALMLFVKRCKEMFDKGTLPHNVVFIF

SEQ ID NO: 2005345 - protein, 23 aa, Staphylococcus
DGHTTALMLFVKRCKNLADKGEL

SEQ ID NO: 2005346 - protein, 24 aa, Staphylococcus
DGHVLRNAILWNDTRNSEQCRQII

SEQ ID NO: 2005347 - protein, 19 aa, Staphylococcus
DGIEHRYGYGLAINSNNAE

SEQ ID NO: 2005348 - protein, 17 aa, Staphylococcus
DGIEVCKTIRSDKNLVP

SEQ ID NO: 2005349 - protein, 20 aa, Staphylococcus
DGIFIFDVHTPYKMETLFNN

SEQ ID NO: 2005350 - protein, 23 aa, Staphylococcus
DGIFKRPIPTYTLQLANGQNVQV

SEQ ID NO: 2005351 - protein, 20 aa, Staphylococcus
DGIKKYGILNEHRKTFEPIK

SEQ ID NO: 2005352 - protein, 25 aa, Staphylococcus
DGILGCVEAGLGIAFLPMSVLNKGN

SEQ ID NO: 2005353 - protein, 17 aa, Staphylococcus
DGIRYLVDECGYNVIVR

SEQ ID NO: 2005354 - protein, 18 aa, Staphylococcus
DGISELFTSMGATHIISG

SEQ ID NO: 2005355 - protein, 19 aa, Staphylococcus
DGISLEKFISMIFDDEHLD

SEQ ID NO: 2005356 - protein, 30 aa, Staphylococcus
DGIYLSGALLMFCGKKAYYLYGASSNDYRD

SEQ ID NO: 2005357 - protein, 24 aa, Staphylococcus
DGKARLNYGASWFEHSKLYIRTEL

SEQ ID NO: 2005358 - protein, 22 aa, Staphylococcus
DGKEISRQNILNGQDGKNGTPG

SEQ ID NO: 2005359 - protein, 22 aa, Staphylococcus
DGKEISRQVIVNGKDGKDGKTP

SEQ ID NO: 2005360 - protein, 22 aa, Staphylococcus
DGKERLNYGSSWFEHNQLFIRT

SEQ ID NO: 2005361 - protein, 24 aa, Staphylococcus
DGKFLLRYPTVYIINDKKEKNDFE

SEQ ID NO: 2005362 - protein, 23 aa, Staphylococcus
DGKKHKASILNWLESAEIDPKRR

SEQ ID NO: 2005363 - protein, 19 aa, Staphylococcus
DGKLTCGHPGQAIEEYIKS

SEQ ID NO: 2005364 - protein, 25 aa, Staphylococcus
DGKNYPCFWTEKSLAEEFFKDNHQS

SEQ ID NO: 2005365 - protein, 31 aa, Staphylococcus
DGKPILVHTVEKFLLTSEFDKIFIATPQKWI

SEQ ID NO: 2005366 - protein, 24 aa, Staphylococcus
DGKPKYFLVHRLVAFAFIPRIEGK

SEQ ID NO: 2005367 - protein, 17 aa, Staphylococcus
DGKRIGKTFDHRNLPDP

SEQ ID NO: 2005368 - protein, 24 aa, Staphylococcus
DGKRLKDLIKVYLKENDFEVLDVT

SEQ ID NO: 2005369 - protein, 19 aa, Staphylococcus
DGKSIGFVPTMGALHDGHL

SEQ ID NO: 2005370 - protein, 24 aa, Staphylococcus
DGKTGEMQLHLNVYKQKTCKICGH

SEQ ID NO: 2005371 - protein, 24 aa, Staphylococcus
DGKTGEMQLHLNVYKQKYCKVCGH

SEQ ID NO: 2005372 - protein, 26 aa, Staphylococcus
DGKVARLTNFGAFIDIGGVDGLVHVS

SEQ ID NO: 2005373 - protein, 32 aa, Staphylococcus
DGKYRVYPYFPFEKSKSFEFFYVELDPGATLD

SEQ ID NO: 2005374 - protein, 18 aa, Staphylococcus
DGLKEADCNIRFKNHLLD

SEQ ID NO: 2005375 - protein, 26 aa, Staphylococcus
DGLKNFKGSIIFTSYDFEFINTIANR

SEQ ID NO: 2005376 - protein, 25 aa, Staphylococcus
DGLKSFKGSIIFTSHDFEFINTIAN

SEQ ID NO: 2005377 - protein, 26 aa, Staphylococcus
DGLKSFKGSLIFTSYDFEFINTIANR

SEQ ID NO: 2005378 - protein, 26 aa, Staphylococcus
DGLKSLDCNLKFKTFLLEEGIIDEAW

SEQ ID NO: 2005379 - protein, 18 aa, Staphylococcus
DGLKTFAYLMQITGERDG

SEQ ID NO: 2005380 - protein, 17 aa, Staphylococcus
DGLLVPFVRDCDKKNFA

SEQ ID NO: 2005381 - protein, 21 aa, Staphylococcus
DGLNSDCILLFSERDIGLHQY

SEQ ID NO: 2005382 - protein, 32 aa, Staphylococcus
DGLSRDRVDIILPAVAVFKALFKQVEATQFTF

SEQ ID NO: 2005383 - protein, 31 aa, Staphylococcus
DGLSRDRVDIILPAVCVFKALYKKVNATQFT

SEQ ID NO: 2005384 - protein, 24 aa, Staphylococcus
DGLSRDRVDIILPAVSVFKTLFKK

SEQ ID NO: 2005385 - protein, 24 aa, Staphylococcus
DGLSRDRVDIILPAVSVFKTLYKI

SEQ ID NO: 2005386 - protein, 24 aa, Staphylococcus
DGLSRDRVDIILPAVSVFKTLYKK

SEQ ID NO: 2005387 - protein, 19 aa, Staphylococcus
DGLVRAGVRKLTIVDRDYI

SEQ ID NO: 2005388 - protein, 17 aa, Staphylococcus
DGLYNFISAIRVATSLE

SEQ ID NO: 2005389 - protein, 25 aa, Staphylococcus
DGMLVKRPLAIAGDNITLGFKEDQY

SEQ ID NO: 2005390 - protein, 26 aa, Staphylococcus
DGMLVKRPLAILGDKITLGFKEEEYK

SEQ ID NO: 2005391 - protein, 25 aa, Staphylococcus
DGMLVKRPLAISGEKITLGFKEDQY

SEQ ID NO: 2005392 - protein, 27 aa, Staphylococcus
DGMPGLTICGGYQFLGTKYITPDGTEL

SEQ ID NO: 2005393 - protein, 21 aa, Staphylococcus
DGMSCDHCKNTIESALAKING

SEQ ID NO: 2005394 - protein, 25 aa, Staphylococcus
DGNAALRICENIKYYFHIISKKPES

SEQ ID NO: 2005395 - protein, 17 aa, Staphylococcus
DGNALFRIVKVMEGGAI

SEQ ID NO: 2005396 - protein, 17 aa, Staphylococcus
DGNDVFVHFSGIAGEGY

SEQ ID NO: 2005397 - protein, 28 aa, Staphylococcus
DGNEVKLRLKGYPAIIFQHEIDHLNGVM

SEQ ID NO: 2005398 - protein, 27 aa, Staphylococcus
DGNEVKLRLKGYPAIVFQHEIDHLNGI

SEQ ID NO: 2005399 - protein, 27 aa, Staphylococcus
DGNIMNRYGIPSVILGVGYENIHTTSE

SEQ ID NO: 2005400 - protein, 19 aa, Staphylococcus
DGNPVFEWRDEPIENPNYN

SEQ ID NO: 2005401 - protein, 21 aa, Staphylococcus
DGPFEGFFSIAGFKEDAKKID

SEQ ID NO: 2005402 - protein, 18 aa, Staphylococcus
DGPKVIEFNARFGDPEAQ

SEQ ID NO: 2005403 - protein, 28 aa, Staphylococcus
DGPLDLTMLFGLVGRLTPELSNLRYDPY

SEQ ID NO: 2005404 - protein, 26 aa, Staphylococcus
DGQLNRFGSIYIKFDQTLFRFIFHIE

SEQ ID NO: 2005405 - protein, 33 aa, Staphylococcus
DGQPEFINRLFDIEGVTSIFYVMDFISVDKEND

SEQ ID NO: 2005406 - protein, 24 aa, Staphylococcus
DGQVFYLYNRVQSIYEKREQLQML

SEQ ID NO: 2005407 - protein, 22 aa, Staphylococcus
DGQWKSWGPYLLSGKDVHGSTV

SEQ ID NO: 2005408 - protein, 18 aa, Staphylococcus
DGQWKSWGPYLLSGKDVY

SEQ ID NO: 2005409 - protein, 30 aa, Staphylococcus; identical to SEQ ID NO: 1803208

SEQ ID NO: 2005410 - protein, 19 aa, Staphylococcus
DGREGVLTYDVLQYLHEIM

SEQ ID NO: 2005411 - protein, 24 aa, Staphylococcus
DGREIALYCPTWRGSDVNNPTESL

SEQ ID NO: 2005412 - protein, 23 aa, Staphylococcus
DGREIPKKPRIVNSQKAIRTNDI

SEQ ID NO: 2005413 - protein, 18 aa, Staphylococcus
DGRFLNIGENQWGIRDWY

SEQ ID NO: 2005414 - protein, 20 aa, Staphylococcus
DGRIHPGRIEEMVDKARKEV

SEQ ID NO: 2005415 - protein, 23 aa, Staphylococcus
DGRTAQRENIEWLNEQLEVEEND

SEQ ID NO: 2005416 - protein, 17 aa, Staphylococcus
DGRVPVIAGTGTNATKK

SEQ ID NO: 2005417 - protein, 24 aa, Staphylococcus
DGSCIRDYLHVVDLIDAHILAYQH

SEQ ID NO: 2005418 - protein, 18 aa, Staphylococcus
DGSFNFKPMYSHIKNDIQ

SEQ ID NO: 2005419 - protein, 20 aa, Staphylococcus
DGSTAYMFVAYLGVDPITRK

SEQ ID NO: 2005420 - protein, 20 aa, Staphylococcus
DGTETGLWLEEAGEPYDILR

SEQ ID NO: 2005421 - protein, 28 aa, Staphylococcus
DGTIIYFDRSWMKIGLQLVDDFMEKYDQ

SEQ ID NO: 2005422 - protein, 23 aa, Staphylococcus
DGTKLGFMSFFTKAAVAALKKYP

SEQ ID NO: 2005423 - protein, 24 aa, Staphylococcus
DGTKYKLSDFGFRVKDIVIESPEI

SEQ ID NO: 2005424 - protein, 18 aa, Staphylococcus
DGTLGIGHTRWATHGVPN

SEQ ID NO: 2005425 - protein, 24 aa, Staphylococcus
DGTLIDFDMSWMKVDIQMVDEFVE

SEQ ID NO: 2005426 - protein, 25 aa, Staphylococcus
DGTLLEAFHKYSYRLSETAFVGVHT

SEQ ID NO: 2005427 - protein, 18 aa, Staphylococcus
DGTLLNDFNEPILLDVLQ

SEQ ID NO: 2005428 - protein, 25 aa, Staphylococcus
DGTMILKPRFRDYLLKLATENDIKH

SEQ ID NO: 2005429 - protein, 18 aa, Staphylococcus
DGTMSFAVADVIGKGIPA

SEQ ID NO: 2005430 - protein, 19 aa, Staphylococcus
DGTMSFAVADVIGKGIPAA

SEQ ID NO: 2005431 - protein, 17 aa, Staphylococcus
DGTNAFRLFNAEGDGIG

SEQ ID NO: 2005432 - protein, 19 aa, Staphylococcus
DGTTCICKCEPNKPNEPGK

SEQ ID NO: 2005433 - protein, 17 aa, Staphylococcus
DGVFIYIGMKPLTAPFT

SEQ ID NO: 2005434 - protein, 18 aa, Staphylococcus
DGVFIYIGMKPLTVPFQD

SEQ ID NO: 2005435 - protein, 24 aa, Staphylococcus
DGVIIPKRRSVALTQTVAKASAGA

SEQ ID NO: 2005436 - protein, 17 aa, Staphylococcus
DGVIKRVTVSSGDAIAT

SEQ ID NO: 2005437 - protein, 33 aa, Staphylococcus
DGVKLVDFWATWCGPCKMIAPVLEELAGDYEGK

SEQ ID NO: 2005438 - protein, 32 aa, Staphylococcus
DGVKLVDFWATWCGPCKMIAPVLEELAQDFEG

SEQ ID NO: 2005439 - protein, 20 aa, Staphylococcus
DGVKSIFYVMDFLAIDKEPK

SEQ ID NO: 2005440 - protein, 20 aa, Staphylococcus
DGVKSIFYVMDFLAIDKQPK

SEQ ID NO: 2005441 - protein, 28 aa, Staphylococcus
DGVKVLNFGSGHAWGMIGLEIETEELGT

SEQ ID NO: 2005442 - protein, 19 aa, Staphylococcus
DGVNQFIFMSTMAVFGEDG

SEQ ID NO: 2005443 - protein, 17 aa, Staphylococcus
DGVRNLMEFTGASLEEV

SEQ ID NO: 2005444 - protein, 24 aa, Staphylococcus
DGVVIPKRRSVALTQTVAKASTGA

SEQ ID NO: 2005445 - protein, 21 aa, Staphylococcus
DGWAHCLTIPRVLTVEEGNLK

SEQ ID NO: 2005446 - protein, 21 aa, Staphylococcus
DGWSLSILINEMWNKKTILGI

SEQ ID NO: 2005447 - protein, 20 aa, Staphylococcus
DGWYSLHLFYAIDWATFRLV

SEQ ID NO: 2005448 - protein, 19 aa, Staphylococcus
DGWYSLHLFYAIDWTTFRL

SEQ ID NO: 2005449 - protein, 24 aa, Staphylococcus
DGWYSLHLFYAMDWTTFRLVPEDE

SEQ ID NO: 2005450 - protein, 17 aa, Staphylococcus
DGWYSLHLFYAVDWPTL

SEQ ID NO: 2005451 - protein, 18 aa, Staphylococcus
DGYARINGLGAMVTTFGV

SEQ ID NO: 2005452 - protein, 17 aa, Staphylococcus
DGYEHDGVIPGGALDDL

SEQ ID NO: 2005453 - protein, 21 aa, Staphylococcus
DGYFWFQGRVDDVIMTAGERV

SEQ ID NO: 2005454 - protein, 25 aa, Staphylococcus
DGYKFAKKLGHSITELFPTEVPITS

SEQ ID NO: 2005455 - protein, 18 aa, Staphylococcus
DGYLKIKVNGGGCTGLTY

SEQ ID NO: 2005456 - protein, 20 aa, Staphylococcus
DGYLKVKVNGGGCTGLTYGM

SEQ ID NO: 2005457 - protein, 19 aa, Staphylococcus
DGYTTFKKVLAIEIPNSRT

SEQ ID NO: 2005458 - protein, 23 aa, Staphylococcus
DGYYADTGISFVVGEADNPLKQK

SEQ ID NO: 2005459 - protein, 17 aa, Staphylococcus
DHAFNYKTNKSIYNILI

SEQ ID NO: 2005460 - protein, 22 aa, Staphylococcus
DHAIQILLDRTSKWRQLAEEIL

SEQ ID NO: 2005461 - protein, 20 aa, Staphylococcus
DHALTVIEWSEFISDFLPED

SEQ ID NO: 2005462 - protein, 21 aa, Staphylococcus
DHAMLKLAYIDLKDYLSTLQH

SEQ ID NO: 2005463 - protein, 21 aa, Staphylococcus
DHAMLKLAYIDLKDYLSTLQQ

SEQ ID NO: 2005464 - protein, 20 aa, Staphylococcus
DHAMLKLAYIDLNDYLATLK

SEQ ID NO: 2005465 - protein, 27 aa, Staphylococcus
DHDILKASCKAYIEAHAKYVAEAKEKE

SEQ ID NO: 2005466 - protein, 24 aa, Staphylococcus
DHEAYCLYEDFFKAKAEKIPEITV

SEQ ID NO: 2005467 - protein, 23 aa, Staphylococcus
DHEFAVKFNLPIIEVIAGGDVQK

SEQ ID NO: 2005468 - protein, 21 aa, Staphylococcus
DHFIMKLRIVKFARTPDYNEL

SEQ ID NO: 2005469 - protein, 23 aa, Staphylococcus
DHFKALSVGKWIRAQGRIEEDSF

SEQ ID NO: 2005470 - protein, 25 aa, Staphylococcus
DHFKVYWKEITQLCINEPTIQMFED

SEQ ID NO: 2005471 - protein, 24 aa, Staphylococcus
DHFVICTNGLFIIETKHWKGDIYF

SEQ ID NO: 2005472 - protein, 22 aa, Staphylococcus
DHFYPSQTNFVFVKTDKPHELY

SEQ ID NO: 2005473 - protein, 23 aa, Staphylococcus
DHGAEAECHFCRAKYQYSEAELK

SEQ ID NO: 2005474 - protein, 25 aa, Staphylococcus
DHGAEAECHFCRNKYQFSEEELQQL

SEQ ID NO: 2005475 - protein, 22 aa, Staphylococcus
DHGAEAVCHFCGNKYNYSETEL

SEQ ID NO: 2005476 - protein, 22 aa, Staphylococcus
DHGAEAVCHFCGNKYQYTESEL

SEQ ID NO: 2005477 - protein, 23 aa, Staphylococcus
DHGESLTAPVLNDIMLNVYQQFF

SEQ ID NO: 2005478 - protein, 23 aa, Staphylococcus
DHGKTTLLDSIRHTKVTAGEAGG

SEQ ID NO: 2005479 - protein, 18 aa, Staphylococcus
DHGLTGLEFACGIPGSIG

SEQ ID NO: 2005480 - protein, 24 aa, Staphylococcus
DHHIVRQGLEFLLSTVADLEVLAS

SEQ ID NO: 2005481 - protein, 21 aa, Staphylococcus
DHHKGQEIIQAISEIDSTQTI

SEQ ID NO: 2005482 - protein, 17 aa, Staphylococcus
DHHLSLTAYKRIEAISD

SEQ ID NO: 2005483 - protein, 18 aa, Staphylococcus
DHHVTKIILGIGGSATND

SEQ ID NO: 2005484 - protein, 23 aa, Staphylococcus
DHIDKIYFTSHMDTVVPGLNVKP

SEQ ID NO: 2005485 - protein, 22 aa, Staphylococcus
DHIIFQYPLYWYSSPPLMKQYL

SEQ ID NO: 2005486 - protein, 18 aa, Staphylococcus
DHIKGLGVIARRYGLPVY

SEQ ID NO: 2005487 - protein, 17 aa, Staphylococcus
DHIRTALYGAKYDALLV

SEQ ID NO: 2005488 - protein, 17 aa, Staphylococcus
DHIVIIVSGAFGNRFKQ

SEQ ID NO: 2005489 - protein, 18 aa, Staphylococcus
DHIVIIVSGAFGNRFKQI

SEQ ID NO: 2005490 - protein, 21 aa, Staphylococcus
DHIYGLPGLLTSRSFQGGENK

SEQ ID NO: 2005491 - protein, 17 aa, Staphylococcus
DHKDGTMSFAIADVIGK

SEQ ID NO: 2005492 - protein, 22 aa, Staphylococcus
DHKETIEELSLLQFSTEEDKWK

SEQ ID NO: 2005493 - protein, 18 aa, Staphylococcus
DHKFTQFVSNEFFTVEKW

SEQ ID NO: 2005494 - protein, 18 aa, Staphylococcus
DHKKIFVPEVDYKSKIMT

SEQ ID NO: 2005495 - protein, 20 aa, Staphylococcus
DHLDGIMFYDHIDKENPLQP

SEQ ID NO: 2005496 - protein, 19 aa, Staphylococcus
DHLDYIVIDQFAKREVYQH

SEQ ID NO: 2005497 - protein, 22 aa, Staphylococcus
DHLKDQYPMRLSGGEAQRVALA

SEQ ID NO: 2005498 - protein, 17 aa, Staphylococcus
DHLMGVPIIGQHFENDP

SEQ ID NO: 2005499 - protein, 17 aa, Staphylococcus
DHLMGVPIIGQHFQNDP

SEQ ID NO: 2005500 - protein, 17 aa, Staphylococcus
DHLMGVPILAQHFENDP

SEQ ID NO: 2005501 - protein, 17 aa, Staphylococcus
DHLMGVPILAQHFQNDP

SEQ ID NO: 2005502 - protein, 19 aa, Staphylococcus
DHLSGLLFDDIPYLKVAQE

SEQ ID NO: 2005503 - protein, 32 aa, Staphylococcus
DHNFTWAAPIMSRPVKNMTVAIIGTGRIGAAT

SEQ ID NO: 2005504 - protein, 25 aa, Staphylococcus
DHNYACILLDLMLPEMDGIEVASKL

SEQ ID NO: 2005505 - protein, 23 aa, Staphylococcus
DHPDLDFTFIHWLVTGVKDHEPI

SEQ ID NO: 2005506 - protein, 25 aa, Staphylococcus
DHPILDAFRILDHVSVPKGAVRPSD

SEQ ID NO: 2005507 - protein, 23 aa, Staphylococcus
DHQARFHFDLARIDTEHFPWQQF

SEQ ID NO: 2005508 - protein, 27 aa, Staphylococcus
DHRIIDGKEAVGFLKTIKDLIENPEDL

SEQ ID NO: 2005509 - protein, 26 aa, Staphylococcus
DHRIIDGKEAVGFLKTIKELIENPED

SEQ ID NO: 2005510 - protein, 27 aa, Staphylococcus
DHRIIDGKEAVGFLKTIKELIENPEDL

SEQ ID NO: 2005511 - protein, 26 aa, Staphylococcus
DHRIIDGKEAVGFLKTIKELIESPED

SEQ ID NO: 2005512 - protein, 28 aa, Staphylococcus
DHRIIDGKEAVGFLKTIKELIESPEDLL

SEQ ID NO: 2005513 - protein, 18 aa, Staphylococcus
DHRLPSDEYKLWYKKEPV

SEQ ID NO: 2005514 - protein, 25 aa, Staphylococcus
DHRPILFSFNYFKSEVVKFKTVRET

SEQ ID NO: 2005515 - protein, 23 aa, Staphylococcus
DHSKRARHTNGRLVIVKFEDLES

SEQ ID NO: 2005516 - protein, 22 aa, Staphylococcus
DHSKVIFCEADDWKPFYESYQN

SEQ ID NO: 2005517 - protein, 22 aa, Staphylococcus
DHSLKDAIKFGIENSDVVTSVS

SEQ ID NO: 2005518 - protein, 25 aa, Staphylococcus
DHSLKRLGTDYVDLYYVHTWDGQVP

SEQ ID NO: 2005519 - protein, 19 aa, Staphylococcus
DHTHHSFDVIIIAVKTHQL

SEQ ID NO: 2005520 - protein, 22 aa, Staphylococcus
DHTLKDAIKFGIEESDIVTSVS

SEQ ID NO: 2005521 - protein, 18 aa, Staphylococcus
DHTREYIPVLLYSPKLKD

SEQ ID NO: 2005522 - protein, 21 aa, Staphylococcus
DHVHKAYIYGFDINDGTQAIM

SEQ ID NO: 2005523 - protein, 19 aa, Staphylococcus
DHVLVKFEEEIHCEIVNKD

SEQ ID NO: 2005524 - protein, 20 aa, Staphylococcus
DHVVFLGFDHGYRGNSKYLF

SEQ ID NO: 2005525 - protein, 20 aa, Staphylococcus
DHWEDELSMIFVVINNQSKK

SEQ ID NO: 2005526 - protein, 22 aa, Staphylococcus
DHWEQELAMIFVVINNKTKKVS

SEQ ID NO: 2005527 - protein, 20 aa, Staphylococcus
DHYEIIKFFIEINEEKRQEH

SEQ ID NO: 2005528 - protein, 20 aa, Staphylococcus
DHYHELPILGICLGSQALTC

SEQ ID NO: 2005529 - protein, 21 aa, Staphylococcus
DHYKQGFKTIALRTSNIELIK

SEQ ID NO: 2005530 - protein, 23 aa, Staphylococcus
DHYRRGVNMAIQYLSFKKRTEKE

SEQ ID NO: 2005531 - protein, 21 aa, Staphylococcus
DIADAEGIEFERAMQDSGFNY

SEQ ID NO: 2005532 - protein, 22 aa, Staphylococcus
DIAEAMNIKGKRNGYIENEKYV

SEQ ID NO: 2005533 - protein, 21 aa, Staphylococcus
DIAEELVIIEKPMRAFSENSD

SEQ ID NO: 2005534 - protein, 23 aa, Staphylococcus
DIAEGLNIIKDIPLFKQTKMDIQ

SEQ ID NO: 2005535 - protein, 21 aa, Staphylococcus
DIAEVIAGWTGIPLTKINETE

SEQ ID NO: 2005536 - protein, 20 aa, Staphylococcus
DIAEVIAGWTGIPLTRINET

SEQ ID NO: 2005537 - protein, 17 aa, Staphylococcus
DIAIPFDTDYGWNVSFG

SEQ ID NO: 2005538 - protein, 24 aa, Staphylococcus
DIAKSIRFGASMVMVGSLFAAHEE

SEQ ID NO: 2005539 - protein, 25 aa, Staphylococcus
DIAKSIRFGASMVMVGSLFAAHEES

SEQ ID NO: 2005540 - protein, 20 aa, Staphylococcus
DIAKYCDIFYIGGTKVGALC

SEQ ID NO: 2005541 - protein, 27 aa, Staphylococcus
DICERFKTIYLEEARKPFPQEPLKQLE

SEQ ID NO: 2005542 - protein, 24 aa, Staphylococcus
DIDEDFLLVKREIFSSGKSICRIN

SEQ ID NO: 2005543 - protein, 21 aa, Staphylococcus
DIDELYALYQEARYGGAIFDL

SEQ ID NO: 2005544 - protein, 18 aa, Staphylococcus
DIDEYGYLFATLESNVYD

SEQ ID NO: 2005545 - protein, 25 aa, Staphylococcus
DIDFKEAPPWFKVSPTHYVKSWLLD

SEQ ID NO: 2005546 - protein, 26 aa, Staphylococcus
DIDGEIRLEAPLDIKVLPKALKLLTI

SEQ ID NO: 2005547 - protein, 24 aa, Staphylococcus
DIDGVKSIFYVMDFISVDKEDDAN

SEQ ID NO: 2005548 - protein, 25 aa, Staphylococcus
DIDGVKSIFYVMDFISVDKEDNADW

SEQ ID NO: 2005549 - protein, 27 aa, Staphylococcus
DIDIDELFDLFIFKHDRLKAKMKEAFV

SEQ ID NO: 2005550 - protein, 26 aa, Staphylococcus
DIDLFKAAKYKVAMDNAYPELKAEAN

SEQ ID NO: 2005551 - protein, 24 aa, Staphylococcus
DIDLSVGLVLHKKVGDKVEEGESL

SEQ ID NO: 2005552 - protein, 27 aa, Staphylococcus
DIDNAIWYKLLVNLAINSVTALTRSTA

SEQ ID NO: 2005553 - protein, 20 aa, Staphylococcus
DIDPALIPFIMEKTGKTADE

SEQ ID NO: 2005554 - protein, 18 aa, Staphylococcus
DIDPKVIFEENRNEDINQ

SEQ ID NO: 2005555 - protein, 19 aa, Staphylococcus
DIDSQYLRQTIKGVTIDSR

SEQ ID NO: 2005556 - protein, 22 aa, Staphylococcus
DIDTWISMSYIDVITCLENIVS

SEQ ID NO: 2005557 - protein, 22 aa, Staphylococcus
DIDVDDLFDMFIFKNERLKDKM

SEQ ID NO: 2005558 - protein, 25 aa, Staphylococcus
DIDYDIRMSLIFINEKIRLIEYTFI

SEQ ID NO: 2005559 - protein, 24 aa, Staphylococcus
DIDYLKFAKNYGFSDRVIAHRFDM

SEQ ID NO: 2005560 - protein, 17 aa, Staphylococcus
DIEAFKLGVELSDGKVK

SEQ ID NO: 2005561 - protein, 24 aa, Staphylococcus
DIEARGFSREDLWTNRKRGEEFFW

SEQ ID NO: 2005562 - protein, 27 aa, Staphylococcus
DIEEIPGEIIMKILAFNPDLEKLTKIE

SEQ ID NO: 2005563 - protein, 25 aa, Staphylococcus
DIEELLARIRAILRRQPQKNVIDIN

SEQ ID NO: 2005564 - protein, 24 aa, Staphylococcus
DIEEMRKWMPLMMKGRTGNEIMAA

SEQ ID NO: 2005565 - protein, 26 aa, Staphylococcus
DIEFYPVLCGTAFKNKGVQLMLDAVI

SEQ ID NO: 2005566 - protein, 25 aa, Staphylococcus
DIEGVKSIFYVMDFISVDKEDEADW

SEQ ID NO: 2005567 - protein, 18 aa, Staphylococcus
DIEIGIGIHGEKGLHRQQ

SEQ ID NO: 2005568 - protein, 18 aa, Staphylococcus
DIEIPGMTGLEILAQIRA

SEQ ID NO: 2005569 - protein, 23 aa, Staphylococcus
DIEIPKDKLIVMTGLSGSGKSSL

SEQ ID NO: 2005570 - protein, 23 aa, Staphylococcus
DIEIPKNKLIVMTGLSGSGKSSL

SEQ ID NO: 2005571 - protein, 25 aa, Staphylococcus
DIEKWSFQTEMFFLCNRYKQIQDIE

SEQ ID NO: 2005572 - protein, 17 aa, Staphylococcus
DIELAYEAGLLSRNEEN

SEQ ID NO: 2005573 - protein, 23 aa, Staphylococcus
DIELPKDKLIVMTGLSGSGKSSL

SEQ ID NO: 2005574 - protein, 23 aa, Staphylococcus
DIELPKNKLIVMTGLSGSGKSSL

SEQ ID NO: 2005575 - protein, 24 aa, Staphylococcus
DIEPKQQIELFKQFKAVADKKKSV

SEQ ID NO: 2005576 - protein, 23 aa, Staphylococcus
DIESGHFYTLLGPSGCGKTTILK

SEQ ID NO: 2005577 - protein, 26 aa, Staphylococcus
DIETCYLAACKPAFKDALHSAVQTEC

SEQ ID NO: 2005578 - protein, 22 aa, Staphylococcus
DIETFPKILFMSGKEDQIIPYT

SEQ ID NO: 2005579 - protein, 21 aa, Staphylococcus
DIEYLKGAVLYQERDHEDIEL

SEQ ID NO: 2005580 - protein, 19 aa, Staphylococcus
DIFDFEGSFINALKRIVGN

SEQ ID NO: 2005581 - protein, 17 aa, Staphylococcus
DIFEIKGEFSFEANPDE

SEQ ID NO: 2005582 - protein, 23 aa, Staphylococcus
DIFESADILYLTGITPALSNHTY

SEQ ID NO: 2005583 - protein, 24 aa, Staphylococcus
DIFGECLHHYLIKDAIRDGNVLGF

SEQ ID NO: 2005584 - protein, 24 aa, Staphylococcus
DIFKALLHAVFKEHGVLLIDAQND

SEQ ID NO: 2005585 - protein, 29 aa, Staphylococcus
DIFKGLLQEVFKDYGVLFIDAQYEKIREL

SEQ ID NO: 2005586 - protein, 18 aa, Staphylococcus
DIFKRRRDMFEHKLSEAG

SEQ ID NO: 2005587 - protein, 17 aa, Staphylococcus
DIFSFNNPKGMCETCSG

SEQ ID NO: 2005588 - protein, 33 aa, Staphylococcus
DIFTQASSLAFDACFFEIWLPLLNNGSIAFIPD

SEQ ID NO: 2005589 - protein, 18 aa, Staphylococcus
DIGALALTLIMKKIQNQG

SEQ ID NO: 2005590 - protein, 20 aa, Staphylococcus
DIGALFRKGPGDVISIEDQL

SEQ ID NO: 2005591 - protein, 23 aa, Staphylococcus
DIGDLRQGYEYSRTANPTRGAIE

SEQ ID NO: 2005592 - protein, 23 aa, Staphylococcus
DIGDLRQGYEYSRTANPTRTSIE

SEQ ID NO: 2005593 - protein, 21 aa, Staphylococcus
DIGEVIAGWTGIPLTKINETE

SEQ ID NO: 2005594 - protein, 18 aa, Staphylococcus
DIGFFCVDNLPPILLPKL

SEQ ID NO: 2005595 - protein, 21 aa, Staphylococcus
DIGGSVVVLGCPAEEGGENGS

SEQ ID NO: 2005596 - protein, 18 aa, Staphylococcus
DIGIKYLTLYAFSTENWS

SEQ ID NO: 2005597 - protein, 23 aa, Staphylococcus
DIGNMIIDGFILRDPGNYKDVID

SEQ ID NO: 2005598 - protein, 20 aa, Staphylococcus
DIGPVIRFYTWNPATLSVGY

SEQ ID NO: 2005599 - protein, 20 aa, Staphylococcus
DIGRHFAKIEVSMMNGQTPV

SEQ ID NO: 2005600 - protein, 25 aa, Staphylococcus
DIGRVELKPAIPTTVTINYDLTGKF

SEQ ID NO: 2005601 - protein, 19 aa, Staphylococcus
DIGRVELRDAIPTTVTINY

SEQ ID NO: 2005602 - protein, 19 aa, Staphylococcus
DIGRVELRNAIPTTVTINY

SEQ ID NO: 2005603 - protein, 25 aa, Staphylococcus
DIGSAEMNLDLAIEMYEGQHRVEKV

SEQ ID NO: 2005604 - protein, 17 aa, Staphylococcus
DIGVRVWSYKDAAGTPW

SEQ ID NO: 2005605 - protein, 19 aa, Staphylococcus
DIGYFCVDNLPPILLPKFV

SEQ ID NO: 2005606 - protein, 20 aa, Staphylococcus
DIHEAICQSTLELLQPNFSR

SEQ ID NO: 2005607 - protein, 20 aa, Staphylococcus
DIHGYIFPTDFSKRNQNLPM

SEQ ID NO: 2005608 - protein, 31 aa, Staphylococcus
DIHILKFEHAFYCKKCSNMATAKTCPHDASD

SEQ ID NO: 2005609 - protein, 19 aa, Staphylococcus
DIHKAAVAIAKRAARPDTF

SEQ ID NO: 2005610 - protein, 23 aa, Staphylococcus
DIHYPISDLYYYLTQTNNGGYTA

SEQ ID NO: 2005611 - protein, 28 aa, Staphylococcus
DIIALLAERSIEMVIGMLGILKAGAGYL

SEQ ID NO: 2005612 - protein, 18 aa, Staphylococcus
DIIDEFKSLGNYEYDEIE

SEQ ID NO: 2005613 - protein, 20 aa, Staphylococcus
DIIEIGIPFSDPVADGPIIM

SEQ ID NO: 2005614 - protein, 24 aa, Staphylococcus
DIIERLKLPVNVVGVIASAENMIN

SEQ ID NO: 2005615 - protein, 23 aa, Staphylococcus
DIIGKTILDFGCNQGGFLRQLYQ

SEQ ID NO: 2005616 - protein, 22 aa, Staphylococcus
DIIKALFQIDGFKNIQFVDLSK

SEQ ID NO: 2005617 - protein, 28 aa, Staphylococcus
DIIKEGIPAKARRKGGHPAKRVFQAIRI

SEQ ID NO: 2005618 - protein, 19 aa, Staphylococcus
DIILYDRLVNPFILQYAKP

SEQ ID NO: 2005619 - protein, 18 aa, Staphylococcus
DIINACAETDYKLKSSYM

SEQ ID NO: 2005620 - protein, 25 aa, Staphylococcus
DIINCLKQLIELHPILKSRFILDNG

SEQ ID NO: 2005621 - protein, 29 aa, Staphylococcus
DIIQIGITFVKGFEIVGSYHSLIKTDLEI

SEQ ID NO: 2005622 - protein, 18 aa, Staphylococcus
DIITCPSGVISKIPNIGR

SEQ ID NO: 2005623 - protein, 25 aa, Staphylococcus
DIITEIKGPVYVLLTMERIVLNLIQ

SEQ ID NO: 2005624 - protein, 25 aa, Staphylococcus
DIITRYKSMLGYYAPYVPGWDTHGL

SEQ ID NO: 2005625 - protein, 27 aa, Staphylococcus
DIIVITFNYRLGALGYLDWSYFNNHYD

SEQ ID NO: 2005626 - protein, 21 aa, Staphylococcus
DIIYYAGGHGTIWDFKDNKDL

SEQ ID NO: 2005627 - protein, 26 aa, Staphylococcus
DIKAIYKRDYLCILGETVKEKLSYEM

SEQ ID NO: 2005628 - protein, 21 aa, Staphylococcus
DIKGFKIAFEKVYEEMKELLK

SEQ ID NO: 2005629 - protein, 26 aa, Staphylococcus
DIKGPDFPTSGIILGKSGIRRAYETG

SEQ ID NO: 2005630 - protein, 22 aa, Staphylococcus
DIKKAVKINEQFQVSKQFWSYL

SEQ ID NO: 2005631 - protein, 24 aa, Staphylococcus
DIKLLKGRWNDVIDHAKNNDRKSL

SEQ ID NO: 2005632 - protein, 22 aa, Staphylococcus
DIKMKTAKTFLNKLYGGDMKSL

SEQ ID NO: 2005633 - protein, 23 aa, Staphylococcus
DIKNIKAGYLIGESVNIARDFSN

SEQ ID NO: 2005634 - protein, 25 aa, Staphylococcus
DIKRIKSDCLILAGELDEKFVNTAK

SEQ ID NO: 2005635 - protein, 25 aa, Staphylococcus
DIKSILKGHDWFHITGITAGLNQEL

SEQ ID NO: 2005636 - protein, 34 aa, Staphylococcus
DIKTLLAKIGITYLRKGKFHQLHMDQMMIQLIEM

SEQ ID NO: 2005637 - protein, 26 aa, Staphylococcus
DIKTYIFYQLFETFVIDQSMASSTGM

SEQ ID NO: 2005638 - protein, 24 aa, Staphylococcus
DIKVGNALPLQFIPVGTVIHNIEL

SEQ ID NO: 2005639 - protein, 21 aa, Staphylococcus
DILDEILSLVATDKLVLSDVL

SEQ ID NO: 2005640 - protein, 21 aa, Staphylococcus
DILDKYDFVVGDFGYDQLRLK

SEQ ID NO: 2005641 - protein, 18 aa, Staphylococcus
DILEDAWKKQPFFSKEDA

SEQ ID NO: 2005642 - protein, 18 aa, Staphylococcus
DILELIQFERFCRDNALW

SEQ ID NO: 2005643 - protein, 20 aa, Staphylococcus
DILFGIKEDVDYIAASFVRR

SEQ ID NO: 2005644 - protein, 29 aa, Staphylococcus
DILGGYNARIATCWFNLRGKENQTSIQPD

SEQ ID NO: 2005645 - protein, 25 aa, Staphylococcus
DILKPAMARNDFRIIGATTPSEWQN

SEQ ID NO: 2005646 - protein, 17 aa, Staphylococcus
DILKRGRNAKSYTKAKN

SEQ ID NO: 2005647 - protein, 18 aa, Staphylococcus
DILLQVLLHTSIGKKEGY

SEQ ID NO: 2005648 - protein, 21 aa, Staphylococcus
DILNLFSYTGAFSVVAAQNAK

SEQ ID NO: 2005649 - protein, 23 aa, Staphylococcus
DILNPYLCIIFCNSRDSADELAK

SEQ ID NO: 2005650 - protein, 23 aa, Staphylococcus
DILNPYLCIIFCNSRDSADELAR

SEQ ID NO: 2005651 - protein, 24 aa, Staphylococcus
DILNPYLCIIFCNSRENANELADS

SEQ ID NO: 2005652 - protein, 17 aa, Staphylococcus
DILQCVSALEVILSDLR

SEQ ID NO: 2005653 - protein, 17 aa, Staphylococcus
DILRTLFNSQRFEEIQK

SEQ ID NO: 2005654 - protein, 17 aa, Staphylococcus
DILTRFIKEYTGLPAER

SEQ ID NO: 2005655 - protein, 24 aa, Staphylococcus
DILVLRLGGEYTVKRVRRTETKLH

SEQ ID NO: 2005656 - protein, 20 aa, Staphylococcus
DILYPRKGVIQYKVRDNVIL

SEQ ID NO: 2005657 - protein, 17 aa, Staphylococcus
DIMCLAKGITGGYLPLA

SEQ ID NO: 2005658 - protein, 19 aa, Staphylococcus
DIMGIPSFLVYKNGELMGS

SEQ ID NO: 2005659 - protein, 20 aa, Staphylococcus
DIMHRMNFDFYFVDIENIDT

SEQ ID NO: 2005660 - protein, 19 aa, Staphylococcus
DIMLTWKNKAYFFHSKIQF

SEQ ID NO: 2005661 - protein, 34 aa, Staphylococcus
DIMNELKRFFRPEFLNRFNGIVEFTHLDKHALQD

SEQ ID NO: 2005662 - protein, 23 aa, Staphylococcus
DIMQYSLDIFLAFKTDKSDLLNC

SEQ ID NO: 2005663 - protein, 18 aa, Staphylococcus
DINAFKVGIELNEGLAKP

SEQ ID NO: 2005664 - protein, 18 aa, Staphylococcus
DINARYLFATIQTLSNNE

SEQ ID NO: 2005665 - protein, 25 aa, Staphylococcus
DINDEIPKIYAIRGPSGIGKTTILN

SEQ ID NO: 2005666 - protein, 18 aa, Staphylococcus
DINKFDLVLVYKLDRLTR

SEQ ID NO: 2005667 - protein, 17 aa, Staphylococcus
DINKYRLSAEVIPSKLC

SEQ ID NO: 2005668 - protein, 19 aa, Staphylococcus
DINLIMGFVRVFGKGNKER

SEQ ID NO: 2005669 - protein, 26 aa, Staphylococcus
DINLMKWIGANSFRTAHYPYSEEMMR

SEQ ID NO: 2005670 - protein, 26 aa, Staphylococcus
DINLMKWIGANSFRTSHYPYSEEMMR

SEQ ID NO: 2005671 - protein, 17 aa, Staphylococcus
DINLPRLLVDYREENEE

SEQ ID NO: 2005672 - protein, 18 aa, Staphylococcus
DINNALIIEVPKEDGTLN

SEQ ID NO: 2005673 - protein, 23 aa, Staphylococcus
DINQYKPWVDLFIIDTPSIQLGG

SEQ ID NO: 2005674 - protein, 19 aa, Staphylococcus
DINSLKILLTQNAIAILYP

SEQ ID NO: 2005675 - protein, 26 aa, Staphylococcus
DINYFYKYRKDLYFIARNIIKNSKGI

SEQ ID NO: 2005676 - protein, 24 aa, Staphylococcus
DIPANRYVLKFGDYGMLSENTPDL

SEQ ID NO: 2005677 - protein, 21 aa, Staphylococcus
DIPEFRNTHSIFKTKTAKLTE

SEQ ID NO: 2005678 - protein, 17 aa, Staphylococcus
DIPELNQALEFKINALL

SEQ ID NO: 2005679 - protein, 24 aa, Staphylococcus
DIPETWELMAQMPFGDVREEPNEK

SEQ ID NO: 2005680 - protein, 25 aa, Staphylococcus
DIPFVEAVKELGERVNIKVDVGQTQ

SEQ ID NO: 2005681 - protein, 18 aa, Staphylococcus
DIPKRVFAKLDIEPNTEP

SEQ ID NO: 2005682 - protein, 19 aa, Staphylococcus
DIPMATGLVAEIGQGLPCI

SEQ ID NO: 2005683 - protein, 26 aa, Staphylococcus
DIPRNEIRYSYTHMAFTIEESEFEEW

SEQ ID NO: 2005684 - protein, 19 aa, Staphylococcus
DIPVITINVNHYFKPSNTM

SEQ ID NO: 2005685 - protein, 27 aa, Staphylococcus
DIQDETVCYMWLRFEHDSQFKRFNPET

SEQ ID NO: 2005686 - protein, 20 aa, Staphylococcus
DIQEAMKLGDRICLLNKGHV

SEQ ID NO: 2005687 - protein, 22 aa, Staphylococcus
DIQLLPKLAKLFNMSVDELLDY

SEQ ID NO: 2005688 - protein, 23 aa, Staphylococcus
DIQMAAQCLIQAIGGEGNVYVRG

SEQ ID NO: 2005689 - protein, 24 aa, Staphylococcus
DIQMAAQCLIQAIGGEGYVYINGY

SEQ ID NO: 2005690 - protein, 25 aa, Staphylococcus
DIQQGLGRTGSWSSVDHFNFTPDLI

SEQ ID NO: 2005691 - protein, 24 aa, Staphylococcus
DIQQGLGRTGSWSSVSHYNIEPDL

SEQ ID NO: 2005692 - protein, 27 aa, Staphylococcus
DIQQGLGRTGTWSSIDHFNFTPDLITF

SEQ ID NO: 2005693 - protein, 27 aa, Staphylococcus
DIQQGLGRTGTWSSVEHFNFIPDMITF

SEQ ID NO: 2005694 - protein, 22 aa, Staphylococcus
DIQRLSPFGTDFEKPLLEIDDN

SEQ ID NO: 2005695 - protein, 21 aa, Staphylococcus
DIQVPGAFPKFGTRDGTITQN

SEQ ID NO: 2005696 - protein, 24 aa, Staphylococcus
DIQYHIGGMVFRKSLFTHHKYTFD

SEQ ID NO: 2005697 - protein, 27 aa, Staphylococcus
DIRDPNLWMLFGTLPIYPCIKDENDQA

SEQ ID NO: 2005698 - protein, 24 aa, Staphylococcus
DIRHLGLRVYFNLEHALVSLSEDD

SEQ ID NO: 2005699 - protein, 18 aa, Staphylococcus
DIRIAFSCVEKNDIPHVF

SEQ ID NO: 2005700 - protein, 23 aa, Staphylococcus
DISDSIQGPIIWVDDTLTALQQL

SEQ ID NO: 2005701 - protein, 18 aa, Staphylococcus
DISDSLVETGFNFINGSN

SEQ ID NO: 2005702 - protein, 18 aa, Staphylococcus
DISFDRKFEAFLVPTVIG

SEQ ID NO: 2005703 - protein, 18 aa, Staphylococcus
DISFIKMLNYLRVYMETF

SEQ ID NO: 2005704 - protein, 18 aa, Staphylococcus
DISKAIKINEQFQISKQF

SEQ ID NO: 2005705 - protein, 19 aa, Staphylococcus
DISKARYHKIVIMTDADVD

SEQ ID NO: 2005706 - protein, 23 aa, Staphylococcus
DISKLQTILFLRQLNLSLENIQN

SEQ ID NO: 2005707 - protein, 18 aa, Staphylococcus
DISQARASEKISFLNITS

SEQ ID NO: 2005708 - protein, 25 aa, Staphylococcus
DISRPGLEMAGYFSHYASDRIQLLG

SEQ ID NO: 2005709 - protein, 21 aa, Staphylococcus
DITARHVVKIAASQAQSIIYH

SEQ ID NO: 2005710 - protein, 24 aa, Staphylococcus
DITEFPFSDLISFKEVKEKLNLTH

SEQ ID NO: 2005711 - protein, 24 aa, Staphylococcus
DITHPDKRIELMIEDAQVSAILTY

SEQ ID NO: 2005712 - protein, 30 aa, Staphylococcus
DITKFTLRNAMPFTTFVAFLISQQREIDAN

SEQ ID NO: 2005713 - protein, 21 aa, Staphylococcus
DITKRELKNAMGPDREFQATA

SEQ ID NO: 2005714 - protein, 24 aa, Staphylococcus
DITMLPKLAKLFNISVDDLLNYSI

SEQ ID NO: 2005715 - protein, 18 aa, Staphylococcus
DITPRFAKVQQLFEGIEI

SEQ ID NO: 2005716 - protein, 29 aa, Staphylococcus
DITRTEFEIIKLLSLNSNFYFSKDQIYDS

SEQ ID NO: 2005717 - protein, 17 aa, Staphylococcus
DITWLKEQLDSIFDDEL

SEQ ID NO: 2005718 - protein, 17 aa, Staphylococcus
DITYDFNYIKGYLPLHN

SEQ ID NO: 2005719 - protein, 25 aa, Staphylococcus
DITYDLDYQFGYPVLYNHPTQTNHV

SEQ ID NO: 2005720 - protein, 18 aa, Staphylococcus
DITYRAVQVLNDVDLIAC

SEQ ID NO: 2005721 - protein, 29 aa, Staphylococcus
DIVAMTSLYRPGPMEEIPTYITRRHVPSK

SEQ ID NO: 2005722 - protein, 21 aa, Staphylococcus
DIVEIGLPFSDPVADGPTIME

SEQ ID NO: 2005723 - protein, 29 aa, Staphylococcus
DIVGIDCKMGLSFVELFPNIEEMLTDGQV

SEQ ID NO: 2005724 - protein, 19 aa, Staphylococcus
DIVKALDKVDVVFASLSGS

SEQ ID NO: 2005725 - protein, 17 aa, Staphylococcus
DIVKSTSFAKLIKDGNY

SEQ ID NO: 2005726 - protein, 17 aa, Staphylococcus
DIVLFKPLSINDMSMIV

SEQ ID NO: 2005727 - protein, 17 aa, Staphylococcus
DIVLFKPLSVNDMSMIV

SEQ ID NO: 2005728 - protein, 25 aa, Staphylococcus
DIVYCRKCIQLGRMDHLTDYRIIKS

SEQ ID NO: 2005729 - protein, 23 aa, Staphylococcus
DIYGMKVAKDLVHITGDTSDYHI

SEQ ID NO: 2005730 - protein, 29 aa, Staphylococcus
DIYHRPKGKFRFPMEGFESGNAESENTTT

SEQ ID NO: 2005731 - protein, 19 aa, Staphylococcus
DIYLEHGHQPFPQDPLQQL

SEQ ID NO: 2005732 - protein, 22 aa, Staphylococcus
DIYPLLNRSLLYSAIILHDLGK

SEQ ID NO: 2005733 - protein, 26 aa, Staphylococcus
DIYPLLNRSLLYSAIILHDLGKVKEL

SEQ ID NO: 2005734 - protein, 26 aa, Staphylococcus
DIYPLLNRSLLYSAIILHDLGKVREL

SEQ ID NO: 2005735 - protein, 23 aa, Staphylococcus
DIYQYKTIRHLSAHLEQQSDESC

SEQ ID NO: 2005736 - protein, 19 aa, Staphylococcus
DIYWCTADPGWVTGTSYGI

SEQ ID NO: 2005737 - protein, 26 aa, Staphylococcus
DKAAARFGSGWAWLVVNNGNLEIVTT

SEQ ID NO: 2005738 - protein, 18 aa, Staphylococcus
DKAAHGFGGKQTPKVTSL

SEQ ID NO: 2005739 - protein, 27 aa, Staphylococcus
DKAAKAFFKDHLDQVDEIYEFNEVLER

SEQ ID NO: 2005740 - protein, 17 aa, Staphylococcus
DKACVTPLNGDWNFDYY

SEQ ID NO: 2005741 - protein, 20 aa, Staphylococcus
DKAFLDEWVDYFDEYYKSLE

SEQ ID NO: 2005742 - protein, 20 aa, Staphylococcus
DKAGLLASILNTFALFDINL

SEQ ID NO: 2005743 - protein, 19 aa, Staphylococcus
DKAIEGIPQELALKNAKVT

SEQ ID NO: 2005744 - protein, 18 aa, Staphylococcus
DKAKDFVDNIKDGKNRDT

SEQ ID NO: 2005745 - protein, 21 aa, Staphylococcus
DKAKENFEWIEAQVDQVSMLD

SEQ ID NO: 2005746 - protein, 19 aa, Staphylococcus
DKAKLGLNLQRMLSGEPIQ

SEQ ID NO: 2005747 - protein, 24 aa, Staphylococcus
DKAPFKKALLFAPLYPIDASTSKD

SEQ ID NO: 2005748 - protein, 19 aa, Staphylococcus
DKAQEGIPQELALKNAKET

SEQ ID NO: 2005749 - protein, 23 aa, Staphylococcus
DKAQRIGIRMADLLEKDTFERRL

SEQ ID NO: 2005750 - protein, 24 aa, Staphylococcus
DKAQRIGIRMADLLEKETFERRLK

SEQ ID NO: 2005751 - protein, 18 aa, Staphylococcus
DKATLPIFDQIFTRIGAA

SEQ ID NO: 2005752 - protein, 19 aa, Staphylococcus
DKAVLPYLFKGLHDKSPAV

SEQ ID NO: 2005753 - protein, 24 aa, Staphylococcus
DKAYGEVLGAFIVGPHATDLISEI

SEQ ID NO: 2005754 - protein, 25 aa, Staphylococcus
DKAYSDKIIDAFGMRPYIKKKVKKY

SEQ ID NO: 2005755 - protein, 17 aa, Staphylococcus
DKCEVQLAYAIGVAEPV

SEQ ID NO: 2005756 - protein, 22 aa, Staphylococcus
DKCIEIGVSFLKEGVTERQVVN

SEQ ID NO: 2005757 - protein, 17 aa, Staphylococcus
DKCNRPKTELAIQEENN

SEQ ID NO: 2005758 - protein, 26 aa, Staphylococcus
DKDARDCIRFSYAYVDAEDIDETLKH

SEQ ID NO: 2005759 - protein, 21 aa, Staphylococcus
DKDDEVCILYGTKNGLVALPS

SEQ ID NO: 2005760 - protein, 19 aa, Staphylococcus
DKDIKWYANSGHVITIDKE

SEQ ID NO: 2005761 - protein, 23 aa, Staphylococcus
DKDKEVDRIYAFQSVPYLLEKLK

SEQ ID NO: 2005762 - protein, 25 aa, Staphylococcus
DKDKVIEVWPEFRTEGDVTLEYTFR

SEQ ID NO: 2005763 - protein, 18 aa, Staphylococcus
DKDLKKYIEYAGDDVLLR

SEQ ID NO: 2005764 - protein, 25 aa, Staphylococcus
DKDLKYKLLREAPAILNWMAEGAYM

SEQ ID NO: 2005765 - protein, 26 aa, Staphylococcus
DKDPFRVGLKLRDGGWVYVQGLTHYE

SEQ ID NO: 2005766 - protein, 26 aa, Staphylococcus
DKDPYRIGLKLRDGGWVYVQGLTHYE

SEQ ID NO: 2005767 - protein, 29 aa, Staphylococcus
DKDSEHYGLWAFKKTWGTYLSEKVGEFDY

SEQ ID NO: 2005768 - protein, 24 aa, Staphylococcus
DKDSEHYGLWAFKRVWGTYLSEKI

SEQ ID NO: 2005769 - protein, 26 aa, Staphylococcus
DKDSEHYGLWAFKRVWGTYLSEKIGE

SEQ ID NO: 2005770 - protein, 23 aa, Staphylococcus
DKDYATISFLNWFLDEQVEEESM

SEQ ID NO: 2005771 - protein, 24 aa, Staphylococcus
DKDYATTSFLNWFLDEQVEEEAMF

SEQ ID NO: 2005772 - protein, 22 aa, Staphylococcus
DKEEIIDFVNFYLKKDEKPLYL

SEQ ID NO: 2005773 - protein, 18 aa, Staphylococcus
DKEELINCIKIYQSRQRR

SEQ ID NO: 2005774 - protein, 26 aa, Staphylococcus
DKEFIEIYTSCSIETCESRDPKGLYQ

SEQ ID NO: 2005775 - protein, 26 aa, Staphylococcus
DKEHKLRADAWLKNQLINNTEYKNAK

SEQ ID NO: 2005776 - protein, 18 aa, Staphylococcus
DKEIIAVDVSALEAGTQY

SEQ ID NO: 2005777 - protein, 28 aa, Staphylococcus
DKELILKAIIRYVTSVLFSFNQTNSIES

SEQ ID NO: 2005778 - protein, 24 aa, Staphylococcus
DKERIKLLHEWIGGKMPLIGIGSI

SEQ ID NO: 2005779 - protein, 31 aa, Staphylococcus
DKESVISAMMFKGNASKLGFEPKEGDEVLLE

SEQ ID NO: 2005780 - protein, 21 aa, Staphylococcus
DKETCVIEMAEASGLKHVPDN

SEQ ID NO: 2005781 - protein, 19 aa, Staphylococcus
DKETLRYGENPQQSAYFVR

SEQ ID NO: 2005782 - protein, 21 aa, Staphylococcus
DKEVPLTIVIIGEHIDVERLR

SEQ ID NO: 2005783 - protein, 18 aa, Staphylococcus
DKEWKRYSSQMIAKVKQD

SEQ ID NO: 2005784 - protein, 21 aa, Staphylococcus
DKEYKLPIGTPAMATGGMGDT

SEQ ID NO: 2005785 - protein, 17 aa, Staphylococcus
DKEYLKFNHLIFNEQPK

SEQ ID NO: 2005786 - protein, 17 aa, Staphylococcus
DKFGHRYLLSGYSYSMT

SEQ ID NO: 2005787 - protein, 18 aa, Staphylococcus
DKFLCAFKTEKELFEYYF

SEQ ID NO: 2005788 - protein, 28 aa, Staphylococcus
DKFLNIYKEFYLSLSKFSNLFYTNRQSY

SEQ ID NO: 2005789 - protein, 24 aa, Staphylococcus
DKFSKAAPLSAVFQAQTLIDLEWI

SEQ ID NO: 2005790 - protein, 19 aa, Staphylococcus
DKFSSYTFSGHKFNGTKGS

SEQ ID NO: 2005791 - protein, 23 aa, Staphylococcus
DKFTEGYFKPILPEAHDEKKIKK

SEQ ID NO: 2005792 - protein, 23 aa, Staphylococcus
DKGDGRGSMELKKITNALRQVGN

SEQ ID NO: 2005793 - protein, 17 aa, Staphylococcus
DKGDVALFFGLSGTGKT

SEQ ID NO: 2005794 - protein, 21 aa, Staphylococcus
DKGEIFPSFTVPIEHPGFKQL

SEQ ID NO: 2005795 - protein, 23 aa, Staphylococcus
DKGELPQNIVFIFQPAEETGGGA

SEQ ID NO: 2005796 - protein, 21 aa, Staphylococcus
DKGFTGYIIRRGHTEADASIN

SEQ ID NO: 2005797 - protein, 25 aa, Staphylococcus
DKGGTPWLDQKHTVFGQLIDGETTL

SEQ ID NO: 2005798 - protein, 21 aa, Staphylococcus
DKGHHIEIISVFRAQDEPYFK

SEQ ID NO: 2005799 - protein, 25 aa, Staphylococcus
DKGIDKDKCVRRIIDEFDELPYLYL

SEQ ID NO: 2005800 - protein, 21 aa, Staphylococcus
DKGIVPFLKVDKGLAEEADGV

SEQ ID NO: 2005801 - protein, 23 aa, Staphylococcus
DKGLLPHNVVFIFQPAEETGGGA

SEQ ID NO: 2005802 - protein, 25 aa, Staphylococcus
DKGLTHFKLGISVSKKLGNAVTRNR

SEQ ID NO: 2005803 - protein, 26 aa, Staphylococcus
DKGNFNYFSFKGLRSKGNNELHVTST

SEQ ID NO: 2005804 - protein, 22 aa, Staphylococcus
DKGPEIFRQKLIKAGIEKSLVE

SEQ ID NO: 2005805 - protein, 22 aa, Staphylococcus
DKGRRLKVFYATQVAVEPPTFV

SEQ ID NO: 2005806 - protein, 23 aa, Staphylococcus
DKGTLPHNVVFIFQPAEETGGGA

SEQ ID NO: 2005807 - protein, 17 aa, Staphylococcus
DKGTWIIYSKMIIEPKG

SEQ ID NO: 2005808 - protein, 22 aa, Staphylococcus
DKGYLSKLDVAFSRDTEHKVYV

SEQ ID NO: 2005809 - protein, 27 aa, Staphylococcus
DKHGVTLPRLFGFQAEGASPIVQNKVI

SEQ ID NO: 2005810 - protein, 25 aa, Staphylococcus
DKHHLKICGGFQFSMHKSGDEWREF

SEQ ID NO: 2005811 - protein, 24 aa, Staphylococcus
DKHILMTMLHQFKVRDDLLPGKLL

SEQ ID NO: 2005812 - protein, 18 aa, Staphylococcus
DKHIQIRFIEFMDVGNDN

SEQ ID NO: 2005813 - protein, 18 aa, Staphylococcus
DKHVFTYEVVLHGQIYNV

SEQ ID NO: 2005814 - protein, 17 aa, Staphylococcus
DKIAKGKIQKHIKNIKE

SEQ ID NO: 2005815 - protein, 17 aa, Staphylococcus
DKIAKGKVQKHLKNIKD

SEQ ID NO: 2005816 - protein, 21 aa, Staphylococcus
DKIDLGVGIVLNKKVEDSVKE

SEQ ID NO: 2005817 - protein, 20 aa, Staphylococcus
DKIEGAFTIIRRGKKKYFMV

SEQ ID NO: 2005818 - protein, 19 aa, Staphylococcus
DKIELFKKLEFKQLLSDID

SEQ ID NO: 2005819 - protein, 19 aa, Staphylococcus
DKIERAIIIGFHYETVDLR

SEQ ID NO: 2005820 - protein, 19 aa, Staphylococcus
DKIEVIPHFQHQLLTEPSE

SEQ ID NO: 2005821 - protein, 27 aa, Staphylococcus
DKIFELEGDLPLFPGHGPYTTVDDEQL

SEQ ID NO: 2005822 - protein, 33 aa, Staphylococcus
DKIFKEAGFEWREPGCSMCLGMNPDQVPEGVHC

SEQ ID NO: 2005823 - protein, 25 aa, Staphylococcus
DKIGEAFGYDLERYVPVLIVAIGKK

SEQ ID NO: 2005824 - protein, 26 aa, Staphylococcus
DKIGYEIPFTRLFYKYTPPEPSETIS

SEQ ID NO: 2005825 - protein, 25 aa, Staphylococcus
DKIIIGGGMAYTFLKAQGKEIGLSL

SEQ ID NO: 2005826 - protein, 23 aa, Staphylococcus
DKIKEQWGSLDAFKEEFADKAAA

SEQ ID NO: 2005827 - protein, 17 aa, Staphylococcus
DKIKNKVHFVGTFTVEF

SEQ ID NO: 2005828 - protein, 22 aa, Staphylococcus
DKIKWLIPFLSYSGPTIIYISS

SEQ ID NO: 2005829 - protein, 25 aa, Staphylococcus
DKIPFTGRMWLSIDGFSEDEQAYKD

SEQ ID NO: 2005830 - protein, 23 aa, Staphylococcus
DKIVKFEGCYHGHSDSLLIKAGS

SEQ ID NO: 2005831 - protein, 20 aa, Staphylococcus
DKIVTYTFGVEGFKEHAVSE

SEQ ID NO: 2005832 - protein, 21 aa, Staphylococcus
DKIYGTHLWSGYPSGTIYSRP

SEQ ID NO: 2005833 - protein, 18 aa, Staphylococcus
DKKAIILYKSFKHAGKQR

SEQ ID NO: 2005834 - protein, 22 aa, Staphylococcus
DKKCPECGNELIKEGQDIPFET

SEQ ID NO: 2005835 - protein, 19 aa, Staphylococcus
DKKDELYVFNGYAGSDEDS

SEQ ID NO: 2005836 - protein, 19 aa, Staphylococcus
DKKDELYVFNGYAGSDKDT

SEQ ID NO: 2005837 - protein, 24 aa, Staphylococcus
DKKEIDWALSVTGTSEFRHRSIND

SEQ ID NO: 2005838 - protein, 22 aa, Staphylococcus
DKKELEVLIGYDGEINERFIKS

SEQ ID NO: 2005839 - protein, 25 aa, Staphylococcus
DKKIKILLKVWKFGYQTEYSVNDLE

SEQ ID NO: 2005840 - protein, 25 aa, Staphylococcus
DKKILRKILKYSFVEYKEFMDKNTL

SEQ ID NO: 2005841 - protein, 26 aa, Staphylococcus
DKKIRDKFLLRIVEYDLFNNCNSKVF

SEQ ID NO: 2005842 - protein, 20 aa, Staphylococcus
DKKLGLDDMVNGSFTITNGG

SEQ ID NO: 2005843 - protein, 20 aa, Staphylococcus
DKKLWPGLWDFSAAGAVMQG

SEQ ID NO: 2005844 - protein, 20 aa, Staphylococcus
DKKRILAKFEPIIEEFNKVI

SEQ ID NO: 2005845 - protein, 17 aa, Staphylococcus
DKKRLKEKLTYLSDEKM

SEQ ID NO: 2005846 - protein, 25 aa, Staphylococcus
DKKTFKACFKILMSKQKVNLVNDGM

SEQ ID NO: 2005847 - protein, 18 aa, Staphylococcus
DKKVCGFLTEMVANADAV

SEQ ID NO: 2005848 - protein, 22 aa, Staphylococcus
DKKVKVIAWYDNEWGYSNRVVD

SEQ ID NO: 2005849 - protein, 25 aa, Staphylococcus
DKKYADQIIDAFGMRPYVKKKVKKY

SEQ ID NO: 2005850 - protein, 18 aa, Staphylococcus
DKLALAKKVILSQRQESH

SEQ ID NO: 2005851 - protein, 17 aa, Staphylococcus
DKLASVIAVVGEVITTM

SEQ ID NO: 2005852 - protein, 24 aa, Staphylococcus
DKLEQLESYGWLSSDNHDILLNHP

SEQ ID NO: 2005853 - protein, 20 aa, Staphylococcus
DKLERVYKLDITRYKSNPSA

SEQ ID NO: 2005854 - protein, 20 aa, Staphylococcus
DKLESIKGFHVEISEEDFIK

SEQ ID NO: 2005855 - protein, 17 aa, Staphylococcus
DKLEYPVFVKPANLGSS

SEQ ID NO: 2005856 - protein, 23 aa, Staphylococcus
DKLEYYTAPFYNQWDTKCFNDYL

SEQ ID NO: 2005857 - protein, 27 aa, Staphylococcus
DKLFELDGDLPLFPGHGDYTTVDDEQL

SEQ ID NO: 2005858 - protein, 27 aa, Staphylococcus
DKLFELEGDLPLFPGHGPYTTVDDEQL

SEQ ID NO: 2005859 - protein, 20 aa, Staphylococcus
DKLHDIKKVISFSELPDAIS

SEQ ID NO: 2005860 - protein, 17 aa, Staphylococcus
DKLKDIDYFVGGVGSGG

SEQ ID NO: 2005861 - protein, 22 aa, Staphylococcus
DKLKGRYSIVVLEDYGSVTLDN

SEQ ID NO: 2005862 - protein, 17 aa, Staphylococcus
DKLKQLFEQAGFNKIKI

SEQ ID NO: 2005863 - protein, 18 aa, Staphylococcus
DKLKQLVEYGWLSTDNYD

SEQ ID NO: 2005864 - protein, 25 aa, Staphylococcus
DKLKRDLADFNVHFDNWFSETSLYE

SEQ ID NO: 2005865 - protein, 17 aa, Staphylococcus
DKLKVYLKKNPNFKFPF

SEQ ID NO: 2005866 - protein, 23 aa, Staphylococcus
DKLLFKHSLTIDSAKKIVQLAQQ

SEQ ID NO: 2005867 - protein, 17 aa, Staphylococcus
DKLNRWGGAIASGHPYG

SEQ ID NO: 2005868 - protein, 23 aa, Staphylococcus
DKLPHAKYQIHFQAKKDGVITKM

SEQ ID NO: 2005869 - protein, 30 aa, Staphylococcus; identical to SEQ ID NO: 1803349

SEQ ID NO: 2005870 - protein, 17 aa, Staphylococcus
DKLSRTKGFDGWAPLFF

SEQ ID NO: 2005871 - protein, 17 aa, Staphylococcus
DKLSRTQGFDGWAPLFF

SEQ ID NO: 2005872 - protein, 17 aa, Staphylococcus
DKLSSVIGVVGEVITTM

SEQ ID NO: 2005873 - protein, 21 aa, Staphylococcus
DKLTFWRLFHERMDILHEALL

SEQ ID NO: 2005874 - protein, 17 aa, Staphylococcus
DKLTYPVFVKPANLGSS

SEQ ID NO: 2005875 - protein, 24 aa, Staphylococcus
DKLVKHLCVELGYLQRNQRIHYKL

SEQ ID NO: 2005876 - protein, 22 aa, Staphylococcus
DKLVMKQLFAHRGLPQLPYVSF

SEQ ID NO: 2005877 - protein, 23 aa, Staphylococcus
DKLVMKQLFAHRGLPQLPYVSFL

SEQ ID NO: 2005878 - protein, 24 aa, Staphylococcus
DKLYINRFNNVWSNWHDPLNDKES

SEQ ID NO: 2005879 - protein, 19 aa, Staphylococcus
DKLYKAIAGEGAFVNGQQL

SEQ ID NO: 2005880 - protein, 19 aa, Staphylococcus
DKMEKRLTKQYAAPSKSLA

SEQ ID NO: 2005881 - protein, 24 aa, Staphylococcus
DKMFDYFIKMILEIAHNKNVLNHE

SEQ ID NO: 2005882 - protein, 28 aa, Staphylococcus
DKMPDKLCLYYHIGQCLGPCVYPVDLEK

SEQ ID NO: 2005883 - protein, 28 aa, Staphylococcus
DKMPDKLCLYYHIGQCMGPCVYDVDLDK

SEQ ID NO: 2005884 - protein, 24 aa, Staphylococcus
DKMPEIKIQGFLGSLGDKQGFAYI

SEQ ID NO: 2005885 - protein, 24 aa, Staphylococcus
DKMPELKIQGFFGSLGDKKGFAYV

SEQ ID NO: 2005886 - protein, 21 aa, Staphylococcus
DKMPNKLCLYYHIGQCLGPCV

SEQ ID NO: 2005887 - protein, 25 aa, Staphylococcus
DKMPYRAKRHYSIVAGTPQHLTFAV

SEQ ID NO: 2005888 - protein, 24 aa, Staphylococcus
DKMTAELERPYILVTDKKISSFQD

SEQ ID NO: 2005889 - protein, 25 aa, Staphylococcus
DKMTKSGMLLPTFIEDYPGLPNGIC

SEQ ID NO: 2005890 - protein, 20 aa, Staphylococcus
DKMVGIKIGQTIVILIENNH

SEQ ID NO: 2005891 - protein, 21 aa, Staphylococcus
DKNCCPYIHFFTSRNNATNYL

SEQ ID NO: 2005892 - protein, 23 aa, Staphylococcus
DKNELWLKTVENLMDRFIEKKYW

SEQ ID NO: 2005893 - protein, 24 aa, Staphylococcus
DKNFKHFGDDLAYLTLTSRNDGTL

SEQ ID NO: 2005894 - protein, 23 aa, Staphylococcus
DKNFSLDTFDGFFNDISKRVKQG

SEQ ID NO: 2005895 - protein, 22 aa, Staphylococcus
DKNFSYKYMHLVNEIYIDDELV

SEQ ID NO: 2005896 - protein, 24 aa, Staphylococcus
DKNGFKTTFGLIFNELTWLFNQEY

SEQ ID NO: 2005897 - protein, 24 aa, Staphylococcus
DKNGFPLNDFYSFIHINDSDIKVT

SEQ ID NO: 2005898 - protein, 19 aa, Staphylococcus
DKNGVYLRMERYFDESIRS

SEQ ID NO: 2005899 - protein, 19 aa, Staphylococcus
DKNIECVDMGIPSGQKIEV

SEQ ID NO: 2005900 - protein, 20 aa, Staphylococcus
DKNIIKREYVRISSGELSHE

SEQ ID NO: 2005901 - protein, 20 aa, Staphylococcus
DKNIQYRIMNAIIKERISPE

SEQ ID NO: 2005902 - protein, 22 aa, Staphylococcus
DKNKLNVLIAHMTVAGGIRSES

SEQ ID NO: 2005903 - protein, 21 aa, Staphylococcus
DKNKLVKALCQIFEENDILKS

SEQ ID NO: 2005904 - protein, 17 aa, Staphylococcus
DKNLDEMEFLKADSDFL

SEQ ID NO: 2005905 - protein, 19 aa, Staphylococcus
DKNLKLLGEEEEEIDDQET

SEQ ID NO: 2005906 - protein, 19 aa, Staphylococcus
DKNLVPILMLTAKDDEFDR

SEQ ID NO: 2005907 - protein, 23 aa, Staphylococcus
DKNMKIFAAHIIKNKAGEPGTII

SEQ ID NO: 2005908 - protein, 20 aa, Staphylococcus
DKNMPGCMIGIARLNLPAVF

SEQ ID NO: 2005909 - protein, 24 aa, Staphylococcus
DKNSVISAMMFKGNASKIDFEPKE

SEQ ID NO: 2005910 - protein, 26 aa, Staphylococcus
DKNSVISAMMFKGNASKLTFDPKEGD

SEQ ID NO: 2005911 - protein, 27 aa, Staphylococcus
DKNTSRIYAKFGKEIYVAAKSGEPDPN

SEQ ID NO: 2005912 - protein, 25 aa, Staphylococcus
DKNVLIELGLIIGHDARRRREILGR

SEQ ID NO: 2005913 - protein, 19 aa, Staphylococcus
DKPAIAICATDDKFDVFDQ

SEQ ID NO: 2005914 - protein, 20 aa, Staphylococcus
DKPDTRFGMELQDVSQLGKE

SEQ ID NO: 2005915 - protein, 19 aa, Staphylococcus
DKPDWRITTNYHQNLVDQK

SEQ ID NO: 2005916 - protein, 19 aa, Staphylococcus
DKPELKGKPVIVGGKASGR

SEQ ID NO: 2005917 - protein, 24 aa, Staphylococcus
DKPELYKAIIKRFHIDRLSWKDLF

SEQ ID NO: 2005918 - protein, 20 aa, Staphylococcus
DKPFYFKGFGKHEDTYYNGR

SEQ ID NO: 2005919 - protein, 20 aa, Staphylococcus
DKPPSAWVVVAKPDLGISSP

SEQ ID NO: 2005920 - protein, 24 aa, Staphylococcus
DKPSFLSCGIQSYLEDVSPSLDSL

SEQ ID NO: 2005921 - protein, 17 aa, Staphylococcus
DKPTPFLFGEDFSFYGQ

SEQ ID NO: 2005922 - protein, 18 aa, Staphylococcus
DKPTPFLFGEDFSFYGQL

SEQ ID NO: 2005923 - protein, 31 aa, Staphylococcus
DKPVIGICLGMQLFYRWSAEGDVEGLNIFPG

SEQ ID NO: 2005924 - protein, 27 aa, Staphylococcus
DKPVIVKFEAGWCPDCKSMDMWIDPIV

SEQ ID NO: 2005925 - protein, 24 aa, Staphylococcus
DKQAMDALVRFTKAEGIIPAIESA

SEQ ID NO: 2005926 - protein, 24 aa, Staphylococcus
DKQDQGKWARAFIEATRSHRSENG

SEQ ID NO: 2005927 - protein, 21 aa, Staphylococcus
DKQHVSAICSGVLNKENKEEL

SEQ ID NO: 2005928 - protein, 30 aa, Staphylococcus
DKQICHCFGCKKGGNVFQFIQDIKDISFVE

SEQ ID NO: 2005929 - protein, 29 aa, Staphylococcus
DKQICHCFGCKKGGNVFQFTQDIKDISFV

SEQ ID NO: 2005930 - protein, 29 aa, Staphylococcus
DKQICHCFGCKKGGNVFQFTQEIKDIPFT

SEQ ID NO: 2005931 - protein, 29 aa, Staphylococcus
DKQICHCFGCKKGGNVFQFTQEIKDIPFV

SEQ ID NO: 2005932 - protein, 29 aa, Staphylococcus
DKQICHCFGCKKGGNVFQFTQEIKDLSFV

SEQ ID NO: 2005933 - protein, 29 aa, Staphylococcus
DKQICHCFGCKKGGNVFQFTQEIKDVSFT

SEQ ID NO: 2005934 - protein, 29 aa, Staphylococcus
DKQICHCFGCKKGGNVFQFTQEIRGVSFV

SEQ ID NO: 2005935 - protein, 17 aa, Staphylococcus
DKQKFKGAYTIERIGND

SEQ ID NO: 2005936 - protein, 23 aa, Staphylococcus
DKQKFRGAYTIERLGGEKVLLIE

SEQ ID NO: 2005937 - protein, 21 aa, Staphylococcus
DKQKYNYFVMKWVNKEYKKIF

SEQ ID NO: 2005938 - protein, 22 aa, Staphylococcus
DKQRVTDMLGRFESLSRREQSQ

SEQ ID NO: 2005939 - protein, 24 aa, Staphylococcus
DKQSFTRYGAFYIPMDETLARVVT

SEQ ID NO: 2005940 - protein, 24 aa, Staphylococcus
DKQSVQLLNDWGNAVAEGIAQIQI

SEQ ID NO: 2005941 - protein, 17 aa, Staphylococcus
DKRAEVDKLPFIEFQAD

SEQ ID NO: 2005942 - protein, 26 aa, Staphylococcus
DKRGIDEYLIRLSIGIEHYQDIEADI

SEQ ID NO: 2005943 - protein, 19 aa, Staphylococcus
DKRGYAMIIGDSMSSDILG

SEQ ID NO: 2005944 - protein, 23 aa, Staphylococcus
DKRIKAVSSVVSVNFGMIAREGD

SEQ ID NO: 2005945 - protein, 21 aa, Staphylococcus
DKRIKNFLIQRMKNEIKSGFD

SEQ ID NO: 2005946 - protein, 18 aa, Staphylococcus
DKRIYDLQLSRQIALQTA

SEQ ID NO: 2005947 - protein, 17 aa, Staphylococcus
DKRIYDLQLSRQISLQT

SEQ ID NO: 2005948 - protein, 23 aa, Staphylococcus
DKRKLEFLAGRFATKEAFSKALG

SEQ ID NO: 2005949 - protein, 23 aa, Staphylococcus
DKRLKSDRAFLNFVEETFNEFIK

SEQ ID NO: 2005950 - protein, 19 aa, Staphylococcus
DKRQKWLSLTKEGMQLYNA

SEQ ID NO: 2005951 - protein, 26 aa, Staphylococcus
DKRRGRLTIVKKWDVTTAILTGNFLL

SEQ ID NO: 2005952 - protein, 20 aa, Staphylococcus
DKRSASIYVAFDVKDDKGVV

SEQ ID NO: 2005953 - protein, 20 aa, Staphylococcus
DKRSASIYVAFDVKDSKGVV

SEQ ID NO: 2005954 - protein, 20 aa, Staphylococcus
DKRSASIYVAFDVKDTKGVV

SEQ ID NO: 2005955 - protein, 20 aa, Staphylococcus
DKRSASIYVAFNVKDDKGVV

SEQ ID NO: 2005956 - protein, 18 aa, Staphylococcus
DKRVHEILSESIVDVCRG

SEQ ID NO: 2005957 - protein, 20 aa, Staphylococcus
DKSIALAIINRDAFEMGREL

SEQ ID NO: 2005958 - protein, 23 aa, Staphylococcus
DKSIEFIDYMASLSMSNKGEVLQ

SEQ ID NO: 2005959 - protein, 25 aa, Staphylococcus
DKSKFNISSSLSFANLFEIDEIITD

SEQ ID NO: 2005960 - protein, 20 aa, Staphylococcus
DKSMTHRAIMLASLASGKTA

SEQ ID NO: 2005961 - protein, 20 aa, Staphylococcus
DKSMTHRAIMLASLATGQTQ

SEQ ID NO: 2005962 - protein, 21 aa, Staphylococcus
DKSMTHRAIMLGSLATGKSTI

SEQ ID NO: 2005963 - protein, 20 aa, Staphylococcus
DKSMTHRAIMLSSLAQGQSV

SEQ ID NO: 2005964 - protein, 20 aa, Staphylococcus
DKSNVRFVIHYNMPGDLESY

SEQ ID NO: 2005965 - protein, 21 aa, Staphylococcus
DKSNVRFVIHYNMPGDLESYY

SEQ ID NO: 2005966 - protein, 20 aa, Staphylococcus
DKSNVRYVVHYNMPGDIESY

SEQ ID NO: 2005967 - protein, 21 aa, Staphylococcus
DKSSMMVAHIMKLGRDDKVLD

SEQ ID NO: 2005968 - protein, 24 aa, Staphylococcus
DKSVKRKYTALVHGNIPHDYGTID

SEQ ID NO: 2005969 - protein, 33 aa, Staphylococcus
DKSYALHLRQFIRLSRFFVDILRRSENGRIVVI

SEQ ID NO: 2005970 - protein, 23 aa, Staphylococcus
DKSYKKSARIVGDVMGKYHPHGD

SEQ ID NO: 2005971 - protein, 25 aa, Staphylococcus
DKSYSDKIIDAFGMRSYINKKVKKY

SEQ ID NO: 2005972 - protein, 22 aa, Staphylococcus
DKTAEMEFRILSRIKEALEEGN

SEQ ID NO: 2005973 - protein, 24 aa, Staphylococcus
DKTAEMELRILSKIKETLEEGKPV

SEQ ID NO: 2005974 - protein, 17 aa, Staphylococcus
DKTAFFLNGYVNEYDDT

SEQ ID NO: 2005975 - protein, 17 aa, Staphylococcus
DKTCETCGGELIKEGQD

SEQ ID NO: 2005976 - protein, 27 aa, Staphylococcus
DKTEGWVYMLTCLKSYLEFNAIIRGGL

SEQ ID NO: 2005977 - protein, 17 aa, Staphylococcus
DKTGLALIEGYHLIEEA

SEQ ID NO: 2005978 - protein, 22 aa, Staphylococcus
DKTKINRWDFDSFKQHETTGDV

SEQ ID NO: 2005979 - protein, 26 aa, Staphylococcus
DKTLPWLIVERGFEIPSFNFAIESEE

SEQ ID NO: 2005980 - protein, 28 aa, Staphylococcus
DKTPAQIVLRWHLAHNRIIIPKSQTPSR

SEQ ID NO: 2005981 - protein, 18 aa, Staphylococcus
DKTPISFHVPGHKNMTIG

SEQ ID NO: 2005982 - protein, 26 aa, Staphylococcus
DKTPNLEVLKFLYFKMNKLGADIVKL

SEQ ID NO: 2005983 - protein, 20 aa, Staphylococcus
DKTVAQWLVGDYMTALDMQG

SEQ ID NO: 2005984 - protein, 18 aa, Staphylococcus
DKTVICFVGDGGFQMTNQ

SEQ ID NO: 2005985 - protein, 24 aa, Staphylococcus
DKTVKRKYTALVHGNIPHDYGTID

SEQ ID NO: 2005986 - protein, 19 aa, Staphylococcus
DKVFKYIVLTNHQKEDIQS

SEQ ID NO: 2005987 - protein, 28 aa, Staphylococcus
DKVFTDVKWCRMMIRQILSNSLKYSDNT

SEQ ID NO: 2005988 - protein, 25 aa, Staphylococcus
DKVIRGGYLYSYRKQNQFTRNILTL

SEQ ID NO: 2005989 - protein, 17 aa, Staphylococcus
DKVKVVIATNAFGMGID

SEQ ID NO: 2005990 - protein, 27 aa, Staphylococcus
DKVLIGGGMAYTFLKAQGYEIGKSLLE

SEQ ID NO: 2005991 - protein, 24 aa, Staphylococcus
DKVLLGHLHHPFSINDDKVNYSGS

SEQ ID NO: 2005992 - protein, 24 aa, Staphylococcus
DKVLLGHLHHPFSITDNIVDYSGS

SEQ ID NO: 2005993 - protein, 17 aa, Staphylococcus
DKVLLPLAYIDLDEYIE

SEQ ID NO: 2005994 - protein, 23 aa, Staphylococcus
DKVMCLPQNFAVAALTATATAEV

SEQ ID NO: 2005995 - protein, 24 aa, Staphylococcus
DKVNELWPEYSLEGDVEIEYTFRL

SEQ ID NO: 2005996 - protein, 20 aa, Staphylococcus
DKVPESYIPYEIKIPSKFIE

SEQ ID NO: 2005997 - protein, 17 aa, Staphylococcus
DKVPYYSARIVKNVTIA

SEQ ID NO: 2005998 - protein, 17 aa, Staphylococcus
DKVQEFKKSVVNKLTGG

SEQ ID NO: 2005999 - protein, 26 aa, Staphylococcus
DKVRPEGKAFYRLNVRVNSEDFIAPQ

SEQ ID NO: 2006000 - protein, 17 aa, Staphylococcus
DKVYIMLNKPAGYISAT

SEQ ID NO: 2006001 - protein, 25 aa, Staphylococcus
DKWNIIRPPFNVTRISEYAAIAALE

SEQ ID NO: 2006002 - protein, 23 aa, Staphylococcus
DKYDDVMRFGRYHPDYKTIMMET

SEQ ID NO: 2006003 - protein, 17 aa, Staphylococcus
DKYDFVVGDFGYELLRL

SEQ ID NO: 2006004 - protein, 24 aa, Staphylococcus
DKYEILDYSLSMTILKDIKETLSI

SEQ ID NO: 2006005 - protein, 25 aa, Staphylococcus
DKYEWLLEHFPFLDPQHFVFCGRKN

SEQ ID NO: 2006006 - protein, 19 aa, Staphylococcus
DKYFDLIIRFFKEINEVET

SEQ ID NO: 2006007 - protein, 24 aa, Staphylococcus
DKYFKIEQFNLMGLKRQPMTEETE

SEQ ID NO: 2006008 - protein, 25 aa, Staphylococcus
DKYGSEIDILFILGGDGTVNELVNG

SEQ ID NO: 2006009 - protein, 18 aa, Staphylococcus
DKYKLKPPIHEWEKKGLL

SEQ ID NO: 2006010 - protein, 20 aa, Staphylococcus
DKYKRGLVLYGDVKDMEKDG

SEQ ID NO: 2006011 - protein, 19 aa, Staphylococcus
DKYKVIGPFVSKDFTLTDN

SEQ ID NO: 2006012 - protein, 25 aa, Staphylococcus
DKYNFKIPFIDQFLLKTLQSDNKKF

SEQ ID NO: 2006013 - protein, 18 aa, Staphylococcus
DLAADLFQETGIDIQFQN

SEQ ID NO: 2006014 - protein, 22 aa, Staphylococcus
DLADYTQRFELLRQEQENIDKL

SEQ ID NO: 2006015 - protein, 24 aa, Staphylococcus
DLAETLHAIFLEVVIAPRFTDEAL

SEQ ID NO: 2006016 - protein, 24 aa, Staphylococcus
DLAKRAGASIILLIVNILTNDTLQ

SEQ ID NO: 2006017 - protein, 24 aa, Staphylococcus
DLAKSLNCHCEAFHCLGPNVLVKN

SEQ ID NO: 2006018 - protein, 19 aa, Staphylococcus
DLAKYSGVPVWNGLTDAWH

SEQ ID NO: 2006019 - protein, 17 aa, Staphylococcus
DLALPKDMTFIGQPLWG

SEQ ID NO: 2006020 - protein, 19 aa, Staphylococcus
DLANFLYFVANKGMHIGAG

SEQ ID NO: 2006021 - protein, 18 aa, Staphylococcus
DLAQEISQQLSIPVIGIG

SEQ ID NO: 2006022 - protein, 18 aa, Staphylococcus
DLAQSLNCHCEPYHCLGP

SEQ ID NO: 2006023 - protein, 25 aa, Staphylococcus
DLAVSRTSFDWGIRVQSNPKHVVYV

SEQ ID NO: 2006024 - protein, 24 aa, Staphylococcus
DLAVSRTTFDWGVQVPSNPKHVVY

SEQ ID NO: 2006025 - protein, 24 aa, Staphylococcus
DLCKAELVYHQSLLPQYVTPDGEV

SEQ ID NO: 2006026 - protein, 19 aa, Staphylococcus
DLDEVTVFVIDGDKKEDGQ

SEQ ID NO: 2006027 - protein, 18 aa, Staphylococcus
DLDFPISVESVVLSGAFK

SEQ ID NO: 2006028 - protein, 20 aa, Staphylococcus
DLDGLNYLAGKTIDEVNTKA

SEQ ID NO: 2006029 - protein, 21 aa, Staphylococcus
DLDGLNYLAGKTMDEVNTKAF

SEQ ID NO: 2006030 - protein, 19 aa, Staphylococcus
DLDIFKKVVEWLNEYFSGN

SEQ ID NO: 2006031 - protein, 18 aa, Staphylococcus
DLDIKNIRTWNNEENQFE

SEQ ID NO: 2006032 - protein, 22 aa, Staphylococcus
DLDLPIGIIPGGTFNDFTKTLN

SEQ ID NO: 2006033 - protein, 20 aa, Staphylococcus
DLDPSFSERVLRTHTSRIDA

SEQ ID NO: 2006034 - protein, 28 aa, Staphylococcus
DLDSIRLKEFVKDVAKEDAVFGLTNKNE

SEQ ID NO: 2006035 - protein, 18 aa, Staphylococcus
DLDTLYKMIDLINDTLVS

SEQ ID NO: 2006036 - protein, 18 aa, Staphylococcus
DLDTLYRMIDIINDTLVS

SEQ ID NO: 2006037 - protein, 24 aa, Staphylococcus
DLDVYRAIGYPVQFVGKNDNIETI

SEQ ID NO: 2006038 - protein, 19 aa, Staphylococcus
DLEAICMSNTDAIMIGGTD

SEQ ID NO: 2006039 - protein, 21 aa, Staphylococcus
DLEGSVSLPNVFGEVTRSKMI

SEQ ID NO: 2006040 - protein, 20 aa, Staphylococcus
DLEGTLSWLKNAINSLIAAI

SEQ ID NO: 2006041 - protein, 22 aa, Staphylococcus
DLEHVDYIGVGPMFATISKNDA

SEQ ID NO: 2006042 - protein, 22 aa, Staphylococcus
DLEIGSGSFIPGFEEQLVGVKT

SEQ ID NO: 2006043 - protein, 25 aa, Staphylococcus
DLEKLIRLPGKFKYFEHNVAAHSFK

SEQ ID NO: 2006044 - protein, 18 aa, Staphylococcus
DLELPLAEILSEMEEIGI

SEQ ID NO: 2006045 - protein, 20 aa, Staphylococcus
DLEMTFFYELIFGEETDFYQ

SEQ ID NO: 2006046 - protein, 18 aa, Staphylococcus
DLENGFECTAKFRYRQKD

SEQ ID NO: 2006047 - protein, 24 aa, Staphylococcus
DLEQRQPIHFKWKDEAVVGVMLAS

SEQ ID NO: 2006048 - protein, 19 aa, Staphylococcus
DLESELRLQYGFVGTNLKV

SEQ ID NO: 2006049 - protein, 26 aa, Staphylococcus
DLESKWKRIHMADAVKEETGVDFFNI

SEQ ID NO: 2006050 - protein, 18 aa, Staphylococcus
DLESLKLAFEKYGDDIAG

SEQ ID NO: 2006051 - protein, 26 aa, Staphylococcus
DLESSWKRLHIVDAVKEATGVDFYNV

SEQ ID NO: 2006052 - protein, 24 aa, Staphylococcus
DLESSWRRLHIVDAVKEATGVNFY

SEQ ID NO: 2006053 - protein, 21 aa, Staphylococcus
DLEVGSGSFIPGFEEQLEGMK

SEQ ID NO: 2006054 - protein, 24 aa, Staphylococcus
DLEVKDLSAFLAKVNKGLHVANQA

SEQ ID NO: 2006055 - protein, 17 aa, Staphylococcus
DLFEVVQAIHELPFDKG

SEQ ID NO: 2006056 - protein, 20 aa, Staphylococcus
DLFGLNALGNIYSRLTNPTV

SEQ ID NO: 2006057 - protein, 19 aa, Staphylococcus
DLFKEFGRQFIDQIPTINP

SEQ ID NO: 2006058 - protein, 19 aa, Staphylococcus
DLFLRNAHRIPDYRSNRIT

SEQ ID NO: 2006059 - protein, 22 aa, Staphylococcus
DLGEFVKLKIKHDASLPFGDYY

SEQ ID NO: 2006060 - protein, 18 aa, Staphylococcus
DLGFGPKLASSIYQYYGA

SEQ ID NO: 2006061 - protein, 18 aa, Staphylococcus
DLGFKHKGFKEGLSKDYI

SEQ ID NO: 2006062 - protein, 19 aa, Staphylococcus
DLGGVCLNVGCIPSKALLH

SEQ ID NO: 2006063 - protein, 19 aa, Staphylococcus
DLGICICGTGVGINNAVNK

SEQ ID NO: 2006064 - protein, 25 aa, Staphylococcus
DLGIDLKGICYPKGYSNEYTPKAAR

SEQ ID NO: 2006065 - protein, 23 aa, Staphylococcus
DLGIGKAPGGFPLATQALQSELK

SEQ ID NO: 2006066 - protein, 17 aa, Staphylococcus
DLGIKYLTLYAFSTENW

SEQ ID NO: 2006067 - protein, 24 aa, Staphylococcus
DLGISSPDVFKALDLNIAHAVHTE

SEQ ID NO: 2006068 - protein, 17 aa, Staphylococcus
DLGLLPHRFNSVMVNDY

SEQ ID NO: 2006069 - protein, 17 aa, Staphylococcus
DLGLTKVNGGFIVTGGS

SEQ ID NO: 2006070 - protein, 19 aa, Staphylococcus
DLGQARAFYIDDLGLEQIS

SEQ ID NO: 2006071 - protein, 29 aa, Staphylococcus
DLGSSEMNIDLAIDMYKGKYHIYKVNAPI

SEQ ID NO: 2006072 - protein, 28 aa, Staphylococcus
DLGYFCVDNLPPILLPKFVELMEQGNPS

SEQ ID NO: 2006073 - protein, 18 aa, Staphylococcus
DLHGLWLGDLILIKRNLP

SEQ ID NO: 2006074 - protein, 17 aa, Staphylococcus
DLHINHVIGLDMTCLLD

SEQ ID NO: 2006075 - protein, 26 aa, Staphylococcus
DLHRAKRQGFPEVIFGEGKTKEQINQ

SEQ ID NO: 2006076 - protein, 26 aa, Staphylococcus
DLHRAKRQGFPEVIFGQGKTKEQIDT

SEQ ID NO: 2006077 - protein, 22 aa, Staphylococcus
DLIDHEYRLTIDIQSPVNAYGL

SEQ ID NO: 2006078 - protein, 26 aa, Staphylococcus
DLIEEVARIYGYDEIPSSLPVFGEVT

SEQ ID NO: 2006079 - protein, 26 aa, Staphylococcus
DLIEEVARIYGYDEIPSTLPVFEDVT

SEQ ID NO: 2006080 - protein, 23 aa, Staphylococcus
DLIEEVARIYGYDNIPSTMPVFE

SEQ ID NO: 2006081 - protein, 26 aa, Staphylococcus
DLIGKRLQYPGAPGLGGIAIAKTMIE

SEQ ID NO: 2006082 - protein, 23 aa, Staphylococcus
DLIKELRRLGLRVYSNVNNAIES

SEQ ID NO: 2006083 - protein, 26 aa, Staphylococcus
DLIKVKELYQLFAHLYTDAITLKEFS

SEQ ID NO: 2006084 - protein, 22 aa, Staphylococcus
DLINLGGGFSIKYVEGDVSFPI

SEQ ID NO: 2006085 - protein, 20 aa, Staphylococcus
DLIPEYQHLNIFPVGRLDKD

SEQ ID NO: 2006086 - protein, 24 aa, Staphylococcus
DLKADMAKLAPRVEVLSQITRDVI

SEQ ID NO: 2006087 - protein, 21 aa, Staphylococcus
DLKAFAKNGSINFDYQDKPKD

SEQ ID NO: 2006088 - protein, 20 aa, Staphylococcus
DLKAPIRMHRLLQGDVGSGK

SEQ ID NO: 2006089 - protein, 22 aa, Staphylococcus
DLKDNHGWHFDKFYPHEPNHVL

SEQ ID NO: 2006090 - protein, 31 aa, Staphylococcus
DLKEKYLPKGACSIFTFGVKGGYDAGIKFIE

SEQ ID NO: 2006091 - protein, 31 aa, Staphylococcus
DLKESLFKWQEKLQGIGWNSLYWNNHDNPRC

SEQ ID NO: 2006092 - protein, 20 aa, Staphylococcus
DLKGKVVLERADFNVPLKNG

SEQ ID NO: 2006093 - protein, 25 aa, Staphylococcus
DLKLRTEMQYELRALQSRLGITFIF

SEQ ID NO: 2006094 - protein, 20 aa, Staphylococcus
DLKMMYKWMDLGRKVDERLW

SEQ ID NO: 2006095 - protein, 21 aa, Staphylococcus
DLKPELVKSFVERRKGKATEE

SEQ ID NO: 2006096 - protein, 22 aa, Staphylococcus
DLKPPLNVYFSGYRPAEGFEAF

SEQ ID NO: 2006097 - protein, 21 aa, Staphylococcus
DLKPPLNVYFSGYRSAEGFEG

SEQ ID NO: 2006098 - protein, 29 aa, Staphylococcus
DLKQLEHNLTHWADLVAHKKSIRLHDLPG

SEQ ID NO: 2006099 - protein, 31 aa, Staphylococcus
DLKRGQRQMELIKILFKKAQKLDSVNKLNNL

SEQ ID NO: 2006100 - protein, 27 aa, Staphylococcus
DLKRINQELGITIIINLHFVDLAREYG

SEQ ID NO: 2006101 - protein, 19 aa, Staphylococcus
DLKRTYVFELDYDSMMRVA

SEQ ID NO: 2006102 - protein, 18 aa, Staphylococcus
DLKRTYVFELNYDAIMRV

SEQ ID NO: 2006103 - protein, 22 aa, Staphylococcus
DLKVEGALALILKDAIKPNLVQ

SEQ ID NO: 2006104 - protein, 19 aa, Staphylococcus
DLKVVYALIQNQERKVLLV

SEQ ID NO: 2006105 - protein, 17 aa, Staphylococcus
DLLAIFKTNSISFSDIF

SEQ ID NO: 2006106 - protein, 17 aa, Staphylococcus
DLLDAKFGYAVDASSPV

SEQ ID NO: 2006107 - protein, 17 aa, Staphylococcus
DLLECDYTPISWKEELE

SEQ ID NO: 2006108 - protein, 23 aa, Staphylococcus
DLLEELHQLIGLANVKQHVDKII

SEQ ID NO: 2006109 - protein, 17 aa, Staphylococcus
DLLEGLLSDHHEFKVNV

SEQ ID NO: 2006110 - protein, 27 aa, Staphylococcus
DLLFRSEGLKVLGYREVPVNKEVLAQH

SEQ ID NO: 2006111 - protein, 26 aa, Staphylococcus
DLLIDWRWGETYFKDKLIDYDNASNV

SEQ ID NO: 2006112 - protein, 21 aa, Staphylococcus
DLLIMAGTNFPYANYLPKKNI

SEQ ID NO: 2006113 - protein, 18 aa, Staphylococcus
DLLIVLRNFMEGHRQSVE

SEQ ID NO: 2006114 - protein, 23 aa, Staphylococcus
DLLKLLNDLAMIFINAGHESLEK

SEQ ID NO: 2006115 - protein, 25 aa, Staphylococcus
DLLMMRRNIGMIFQHFNLVKRSSVL

SEQ ID NO: 2006116 - protein, 20 aa, Staphylococcus
DLLPERQRRAIWAIYSVCRI

SEQ ID NO: 2006117 - protein, 26 aa, Staphylococcus
DLLPVIPEFADYTLIGGNGAIISQNG

SEQ ID NO: 2006118 - protein, 22 aa, Staphylococcus
DLLSKCLVCDKLHITINQLEVS

SEQ ID NO: 2006119 - protein, 18 aa, Staphylococcus
DLLSKRIDDSLIKQLETV

SEQ ID NO: 2006120 - protein, 21 aa, Staphylococcus
DLLTEFGVWHPKAWEHAPTRQ

SEQ ID NO: 2006121 - protein, 19 aa, Staphylococcus
DLLTIKGMKAIQMSDVILY

SEQ ID NO: 2006122 - protein, 23 aa, Staphylococcus
DLMAAKNRFGLDIKVSETIYSKY

SEQ ID NO: 2006123 - protein, 21 aa, Staphylococcus
DLMHRMNFHFYFIDIENTNIK

SEQ ID NO: 2006124 - protein, 23 aa, Staphylococcus
DLMNGHLTLPVLFEMRKNETFKQ

SEQ ID NO: 2006125 - protein, 17 aa, Staphylococcus
DLMQLLKINDGTFRNWK

SEQ ID NO: 2006126 - protein, 25 aa, Staphylococcus
DLNEALRIGDRIALMRDGKIMQIGT

SEQ ID NO: 2006127 - protein, 22 aa, Staphylococcus
DLNFRTDRLIAFLKEAAERYGF

SEQ ID NO: 2006128 - protein, 25 aa, Staphylococcus
DLNGSVIKSGMRFDFYETVGGNLGY

SEQ ID NO: 2006129 - protein, 26 aa, Staphylococcus
DLNHAAPYGGSPVKIKAGSYKACHNA

SEQ ID NO: 2006130 - protein, 24 aa, Staphylococcus
DLNITVPVAIHLDHGSSFEKCKEA

SEQ ID NO: 2006131 - protein, 24 aa, Staphylococcus
DLNKRMKWYTVIQSIGMVQWYEEQ

SEQ ID NO: 2006132 - protein, 18 aa, Staphylococcus
DLNLPADKKVIMYAPTWR

SEQ ID NO: 2006133 - protein, 23 aa, Staphylococcus
DLNLTDDVLIEFLKLNEEDYTLN

SEQ ID NO: 2006134 - protein, 23 aa, Staphylococcus
DLNMPLELYVQLVYSVQNEMVYK

SEQ ID NO: 2006135 - protein, 23 aa, Staphylococcus
DLNQKLYHYWALGHIHERQELSD

SEQ ID NO: 2006136 - protein, 27 aa, Staphylococcus
DLNRLRIMELLEFGEASVGHISHTLNM

SEQ ID NO: 2006137 - protein, 18 aa, Staphylococcus
DLNWPKDTEFVYSPFMVE

SEQ ID NO: 2006138 - protein, 29 aa, Staphylococcus
DLPDGINFRTKRVGVLNYSKSKWVHVNEY

SEQ ID NO: 2006139 - protein, 24 aa, Staphylococcus
DLPDKKCECGAEMIKEGQDIPFET

SEQ ID NO: 2006140 - protein, 24 aa, Staphylococcus
DLPFLPFDHKIVLSSDDILKLEAL

SEQ ID NO: 2006141 - protein, 35 aa, Staphylococcus
DLPGALKKDNCCYMKEGSCWCVTAYHNERLTKASN

SEQ ID NO: 2006142 - protein, 21 aa, Staphylococcus
DLPGYMGADYHKLPISKVAEV

SEQ ID NO: 2006143 - protein, 25 aa, Staphylococcus
DLPHIRVVMLTSFIEDKEVYRALDA

SEQ ID NO: 2006144 - protein, 21 aa, Staphylococcus
DLPILIECFNHLIDQGNTVIL

SEQ ID NO: 2006145 - protein, 17 aa, Staphylococcus
DLPKVKSLWPQSGDYVL

SEQ ID NO: 2006146 - protein, 23 aa, Staphylococcus
DLPKVWKDLGMRSASAYAKKTRS

SEQ ID NO: 2006147 - protein, 24 aa, Staphylococcus
DLPLEGRMGFGIHFAMDYLTEQGQ

SEQ ID NO: 2006148 - protein, 24 aa, Staphylococcus
DLPLEGRMGFGIHFAMDYLTEQMQ

SEQ ID NO: 2006149 - protein, 24 aa, Staphylococcus
DLPLEGRMGFGIHFAMDYLTEQTQ

SEQ ID NO: 2006150 - protein, 20 aa, Staphylococcus
DLPMLKRWAQAGTQVNTELW

SEQ ID NO: 2006151 - protein, 23 aa, Staphylococcus
DLPNIKVLMLTSYIEDNEVYRAL

SEQ ID NO: 2006152 - protein, 24 aa, Staphylococcus
DLPNYIFQRYWHFRTWGNANAMAN

SEQ ID NO: 2006153 - protein, 17 aa, Staphylococcus
DLPTKFEAGTPIIAQAI

SEQ ID NO: 2006154 - protein, 18 aa, Staphylococcus
DLPTKFEAGTPIIAQAIG

SEQ ID NO: 2006155 - protein, 22 aa, Staphylococcus
DLPTLGEVFLKVTGEELNDNEN

SEQ ID NO: 2006156 - protein, 21 aa, Staphylococcus
DLPVDSYIIWGGVSNVNLMYE

SEQ ID NO: 2006157 - protein, 22 aa, Staphylococcus
DLQCYEEGEFIYNKAVEEGHMP

SEQ ID NO: 2006158 - protein, 26 aa, Staphylococcus
DLQDFGPAWIEQFVRLQIEEAFAVAL

SEQ ID NO: 2006159 - protein, 17 aa, Staphylococcus
DLQDLPFISGFIGSCSF

SEQ ID NO: 2006160 - protein, 17 aa, Staphylococcus
DLQHIYYVSKFDHPKNQ

SEQ ID NO: 2006161 - protein, 22 aa, Staphylococcus
DLRAGACLIVAGLLAEGVTTIY

SEQ ID NO: 2006162 - protein, 20 aa, Staphylococcus
DLRAGACLMVAGLIAEGVTT

SEQ ID NO: 2006163 - protein, 20 aa, Staphylococcus
DLRALFRGKADHVVNFMHFI

SEQ ID NO: 2006164 - protein, 19 aa, Staphylococcus
DLRATPIIETKPDMFILGT

SEQ ID NO: 2006165 - protein, 17 aa, Staphylococcus
DLREMRDKKGADVKEHE

SEQ ID NO: 2006166 - protein, 21 aa, Staphylococcus
DLRGKELFKSLIKEIDIIKSR

SEQ ID NO: 2006167 - protein, 19 aa, Staphylococcus
DLRGLLTPTEFELAKQRMA

SEQ ID NO: 2006168 - protein, 22 aa, Staphylococcus
DLRIMLESFAFSRIKNLNHEQI

SEQ ID NO: 2006169 - protein, 19 aa, Staphylococcus
DLRKGHIQFLYVAPERFDN

SEQ ID NO: 2006170 - protein, 34 aa, Staphylococcus
DLRKYCEINDYILMPFVFTSGLGIHALNSQNLLG

SEQ ID NO: 2006171 - protein, 22 aa, Staphylococcus
DLRLMLESFAFAKIKDKDLQSI

SEQ ID NO: 2006172 - protein, 24 aa, Staphylococcus
DLRLTDIGYDLGMISEERYARFND

SEQ ID NO: 2006173 - protein, 25 aa, Staphylococcus
DLRLTDIGYELGMISEARYARFNEK

SEQ ID NO: 2006174 - protein, 25 aa, Staphylococcus
DLRPRDSFEVIRHFELSQAHLEILN

SEQ ID NO: 2006175 - protein, 17 aa, Staphylococcus
DLRRTELAQTFKMRHQI

SEQ ID NO: 2006176 - protein, 21 aa, Staphylococcus
DLRYSDSVLLSTKFKLPKWMF

SEQ ID NO: 2006177 - protein, 17 aa, Staphylococcus
DLSEASIHFEVDEGDYL

SEQ ID NO: 2006178 - protein, 18 aa, Staphylococcus
DLSETRKAEVLYEELAHH

SEQ ID NO: 2006179 - protein, 19 aa, Staphylococcus
DLSFKDYVKYASEYIDISG

SEQ ID NO: 2006180 - protein, 26 aa, Staphylococcus
DLSFVEAVKELGERINISVDIGNSSD

SEQ ID NO: 2006181 - protein, 20 aa, Staphylococcus
DLSGDFRLTNRATYETYYGE

SEQ ID NO: 2006182 - protein, 18 aa, Staphylococcus
DLSIKVYLFESFISGEHI

SEQ ID NO: 2006183 - protein, 23 aa, Staphylococcus
DLSNRLYHDFLRENNEREKLRAE

SEQ ID NO: 2006184 - protein, 19 aa, Staphylococcus
DLSPKFVVGYVETKEKHPD

SEQ ID NO: 2006185 - protein, 20 aa, Staphylococcus
DLSPKFVVGYVETKEKHPDA

SEQ ID NO: 2006186 - protein, 19 aa, Staphylococcus
DLSPKFVVGYVKTKEKHPN

SEQ ID NO: 2006187 - protein, 18 aa, Staphylococcus
DLSPRKKVDLLLDEAEIT

SEQ ID NO: 2006188 - protein, 17 aa, Staphylococcus
DLSQNFRSREEVLTTTN

SEQ ID NO: 2006189 - protein, 17 aa, Staphylococcus
DLSQNFRSRQEVLSTTN

SEQ ID NO: 2006190 - protein, 32 aa, Staphylococcus
DLSRLARRGSGSACRSIFGGFAEWEKGHDDAS

SEQ ID NO: 2006191 - protein, 24 aa, Staphylococcus
DLSRLARRGSGSASRSIFGGFAEW

SEQ ID NO: 2006192 - protein, 25 aa, Staphylococcus
DLSRLARRGSGSASRSIFGGFVEWH

SEQ ID NO: 2006193 - protein, 17 aa, Staphylococcus
DLSRLGANANQIAKYCH

SEQ ID NO: 2006194 - protein, 29 aa, Staphylococcus
DLSRPATNFKEAVQWLYLAYLAAIKEQNG

SEQ ID NO: 2006195 - protein, 24 aa, Staphylococcus
DLSSRTGERIIIFKLHNDLEKQII

SEQ ID NO: 2006196 - protein, 18 aa, Staphylococcus
DLTDEFVEPFIVEGQNDG

SEQ ID NO: 2006197 - protein, 18 aa, Staphylococcus
DLTDEFVEPFIVQDQNEG

SEQ ID NO: 2006198 - protein, 24 aa, Staphylococcus
DLTEGHLLICGKSGSGKSTLAKMI

SEQ ID NO: 2006199 - protein, 20 aa, Staphylococcus
DLTGECWAISALPNGSNIIE

SEQ ID NO: 2006200 - protein, 23 aa, Staphylococcus
DLTKRFGKFEALSHLDLTVEEGE

SEQ ID NO: 2006201 - protein, 17 aa, Staphylococcus
DLTQCFDTQSSQFKNLL

SEQ ID NO: 2006202 - protein, 27 aa, Staphylococcus
DLTVTVKFSAGYIKQAILTEVKENAYD

SEQ ID NO: 2006203 - protein, 18 aa, Staphylococcus
DLTWEVYRDTLIEQAEQG

SEQ ID NO: 2006204 - protein, 24 aa, Staphylococcus
DLVARLKTMQGFYVERKAGWDTHG

SEQ ID NO: 2006205 - protein, 18 aa, Staphylococcus
DLVDVAVRLVKDQKKALV

SEQ ID NO: 2006206 - protein, 18 aa, Staphylococcus
DLVDVAVRLVKEEKKALV

SEQ ID NO: 2006207 - protein, 19 aa, Staphylococcus
DLVEELKMADFERAAKISG

SEQ ID NO: 2006208 - protein, 28 aa, Staphylococcus
DLVKEYLYVILIKTFQYWSANKDSIDVR

SEQ ID NO: 2006209 - protein, 19 aa, Staphylococcus
DLWDQRMLNRFAEDIKQGA

SEQ ID NO: 2006210 - protein, 17 aa, Staphylococcus
DLWFDIVQQLSVSLPSN

SEQ ID NO: 2006211 - protein, 30 aa, Staphylococcus
DLYDKTEFELIRWFGKRGRGLYLKARGIDH

SEQ ID NO: 2006212 - protein, 19 aa, Staphylococcus
DLYEAHGYKNFIYTPVGFV

SEQ ID NO: 2006213 - protein, 19 aa, Staphylococcus
DLYFDKRASIPRDDVATVL

SEQ ID NO: 2006214 - protein, 17 aa, Staphylococcus
DLYHFLVKIKDIYKTKL

SEQ ID NO: 2006215 - protein, 22 aa, Staphylococcus
DLYKTDWGIALLHNQEQVYLGY

SEQ ID NO: 2006216 - protein, 18 aa, Staphylococcus
DLYLEASVDMIKRTDTDH

SEQ ID NO: 2006217 - protein, 19 aa, Staphylococcus
DLYLEVTTALELTYRPQQL

SEQ ID NO: 2006218 - protein, 26 aa, Staphylococcus
DLYQSWRRVLANVGIGRPGYIRFLAQ

SEQ ID NO: 2006219 - protein, 19 aa, Staphylococcus
DLYRLWQNAFVVGKDDPIK

SEQ ID NO: 2006220 - protein, 22 aa, Staphylococcus
DMAADMSLAIVIGSEGQGMSRL

SEQ ID NO: 2006221 - protein, 20 aa, Staphylococcus
DMAKRAAAKQTKWFPVVGQA

SEQ ID NO: 2006222 - protein, 20 aa, Staphylococcus
DMAKRAAAKQTRWFPLVGQA

SEQ ID NO: 2006223 - protein, 20 aa, Staphylococcus
DMDEAIKLADRICIMSKGKI

SEQ ID NO: 2006224 - protein, 21 aa, Staphylococcus
DMDEAIKLADRICIMSKGKVV

SEQ ID NO: 2006225 - protein, 20 aa, Staphylococcus
DMDEAIKLADRICIMSNGKV

SEQ ID NO: 2006226 - protein, 18 aa, Staphylococcus
DMDMYKLAFAIRDAAAEK

SEQ ID NO: 2006227 - protein, 26 aa, Staphylococcus
DMDTCIACGACGAAAPDIYDYDDEGI

SEQ ID NO: 2006228 - protein, 24 aa, Staphylococcus
DMEFKKLHVREKVGLSEKTMTNQM

SEQ ID NO: 2006229 - protein, 26 aa, Staphylococcus
DMEKLIRLPGKFKYFEHNVAAHSFKV

SEQ ID NO: 2006230 - protein, 25 aa, Staphylococcus
DMFDCVLPTRIARNGTCMTSKGRVV

SEQ ID NO: 2006231 - protein, 24 aa, Staphylococcus
DMFILQGAASFNIWTGQTANINTM

SEQ ID NO: 2006232 - protein, 17 aa, Staphylococcus
DMFKALLHIVFKEYGVL

SEQ ID NO: 2006233 - protein, 17 aa, Staphylococcus
DMFLLRFNADIFSHTDY

SEQ ID NO: 2006234 - protein, 17 aa, Staphylococcus
DMGKTYHATVAIGTSTT

SEQ ID NO: 2006235 - protein, 24 aa, Staphylococcus
DMHIGHLKSVMALLKANQIETYIH

SEQ ID NO: 2006236 - protein, 20 aa, Staphylococcus
DMHLFKEKLEMMGQEITFYE

SEQ ID NO: 2006237 - protein, 17 aa, Staphylococcus
DMIKDCSDFVMINNMTN

SEQ ID NO: 2006238 - protein, 35 aa, Staphylococcus
DMIKGVLGNIPFFGICLGHQLFALSQGAKAFKMKF

SEQ ID NO: 2006239 - protein, 22 aa, Staphylococcus
DMILRRNVDILQQWIEQKKGPF

SEQ ID NO: 2006240 - protein, 23 aa, Staphylococcus
DMINYWIDFGVDGFRFDVINLIS

SEQ ID NO: 2006241 - protein, 23 aa, Staphylococcus
DMIPAEWEQVYTIAYIGDEGGQV

SEQ ID NO: 2006242 - protein, 30 aa, Staphylococcus
DMIRHRLGSMPLEWSDKLNIVATELETSER

SEQ ID NO: 2006243 - protein, 17 aa, Staphylococcus
DMISELNHYLHISKEQS

SEQ ID NO: 2006244 - protein, 18 aa, Staphylococcus
DMITLDFGAYYRGYCSDI

SEQ ID NO: 2006245 - protein, 20 aa, Staphylococcus
DMITPYSEFEVMADENYLLA

SEQ ID NO: 2006246 - protein, 21 aa, Staphylococcus
DMIVECGKGTYIRTLATDIGK

SEQ ID NO: 2006247 - protein, 24 aa, Staphylococcus
DMIYRLNAFGIRVGSDIKVKQRCM

SEQ ID NO: 2006248 - protein, 18 aa, Staphylococcus
DMKDQFKGKVVVIHQPAE

SEQ ID NO: 2006249 - protein, 24 aa, Staphylococcus
DMKGWTKDDVLAFQSLTNIKVITK

SEQ ID NO: 2006250 - protein, 24 aa, Staphylococcus
DMKGWTKEDILAFQELTNIKVKTT

SEQ ID NO: 2006251 - protein, 27 aa, Staphylococcus
DMKKKWGEKVVERFSFRNYLYVFVSNY

SEQ ID NO: 2006252 - protein, 24 aa, Staphylococcus
DMKNWSKDDVIAFESLTGINVKMK

SEQ ID NO: 2006253 - protein, 20 aa, Staphylococcus
DMKPPLNVYFSGYRPAEGFE

SEQ ID NO: 2006254 - protein, 23 aa, Staphylococcus
DMKQLAPRIKYLVQIIKDIINDF

SEQ ID NO: 2006255 - protein, 18 aa, Staphylococcus
DMLDEGVKHTISQEEIKK

SEQ ID NO: 2006256 - protein, 18 aa, Staphylococcus
DMLEGIKIAHPELEVIND

SEQ ID NO: 2006257 - protein, 18 aa, Staphylococcus
DMLELAKYSYVMKNSQDK

SEQ ID NO: 2006258 - protein, 18 aa, Staphylococcus
DMLFKRCNKDMIFIGILS

SEQ ID NO: 2006259 - protein, 23 aa, Staphylococcus
DMLHSCKILLKQINLFLENQINE

SEQ ID NO: 2006260 - protein, 25 aa, Staphylococcus
DMLIKGFDVEAMIERMSRLLKVPVL

SEQ ID NO: 2006261 - protein, 18 aa, Staphylococcus
DMLLFCPQGIDAEGDQFR

SEQ ID NO: 2006262 - protein, 20 aa, Staphylococcus
DMLNFLLTSGAFGFVVANNA

SEQ ID NO: 2006263 - protein, 23 aa, Staphylococcus
DMLRNVKTPVFLVLNKIDLVHPD

SEQ ID NO: 2006264 - protein, 19 aa, Staphylococcus
DMLSDVLVLIEFDSLNDPD

SEQ ID NO: 2006265 - protein, 24 aa, Staphylococcus
DMLSECFYIRREVFVKEQGVPLEN

SEQ ID NO: 2006266 - protein, 24 aa, Staphylococcus
DMNKDYFDELSIYIEAAKHKQYVL

SEQ ID NO: 2006267 - protein, 19 aa, Staphylococcus
DMNLDLAIEAYDGSFHIYK

SEQ ID NO: 2006268 - protein, 20 aa, Staphylococcus
DMPDHPFVYWATYYHAAELL

SEQ ID NO: 2006269 - protein, 26 aa, Staphylococcus
DMRIGLEVLDSVKIEYKLVDNWKQYL

SEQ ID NO: 2006270 - protein, 17 aa, Staphylococcus
DMSECLILIQKLNERMV

SEQ ID NO: 2006271 - protein, 26 aa, Staphylococcus
DMSGWTKEEVVAFENLANVKITTKGS

SEQ ID NO: 2006272 - protein, 34 aa, Staphylococcus
DMSIMKKRVDTILEEGKGWLVFYSHTNIFKQNTM

SEQ ID NO: 2006273 - protein, 22 aa, Staphylococcus
DMSRSVSRFAFRNEPEKQQSHF

SEQ ID NO: 2006274 - protein, 25 aa, Staphylococcus
DMTGWTKEDVLAFEDLTHIKVSTKG

SEQ ID NO: 2006275 - protein, 18 aa, Staphylococcus
DMTKCICMYDAPDEDAVR

SEQ ID NO: 2006276 - protein, 17 aa, Staphylococcus
DMTSFELNQKFNIITIF

SEQ ID NO: 2006277 - protein, 20 aa, Staphylococcus
DMTTFWKIFYHKMTLMHDAL

SEQ ID NO: 2006278 - protein, 22 aa, Staphylococcus
DMVKAGKGFTVISKSVLDEEHN

SEQ ID NO: 2006279 - protein, 23 aa, Staphylococcus
DMVKEMRDGAVIVDIAIDQGGIF

SEQ ID NO: 2006280 - protein, 17 aa, Staphylococcus
DMVKVKRYLQGRKTRLV

SEQ ID NO: 2006281 - protein, 18 aa, Staphylococcus
DMVKVKRYLQGRKTRLVG

SEQ ID NO: 2006282 - protein, 25 aa, Staphylococcus
DMVLGFKEGHSFSHHLLIEQSVTAL

SEQ ID NO: 2006283 - protein, 18 aa, Staphylococcus
DMVTLDFGAYYKGYCSDI

SEQ ID NO: 2006284 - protein, 25 aa, Staphylococcus
DMVYRAGSMPKEFKIPDQDTINNIK

SEQ ID NO: 2006285 - protein, 22 aa, Staphylococcus
DMYIKQGYTFIGFRYQILKENI

SEQ ID NO: 2006286 - protein, 27 aa, Staphylococcus
DMYLHPDLDTWVIFPWTAGQGKVARLI

SEQ ID NO: 2006287 - protein, 18 aa, Staphylococcus
DMYREIAFHGGIPDTGFY

SEQ ID NO: 2006288 - protein, 22 aa, Staphylococcus
DMYRYSEEWELIDFKVNENYRT

SEQ ID NO: 2006289 - protein, 22 aa, Staphylococcus
DNAKEHGLEFIGGETVQSLNGD

SEQ ID NO: 2006290 - protein, 22 aa, Staphylococcus
DNAKELLLKGLEKLEYRGYDSA

SEQ ID NO: 2006291 - protein, 25 aa, Staphylococcus
DNALWDSMRTCFAKDSHVSISWFNG

SEQ ID NO: 2006292 - protein, 17 aa, Staphylococcus
DNARTPMQWDDSVNGGF

SEQ ID NO: 2006293 - protein, 23 aa, Staphylococcus
DNDEVLEFYGLKVLVDKDDAPVL

SEQ ID NO: 2006294 - protein, 18 aa, Staphylococcus
DNDKLCVMLDNNKDSNIL

SEQ ID NO: 2006295 - protein, 20 aa, Staphylococcus
DNDLLLKIIHQYKDKPILGV

SEQ ID NO: 2006296 - protein, 23 aa, Staphylococcus
DNDRAMFDFGHYTVAMKNARQEI

SEQ ID NO: 2006297 - protein, 24 aa, Staphylococcus
DNDRAMFEFGGYTVSMKNARPEIQ

SEQ ID NO: 2006298 - protein, 24 aa, Staphylococcus
DNDRAMFEFGHYTVAMKNARSEIK

SEQ ID NO: 2006299 - protein, 25 aa, Staphylococcus
DNEEKYLRLYAEFENYKRRIQKENE

SEQ ID NO: 2006300 - protein, 25 aa, Staphylococcus
DNEEKYLRLYAEFENYKRRIQNENK

SEQ ID NO: 2006301 - protein, 25 aa, Staphylococcus
DNEEKYLRLYAEFENYKRRIQNENQ

SEQ ID NO: 2006302 - protein, 28 aa, Staphylococcus
DNEGFIKFQPIGGWWSQVMLSQKVTITT

SEQ ID NO: 2006303 - protein, 26 aa, Staphylococcus
DNEIERGFCLLVGVGKDSTEEDIKIV

SEQ ID NO: 2006304 - protein, 25 aa, Staphylococcus
DNEKDGRQAIQFLKQRNLGRATFLP

SEQ ID NO: 2006305 - protein, 24 aa, Staphylococcus
DNEKRLWLHIKLDTGMGRLGIKNQ

SEQ ID NO: 2006306 - protein, 18 aa, Staphylococcus
DNEKSVIFNTGYLKNNIE

SEQ ID NO: 2006307 - protein, 22 aa, Staphylococcus
DNEVRIQWRVADIKIPNNEIKN

SEQ ID NO: 2006308 - protein, 17 aa, Staphylococcus
DNEWKRVVPESVHALYH

SEQ ID NO: 2006309 - protein, 26 aa, Staphylococcus
DNFDLIVDYCRERGFLVLTYDNGYII

SEQ ID NO: 2006310 - protein, 25 aa, Staphylococcus
DNFKQGFKAFALRTDNIEKLKTELE

SEQ ID NO: 2006311 - protein, 27 aa, Staphylococcus
DNFKQGFKTICLRTSNIDAIKQTLEER

SEQ ID NO: 2006312 - protein, 23 aa, Staphylococcus
DNFKQGFKTMAFRTEDIERVKQS

SEQ ID NO: 2006313 - protein, 32 aa, Staphylococcus
DNFSLEMWGGATFDVAYNFLKENPWERLERLR

SEQ ID NO: 2006314 - protein, 30 aa, Staphylococcus
DNGDLLFGTIDSWLVWKLSGKEAHITDYTN

SEQ ID NO: 2006315 - protein, 23 aa, Staphylococcus
DNGEHRYLFTGDFLCFEGDTWRT

SEQ ID NO: 2006316 - protein, 22 aa, Staphylococcus
DNGEHRYLFTGDFLCYEGDEWR

SEQ ID NO: 2006317 - protein, 23 aa, Staphylococcus
DNGELKGAMGVEKVFDSYLSGQK

SEQ ID NO: 2006318 - protein, 18 aa, Staphylococcus
DNGELKSTSILIDGQYIK

SEQ ID NO: 2006319 - protein, 23 aa, Staphylococcus
DNGESLTAPVLNKLMRNVYEQFF

SEQ ID NO: 2006320 - protein, 24 aa, Staphylococcus
DNGFEVLDGTSFNEFVVKFDQPIK

SEQ ID NO: 2006321 - protein, 27 aa, Staphylococcus
DNGHYEFKETIAFLLSNEVEADNLKSL

SEQ ID NO: 2006322 - protein, 25 aa, Staphylococcus
DNGHYEFRKTVAFLLSNQVESYNLK

SEQ ID NO: 2006323 - protein, 17 aa, Staphylococcus
DNGRLPVVNFAAGGVAT

SEQ ID NO: 2006324 - protein, 24 aa, Staphylococcus
DNGTKRLIFVTALNTLHEVPGKFG

SEQ ID NO: 2006325 - protein, 22 aa, Staphylococcus
DNGYCMLNHLYVNKGQEGAFEQ

SEQ ID NO: 2006326 - protein, 20 aa, Staphylococcus
DNGYHFFKYMRTYHPDKPVY

SEQ ID NO: 2006327 - protein, 17 aa, Staphylococcus
DNHFYFNVFKKYSEEDL

SEQ ID NO: 2006328 - protein, 20 aa, Staphylococcus
DNHIKLSIIYKHDKIKKIEV

SEQ ID NO: 2006329 - protein, 17 aa, Staphylococcus
DNHKTLVAYSLGNFLNG

SEQ ID NO: 2006330 - protein, 22 aa, Staphylococcus
DNHLDRLAKWSIQTDVSDPTGV

SEQ ID NO: 2006331 - protein, 17 aa, Staphylococcus
DNHMLIAVTELRTKEEI

SEQ ID NO: 2006332 - protein, 18 aa, Staphylococcus
DNIFCLTLGTGIGGAFYN

SEQ ID NO: 2006333 - protein, 21 aa, Staphylococcus
DNIIMPLVLANRSHKTIDARL

SEQ ID NO: 2006334 - protein, 17 aa, Staphylococcus
DNIKGISFLIAGGLTDQ

SEQ ID NO: 2006335 - protein, 23 aa, Staphylococcus
DNILMPLVLANRSHKVMEQRMNT

SEQ ID NO: 2006336 - protein, 19 aa, Staphylococcus
DNILMPLVLANRSHQTMRH

SEQ ID NO: 2006337 - protein, 17 aa, Staphylococcus
DNIMLGFTTREDGVSDY

SEQ ID NO: 2006338 - protein, 24 aa, Staphylococcus
DNIPFEINGLLGLETGHINIGMSA

SEQ ID NO: 2006339 - protein, 17 aa, Staphylococcus
DNIYGERVIVYWHHYLR

SEQ ID NO: 2006340 - protein, 17 aa, Staphylococcus
DNKEFFFNQFSKVESII

SEQ ID NO: 2006341 - protein, 20 aa, Staphylococcus
DNKGKVVLVTAMSPTPAGEG

SEQ ID NO: 2006342 - protein, 21 aa, Staphylococcus
DNKGKVVLVTAMSPTPAGEGK

SEQ ID NO: 2006343 - protein, 17 aa, Staphylococcus
DNKHKLAQEEIFGPVLV

SEQ ID NO: 2006344 - protein, 17 aa, Staphylococcus
DNKILFEKLEQVKNDNA

SEQ ID NO: 2006345 - protein, 29 aa, Staphylococcus
DNKLLDFFIIDILNKLYLPSLNKRINHKI

SEQ ID NO: 2006346 - protein, 22 aa, Staphylococcus
DNKTLGRFSLTDIPPAPRGVPQ

SEQ ID NO: 2006347 - protein, 20 aa, Staphylococcus
DNKTSFVYDVDFSSFGAPTS

SEQ ID NO: 2006348 - protein, 18 aa, Staphylococcus
DNKVGMAPGMLVQQHGKQ

SEQ ID NO: 2006349 - protein, 22 aa, Staphylococcus
DNKVKVIAWYDNEWGYSNRVVD

SEQ ID NO: 2006350 - protein, 22 aa, Staphylococcus
DNKVKVIAWYDNEWGYSNRVVE

SEQ ID NO: 2006351 - protein, 29 aa, Staphylococcus
DNKVMSEFMKFVLKDEGKSAEAKDEVAAP

SEQ ID NO: 2006352 - protein, 24 aa, Staphylococcus
DNLDQINWLGFYLIENNELILGPF

SEQ ID NO: 2006353 - protein, 23 aa, Staphylococcus
DNLEKRLPKLLKIADNNCMISNS

SEQ ID NO: 2006354 - protein, 19 aa, Staphylococcus
DNLIGCHNFYPQQYTGLSF

SEQ ID NO: 2006355 - protein, 19 aa, Staphylococcus
DNLIHPVVYNDALQQDGSF

SEQ ID NO: 2006356 - protein, 26 aa, Staphylococcus
DNLILLGIKTRGAFLARRIQQKIEQI

SEQ ID NO: 2006357 - protein, 21 aa, Staphylococcus
DNLKFPMSVIEEVVKAKNKYA

SEQ ID NO: 2006358 - protein, 21 aa, Staphylococcus
DNLKFTGKETYKDGLNAFETI

SEQ ID NO: 2006359 - protein, 18 aa, Staphylococcus
DNLKMVIGGDEVPGGGAQ

SEQ ID NO: 2006360 - protein, 17 aa, Staphylococcus
DNLKRMKAWIPIDGTYD

SEQ ID NO: 2006361 - protein, 19 aa, Staphylococcus
DNLKRYAFDLKLINEKREH

SEQ ID NO: 2006362 - protein, 18 aa, Staphylococcus
DNLKTFGVEKIFTEKQSG

SEQ ID NO: 2006363 - protein, 17 aa, Staphylococcus
DNLPVYIEKSIIHQLDR

SEQ ID NO: 2006364 - protein, 24 aa, Staphylococcus
DNLRTVRDAFKFYHVRHEEVASLA

SEQ ID NO: 2006365 - protein, 28 aa, Staphylococcus
DNMPDKLCLYYHIGQCMGPCVYDVDLDK

SEQ ID NO: 2006366 - protein, 26 aa, Staphylococcus
DNNAPFLPRFGLLITLPSTYEQINYY

SEQ ID NO: 2006367 - protein, 21 aa, Staphylococcus
DNNDFKAIAIVVGSKKMVLEN

SEQ ID NO: 2006368 - protein, 27 aa, Staphylococcus
DNNEKWNDVVFIFPISMKYLLPENAQF

SEQ ID NO: 2006369 - protein, 22 aa, Staphylococcus
DNNMKDLARMSVGQVLNENDID

SEQ ID NO: 2006370 - protein, 22 aa, Staphylococcus
DNNMKDLARMSVGQVLNQHDID

SEQ ID NO: 2006371 - protein, 29 aa, Staphylococcus
DNNPHCWKLRFDWCLSNASPFQSAYHILD

SEQ ID NO: 2006372 - protein, 18 aa, Staphylococcus
DNPQLKGKPVIVGGKASH

SEQ ID NO: 2006373 - protein, 17 aa, Staphylococcus
DNPTLKGKPVIVGGKAS

SEQ ID NO: 2006374 - protein, 23 aa, Staphylococcus
DNQFFKRIYSVLEDFYAENDSYT

SEQ ID NO: 2006375 - protein, 20 aa, Staphylococcus
DNQIPFEIVPGITSGIAAPA

SEQ ID NO: 2006376 - protein, 24 aa, Staphylococcus
DNQLIKRRHHILLENDFEQQYDID

SEQ ID NO: 2006377 - protein, 18 aa, Staphylococcus
DNQVLFEKLELVKNDNAQ

SEQ ID NO: 2006378 - protein, 23 aa, Staphylococcus
DNRAAHDFASYIADFINGYCFGH

SEQ ID NO: 2006379 - protein, 32 aa, Staphylococcus
DNRFYDHGALDYKRLFGAVAKNVTGGFGSQGA

SEQ ID NO: 2006380 - protein, 17 aa, Staphylococcus
DNRKIIEGFKHLTPNTN

SEQ ID NO: 2006381 - protein, 20 aa, Staphylococcus
DNRPFSGFKNFNTPSQIAQD

SEQ ID NO: 2006382 - protein, 25 aa, Staphylococcus
DNRTALNFYIKNGFKIYSESQKDDQ

SEQ ID NO: 2006383 - protein, 21 aa, Staphylococcus
DNRVVKIISLIAMTADTNRIQ

SEQ ID NO: 2006384 - protein, 26 aa, Staphylococcus
DNRYGCALAIDVLKRLKDEQIGVDLY

SEQ ID NO: 2006385 - protein, 24 aa, Staphylococcus
DNRYGCALAIDVLNELKDETIDIN

SEQ ID NO: 2006386 - protein, 23 aa, Staphylococcus
DNRYGCALAIDVLNNLKDESIGI

SEQ ID NO: 2006387 - protein, 25 aa, Staphylococcus
DNRYGCALAIDVLNRLKDDSIDINL

SEQ ID NO: 2006388 - protein, 23 aa, Staphylococcus
DNRYGCALAIDVLQNLKNEAIDI

SEQ ID NO: 2006389 - protein, 21 aa, Staphylococcus
DNRYGCAVAVEVLKNLKDENL

SEQ ID NO: 2006390 - protein, 17 aa, Staphylococcus
DNSKAKYINICLELEQV

SEQ ID NO: 2006391 - protein, 24 aa, Staphylococcus
DNSKRIEGIMSRLIDDVRNLSVEL

SEQ ID NO: 2006392 - protein, 26 aa, Staphylococcus
DNSLEHLLFGLGIRHLGVKASQVLAE

SEQ ID NO: 2006393 - protein, 19 aa, Staphylococcus
DNSMIRPYEGHLWIMDPID

SEQ ID NO: 2006394 - protein, 21 aa, Staphylococcus
DNSRTPMQWDQSTNGGFTNGT

SEQ ID NO: 2006395 - protein, 20 aa, Staphylococcus
DNTEHARKLFALEEDGNIYT

SEQ ID NO: 2006396 - protein, 17 aa, Staphylococcus
DNTGEWLPQETLDTIKE

SEQ ID NO: 2006397 - protein, 30 aa, Staphylococcus
DNTISYAYRGVRYKGCINVFIEKNYLNNIK

SEQ ID NO: 2006398 - protein, 35 aa, Staphylococcus
DNTKQQIKGIVGFKIKVNDIQGAYKLSQNKSEKDY

SEQ ID NO: 2006399 - protein, 24 aa, Staphylococcus
DNTSSIRIYINWNGQPVNLNTIDM

SEQ ID NO: 2006400 - protein, 18 aa, Staphylococcus
DNVAGLCQVVARLEISDK

SEQ ID NO: 2006401 - protein, 22 aa, Staphylococcus
DNVAGLCQVVARLVFNEKSGKR

SEQ ID NO: 2006402 - protein, 17 aa, Staphylococcus
DNVDAALVFANIVGYAA

SEQ ID NO: 2006403 - protein, 24 aa, Staphylococcus
DNVELPNIIPIYTRYFDNVYWITY

SEQ ID NO: 2006404 - protein, 34 aa, Staphylococcus
DNVFPTKHAIGLKAENGLELLVHIGLDTVQLDGE

SEQ ID NO: 2006405 - protein, 18 aa, Staphylococcus
DNVIKKFVKESAEAGIDV

SEQ ID NO: 2006406 - protein, 17 aa, Staphylococcus
DNVIVGAVNIRYQLNES

SEQ ID NO: 2006407 - protein, 20 aa, Staphylococcus
DNVKGPIIWVDDTLIALQQL

SEQ ID NO: 2006408 - protein, 17 aa, Staphylococcus
DNVRRKVLHQLLKLQET

SEQ ID NO: 2006409 - protein, 17 aa, Staphylococcus
DNVRRVKQLQGIAEAHN

SEQ ID NO: 2006410 - protein, 17 aa, Staphylococcus
DNWQEFDALAAELNKRA

SEQ ID NO: 2006411 - protein, 18 aa, Staphylococcus
DNYICIFKVHPNHTDVVI

SEQ ID NO: 2006412 - protein, 23 aa, Staphylococcus
DNYKIIEGFKHLTPNTNQYRTVM

SEQ ID NO: 2006413 - protein, 17 aa, Staphylococcus
DNYKQFIMDSGIDSTRF

SEQ ID NO: 2006414 - protein, 17 aa, Staphylococcus
DNYKWLQILPEKKRYSL

SEQ ID NO: 2006415 - protein, 21 aa, Staphylococcus
DNYLKPVIIYFYGGGFINGHG

SEQ ID NO: 2006416 - protein, 20 aa, Staphylococcus
DPAGKPWSEFQRVRDEIKTA

SEQ ID NO: 2006417 - protein, 17 aa, Staphylococcus
DPAKCIALKISEDKLNR

SEQ ID NO: 2006418 - protein, 19 aa, Staphylococcus
DPALARRFNEVLVKEPSAK

SEQ ID NO: 2006419 - protein, 24 aa, Staphylococcus
DPASLHKPKAFFGAARNIEAGGSM

SEQ ID NO: 2006420 - protein, 23 aa, Staphylococcus
DPDGFINFCHEYLLFADKKPNIV

SEQ ID NO: 2006421 - protein, 29 aa, Staphylococcus
DPDGSFYIWFKFSISINVKTLFNESIKEN

SEQ ID NO: 2006422 - protein, 21 aa, Staphylococcus
DPDIAKMCNRYAVPYLPGCGS

SEQ ID NO: 2006423 - protein, 23 aa, Staphylococcus
DPDIMRARLQAVINASIKRSLTL

SEQ ID NO: 2006424 - protein, 24 aa, Staphylococcus
DPDKVLKSHVLIFKHSEGFYWQEH

SEQ ID NO: 2006425 - protein, 23 aa, Staphylococcus
DPDYYKWTQWIFIQLYNKGLAYV

SEQ ID NO: 2006426 - protein, 27 aa, Staphylococcus
DPEAALKICNYCFDKGVVIIAVAGNVL

SEQ ID NO: 2006427 - protein, 17 aa, Staphylococcus
DPEAVKIVFDSEIKIDM

SEQ ID NO: 2006428 - protein, 21 aa, Staphylococcus
DPEELRVHLINKYSIGIIALN

SEQ ID NO: 2006429 - protein, 19 aa, Staphylococcus
DPEMARPSALQAPLESKTA

SEQ ID NO: 2006430 - protein, 18 aa, Staphylococcus
DPEMSWKERARVKNLRKS

SEQ ID NO: 2006431 - protein, 23 aa, Staphylococcus
DPENFKINPEWLKELDKCANRDT

SEQ ID NO: 2006432 - protein, 24 aa, Staphylococcus
DPETKAVVMIGEIGGTAEEEAAEW

SEQ ID NO: 2006433 - protein, 24 aa, Staphylococcus
DPETKAVVMIGEIGGTAEEEAAQW

SEQ ID NO: 2006434 - protein, 22 aa, Staphylococcus
DPEYWKKLFKRYDDWINNFNAC

SEQ ID NO: 2006435 - protein, 23 aa, Staphylococcus
DPEYWKKLFRRYDEWIYNFNACP

SEQ ID NO: 2006436 - protein, 18 aa, Staphylococcus
DPFAPPSKMRCIVARDEA

SEQ ID NO: 2006437 - protein, 25 aa, Staphylococcus
DPFAPPSKMRLIIQRDVAKIPSELL

SEQ ID NO: 2006438 - protein, 21 aa, Staphylococcus
DPFAPPSKMRVIIGKHETEIP

SEQ ID NO: 2006439 - protein, 24 aa, Staphylococcus
DPFDKRVAPSVAREVARAAMETGV

SEQ ID NO: 2006440 - protein, 17 aa, Staphylococcus
DPFGCSFEVYEKTFQNI

SEQ ID NO: 2006441 - protein, 29 aa, Staphylococcus
DPFHRELRLAIETEIKRLNLTLKKTIRVE

SEQ ID NO: 2006442 - protein, 18 aa, Staphylococcus
DPFLCGLKTYVPEQLDIE

SEQ ID NO: 2006443 - protein, 27 aa, Staphylococcus
DPFSKECFKLSAILSKLRIEYKQYISI

SEQ ID NO: 2006444 - protein, 26 aa, Staphylococcus
DPGESFRMECLDWTDGQVANNDDPSD

SEQ ID NO: 2006445 - protein, 23 aa, Staphylococcus
DPHYIEVWGKFTPRGGISIDPYT

SEQ ID NO: 2006446 - protein, 26 aa, Staphylococcus
DPHYIEVWGKFTPRGGISIDPYTNYG

SEQ ID NO: 2006447 - protein, 18 aa, Staphylococcus
DPIKAILLNIKSEEFATI

SEQ ID NO: 2006448 - protein, 25 aa, Staphylococcus
DPIKDLKYDLAHPEILGVFQSLLET

SEQ ID NO: 2006449 - protein, 22 aa, Staphylococcus
DPIKYNLLFERFLNPERVTMPD

SEQ ID NO: 2006450 - protein, 23 aa, Staphylococcus
DPILQIRFHSVLDLAGKTAKDVL

SEQ ID NO: 2006451 - protein, 23 aa, Staphylococcus
DPILQIRFHSVLNLKDKTAKDVL

SEQ ID NO: 2006452 - protein, 18 aa, Staphylococcus
DPKAWDVSMYSYLTIPRG

SEQ ID NO: 2006453 - protein, 28 aa, Staphylococcus
DPKEIIARHSLKVEAGVIAIEKSILINM

SEQ ID NO: 2006454 - protein, 25 aa, Staphylococcus
DPKIFKVVAEYGAEIVLMHNGDGRR

SEQ ID NO: 2006455 - protein, 26 aa, Staphylococcus
DPKLRLKRDLIKEFMDKIIPDLSEDE

SEQ ID NO: 2006456 - protein, 24 aa, Staphylococcus
DPKSGELTYQMFLNGMPVFNKDEL

SEQ ID NO: 2006457 - protein, 18 aa, Staphylococcus
DPKTQFIYVMDTFDFYHY

SEQ ID NO: 2006458 - protein, 20 aa, Staphylococcus
DPKVLAPLFEAFDVKPEAVT

SEQ ID NO: 2006459 - protein, 20 aa, Staphylococcus
DPLEIVQTISRNHCAYPNHE

SEQ ID NO: 2006460 - protein, 20 aa, Staphylococcus
DPLEIVQTISRNHCAYPNHS

SEQ ID NO: 2006461 - protein, 20 aa, Staphylococcus
DPLIFSRAFKRHFNMNPSEY

SEQ ID NO: 2006462 - protein, 22 aa, Staphylococcus
DPLKPYLPELVKMKKLIYPVGD

SEQ ID NO: 2006463 - protein, 30 aa, Staphylococcus
DPLNDVLALAEFERLVLVDSLNDVLVLVES

SEQ ID NO: 2006464 - protein, 22 aa, Staphylococcus
DPLPMELIFKRLDEIPNLRTLS

SEQ ID NO: 2006465 - protein, 21 aa, Staphylococcus
DPLRPRKLLLHKREIEKLGTR

SEQ ID NO: 2006466 - protein, 23 aa, Staphylococcus
DPMKGGCVGAILFEGWGKDEEGA

SEQ ID NO: 2006467 - protein, 29 aa, Staphylococcus
DPNGELQAGCPLCAPEADAATGMVATNSV

SEQ ID NO: 2006468 - protein, 29 aa, Staphylococcus
DPNGELQAGCPLCAPEGDAATGMVATNSV

SEQ ID NO: 2006469 - protein, 18 aa, Staphylococcus
DPNTLVFGPYYRGNNGSE

SEQ ID NO: 2006470 - protein, 35 aa, Staphylococcus
DPNVRLPLWDSEADCKSAIQAFVPFADIIKISDEE

SEQ ID NO: 2006471 - protein, 24 aa, Staphylococcus
DPNYYKWTQWIFIQLYNKGLAYVD

SEQ ID NO: 2006472 - protein, 26 aa, Staphylococcus
DPQKIVRWRAAMFIFDEGGEAQLPAL

SEQ ID NO: 2006473 - protein, 25 aa, Staphylococcus
DPQKIVRWRAAMFIFDEGNEQQLVS

SEQ ID NO: 2006474 - protein, 23 aa, Staphylococcus
DPQLSMDITWSFDVSEEVFDQQF

SEQ ID NO: 2006475 - protein, 23 aa, Staphylococcus
DPQNFKIKPEWLIELDKCANRDT

SEQ ID NO: 2006476 - protein, 17 aa, Staphylococcus
DPRVGFITITDVDLTND

SEQ ID NO: 2006477 - protein, 18 aa, Staphylococcus
DPRVGFLTITDVELTNDL

SEQ ID NO: 2006478 - protein, 18 aa, Staphylococcus
DPSAASFAERVIMLKDGN

SEQ ID NO: 2006479 - protein, 18 aa, Staphylococcus
DPSAASFAQRVIMLKDGD

SEQ ID NO: 2006480 - protein, 21 aa, Staphylococcus
DPSARGAIFGITRGTEKEHFV

SEQ ID NO: 2006481 - protein, 22 aa, Staphylococcus
DPSIKIFTGKAICFNSHDEAVE

SEQ ID NO: 2006482 - protein, 23 aa, Staphylococcus
DPSLRDIKARYVALEDSLIKVVK

SEQ ID NO: 2006483 - protein, 24 aa, Staphylococcus
DPSLRQSIWRELRHLSEEGQTILM

SEQ ID NO: 2006484 - protein, 20 aa, Staphylococcus
DPSSDCPCRYVAHEFIEANY

SEQ ID NO: 2006485 - protein, 21 aa, Staphylococcus
DPSYKQLISYCILENEHDEIL

SEQ ID NO: 2006486 - protein, 21 aa, Staphylococcus
DPSYKQLISYCLLENENDEIL

SEQ ID NO: 2006487 - protein, 21 aa, Staphylococcus
DPSYKQLISYCLLENENGEIL

SEQ ID NO: 2006488 - protein, 18 aa, Staphylococcus
DPTIDIFFQMNGQLRIWN

SEQ ID NO: 2006489 - protein, 17 aa, Staphylococcus
DPTISIKPIPRIKTKPK

SEQ ID NO: 2006490 - protein, 28 aa, Staphylococcus
DPTLRLKRDLLREFIDDVIPELSEEDNI

SEQ ID NO: 2006491 - protein, 22 aa, Staphylococcus
DPVDSYIIWGGVSDIHLMYEER

SEQ ID NO: 2006492 - protein, 26 aa, Staphylococcus
DPVFDSKGGFYFTDFRGYSTNLKGGV

SEQ ID NO: 2006493 - protein, 21 aa, Staphylococcus
DPVGLRFTLNVLYNRYQIPLF

SEQ ID NO: 2006494 - protein, 24 aa, Staphylococcus
DPVHRRYYEHNYKQLVEDLKQIDH

SEQ ID NO: 2006495 - protein, 19 aa, Staphylococcus
DPVLSRVSVHLANYLEIPF

SEQ ID NO: 2006496 - protein, 19 aa, Staphylococcus
DPVVKRVADKYGVSVPQLS

SEQ ID NO: 2006497 - protein, 26 aa, Staphylococcus
DPYASLNPRLKVMDIIAEGIDIHKLA

SEQ ID NO: 2006498 - protein, 20 aa, Staphylococcus
DPYASLNPRLKVMDIVGEGI

SEQ ID NO: 2006499 - protein, 22 aa, Staphylococcus
DPYFAGTKVKWILDNVDGAREK

SEQ ID NO: 2006500 - protein, 20 aa, Staphylococcus
DPYFILRYIQKSIIKAIDMA

SEQ ID NO: 2006501 - protein, 19 aa, Staphylococcus
DPYHGHVWIMDPIDGTANL

SEQ ID NO: 2006502 - protein, 28 aa, Staphylococcus
DPYKVSALLPVAGPKGYGLMMMVDILSG

SEQ ID NO: 2006503 - protein, 23 aa, Staphylococcus
DPYRGVISSIRIIDGVVKAGDKI

SEQ ID NO: 2006504 - protein, 23 aa, Staphylococcus
DPYRGVISSIRIVDGVVKAGDKI

SEQ ID NO: 2006505 - protein, 36 aa, Staphylococcus
DPYYREIRLAIEAEVKRLNLSLKRTIRIDGQQDHID

SEQ ID NO: 2006506 - protein, 25 aa, Staphylococcus
DQAENWLRTTLKAINRELYEMSVEN

SEQ ID NO: 2006507 - protein, 17 aa, Staphylococcus
DQAFVVAVLYKYYTEKV

SEQ ID NO: 2006508 - protein, 20 aa, Staphylococcus
DQAICIGEANPLDSYLNIPR

SEQ ID NO: 2006509 - protein, 23 aa, Staphylococcus
DQAIKQLKIVLSIDSNHVDAIYN

SEQ ID NO: 2006510 - protein, 27 aa, Staphylococcus
DQAKLNMGYRFPTRFGSNDYYALVVLN

SEQ ID NO: 2006511 - protein, 25 aa, Staphylococcus
DQALLRSCPFISNLAQTYQVDIVAG

SEQ ID NO: 2006512 - protein, 17 aa, Staphylococcus
DQAVCIGEANPLESYLN

SEQ ID NO: 2006513 - protein, 24 aa, Staphylococcus
DQEVAGRFKATFHQVQTHFTNVFK

SEQ ID NO: 2006514 - protein, 27 aa, Staphylococcus
DQEVKDRFKATFFEVQDYFTSVFQSLF

SEQ ID NO: 2006515 - protein, 21 aa, Staphylococcus
DQEWRDVRYLYDYNEEELEDL

SEQ ID NO: 2006516 - protein, 22 aa, Staphylococcus
DQFDLHPGQWLILRDIASTSPT

SEQ ID NO: 2006517 - protein, 17 aa, Staphylococcus
DQFGFLLDAFKYGAPPH

SEQ ID NO: 2006518 - protein, 28 aa, Staphylococcus
DQFKACTAPHPYLNFLNYILMEASNAPI

SEQ ID NO: 2006519 - protein, 23 aa, Staphylococcus
DQFLPGRLDKMIDYYERNQEVDI

SEQ ID NO: 2006520 - protein, 27 aa, Staphylococcus
DQFNEPLCVKVGMELFYQTGPGLIQSL

SEQ ID NO: 2006521 - protein, 17 aa, Staphylococcus
DQFQWAEIGYFIHNQYW

SEQ ID NO: 2006522 - protein, 23 aa, Staphylococcus
DQFRKQFKLGRERKISIIKRKCK

SEQ ID NO: 2006523 - protein, 17 aa, Staphylococcus
DQFTFPVPMAKIYQFIE

SEQ ID NO: 2006524 - protein, 25 aa, Staphylococcus
DQHEIAELSYIIWEDMELPIVKNFD

SEQ ID NO: 2006525 - protein, 25 aa, Staphylococcus
DQHRLYKLIWERFVASQMAPAILDT

SEQ ID NO: 2006526 - protein, 17 aa, Staphylococcus
DQICLSPQCGFASTEEG

SEQ ID NO: 2006527 - protein, 22 aa, Staphylococcus
DQIFDLLAVRIIVDSIKDCYAV

SEQ ID NO: 2006528 - protein, 31 aa, Staphylococcus
DQIKIGATVLAGFGPRIVRINDFSLDFKPNE

SEQ ID NO: 2006529 - protein, 27 aa, Staphylococcus
DQIKSTFGIKEVHVIPGDADAQENVKS

SEQ ID NO: 2006530 - protein, 29 aa, Staphylococcus
DQINHMNAWLKPYRRAFNLEEPVVNVTED

SEQ ID NO: 2006531 - protein, 17 aa, Staphylococcus
DQIRCRIRSKGITINDV

SEQ ID NO: 2006532 - protein, 18 aa, Staphylococcus
DQIRCRIRSKGKIIINDV

SEQ ID NO: 2006533 - protein, 24 aa, Staphylococcus
DQKITKIGVFGTFSAGKSSLINAL

SEQ ID NO: 2006534 - protein, 21 aa, Staphylococcus
DQKRLAEQYVHQLEQTIHSEK

SEQ ID NO: 2006535 - protein, 18 aa, Staphylococcus
DQKVIDWLWETQDKTFFD

SEQ ID NO: 2006536 - protein, 21 aa, Staphylococcus
DQKYILKQFIKAMETEKPDLI

SEQ ID NO: 2006537 - protein, 21 aa, Staphylococcus
DQLDITLKVGRLAEVLEGAQR

SEQ ID NO: 2006538 - protein, 24 aa, Staphylococcus
DQLDKCFYKYYGLNKLINILINEK

SEQ ID NO: 2006539 - protein, 17 aa, Staphylococcus
DQLFIMFGVMHEAKDKA

SEQ ID NO: 2006540 - protein, 17 aa, Staphylococcus
DQLIILTAVDYVYINYG

SEQ ID NO: 2006541 - protein, 20 aa, Staphylococcus
DQLKAMGIEAAYLNSSLNKK

SEQ ID NO: 2006542 - protein, 21 aa, Staphylococcus
DQLKAMGIHAAYLNSSLSQKQ

SEQ ID NO: 2006543 - protein, 21 aa, Staphylococcus
DQLKAMGIHAAYLNSSLTQKQ

SEQ ID NO: 2006544 - protein, 24 aa, Staphylococcus
DQLKAMGIKAAFLNSSLTKKQQKE

SEQ ID NO: 2006545 - protein, 24 aa, Staphylococcus
DQLKAMGIKAAYLNSSLTQKQQKE

SEQ ID NO: 2006546 - protein, 20 aa, Staphylococcus
DQLKAMGINAAYINSSLTQK

SEQ ID NO: 2006547 - protein, 20 aa, Staphylococcus
DQLKAMGINAAYLNSSLSQK

SEQ ID NO: 2006548 - protein, 17 aa, Staphylococcus
DQLKQLLIKQLKDNKGN

SEQ ID NO: 2006549 - protein, 26 aa, Staphylococcus
DQLLKLLNDLAMIFLKAAYEEIIKSF

SEQ ID NO: 2006550 - protein, 18 aa, Staphylococcus
DQLLKPTIIHGFGGDLMT

SEQ ID NO: 2006551 - protein, 26 aa, Staphylococcus
DQLMKIGLELPFSMKMNQLLFESSSF

SEQ ID NO: 2006552 - protein, 22 aa, Staphylococcus
DQLPTRGAIIYAISPKPKNAPG

SEQ ID NO: 2006553 - protein, 24 aa, Staphylococcus
DQLRLKSDLIRTFLDKVVPNLNEG

SEQ ID NO: 2006554 - protein, 19 aa, Staphylococcus
DQLVHKIGALGIVNGENLG

SEQ ID NO: 2006555 - protein, 24 aa, Staphylococcus
DQMPEYVRGAFISLEDERFYKHHG

SEQ ID NO: 2006556 - protein, 17 aa, Staphylococcus
DQMPYSHFTQMEGNYEL

SEQ ID NO: 2006557 - protein, 25 aa, Staphylococcus
DQMSEFERMILLRSIDSHWTDHIDT

SEQ ID NO: 2006558 - protein, 22 aa, Staphylococcus
DQMVSFLIGCSFTFEHALLEAG

SEQ ID NO: 2006559 - protein, 22 aa, Staphylococcus
DQNALYIKQWLPTFNNVDSHLL

SEQ ID NO: 2006560 - protein, 18 aa, Staphylococcus
DQNFKAVKVIKANLKNLN

SEQ ID NO: 2006561 - protein, 17 aa, Staphylococcus
DQNFKAVKVIQANLKQL

SEQ ID NO: 2006562 - protein, 24 aa, Staphylococcus
DQNFKRINNSLARLEMPEVDEEAL

SEQ ID NO: 2006563 - protein, 20 aa, Staphylococcus
DQNLPFEIVPGITSGIAAPA

SEQ ID NO: 2006564 - protein, 23 aa, Staphylococcus
DQNQEYFKALGVPESQIYPISYD

SEQ ID NO: 2006565 - protein, 17 aa, Staphylococcus
DQNWKLVGIITSKETID

SEQ ID NO: 2006566 - protein, 35 aa, Staphylococcus
DQPDIFRPQLRALLRASAFGKLNIMFPMVATIQEF

SEQ ID NO: 2006567 - protein, 17 aa, Staphylococcus
DQPRRVSTWGDDKTYWY

SEQ ID NO: 2006568 - protein, 17 aa, Staphylococcus
DQQDIFIDLIFSPIYFN

SEQ ID NO: 2006569 - protein, 22 aa, Staphylococcus
DQQIEGFFSISGFKEDAQDIDE

SEQ ID NO: 2006570 - protein, 19 aa, Staphylococcus
DQQTIDWLWETQDKSFFSS

SEQ ID NO: 2006571 - protein, 21 aa, Staphylococcus
DQRDYEFAKTFDLPIIEVIEG

SEQ ID NO: 2006572 - protein, 18 aa, Staphylococcus
DQRFVVVTDLGADRIITY

SEQ ID NO: 2006573 - protein, 24 aa, Staphylococcus
DQRIFKSAMFYWSDKNNQRINNLK

SEQ ID NO: 2006574 - protein, 23 aa, Staphylococcus
DQRKIIEGFKHLTPNTNQYRTVM

SEQ ID NO: 2006575 - protein, 20 aa, Staphylococcus
DQRPSINLNLIEKAIQQIKA

SEQ ID NO: 2006576 - protein, 24 aa, Staphylococcus
DQRREMIREAAFKLVDNIKNDLKP

SEQ ID NO: 2006577 - protein, 24 aa, Staphylococcus
DQRREMIRQAAFQLVENIKNDIKP

SEQ ID NO: 2006578 - protein, 24 aa, Staphylococcus
DQRREMIRQAAFQLVENIKNDLKP

SEQ ID NO: 2006579 - protein, 25 aa, Staphylococcus
DQRREMIRQAAFRLVDNIKNDIKPR

SEQ ID NO: 2006580 - protein, 25 aa, Staphylococcus
DQRREMIRQAAFRLVENIKNDIKPR

SEQ ID NO: 2006581 - protein, 20 aa, Staphylococcus
DQRRIEWKRVLDMNDRALRH

SEQ ID NO: 2006582 - protein, 21 aa, Staphylococcus
DQRRIEWKRVLDMNDRALRNV

SEQ ID NO: 2006583 - protein, 20 aa, Staphylococcus
DQRRIEWKRVLDMNDRALRY

SEQ ID NO: 2006584 - protein, 18 aa, Staphylococcus
DQSAAWMTTHFDFHSIHD

SEQ ID NO: 2006585 - protein, 25 aa, Staphylococcus
DQSFRRKKLGYSRMLGYTQLDQCRR

SEQ ID NO: 2006586 - protein, 22 aa, Staphylococcus
DQSKFPLQQAVYFDTEKDGRMI

SEQ ID NO: 2006587 - protein, 23 aa, Staphylococcus
DQSKFPLQQAVYFDTEKDGRMIF

SEQ ID NO: 2006588 - protein, 22 aa, Staphylococcus
DQSKFPLQQAVYFDTENDGRMI

SEQ ID NO: 2006589 - protein, 27 aa, Staphylococcus
DQSQLKGRYSIVIFDTYGAITLDNDEM

SEQ ID NO: 2006590 - protein, 19 aa, Staphylococcus
DQSSAWMTTHFDFHSIHDN

SEQ ID NO: 2006591 - protein, 18 aa, Staphylococcus
DQSVFHLHFHLIPRYEND

SEQ ID NO: 2006592 - protein, 23 aa, Staphylococcus
DQSVFHLHFHLIPRYENDIDGFG

SEQ ID NO: 2006593 - protein, 23 aa, Staphylococcus
DQSVFHLHFHLLPRYENDVDGFG

SEQ ID NO: 2006594 - protein, 24 aa, Staphylococcus
DQTAIPLLLGLGLDEFSMSATSIL

SEQ ID NO: 2006595 - protein, 19 aa, Staphylococcus
DQTGESWAISAHQNGPNVI

SEQ ID NO: 2006596 - protein, 24 aa, Staphylococcus
DQTILGYIPLHWHNDLQLMVVTCG

SEQ ID NO: 2006597 - protein, 20 aa, Staphylococcus
DQTLFRFIFHIEKGSLRIEK

SEQ ID NO: 2006598 - protein, 25 aa, Staphylococcus
DQTVLPIEMNERIYVIRKDDITAVS

SEQ ID NO: 2006599 - protein, 26 aa, Staphylococcus
DQVAQWFKHVCDIDLYPSHASVMTAL

SEQ ID NO: 2006600 - protein, 18 aa, Staphylococcus
DQVHVMYGGKVVKTGGPE

SEQ ID NO: 2006601 - protein, 26 aa, Staphylococcus
DQVIKKDGHWWVRFKYVQPGSSDKDF

SEQ ID NO: 2006602 - protein, 18 aa, Staphylococcus
DQVLKMVIENKVVSKNGK

SEQ ID NO: 2006603 - protein, 18 aa, Staphylococcus
DQWYSGIVNPIIEQRHIF

SEQ ID NO: 2006604 - protein, 19 aa, Staphylococcus
DQYLPSRIDAMIQTYENHE

SEQ ID NO: 2006605 - protein, 30 aa, Staphylococcus
DQYPKLAHLNLKWYAVPIISNMDLKIGGII

SEQ ID NO: 2006606 - protein, 24 aa, Staphylococcus
DQYRQAVNVAIQFLSYRKRTDHEV

SEQ ID NO: 2006607 - protein, 22 aa, Staphylococcus
DRAAKISGARFVYLTRDGAQLE

SEQ ID NO: 2006608 - protein, 21 aa, Staphylococcus
DRAEGNIEFIIMVIEDGSYAM

SEQ ID NO: 2006609 - protein, 33 aa, Staphylococcus; identical to SEQ ID NO: 1803549

SEQ ID NO: 2006610 - protein, 18 aa, Staphylococcus
DRAENVMIVDLLRNDIAR

SEQ ID NO: 2006611 - protein, 26 aa, Staphylococcus
DRAIRIQAKIASLVTAFSRVREGKEP

SEQ ID NO: 2006612 - protein, 25 aa, Staphylococcus
DRARLKDIIEIFLDSGLGKEAFSII

SEQ ID NO: 2006613 - protein, 25 aa, Staphylococcus
DRDAHLRSGDFLDVENNPEIKFEIT

SEQ ID NO: 2006614 - protein, 21 aa, Staphylococcus
DRDEALILFPFAGGGANIYRH

SEQ ID NO: 2006615 - protein, 20 aa, Staphylococcus
DRDEFELGKELLVQVRKRQL

SEQ ID NO: 2006616 - protein, 24 aa, Staphylococcus
DRDELKALFQLAGFKNVEVKSFTG

SEQ ID NO: 2006617 - protein, 23 aa, Staphylococcus
DRDYWLKRVGHFLTAPEIPTMAV

SEQ ID NO: 2006618 - protein, 24 aa, Staphylococcus
DREIDRGVCLFGPHRDDLGFNVNS

SEQ ID NO: 2006619 - protein, 24 aa, Staphylococcus
DRERFEARKACLLEIRDQINTVYN

SEQ ID NO: 2006620 - protein, 18 aa, Staphylococcus
DRESLDILIGYDGDIDQA

SEQ ID NO: 2006621 - protein, 22 aa, Staphylococcus
DREYIPGIKFFTTDKGESIINY

SEQ ID NO: 2006622 - protein, 23 aa, Staphylococcus
DRFFKKGNLQFVILKMLEEESRH

SEQ ID NO: 2006623 - protein, 23 aa, Staphylococcus
DRFFKKGNLQFVILKMLKEESRH

SEQ ID NO: 2006624 - protein, 25 aa, Staphylococcus
DRFNDYPVEVERLLEMVEIKIHALH

SEQ ID NO: 2006625 - protein, 36 aa, Staphylococcus
DRFREILKRFYYFSIANPSPFKWLDSLVDPYENDEK

SEQ ID NO: 2006626 - protein, 17 aa, Staphylococcus
DRFRNRIMFPLKNAQGR

SEQ ID NO: 2006627 - protein, 23 aa, Staphylococcus
DRFSKATPLSAVFSPQFLMEIDW

SEQ ID NO: 2006628 - protein, 25 aa, Staphylococcus
DRGIPRGFRHMHGFGSHTYSLVNDQ

SEQ ID NO: 2006629 - protein, 17 aa, Staphylococcus
DRGRALEPLDLIKNLAL

SEQ ID NO: 2006630 - protein, 26 aa, Staphylococcus
DRGVEFKIATPIVACNEKGFVVKIND

SEQ ID NO: 2006631 - protein, 21 aa, Staphylococcus
DRGYEGNYLFNGDNYKKASDN

SEQ ID NO: 2006632 - protein, 17 aa, Staphylococcus
DRHEPLTLLAALAPVTK

SEQ ID NO: 2006633 - protein, 17 aa, Staphylococcus
DRHETKDLLGFASVYEN

SEQ ID NO: 2006634 - protein, 17 aa, Staphylococcus
DRHLPSDVLATLKQDHW

SEQ ID NO: 2006635 - protein, 29 aa, Staphylococcus
DRHVKLRMFICWGAQFALNYRYGIQKRMF

SEQ ID NO: 2006636 - protein, 21 aa, Staphylococcus
DRIAFMRIVSGAFERGMDVKL

SEQ ID NO: 2006637 - protein, 17 aa, Staphylococcus
DRIAGFTPIPAMSMLSY

SEQ ID NO: 2006638 - protein, 18 aa, Staphylococcus
DRIAGFTPIPAMSMVSYA

SEQ ID NO: 2006639 - protein, 20 aa, Staphylococcus
DRIARSGVALSKIAYNKIGL

SEQ ID NO: 2006640 - protein, 18 aa, Staphylococcus
DRIILRMATFEILHSDTP

SEQ ID NO: 2006641 - protein, 18 aa, Staphylococcus
DRIILRMATFELLHSDTP

SEQ ID NO: 2006642 - protein, 19 aa, Staphylococcus
DRIILRMATFELLHSDTPP

SEQ ID NO: 2006643 - protein, 18 aa, Staphylococcus
DRIILRMATFEMLHSDTP

SEQ ID NO: 2006644 - protein, 17 aa, Staphylococcus
DRILERFDDVLTLDDKG

SEQ ID NO: 2006645 - protein, 24 aa, Staphylococcus
DRILPRVDCDIDFEELANEWIDNI

SEQ ID NO: 2006646 - protein, 18 aa, Staphylococcus
DRISRLFEITGLSDLMHV

SEQ ID NO: 2006647 - protein, 17 aa, Staphylococcus
DRITGRMLPGTKLQSGL

SEQ ID NO: 2006648 - protein, 19 aa, Staphylococcus
DRIYVEAFIPIAKHVEVQV

SEQ ID NO: 2006649 - protein, 18 aa, Staphylococcus
DRKARSREPITAKLVANL

SEQ ID NO: 2006650 - protein, 24 aa, Staphylococcus
DRKEIPFDELVLFSSARSAGQTIE

SEQ ID NO: 2006651 - protein, 21 aa, Staphylococcus
DRKGIIVNVVDIFDFEGSFIN

SEQ ID NO: 2006652 - protein, 23 aa, Staphylococcus
DRKGIPFDELVLFSSARSAGKKI

SEQ ID NO: 2006653 - protein, 17 aa, Staphylococcus
DRKGYEWVIQTTKKADV

SEQ ID NO: 2006654 - protein, 18 aa, Staphylococcus
DRKGYEWVIQTTKKAEVG

SEQ ID NO: 2006655 - protein, 19 aa, Staphylococcus
DRKIQAFVNRVERLSGQSF

SEQ ID NO: 2006656 - protein, 22 aa, Staphylococcus
DRKKFDALLAERSLNYQDFCDN

SEQ ID NO: 2006657 - protein, 25 aa, Staphylococcus
DRKNIPFDELVLFSSARSAGKEVEF

SEQ ID NO: 2006658 - protein, 24 aa, Staphylococcus
DRKQAKRLLKTVGLGHYNFNTRVE

SEQ ID NO: 2006659 - protein, 35 aa, Staphylococcus
DRKRSIQSLELIKSLNFDVLVPWVSIKEGPVAYFV

SEQ ID NO: 2006660 - protein, 20 aa, Staphylococcus
DRLAISTGVLTFIPSSSTEH

SEQ ID NO: 2006661 - protein, 33 aa, Staphylococcus
DRLDAIGAIGIARAFQFAGHFNEPMWTELPTSS

SEQ ID NO: 2006662 - protein, 21 aa, Staphylococcus
DRLDAIGAIGIARTFQFAGHF

SEQ ID NO: 2006663 - protein, 19 aa, Staphylococcus
DRLELSIKNNWFDDNGDIF

SEQ ID NO: 2006664 - protein, 20 aa, Staphylococcus
DRLFIYELLKSSKINNKILS

SEQ ID NO: 2006665 - protein, 19 aa, Staphylococcus
DRLGWIEGDKGVWNYTLFI

SEQ ID NO: 2006666 - protein, 25 aa, Staphylococcus
DRLICDWLKIVDDILPRLIQEMHTD

SEQ ID NO: 2006667 - protein, 28 aa, Staphylococcus
DRLIRRSHHQRFLIVFSDGEPSAYNYSQ

SEQ ID NO: 2006668 - protein, 24 aa, Staphylococcus
DRLKAKMKEAFVEKAVAINDISDT

SEQ ID NO: 2006669 - protein, 25 aa, Staphylococcus
DRLKTKASFNFFSLFTFTEPIEQVV

SEQ ID NO: 2006670 - protein, 20 aa, Staphylococcus
DRLNNIISFEQHKVWRKHVM

SEQ ID NO: 2006671 - protein, 21 aa, Staphylococcus
DRLSEDIKRNFYIGVKTDDNQ

SEQ ID NO: 2006672 - protein, 19 aa, Staphylococcus
DRMGYRLIGDNIPPDNGAD

SEQ ID NO: 2006673 - protein, 18 aa, Staphylococcus
DRNFYKKNIQKFEAANGP

SEQ ID NO: 2006674 - protein, 19 aa, Staphylococcus
DRNTLLAMREFLINSQDDE

SEQ ID NO: 2006675 - protein, 20 aa, Staphylococcus
DRPFEFPAFKIKETQLSKQF

SEQ ID NO: 2006676 - protein, 21 aa, Staphylococcus
DRPHHHPRFALNEEAFEMAFD

SEQ ID NO: 2006677 - protein, 24 aa, Staphylococcus
DRPIRPLFPKGYRHDVQIINMVLS

SEQ ID NO: 2006678 - protein, 24 aa, Staphylococcus
DRPIRPLFPKGYRHDVQIMNIVLS

SEQ ID NO: 2006679 - protein, 30 aa, Staphylococcus
DRPLHFETYISLTCQKCPDVVQALNLMSLL

SEQ ID NO: 2006680 - protein, 21 aa, Staphylococcus
DRPVGRCWLVQASKLKWVFKF

SEQ ID NO: 2006681 - protein, 22 aa, Staphylococcus
DRPYESWQWDGNFVKMDTLAVD

SEQ ID NO: 2006682 - protein, 35 aa, Staphylococcus
DRQLFYQFIMRLPDEVFRLKGFVKFKDQSDSTYEF

SEQ ID NO: 2006683 - protein, 19 aa, Staphylococcus
DRQLRRVITSTARMDGLLN

SEQ ID NO: 2006684 - protein, 18 aa, Staphylococcus
DRQSLDILIGYDGSLDET

SEQ ID NO: 2006685 - protein, 21 aa, Staphylococcus
DRSAAYAARYVAKNIVAAELA

SEQ ID NO: 2006686 - protein, 18 aa, Staphylococcus
DRSAQFVCVISMSTPGEE

SEQ ID NO: 2006687 - protein, 23 aa, Staphylococcus
DRSEQFFKSLGFEINKNPEMLDK

SEQ ID NO: 2006688 - protein, 17 aa, Staphylococcus
DRSGTGLAFTRNPVTGE

SEQ ID NO: 2006689 - protein, 19 aa, Staphylococcus
DRSNYALSFSKMTFPHQMM

SEQ ID NO: 2006690 - protein, 20 aa, Staphylococcus
DRTILELLYATGMRVSELIQ

SEQ ID NO: 2006691 - protein, 20 aa, Staphylococcus
DRTILELLYATGMRVTELIQ

SEQ ID NO: 2006692 - protein, 20 aa, Staphylococcus
DRTKIEIGRIYKLNDGTENY

SEQ ID NO: 2006693 - protein, 21 aa, Staphylococcus
DRTMLELLYATGMRVSEIIQL

SEQ ID NO: 2006694 - protein, 21 aa, Staphylococcus
DRTMLELLYATGMRVSEVIQI

SEQ ID NO: 2006695 - protein, 17 aa, Staphylococcus
DRTRASLKIQEGCNNFC

SEQ ID NO: 2006696 - protein, 23 aa, Staphylococcus
DRVAIKWPNDIYIGKKKICGFLT

SEQ ID NO: 2006697 - protein, 20 aa, Staphylococcus
DRVEKIRLGNGFDETTEMGP

SEQ ID NO: 2006698 - protein, 26 aa, Staphylococcus
DRVEPPCVYYYKCGGCQMQHMTYQAQ

SEQ ID NO: 2006699 - protein, 18 aa, Staphylococcus
DRVFLCEIFGSIRENTGE

SEQ ID NO: 2006700 - protein, 20 aa, Staphylococcus
DRVGEVITRTWQVAHRMKEQ

SEQ ID NO: 2006701 - protein, 17 aa, Staphylococcus
DRVGKIKLGNGFDDDTE

SEQ ID NO: 2006702 - protein, 19 aa, Staphylococcus
DRVIIELLYATGIRVSELV

SEQ ID NO: 2006703 - protein, 19 aa, Staphylococcus
DRVILELLYATGIRVSELV

SEQ ID NO: 2006704 - protein, 20 aa, Staphylococcus
DRVILELLYSTGIRVSELVH

SEQ ID NO: 2006705 - protein, 19 aa, Staphylococcus
DRVILELLYSTGMRVSELV

SEQ ID NO: 2006706 - protein, 17 aa, Staphylococcus
DRVKLAMMASFKNKTLL

SEQ ID NO: 2006707 - protein, 24 aa, Staphylococcus
DRVMLGHLHHPFSIESNFINYSGS

SEQ ID NO: 2006708 - protein, 19 aa, Staphylococcus
DRVNTCLNTLSFLKKHASK

SEQ ID NO: 2006709 - protein, 21 aa, Staphylococcus
DRVPSIEKVRMVSSGTEATLD

SEQ ID NO: 2006710 - protein, 18 aa, Staphylococcus
DRVSKIKIGNGFDQDTEM

SEQ ID NO: 2006711 - protein, 32 aa, Staphylococcus
DRVSPKLPILKKGHRYLFKFNFQVEPEGAAYF

SEQ ID NO: 2006712 - protein, 22 aa, Staphylococcus
DRYDVGEKLGFVKTTIEYALKD

SEQ ID NO: 2006713 - protein, 23 aa, Staphylococcus
DRYDVGEKLGFVKTTIEYALKDE

SEQ ID NO: 2006714 - protein, 19 aa, Staphylococcus
DRYFPDWHATYSRVAELNK

SEQ ID NO: 2006715 - protein, 23 aa, Staphylococcus
DRYLSDTQLEFIFKNHLKANSLI

SEQ ID NO: 2006716 - protein, 39 aa, Staphylococcus
DRYPNIKIILAHAGGTLPYLTWRINQCYELIEQTMDNSK

SEQ ID NO: 2006717 - protein, 19 aa, Staphylococcus
DRYQLPVIMLTARDALSDK

SEQ ID NO: 2006718 - protein, 17 aa, Staphylococcus
DRYRLNINLEENAQVTL

SEQ ID NO: 2006719 - protein, 17 aa, Staphylococcus
DSAFCKGTVRTFDTELQ

SEQ ID NO: 2006720 - protein, 18 aa, Staphylococcus
DSAFCKGTVRTFDTEVQS

SEQ ID NO: 2006721 - protein, 17 aa, Staphylococcus
DSAFCKGTVRTFDTKLQ

SEQ ID NO: 2006722 - protein, 21 aa, Staphylococcus
DSAFKEEIFGPVLPIVTYSEF

SEQ ID NO: 2006723 - protein, 19 aa, Staphylococcus
DSAHYRFVGPSVMQPQSTD

SEQ ID NO: 2006724 - protein, 25 aa, Staphylococcus
DSAIKCARAGATVVHLHARDPETGG

SEQ ID NO: 2006725 - protein, 23 aa, Staphylococcus
DSAKAYRLGKVNPETQYALDYFK

SEQ ID NO: 2006726 - protein, 18 aa, Staphylococcus
DSAQGRDEYALTDSTVED

SEQ ID NO: 2006727 - protein, 25 aa, Staphylococcus
DSARAKKLLASFGLGDYKLDTNVEF

SEQ ID NO: 2006728 - protein, 21 aa, Staphylococcus
DSASIRRDFSYFGELGKKGYG

SEQ ID NO: 2006729 - protein, 24 aa, Staphylococcus
DSAYLIDLLENFVVERGVYGKRWL

SEQ ID NO: 2006730 - protein, 25 aa, Staphylococcus
DSCFMFKARFKTMRDVESFIDTIQK

SEQ ID NO: 2006731 - protein, 26 aa, Staphylococcus
DSCGDCTICVDRCPTGALVGDGQLNS

SEQ ID NO: 2006732 - protein, 27 aa, Staphylococcus
DSCGDCTICVDRCPTGALVGDGQLNSQ

SEQ ID NO: 2006733 - protein, 26 aa, Staphylococcus
DSCGDCTICVDRCPTGALVGNGQLNS

SEQ ID NO: 2006734 - protein, 22 aa, Staphylococcus
DSDARGAFFGLTRGTEKEHFIR

SEQ ID NO: 2006735 - protein, 23 aa, Staphylococcus
DSDCFKLSALISKLRIEYNQYIR

SEQ ID NO: 2006736 - protein, 19 aa, Staphylococcus
DSDVPIDLVARVFEATIQA

SEQ ID NO: 2006737 - protein, 26 aa, Staphylococcus
DSEAALKICNYCFEHGVVIIAVAGNV

SEQ ID NO: 2006738 - protein, 28 aa, Staphylococcus
DSEAFAKFFKLMLNQGINLAPSKFEAWF

SEQ ID NO: 2006739 - protein, 25 aa, Staphylococcus
DSEERLKAGLLYTLEEECIKQGHTY

SEQ ID NO: 2006740 - protein, 19 aa, Staphylococcus
DSEFKRIMIDISDKSVFES

SEQ ID NO: 2006741 - protein, 23 aa, Staphylococcus
DSEGFKDIRDILGQVYETAEELD

SEQ ID NO: 2006742 - protein, 21 aa, Staphylococcus
DSEIALGKGIRNHRDEMVIST

SEQ ID NO: 2006743 - protein, 24 aa, Staphylococcus
DSEIKRPLRKGAKPFNVMMTPSDK

SEQ ID NO: 2006744 - protein, 21 aa, Staphylococcus
DSEIVYLAFHIYHFQSQNNTQ

SEQ ID NO: 2006745 - protein, 25 aa, Staphylococcus
DSELCIELDPGMAFGTGDHPTTSMC

SEQ ID NO: 2006746 - protein, 24 aa, Staphylococcus
DSEMCIELDPGMAFGTGDHPTTSM

SEQ ID NO: 2006747 - protein, 26 aa, Staphylococcus
DSENFKIGKFYAFKYDSKLVIHDILS

SEQ ID NO: 2006748 - protein, 23 aa, Staphylococcus
DSENFKMKIVFLPESTKTQEWLI

SEQ ID NO: 2006749 - protein, 21 aa, Staphylococcus
DSEPLCELIYASADPYLRSEQ

SEQ ID NO: 2006750 - protein, 18 aa, Staphylococcus
DSEQLLNVWNKLGAGTPL

SEQ ID NO: 2006751 - protein, 31 aa, Staphylococcus
DSEVKCITPADIIASMSYFFNLLSGIGYTDD

SEQ ID NO: 2006752 - protein, 29 aa, Staphylococcus
DSEVKCITPADIISSMSYFFNLLAGIGYT

SEQ ID NO: 2006753 - protein, 25 aa, Staphylococcus
DSEYGVKIYDVFTILYLLQPQAFNV

SEQ ID NO: 2006754 - protein, 26 aa, Staphylococcus
DSFELSRTKVLASIRKLVNQDRVSKV

SEQ ID NO: 2006755 - protein, 24 aa, Staphylococcus
DSFEYPMSFIMTKLLNTHDYRPQI

SEQ ID NO: 2006756 - protein, 19 aa, Staphylococcus
DSFGLTILEAMKYGTPVIT

SEQ ID NO: 2006757 - protein, 21 aa, Staphylococcus
DSFKSLQKGVQMVHESLLRAL

SEQ ID NO: 2006758 - protein, 32 aa, Staphylococcus
DSFSLEMWGGATFDVAYNFLKENPWKRLERLR

SEQ ID NO: 2006759 - protein, 24 aa, Staphylococcus
DSFSQVRWMGVLYLKNETPQSLKK

SEQ ID NO: 2006760 - protein, 17 aa, Staphylococcus
DSFYYNRFKHFKDRVLV

SEQ ID NO: 2006761 - protein, 32 aa, Staphylococcus
DSFYYNRYRHFKDRVLVPLAYIKFDEYIEELQ

SEQ ID NO: 2006762 - protein, 22 aa, Staphylococcus
DSGDIIDIFLEIQVQEVLEPIK

SEQ ID NO: 2006763 - protein, 21 aa, Staphylococcus
DSGFDGYFLIAANPVDILTRY

SEQ ID NO: 2006764 - protein, 24 aa, Staphylococcus
DSGIGRAVAILFAKEGANVAIGYY

SEQ ID NO: 2006765 - protein, 26 aa, Staphylococcus
DSGISRMLATFDWKYNNNPPKDEDYW

SEQ ID NO: 2006766 - protein, 19 aa, Staphylococcus
DSGTARFRRVFAEQNSLDE

SEQ ID NO: 2006767 - protein, 25 aa, Staphylococcus
DSGVLVCTVIGFPLGATTTATKIFE

SEQ ID NO: 2006768 - protein, 25 aa, Staphylococcus
DSGYRIGYGGGYFDKFISTYNQLTM

SEQ ID NO: 2006769 - protein, 18 aa, Staphylococcus
DSHGKLKARAMLIHDKPL

SEQ ID NO: 2006770 - protein, 22 aa, Staphylococcus
DSHYRLYGIFLLNQLNGKEILI

SEQ ID NO: 2006771 - protein, 25 aa, Staphylococcus
DSIAKRLKLSPIIKKILESKQIIEE

SEQ ID NO: 2006772 - protein, 18 aa, Staphylococcus
DSIDRKLPDLSERERKVI

SEQ ID NO: 2006773 - protein, 23 aa, Staphylococcus
DSIDRKLPGLSERERKIISKHTK

SEQ ID NO: 2006774 - protein, 19 aa, Staphylococcus
DSIDRKLPHLSERERKVIS

SEQ ID NO: 2006775 - protein, 18 aa, Staphylococcus
DSIHLADLVSYFENKKEK

SEQ ID NO: 2006776 - protein, 19 aa, Staphylococcus
DSIIEGRVVRLTDFGAFVE

SEQ ID NO: 2006777 - protein, 24 aa, Staphylococcus
DSIKDCYAVLGLVHTLWKPMPGRF

SEQ ID NO: 2006778 - protein, 26 aa, Staphylococcus
DSIKKRLESVIKVPIYTLGTTSLGQY

SEQ ID NO: 2006779 - protein, 20 aa, Staphylococcus
DSILKAIKLIKVLDDAKLLD

SEQ ID NO: 2006780 - protein, 22 aa, Staphylococcus
DSILKAIRLVKALDEAKILDLM

SEQ ID NO: 2006781 - protein, 26 aa, Staphylococcus
DSILKERKLLITIAYKLLMDHHTYTL

SEQ ID NO: 2006782 - protein, 25 aa, Staphylococcus
DSISICGMGGPLIAKILTEGQAKLS

SEQ ID NO: 2006783 - protein, 26 aa, Staphylococcus
DSITICGMGGPLIASIIEKGKSKLQN

SEQ ID NO: 2006784 - protein, 17 aa, Staphylococcus
DSIVIPEVGSFLILHQG

SEQ ID NO: 2006785 - protein, 21 aa, Staphylococcus
DSKFYACLNEIVNVYMDAQQG

SEQ ID NO: 2006786 - protein, 19 aa, Staphylococcus
DSKGFSFAINDILVIIEDV

SEQ ID NO: 2006787 - protein, 27 aa, Staphylococcus
DSKGKWKNKEIIDFGKIIGKDYIEGKF

SEQ ID NO: 2006788 - protein, 19 aa, Staphylococcus
DSKGPKAVADWVREQNDVL

SEQ ID NO: 2006789 - protein, 24 aa, Staphylococcus
DSKIKTVLHGLNFNEDDFNKPIND

SEQ ID NO: 2006790 - protein, 25 aa, Staphylococcus
DSKKVDGFILLYSKENDPIFQLLVN

SEQ ID NO: 2006791 - protein, 33 aa, Staphylococcus
DSKPDWVIFQLIAKRMGFDWNYSHPSEIMDEIA

SEQ ID NO: 2006792 - protein, 23 aa, Staphylococcus
DSKQIAELCYIIWHDMELDIVQE

SEQ ID NO: 2006793 - protein, 22 aa, Staphylococcus
DSKRIEKDEMVLIRKKESQYNM

SEQ ID NO: 2006794 - protein, 23 aa, Staphylococcus
DSKSISFGLAYQIQRLVELVNTN

SEQ ID NO: 2006795 - protein, 24 aa, Staphylococcus
DSKSISFGLGYQIKYLSEIINKGY

SEQ ID NO: 2006796 - protein, 23 aa, Staphylococcus
DSKSISFGLGYQIQRLVELINTN

SEQ ID NO: 2006797 - protein, 25 aa, Staphylococcus
DSKSISFGLGYQVQHIVDWNNTGLS

SEQ ID NO: 2006798 - protein, 19 aa, Staphylococcus
DSKSNRWLTALTIDENKTG

SEQ ID NO: 2006799 - protein, 20 aa, Staphylococcus
DSKSSGFDWFKRKSNKKDVY

SEQ ID NO: 2006800 - protein, 21 aa, Staphylococcus
DSKVIFCEADDWKTFYETNQS

SEQ ID NO: 2006801 - protein, 18 aa, Staphylococcus
DSLEIERLYILKNYQNYG

SEQ ID NO: 2006802 - protein, 25 aa, Staphylococcus
DSLGRLLCAAAIGISKDTDIRAEKL

SEQ ID NO: 2006803 - protein, 20 aa, Staphylococcus
DSLGYLTHRYHFKQEGVNGM

SEQ ID NO: 2006804 - protein, 19 aa, Staphylococcus
DSLIPPFIAVPGLGENVAQ

SEQ ID NO: 2006805 - protein, 17 aa, Staphylococcus
DSLKGKDLQPVIIGNGN

SEQ ID NO: 2006806 - protein, 18 aa, Staphylococcus
DSLKRAVVDVAKQAYNDN

SEQ ID NO: 2006807 - protein, 28 aa, Staphylococcus
DSLRQVSRIPLSLTFDHQILDGAGAAEF

SEQ ID NO: 2006808 - protein, 19 aa, Staphylococcus
DSLVLARLSTQVVESCKAH

SEQ ID NO: 2006809 - protein, 21 aa, Staphylococcus
DSMCLLHLLLNEYQHTYSKLT

SEQ ID NO: 2006810 - protein, 25 aa, Staphylococcus
DSMLFRGVHYEICCIDEKGYEWVIQ

SEQ ID NO: 2006811 - protein, 23 aa, Staphylococcus
DSMLFRGVHYEINCIDRKGYEWM

SEQ ID NO: 2006812 - protein, 27 aa, Staphylococcus
DSNKDPELCVLKVIPKSIKLMNDKDLD

SEQ ID NO: 2006813 - protein, 17 aa, Staphylococcus
DSNKFKSTLKDFDLPTS

SEQ ID NO: 2006814 - protein, 18 aa, Staphylococcus
DSNLKGSLFGLSLQTKHE

SEQ ID NO: 2006815 - protein, 20 aa, Staphylococcus
DSNLPALFWQNGAYATQLET

SEQ ID NO: 2006816 - protein, 17 aa, Staphylococcus
DSNLPVIAVQFMAENVI

SEQ ID NO: 2006817 - protein, 26 aa, Staphylococcus
DSNRGGCCQSCRWDYDLLAVDEEGEL

SEQ ID NO: 2006818 - protein, 25 aa, Staphylococcus
DSNRGGCCQSCRWDYDLLEVDEDGE

SEQ ID NO: 2006819 - protein, 25 aa, Staphylococcus
DSNRGGCCQSCRWDYDLLEVDNDGE

SEQ ID NO: 2006820 - protein, 25 aa, Staphylococcus
DSNRGGCCQSCRWDYDLLHIESDGE

SEQ ID NO: 2006821 - protein, 25 aa, Staphylococcus
DSNRGGCCQSCRWDYDLLQVDEDGE

SEQ ID NO: 2006822 - protein, 25 aa, Staphylococcus
DSNRGGCCQSCRWDYDLLQVDNDGE

SEQ ID NO: 2006823 - protein, 26 aa, Staphylococcus
DSNRGGCCQSCRWDYDLLSIDQDGDL

SEQ ID NO: 2006824 - protein, 19 aa, Staphylococcus
DSNTWIYKKMPTISQWTED

SEQ ID NO: 2006825 - protein, 18 aa, Staphylococcus
DSPDAWVVAGRGELHLSI

SEQ ID NO: 2006826 - protein, 35 aa, Staphylococcus
DSPKYIYEYMMKRYPNYEFIWVFKNPSKVQIPGLA

SEQ ID NO: 2006827 - protein, 20 aa, Staphylococcus
DSPVKYTQHIGGTRHFNYAT

SEQ ID NO: 2006828 - protein, 19 aa, Staphylococcus
DSPVKYTQHIGGTRHFNYD

SEQ ID NO: 2006829 - protein, 19 aa, Staphylococcus
DSQEMRPLIVMSPKSLLRN

SEQ ID NO: 2006830 - protein, 23 aa, Staphylococcus
DSQKRLIIIGGAGSLYVDKAHTE

SEQ ID NO: 2006831 - protein, 30 aa, Staphylococcus
DSRKLSPLRFKEIMHLFDIPILEEVQNAQQ

SEQ ID NO: 2006832 - protein, 20 aa, Staphylococcus
DSRLENIRQLTDFDCSFTIL

SEQ ID NO: 2006833 - protein, 21 aa, Staphylococcus
DSRLFFKRRQQFIEMMQDKGF

SEQ ID NO: 2006834 - protein, 31 aa, Staphylococcus
DSSCVGCGQCATVCPCNAMLEVNMEGNAGYM

SEQ ID NO: 2006835 - protein, 17 aa, Staphylococcus
DSSIERIGDIAYYQELA

SEQ ID NO: 2006836 - protein, 23 aa, Staphylococcus
DSSKMRFADSWLVTTKFKLPKWL

SEQ ID NO: 2006837 - protein, 21 aa, Staphylococcus
DSSLMAMQFMLTAKAYGYDTN

SEQ ID NO: 2006838 - protein, 22 aa, Staphylococcus
DSSLMAMQFMLVAKSHGYDTNP

SEQ ID NO: 2006839 - protein, 17 aa, Staphylococcus
DSSYWRDIAFGVGEGER

SEQ ID NO: 2006840 - protein, 17 aa, Staphylococcus
DSTAHGFELMFDKMNAV

SEQ ID NO: 2006841 - protein, 17 aa, Staphylococcus
DSTAHGFENMFVKLQDI

SEQ ID NO: 2006842 - protein, 23 aa, Staphylococcus
DSTKIIIVTTFKRPGYFEKAVAN

SEQ ID NO: 2006843 - protein, 17 aa, Staphylococcus
DSTVHGFELMFDKMNQV

SEQ ID NO: 2006844 - protein, 20 aa, Staphylococcus
DSTYPYISFIPLNDEVSLSL

SEQ ID NO: 2006845 - protein, 24 aa, Staphylococcus
DSVEAGFVKNAKFKPYFEQLEILE

SEQ ID NO: 2006846 - protein, 20 aa, Staphylococcus
DSVIDFGSFFADYGGETADE

SEQ ID NO: 2006847 - protein, 18 aa, Staphylococcus
DSVKYVEREGFTFVGEQI

SEQ ID NO: 2006848 - protein, 25 aa, Staphylococcus
DSVLKRMRRKYSMAHFSERLMKLHE

SEQ ID NO: 2006849 - protein, 23 aa, Staphylococcus
DSVLKRMRRKYTMEHFSERLSKL

SEQ ID NO: 2006850 - protein, 24 aa, Staphylococcus
DSVLKRMRRKYTMEHFSERLTELH

SEQ ID NO: 2006851 - protein, 17 aa, Staphylococcus
DSVRNQGKAFYRIHLEI

SEQ ID NO: 2006852 - protein, 18 aa, Staphylococcus
DSYIKWTYNELTSESIER

SEQ ID NO: 2006853 - protein, 25 aa, Staphylococcus
DSYIPYPVEVEVGGATVFVMPIDAF

SEQ ID NO: 2006854 - protein, 24 aa, Staphylococcus
DSYIPYPVEVEVGGATVFVMPVDA

SEQ ID NO: 2006855 - protein, 24 aa, Staphylococcus
DSYIPYPVEVEVGGATVFVMPVEK

SEQ ID NO: 2006856 - protein, 25 aa, Staphylococcus
DSYIPYPVEVEVGGATVFVMPVESF

SEQ ID NO: 2006857 - protein, 17 aa, Staphylococcus
DSYPIDQMRGLNNEIID

SEQ ID NO: 2006858 - protein, 19 aa, Staphylococcus
DSYPIMKYIQPIRKQIKSP

SEQ ID NO: 2006859 - protein, 19 aa, Staphylococcus
DSYTRRIYAKLGYTQTETY

SEQ ID NO: 2006860 - protein, 23 aa, Staphylococcus
DSYTRRLYAKLGYTNTDSYDKFK

SEQ ID NO: 2006861 - protein, 24 aa, Staphylococcus
DSYTRRLYHKLGYQQTASYDKLKQ

SEQ ID NO: 2006862 - protein, 19 aa, Staphylococcus
DSYTRRLYSKLGYAHTESY

SEQ ID NO: 2006863 - protein, 23 aa, Staphylococcus
DTADFPYTIRIVSEVLESNGSSS

SEQ ID NO: 2006864 - protein, 20 aa, Staphylococcus
DTAEKVKHQYGHAFYNSASD

SEQ ID NO: 2006865 - protein, 25 aa, Staphylococcus
DTARFKYELGAEFGIAPESVNASII

SEQ ID NO: 2006866 - protein, 20 aa, Staphylococcus
DTASHFVLIFARKNVTSQSE

SEQ ID NO: 2006867 - protein, 18 aa, Staphylococcus
DTASHFVLILARKNVTSQ

SEQ ID NO: 2006868 - protein, 18 aa, Staphylococcus
DTCRIWDKDSGTNFDKDV

SEQ ID NO: 2006869 - protein, 19 aa, Staphylococcus
DTDAIIVYTLVKPEIKKYM

SEQ ID NO: 2006870 - protein, 21 aa, Staphylococcus
DTDIANTVAFLASDKAKYITG

SEQ ID NO: 2006871 - protein, 21 aa, Staphylococcus
DTDIANTVAFLASEKAKYITG

SEQ ID NO: 2006872 - protein, 17 aa, Staphylococcus
DTDLKLYMDARRYRGNP

SEQ ID NO: 2006873 - protein, 17 aa, Staphylococcus
DTDLYYEKMIELVKPLG

SEQ ID NO: 2006874 - protein, 26 aa, Staphylococcus
DTDVLVCTVIGFPLGATTTDVKVFET

SEQ ID NO: 2006875 - protein, 26 aa, Staphylococcus
DTEHFGISVMVGFGYRAEEPAHGKVR

SEQ ID NO: 2006876 - protein, 21 aa, Staphylococcus
DTEHIEYIISQWLKIDDVEVT

SEQ ID NO: 2006877 - protein, 24 aa, Staphylococcus
DTEIYVCGGVNFLQSIITTLKEME

SEQ ID NO: 2006878 - protein, 24 aa, Staphylococcus
DTELPQNVTICSGLIKSDKYEWML

SEQ ID NO: 2006879 - protein, 17 aa, Staphylococcus
DTEYTGGFVEGEQQTFP

SEQ ID NO: 2006880 - protein, 19 aa, Staphylococcus
DTFDHCLEEALAYTKENEM

SEQ ID NO: 2006881 - protein, 22 aa, Staphylococcus
DTFIGAFVSGFGVSKMNLVEAI

SEQ ID NO: 2006882 - protein, 18 aa, Staphylococcus
DTFIGAFVSQLNKDLSNL

SEQ ID NO: 2006883 - protein, 26 aa, Staphylococcus
DTFIYCLKGEVVLMLGNQNYYATTGD

SEQ ID NO: 2006884 - protein, 34 aa, Staphylococcus
DTFKSRVEKSIKDWGIELTDTYYVSKFEHPENQI

SEQ ID NO: 2006885 - protein, 24 aa, Staphylococcus
DTFKSRVEKSINEWDIDLQHIYYV

SEQ ID NO: 2006886 - protein, 20 aa, Staphylococcus
DTFPNLKTTIKWNQPMFTDH

SEQ ID NO: 2006887 - protein, 19 aa, Staphylococcus
DTFRPIRLDRYFADWHETY

SEQ ID NO: 2006888 - protein, 27 aa, Staphylococcus
DTFVPAICYNESMGPIQTCDTCMVEID

SEQ ID NO: 2006889 - protein, 18 aa, Staphylococcus
DTGAYLFVDDLKNLQKSG

SEQ ID NO: 2006890 - protein, 24 aa, Staphylococcus
DTGELKGAMGAEKVFDSYLAGKKG

SEQ ID NO: 2006891 - protein, 30 aa, Staphylococcus
DTGRIIAYRSSGGFGVRLDAGDGFQGAEIS

SEQ ID NO: 2006892 - protein, 26 aa, Staphylococcus
DTGVSFAFQGCEHINRAVTIEREDFN

SEQ ID NO: 2006893 - protein, 24 aa, Staphylococcus
DTHLPEFFERASFAPDGQDPSMIE

SEQ ID NO: 2006894 - protein, 17 aa, Staphylococcus
DTICIYVAIGQKDSTVR

SEQ ID NO: 2006895 - protein, 19 aa, Staphylococcus
DTIDLGVGIVLNKKVGDTV

SEQ ID NO: 2006896 - protein, 22 aa, Staphylococcus
DTIHKGRFILDKHITSNEDGTY

SEQ ID NO: 2006897 - protein, 31 aa, Staphylococcus
DTIIYKVHLMKECLERGIKMISSMGAANKTD

SEQ ID NO: 2006898 - protein, 30 aa, Staphylococcus
DTIIYKVHLMKECLNRGINLISSMGAANKI

SEQ ID NO: 2006899 - protein, 33 aa, Staphylococcus
DTIKIGGTVLSGFGPRIVRINNFSLDFKPNQYQ

SEQ ID NO: 2006900 - protein, 30 aa, Staphylococcus
DTIKLGGSNIKFGVNGMEYYYSVDNNEIVD

SEQ ID NO: 2006901 - protein, 32 aa, Staphylococcus
DTIMYKIHLMKECLKRDVKLISSMGAANKTDP

SEQ ID NO: 2006902 - protein, 31 aa, Staphylococcus
DTIMYKVHLMKECLDRGISVISSMGAANKTD

SEQ ID NO: 2006903 - protein, 19 aa, Staphylococcus
DTISFDRLLVATGRQPNIE

SEQ ID NO: 2006904 - protein, 20 aa, Staphylococcus
DTITFPAFVYSGDATVVPEG

SEQ ID NO: 2006905 - protein, 30 aa, Staphylococcus
DTKPRGLFRKKKFSPVVGDIVDFEVQNEQE

SEQ ID NO: 2006906 - protein, 23 aa, Staphylococcus
DTKTFRGNRPFTFTNLKTDNGLD

SEQ ID NO: 2006907 - protein, 20 aa, Staphylococcus
DTLCFYDIGSAEMNLDLAIE

SEQ ID NO: 2006908 - protein, 31 aa, Staphylococcus
DTLEAVRIFYCLQKNNCCFIPVSNDTPLNRV

SEQ ID NO: 2006909 - protein, 25 aa, Staphylococcus
DTLFKHVPVKAGDFFYVPAGTVHAI

SEQ ID NO: 2006910 - protein, 17 aa, Staphylococcus
DTLKCLYDMDVQIESVN

SEQ ID NO: 2006911 - protein, 30 aa, Staphylococcus
DTLLLRESRIYYSYRMDELIVSYLLQSYIE

SEQ ID NO: 2006912 - protein, 19 aa, Staphylococcus
DTLPTPFAQIKGQFHENDV

SEQ ID NO: 2006913 - protein, 30 aa, Staphylococcus
DTLSRYCFDKAFLGMNGLDLKYGLTTPDEK

SEQ ID NO: 2006914 - protein, 19 aa, Staphylococcus
DTLTFLSWMKNINHYPNII

SEQ ID NO: 2006915 - protein, 28 aa, Staphylococcus
DTLVKLKTSGRMVGIISHVSELKQRIPL

SEQ ID NO: 2006916 - protein, 22 aa, Staphylococcus
DTMALPPCHTMFQFYVQDGKLS

SEQ ID NO: 2006917 - protein, 24 aa, Staphylococcus
DTMALPPCHTMFQFYVQNGKLSCQ

SEQ ID NO: 2006918 - protein, 22 aa, Staphylococcus
DTMSQIRWLSVLDLKDKTEDQL

SEQ ID NO: 2006919 - protein, 26 aa, Staphylococcus
DTNKWFYKEMPALEQWFKDMTSQYEL

SEQ ID NO: 2006920 - protein, 20 aa, Staphylococcus
DTPEAVILSGFDPIRREIAR

SEQ ID NO: 2006921 - protein, 17 aa, Staphylococcus
DTPFTYDYMHLINEIYV

SEQ ID NO: 2006922 - protein, 24 aa, Staphylococcus
DTPGEIVMKILAFDSDLAKIDRVS

SEQ ID NO: 2006923 - protein, 17 aa, Staphylococcus
DTPKEERKGFFARLFNL

SEQ ID NO: 2006924 - protein, 19 aa, Staphylococcus
DTQEMRPLIVMSPKSLLRN

SEQ ID NO: 2006925 - protein, 18 aa, Staphylococcus
DTQFCNAVRVGISLYGYY

SEQ ID NO: 2006926 - protein, 24 aa, Staphylococcus
DTQIKEAAAHIFLCSADHAGCTAE

SEQ ID NO: 2006927 - protein, 24 aa, Staphylococcus
DTQLRLTVVNEMAWHNLFAHNMFI

SEQ ID NO: 2006928 - protein, 20 aa, Staphylococcus
DTRAVFKIGGVGLAFKKGKF

SEQ ID NO: 2006929 - protein, 21 aa, Staphylococcus
DTRGAYQILKWAYDQYDDELV

SEQ ID NO: 2006930 - protein, 25 aa, Staphylococcus
DTRKGAEVLKYIRHVDLSNLHLRLA

SEQ ID NO: 2006931 - protein, 23 aa, Staphylococcus
DTRLPGMKVVLEFKQLNKQQTEV

SEQ ID NO: 2006932 - protein, 20 aa, Staphylococcus
DTRSIFKIGGIGLAFKKGKF

SEQ ID NO: 2006933 - protein, 18 aa, Staphylococcus
DTSDLIKKCEGFTEEVIK

SEQ ID NO: 2006934 - protein, 17 aa, Staphylococcus
DTSIKFNALIEDKNIAY

SEQ ID NO: 2006935 - protein, 17 aa, Staphylococcus
DTSIQFGPRSFKLPVVP

SEQ ID NO: 2006936 - protein, 26 aa, Staphylococcus
DTSQLFSFFIGYHFNKFELTFEKLFI

SEQ ID NO: 2006937 - protein, 21 aa, Staphylococcus
DTSRFYQYWLDHVDEDIKEAK

SEQ ID NO: 2006938 - protein, 21 aa, Staphylococcus
DTSRFYQYWLDHVEEDLKVVK

SEQ ID NO: 2006939 - protein, 22 aa, Staphylococcus
DTSVAVKWLIDKGYDVVAVCLD

SEQ ID NO: 2006940 - protein, 17 aa, Staphylococcus
DTTGEWLPQETLDAIEE

SEQ ID NO: 2006941 - protein, 18 aa, Staphylococcus
DTTLIAPAVIKWIETFSE

SEQ ID NO: 2006942 - protein, 24 aa, Staphylococcus
DTTMPAFWFDPIVNLTAISQVTNH

SEQ ID NO: 2006943 - protein, 24 aa, Staphylococcus
DTTSFPTLDVFNWLQQQGNISTDE

SEQ ID NO: 2006944 - protein, 28 aa, Staphylococcus
DTTYGKLGVKVWIYRGEVLPTKNNSEGG

SEQ ID NO: 2006945 - protein, 28 aa, Staphylococcus
DTTYGKLGVKVWIYRGEVLPTTKNTSEG

SEQ ID NO: 2006946 - protein, 17 aa, Staphylococcus
DTVEVGQAIAIVGEGKG

SEQ ID NO: 2006947 - protein, 25 aa, Staphylococcus
DTVHIKNIILQWLKLDVEVERISVD

SEQ ID NO: 2006948 - protein, 20 aa, Staphylococcus
DTVIRFAPPLIITKEEIDDA

SEQ ID NO: 2006949 - protein, 18 aa, Staphylococcus
DTVIRFAPPLVISKEELD

SEQ ID NO: 2006950 - protein, 24 aa, Staphylococcus
DTVKAPTIKAVFNYYLQGYGYKKI

SEQ ID NO: 2006951 - protein, 26 aa, Staphylococcus
DTVKHALAIGKGRPGVLHGSKMYLIQ

SEQ ID NO: 2006952 - protein, 23 aa, Staphylococcus
DTVLKRMRRKYTMEHFSERIMKL

SEQ ID NO: 2006953 - protein, 24 aa, Staphylococcus
DTVLKRMRRKYTMEHFSERITKLH

SEQ ID NO: 2006954 - protein, 23 aa, Staphylococcus
DTVLKRMRRKYTMEHFSERLTKL

SEQ ID NO: 2006955 - protein, 20 aa, Staphylococcus
DTVMLGHLHHPFSIQSDYVF

SEQ ID NO: 2006956 - protein, 28 aa, Staphylococcus
DTVYNIPFLWRLTSELNVNQLQRSLSQL

SEQ ID NO: 2006957 - protein, 24 aa, Staphylococcus
DTWFSSALWPFSTLGWPDVDAEDF

SEQ ID NO: 2006958 - protein, 24 aa, Staphylococcus
DTWFSSALWPFSTLGWPNESADDF

SEQ ID NO: 2006959 - protein, 24 aa, Staphylococcus
DTWFSSALWPFSTLGWPNIDADDF

SEQ ID NO: 2006960 - protein, 19 aa, Staphylococcus
DTWLFHQFLNAVPIDAQVI

SEQ ID NO: 2006961 - protein, 20 aa, Staphylococcus
DTWLFHQFLNAVPLDAQIVF

SEQ ID NO: 2006962 - protein, 22 aa, Staphylococcus
DTYCGIGTIGLYMAENAKHVYG

SEQ ID NO: 2006963 - protein, 22 aa, Staphylococcus
DTYCGIGTIGLYMAPKAKHVYG

SEQ ID NO: 2006964 - protein, 19 aa, Staphylococcus
DTYCGIGTIGLYMAPQAKH

SEQ ID NO: 2006965 - protein, 23 aa, Staphylococcus
DTYCGIGTIGLYMAPVAKHVYGV

SEQ ID NO: 2006966 - protein, 19 aa, Staphylococcus
DTYHLLGKKEFETMKDSAL

SEQ ID NO: 2006967 - protein, 22 aa, Staphylococcus
DTYKTLTCVHVNHGLRAQSVEE

SEQ ID NO: 2006968 - protein, 19 aa, Staphylococcus
DVAIVYKPKGMVVHPSAGH

SEQ ID NO: 2006969 - protein, 19 aa, Staphylococcus
DVAIVYKPKGMVVHPSPGH

SEQ ID NO: 2006970 - protein, 21 aa, Staphylococcus
DVAIYGLDFFKEHDVEALQKN

SEQ ID NO: 2006971 - protein, 19 aa, Staphylococcus
DVAKSILIERGHRSSYKRF

SEQ ID NO: 2006972 - protein, 19 aa, Staphylococcus
DVALFAEMGLKCLRTSIAW

SEQ ID NO: 2006973 - protein, 17 aa, Staphylococcus
DVAMKWFQRQRLYSKQD

SEQ ID NO: 2006974 - protein, 24 aa, Staphylococcus
DVATFTLAVNRNFKSKNGEQQADF

SEQ ID NO: 2006975 - protein, 19 aa, Staphylococcus
DVAVKMINGILGKIPFFGI

SEQ ID NO: 2006976 - protein, 19 aa, Staphylococcus
DVCFIPIGDNFTMGIDDAS

SEQ ID NO: 2006977 - protein, 19 aa, Staphylococcus
DVCFIPIGDNFTMGIEDAS

SEQ ID NO: 2006978 - protein, 19 aa, Staphylococcus
DVCFIPIGDNYTMGIDDAS

SEQ ID NO: 2006979 - protein, 17 aa, Staphylococcus
DVCFVPIGDNFTMGIDD

SEQ ID NO: 2006980 - protein, 18 aa, Staphylococcus
DVCFVPIGDNFTMGIDDA

SEQ ID NO: 2006981 - protein, 23 aa, Staphylococcus
DVDEKQKLVGMLPDSEIFLSNTS

SEQ ID NO: 2006982 - protein, 25 aa, Staphylococcus
DVDFGVALCGTGVGISASADKVPGT

SEQ ID NO: 2006983 - protein, 23 aa, Staphylococcus
DVDGRYGTFAKAFMKDNKPVFAI

SEQ ID NO: 2006984 - protein, 22 aa, Staphylococcus
DVDIRWLDAYQVIRDDEQLNDG

SEQ ID NO: 2006985 - protein, 22 aa, Staphylococcus
DVDKIYFTSHMDTVVPGVNIQP

SEQ ID NO: 2006986 - protein, 18 aa, Staphylococcus
DVDLFIKPYIKLSKDVFP

SEQ ID NO: 2006987 - protein, 32 aa, Staphylococcus
DVDMLRMCGYPWKTKQRILSDMGHVSNEDAGR

SEQ ID NO: 2006988 - protein, 19 aa, Staphylococcus
DVDNEIYGFIVIDQNQSEW

SEQ ID NO: 2006989 - protein, 19 aa, Staphylococcus
DVEAYRLWHEDIGLEESRI

SEQ ID NO: 2006990 - protein, 25 aa, Staphylococcus
DVEFYPVLVGTAFKNKGVQLMLNAV

SEQ ID NO: 2006991 - protein, 21 aa, Staphylococcus
DVEGLNIFPGNIIPIQSPYPV

SEQ ID NO: 2006992 - protein, 17 aa, Staphylococcus
DVEHRWTVEYEAKTNQD

SEQ ID NO: 2006993 - protein, 24 aa, Staphylococcus
DVEIPRPFPRMTYNEAMERYGSDK

SEQ ID NO: 2006994 - protein, 19 aa, Staphylococcus
DVELKSMVDTGVLSDRAVA

SEQ ID NO: 2006995 - protein, 18 aa, Staphylococcus
DVELPKYDGFYWCRQIRH

SEQ ID NO: 2006996 - protein, 25 aa, Staphylococcus
DVEQLLKLKAWHDAQMEQLENKTSR

SEQ ID NO: 2006997 - protein, 19 aa, Staphylococcus
DVESAEGIVEWVGDYNSLL

SEQ ID NO: 2006998 - protein, 17 aa, Staphylococcus
DVFDAWLSTDLAKSLNC

SEQ ID NO: 2006999 - protein, 24 aa, Staphylococcus
DVFEGIEIYNYLKSLSNHITIEVT

SEQ ID NO: 2007000 - protein, 18 aa, Staphylococcus
DVFFTEFTNTASFCHPEG

SEQ ID NO: 2007001 - protein, 20 aa, Staphylococcus
DVFIPGKLVDYVVVNTNPKL

SEQ ID NO: 2007002 - protein, 19 aa, Staphylococcus
DVFKLRHHHDAVLTGSGTL

SEQ ID NO: 2007003 - protein, 25 aa, Staphylococcus
DVFKQRDSMNWNKMTEGIKHLPAKK

SEQ ID NO: 2007004 - protein, 24 aa, Staphylococcus
DVFKSTGISDVFSKVAAPTLIIAG

SEQ ID NO: 2007005 - protein, 23 aa, Staphylococcus
DVFQAELPFSWVYDENGVTETMQ

SEQ ID NO: 2007006 - protein, 17 aa, Staphylococcus
DVFSGKSARGINNEFVE

SEQ ID NO: 2007007 - protein, 20 aa, Staphylococcus
DVFSGVTIYNMLRRFDAHIT

SEQ ID NO: 2007008 - protein, 17 aa, Staphylococcus
DVGGRYSVLTAVGLLPI

SEQ ID NO: 2007009 - protein, 23 aa, Staphylococcus
DVGVSGIHRLFAHIESIRQSKVS

SEQ ID NO: 2007010 - protein, 25 aa, Staphylococcus
DVHIIKWSKLYLDQFQSSWTMPKRE

SEQ ID NO: 2007011 - protein, 24 aa, Staphylococcus
DVHQPDLAIVFGRTKRRVDELTSA

SEQ ID NO: 2007012 - protein, 18 aa, Staphylococcus
DVHVFPIALGTNAVGGHN

SEQ ID NO: 2007013 - protein, 28 aa, Staphylococcus
DVIKEGIPAKARRKGGHPAKRIFQAIRI

SEQ ID NO: 2007014 - protein, 19 aa, Staphylococcus
DVIKFLKYFTFLDKDEINR

SEQ ID NO: 2007015 - protein, 19 aa, Staphylococcus
DVIKFLKYFTFLNKEEIER

SEQ ID NO: 2007016 - protein, 19 aa, Staphylococcus
DVIKYLKFFTFLDKEEIDF

SEQ ID NO: 2007017 - protein, 24 aa, Staphylococcus
DVILRRSVDILQQWIEQKKGPFAP

SEQ ID NO: 2007018 - protein, 18 aa, Staphylococcus
DVILYDRLVNPLILQYAK

SEQ ID NO: 2007019 - protein, 18 aa, Staphylococcus
DVILYDRLVNPLILQYSS

SEQ ID NO: 2007020 - protein, 37 aa, Staphylococcus
DVINIKGLELKAGDTIKFDGIHTFRNGLNIDAYNVSR

SEQ ID NO: 2007021 - protein, 18 aa, Staphylococcus
DVIPSYRAIMINFNNDSI

SEQ ID NO: 2007022 - protein, 19 aa, Staphylococcus
DVIQPRLDKILDEGMQHGK

SEQ ID NO: 2007023 - protein, 17 aa, Staphylococcus
DVITYAAIDFMKMDYYA

SEQ ID NO: 2007024 - protein, 17 aa, Staphylococcus
DVITYEFENISANQLQA

SEQ ID NO: 2007025 - protein, 17 aa, Staphylococcus
DVITYFINYLFTGYEVL

SEQ ID NO: 2007026 - protein, 18 aa, Staphylococcus
DVITYFINYLFTGYEVLN

SEQ ID NO: 2007027 - protein, 23 aa, Staphylococcus
DVKAATQSLKWAVDEMEKRYKLF

SEQ ID NO: 2007028 - protein, 20 aa, Staphylococcus
DVKASHGYKQVIIETDKSMP

SEQ ID NO: 2007029 - protein, 21 aa, Staphylococcus
DVKKPMVLYGHMSPYMIVGML

SEQ ID NO: 2007030 - protein, 25 aa, Staphylococcus
DVKQRLKSKWSRIEALAGAKPRVEA

SEQ ID NO: 2007031 - protein, 25 aa, Staphylococcus
DVKRMPFIGLQWIFARKGAAASNHF

SEQ ID NO: 2007032 - protein, 21 aa, Staphylococcus
DVKSIEWLASYIKNNDSATVI

SEQ ID NO: 2007033 - protein, 20 aa, Staphylococcus
DVKSLPLLLMYGTEDRVADI

SEQ ID NO: 2007034 - protein, 24 aa, Staphylococcus
DVKYYFKEINAFGNDCKFRNCNHI

SEQ ID NO: 2007035 - protein, 27 aa, Staphylococcus
DVLCCYRLNRLHRNLKNALKLMKLCQT

SEQ ID NO: 2007036 - protein, 17 aa, Staphylococcus
DVLCLNRYYGWYTQSGD

SEQ ID NO: 2007037 - protein, 25 aa, Staphylococcus
DVLDDVKAILGFHNYPTLNIGEFAI

SEQ ID NO: 2007038 - protein, 17 aa, Staphylococcus
DVLDGKFLVITRKDASS

SEQ ID NO: 2007039 - protein, 22 aa, Staphylococcus
DVLDRSDYALSFSKMTFPHQMM

SEQ ID NO: 2007040 - protein, 27 aa, Staphylococcus
DVLDTWFSSALWPFSTLGWPDTESEDF

SEQ ID NO: 2007041 - protein, 17 aa, Staphylococcus
DVLEKFDNAVILFMGAG

SEQ ID NO: 2007042 - protein, 25 aa, Staphylococcus
DVLGLDWRISIIQAQSMGISKTLQG

SEQ ID NO: 2007043 - protein, 24 aa, Staphylococcus
DVLGLDWRTSILQADQLGVNKTLQ

SEQ ID NO: 2007044 - protein, 17 aa, Staphylococcus
DVLGLRLVKKTVNQDDI

SEQ ID NO: 2007045 - protein, 17 aa, Staphylococcus
DVLGPVLGKAIREMEDG

SEQ ID NO: 2007046 - protein, 20 aa, Staphylococcus
DVLIVMSHCGIFFDRKLCEE

SEQ ID NO: 2007047 - protein, 18 aa, Staphylococcus
DVLKEVLSFTESDELVES

SEQ ID NO: 2007048 - protein, 18 aa, Staphylococcus
DVLKKQWANEALPDKMPE

SEQ ID NO: 2007049 - protein, 21 aa, Staphylococcus
DVLKNRARHDAILTGAGTVEA

SEQ ID NO: 2007050 - protein, 19 aa, Staphylococcus
DVLKRCYKNEFDAWIPKIK

SEQ ID NO: 2007051 - protein, 18 aa, Staphylococcus
DVLLKSWDIFTLEDKADF

SEQ ID NO: 2007052 - protein, 17 aa, Staphylococcus
DVLLMVYLSGYKNANII

SEQ ID NO: 2007053 - protein, 21 aa, Staphylococcus
DVLLRRARHAITENARVKEAH

SEQ ID NO: 2007054 - protein, 23 aa, Staphylococcus
DVLNRSNYALSFSKMTFPHQMMR

SEQ ID NO: 2007055 - protein, 24 aa, Staphylococcus
DVLQARLNLMPQIHDELEAQIKEQ

SEQ ID NO: 2007056 - protein, 27 aa, Staphylococcus
DVLSNTDTIVWGRKTYEMMYDDYWPTV

SEQ ID NO: 2007057 - protein, 23 aa, Staphylococcus
DVLTRSNYALSFSKMTFPHQMMR

SEQ ID NO: 2007058 - protein, 17 aa, Staphylococcus
DVLVERLVRIESDTLAE

SEQ ID NO: 2007059 - protein, 20 aa, Staphylococcus
DVLVPLQMLVLFNKTIFKDE

SEQ ID NO: 2007060 - protein, 17 aa, Staphylococcus
DVLYSEAIYLALPPDYA

SEQ ID NO: 2007061 - protein, 20 aa, Staphylococcus
DVMGIPSILVFKNGEKLAHL

SEQ ID NO: 2007062 - protein, 20 aa, Staphylococcus
DVMGIPSLLVFKNGEKLAHL

SEQ ID NO: 2007063 - protein, 25 aa, Staphylococcus
DVMKELDKRNAVVFIHPSAAQADQN

SEQ ID NO: 2007064 - protein, 17 aa, Staphylococcus
DVMKLQWQNKPLPEKMP

SEQ ID NO: 2007065 - protein, 20 aa, Staphylococcus
DVMRFGKYHPDYKRIMMETR

SEQ ID NO: 2007066 - protein, 24 aa, Staphylococcus
DVNAALHYLARLIAAGDLPTIVRR

SEQ ID NO: 2007067 - protein, 20 aa, Staphylococcus
DVNFKVVKDFVKTVSDRALG

SEQ ID NO: 2007068 - protein, 18 aa, Staphylococcus
DVNFKVVKDFVKTVSERA

SEQ ID NO: 2007069 - protein, 20 aa, Staphylococcus
DVNFKVVKDFVKTVSERALG

SEQ ID NO: 2007070 - protein, 17 aa, Staphylococcus
DVNGYPLVIKKLQLWIK

SEQ ID NO: 2007071 - protein, 17 aa, Staphylococcus
DVNLEVGTGEFISLLGA

SEQ ID NO: 2007072 - protein, 19 aa, Staphylococcus
DVNLIMGFVKVFGKGNKER

SEQ ID NO: 2007073 - protein, 20 aa, Staphylococcus
DVNLIMGFVKVFGKGNKERI

SEQ ID NO: 2007074 - protein, 20 aa, Staphylococcus
DVNLIMGFVRVFGKGSKERI

SEQ ID NO: 2007075 - protein, 18 aa, Staphylococcus
DVPAGIMTKCPKCKKIMY

SEQ ID NO: 2007076 - protein, 19 aa, Staphylococcus
DVPGKLVVVGGGYIGSELG

SEQ ID NO: 2007077 - protein, 23 aa, Staphylococcus
DVPKLYFTSHMDTVVPGLDIKPH

SEQ ID NO: 2007078 - protein, 23 aa, Staphylococcus
DVPKNPKRAIVFDYGAVDVLKAF

SEQ ID NO: 2007079 - protein, 22 aa, Staphylococcus
DVPLAGDRFVIFKDEKQARRIG

SEQ ID NO: 2007080 - protein, 22 aa, Staphylococcus
DVPLAGDRFVVFSDEKQARRIG

SEQ ID NO: 2007081 - protein, 18 aa, Staphylococcus
DVPLDVRTSEVFDLEGYN

SEQ ID NO: 2007082 - protein, 22 aa, Staphylococcus
DVPQAGDRFVIFKDEKQARRIG

SEQ ID NO: 2007083 - protein, 18 aa, Staphylococcus
DVPQAGDRFVIFSDEKQA

SEQ ID NO: 2007084 - protein, 18 aa, Staphylococcus
DVPQIIWHGLPLTEAFLF

SEQ ID NO: 2007085 - protein, 24 aa, Staphylococcus
DVPSELPDGLTLGCIPDREIPLDA

SEQ ID NO: 2007086 - protein, 19 aa, Staphylococcus
DVPSMPFAPPLEDEFMINP

SEQ ID NO: 2007087 - protein, 22 aa, Staphylococcus
DVPTFAICHGPLLLVDTDDLKG

SEQ ID NO: 2007088 - protein, 25 aa, Staphylococcus
DVPTFKTNPILVTGISFSPNTKEIK

SEQ ID NO: 2007089 - protein, 27 aa, Staphylococcus
DVQAAILKWPMSVIRLKGEDLDEMTEA

SEQ ID NO: 2007090 - protein, 18 aa, Staphylococcus
DVQARYTYLTANGGFVTV

SEQ ID NO: 2007091 - protein, 17 aa, Staphylococcus
DVQGSVEALAASLMKID

SEQ ID NO: 2007092 - protein, 17 aa, Staphylococcus
DVQRYGLNVTEFAVMEL

SEQ ID NO: 2007093 - protein, 25 aa, Staphylococcus
DVQSFPTPAVFDWLQKEGNIETEEM

SEQ ID NO: 2007094 - protein, 17 aa, Staphylococcus
DVQTICIGMAASMGSFL

SEQ ID NO: 2007095 - protein, 23 aa, Staphylococcus
DVQYKEHIGVVFDDLRVPNKLTL

SEQ ID NO: 2007096 - protein, 19 aa, Staphylococcus
DVREYLPFESLILDLNQPF

SEQ ID NO: 2007097 - protein, 31 aa, Staphylococcus
DVRLEFYRLYLLMVHLVKFGEMYAGSVDRSM

SEQ ID NO: 2007098 - protein, 19 aa, Staphylococcus
DVRLKLCLIDILKSNHLIQ

SEQ ID NO: 2007099 - protein, 23 aa, Staphylococcus
DVRSKGKAFYRLTVNIDSDITLS

SEQ ID NO: 2007100 - protein, 23 aa, Staphylococcus
DVSAKWFFDRFSPITQIKAVGHA

SEQ ID NO: 2007101 - protein, 23 aa, Staphylococcus
DVSGKWFFDRFSPVTNIKAVGNA

SEQ ID NO: 2007102 - protein, 24 aa, Staphylococcus
DVSGKWFFDRFSPVTNIKAVGNAD

SEQ ID NO: 2007103 - protein, 24 aa, Staphylococcus
DVSGKWFFDRFSPVTQIKAIGNAD

SEQ ID NO: 2007104 - protein, 18 aa, Staphylococcus
DVSGRGGTNFVDIENERR

SEQ ID NO: 2007105 - protein, 25 aa, Staphylococcus
DVSGTIEGRVLWKAKSFSIRGGDKM

SEQ ID NO: 2007106 - protein, 28 aa, Staphylococcus
DVSIAFMSGNFVMRGEPALFNKFIRTQM

SEQ ID NO: 2007107 - protein, 23 aa, Staphylococcus
DVSLLKMELLVWITQTETGDIQE

SEQ ID NO: 2007108 - protein, 20 aa, Staphylococcus
DVSLPIKEVMRIATQQDIDI

SEQ ID NO: 2007109 - protein, 24 aa, Staphylococcus
DVSQLLKLKQWHDAQFQQLQDTAD

SEQ ID NO: 2007110 - protein, 18 aa, Staphylococcus
DVSVKTGLMPAREIVLVI

SEQ ID NO: 2007111 - protein, 19 aa, Staphylococcus
DVTALTLYWTAILILQGNV

SEQ ID NO: 2007112 - protein, 18 aa, Staphylococcus
DVTCHTCNGEGAKPGTNK

SEQ ID NO: 2007113 - protein, 18 aa, Staphylococcus
DVTDIIAAQILYTIKKDG

SEQ ID NO: 2007114 - protein, 19 aa, Staphylococcus
DVTDIIAAQILYTIKKDGP

SEQ ID NO: 2007115 - protein, 19 aa, Staphylococcus
DVTDIIAAQLLYTIKKDGP

SEQ ID NO: 2007116 - protein, 20 aa, Staphylococcus
DVTGKWSWLAPPLSPTLTAN

SEQ ID NO: 2007117 - protein, 20 aa, Staphylococcus
DVTGKWSWLAPPLSPTLTSN

SEQ ID NO: 2007118 - protein, 27 aa, Staphylococcus
DVTIAIMSGQFVMRGEPAVYNKFIRTQ

SEQ ID NO: 2007119 - protein, 25 aa, Staphylococcus
DVTQPLLVKFLWDNLTDQPIGQVKY

SEQ ID NO: 2007120 - protein, 19 aa, Staphylococcus
DVTRFNKKAGREITTSEFI

SEQ ID NO: 2007121 - protein, 17 aa, Staphylococcus
DVTYRLINEEGPAHHRL

SEQ ID NO: 2007122 - protein, 17 aa, Staphylococcus
DVVACCLDVGEGKDLDE

SEQ ID NO: 2007123 - protein, 17 aa, Staphylococcus
DVVACCLDVGEGKDLDV

SEQ ID NO: 2007124 - protein, 17 aa, Staphylococcus
DVVACCLDVGEGKDLEL

SEQ ID NO: 2007125 - protein, 27 aa, Staphylococcus
DVVDQAKLNLGYRFPATYGNVNYYTLV

SEQ ID NO: 2007126 - protein, 27 aa, Staphylococcus
DVVERIKVKPGEFYFIPAGMLHSIGSG

SEQ ID NO: 2007127 - protein, 23 aa, Staphylococcus
DVVIGIRPGRSFDKAKENGFDVY

SEQ ID NO: 2007128 - protein, 18 aa, Staphylococcus
DVVIKREIELLVIAGDIS

SEQ ID NO: 2007129 - protein, 25 aa, Staphylococcus
DVVIMGGNTFRWLLDNNVKENPYEG

SEQ ID NO: 2007130 - protein, 24 aa, Staphylococcus
DVVKRTCGYLGNPVQRPTIEGRHK

SEQ ID NO: 2007131 - protein, 24 aa, Staphylococcus
DVVKRTCGYLGNPVQRPTIEGRQK

SEQ ID NO: 2007132 - protein, 24 aa, Staphylococcus
DVVKRTCGYLGNPVQRPVIEGRHK

SEQ ID NO: 2007133 - protein, 24 aa, Staphylococcus
DVVKYGREILKEGAQSVIISLGGD

SEQ ID NO: 2007134 - protein, 17 aa, Staphylococcus
DVVRMMTIHASKGLEFP

SEQ ID NO: 2007135 - protein, 17 aa, Staphylococcus
DVVRRISGGGAVYHDTG

SEQ ID NO: 2007136 - protein, 25 aa, Staphylococcus
DVVVEISIRIAEAFASEDIDVLYQG

SEQ ID NO: 2007137 - protein, 25 aa, Staphylococcus
DVVVGIRPGHSFDRAKEDGFDVYPV

SEQ ID NO: 2007138 - protein, 26 aa, Staphylococcus
DVYDPRKYLGPAREAIKETVKGKIRE

SEQ ID NO: 2007139 - protein, 18 aa, Staphylococcus
DVYGSWKALEELQENGKI

SEQ ID NO: 2007140 - protein, 19 aa, Staphylococcus
DVYLAGPIQLINRPKHDEF

SEQ ID NO: 2007141 - protein, 22 aa, Staphylococcus
DVYMGAGVIKDAHTVTVNDEAL

SEQ ID NO: 2007142 - protein, 18 aa, Staphylococcus
DVYPEIYLTSFRYEEAKN

SEQ ID NO: 2007143 - protein, 19 aa, Staphylococcus
DVYQCKFLTVATGYYGQHN

SEQ ID NO: 2007144 - protein, 17 aa, Staphylococcus
DVYVLPQLHTLLWSNKK

SEQ ID NO: 2007145 - protein, 19 aa, Staphylococcus
DVYWCTADPGWVTGTSYGI

SEQ ID NO: 2007146 - protein, 35 aa, Staphylococcus
DVYYEREIMIPKHLKGERIVLRFGSVTHHATVYLD

SEQ ID NO: 2007147 - protein, 23 aa, Staphylococcus
DWDQEALELLGISASQLPQLVPT

SEQ ID NO: 2007148 - protein, 20 aa, Staphylococcus
DWEKDLSMIFVVINNQSKKV

SEQ ID NO: 2007149 - protein, 18 aa, Staphylococcus
DWGGDTIFVPLSALSGDG

SEQ ID NO: 2007150 - protein, 18 aa, Staphylococcus
DWGGETIFVPLSALSGEG

SEQ ID NO: 2007151 - protein, 23 aa, Staphylococcus
DWGKRRLAYEINDFSEGYYNIVR

SEQ ID NO: 2007152 - protein, 23 aa, Staphylococcus
DWLEVYNRNGVVTARAVTSHRMP

SEQ ID NO: 2007153 - protein, 17 aa, Staphylococcus
DWMKAYDGECLITHNST

SEQ ID NO: 2007154 - protein, 25 aa, Staphylococcus
DWQGQSYFFPSKVAFITFYLQQIQV

SEQ ID NO: 2007155 - protein, 22 aa, Staphylococcus
DWSKRWPNIEAFENKDDAGALH

SEQ ID NO: 2007156 - protein, 17 aa, Staphylococcus
DWTKLGTSIVDIVDNGV

SEQ ID NO: 2007157 - protein, 23 aa, Staphylococcus
DWVEKLCEFAKTYQVAVTEDEHI

SEQ ID NO: 2007158 - protein, 21 aa, Staphylococcus
DWWACVQEAYQFLKKEGYEVI

SEQ ID NO: 2007159 - protein, 21 aa, Staphylococcus
DYACILLDLMLPELDGIEVAN

SEQ ID NO: 2007160 - protein, 23 aa, Staphylococcus
DYACILLDLMLPEMDGIEMSSKL

SEQ ID NO: 2007161 - protein, 23 aa, Staphylococcus
DYACILLDLMLPEMDGIEVATQL

SEQ ID NO: 2007162 - protein, 24 aa, Staphylococcus
DYAEYGGSVLLGLDGTVVKAHGGS

SEQ ID NO: 2007163 - protein, 23 aa, Staphylococcus
DYAEYGGSVLLGLNGTVVKAHGS

SEQ ID NO: 2007164 - protein, 19 aa, Staphylococcus
DYAGGLMILNEVGGKGTNL

SEQ ID NO: 2007165 - protein, 19 aa, Staphylococcus
DYAPFINFVEDVFLHEGEV

SEQ ID NO: 2007166 - protein, 22 aa, Staphylococcus
DYAQVYPYYGFDKNVGYGTKAH

SEQ ID NO: 2007167 - protein, 18 aa, Staphylococcus
DYARRGAANLALISGDPD

SEQ ID NO: 2007168 - protein, 26 aa, Staphylococcus
DYAVLDAFRILDAVSIPKGAVRSQND

SEQ ID NO: 2007169 - protein, 18 aa, Staphylococcus
DYCGYSFAYEATKNQTQL

SEQ ID NO: 2007170 - protein, 29 aa, Staphylococcus
DYCKQRHIPMAIATSSYREDILPTFKNLG

SEQ ID NO: 2007171 - protein, 22 aa, Staphylococcus
DYCTEHRLPFILFSASGGARMQ

SEQ ID NO: 2007172 - protein, 25 aa, Staphylococcus
DYDALRRHVTFLLENNAQAIIVNGT

SEQ ID NO: 2007173 - protein, 20 aa, Staphylococcus
DYDCYFCIVDQHAITVPQDK

SEQ ID NO: 2007174 - protein, 24 aa, Staphylococcus
DYDEIIQIGITFVRENKIIGTYHS

SEQ ID NO: 2007175 - protein, 24 aa, Staphylococcus
DYDEIIQIGITFVRGQKIVGTYHS

SEQ ID NO: 2007176 - protein, 23 aa, Staphylococcus
DYDEIIQIGITFVRNHKIIDTYH

SEQ ID NO: 2007177 - protein, 22 aa, Staphylococcus
DYDEKRVHFFLELFKNDETLAA

SEQ ID NO: 2007178 - protein, 17 aa, Staphylococcus
DYDELVIGLGCEDKYHN

SEQ ID NO: 2007179 - protein, 20 aa, Staphylococcus
DYDGAAMFRIVKVIEQGSKK

SEQ ID NO: 2007180 - protein, 18 aa, Staphylococcus
DYDKFTVHSAIFKEENNM

SEQ ID NO: 2007181 - protein, 18 aa, Staphylococcus
DYDKGALEYEFERREREE

SEQ ID NO: 2007182 - protein, 24 aa, Staphylococcus
DYEASRLAGMHGIYRENGENEIHT

SEQ ID NO: 2007183 - protein, 26 aa, Staphylococcus
DYEEIKRFINAYNFATVVSIDGEQPV

SEQ ID NO: 2007184 - protein, 18 aa, Staphylococcus
DYEEIPKDNVETVLNNVH

SEQ ID NO: 2007185 - protein, 17 aa, Staphylococcus
DYEFDLGHFRGAIRPDI

SEQ ID NO: 2007186 - protein, 24 aa, Staphylococcus
DYEKFIEMRSLRESLETQNYMHYY

SEQ ID NO: 2007187 - protein, 22 aa, Staphylococcus
DYENLLFYFAYKTFINTADEII

SEQ ID NO: 2007188 - protein, 29 aa, Staphylococcus
DYESIHLVGYCSGGLVALETANILTLQGI

SEQ ID NO: 2007189 - protein, 19 aa, Staphylococcus
DYEYEAGEKQNLYAHDIIY

SEQ ID NO: 2007190 - protein, 24 aa, Staphylococcus
DYFAKGGDMIDTWMNMTPMNRPGV

SEQ ID NO: 2007191 - protein, 17 aa, Staphylococcus
DYFFLNKFLNIIHIEHE

SEQ ID NO: 2007192 - protein, 19 aa, Staphylococcus
DYFFLNKFQHIIDIEHELK

SEQ ID NO: 2007193 - protein, 19 aa, Staphylococcus
DYFFLNKFQNIINIEHELK

SEQ ID NO: 2007194 - protein, 17 aa, Staphylococcus
DYFGKYQPARSCVEVAR

SEQ ID NO: 2007195 - protein, 26 aa, Staphylococcus
DYFKNEAIEFAWEFLTSDKWMGMEPE

SEQ ID NO: 2007196 - protein, 30 aa, Staphylococcus
DYFKQEAIEFAWEFLTSEKWMGMEPEKLYV

SEQ ID NO: 2007197 - protein, 19 aa, Staphylococcus
DYFLIVSDLIHYAKTHNVM

SEQ ID NO: 2007198 - protein, 24 aa, Staphylococcus
DYFLPSVMVAFGYRAEDPKRAKTR

SEQ ID NO: 2007199 - protein, 18 aa, Staphylococcus
DYFMLPKDYLRYRLTGNI

SEQ ID NO: 2007200 - protein, 26 aa, Staphylococcus
DYFTIHAGLLLHYIPLTVDRLTGIVS

SEQ ID NO: 2007201 - protein, 17 aa, Staphylococcus
DYGFPRAHAVSYSKIAY

SEQ ID NO: 2007202 - protein, 18 aa, Staphylococcus
DYGKHVGVNYMLAKDSIQ

SEQ ID NO: 2007203 - protein, 20 aa, Staphylococcus
DYGQKIDILFILGGDGTVNE

SEQ ID NO: 2007204 - protein, 26 aa, Staphylococcus
DYGVLKRPQFFFAYDLDKYGQDLRGF

SEQ ID NO: 2007205 - protein, 23 aa, Staphylococcus
DYGVYRFKRGFNVQIEELIGDFY

SEQ ID NO: 2007206 - protein, 20 aa, Staphylococcus
DYGYNISLGNHFYANFNPVM

SEQ ID NO: 2007207 - protein, 22 aa, Staphylococcus
DYHIAAQILKYFNVQQVNLLSN

SEQ ID NO: 2007208 - protein, 20 aa, Staphylococcus
DYHIPYQFEAPRLGDIKHSC

SEQ ID NO: 2007209 - protein, 21 aa, Staphylococcus
DYHLEGFFAKPEHSRSNKHYI

SEQ ID NO: 2007210 - protein, 17 aa, Staphylococcus
DYHLMVVHPWQFEHILL

SEQ ID NO: 2007211 - protein, 18 aa, Staphylococcus
DYHNAIGHVRYATSGNKG

SEQ ID NO: 2007212 - protein, 25 aa, Staphylococcus
DYIAASFVRRPSDVLDIREILEREN

SEQ ID NO: 2007213 - protein, 17 aa, Staphylococcus
DYIDLYYTHLWDGQTPV

SEQ ID NO: 2007214 - protein, 18 aa, Staphylococcus
DYIFEARKPMGKSFKRAC

SEQ ID NO: 2007215 - protein, 19 aa, Staphylococcus
DYIHLKGHVNLDEIYTQYE

SEQ ID NO: 2007216 - protein, 37 aa, Staphylococcus
DYIKFSEKWFFPLQDFQKFISCFVFLYEKDTKTPYFS

SEQ ID NO: 2007217 - protein, 24 aa, Staphylococcus
DYIKNRITTFPTFMEMLMATYHII

SEQ ID NO: 2007218 - protein, 17 aa, Staphylococcus
DYILEYRTLSKLQSTYV

SEQ ID NO: 2007219 - protein, 20 aa, Staphylococcus
DYIQPRMTMITPIDKSDEEI

SEQ ID NO: 2007220 - protein, 25 aa, Staphylococcus
DYIVNSYPVWFPKAEAEEIIQDMVE

SEQ ID NO: 2007221 - protein, 32 aa, Staphylococcus
DYIVNSYPVWFPKAEAQEIIKDMIELVLENKK

SEQ ID NO: 2007222 - protein, 24 aa, Staphylococcus
DYIVNSYPVWFPKVEAEEIIKDMI

SEQ ID NO: 2007223 - protein, 20 aa, Staphylococcus
DYKALPKVFGGDNVVVHDVK

SEQ ID NO: 2007224 - protein, 25 aa, Staphylococcus
DYKDKPLVCVGILKGSVMFMADLIK

SEQ ID NO: 2007225 - protein, 25 aa, Staphylococcus
DYKDRPLVCVGILKGSVMFMADLIK

SEQ ID NO: 2007226 - protein, 19 aa, Staphylococcus
DYKLMMHKLELHHRQTENS

SEQ ID NO: 2007227 - protein, 21 aa, Staphylococcus
DYKLYYPKEMILNIENPQTKG

SEQ ID NO: 2007228 - protein, 25 aa, Staphylococcus
DYKWNKKLVKFMLVFDTETMSIHDI

SEQ ID NO: 2007229 - protein, 17 aa, Staphylococcus
DYLEPLLSDYVRGLFGE

SEQ ID NO: 2007230 - protein, 19 aa, Staphylococcus
DYLMPEFLRDIFKEKLIQM

SEQ ID NO: 2007231 - protein, 25 aa, Staphylococcus
DYLNHVRYVGALFLGYYSPEVIGDY

SEQ ID NO: 2007232 - protein, 24 aa, Staphylococcus
DYLNRVAAADVWLRNNPLQFEWGG

SEQ ID NO: 2007233 - protein, 20 aa, Staphylococcus
DYLNRVAQADVWLKDNPLEF

SEQ ID NO: 2007234 - protein, 27 aa, Staphylococcus
DYLPEIYKALDAEVLFNKVQMRPGSVT

SEQ ID NO: 2007235 - protein, 27 aa, Staphylococcus
DYLPEIYKAVNAEVLFNKVAMRPGSVT

SEQ ID NO: 2007236 - protein, 27 aa, Staphylococcus
DYLQTRLKINIGFSDIYFYIDFLNDNE

SEQ ID NO: 2007237 - protein, 24 aa, Staphylococcus
DYLREVRRHIGIVFQNPENQFVGS

SEQ ID NO: 2007238 - protein, 18 aa, Staphylococcus
DYLRRFDLPYNQKINQFS

SEQ ID NO: 2007239 - protein, 18 aa, Staphylococcus
DYLSRIQAWCEKFNVKIE

SEQ ID NO: 2007240 - protein, 24 aa, Staphylococcus
DYMKRVAESALWKTDDNAMYDLTS

SEQ ID NO: 2007241 - protein, 18 aa, Staphylococcus
DYMQRFLVTKTFLKSDNK

SEQ ID NO: 2007242 - protein, 23 aa, Staphylococcus
DYMVKPPFFIEWEEREEVHNQKL

SEQ ID NO: 2007243 - protein, 20 aa, Staphylococcus
DYNCYFCIVDQHAITVPQDK

SEQ ID NO: 2007244 - protein, 23 aa, Staphylococcus
DYNHVQSALNFQFIKRMNDVGIP

SEQ ID NO: 2007245 - protein, 23 aa, Staphylococcus
DYNHVQSALNFQFMKQLNQAGVP

SEQ ID NO: 2007246 - protein, 24 aa, Staphylococcus
DYNHVQSALNFQFMKRINEVGIPV

SEQ ID NO: 2007247 - protein, 19 aa, Staphylococcus
DYNPFGIGDYDFIRPEHVN

SEQ ID NO: 2007248 - protein, 18 aa, Staphylococcus
DYNPHFHVLIAVNKSYFT

SEQ ID NO: 2007249 - protein, 21 aa, Staphylococcus
DYNRLRILELLYKGEASVGHI

SEQ ID NO: 2007250 - protein, 22 aa, Staphylococcus
DYNTAWPLAMPVFKMDYAHKEY

SEQ ID NO: 2007251 - protein, 20 aa, Staphylococcus
DYNVAYEIRLQKALESEILC

SEQ ID NO: 2007252 - protein, 24 aa, Staphylococcus
DYPDLEFDFIYWLVSGVKDHEPVL

SEQ ID NO: 2007253 - protein, 24 aa, Staphylococcus
DYPEFKIVDIFSENDFSPNSQALS

SEQ ID NO: 2007254 - protein, 29 aa, Staphylococcus
DYPEKGVRLKAYFNELKFDDSLRNKIKTA

SEQ ID NO: 2007255 - protein, 31 aa, Staphylococcus
DYPKAADVFKHAGIDFCCGGAISIEQASQKS

SEQ ID NO: 2007256 - protein, 26 aa, Staphylococcus
DYPTDSEGWAHCLTIPRELTLENGKL

SEQ ID NO: 2007257 - protein, 22 aa, Staphylococcus
DYPVDSYIIWGGVSSMHLMYEE

SEQ ID NO: 2007258 - protein, 21 aa, Staphylococcus
DYQAGFEIGMRIGQKGLHQVT

SEQ ID NO: 2007259 - protein, 30 aa, Staphylococcus
DYQEMKPLYEWLGLSASLGFVDIPNYEYEE

SEQ ID NO: 2007260 - protein, 23 aa, Staphylococcus
DYQLPLKFLEHVQSGKSNIFSRL

SEQ ID NO: 2007261 - protein, 25 aa, Staphylococcus
DYQPEINRYGGIETIEIIEDYFMYD

SEQ ID NO: 2007262 - protein, 22 aa, Staphylococcus
DYRPNIYSYFGIKKNPNDTVLM

SEQ ID NO: 2007263 - protein, 18 aa, Staphylococcus
DYRPNIYSYFGIQKKPND

SEQ ID NO: 2007264 - protein, 18 aa, Staphylococcus
DYRSKRKQLSIDFHDEQL

SEQ ID NO: 2007265 - protein, 18 aa, Staphylococcus
DYRVKNKRLTVMKRSLKQ

SEQ ID NO: 2007266 - protein, 17 aa, Staphylococcus
DYRVNIIDTPGHVDFTV

SEQ ID NO: 2007267 - protein, 23 aa, Staphylococcus
DYSDLKYQLGLIGKNENEKLLKA

SEQ ID NO: 2007268 - protein, 21 aa, Staphylococcus
DYSKSIPLRRVGKLTDIADLV

SEQ ID NO: 2007269 - protein, 19 aa, Staphylococcus
DYSLKHVYIDKSIDRETGK

SEQ ID NO: 2007270 - protein, 17 aa, Staphylococcus
DYSSIFFDFLVTDNPII

SEQ ID NO: 2007271 - protein, 20 aa, Staphylococcus
DYTAERIFILISFDEKDPTI

SEQ ID NO: 2007272 - protein, 21 aa, Staphylococcus
DYTIIRPAWFTFKNETDYEVT

SEQ ID NO: 2007273 - protein, 20 aa, Staphylococcus
DYTIIRPAWLTFKNETDYEV

SEQ ID NO: 2007274 - protein, 32 aa, Staphylococcus
DYTLKIDLTKPIPYFKQMLAFGTFMPQNEKAV

SEQ ID NO: 2007275 - protein, 18 aa, Staphylococcus
DYTLVSLLHKGGEESGIS

SEQ ID NO: 2007276 - protein, 17 aa, Staphylococcus
DYTLVSLLTKGGEDANV

SEQ ID NO: 2007277 - protein, 18 aa, Staphylococcus
DYTPILWNNEMRAFTGWG

SEQ ID NO: 2007278 - protein, 17 aa, Staphylococcus
DYTYFFNGVKHILKAKD

SEQ ID NO: 2007279 - protein, 18 aa, Staphylococcus
DYTYFFNGVKHILKAKDK

SEQ ID NO: 2007280 - protein, 17 aa, Staphylococcus
DYVKRVIGTPGDSVQYK

SEQ ID NO: 2007281 - protein, 18 aa, Staphylococcus
DYVLDWQGQSYFFPSKVA

SEQ ID NO: 2007282 - protein, 23 aa, Staphylococcus
DYVQRGAANLALLSGDPDLLNGI

SEQ ID NO: 2007283 - protein, 19 aa, Staphylococcus
DYVRYCLTGHIHMEYSDAA

SEQ ID NO: 2007284 - protein, 22 aa, Staphylococcus
DYVSCSPFRVPGAIIATAQSQV

SEQ ID NO: 2007285 - protein, 23 aa, Staphylococcus
DYVSCSPFRVPGAILATAQSQAE

SEQ ID NO: 2007286 - protein, 24 aa, Staphylococcus
DYVSCSPFRVPGAILATAQSQAEE

SEQ ID NO: 2007287 - protein, 22 aa, Staphylococcus
DYVSCSPFRVPGALLSTAQSEV

SEQ ID NO: 2007288 - protein, 26 aa, Staphylococcus
DYVSGGKRPLICFFSNDLNIHRTKTE

SEQ ID NO: 2007289 - protein, 19 aa, Staphylococcus
DYVSYAIKGNLMYEGTYPL

SEQ ID NO: 2007290 - protein, 19 aa, Staphylococcus
DYVSYAIKGNLMYENAYPL

SEQ ID NO: 2007291 - protein, 18 aa, Staphylococcus
DYVSYAIKGNLMYENSYP

SEQ ID NO: 2007292 - protein, 20 aa, Staphylococcus
DYWKKLFKRYEDWINNFNAC

SEQ ID NO: 2007293 - protein, 18 aa, Staphylococcus
DYYDSFKRGYNLTIGGEG

SEQ ID NO: 2007294 - protein, 31 aa, Staphylococcus
DYYEAFMSWTERRFGYTFPQEHLVFSHGIVA

SEQ ID NO: 2007295 - protein, 27 aa, Staphylococcus
DYYGSSVNSEWMIPKILEMKHKAPELL

SEQ ID NO: 2007296 - protein, 26 aa, Staphylococcus
DYYHAAEILKHFGIEKINLLSNNPEK

SEQ ID NO: 2007297 - protein, 19 aa, Staphylococcus
DYYKEWLKLNGKYELSSKQ

SEQ ID NO: 2007298 - protein, 24 aa, Staphylococcus
EAAAKLKPDLIITYKENKNNKKLA

SEQ ID NO: 2007299 - protein, 26 aa, Staphylococcus
EAAERYGFDLSLAIPVGFSNGSNIAI

SEQ ID NO: 2007300 - protein, 19 aa, Staphylococcus
EAAEYFSANLFQLDIPNNL

SEQ ID NO: 2007301 - protein, 18 aa, Staphylococcus
EAAGLYDAHLEGCPSKPN

SEQ ID NO: 2007302 - protein, 24 aa, Staphylococcus
EAAGRKAVLIPGDIRDEQFNYDLV

SEQ ID NO: 2007303 - protein, 17 aa, Staphylococcus
EAAIYEHFGRPWIAPPM

SEQ ID NO: 2007304 - protein, 26 aa, Staphylococcus
EAAKAESMSICWAMGVTQQDIGSDTS

SEQ ID NO: 2007305 - protein, 18 aa, Staphylococcus
EAAKAIGIKDLRKMGYRD

SEQ ID NO: 2007306 - protein, 23 aa, Staphylococcus
EAAKDLNDFLGINYYMSDWMRGY

SEQ ID NO: 2007307 - protein, 17 aa, Staphylococcus
EAAKMDGLHPGRTANVL

SEQ ID NO: 2007308 - protein, 17 aa, Staphylococcus
EAAKRLGATTAINIKNE

SEQ ID NO: 2007309 - protein, 23 aa, Staphylococcus
EAALKICNRCFDNGVVIIAVAGN

SEQ ID NO: 2007310 - protein, 27 aa, Staphylococcus
EAAMKRTLMRMAHEILEYNRGTKDLVL

SEQ ID NO: 2007311 - protein, 25 aa, Staphylococcus
EAAPNLKIIANMAVGFDNIDIDLVN

SEQ ID NO: 2007312 - protein, 24 aa, Staphylococcus
EAAVSEWSFPFVLKPGDDLPTAGG

SEQ ID NO: 2007313 - protein, 21 aa, Staphylococcus
EAAWNKLPLEEDIKALGTPLP

SEQ ID NO: 2007314 - protein, 21 aa, Staphylococcus
EACEILLERGYIVCPYIAEDV

SEQ ID NO: 2007315 - protein, 24 aa, Staphylococcus
EACQTWRLVYHRLMNLERETHEHV

SEQ ID NO: 2007316 - protein, 19 aa, Staphylococcus
EACRGWRYCMTGCPYKKVY

SEQ ID NO: 2007317 - protein, 26 aa, Staphylococcus
EADAALWGARAAYIGGFNSTSNVRAG

SEQ ID NO: 2007318 - protein, 19 aa, Staphylococcus
EADACLISESIMGQIDFLT

SEQ ID NO: 2007319 - protein, 19 aa, Staphylococcus
EADAFIELFGDRVVITRPS

SEQ ID NO: 2007320 - protein, 23 aa, Staphylococcus
EADFINCVVFRRQAENVNNYLNK

SEQ ID NO: 2007321 - protein, 23 aa, Staphylococcus
EADFINCVVFRRQAENVNNYLSK

SEQ ID NO: 2007322 - protein, 17 aa, Staphylococcus
EADFINIVVFRKQADNV

SEQ ID NO: 2007323 - protein, 18 aa, Staphylococcus
EADIIFRDGLATAPVKYF

SEQ ID NO: 2007324 - protein, 19 aa, Staphylococcus
EADIKHYVMVSTYDSRREA

SEQ ID NO: 2007325 - protein, 24 aa, Staphylococcus
EADIKLMMREVRLALLEADVNFKV

SEQ ID NO: 2007326 - protein, 19 aa, Staphylococcus
EADLGYDLFMRTTKDIKIT

SEQ ID NO: 2007327 - protein, 25 aa, Staphylococcus
EADNPLKQKVCDVALESFDAAMAKV

SEQ ID NO: 2007328 - protein, 26 aa, Staphylococcus
EADNPLKQKVCDVATMAFENAMTKVK

SEQ ID NO: 2007329 - protein, 20 aa, Staphylococcus
EADNVFTFYENNGFGRLNST

SEQ ID NO: 2007330 - protein, 17 aa, Staphylococcus
EADVPIYYYGFKETDDI

SEQ ID NO: 2007331 - protein, 19 aa, Staphylococcus
EAEEIIKDMIEYVLEHKKV

SEQ ID NO: 2007332 - protein, 20 aa, Staphylococcus
EAEKLLNLVGMLSYKDQYLG

SEQ ID NO: 2007333 - protein, 25 aa, Staphylococcus
EAELRKGEIQFLYIAPERFENNQFM

SEQ ID NO: 2007334 - protein, 24 aa, Staphylococcus
EAEMKYSHTPYYQAFKENQKQLNS

SEQ ID NO: 2007335 - protein, 19 aa, Staphylococcus
EAERLVIHGFLDPVVRELP

SEQ ID NO: 2007336 - protein, 25 aa, Staphylococcus
EAEYAQKIQQGWFDFDVVVATPDMM

SEQ ID NO: 2007337 - protein, 20 aa, Staphylococcus
EAFAKVFSEKVLKNIMVYIN

SEQ ID NO: 2007338 - protein, 19 aa, Staphylococcus
EAFEKAGLLSRLQIAAHNK

SEQ ID NO: 2007339 - protein, 19 aa, Staphylococcus
EAFELLKKQFIGEFISSLN

SEQ ID NO: 2007340 - protein, 24 aa, Staphylococcus
EAFFKSCEEAGVYGLIIPDLPFEL

SEQ ID NO: 2007341 - protein, 20 aa, Staphylococcus
EAFGGDVFEAHKEGCAYVKE

SEQ ID NO: 2007342 - protein, 19 aa, Staphylococcus
EAFGHSLGHGIGLDIHEGP

SEQ ID NO: 2007343 - protein, 20 aa, Staphylococcus
EAFGQAKAKVVINYRSERHK

SEQ ID NO: 2007344 - protein, 17 aa, Staphylococcus
EAFKIILGDEHVKGIFV

SEQ ID NO: 2007345 - protein, 23 aa, Staphylococcus
EAFKVQLDDGMAFLSGVVSRKKQ

SEQ ID NO: 2007346 - protein, 17 aa, Staphylococcus
EAFNVKLEDDMAFLTGV

SEQ ID NO: 2007347 - protein, 24 aa, Staphylococcus
EAFNVQLDDGMAFLSGVVSRKKQV

SEQ ID NO: 2007348 - protein, 19 aa, Staphylococcus
EAFQKVLLQIEAQPDTMHF

SEQ ID NO: 2007349 - protein, 32 aa, Staphylococcus
EAFVCYIAMTRSRAHVTFSYALMGASGDVKEP

SEQ ID NO: 2007350 - protein, 32 aa, Staphylococcus
EAGAKFNGVLCGRATWAGAVQVYIEQDEAAAR

SEQ ID NO: 2007351 - protein, 17 aa, Staphylococcus
EAGCGVVYDSVPEKELE

SEQ ID NO: 2007352 - protein, 17 aa, Staphylococcus
EAGDIIGHIMLSEINLK

SEQ ID NO: 2007353 - protein, 22 aa, Staphylococcus
EAGDLPTIIRRLLVISYEDIGL

SEQ ID NO: 2007354 - protein, 25 aa, Staphylococcus
EAGIKNIQIGMAHRGRLNVLTHVLE

SEQ ID NO: 2007355 - protein, 17 aa, Staphylococcus
EAGIPLIVDNTFASPYL

SEQ ID NO: 2007356 - protein, 21 aa, Staphylococcus
EAGLFHIGIKLPELSSLADLL

SEQ ID NO: 2007357 - protein, 24 aa, Staphylococcus
EAGNHIKTAVVMYLCNTTKEDAET

SEQ ID NO: 2007358 - protein, 27 aa, Staphylococcus
EAGNIGYKIAQRLGGYDAVGPVLQGLN

SEQ ID NO: 2007359 - protein, 18 aa, Staphylococcus
EAGRRISRERYVKQEKNN

SEQ ID NO: 2007360 - protein, 39 aa, Staphylococcus
EAGRSDYFWDLFIQMPAALMFPSGNPLYDWIYQTEEEPH

SEQ ID NO: 2007361 - protein, 27 aa, Staphylococcus
EAGVDVFRIFDSLNWVDQMKVANEAVQ

SEQ ID NO: 2007362 - protein, 22 aa, Staphylococcus
EAHFIKQLIKMMNLHISNQSNS

SEQ ID NO: 2007363 - protein, 34 aa, Staphylococcus
EAHKEGCAYVKEHAMFKCDDRFDVVIASNSGYPL

SEQ ID NO: 2007364 - protein, 35 aa, Staphylococcus
EAHKEGCAYVKEHAMFKCHQRFDVVIASNSGYPLD

SEQ ID NO: 2007365 - protein, 19 aa, Staphylococcus
EAHPVIASRMKRAQKLFGQ

SEQ ID NO: 2007366 - protein, 17 aa, Staphylococcus
EAHRFANDWSEIRPEWG

SEQ ID NO: 2007367 - protein, 19 aa, Staphylococcus
EAIAKALSQHGVNIALAGR

SEQ ID NO: 2007368 - protein, 18 aa, Staphylococcus
EAIDVLRKKVKLTKMSIE

SEQ ID NO: 2007369 - protein, 18 aa, Staphylococcus
EAIDWPLTIRTRRDGDKF

SEQ ID NO: 2007370 - protein, 19 aa, Staphylococcus
EAIGVAGLITPWNFPTNQT

SEQ ID NO: 2007371 - protein, 19 aa, Staphylococcus
EAIHIGGKEGLSIARQLGF

SEQ ID NO: 2007372 - protein, 25 aa, Staphylococcus
EAIHVPREHFHHIKDIIAEKEIDGF

SEQ ID NO: 2007373 - protein, 17 aa, Staphylococcus
EAIIDLVTMKCYQYNGD

SEQ ID NO: 2007374 - protein, 22 aa, Staphylococcus
EAIKAAGVPASLSNTAGTFVCN

SEQ ID NO: 2007375 - protein, 18 aa, Staphylococcus
EAIKAYLSIAPKNTILIT

SEQ ID NO: 2007376 - protein, 19 aa, Staphylococcus
EAIKAYPDMMHFVEVKMAM

SEQ ID NO: 2007377 - protein, 17 aa, Staphylococcus
EAIKIASNLTNWIVNDF

SEQ ID NO: 2007378 - protein, 19 aa, Staphylococcus
EAIKNFLYKNSDLQISYNF

SEQ ID NO: 2007379 - protein, 24 aa, Staphylococcus
EAINVPRLLTNVSEQTWQGIPKGT

SEQ ID NO: 2007380 - protein, 22 aa, Staphylococcus
EAINYAKWAYRSITEDKKLDFD

SEQ ID NO: 2007381 - protein, 20 aa, Staphylococcus
EAIPSDLAGLISEQLDIPVI

SEQ ID NO: 2007382 - protein, 21 aa, Staphylococcus
EAIPSDLAGLISKQLDIPVIG

SEQ ID NO: 2007383 - protein, 17 aa, Staphylococcus
EAIRDINKAVVIVREEE

SEQ ID NO: 2007384 - protein, 24 aa, Staphylococcus
EAIREAGAIPFEFDTIGVDDGIAM

SEQ ID NO: 2007385 - protein, 23 aa, Staphylococcus
EAIREAGAISFEFNTIGVDDGIA

SEQ ID NO: 2007386 - protein, 25 aa, Staphylococcus
EAISAKADDGAPCVTYIGPDGAGHY

SEQ ID NO: 2007387 - protein, 19 aa, Staphylococcus
EAISRPIVTNALTHGLSLV

SEQ ID NO: 2007388 - protein, 24 aa, Staphylococcus
EAIYLPGGHGTVFDFANNEKLANI

SEQ ID NO: 2007389 - protein, 19 aa, Staphylococcus
EAKAFTIEILKEMQRLQKQ

SEQ ID NO: 2007390 - protein, 22 aa, Staphylococcus
EAKAKLRPLIQFNTNQNDTSSA

SEQ ID NO: 2007391 - protein, 24 aa, Staphylococcus
EAKAKLRPLIRFNTSQNDTSSAMI

SEQ ID NO: 2007392 - protein, 18 aa, Staphylococcus
EAKDWMVKALQPMGEEYM

SEQ ID NO: 2007393 - protein, 19 aa, Staphylococcus
EAKEWMLKALEPMGEEYLD

SEQ ID NO: 2007394 - protein, 19 aa, Staphylococcus
EAKEWMLKALEPMGKEYLD

SEQ ID NO: 2007395 - protein, 28 aa, Staphylococcus
EAKFAEGIEVGQVFKLGTKYSEAMNATF

SEQ ID NO: 2007396 - protein, 35 aa, Staphylococcus
EAKHPKTRYAGGMGAKPLIFLKWALPDKAFDALWM

SEQ ID NO: 2007397 - protein, 27 aa, Staphylococcus
EAKILAAAYSFKCGRDVERNRRQDGAP

SEQ ID NO: 2007398 - protein, 20 aa, Staphylococcus
EAKISGNAMVKVKNRMFSHG

SEQ ID NO: 2007399 - protein, 19 aa, Staphylococcus
EAKKAELLSSLSEGDVIEG

SEQ ID NO: 2007400 - protein, 20 aa, Staphylococcus
EAKKIISCIVRMRQQETYGV

SEQ ID NO: 2007401 - protein, 27 aa, Staphylococcus
EAKKRALELVELVGLKGREKAYPSELS

SEQ ID NO: 2007402 - protein, 24 aa, Staphylococcus
EAKLSRLSEELLRDINKDTVPFVP

SEQ ID NO: 2007403 - protein, 20 aa, Staphylococcus
EAKMSGQVILLLDEIHRLDK

SEQ ID NO: 2007404 - protein, 30 aa, Staphylococcus
EAKSIDFANRMGIGLNKLFEALSITNKIPM

SEQ ID NO: 2007405 - protein, 17 aa, Staphylococcus
EAKTIFLEQNYRSTKTI

SEQ ID NO: 2007406 - protein, 19 aa, Staphylococcus
EALALKYLPSLKFSHQDQS

SEQ ID NO: 2007407 - protein, 17 aa, Staphylococcus
EALDELFDAILTLKDRE

SEQ ID NO: 2007408 - protein, 25 aa, Staphylococcus
EALDLPERMSVIVGREDVDEVKPAP

SEQ ID NO: 2007409 - protein, 25 aa, Staphylococcus
EALEIAEQMGIIFIDEIDKVATNNS

SEQ ID NO: 2007410 - protein, 17 aa, Staphylococcus
EALEIAESIRSEYVIEV

SEQ ID NO: 2007411 - protein, 24 aa, Staphylococcus
EALEKRIDRFIAYKDRNNCERIFD

SEQ ID NO: 2007412 - protein, 25 aa, Staphylococcus
EALELAEQMGIIFIDEIDKVATNNA

SEQ ID NO: 2007413 - protein, 17 aa, Staphylococcus
EALFKGDLKSLSIKDIK

SEQ ID NO: 2007414 - protein, 18 aa, Staphylococcus
EALGGIVVGIAFIIELKY

SEQ ID NO: 2007415 - protein, 22 aa, Staphylococcus
EALGQFDVIIGRRVLMYLPDVP

SEQ ID NO: 2007416 - protein, 22 aa, Staphylococcus
EALGYSRWAYRSITEDKNLDFD

SEQ ID NO: 2007417 - protein, 25 aa, Staphylococcus
EALHKEIQFSIGHTVATFDEVNDAV

SEQ ID NO: 2007418 - protein, 28 aa, Staphylococcus
EALHKVECAACPGAGACGGMFTANTMSS

SEQ ID NO: 2007419 - protein, 18 aa, Staphylococcus
EALIDFIPNERDSKLKEV

SEQ ID NO: 2007420 - protein, 18 aa, Staphylococcus
EALIKLDMSEYMDRTAVS

SEQ ID NO: 2007421 - protein, 17 aa, Staphylococcus
EALIKTVAIIGGAGIGF

SEQ ID NO: 2007422 - protein, 21 aa, Staphylococcus
EALKDKIQWVETLPDKDYSKI

SEQ ID NO: 2007423 - protein, 24 aa, Staphylococcus
EALKNRFVVIQVDYIDGDILKDVI

SEQ ID NO: 2007424 - protein, 24 aa, Staphylococcus
EALKNRFVVIQVDYIDGDILSDVI

SEQ ID NO: 2007425 - protein, 23 aa, Staphylococcus
EALKNRFVVIQVDYIDGDILSHV

SEQ ID NO: 2007426 - protein, 23 aa, Staphylococcus
EALKNRFVVIQVDYIDGDILSNV

SEQ ID NO: 2007427 - protein, 25 aa, Staphylococcus
EALKNRFVVIQVDYIDGEILKRVIK

SEQ ID NO: 2007428 - protein, 18 aa, Staphylococcus
EALLALAALGYSKRELSK

SEQ ID NO: 2007429 - protein, 19 aa, Staphylococcus
EALLALEALGYSKRELTKV

SEQ ID NO: 2007430 - protein, 23 aa, Staphylococcus
EALLKVGCITRPFPTGVRITIGF

SEQ ID NO: 2007431 - protein, 18 aa, Staphylococcus
EALLMDVPLLAFPQNADQ

SEQ ID NO: 2007432 - protein, 30 aa, Staphylococcus; identical to SEQ ID NO: 1646911

SEQ ID NO: 2007433 - protein, 22 aa, Staphylococcus
EALLQWDIDHLYGIPGDSIDAV

SEQ ID NO: 2007434 - protein, 20 aa, Staphylococcus
EALLRKGYEYDTIKDKMRES

SEQ ID NO: 2007435 - protein, 20 aa, Staphylococcus
EALMGKYRISGVPIVDNDSD

SEQ ID NO: 2007436 - protein, 21 aa, Staphylococcus
EALMGKYRISGVPIVDNKEVR

SEQ ID NO: 2007437 - protein, 20 aa, Staphylococcus
EALMGKYRISGVPIVSDKES

SEQ ID NO: 2007438 - protein, 25 aa, Staphylococcus
EALNIPPKHFHLIKEIMAEKEIDGF

SEQ ID NO: 2007439 - protein, 18 aa, Staphylococcus
EALNRIDADYTMGHSLGE

SEQ ID NO: 2007440 - protein, 18 aa, Staphylococcus
EALNYTLFTVEEHTAYLS

SEQ ID NO: 2007441 - protein, 20 aa, Staphylococcus
EALPHTFSDLLIYCAERNVM

SEQ ID NO: 2007442 - protein, 19 aa, Staphylococcus
EALQDIGYTHLSFYVDDFE

SEQ ID NO: 2007443 - protein, 21 aa, Staphylococcus
EALQRMAMMRSYMRAQVTGKE

SEQ ID NO: 2007444 - protein, 21 aa, Staphylococcus
EALRGSGYAFLVVPSNIFEGE

SEQ ID NO: 2007445 - protein, 25 aa, Staphylococcus
EALVKTEFCGVCHTDLHVKNADFGD

SEQ ID NO: 2007446 - protein, 17 aa, Staphylococcus
EALYLNDQVMEFDLTPN

SEQ ID NO: 2007447 - protein, 25 aa, Staphylococcus
EAMEALIRFSKMEGIIPAIESAHAL

SEQ ID NO: 2007448 - protein, 20 aa, Staphylococcus
EAMIHYLSCFDINKYANKPI

SEQ ID NO: 2007449 - protein, 18 aa, Staphylococcus
EAMKLGIHAGRLSYEAGR

SEQ ID NO: 2007450 - protein, 25 aa, Staphylococcus
EAMKRAEPLLKIFRLQDELKVFPSH

SEQ ID NO: 2007451 - protein, 17 aa, Staphylococcus
EAMKRARPLLKTFRLEN

SEQ ID NO: 2007452 - protein, 20 aa, Staphylococcus
EAMPRVSYHANLERLAQLPR

SEQ ID NO: 2007453 - protein, 26 aa, Staphylococcus
EAMRRAEPLLKVFRLENELKVFPSHF

SEQ ID NO: 2007454 - protein, 31 aa, Staphylococcus; identical to SEQ ID NO: 1799106

SEQ ID NO: 2007455 - protein, 30 aa, Staphylococcus
EAMVRMAQEFSYRYPLVDGQGNFGSMDGDG

SEQ ID NO: 2007456 - protein, 21 aa, Staphylococcus
EANANRYTFVWKRVFKTMNQR

SEQ ID NO: 2007457 - protein, 24 aa, Staphylococcus
EANHSNDLIYCFLLDNVFPERMKV

SEQ ID NO: 2007458 - protein, 21 aa, Staphylococcus
EANKAFLFGINYVTISGDEDY

SEQ ID NO: 2007459 - protein, 24 aa, Staphylococcus
EANKTLQFCKNWLEQEGLEPVRLS

SEQ ID NO: 2007460 - protein, 28 aa, Staphylococcus
EANNALVFAHGFNIHFGVIQPPENVDVF

SEQ ID NO: 2007461 - protein, 28 aa, Staphylococcus
EANTLIGLSRLGIHSSLISALGNDAVGE

SEQ ID NO: 2007462 - protein, 27 aa, Staphylococcus
EAPDIYKILASYYMFEYIHPFYDGNGR

SEQ ID NO: 2007463 - protein, 17 aa, Staphylococcus
EAPFYTLGPLVTDIAPA

SEQ ID NO: 2007464 - protein, 18 aa, Staphylococcus
EAPFYTLGPLVTDIAPAY

SEQ ID NO: 2007465 - protein, 22 aa, Staphylococcus
EAPKQLPVLLLLHGLSSDETSY

SEQ ID NO: 2007466 - protein, 20 aa, Staphylococcus
EAPLKALIFDSEYDPYRGVI

SEQ ID NO: 2007467 - protein, 18 aa, Staphylococcus
EAPNYKALERNISELRER

SEQ ID NO: 2007468 - protein, 21 aa, Staphylococcus
EAPPVKDGRITKKTKMDAKLK

SEQ ID NO: 2007469 - protein, 22 aa, Staphylococcus
EAPSHPGWLVLEVCGAQTESKR

SEQ ID NO: 2007470 - protein, 28 aa, Staphylococcus
EAQDIENLWSLFEIALLYSADKSEDNEN

SEQ ID NO: 2007471 - protein, 21 aa, Staphylococcus
EAQEFKKWVKQVIKELRQATG

SEQ ID NO: 2007472 - protein, 24 aa, Staphylococcus
EAQEIKPNFTIISAPHFKADPSID

SEQ ID NO: 2007473 - protein, 22 aa, Staphylococcus
EAQEMGGNFLKPVVVSNANQDM

SEQ ID NO: 2007474 - protein, 20 aa, Staphylococcus
EAQETFALILGNEGEGVDPA

SEQ ID NO: 2007475 - protein, 20 aa, Staphylococcus
EAQFPAGVGEYLYERLRLTA

SEQ ID NO: 2007476 - protein, 19 aa, Staphylococcus
EAQGFIKIVTDKAYGEVLG

SEQ ID NO: 2007477 - protein, 25 aa, Staphylococcus
EAQIKRLKFDYLYIDNAQLTSPYLM

SEQ ID NO: 2007478 - protein, 19 aa, Staphylococcus
EAQQYISLDQICLSPQCGF

SEQ ID NO: 2007479 - protein, 17 aa, Staphylococcus
EAQRVALARALSTKPDL

SEQ ID NO: 2007480 - protein, 24 aa, Staphylococcus
EAQVRPRLGNSLKTKLRVALGTID

SEQ ID NO: 2007481 - protein, 23 aa, Staphylococcus
EAQWEAMLLGWKVVGAVKSNAVI

SEQ ID NO: 2007482 - protein, 20 aa, Staphylococcus
EAQWMYPPFELHEQDGKLYG

SEQ ID NO: 2007483 - protein, 24 aa, Staphylococcus
EARDLRYQWFDEMMSKINADVLLT

SEQ ID NO: 2007484 - protein, 27 aa, Staphylococcus
EARGKGGHVRANWRDVTDIIAAQILYT

SEQ ID NO: 2007485 - protein, 26 aa, Staphylococcus
EARGKGGHVRASWKDVTDIIAAQILY

SEQ ID NO: 2007486 - protein, 22 aa, Staphylococcus
EARHASNYIGYHFNHLIKNDFN

SEQ ID NO: 2007487 - protein, 25 aa, Staphylococcus
EARKYGLEVFNVFLSQEPITEDIET

SEQ ID NO: 2007488 - protein, 18 aa, Staphylococcus
EARLNRYEIQTTTSTYLG

SEQ ID NO: 2007489 - protein, 21 aa, Staphylococcus
EARNALDAMISYFNGVAQLRQ

SEQ ID NO: 2007490 - protein, 20 aa, Staphylococcus
EARPELSYPADLYLEGSDQY

SEQ ID NO: 2007491 - protein, 30 aa, Staphylococcus
EARPYRLLRIGSFLLSKYGYKIFVHETERK

SEQ ID NO: 2007492 - protein, 22 aa, Staphylococcus
EARPYRVLRVGSFLLSTEGYKI

SEQ ID NO: 2007493 - protein, 20 aa, Staphylococcus
EARQGYGEVHHVSFRLKDHA

SEQ ID NO: 2007494 - protein, 20 aa, Staphylococcus
EARSKIQILAPVVSHRKGAQ

SEQ ID NO: 2007495 - protein, 26 aa, Staphylococcus
EARVDLSLNVRKVFFSTYNKRELNEC

SEQ ID NO: 2007496 - protein, 24 aa, Staphylococcus
EASALCAPQIGISKQVAIIDMEVE

SEQ ID NO: 2007497 - protein, 21 aa, Staphylococcus
EASDGVVIGSEIVKRFENDDK

SEQ ID NO: 2007498 - protein, 24 aa, Staphylococcus
EASDLKIIANMAVGYDNIDVVRAN

SEQ ID NO: 2007499 - protein, 26 aa, Staphylococcus
EASDPLKQKVCDVALMAFENAMAKVK

SEQ ID NO: 2007500 - protein, 25 aa, Staphylococcus
EASEILQRFGSDIDVLITGHQHREI

SEQ ID NO: 2007501 - protein, 21 aa, Staphylococcus
EASEKAILLLHSFTGTVRDVK

SEQ ID NO: 2007502 - protein, 24 aa, Staphylococcus
EASEKFGRQCICIAIDSNYDSELN

SEQ ID NO: 2007503 - protein, 20 aa, Staphylococcus
EASGSLTLINKCLESVEGTG

SEQ ID NO: 2007504 - protein, 18 aa, Staphylococcus
EASLKYKELLQEALPNIE

SEQ ID NO: 2007505 - protein, 18 aa, Staphylococcus
EASNAQVLSSQRKESNQS

SEQ ID NO: 2007506 - protein, 34 aa, Staphylococcus
EASQKNQFPWCVAAFPSKAWAQRVYPDLTETEAY

SEQ ID NO: 2007507 - protein, 17 aa, Staphylococcus
EASRIAIETTRQYLHET

SEQ ID NO: 2007508 - protein, 25 aa, Staphylococcus
EATDWKDKLRMLKEFPTPTLQDIDL

SEQ ID NO: 2007509 - protein, 19 aa, Staphylococcus
EATGHIAWENALQQKTSAF

SEQ ID NO: 2007510 - protein, 17 aa, Staphylococcus
EATKEAFAQFGLSEPSD

SEQ ID NO: 2007511 - protein, 19 aa, Staphylococcus
EATLAPYFKAIEETAFVNQ

SEQ ID NO: 2007512 - protein, 24 aa, Staphylococcus
EATLEMTNRMASFRFTEPTLIAMS

SEQ ID NO: 2007513 - protein, 17 aa, Staphylococcus
EATQIGMAYAMREGDIS

SEQ ID NO: 2007514 - protein, 19 aa, Staphylococcus
EATYEDKLYQAYRYTDKMR

SEQ ID NO: 2007515 - protein, 18 aa, Staphylococcus
EATYRCICGYTETQRHMD

SEQ ID NO: 2007516 - protein, 20 aa, Staphylococcus
EAVAMAFGFFDGMHKGHAKV

SEQ ID NO: 2007517 - protein, 19 aa, Staphylococcus
EAVARFIGKGTFIKGTLKE

SEQ ID NO: 2007518 - protein, 25 aa, Staphylococcus
EAVATFPEYRGQGIATQLLKHLIET

SEQ ID NO: 2007519 - protein, 17 aa, Staphylococcus
EAVAYFALIQTMGGSDR

SEQ ID NO: 2007520 - protein, 20 aa, Staphylococcus
EAVDRACYLLQTYAGGSVAQ

SEQ ID NO: 2007521 - protein, 17 aa, Staphylococcus
EAVEHIFRVTAGLDSIV

SEQ ID NO: 2007522 - protein, 17 aa, Staphylococcus
EAVEWYIYSVGFRNSFV

SEQ ID NO: 2007523 - protein, 17 aa, Staphylococcus
EAVHLSKSLTLAKDMYE

SEQ ID NO: 2007524 - protein, 21 aa, Staphylococcus
EAVKALGAKKERYPIDQMRGL

SEQ ID NO: 2007525 - protein, 20 aa, Staphylococcus
EAVKELGARVNINVDIGTPS

SEQ ID NO: 2007526 - protein, 18 aa, Staphylococcus
EAVLRFAKEKGISKVYSF

SEQ ID NO: 2007527 - protein, 26 aa, Staphylococcus
EAVPPVLKGSLTWTVYQDGKVNVDYN

SEQ ID NO: 2007528 - protein, 18 aa, Staphylococcus
EAVSRVLKEQGAYEIIKK

SEQ ID NO: 2007529 - protein, 22 aa, Staphylococcus
EAVWQFSEQIIFPYVEDDELDG

SEQ ID NO: 2007530 - protein, 17 aa, Staphylococcus
EAYACDITYCTNNELGF

SEQ ID NO: 2007531 - protein, 24 aa, Staphylococcus
EAYDLGIRAIMFFGVPNAKDEVGS

SEQ ID NO: 2007532 - protein, 24 aa, Staphylococcus
EAYDLGIRAIMFFGVPNEKDDVGS

SEQ ID NO: 2007533 - protein, 24 aa, Staphylococcus
EAYELGIRAIMFFGVPNAKDDVGS

SEQ ID NO: 2007534 - protein, 25 aa, Staphylococcus
EAYELTLRDKVCWFYSRSKGRLWKK

SEQ ID NO: 2007535 - protein, 25 aa, Staphylococcus
EAYEMGVSKAFKPIMENTLKYLNVG

SEQ ID NO: 2007536 - protein, 21 aa, Staphylococcus
EAYEMPKEKVIIQSFDQQVIQ

SEQ ID NO: 2007537 - protein, 21 aa, Staphylococcus
EAYEYFAQAGLGEKLVIQTYF

SEQ ID NO: 2007538 - protein, 18 aa, Staphylococcus
EAYFKDVQSLVGDIPQSD

SEQ ID NO: 2007539 - protein, 23 aa, Staphylococcus
EAYGEIDKSIAFIDYMTSLSMSN

SEQ ID NO: 2007540 - protein, 32 aa, Staphylococcus
EAYKARLAYLKSRLLEMGFKLDAEPEGAFYIF

SEQ ID NO: 2007541 - protein, 18 aa, Staphylococcus
EAYKDLNCITTLTDADRK

SEQ ID NO: 2007542 - protein, 23 aa, Staphylococcus
EAYKRSEAEIAQIQEKIDALPIV

SEQ ID NO: 2007543 - protein, 28 aa, Staphylococcus
EAYKTFLKNEIARWIKIQEDIGLDVLVH

SEQ ID NO: 2007544 - protein, 17 aa, Staphylococcus
EAYLDFGDAYTLELQPH

SEQ ID NO: 2007545 - protein, 26 aa, Staphylococcus
EAYLKPISDRGIGFYNLDKNTAQFQF

SEQ ID NO: 2007546 - protein, 27 aa, Staphylococcus
EAYLNRVADADIWLRENPLQFEWGGES

SEQ ID NO: 2007547 - protein, 19 aa, Staphylococcus
EAYLRLKNIVKETPLQLDH

SEQ ID NO: 2007548 - protein, 19 aa, Staphylococcus
EAYMPRASFMSLNKQKEKN

SEQ ID NO: 2007549 - protein, 18 aa, Staphylococcus
EAYNFIKQVSEDGGKVLF

SEQ ID NO: 2007550 - protein, 19 aa, Staphylococcus
EAYNFIKQVSEDGGKVLFV

SEQ ID NO: 2007551 - protein, 19 aa, Staphylococcus
EAYNFIKQVSEDGGRVLFV

SEQ ID NO: 2007552 - protein, 25 aa, Staphylococcus
ECFDSGHIRFARQLIEEGLIDGEPM

SEQ ID NO: 2007553 - protein, 19 aa, Staphylococcus
ECFYNKWERELHALEKIKQ

SEQ ID NO: 2007554 - protein, 23 aa, Staphylococcus
ECHFIAVKLPYGIQKDADEVEDA

SEQ ID NO: 2007555 - protein, 18 aa, Staphylococcus
ECINVLKEQNIPHGQIQF

SEQ ID NO: 2007556 - protein, 22 aa, Staphylococcus
ECKECLRSDIEINDDGLCSICE

SEQ ID NO: 2007557 - protein, 23 aa, Staphylococcus
ECKESKAKLWGFKDSGIPLSEMK

SEQ ID NO: 2007558 - protein, 19 aa, Staphylococcus
ECKKSVFNYEKEWRDFSKD

SEQ ID NO: 2007559 - protein, 22 aa, Staphylococcus
ECMACGYQSPKWMGKCPNCGGW

SEQ ID NO: 2007560 - protein, 22 aa, Staphylococcus
ECMACGYQSPKWMGKCPNCGSW

SEQ ID NO: 2007561 - protein, 18 aa, Staphylococcus
ECNLEVGEFVHTFGDAHI

SEQ ID NO: 2007562 - protein, 20 aa, Staphylococcus
ECPNFVKGHIPELYIENERI

SEQ ID NO: 2007563 - protein, 21 aa, Staphylococcus
ECREAGLPCYFTMDAGPNVKV

SEQ ID NO: 2007564 - protein, 22 aa, Staphylococcus
ECVAEQFLDIALEVSLTVTIGN

SEQ ID NO: 2007565 - protein, 21 aa, Staphylococcus
ECYNRKKVKRQFTFNEKIKNL

SEQ ID NO: 2007566 - protein, 17 aa, Staphylococcus
EDAFYLTMKAFNLAEEY

SEQ ID NO: 2007567 - protein, 27 aa, Staphylococcus
EDAITVFKCVGAAYFDLAVAVGAYQKL

SEQ ID NO: 2007568 - protein, 18 aa, Staphylococcus
EDAKDCLQKGAFISDKDG

SEQ ID NO: 2007569 - protein, 25 aa, Staphylococcus
EDAKRKVAIALRNRYRRSLLGEETK

SEQ ID NO: 2007570 - protein, 18 aa, Staphylococcus
EDALKYIRDYAVEQNATP

SEQ ID NO: 2007571 - protein, 18 aa, Staphylococcus
EDAQCGVASFKKEADGSL

SEQ ID NO: 2007572 - protein, 20 aa, Staphylococcus
EDAQWKKLAYVVEIANEVFG

SEQ ID NO: 2007573 - protein, 26 aa, Staphylococcus
EDARKFGIEVFNVFLSQDPITEDIEQ

SEQ ID NO: 2007574 - protein, 18 aa, Staphylococcus
EDARLAALLEQIVQIVDE

SEQ ID NO: 2007575 - protein, 20 aa, Staphylococcus
EDARQSMLRGVDKLANAVKV

SEQ ID NO: 2007576 - protein, 17 aa, Staphylococcus
EDARQSMLRGVDQLANA

SEQ ID NO: 2007577 - protein, 23 aa, Staphylococcus
EDATKCFTFIKGFGGYTDQQTYN

SEQ ID NO: 2007578 - protein, 28 aa, Staphylococcus
EDAVKIVRKRGELMAQAFPSGVGSMAAV

SEQ ID NO: 2007579 - protein, 18 aa, Staphylococcus
EDCFKLSAILSKLRVEYK

SEQ ID NO: 2007580 - protein, 17 aa, Staphylococcus
EDCREGQKRMKAMKKEV

SEQ ID NO: 2007581 - protein, 24 aa, Staphylococcus
EDDAKKGFLLDGFPRTLEQAEALS

SEQ ID NO: 2007582 - protein, 21 aa, Staphylococcus
EDDALCFFDLGSAEMNLDMAI

SEQ ID NO: 2007583 - protein, 19 aa, Staphylococcus
EDDIELFRDIADKVKQTNS

SEQ ID NO: 2007584 - protein, 24 aa, Staphylococcus
EDDIPILIDCFKRLIDEHNTVVII

SEQ ID NO: 2007585 - protein, 26 aa, Staphylococcus
EDDLDPRFMWNLAYALGAEERDKEAQ

SEQ ID NO: 2007586 - protein, 22 aa, Staphylococcus
EDDLTYRGEIHLDLTQTDAMFQ

SEQ ID NO: 2007587 - protein, 19 aa, Staphylococcus
EDDRIKNDLGMSYEDIKAK

SEQ ID NO: 2007588 - protein, 17 aa, Staphylococcus
EDEGYEIYEMILDDLPK

SEQ ID NO: 2007589 - protein, 18 aa, Staphylococcus
EDEIRAMGGKVSGVSSSN

SEQ ID NO: 2007590 - protein, 23 aa, Staphylococcus
EDEIRRFLPRKVRTFQLQEAQRL

SEQ ID NO: 2007591 - protein, 23 aa, Staphylococcus
EDEIRRFLPRKVRTFQLQEAQRM

SEQ ID NO: 2007592 - protein, 25 aa, Staphylococcus
EDEIRRFLPRKVRTFQLQEAQRMVD

SEQ ID NO: 2007593 - protein, 27 aa, Staphylococcus
EDEKDGRQAIQFLKQRSLGRATFLPLN

SEQ ID NO: 2007594 - protein, 19 aa, Staphylococcus
EDEKFMLVDPIEAIQPEHR

SEQ ID NO: 2007595 - protein, 24 aa, Staphylococcus
EDENLKLLGDDEMDDDDDIPAQTD

SEQ ID NO: 2007596 - protein, 25 aa, Staphylococcus
EDERFYKHHGFDFKGTSRALFSTLS

SEQ ID NO: 2007597 - protein, 22 aa, Staphylococcus
EDEVKEALSVLVNSVDKLRKST

SEQ ID NO: 2007598 - protein, 27 aa, Staphylococcus
EDEWGDHLKFPLAVIDEVLKVKETYAN

SEQ ID NO: 2007599 - protein, 21 aa, Staphylococcus
EDFEFIKNFVVNSGSLKALAK

SEQ ID NO: 2007600 - protein, 18 aa, Staphylococcus
EDFEPGKHYTIFTHTYNG

SEQ ID NO: 2007601 - protein, 23 aa, Staphylococcus
EDFFSSDVSFHFNQFTQDEDCLY

SEQ ID NO: 2007602 - protein, 17 aa, Staphylococcus
EDFKRQALEEGWLTEEE

SEQ ID NO: 2007603 - protein, 23 aa, Staphylococcus
EDFKRYFPTNALVTGYDIIFFWV

SEQ ID NO: 2007604 - protein, 23 aa, Staphylococcus
EDFKRYYPTNALVTGYDIIFFWV

SEQ ID NO: 2007605 - protein, 31 aa, Staphylococcus
EDFQNLILLFLESWYLRASFSQRFGVTEENK

SEQ ID NO: 2007606 - protein, 21 aa, Staphylococcus
EDFRIMLPIHDAIMIECNTDE

SEQ ID NO: 2007607 - protein, 23 aa, Staphylococcus
EDFTKLKLGDNVVFQATTEESLD

SEQ ID NO: 2007608 - protein, 20 aa, Staphylococcus
EDFTLLKLGDNVTFKPEKRK

SEQ ID NO: 2007609 - protein, 19 aa, Staphylococcus
EDFTSFCHLDDLTAVVMDV

SEQ ID NO: 2007610 - protein, 21 aa, Staphylococcus
EDFYFMKLNQFYDDVVEYDSL

SEQ ID NO: 2007611 - protein, 28 aa, Staphylococcus
EDGIPVYLGMPMGLILEVEGKTIYHMGD

SEQ ID NO: 2007612 - protein, 19 aa, Staphylococcus
EDGKLVLNRDGHIMETPNG

SEQ ID NO: 2007613 - protein, 24 aa, Staphylococcus
EDGKPCIHYEGYKVHVSISHTEHY

SEQ ID NO: 2007614 - protein, 29 aa, Staphylococcus
EDGMPGLTICGGYQFLGTKYITPDGTELE

SEQ ID NO: 2007615 - protein, 18 aa, Staphylococcus
EDGRLFSIYSNIELKQKL

SEQ ID NO: 2007616 - protein, 23 aa, Staphylococcus
EDGRRPGFREAGLFHVAYLLPTR

SEQ ID NO: 2007617 - protein, 17 aa, Staphylococcus
EDGVIPFTTYREWEKNK

SEQ ID NO: 2007618 - protein, 17 aa, Staphylococcus
EDGVKDILNRFFNNEPF

SEQ ID NO: 2007619 - protein, 22 aa, Staphylococcus
EDGYFWFQGRVDDVIMTAGERV

SEQ ID NO: 2007620 - protein, 23 aa, Staphylococcus
EDGYPGDMMIKVIHTYDVEHRWT

SEQ ID NO: 2007621 - protein, 21 aa, Staphylococcus
EDGYYWFQGRVDDVIMTAGER

SEQ ID NO: 2007622 - protein, 22 aa, Staphylococcus
EDHAMLKLAYIDLQDYLNTLQE

SEQ ID NO: 2007623 - protein, 20 aa, Staphylococcus
EDHFYCALFIPSSEDHKNQL

SEQ ID NO: 2007624 - protein, 24 aa, Staphylococcus
EDHGAEAVCHFCGNKYHYSEGELQ

SEQ ID NO: 2007625 - protein, 17 aa, Staphylococcus
EDIAFADSRIRKETIAA

SEQ ID NO: 2007626 - protein, 19 aa, Staphylococcus
EDIAFADSRIRKETIAAED

SEQ ID NO: 2007627 - protein, 19 aa, Staphylococcus
EDIAPFDVIVDAFGQMNKD

SEQ ID NO: 2007628 - protein, 24 aa, Staphylococcus
EDIEEMRKWIPLMMQGHSAGDIMA

SEQ ID NO: 2007629 - protein, 20 aa, Staphylococcus
EDIEKCYLIIPQEIFEEDDT

SEQ ID NO: 2007630 - protein, 17 aa, Staphylococcus
EDIELFRDIADKVKQTN

SEQ ID NO: 2007631 - protein, 25 aa, Staphylococcus
EDIEVMRKWIPLMMQGRFDDGLMAA

SEQ ID NO: 2007632 - protein, 20 aa, Staphylococcus
EDIGYFCVDNLPPILLPKFV

SEQ ID NO: 2007633 - protein, 21 aa, Staphylococcus
EDIKFIGPHLEHLDMFGDKVK

SEQ ID NO: 2007634 - protein, 18 aa, Staphylococcus
EDIKRMYQVLSMKSKRDY

SEQ ID NO: 2007635 - protein, 27 aa, Staphylococcus
EDIKRRHIRHCYKADPDYGKGVAKALG

SEQ ID NO: 2007636 - protein, 17 aa, Staphylococcus
EDIKVSGDFTIENEASD

SEQ ID NO: 2007637 - protein, 18 aa, Staphylococcus
EDILKADIAHYITEHLTD

SEQ ID NO: 2007638 - protein, 17 aa, Staphylococcus
EDILKKRIVDLHEVNPM

SEQ ID NO: 2007639 - protein, 20 aa, Staphylococcus
EDILKNTLVFDVYEGEHLEE

SEQ ID NO: 2007640 - protein, 20 aa, Staphylococcus
EDILPTFKNLGLDAYIDIIV

SEQ ID NO: 2007641 - protein, 24 aa, Staphylococcus
EDIPGELIMKVLAFNPDLGKMDRV

SEQ ID NO: 2007642 - protein, 18 aa, Staphylococcus
EDIREIVESYGINDNELT

SEQ ID NO: 2007643 - protein, 17 aa, Staphylococcus
EDIRHFYTNDVRFLDQF

SEQ ID NO: 2007644 - protein, 17 aa, Staphylococcus
EDIRWLRCDIKSLNLLG

SEQ ID NO: 2007645 - protein, 28 aa, Staphylococcus
EDIRWLRCDIKSLNLLGNVLAKEYAVKY

SEQ ID NO: 2007646 - protein, 28 aa, Staphylococcus
EDISFDIFKGETFGLVGESGCGKSTTGK

SEQ ID NO: 2007647 - protein, 24 aa, Staphylococcus
EDISLKFEQHILTIKAYKKINNEN

SEQ ID NO: 2007648 - protein, 20 aa, Staphylococcus
EDITGCRSLEELPENARKYL

SEQ ID NO: 2007649 - protein, 24 aa, Staphylococcus
EDITRFEEELNLWAKSNATELLNE

SEQ ID NO: 2007650 - protein, 18 aa, Staphylococcus
EDIVEVLTQFAMEQEMKF

SEQ ID NO: 2007651 - protein, 18 aa, Staphylococcus
EDIVHGFTKLMIEHQDEI

SEQ ID NO: 2007652 - protein, 22 aa, Staphylococcus
EDIYPTFKKLGLDNYIDVIIGR

SEQ ID NO: 2007653 - protein, 25 aa, Staphylococcus
EDKEILNVFSYTGAFSVIAAENATM

SEQ ID NO: 2007654 - protein, 23 aa, Staphylococcus
EDKGEIFPSFTVPVDHPGFHQLQ

SEQ ID NO: 2007655 - protein, 23 aa, Staphylococcus
EDKKHPQVLVGRDTRVSGEMLES

SEQ ID NO: 2007656 - protein, 20 aa, Staphylococcus
EDKKLRAIAHELTKTVKENM

SEQ ID NO: 2007657 - protein, 19 aa, Staphylococcus
EDKLFFFQLFGKVDDITMS

SEQ ID NO: 2007658 - protein, 20 aa, Staphylococcus
EDKLKQLVDYGWLDKTNYQT

SEQ ID NO: 2007659 - protein, 18 aa, Staphylococcus
EDKLKQLVDYGWLTDESY

SEQ ID NO: 2007660 - protein, 24 aa, Staphylococcus
EDKNLKLLGDDEMDDDDDIPAQTD

SEQ ID NO: 2007661 - protein, 19 aa, Staphylococcus
EDKNLKLLGEDEADDDDDI

SEQ ID NO: 2007662 - protein, 20 aa, Staphylococcus
EDKNLKLLGEDEADDDDDIP

SEQ ID NO: 2007663 - protein, 24 aa, Staphylococcus
EDKNLKLLGEDEMDDDDDIPAQTD

SEQ ID NO: 2007664 - protein, 23 aa, Staphylococcus
EDKQLGQFFIKFNNKYENSEEAL

SEQ ID NO: 2007665 - protein, 18 aa, Staphylococcus
EDLDLKELVLPLIVLDYS

SEQ ID NO: 2007666 - protein, 23 aa, Staphylococcus
EDLDPVFMWHLAHAYGEEERDTE

SEQ ID NO: 2007667 - protein, 27 aa, Staphylococcus
EDLDPVFTWHLAFAFGQEERDKEAQHF

SEQ ID NO: 2007668 - protein, 17 aa, Staphylococcus
EDLESVIDYAHHSNQPT

SEQ ID NO: 2007669 - protein, 24 aa, Staphylococcus
EDLEYRGQRLLGFIYEAAEQYQFD

SEQ ID NO: 2007670 - protein, 23 aa, Staphylococcus
EDLFKEYFASVVPAADNKFAALN

SEQ ID NO: 2007671 - protein, 24 aa, Staphylococcus
EDLFTKEEWLEMSIADQKAAEKQF

SEQ ID NO: 2007672 - protein, 24 aa, Staphylococcus
EDLFTKEEWLHMSVKERTRQEREF

SEQ ID NO: 2007673 - protein, 24 aa, Staphylococcus
EDLIEEIARIYGYDKIPSTLPVFD

SEQ ID NO: 2007674 - protein, 24 aa, Staphylococcus
EDLIEEIARIYGYDNIPSTLPVFD

SEQ ID NO: 2007675 - protein, 24 aa, Staphylococcus
EDLKQRLNLDEFALYSGNDDNIVD

SEQ ID NO: 2007676 - protein, 18 aa, Staphylococcus
EDLLALKFDDYMYTWDCG

SEQ ID NO: 2007677 - protein, 20 aa, Staphylococcus
EDLLKKGLEAWDLEFDIHHD

SEQ ID NO: 2007678 - protein, 19 aa, Staphylococcus
EDLLKPLIHELTDLHEDIP

SEQ ID NO: 2007679 - protein, 24 aa, Staphylococcus
EDLNHKLYHYWALGHIHQRQELSD

SEQ ID NO: 2007680 - protein, 24 aa, Staphylococcus
EDLNLPYDIVFTVGSATTEILSEL

SEQ ID NO: 2007681 - protein, 24 aa, Staphylococcus
EDLNNKLYHYWALGHIHERQQLSD

SEQ ID NO: 2007682 - protein, 24 aa, Staphylococcus
EDLNTKLYHYWALGHIHERSQLND

SEQ ID NO: 2007683 - protein, 19 aa, Staphylococcus
EDLPIIPKQMKTVVIGKTS

SEQ ID NO: 2007684 - protein, 22 aa, Staphylococcus
EDLPIYHALLLQGIDKKLEVMA

SEQ ID NO: 2007685 - protein, 17 aa, Staphylococcus
EDLPKVKDVWPVQGDEL

SEQ ID NO: 2007686 - protein, 18 aa, Staphylococcus
EDLPKVKSLWPQNGDYVL

SEQ ID NO: 2007687 - protein, 19 aa, Staphylococcus
EDLPKVKTLWPEAGDQLLV

SEQ ID NO: 2007688 - protein, 17 aa, Staphylococcus
EDLQIFYSYIVLNNNEV

SEQ ID NO: 2007689 - protein, 22 aa, Staphylococcus
EDLQRYFINGAIIGQSVNVARD

SEQ ID NO: 2007690 - protein, 20 aa, Staphylococcus
EDLRHIMEFLIAHIEENITF

SEQ ID NO: 2007691 - protein, 19 aa, Staphylococcus
EDLSLFFSYRVEKGQTGRM

SEQ ID NO: 2007692 - protein, 19 aa, Staphylococcus
EDLTQVAFYERGELLDAAS

SEQ ID NO: 2007693 - protein, 19 aa, Staphylococcus
EDLTWEIYRDTLIEQAEQG

SEQ ID NO: 2007694 - protein, 17 aa, Staphylococcus
EDLVLKEYGGIRINKEV

SEQ ID NO: 2007695 - protein, 25 aa, Staphylococcus
EDMYTEIKRSLNLVSPIRYIGSIKK

SEQ ID NO: 2007696 - protein, 18 aa, Staphylococcus
EDNDLFFIISLSGEATQL

SEQ ID NO: 2007697 - protein, 18 aa, Staphylococcus
EDNELWLSFSTKANHLIT

SEQ ID NO: 2007698 - protein, 33 aa, Staphylococcus
EDNRFYKHGALDYKRLFGAVGKNITGGFGSQGA

SEQ ID NO: 2007699 - protein, 23 aa, Staphylococcus
EDPEFKQLISYCLLENQSGEILV

SEQ ID NO: 2007700 - protein, 24 aa, Staphylococcus
EDPKPKFDYYFAIGKQTANTLHSY

SEQ ID NO: 2007701 - protein, 24 aa, Staphylococcus
EDPNWGRIFAAIGYTQSNFDINNV

SEQ ID NO: 2007702 - protein, 24 aa, Staphylococcus
EDQGEVFPSFTLPLEHPGYAMLEK

SEQ ID NO: 2007703 - protein, 24 aa, Staphylococcus
EDQKASGVVPELVRLSVGTENIND

SEQ ID NO: 2007704 - protein, 24 aa, Staphylococcus
EDQNLKLLGEDDIDEDDDIPAETD

SEQ ID NO: 2007705 - protein, 20 aa, Staphylococcus
EDQSHYKGGWVLNKKGQLEL

SEQ ID NO: 2007706 - protein, 23 aa, Staphylococcus
EDQYTVLIYDWRVLESESLQVNY

SEQ ID NO: 2007707 - protein, 20 aa, Staphylococcus
EDRVKLALLASFKNKSLLKF

SEQ ID NO: 2007708 - protein, 18 aa, Staphylococcus
EDSDIEKIVQRVNENKKK

SEQ ID NO: 2007709 - protein, 33 aa, Staphylococcus
EDSFYYNRFDHFKDRVLVPLAYIKFDEYLEELH

SEQ ID NO: 2007710 - protein, 24 aa, Staphylococcus
EDSGIPFTSIRNGFYAESGAEFFF

SEQ ID NO: 2007711 - protein, 18 aa, Staphylococcus
EDSIKWRYIENKLDQLME

SEQ ID NO: 2007712 - protein, 17 aa, Staphylococcus
EDSRRVLPDKYSHEKAV

SEQ ID NO: 2007713 - protein, 22 aa, Staphylococcus
EDSYDFPRVWLDKNSYDFSFSG

SEQ ID NO: 2007714 - protein, 18 aa, Staphylococcus
EDTCKFILKSVVQVEDDI

SEQ ID NO: 2007715 - protein, 22 aa, Staphylococcus
EDTCKYILKSVVQFEDDIEREK

SEQ ID NO: 2007716 - protein, 18 aa, Staphylococcus
EDTIKYGLDKGFNLTLHA

SEQ ID NO: 2007717 - protein, 24 aa, Staphylococcus
EDTMFKLKLINDLKDLDLDLQNIN

SEQ ID NO: 2007718 - protein, 22 aa, Staphylococcus
EDVDAAIYLCFEIYEDKIRVVV

SEQ ID NO: 2007719 - protein, 17 aa, Staphylococcus
EDVDEWIGLLDQLEEKV

SEQ ID NO: 2007720 - protein, 24 aa, Staphylococcus
EDVDFKAGETLIFDGQNILNNNLS

SEQ ID NO: 2007721 - protein, 18 aa, Staphylococcus
EDVDYIAASFVRRPSDVL

SEQ ID NO: 2007722 - protein, 21 aa, Staphylococcus
EDVFNKKMLVFGLTASPNYIM

SEQ ID NO: 2007723 - protein, 17 aa, Staphylococcus
EDVKAALGLDNDVAVFA

SEQ ID NO: 2007724 - protein, 29 aa, Staphylococcus
EDVKDCLINFGVWDMCLWNKTDNKVELPN

SEQ ID NO: 2007725 - protein, 28 aa, Staphylococcus
EDVKGRFEAYGWKHILVKDGNDLDAIDK

SEQ ID NO: 2007726 - protein, 23 aa, Staphylococcus
EDVKKRFESYGWNHILVKDGNDL

SEQ ID NO: 2007727 - protein, 23 aa, Staphylococcus
EDVKKRFESYGWNHILVKDGNNL

SEQ ID NO: 2007728 - protein, 27 aa, Staphylococcus
EDVKKRHIRHCYKADPDYGKGVAKALE

SEQ ID NO: 2007729 - protein, 18 aa, Staphylococcus
EDVKLLNSNGDWSVQYRN

SEQ ID NO: 2007730 - protein, 29 aa, Staphylococcus
EDVKSCLIDYGIWDLCQWNKTDNKVVLPN

SEQ ID NO: 2007731 - protein, 18 aa, Staphylococcus
EDVKSVLENVHRTLEERG

SEQ ID NO: 2007732 - protein, 27 aa, Staphylococcus
EDVNMCKKMLKDFGLDPEQGHIINGHT

SEQ ID NO: 2007733 - protein, 28 aa, Staphylococcus
EDVVQPLYCAKLWPEFTLFQPFQKKEIK

SEQ ID NO: 2007734 - protein, 19 aa, Staphylococcus
EDVYEPFLIQKGFLERTPR

SEQ ID NO: 2007735 - protein, 25 aa, Staphylococcus
EDVYKRLLNEAGFKEVKTFTDFDFN

SEQ ID NO: 2007736 - protein, 30 aa, Staphylococcus
EDVYQNFDWNEVEKAFSWYKTGKINMAYEC

SEQ ID NO: 2007737 - protein, 23 aa, Staphylococcus
EDWNYAIKFAKSIDSIDETQLLL

SEQ ID NO: 2007738 - protein, 19 aa, Staphylococcus
EDWQFDETLLREIVEELYA

SEQ ID NO: 2007739 - protein, 17 aa, Staphylococcus
EDYFVILVHPWQYNHTI

SEQ ID NO: 2007740 - protein, 24 aa, Staphylococcus
EDYGVYRFKRGFNVHIEELIGDFY

SEQ ID NO: 2007741 - protein, 21 aa, Staphylococcus
EDYTLVSLLYKGGEEAVTSIA

SEQ ID NO: 2007742 - protein, 20 aa, Staphylococcus
EDYVETFGGAVITVSHDRYF

SEQ ID NO: 2007743 - protein, 20 aa, Staphylococcus
EDYVSYAIKGNLMYENAYPL

SEQ ID NO: 2007744 - protein, 20 aa, Staphylococcus
EDYVSYAIKGNLMYENSYPL

SEQ ID NO: 2007745 - protein, 26 aa, Staphylococcus
EEAAKAETVAICWAMGITQQDIGSDS

SEQ ID NO: 2007746 - protein, 22 aa, Staphylococcus
EEAALEFIAKASEGGMRDALSI

SEQ ID NO: 2007747 - protein, 24 aa, Staphylococcus
EEAAREWLRTTGFKNIDDLNKVLA

SEQ ID NO: 2007748 - protein, 18 aa, Staphylococcus
EEACIRQARIVEGHLYDA

SEQ ID NO: 2007749 - protein, 22 aa, Staphylococcus
EEAFFKECEKVGVYGVIIPDLP

SEQ ID NO: 2007750 - protein, 18 aa, Staphylococcus
EEAFKEVGRIISLALKNP

SEQ ID NO: 2007751 - protein, 25 aa, Staphylococcus
EEAGICFKTDVEVGVDISKTTLEDT

SEQ ID NO: 2007752 - protein, 19 aa, Staphylococcus
EEAGLPKGVVNWIPGDSSD

SEQ ID NO: 2007753 - protein, 25 aa, Staphylococcus
EEAGYKAGIEYLNFDEQPATILDAE

SEQ ID NO: 2007754 - protein, 32 aa, Staphylococcus
EEAKCLMDEFWPGPISFILPLRQGYLCEKVTG

SEQ ID NO: 2007755 - protein, 21 aa, Staphylococcus
EEAKFSLALDRMLLGEPIQYI

SEQ ID NO: 2007756 - protein, 19 aa, Staphylococcus
EEAKMSGQVILLLDEIHRL

SEQ ID NO: 2007757 - protein, 23 aa, Staphylococcus
EEAKRLEEMNGYTMVEDAGRGYR

SEQ ID NO: 2007758 - protein, 21 aa, Staphylococcus
EEAKVKAVLGVIGEEGESTQQ

SEQ ID NO: 2007759 - protein, 26 aa, Staphylococcus
EEALKQIKRALGWVNLDSEEILGKYR

SEQ ID NO: 2007760 - protein, 22 aa, Staphylococcus
EEALKYIRDLAVNQNAKPIELD

SEQ ID NO: 2007761 - protein, 25 aa, Staphylococcus
EEANLPNFYAYYAIGRQTANTIRYY

SEQ ID NO: 2007762 - protein, 20 aa, Staphylococcus
EEAPGMPFYLSNGQFIRNQM

SEQ ID NO: 2007763 - protein, 20 aa, Staphylococcus
EEAPGMPFYLSNGQFVRNQM

SEQ ID NO: 2007764 - protein, 26 aa, Staphylococcus
EEAPWFKVSPTHFVKSWLLDERAPKV

SEQ ID NO: 2007765 - protein, 26 aa, Staphylococcus
EEAQAIWMSTFHSMCVRILRRDADRI

SEQ ID NO: 2007766 - protein, 37 aa, Staphylococcus
EEAQVIWMSTFHSMCVKILRRDADRIGIERNFTIIDP

SEQ ID NO: 2007767 - protein, 22 aa, Staphylococcus
EEARFGIGVLGGKVLDTISYEL

SEQ ID NO: 2007768 - protein, 22 aa, Staphylococcus
EEARKVTPYIFVDFHAETTSEK

SEQ ID NO: 2007769 - protein, 19 aa, Staphylococcus
EEAVELVVHAFKYAKTGDI

SEQ ID NO: 2007770 - protein, 20 aa, Staphylococcus
EECGSPMVIKMGRYGKFMAC

SEQ ID NO: 2007771 - protein, 18 aa, Staphylococcus
EECWTADLIVKVKEPDAK

SEQ ID NO: 2007772 - protein, 18 aa, Staphylococcus
EECYEFFDDLCTVNEIQS

SEQ ID NO: 2007773 - protein, 24 aa, Staphylococcus
EEDINILPIVEEFRESQAEANDLL

SEQ ID NO: 2007774 - protein, 27 aa, Staphylococcus
EEDLDPVFMWHLAYALGQEERDKEAQH

SEQ ID NO: 2007775 - protein, 28 aa, Staphylococcus
EEDLDPVFMWHLAYAYGHEERDKEAQHF

SEQ ID NO: 2007776 - protein, 26 aa, Staphylococcus
EEDLDPVFMWHLAYAYGQEERDKEAQ

SEQ ID NO: 2007777 - protein, 28 aa, Staphylococcus
EEDLELLESVAFQIGSAIKRIILTNKEK

SEQ ID NO: 2007778 - protein, 25 aa, Staphylococcus
EEDLELLESVAFQIGSTIKRIELTN

SEQ ID NO: 2007779 - protein, 23 aa, Staphylococcus
EEDLKEIYKWMDLGRKVDERLWL

SEQ ID NO: 2007780 - protein, 21 aa, Staphylococcus
EEDWNRFTVAVGKLSRTKIFI

SEQ ID NO: 2007781 - protein, 22 aa, Staphylococcus
EEEDKFLVLYLSFLENVEQITE

SEQ ID NO: 2007782 - protein, 27 aa, Staphylococcus
EEEFKRCVKELGFKGALIMGHPKSGFL

SEQ ID NO: 2007783 - protein, 25 aa, Staphylococcus
EEEGSRFPFAFWGSKNFFNLADEED

SEQ ID NO: 2007784 - protein, 24 aa, Staphylococcus
EEEKAHITIFPKIENQEGIDNIDE

SEQ ID NO: 2007785 - protein, 18 aa, Staphylococcus
EEEKRFMHHYNFPNFSVG

SEQ ID NO: 2007786 - protein, 21 aa, Staphylococcus
EEELRAAVTEAHRKGRTACSH

SEQ ID NO: 2007787 - protein, 26 aa, Staphylococcus
EEELRLLNMFKQRQIAGVIMGALEND

SEQ ID NO: 2007788 - protein, 24 aa, Staphylococcus
EEEMFLGLRMNQGVNRERFKLKFG

SEQ ID NO: 2007789 - protein, 22 aa, Staphylococcus
EEERQNIDILIGYDGHVDQSFL

SEQ ID NO: 2007790 - protein, 22 aa, Staphylococcus
EEFKAAVEGVIFDINLKELKSG

SEQ ID NO: 2007791 - protein, 17 aa, Staphylococcus
EEFKEYLPVNSDTPKLT

SEQ ID NO: 2007792 - protein, 29 aa, Staphylococcus
EEFKRIFGDLKIDWFIHYTGFERKEAEMM

SEQ ID NO: 2007793 - protein, 27 aa, Staphylococcus
EEFKRLFGDVKIDWMIHYTGFERKEAE

SEQ ID NO: 2007794 - protein, 26 aa, Staphylococcus
EEFKRVVELILDVYEDFGFENYSFRL

SEQ ID NO: 2007795 - protein, 20 aa, Staphylococcus
EEFKRVVNMIQDVYKDFGFE

SEQ ID NO: 2007796 - protein, 19 aa, Staphylococcus
EEFKRVVNMIQEVYEDFGF

SEQ ID NO: 2007797 - protein, 21 aa, Staphylococcus
EEFKVAIEGVIFDINIKELKS

SEQ ID NO: 2007798 - protein, 21 aa, Staphylococcus
EEFKVAIEGVIFDMNIKELKS

SEQ ID NO: 2007799 - protein, 25 aa, Staphylococcus
EEFMIPRVKQMLTRFYAENIEHRRW

SEQ ID NO: 2007800 - protein, 22 aa, Staphylococcus
EEFRPRIKAKIGGRRNGALISM

SEQ ID NO: 2007801 - protein, 19 aa, Staphylococcus
EEGNYAVGLFFTNSPIEGS

SEQ ID NO: 2007802 - protein, 17 aa, Staphylococcus
EEGPGEHDYAFWDKAIE

SEQ ID NO: 2007803 - protein, 22 aa, Staphylococcus
EEGRFAEFMDLDGFYNSFKNVL

SEQ ID NO: 2007804 - protein, 18 aa, Staphylococcus
EEGRRIRKAFKPAEPGNV

SEQ ID NO: 2007805 - protein, 17 aa, Staphylococcus
EEGRRIRKAFKSSDDNN

SEQ ID NO: 2007806 - protein, 24 aa, Staphylococcus
EEGTTYKIYFGFASRQTYEDFKSS

SEQ ID NO: 2007807 - protein, 28 aa, Staphylococcus
EEGYALVGCMCHPGFMFETFELFEQSTL

SEQ ID NO: 2007808 - protein, 20 aa, Staphylococcus
EEGYKPAIVIATAGTTNTGS

SEQ ID NO: 2007809 - protein, 32 aa, Staphylococcus
EEHAFDFPGFVPAYIRPLFCEGKGPFRFAALS

SEQ ID NO: 2007810 - protein, 22 aa, Staphylococcus
EEHDACGIGFYANMDNKRSHDI

SEQ ID NO: 2007811 - protein, 24 aa, Staphylococcus
EEHGFKGNTWLFFGDQHFTTDFLY

SEQ ID NO: 2007812 - protein, 21 aa, Staphylococcus
EEHKARIDSIRKVSKKLGKTI

SEQ ID NO: 2007813 - protein, 17 aa, Staphylococcus
EEIAVTGLARFDRLPLK

SEQ ID NO: 2007814 - protein, 23 aa, Staphylococcus
EEIDKCFYKYYGLNKLINLLLKE

SEQ ID NO: 2007815 - protein, 17 aa, Staphylococcus
EEIDLLYEKVIKYGQSL

SEQ ID NO: 2007816 - protein, 17 aa, Staphylococcus
EEIDVTLELKLLADVGL

SEQ ID NO: 2007817 - protein, 20 aa, Staphylococcus
EEIEDLFLGLGYEIVDGFEV

SEQ ID NO: 2007818 - protein, 19 aa, Staphylococcus
EEIEEAISLSENKSNIEEK

SEQ ID NO: 2007819 - protein, 19 aa, Staphylococcus
EEIEKRLNQKKAFQVEFGQ

SEQ ID NO: 2007820 - protein, 24 aa, Staphylococcus
EEIIEPRLQSAVFNPILDNNSDIY

SEQ ID NO: 2007821 - protein, 20 aa, Staphylococcus
EEIIPLFSKIFLLKEGSCFD

SEQ ID NO: 2007822 - protein, 25 aa, Staphylococcus
EEIITRKIFREEMENYFKAMLSEKQ

SEQ ID NO: 2007823 - protein, 19 aa, Staphylococcus
EEIKADMELQKPMDRLLCG

SEQ ID NO: 2007824 - protein, 20 aa, Staphylococcus
EEIKFSLATERMLLGEPIQY

SEQ ID NO: 2007825 - protein, 23 aa, Staphylococcus
EEIKGRRDLRNDLTITIDGADAK

SEQ ID NO: 2007826 - protein, 17 aa, Staphylococcus
EEIKNIQIGMAHRGRLN

SEQ ID NO: 2007827 - protein, 22 aa, Staphylococcus
EEIKQDMEIERPMDRLLCGDVG

SEQ ID NO: 2007828 - protein, 26 aa, Staphylococcus
EEIKTQMLEWILPYYKSLSREGMKDI

SEQ ID NO: 2007829 - protein, 17 aa, Staphylococcus
EEILERIGKYYYGSDDI

SEQ ID NO: 2007830 - protein, 23 aa, Staphylococcus
EEILNIKELILLDLKKTSLNDEE

SEQ ID NO: 2007831 - protein, 21 aa, Staphylococcus
EEILPEAFALVREGAKRVFNM

SEQ ID NO: 2007832 - protein, 21 aa, Staphylococcus
EEILTRYSFQLSGGQLERVYI

SEQ ID NO: 2007833 - protein, 29 aa, Staphylococcus
EEINAPSWLHHLLRIYQLAPRFIEKHFTF

SEQ ID NO: 2007834 - protein, 20 aa, Staphylococcus
EEINGLKVLALQVDAENAKA

SEQ ID NO: 2007835 - protein, 17 aa, Staphylococcus
EEINHRLGYDLNDDTSQ

SEQ ID NO: 2007836 - protein, 24 aa, Staphylococcus
EEINYKVGDCILFSLEYEALSQLM

SEQ ID NO: 2007837 - protein, 22 aa, Staphylococcus
EEIPHSIGVNVDRMVKQSEDRV

SEQ ID NO: 2007838 - protein, 21 aa, Staphylococcus
EEIPLEKEHLIEYLDDSYPFY

SEQ ID NO: 2007839 - protein, 22 aa, Staphylococcus
EEIQFQYGLVLCHLEMFEAAVA

SEQ ID NO: 2007840 - protein, 17 aa, Staphylococcus
EEIQLILNFYRNKTIQD

SEQ ID NO: 2007841 - protein, 20 aa, Staphylococcus
EEIRGQRICIYYDEVTEVPE

SEQ ID NO: 2007842 - protein, 19 aa, Staphylococcus
EEISHYWSTVRPYYVDFES

SEQ ID NO: 2007843 - protein, 17 aa, Staphylococcus
EEITFESNTSWPLALPV

SEQ ID NO: 2007844 - protein, 26 aa, Staphylococcus
EEITSGCICCAMKADVSQQLHQLYIH

SEQ ID NO: 2007845 - protein, 26 aa, Staphylococcus
EEIYFPEFDDYLLLWKLEVLDNYKNK

SEQ ID NO: 2007846 - protein, 25 aa, Staphylococcus
EEIYIPRIKQMLTRFYAENIEHRRW

SEQ ID NO: 2007847 - protein, 22 aa, Staphylococcus
EEIYRIDHYLGKDMVQNIEVLR

SEQ ID NO: 2007848 - protein, 23 aa, Staphylococcus
EEKAHSITAIWNFEKQNYYLKNL

SEQ ID NO: 2007849 - protein, 18 aa, Staphylococcus
EEKALPYVDYMSELISIV

SEQ ID NO: 2007850 - protein, 22 aa, Staphylococcus
EEKEMSGSMLFRDKGYVDDLDG

SEQ ID NO: 2007851 - protein, 19 aa, Staphylococcus
EEKFLTLYLNFVEKNDVSN

SEQ ID NO: 2007852 - protein, 25 aa, Staphylococcus
EEKIWYKLLVNLGINSITALGHNTA

SEQ ID NO: 2007853 - protein, 25 aa, Staphylococcus
EEKIWYKLLVNLGINSITALGRDTA

SEQ ID NO: 2007854 - protein, 23 aa, Staphylococcus
EEKLADNILLYFNQVSNLDDEKL

SEQ ID NO: 2007855 - protein, 25 aa, Staphylococcus
EEKMKELQDFIARFSANASKSKQAT

SEQ ID NO: 2007856 - protein, 21 aa, Staphylococcus
EEKPDIIVIAGDLYDTTYPGK

SEQ ID NO: 2007857 - protein, 24 aa, Staphylococcus
EEKQCPTCHMTLKDIAHVGKFGCA

SEQ ID NO: 2007858 - protein, 23 aa, Staphylococcus
EEKTFKALKQWFQSYEDVLSIHI

SEQ ID NO: 2007859 - protein, 20 aa, Staphylococcus
EEKVLIHVSNFRKVKRIDTI

SEQ ID NO: 2007860 - protein, 55 aa, Staphylococcus
EEKVRFKLYKAGKHWIKAGLKDIELLRIMGMPFGRKTIEKEQKLEIDVDTTDDLK

SEQ ID NO: 2007861 - protein, 17 aa, Staphylococcus
EEKYNHFNFVSVDRDEF

SEQ ID NO: 2007862 - protein, 18 aa, Staphylococcus
EELAHWFAKNDYFYIMHR

SEQ ID NO: 2007863 - protein, 24 aa, Staphylococcus
EELCIELDPGMAFGTGDHPTTSMC

SEQ ID NO: 2007864 - protein, 18 aa, Staphylococcus
EELDLKELVLPLIVLDYS

SEQ ID NO: 2007865 - protein, 19 aa, Staphylococcus
EELDLTGKTWLFFGNQHFT

SEQ ID NO: 2007866 - protein, 25 aa, Staphylococcus
EELEKLRLLTHVQYFYNYNNENALN

SEQ ID NO: 2007867 - protein, 22 aa, Staphylococcus
EELFKDFLGKPVRVTVKNETSE

SEQ ID NO: 2007868 - protein, 23 aa, Staphylococcus
EELFKEYFASVVPAADNKFAALN

SEQ ID NO: 2007869 - protein, 19 aa, Staphylococcus
EELGLKFGERGLIEVDKQS

SEQ ID NO: 2007870 - protein, 17 aa, Staphylococcus
EELIHREKMNFGVINIL

SEQ ID NO: 2007871 - protein, 25 aa, Staphylococcus
EELKEQKEIFLLTEILSGKNSHKLT

SEQ ID NO: 2007872 - protein, 17 aa, Staphylococcus
EELKKKLTKEGYFDSSV

SEQ ID NO: 2007873 - protein, 26 aa, Staphylococcus
EELKLPYRRVNLCTGDIGFSASKTYD

SEQ ID NO: 2007874 - protein, 20 aa, Staphylococcus
EELKMMINIMKPEYFIPVNG

SEQ ID NO: 2007875 - protein, 20 aa, Staphylococcus
EELKMMINIMKPEYFIPVQG

SEQ ID NO: 2007876 - protein, 20 aa, Staphylococcus
EELKMMINIMKPEYFVPVQG

SEQ ID NO: 2007877 - protein, 21 aa, Staphylococcus
EELKMMLNIMKPEYFIPVQGE

SEQ ID NO: 2007878 - protein, 18 aa, Staphylococcus
EELKVMVQEAQFRGNRKV

SEQ ID NO: 2007879 - protein, 20 aa, Staphylococcus
EELLKALGFSIQREQLYMND

SEQ ID NO: 2007880 - protein, 17 aa, Staphylococcus
EELLKRDEKIAVIMNEF

SEQ ID NO: 2007881 - protein, 25 aa, Staphylococcus
EELLSALQLWLLRINYLDQPQFYPS

SEQ ID NO: 2007882 - protein, 25 aa, Staphylococcus
EELNHKLKEALRIGDVESQKYYLQM

SEQ ID NO: 2007883 - protein, 18 aa, Staphylococcus
EELNRLFLYKEVKSTGFV

SEQ ID NO: 2007884 - protein, 17 aa, Staphylococcus
EELNYGAKMAWRNSNRC

SEQ ID NO: 2007885 - protein, 20 aa, Staphylococcus
EELQQFWHGLADDLVRNEQF

SEQ ID NO: 2007886 - protein, 18 aa, Staphylococcus
EELREFVEAAKIPVIHTL

SEQ ID NO: 2007887 - protein, 24 aa, Staphylococcus
EELSETGYRCIVHVDESYHPSQQQ

SEQ ID NO: 2007888 - protein, 19 aa, Staphylococcus
EELSHYWSTVRPYYVDFES

SEQ ID NO: 2007889 - protein, 25 aa, Staphylococcus
EELSQKMPVFFSANMSYGIHVLTKL

SEQ ID NO: 2007890 - protein, 25 aa, Staphylococcus
EELSQTSFKRWFVDFEFPDEDGNPY

SEQ ID NO: 2007891 - protein, 24 aa, Staphylococcus
EELSYGAKLAWRNSNRCIGRLFWD

SEQ ID NO: 2007892 - protein, 17 aa, Staphylococcus
EELTEIFDYNVYVHHRD

SEQ ID NO: 2007893 - protein, 30 aa, Staphylococcus
EELTYGAKMAWRHSNRCIGRFFWESLNVKD

SEQ ID NO: 2007894 - protein, 17 aa, Staphylococcus
EELWSRLGHDETITYQP

SEQ ID NO: 2007895 - protein, 43 aa, Staphylococcus
EEMAQCFKESFEARPDQMLKFGLPRLVKYLNMDIEEAQRSLKA

SEQ ID NO: 2007896 - protein, 20 aa, Staphylococcus
EEMEEAFEIGFKKGLDINFK

SEQ ID NO: 2007897 - protein, 21 aa, Staphylococcus
EEMFLGLRLNNGVNKNKFNKK

SEQ ID NO: 2007898 - protein, 25 aa, Staphylococcus
EEMFLGLRMNKGVNIIRFKQKFDQS

SEQ ID NO: 2007899 - protein, 20 aa, Staphylococcus
EEMFLGLRMNQGVNKARFKE

SEQ ID NO: 2007900 - protein, 17 aa, Staphylococcus
EEMGKCFEGAFDAQAAQ

SEQ ID NO: 2007901 - protein, 20 aa, Staphylococcus
EEMGRLAARVIQQHHQSFFI

SEQ ID NO: 2007902 - protein, 22 aa, Staphylococcus
EEMKLQSPKLMLGFKNQPLDES

SEQ ID NO: 2007903 - protein, 25 aa, Staphylococcus
EEMKLQSPRLMLGFKNEPTEASPHE

SEQ ID NO: 2007904 - protein, 26 aa, Staphylococcus
EEMKYKRAAGVAFGPVDYVKYAESFG

SEQ ID NO: 2007905 - protein, 23 aa, Staphylococcus
EEMLKFSELMQSVGKQVSVDDVQ

SEQ ID NO: 2007906 - protein, 17 aa, Staphylococcus
EEMMEMSALGAGVLETR

SEQ ID NO: 2007907 - protein, 26 aa, Staphylococcus
EEMPTLRWVAWYAAGVNNLPLEYFKE

SEQ ID NO: 2007908 - protein, 21 aa, Staphylococcus
EEMRRLDSLIIAAADKARVPA

SEQ ID NO: 2007909 - protein, 20 aa, Staphylococcus
EEMRRLDSLIISAADKARVP

SEQ ID NO: 2007910 - protein, 19 aa, Staphylococcus
EEMSKPFAKLKQMEADMQA

SEQ ID NO: 2007911 - protein, 19 aa, Staphylococcus
EEMSVYDAICTIFLEDAGT

SEQ ID NO: 2007912 - protein, 26 aa, Staphylococcus
EEMTKFKGTMLAKLTDGFHLHTISAD

SEQ ID NO: 2007913 - protein, 23 aa, Staphylococcus
EEMYDIAGLRMMCQFVDDIDIVV

SEQ ID NO: 2007914 - protein, 22 aa, Staphylococcus
EENDVFMINKFISAVEKEIGYK

SEQ ID NO: 2007915 - protein, 26 aa, Staphylococcus
EENELLPKFIIGFGGIPNHKLKEHTD

SEQ ID NO: 2007916 - protein, 20 aa, Staphylococcus
EENFLLLLFAKVLSEQMGRE

SEQ ID NO: 2007917 - protein, 25 aa, Staphylococcus
EENKYKVLGPFVRKSLSLTEENFKT

SEQ ID NO: 2007918 - protein, 27 aa, Staphylococcus
EENRNLLQRLWDGIVEIIQSIIQFFSN

SEQ ID NO: 2007919 - protein, 25 aa, Staphylococcus
EENSAEFYKWIQAGATIYLCGNKDE

SEQ ID NO: 2007920 - protein, 21 aa, Staphylococcus
EEPDFLIVIYHGGLDKISKSN

SEQ ID NO: 2007921 - protein, 19 aa, Staphylococcus
EEPGIRMELTKELLEHLRE

SEQ ID NO: 2007922 - protein, 19 aa, Staphylococcus
EEPHLKYKADKIIENYHKL

SEQ ID NO: 2007923 - protein, 18 aa, Staphylococcus
EEPHLKYKSDKIIDNYHK

SEQ ID NO: 2007924 - protein, 18 aa, Staphylococcus
EEPHLKYKSDKIIENYHK

SEQ ID NO: 2007925 - protein, 19 aa, Staphylococcus
EEPHLKYKSDKIIENYHKL

SEQ ID NO: 2007926 - protein, 18 aa, Staphylococcus
EEPHLKYKSDKIINNYHK

SEQ ID NO: 2007927 - protein, 18 aa, Staphylococcus
EEPHLKYKSDKIISNYHK

SEQ ID NO: 2007928 - protein, 21 aa, Staphylococcus
EEPLVFPLIALIVSGGHTELV

SEQ ID NO: 2007929 - protein, 26 aa, Staphylococcus
EEPPISVKEGGLFKTGFNETLDSYLE

SEQ ID NO: 2007930 - protein, 17 aa, Staphylococcus
EEQFIKDCEAAGVYGLI

SEQ ID NO: 2007931 - protein, 19 aa, Staphylococcus
EEQKRIYAFQSVPNLLENL

SEQ ID NO: 2007932 - protein, 23 aa, Staphylococcus
EEQLKVGRFLNSFDKLIEKQVSK

SEQ ID NO: 2007933 - protein, 25 aa, Staphylococcus
EEQNRIKLKYLFKLSDKKKYILYCP

SEQ ID NO: 2007934 - protein, 17 aa, Staphylococcus
EEQPIESIIHVAKKIMK

SEQ ID NO: 2007935 - protein, 24 aa, Staphylococcus
EEQQRRLKLVIDMLQDKVNQQIRQ

SEQ ID NO: 2007936 - protein, 18 aa, Staphylococcus
EEQVCMNRNMALMGRNAE

SEQ ID NO: 2007937 - protein, 20 aa, Staphylococcus
EEQVHIWRRSYDIAPPDATA

SEQ ID NO: 2007938 - protein, 17 aa, Staphylococcus
EEQVHQWRRSYDVQPPA

SEQ ID NO: 2007939 - protein, 18 aa, Staphylococcus
EERARFYSVADMQKKVGY

SEQ ID NO: 2007940 - protein, 21 aa, Staphylococcus
EERDKRLLIEFEAYKTQQKKI

SEQ ID NO: 2007941 - protein, 20 aa, Staphylococcus
EERGYHLSKTEYRGREATDF

SEQ ID NO: 2007942 - protein, 19 aa, Staphylococcus
EERIKYILDDFNAKYVITD

SEQ ID NO: 2007943 - protein, 19 aa, Staphylococcus
EERIRRLSKENVFETLSNV

SEQ ID NO: 2007944 - protein, 21 aa, Staphylococcus
EERKQLPAKFVDTMLDAQKDD

SEQ ID NO: 2007945 - protein, 18 aa, Staphylococcus
EERPQIIVANKMDVPGAQ

SEQ ID NO: 2007946 - protein, 18 aa, Staphylococcus
EERQMLGQMISQVHQQQK

SEQ ID NO: 2007947 - protein, 24 aa, Staphylococcus
EERQWLIIIYICISNEFITINKLM

SEQ ID NO: 2007948 - protein, 20 aa, Staphylococcus
EERVKYILDRTDYYGYSGDT

SEQ ID NO: 2007949 - protein, 17 aa, Staphylococcus
EERVMRPLHFAIIDEVD

SEQ ID NO: 2007950 - protein, 18 aa, Staphylococcus
EERVMRPLHFAIIDEVDS

SEQ ID NO: 2007951 - protein, 20 aa, Staphylococcus
EERYLLFLIEQAHISDDLTA

SEQ ID NO: 2007952 - protein, 27 aa, Staphylococcus
EESDMYLCPDLDTWVIFPWTAGQGKVA

SEQ ID NO: 2007953 - protein, 30 aa, Staphylococcus
EESDMYLCPDLDTWVIFPWTAGQGKVARLI

SEQ ID NO: 2007954 - protein, 20 aa, Staphylococcus
EESFLYTHFEDICKILNQYD

SEQ ID NO: 2007955 - protein, 19 aa, Staphylococcus
EESGLNFIASRNGFYSANG

SEQ ID NO: 2007956 - protein, 21 aa, Staphylococcus
EESGRWSAYGPELMRLKDRNG

SEQ ID NO: 2007957 - protein, 21 aa, Staphylococcus
EESGRWSAYGPELMRLQDRNG

SEQ ID NO: 2007958 - protein, 18 aa, Staphylococcus
EESLFPHIRAIKSDDEHE

SEQ ID NO: 2007959 - protein, 27 aa, Staphylococcus
EESQKSNGRWARNFVQELLVRHKNKVI

SEQ ID NO: 2007960 - protein, 19 aa, Staphylococcus
EESRMIIELAAQVYRGILT

SEQ ID NO: 2007961 - protein, 21 aa, Staphylococcus
EESSFEFSLRPTKLKQYIGQS

SEQ ID NO: 2007962 - protein, 25 aa, Staphylococcus
EETDHLIHLPFDYMFFTGSDKVGKI

SEQ ID NO: 2007963 - protein, 24 aa, Staphylococcus
EETFKKLLIHPTIASKHYLYEQYD

SEQ ID NO: 2007964 - protein, 18 aa, Staphylococcus
EETGINCSIGIGSNMLLS

SEQ ID NO: 2007965 - protein, 18 aa, Staphylococcus
EETGYKANHLTFITHMYG

SEQ ID NO: 2007966 - protein, 25 aa, Staphylococcus
EETIKEAAMLSGYFSKAGSSAQIPV

SEQ ID NO: 2007967 - protein, 22 aa, Staphylococcus
EETIKGVVLFHETLKSLNVKHE

SEQ ID NO: 2007968 - protein, 21 aa, Staphylococcus
EETKHGIALSEVNDFIEQIKA

SEQ ID NO: 2007969 - protein, 20 aa, Staphylococcus
EETKYLNVFGAFDNNHLVAT

SEQ ID NO: 2007970 - protein, 18 aa, Staphylococcus
EETLPELFIQCGTEDFLY

SEQ ID NO: 2007971 - protein, 19 aa, Staphylococcus
EETPFAAVILAEIFDKVGV

SEQ ID NO: 2007972 - protein, 20 aa, Staphylococcus
EETPFAAVILAEIFDKVGVP

SEQ ID NO: 2007973 - protein, 27 aa, Staphylococcus
EETYHLLKRKHFEYMKDNALFINVGRG

SEQ ID NO: 2007974 - protein, 20 aa, Staphylococcus
EETYRIARKLGEALQITNIL

SEQ ID NO: 2007975 - protein, 22 aa, Staphylococcus
EEVAELFKGNGMGDIYKEETFE

SEQ ID NO: 2007976 - protein, 17 aa, Staphylococcus
EEVDGYNAIQVGFEDKK

SEQ ID NO: 2007977 - protein, 17 aa, Staphylococcus
EEVDSRYVLNQLNRNPI

SEQ ID NO: 2007978 - protein, 24 aa, Staphylococcus
EEVENFPGFEMVTGPDLSTKMFEH

SEQ ID NO: 2007979 - protein, 17 aa, Staphylococcus
EEVFKKLNATVINTEYK

SEQ ID NO: 2007980 - protein, 18 aa, Staphylococcus
EEVGEDITIVPVSTITRD

SEQ ID NO: 2007981 - protein, 18 aa, Staphylococcus
EEVIDVWFDSGSMPFAQH

SEQ ID NO: 2007982 - protein, 30 aa, Staphylococcus
EEVKIGATVIAGFGARIVRINDYSVDFKPN

SEQ ID NO: 2007983 - protein, 23 aa, Staphylococcus
EEVKVASISPELFFQKGTFNDKA

SEQ ID NO: 2007984 - protein, 26 aa, Staphylococcus
EEVLILLTLWEKGPMTLKEMDQYVNI

SEQ ID NO: 2007985 - protein, 18 aa, Staphylococcus
EEVLKAELKKGLDSLNDD

SEQ ID NO: 2007986 - protein, 25 aa, Staphylococcus
EEVLYPAMEDFFLDIVIGKGEEARS

SEQ ID NO: 2007987 - protein, 24 aa, Staphylococcus
EEVLYPAMEDFYLDIVIGKGEEAR

SEQ ID NO: 2007988 - protein, 28 aa, Staphylococcus
EEVMISVLRAPRTFTREDIIEINCHGGI

SEQ ID NO: 2007989 - protein, 20 aa, Staphylococcus
EEVMKYAAENNITFIPYFPL

SEQ ID NO: 2007990 - protein, 17 aa, Staphylococcus
EEVPSTYLRPSNKHIEI

SEQ ID NO: 2007991 - protein, 20 aa, Staphylococcus
EEVQNIIELIKSFQHEIIKL

SEQ ID NO: 2007992 - protein, 19 aa, Staphylococcus
EEVSLPVIGIVKRDYEGSN

SEQ ID NO: 2007993 - protein, 18 aa, Staphylococcus
EEVYEIFQQSMLKRANEK

SEQ ID NO: 2007994 - protein, 18 aa, Staphylococcus
EEVYEIFQTSMLKRANEN

SEQ ID NO: 2007995 - protein, 19 aa, Staphylococcus
EEVYEIFQTTMLKRANENE

SEQ ID NO: 2007996 - protein, 20 aa, Staphylococcus
EEWARAGKVTILRAAVLTPY

SEQ ID NO: 2007997 - protein, 23 aa, Staphylococcus
EEWMFRWNHNIRLPEKNIYFHSI

SEQ ID NO: 2007998 - protein, 18 aa, Staphylococcus
EEWRDWLKHVFKQDIANL

SEQ ID NO: 2007999 - protein, 23 aa, Staphylococcus
EEYASEVFFFFTVPQKDELYYSQ

SEQ ID NO: 2008000 - protein, 24 aa, Staphylococcus
EEYASFIRKQWAKLGLGLDYSRER

SEQ ID NO: 2008001 - protein, 19 aa, Staphylococcus
EEYASFIRQQWAKLGLGLD

SEQ ID NO: 2008002 - protein, 23 aa, Staphylococcus
EEYEWLQQSTFDFPDKDKLKQLF

SEQ ID NO: 2008003 - protein, 22 aa, Staphylococcus
EEYEWLQQSTFNFPDKQTLKRL

SEQ ID NO: 2008004 - protein, 17 aa, Staphylococcus
EEYEWLQQSTFNFPDKT

SEQ ID NO: 2008005 - protein, 25 aa, Staphylococcus
EEYFLKQFCKAHHVELYVRHLDLSD

SEQ ID NO: 2008006 - protein, 17 aa, Staphylococcus
EEYKKTGVSVFGQQYNG

SEQ ID NO: 2008007 - protein, 19 aa, Staphylococcus
EEYKRKNFSVVEYESKKYL

SEQ ID NO: 2008008 - protein, 24 aa, Staphylococcus
EEYKWMKPCYTYEGHNVVLIHGFK

SEQ ID NO: 2008009 - protein, 25 aa, Staphylococcus
EEYKYFREGLILFTYLHLANEEKLT

SEQ ID NO: 2008010 - protein, 17 aa, Staphylococcus
EEYLRLLRKLQLKLEII

SEQ ID NO: 2008011 - protein, 25 aa, Staphylococcus
EEYRCPYCKKKLLLKKGLKKIPHFA

SEQ ID NO: 2008012 - protein, 18 aa, Staphylococcus
EEYRDCFDEEQFVNRYSE

SEQ ID NO: 2008013 - protein, 19 aa, Staphylococcus
EEYVKISLIGSGMRDMSGV

SEQ ID NO: 2008014 - protein, 27 aa, Staphylococcus
EFACGIPGSIGGAVFMNAGAYGGEVKD

SEQ ID NO: 2008015 - protein, 26 aa, Staphylococcus
EFACGIPGSIGGAVFMNAGAYGGEVR

SEQ ID NO: 2008016 - protein, 25 aa, Staphylococcus
EFACGIPGSIGGAVYMNAGAYGGEV

SEQ ID NO: 2008017 - protein, 29 aa, Staphylococcus
EFAECLSLADKTFLCEIFGSIRENSGNLT

SEQ ID NO: 2008018 - protein, 18 aa, Staphylococcus
EFAMSLIAYSGDAKSHAM

SEQ ID NO: 2008019 - protein, 18 aa, Staphylococcus
EFANKRFMKMTNNRYILK

SEQ ID NO: 2008020 - protein, 19 aa, Staphylococcus
EFAREVLKKVDVFEADTLE

SEQ ID NO: 2008021 - protein, 26 aa, Staphylococcus
EFAVFKRPMLFYAFDLEDYITSRDFY

SEQ ID NO: 2008022 - protein, 24 aa, Staphylococcus
EFDFEPKAHWDLVEELKMADFERA

SEQ ID NO: 2008023 - protein, 28 aa, Staphylococcus
EFDIPASWKLVAQMPFGDIREKAGEKEI

SEQ ID NO: 2008024 - protein, 20 aa, Staphylococcus
EFDLTKYLVSQLMLSNEERV

SEQ ID NO: 2008025 - protein, 20 aa, Staphylococcus
EFDMEPLILTLRANASYKNF

SEQ ID NO: 2008026 - protein, 21 aa, Staphylococcus
EFDSGLDLYVSETINIPAHTT

SEQ ID NO: 2008027 - protein, 21 aa, Staphylococcus
EFDSMPTVVGFFPEIAEGDVY

SEQ ID NO: 2008028 - protein, 24 aa, Staphylococcus
EFEIITTMMFVYFGQIHPVDFVVV

SEQ ID NO: 2008029 - protein, 20 aa, Staphylococcus
EFEKGVGIDLAYNSLEKANT

SEQ ID NO: 2008030 - protein, 20 aa, Staphylococcus
EFEKHMYAIHTITSLYTTSS

SEQ ID NO: 2008031 - protein, 31 aa, Staphylococcus
EFEKLCAYIKQYAERIPVFGINCSSVAGINK

SEQ ID NO: 2008032 - protein, 20 aa, Staphylococcus
EFENAFLLRTFSKAYGLAGM

SEQ ID NO: 2008033 - protein, 19 aa, Staphylococcus
EFENSSGYSSYHAVKAVQS

SEQ ID NO: 2008034 - protein, 32 aa, Staphylococcus
EFEPETSQALGFGFRTGFLGMLHMEIIQERIE

SEQ ID NO: 2008035 - protein, 23 aa, Staphylococcus
EFERFPTDFIPFFEGTMTIEQYV

SEQ ID NO: 2008036 - protein, 21 aa, Staphylococcus
EFETTMSIVFDCHIYTLRQVY

SEQ ID NO: 2008037 - protein, 23 aa, Staphylococcus
EFFFKKLTHYVSMRRGVFILVDP

SEQ ID NO: 2008038 - protein, 18 aa, Staphylococcus
EFFKWYENQNQFKFDNAT

SEQ ID NO: 2008039 - protein, 18 aa, Staphylococcus
EFFPSLKAHQDVLGQERG

SEQ ID NO: 2008040 - protein, 18 aa, Staphylococcus
EFGALMITHYQRLLNYIT

SEQ ID NO: 2008041 - protein, 22 aa, Staphylococcus
EFGHSAHSYFSRKNQPSNHSDY

SEQ ID NO: 2008042 - protein, 21 aa, Staphylococcus
EFGHSAHSYFSRKNQPSNSSD

SEQ ID NO: 2008043 - protein, 22 aa, Staphylococcus
EFGKLRKAAMDKGFKHCEAGPM

SEQ ID NO: 2008044 - protein, 22 aa, Staphylococcus
EFGKLRKIAMEKGFKHCEAGPM

SEQ ID NO: 2008045 - protein, 17 aa, Staphylococcus
EFGSLIITHYQRLLNYI

SEQ ID NO: 2008046 - protein, 24 aa, Staphylococcus
EFGVYLRKVRGWATLPEQIEKNKA

SEQ ID NO: 2008047 - protein, 30 aa, Staphylococcus
EFHDGVCSFNILIRCGKGTYIRTLATDIGN

SEQ ID NO: 2008048 - protein, 29 aa, Staphylococcus
EFHEFLHSRKAPKLEGVRFSVLALGDQTY

SEQ ID NO: 2008049 - protein, 24 aa, Staphylococcus
EFICPNNKRIGFKRYAYRHDKYGF

SEQ ID NO: 2008050 - protein, 23 aa, Staphylococcus
EFIKPSISVPVHYNTFPLIEQDP

SEQ ID NO: 2008051 - protein, 23 aa, Staphylococcus
EFIQPKISVPIHYDTFPYIEQNP

SEQ ID NO: 2008052 - protein, 24 aa, Staphylococcus
EFIQPKISVPIHYNTFPLIEQNPQ

SEQ ID NO: 2008053 - protein, 27 aa, Staphylococcus
EFISPDVKFAMISSIDIARIAANLFKD

SEQ ID NO: 2008054 - protein, 25 aa, Staphylococcus
EFIVCGLKSAYILKDTSEAFKKDAH

SEQ ID NO: 2008055 - protein, 21 aa, Staphylococcus
EFKDLMIKQIMGIDDIKDAKR

SEQ ID NO: 2008056 - protein, 22 aa, Staphylococcus
EFKEAKKTIFFVSHNLRQVREF

SEQ ID NO: 2008057 - protein, 25 aa, Staphylococcus
EFKFFKEGQVIWGFQHLASSKETVE

SEQ ID NO: 2008058 - protein, 23 aa, Staphylococcus
EFKIAFNDIEFLPPVTPPNNVIA

SEQ ID NO: 2008059 - protein, 22 aa, Staphylococcus
EFKISFNDVEFLPPVTPPNNVI

SEQ ID NO: 2008060 - protein, 24 aa, Staphylococcus
EFKKDVKVSLFIGGTDFERDKQRC

SEQ ID NO: 2008061 - protein, 24 aa, Staphylococcus
EFKLYKKVTIVLGKNVSSKESFQF

SEQ ID NO: 2008062 - protein, 21 aa, Staphylococcus
EFKQHFPQSGWVEHDANEIWT

SEQ ID NO: 2008063 - protein, 24 aa, Staphylococcus
EFKQNFKPLMKMEGDVFNQQFDSL

SEQ ID NO: 2008064 - protein, 23 aa, Staphylococcus
EFKSNKTILDYVWDQYPMMNEKD

SEQ ID NO: 2008065 - protein, 22 aa, Staphylococcus
EFKSNKTILDYVWDQYPNMNEK

SEQ ID NO: 2008066 - protein, 23 aa, Staphylococcus
EFKSNKTILDYVWDQYPTMNEKD

SEQ ID NO: 2008067 - protein, 23 aa, Staphylococcus
EFKSNKTILNYLWDQFPNMNEKD

SEQ ID NO: 2008068 - protein, 19 aa, Staphylococcus
EFLGEGDKVLIIDDFLANG

SEQ ID NO: 2008069 - protein, 19 aa, Staphylococcus
EFLHEIRVDRIIFGDPAVV

SEQ ID NO: 2008070 - protein, 24 aa, Staphylococcus
EFLKKKEDLLMWIVIHDHKEYKII

SEQ ID NO: 2008071 - protein, 22 aa, Staphylococcus
EFLPSRIDFMADYYQQDDNVDI

SEQ ID NO: 2008072 - protein, 24 aa, Staphylococcus
EFLQKYKGGMGILLGGVPGVSKGR

SEQ ID NO: 2008073 - protein, 20 aa, Staphylococcus
EFLTGGILSVITNWIQHGQQ

SEQ ID NO: 2008074 - protein, 18 aa, Staphylococcus
EFLTSEKWMAMEPKLLYV

SEQ ID NO: 2008075 - protein, 21 aa, Staphylococcus
EFMATPPYDGAFCEYVSHPAD

SEQ ID NO: 2008076 - protein, 19 aa, Staphylococcus
EFNEWLEKGASIYICGDEK

SEQ ID NO: 2008077 - protein, 26 aa, Staphylococcus
EFNISLPFTNQFILKMERDMQDSSKD

SEQ ID NO: 2008078 - protein, 22 aa, Staphylococcus
EFNLLIKQIKVFEGHLNQLLKM

SEQ ID NO: 2008079 - protein, 19 aa, Staphylococcus
EFNLTKYLVSQLMLSHKDR

SEQ ID NO: 2008080 - protein, 20 aa, Staphylococcus
EFNLTKYLVSQLMLSNEERV

SEQ ID NO: 2008081 - protein, 26 aa, Staphylococcus
EFNSDWSRSQIQDWIKEDLVTVNGKK

SEQ ID NO: 2008082 - protein, 22 aa, Staphylococcus
EFPEEAYAYKIELINAGLSELF

SEQ ID NO: 2008083 - protein, 21 aa, Staphylococcus
EFPRDFNITPDDNFVVCAHQE

SEQ ID NO: 2008084 - protein, 19 aa, Staphylococcus
EFQDKVTVQPGFKALKSET

SEQ ID NO: 2008085 - protein, 17 aa, Staphylococcus
EFQEIHRPLVLKKYDGL

SEQ ID NO: 2008086 - protein, 25 aa, Staphylococcus
EFQYFKEGLILFTYLHLANEEKLTR

SEQ ID NO: 2008087 - protein, 25 aa, Staphylococcus
EFRHFAGSYAIQWKMINYAIDHNID

SEQ ID NO: 2008088 - protein, 25 aa, Staphylococcus
EFRHFAGSYAVQWEMINYAIQHGID

SEQ ID NO: 2008089 - protein, 20 aa, Staphylococcus
EFRMYPHDFVPFFEGTMTIE

SEQ ID NO: 2008090 - protein, 17 aa, Staphylococcus
EFSEDYVSYAIKGNLMY

SEQ ID NO: 2008091 - protein, 21 aa, Staphylococcus
EFSEVYEEIVARLVEAAQSED

SEQ ID NO: 2008092 - protein, 24 aa, Staphylococcus
EFSLKAFNLYGALSMANAGPNTNG

SEQ ID NO: 2008093 - protein, 18 aa, Staphylococcus
EFSSLSWINNQEVALVGV

SEQ ID NO: 2008094 - protein, 24 aa, Staphylococcus
EFTAGWCPDCKVIEPDLPKLEKKY

SEQ ID NO: 2008095 - protein, 19 aa, Staphylococcus
EFTIPMYVFDDLYEEYSEW

SEQ ID NO: 2008096 - protein, 18 aa, Staphylococcus
EFTVPMYVFDDLYEEYTE

SEQ ID NO: 2008097 - protein, 17 aa, Staphylococcus
EFVDEAVDRACYLLERY

SEQ ID NO: 2008098 - protein, 21 aa, Staphylococcus
EFVNESPFEKAWMVKVELDDE

SEQ ID NO: 2008099 - protein, 26 aa, Staphylococcus
EFVVEGPLWIQVHAFEKGVEVLISKS

SEQ ID NO: 2008100 - protein, 23 aa, Staphylococcus
EFVVEMKLTYLWINADKPEEQLE

SEQ ID NO: 2008101 - protein, 23 aa, Staphylococcus
EFVYNRMGGFYGVKRSKSSNPKR

SEQ ID NO: 2008102 - protein, 20 aa, Staphylococcus
EFYFLPSYMAPLKEHQDFLD

SEQ ID NO: 2008103 - protein, 17 aa, Staphylococcus
EFYGMFNDPFGITWMIN

SEQ ID NO: 2008104 - protein, 22 aa, Staphylococcus
EFYQCLNHLLNIFDQYEQINQY

SEQ ID NO: 2008105 - protein, 19 aa, Staphylococcus
EGAALAMSILDYVRNLGSL

SEQ ID NO: 2008106 - protein, 27 aa, Staphylococcus
EGACPECHGKGVLKTELAFMPDFSQVC

SEQ ID NO: 2008107 - protein, 18 aa, Staphylococcus
EGADGVSVISVITHSQNI

SEQ ID NO: 2008108 - protein, 20 aa, Staphylococcus
EGADRPKVLVGRDTRVSGEM

SEQ ID NO: 2008109 - protein, 18 aa, Staphylococcus
EGALKLYTKLGFKHNGDI

SEQ ID NO: 2008110 - protein, 19 aa, Staphylococcus
EGALTRVLAFSKLQGQPIT

SEQ ID NO: 2008111 - protein, 28 aa, Staphylococcus
EGAMSIDNPHLWQPLNAYLYHMKVELLN

SEQ ID NO: 2008112 - protein, 19 aa, Staphylococcus
EGANLAKVFYYFKEAHPYF

SEQ ID NO: 2008113 - protein, 22 aa, Staphylococcus
EGAQRPGHFDGVVTVLNKLFNI

SEQ ID NO: 2008114 - protein, 22 aa, Staphylococcus
EGAQRPGHFEGVVTVVNKLFNI

SEQ ID NO: 2008115 - protein, 23 aa, Staphylococcus
EGAQRPGHFEGVVTVVNKLFNIV

SEQ ID NO: 2008116 - protein, 22 aa, Staphylococcus
EGAQRPIHFNGVVTVVNKLFNI

SEQ ID NO: 2008117 - protein, 27 aa, Staphylococcus
EGARVKSLHPFYYPLGEVVSISRMIED

SEQ ID NO: 2008118 - protein, 17 aa, Staphylococcus
EGAVCSTILDMYSKQAI

SEQ ID NO: 2008119 - protein, 18 aa, Staphylococcus
EGAWNVYERAGFMHTATK

SEQ ID NO: 2008120 - protein, 24 aa, Staphylococcus
EGAYDLLIIMSHVGVFFDEKLCQE

SEQ ID NO: 2008121 - protein, 25 aa, Staphylococcus
EGAYKIKYIRRIDLSDVHPQLANAK

SEQ ID NO: 2008122 - protein, 24 aa, Staphylococcus
EGAYKVYIIESFEKLTVQGENSIL

SEQ ID NO: 2008123 - protein, 19 aa, Staphylococcus
EGDAFTFDKVLFVGGDAVK

SEQ ID NO: 2008124 - protein, 25 aa, Staphylococcus
EGDDAKEYWLCWVTTERSEQGPYYA

SEQ ID NO: 2008125 - protein, 19 aa, Staphylococcus
EGDDCGIASLKIESDGTLS

SEQ ID NO: 2008126 - protein, 19 aa, Staphylococcus
EGDDIFYNLNVSFPQAALG

SEQ ID NO: 2008127 - protein, 25 aa, Staphylococcus
EGDEAKEYWLCWVTTERGENGPYYA

SEQ ID NO: 2008128 - protein, 25 aa, Staphylococcus
EGDEAKEYWLCWVTTERSEQGPYYA

SEQ ID NO: 2008129 - protein, 21 aa, Staphylococcus
EGDKGFGQEAIDTILKYMEDH

SEQ ID NO: 2008130 - protein, 19 aa, Staphylococcus
EGDMNWRKVVGDFYNSFKQ

SEQ ID NO: 2008131 - protein, 19 aa, Staphylococcus
EGDMTDFNLNLSFDLITIF

SEQ ID NO: 2008132 - protein, 26 aa, Staphylococcus
EGDMTRFKLDYQFDIITIFCDSLNYL

SEQ ID NO: 2008133 - protein, 23 aa, Staphylococcus
EGDPRAKYLKEMSRKITSETGHN

SEQ ID NO: 2008134 - protein, 24 aa, Staphylococcus
EGDSIKSSYKYALNNSDKIAKYYV

SEQ ID NO: 2008135 - protein, 31 aa, Staphylococcus
EGDSRLNLFLGGIDRYGLEFEYLPQSNTFML

SEQ ID NO: 2008136 - protein, 17 aa, Staphylococcus
EGDVEFRASIGSDDKSK

SEQ ID NO: 2008137 - protein, 24 aa, Staphylococcus
EGDYKVYIIESFEKLTVQGENSIL

SEQ ID NO: 2008138 - protein, 20 aa, Staphylococcus
EGDYLTADILKFGIQADGHF

SEQ ID NO: 2008139 - protein, 23 aa, Staphylococcus
EGEAALNYLKERGFTDELIDARK

SEQ ID NO: 2008140 - protein, 25 aa, Staphylococcus
EGEEAKEYWLCWVTTERGENGPYYA

SEQ ID NO: 2008141 - protein, 25 aa, Staphylococcus
EGEEAKEYWLCWVTTERSESGPYYA

SEQ ID NO: 2008142 - protein, 25 aa, Staphylococcus
EGEERLKLIHQWVDGRIPVIGIGSV

SEQ ID NO: 2008143 - protein, 24 aa, Staphylococcus
EGEEVKVVVGIAGKDGEHLDLLSK

SEQ ID NO: 2008144 - protein, 19 aa, Staphylococcus
EGEEVMLLRHMILAHHGKL

SEQ ID NO: 2008145 - protein, 19 aa, Staphylococcus
EGEEVMLLRHMILAHHGKM

SEQ ID NO: 2008146 - protein, 22 aa, Staphylococcus
EGEICFGNEPLMRVEAPLIQAQ

SEQ ID NO: 2008147 - protein, 24 aa, Staphylococcus
EGEIPILGVCLGFQFIYEYYGGTI

SEQ ID NO: 2008148 - protein, 26 aa, Staphylococcus
EGELCFGNEPMLRVEAPLIQAQLLET

SEQ ID NO: 2008149 - protein, 26 aa, Staphylococcus
EGELDRYPLAKFKRSNTGTCYNQRPI

SEQ ID NO: 2008150 - protein, 17 aa, Staphylococcus
EGELFMSYIEKQDKVIF

SEQ ID NO: 2008151 - protein, 24 aa, Staphylococcus
EGELKDKLFINGRYFNEYVMAKIL

SEQ ID NO: 2008152 - protein, 20 aa, Staphylococcus
EGELVARLILDKVHNKKPIK

SEQ ID NO: 2008153 - protein, 18 aa, Staphylococcus
EGEMKFRIACTNHHHHHF

SEQ ID NO: 2008154 - protein, 17 aa, Staphylococcus
EGERAVHMSDILPTNAH

SEQ ID NO: 2008155 - protein, 24 aa, Staphylococcus
EGERDLKERLIRTVGEPRERFEED

SEQ ID NO: 2008156 - protein, 23 aa, Staphylococcus
EGERKLAALSFLTFVALDQSGKP

SEQ ID NO: 2008157 - protein, 22 aa, Staphylococcus
EGESLTAPILNKIMLDVYETFF

SEQ ID NO: 2008158 - protein, 20 aa, Staphylococcus
EGEVCFNNEPLLRVEAPLIQ

SEQ ID NO: 2008159 - protein, 23 aa, Staphylococcus
EGEVPFKPSRVILQDFTGVPAVV

SEQ ID NO: 2008160 - protein, 41 aa, Staphylococcus
EGFDIPDCHCVILLRPTESLSLFIQQTMRAMRYQLNKEAII

SEQ ID NO: 2008161 - protein, 20 aa, Staphylococcus
EGFEKALLIREYVHPLEKVF

SEQ ID NO: 2008162 - protein, 20 aa, Staphylococcus
EGFELPYMQLVVITERELFK

SEQ ID NO: 2008163 - protein, 17 aa, Staphylococcus
EGFGLIHAVGKGSIHEP

SEQ ID NO: 2008164 - protein, 19 aa, Staphylococcus
EGFGPRIIRINDFSVDFQP

SEQ ID NO: 2008165 - protein, 26 aa, Staphylococcus
EGFHICKGDLFGKHRHGEDCLFCLQT

SEQ ID NO: 2008166 - protein, 17 aa, Staphylococcus
EGFHILKKLNKVLEKRR

SEQ ID NO: 2008167 - protein, 17 aa, Staphylococcus
EGFKFDVLHSPGHSPGS

SEQ ID NO: 2008168 - protein, 19 aa, Staphylococcus
EGFPNVIGEAMSVGVPVIS

SEQ ID NO: 2008169 - protein, 19 aa, Staphylococcus
EGFSKIYPINELKEALQEA

SEQ ID NO: 2008170 - protein, 23 aa, Staphylococcus
EGFYRRMVIIPMLRKFGKDGQKK

SEQ ID NO: 2008171 - protein, 24 aa, Staphylococcus
EGGAWGIAVLARYLIDVKEGVTLA

SEQ ID NO: 2008172 - protein, 23 aa, Staphylococcus
EGGGFRLAEEGLIFSNGLNGPKA

SEQ ID NO: 2008173 - protein, 27 aa, Staphylococcus
EGGKRCTACFEMRLELVAEAAVKYGYD

SEQ ID NO: 2008174 - protein, 17 aa, Staphylococcus
EGGLKEYFAEQELVEPF

SEQ ID NO: 2008175 - protein, 27 aa, Staphylococcus
EGGLRCTTCFEMRLEMVAEAAIKYGYD

SEQ ID NO: 2008176 - protein, 36 aa, Staphylococcus; identical to SEQ ID NO: 1713109

SEQ ID NO: 2008177 - protein, 18 aa, Staphylococcus
EGHCTALIGPNCAGKSTL

SEQ ID NO: 2008178 - protein, 25 aa, Staphylococcus
EGHGVIKLDRYPIFVPNVLIDEEVE

SEQ ID NO: 2008179 - protein, 20 aa, Staphylococcus
EGHLKYGITSKAGYSGFIEY

SEQ ID NO: 2008180 - protein, 18 aa, Staphylococcus
EGHLPKTILYNLNPIYND

SEQ ID NO: 2008181 - protein, 24 aa, Staphylococcus
EGHMFKFYVDKSISDWKQESEWIR

SEQ ID NO: 2008182 - protein, 23 aa, Staphylococcus
EGHPVRHAILWNDTRNSEQCKQI

SEQ ID NO: 2008183 - protein, 23 aa, Staphylococcus
EGHTGTPWLGPDVQDLTRTLYNE

SEQ ID NO: 2008184 - protein, 23 aa, Staphylococcus
EGHTPLIYCERMSEKLGIELHVK

SEQ ID NO: 2008185 - protein, 20 aa, Staphylococcus
EGIDALLFRTSMPKNELKKI

SEQ ID NO: 2008186 - protein, 20 aa, Staphylococcus
EGIELLNYIKRIFTILHEAE

SEQ ID NO: 2008187 - protein, 25 aa, Staphylococcus
EGIGKAKITPAYNLPCRYVLHTVGP

SEQ ID NO: 2008188 - protein, 18 aa, Staphylococcus
EGIKELLEEIDLDAELKH

SEQ ID NO: 2008189 - protein, 17 aa, Staphylococcus
EGIKLARDFSNIPPNIL

SEQ ID NO: 2008190 - protein, 18 aa, Staphylococcus
EGIKRLQDSIQHFTQIES

SEQ ID NO: 2008191 - protein, 19 aa, Staphylococcus
EGINIAKAEHVHFEPNIVN

SEQ ID NO: 2008192 - protein, 20 aa, Staphylococcus
EGIQQWFPQLSFEDRQVGGK

SEQ ID NO: 2008193 - protein, 19 aa, Staphylococcus
EGISEIFKSMGATHMISGG

SEQ ID NO: 2008194 - protein, 19 aa, Staphylococcus
EGISLFELQARQLLHLKNE

SEQ ID NO: 2008195 - protein, 19 aa, Staphylococcus
EGISVARAEGLNFDVNTRD

SEQ ID NO: 2008196 - protein, 20 aa, Staphylococcus
EGIVCPVSGTANWTDIRQFN

SEQ ID NO: 2008197 - protein, 25 aa, Staphylococcus
EGIYIDVYCSLAYGINISETAKKIQ

SEQ ID NO: 2008198 - protein, 27 aa, Staphylococcus
EGIYTPELLKFPFIPVSDASGIVVEIG

SEQ ID NO: 2008199 - protein, 20 aa, Staphylococcus
EGKALLSDAVIDYPIQLPRR

SEQ ID NO: 2008200 - protein, 19 aa, Staphylococcus
EGKAMVIVVNKWDAVEKDT

SEQ ID NO: 2008201 - protein, 21 aa, Staphylococcus
EGKAPRVKFEKVFADHFMALY

SEQ ID NO: 2008202 - protein, 18 aa, Staphylococcus
EGKDEFYRGDLNDVTELI

SEQ ID NO: 2008203 - protein, 22 aa, Staphylococcus
EGKDFKGIYPSSANYTTDLHSL

SEQ ID NO: 2008204 - protein, 23 aa, Staphylococcus
EGKDHFLRISIDKEGGVDLNDCT

SEQ ID NO: 2008205 - protein, 21 aa, Staphylococcus
EGKDHFLRVSIDKEGGVDLND

SEQ ID NO: 2008206 - protein, 19 aa, Staphylococcus
EGKDRFLRVSIDKEGGVDL

SEQ ID NO: 2008207 - protein, 19 aa, Staphylococcus
EGKFTIGRNHLGTLGKVVF

SEQ ID NO: 2008208 - protein, 22 aa, Staphylococcus
EGKGIYRFVLDEAKAAIEKVET

SEQ ID NO: 2008209 - protein, 30 aa, Staphylococcus
EGKGWDFDGVYGWQCVDLANMYWYKLFGHG

SEQ ID NO: 2008210 - protein, 25 aa, Staphylococcus
EGKHAPIIGKDLWDKVQARKKQVSE

SEQ ID NO: 2008211 - protein, 21 aa, Staphylococcus
EGKHPIRIILSKRGQIDYSKQ

SEQ ID NO: 2008212 - protein, 25 aa, Staphylococcus
EGKIPRVKFEKVFADHFMTLYDKTK

SEQ ID NO: 2008213 - protein, 23 aa, Staphylococcus
EGKKCLCHNDFSCNHLLLDGNNR

SEQ ID NO: 2008214 - protein, 24 aa, Staphylococcus
EGKLPREVIRYEYDLEYGTNILTM

SEQ ID NO: 2008215 - protein, 25 aa, Staphylococcus
EGKLPREVIRYEYDLEYGTNVLTMH

SEQ ID NO: 2008216 - protein, 23 aa, Staphylococcus
EGKLPREVIRYEYNLEYGTNVLT

SEQ ID NO: 2008217 - protein, 22 aa, Staphylococcus
EGKLPREVIRYEYSLEYGTNIL

SEQ ID NO: 2008218 - protein, 17 aa, Staphylococcus
EGKRANLIATIGSGSPV

SEQ ID NO: 2008219 - protein, 19 aa, Staphylococcus
EGKRVFYSHVDEIIDDLDR

SEQ ID NO: 2008220 - protein, 25 aa, Staphylococcus
EGKVIRLANFGAFVEIAPGVQGLVH

SEQ ID NO: 2008221 - protein, 25 aa, Staphylococcus
EGKVVRLANFGAFVEIAPGVQGLVH

SEQ ID NO: 2008222 - protein, 24 aa, Staphylococcus
EGKWKNKEVINFGQIIGKDYINGK

SEQ ID NO: 2008223 - protein, 18 aa, Staphylococcus
EGKYRFSKENNIEYPKNE

SEQ ID NO: 2008224 - protein, 19 aa, Staphylococcus
EGLAERKAKNILIEPEGSI

SEQ ID NO: 2008225 - protein, 20 aa, Staphylococcus
EGLASTGLKRSDLFITSKLW

SEQ ID NO: 2008226 - protein, 20 aa, Staphylococcus
EGLDGAGLIVEFEHPNMKDY

SEQ ID NO: 2008227 - protein, 27 aa, Staphylococcus
EGLDKCLDKNIPIILVSRSFNGIVGPI

SEQ ID NO: 2008228 - protein, 27 aa, Staphylococcus
EGLDMPRVLGDIIICADVAKEQAEEYG

SEQ ID NO: 2008229 - protein, 20 aa, Staphylococcus
EGLEVKLLYDDVGSKKVNMA

SEQ ID NO: 2008230 - protein, 25 aa, Staphylococcus
EGLFADYGEIFGRMISAQMRNYQIR

SEQ ID NO: 2008231 - protein, 22 aa, Staphylococcus
EGLGIEVGNFISFDPRTEITSS

SEQ ID NO: 2008232 - protein, 23 aa, Staphylococcus
EGLKRFDTLVLTGGLGPTKDDLT

SEQ ID NO: 2008233 - protein, 20 aa, Staphylococcus
EGLLDFRRFGGTMHHRTAYA

SEQ ID NO: 2008234 - protein, 28 aa, Staphylococcus
EGLNFAGVHKLPFVCVIINNKYAISVPN

SEQ ID NO: 2008235 - protein, 19 aa, Staphylococcus
EGLNHIVVDSVQFGNQEMI

SEQ ID NO: 2008236 - protein, 17 aa, Staphylococcus
EGLPHYTQYQCVMNCSN

SEQ ID NO: 2008237 - protein, 19 aa, Staphylococcus
EGLPKVIAAKAHLESIDKD

SEQ ID NO: 2008238 - protein, 18 aa, Staphylococcus
EGLQQIKQVFGDKAIDQN

SEQ ID NO: 2008239 - protein, 18 aa, Staphylococcus
EGLRMRTSIVALSGEARE

SEQ ID NO: 2008240 - protein, 17 aa, Staphylococcus
EGLTDLFEFNTLIEYNH

SEQ ID NO: 2008241 - protein, 18 aa, Staphylococcus
EGLTDLFEFNTLIEYNHL

SEQ ID NO: 2008242 - protein, 17 aa, Staphylococcus
EGLVLAVEPFISSNATF

SEQ ID NO: 2008243 - protein, 19 aa, Staphylococcus
EGLVRAGIGKLTIVDRDYI

SEQ ID NO: 2008244 - protein, 28 aa, Staphylococcus
EGMPSKALFKECFKALINKQETNLAKEG

SEQ ID NO: 2008245 - protein, 20 aa, Staphylococcus
EGMSCDHCKHAVETALTELD

SEQ ID NO: 2008246 - protein, 21 aa, Staphylococcus
EGMSCDHCKNAVESALAKMNG

SEQ ID NO: 2008247 - protein, 21 aa, Staphylococcus
EGMSCDHCRNAVESALAKLNG

SEQ ID NO: 2008248 - protein, 22 aa, Staphylococcus
EGMSCGHCKSAVESAVGNIEGV

SEQ ID NO: 2008249 - protein, 20 aa, Staphylococcus
EGNAGLSLYSSTKFAVRGLT

SEQ ID NO: 2008250 - protein, 25 aa, Staphylococcus
EGNALKFYVDYDFEMWKYDEDNRVK

SEQ ID NO: 2008251 - protein, 26 aa, Staphylococcus
EGNFAMWWLGNCGIWIKTPEGANIVM

SEQ ID NO: 2008252 - protein, 19 aa, Staphylococcus
EGNHWKAIGQMNAYHEPTK

SEQ ID NO: 2008253 - protein, 18 aa, Staphylococcus
EGNKSLVLEGDFGTSFKP

SEQ ID NO: 2008254 - protein, 22 aa, Staphylococcus
EGNLKIGQTVKVAYFKQTEERL

SEQ ID NO: 2008255 - protein, 18 aa, Staphylococcus
EGNLTKMRATIVCEPSLV

SEQ ID NO: 2008256 - protein, 19 aa, Staphylococcus
EGNMLKFYVDYPLEDWLYR

SEQ ID NO: 2008257 - protein, 22 aa, Staphylococcus
EGNQHLPGWGLDALKFLIEERG

SEQ ID NO: 2008258 - protein, 20 aa, Staphylococcus
EGNRLFYLAMAPQFFGPISD

SEQ ID NO: 2008259 - protein, 20 aa, Staphylococcus
EGNRTFASWMDNIAKMINHV

SEQ ID NO: 2008260 - protein, 19 aa, Staphylococcus
EGNTPLIYCANMSEMLGIE

SEQ ID NO: 2008261 - protein, 21 aa, Staphylococcus
EGNYEYCFFESAGKGQFKPVG

SEQ ID NO: 2008262 - protein, 20 aa, Staphylococcus
EGNYEYCFFESKGQGQFKPV

SEQ ID NO: 2008263 - protein, 20 aa, Staphylococcus
EGNYEYCFFESKGTGQFKPV

SEQ ID NO: 2008264 - protein, 20 aa, Staphylococcus
EGNYKVYIVEDFEKLTVQGE

SEQ ID NO: 2008265 - protein, 25 aa, Staphylococcus
EGPEAKEYWLCWVTTERGENGPYYA

SEQ ID NO: 2008266 - protein, 25 aa, Staphylococcus
EGPEAKEYWLCWVTTERGEQGAYYA

SEQ ID NO: 2008267 - protein, 24 aa, Staphylococcus
EGPKVIEFNARFGDPEAQVLLTRM

SEQ ID NO: 2008268 - protein, 32 aa, Staphylococcus
EGPSVKALHPFYYPLNKLFSISEMITCAGYQS

SEQ ID NO: 2008269 - protein, 19 aa, Staphylococcus
EGQDIFFMMDLHYENDMFH

SEQ ID NO: 2008270 - protein, 22 aa, Staphylococcus
EGQDILRFSNMVAAKVTTKYGA

SEQ ID NO: 2008271 - protein, 25 aa, Staphylococcus
EGQEELTVFLLNGFQMKGTIVDFDD

SEQ ID NO: 2008272 - protein, 19 aa, Staphylococcus
EGQEKLAHHPRLILQSNIQ

SEQ ID NO: 2008273 - protein, 17 aa, Staphylococcus
EGQITLSLGNQLYRANA

SEQ ID NO: 2008274 - protein, 25 aa, Staphylococcus
EGQKAVHMADIFPTLAHRNPLWVTA

SEQ ID NO: 2008275 - protein, 21 aa, Staphylococcus
EGQNRLELIHKWINGRMPLIG

SEQ ID NO: 2008276 - protein, 25 aa, Staphylococcus
EGQPGICLVGPIVEHMSQIPKANSR

SEQ ID NO: 2008277 - protein, 23 aa, Staphylococcus
EGQPLRNAILWNDTRNSEQCRQI

SEQ ID NO: 2008278 - protein, 23 aa, Staphylococcus
EGQQHLPGWGLDALKFLIEERHI

SEQ ID NO: 2008279 - protein, 17 aa, Staphylococcus
EGQRLALQQDESWMRGM

SEQ ID NO: 2008280 - protein, 19 aa, Staphylococcus
EGQTLFFGGLSRIDYVSGG

SEQ ID NO: 2008281 - protein, 19 aa, Staphylococcus
EGRFIRLKLLEKFETEKMH

SEQ ID NO: 2008282 - protein, 21 aa, Staphylococcus
EGRGLICAPLAPSLAKKLNLT

SEQ ID NO: 2008283 - protein, 18 aa, Staphylococcus
EGRIIGYINGPVINQRYI

SEQ ID NO: 2008284 - protein, 21 aa, Staphylococcus
EGRKPSIRFRVPKDKTYSFKD

SEQ ID NO: 2008285 - protein, 21 aa, Staphylococcus
EGRKPSIRFRVPKDTTYSFDD

SEQ ID NO: 2008286 - protein, 24 aa, Staphylococcus
EGRLDMSICTKGWYEQLVEKHHQF

SEQ ID NO: 2008287 - protein, 18 aa, Staphylococcus
EGRLLGAVLNKTPVDKSS

SEQ ID NO: 2008288 - protein, 20 aa, Staphylococcus
EGRRDLRNDLTITIDGADAK

SEQ ID NO: 2008289 - protein, 24 aa, Staphylococcus
EGRRSEIEEVIFAPTIDYKCVTTM

SEQ ID NO: 2008290 - protein, 19 aa, Staphylococcus
EGSDQYRGWFNSSITTAVA

SEQ ID NO: 2008291 - protein, 19 aa, Staphylococcus
EGSEIASFSVATERNYNYQ

SEQ ID NO: 2008292 - protein, 17 aa, Staphylococcus
EGSFMIESGIVKDITKK

SEQ ID NO: 2008293 - protein, 18 aa, Staphylococcus
EGSFVIYAIQLVEKGYTA

SEQ ID NO: 2008294 - protein, 33 aa, Staphylococcus
EGSKRVFNMIPFKVQVMGGIAIHKGDIAEMRTG

SEQ ID NO: 2008295 - protein, 23 aa, Staphylococcus
EGSLHMLRRPISICHIEPELDTF

SEQ ID NO: 2008296 - protein, 19 aa, Staphylococcus
EGSLRCDANISLRPYGQKE

SEQ ID NO: 2008297 - protein, 20 aa, Staphylococcus
EGSLRCDANISLRPYGQKEF

SEQ ID NO: 2008298 - protein, 19 aa, Staphylococcus
EGSNGIGIQAPYRLFDINY

SEQ ID NO: 2008299 - protein, 22 aa, Staphylococcus
EGSYKWGVTTSLSYFPKDNSEF

SEQ ID NO: 2008300 - protein, 17 aa, Staphylococcus
EGTFKVIARKEVVEEVF

SEQ ID NO: 2008301 - protein, 18 aa, Staphylococcus
EGTFKVIARKEVVEEVFD

SEQ ID NO: 2008302 - protein, 17 aa, Staphylococcus
EGTHKVYIIEDFEKLTV

SEQ ID NO: 2008303 - protein, 19 aa, Staphylococcus
EGTIAEWLKNVGDSVDKGE

SEQ ID NO: 2008304 - protein, 19 aa, Staphylococcus
EGTIAEWLKQVGDSVDKGE

SEQ ID NO: 2008305 - protein, 26 aa, Staphylococcus
EGTIARLTNFGAFVDIGGVDGLVHVS

SEQ ID NO: 2008306 - protein, 20 aa, Staphylococcus
EGTLPLKEIIEVGRESGSEY

SEQ ID NO: 2008307 - protein, 25 aa, Staphylococcus
EGTMPQTRFVLKKALEQDLKPVVVV

SEQ ID NO: 2008308 - protein, 18 aa, Staphylococcus
EGTNAFRLFNAEGDGVGG

SEQ ID NO: 2008309 - protein, 31 aa, Staphylococcus
EGTSIKALRPFYYPLNKLFSISEMIKKAGYE

SEQ ID NO: 2008310 - protein, 20 aa, Staphylococcus
EGTVKWGVTTSLSYFPKDNS

SEQ ID NO: 2008311 - protein, 20 aa, Staphylococcus
EGTVKWGVTTSQTYFPKDNS

SEQ ID NO: 2008312 - protein, 25 aa, Staphylococcus
EGTVVRLAAFGAFVEVAPGVQGLVH

SEQ ID NO: 2008313 - protein, 25 aa, Staphylococcus
EGTVVRLANFGAFVEIAPAVQGLVH

SEQ ID NO: 2008314 - protein, 25 aa, Staphylococcus
EGTVVRLANFGAFVEIAPGVQGLVH

SEQ ID NO: 2008315 - protein, 26 aa, Staphylococcus
EGTVVRLANFGAFVEIKPGVQGLVHI

SEQ ID NO: 2008316 - protein, 19 aa, Staphylococcus
EGTYKVYIIEDFEKLTVQG

SEQ ID NO: 2008317 - protein, 17 aa, Staphylococcus
EGVAKEIVDNSVGDYED

SEQ ID NO: 2008318 - protein, 21 aa, Staphylococcus
EGVDMRLHRVIYNVIEEIESA

SEQ ID NO: 2008319 - protein, 19 aa, Staphylococcus
EGVIKVMAKMGISTVQSYH

SEQ ID NO: 2008320 - protein, 17 aa, Staphylococcus
EGVKEESGELIKANENG

SEQ ID NO: 2008321 - protein, 17 aa, Staphylococcus
EGVLCLLSDSTNALVPD

SEQ ID NO: 2008322 - protein, 23 aa, Staphylococcus
EGVRLKAYFNEMTYDNTLLSNIE

SEQ ID NO: 2008323 - protein, 18 aa, Staphylococcus
EGVSLFELQARQLLELKK

SEQ ID NO: 2008324 - protein, 17 aa, Staphylococcus
EGVSRTPNRAYLRALGF

SEQ ID NO: 2008325 - protein, 19 aa, Staphylococcus
EGYARVSGKPGVVVVTSGP

SEQ ID NO: 2008326 - protein, 19 aa, Staphylococcus
EGYARVSGKTGVVVVTSGP

SEQ ID NO: 2008327 - protein, 20 aa, Staphylococcus
EGYEIYEMILDDLPKVLNKG

SEQ ID NO: 2008328 - protein, 17 aa, Staphylococcus
EGYEVIIHYNRSDITML

SEQ ID NO: 2008329 - protein, 33 aa, Staphylococcus
EGYHTLMMIGRYPICYINIKMDPILVDVNVHPT

SEQ ID NO: 2008330 - protein, 21 aa, Staphylococcus
EGYKVAICEQMEDPKTTKGMV

SEQ ID NO: 2008331 - protein, 21 aa, Staphylococcus
EGYMTPFGIAFGVGNSTKQAI

SEQ ID NO: 2008332 - protein, 26 aa, Staphylococcus
EGYMWECPDLFELDGQHVLLFSPQGM

SEQ ID NO: 2008333 - protein, 18 aa, Staphylococcus
EGYPSHSSDKFKLSLLDI

SEQ ID NO: 2008334 - protein, 22 aa, Staphylococcus
EGYSHLGSCYFIHPDITKQTLD

SEQ ID NO: 2008335 - protein, 17 aa, Staphylococcus
EGYSIADILALTVDEAI

SEQ ID NO: 2008336 - protein, 20 aa, Staphylococcus
EGYSLVGCMCQPAFEFEHFE

SEQ ID NO: 2008337 - protein, 20 aa, Staphylococcus
EGYSLVGCMCQPAFEFKYFE

SEQ ID NO: 2008338 - protein, 26 aa, Staphylococcus
EGYVQTGRAYFKLVVQGKGGHGSSPH

SEQ ID NO: 2008339 - protein, 24 aa, Staphylococcus
EHAPKKLNLMLASSEYRAVHFPKV

SEQ ID NO: 2008340 - protein, 24 aa, Staphylococcus
EHARDMLKRERLFFDKMQAHIGEV

SEQ ID NO: 2008341 - protein, 17 aa, Staphylococcus
EHARKVFGKQVVLEDIS

SEQ ID NO: 2008342 - protein, 25 aa, Staphylococcus
EHARRNSVAVIFVRVAFTGEYMEVS

SEQ ID NO: 2008343 - protein, 23 aa, Staphylococcus
EHDACGIGFYANMDNLRSHDIIE

SEQ ID NO: 2008344 - protein, 23 aa, Staphylococcus
EHDACGIGFYANMDNLRSHDIVI

SEQ ID NO: 2008345 - protein, 23 aa, Staphylococcus
EHDACGIGFYANMNNLRSHDIIE

SEQ ID NO: 2008346 - protein, 23 aa, Staphylococcus
EHDEIIQIGITFVRDNKISGTYH

SEQ ID NO: 2008347 - protein, 23 aa, Staphylococcus
EHDIKHRMIRNLCLSIIDEQQNG

SEQ ID NO: 2008348 - protein, 18 aa, Staphylococcus
EHDYACILLDLMLPEMDG

SEQ ID NO: 2008349 - protein, 22 aa, Staphylococcus
EHEELDWFIADLLNHSQRASSL

SEQ ID NO: 2008350 - protein, 23 aa, Staphylococcus
EHELKEIIIRTADVLGTSIDDES

SEQ ID NO: 2008351 - protein, 18 aa, Staphylococcus
EHELKMVLNKTVPQDLFF

SEQ ID NO: 2008352 - protein, 22 aa, Staphylococcus
EHEMWDKPLLEKFAEDIKNGAL

SEQ ID NO: 2008353 - protein, 18 aa, Staphylococcus
EHEYQIITKMGFEDYFLI

SEQ ID NO: 2008354 - protein, 24 aa, Staphylococcus
EHEYRVITEMGFEDYFLIVSDLIH

SEQ ID NO: 2008355 - protein, 19 aa, Staphylococcus
EHFEALLAQVSIKPVINQV

SEQ ID NO: 2008356 - protein, 18 aa, Staphylococcus
EHFEKLKGVGPYTKAAVM

SEQ ID NO: 2008357 - protein, 19 aa, Staphylococcus
EHFNIPVAVNNDIIEMPSL

SEQ ID NO: 2008358 - protein, 25 aa, Staphylococcus
EHFNKMEVPFIYRVHEQPKSDRLRQ

SEQ ID NO: 2008359 - protein, 23 aa, Staphylococcus
EHFYRYPLMIRLKVRAITIDVYE

SEQ ID NO: 2008360 - protein, 19 aa, Staphylococcus
EHGAKAFLKTYAKVDDQLA

SEQ ID NO: 2008361 - protein, 18 aa, Staphylococcus
EHGIDRYNFYGVSGDFSE

SEQ ID NO: 2008362 - protein, 33 aa, Staphylococcus
EHGSHAVPIWSRVRIAGIELPEFETLTGSTPID

SEQ ID NO: 2008363 - protein, 19 aa, Staphylococcus
EHHSDIGFGQSFRHKDKNV

SEQ ID NO: 2008364 - protein, 24 aa, Staphylococcus
EHIDELKIYYSHYVSVLENKPSVK

SEQ ID NO: 2008365 - protein, 24 aa, Staphylococcus
EHIDELKIYYSHYVSVLENKPTTK

SEQ ID NO: 2008366 - protein, 21 aa, Staphylococcus
EHILGKYPTYVAFGNDHNDIE

SEQ ID NO: 2008367 - protein, 18 aa, Staphylococcus
EHINEGFDRLARGEAARL

SEQ ID NO: 2008368 - protein, 23 aa, Staphylococcus
EHKKAYRLLKEEVPEEYYTVPLG

SEQ ID NO: 2008369 - protein, 28 aa, Staphylococcus
EHKKAYRLLKEEVPESYYTVPIGKADVK

SEQ ID NO: 2008370 - protein, 26 aa, Staphylococcus
EHLAIDLLKLCHDYQVPFIVNDDVDL

SEQ ID NO: 2008371 - protein, 20 aa, Staphylococcus
EHLKEAQAFIDAIEDHHLIA

SEQ ID NO: 2008372 - protein, 18 aa, Staphylococcus
EHLKRYDHITTFLNDNQF

SEQ ID NO: 2008373 - protein, 17 aa, Staphylococcus
EHLLKLLHLEKVKHHHP

SEQ ID NO: 2008374 - protein, 26 aa, Staphylococcus
EHLLSRYEKFASFKQQIVDMLKNYPG

SEQ ID NO: 2008375 - protein, 19 aa, Staphylococcus
EHLNLPPIFSEVLIYCTER

SEQ ID NO: 2008376 - protein, 21 aa, Staphylococcus
EHLQAMIEWAIQQIENNFDGV

SEQ ID NO: 2008377 - protein, 28 aa, Staphylococcus
EHLRFAKRFNPLYFKKIWLEAWEETHKR

SEQ ID NO: 2008378 - protein, 19 aa, Staphylococcus
EHLTHVVFILWGKPAQQKI

SEQ ID NO: 2008379 - protein, 24 aa, Staphylococcus
EHMKNAFLQKGIVFLIIRFKLLDE

SEQ ID NO: 2008380 - protein, 25 aa, Staphylococcus
EHMKSCFLQKGLVFLLIRFKVLDEV

SEQ ID NO: 2008381 - protein, 20 aa, Staphylococcus
EHMLFYFAYKTFIKTADEII

SEQ ID NO: 2008382 - protein, 20 aa, Staphylococcus
EHMLFYFAYKTFITTADEII

SEQ ID NO: 2008383 - protein, 20 aa, Staphylococcus
EHMLFYFAYKTFVTTADDII

SEQ ID NO: 2008384 - protein, 20 aa, Staphylococcus
EHMLFYFAYKTFVTTADEII

SEQ ID NO: 2008385 - protein, 28 aa, Staphylococcus
EHMPIEVIYGFAQLKRGAALANHELGKL

SEQ ID NO: 2008386 - protein, 17 aa, Staphylococcus
EHMPVGVGSYVQYDRKL

SEQ ID NO: 2008387 - protein, 17 aa, Staphylococcus
EHMTSLIYKLEEMGVNL

SEQ ID NO: 2008388 - protein, 17 aa, Staphylococcus
EHMTSLVYKLEEMGVNL

SEQ ID NO: 2008389 - protein, 18 aa, Staphylococcus
EHNLKGRILVSTEGINGT

SEQ ID NO: 2008390 - protein, 23 aa, Staphylococcus
EHNLSIMCDADWIIDVGPGPGLD

SEQ ID NO: 2008391 - protein, 17 aa, Staphylococcus
EHPEEYPQLTIRVSGYA

SEQ ID NO: 2008392 - protein, 28 aa, Staphylococcus
EHPEGVYLSGALLMFAGKKSYYLYGASS

SEQ ID NO: 2008393 - protein, 19 aa, Staphylococcus
EHPKNIYVFESPIDALSYK

SEQ ID NO: 2008394 - protein, 20 aa, Staphylococcus
EHPYQFELNKDFNFSAAHYI

SEQ ID NO: 2008395 - protein, 24 aa, Staphylococcus
EHQKPHIMPVWSIKNRASKVRDED

SEQ ID NO: 2008396 - protein, 23 aa, Staphylococcus
EHQPKRLALVFDHQRITYDELIH

SEQ ID NO: 2008397 - protein, 20 aa, Staphylococcus
EHQRRIPFTRVPFNDHDSIR

SEQ ID NO: 2008398 - protein, 23 aa, Staphylococcus
EHQTSIDTLEWLYVPQLTEAAQK

SEQ ID NO: 2008399 - protein, 19 aa, Staphylococcus
EHQYKHFIYTPVGFVCEHL

SEQ ID NO: 2008400 - protein, 17 aa, Staphylococcus
EHRALKKSEIKQIEELQ

SEQ ID NO: 2008401 - protein, 19 aa, Staphylococcus
EHRPLRLVNEEDYRFTLKN

SEQ ID NO: 2008402 - protein, 19 aa, Staphylococcus
EHSFNHIIKIGRTHLQDAT

SEQ ID NO: 2008403 - protein, 23 aa, Staphylococcus
EHSIIYYKWLTQISDAIQSGEIF

SEQ ID NO: 2008404 - protein, 22 aa, Staphylococcus
EHSKVIFCEADDWKPFYEENQA

SEQ ID NO: 2008405 - protein, 22 aa, Staphylococcus
EHSTKSSGFDWFKKKSNKQDDE

SEQ ID NO: 2008406 - protein, 19 aa, Staphylococcus
EHSTLKFYLNVDMRDIKDQ

SEQ ID NO: 2008407 - protein, 20 aa, Staphylococcus
EHSYCPGKFDLSIDGKKFAG

SEQ ID NO: 2008408 - protein, 18 aa, Staphylococcus
EHTEFKLNIIPNVIQHIE

SEQ ID NO: 2008409 - protein, 19 aa, Staphylococcus
EHTEKSGGFDWFKKKPNKQ

SEQ ID NO: 2008410 - protein, 18 aa, Staphylococcus
EHTFGVTCDYEFVDDYPA

SEQ ID NO: 2008411 - protein, 23 aa, Staphylococcus
EHTGRYAYVITMLRRNGYHVIMG

SEQ ID NO: 2008412 - protein, 23 aa, Staphylococcus
EHTLFRLQKQFAYTKEDINKYMV

SEQ ID NO: 2008413 - protein, 20 aa, Staphylococcus
EHVLAIPLYQGKYILTNHKK

SEQ ID NO: 2008414 - protein, 23 aa, Staphylococcus
EHVSYCKARFDIVQFSPEDATRT

SEQ ID NO: 2008415 - protein, 18 aa, Staphylococcus
EHYDLDCYLTMLDVLDSH

SEQ ID NO: 2008416 - protein, 25 aa, Staphylococcus
EHYELPILGIHNMKNATIAIAIGHE

SEQ ID NO: 2008417 - protein, 24 aa, Staphylococcus
EHYELPILGVHNMRNAAIAIAVGH

SEQ ID NO: 2008418 - protein, 17 aa, Staphylococcus
EHYGDKVLVPLAYIDLD

SEQ ID NO: 2008419 - protein, 20 aa, Staphylococcus
EHYIGCGENMFDLNTFQVVK

SEQ ID NO: 2008420 - protein, 19 aa, Staphylococcus
EHYNIPLKINGNVIQTIPD

SEQ ID NO: 2008421 - protein, 25 aa, Staphylococcus
EHYYCPSCRELVILKRGYKVKAHFA

SEQ ID NO: 2008422 - protein, 20 aa, Staphylococcus
EIADEVGAKLMVDMAHIAGL

SEQ ID NO: 2008423 - protein, 23 aa, Staphylococcus
EIAEYKSRIFAGLNEKGIAIYNA

SEQ ID NO: 2008424 - protein, 17 aa, Staphylococcus
EIAGIHFYNSKDHSTIQ

SEQ ID NO: 2008425 - protein, 20 aa, Staphylococcus
EIAKMCNRYAVPYLPGCGSV

SEQ ID NO: 2008426 - protein, 19 aa, Staphylococcus
EIAKQTILEEFDKFKKGEF

SEQ ID NO: 2008427 - protein, 24 aa, Staphylococcus
EIAMACGFSTTSYFIKVFKARYGM

SEQ ID NO: 2008428 - protein, 27 aa, Staphylococcus
EIANKGTDIIFCLHPNMQPFIDYFDVP

SEQ ID NO: 2008429 - protein, 19 aa, Staphylococcus
EIANRWKLDKAFKPKMPEA

SEQ ID NO: 2008430 - protein, 23 aa, Staphylococcus
EIAPEVLSVIAIIATSEVEGISG

SEQ ID NO: 2008431 - protein, 19 aa, Staphylococcus
EIAPEVLSVIASIATSEID

SEQ ID NO: 2008432 - protein, 22 aa, Staphylococcus
EIAQRQNIDFNLRRFTKQERFE

SEQ ID NO: 2008433 - protein, 19 aa, Staphylococcus
EIARGAAIQTGCDYEFGPI

SEQ ID NO: 2008434 - protein, 25 aa, Staphylococcus
EIARRLEAASVLAYVDPYRAVTHNK

SEQ ID NO: 2008435 - protein, 17 aa, Staphylococcus
EICEAKKDLGLKEGTTI

SEQ ID NO: 2008436 - protein, 18 aa, Staphylococcus
EICGFVIEPLIQGATGLY

SEQ ID NO: 2008437 - protein, 21 aa, Staphylococcus
EICGLKVKRVEDYQTCLITDI

SEQ ID NO: 2008438 - protein, 26 aa, Staphylococcus
EIDAAVWGARAAYIGGFDSTSNVRAG

SEQ ID NO: 2008439 - protein, 18 aa, Staphylococcus
EIDADVFSGWGKLQNGET

SEQ ID NO: 2008440 - protein, 26 aa, Staphylococcus
EIDAEYFPSHLFRKYAKDVFEDNQFE

SEQ ID NO: 2008441 - protein, 27 aa, Staphylococcus
EIDAGLWGARAAFIGGFDSTSNVRAGK

SEQ ID NO: 2008442 - protein, 18 aa, Staphylococcus
EIDFAKKLRDAIPSLEKI

SEQ ID NO: 2008443 - protein, 18 aa, Staphylococcus
EIDFRIIEPAAYYHTLQH

SEQ ID NO: 2008444 - protein, 18 aa, Staphylococcus
EIDFSKKLRAAIPSLEKI

SEQ ID NO: 2008445 - protein, 24 aa, Staphylococcus
EIDGIQGYLFYKARKHHLNTPILD

SEQ ID NO: 2008446 - protein, 21 aa, Staphylococcus
EIDGMLIGFAIVSSREYERTQ

SEQ ID NO: 2008447 - protein, 22 aa, Staphylococcus
EIDHLNGIMFYDYIDKDHPLTP

SEQ ID NO: 2008448 - protein, 20 aa, Staphylococcus
EIDIAGPGFINFYLDNQYLT

SEQ ID NO: 2008449 - protein, 18 aa, Staphylococcus
EIDKANGEVRCEILNTGE

SEQ ID NO: 2008450 - protein, 25 aa, Staphylococcus
EIDKEVKEALKLVKLTGYEQRHIDE

SEQ ID NO: 2008451 - protein, 20 aa, Staphylococcus
EIDLTKYLVSQLMLKHEDRM

SEQ ID NO: 2008452 - protein, 19 aa, Staphylococcus
EIDNLVWYFSELFKSELKL

SEQ ID NO: 2008453 - protein, 19 aa, Staphylococcus
EIDNLVWYFSELFKSELRV

SEQ ID NO: 2008454 - protein, 18 aa, Staphylococcus
EIDNTFSYLERIDYDLIT

SEQ ID NO: 2008455 - protein, 21 aa, Staphylococcus
EIDQHLPIRSRRELNINGGDI

SEQ ID NO: 2008456 - protein, 23 aa, Staphylococcus
EIDRGEGVLYIYGNYAGDLMNFE

SEQ ID NO: 2008457 - protein, 23 aa, Staphylococcus
EIDRGELCDIIFEQLKPETVVYG

SEQ ID NO: 2008458 - protein, 18 aa, Staphylococcus
EIDRKLREKLGIFDGDVE

SEQ ID NO: 2008459 - protein, 22 aa, Staphylococcus
EIDRLVKGCTGVKRTTGQHPGG

SEQ ID NO: 2008460 - protein, 20 aa, Staphylococcus
EIDSGLDIDALKVVSKGINE

SEQ ID NO: 2008461 - protein, 22 aa, Staphylococcus
EIDSPYAPLIKGLRETLKLCLQ

SEQ ID NO: 2008462 - protein, 19 aa, Staphylococcus
EIDTLLPVFQDILNTIDND

SEQ ID NO: 2008463 - protein, 22 aa, Staphylococcus
EIDVRGRVLGVKQLERYKQQEI

SEQ ID NO: 2008464 - protein, 24 aa, Staphylococcus
EIDYKIFPKADWVVVDDLEGVKEE

SEQ ID NO: 2008465 - protein, 21 aa, Staphylococcus
EIEAMGGKVPQSMKNEHTSHS

SEQ ID NO: 2008466 - protein, 19 aa, Staphylococcus
EIEAPYKIIYHDYFANEKG

SEQ ID NO: 2008467 - protein, 26 aa, Staphylococcus
EIEASSLPENMIWFDLEQRDQFTFPV

SEQ ID NO: 2008468 - protein, 24 aa, Staphylococcus
EIEDFKEGFYFIVRIKTDNNRATD

SEQ ID NO: 2008469 - protein, 20 aa, Staphylococcus
EIEDVRFLFVAATAPFTPFY

SEQ ID NO: 2008470 - protein, 25 aa, Staphylococcus
EIEELFARIRAILRRQPQKDVIDIN

SEQ ID NO: 2008471 - protein, 20 aa, Staphylococcus
EIEFQLRQVNVIKEAVVVPI

SEQ ID NO: 2008472 - protein, 17 aa, Staphylococcus
EIEIPRNKIAKARHAVM

SEQ ID NO: 2008473 - protein, 18 aa, Staphylococcus
EIEIVTKCGIVLPSSPEQ

SEQ ID NO: 2008474 - protein, 20 aa, Staphylococcus
EIEKEAWLNIVHSLLEEGYK

SEQ ID NO: 2008475 - protein, 19 aa, Staphylococcus
EIEKGEFAVIVGLSGAGKS

SEQ ID NO: 2008476 - protein, 17 aa, Staphylococcus
EIEKLEADYRVKNKRLT

SEQ ID NO: 2008477 - protein, 18 aa, Staphylococcus
EIEKRFMHHYNFPNFSVG

SEQ ID NO: 2008478 - protein, 23 aa, Staphylococcus
EIENFKFFVQYANFKDINDYKNG

SEQ ID NO: 2008479 - protein, 25 aa, Staphylococcus
EIENFKFFVQYGKFKDLNDYKGGDI

SEQ ID NO: 2008480 - protein, 23 aa, Staphylococcus
EIENFKFFVQYGNFKDFKDYKNG

SEQ ID NO: 2008481 - protein, 21 aa, Staphylococcus
EIENFKFFVQYGSFKDFKDYK

SEQ ID NO: 2008482 - protein, 18 aa, Staphylococcus
EIENRIVQFYTDLNTDGR

SEQ ID NO: 2008483 - protein, 19 aa, Staphylococcus
EIENRVVQFYTDLNTDGRF

SEQ ID NO: 2008484 - protein, 19 aa, Staphylococcus
EIEQALNVLCIIDSRIKQF

SEQ ID NO: 2008485 - protein, 24 aa, Staphylococcus
EIERFLKERKRGTAVRLEVDGRQA

SEQ ID NO: 2008486 - protein, 18 aa, Staphylococcus
EIERHLTIPQDFKEESKL

SEQ ID NO: 2008487 - protein, 22 aa, Staphylococcus
EIERIAKVAFELARTRNKKVTS

SEQ ID NO: 2008488 - protein, 25 aa, Staphylococcus
EIERIARVGFELAQKRHKKLTSVDK

SEQ ID NO: 2008489 - protein, 26 aa, Staphylococcus
EIERLRYLVDNDFYFDLFAKYSEADL

SEQ ID NO: 2008490 - protein, 27 aa, Staphylococcus
EIESILKAHEWFHITGITAALNDALFE

SEQ ID NO: 2008491 - protein, 24 aa, Staphylococcus
EIESKRGGGGYIRITKIENKDATG

SEQ ID NO: 2008492 - protein, 24 aa, Staphylococcus
EIESKRGGGGYIRITKVETKDTKG

SEQ ID NO: 2008493 - protein, 22 aa, Staphylococcus
EIETRIKGISSIDIHATKASSF

SEQ ID NO: 2008494 - protein, 25 aa, Staphylococcus
EIEVIGNGIIMWLLSQGSKVKVLSP

SEQ ID NO: 2008495 - protein, 20 aa, Staphylococcus
EIEVPRFWNIEGDNNQAVIK

SEQ ID NO: 2008496 - protein, 17 aa, Staphylococcus
EIEVRGRVLGVNQQTRY

SEQ ID NO: 2008497 - protein, 20 aa, Staphylococcus
EIEYTFRLSPFGSTEYPDTT

SEQ ID NO: 2008498 - protein, 38 aa, Staphylococcus; identical to SEQ ID NO: 1804092

SEQ ID NO: 2008499 - protein, 38 aa, Staphylococcus
EIFATAMNRKGYFLYGYRHFSSRIKGGHTNNKIRVSTT

SEQ ID NO: 2008500 - protein, 38 aa, Staphylococcus
EIFATAMNRKGYYLYGYRHFSSRIKGGHTNNKIRVSTA

SEQ ID NO: 2008501 - protein, 31 aa, Staphylococcus
EIFATAMNRKGYYLYGYRHFSSRIMGGHTNN

SEQ ID NO: 2008502 - protein, 22 aa, Staphylococcus
EIFDRDDMEIIAGNHDEAVMSI

SEQ ID NO: 2008503 - protein, 23 aa, Staphylococcus
EIFFSNATTIVFAQYMKDVLAKK

SEQ ID NO: 2008504 - protein, 19 aa, Staphylococcus
EIFTDKAFEGFKVEQINDL

SEQ ID NO: 2008505 - protein, 20 aa, Staphylococcus
EIFTNKAFDGFKVERVNDLF

SEQ ID NO: 2008506 - protein, 23 aa, Staphylococcus
EIFVLDMGKPVKIVDLAKNLIRL

SEQ ID NO: 2008507 - protein, 27 aa, Staphylococcus
EIFYDPKHPYTWGLLSSMPDLDTKNDT

SEQ ID NO: 2008508 - protein, 27 aa, Staphylococcus
EIFYDPKHPYTWGLLSSMPDLTTGTET

SEQ ID NO: 2008509 - protein, 27 aa, Staphylococcus
EIFYDPKHPYTWGLLSSMPDLTTSNDT

SEQ ID NO: 2008510 - protein, 27 aa, Staphylococcus
EIFYDPKHPYTWGLLSSMPDLTTSNET

SEQ ID NO: 2008511 - protein, 25 aa, Staphylococcus
EIFYDSRHPYTWGLLSSMPDLDSKD

SEQ ID NO: 2008512 - protein, 27 aa, Staphylococcus
EIFYGPKHPYTWGLLSSMPDLTTSNDT

SEQ ID NO: 2008513 - protein, 24 aa, Staphylococcus
EIFYKKWRHELEALNHIRNQLNSE

SEQ ID NO: 2008514 - protein, 23 aa, Staphylococcus
EIGDLRQGYEYSRTANPTRTAIE

SEQ ID NO: 2008515 - protein, 19 aa, Staphylococcus
EIGDSIVPDTEFIQLSENR

SEQ ID NO: 2008516 - protein, 18 aa, Staphylococcus
EIGGYSFYTFKGIRKNKN

SEQ ID NO: 2008517 - protein, 28 aa, Staphylococcus
EIGLGRTRELPVLDIYDISYSFEKTIKT

SEQ ID NO: 2008518 - protein, 22 aa, Staphylococcus
EIGQIKIIFTTTIKEMEDHYPG

SEQ ID NO: 2008519 - protein, 19 aa, Staphylococcus
EIGSTFSIQGLDLNYAGVI

SEQ ID NO: 2008520 - protein, 18 aa, Staphylococcus
EIGVKRILYTSQIGSAPQ

SEQ ID NO: 2008521 - protein, 21 aa, Staphylococcus
EIGVMYGHIPTVAALEIGYVK

SEQ ID NO: 2008522 - protein, 20 aa, Staphylococcus
EIHEDSRIVYDYTIKANTVA

SEQ ID NO: 2008523 - protein, 24 aa, Staphylococcus
EIHEQPAVMRRIIQEYQDDQGNLK

SEQ ID NO: 2008524 - protein, 24 aa, Staphylococcus
EIHEQPAVMRRIIQEYQDEEGNLK

SEQ ID NO: 2008525 - protein, 20 aa, Staphylococcus
EIHHRIMHCYKKMIGKLNKH

SEQ ID NO: 2008526 - protein, 18 aa, Staphylococcus
EIHKAAVKIAKRAATKNT

SEQ ID NO: 2008527 - protein, 17 aa, Staphylococcus
EIIDYAYSIGIDSIGFT

SEQ ID NO: 2008528 - protein, 19 aa, Staphylococcus
EIIEDFPILKQQVNGKRLA

SEQ ID NO: 2008529 - protein, 17 aa, Staphylococcus
EIIEEAAKNESYDGFVI

SEQ ID NO: 2008530 - protein, 27 aa, Staphylococcus
EIIEGCICCAMKGDVSRQLHQIYLDYQ

SEQ ID NO: 2008531 - protein, 23 aa, Staphylococcus
EIIEHMKRVGFNIISINHDNGWA

SEQ ID NO: 2008532 - protein, 19 aa, Staphylococcus
EIIEILIKYHGQYVTIYDI

SEQ ID NO: 2008533 - protein, 21 aa, Staphylococcus
EIIELLIKYHGQYVTIYDIAQ

SEQ ID NO: 2008534 - protein, 19 aa, Staphylococcus
EIIEMLIKYHGQYVTIYDI

SEQ ID NO: 2008535 - protein, 19 aa, Staphylococcus
EIIKNPIFEIKQLRPTASR

SEQ ID NO: 2008536 - protein, 17 aa, Staphylococcus
EIIKRAGDAYVESGADY

SEQ ID NO: 2008537 - protein, 19 aa, Staphylococcus
EIILCKRLGKHQHLQDALK

SEQ ID NO: 2008538 - protein, 23 aa, Staphylococcus
EIIPHRQPFLLIDRVVEYEVGTR

SEQ ID NO: 2008539 - protein, 25 aa, Staphylococcus
EIIQLSHLKPYFISKAIQKLKERGL

SEQ ID NO: 2008540 - protein, 18 aa, Staphylococcus
EIIQSRPKPLSLYLFSED

SEQ ID NO: 2008541 - protein, 20 aa, Staphylococcus
EIISRLYFLNNVGLDYLTLN

SEQ ID NO: 2008542 - protein, 22 aa, Staphylococcus
EIKAEDGITFAVEKNTTVRVSG

SEQ ID NO: 2008543 - protein, 22 aa, Staphylococcus
EIKAENGITFAVEKNTTIKVSG

SEQ ID NO: 2008544 - protein, 20 aa, Staphylococcus
EIKAEVLVFKGIPYQIKLST

SEQ ID NO: 2008545 - protein, 22 aa, Staphylococcus
EIKARANQFIKYRDQHNSCRIY

SEQ ID NO: 2008546 - protein, 21 aa, Staphylococcus
EIKDLSSKVRIDKDVATISGV

SEQ ID NO: 2008547 - protein, 27 aa, Staphylococcus
EIKDPIKLELLIAIMSFKQSSNISLSM

SEQ ID NO: 2008548 - protein, 31 aa, Staphylococcus
EIKDSDGRIILFIDELHMLVGAGKTDGAMDA

SEQ ID NO: 2008549 - protein, 28 aa, Staphylococcus
EIKEDGRLAIDLIGGFHFNAIEGEYCEI

SEQ ID NO: 2008550 - protein, 29 aa, Staphylococcus
EIKEDGRLAIDLIGGYAYNAIEGEYCTIH

SEQ ID NO: 2008551 - protein, 25 aa, Staphylococcus
EIKFPSNKFNLGFTLQDTPGVDSNV

SEQ ID NO: 2008552 - protein, 24 aa, Staphylococcus
EIKFPSTKFNKGFTLQDTPGVDSN

SEQ ID NO: 2008553 - protein, 21 aa, Staphylococcus
EIKGTLLNHSYISLIDELHPT

SEQ ID NO: 2008554 - protein, 19 aa, Staphylococcus
EIKHGKIRVAFTPDEEIGR

SEQ ID NO: 2008555 - protein, 20 aa, Staphylococcus
EIKKEIKLFFKDIEDESLAE

SEQ ID NO: 2008556 - protein, 22 aa, Staphylococcus
EIKKKVKHFHGLASKDDEHVSY

SEQ ID NO: 2008557 - protein, 25 aa, Staphylococcus
EIKNKDFHAHLLLQVHDELIFELPE

SEQ ID NO: 2008558 - protein, 17 aa, Staphylococcus
EIKRRFNNINTRASEAD

SEQ ID NO: 2008559 - protein, 17 aa, Staphylococcus
EIKVASISPELFFQKGA

SEQ ID NO: 2008560 - protein, 29 aa, Staphylococcus
EIKVASISPELFFQKGIFNGEENMLVSKP

SEQ ID NO: 2008561 - protein, 26 aa, Staphylococcus
EIKYFSSHIDYRMKGIAFDLLEYALN

SEQ ID NO: 2008562 - protein, 18 aa, Staphylococcus
EIKYIVAEIQKIYHRFKE

SEQ ID NO: 2008563 - protein, 24 aa, Staphylococcus
EILACEAWSKLGFIPEEDVKKIRE

SEQ ID NO: 2008564 - protein, 23 aa, Staphylococcus
EILDEMSELILLIYKEYAGMYFK

SEQ ID NO: 2008565 - protein, 17 aa, Staphylococcus
EILDFESVIVMGHEAYY

SEQ ID NO: 2008566 - protein, 26 aa, Staphylococcus
EILDLPEYAFPLFGMAVGEPAEDENG

SEQ ID NO: 2008567 - protein, 26 aa, Staphylococcus
EILDLPEYTFPLFGMAIGEPAENENG

SEQ ID NO: 2008568 - protein, 23 aa, Staphylococcus
EILEEAYMSKAMVIDVWSKEGDV

SEQ ID NO: 2008569 - protein, 24 aa, Staphylococcus
EILEEAYMSKAMVVDVWSKEGDII

SEQ ID NO: 2008570 - protein, 18 aa, Staphylococcus
EILHDITVTIQRGKLTSL

SEQ ID NO: 2008571 - protein, 22 aa, Staphylococcus
EILHGPVCAAIMQSEFGIEDEE

SEQ ID NO: 2008572 - protein, 26 aa, Staphylococcus
EILHGPVCAALMKAKYGIEDEEVLSA

SEQ ID NO: 2008573 - protein, 18 aa, Staphylococcus
EILHGPVCSAIMENDFDV

SEQ ID NO: 2008574 - protein, 18 aa, Staphylococcus
EILKFASKPVKENLLNSK

SEQ ID NO: 2008575 - protein, 19 aa, Staphylococcus
EILKPAVMMNLLGRDLDLL

SEQ ID NO: 2008576 - protein, 20 aa, Staphylococcus
EILKPAVMMNLLGRDLDLLE

SEQ ID NO: 2008577 - protein, 39 aa, Staphylococcus
EILKSIKVAPGIEIPDARYIDWFPNFTLGDLISDNTASG

SEQ ID NO: 2008578 - protein, 19 aa, Staphylococcus
EILKYEAFTDIEFNPKRSF

SEQ ID NO: 2008579 - protein, 18 aa, Staphylococcus
EILNRMDDIVLFKPLSVN

SEQ ID NO: 2008580 - protein, 22 aa, Staphylococcus
EILPAKYIRPFGLAWHIENKMI

SEQ ID NO: 2008581 - protein, 20 aa, Staphylococcus
EILREPGFFRHLKVMPNAQE

SEQ ID NO: 2008582 - protein, 22 aa, Staphylococcus
EILRKPDWLKIKLNTNENYIGL

SEQ ID NO: 2008583 - protein, 22 aa, Staphylococcus
EILSSSPFVWFKDALDGYDFLV

SEQ ID NO: 2008584 - protein, 20 aa, Staphylococcus
EILVRRLIEENGKEYEGELD

SEQ ID NO: 2008585 - protein, 19 aa, Staphylococcus
EILVRRLVEENGTEHEGEL

SEQ ID NO: 2008586 - protein, 19 aa, Staphylococcus
EILVRRLVEQDGQEYEGEL

SEQ ID NO: 2008587 - protein, 19 aa, Staphylococcus
EIMEIGVSKGYFGVAGFDL

SEQ ID NO: 2008588 - protein, 18 aa, Staphylococcus
EIMESLEAPAHLFTTGAN

SEQ ID NO: 2008589 - protein, 17 aa, Staphylococcus
EIMGLNIMQPFKVYPEG

SEQ ID NO: 2008590 - protein, 18 aa, Staphylococcus
EIMIPLVSTVEEFITLKD

SEQ ID NO: 2008591 - protein, 17 aa, Staphylococcus
EIMTFKQIYELWLEQYR

SEQ ID NO: 2008592 - protein, 20 aa, Staphylococcus
EIMTILCLSTGLKDLKASIA

SEQ ID NO: 2008593 - protein, 17 aa, Staphylococcus
EIMVIFVTNGKKFKNAN

SEQ ID NO: 2008594 - protein, 24 aa, Staphylococcus
EIMYCATYGNGLWKSNDEGNHWKA

SEQ ID NO: 2008595 - protein, 20 aa, Staphylococcus
EIMYIYLNIVPFGRDYNGDN

SEQ ID NO: 2008596 - protein, 19 aa, Staphylococcus
EINDLAALVYYPEEKLKLI

SEQ ID NO: 2008597 - protein, 24 aa, Staphylococcus
EINELPIVEEFRASQYEANDLLQM

SEQ ID NO: 2008598 - protein, 19 aa, Staphylococcus
EINEQWPGTIVSIVHRIGP

SEQ ID NO: 2008599 - protein, 25 aa, Staphylococcus
EINFPSSKFKNGFTLQDTPGVDSNV

SEQ ID NO: 2008600 - protein, 25 aa, Staphylococcus
EINGQIFIALAVKFSKARLIDNIIL

SEQ ID NO: 2008601 - protein, 31 aa, Staphylococcus
EINGRPKHIYSIYRKMMKQKKQFDQIFDLLA

SEQ ID NO: 2008602 - protein, 23 aa, Staphylococcus
EINHGHGVLYIYGNYAGDLMNFE

SEQ ID NO: 2008603 - protein, 18 aa, Staphylococcus
EINICIEEILTLPFFSDK

SEQ ID NO: 2008604 - protein, 18 aa, Staphylococcus
EINNGMFGILGRNGSGKS

SEQ ID NO: 2008605 - protein, 25 aa, Staphylococcus
EINQPAKFIFLDFISAENIQTLTDN

SEQ ID NO: 2008606 - protein, 17 aa, Staphylococcus
EINRVVAHLPNFDSDFD

SEQ ID NO: 2008607 - protein, 24 aa, Staphylococcus
EINTIKGNVNWMRARQNELIATIF

SEQ ID NO: 2008608 - protein, 24 aa, Staphylococcus
EINTIKGNVNWMRARQNKLVETLF

SEQ ID NO: 2008609 - protein, 24 aa, Staphylococcus
EINTIKGNVNWMRARQNKLVHTLF

SEQ ID NO: 2008610 - protein, 24 aa, Staphylococcus
EINTIKGNVNWMRARQRQLINTLF

SEQ ID NO: 2008611 - protein, 24 aa, Staphylococcus
EINTIKGNVNWMRARQRQLIQTLF

SEQ ID NO: 2008612 - protein, 24 aa, Staphylococcus
EINTIRGNINWMRARQKRLIQTLF

SEQ ID NO: 2008613 - protein, 19 aa, Staphylococcus
EIQEMYKNLYVNRQTIEDA

SEQ ID NO: 2008614 - protein, 24 aa, Staphylococcus
EIQIIKSVILKAKRSFNDMYGEVY

SEQ ID NO: 2008615 - protein, 17 aa, Staphylococcus
EIQIRTLAMNFWSTIEH

SEQ ID NO: 2008616 - protein, 23 aa, Staphylococcus
EIQKHYPGFALDYEVDPVRQAIA

SEQ ID NO: 2008617 - protein, 19 aa, Staphylococcus
EIQKMREERQMLGQMISQV

SEQ ID NO: 2008618 - protein, 25 aa, Staphylococcus
EIQNNPRAYILLGYNDTKQRSFVEI

SEQ ID NO: 2008619 - protein, 22 aa, Staphylococcus
EIQNRIIPRIKKGTNLIGQSQT

SEQ ID NO: 2008620 - protein, 26 aa, Staphylococcus
EIQPGDDVGRAFSFETTEFILDQLPC

SEQ ID NO: 2008621 - protein, 21 aa, Staphylococcus
EIQPKLAALGTYFTDFLNTHT

SEQ ID NO: 2008622 - protein, 20 aa, Staphylococcus
EIQSALRIGDTCPICGNEIE

SEQ ID NO: 2008623 - protein, 19 aa, Staphylococcus
EIQSRGFVYVRESEELLKE

SEQ ID NO: 2008624 - protein, 18 aa, Staphylococcus
EIQVEGLINLSSSIEEHV

SEQ ID NO: 2008625 - protein, 20 aa, Staphylococcus
EIQYELRGYMSYTSQYLSDE

SEQ ID NO: 2008626 - protein, 21 aa, Staphylococcus
EIREIRIIKSVLLKGKKSFNN

SEQ ID NO: 2008627 - protein, 27 aa, Staphylococcus
EIREPCWKIQAKYGISDLVKRMSQSGK

SEQ ID NO: 2008628 - protein, 23 aa, Staphylococcus
EIRFSAEEPFSFNAKHYSDEQMT

SEQ ID NO: 2008629 - protein, 19 aa, Staphylococcus
EIRGKIFYQSNFKSRIVNR

SEQ ID NO: 2008630 - protein, 20 aa, Staphylococcus
EIRMPKVGGRVMSLQDPTKK

SEQ ID NO: 2008631 - protein, 22 aa, Staphylococcus
EIRNHVVGFVFQNFKLIQNNTI

SEQ ID NO: 2008632 - protein, 25 aa, Staphylococcus
EIRRTNWIITTWWRPQAYYDQSSWR

SEQ ID NO: 2008633 - protein, 28 aa, Staphylococcus
EIRRYAPEFEKIIPLHIMLVSSSHIITT

SEQ ID NO: 2008634 - protein, 24 aa, Staphylococcus
EISDDAKFGKFVVEPLERGYGTTL

SEQ ID NO: 2008635 - protein, 18 aa, Staphylococcus
EISDFTALIYYPEDKLKL

SEQ ID NO: 2008636 - protein, 19 aa, Staphylococcus
EISEVYYPGNHAKHLQQAS

SEQ ID NO: 2008637 - protein, 24 aa, Staphylococcus
EISFPSQLIITGRTKDCIQSYETK

SEQ ID NO: 2008638 - protein, 24 aa, Staphylococcus
EISGRPKHIYSIYRKMVKQKKQFD

SEQ ID NO: 2008639 - protein, 23 aa, Staphylococcus
EISIYPFLCYLDKELIAIGYLDN

SEQ ID NO: 2008640 - protein, 23 aa, Staphylococcus
EISKIFGELFFSIDPSYRGITGA

SEQ ID NO: 2008641 - protein, 17 aa, Staphylococcus
EISKRFSTIQDYLLEYC

SEQ ID NO: 2008642 - protein, 17 aa, Staphylococcus
EISKYVALHPGDIIATG

SEQ ID NO: 2008643 - protein, 28 aa, Staphylococcus
EISSDYLLCKAFGKTATNIEKYTSQGTL

SEQ ID NO: 2008644 - protein, 19 aa, Staphylococcus
EISSGIFAFDNKELFDKLA

SEQ ID NO: 2008645 - protein, 18 aa, Staphylococcus
EITAVFAGELYEAHDKGC

SEQ ID NO: 2008646 - protein, 22 aa, Staphylococcus
EITDRIAARIVEYFQGNTEAFH

SEQ ID NO: 2008647 - protein, 25 aa, Staphylococcus
EITEFAKSINFEFASYMSASKFYKD

SEQ ID NO: 2008648 - protein, 17 aa, Staphylococcus
EITHDYGALVIYDEVIT

SEQ ID NO: 2008649 - protein, 24 aa, Staphylococcus
EITIGLKSNGTFIYDGDEPLLKPH

SEQ ID NO: 2008650 - protein, 22 aa, Staphylococcus
EITKELVDEFILVSEEEISNAM

SEQ ID NO: 2008651 - protein, 19 aa, Staphylococcus
EITKHLKAQLDKFIHPGFN

SEQ ID NO: 2008652 - protein, 22 aa, Staphylococcus
EITNLLQLRQKYFISVTTLKDN

SEQ ID NO: 2008653 - protein, 19 aa, Staphylococcus
EITPLASIILAEIIEEANI

SEQ ID NO: 2008654 - protein, 25 aa, Staphylococcus
EITREYELGLLLSKKKYLMRMPNFN

SEQ ID NO: 2008655 - protein, 17 aa, Staphylococcus
EITSLKMGNIEDQIEEI

SEQ ID NO: 2008656 - protein, 17 aa, Staphylococcus
EITSLKMGNIEDQVEMI

SEQ ID NO: 2008657 - protein, 17 aa, Staphylococcus
EITTRFKNVHGTPIHIG

SEQ ID NO: 2008658 - protein, 24 aa, Staphylococcus
EITYCRQCLQLGRMDTHSDVCITK

SEQ ID NO: 2008659 - protein, 18 aa, Staphylococcus
EIVADFYSSGVIEVLRRW

SEQ ID NO: 2008660 - protein, 17 aa, Staphylococcus
EIVCVFDAYEQSGIERE

SEQ ID NO: 2008661 - protein, 22 aa, Staphylococcus
EIVDLRTVYPLDKETIIERAKK

SEQ ID NO: 2008662 - protein, 24 aa, Staphylococcus
EIVEALNLPIPIYAIGGISEHTIL

SEQ ID NO: 2008663 - protein, 24 aa, Staphylococcus
EIVEGCICCAMKSNVSQQLHEIYL

SEQ ID NO: 2008664 - protein, 27 aa, Staphylococcus
EIVEKSLRGAAIWDELKDRLDTNAYSL

SEQ ID NO: 2008665 - protein, 26 aa, Staphylococcus
EIVFKLKHQFTHMTWDISVFSVIETV

SEQ ID NO: 2008666 - protein, 18 aa, Staphylococcus
EIVGFKLDTEEAIKKAGD

SEQ ID NO: 2008667 - protein, 18 aa, Staphylococcus
EIVKWFVKAGDTIEEDDV

SEQ ID NO: 2008668 - protein, 19 aa, Staphylococcus
EIVPIWKKEIWEDGEEWQG

SEQ ID NO: 2008669 - protein, 26 aa, Staphylococcus
EIVPIWKKEIWQDGSAWQGHQRGYYQ

SEQ ID NO: 2008670 - protein, 23 aa, Staphylococcus
EIVPLSEMFFRDEIELDEEEKEV

SEQ ID NO: 2008671 - protein, 26 aa, Staphylococcus
EIVSVLKRFKAMLLQKNETVEAMQGY

SEQ ID NO: 2008672 - protein, 21 aa, Staphylococcus
EIVTLLMKYQGQFITIYEIAQ

SEQ ID NO: 2008673 - protein, 25 aa, Staphylococcus
EIVYCRNCINLGRMDNVKPIFITKS

SEQ ID NO: 2008674 - protein, 22 aa, Staphylococcus
EIYDFPPILFYRGDISLLNSNT

SEQ ID NO: 2008675 - protein, 20 aa, Staphylococcus
EIYDFPYVIFYKGNKQLFNC

SEQ ID NO: 2008676 - protein, 18 aa, Staphylococcus
EIYDIKYGIYSHWHPDHT

SEQ ID NO: 2008677 - protein, 19 aa, Staphylococcus
EIYDYPLVLFYKGDEKLFL

SEQ ID NO: 2008678 - protein, 20 aa, Staphylococcus
EIYEDPRKVYDYTAKGNTVA

SEQ ID NO: 2008679 - protein, 18 aa, Staphylococcus
EIYERLRPGEPPTVENAK

SEQ ID NO: 2008680 - protein, 23 aa, Staphylococcus
EIYGMKVAKDLVHISGDTSDYHL

SEQ ID NO: 2008681 - protein, 19 aa, Staphylococcus
EIYNEAGVYSEERGKQNNY

SEQ ID NO: 2008682 - protein, 18 aa, Staphylococcus
EIYNELNLLIDSLKNKIL

SEQ ID NO: 2008683 - protein, 22 aa, Staphylococcus
EIYPRPHQGFDIVYNTNAYDEL

SEQ ID NO: 2008684 - protein, 24 aa, Staphylococcus
EIYRSCINSCFNYFSCFIKAAHED

SEQ ID NO: 2008685 - protein, 25 aa, Staphylococcus
EIYYDRPKAGWIWNDNKVKMDTLEV

SEQ ID NO: 2008686 - protein, 17 aa, Staphylococcus
EKAASIAKKAHREGLTL

SEQ ID NO: 2008687 - protein, 24 aa, Staphylococcus
EKADRELSRSFPFIQSLAKQYNVD

SEQ ID NO: 2008688 - protein, 19 aa, Staphylococcus
EKADTLWQTQLGNLLTPPN

SEQ ID NO: 2008689 - protein, 17 aa, Staphylococcus
EKAEKWYEKTLGFKSVF

SEQ ID NO: 2008690 - protein, 27 aa, Staphylococcus
EKAEMKFKPQYIFSDLCSQMYQLDDSG

SEQ ID NO: 2008691 - protein, 19 aa, Staphylococcus
EKAERFFQRAITIDDKNGA

SEQ ID NO: 2008692 - protein, 22 aa, Staphylococcus
EKAEYIEGLTFESAESTLAQWL

SEQ ID NO: 2008693 - protein, 25 aa, Staphylococcus
EKAFEIYDAGGWCMIDPNSDDHYHQ

SEQ ID NO: 2008694 - protein, 18 aa, Staphylococcus
EKAFEQKQYLGIYKLANA

SEQ ID NO: 2008695 - protein, 24 aa, Staphylococcus
EKAHSIQVANDWGMTTKELNIDFS

SEQ ID NO: 2008696 - protein, 23 aa, Staphylococcus
EKAKKLLAQEGFSKSHPLKINMV

SEQ ID NO: 2008697 - protein, 21 aa, Staphylococcus
EKAKLACLTIDTSMKHLDDIS

SEQ ID NO: 2008698 - protein, 19 aa, Staphylococcus
EKAKLNAYIKRSSKKLALF

SEQ ID NO: 2008699 - protein, 24 aa, Staphylococcus
EKAKNKRGKIGIEHANVKDIREAL

SEQ ID NO: 2008700 - protein, 21 aa, Staphylococcus
EKAKNKRGKIGIEHTHPDDIK

SEQ ID NO: 2008701 - protein, 21 aa, Staphylococcus
EKAKNKRGKIGVEHAALEDIR

SEQ ID NO: 2008702 - protein, 20 aa, Staphylococcus
EKAKNKRGKIGVEHAHVDDI

SEQ ID NO: 2008703 - protein, 17 aa, Staphylococcus
EKAKRIKSKLEDLKKDV

SEQ ID NO: 2008704 - protein, 24 aa, Staphylococcus
EKAKSLSCQFAFYGHTHVAKYENI

SEQ ID NO: 2008705 - protein, 22 aa, Staphylococcus
EKAKTFISLSIKYTPEIGKGRG

SEQ ID NO: 2008706 - protein, 25 aa, Staphylococcus
EKAKTVGAQLAFYGHTHVAKYENIA

SEQ ID NO: 2008707 - protein, 22 aa, Staphylococcus
EKAMPLELHALIKSENEDTDLD

SEQ ID NO: 2008708 - protein, 19 aa, Staphylococcus
EKANDLWRNQIGHLLSPPS

SEQ ID NO: 2008709 - protein, 20 aa, Staphylococcus
EKANDLWRNQIGNVLTPPNN

SEQ ID NO: 2008710 - protein, 21 aa, Staphylococcus
EKARHEDCTHFVLINDSIDIY

SEQ ID NO: 2008711 - protein, 25 aa, Staphylococcus
EKATGYFYQICKRNHYVKEDAIAKN

SEQ ID NO: 2008712 - protein, 20 aa, Staphylococcus
EKCREGWKQCLLFKSKKHKN

SEQ ID NO: 2008713 - protein, 30 aa, Staphylococcus
EKDFFNFFSNFFTRKWRREIVINAEAVHDA

SEQ ID NO: 2008714 - protein, 25 aa, Staphylococcus
EKDFYIRLLKQTGFNRIETFVDFDI

SEQ ID NO: 2008715 - protein, 19 aa, Staphylococcus
EKDGVKFIFLNNIDNVLVK

SEQ ID NO: 2008716 - protein, 17 aa, Staphylococcus
EKDKVGVAFNVTLDNNT

SEQ ID NO: 2008717 - protein, 18 aa, Staphylococcus
EKDLWYFDGEDLTIDVDN

SEQ ID NO: 2008718 - protein, 21 aa, Staphylococcus
EKDLWYFEDHNLFIDVNDGID

SEQ ID NO: 2008719 - protein, 19 aa, Staphylococcus
EKDLWYFKDDVILVDVVDH

SEQ ID NO: 2008720 - protein, 17 aa, Staphylococcus
EKDMLFIPFKGENVDGH

SEQ ID NO: 2008721 - protein, 23 aa, Staphylococcus
EKDPKLAPFQGYVLQNFDLNENG

SEQ ID NO: 2008722 - protein, 23 aa, Staphylococcus
EKDPKLLPFQGYILQNFELDNVG

SEQ ID NO: 2008723 - protein, 24 aa, Staphylococcus
EKDPKLLPFQGYVLQHFDLNEKGF

SEQ ID NO: 2008724 - protein, 23 aa, Staphylococcus
EKDPKLMPFQGYILQNFQLSENH

SEQ ID NO: 2008725 - protein, 23 aa, Staphylococcus
EKDPKLMPFQGYVLQNFELSDSH

SEQ ID NO: 2008726 - protein, 23 aa, Staphylococcus
EKDTIKRALSFFDSDEENHKLAD

SEQ ID NO: 2008727 - protein, 26 aa, Staphylococcus
EKDVPFREAHAIVGQIVYWCIQHDCY

SEQ ID NO: 2008728 - protein, 23 aa, Staphylococcus
EKEEAGIVWRMERYGQRMNELMN

SEQ ID NO: 2008729 - protein, 24 aa, Staphylococcus
EKEENVDLYDGYSFIGLGSDGGFA

SEQ ID NO: 2008730 - protein, 23 aa, Staphylococcus
EKEFFDLYSKIVIQIPTSNPVIR

SEQ ID NO: 2008731 - protein, 21 aa, Staphylococcus
EKEFFDLYSKIVVEIPTNSPI

SEQ ID NO: 2008732 - protein, 18 aa, Staphylococcus
EKEFFDLYSKLVVEIPTN

SEQ ID NO: 2008733 - protein, 17 aa, Staphylococcus
EKEGQRLLAKIKPQSTV

SEQ ID NO: 2008734 - protein, 17 aa, Staphylococcus
EKEGQRLLAKVKQQSTV

SEQ ID NO: 2008735 - protein, 22 aa, Staphylococcus
EKEGYNLTFFAFFVKAVADALK

SEQ ID NO: 2008736 - protein, 22 aa, Staphylococcus
EKEIFKVVNYYANHLCDKKVLY

SEQ ID NO: 2008737 - protein, 24 aa, Staphylococcus
EKEIKRIAEDLGYNKNLAAEELVK

SEQ ID NO: 2008738 - protein, 21 aa, Staphylococcus
EKEILPYLYKGLRDKNPAVRR

SEQ ID NO: 2008739 - protein, 21 aa, Staphylococcus
EKEINDLAALVYYPEDKLKLV

SEQ ID NO: 2008740 - protein, 20 aa, Staphylococcus
EKEKDFLQVIVKDEDSQLPT

SEQ ID NO: 2008741 - protein, 19 aa, Staphylococcus
EKEKILSVKIEFDTEQVEK

SEQ ID NO: 2008742 - protein, 21 aa, Staphylococcus
EKEKILTVKIEFDITHIQQFI

SEQ ID NO: 2008743 - protein, 20 aa, Staphylococcus
EKEKVLSIKIEFDTTSIETF

SEQ ID NO: 2008744 - protein, 18 aa, Staphylococcus
EKEKVLSVKVEFDTQQIA

SEQ ID NO: 2008745 - protein, 26 aa, Staphylococcus
EKELISRINIVNEWYDKNVIWEHHQW

SEQ ID NO: 2008746 - protein, 30 aa, Staphylococcus
EKELKGAHTVVWNGPMGVFEFENFAQGTVG

SEQ ID NO: 2008747 - protein, 19 aa, Staphylococcus
EKELKRLGINATIRREQGA

SEQ ID NO: 2008748 - protein, 23 aa, Staphylococcus
EKELKRLGINATIRREQGSDIDA

SEQ ID NO: 2008749 - protein, 18 aa, Staphylococcus
EKEMETIIEFLKRSVDEL

SEQ ID NO: 2008750 - protein, 19 aa, Staphylococcus
EKEMFGRQDAILNAYGLTR

SEQ ID NO: 2008751 - protein, 23 aa, Staphylococcus
EKEMFTYFFDFYFNDQDIVFNDA

SEQ ID NO: 2008752 - protein, 26 aa, Staphylococcus
EKENKFILFIYDWRVLESESRNANYE

SEQ ID NO: 2008753 - protein, 20 aa, Staphylococcus
EKENYKMVGLVEENELRAVI

SEQ ID NO: 2008754 - protein, 18 aa, Staphylococcus
EKERDIGAKYVDLDTLLE

SEQ ID NO: 2008755 - protein, 18 aa, Staphylococcus
EKEREIGAKYVDLDTLLE

SEQ ID NO: 2008756 - protein, 18 aa, Staphylococcus
EKERGVCLYGPHRDDLGF

SEQ ID NO: 2008757 - protein, 17 aa, Staphylococcus
EKERLSSQLVNLNEKSE

SEQ ID NO: 2008758 - protein, 21 aa, Staphylococcus
EKESFGLSLLEAMKTGVVPIG

SEQ ID NO: 2008759 - protein, 22 aa, Staphylococcus
EKESFGLTLLEAMKSGVVPIGS

SEQ ID NO: 2008760 - protein, 23 aa, Staphylococcus
EKESFGLTLLEAMKTGVLPIGTN

SEQ ID NO: 2008761 - protein, 21 aa, Staphylococcus
EKESFGLTLLEAMTTGVVPIG

SEQ ID NO: 2008762 - protein, 21 aa, Staphylococcus
EKETPVNIVACENAIMATNTL

SEQ ID NO: 2008763 - protein, 36 aa, Staphylococcus
EKEVNEIKHFIKSYVQSHSFIKSLVLGISGGQDSTL

SEQ ID NO: 2008764 - protein, 17 aa, Staphylococcus
EKFDFTTEGSWHKRQSH

SEQ ID NO: 2008765 - protein, 20 aa, Staphylococcus
EKFKAFVHKSYRHEKWFEIS

SEQ ID NO: 2008766 - protein, 21 aa, Staphylococcus
EKFKLTVLVDMFGRETPVEVE

SEQ ID NO: 2008767 - protein, 17 aa, Staphylococcus
EKFMLVDPIEAIQPEHR

SEQ ID NO: 2008768 - protein, 38 aa, Staphylococcus
EKFPNAFLMRTFSKAYGLAGLRVGYVIATKEAIHNYNI

SEQ ID NO: 2008769 - protein, 23 aa, Staphylococcus
EKFRGIRSNILFSTADAEIQTLL

SEQ ID NO: 2008770 - protein, 22 aa, Staphylococcus
EKFSGFLLKEGFEDVAQLEGGI

SEQ ID NO: 2008771 - protein, 20 aa, Staphylococcus
EKFYQLPKVFFTNPKYVNLS

SEQ ID NO: 2008772 - protein, 22 aa, Staphylococcus
EKGDEVLPITFIEGGIAKTGAY

SEQ ID NO: 2008773 - protein, 17 aa, Staphylococcus
EKGDVALFFGLSGTGKT

SEQ ID NO: 2008774 - protein, 19 aa, Staphylococcus
EKGDVALFFGLSGTGKTTL

SEQ ID NO: 2008775 - protein, 17 aa, Staphylococcus
EKGEFVSIMGPSGSGKT

SEQ ID NO: 2008776 - protein, 17 aa, Staphylococcus
EKGIKNVHGYGYGDLFI

SEQ ID NO: 2008777 - protein, 19 aa, Staphylococcus
EKGIYRLIMRSNKKEAEDF

SEQ ID NO: 2008778 - protein, 22 aa, Staphylococcus
EKGKDLKFDATVTVQPEVKLGE

SEQ ID NO: 2008779 - protein, 19 aa, Staphylococcus
EKGKEVIVSMSQVEGTPEK

SEQ ID NO: 2008780 - protein, 24 aa, Staphylococcus
EKGLYRKRMLSYGGLLKQKHKILN

SEQ ID NO: 2008781 - protein, 28 aa, Staphylococcus
EKGLYRKRMLSYGGLLKQKHKILNLDDA

SEQ ID NO: 2008782 - protein, 20 aa, Staphylococcus
EKGMFLVPTLLAPVSVIECA

SEQ ID NO: 2008783 - protein, 19 aa, Staphylococcus
EKGNGALIGDEKEDLARKL

SEQ ID NO: 2008784 - protein, 22 aa, Staphylococcus
EKGNYDYFSFEAIRPKNNTELH

SEQ ID NO: 2008785 - protein, 23 aa, Staphylococcus
EKGPEVPRGIPIIPEGYSPKLKR

SEQ ID NO: 2008786 - protein, 20 aa, Staphylococcus
EKGTKFDVYFKGEYFDTFLS

SEQ ID NO: 2008787 - protein, 22 aa, Staphylococcus
EKGVHRLVRISPFDASGRRHTS

SEQ ID NO: 2008788 - protein, 25 aa, Staphylococcus
EKGYFARPTIFINVDNHMTIAQEEI

SEQ ID NO: 2008789 - protein, 17 aa, Staphylococcus
EKGYKIFLATGRSYTEI

SEQ ID NO: 2008790 - protein, 24 aa, Staphylococcus
EKGYPTKLVLFGAGIGAERKNIEK

SEQ ID NO: 2008791 - protein, 17 aa, Staphylococcus
EKGYYPVAVDAKHGKNL

SEQ ID NO: 2008792 - protein, 24 aa, Staphylococcus
EKHGFKFRELEYFKQMQHTYGNRA

SEQ ID NO: 2008793 - protein, 19 aa, Staphylococcus
EKHGFSFRDEPYFIEMQKI

SEQ ID NO: 2008794 - protein, 27 aa, Staphylococcus
EKHGYVGLAHAGWRGTYGEIVKEMVRK

SEQ ID NO: 2008795 - protein, 18 aa, Staphylococcus
EKHPRLIVTRTVKKGTGK

SEQ ID NO: 2008796 - protein, 19 aa, Staphylococcus
EKHPRVELIEPLDVVDFHN

SEQ ID NO: 2008797 - protein, 18 aa, Staphylococcus
EKHSYYGISGFVRPAYQA

SEQ ID NO: 2008798 - protein, 28 aa, Staphylococcus
EKHVPLKTAESWDNVGLLIGDKHTKMTG

SEQ ID NO: 2008799 - protein, 24 aa, Staphylococcus
EKHWPADLILLAIGFIGTENTVPN

SEQ ID NO: 2008800 - protein, 30 aa, Staphylococcus
EKHYDGHAYKDCPNFVKGHIPELYIENNHI

SEQ ID NO: 2008801 - protein, 23 aa, Staphylococcus
EKIDDVMTSFTWFDEEYFTHDPK

SEQ ID NO: 2008802 - protein, 22 aa, Staphylococcus
EKIDHINVLLGFLEAFGLIDFE

SEQ ID NO: 2008803 - protein, 40 aa, Staphylococcus
EKIDKCIRFIDKWYFPVQPFQKFIIAFLFLMDEELDTPYF

SEQ ID NO: 2008804 - protein, 17 aa, Staphylococcus
EKIDLLMHINRNEIVNW

SEQ ID NO: 2008805 - protein, 23 aa, Staphylococcus
EKIEEVLTLVGLKNATKKVKQYS

SEQ ID NO: 2008806 - protein, 20 aa, Staphylococcus
EKIELFKKLEFNQLLAEIDS

SEQ ID NO: 2008807 - protein, 24 aa, Staphylococcus
EKIFKSNKKVIVFYGGGFYNNGIT

SEQ ID NO: 2008808 - protein, 28 aa, Staphylococcus
EKIHGIIFDGAWLWEEYIDTLIHEDYYH

SEQ ID NO: 2008809 - protein, 20 aa, Staphylococcus
EKIIWDIGGLAPKPCFEVIQ

SEQ ID NO: 2008810 - protein, 18 aa, Staphylococcus
EKIKEMVPSFGMKLSENE

SEQ ID NO: 2008811 - protein, 20 aa, Staphylococcus
EKIKWLLNFLDQSGPTIIYV

SEQ ID NO: 2008812 - protein, 17 aa, Staphylococcus
EKIKWNFTKFLVDRQGH

SEQ ID NO: 2008813 - protein, 23 aa, Staphylococcus
EKILEWLEAAGIDPRRRGETLSI

SEQ ID NO: 2008814 - protein, 18 aa, Staphylococcus
EKILKSALGGVLFIDEAY

SEQ ID NO: 2008815 - protein, 20 aa, Staphylococcus
EKILKVDGFLNHQIDAKLMY

SEQ ID NO: 2008816 - protein, 17 aa, Staphylococcus
EKILKVDGFLNHQIDAR

SEQ ID NO: 2008817 - protein, 23 aa, Staphylococcus
EKIPKALALDYVYGYTIINDITD

SEQ ID NO: 2008818 - protein, 24 aa, Staphylococcus
EKIPYRAKRHYSIVSGEKERLTFA

SEQ ID NO: 2008819 - protein, 27 aa, Staphylococcus
EKIQPILKEKFESLGLKVEEDQASQTD

SEQ ID NO: 2008820 - protein, 20 aa, Staphylococcus
EKIREAFKDRILIPQNDLDR

SEQ ID NO: 2008821 - protein, 21 aa, Staphylococcus
EKIREAFKDRILIPQNDMDKI

SEQ ID NO: 2008822 - protein, 17 aa, Staphylococcus
EKISLLIKQNMNRYMSI

SEQ ID NO: 2008823 - protein, 18 aa, Staphylococcus
EKISMRWVDLIRTLNHFI

SEQ ID NO: 2008824 - protein, 24 aa, Staphylococcus
EKITEYELLTAYNPVFINRKIQTI

SEQ ID NO: 2008825 - protein, 25 aa, Staphylococcus
EKITNDWPDNVSVFSNRVETYQAIT

SEQ ID NO: 2008826 - protein, 27 aa, Staphylococcus
EKIVFVDRLGKIIAMNGAARDILSEED

SEQ ID NO: 2008827 - protein, 23 aa, Staphylococcus
EKIYKQLLRDGVDFITMGNHTYG

SEQ ID NO: 2008828 - protein, 25 aa, Staphylococcus
EKKDARAKELIKLVDLPEDYLDRYP

SEQ ID NO: 2008829 - protein, 27 aa, Staphylococcus
EKKDKKARELIKLVDLPEEYLDRYPSE

SEQ ID NO: 2008830 - protein, 22 aa, Staphylococcus
EKKEIFLYLMYVYQQIVKADIE

SEQ ID NO: 2008831 - protein, 20 aa, Staphylococcus
EKKGPTVLGTIEYSVQGSTE

SEQ ID NO: 2008832 - protein, 28 aa, Staphylococcus
EKKIPILGVCLGFQFLIEHYGGNIVPNF

SEQ ID NO: 2008833 - protein, 18 aa, Staphylococcus
EKKLITFFNAVKESNFYE

SEQ ID NO: 2008834 - protein, 24 aa, Staphylococcus
EKKLPTTQFLKIHRSTIINKVHIK

SEQ ID NO: 2008835 - protein, 19 aa, Staphylococcus
EKKRFKADIDRVVTKHDCP

SEQ ID NO: 2008836 - protein, 17 aa, Staphylococcus
EKKRYSITAMFDDKGNP

SEQ ID NO: 2008837 - protein, 24 aa, Staphylococcus
EKKVTRLAQHLGWSSEGTDFDILP

SEQ ID NO: 2008838 - protein, 20 aa, Staphylococcus
EKKWQCFWLDNQTFKTSDNL

SEQ ID NO: 2008839 - protein, 21 aa, Staphylococcus
EKKWQDYWAENKTFKTSDNLG

SEQ ID NO: 2008840 - protein, 20 aa, Staphylococcus
EKKWQNYWAENKTFKANDNL

SEQ ID NO: 2008841 - protein, 33 aa, Staphylococcus
EKLASSKWIGAEHFCLKFAQILVKENEELNFKE

SEQ ID NO: 2008842 - protein, 22 aa, Staphylococcus
EKLDIPPIDVFGLKTTVNEIHD

SEQ ID NO: 2008843 - protein, 21 aa, Staphylococcus
EKLEECGQCSNCVVENKTYNM

SEQ ID NO: 2008844 - protein, 21 aa, Staphylococcus
EKLEECGRCSNCVNENKTYDM

SEQ ID NO: 2008845 - protein, 20 aa, Staphylococcus
EKLEIIPLNIERYFYLLTHT

SEQ ID NO: 2008846 - protein, 26 aa, Staphylococcus
EKLERAIRIQAKMASLVASFQRVREG

SEQ ID NO: 2008847 - protein, 29 aa, Staphylococcus
EKLFEMIPSIKILFSLMVLEDRNSYLGAT

SEQ ID NO: 2008848 - protein, 24 aa, Staphylococcus
EKLFKEEIYTLFASINSYNELSIL

SEQ ID NO: 2008849 - protein, 20 aa, Staphylococcus
EKLIKAGMNVARLNFSHGDQ

SEQ ID NO: 2008850 - protein, 18 aa, Staphylococcus
EKLIKMLNLEAVRNHHPF

SEQ ID NO: 2008851 - protein, 20 aa, Staphylococcus
EKLKCSFCGKDQDQVKKLVA

SEQ ID NO: 2008852 - protein, 23 aa, Staphylococcus
EKLKEGLEVKLLYDDVGSKKVGR

SEQ ID NO: 2008853 - protein, 22 aa, Staphylococcus
EKLKESEAWSNIEAVRNDRVHD

SEQ ID NO: 2008854 - protein, 18 aa, Staphylococcus
EKLKETFPNITSIKQNIN

SEQ ID NO: 2008855 - protein, 17 aa, Staphylococcus
EKLKHHLDYQVLVKVHP

SEQ ID NO: 2008856 - protein, 20 aa, Staphylococcus
EKLKHLFEWIETQYSDLKPV

SEQ ID NO: 2008857 - protein, 17 aa, Staphylococcus
EKLKLVVHKNHELSKKT

SEQ ID NO: 2008858 - protein, 36 aa, Staphylococcus
EKLKRHMTFLMDKGCLYLPYNGNLLIHGCIPIDENG

SEQ ID NO: 2008859 - protein, 23 aa, Staphylococcus
EKLKRLFNQAGFSNVKVRSFTGG

SEQ ID NO: 2008860 - protein, 23 aa, Staphylococcus
EKLKRYYKDFGFTEIENHTSENG

SEQ ID NO: 2008861 - protein, 21 aa, Staphylococcus
EKLLFEKLHDFIEVMGELEIP

SEQ ID NO: 2008862 - protein, 29 aa, Staphylococcus
EKLNEWFKRPSIVHKFLDNFDVSFTDISF

SEQ ID NO: 2008863 - protein, 19 aa, Staphylococcus
EKLNIPILFVPGNHDLWSD

SEQ ID NO: 2008864 - protein, 26 aa, Staphylococcus
EKLPLGVINILLQFVMLKNEMMLPKK

SEQ ID NO: 2008865 - protein, 24 aa, Staphylococcus
EKLPNEHFGDFVIRTGVVSKVNDG

SEQ ID NO: 2008866 - protein, 23 aa, Staphylococcus
EKLPYRAKRHYSIVDGDESYLTF

SEQ ID NO: 2008867 - protein, 25 aa, Staphylococcus
EKLPYRAKRHYSIVGGDKDTLTFAV

SEQ ID NO: 2008868 - protein, 22 aa, Staphylococcus
EKLRQEGALDYTIVVSASAADP

SEQ ID NO: 2008869 - protein, 19 aa, Staphylococcus
EKLSDLGYQPGLQPYTEGV

SEQ ID NO: 2008870 - protein, 22 aa, Staphylococcus
EKLSDRAIGYGIKGITVDGNDP

SEQ ID NO: 2008871 - protein, 23 aa, Staphylococcus
EKLSDRAIGYGMHGEHVDGNDPI

SEQ ID NO: 2008872 - protein, 18 aa, Staphylococcus
EKLSDRALGYGIYGETVD

SEQ ID NO: 2008873 - protein, 18 aa, Staphylococcus
EKLSESYKALDYKLNDEY

SEQ ID NO: 2008874 - protein, 21 aa, Staphylococcus
EKLSKYISKWFSKHDVTVVPN

SEQ ID NO: 2008875 - protein, 17 aa, Staphylococcus
EKLSNEKYRTWDWNYGK

SEQ ID NO: 2008876 - protein, 28 aa, Staphylococcus
EKLTFAEVIDELRAGGAYESKLETDPQR

SEQ ID NO: 2008877 - protein, 23 aa, Staphylococcus
EKLTFMHAYNCICANVPAQYACI

SEQ ID NO: 2008878 - protein, 23 aa, Staphylococcus
EKLTFMHAYNCICANVPSQIACI

SEQ ID NO: 2008879 - protein, 19 aa, Staphylococcus
EKLTNCGIPSVGLTGKDNI

SEQ ID NO: 2008880 - protein, 17 aa, Staphylococcus
EKLYDMYVQLGIENPNI

SEQ ID NO: 2008881 - protein, 27 aa, Staphylococcus
EKMFQWSEALAQVGVCRFSSLETMTLP

SEQ ID NO: 2008882 - protein, 23 aa, Staphylococcus
EKMIPKLDSALSHYHDKIKEELQ

SEQ ID NO: 2008883 - protein, 21 aa, Staphylococcus
EKMIRRHPHIFGEAHAETEED

SEQ ID NO: 2008884 - protein, 24 aa, Staphylococcus
EKMKELGRKSAGLDTTRKAILTAV

SEQ ID NO: 2008885 - protein, 24 aa, Staphylococcus
EKMKLQSPRLMLGFKNEPLNEAPE

SEQ ID NO: 2008886 - protein, 23 aa, Staphylococcus
EKMPEIKIQGFLGSLGDKKGFAY

SEQ ID NO: 2008887 - protein, 23 aa, Staphylococcus
EKMPELKVQGFLGSLGDKQGFAY

SEQ ID NO: 2008888 - protein, 20 aa, Staphylococcus
EKMPELKVQGFLGSLGEKKG

SEQ ID NO: 2008889 - protein, 18 aa, Staphylococcus
EKMPRTQPRMKWYTDDKI

SEQ ID NO: 2008890 - protein, 24 aa, Staphylococcus
EKMPYRAKRHYSIVKGDKQHLTFA

SEQ ID NO: 2008891 - protein, 23 aa, Staphylococcus
EKMPYRAKRHYSIVKGDQNHLTF

SEQ ID NO: 2008892 - protein, 24 aa, Staphylococcus
EKMPYRAKRHYSIVSGDNNHLTFA

SEQ ID NO: 2008893 - protein, 18 aa, Staphylococcus
EKMRFKDADYSGGFVKGE

SEQ ID NO: 2008894 - protein, 18 aa, Staphylococcus
EKMRFKDTEYTGGFVEGE

SEQ ID NO: 2008895 - protein, 24 aa, Staphylococcus
EKMRFKDTEYTGGHVLGKTPEFPI

SEQ ID NO: 2008896 - protein, 19 aa, Staphylococcus
EKMRFKDTTYTGGFVDGEA

SEQ ID NO: 2008897 - protein, 21 aa, Staphylococcus
EKMSEYCLSYILADLQHHKLF

SEQ ID NO: 2008898 - protein, 19 aa, Staphylococcus
EKMYRRFSILATISQNEPV

SEQ ID NO: 2008899 - protein, 21 aa, Staphylococcus
EKMYRRFSILTTIAKHQPVGR

SEQ ID NO: 2008900 - protein, 24 aa, Staphylococcus
EKNDIKMLYGMEGMLVDDGVPIAY

SEQ ID NO: 2008901 - protein, 17 aa, Staphylococcus
EKNDVLVVAGFQGINDE

SEQ ID NO: 2008902 - protein, 22 aa, Staphylococcus
EKNERINVLKDFIESFLEPCHI

SEQ ID NO: 2008903 - protein, 18 aa, Staphylococcus
EKNESVIYLGTFSKTLMP

SEQ ID NO: 2008904 - protein, 24 aa, Staphylococcus
EKNISRIGSTFGKTNRVIIDTNDH

SEQ ID NO: 2008905 - protein, 22 aa, Staphylococcus
EKNKIAGIPVEYFHSYVTGSMI

SEQ ID NO: 2008906 - protein, 17 aa, Staphylococcus
EKNKLAFVNAVEKHYDM

SEQ ID NO: 2008907 - protein, 19 aa, Staphylococcus
EKNKRRMISGLPHEVAQQL

SEQ ID NO: 2008908 - protein, 23 aa, Staphylococcus
EKNTYKISDFIGVMSPANKNYLL

SEQ ID NO: 2008909 - protein, 17 aa, Staphylococcus
EKNVTWDECQTLDLTDL

SEQ ID NO: 2008910 - protein, 20 aa, Staphylococcus
EKNWMKLDLPEKVRDIGTPL

SEQ ID NO: 2008911 - protein, 25 aa, Staphylococcus
EKNYKEVTEALGIQELGDKYPNEIS

SEQ ID NO: 2008912 - protein, 22 aa, Staphylococcus
EKPDLIEVLFEFEADVHPKING

SEQ ID NO: 2008913 - protein, 19 aa, Staphylococcus
EKPDVLVISGDIYDTSYPS

SEQ ID NO: 2008914 - protein, 20 aa, Staphylococcus
EKPGIVGAFCRAYTIEEAIE

SEQ ID NO: 2008915 - protein, 21 aa, Staphylococcus
EKPHDYCLVSVIGGQGILEID

SEQ ID NO: 2008916 - protein, 20 aa, Staphylococcus
EKPKFGQAVNEVRQAIESAI

SEQ ID NO: 2008917 - protein, 21 aa, Staphylococcus
EKPRKILLMIKAGSPTDNMIN

SEQ ID NO: 2008918 - protein, 18 aa, Staphylococcus
EKPSEYYLVSVIEGAGSV

SEQ ID NO: 2008919 - protein, 26 aa, Staphylococcus
EKPTGLWLGELVHFYDYFNNNNYQID

SEQ ID NO: 2008920 - protein, 27 aa, Staphylococcus
EKPWIDARIGYSPLENCNEIITEEEMF

SEQ ID NO: 2008921 - protein, 20 aa, Staphylococcus
EKQAGFTSGTPWIDIPNNAE

SEQ ID NO: 2008922 - protein, 22 aa, Staphylococcus
EKQEKRHEVTVEFYRKELQERS

SEQ ID NO: 2008923 - protein, 26 aa, Staphylococcus
EKQITHIIEAYKIFKEKGYPTKLVLF

SEQ ID NO: 2008924 - protein, 20 aa, Staphylococcus
EKQLCFLFYVSSKEIIKRYS

SEQ ID NO: 2008925 - protein, 24 aa, Staphylococcus
EKQLDHLLKAYIEFLKSGHQTKLA

SEQ ID NO: 2008926 - protein, 29 aa, Staphylococcus
EKQLIELLTRLGIKLNLPSLDFDTNELIG

SEQ ID NO: 2008927 - protein, 17 aa, Staphylococcus
EKQRYALVEPDKIKAGA

SEQ ID NO: 2008928 - protein, 24 aa, Staphylococcus
EKQSGIASLCIGGGQGIATAVSYY

SEQ ID NO: 2008929 - protein, 22 aa, Staphylococcus
EKQSYGKKVIVFSFFEDTIKYL

SEQ ID NO: 2008930 - protein, 18 aa, Staphylococcus
EKQVRKIVQHLEERGYQL

SEQ ID NO: 2008931 - protein, 20 aa, Staphylococcus
EKRDIMISGLGFITIDSGAK

SEQ ID NO: 2008932 - protein, 20 aa, Staphylococcus
EKRDVMISGLGFITIDSGAK

SEQ ID NO: 2008933 - protein, 21 aa, Staphylococcus
EKRKRAWKWRQLFNKHSSRFI

SEQ ID NO: 2008934 - protein, 20 aa, Staphylococcus
EKRLKEGIIVHFTQREQDKL

SEQ ID NO: 2008935 - protein, 23 aa, Staphylococcus
EKRLNYAGFYRIHHQYKKKVMMV

SEQ ID NO: 2008936 - protein, 24 aa, Staphylococcus
EKRMILERILPILSDREKEIIQCT

SEQ ID NO: 2008937 - protein, 24 aa, Staphylococcus
EKRMILERILPILSDREREIIQCT

SEQ ID NO: 2008938 - protein, 25 aa, Staphylococcus
EKRMILERILPILSDREREIIQCTF

SEQ ID NO: 2008939 - protein, 25 aa, Staphylococcus
EKRMILERILPILSDRERQIIQCTF

SEQ ID NO: 2008940 - protein, 25 aa, Staphylococcus
EKRMILERILPILSEREREIIQCTF

SEQ ID NO: 2008941 - protein, 24 aa, Staphylococcus
EKRMILERILPILTDREREIIQCT

SEQ ID NO: 2008942 - protein, 26 aa, Staphylococcus
EKRNLTVDNWIKWYDMKVVDETDTYT

SEQ ID NO: 2008943 - protein, 20 aa, Staphylococcus
EKRVLSWQDAILDLSKDSIN

SEQ ID NO: 2008944 - protein, 26 aa, Staphylococcus
EKSESVYQCIKSVFKELDTISKQLET

SEQ ID NO: 2008945 - protein, 19 aa, Staphylococcus
EKSEVLQILYSYYTYQQLR

SEQ ID NO: 2008946 - protein, 21 aa, Staphylococcus
EKSFELVFVKWVPREQNKEAN

SEQ ID NO: 2008947 - protein, 28 aa, Staphylococcus
EKSGWTDIFIYPGFEYKAIDGLITNFHL

SEQ ID NO: 2008948 - protein, 17 aa, Staphylococcus
EKSIADLAVKARDKKLG

SEQ ID NO: 2008949 - protein, 18 aa, Staphylococcus
EKSIAIRLAYLDTEQTLT

SEQ ID NO: 2008950 - protein, 24 aa, Staphylococcus
EKSKEGLLRHVIIRVGYTSREVMV

SEQ ID NO: 2008951 - protein, 23 aa, Staphylococcus
EKSLLHKKIEAMIDNKAQYSFIN

SEQ ID NO: 2008952 - protein, 25 aa, Staphylococcus
EKSLLTKKLEAMIDNKAQYSFLKLM

SEQ ID NO: 2008953 - protein, 21 aa, Staphylococcus
EKSSIDFKGFNKIKEFPNNYE

SEQ ID NO: 2008954 - protein, 18 aa, Staphylococcus
EKSSVCIGFTEVFIKMGD

SEQ ID NO: 2008955 - protein, 25 aa, Staphylococcus
EKSYEPWKFQAFRPQKIILDESIIS

SEQ ID NO: 2008956 - protein, 17 aa, Staphylococcus
EKTAAVFNFEDRVRTYH

SEQ ID NO: 2008957 - protein, 17 aa, Staphylococcus
EKTFYHFSTEPENDIEV

SEQ ID NO: 2008958 - protein, 19 aa, Staphylococcus
EKTGITIMYMVKKLDAGNI

SEQ ID NO: 2008959 - protein, 19 aa, Staphylococcus
EKTKEKFGQIDILVNSAGL

SEQ ID NO: 2008960 - protein, 18 aa, Staphylococcus
EKTLLKKKLEAVNDNKSQ

SEQ ID NO: 2008961 - protein, 18 aa, Staphylococcus
EKTLLTKKLESMVDNKSQ

SEQ ID NO: 2008962 - protein, 17 aa, Staphylococcus
EKTPAQIILNWHLCHGR

SEQ ID NO: 2008963 - protein, 18 aa, Staphylococcus
EKTPQALLTMTRLLNARS

SEQ ID NO: 2008964 - protein, 18 aa, Staphylococcus
EKTRKALEDYGIDYDQII

SEQ ID NO: 2008965 - protein, 23 aa, Staphylococcus
EKTRLNKRLPKLLDIADHHCMIS

SEQ ID NO: 2008966 - protein, 18 aa, Staphylococcus
EKTRNILESYGIDYDQII

SEQ ID NO: 2008967 - protein, 17 aa, Staphylococcus
EKTSLPVVETFQGAGVI

SEQ ID NO: 2008968 - protein, 21 aa, Staphylococcus
EKTVRYILFHLRIAPDEAHAV

SEQ ID NO: 2008969 - protein, 18 aa, Staphylococcus
EKVADAFNFDTLKNNTFN

SEQ ID NO: 2008970 - protein, 18 aa, Staphylococcus
EKVAEAFEFDTLKNNSFN

SEQ ID NO: 2008971 - protein, 20 aa, Staphylococcus
EKVAIGLKAAEFVENGDTLF

SEQ ID NO: 2008972 - protein, 20 aa, Staphylococcus
EKVEEMLDFVGLGDKGTQYP

SEQ ID NO: 2008973 - protein, 21 aa, Staphylococcus
EKVEEMLEFVGLADKKNQFPD

SEQ ID NO: 2008974 - protein, 29 aa, Staphylococcus
EKVEHMNAWLKPYRRAFNIEEPVINMTEK

SEQ ID NO: 2008975 - protein, 23 aa, Staphylococcus
EKVIDELAARFVVLVDEQKVVNY

SEQ ID NO: 2008976 - protein, 18 aa, Staphylococcus
EKVKEIARGAAIQTGCDY

SEQ ID NO: 2008977 - protein, 18 aa, Staphylococcus
EKVKELFANMQIPTSEDW

SEQ ID NO: 2008978 - protein, 25 aa, Staphylococcus
EKVKRELGQTLPIVIDGKHITKDDT

SEQ ID NO: 2008979 - protein, 17 aa, Staphylococcus
EKVLIHVSNFRKVKRID

SEQ ID NO: 2008980 - protein, 17 aa, Staphylococcus
EKVMAIYIQHPEKNHEI

SEQ ID NO: 2008981 - protein, 20 aa, Staphylococcus
EKVNEMLEFVGLADKKNQFP

SEQ ID NO: 2008982 - protein, 20 aa, Staphylococcus
EKVPTHWKDNVLIRQLDYFD

SEQ ID NO: 2008983 - protein, 22 aa, Staphylococcus
EKVPYYSARIVKNVTIAPSPIW

SEQ ID NO: 2008984 - protein, 26 aa, Staphylococcus
EKVQSLRAGNHMVVFTTTILERGFTM

SEQ ID NO: 2008985 - protein, 28 aa, Staphylococcus
EKVRELFKGFEIPTAEDWKALQKDVEQY

SEQ ID NO: 2008986 - protein, 23 aa, Staphylococcus
EKVRGIRSNIMFSGVEEVQSIIV

SEQ ID NO: 2008987 - protein, 27 aa, Staphylococcus
EKVRRNPYSVILFDEIEKANPQILTLL

SEQ ID NO: 2008988 - protein, 35 aa, Staphylococcus
EKWAKPEGMDSWDYAHCLPYFKRLEKTFGATKDDQ

SEQ ID NO: 2008989 - protein, 35 aa, Staphylococcus
EKWGAPEGMDTWDFAHCLPYFKRLEKTFGATKDDE

SEQ ID NO: 2008990 - protein, 24 aa, Staphylococcus
EKWTEKRESLSYDIDGIVIKVNDL

SEQ ID NO: 2008991 - protein, 17 aa, Staphylococcus
EKWVCPVCAQGENPWNQ

SEQ ID NO: 2008992 - protein, 20 aa, Staphylococcus
EKWVCSICAQGDNPWQQSHE

SEQ ID NO: 2008993 - protein, 28 aa, Staphylococcus
EKYDSFIGGFVWEWCDHSIQVGIKEGKP

SEQ ID NO: 2008994 - protein, 24 aa, Staphylococcus
EKYEWLRMHFPFLDPQNFVFCGRK

SEQ ID NO: 2008995 - protein, 18 aa, Staphylococcus
EKYFRIHRLVAREFIPNP

SEQ ID NO: 2008996 - protein, 18 aa, Staphylococcus
EKYIKAFYEDVGALNVKK

SEQ ID NO: 2008997 - protein, 23 aa, Staphylococcus
EKYIRLYLQLSYALFQFKDEFLQ

SEQ ID NO: 2008998 - protein, 21 aa, Staphylococcus
EKYKIQWLKSDQHLIKTGYNR

SEQ ID NO: 2008999 - protein, 24 aa, Staphylococcus
EKYLRPETLFGTKFEGYLNQQQSN

SEQ ID NO: 2009000 - protein, 19 aa, Staphylococcus
EKYNEAFPNGEIEELNLYE

SEQ ID NO: 2009001 - protein, 20 aa, Staphylococcus
EKYNGLKPIQIIDMKGLMGD

SEQ ID NO: 2009002 - protein, 26 aa, Staphylococcus
EKYPAFIGAFVWEWCDHAVTAGMQHG

SEQ ID NO: 2009003 - protein, 17 aa, Staphylococcus
EKYRIQMQYYKNALETM

SEQ ID NO: 2009004 - protein, 23 aa, Staphylococcus
EKYSRLRSLYCYEVYNEKGELAT

SEQ ID NO: 2009005 - protein, 28 aa, Staphylococcus
EKYSTGKWGEIPVRFISPKGNTDVLPVI

SEQ ID NO: 2009006 - protein, 18 aa, Staphylococcus
EKYSVLRALKAIERSNVV

SEQ ID NO: 2009007 - protein, 22 aa, Staphylococcus
EKYSVLRALKAIERSNVVLVVI

SEQ ID NO: 2009008 - protein, 27 aa, Staphylococcus
EKYVDYWKAYDFNSGYFMALKVKHVDP

SEQ ID NO: 2009009 - protein, 18 aa, Staphylococcus
EKYVELFAEHGADMISVH

SEQ ID NO: 2009010 - protein, 24 aa, Staphylococcus
EKYVPYCIEPSLGADRVTLAFLCD

SEQ ID NO: 2009011 - protein, 25 aa, Staphylococcus
EKYVPYCIEPSLGADRVTLAFLCDA

SEQ ID NO: 2009012 - protein, 25 aa, Staphylococcus
EKYWKEHYQTISFPQFKYKVGQSSD

SEQ ID NO: 2009013 - protein, 21 aa, Staphylococcus
ELADSLIRRTMEPTRQAMKDA

SEQ ID NO: 2009014 - protein, 19 aa, Staphylococcus
ELAEAYLGHHDRIELIDPL

SEQ ID NO: 2009015 - protein, 26 aa, Staphylococcus
ELAELTCLNPVQLRRVVANLSDQQLI

SEQ ID NO: 2009016 - protein, 21 aa, Staphylococcus
ELAENLNVCFNCDHHIALTAH

SEQ ID NO: 2009017 - protein, 21 aa, Staphylococcus
ELAENLNVCFNCDHHIALTAY

SEQ ID NO: 2009018 - protein, 19 aa, Staphylococcus
ELAEVNFFGNFEMIKTFTP

SEQ ID NO: 2009019 - protein, 18 aa, Staphylococcus
ELAHKMKLGQPIDITQRF

SEQ ID NO: 2009020 - protein, 19 aa, Staphylococcus
ELAKKVIKGECLIDERDSD

SEQ ID NO: 2009021 - protein, 17 aa, Staphylococcus
ELAKSRAESHLNNEEDN

SEQ ID NO: 2009022 - protein, 24 aa, Staphylococcus
ELALKRDIFFHHPYESFQPIVDFI

SEQ ID NO: 2009023 - protein, 20 aa, Staphylococcus
ELAPTTELRKWFNHDPKLYA

SEQ ID NO: 2009024 - protein, 25 aa, Staphylococcus
ELAQEIYKAGFLTGIYHGDMSYQER

SEQ ID NO: 2009025 - protein, 18 aa, Staphylococcus
ELAQKGIVQEVKRDKAAI

SEQ ID NO: 2009026 - protein, 18 aa, Staphylococcus
ELCHYFLHLAGKGYQHRD

SEQ ID NO: 2009027 - protein, 17 aa, Staphylococcus
ELCHYHLHLQKKGYQHK

SEQ ID NO: 2009028 - protein, 26 aa, Staphylococcus
ELCQEIKDNYTLPVIMLTARDALSDK

SEQ ID NO: 2009029 - protein, 20 aa, Staphylococcus
ELCQQIKLDFDLPVIMLTAR

SEQ ID NO: 2009030 - protein, 26 aa, Staphylococcus
ELDAALWGARAAYIGGFDSTSNVRSG

SEQ ID NO: 2009031 - protein, 26 aa, Staphylococcus
ELDDPYLKIDLETMLNALPKGLTKKT

SEQ ID NO: 2009032 - protein, 28 aa, Staphylococcus
ELDETLALIKCDMLYHLNSFLELREEAI

SEQ ID NO: 2009033 - protein, 20 aa, Staphylococcus
ELDETLSLIKCETLLQLNAF

SEQ ID NO: 2009034 - protein, 26 aa, Staphylococcus
ELDLFTCLRPVRWFQGVPSPVKRPQD

SEQ ID NO: 2009035 - protein, 19 aa, Staphylococcus
ELDLMGSHLGPYCYPLVID

SEQ ID NO: 2009036 - protein, 30 aa, Staphylococcus
ELDLSALVAGAKYRGEFEERLKAVLKEIKD

SEQ ID NO: 2009037 - protein, 30 aa, Staphylococcus
ELDLSALVAGAKYRGEFEERLKAVLKEVKD

SEQ ID NO: 2009038 - protein, 31 aa, Staphylococcus
ELDLSALVAGAKYRGEFEERLKAVLKEVKDS

SEQ ID NO: 2009039 - protein, 30 aa, Staphylococcus; identical to SEQ ID NO: 1648232

SEQ ID NO: 2009040 - protein, 17 aa, Staphylococcus
ELDLTVFNNGHRSVARN

SEQ ID NO: 2009041 - protein, 24 aa, Staphylococcus
ELDNGFDFYAPQTFIDEYGKRILI

SEQ ID NO: 2009042 - protein, 24 aa, Staphylococcus
ELDNNSFLLLEFIENGHAYPESYR

SEQ ID NO: 2009043 - protein, 20 aa, Staphylococcus
ELDPKRVIVEFNKELIKQDK

SEQ ID NO: 2009044 - protein, 18 aa, Staphylococcus
ELDRKIDAVINIEVPEEE

SEQ ID NO: 2009045 - protein, 22 aa, Staphylococcus
ELDVLKHRIAKRNRSFEHQIED

SEQ ID NO: 2009046 - protein, 17 aa, Staphylococcus
ELEDAVYHLIKIGKTTK

SEQ ID NO: 2009047 - protein, 18 aa, Staphylococcus
ELEDIFLTLLVQQHPNET

SEQ ID NO: 2009048 - protein, 18 aa, Staphylococcus
ELEDLFDGRVHTIMSNPL

SEQ ID NO: 2009049 - protein, 19 aa, Staphylococcus
ELEDTALRYTDSVQYFRIV

SEQ ID NO: 2009050 - protein, 23 aa, Staphylococcus
ELEELRLRVATSRPQDNKSFASG

SEQ ID NO: 2009051 - protein, 22 aa, Staphylococcus
ELEELRLRVATSRPQENKNFSS

SEQ ID NO: 2009052 - protein, 23 aa, Staphylococcus
ELEELRLRVATSRPQENKNFSSN

SEQ ID NO: 2009053 - protein, 24 aa, Staphylococcus
ELEERYPILMLFDDYNRIDLTLLS

SEQ ID NO: 2009054 - protein, 26 aa, Staphylococcus
ELEFPLIDISEDWNLGEITRQMANYI

SEQ ID NO: 2009055 - protein, 19 aa, Staphylococcus
ELEGLGILDFYTKSQKERL

SEQ ID NO: 2009056 - protein, 24 aa, Staphylococcus
ELEKEKDFLQVLVKDDGNHLPTDQ

SEQ ID NO: 2009057 - protein, 20 aa, Staphylococcus
ELEKGLIIPVDYELDYFAGL

SEQ ID NO: 2009058 - protein, 22 aa, Staphylococcus
ELEKMKHVIGKAVPDAPHEVLL

SEQ ID NO: 2009059 - protein, 26 aa, Staphylococcus
ELELSFGLKFLRIIDKVMAMESENIS

SEQ ID NO: 2009060 - protein, 24 aa, Staphylococcus
ELELSRTKLLVSIRRLIEKDKLSK

SEQ ID NO: 2009061 - protein, 24 aa, Staphylococcus
ELELSRTKLLVSIRRLIEKEKLSK

SEQ ID NO: 2009062 - protein, 24 aa, Staphylococcus
ELELSRTKLLVSIRRLIEKERLSK

SEQ ID NO: 2009063 - protein, 22 aa, Staphylococcus
ELENHFFGRVGLFRNQVGDELL

SEQ ID NO: 2009064 - protein, 21 aa, Staphylococcus
ELENWDFFVYGVNDFSNVMET

SEQ ID NO: 2009065 - protein, 22 aa, Staphylococcus
ELEPKELLKYCLETEQRLHRVR

SEQ ID NO: 2009066 - protein, 20 aa, Staphylococcus
ELEQHWAVMKSYPDMPSGAN

SEQ ID NO: 2009067 - protein, 17 aa, Staphylococcus
ELERHWAVMKSSPGMPP

SEQ ID NO: 2009068 - protein, 23 aa, Staphylococcus
ELESHFFGRVGLFRNQVGDELLR

SEQ ID NO: 2009069 - protein, 27 aa, Staphylococcus
ELESIIGNGFSVIYLISQRLVKKSLDD

SEQ ID NO: 2009070 - protein, 17 aa, Staphylococcus
ELETFDDETLCEHKVIS

SEQ ID NO: 2009071 - protein, 17 aa, Staphylococcus
ELFDIAPTLDRGTKTLE

SEQ ID NO: 2009072 - protein, 23 aa, Staphylococcus
ELFDVGLEQLEFVMIPQTLDQVS

SEQ ID NO: 2009073 - protein, 20 aa, Staphylococcus
ELFEAMVMTPYFPKPDVLIY

SEQ ID NO: 2009074 - protein, 21 aa, Staphylococcus
ELFELDCDILVPAAISNQITE

SEQ ID NO: 2009075 - protein, 18 aa, Staphylococcus
ELFERFLYEHPQVGRIVV

SEQ ID NO: 2009076 - protein, 17 aa, Staphylococcus
ELFKEYFASVVPAGDNK

SEQ ID NO: 2009077 - protein, 17 aa, Staphylococcus
ELFKNKWIGKFLTSLNA

SEQ ID NO: 2009078 - protein, 24 aa, Staphylococcus
ELFKQFRHMLEPLIAHHKLAMVLV

SEQ ID NO: 2009079 - protein, 23 aa, Staphylococcus
ELFKRTLPDVLIKLEKAGFETSA

SEQ ID NO: 2009080 - protein, 23 aa, Staphylococcus
ELFKRTLPDVLIKLERAGYETSA

SEQ ID NO: 2009081 - protein, 27 aa, Staphylococcus
ELFMFELRMQWLNRLEKSSDEAIEIDY

SEQ ID NO: 2009082 - protein, 18 aa, Staphylococcus
ELFNKLAHVEGFEKYLHK

SEQ ID NO: 2009083 - protein, 18 aa, Staphylococcus
ELFRRVENAIEQISQQIW

SEQ ID NO: 2009084 - protein, 24 aa, Staphylococcus
ELFTFKEFCDITGYSLNELQTYGG

SEQ ID NO: 2009085 - protein, 20 aa, Staphylococcus
ELGAEVGWYIPNRFTEGYGP

SEQ ID NO: 2009086 - protein, 19 aa, Staphylococcus
ELGDNLFVLLCIANSLNID

SEQ ID NO: 2009087 - protein, 19 aa, Staphylococcus
ELGDNLFVLMCIANSLDID

SEQ ID NO: 2009088 - protein, 18 aa, Staphylococcus
ELGDYFKSELEKIDHPAI

SEQ ID NO: 2009089 - protein, 18 aa, Staphylococcus
ELGFKGNTWLFFGEQHFT

SEQ ID NO: 2009090 - protein, 18 aa, Staphylococcus
ELGFLTIYFSVYLEQLEQ

SEQ ID NO: 2009091 - protein, 23 aa, Staphylococcus
ELGKPCIDYDGFRAHVSITHTDN

SEQ ID NO: 2009092 - protein, 18 aa, Staphylococcus
ELGLGCMSLGTDINQAEP

SEQ ID NO: 2009093 - protein, 18 aa, Staphylococcus
ELGLGCMSLGTDYKTAQP

SEQ ID NO: 2009094 - protein, 25 aa, Staphylococcus
ELGPKQIRVCSARYSQYLPELNHID

SEQ ID NO: 2009095 - protein, 18 aa, Staphylococcus
ELGQTYGFDLSRPAENFK

SEQ ID NO: 2009096 - protein, 23 aa, Staphylococcus
ELGRSPSILEIANRLEVNEEEVL

SEQ ID NO: 2009097 - protein, 29 aa, Staphylococcus
ELGYPFIIKTRFGGYDGKGQILVKDHTAI

SEQ ID NO: 2009098 - protein, 20 aa, Staphylococcus
ELHDLAFLLLVYPLSEIEGA

SEQ ID NO: 2009099 - protein, 20 aa, Staphylococcus
ELHDLAFLLLVYPMSEYEGA

SEQ ID NO: 2009100 - protein, 29 aa, Staphylococcus
ELHEYIHGRKAPKLDGVRFSVLALGDQTY

SEQ ID NO: 2009101 - protein, 20 aa, Staphylococcus
ELHGTLNRFYCIKCYNEYSK

SEQ ID NO: 2009102 - protein, 18 aa, Staphylococcus
ELHIALGPIERGGAGGGI

SEQ ID NO: 2009103 - protein, 23 aa, Staphylococcus
ELHKDDEVCILYGTKNGLVALPT

SEQ ID NO: 2009104 - protein, 25 aa, Staphylococcus
ELHSYDFYGVSGFDKTYYPKNKVAD

SEQ ID NO: 2009105 - protein, 17 aa, Staphylococcus
ELIASWIQWGNFSMQSW

SEQ ID NO: 2009106 - protein, 19 aa, Staphylococcus
ELIDDLSLEYNRARQAEIT

SEQ ID NO: 2009107 - protein, 24 aa, Staphylococcus
ELIDEYDFIYGIIGWHPVDAIDFT

SEQ ID NO: 2009108 - protein, 24 aa, Staphylococcus
ELIDKYDFVYGIIGWHPVDAIDCT

SEQ ID NO: 2009109 - protein, 24 aa, Staphylococcus
ELIDKYEFIYGIIGWHPVDAIDCT

SEQ ID NO: 2009110 - protein, 25 aa, Staphylococcus
ELIDLYKQREMSVGYQFGPDTEEQS

SEQ ID NO: 2009111 - protein, 17 aa, Staphylococcus
ELIELYKAREMSVGYKF

SEQ ID NO: 2009112 - protein, 22 aa, Staphylococcus
ELIEQYDFLYAIIGWHPVDAID

SEQ ID NO: 2009113 - protein, 21 aa, Staphylococcus
ELIESGCEVIALDATTQTRPK

SEQ ID NO: 2009114 - protein, 24 aa, Staphylococcus
ELIGELKAAVDLPIHLHTHDTSGN

SEQ ID NO: 2009115 - protein, 24 aa, Staphylococcus
ELIGELKSAINLPIHLHTHDTSGN

SEQ ID NO: 2009116 - protein, 25 aa, Staphylococcus
ELIGELRAAVNLPIHLHTHDTSGNG

SEQ ID NO: 2009117 - protein, 34 aa, Staphylococcus
ELIGKPCHLVLKWKFNKDEGKYFTDFSFIKPYKN

SEQ ID NO: 2009118 - protein, 23 aa, Staphylococcus
ELIGRLAKELGIAMKGLDINDLS

SEQ ID NO: 2009119 - protein, 22 aa, Staphylococcus
ELIGRLPSLGAFENVHSTLKHA

SEQ ID NO: 2009120 - protein, 20 aa, Staphylococcus
ELIHGGRTTQVWNINIIDDN

SEQ ID NO: 2009121 - protein, 19 aa, Staphylococcus
ELIIKKAQEGVTFLISSHI

SEQ ID NO: 2009122 - protein, 37 aa, Staphylococcus
ELIKARPYRLLRIGSFLLSKEGYKIFVHESERKEEPR

SEQ ID NO: 2009123 - protein, 17 aa, Staphylococcus
ELIKLRHEHDIITYGDI

SEQ ID NO: 2009124 - protein, 24 aa, Staphylococcus
ELIKNELKIAIGPIERGGAGGGIA

SEQ ID NO: 2009125 - protein, 25 aa, Staphylococcus
ELIKRIGDAGGRLHTGRSRNDQVAT

SEQ ID NO: 2009126 - protein, 19 aa, Staphylococcus
ELIKTYKPDIAILDIEMPG

SEQ ID NO: 2009127 - protein, 20 aa, Staphylococcus
ELIPESQDGYILRFNFAGEE

SEQ ID NO: 2009128 - protein, 20 aa, Staphylococcus
ELIQKLMLIMPEGPALALNP

SEQ ID NO: 2009129 - protein, 20 aa, Staphylococcus
ELIRFKAEYAKIEGELNYRH

SEQ ID NO: 2009130 - protein, 18 aa, Staphylococcus
ELIRFNSEYAKIEGELSY

SEQ ID NO: 2009131 - protein, 19 aa, Staphylococcus
ELIRFNSEYAKIEGVLNYR

SEQ ID NO: 2009132 - protein, 20 aa, Staphylococcus
ELIRRLKRGIFAKQKVVVFK

SEQ ID NO: 2009133 - protein, 21 aa, Staphylococcus
ELISNLKLRYEHVGLKGQPLV

SEQ ID NO: 2009134 - protein, 26 aa, Staphylococcus
ELIVKKAEEGITFLISSHILSELVKI

SEQ ID NO: 2009135 - protein, 20 aa, Staphylococcus
ELIVVPMFLYDGRLVNKVKR

SEQ ID NO: 2009136 - protein, 19 aa, Staphylococcus
ELKAIVPEEIIKIDEPLKK

SEQ ID NO: 2009137 - protein, 19 aa, Staphylococcus
ELKALSLTCQLDVKGQVTQ

SEQ ID NO: 2009138 - protein, 26 aa, Staphylococcus
ELKDILKEYKLKLGGNKPELIERVKT

SEQ ID NO: 2009139 - protein, 21 aa, Staphylococcus
ELKDTLKIYMDYQCDITKTAK

SEQ ID NO: 2009140 - protein, 18 aa, Staphylococcus
ELKERKLRIEDALNSTRA

SEQ ID NO: 2009141 - protein, 23 aa, Staphylococcus
ELKETYESFQLFEAEMFDHQVLR

SEQ ID NO: 2009142 - protein, 23 aa, Staphylococcus
ELKEYRLNPERAILQSFDEKSIQ

SEQ ID NO: 2009143 - protein, 19 aa, Staphylococcus
ELKFTYYKMHQFEADYLKV

SEQ ID NO: 2009144 - protein, 22 aa, Staphylococcus
ELKIIAHRGFNIDYPENTLLAY

SEQ ID NO: 2009145 - protein, 30 aa, Staphylococcus
ELKKALNHQLFKGIEWIIVSLGANGAFAKH

SEQ ID NO: 2009146 - protein, 26 aa, Staphylococcus
ELKKELEHWDFFVTGIDDFSAVMDIY

SEQ ID NO: 2009147 - protein, 20 aa, Staphylococcus
ELKKVLPEEIIKVDEPLKRY

SEQ ID NO: 2009148 - protein, 21 aa, Staphylococcus
ELKLDHYQSYIISYNGGKTIN

SEQ ID NO: 2009149 - protein, 20 aa, Staphylococcus
ELKMMLNIMKPEYFIPVQGE

SEQ ID NO: 2009150 - protein, 21 aa, Staphylococcus
ELKMQPRLYIKLTTTEKPPNA

SEQ ID NO: 2009151 - protein, 18 aa, Staphylococcus
ELKNELEILIGYDSGVDK

SEQ ID NO: 2009152 - protein, 26 aa, Staphylococcus
ELKNRRATLVNLQRIDKISAKRIIDF

SEQ ID NO: 2009153 - protein, 22 aa, Staphylococcus
ELKNRRATLVNLQRIDKVSAKR

SEQ ID NO: 2009154 - protein, 26 aa, Staphylococcus
ELKNRRATLVNLQRIDKVSAKRIIDF

SEQ ID NO: 2009155 - protein, 25 aa, Staphylococcus
ELKNRRATLVNLQRIDNVSAKRIID

SEQ ID NO: 2009156 - protein, 20 aa, Staphylococcus
ELKQDYVRLQDDLEKRESTG

SEQ ID NO: 2009157 - protein, 21 aa, Staphylococcus
ELKQELVTAFVERRKGKATEE

SEQ ID NO: 2009158 - protein, 26 aa, Staphylococcus
ELKQLNQWVLWRAEWNESRQEYKKVP

SEQ ID NO: 2009159 - protein, 24 aa, Staphylococcus
ELKRDYSKRHIKLFENLAKTRTTD

SEQ ID NO: 2009160 - protein, 19 aa, Staphylococcus
ELKRRGVDINEAFNQVMRY

SEQ ID NO: 2009161 - protein, 21 aa, Staphylococcus
ELKRSGIAISQAFNQIERYRK

SEQ ID NO: 2009162 - protein, 19 aa, Staphylococcus
ELKRSGIAITQAFNQIERY

SEQ ID NO: 2009163 - protein, 23 aa, Staphylococcus
ELKRSGVAITEAFNQIERYRRQN

SEQ ID NO: 2009164 - protein, 20 aa, Staphylococcus
ELKSTSILIDGQYIKEMNEN

SEQ ID NO: 2009165 - protein, 20 aa, Staphylococcus
ELKYDYIRLQNDLEKKESLN

SEQ ID NO: 2009166 - protein, 17 aa, Staphylococcus
ELKYDYTRLQGDLEKRE

SEQ ID NO: 2009167 - protein, 18 aa, Staphylococcus
ELKYDYVRLQGDLEKRES

SEQ ID NO: 2009168 - protein, 19 aa, Staphylococcus
ELKYDYVRLQNDLDKKESL

SEQ ID NO: 2009169 - protein, 17 aa, Staphylococcus
ELLDFITTIIKRKYESL

SEQ ID NO: 2009170 - protein, 23 aa, Staphylococcus
ELLDPSKMAILFQKTQFPKMIKV

SEQ ID NO: 2009171 - protein, 19 aa, Staphylococcus
ELLELREIVESATVANAAR

SEQ ID NO: 2009172 - protein, 24 aa, Staphylococcus
ELLEMRRNIGMIFQHFNLVKRSSV

SEQ ID NO: 2009173 - protein, 23 aa, Staphylococcus
ELLHHPFHIKLPVNVQATSAVRT

SEQ ID NO: 2009174 - protein, 24 aa, Staphylococcus
ELLIKRETDWLAAHANEYDTPTYQ

SEQ ID NO: 2009175 - protein, 17 aa, Staphylococcus
ELLKARRTYAFTELFLF

SEQ ID NO: 2009176 - protein, 23 aa, Staphylococcus
ELLKGDLPLSYVLTDMPSDTGLQ

SEQ ID NO: 2009177 - protein, 19 aa, Staphylococcus
ELLKLELLVGEKGLNKQIK

SEQ ID NO: 2009178 - protein, 18 aa, Staphylococcus
ELLKQSGIFRENEHVDER

SEQ ID NO: 2009179 - protein, 24 aa, Staphylococcus
ELLLKALELDSSYQEPLIELSSLY

SEQ ID NO: 2009180 - protein, 19 aa, Staphylococcus
ELLMIKSKLLLPQTSVEDD

SEQ ID NO: 2009181 - protein, 21 aa, Staphylococcus
ELLMIKSKMLLPQHDTEMDDE

SEQ ID NO: 2009182 - protein, 20 aa, Staphylococcus
ELLMIKSKMLLPQTNEVEDL

SEQ ID NO: 2009183 - protein, 20 aa, Staphylococcus
ELLMIKSRLLLPQQETENDL

SEQ ID NO: 2009184 - protein, 19 aa, Staphylococcus
ELLNESKLVTSMDLVEVNP

SEQ ID NO: 2009185 - protein, 17 aa, Staphylococcus
ELLRILYNYDRLSQYDL

SEQ ID NO: 2009186 - protein, 20 aa, Staphylococcus
ELLTHQGIHYFDVNGKTIGV

SEQ ID NO: 2009187 - protein, 21 aa, Staphylococcus
ELLYNRRFVVDKAVILAATDK

SEQ ID NO: 2009188 - protein, 29 aa, Staphylococcus
ELMDYLKQRHIPMAIATSSYREDIYPTFK

SEQ ID NO: 2009189 - protein, 21 aa, Staphylococcus
ELMELLPRYKYDNIFNSNKFK

SEQ ID NO: 2009190 - protein, 17 aa, Staphylococcus
ELMKLSLTTKGIKQIKV

SEQ ID NO: 2009191 - protein, 18 aa, Staphylococcus
ELMKLYNYKEIRTPIFES

SEQ ID NO: 2009192 - protein, 23 aa, Staphylococcus
ELMKNGVTYGERVALLVDRSFEM

SEQ ID NO: 2009193 - protein, 25 aa, Staphylococcus
ELMLEFQKNGAVAFDYGNNIRQVAF

SEQ ID NO: 2009194 - protein, 19 aa, Staphylococcus
ELMLLKYDVIQDMLYNLDY

SEQ ID NO: 2009195 - protein, 28 aa, Staphylococcus
ELMNRLTGRRICEKCGTTYHLVFNPPKV

SEQ ID NO: 2009196 - protein, 25 aa, Staphylococcus
ELMNRLTGRRICENCGTTYHLVFNP

SEQ ID NO: 2009197 - protein, 28 aa, Staphylococcus
ELMNRLTGRRICETCGTTYHLVFNPPKV

SEQ ID NO: 2009198 - protein, 25 aa, Staphylococcus
ELMNRLTGRRICEVCGTTYHLVFNP

SEQ ID NO: 2009199 - protein, 19 aa, Staphylococcus
ELMPGGVNSPVRAFKSVDT

SEQ ID NO: 2009200 - protein, 17 aa, Staphylococcus
ELMYCDYMREWIDHDEK

SEQ ID NO: 2009201 - protein, 26 aa, Staphylococcus
ELNAKPGGAFYIFPSIKNYTEDDFNF

SEQ ID NO: 2009202 - protein, 17 aa, Staphylococcus
ELNCFYTTADIDWSTLV

SEQ ID NO: 2009203 - protein, 25 aa, Staphylococcus
ELNCYRVLCEVDWETLRPASEITDL

SEQ ID NO: 2009204 - protein, 20 aa, Staphylococcus
ELNDEIAFFKAVKAGLVKLL

SEQ ID NO: 2009205 - protein, 24 aa, Staphylococcus
ELNDYSLMFVHPWQYEKVIPHQFA

SEQ ID NO: 2009206 - protein, 18 aa, Staphylococcus
ELNEAGIIELDFNKMIDG

SEQ ID NO: 2009207 - protein, 25 aa, Staphylococcus
ELNEIKKKFKVDRLSTIEAEISEIK

SEQ ID NO: 2009208 - protein, 19 aa, Staphylococcus
ELNGSFLPLAHERLDDDGQ

SEQ ID NO: 2009209 - protein, 20 aa, Staphylococcus
ELNGSILPGITRKTVIELAQ

SEQ ID NO: 2009210 - protein, 24 aa, Staphylococcus
ELNGYRTTVSINWDKIHTDNEITD

SEQ ID NO: 2009211 - protein, 18 aa, Staphylococcus
ELNHEVERLYVFTKAASS

SEQ ID NO: 2009212 - protein, 18 aa, Staphylococcus
ELNKALGDMNRKLDDGQR

SEQ ID NO: 2009213 - protein, 25 aa, Staphylococcus
ELNKDFNFSAAHFIPCKDAGKCVRT

SEQ ID NO: 2009214 - protein, 25 aa, Staphylococcus
ELNKDFNFSAAHYIPCEDAGKCMRT

SEQ ID NO: 2009215 - protein, 22 aa, Staphylococcus
ELNKLRIADFFIQTYSYVSVIE

SEQ ID NO: 2009216 - protein, 22 aa, Staphylococcus
ELNLKGGQKMYFDQKIETYVPE

SEQ ID NO: 2009217 - protein, 22 aa, Staphylococcus
ELNLKGGQKMYFDQKLETYVPV

SEQ ID NO: 2009218 - protein, 20 aa, Staphylococcus
ELNLKGGQKMYLEQKSETYV

SEQ ID NO: 2009219 - protein, 22 aa, Staphylococcus
ELNPDYCIPGPFDKRVAPSVAR

SEQ ID NO: 2009220 - protein, 26 aa, Staphylococcus
ELNPIKCLRIIAMFRLINPTKEIRIA

SEQ ID NO: 2009221 - protein, 25 aa, Staphylococcus
ELNPTPKWQISRYKGLGEMNADQLW

SEQ ID NO: 2009222 - protein, 23 aa, Staphylococcus
ELNRFYATNILERWYSLKEATYI

SEQ ID NO: 2009223 - protein, 19 aa, Staphylococcus
ELNRVGGWGYVLGDEGSGY

SEQ ID NO: 2009224 - protein, 26 aa, Staphylococcus
ELNSDWSRSQIQDWIKEDLVKVNDKV

SEQ ID NO: 2009225 - protein, 24 aa, Staphylococcus
ELNTQLFIKKGRSIQLTDSGQLLL

SEQ ID NO: 2009226 - protein, 25 aa, Staphylococcus
ELPEEEVEAFSAFIEDIMDNAIDLD

SEQ ID NO: 2009227 - protein, 18 aa, Staphylococcus
ELPFLPFDHHTVLSSDDV

SEQ ID NO: 2009228 - protein, 22 aa, Staphylococcus
ELPFYEIGWRLIPEVWDNGIAT

SEQ ID NO: 2009229 - protein, 21 aa, Staphylococcus
ELPIIPDHMKTVVIPKTKKQF

SEQ ID NO: 2009230 - protein, 19 aa, Staphylococcus
ELPITASILTNVFGLNIFA

SEQ ID NO: 2009231 - protein, 21 aa, Staphylococcus
ELPIVEEFRSAQYEANDLLQL

SEQ ID NO: 2009232 - protein, 19 aa, Staphylococcus
ELPLGKLSGKHAFAEKLKQ

SEQ ID NO: 2009233 - protein, 24 aa, Staphylococcus
ELPNTKPGAYVWRDKVCSMEIWKV

SEQ ID NO: 2009234 - protein, 19 aa, Staphylococcus
ELPVTASILKNVFNLTHYA

SEQ ID NO: 2009235 - protein, 23 aa, Staphylococcus
ELPYGAVPIDFAYAVHSEVGNKM

SEQ ID NO: 2009236 - protein, 18 aa, Staphylococcus
ELPYGDSSSRFDFSTHNH

SEQ ID NO: 2009237 - protein, 23 aa, Staphylococcus
ELQARIRVALRVSKKTTTEENNF

SEQ ID NO: 2009238 - protein, 18 aa, Staphylococcus
ELQERSKLLENQQVLALE

SEQ ID NO: 2009239 - protein, 18 aa, Staphylococcus
ELQEVGLLEQVKTGFNRP

SEQ ID NO: 2009240 - protein, 27 aa, Staphylococcus
ELQGAHTVVWNGPMGVFEFSNFAKGTI

SEQ ID NO: 2009241 - protein, 27 aa, Staphylococcus
ELQGAHTVVWNGPMGVFEFSNFAQGTI

SEQ ID NO: 2009242 - protein, 21 aa, Staphylococcus
ELQIIKLLFQNEGKFVNRTAL

SEQ ID NO: 2009243 - protein, 20 aa, Staphylococcus
ELQLKIGNKIYLSAIYDLGS

SEQ ID NO: 2009244 - protein, 25 aa, Staphylococcus
ELQLLKEHARYFVAHFVSKNDSATG

SEQ ID NO: 2009245 - protein, 21 aa, Staphylococcus
ELQMQKRLYIKISTTDRPPYT

SEQ ID NO: 2009246 - protein, 21 aa, Staphylococcus
ELQNGLRLFVIPKPGFQKTFV

SEQ ID NO: 2009247 - protein, 19 aa, Staphylococcus
ELQQKLGKTFIFVTHDMDE

SEQ ID NO: 2009248 - protein, 34 aa, Staphylococcus
ELRAQKILQDRAFKNDKIDFIWSHTLKSINEKDG

SEQ ID NO: 2009249 - protein, 20 aa, Staphylococcus
ELRDRLAVRHGRYIKQDAED

SEQ ID NO: 2009250 - protein, 26 aa, Staphylococcus
ELRELRLIKTLQHFDINISREEANEY

SEQ ID NO: 2009251 - protein, 22 aa, Staphylococcus
ELRERICDAALQLMNNIRYVNA

SEQ ID NO: 2009252 - protein, 19 aa, Staphylococcus
ELRESRADLEILLYDRGPR

SEQ ID NO: 2009253 - protein, 18 aa, Staphylococcus
ELRESRSDLDIRLYDRGE

SEQ ID NO: 2009254 - protein, 18 aa, Staphylococcus
ELRESRTDLEIILYDRGP

SEQ ID NO: 2009255 - protein, 23 aa, Staphylococcus
ELRLVDFKIEFGITDEGNILLAD

SEQ ID NO: 2009256 - protein, 26 aa, Staphylococcus
ELRSYKDLPLRIAEFGQVHRHEFSGA

SEQ ID NO: 2009257 - protein, 21 aa, Staphylococcus
ELRSYYKVQVFIPKENLIDFK

SEQ ID NO: 2009258 - protein, 19 aa, Staphylococcus
ELSDRIKLNIPVVSAGMDT

SEQ ID NO: 2009259 - protein, 23 aa, Staphylococcus
ELSDYLPLMLEFLYAAQWQNDDR

SEQ ID NO: 2009260 - protein, 20 aa, Staphylococcus
ELSDYLPLMLQFLHVAQWHD

SEQ ID NO: 2009261 - protein, 20 aa, Staphylococcus
ELSDYLPLMLQFLHVASWHN

SEQ ID NO: 2009262 - protein, 20 aa, Staphylococcus
ELSDYLPLMLQFLHVASWQN

SEQ ID NO: 2009263 - protein, 22 aa, Staphylococcus
ELSEATIHFELDGSNYLKDDIL

SEQ ID NO: 2009264 - protein, 23 aa, Staphylococcus
ELSEHRMLVDLGRNDIHRVSQTG

SEQ ID NO: 2009265 - protein, 23 aa, Staphylococcus
ELSEHRMLVDLGRNDIHRVSRTG

SEQ ID NO: 2009266 - protein, 27 aa, Staphylococcus
ELSELGRFGVGLPRVSDGQLLFNSMVF

SEQ ID NO: 2009267 - protein, 21 aa, Staphylococcus
ELSEQFPYVRQLLDAYQIKRY

SEQ ID NO: 2009268 - protein, 26 aa, Staphylococcus
ELSGAHGRTLLSLKDEALMKKVGKEA

SEQ ID NO: 2009269 - protein, 36 aa, Staphylococcus
ELSHILYMPVDVFEFLQEYFAFKGIDPLDLVSPEER

SEQ ID NO: 2009270 - protein, 25 aa, Staphylococcus
ELSHWNYEVSIAKQFGNILEEFKTA

SEQ ID NO: 2009271 - protein, 26 aa, Staphylococcus
ELSIAEFRKKCEAFALEQIDNQKKDF

SEQ ID NO: 2009272 - protein, 24 aa, Staphylococcus
ELSKWNYEVIVAKQFDNIIDVFNA

SEQ ID NO: 2009273 - protein, 19 aa, Staphylococcus
ELSKYLKQQYCLYVRIDPY

SEQ ID NO: 2009274 - protein, 24 aa, Staphylococcus
ELSPKLIPNHLFKEIISNSIEDSI

SEQ ID NO: 2009275 - protein, 19 aa, Staphylococcus
ELSQLRVIVDLNQEPDLYL

SEQ ID NO: 2009276 - protein, 18 aa, Staphylococcus
ELSRDGQVFYLYNRVQSI

SEQ ID NO: 2009277 - protein, 19 aa, Staphylococcus
ELSRGGQAFYLYNKVQSIY

SEQ ID NO: 2009278 - protein, 30 aa, Staphylococcus
ELSSFQLLGIDKYRPHIAIITNIYSAHLDY

SEQ ID NO: 2009279 - protein, 25 aa, Staphylococcus
ELSYQRLLKVWGYTFQYLKQEHINE

SEQ ID NO: 2009280 - protein, 17 aa, Staphylococcus
ELTENGFESLETSDAVS

SEQ ID NO: 2009281 - protein, 18 aa, Staphylococcus
ELTFEKLFIDSYIQQLIL

SEQ ID NO: 2009282 - protein, 19 aa, Staphylococcus
ELTGECWAISAHPNGPNTI

SEQ ID NO: 2009283 - protein, 19 aa, Staphylococcus
ELTGGLYFGEPRELTDHHA

SEQ ID NO: 2009284 - protein, 22 aa, Staphylococcus
ELTHDWLNFGYTFMDKSNTSRA

SEQ ID NO: 2009285 - protein, 19 aa, Staphylococcus
ELTKEDKFVEETKSDPDDN

SEQ ID NO: 2009286 - protein, 19 aa, Staphylococcus
ELTKEDKFVEETKSGPDDN

SEQ ID NO: 2009287 - protein, 18 aa, Staphylococcus
ELTKPFFEQGGAMIDDWM

SEQ ID NO: 2009288 - protein, 31 aa, Staphylococcus
ELTKYLKKYNCLYVRIDPYLPYQYRDHDGNI

SEQ ID NO: 2009289 - protein, 21 aa, Staphylococcus
ELTNGLRLFVIPKNGFQKTFV

SEQ ID NO: 2009290 - protein, 26 aa, Staphylococcus
ELTPELAFKLGRYGGYVLAHNKGEKH

SEQ ID NO: 2009291 - protein, 23 aa, Staphylococcus
ELTRHNIGFEVIDYILKKHNFSL

SEQ ID NO: 2009292 - protein, 23 aa, Staphylococcus
ELTRKVKAVSEVPVYVKLSPNVT

SEQ ID NO: 2009293 - protein, 17 aa, Staphylococcus
ELTRTFDDSMSYKLEDN

SEQ ID NO: 2009294 - protein, 19 aa, Staphylococcus
ELTTALRKAFFNNGDTSTK

SEQ ID NO: 2009295 - protein, 18 aa, Staphylococcus
ELTTNIDKVIDWLNNEDI

SEQ ID NO: 2009296 - protein, 25 aa, Staphylococcus
ELVDFKGLADHGAFAFTDDGVGVQT

SEQ ID NO: 2009297 - protein, 26 aa, Staphylococcus
ELVDRMYRRFTILTTIKMHQPVGRRS

SEQ ID NO: 2009298 - protein, 31 aa, Staphylococcus
ELVEQKWMSGQVFISLAVKFSKARLIDNMII

SEQ ID NO: 2009299 - protein, 30 aa, Staphylococcus
ELVEQLKFFINERIIPVIPQQGSLGASGDL

SEQ ID NO: 2009300 - protein, 23 aa, Staphylococcus
ELVERIKAILDREDVYYQVYTNR

SEQ ID NO: 2009301 - protein, 20 aa, Staphylococcus
ELVFQLKDKQFKVVRQGAFI

SEQ ID NO: 2009302 - protein, 24 aa, Staphylococcus
ELVGELKAATNLPIHLHTHDTSGN

SEQ ID NO: 2009303 - protein, 17 aa, Staphylococcus
ELVHINIQFKKRTNSYE

SEQ ID NO: 2009304 - protein, 18 aa, Staphylococcus
ELVKCFFKGLTTYLQKKE

SEQ ID NO: 2009305 - protein, 19 aa, Staphylococcus
ELVNLWKPIIINKLKKVDY

SEQ ID NO: 2009306 - protein, 19 aa, Staphylococcus
ELVQVIGSMIVLYKESQEN

SEQ ID NO: 2009307 - protein, 18 aa, Staphylococcus
ELVSVSWHALQRFERKSI

SEQ ID NO: 2009308 - protein, 23 aa, Staphylococcus
ELVTKEMVKEGAVIIDVGNTPDE

SEQ ID NO: 2009309 - protein, 22 aa, Staphylococcus
ELWMADDRLNMIAKHLVANHHK

SEQ ID NO: 2009310 - protein, 18 aa, Staphylococcus
ELWTAEVVLALKATYPDL

SEQ ID NO: 2009311 - protein, 25 aa, Staphylococcus
ELYDFLKQKRKAIIDNAYIMTHDTR

SEQ ID NO: 2009312 - protein, 19 aa, Staphylococcus
ELYECPNCGHINETEEKKG

SEQ ID NO: 2009313 - protein, 18 aa, Staphylococcus
ELYFDLAGKVLPYQLPTL

SEQ ID NO: 2009314 - protein, 19 aa, Staphylococcus
ELYHDFRAAQEMLNNDDEA

SEQ ID NO: 2009315 - protein, 17 aa, Staphylococcus
ELYLRFLDGEKLTKSTI

SEQ ID NO: 2009316 - protein, 19 aa, Staphylococcus
ELYLTMLHHQCIPCILDYR

SEQ ID NO: 2009317 - protein, 17 aa, Staphylococcus
ELYQIIRVCLGELDVIK

SEQ ID NO: 2009318 - protein, 20 aa, Staphylococcus
ELYTPLLREGGIVITDNVLY

SEQ ID NO: 2009319 - protein, 19 aa, Staphylococcus
EMAARADAFYQPKPGTDLV

SEQ ID NO: 2009320 - protein, 23 aa, Staphylococcus
EMADYVKREFGVAIQRVKSIGIS

SEQ ID NO: 2009321 - protein, 18 aa, Staphylococcus
EMAERVDLDLVIVAPNAK

SEQ ID NO: 2009322 - protein, 19 aa, Staphylococcus
EMAERVGLDVVIMAPNAKP

SEQ ID NO: 2009323 - protein, 19 aa, Staphylococcus
EMASYRPGFQEVKYLKSEK

SEQ ID NO: 2009324 - protein, 22 aa, Staphylococcus
EMDAGMPLGIVIGSEGQGMSRL

SEQ ID NO: 2009325 - protein, 18 aa, Staphylococcus
EMDVELISPIAIEDGTRF

SEQ ID NO: 2009326 - protein, 18 aa, Staphylococcus
EMDYRKIPREYLNARIPK

SEQ ID NO: 2009327 - protein, 20 aa, Staphylococcus
EMEEELKILLIPKDPNDEKD

SEQ ID NO: 2009328 - protein, 20 aa, Staphylococcus
EMEEQLKLLLIPKDPNDEKD

SEQ ID NO: 2009329 - protein, 18 aa, Staphylococcus
EMEIGIGIHGEKGLSREK

SEQ ID NO: 2009330 - protein, 20 aa, Staphylococcus
EMERYLAAHVYLYYRHTALK

SEQ ID NO: 2009331 - protein, 22 aa, Staphylococcus
EMFDHQVLRRLVAFMYEQPATI

SEQ ID NO: 2009332 - protein, 19 aa, Staphylococcus
EMFQSVEMGWFLNAINKFN

SEQ ID NO: 2009333 - protein, 18 aa, Staphylococcus
EMGHCFNESFDAQPSQML

SEQ ID NO: 2009334 - protein, 20 aa, Staphylococcus
EMGHSGAIGYYVKMAAEKGL

SEQ ID NO: 2009335 - protein, 20 aa, Staphylococcus
EMGKTYKATVSLGITTTTED

SEQ ID NO: 2009336 - protein, 21 aa, Staphylococcus
EMGMFEFKKDVQLFNKNVILS

SEQ ID NO: 2009337 - protein, 21 aa, Staphylococcus
EMGNMYKLLIGTVTPRPIAFV

SEQ ID NO: 2009338 - protein, 21 aa, Staphylococcus
EMHRVLKPGGMVVCLETSQPT

SEQ ID NO: 2009339 - protein, 19 aa, Staphylococcus
EMHVVPMTIRRDLKELEQK

SEQ ID NO: 2009340 - protein, 17 aa, Staphylococcus
EMIKYAKHGIAMDNGLD

SEQ ID NO: 2009341 - protein, 18 aa, Staphylococcus
EMINEWESLYLKKKRFTQ

SEQ ID NO: 2009342 - protein, 19 aa, Staphylococcus
EMIPLLKEYWFDDLSKVDS

SEQ ID NO: 2009343 - protein, 20 aa, Staphylococcus
EMIQKLLFQHIHFTLNTMAL

SEQ ID NO: 2009344 - protein, 17 aa, Staphylococcus
EMKCFKYTNDLGTEIEE

SEQ ID NO: 2009345 - protein, 20 aa, Staphylococcus
EMKEACYAATPAIQLAKDYI

SEQ ID NO: 2009346 - protein, 25 aa, Staphylococcus
EMKIKELFKASNFSEIYLLLRRDKS

SEQ ID NO: 2009347 - protein, 25 aa, Staphylococcus
EMKLGFKEGHSYSHYLLIEQAVNAL

SEQ ID NO: 2009348 - protein, 19 aa, Staphylococcus
EMKQRRVDLNQMIEDNDSK

SEQ ID NO: 2009349 - protein, 22 aa, Staphylococcus
EMLRNLKRFKAVREEIEVGKMS

SEQ ID NO: 2009350 - protein, 17 aa, Staphylococcus
EMLSKLTNVCFTINLNE

SEQ ID NO: 2009351 - protein, 21 aa, Staphylococcus
EMMFIRTPISIGRNVANCHPP

SEQ ID NO: 2009352 - protein, 29 aa, Staphylococcus
EMMLPKKYIFEVASNWKKLGISNAKEAYE

SEQ ID NO: 2009353 - protein, 24 aa, Staphylococcus
EMMQLKQKWLKESELSTYAIVDYQ

SEQ ID NO: 2009354 - protein, 24 aa, Staphylococcus
EMMYELKADILLTAHHQDDQIETI

SEQ ID NO: 2009355 - protein, 18 aa, Staphylococcus
EMNGIEVTEYVKSHFPDI

SEQ ID NO: 2009356 - protein, 20 aa, Staphylococcus
EMPALGFAPDAEFPAIHGEK

SEQ ID NO: 2009357 - protein, 26 aa, Staphylococcus
EMPISEFRKLCEEFALEQIDIQKKDF

SEQ ID NO: 2009358 - protein, 20 aa, Staphylococcus
EMPLDEWQKVIDINLTGAFI

SEQ ID NO: 2009359 - protein, 17 aa, Staphylococcus
EMPRYGGKHAHLTEEQR

SEQ ID NO: 2009360 - protein, 18 aa, Staphylococcus
EMPYEEAKDWMVKALQPM

SEQ ID NO: 2009361 - protein, 18 aa, Staphylococcus
EMQLDAKAGALLKADLEQ

SEQ ID NO: 2009362 - protein, 17 aa, Staphylococcus
EMRKRRGEIDFDIDEAK

SEQ ID NO: 2009363 - protein, 25 aa, Staphylococcus
EMRNEIYDFYSLGFGDPYPISGSHG

SEQ ID NO: 2009364 - protein, 25 aa, Staphylococcus
EMRQRKHIWRRLAKDLKPDNLHDIK

SEQ ID NO: 2009365 - protein, 17 aa, Staphylococcus
EMSACLILIQKLNERMV

SEQ ID NO: 2009366 - protein, 18 aa, Staphylococcus
EMSECLILIQKLNERMVE

SEQ ID NO: 2009367 - protein, 20 aa, Staphylococcus
EMTDSILIGPGLGVDFKGNN

SEQ ID NO: 2009368 - protein, 25 aa, Staphylococcus
EMTLPELIEWAWKNEVSDKAFYSNL

SEQ ID NO: 2009369 - protein, 21 aa, Staphylococcus
EMYDIAGLRIMCQFVDDIDVV

SEQ ID NO: 2009370 - protein, 27 aa, Staphylococcus
EMYDNMLWDGFQPFKLTNIENVASDIK

SEQ ID NO: 2009371 - protein, 25 aa, Staphylococcus
EMYDPRKYLGPAREAIKATVIGKIK

SEQ ID NO: 2009372 - protein, 28 aa, Staphylococcus
EMYEELRFLTFTGFRIGRFKEIAVDEMG

SEQ ID NO: 2009373 - protein, 19 aa, Staphylococcus
EMYIGIANLKYVDKKKIIY

SEQ ID NO: 2009374 - protein, 25 aa, Staphylococcus
EMYNVFNMGIGFTVIIDKKDVAQTL

SEQ ID NO: 2009375 - protein, 19 aa, Staphylococcus
EMYQLFDIYEASFELDNQL

SEQ ID NO: 2009376 - protein, 31 aa, Staphylococcus; identical to SEQ ID NO: 1804352

SEQ ID NO: 2009377 - protein, 21 aa, Staphylococcus
ENAIELFQFVAPIKTIITDIL

SEQ ID NO: 2009378 - protein, 17 aa, Staphylococcus
ENAKSVVSPIIITNSDN

SEQ ID NO: 2009379 - protein, 21 aa, Staphylococcus
ENAYALVGCMCQPGFEFEHFE

SEQ ID NO: 2009380 - protein, 17 aa, Staphylococcus
ENCDIFFIGGGSDREQS

SEQ ID NO: 2009381 - protein, 19 aa, Staphylococcus
ENCLIPRPETEEVMLHFLN

SEQ ID NO: 2009382 - protein, 31 aa, Staphylococcus
ENCSFLVFFGYNFNSSFLKYGELALLNSLIE

SEQ ID NO: 2009383 - protein, 25 aa, Staphylococcus
ENDARVARYQWFDEMMYELKADILL

SEQ ID NO: 2009384 - protein, 22 aa, Staphylococcus
ENDAWARLSLNHTELKRTICAV

SEQ ID NO: 2009385 - protein, 18 aa, Staphylococcus
ENDEFLLAGFNYEGQLAA

SEQ ID NO: 2009386 - protein, 23 aa, Staphylococcus
ENDFLKGCMRQALLDEGKLQLRS

SEQ ID NO: 2009387 - protein, 18 aa, Staphylococcus
ENDINVPIFLKLTSDMEL

SEQ ID NO: 2009388 - protein, 19 aa, Staphylococcus
ENDNVFAIDLNFRQNGSTS

SEQ ID NO: 2009389 - protein, 25 aa, Staphylococcus
ENDPRVKYKFIKPLLYKSTDELHHK

SEQ ID NO: 2009390 - protein, 19 aa, Staphylococcus
ENECLDCQFLAKNFKLMEQ

SEQ ID NO: 2009391 - protein, 24 aa, Staphylococcus
ENEDFEAGLAFLKEQYNVVQTQEA

SEQ ID NO: 2009392 - protein, 18 aa, Staphylococcus
ENEEIAVEITLSGDDIEG

SEQ ID NO: 2009393 - protein, 25 aa, Staphylococcus
ENEEKYLRLYAEFENYKRRIQKENE

SEQ ID NO: 2009394 - protein, 25 aa, Staphylococcus
ENEEKYLRLYAEFENYKRRIQKENQ

SEQ ID NO: 2009395 - protein, 25 aa, Staphylococcus
ENEEKYLRLYAEFENYKRRIRNENE

SEQ ID NO: 2009396 - protein, 21 aa, Staphylococcus
ENEGDIIKYCERIKNQEYSSD

SEQ ID NO: 2009397 - protein, 22 aa, Staphylococcus
ENEGDIIKYCQKIKQGDYGQKI

SEQ ID NO: 2009398 - protein, 19 aa, Staphylococcus
ENEIPHGQIQFIITVGEES

SEQ ID NO: 2009399 - protein, 26 aa, Staphylococcus
ENELKARFPNVDFVFSNGLSDIDDKD

SEQ ID NO: 2009400 - protein, 23 aa, Staphylococcus
ENELRMAATTSLFAQLFTVDILY

SEQ ID NO: 2009401 - protein, 22 aa, Staphylococcus
ENELRMGATTSLFAQMYTIDTL

SEQ ID NO: 2009402 - protein, 22 aa, Staphylococcus
ENELWLKTVENLMDRFIEKKYW

SEQ ID NO: 2009403 - protein, 24 aa, Staphylococcus
ENENAILFFDEIHQMIGSGSTGGE

SEQ ID NO: 2009404 - protein, 26 aa, Staphylococcus
ENEPELWKKAATFLLPKDYLRYCLTG

SEQ ID NO: 2009405 - protein, 20 aa, Staphylococcus
ENERGIVDIETLKATQNDII

SEQ ID NO: 2009406 - protein, 19 aa, Staphylococcus
ENERGIVDIETLKTTQNDI

SEQ ID NO: 2009407 - protein, 19 aa, Staphylococcus
ENERGIVDIETLKTTQSDI

SEQ ID NO: 2009408 - protein, 20 aa, Staphylococcus
ENERGVVDIETLKQTQSDII

SEQ ID NO: 2009409 - protein, 20 aa, Staphylococcus
ENERGVVDIETLKTTQKDII

SEQ ID NO: 2009410 - protein, 24 aa, Staphylococcus
ENERYLEVWNLVFSEYNHNKDHTY

SEQ ID NO: 2009411 - protein, 34 aa, Staphylococcus
ENETKRLGEYVVLRFGWLYGPGTWYGKDGMIYNQ

SEQ ID NO: 2009412 - protein, 34 aa, Staphylococcus
ENEWKNYFHPFRASKRFTIVPSWETYTKDSNEEL

SEQ ID NO: 2009413 - protein, 23 aa, Staphylococcus
ENEWKPKLQNMIPSYGQSLINDV

SEQ ID NO: 2009414 - protein, 29 aa, Staphylococcus
ENEYKNILKQVGFKNIRTLYDFDSENHNP

SEQ ID NO: 2009415 - protein, 19 aa, Staphylococcus
ENFEALLAQVSIKPVINQV

SEQ ID NO: 2009416 - protein, 19 aa, Staphylococcus
ENFGVVMEGMRLLARSVFV

SEQ ID NO: 2009417 - protein, 27 aa, Staphylococcus
ENFIELDRAESWLSQTLKDINLELFEY

SEQ ID NO: 2009418 - protein, 18 aa, Staphylococcus
ENFIKFTEKWYFPLQPFQ

SEQ ID NO: 2009419 - protein, 17 aa, Staphylococcus
ENFKIHKEDILPMDIIV

SEQ ID NO: 2009420 - protein, 21 aa, Staphylococcus
ENFKIKPEWLKELDKCANRDT

SEQ ID NO: 2009421 - protein, 17 aa, Staphylococcus
ENFKKNHCEAVIEANTG

SEQ ID NO: 2009422 - protein, 19 aa, Staphylococcus
ENFRFSLDTILSRIEEVQP

SEQ ID NO: 2009423 - protein, 25 aa, Staphylococcus
ENGDKFLLLAKEGWHEGVLGIVASK

SEQ ID NO: 2009424 - protein, 19 aa, Staphylococcus
ENGDLLFGTIDTWLVWKLS

SEQ ID NO: 2009425 - protein, 32 aa, Staphylococcus
ENGDLLFGTIDTWLVWKLSGGEAHITDYSNAS

SEQ ID NO: 2009426 - protein, 25 aa, Staphylococcus
ENGFIKFAAAGGWWSQVMLSQKVTV

SEQ ID NO: 2009427 - protein, 18 aa, Staphylococcus
ENGFKTTYGLIFNDLSWM

SEQ ID NO: 2009428 - protein, 24 aa, Staphylococcus
ENGFKTVLGIIIGQIKWMMNQSRT

SEQ ID NO: 2009429 - protein, 25 aa, Staphylococcus
ENGKVLACFPKHFFGKEELNREYIE

SEQ ID NO: 2009430 - protein, 24 aa, Staphylococcus
ENGLKGTEIHLDFPSVGATQNIIM

SEQ ID NO: 2009431 - protein, 21 aa, Staphylococcus
ENGMFPFGIILDDMTKNKIIS

SEQ ID NO: 2009432 - protein, 18 aa, Staphylococcus
ENGRLIFNEKGYIMETPN

SEQ ID NO: 2009433 - protein, 21 aa, Staphylococcus
ENGRMIPTIAFYNPKILPVIK

SEQ ID NO: 2009434 - protein, 21 aa, Staphylococcus
ENGVFIFDVHTIYKMSTLFHN

SEQ ID NO: 2009435 - protein, 23 aa, Staphylococcus
ENGYKPTYFIARPINADKGAMKL

SEQ ID NO: 2009436 - protein, 20 aa, Staphylococcus
ENGYLFIFVMDYHRHELINE

SEQ ID NO: 2009437 - protein, 23 aa, Staphylococcus
ENGYLFVFVLDYYRHNLINENVE

SEQ ID NO: 2009438 - protein, 26 aa, Staphylococcus
ENGYRIGYGGGYYDKFLTQFKTRTVS

SEQ ID NO: 2009439 - protein, 20 aa, Staphylococcus
ENHFYCALFIPSSEDHSNQL

SEQ ID NO: 2009440 - protein, 25 aa, Staphylococcus
ENHVKEVIAGFDFTFGKHGKGNMSV

SEQ ID NO: 2009441 - protein, 24 aa, Staphylococcus
ENHYDISSALSYFADELSIKSQYA

SEQ ID NO: 2009442 - protein, 24 aa, Staphylococcus
ENHYDISSALSYFANELSMKSHYA

SEQ ID NO: 2009443 - protein, 20 aa, Staphylococcus
ENIDLSLLMHDTERFTQLTH

SEQ ID NO: 2009444 - protein, 18 aa, Staphylococcus
ENIFCLTLGTGIGGAFYN

SEQ ID NO: 2009445 - protein, 19 aa, Staphylococcus
ENIGQPMINVFKAVRKLID

SEQ ID NO: 2009446 - protein, 17 aa, Staphylococcus
ENIGTPMHNIFKAIQKL

SEQ ID NO: 2009447 - protein, 19 aa, Staphylococcus
ENIKHLLDSEVIESLPKAS

SEQ ID NO: 2009448 - protein, 17 aa, Staphylococcus
ENIKLCIFANPHNPTGR

SEQ ID NO: 2009449 - protein, 24 aa, Staphylococcus
ENIKRLDKGLSIKFEEISKEVEQG

SEQ ID NO: 2009450 - protein, 18 aa, Staphylococcus
ENIKRNVIDIGIIEKEIQ

SEQ ID NO: 2009451 - protein, 18 aa, Staphylococcus
ENILDYFSKMSMLDHECL

SEQ ID NO: 2009452 - protein, 18 aa, Staphylococcus
ENILELIQFERFCRDNAL

SEQ ID NO: 2009453 - protein, 22 aa, Staphylococcus
ENILPTRFVDHTPLAHLTLETY

SEQ ID NO: 2009454 - protein, 19 aa, Staphylococcus
ENIMFYTCILDMMKDNETA

SEQ ID NO: 2009455 - protein, 19 aa, Staphylococcus
ENIMFYTCILDMMKEEETA

SEQ ID NO: 2009456 - protein, 20 aa, Staphylococcus
ENIMLPLSVQKLSAAEMEQN

SEQ ID NO: 2009457 - protein, 20 aa, Staphylococcus
ENIMLPLSVQKVGKEEMARR

SEQ ID NO: 2009458 - protein, 17 aa, Staphylococcus
ENIPFDGTFSIEYKLTE

SEQ ID NO: 2009459 - protein, 24 aa, Staphylococcus
ENIPGRKQFEWEKIVSKVSPQTSV

SEQ ID NO: 2009460 - protein, 24 aa, Staphylococcus
ENIQRRGGKVILFNDGDILNGLKP

SEQ ID NO: 2009461 - protein, 21 aa, Staphylococcus
ENIRLKYRYLDLRRPELAQTF

SEQ ID NO: 2009462 - protein, 21 aa, Staphylococcus
ENIRLKYRYLDLRRQELAQTF

SEQ ID NO: 2009463 - protein, 21 aa, Staphylococcus
ENITFPSDFKVFGSSDSKVIF

SEQ ID NO: 2009464 - protein, 25 aa, Staphylococcus
ENIVKLDVLRFTSGAPSKVASAQIV

SEQ ID NO: 2009465 - protein, 22 aa, Staphylococcus
ENIVLVPKLLKWSKEKKDQKAE

SEQ ID NO: 2009466 - protein, 22 aa, Staphylococcus
ENIVLVPKLLKWSKEKKDSKAK

SEQ ID NO: 2009467 - protein, 22 aa, Staphylococcus
ENIVLVPKLLKWSQEKKDKKAR

SEQ ID NO: 2009468 - protein, 26 aa, Staphylococcus
ENIYMHFSRTYLRLMRNVYLNNPLTS

SEQ ID NO: 2009469 - protein, 17 aa, Staphylococcus
ENIYPFEIESVAKQFPN

SEQ ID NO: 2009470 - protein, 17 aa, Staphylococcus
ENIYPYQIESVAKYFPE

SEQ ID NO: 2009471 - protein, 24 aa, Staphylococcus
ENKEKLKGIFLSHGHEHAIGAVSY

SEQ ID NO: 2009472 - protein, 24 aa, Staphylococcus
ENKEKLKGIFLTHGHEHAIGAVTY

SEQ ID NO: 2009473 - protein, 25 aa, Staphylococcus
ENKEKLKGIFLTHGHEHAMGAVSYI

SEQ ID NO: 2009474 - protein, 23 aa, Staphylococcus
ENKETKHGLIIGEGYKTPKELIS

SEQ ID NO: 2009475 - protein, 23 aa, Staphylococcus
ENKEVFMDKKIVTYCTGGIRCEK

SEQ ID NO: 2009476 - protein, 17 aa, Staphylococcus
ENKFSRQRMNKIIDKAL

SEQ ID NO: 2009477 - protein, 24 aa, Staphylococcus
ENKGKIALFAGIDKCRFKRQVTPG

SEQ ID NO: 2009478 - protein, 24 aa, Staphylococcus
ENKGKLAFFAGIDKCRFKKQVTPG

SEQ ID NO: 2009479 - protein, 19 aa, Staphylococcus
ENKGLKLVGAKLMTVPTSL

SEQ ID NO: 2009480 - protein, 25 aa, Staphylococcus
ENKHFRLGISVSKKLGNAVTRNRIK

SEQ ID NO: 2009481 - protein, 29 aa, Staphylococcus
ENKKVISYMPTWRGTVGKVKKSTEVEKML

SEQ ID NO: 2009482 - protein, 17 aa, Staphylococcus
ENKRKAMGEAERNNYKK

SEQ ID NO: 2009483 - protein, 17 aa, Staphylococcus
ENKRLNNMFKLLDTVSV

SEQ ID NO: 2009484 - protein, 18 aa, Staphylococcus
ENKWSKWFETYGVQESLN

SEQ ID NO: 2009485 - protein, 25 aa, Staphylococcus
ENKYPSKVILLAWNRYLTDTASNYL

SEQ ID NO: 2009486 - protein, 19 aa, Staphylococcus
ENLDICIFAESLGGTETFI

SEQ ID NO: 2009487 - protein, 19 aa, Staphylococcus
ENLFRIKWNQEIDYDLIGD

SEQ ID NO: 2009488 - protein, 18 aa, Staphylococcus
ENLFRIKWTDEVDYELLK

SEQ ID NO: 2009489 - protein, 33 aa, Staphylococcus
ENLGLEYLDLFLIHWPCEENGLFIESYKALETL

SEQ ID NO: 2009490 - protein, 19 aa, Staphylococcus
ENLKDLRNGHAVEVPTYDY

SEQ ID NO: 2009491 - protein, 24 aa, Staphylococcus
ENLKEKLYHYWALGHIHERQQLSD

SEQ ID NO: 2009492 - protein, 25 aa, Staphylococcus
ENLKGSWSVVCFYPADFSFVCPTEL

SEQ ID NO: 2009493 - protein, 32 aa, Staphylococcus
ENLKIANELARAIQYKARIVTLEGDIVNPGGS

SEQ ID NO: 2009494 - protein, 17 aa, Staphylococcus
ENLKVVLDQAGSDLDSV

SEQ ID NO: 2009495 - protein, 23 aa, Staphylococcus
ENLLKPFAVTYFTLFTATMPVQL

SEQ ID NO: 2009496 - protein, 19 aa, Staphylococcus
ENLNVIACLMEIRRNPINT

SEQ ID NO: 2009497 - protein, 19 aa, Staphylococcus
ENLNVIACLMEIRRNPVNA

SEQ ID NO: 2009498 - protein, 26 aa, Staphylococcus
ENLQFSVALSTVWKFISRTNKYIDET

SEQ ID NO: 2009499 - protein, 25 aa, Staphylococcus
ENLRFIYKKCHVHTIFVDKSVYNVS

SEQ ID NO: 2009500 - protein, 23 aa, Staphylococcus
ENLRTRLLEMIGVNEVVINFDER

SEQ ID NO: 2009501 - protein, 17 aa, Staphylococcus
ENLSAKENLTFFGNLKG

SEQ ID NO: 2009502 - protein, 21 aa, Staphylococcus
ENLTLPHTIQFYISNNEEIGY

SEQ ID NO: 2009503 - protein, 28 aa, Staphylococcus
ENLVLLGIKTRGEFLAIRIQDKINQIEQ

SEQ ID NO: 2009504 - protein, 25 aa, Staphylococcus
ENLVPDYLGGLLFDDIPYLEVAQQE

SEQ ID NO: 2009505 - protein, 18 aa, Staphylococcus
ENMNIIACLMEIRRNPVN

SEQ ID NO: 2009506 - protein, 22 aa, Staphylococcus
ENMPVGIGSYVHYDRKLDGRIA

SEQ ID NO: 2009507 - protein, 23 aa, Staphylococcus
ENMQKKLGDDYVILLRMHYLIAI

SEQ ID NO: 2009508 - protein, 21 aa, Staphylococcus
ENMSLPLLWEFPGGKIEKGES

SEQ ID NO: 2009509 - protein, 17 aa, Staphylococcus
ENMSVIFDCHVYTLRQV

SEQ ID NO: 2009510 - protein, 18 aa, Staphylococcus
ENNFIKKSDKLICHVRPH

SEQ ID NO: 2009511 - protein, 23 aa, Staphylococcus
ENNFSKIAIHFDIDVLDPNEFRA

SEQ ID NO: 2009512 - protein, 23 aa, Staphylococcus
ENNGRCNLGVVTLNLPRIALESQ

SEQ ID NO: 2009513 - protein, 18 aa, Staphylococcus
ENNITFIPYFPLASGILA

SEQ ID NO: 2009514 - protein, 18 aa, Staphylococcus
ENNITFVPYFPLASGILA

SEQ ID NO: 2009515 - protein, 22 aa, Staphylococcus
ENNKEWLGILVEVTAETITMEV

SEQ ID NO: 2009516 - protein, 23 aa, Staphylococcus
ENNKIKCIYPISSKKTNKLVYTN

SEQ ID NO: 2009517 - protein, 29 aa, Staphylococcus
ENNLRRKGLLKAAALLLKYDDMNDKETIE

SEQ ID NO: 2009518 - protein, 24 aa, Staphylococcus
ENNQLLGRIHFDIVKEPKGVHLEN

SEQ ID NO: 2009519 - protein, 24 aa, Staphylococcus
ENNRFISIMAGLPINYIQEQLQVE

SEQ ID NO: 2009520 - protein, 19 aa, Staphylococcus
ENNTVPFIARYRKERTGGL

SEQ ID NO: 2009521 - protein, 24 aa, Staphylococcus
ENNVRFLKSRVDSLQKNVLFEKME

SEQ ID NO: 2009522 - protein, 23 aa, Staphylococcus
ENNVRIALTEVWEKGGKGGVDLA

SEQ ID NO: 2009523 - protein, 23 aa, Staphylococcus
ENNVRIALTEVWEKGGKGGVELA

SEQ ID NO: 2009524 - protein, 19 aa, Staphylococcus
ENPDELFDAVLMTVKHVVR

SEQ ID NO: 2009525 - protein, 24 aa, Staphylococcus
ENPNFRKPASLTFTLKDMEDAAQR

SEQ ID NO: 2009526 - protein, 24 aa, Staphylococcus
ENPQSGKVQLVYNEHVELIEVPIK

SEQ ID NO: 2009527 - protein, 19 aa, Staphylococcus
ENPRFIDKMLWNTRFKVPH

SEQ ID NO: 2009528 - protein, 25 aa, Staphylococcus
ENQEAIKFAQEHGITVVIATGRAFY

SEQ ID NO: 2009529 - protein, 18 aa, Staphylococcus
ENQESKDLFDEFRETQLS

SEQ ID NO: 2009530 - protein, 25 aa, Staphylococcus
ENQKPNIMPVWSIKNRARKVRDKDF

SEQ ID NO: 2009531 - protein, 18 aa, Staphylococcus
ENQKYGAFHGKESFKEAI

SEQ ID NO: 2009532 - protein, 23 aa, Staphylococcus
ENQLAALYWSYGHFAKEIEMGQP

SEQ ID NO: 2009533 - protein, 24 aa, Staphylococcus
ENQLKTRLENMIGVEKVDIDSKVG

SEQ ID NO: 2009534 - protein, 22 aa, Staphylococcus
ENQVKVMAWSPLAGGKLFDPSD

SEQ ID NO: 2009535 - protein, 24 aa, Staphylococcus
ENQYFLSILRKLEIHLIAFDEAHC

SEQ ID NO: 2009536 - protein, 21 aa, Staphylococcus
ENRELIKIHILQNNFDDKNDL

SEQ ID NO: 2009537 - protein, 21 aa, Staphylococcus
ENRENWSQLMFSFSTAIANAL

SEQ ID NO: 2009538 - protein, 21 aa, Staphylococcus
ENRFMHVAEFRRMNANINVEG

SEQ ID NO: 2009539 - protein, 21 aa, Staphylococcus
ENRGQIPYTVFIDPPLSRVGL

SEQ ID NO: 2009540 - protein, 20 aa, Staphylococcus
ENRIYFGITEYGRILLGADN

SEQ ID NO: 2009541 - protein, 20 aa, Staphylococcus
ENRKIKAMPSVRKYAREKGV

SEQ ID NO: 2009542 - protein, 20 aa, Staphylococcus
ENRMRFLMEVYREMRRQVGE

SEQ ID NO: 2009543 - protein, 26 aa, Staphylococcus
ENRSLKGGQTIGLFSYGSGSVGEFFS

SEQ ID NO: 2009544 - protein, 17 aa, Staphylococcus
ENRSVLNLFSYTGAFSV

SEQ ID NO: 2009545 - protein, 22 aa, Staphylococcus
ENSFRRCYEGVRISSVGGEDKS

SEQ ID NO: 2009546 - protein, 25 aa, Staphylococcus
ENSSFRGLFQFIRFIDELIDRGKDF

SEQ ID NO: 2009547 - protein, 25 aa, Staphylococcus
ENSSFRGLFQFIRFIDELIDRGRDF

SEQ ID NO: 2009548 - protein, 27 aa, Staphylococcus
ENSVVLRYGLLYGPGTWYGKDGMIYNS

SEQ ID NO: 2009549 - protein, 19 aa, Staphylococcus
ENTKALLFNLLDSPVKFTQ

SEQ ID NO: 2009550 - protein, 20 aa, Staphylococcus
ENTKEALAYYEEVFGATNIT

SEQ ID NO: 2009551 - protein, 22 aa, Staphylococcus
ENTSRSIGFNWFKGKSNKNDST

SEQ ID NO: 2009552 - protein, 17 aa, Staphylococcus
ENVEKVVFSKALNHVEW

SEQ ID NO: 2009553 - protein, 21 aa, Staphylococcus
ENVKFADNWLAPHPGTDAAIA

SEQ ID NO: 2009554 - protein, 20 aa, Staphylococcus
ENVKPVVVKSELFRNEEFNK

SEQ ID NO: 2009555 - protein, 17 aa, Staphylococcus
ENVKRLAKQEGLLVGSS

SEQ ID NO: 2009556 - protein, 17 aa, Staphylococcus
ENVRSVLSNVHRTLEER

SEQ ID NO: 2009557 - protein, 17 aa, Staphylococcus
ENVSIFYTSHYIEEVER

SEQ ID NO: 2009558 - protein, 20 aa, Staphylococcus
ENVSIPLVYAGIGSQERKKR

SEQ ID NO: 2009559 - protein, 23 aa, Staphylococcus
ENVTWKAADLFDLDEITEVMEGV

SEQ ID NO: 2009560 - protein, 25 aa, Staphylococcus
ENVWGPRAKPVQKFVEKTRSDFLPD

SEQ ID NO: 2009561 - protein, 19 aa, Staphylococcus
ENYEALLVYYGENSVNPIV

SEQ ID NO: 2009562 - protein, 19 aa, Staphylococcus
ENYEALLVYYSHSAENPVV

SEQ ID NO: 2009563 - protein, 20 aa, Staphylococcus
ENYIGPTLLDGITFNDKIME

SEQ ID NO: 2009564 - protein, 23 aa, Staphylococcus
ENYLEMAEVLAIVEELNRIANKK

SEQ ID NO: 2009565 - protein, 17 aa, Staphylococcus
ENYLRFIQESQIPSYKF

SEQ ID NO: 2009566 - protein, 22 aa, Staphylococcus
ENYTAKAYIEWLKRRINRNELE

SEQ ID NO: 2009567 - protein, 24 aa, Staphylococcus
EPADLKAHRMVNVILDKEAAAGLP

SEQ ID NO: 2009568 - protein, 25 aa, Staphylococcus
EPADLKAHRMVTVILDEAAAEGLPE

SEQ ID NO: 2009569 - protein, 20 aa, Staphylococcus
EPAGALSIAALDQYQAEIKG

SEQ ID NO: 2009570 - protein, 18 aa, Staphylococcus
EPALKHLRDTFKEKEDKY

SEQ ID NO: 2009571 - protein, 19 aa, Staphylococcus
EPALKHLRDTFKEKENQYQ

SEQ ID NO: 2009572 - protein, 18 aa, Staphylococcus
EPALKHLRQTFKQKEDEF

SEQ ID NO: 2009573 - protein, 25 aa, Staphylococcus
EPATELVEGLKLVTEFVQDENATQD

SEQ ID NO: 2009574 - protein, 18 aa, Staphylococcus
EPAVAFRLFKQLLEDKYG

SEQ ID NO: 2009575 - protein, 20 aa, Staphylococcus
EPAVAFRLFKQLVEDKYGKA

SEQ ID NO: 2009576 - protein, 20 aa, Staphylococcus
EPAVAFRLFKQLVEDKYGKD

SEQ ID NO: 2009577 - protein, 20 aa, Staphylococcus
EPAVAFRLFKQLVENKYGKE

SEQ ID NO: 2009578 - protein, 25 aa, Staphylococcus
EPAVKRYINEFLKKGSSNYPIEILK

SEQ ID NO: 2009579 - protein, 21 aa, Staphylococcus
EPDESILLVAVERLYPFPVEE

SEQ ID NO: 2009580 - protein, 18 aa, Staphylococcus
EPDFKVYQEQVIKNAKTL

SEQ ID NO: 2009581 - protein, 17 aa, Staphylococcus
EPDYLFEEKELLKKNQT

SEQ ID NO: 2009582 - protein, 23 aa, Staphylococcus
EPEGAAYFKIKFYRNNKEQFEYK

SEQ ID NO: 2009583 - protein, 30 aa, Staphylococcus
EPEGGLRCSACFEMRLEIVAQAAVEYGYDY

SEQ ID NO: 2009584 - protein, 29 aa, Staphylococcus
EPEGGLRCTACFEMRLELVAEAAVKYGYD

SEQ ID NO: 2009585 - protein, 24 aa, Staphylococcus
EPEGIAAKVLESFGITEDLVVAEV

SEQ ID NO: 2009586 - protein, 23 aa, Staphylococcus
EPEGIAAKVLESFNITEDKVITE

SEQ ID NO: 2009587 - protein, 22 aa, Staphylococcus
EPEGIAAKVLETFEITEEKVVE

SEQ ID NO: 2009588 - protein, 25 aa, Staphylococcus
EPEILKPRLVPLLQMSNKEFKQTYG

SEQ ID NO: 2009589 - protein, 22 aa, Staphylococcus
EPELLYQAWTDERFLKQWFMTT

SEQ ID NO: 2009590 - protein, 26 aa, Staphylococcus
EPEQKSDGSWGFSFVDKSGNLAGSYI

SEQ ID NO: 2009591 - protein, 18 aa, Staphylococcus
EPERTAAARLSDYYVTGD

SEQ ID NO: 2009592 - protein, 21 aa, Staphylococcus
EPFEFPLMALIVSGGHTELVY

SEQ ID NO: 2009593 - protein, 18 aa, Staphylococcus
EPFMYKLVDIVADIMEPY

SEQ ID NO: 2009594 - protein, 17 aa, Staphylococcus
EPFRRHIEHAGPFKTIG

SEQ ID NO: 2009595 - protein, 17 aa, Staphylococcus
EPFTEREYNVFGKIQPP

SEQ ID NO: 2009596 - protein, 17 aa, Staphylococcus
EPGIGYNAATDEWVNML

SEQ ID NO: 2009597 - protein, 23 aa, Staphylococcus
EPGLIQTEWEGISAKSLLKTSGD

SEQ ID NO: 2009598 - protein, 19 aa, Staphylococcus
EPGSLVAMIDLIKKSEPGY

SEQ ID NO: 2009599 - protein, 22 aa, Staphylococcus
EPHARDVIEFNHLIIDNDAHRV

SEQ ID NO: 2009600 - protein, 20 aa, Staphylococcus
EPHDDFDYIIAMDQSNVDNI

SEQ ID NO: 2009601 - protein, 22 aa, Staphylococcus
EPHPRFGEIAVLLYTGSIELEY

SEQ ID NO: 2009602 - protein, 18 aa, Staphylococcus
EPHYELADHVTLYSLELD

SEQ ID NO: 2009603 - protein, 18 aa, Staphylococcus
EPIALAGVMGGDFSEVTD

SEQ ID NO: 2009604 - protein, 21 aa, Staphylococcus
EPIDMKHPLLAMANAVIVPHI

SEQ ID NO: 2009605 - protein, 18 aa, Staphylococcus
EPIFPRLDSEVEISYIKE

SEQ ID NO: 2009606 - protein, 20 aa, Staphylococcus
EPIGALLPEMCTLDCGSTNF

SEQ ID NO: 2009607 - protein, 27 aa, Staphylococcus
EPIKGSELSQRFGVSRQIIVKDISHLK

SEQ ID NO: 2009608 - protein, 23 aa, Staphylococcus
EPIKRIANHRILAMNRGEKEKVL

SEQ ID NO: 2009609 - protein, 26 aa, Staphylococcus
EPIMTKRRFSAFTGSGLEVFLNANQI

SEQ ID NO: 2009610 - protein, 17 aa, Staphylococcus
EPIPRFPGVSRDIALEV

SEQ ID NO: 2009611 - protein, 20 aa, Staphylococcus
EPISKLLSTLSCDVNPIPIK

SEQ ID NO: 2009612 - protein, 31 aa, Staphylococcus
EPIYGKTYLPRKFKIGIAVPPSNDIDVYSQD

SEQ ID NO: 2009613 - protein, 19 aa, Staphylococcus
EPKAHWDLVEELNMANFER

SEQ ID NO: 2009614 - protein, 20 aa, Staphylococcus
EPKDVIIVEGIFALENKTLR

SEQ ID NO: 2009615 - protein, 22 aa, Staphylococcus
EPKFKDAMILADFFDTPYQMLV

SEQ ID NO: 2009616 - protein, 22 aa, Staphylococcus
EPKGKIALRLEIVEYMKKRGVT

SEQ ID NO: 2009617 - protein, 21 aa, Staphylococcus
EPKLKDWSIQRLLKTDRIILR

SEQ ID NO: 2009618 - protein, 21 aa, Staphylococcus
EPKNKRILLEYVSANPTGDLH

SEQ ID NO: 2009619 - protein, 21 aa, Staphylococcus
EPKSEKVLYKKATQITYDEYD

SEQ ID NO: 2009620 - protein, 17 aa, Staphylococcus
EPLDHVLLFGPPGLGKT

SEQ ID NO: 2009621 - protein, 17 aa, Staphylococcus
EPLFVKIGMELFYQTGP

SEQ ID NO: 2009622 - protein, 19 aa, Staphylococcus
EPLFVKVGMELFYQSGPQF

SEQ ID NO: 2009623 - protein, 18 aa, Staphylococcus
EPLFVKVGMELFYQTGPE

SEQ ID NO: 2009624 - protein, 24 aa, Staphylococcus
EPLHKNSELWQRNNITITPHISAL

SEQ ID NO: 2009625 - protein, 19 aa, Staphylococcus
EPLILIGFMGTGKSTLGEY

SEQ ID NO: 2009626 - protein, 17 aa, Staphylococcus
EPLNFEVRGEAYMPRQS

SEQ ID NO: 2009627 - protein, 25 aa, Staphylococcus
EPLRFLQVRIPVRMDDGTVQTFTGY

SEQ ID NO: 2009628 - protein, 17 aa, Staphylococcus
EPLSLGLNTYKGYVTNK

SEQ ID NO: 2009629 - protein, 22 aa, Staphylococcus
EPLVTKHRLSAFTGSNLEVLLR

SEQ ID NO: 2009630 - protein, 22 aa, Staphylococcus
EPLYIKIGMELYYQTGPELINR

SEQ ID NO: 2009631 - protein, 32 aa, Staphylococcus
EPMFSKKSIKNVVKPLLKYAFDRGIYVQMNSN

SEQ ID NO: 2009632 - protein, 25 aa, Staphylococcus
EPMVLPARFPNLLINGSTGISAGYA

SEQ ID NO: 2009633 - protein, 25 aa, Staphylococcus
EPMVLPARFPNLLVNGSTGISSGYA

SEQ ID NO: 2009634 - protein, 25 aa, Staphylococcus
EPMVLPSRFPNLLVNGSTGISSGYA

SEQ ID NO: 2009635 - protein, 30 aa, Staphylococcus
EPMYGKKYLPRKFKIGIALPPSNDIDVYSQ

SEQ ID NO: 2009636 - protein, 31 aa, Staphylococcus
EPMYGKTYLPRKFKIGIAVPPSNDIDVYSQD

SEQ ID NO: 2009637 - protein, 23 aa, Staphylococcus
EPNDPIIHFALAELLYFDGQYLR

SEQ ID NO: 2009638 - protein, 20 aa, Staphylococcus
EPNFDFFNYAGIHRPVKIYT

SEQ ID NO: 2009639 - protein, 24 aa, Staphylococcus
EPNGLIRMYLEGCDYTYSSRRYLK

SEQ ID NO: 2009640 - protein, 20 aa, Staphylococcus
EPNILLTMCYADCVPVYFYS

SEQ ID NO: 2009641 - protein, 23 aa, Staphylococcus
EPNSAEIFNFIYGHLDELINQTK

SEQ ID NO: 2009642 - protein, 25 aa, Staphylococcus
EPNYEGIEFVEFLISPNKGEPLKSL

SEQ ID NO: 2009643 - protein, 17 aa, Staphylococcus
EPPIISLIQRYKHHYDK

SEQ ID NO: 2009644 - protein, 25 aa, Staphylococcus
EPPISIKDGGLFKQGFSKQLDEYLE

SEQ ID NO: 2009645 - protein, 24 aa, Staphylococcus
EPPISVKDGGLFKQGFNQQLDEYL

SEQ ID NO: 2009646 - protein, 25 aa, Staphylococcus
EPPISVKDGGLFKQGFSKQLDEYLE

SEQ ID NO: 2009647 - protein, 25 aa, Staphylococcus
EPPISVKDGGLFKRGFNQQLDEYLD

SEQ ID NO: 2009648 - protein, 19 aa, Staphylococcus
EPPWFKVSPTHFVKSWLLD

SEQ ID NO: 2009649 - protein, 25 aa, Staphylococcus
EPQRHIKVFPGLVTYVGQTKEEALA

SEQ ID NO: 2009650 - protein, 23 aa, Staphylococcus
EPRKGEYYITGDLAKLDADGYFW

SEQ ID NO: 2009651 - protein, 21 aa, Staphylococcus
EPRLERLFIKYLGVEDTEVNR

SEQ ID NO: 2009652 - protein, 25 aa, Staphylococcus
EPSDLKAHRMVNVILDEAAAEGLPE

SEQ ID NO: 2009653 - protein, 25 aa, Staphylococcus
EPSDLKAHRMVTVVLDRAAAEGLPE

SEQ ID NO: 2009654 - protein, 22 aa, Staphylococcus
EPSEIADTVVFLASDGASAITG

SEQ ID NO: 2009655 - protein, 22 aa, Staphylococcus
EPSEYSALFIPGGFSPDHLRGD

SEQ ID NO: 2009656 - protein, 22 aa, Staphylococcus
EPSFDLLFVKWIPREQNKEANH

SEQ ID NO: 2009657 - protein, 23 aa, Staphylococcus
EPSKRLRESFNRSRKDDFSDYKL

SEQ ID NO: 2009658 - protein, 31 aa, Staphylococcus
EPSLEALNYYIKRYMLAVPFENINVQNGMPV

SEQ ID NO: 2009659 - protein, 20 aa, Staphylococcus
EPSTQLQALFKLVNDTSHVV

SEQ ID NO: 2009660 - protein, 20 aa, Staphylococcus
EPTEEQWKAMELGWKVVPSV

SEQ ID NO: 2009661 - protein, 20 aa, Staphylococcus
EPTTYLDICHQLEILELVQR

SEQ ID NO: 2009662 - protein, 24 aa, Staphylococcus
EPVERYSGFVLIPPQRGVYKGIKK

SEQ ID NO: 2009663 - protein, 24 aa, Staphylococcus
EPVGEGFRWLTLVSPTHQDGTELI

SEQ ID NO: 2009664 - protein, 24 aa, Staphylococcus
EPVKGDVWAAWYADLLNVNPQLNI

SEQ ID NO: 2009665 - protein, 21 aa, Staphylococcus
EPVNEPYILVTGTIGFGEVPQ

SEQ ID NO: 2009666 - protein, 23 aa, Staphylococcus
EPVPPLPPVESFKGPKGRYQTVL

SEQ ID NO: 2009667 - protein, 27 aa, Staphylococcus
EPYNDIRMWDYKALPAVFGGDNVEVHD

SEQ ID NO: 2009668 - protein, 21 aa, Staphylococcus
EPYVIVCLNAIVADTDEQAEY

SEQ ID NO: 2009669 - protein, 30 aa, Staphylococcus
EQAFAFKEEVGYPLIVRPAFTMGGTGGGIC

SEQ ID NO: 2009670 - protein, 30 aa, Staphylococcus
EQAFKFKEEVGYPLIVRPAFTMGGTGGGIC

SEQ ID NO: 2009671 - protein, 25 aa, Staphylococcus
EQALEHFAGTIIFVSHDRYFINQLA

SEQ ID NO: 2009672 - protein, 25 aa, Staphylococcus
EQALKDFAERLGVNYSYDDKELLKN

SEQ ID NO: 2009673 - protein, 19 aa, Staphylococcus
EQALSMGVETGMRKTLTQL

SEQ ID NO: 2009674 - protein, 26 aa, Staphylococcus
EQAQVLWMSTFHSMCVRILRRDADRI

SEQ ID NO: 2009675 - protein, 19 aa, Staphylococcus
EQAWDWKEEYASFIRQQWA

SEQ ID NO: 2009676 - protein, 19 aa, Staphylococcus
EQAWEWKEEYASFIRQQWA

SEQ ID NO: 2009677 - protein, 17 aa, Staphylococcus
EQCEVQLAYAIGVAEPV

SEQ ID NO: 2009678 - protein, 20 aa, Staphylococcus
EQCNQLGLELAEKLAPNHQV

SEQ ID NO: 2009679 - protein, 23 aa, Staphylococcus
EQDDVRFSYTFDHDTELVGNMNL

SEQ ID NO: 2009680 - protein, 29 aa, Staphylococcus
EQDLELLESVAFQIGSAIKRILLTDREKE

SEQ ID NO: 2009681 - protein, 21 aa, Staphylococcus
EQDNRIIISFDIGFYSTNTPK

SEQ ID NO: 2009682 - protein, 19 aa, Staphylococcus
EQDPEEWFEAVKKGIKYIN

SEQ ID NO: 2009683 - protein, 25 aa, Staphylococcus
EQEHFRLGISVSKKLGNAVTRNKIK

SEQ ID NO: 2009684 - protein, 18 aa, Staphylococcus
EQEILTILGQKSRDNSRT

SEQ ID NO: 2009685 - protein, 18 aa, Staphylococcus
EQEKRFMHHYNFPNFSVG

SEQ ID NO: 2009686 - protein, 18 aa, Staphylococcus
EQELGFKAPVKVYAGGGD

SEQ ID NO: 2009687 - protein, 27 aa, Staphylococcus
EQELKLKKGEIVPIEIEILPSSTYFKQ

SEQ ID NO: 2009688 - protein, 18 aa, Staphylococcus
EQEMKFGSVSGIGACDNV

SEQ ID NO: 2009689 - protein, 25 aa, Staphylococcus
EQEMLDEAFAVYLMAFEHARKYVEK

SEQ ID NO: 2009690 - protein, 23 aa, Staphylococcus
EQENGRINLCFEILENQIKIVIS

SEQ ID NO: 2009691 - protein, 19 aa, Staphylococcus
EQETALALNFYRNLTINDV

SEQ ID NO: 2009692 - protein, 20 aa, Staphylococcus
EQFALFVKRGFVTPEEYLEL

SEQ ID NO: 2009693 - protein, 18 aa, Staphylococcus
EQFMFTSNIVFYTVDYNH

SEQ ID NO: 2009694 - protein, 19 aa, Staphylococcus
EQGKDPMIVLGQLINSVQS

SEQ ID NO: 2009695 - protein, 22 aa, Staphylococcus
EQGKQIFLNFLQECGIDYVKPK

SEQ ID NO: 2009696 - protein, 24 aa, Staphylococcus
EQGKRKFLNLGHTFGHAIEYNQKI

SEQ ID NO: 2009697 - protein, 25 aa, Staphylococcus
EQGSRARPGQGYVHHIAVNTPNDSD

SEQ ID NO: 2009698 - protein, 23 aa, Staphylococcus
EQGVRIALTEVWEKGGKGGVDLA

SEQ ID NO: 2009699 - protein, 25 aa, Staphylococcus
EQGYRIGYGGGYFDKFLNKHKTKTL

SEQ ID NO: 2009700 - protein, 22 aa, Staphylococcus
EQHAIFGAGAYRVSSREMWRDL

SEQ ID NO: 2009701 - protein, 21 aa, Staphylococcus
EQHAIFGTGAYRVSSREMWRE

SEQ ID NO: 2009702 - protein, 24 aa, Staphylococcus
EQHKTWRKRVMKEMNVKSGSKALD

SEQ ID NO: 2009703 - protein, 25 aa, Staphylococcus
EQHYKEVTDALGIYDLSQKYPNEIS

SEQ ID NO: 2009704 - protein, 25 aa, Staphylococcus
EQIDYAISIGFKIKVNVVIQKGVND

SEQ ID NO: 2009705 - protein, 17 aa, Staphylococcus
EQIEAFVEVLVPIIEER

SEQ ID NO: 2009706 - protein, 19 aa, Staphylococcus
EQIHPAIIVGFNYEDVDKR

SEQ ID NO: 2009707 - protein, 17 aa, Staphylococcus
EQIKEGTNHIVVDSVQY

SEQ ID NO: 2009708 - protein, 17 aa, Staphylococcus
EQILMSLEILKTIAQTY

SEQ ID NO: 2009709 - protein, 21 aa, Staphylococcus
EQILTRFNIQFSTIDTTHLNE

SEQ ID NO: 2009710 - protein, 19 aa, Staphylococcus
EQINAWLKIYEEIGYNTQF

SEQ ID NO: 2009711 - protein, 17 aa, Staphylococcus
EQIVLFLNRRGYASFML

SEQ ID NO: 2009712 - protein, 42 aa, Staphylococcus
EQIVLFLNRRGYASFMLCRDCGHVPQCPNCDISLTYHKTTDQ

SEQ ID NO: 2009713 - protein, 18 aa, Staphylococcus
EQIVRVAFEIAQQRHKKL

SEQ ID NO: 2009714 - protein, 24 aa, Staphylococcus
EQIYDIVKQYGFVKRFQVVEPSLN

SEQ ID NO: 2009715 - protein, 26 aa, Staphylococcus
EQKFGLRLAGEFDKAAMIEAVDMIHR

SEQ ID NO: 2009716 - protein, 25 aa, Staphylococcus
EQKFGLRLAGEFDREAMKEAVQLIH

SEQ ID NO: 2009717 - protein, 26 aa, Staphylococcus
EQKFGLRLAGEFKRTDMKKAVEIAHK

SEQ ID NO: 2009718 - protein, 24 aa, Staphylococcus
EQKFGLRLPGEFNREDVRKAVNLA

SEQ ID NO: 2009719 - protein, 25 aa, Staphylococcus
EQKFGLRLPGEFNREMMKEAVEIAH

SEQ ID NO: 2009720 - protein, 19 aa, Staphylococcus
EQKKIGLFFTEIDKCSEIL

SEQ ID NO: 2009721 - protein, 22 aa, Staphylococcus
EQKLYLMIAERFIENLLPPYEY

SEQ ID NO: 2009722 - protein, 24 aa, Staphylococcus
EQKPKILLHSCCAPCSTYTLEYLT

SEQ ID NO: 2009723 - protein, 25 aa, Staphylococcus
EQKVFFKLLFYSGARKGEVRALTWE

SEQ ID NO: 2009724 - protein, 17 aa, Staphylococcus
EQKVWLSGYLIANQQTI

SEQ ID NO: 2009725 - protein, 25 aa, Staphylococcus
EQLAKRAKKVMSFEIDQRLIPVLKE

SEQ ID NO: 2009726 - protein, 19 aa, Staphylococcus
EQLEFNGLILKNQSKTLTI

SEQ ID NO: 2009727 - protein, 20 aa, Staphylococcus
EQLEGFRKIEVWQIDNTNDT

SEQ ID NO: 2009728 - protein, 30 aa, Staphylococcus
EQLFAAGYASCFNGAFDLILKQNKVRDAQP

SEQ ID NO: 2009729 - protein, 30 aa, Staphylococcus
EQLFAAGYASCFNGAFDLILKQNKVRGAEP

SEQ ID NO: 2009730 - protein, 30 aa, Staphylococcus
EQLFAAGYASCFNGAYDLILKQNKVRGAEP

SEQ ID NO: 2009731 - protein, 21 aa, Staphylococcus
EQLIQFKFTINPFKMAKTNQL

SEQ ID NO: 2009732 - protein, 18 aa, Staphylococcus
EQLKFAGIGESKVETILM

SEQ ID NO: 2009733 - protein, 23 aa, Staphylococcus
EQLKKKLTKEGFFDQNHKKVIPK

SEQ ID NO: 2009734 - protein, 17 aa, Staphylococcus
EQLKKVTGYIRGGCSPI

SEQ ID NO: 2009735 - protein, 23 aa, Staphylococcus
EQLLDEGLEWVLIQGQMGIELWT

SEQ ID NO: 2009736 - protein, 18 aa, Staphylococcus
EQLLKLKHWHDMQLQLTQ

SEQ ID NO: 2009737 - protein, 18 aa, Staphylococcus
EQLLLPLFQFYQNKYPNI

SEQ ID NO: 2009738 - protein, 19 aa, Staphylococcus
EQLLRKKKQVFVVSSKKTE

SEQ ID NO: 2009739 - protein, 19 aa, Staphylococcus
EQLNLKHQVILMVDWKDGR

SEQ ID NO: 2009740 - protein, 18 aa, Staphylococcus
EQLPQVWQDLGMRSASAY

SEQ ID NO: 2009741 - protein, 29 aa, Staphylococcus
EQLQFFKINALRSIFWKVLDQEFYLIDNS

SEQ ID NO: 2009742 - protein, 22 aa, Staphylococcus
EQLRIDLADVMAIGDNLNDMSM

SEQ ID NO: 2009743 - protein, 17 aa, Staphylococcus
EQLRLKGFYKDSNKKAE

SEQ ID NO: 2009744 - protein, 25 aa, Staphylococcus
EQLSERMPVFFSANMSYGVHALTKI

SEQ ID NO: 2009745 - protein, 17 aa, Staphylococcus
EQLSNEKYRTWEWNYGR

SEQ ID NO: 2009746 - protein, 31 aa, Staphylococcus
EQLTVLSYRVHKGFHMLKFEGINNINDVEQY

SEQ ID NO: 2009747 - protein, 28 aa, Staphylococcus
EQLVNFGRFPYCKGHLKKEDKEQVKYAL

SEQ ID NO: 2009748 - protein, 29 aa, Staphylococcus
EQLYQLIVEKIRYAFKDRILIPQNDLDRT

SEQ ID NO: 2009749 - protein, 20 aa, Staphylococcus
EQLYYLMSRGISQHEAERLV

SEQ ID NO: 2009750 - protein, 22 aa, Staphylococcus
EQLYYLMSRGISRQEAERLVIH

SEQ ID NO: 2009751 - protein, 24 aa, Staphylococcus
EQMKLQSPRLMLGFKNQPLKESSE

SEQ ID NO: 2009752 - protein, 28 aa, Staphylococcus
EQMNLKKAKLHPAICFTILGHHLGMNID

SEQ ID NO: 2009753 - protein, 22 aa, Staphylococcus
EQMPADVFPLTIRTRKNGDIFC

SEQ ID NO: 2009754 - protein, 31 aa, Staphylococcus
EQMPIEVIYGFAQLKRAAALANHELGKLSDA

SEQ ID NO: 2009755 - protein, 37 aa, Staphylococcus
EQNDTFLAWQAFRGEVPLSVYHEMTFFKLNDHKNYQR

SEQ ID NO: 2009756 - protein, 20 aa, Staphylococcus
EQNKAFLFGINYVLLTDDQD

SEQ ID NO: 2009757 - protein, 22 aa, Staphylococcus
EQNVEGLFSIAGFKDDAVDIDE

SEQ ID NO: 2009758 - protein, 25 aa, Staphylococcus
EQNYKEVTEALGINDLGNKYPSEIS

SEQ ID NO: 2009759 - protein, 25 aa, Staphylococcus
EQNYKEVTEALGIYELSDKYPSEIS

SEQ ID NO: 2009760 - protein, 23 aa, Staphylococcus
EQPEYIETLTFQSAVETLYSQLP

SEQ ID NO: 2009761 - protein, 27 aa, Staphylococcus
EQPVIVKFEAGWCPDCKAMDMWIDPIV

SEQ ID NO: 2009762 - protein, 22 aa, Staphylococcus
EQQKLGIFFSKLDRQIELEEEK

SEQ ID NO: 2009763 - protein, 19 aa, Staphylococcus
EQQRLKNQYGIQGKLAVYM

SEQ ID NO: 2009764 - protein, 17 aa, Staphylococcus
EQRADLRAAKLTLEQLI

SEQ ID NO: 2009765 - protein, 20 aa, Staphylococcus
EQRDKLKLVAKHLISSELIK

SEQ ID NO: 2009766 - protein, 25 aa, Staphylococcus
EQRKKALLFEWSRINEMLDKQLYLT

SEQ ID NO: 2009767 - protein, 20 aa, Staphylococcus
EQRMIDILRHYYKTTHKGMI

SEQ ID NO: 2009768 - protein, 32 aa, Staphylococcus
EQRQPIEFFRYPKMIHDFSLFPIHESHKVVKQ

SEQ ID NO: 2009769 - protein, 24 aa, Staphylococcus
EQRREMIRAAAFKLVENIKNDLKP

SEQ ID NO: 2009770 - protein, 24 aa, Staphylococcus
EQRREMIREAAFKLVDNIKKDIKP

SEQ ID NO: 2009771 - protein, 24 aa, Staphylococcus
EQSFDLMFVKWVPRDKNKEANQHA

SEQ ID NO: 2009772 - protein, 22 aa, Staphylococcus
EQSILHLSFDFLILDWTSIWIL

SEQ ID NO: 2009773 - protein, 25 aa, Staphylococcus
EQSKLRKAYLESFRKNFKQQIESTR

SEQ ID NO: 2009774 - protein, 20 aa, Staphylococcus
EQSYRLTIPHISYLSNSKLI

SEQ ID NO: 2009775 - protein, 21 aa, Staphylococcus
EQSYRLTIPSVKYMSNLKSVY

SEQ ID NO: 2009776 - protein, 26 aa, Staphylococcus
EQTAVYVCGGTKFLQSMISMLREMGV

SEQ ID NO: 2009777 - protein, 24 aa, Staphylococcus
EQTLKIESIIGFKGDAEDEISRIT

SEQ ID NO: 2009778 - protein, 18 aa, Staphylococcus
EQVAFKDDALRLAHEDLY

SEQ ID NO: 2009779 - protein, 20 aa, Staphylococcus
EQVLERWNQFNLYEITRGIN

SEQ ID NO: 2009780 - protein, 36 aa, Staphylococcus
EQVLGYRINAAIIKSRRDYISLGLISQILKDETQNY

SEQ ID NO: 2009781 - protein, 27 aa, Staphylococcus
EQVPRHIYCGTIGLLLPNDKMIFNIPI

SEQ ID NO: 2009782 - protein, 18 aa, Staphylococcus
EQVTGFVVSGKIDREKYG

SEQ ID NO: 2009783 - protein, 17 aa, Staphylococcus
EQVYLAVTVWTAGLRGP

SEQ ID NO: 2009784 - protein, 20 aa, Staphylococcus
EQWNRYASQMIAKVQSNGEI

SEQ ID NO: 2009785 - protein, 19 aa, Staphylococcus
EQYDFIYGIIGWHPVGAID

SEQ ID NO: 2009786 - protein, 19 aa, Staphylococcus
EQYGAVYLVNLFSNIKTPM

SEQ ID NO: 2009787 - protein, 18 aa, Staphylococcus
EQYIELFADHGADLISVH

SEQ ID NO: 2009788 - protein, 21 aa, Staphylococcus
EQYKKDWPFDMVVIDELSTFK

SEQ ID NO: 2009789 - protein, 20 aa, Staphylococcus
EQYPGYDFEHNVGYGTKAHL

SEQ ID NO: 2009790 - protein, 22 aa, Staphylococcus
EQYSRLKSVYCYEVYNENGELA

SEQ ID NO: 2009791 - protein, 25 aa, Staphylococcus
ERAAKVSGARFVFLTGDGAQLERAL

SEQ ID NO: 2009792 - protein, 22 aa, Staphylococcus
ERAAKVSGARFVYLTKDGAQLE

SEQ ID NO: 2009793 - protein, 24 aa, Staphylococcus
ERADKLYKWFSLINEHKDELAELI

SEQ ID NO: 2009794 - protein, 19 aa, Staphylococcus
ERADYLLEISRKIHENAER

SEQ ID NO: 2009795 - protein, 19 aa, Staphylococcus
ERADYLLEISRRIHEKVEH

SEQ ID NO: 2009796 - protein, 19 aa, Staphylococcus
ERADYLLEISRRILEKKEH

SEQ ID NO: 2009797 - protein, 20 aa, Staphylococcus
ERAFSYQLLIFAFKETAHNS

SEQ ID NO: 2009798 - protein, 21 aa, Staphylococcus
ERAGLGFVGRNGFVISPELGT

SEQ ID NO: 2009799 - protein, 26 aa, Staphylococcus
ERAGLKTDVMLAAYGYKLMDEKIVNE

SEQ ID NO: 2009800 - protein, 26 aa, Staphylococcus
ERAKAEGYPAIFVHCYTEFFNHIGYV

SEQ ID NO: 2009801 - protein, 17 aa, Staphylococcus
ERAKRLQNVVDRLQEKV

SEQ ID NO: 2009802 - protein, 18 aa, Staphylococcus
ERALLFGPFAGFSPKFLK

SEQ ID NO: 2009803 - protein, 30 aa, Staphylococcus
ERAYDIYSRLLKDRIIMLGSAIDDNVANSI

SEQ ID NO: 2009804 - protein, 20 aa, Staphylococcus
ERAYKLKPQIIGVNNRDLKR

SEQ ID NO: 2009805 - protein, 17 aa, Staphylococcus
ERCIPYYIFNEYWFLFY

SEQ ID NO: 2009806 - protein, 35 aa, Staphylococcus
ERDAFKTSDCNLKFKNELLDLGIIDEDWLNELDNA

SEQ ID NO: 2009807 - protein, 21 aa, Staphylococcus
ERDDVLPFCLHISGKPIVNSR

SEQ ID NO: 2009808 - protein, 25 aa, Staphylococcus
ERDKGRFKDSLKRIDISPLGAAALS

SEQ ID NO: 2009809 - protein, 19 aa, Staphylococcus
ERDKSRFQDSLKRIDISPL

SEQ ID NO: 2009810 - protein, 23 aa, Staphylococcus
ERDRLRNIINIFKEGLLNERTKI

SEQ ID NO: 2009811 - protein, 25 aa, Staphylococcus
ERDVTRLAQHLGWQGNHTDFDVLPL

SEQ ID NO: 2009812 - protein, 26 aa, Staphylococcus
ERDYTRFADSLKRIDISPLGAAALSG

SEQ ID NO: 2009813 - protein, 20 aa, Staphylococcus
EREDIILTPHIAFYTDAAVK

SEQ ID NO: 2009814 - protein, 19 aa, Staphylococcus
EREEWKIEEAVLYEMKKNP

SEQ ID NO: 2009815 - protein, 25 aa, Staphylococcus
EREGLVKAAALLLAYDDNADQETVE

SEQ ID NO: 2009816 - protein, 25 aa, Staphylococcus
EREHTSKSGGFDWFKRKSNKNENTY

SEQ ID NO: 2009817 - protein, 17 aa, Staphylococcus
EREISFVELVPYTEKLI

SEQ ID NO: 2009818 - protein, 26 aa, Staphylococcus
EREKEKGLKPRAIRAMIVGIPNVGKS

SEQ ID NO: 2009819 - protein, 18 aa, Staphylococcus
EREKLSFGVINILLQFVM

SEQ ID NO: 2009820 - protein, 19 aa, Staphylococcus
EREKLSFGVINILLQFVML

SEQ ID NO: 2009821 - protein, 23 aa, Staphylococcus
ERENGGDVFVHFSAIVEDGYKSL

SEQ ID NO: 2009822 - protein, 18 aa, Staphylococcus
ERERILTILTTMVAQQAE

SEQ ID NO: 2009823 - protein, 25 aa, Staphylococcus
ERERPMDRLLCGDVGYGKTEVAVRA

SEQ ID NO: 2009824 - protein, 17 aa, Staphylococcus
ERESLTVITNCFPVFQI

SEQ ID NO: 2009825 - protein, 25 aa, Staphylococcus
ERFARRFENFGTRVILGRFSMILSS

SEQ ID NO: 2009826 - protein, 20 aa, Staphylococcus
ERFGTLVLGRVKDDFNENDL

SEQ ID NO: 2009827 - protein, 17 aa, Staphylococcus
ERFIASLMEPYQYEMTT

SEQ ID NO: 2009828 - protein, 17 aa, Staphylococcus
ERFKFASRHDVYIETET

SEQ ID NO: 2009829 - protein, 21 aa, Staphylococcus
ERFKFHKHFFVPDNVGHDGFL

SEQ ID NO: 2009830 - protein, 25 aa, Staphylococcus
ERFKSIKICPLIYWTEEEVWDYIND

SEQ ID NO: 2009831 - protein, 21 aa, Staphylococcus
ERFWPADLVILSIGFIGTEIT

SEQ ID NO: 2009832 - protein, 22 aa, Staphylococcus
ERFWPADLVLLSIGFIGTETTI

SEQ ID NO: 2009833 - protein, 17 aa, Staphylococcus
ERGFLPGNGAITSVVTV

SEQ ID NO: 2009834 - protein, 21 aa, Staphylococcus
ERGIEGYSLYSGISGIAFSID

SEQ ID NO: 2009835 - protein, 19 aa, Staphylococcus
ERGILICGTGIGVAITANK

SEQ ID NO: 2009836 - protein, 22 aa, Staphylococcus
ERGKEILKESGLAIEPAATMAE

SEQ ID NO: 2009837 - protein, 22 aa, Staphylococcus
ERGKEILNESGLAIEPAATMAE

SEQ ID NO: 2009838 - protein, 24 aa, Staphylococcus
ERGVEFKIGTPIVGANEKGFLVKV

SEQ ID NO: 2009839 - protein, 18 aa, Staphylococcus
ERGVKLVGATSHYVTSDL

SEQ ID NO: 2009840 - protein, 24 aa, Staphylococcus
ERHFKEITENISFVRSSILKNKIV

SEQ ID NO: 2009841 - protein, 19 aa, Staphylococcus
ERHIIKFSIRKHHIPDTAL

SEQ ID NO: 2009842 - protein, 22 aa, Staphylococcus
ERHLAALSFLTFVALDENGKPQ

SEQ ID NO: 2009843 - protein, 24 aa, Staphylococcus
ERHNLKMITIESLIEYRKQSESHV

SEQ ID NO: 2009844 - protein, 22 aa, Staphylococcus
ERHPRQCVFVGTTNNYEFLKDQ

SEQ ID NO: 2009845 - protein, 23 aa, Staphylococcus
ERHWPADLVLLSIGFEGTEPTVP

SEQ ID NO: 2009846 - protein, 23 aa, Staphylococcus
ERHWPADLVLLSIGFEGTETTVP

SEQ ID NO: 2009847 - protein, 23 aa, Staphylococcus
ERHWPADLVLLSIGFIGTETTVP

SEQ ID NO: 2009848 - protein, 23 aa, Staphylococcus
ERHWPADLVLLSIGFVGTENIVP

SEQ ID NO: 2009849 - protein, 17 aa, Staphylococcus
ERIAQMFIESAVDIGNM

SEQ ID NO: 2009850 - protein, 17 aa, Staphylococcus
ERIAQMLIESSVDIGNM

SEQ ID NO: 2009851 - protein, 23 aa, Staphylococcus
ERIASCSLLPVSDDDDFVVNEDD

SEQ ID NO: 2009852 - protein, 19 aa, Staphylococcus
ERIERAIIVGFHYEDVEKR

SEQ ID NO: 2009853 - protein, 18 aa, Staphylococcus
ERIGYLIEHPKLYDNKTG

SEQ ID NO: 2009854 - protein, 25 aa, Staphylococcus
ERIIYCRYCIQLGRMDNITEFRITQ

SEQ ID NO: 2009855 - protein, 17 aa, Staphylococcus
ERIKKYYNRQLSEQVAP

SEQ ID NO: 2009856 - protein, 21 aa, Staphylococcus
ERIKSKPYYSVINLESNIEYL

SEQ ID NO: 2009857 - protein, 23 aa, Staphylococcus
ERIKTFRKLGVDYEMEKLRTDLS

SEQ ID NO: 2009858 - protein, 20 aa, Staphylococcus
ERILYYTGRIHKIGETHEGA

SEQ ID NO: 2009859 - protein, 22 aa, Staphylococcus
ERIPFPNSYQAVVYISGQKNNN

SEQ ID NO: 2009860 - protein, 18 aa, Staphylococcus
ERIQLFIEGHVEDIKLNK

SEQ ID NO: 2009861 - protein, 21 aa, Staphylococcus
ERIVIELKKLIKGINVAQSFN

SEQ ID NO: 2009862 - protein, 22 aa, Staphylococcus
ERIVKKGGIDQIVIESTGISEP

SEQ ID NO: 2009863 - protein, 20 aa, Staphylococcus
ERIVRVAFNLAQNRRKKLTS

SEQ ID NO: 2009864 - protein, 20 aa, Staphylococcus
ERIVRVAFNLAQQRKKKLTS

SEQ ID NO: 2009865 - protein, 24 aa, Staphylococcus
ERKAEPRLGELVTVRIIGHNERGE

SEQ ID NO: 2009866 - protein, 19 aa, Staphylococcus
ERKATWDSWMAKDMADSSS

SEQ ID NO: 2009867 - protein, 23 aa, Staphylococcus
ERKEGIKRLGVVRADIDNLGATF

SEQ ID NO: 2009868 - protein, 21 aa, Staphylococcus
ERKGLKIVGGKFIIPTKDTVN

SEQ ID NO: 2009869 - protein, 19 aa, Staphylococcus
ERKGLKLVGGKFMTVPQSL

SEQ ID NO: 2009870 - protein, 24 aa, Staphylococcus
ERKKAIDIANAMLKDGYKESDVIP

SEQ ID NO: 2009871 - protein, 25 aa, Staphylococcus
ERKKAIDIGNAMLKDGYDEHDVIPI

SEQ ID NO: 2009872 - protein, 25 aa, Staphylococcus
ERKKAIDIGNAMLKDGYEESNVIPI

SEQ ID NO: 2009873 - protein, 25 aa, Staphylococcus
ERKKAIDIGNAMLKDGYKEGDVIPI

SEQ ID NO: 2009874 - protein, 31 aa, Staphylococcus
ERKKTGLSYKEKREYESLMSRIEETEIRLSE

SEQ ID NO: 2009875 - protein, 21 aa, Staphylococcus
ERKLTEMGIYPAVDPLASTSR

SEQ ID NO: 2009876 - protein, 17 aa, Staphylococcus
ERKPHLFNGTPQKHVFD

SEQ ID NO: 2009877 - protein, 21 aa, Staphylococcus
ERKSFQRYGVSYIPMDETLSR

SEQ ID NO: 2009878 - protein, 25 aa, Staphylococcus
ERKTHFPINLLIKLNNEIEEYLTTI

SEQ ID NO: 2009879 - protein, 20 aa, Staphylococcus
ERKYYLLNVHNNFLLNDDHM

SEQ ID NO: 2009880 - protein, 21 aa, Staphylococcus
ERLAEILDEFLSADKYVFVSP

SEQ ID NO: 2009881 - protein, 18 aa, Staphylococcus
ERLAHAISQGLTRFDTIV

SEQ ID NO: 2009882 - protein, 17 aa, Staphylococcus
ERLEFLGDAVLELTVSR

SEQ ID NO: 2009883 - protein, 18 aa, Staphylococcus
ERLEIPASITGVNFYRKR

SEQ ID NO: 2009884 - protein, 26 aa, Staphylococcus
ERLEKLRTAIPNVLFQMLLRASNAVG

SEQ ID NO: 2009885 - protein, 21 aa, Staphylococcus
ERLERAWNKLIHSHGMMRAII

SEQ ID NO: 2009886 - protein, 18 aa, Staphylococcus
ERLFKKGLMKRYKLLLNK

SEQ ID NO: 2009887 - protein, 23 aa, Staphylococcus
ERLFKYSPELVYSAWTDINLLKQ

SEQ ID NO: 2009888 - protein, 32 aa, Staphylococcus
ERLGFPEARIPLSQAVIELCLSPKSNSAITAV

SEQ ID NO: 2009889 - protein, 22 aa, Staphylococcus
ERLGRLKPVFPEGTVTVGNACP

SEQ ID NO: 2009890 - protein, 18 aa, Staphylococcus
ERLIPYFMHHNYWFLFYH

SEQ ID NO: 2009891 - protein, 22 aa, Staphylococcus
ERLKECQSALALLQQELDVDAL

SEQ ID NO: 2009892 - protein, 23 aa, Staphylococcus
ERLKGGFSGWYSRRITQDHRLVY

SEQ ID NO: 2009893 - protein, 24 aa, Staphylococcus
ERLKIAKQLEHWGVDVIEAGFPAS

SEQ ID NO: 2009894 - protein, 17 aa, Staphylococcus
ERLKMLASKSAGLDTTR

SEQ ID NO: 2009895 - protein, 23 aa, Staphylococcus
ERLKSKMKAAFVDKAVALNDIAD

SEQ ID NO: 2009896 - protein, 27 aa, Staphylococcus
ERLLKDYKVILVHPWQYEHTIRNKYKE

SEQ ID NO: 2009897 - protein, 17 aa, Staphylococcus
ERLNLGRKLGFELETAK

SEQ ID NO: 2009898 - protein, 17 aa, Staphylococcus
ERLNLGRKLGFELSTAK

SEQ ID NO: 2009899 - protein, 19 aa, Staphylococcus
ERLQLDYIDLVLIHQPYND

SEQ ID NO: 2009900 - protein, 17 aa, Staphylococcus
ERLRAGYEDAVYYNRYV

SEQ ID NO: 2009901 - protein, 18 aa, Staphylococcus
ERLSYRIFQELGGLTETR

SEQ ID NO: 2009902 - protein, 19 aa, Staphylococcus
ERLSYRVFQEVGGLMEQQL

SEQ ID NO: 2009903 - protein, 19 aa, Staphylococcus
ERLSYRVFQEVGGLTEERL

SEQ ID NO: 2009904 - protein, 24 aa, Staphylococcus
ERLVEMRRFILSSSYEQRVEALNN

SEQ ID NO: 2009905 - protein, 24 aa, Staphylococcus
ERLYEAGIPITMFGVKDVQQTYET

SEQ ID NO: 2009906 - protein, 26 aa, Staphylococcus
ERLYSGLKKGGAILMAKSELGPYREF

SEQ ID NO: 2009907 - protein, 19 aa, Staphylococcus
ERMADKVIFLDQGIIKLND

SEQ ID NO: 2009908 - protein, 24 aa, Staphylococcus
ERMFKKGNLQFMILNSLKEEPKHG

SEQ ID NO: 2009909 - protein, 18 aa, Staphylococcus
ERMYDFLDKLIAVSLPRV

SEQ ID NO: 2009910 - protein, 19 aa, Staphylococcus
ERMYEFLDKLISVSLPRVR

SEQ ID NO: 2009911 - protein, 18 aa, Staphylococcus
ERNEKRTKDEIGIHAVRG

SEQ ID NO: 2009912 - protein, 19 aa, Staphylococcus
ERNFKEFLSNYLPAQSGDM

SEQ ID NO: 2009913 - protein, 19 aa, Staphylococcus
ERNFKEFLSQYLPAQSGDM

SEQ ID NO: 2009914 - protein, 19 aa, Staphylococcus
ERNFKEFLSQYLPAQSGEM

SEQ ID NO: 2009915 - protein, 19 aa, Staphylococcus
ERNGHLYGRGAADMKSGLA

SEQ ID NO: 2009916 - protein, 17 aa, Staphylococcus
ERNIEFIAASGNQFAKL

SEQ ID NO: 2009917 - protein, 18 aa, Staphylococcus
ERNMKLEFERNYERYQFL

SEQ ID NO: 2009918 - protein, 21 aa, Staphylococcus
ERPDVIVSPHIAFYTDAAVEN

SEQ ID NO: 2009919 - protein, 22 aa, Staphylococcus
ERPESLFNYFKQLFAQVTNPPI

SEQ ID NO: 2009920 - protein, 18 aa, Staphylococcus
ERPETALLSGYHSAKPVG

SEQ ID NO: 2009921 - protein, 24 aa, Staphylococcus
ERPIKIGLATLVDRGHRELPIRAD

SEQ ID NO: 2009922 - protein, 25 aa, Staphylococcus
ERPKGKFRFPMNISDNEVQDDISST

SEQ ID NO: 2009923 - protein, 19 aa, Staphylococcus
ERQLCFLFYVSSKEIIKKY

SEQ ID NO: 2009924 - protein, 17 aa, Staphylococcus
ERQMLGQMINQVHQQQQ

SEQ ID NO: 2009925 - protein, 25 aa, Staphylococcus
ERQPIRVILDKSGSLSFQENIFHDQ

SEQ ID NO: 2009926 - protein, 25 aa, Staphylococcus
ERQRAGWSQVKMKAVLHNQAIANVV

SEQ ID NO: 2009927 - protein, 19 aa, Staphylococcus
ERQSCVIIQSITSYLNNNT

SEQ ID NO: 2009928 - protein, 21 aa, Staphylococcus
ERRINIIPCEYYVEKADTSLI

SEQ ID NO: 2009929 - protein, 25 aa, Staphylococcus
ERRNRSKVRLALKRGTKVERAGREQ

SEQ ID NO: 2009930 - protein, 19 aa, Staphylococcus
ERRQESKETIEFLSNVQNI

SEQ ID NO: 2009931 - protein, 18 aa, Staphylococcus
ERRSKYILFHIETNDDQR

SEQ ID NO: 2009932 - protein, 21 aa, Staphylococcus
ERSAAFFAMGLMKGSEKPVAI

SEQ ID NO: 2009933 - protein, 18 aa, Staphylococcus
ERSAGRFDELHVCVLKNS

SEQ ID NO: 2009934 - protein, 23 aa, Staphylococcus
ERSASFFALGLIKGSNRPVAILC

SEQ ID NO: 2009935 - protein, 22 aa, Staphylococcus
ERSFRMGEVIYLEYNNEAITNM

SEQ ID NO: 2009936 - protein, 24 aa, Staphylococcus
ERSFWQHDHHIFALRNDFTDQLLR

SEQ ID NO: 2009937 - protein, 21 aa, Staphylococcus
ERSGNVFRIGDSVKIKVVNVD

SEQ ID NO: 2009938 - protein, 19 aa, Staphylococcus
ERSKYRFKKDRVMHQIGDM

SEQ ID NO: 2009939 - protein, 27 aa, Staphylococcus
ERSLLYEEMKHYFILNFPQRPGALKEF

SEQ ID NO: 2009940 - protein, 28 aa, Staphylococcus
ERSLLYEEMKHYFILNFPQRPGALKEFV

SEQ ID NO: 2009941 - protein, 38 aa, Staphylococcus
ERSLLYEEMKHYFILNFPQRPGALREFVNDVLGPQDDI

SEQ ID NO: 2009942 - protein, 19 aa, Staphylococcus
ERSYCPGKFDLSINDKKFA

SEQ ID NO: 2009943 - protein, 21 aa, Staphylococcus
ERTAIFDLYFRNMPFNSGYAV

SEQ ID NO: 2009944 - protein, 23 aa, Staphylococcus
ERTEGYEGFYHLMKIEGTVEKAS

SEQ ID NO: 2009945 - protein, 23 aa, Staphylococcus
ERTEGYEGFYHLMNFEGNVEKAT

SEQ ID NO: 2009946 - protein, 23 aa, Staphylococcus
ERTEGYEGFYHLMSFEGNVEKAT

SEQ ID NO: 2009947 - protein, 25 aa, Staphylococcus
ERTIKRYYICSLFNRSGSSACHSNS

SEQ ID NO: 2009948 - protein, 19 aa, Staphylococcus
ERTKIQLLAPVVSHRKGTH

SEQ ID NO: 2009949 - protein, 27 aa, Staphylococcus
ERTLYDWACKQTYIALGNMMTSAALLG

SEQ ID NO: 2009950 - protein, 24 aa, Staphylococcus
ERTPRGRKATAFAYEHFMKSKEKR

SEQ ID NO: 2009951 - protein, 24 aa, Staphylococcus
ERTPRGRKATPFAYEHFNNTNEKR

SEQ ID NO: 2009952 - protein, 18 aa, Staphylococcus
ERTVLHFHPAIAPYKAAV

SEQ ID NO: 2009953 - protein, 24 aa, Staphylococcus
ERTWLKRRIETPYKADLNKNQKIN

SEQ ID NO: 2009954 - protein, 24 aa, Staphylococcus
ERTWLKRRIETPYKATINSDEKIN

SEQ ID NO: 2009955 - protein, 24 aa, Staphylococcus
ERTWLKRRIETPYKATLNHDQKRH

SEQ ID NO: 2009956 - protein, 24 aa, Staphylococcus
ERTWLKRRIETPYRANINNDERKK

SEQ ID NO: 2009957 - protein, 24 aa, Staphylococcus
ERVEDGKITLKELGDLNIKNDTVN

SEQ ID NO: 2009958 - protein, 17 aa, Staphylococcus
ERVEGFATTDEWQRAYG

SEQ ID NO: 2009959 - protein, 29 aa, Staphylococcus
ERVEPPCIYYYKCGGCQLQHLAYDAQLEM

SEQ ID NO: 2009960 - protein, 18 aa, Staphylococcus
ERVGKIKLGNGFDSDTEM

SEQ ID NO: 2009961 - protein, 19 aa, Staphylococcus
ERVHLKFLSSLPVGGLGLD

SEQ ID NO: 2009962 - protein, 27 aa, Staphylococcus
ERVKFWIIKLLELHTLKKAYKTEANKL

SEQ ID NO: 2009963 - protein, 18 aa, Staphylococcus
ERVKVALTKVFLSEVNTL

SEQ ID NO: 2009964 - protein, 19 aa, Staphylococcus
ERVLKPGGMIVCLETSQPT

SEQ ID NO: 2009965 - protein, 19 aa, Staphylococcus
ERVSKRLGINRWKDNVRQV

SEQ ID NO: 2009966 - protein, 24 aa, Staphylococcus
ERVWLKRRIETPYKANLNNNQKKE

SEQ ID NO: 2009967 - protein, 24 aa, Staphylococcus
ERVWLKRRIETPYKATLNDNQKIE

SEQ ID NO: 2009968 - protein, 24 aa, Staphylococcus
ERVWLKRRIETPYKATLNNKQKTE

SEQ ID NO: 2009969 - protein, 17 aa, Staphylococcus
ERYAFTLLYQNLKGKII

SEQ ID NO: 2009970 - protein, 26 aa, Staphylococcus
ERYAPEFEKVIPLKVMLIKKEDAIAT

SEQ ID NO: 2009971 - protein, 17 aa, Staphylococcus
ERYGLFINNEFQQSETG

SEQ ID NO: 2009972 - protein, 20 aa, Staphylococcus
ERYHYMIARKYHFMGYRQMK

SEQ ID NO: 2009973 - protein, 25 aa, Staphylococcus
ERYISQRSNYEFNRLQYQIIDMLSK

SEQ ID NO: 2009974 - protein, 18 aa, Staphylococcus
ERYKEDKVVFIIDECHRT

SEQ ID NO: 2009975 - protein, 25 aa, Staphylococcus
ERYPKAIKPWILPNFESLVNHEKIT

SEQ ID NO: 2009976 - protein, 23 aa, Staphylococcus
ERYQKAREGVQYSFHNDVVPFTK

SEQ ID NO: 2009977 - protein, 25 aa, Staphylococcus
ESAEIIKKLFLLGIVANINQSLDED

SEQ ID NO: 2009978 - protein, 19 aa, Staphylococcus
ESAKISRFMDIVRATSGTT

SEQ ID NO: 2009979 - protein, 20 aa, Staphylococcus
ESARIGIPNKGEWTEKHLRY

SEQ ID NO: 2009980 - protein, 17 aa, Staphylococcus
ESARLLCKLKTDLLQSV

SEQ ID NO: 2009981 - protein, 17 aa, Staphylococcus
ESAWTRLHIVDAVKEAT

SEQ ID NO: 2009982 - protein, 25 aa, Staphylococcus
ESDDRKLRESAFRNVYKAYGSHNNT

SEQ ID NO: 2009983 - protein, 25 aa, Staphylococcus
ESDDWSEIYALYLLEAYQRHMIGYA

SEQ ID NO: 2009984 - protein, 22 aa, Staphylococcus
ESDEVILAWGAYAKKPVVEARV

SEQ ID NO: 2009985 - protein, 19 aa, Staphylococcus
ESDFGLAFDGDGDRLIAVD

SEQ ID NO: 2009986 - protein, 21 aa, Staphylococcus
ESDFKGVPNDLVWTDKWQAKL

SEQ ID NO: 2009987 - protein, 21 aa, Staphylococcus
ESDIWYQNIVMNFDPSIFDLL

SEQ ID NO: 2009988 - protein, 18 aa, Staphylococcus
ESDKVLQMYEIKSEQVVE

SEQ ID NO: 2009989 - protein, 21 aa, Staphylococcus
ESDRSLWDWASKQTYIALGNM

SEQ ID NO: 2009990 - protein, 20 aa, Staphylococcus
ESDVLFKYVENILNQNQSSL

SEQ ID NO: 2009991 - protein, 18 aa, Staphylococcus
ESEDVFLGWEAVQGEEPL

SEQ ID NO: 2009992 - protein, 23 aa, Staphylococcus
ESEEMPALGFAPDAEFPAIHGEK

SEQ ID NO: 2009993 - protein, 20 aa, Staphylococcus
ESEGPVFKGIKFFSMPEKDI

SEQ ID NO: 2009994 - protein, 22 aa, Staphylococcus
ESEGYNLTFFAFFVKAVAEGLK

SEQ ID NO: 2009995 - protein, 24 aa, Staphylococcus
ESEKEIKKDVIIVGFDDSYWNEIY

SEQ ID NO: 2009996 - protein, 22 aa, Staphylococcus
ESELLVEVLILISVDSLNESER

SEQ ID NO: 2009997 - protein, 23 aa, Staphylococcus
ESERLRFDFSHFGPMTEEEIDQV

SEQ ID NO: 2009998 - protein, 23 aa, Staphylococcus
ESERLRFDFSHFGPMTNEEIEHV

SEQ ID NO: 2009999 - protein, 23 aa, Staphylococcus
ESERLRFDFSHFGPMTQDEIDQV

SEQ ID NO: 2010000 - protein, 19 aa, Staphylococcus
ESEVPKQAISMGLQSIIKA

SEQ ID NO: 2010001 - protein, 25 aa, Staphylococcus
ESEYATKIQQGWFDFDVVVATPDMM

SEQ ID NO: 2010002 - protein, 21 aa, Staphylococcus
ESFDLSCYLTLLDVLDSHNID

SEQ ID NO: 2010003 - protein, 22 aa, Staphylococcus
ESFDNLPTVVGFFPNIVEGDVY

SEQ ID NO: 2010004 - protein, 20 aa, Staphylococcus
ESFDSMPTVVGFLPNVVEGD

SEQ ID NO: 2010005 - protein, 21 aa, Staphylococcus
ESFEGVKRGRIINKQDLTIEG

SEQ ID NO: 2010006 - protein, 23 aa, Staphylococcus
ESFEGVKRGRIVTKQDLTIEGHD

SEQ ID NO: 2010007 - protein, 23 aa, Staphylococcus
ESFEGVKRGRIVTKQDLTIEGYD

SEQ ID NO: 2010008 - protein, 23 aa, Staphylococcus
ESFEGVKRGRIVTNQDLTIAGHD

SEQ ID NO: 2010009 - protein, 21 aa, Staphylococcus
ESFELRKKKLLEIRDDINVHY

SEQ ID NO: 2010010 - protein, 20 aa, Staphylococcus
ESFEPGDCVVVLPQNEPEIV

SEQ ID NO: 2010011 - protein, 19 aa, Staphylococcus
ESFFRRFDDLSFNHEIENV

SEQ ID NO: 2010012 - protein, 20 aa, Staphylococcus
ESFIKELLQLLQFISDLNMH

SEQ ID NO: 2010013 - protein, 18 aa, Staphylococcus
ESFKEAIVNFYERQYDVT

SEQ ID NO: 2010014 - protein, 19 aa, Staphylococcus
ESFKEAIVNFYQRQYGVEL

SEQ ID NO: 2010015 - protein, 18 aa, Staphylococcus
ESFKEAIVNFYQRQYNVT

SEQ ID NO: 2010016 - protein, 22 aa, Staphylococcus
ESFKLGIVLCYLKQYEASQKIL

SEQ ID NO: 2010017 - protein, 20 aa, Staphylococcus
ESFNEALRSYGLNVKTGEFG

SEQ ID NO: 2010018 - protein, 25 aa, Staphylococcus
ESFQFSVALATVWKLISRTNKYIDE

SEQ ID NO: 2010019 - protein, 25 aa, Staphylococcus
ESFQFSVALSTVWKLISRTNKYIDE

SEQ ID NO: 2010020 - protein, 23 aa, Staphylococcus
ESFRILKEQPKVIWLDCDIEILY

SEQ ID NO: 2010021 - protein, 20 aa, Staphylococcus
ESFTDFKMGIQIRHYTVQAI

SEQ ID NO: 2010022 - protein, 18 aa, Staphylococcus
ESGAEFFFDGIHDGTLYV

SEQ ID NO: 2010023 - protein, 17 aa, Staphylococcus
ESGAKYFVVDPVMVCKG

SEQ ID NO: 2010024 - protein, 23 aa, Staphylococcus
ESGCGKSSAGRSILRLQKPSEGT

SEQ ID NO: 2010025 - protein, 22 aa, Staphylococcus
ESGCGKSTTGKAIIKLNDITDG

SEQ ID NO: 2010026 - protein, 22 aa, Staphylococcus
ESGCGKSTTGKAIIKLNDITSG

SEQ ID NO: 2010027 - protein, 20 aa, Staphylococcus
ESGCGKSTTGKAIIKLNEIT

SEQ ID NO: 2010028 - protein, 19 aa, Staphylococcus
ESGCGKSTTGKALIKLNDA

SEQ ID NO: 2010029 - protein, 19 aa, Staphylococcus
ESGFAMPMLLAMSHVHQCL

SEQ ID NO: 2010030 - protein, 33 aa, Staphylococcus
ESGKFVSLLGASGCGKTTLLRLIAGLETPDSGS

SEQ ID NO: 2010031 - protein, 17 aa, Staphylococcus
ESGNGFIGQSFMKYDGF

SEQ ID NO: 2010032 - protein, 18 aa, Staphylococcus
ESGPILGFNGNVLGTSDY

SEQ ID NO: 2010033 - protein, 20 aa, Staphylococcus
ESGSIFGVIGFSGAGKSTLI

SEQ ID NO: 2010034 - protein, 21 aa, Staphylococcus
ESGSIFGVIGFSGAGKSTLIR

SEQ ID NO: 2010035 - protein, 17 aa, Staphylococcus
ESGTGAGVRRIEAFTGK

SEQ ID NO: 2010036 - protein, 29 aa, Staphylococcus
ESGVKRDDIVFCSSLTFSASANPIIYQGA

SEQ ID NO: 2010037 - protein, 17 aa, Staphylococcus
ESHKLAMVLVQFPPWFD

SEQ ID NO: 2010038 - protein, 23 aa, Staphylococcus
ESHKRFGGVVPEIASRHHVEGIT

SEQ ID NO: 2010039 - protein, 25 aa, Staphylococcus
ESHLLSLPGWAGMMYYRAEKNEFEK

SEQ ID NO: 2010040 - protein, 24 aa, Staphylococcus
ESIAAFVEHIVKFITNEQLSYVQY

SEQ ID NO: 2010041 - protein, 17 aa, Staphylococcus
ESIEVFGKGKKRHVPED

SEQ ID NO: 2010042 - protein, 17 aa, Staphylococcus
ESIFVQLGFETTKNKDV

SEQ ID NO: 2010043 - protein, 17 aa, Staphylococcus
ESIHFLAREYKIEDVSS

SEQ ID NO: 2010044 - protein, 23 aa, Staphylococcus
ESIHLLPFNVFFVPARGGLGENM

SEQ ID NO: 2010045 - protein, 23 aa, Staphylococcus
ESIILTCRLENFINFNTKKFEVS

SEQ ID NO: 2010046 - protein, 21 aa, Staphylococcus
ESIINYPKKHYVFGVDKNERT

SEQ ID NO: 2010047 - protein, 17 aa, Staphylococcus
ESIKFNANMFHNYANNH

SEQ ID NO: 2010048 - protein, 19 aa, Staphylococcus
ESILLVLSIVDYVLVMTVN

SEQ ID NO: 2010049 - protein, 20 aa, Staphylococcus
ESILTNRLGKLFYELITNDI

SEQ ID NO: 2010050 - protein, 23 aa, Staphylococcus
ESITEGTIAEWLKNPGDSVDKGE

SEQ ID NO: 2010051 - protein, 23 aa, Staphylococcus
ESITEGTIAEWLKNVGDSVDKGE

SEQ ID NO: 2010052 - protein, 23 aa, Staphylococcus
ESITEGTVAEWLKNIGDNVEKGE

SEQ ID NO: 2010053 - protein, 23 aa, Staphylococcus
ESITPYEGGIGFAAKPLIEDEFI

SEQ ID NO: 2010054 - protein, 18 aa, Staphylococcus
ESIYGGAFEDEFSLEAFN

SEQ ID NO: 2010055 - protein, 19 aa, Staphylococcus
ESKEFIFAVAGGKSKGQAI

SEQ ID NO: 2010056 - protein, 18 aa, Staphylococcus
ESKIIVEAVTAYLESHTS

SEQ ID NO: 2010057 - protein, 24 aa, Staphylococcus
ESKIKTILHGLNFTETDFDRPIND

SEQ ID NO: 2010058 - protein, 24 aa, Staphylococcus
ESKIKTVLHGLDFSEDDFHRPVND

SEQ ID NO: 2010059 - protein, 24 aa, Staphylococcus
ESKIKTVLHGLNFNEDDFDKPIND

SEQ ID NO: 2010060 - protein, 24 aa, Staphylococcus
ESKIKTVLHGLNFTEEEFDKPIND

SEQ ID NO: 2010061 - protein, 24 aa, Staphylococcus
ESKIKTVLHGLNFTESDFNKPIND

SEQ ID NO: 2010062 - protein, 24 aa, Staphylococcus
ESKIKTVLHGLNFTESDFNRPIND

SEQ ID NO: 2010063 - protein, 22 aa, Staphylococcus
ESKIQIGEKLTRGLGAGANPEI

SEQ ID NO: 2010064 - protein, 24 aa, Staphylococcus
ESKKVFEQMMNWFKYEIRQYTESD

SEQ ID NO: 2010065 - protein, 21 aa, Staphylococcus
ESKLFAIQLIFQYLFSQGRLP

SEQ ID NO: 2010066 - protein, 23 aa, Staphylococcus
ESKLMMEKMMHWSHNAYGVNYAA

SEQ ID NO: 2010067 - protein, 20 aa, Staphylococcus
ESKNYFGYDRDHVHFFMQDN

SEQ ID NO: 2010068 - protein, 27 aa, Staphylococcus
ESKRRISIYPFVWWFATKPSYDGKGIG

SEQ ID NO: 2010069 - protein, 20 aa, Staphylococcus
ESKSSGFDWFKRKSNKKENH

SEQ ID NO: 2010070 - protein, 26 aa, Staphylococcus
ESLAKVVVESECDFGLAFDGDGDRLI

SEQ ID NO: 2010071 - protein, 34 aa, Staphylococcus
ESLCEQFDDFSCRIGMPFLRSPHVHHVHPDPFHL

SEQ ID NO: 2010072 - protein, 17 aa, Staphylococcus
ESLEWLKDQEVALVGVG

SEQ ID NO: 2010073 - protein, 25 aa, Staphylococcus
ESLFEHLKDLFLEETFEEDQSAFSI

SEQ ID NO: 2010074 - protein, 19 aa, Staphylococcus
ESLFGGSIPNFGQNNDDEE

SEQ ID NO: 2010075 - protein, 18 aa, Staphylococcus
ESLFKSVLERANIETELL

SEQ ID NO: 2010076 - protein, 18 aa, Staphylococcus
ESLFKYADRVIELYDGKI

SEQ ID NO: 2010077 - protein, 24 aa, Staphylococcus
ESLGARKGEMLDMLTTDNGLTRLI

SEQ ID NO: 2010078 - protein, 21 aa, Staphylococcus
ESLGARKGEMLDMSTTDNGLT

SEQ ID NO: 2010079 - protein, 19 aa, Staphylococcus
ESLGARKGEMVDMTTTDNG

SEQ ID NO: 2010080 - protein, 24 aa, Staphylococcus
ESLGQRKGEMLDMVTTDNGLTRII

SEQ ID NO: 2010081 - protein, 24 aa, Staphylococcus
ESLGQRKGEMLDMVTTDNGLTRLI

SEQ ID NO: 2010082 - protein, 19 aa, Staphylococcus
ESLIPMPRDKFLAEVQDAI

SEQ ID NO: 2010083 - protein, 20 aa, Staphylococcus
ESLISYAAEHHPAYLKSYSE

SEQ ID NO: 2010084 - protein, 17 aa, Staphylococcus
ESLKFNYEFDKKQLILY

SEQ ID NO: 2010085 - protein, 17 aa, Staphylococcus
ESLKGFHKIEVWQVNNE

SEQ ID NO: 2010086 - protein, 25 aa, Staphylococcus
ESLKRVKVQPGEFYFIPAGTIHSIG

SEQ ID NO: 2010087 - protein, 20 aa, Staphylococcus
ESLLMKANHPTVKKDGLRVT

SEQ ID NO: 2010088 - protein, 24 aa, Staphylococcus
ESLLRALKDNGLEVIETEGQTFDP

SEQ ID NO: 2010089 - protein, 26 aa, Staphylococcus
ESLPVYKPTLPPMVFGARDKKVKGGQ

SEQ ID NO: 2010090 - protein, 20 aa, Staphylococcus
ESLPVYKPTLPPMVFGTKDK

SEQ ID NO: 2010091 - protein, 26 aa, Staphylococcus
ESLPVYKPTLPPMVFGTRDKKVKGGQ

SEQ ID NO: 2010092 - protein, 25 aa, Staphylococcus
ESLPVYKPTLPPMVFGTRDKQVKGG

SEQ ID NO: 2010093 - protein, 26 aa, Staphylococcus
ESLPVYKPTLPPMVFGTRDKQVKGGQ

SEQ ID NO: 2010094 - protein, 24 aa, Staphylococcus
ESLRERICDAALQLMNNVGYVNAG

SEQ ID NO: 2010095 - protein, 24 aa, Staphylococcus
ESLRERIDYFYGLCSTDDPYVPYK

SEQ ID NO: 2010096 - protein, 25 aa, Staphylococcus
ESLRQIKGGFTFAILTEDALYGAVD

SEQ ID NO: 2010097 - protein, 25 aa, Staphylococcus
ESLRQIKGGFTFAILTKDALYGAVD

SEQ ID NO: 2010098 - protein, 25 aa, Staphylococcus
ESLRQIKGGFTFAILTKDALYGVVD

SEQ ID NO: 2010099 - protein, 25 aa, Staphylococcus
ESLRQIKGGFTFAVLTKDALYGAVD

SEQ ID NO: 2010100 - protein, 24 aa, Staphylococcus
ESLRQIKGGFTFTILTKDALYGAV

SEQ ID NO: 2010101 - protein, 24 aa, Staphylococcus
ESLSAKENLIFFGHLAGIKGKQLI

SEQ ID NO: 2010102 - protein, 23 aa, Staphylococcus
ESLSARENLVFFGNLMGLKGKEL

SEQ ID NO: 2010103 - protein, 20 aa, Staphylococcus
ESLSIPPVSIFSDFTLEEFA

SEQ ID NO: 2010104 - protein, 25 aa, Staphylococcus
ESLTLKRLHCREMDTLAFDYKAQHP

SEQ ID NO: 2010105 - protein, 27 aa, Staphylococcus
ESMKQVAMDFAKLILCQNNQQCELKVA

SEQ ID NO: 2010106 - protein, 31 aa, Staphylococcus
ESMNLVHKIYELWNIPIIFVTHSNEEAHTLA

SEQ ID NO: 2010107 - protein, 18 aa, Staphylococcus
ESMWFKKDGKFIYVTYKA

SEQ ID NO: 2010108 - protein, 17 aa, Staphylococcus
ESNCEVIALDATKQTRP

SEQ ID NO: 2010109 - protein, 26 aa, Staphylococcus
ESNDAWSRSQLQDWIKEDLVKVNDKV

SEQ ID NO: 2010110 - protein, 25 aa, Staphylococcus
ESNDLLGRIEFKIMKTPKAVKIENV

SEQ ID NO: 2010111 - protein, 18 aa, Staphylococcus
ESNFKHTVMMGVGGSLEV

SEQ ID NO: 2010112 - protein, 36 aa, Staphylococcus
ESNHDVDMLRMCRYPWKTKQRILSDMGHVSNEDAGH

SEQ ID NO: 2010113 - protein, 25 aa, Staphylococcus
ESNIKHLVERGMDGLVIGRLIENPE

SEQ ID NO: 2010114 - protein, 24 aa, Staphylococcus
ESNIKLIYWLKGTGKVFINLKEYE

SEQ ID NO: 2010115 - protein, 19 aa, Staphylococcus
ESNLSALSFEYLKSHDALG

SEQ ID NO: 2010116 - protein, 19 aa, Staphylococcus
ESNLSYPSLSSVTYKAIAE

SEQ ID NO: 2010117 - protein, 18 aa, Staphylococcus
ESNYFLKLLSQIDINLIA

SEQ ID NO: 2010118 - protein, 19 aa, Staphylococcus
ESPDFGRIVNQKHFNRLNE

SEQ ID NO: 2010119 - protein, 18 aa, Staphylococcus
ESPGLYPFMSGYDNLKLF

SEQ ID NO: 2010120 - protein, 24 aa, Staphylococcus
ESPMAKALIGKSLKDEVRVPLPNG

SEQ ID NO: 2010121 - protein, 19 aa, Staphylococcus
ESPMAKSLIGKKLDDEVRV

SEQ ID NO: 2010122 - protein, 24 aa, Staphylococcus
ESPMANALIGKGLNDEVRVPLPNG

SEQ ID NO: 2010123 - protein, 19 aa, Staphylococcus
ESPQAFYFVDGKVKWHASH

SEQ ID NO: 2010124 - protein, 21 aa, Staphylococcus
ESPQAFYFVKGQAIWNASHSD

SEQ ID NO: 2010125 - protein, 24 aa, Staphylococcus
ESPRIGVPNKGEWTHKPLRFTVEG

SEQ ID NO: 2010126 - protein, 22 aa, Staphylococcus
ESQDWASMLLRMYQRYAEQQGF

SEQ ID NO: 2010127 - protein, 30 aa, Staphylococcus
ESQDWASMLLRMYQRYCEQNGFKVETVDYL

SEQ ID NO: 2010128 - protein, 25 aa, Staphylococcus
ESQIKRIGFDYLFIDNAHLEQPYLL

SEQ ID NO: 2010129 - protein, 24 aa, Staphylococcus
ESQIKRINFEFLYIDNAQLKMPYL

SEQ ID NO: 2010130 - protein, 25 aa, Staphylococcus
ESQIKRLKFEYLFIDNAKLKTSYLI

SEQ ID NO: 2010131 - protein, 24 aa, Staphylococcus
ESQIKRVNFQFLFIDNSKLNQPYL

SEQ ID NO: 2010132 - protein, 22 aa, Staphylococcus
ESQKVLFMPTWQRGLQYLTTAQ

SEQ ID NO: 2010133 - protein, 27 aa, Staphylococcus
ESQLKKRLKVGDIMKLPTVEQLSQHIM

SEQ ID NO: 2010134 - protein, 20 aa, Staphylococcus
ESQLPIYFLKQALRSLGYMG

SEQ ID NO: 2010135 - protein, 23 aa, Staphylococcus
ESQWEAMLLGWKVVSSVKSNAVI

SEQ ID NO: 2010136 - protein, 18 aa, Staphylococcus
ESQWKESYQYLRNLIFDE

SEQ ID NO: 2010137 - protein, 25 aa, Staphylococcus
ESRKEEGVLFYSHYEDVQDRNIFIV

SEQ ID NO: 2010138 - protein, 25 aa, Staphylococcus
ESRVDYKGTTTYGFTGAGSDMEGFI

SEQ ID NO: 2010139 - protein, 20 aa, Staphylococcus
ESRVKTFKVGGLFNKKKKTE

SEQ ID NO: 2010140 - protein, 23 aa, Staphylococcus
ESSEWYNAAYLIMWGSNVPLTRT

SEQ ID NO: 2010141 - protein, 19 aa, Staphylococcus
ESSFELSLRPHFLKQYIGQ

SEQ ID NO: 2010142 - protein, 19 aa, Staphylococcus
ESSKMCLFEPRVFSDTQDI

SEQ ID NO: 2010143 - protein, 18 aa, Staphylococcus
ESSLKYINEHGGMVIYLP

SEQ ID NO: 2010144 - protein, 31 aa, Staphylococcus
ESSNLKDALPLLEEKLKFLLIPKDPNDDKDV

SEQ ID NO: 2010145 - protein, 28 aa, Staphylococcus
ESSNYEVCILKMQLLIWITETDTGDIQE

SEQ ID NO: 2010146 - protein, 24 aa, Staphylococcus
ESSQFYQARLSRIEVEKLLLYDDF

SEQ ID NO: 2010147 - protein, 23 aa, Staphylococcus
ESSTIKQGHAYRNHESHNDIDSK

SEQ ID NO: 2010148 - protein, 20 aa, Staphylococcus
ESSVALSIFKRTQEILEEHQ

SEQ ID NO: 2010149 - protein, 22 aa, Staphylococcus
ESSYKIHVHTGVNQGLIGDIRD

SEQ ID NO: 2010150 - protein, 17 aa, Staphylococcus
ESTDVPVIFGILTTESI

SEQ ID NO: 2010151 - protein, 28 aa, Staphylococcus
ESTISVNINHHFIKSFPIFSSLINSEYG

SEQ ID NO: 2010152 - protein, 19 aa, Staphylococcus
ESTLNLKVVIFDDDDYEFA

SEQ ID NO: 2010153 - protein, 17 aa, Staphylococcus
ESTRGGADVVIDCVGMD

SEQ ID NO: 2010154 - protein, 30 aa, Staphylococcus
ESTVLDCTRFPFKIARPGSITKSMIEAVIP

SEQ ID NO: 2010155 - protein, 18 aa, Staphylococcus
ESVFARFISSIKAERVNA

SEQ ID NO: 2010156 - protein, 19 aa, Staphylococcus
ESVFARFISSIKEERVKAS

SEQ ID NO: 2010157 - protein, 18 aa, Staphylococcus
ESVFARFISSMKEERIEA

SEQ ID NO: 2010158 - protein, 24 aa, Staphylococcus
ESVFPEFDIPFNIDTKKSMTHHPV

SEQ ID NO: 2010159 - protein, 17 aa, Staphylococcus
ESVICAPTIQLDALVTL

SEQ ID NO: 2010160 - protein, 18 aa, Staphylococcus
ESVKQSLKNLGVDELDLY

SEQ ID NO: 2010161 - protein, 18 aa, Staphylococcus
ESVKWLNKKLHSHGKSLK

SEQ ID NO: 2010162 - protein, 17 aa, Staphylococcus
ESVLGYHPLFIKPNKDE

SEQ ID NO: 2010163 - protein, 20 aa, Staphylococcus
ESVPEIADRYIKAFYEDVGA

SEQ ID NO: 2010164 - protein, 20 aa, Staphylococcus
ESVPEIADRYIQAFYEDTGA

SEQ ID NO: 2010165 - protein, 19 aa, Staphylococcus
ESVRSDGKAFYRLTVNVDS

SEQ ID NO: 2010166 - protein, 21 aa, Staphylococcus
ESVSLDFTLPLSFLDGVTAGK

SEQ ID NO: 2010167 - protein, 19 aa, Staphylococcus
ESVSLKFDKVQEFKKSVVN

SEQ ID NO: 2010168 - protein, 19 aa, Staphylococcus
ESVSLKFDKVQEFKQSVVK

SEQ ID NO: 2010169 - protein, 19 aa, Staphylococcus
ESVSLKFDKVQEFKQSVVN

SEQ ID NO: 2010170 - protein, 20 aa, Staphylococcus
ESYDAMAVVHQCREAGLPCY

SEQ ID NO: 2010171 - protein, 20 aa, Staphylococcus
ESYDLSCYLTMLNVLDSHHL

SEQ ID NO: 2010172 - protein, 17 aa, Staphylococcus
ESYEMYIDFLYESRQLI

SEQ ID NO: 2010173 - protein, 23 aa, Staphylococcus
ESYFPDCDDYLLLWKLEVLEKYQ

SEQ ID NO: 2010174 - protein, 19 aa, Staphylococcus
ESYILIKTSPGFAQSINYY

SEQ ID NO: 2010175 - protein, 23 aa, Staphylococcus
ESYIPNERIKVFVNKVEQTTKGP

SEQ ID NO: 2010176 - protein, 17 aa, Staphylococcus
ESYPIDQMRGLNHQIID

SEQ ID NO: 2010177 - protein, 25 aa, Staphylococcus
ESYTDFKMGLQIRHYTVQALKLLKT

SEQ ID NO: 2010178 - protein, 21 aa, Staphylococcus
ESYVCKHLGLGAAPVSTQTLQ

SEQ ID NO: 2010179 - protein, 26 aa, Staphylococcus
ESYYENVHIFEVEWGKAVNVPDFIDF

SEQ ID NO: 2010180 - protein, 19 aa, Staphylococcus
ETAAGFLMEKEIKFIGGVV

SEQ ID NO: 2010181 - protein, 19 aa, Staphylococcus
ETADHKIIMLIEQGQFEKV

SEQ ID NO: 2010182 - protein, 23 aa, Staphylococcus
ETADVLIVYIFKGIEFIPDSYTR

SEQ ID NO: 2010183 - protein, 27 aa, Staphylococcus
ETADVLLVYIFKCIEFIPDSYTRRLYS

SEQ ID NO: 2010184 - protein, 24 aa, Staphylococcus
ETAFPLLYTHFVKKGDWSLQQLVD

SEQ ID NO: 2010185 - protein, 23 aa, Staphylococcus
ETAFPLLYTHFVKNGDWSLQQLV

SEQ ID NO: 2010186 - protein, 23 aa, Staphylococcus
ETAFPLLYTHFVKNGDWTLQQLV

SEQ ID NO: 2010187 - protein, 18 aa, Staphylococcus
ETAGEKIVIKNGEGHSMD

SEQ ID NO: 2010188 - protein, 19 aa, Staphylococcus
ETAGPLYYRAEPVGCTATI

SEQ ID NO: 2010189 - protein, 24 aa, Staphylococcus
ETAHAIVITFNYRLGALGYTNWHL

SEQ ID NO: 2010190 - protein, 18 aa, Staphylococcus
ETAIKMGKQIYVPHTDYN

SEQ ID NO: 2010191 - protein, 18 aa, Staphylococcus
ETAKEMFERLLSEDNTDV

SEQ ID NO: 2010192 - protein, 24 aa, Staphylococcus
ETAKRYGLRSGVGLAAPQIDVAKR

SEQ ID NO: 2010193 - protein, 23 aa, Staphylococcus
ETALKFAERENNLILVARNEDNL

SEQ ID NO: 2010194 - protein, 20 aa, Staphylococcus
ETAPMAPTMKDFTSNDTQIT

SEQ ID NO: 2010195 - protein, 26 aa, Staphylococcus
ETARKFGIEVFNVFLSQEAITEDIEQ

SEQ ID NO: 2010196 - protein, 28 aa, Staphylococcus
ETDESPIVMSSRIRLARNLENHVHPLMF

SEQ ID NO: 2010197 - protein, 23 aa, Staphylococcus
ETDLKVPYICLNGAEVRDESFNI

SEQ ID NO: 2010198 - protein, 20 aa, Staphylococcus
ETDMLFKYVEKIIENDNAKL

SEQ ID NO: 2010199 - protein, 24 aa, Staphylococcus
ETDNGFKLAADIKVTLENISQEDA

SEQ ID NO: 2010200 - protein, 21 aa, Staphylococcus
ETDTLKIKWMHQGRIDNYDDF

SEQ ID NO: 2010201 - protein, 35 aa, Staphylococcus
ETDTPLRYSLPFNEANRYLVMPALSDTLKVAGVKT

SEQ ID NO: 2010202 - protein, 22 aa, Staphylococcus
ETDVLFKYVESIVGKNKSDLSV

SEQ ID NO: 2010203 - protein, 19 aa, Staphylococcus
ETEARTGFVSKTDQYFYNF

SEQ ID NO: 2010204 - protein, 20 aa, Staphylococcus
ETEHNFEVIHHFDNINFKKL

SEQ ID NO: 2010205 - protein, 25 aa, Staphylococcus
ETEIINAFPIKFVVDGENEVSDPKE

SEQ ID NO: 2010206 - protein, 25 aa, Staphylococcus
ETEIYICGGTHFLQSIIKALKEMNV

SEQ ID NO: 2010207 - protein, 26 aa, Staphylococcus
ETEIYVCGGNSFLKAMIAELQTLGIS

SEQ ID NO: 2010208 - protein, 28 aa, Staphylococcus
ETERKVCKREILNGNIIILAGKHPHSRK

SEQ ID NO: 2010209 - protein, 18 aa, Staphylococcus
ETERYGFQTIKERLPVWI

SEQ ID NO: 2010210 - protein, 27 aa, Staphylococcus
ETETYHPAMLILLFQVFYEFQEKQRKN

SEQ ID NO: 2010211 - protein, 30 aa, Staphylococcus
ETEVRSIIRFIKEYVQSHGFIKSLVLGISG

SEQ ID NO: 2010212 - protein, 24 aa, Staphylococcus
ETFDMVISRNVTWLLPNTKAAYQE

SEQ ID NO: 2010213 - protein, 24 aa, Staphylococcus
ETFDSMPTIVGFFPEIAEGDVYTF

SEQ ID NO: 2010214 - protein, 19 aa, Staphylococcus
ETFEFKQGKVLTIEGVQNT

SEQ ID NO: 2010215 - protein, 20 aa, Staphylococcus
ETFEGLNILICGDIKNSRVA

SEQ ID NO: 2010216 - protein, 19 aa, Staphylococcus
ETFETNVYPIFWTVQKALE

SEQ ID NO: 2010217 - protein, 19 aa, Staphylococcus
ETFETNVYPVFWTIQKALD

SEQ ID NO: 2010218 - protein, 22 aa, Staphylococcus
ETFGINGMKDYAFQIENIETAR

SEQ ID NO: 2010219 - protein, 17 aa, Staphylococcus
ETFGVNCEFTFSKDYPA

SEQ ID NO: 2010220 - protein, 17 aa, Staphylococcus
ETFKKAAQVQGKFSRQS

SEQ ID NO: 2010221 - protein, 22 aa, Staphylococcus
ETFKKCFKALATKKETDLAKEG

SEQ ID NO: 2010222 - protein, 20 aa, Staphylococcus
ETFLHPKAQAKIINAFRKIS

SEQ ID NO: 2010223 - protein, 40 aa, Staphylococcus
ETFLKTAELFDGMGVNLYFSRNSFNAIHIFDENGFKTVLG

SEQ ID NO: 2010224 - protein, 18 aa, Staphylococcus
ETFMKANIPYTMVGGHKF

SEQ ID NO: 2010225 - protein, 25 aa, Staphylococcus
ETFVKEIQTALSIGDTCPVCGNEIH

SEQ ID NO: 2010226 - protein, 23 aa, Staphylococcus
ETFYHPSNMVLFIVGDVNPQNMI

SEQ ID NO: 2010227 - protein, 23 aa, Staphylococcus
ETGCYECLERQLISKFPGTIENY

SEQ ID NO: 2010228 - protein, 18 aa, Staphylococcus
ETGEIVRLIQELAHDYPT

SEQ ID NO: 2010229 - protein, 24 aa, Staphylococcus
ETGLRIGELLSLYIDDIKYDLTNG

SEQ ID NO: 2010230 - protein, 17 aa, Staphylococcus
ETGMINLCFEIFDDKIK

SEQ ID NO: 2010231 - protein, 23 aa, Staphylococcus
ETGRGSIQMRARASIEERGGGRQ

SEQ ID NO: 2010232 - protein, 23 aa, Staphylococcus
ETGRKLARERHAFMEQFLNQFYK

SEQ ID NO: 2010233 - protein, 21 aa, Staphylococcus
ETGRLFIKNVLTTIFHHIDRN

SEQ ID NO: 2010234 - protein, 26 aa, Staphylococcus
ETGVSFAFQGCEHINRAITIEREDYN

SEQ ID NO: 2010235 - protein, 20 aa, Staphylococcus
ETHVLIKLEEEIHCEIVNKD

SEQ ID NO: 2010236 - protein, 21 aa, Staphylococcus
ETIALLAPCIANLKQAMSDIV

SEQ ID NO: 2010237 - protein, 26 aa, Staphylococcus
ETICYLWLRFEHDAQFSRDTVESYFN

SEQ ID NO: 2010238 - protein, 19 aa, Staphylococcus
ETIDPIVILAEFILSAQKI

SEQ ID NO: 2010239 - protein, 20 aa, Staphylococcus
ETIDPVVGLAPFQARRIAFN

SEQ ID NO: 2010240 - protein, 21 aa, Staphylococcus
ETIDYLKNRGINIVVGGMYEY

SEQ ID NO: 2010241 - protein, 25 aa, Staphylococcus
ETIEGVFHFCAYSLVGESVEKPLAY

SEQ ID NO: 2010242 - protein, 17 aa, Staphylococcus
ETIEWTKSMGADIVINH

SEQ ID NO: 2010243 - protein, 18 aa, Staphylococcus
ETIFPYITLSHFSKEQVT

SEQ ID NO: 2010244 - protein, 25 aa, Staphylococcus
ETIGCPIGNYIPEWNDLVYHQDFKE

SEQ ID NO: 2010245 - protein, 26 aa, Staphylococcus
ETIGCPIGNYIPEWNDLVYRQDFKAA

SEQ ID NO: 2010246 - protein, 26 aa, Staphylococcus
ETIGCPIGNYIPEWNDLVYRQDFKTA

SEQ ID NO: 2010247 - protein, 19 aa, Staphylococcus
ETIGIAGFFGLPIQKEVLD

SEQ ID NO: 2010248 - protein, 17 aa, Staphylococcus
ETIGIAGFFGLPIRKEV

SEQ ID NO: 2010249 - protein, 27 aa, Staphylococcus
ETIIMQIALDILKLDKSEVAMVGDLYD

SEQ ID NO: 2010250 - protein, 18 aa, Staphylococcus
ETIKGIGYTRAKYGYDYQ

SEQ ID NO: 2010251 - protein, 18 aa, Staphylococcus
ETIKICVDNGADMFVTGS

SEQ ID NO: 2010252 - protein, 21 aa, Staphylococcus
ETIKPFILLVVDKREEGLKAA

SEQ ID NO: 2010253 - protein, 25 aa, Staphylococcus
ETIMKTGYDYSWFILTEDIIKKEFV

SEQ ID NO: 2010254 - protein, 19 aa, Staphylococcus
ETINEAFLMSSYQVQMASW

SEQ ID NO: 2010255 - protein, 19 aa, Staphylococcus
ETINELSLLQYSEEDDKWT

SEQ ID NO: 2010256 - protein, 17 aa, Staphylococcus
ETISIDWDREHPRVIWD

SEQ ID NO: 2010257 - protein, 23 aa, Staphylococcus
ETITPYEAGIAFAAKPLIEADFI

SEQ ID NO: 2010258 - protein, 18 aa, Staphylococcus
ETITRPIVTNALTHGLSL

SEQ ID NO: 2010259 - protein, 23 aa, Staphylococcus
ETKEPRALFRFTSQLEDWHITLP

SEQ ID NO: 2010260 - protein, 22 aa, Staphylococcus
ETKGAFPTWLAPKQVEIIPVNL

SEQ ID NO: 2010261 - protein, 25 aa, Staphylococcus
ETKGAREVIRWAYDVYGDSIIYSCS

SEQ ID NO: 2010262 - protein, 23 aa, Staphylococcus
ETKGAYHVLKWAYDTYGDEIVYA

SEQ ID NO: 2010263 - protein, 25 aa, Staphylococcus
ETKHWKGDIYFNFSKDNLEKFNLDG

SEQ ID NO: 2010264 - protein, 20 aa, Staphylococcus
ETKKLTGWYSKRVAVGENGE

SEQ ID NO: 2010265 - protein, 21 aa, Staphylococcus
ETKNKRGFCEIILNKDNGDII

SEQ ID NO: 2010266 - protein, 19 aa, Staphylococcus
ETKQLTGWYSKRVAVGENG

SEQ ID NO: 2010267 - protein, 17 aa, Staphylococcus
ETKREWLSIHLYIDESY

SEQ ID NO: 2010268 - protein, 19 aa, Staphylococcus
ETKRIGITRLHMEEDAGKL

SEQ ID NO: 2010269 - protein, 18 aa, Staphylococcus
ETKRQYVSLCGRDTVQYE

SEQ ID NO: 2010270 - protein, 25 aa, Staphylococcus
ETKSTLAIPSLRYAGKPDITISRVA

SEQ ID NO: 2010271 - protein, 22 aa, Staphylococcus
ETKTLTGWYSRRIAVGEDDEIV

SEQ ID NO: 2010272 - protein, 22 aa, Staphylococcus
ETKVYLSFMDTLKWCKNKFQVT

SEQ ID NO: 2010273 - protein, 20 aa, Staphylococcus
ETKVYLSLMNIKKWCQNTFQ

SEQ ID NO: 2010274 - protein, 19 aa, Staphylococcus
ETKYNVKIFEFTRPSIRLT

SEQ ID NO: 2010275 - protein, 18 aa, Staphylococcus
ETLACLTIAFKTFEIRDA

SEQ ID NO: 2010276 - protein, 23 aa, Staphylococcus
ETLDCVHICLPHYLHVSATTTCV

SEQ ID NO: 2010277 - protein, 17 aa, Staphylococcus
ETLDEIAGIHFYNSKDH

SEQ ID NO: 2010278 - protein, 24 aa, Staphylococcus
ETLDRIYRSLGILQNSRIISMEEA

SEQ ID NO: 2010279 - protein, 24 aa, Staphylococcus
ETLDRIYRSLGILQNSRMISMEEA

SEQ ID NO: 2010280 - protein, 31 aa, Staphylococcus
ETLDRVYRSLGILKYSRLISMEEASLRLSEV

SEQ ID NO: 2010281 - protein, 26 aa, Staphylococcus
ETLDRVYRSLGILQNCRMISMEEASY

SEQ ID NO: 2010282 - protein, 24 aa, Staphylococcus
ETLDRVYRSLGILQNSRIISMEEA

SEQ ID NO: 2010283 - protein, 23 aa, Staphylococcus
ETLDRVYRSLGILQNSRLITMEE

SEQ ID NO: 2010284 - protein, 30 aa, Staphylococcus
ETLEAFNYRKVHLFKEWKTEKGIVNYLLDV

SEQ ID NO: 2010285 - protein, 21 aa, Staphylococcus
ETLELLLYDDYDVIFLDINLM

SEQ ID NO: 2010286 - protein, 18 aa, Staphylococcus
ETLFKLQRQFAYTKEEMN

SEQ ID NO: 2010287 - protein, 24 aa, Staphylococcus
ETLFPHRVDLGLGRAPGTDMMTAS

SEQ ID NO: 2010288 - protein, 25 aa, Staphylococcus
ETLFPNRVNLGLGRAPGTDMMTASA

SEQ ID NO: 2010289 - protein, 17 aa, Staphylococcus
ETLGRVFNVLGETIDLN

SEQ ID NO: 2010290 - protein, 31 aa, Staphylococcus
ETLHPMGGLQERIWNPLQIMNDFGIDVFSPS

SEQ ID NO: 2010291 - protein, 25 aa, Staphylococcus
ETLIELKSQFKGKVVIIHQPAEEVP

SEQ ID NO: 2010292 - protein, 24 aa, Staphylococcus
ETLIEMKEQFKGKVVIIHQPAEEM

SEQ ID NO: 2010293 - protein, 21 aa, Staphylococcus
ETLIRIYLALHTFDFSTDVPF

SEQ ID NO: 2010294 - protein, 17 aa, Staphylococcus
ETLKDALGLDEITFIPT

SEQ ID NO: 2010295 - protein, 25 aa, Staphylococcus
ETLKGCKAILYFYPRDNTPTCTTEA

SEQ ID NO: 2010296 - protein, 20 aa, Staphylococcus
ETLKHMPIFVISDEIYAENT

SEQ ID NO: 2010297 - protein, 24 aa, Staphylococcus
ETLKRYLLEETFELFEAIDNEDDW

SEQ ID NO: 2010298 - protein, 21 aa, Staphylococcus
ETLLFYKARFKYYKNVEFVIK

SEQ ID NO: 2010299 - protein, 19 aa, Staphylococcus
ETLMPAIIELKQAYKKAKN

SEQ ID NO: 2010300 - protein, 19 aa, Staphylococcus
ETLMPAIIELKQAYNKAKQ

SEQ ID NO: 2010301 - protein, 23 aa, Staphylococcus
ETLRIYRRDNFKGVTIKLNAIVA

SEQ ID NO: 2010302 - protein, 26 aa, Staphylococcus
ETLRRYCFDKSFIGMNGIDVKYGLTT

SEQ ID NO: 2010303 - protein, 17 aa, Staphylococcus
ETLSLTYLPSIKLSDTS

SEQ ID NO: 2010304 - protein, 18 aa, Staphylococcus
ETLSNVKVDYAFNDNAYK

SEQ ID NO: 2010305 - protein, 24 aa, Staphylococcus
ETLSRSKVDGIILMATRITPQHLD

SEQ ID NO: 2010306 - protein, 23 aa, Staphylococcus
ETLSRSKVDGIVLMATNITEQHI

SEQ ID NO: 2010307 - protein, 18 aa, Staphylococcus
ETMDTFGHIDILFNNAGI

SEQ ID NO: 2010308 - protein, 18 aa, Staphylococcus
ETMFKHFNIPITIDGKSI

SEQ ID NO: 2010309 - protein, 22 aa, Staphylococcus
ETMTSFEIPKGMNIKITSADNT

SEQ ID NO: 2010310 - protein, 22 aa, Staphylococcus
ETNEWLGFIGLNYIPEDSEYPF

SEQ ID NO: 2010311 - protein, 22 aa, Staphylococcus
ETNGIFKHYFVIEYVKNSESPD

SEQ ID NO: 2010312 - protein, 19 aa, Staphylococcus
ETNMKFSIISGGNSSMIPQ

SEQ ID NO: 2010313 - protein, 28 aa, Staphylococcus
ETNTMPQWAGSCWYYLRYIDPDNENMIA

SEQ ID NO: 2010314 - protein, 29 aa, Staphylococcus
ETNTMPQWAGSCWYYLRYIDPHNEEMLAD

SEQ ID NO: 2010315 - protein, 29 aa, Staphylococcus
ETNTMPQWAGSCWYYLRYIDPHNENMLAD

SEQ ID NO: 2010316 - protein, 18 aa, Staphylococcus
ETNYDFYEVVYPYSQAID

SEQ ID NO: 2010317 - protein, 21 aa, Staphylococcus
ETPERFKFVVKIHQALTLHAD

SEQ ID NO: 2010318 - protein, 18 aa, Staphylococcus
ETPIPDDSTIVFESLGDQ

SEQ ID NO: 2010319 - protein, 25 aa, Staphylococcus
ETPQDIKAGYDFGSKGIGLVRTEHM

SEQ ID NO: 2010320 - protein, 28 aa, Staphylococcus
ETPQDIKAGYNFSAKGIGLVRTEHMFFG

SEQ ID NO: 2010321 - protein, 26 aa, Staphylococcus
ETPQDIKVGYQFGAKGIGLVRTEHMF

SEQ ID NO: 2010322 - protein, 18 aa, Staphylococcus
ETPRACLVADELAKHCDF

SEQ ID NO: 2010323 - protein, 20 aa, Staphylococcus
ETPSNPLLRVTDIKASAEIA

SEQ ID NO: 2010324 - protein, 31 aa, Staphylococcus
ETPSNPLLRVTDIKGAVAIAKKHNLISVVDN

SEQ ID NO: 2010325 - protein, 20 aa, Staphylococcus
ETPSNPLLRVTDIKKSAEIA

SEQ ID NO: 2010326 - protein, 20 aa, Staphylococcus
ETPSNPLLRVTDIKKTAEIA

SEQ ID NO: 2010327 - protein, 21 aa, Staphylococcus
ETPSNPLLRVTDIRRAAEIAT

SEQ ID NO: 2010328 - protein, 20 aa, Staphylococcus
ETPVNVVACENAIMATDTLK

SEQ ID NO: 2010329 - protein, 19 aa, Staphylococcus
ETQAILPLRGKILNVEKAR

SEQ ID NO: 2010330 - protein, 23 aa, Staphylococcus
ETQCIPNDINLLGDQAPSILEAN

SEQ ID NO: 2010331 - protein, 22 aa, Staphylococcus
ETQFKVVPLLIFSAMHYIVDIP

SEQ ID NO: 2010332 - protein, 22 aa, Staphylococcus
ETQFKVVPLLIFSAMHYIVDVP

SEQ ID NO: 2010333 - protein, 27 aa, Staphylococcus
ETQPKRIKIKWSNHILKDLAHMNKQLD

SEQ ID NO: 2010334 - protein, 18 aa, Staphylococcus
ETQRIAGITSKPPILLTP

SEQ ID NO: 2010335 - protein, 24 aa, Staphylococcus
ETQYALDYFKAEAPELLTEDLTDK

SEQ ID NO: 2010336 - protein, 24 aa, Staphylococcus
ETQYALDYFKVEAPELLSEDLNNE

SEQ ID NO: 2010337 - protein, 25 aa, Staphylococcus
ETRDLKGGQTIGLFSYGSGSVGEFF

SEQ ID NO: 2010338 - protein, 22 aa, Staphylococcus
ETRIKSWSYPFVIKPGDDLPTA

SEQ ID NO: 2010339 - protein, 18 aa, Staphylococcus
ETRIYPVGRLDYDTSGLL

SEQ ID NO: 2010340 - protein, 25 aa, Staphylococcus
ETRKRKRAYEMLDVVMDYKQKEVAL

SEQ ID NO: 2010341 - protein, 18 aa, Staphylococcus
ETRVEKWFHETAPQRVKR

SEQ ID NO: 2010342 - protein, 21 aa, Staphylococcus
ETSEAVGILSLLRIDRHNGSI

SEQ ID NO: 2010343 - protein, 21 aa, Staphylococcus
ETSHAKTLFSTHYHELTTLDQ

SEQ ID NO: 2010344 - protein, 22 aa, Staphylococcus
ETSHAKTLFSTHYHELTTLDQQ

SEQ ID NO: 2010345 - protein, 23 aa, Staphylococcus
ETSKTDFVAVRFGNVLGSRGSVI

SEQ ID NO: 2010346 - protein, 29 aa, Staphylococcus
ETSLKLLGLDYLDLYLIHWPGTDQSLMIE

SEQ ID NO: 2010347 - protein, 19 aa, Staphylococcus
ETSLLRRLNTIANKNITKE

SEQ ID NO: 2010348 - protein, 19 aa, Staphylococcus
ETSLLRRLNTVANKNVTKE

SEQ ID NO: 2010349 - protein, 19 aa, Staphylococcus
ETSPIDMLASWSGSEPTQS

SEQ ID NO: 2010350 - protein, 21 aa, Staphylococcus
ETSRFYQYWLDHVDQDLAETK

SEQ ID NO: 2010351 - protein, 22 aa, Staphylococcus
ETSRFYQYWLDYVEQDLADAKA

SEQ ID NO: 2010352 - protein, 20 aa, Staphylococcus
ETSRWDYLISPNRYSSEIFR

SEQ ID NO: 2010353 - protein, 19 aa, Staphylococcus
ETSRWDYLISPNRYSTEIF

SEQ ID NO: 2010354 - protein, 20 aa, Staphylococcus
ETSVKHFLQESSLAPGVICG

SEQ ID NO: 2010355 - protein, 18 aa, Staphylococcus
ETSYFKKTVNPFDHQAVP

SEQ ID NO: 2010356 - protein, 18 aa, Staphylococcus
ETTEFILDQLPCWLTYTN

SEQ ID NO: 2010357 - protein, 26 aa, Staphylococcus
ETTIKEAAMLAGYFSKAGLSGQIPVD

SEQ ID NO: 2010358 - protein, 25 aa, Staphylococcus
ETTIKEAAMLAGYFSKAGNSGQIPV

SEQ ID NO: 2010359 - protein, 17 aa, Staphylococcus
ETTKEFIAFYLNELNID

SEQ ID NO: 2010360 - protein, 25 aa, Staphylococcus
ETTKTGIASLCIGGGQGIATVVSHY

SEQ ID NO: 2010361 - protein, 20 aa, Staphylococcus
ETTLLKRLNKVASKNITKET

SEQ ID NO: 2010362 - protein, 31 aa, Staphylococcus
ETTLLTLRLAELFRASTIPAGLVQIVPGTGE

SEQ ID NO: 2010363 - protein, 33 aa, Staphylococcus
ETTLLTLRLAQLFKASTIPAGLVQIVPGTGETV

SEQ ID NO: 2010364 - protein, 31 aa, Staphylococcus
ETTQWLEDYLNYFKGAIVIISHDRFFLDKTV

SEQ ID NO: 2010365 - protein, 19 aa, Staphylococcus
ETTQWLESYLNYFNGAIVI

SEQ ID NO: 2010366 - protein, 21 aa, Staphylococcus
ETTRWGSWYDATKGVVIPGSN

SEQ ID NO: 2010367 - protein, 17 aa, Staphylococcus
ETTSEKNAMGWYLDGRA

SEQ ID NO: 2010368 - protein, 31 aa, Staphylococcus
ETTSEKNAMGWYLDGRVSAIVGTHTHIQTSD

SEQ ID NO: 2010369 - protein, 17 aa, Staphylococcus
ETTVDGFIQKGLQPIIA

SEQ ID NO: 2010370 - protein, 17 aa, Staphylococcus
ETVAVDSIICRIETHGE

SEQ ID NO: 2010371 - protein, 19 aa, Staphylococcus
ETVFRRYKNKVKYWITFNE

SEQ ID NO: 2010372 - protein, 19 aa, Staphylococcus
ETVIIPGIMEHIERAGVHS

SEQ ID NO: 2010373 - protein, 24 aa, Staphylococcus
ETVKFLKNKGYRVVTIKHHGHGAE

SEQ ID NO: 2010374 - protein, 25 aa, Staphylococcus
ETVLETESDFGLAFDGDGDRIIAVD

SEQ ID NO: 2010375 - protein, 20 aa, Staphylococcus
ETVLEYQPLFIKPNKDELEV

SEQ ID NO: 2010376 - protein, 19 aa, Staphylococcus
ETVRKALDLLANDGMIQKI

SEQ ID NO: 2010377 - protein, 17 aa, Staphylococcus
ETVRKALELLANDGMIQ

SEQ ID NO: 2010378 - protein, 21 aa, Staphylococcus
ETVRKALNLLVREGMIQKIRG

SEQ ID NO: 2010379 - protein, 20 aa, Staphylococcus
ETVWGPRAKEVQSFVTNLCE

SEQ ID NO: 2010380 - protein, 19 aa, Staphylococcus
ETVWGPRAQIVQKFVDDVR

SEQ ID NO: 2010381 - protein, 20 aa, Staphylococcus
ETWVPSLIMRAVLGEMSTVV

SEQ ID NO: 2010382 - protein, 18 aa, Staphylococcus
ETWWRWYRNGESYRFSQH

SEQ ID NO: 2010383 - protein, 19 aa, Staphylococcus
ETYANKDFIVGYRLSPEEA

SEQ ID NO: 2010384 - protein, 22 aa, Staphylococcus
ETYDLSCYLTMLNVLDSHNVDR

SEQ ID NO: 2010385 - protein, 24 aa, Staphylococcus
ETYEACKVLLERGYIVCPYISNDV

SEQ ID NO: 2010386 - protein, 20 aa, Staphylococcus
ETYELWRHTLIEVGIGRPGF

SEQ ID NO: 2010387 - protein, 20 aa, Staphylococcus
ETYESFKLFETTFFDHQLLR

SEQ ID NO: 2010388 - protein, 19 aa, Staphylococcus
ETYESFNLIDTTAVDHQLL

SEQ ID NO: 2010389 - protein, 28 aa, Staphylococcus
ETYHLYLPKEEPLALAMNPHLAQFEGAT

SEQ ID NO: 2010390 - protein, 25 aa, Staphylococcus
ETYPELKLGVITPFEGHTSKWNEQN

SEQ ID NO: 2010391 - protein, 17 aa, Staphylococcus
ETYRGVANVGVKPTFHD

SEQ ID NO: 2010392 - protein, 25 aa, Staphylococcus
ETYTDFRMGIQIRHYTVQALKLLKT

SEQ ID NO: 2010393 - protein, 17 aa, Staphylococcus
ETYVPVRHDIHYYNYIK

SEQ ID NO: 2010394 - protein, 18 aa, Staphylococcus
ETYVPVRHDMHYYNYIKR

SEQ ID NO: 2010395 - protein, 22 aa, Staphylococcus
EVACLNKHLHFHGTTEDFKSLD

SEQ ID NO: 2010396 - protein, 23 aa, Staphylococcus
EVACLNKHLHFHGTTEDFKSLDE

SEQ ID NO: 2010397 - protein, 19 aa, Staphylococcus
EVADKYGVFVIFDNKTPIF

SEQ ID NO: 2010398 - protein, 20 aa, Staphylococcus
EVADVIFVSAHWGNEGAHQP

SEQ ID NO: 2010399 - protein, 25 aa, Staphylococcus
EVAFEVFKKKGWTNSAISRSAVQLA

SEQ ID NO: 2010400 - protein, 18 aa, Staphylococcus
EVAIEMIKGILGKIPFFG

SEQ ID NO: 2010401 - protein, 22 aa, Staphylococcus
EVAIYALDFMKAHDYDGLIQHY

SEQ ID NO: 2010402 - protein, 20 aa, Staphylococcus
EVAKHVPMDRLLVETDAPYL

SEQ ID NO: 2010403 - protein, 23 aa, Staphylococcus
EVAKYLKDLLDKHGIKADIDEIK

SEQ ID NO: 2010404 - protein, 20 aa, Staphylococcus
EVALALYVRRDHYGIESQIK

SEQ ID NO: 2010405 - protein, 23 aa, Staphylococcus
EVANCPKNYLAHVLTKHGFNCKK

SEQ ID NO: 2010406 - protein, 26 aa, Staphylococcus
EVARCPKKYLAKVLHKHGFMVRQEQQ

SEQ ID NO: 2010407 - protein, 25 aa, Staphylococcus
EVARCPKRYLSRVLEKHGFTVKDEE

SEQ ID NO: 2010408 - protein, 23 aa, Staphylococcus
EVARELGEALQLTNILRDVGEDF

SEQ ID NO: 2010409 - protein, 23 aa, Staphylococcus
EVARTDYIRKLGFNYADMEAVGI

SEQ ID NO: 2010410 - protein, 23 aa, Staphylococcus
EVARTDYIRKLGFSYADMEKQGI

SEQ ID NO: 2010411 - protein, 23 aa, Staphylococcus
EVAVKRYNRIGAEGMTTESVEGR

SEQ ID NO: 2010412 - protein, 23 aa, Staphylococcus
EVCIKRKCLFNGPSIIEVNGQFL

SEQ ID NO: 2010413 - protein, 18 aa, Staphylococcus
EVDAFPLSMDPRLMEAIR

SEQ ID NO: 2010414 - protein, 25 aa, Staphylococcus
EVDAIQGFIYRTGQSLELYTPYLET

SEQ ID NO: 2010415 - protein, 29 aa, Staphylococcus
EVDDSLKMLISYPGYSGYDIQKWFENEHI

SEQ ID NO: 2010416 - protein, 24 aa, Staphylococcus
EVDEVKIYFSHFVSVLENTPSTKT

SEQ ID NO: 2010417 - protein, 23 aa, Staphylococcus
EVDGKVAGCVIAYDGKHELDYEE

SEQ ID NO: 2010418 - protein, 20 aa, Staphylococcus
EVDGSEFFTYIRGYGDYRDE

SEQ ID NO: 2010419 - protein, 20 aa, Staphylococcus
EVDGVLPVCIGIATRVSDYI

SEQ ID NO: 2010420 - protein, 23 aa, Staphylococcus
EVDHLLVNLSFYCHIHDDYINLN

SEQ ID NO: 2010421 - protein, 22 aa, Staphylococcus
EVDKFNWFHIAKKIEAFDDIIT

SEQ ID NO: 2010422 - protein, 18 aa, Staphylococcus
EVDKFNWYQVAKKIETIG

SEQ ID NO: 2010423 - protein, 21 aa, Staphylococcus
EVDRYLLNRLREFTASTIEHY

SEQ ID NO: 2010424 - protein, 21 aa, Staphylococcus
EVDRYLLNRLREFTASTIHHY

SEQ ID NO: 2010425 - protein, 21 aa, Staphylococcus
EVDRYLLNRLREFTASTINHY

SEQ ID NO: 2010426 - protein, 18 aa, Staphylococcus
EVDRYLLNRLREFTESII

SEQ ID NO: 2010427 - protein, 18 aa, Staphylococcus
EVDVPIILEKDIYKATAL

SEQ ID NO: 2010428 - protein, 19 aa, Staphylococcus
EVDVPVILERDIYKATAKT

SEQ ID NO: 2010429 - protein, 34 aa, Staphylococcus
EVDVSCFKCGGKGCNVCKQTGWIEILGAGMVHPN

SEQ ID NO: 2010430 - protein, 23 aa, Staphylococcus
EVEAKALFAFDIKAKKFAEDTKD

SEQ ID NO: 2010431 - protein, 20 aa, Staphylococcus
EVEDQFCFIGRLAQEKQIDH

SEQ ID NO: 2010432 - protein, 23 aa, Staphylococcus
EVEELRLRVATSRPSDNKSFSSN

SEQ ID NO: 2010433 - protein, 20 aa, Staphylococcus
EVEGKVSLIATVPKADTSKI

SEQ ID NO: 2010434 - protein, 21 aa, Staphylococcus
EVEGQMFYQRIIKVLESTNMF

SEQ ID NO: 2010435 - protein, 18 aa, Staphylococcus
EVEIPDHLLHYINLNTPR

SEQ ID NO: 2010436 - protein, 32 aa, Staphylococcus
EVEKDIYKTMAWDGFQAFVIKNIETVATDIKA

SEQ ID NO: 2010437 - protein, 18 aa, Staphylococcus
EVEKRFMHHYNFPNFSVG

SEQ ID NO: 2010438 - protein, 18 aa, Staphylococcus
EVENKGYSQQEFINTVKS

SEQ ID NO: 2010439 - protein, 18 aa, Staphylococcus
EVEPASAIVQRFNTGAMS

SEQ ID NO: 2010440 - protein, 23 aa, Staphylococcus
EVESMMFYTCILDMIKDEETAEL

SEQ ID NO: 2010441 - protein, 23 aa, Staphylococcus
EVESMMFYTCILDMMKVEETAEM

SEQ ID NO: 2010442 - protein, 20 aa, Staphylococcus
EVFPFGEQRLVLKEDEQWIR

SEQ ID NO: 2010443 - protein, 20 aa, Staphylococcus
EVFQKLKTLCLGNYQEQCSA

SEQ ID NO: 2010444 - protein, 24 aa, Staphylococcus
EVFSSSRTTVFPILGGGERLGTLV

SEQ ID NO: 2010445 - protein, 18 aa, Staphylococcus
EVFTHGWAYGSKGDALKG

SEQ ID NO: 2010446 - protein, 19 aa, Staphylococcus
EVFTNKAFDGFKVEQVKDL

SEQ ID NO: 2010447 - protein, 20 aa, Staphylococcus
EVFTNKAFEGFKVERVNDLF

SEQ ID NO: 2010448 - protein, 27 aa, Staphylococcus
EVGCDPEIMGIAPFYAVSKLLEKTGKT

SEQ ID NO: 2010449 - protein, 24 aa, Staphylococcus
EVGEVHLGIVFKIRVDTENVEVKE

SEQ ID NO: 2010450 - protein, 23 aa, Staphylococcus
EVGEYEPLCEVITDKVTAEVPST

SEQ ID NO: 2010451 - protein, 25 aa, Staphylococcus
EVGKQTDMFARFSTVAGERGAADAE

SEQ ID NO: 2010452 - protein, 25 aa, Staphylococcus
EVGKQTEMFARFSTVAGERGAADAE

SEQ ID NO: 2010453 - protein, 25 aa, Staphylococcus
EVGKQTEMFARFSTVAGERGAADLE

SEQ ID NO: 2010454 - protein, 25 aa, Staphylococcus
EVGKQTEMFARFSTVSGERGAADAE

SEQ ID NO: 2010455 - protein, 25 aa, Staphylococcus
EVGKQTEMFARFSTVSGERGAADLE

SEQ ID NO: 2010456 - protein, 20 aa, Staphylococcus
EVGKVHMGIVFKITVSTTDV

SEQ ID NO: 2010457 - protein, 17 aa, Staphylococcus
EVGRTLYNFIWDEFCDW

SEQ ID NO: 2010458 - protein, 25 aa, Staphylococcus
EVGVGRPKRLLAFEFSVTPKKVRFT

SEQ ID NO: 2010459 - protein, 25 aa, Staphylococcus
EVGYKFKRVLEDAGVFKNTDTGRQA

SEQ ID NO: 2010460 - protein, 19 aa, Staphylococcus
EVHDLGGLTVLINEHMENS

SEQ ID NO: 2010461 - protein, 22 aa, Staphylococcus
EVHKLHFVYHFDVTPILNDLHA

SEQ ID NO: 2010462 - protein, 19 aa, Staphylococcus
EVHLAKERIQSIVEAEHLK

SEQ ID NO: 2010463 - protein, 20 aa, Staphylococcus
EVHPYKRGVYSGGVGYINCN

SEQ ID NO: 2010464 - protein, 21 aa, Staphylococcus
EVHVASEFVYNMPLLSEKPLF

SEQ ID NO: 2010465 - protein, 26 aa, Staphylococcus
EVIAACLLTAVPVMKFFKYFYTNRGP

SEQ ID NO: 2010466 - protein, 20 aa, Staphylococcus
EVIEKLNVPVILVGQSYPNL

SEQ ID NO: 2010467 - protein, 22 aa, Staphylococcus
EVIELKEIYRLILKIQNKQFGL

SEQ ID NO: 2010468 - protein, 18 aa, Staphylococcus
EVIFCLHPNMQPFIDLFD

SEQ ID NO: 2010469 - protein, 26 aa, Staphylococcus
EVIFPRETMIGSMAYYISHAKNDKNF

SEQ ID NO: 2010470 - protein, 19 aa, Staphylococcus
EVIGRVCMDQMIIKVPDDV

SEQ ID NO: 2010471 - protein, 20 aa, Staphylococcus
EVIHKINVPVIIVGQTHEQL

SEQ ID NO: 2010472 - protein, 23 aa, Staphylococcus
EVIKAAPGFNVIAAINEGYVGTL

SEQ ID NO: 2010473 - protein, 28 aa, Staphylococcus
EVIKEGIPAKARRKGGHPAKRVFQAIRI

SEQ ID NO: 2010474 - protein, 21 aa, Staphylococcus
EVIKLCGALMQYYRETGVYAE

SEQ ID NO: 2010475 - protein, 22 aa, Staphylococcus
EVIKPPKDVDVFLVAPKGPGHL

SEQ ID NO: 2010476 - protein, 20 aa, Staphylococcus
EVILDLKLIFSTNAILNFPP

SEQ ID NO: 2010477 - protein, 18 aa, Staphylococcus
EVILVGGSTRIPAVQDAV

SEQ ID NO: 2010478 - protein, 25 aa, Staphylococcus
EVINKIRLSKAFGEVLPVPKDIPLI

SEQ ID NO: 2010479 - protein, 20 aa, Staphylococcus
EVIQLCGALMQYYRETGIYA

SEQ ID NO: 2010480 - protein, 23 aa, Staphylococcus
EVIQRLTQIYGIKSVSPVLKTGK

SEQ ID NO: 2010481 - protein, 22 aa, Staphylococcus
EVIRICGALMQYYRETGIYSER

SEQ ID NO: 2010482 - protein, 21 aa, Staphylococcus
EVISRAQVILDEFEQKPSNQI

SEQ ID NO: 2010483 - protein, 27 aa, Staphylococcus
EVIYYAGGHGVMWDFAKDKGLIDLAEK

SEQ ID NO: 2010484 - protein, 28 aa, Staphylococcus
EVKARAYKLLIDFGFSRDILQQSPFQMS

SEQ ID NO: 2010485 - protein, 20 aa, Staphylococcus
EVKASGGVRSLEDFEKMIEA

SEQ ID NO: 2010486 - protein, 27 aa, Staphylococcus
EVKDSDGRIILFIDEIHMLVGAGKTDG

SEQ ID NO: 2010487 - protein, 24 aa, Staphylococcus
EVKEHKTRMALFPLKEYAQSKLDE

SEQ ID NO: 2010488 - protein, 32 aa, Staphylococcus
EVKERAFDLLLELGFPRNVMSLSPFQMSGGQM

SEQ ID NO: 2010489 - protein, 17 aa, Staphylococcus
EVKEYADFADIFCETGV

SEQ ID NO: 2010490 - protein, 26 aa, Staphylococcus
EVKGRFKETFLQVQAHFTTVFQSLFG

SEQ ID NO: 2010491 - protein, 27 aa, Staphylococcus
EVKIIKGCKLYDSRQFKDNVVEPLKVG

SEQ ID NO: 2010492 - protein, 19 aa, Staphylococcus
EVKIQWRVANIKIPTESIT

SEQ ID NO: 2010493 - protein, 19 aa, Staphylococcus
EVKKASLLDSLNAGDVIKG

SEQ ID NO: 2010494 - protein, 25 aa, Staphylococcus
EVKPAPDLYLKAVQELNLNPVSCLA

SEQ ID NO: 2010495 - protein, 21 aa, Staphylococcus
EVKPDIVIDGMDHFKIRYLIN

SEQ ID NO: 2010496 - protein, 21 aa, Staphylococcus
EVKSLESITGYQVLLKVHPFV

SEQ ID NO: 2010497 - protein, 17 aa, Staphylococcus
EVKTCLKNHLSRYEVPS

SEQ ID NO: 2010498 - protein, 23 aa, Staphylococcus
EVKWGELDYLLLDLPPGTGDVAL

SEQ ID NO: 2010499 - protein, 20 aa, Staphylococcus
EVLAHLLIRGKSPNIKTNQK

SEQ ID NO: 2010500 - protein, 24 aa, Staphylococcus
EVLALKRIRIGDLQLDSTLASGEY

SEQ ID NO: 2010501 - protein, 23 aa, Staphylococcus
EVLCNLGRRLPRIYYLNKKFEVT

SEQ ID NO: 2010502 - protein, 23 aa, Staphylococcus
EVLCNLSRRLPRIYHIEDNTEIS

SEQ ID NO: 2010503 - protein, 26 aa, Staphylococcus
EVLDPSLPIDLIIDYAHTADGMDKLI

SEQ ID NO: 2010504 - protein, 26 aa, Staphylococcus
EVLDPSLPIDLIIDYAHTADGMNKLI

SEQ ID NO: 2010505 - protein, 25 aa, Staphylococcus
EVLDPSLPIDLIIDYAHTTDGIEKL

SEQ ID NO: 2010506 - protein, 25 aa, Staphylococcus
EVLELKRIQIANLRLDEELDEGQYR

SEQ ID NO: 2010507 - protein, 26 aa, Staphylococcus
EVLELKRLKIANLALDENLKSGEYKL

SEQ ID NO: 2010508 - protein, 25 aa, Staphylococcus
EVLESLKYLLIGGEVLNAKWVNLLN

SEQ ID NO: 2010509 - protein, 31 aa, Staphylococcus
EVLHPMGGLQERIWNPLQIMNDFGKNVFHPS

SEQ ID NO: 2010510 - protein, 17 aa, Staphylococcus
EVLKAHLHKVTFVHNNF

SEQ ID NO: 2010511 - protein, 17 aa, Staphylococcus
EVLKEKFEPVLKEPGVV

SEQ ID NO: 2010512 - protein, 24 aa, Staphylococcus
EVLKNYKFKVFFNKSNIESKYKEF

SEQ ID NO: 2010513 - protein, 19 aa, Staphylococcus
EVLLSELNKYCGNLDDQEA

SEQ ID NO: 2010514 - protein, 25 aa, Staphylococcus
EVLNHGITSYGYRIEAPTTPGTINV

SEQ ID NO: 2010515 - protein, 17 aa, Staphylococcus
EVLNKYNITASWFTSSL

SEQ ID NO: 2010516 - protein, 21 aa, Staphylococcus
EVLNLAAALYIYNEHEVYYLS

SEQ ID NO: 2010517 - protein, 26 aa, Staphylococcus
EVLNRWQKRLEGIGWNALFIENHDQP

SEQ ID NO: 2010518 - protein, 17 aa, Staphylococcus
EVLPGIAHKAVRCIQEE

SEQ ID NO: 2010519 - protein, 25 aa, Staphylococcus
EVLREREHFAIFPASHFVTRDEKMQ

SEQ ID NO: 2010520 - protein, 26 aa, Staphylococcus
EVLRQREHFSIFPASHYVTRDEKLKL

SEQ ID NO: 2010521 - protein, 26 aa, Staphylococcus
EVLRRYCFDKAFIGMNGLDLNHGLTT

SEQ ID NO: 2010522 - protein, 24 aa, Staphylococcus
EVLRTVKDSVHFGVNVGQYSFDLK

SEQ ID NO: 2010523 - protein, 18 aa, Staphylococcus
EVLSEPYVIVCLNAIVAD

SEQ ID NO: 2010524 - protein, 19 aa, Staphylococcus
EVLSRVSSTFPKEVAEVIN

SEQ ID NO: 2010525 - protein, 18 aa, Staphylococcus
EVLTQFAMEQEMKFGSVS

SEQ ID NO: 2010526 - protein, 20 aa, Staphylococcus
EVLTRVQAYIADKLYHRQLD

SEQ ID NO: 2010527 - protein, 36 aa, Staphylococcus
EVLTYKAIHACKSYDVKRLIVAGGVASNKGLRTSLK

SEQ ID NO: 2010528 - protein, 20 aa, Staphylococcus
EVLVQYKIPGISGVDTRSIT

SEQ ID NO: 2010529 - protein, 21 aa, Staphylococcus
EVMAGQGTIGLEILDAIWDVD

SEQ ID NO: 2010530 - protein, 29 aa, Staphylococcus
EVMGHLDFLTAKARYASAIKGTKPTFYEA

SEQ ID NO: 2010531 - protein, 20 aa, Staphylococcus
EVMGIPSLLVFQYGDKLAHL

SEQ ID NO: 2010532 - protein, 24 aa, Staphylococcus
EVMIPRVKQMLSRFYAESIEHRRW

SEQ ID NO: 2010533 - protein, 19 aa, Staphylococcus
EVMKYAAENDITFVPYFPL

SEQ ID NO: 2010534 - protein, 24 aa, Staphylococcus
EVMNRLTKIFGIKSISPVFKTTQN

SEQ ID NO: 2010535 - protein, 26 aa, Staphylococcus
EVMPHKRGVYSGGIGYINCNHNLDLA

SEQ ID NO: 2010536 - protein, 19 aa, Staphylococcus
EVMPVIKLDGEAVGEGKVG

SEQ ID NO: 2010537 - protein, 24 aa, Staphylococcus
EVMRKYMTELPCETCHGKRLSKEA

SEQ ID NO: 2010538 - protein, 30 aa, Staphylococcus
EVMTGFRVGYNCAQGYFDVIPDLTCLGKVI

SEQ ID NO: 2010539 - protein, 25 aa, Staphylococcus
EVMTGFRVGYNCAQGYFGVTPDITC

SEQ ID NO: 2010540 - protein, 25 aa, Staphylococcus
EVMTGFRVGYNCAQGYFGVTPDLTC

SEQ ID NO: 2010541 - protein, 17 aa, Staphylococcus
EVMVRSQVRGLIDNYDY

SEQ ID NO: 2010542 - protein, 17 aa, Staphylococcus
EVNDVLTGFKFISDLIE

SEQ ID NO: 2010543 - protein, 21 aa, Staphylococcus
EVNEALELTSLLGNISHIDDK

SEQ ID NO: 2010544 - protein, 17 aa, Staphylococcus
EVNELINAFGSVIEVSE

SEQ ID NO: 2010545 - protein, 18 aa, Staphylococcus
EVNELINAFGSVIEVSED

SEQ ID NO: 2010546 - protein, 22 aa, Staphylococcus
EVNEPHFKRGIIANPNCSTIQS

SEQ ID NO: 2010547 - protein, 19 aa, Staphylococcus
EVNEPHFTRGIIANPNCST

SEQ ID NO: 2010548 - protein, 18 aa, Staphylococcus
EVNFRTSKNYHQFIAERT

SEQ ID NO: 2010549 - protein, 19 aa, Staphylococcus
EVNGNLLVLDKSRYLDFED

SEQ ID NO: 2010550 - protein, 24 aa, Staphylococcus
EVNILKMQLLIWILETNTGDMQEL

SEQ ID NO: 2010551 - protein, 29 aa, Staphylococcus
EVNKIIKAIHFIGTFTVEFFIDQQNQLYV

SEQ ID NO: 2010552 - protein, 27 aa, Staphylococcus
EVNKSAAQVVIRWNMQHGVIVIPKSVT

SEQ ID NO: 2010553 - protein, 31 aa, Staphylococcus
EVNLERAMHSNGRFGGHFVLGHVDELGTITK

SEQ ID NO: 2010554 - protein, 17 aa, Staphylococcus
EVNRLINDMIYFVRDTI

SEQ ID NO: 2010555 - protein, 18 aa, Staphylococcus
EVNVPIILEKDIYKATAM

SEQ ID NO: 2010556 - protein, 18 aa, Staphylococcus
EVPAGIMTKCPKCKKIMY

SEQ ID NO: 2010557 - protein, 17 aa, Staphylococcus
EVPCVKRNAAGASNAIV

SEQ ID NO: 2010558 - protein, 24 aa, Staphylococcus
EVPEGLVPLLKIQGLGSKKIAKLY

SEQ ID NO: 2010559 - protein, 22 aa, Staphylococcus
EVPVKTARKILADDFADELIDQ

SEQ ID NO: 2010560 - protein, 20 aa, Staphylococcus
EVPVKTARKILADEYADELI

SEQ ID NO: 2010561 - protein, 18 aa, Staphylococcus
EVPVRKLPSAAIIATGSE

SEQ ID NO: 2010562 - protein, 23 aa, Staphylococcus
EVQDLLIPLTFHFSKDEQLIIDQ

SEQ ID NO: 2010563 - protein, 24 aa, Staphylococcus
EVQDLLIPLTFHFSKDEQMIIDQY

SEQ ID NO: 2010564 - protein, 19 aa, Staphylococcus
EVQDQIALAINEEVLALED

SEQ ID NO: 2010565 - protein, 23 aa, Staphylococcus
EVQEMNGGLFIKKKEESIKDKIT

SEQ ID NO: 2010566 - protein, 18 aa, Staphylococcus
EVQERLGVELETEVKLLA

SEQ ID NO: 2010567 - protein, 21 aa, Staphylococcus
EVQKLAVNFIFKKLEQKFEIK

SEQ ID NO: 2010568 - protein, 23 aa, Staphylococcus
EVQKRSGNHFIIYNNKDTTKSIV

SEQ ID NO: 2010569 - protein, 23 aa, Staphylococcus
EVQNGDYCGYSWAFETQHDNTKL

SEQ ID NO: 2010570 - protein, 20 aa, Staphylococcus
EVQTGITIMYMVKKLDAGNI

SEQ ID NO: 2010571 - protein, 17 aa, Staphylococcus
EVRALTWEDINFKEEYI

SEQ ID NO: 2010572 - protein, 18 aa, Staphylococcus
EVRIPIRMDDGTVKTFTG

SEQ ID NO: 2010573 - protein, 23 aa, Staphylococcus
EVRKASYTLHRRVYVSKLDKVKM

SEQ ID NO: 2010574 - protein, 20 aa, Staphylococcus
EVRMPKIGGRVMSLQDPTKK

SEQ ID NO: 2010575 - protein, 19 aa, Staphylococcus
EVRNAFTPKTVAEMIDAFS

SEQ ID NO: 2010576 - protein, 19 aa, Staphylococcus
EVRNAFTPKTVAEMIDAFT

SEQ ID NO: 2010577 - protein, 19 aa, Staphylococcus
EVRNAFTPKTVQEMMDAFS

SEQ ID NO: 2010578 - protein, 19 aa, Staphylococcus
EVRNMFGYTGTYKGKEVSV

SEQ ID NO: 2010579 - protein, 33 aa, Staphylococcus
EVRPERRSTLGLRWLVNYARLRGEKTMEERLAN

SEQ ID NO: 2010580 - protein, 22 aa, Staphylococcus
EVRRHLHEYPELSFHETETPKY

SEQ ID NO: 2010581 - protein, 23 aa, Staphylococcus
EVRTYSPEFEKIINLKVMLIHNE

SEQ ID NO: 2010582 - protein, 18 aa, Staphylococcus
EVRWLEGDMTSFELNQKF

SEQ ID NO: 2010583 - protein, 20 aa, Staphylococcus
EVSCGKGTYIRTLATDIGKK

SEQ ID NO: 2010584 - protein, 21 aa, Staphylococcus
EVSEAAVLNANYIKARLKDAF

SEQ ID NO: 2010585 - protein, 21 aa, Staphylococcus
EVSEAAVLNANYIKARLKDHF

SEQ ID NO: 2010586 - protein, 21 aa, Staphylococcus
EVSEAAVLNANYIKARLKDRY

SEQ ID NO: 2010587 - protein, 19 aa, Staphylococcus
EVSEAAVLNANYIKASLKD

SEQ ID NO: 2010588 - protein, 32 aa, Staphylococcus
EVSEAAVLNANYLKARLTDHFEIPYKQYCKHE

SEQ ID NO: 2010589 - protein, 22 aa, Staphylococcus
EVSEALPASILHKHPNVEVIID

SEQ ID NO: 2010590 - protein, 22 aa, Staphylococcus
EVSEGRGIMSYEMGSDGSGGKY

SEQ ID NO: 2010591 - protein, 22 aa, Staphylococcus
EVSGPICIAGSIGSYEQLDLIK

SEQ ID NO: 2010592 - protein, 19 aa, Staphylococcus
EVSHRGKAIEKLRQYLEGD

SEQ ID NO: 2010593 - protein, 24 aa, Staphylococcus
EVSILKMQLLIWITETQTGDIQEL

SEQ ID NO: 2010594 - protein, 23 aa, Staphylococcus
EVSILKMQLLIWITETTTGDIQE

SEQ ID NO: 2010595 - protein, 21 aa, Staphylococcus
EVSRIYLNFSDPWPKKRHAKR

SEQ ID NO: 2010596 - protein, 26 aa, Staphylococcus
EVSSHGLALGRLRGVEFDVAIFSNLT

SEQ ID NO: 2010597 - protein, 26 aa, Staphylococcus
EVSSHGLALGRLRGVEFDVAVFSNLT

SEQ ID NO: 2010598 - protein, 23 aa, Staphylococcus
EVSTVEALLDMLSNHFDINIHQQ

SEQ ID NO: 2010599 - protein, 21 aa, Staphylococcus
EVTAATFACFGYGWHVDVGIH

SEQ ID NO: 2010600 - protein, 21 aa, Staphylococcus
EVTLDLKLLFNTNAVLNFPPE

SEQ ID NO: 2010601 - protein, 18 aa, Staphylococcus
EVTLELKLLADVGLVGFP

SEQ ID NO: 2010602 - protein, 24 aa, Staphylococcus
EVTLFKSVGLAIVDIVVANYFYKK

SEQ ID NO: 2010603 - protein, 24 aa, Staphylococcus
EVTLFKSVGLAIVDIVVAQYFYKK

SEQ ID NO: 2010604 - protein, 20 aa, Staphylococcus
EVTLNFWLRHFHGEHDQKLL

SEQ ID NO: 2010605 - protein, 26 aa, Staphylococcus
EVTPEQCNQLGLALAEKFATNHQVAV

SEQ ID NO: 2010606 - protein, 26 aa, Staphylococcus
EVTPEQCNQLGLALAKKFATNHQVAV

SEQ ID NO: 2010607 - protein, 21 aa, Staphylococcus
EVTPSMMIFTNFFRDQMDRFG

SEQ ID NO: 2010608 - protein, 22 aa, Staphylococcus
EVTQLLQLRQKYFISVTTMKDN

SEQ ID NO: 2010609 - protein, 23 aa, Staphylococcus
EVTRPRGTVVIVSIFAHPVEFDP

SEQ ID NO: 2010610 - protein, 32 aa, Staphylococcus
EVTVISKAFWPEFFEHSYPGIKLITKDYDKED

SEQ ID NO: 2010611 - protein, 18 aa, Staphylococcus
EVTVSRYLFDKHPNLPEG

SEQ ID NO: 2010612 - protein, 21 aa, Staphylococcus
EVVARVKAILRRSAIVNEAVP

SEQ ID NO: 2010613 - protein, 22 aa, Staphylococcus
EVVDLRTVYPLDKETIIDRAKQ

SEQ ID NO: 2010614 - protein, 18 aa, Staphylococcus
EVVFKCFANVYQPSQKDL

SEQ ID NO: 2010615 - protein, 29 aa, Staphylococcus
EVVGKLNALNCVKAFLKAGYDAGRHQIRI

SEQ ID NO: 2010616 - protein, 18 aa, Staphylococcus
EVVIAPRFTDEALDILTK

SEQ ID NO: 2010617 - protein, 19 aa, Staphylococcus
EVVIAPRFTDEALDILTKK

SEQ ID NO: 2010618 - protein, 23 aa, Staphylococcus
EVVLDCHPDVNILIGENAQGKTN

SEQ ID NO: 2010619 - protein, 22 aa, Staphylococcus
EVVLISAHKGWGIDALLESINR

SEQ ID NO: 2010620 - protein, 25 aa, Staphylococcus
EVVPIWKKEIWEDGAEWIGHQRGYH

SEQ ID NO: 2010621 - protein, 20 aa, Staphylococcus
EVVRHLPIDINRSGRVIINQ

SEQ ID NO: 2010622 - protein, 24 aa, Staphylococcus
EVVVDRLVVKSGIETRLADSIETS

SEQ ID NO: 2010623 - protein, 20 aa, Staphylococcus
EVWLSDQRVELIARHITENH

SEQ ID NO: 2010624 - protein, 23 aa, Staphylococcus
EVWMSDDRIELIVRHIIENHDKY

SEQ ID NO: 2010625 - protein, 17 aa, Staphylococcus
EVYDFDADPGWLGPKNM

SEQ ID NO: 2010626 - protein, 30 aa, Staphylococcus
EVYDMMRYWLDKGVDGFRMDVINMISKDPN

SEQ ID NO: 2010627 - protein, 25 aa, Staphylococcus
EVYDPRKYLGPAREAIKATVTGKIK

SEQ ID NO: 2010628 - protein, 26 aa, Staphylococcus
EVYDPRKYLGPAREAIKETVKGKIRE

SEQ ID NO: 2010629 - protein, 17 aa, Staphylococcus
EVYFKHQLLVLDHSEYL

SEQ ID NO: 2010630 - protein, 17 aa, Staphylococcus
EVYHYVHQIFPLSTRRE

SEQ ID NO: 2010631 - protein, 17 aa, Staphylococcus
EVYKHALLTGAVATEDI

SEQ ID NO: 2010632 - protein, 17 aa, Staphylococcus
EVYPKLEAYGIKQIAQR

SEQ ID NO: 2010633 - protein, 19 aa, Staphylococcus
EVYPKLEAYGIKQIAQRTA

SEQ ID NO: 2010634 - protein, 17 aa, Staphylococcus
EVYRRKLSYIPEAPVIY

SEQ ID NO: 2010635 - protein, 21 aa, Staphylococcus
EWAACIHALEHARELKVNNAL

SEQ ID NO: 2010636 - protein, 27 aa, Staphylococcus
EWFLNPDHLPLILGIEKGWFKEEALEI

SEQ ID NO: 2010637 - protein, 28 aa, Staphylococcus
EWFLNPDHMPLILGIEKGWFKEQNLEVE

SEQ ID NO: 2010638 - protein, 18 aa, Staphylococcus
EWGTLKGKTLTYIGDARN

SEQ ID NO: 2010639 - protein, 22 aa, Staphylococcus
EWIENYSVYALEDHKFNESVHI

SEQ ID NO: 2010640 - protein, 21 aa, Staphylococcus
EWIILAGYMRLVGPDLLNAYE

SEQ ID NO: 2010641 - protein, 23 aa, Staphylococcus
EWIKRAEVYIDGFHNFSTLEYQI

SEQ ID NO: 2010642 - protein, 25 aa, Staphylococcus
EWIVLAGYMKLIGENILRAYDKRIL

SEQ ID NO: 2010643 - protein, 24 aa, Staphylococcus
EWLVKEGYSLLTLPVEYGGEGATI

SEQ ID NO: 2010644 - protein, 30 aa, Staphylococcus
EWMLDFRLKALKLFYKMPMPQWGGDLSELN

SEQ ID NO: 2010645 - protein, 23 aa, Staphylococcus
EWPIDRKGAYVIHRLAGSQSYKG

SEQ ID NO: 2010646 - protein, 19 aa, Staphylococcus
EWQNAKFPVVQNVNALGET

SEQ ID NO: 2010647 - protein, 22 aa, Staphylococcus
EWRRTFHRYPEVSYKEFETTKR

SEQ ID NO: 2010648 - protein, 18 aa, Staphylococcus
EWSAFIHALEHARELNVS

SEQ ID NO: 2010649 - protein, 25 aa, Staphylococcus
EWVVEADAWYGPQLEHIKYVDDLRP

SEQ ID NO: 2010650 - protein, 21 aa, Staphylococcus
EWYIYSVGFRNSFVNGMTKDD

SEQ ID NO: 2010651 - protein, 18 aa, Staphylococcus
EWYLCKFSNQILEEDKNQ

SEQ ID NO: 2010652 - protein, 19 aa, Staphylococcus
EYAESLFNMRTIPAYDNKK

SEQ ID NO: 2010653 - protein, 24 aa, Staphylococcus
EYALKITLKRVHFINELETLAKPI

SEQ ID NO: 2010654 - protein, 20 aa, Staphylococcus
EYALKVTLRREHFIKELEQL

SEQ ID NO: 2010655 - protein, 19 aa, Staphylococcus
EYANKELKPMGVNVSADVF

SEQ ID NO: 2010656 - protein, 20 aa, Staphylococcus
EYAPGMPFYAHNGQVIRLEL

SEQ ID NO: 2010657 - protein, 19 aa, Staphylococcus
EYCGFKVSNQLIYQTVKFM

SEQ ID NO: 2010658 - protein, 24 aa, Staphylococcus
EYCGFRVSNQLIYQTVKYMMDTAN

SEQ ID NO: 2010659 - protein, 21 aa, Staphylococcus
EYDGKPGLEKALSNTYDLILL

SEQ ID NO: 2010660 - protein, 19 aa, Staphylococcus
EYDLDVLHMHYAVPHAVCG

SEQ ID NO: 2010661 - protein, 20 aa, Staphylococcus
EYDPLCEVITDKVTAEVPST

SEQ ID NO: 2010662 - protein, 19 aa, Staphylococcus
EYEIIEFLNKILSFNQYFE

SEQ ID NO: 2010663 - protein, 24 aa, Staphylococcus
EYELPILGIHNMKNAAIAIAVGQE

SEQ ID NO: 2010664 - protein, 26 aa, Staphylococcus
EYEQAETWLRFNLKEINRELFEYAQT

SEQ ID NO: 2010665 - protein, 23 aa, Staphylococcus
EYERFKAGYARYYNLSPDQIIAG

SEQ ID NO: 2010666 - protein, 22 aa, Staphylococcus
EYEVNYIFPFMGRVRKTADIIN

SEQ ID NO: 2010667 - protein, 19 aa, Staphylococcus
EYFIGDSYLNMLSTEGITI

SEQ ID NO: 2010668 - protein, 18 aa, Staphylococcus
EYFTREGEPLIYVNYTTS

SEQ ID NO: 2010669 - protein, 17 aa, Staphylococcus
EYGCQKVVIAAGNEAHV

SEQ ID NO: 2010670 - protein, 19 aa, Staphylococcus
EYGDVVGFFVLHQYYQHEG

SEQ ID NO: 2010671 - protein, 23 aa, Staphylococcus
EYGHKEVYLGVPTLINQNGAVKI

SEQ ID NO: 2010672 - protein, 25 aa, Staphylococcus
EYGKTECWYILDAEPGSEIIYGVEA

SEQ ID NO: 2010673 - protein, 18 aa, Staphylococcus
EYGLRVITTAGRNESKEW

SEQ ID NO: 2010674 - protein, 18 aa, Staphylococcus
EYGNIFKYLINHVQTTQD

SEQ ID NO: 2010675 - protein, 20 aa, Staphylococcus
EYGVDVYVDFISKEVTSIFI

SEQ ID NO: 2010676 - protein, 25 aa, Staphylococcus
EYIALEFASLFAHLDVDVTVLANHD

SEQ ID NO: 2010677 - protein, 23 aa, Staphylococcus
EYIELDWLIADMLKRSQRADSNF

SEQ ID NO: 2010678 - protein, 17 aa, Staphylococcus
EYIEWHCGNAFANSHYV

SEQ ID NO: 2010679 - protein, 19 aa, Staphylococcus
EYIHFPKEHLLPYKLKDHP

SEQ ID NO: 2010680 - protein, 23 aa, Staphylococcus
EYIPTDFIEEFTFNTTRAANNLI

SEQ ID NO: 2010681 - protein, 20 aa, Staphylococcus
EYISLGLISQILKDENINYE

SEQ ID NO: 2010682 - protein, 19 aa, Staphylococcus
EYISLGLISQILKDETTNY

SEQ ID NO: 2010683 - protein, 28 aa, Staphylococcus
EYKDLVVSVRVGMEMDRSELLRKLVDVQ

SEQ ID NO: 2010684 - protein, 18 aa, Staphylococcus
EYKNARYRDLTTFFDSPL

SEQ ID NO: 2010685 - protein, 26 aa, Staphylococcus
EYKNKYPLILVHGFFGGVGENRPVFY

SEQ ID NO: 2010686 - protein, 17 aa, Staphylococcus
EYKQAFEDLTYFQIKLI

SEQ ID NO: 2010687 - protein, 18 aa, Staphylococcus
EYKVLKNTMVRRAAQQAG

SEQ ID NO: 2010688 - protein, 22 aa, Staphylococcus
EYLASSLAQVFISIARGRMQPV

SEQ ID NO: 2010689 - protein, 18 aa, Staphylococcus
EYLEGPIFISTDKPDPLL

SEQ ID NO: 2010690 - protein, 18 aa, Staphylococcus
EYLEGPVFISTDKPDPFL

SEQ ID NO: 2010691 - protein, 19 aa, Staphylococcus
EYLEGPVFISTDKPDPLLG

SEQ ID NO: 2010692 - protein, 19 aa, Staphylococcus
EYLGELLFDDIPYLKVAQE

SEQ ID NO: 2010693 - protein, 22 aa, Staphylococcus
EYLIVYKGDFDYIANINETLLD

SEQ ID NO: 2010694 - protein, 21 aa, Staphylococcus
EYLKIKFYYEAGREKSVDEFL

SEQ ID NO: 2010695 - protein, 20 aa, Staphylococcus
EYLKQLRFTGHIHAMQEGEL

SEQ ID NO: 2010696 - protein, 31 aa, Staphylococcus
EYLKYAEHFVRVFDFPFYYRGEVYDPFNSNT

SEQ ID NO: 2010697 - protein, 19 aa, Staphylococcus
EYLNDCRYFGQAQVDFKTW

SEQ ID NO: 2010698 - protein, 22 aa, Staphylococcus
EYLNGRVPLIASGGINTPETAL

SEQ ID NO: 2010699 - protein, 18 aa, Staphylococcus
EYLSECFDKIEKLYPNIV

SEQ ID NO: 2010700 - protein, 17 aa, Staphylococcus
EYLTFWGEFASDLKQTN

SEQ ID NO: 2010701 - protein, 24 aa, Staphylococcus
EYLTKRENLGLVIQLVDLRHNPTE

SEQ ID NO: 2010702 - protein, 25 aa, Staphylococcus
EYLVEGAELFGFIYYADNKKIYIHD

SEQ ID NO: 2010703 - protein, 31 aa, Staphylococcus
EYLVYMLGFMPGFPFLGGLDERIHTPRRSEP

SEQ ID NO: 2010704 - protein, 30 aa, Staphylococcus
EYLVYMLGFMPGFPFLGGLDSRLHTPRRDE

SEQ ID NO: 2010705 - protein, 22 aa, Staphylococcus
EYMDFTEIVPISALEGLNVDHF

SEQ ID NO: 2010706 - protein, 21 aa, Staphylococcus
EYNFKSICVNPTHVKYAAERL

SEQ ID NO: 2010707 - protein, 19 aa, Staphylococcus
EYNLYGLLHRKIFYVNNSS

SEQ ID NO: 2010708 - protein, 30 aa, Staphylococcus
EYNQFMGAYRLQWEMIKFAKKNHIDRYNFY

SEQ ID NO: 2010709 - protein, 19 aa, Staphylococcus
EYPAFYKLIDTVRKDQYFE

SEQ ID NO: 2010710 - protein, 25 aa, Staphylococcus
EYPDLKLGIITPFYGHTSKWNEQNQ

SEQ ID NO: 2010711 - protein, 25 aa, Staphylococcus
EYPKMFHDFPLFPIHESHKVIKQIT

SEQ ID NO: 2010712 - protein, 20 aa, Staphylococcus
EYPLIEVGEFELNRNPNNYF

SEQ ID NO: 2010713 - protein, 19 aa, Staphylococcus
EYQDVHWLIYHTKRAKQKN

SEQ ID NO: 2010714 - protein, 26 aa, Staphylococcus
EYQEFLQNEIARWIKIQEDIGLDVLV

SEQ ID NO: 2010715 - protein, 19 aa, Staphylococcus
EYQGRGIGKLIINTLEDDE

SEQ ID NO: 2010716 - protein, 21 aa, Staphylococcus
EYQKRLGAYTKIEIIEVPDEK

SEQ ID NO: 2010717 - protein, 24 aa, Staphylococcus
EYQLGLKGYQAYYLSEKTPQALLT

SEQ ID NO: 2010718 - protein, 28 aa, Staphylococcus
EYQYKIPHGHAIMFGIIYQFIVANEILR

SEQ ID NO: 2010719 - protein, 29 aa, Staphylococcus
EYRDLVVSIRAGMEMDRSELLKKLVDVQY

SEQ ID NO: 2010720 - protein, 23 aa, Staphylococcus
EYREKETLYEFYFYSQGSQNEDI

SEQ ID NO: 2010721 - protein, 18 aa, Staphylococcus
EYRIKDNHFGRWITNKPT

SEQ ID NO: 2010722 - protein, 21 aa, Staphylococcus
EYRKQLKLSVNQLSKLSNVSV

SEQ ID NO: 2010723 - protein, 18 aa, Staphylococcus
EYSGNAWQGKKENVDFYL

SEQ ID NO: 2010724 - protein, 17 aa, Staphylococcus
EYSLYLSKNEYLLYKHD

SEQ ID NO: 2010725 - protein, 23 aa, Staphylococcus
EYTDKIIDAFGMRPYIKKKVKKY

SEQ ID NO: 2010726 - protein, 17 aa, Staphylococcus
EYYEAFVSWTKKRYGFT

SEQ ID NO: 2010727 - protein, 26 aa, Staphylococcus
EYYHLPRRVYEAIHEMTFDELKRTDA

SEQ ID NO: 2010728 - protein, 21 aa, Staphylococcus
EYYLPDAVALILHNHGIAEVY

SEQ ID NO: 2010729 - protein, 23 aa, Staphylococcus
EYYQELWGLPSQVQISPYMIDAH

SEQ ID NO: 2010730 - protein, 17 aa, Staphylococcus
EYYTHFTSPIRRYPDLT

SEQ ID NO: 2010731 - protein, 24 aa, Staphylococcus
EYYYEYKKFGILPEKEYAINKVKK

SEQ ID NO: 2010732 - protein, 21 aa, Staphylococcus
FAAEKLKKWGLPANRNTVRLH

SEQ ID NO: 2010733 - protein, 24 aa, Staphylococcus
FAAGDARRGPSLVVWAIKEGRAVA

SEQ ID NO: 2010734 - protein, 24 aa, Staphylococcus
FAAGDARRGQSLVVWAIQEGRAVA

SEQ ID NO: 2010735 - protein, 28 aa, Staphylococcus
FAAGDARRGQSLVVWAIREGRGVAKAVH

SEQ ID NO: 2010736 - protein, 17 aa, Staphylococcus
FAAIPWVAIMDKDVTTT

SEQ ID NO: 2010737 - protein, 19 aa, Staphylococcus
FAALAFKVMTDPYVGKLTF

SEQ ID NO: 2010738 - protein, 17 aa, Staphylococcus
FAANLGLIDIEMGKEIM

SEQ ID NO: 2010739 - protein, 17 aa, Staphylococcus
FAAVGFGGVTALQIVNK

SEQ ID NO: 2010740 - protein, 18 aa, Staphylococcus
FADDIILLLDYLYIDQAA

SEQ ID NO: 2010741 - protein, 18 aa, Staphylococcus
FADMNVFVILSYANQPFI

SEQ ID NO: 2010742 - protein, 19 aa, Staphylococcus
FADNSYINISWFKGNGSEF

SEQ ID NO: 2010743 - protein, 20 aa, Staphylococcus
FADTASPIWIYTENENLKNQ

SEQ ID NO: 2010744 - protein, 25 aa, Staphylococcus
FADYFRYEVPYSFEEARAGDIKHSY

SEQ ID NO: 2010745 - protein, 21 aa, Staphylococcus
FAEAGFASLVFDYRNFGNSGG

SEQ ID NO: 2010746 - protein, 18 aa, Staphylococcus
FAEAKVFVKENMTDVIQH

SEQ ID NO: 2010747 - protein, 17 aa, Staphylococcus
FAEEAVREIPDASISFE

SEQ ID NO: 2010748 - protein, 24 aa, Staphylococcus
FAEEGKPVLGVCNGFQVLTEVGLL

SEQ ID NO: 2010749 - protein, 27 aa, Staphylococcus
FAEGYYLTKEGMEWFWNQYTTSEQERN

SEQ ID NO: 2010750 - protein, 17 aa, Staphylococcus
FAEHFMKLYDKTKNMSL

SEQ ID NO: 2010751 - protein, 28 aa, Staphylococcus
FAEMGLKCLRTSIAWTRIFPNGNETEPN

SEQ ID NO: 2010752 - protein, 22 aa, Staphylococcus
FAERKRAMIAPSYFQPDAEAFE

SEQ ID NO: 2010753 - protein, 19 aa, Staphylococcus
FAETSLRPLGRTAAGVKGI

SEQ ID NO: 2010754 - protein, 19 aa, Staphylococcus
FAETSLRPLGRTAAGVRGI

SEQ ID NO: 2010755 - protein, 23 aa, Staphylococcus
FAEYALKITLRREHFINELESLA

SEQ ID NO: 2010756 - protein, 21 aa, Staphylococcus
FAEYFERFLFEHPAVGRIIVE

SEQ ID NO: 2010757 - protein, 24 aa, Staphylococcus
FAFEFNGIPTVVPRDFKYDFDLED

SEQ ID NO: 2010758 - protein, 18 aa, Staphylococcus
FAFEFNGVPTAVPRNFEY

SEQ ID NO: 2010759 - protein, 17 aa, Staphylococcus
FAFELPITQTEQQLIRN

SEQ ID NO: 2010760 - protein, 17 aa, Staphylococcus
FAGALAYQRNAKHIITG

SEQ ID NO: 2010761 - protein, 17 aa, Staphylococcus
FAGALAYQTNAKHIITG

SEQ ID NO: 2010762 - protein, 17 aa, Staphylococcus
FAGCGIVKDSDPDSELA

SEQ ID NO: 2010763 - protein, 17 aa, Staphylococcus
FAGGGANIYRHWSDYFP

SEQ ID NO: 2010764 - protein, 17 aa, Staphylococcus
FAGGLIVLNEVGGVASN

SEQ ID NO: 2010765 - protein, 17 aa, Staphylococcus
FAGIDYTIHVGRALGER

SEQ ID NO: 2010766 - protein, 25 aa, Staphylococcus
FAGVHKLPLVCVIINNKYAISVPDS

SEQ ID NO: 2010767 - protein, 26 aa, Staphylococcus
FAHGEIHLDINFGLYATRDSKIENIK

SEQ ID NO: 2010768 - protein, 18 aa, Staphylococcus
FAHKSTTHTIHYAKEERL

SEQ ID NO: 2010769 - protein, 17 aa, Staphylococcus
FAHRDLINLAHRYNKQV

SEQ ID NO: 2010770 - protein, 18 aa, Staphylococcus
FAIHTGIKLTDLLNMKVK

SEQ ID NO: 2010771 - protein, 18 aa, Staphylococcus
FAIQLAKAIGAYVATTTS

SEQ ID NO: 2010772 - protein, 32 aa, Staphylococcus
FAISIGIYRNGKPYAGFVYDVMKDVLYHAKVG

SEQ ID NO: 2010773 - protein, 28 aa, Staphylococcus
FAITNLYGYASLERVVHLMKHLYNRDMT

SEQ ID NO: 2010774 - protein, 21 aa, Staphylococcus
FAKALLFAPLYPADIENVRDL

SEQ ID NO: 2010775 - protein, 18 aa, Staphylococcus
FAKANPFTRFIRATASFT

SEQ ID NO: 2010776 - protein, 18 aa, Staphylococcus
FAKDKGLIDLAEKIYSDN

SEQ ID NO: 2010777 - protein, 19 aa, Staphylococcus
FAKQHGVTVKEVLIGFKFI

SEQ ID NO: 2010778 - protein, 18 aa, Staphylococcus
FAKTFDLPIIEVIEGGDM

SEQ ID NO: 2010779 - protein, 23 aa, Staphylococcus
FAKVPVVAGFGIRNVQHVKDISQ

SEQ ID NO: 2010780 - protein, 19 aa, Staphylococcus
FALAKSLGATAVFNSGEAH

SEQ ID NO: 2010781 - protein, 19 aa, Staphylococcus
FALLGKPGFEDMKKDLEAR

SEQ ID NO: 2010782 - protein, 19 aa, Staphylococcus
FALMDHLVDVSITYVVAQI

SEQ ID NO: 2010783 - protein, 19 aa, Staphylococcus
FALMDHLVEMSITYTSAQI

SEQ ID NO: 2010784 - protein, 18 aa, Staphylococcus
FALNEEAFEMAFDMFTEV

SEQ ID NO: 2010785 - protein, 31 aa, Staphylococcus
FALNSFKQPIVWLCGGLDRGNDFDELIPYMK

SEQ ID NO: 2010786 - protein, 21 aa, Staphylococcus
FALSEGNLFYEFEKDQPIPKN

SEQ ID NO: 2010787 - protein, 19 aa, Staphylococcus
FALTLVGRPEFLILDEPTT

SEQ ID NO: 2010788 - protein, 17 aa, Staphylococcus
FALTYQVMGVFDPNQLD

SEQ ID NO: 2010789 - protein, 26 aa, Staphylococcus
FALYKRKIPLVLVFEGMDAAGKGGNI

SEQ ID NO: 2010790 - protein, 17 aa, Staphylococcus
FAMISSIDIAKIAAHIF

SEQ ID NO: 2010791 - protein, 20 aa, Staphylococcus
FAMRRRFRFIEIKANENIEM

SEQ ID NO: 2010792 - protein, 28 aa, Staphylococcus
FAMSLGYEKFKIALLSSVEKPIKKIQSS

SEQ ID NO: 2010793 - protein, 25 aa, Staphylococcus
FAMSPKDLKLIEAIPKMMDIGVDSL

SEQ ID NO: 2010794 - protein, 20 aa, Staphylococcus
FAMSPKDLKLIESIPNMMDI

SEQ ID NO: 2010795 - protein, 20 aa, Staphylococcus
FAMSPKDLKLIESIPQMMDI

SEQ ID NO: 2010796 - protein, 20 aa, Staphylococcus
FAMSPKDLKLIESIPQMMDL

SEQ ID NO: 2010797 - protein, 21 aa, Staphylococcus
FAMSPKDLKLIESIPQMMEIG

SEQ ID NO: 2010798 - protein, 17 aa, Staphylococcus
FAMSVGMAMAEDHLAGK

SEQ ID NO: 2010799 - protein, 19 aa, Staphylococcus
FANASKELAQWVQEDKIKT

SEQ ID NO: 2010800 - protein, 17 aa, Staphylococcus
FANEKMNSFSINVTSFG

SEQ ID NO: 2010801 - protein, 17 aa, Staphylococcus
FANGEGYMNVLGKNNNV

SEQ ID NO: 2010802 - protein, 17 aa, Staphylococcus
FANIFFMMMNYYSIERS

SEQ ID NO: 2010803 - protein, 20 aa, Staphylococcus
FANLDSRAIWYIFEESEIST

SEQ ID NO: 2010804 - protein, 21 aa, Staphylococcus
FANNIKLQFILIHKNIAKTHA

SEQ ID NO: 2010805 - protein, 24 aa, Staphylococcus
FANPRGELSRAFAFATDETGFVGV

SEQ ID NO: 2010806 - protein, 21 aa, Staphylococcus
FANSEWNRVDIPWKEKYLDQH

SEQ ID NO: 2010807 - protein, 18 aa, Staphylococcus
FANTFFMMMNYYSIERSM

SEQ ID NO: 2010808 - protein, 17 aa, Staphylococcus
FANTVIEEYSYKIVDEK

SEQ ID NO: 2010809 - protein, 17 aa, Staphylococcus
FANTVIEEYSYKVVEDD

SEQ ID NO: 2010810 - protein, 19 aa, Staphylococcus
FANYFVIEFNHTIIGYLGL

SEQ ID NO: 2010811 - protein, 19 aa, Staphylococcus
FAPELKADTVLQERLRSFP

SEQ ID NO: 2010812 - protein, 19 aa, Staphylococcus
FAPELKADTVLQERLRSLS

SEQ ID NO: 2010813 - protein, 17 aa, Staphylococcus
FAPLADFELILKAKQKA

SEQ ID NO: 2010814 - protein, 19 aa, Staphylococcus
FAPSVMVAFGYRKEEPKDK

SEQ ID NO: 2010815 - protein, 18 aa, Staphylococcus
FAPSVMVAFGYRKENPTK

SEQ ID NO: 2010816 - protein, 24 aa, Staphylococcus
FAPTMKVKSLMRMRMEGKVKKYVN

SEQ ID NO: 2010817 - protein, 19 aa, Staphylococcus
FAPTRRKDFINSRKGRYKG

SEQ ID NO: 2010818 - protein, 23 aa, Staphylococcus
FAQGGDMIDTWMKFTPLGRPGVP

SEQ ID NO: 2010819 - protein, 24 aa, Staphylococcus
FAQREVYQHYALSALPFPEKTKFE

SEQ ID NO: 2010820 - protein, 20 aa, Staphylococcus
FARDIINTIGKVGGNKFSTV

SEQ ID NO: 2010821 - protein, 18 aa, Staphylococcus
FARKGAAASNHFEGGAFV

SEQ ID NO: 2010822 - protein, 23 aa, Staphylococcus
FARLPEALNFFTWLQHLADNGVT

SEQ ID NO: 2010823 - protein, 24 aa, Staphylococcus
FARNIEIYKSIALSYGHDPSKLPI

SEQ ID NO: 2010824 - protein, 27 aa, Staphylococcus
FARSIPFKFASYMSASKFFKDYALKTN

SEQ ID NO: 2010825 - protein, 18 aa, Staphylococcus
FARVFRKHIEGGIVKAVR

SEQ ID NO: 2010826 - protein, 28 aa, Staphylococcus
FARVFRKHLEGGIIKAIRQIGNDRRIEI

SEQ ID NO: 2010827 - protein, 28 aa, Staphylococcus
FARVFRKHLEGGIIKAIRQIGNDRRVEI

SEQ ID NO: 2010828 - protein, 28 aa, Staphylococcus
FARVFRKHLEGGIIKSIRQIGNDRRVEI

SEQ ID NO: 2010829 - protein, 27 aa, Staphylococcus
FARVFRKHLEGGIVKSIRQIGNDRRVE

SEQ ID NO: 2010830 - protein, 19 aa, Staphylococcus
FASAESWDNVGLLIGNKSA

SEQ ID NO: 2010831 - protein, 19 aa, Staphylococcus
FASGLSYHVLTMLKVAKSI

SEQ ID NO: 2010832 - protein, 17 aa, Staphylococcus
FASGLSYHVLTMLRIAK

SEQ ID NO: 2010833 - protein, 20 aa, Staphylococcus
FASNLEAAYIPNADKVLDVA

SEQ ID NO: 2010834 - protein, 18 aa, Staphylococcus
FASRIPYGEPLSISKINK

SEQ ID NO: 2010835 - protein, 36 aa, Staphylococcus
FATAMNRKGYYLYGYRHFSSRIKGGHTNNKIRVSTK

SEQ ID NO: 2010836 - protein, 28 aa, Staphylococcus
FATILKYVRLGVLFPLSYYDGEWFENDT

SEQ ID NO: 2010837 - protein, 21 aa, Staphylococcus
FATQLSYPVAEILCKLLPAFV

SEQ ID NO: 2010838 - protein, 18 aa, Staphylococcus
FATTDEWQRAYGEINDFE

SEQ ID NO: 2010839 - protein, 18 aa, Staphylococcus
FATYGSFRDWPAYQYSIE

SEQ ID NO: 2010840 - protein, 18 aa, Staphylococcus
FAVLELLYSKGPQPIQRI

SEQ ID NO: 2010841 - protein, 23 aa, Staphylococcus
FAVRHLQVNAGIMITASHNPKNY

SEQ ID NO: 2010842 - protein, 19 aa, Staphylococcus
FAVRQFLRAGINTFSTTSL

SEQ ID NO: 2010843 - protein, 21 aa, Staphylococcus
FAVVGDTLFNNGIGRTDLYKG

SEQ ID NO: 2010844 - protein, 18 aa, Staphylococcus
FAYADGYEFENLDANQKL

SEQ ID NO: 2010845 - protein, 17 aa, Staphylococcus
FAYEESYGYLADDFVRD

SEQ ID NO: 2010846 - protein, 20 aa, Staphylococcus
FAYEESYGYLAGEFVRDKDA

SEQ ID NO: 2010847 - protein, 19 aa, Staphylococcus
FAYHAYKSGISIAIIQKYL

SEQ ID NO: 2010848 - protein, 17 aa, Staphylococcus
FAYKRLKQNQLINNPFI

SEQ ID NO: 2010849 - protein, 18 aa, Staphylococcus
FAYKRLKQNQLISNPFAM

SEQ ID NO: 2010850 - protein, 19 aa, Staphylococcus
FCHPSELTIDTTIEIPEKA

SEQ ID NO: 2010851 - protein, 24 aa, Staphylococcus
FCKDLELKGRILVSTEGINGTVSG

SEQ ID NO: 2010852 - protein, 30 aa, Staphylococcus
FCLELIKSYDITKELGFLNIAEFILSNIDI

SEQ ID NO: 2010853 - protein, 25 aa, Staphylococcus
FCNLNISLKIARAFRERFGYSKTIW

SEQ ID NO: 2010854 - protein, 17 aa, Staphylococcus
FCQAVASGTATAFNDDL

SEQ ID NO: 2010855 - protein, 25 aa, Staphylococcus
FCRLDRERFGLIPNITDKGYYQNSF

SEQ ID NO: 2010856 - protein, 18 aa, Staphylococcus
FCSTCTRARLSSDGKFYG

SEQ ID NO: 2010857 - protein, 19 aa, Staphylococcus
FCTKIAWIEGGKLKEFGEL

SEQ ID NO: 2010858 - protein, 23 aa, Staphylococcus
FCVRICTYCDFNKYFIAKQPVDD

SEQ ID NO: 2010859 - protein, 22 aa, Staphylococcus
FCVRICTYCDFNKYFIDKQPVD

SEQ ID NO: 2010860 - protein, 23 aa, Staphylococcus
FCVRICTYCDFNKYFIDKQPVDE

SEQ ID NO: 2010861 - protein, 24 aa, Staphylococcus
FCVRICTYCDFNKYFIHNQPVDEY

SEQ ID NO: 2010862 - protein, 22 aa, Staphylococcus
FCVRICTYCDFNKYFINKQPVD

SEQ ID NO: 2010863 - protein, 18 aa, Staphylococcus
FDAADFLKDFENLHQLFI

SEQ ID NO: 2010864 - protein, 18 aa, Staphylococcus
FDADPGWLGPKKMKAFLN

SEQ ID NO: 2010865 - protein, 17 aa, Staphylococcus
FDADPGWLGPKNMNHFL

SEQ ID NO: 2010866 - protein, 19 aa, Staphylococcus
FDADPGWLGPKNMNRFLQI

SEQ ID NO: 2010867 - protein, 18 aa, Staphylococcus
FDADPGWLGPKNMTRYRE

SEQ ID NO: 2010868 - protein, 17 aa, Staphylococcus
FDADPGWLGPKRMNHLL

SEQ ID NO: 2010869 - protein, 19 aa, Staphylococcus
FDAIILCTGAQKARDLPLE

SEQ ID NO: 2010870 - protein, 23 aa, Staphylococcus
FDAKEVTARVSVQLRNLDNKPQM

SEQ ID NO: 2010871 - protein, 18 aa, Staphylococcus
FDALNFYKKPVKMCVNCI

SEQ ID NO: 2010872 - protein, 17 aa, Staphylococcus
FDALNYIVHHEVFENIP

SEQ ID NO: 2010873 - protein, 17 aa, Staphylococcus
FDALRKGEYTSFIDKGT

SEQ ID NO: 2010874 - protein, 17 aa, Staphylococcus
FDAPMPVYIAIYQPLVT

SEQ ID NO: 2010875 - protein, 24 aa, Staphylococcus
FDAPYSGLCVESFTGDYPAGLFDY

SEQ ID NO: 2010876 - protein, 21 aa, Staphylococcus
FDCPGHQGGQYFAKHPAGRQF

SEQ ID NO: 2010877 - protein, 31 aa, Staphylococcus
FDCVKKLANMNLEYELGVLLSKKKYWYKLPD

SEQ ID NO: 2010878 - protein, 19 aa, Staphylococcus
FDDCLKEALIYTEQNHMTF

SEQ ID NO: 2010879 - protein, 17 aa, Staphylococcus
FDDCLKEALVYTDEHHM

SEQ ID NO: 2010880 - protein, 17 aa, Staphylococcus
FDDCLKEALVYTEENKM

SEQ ID NO: 2010881 - protein, 17 aa, Staphylococcus
FDDCREGQKRYKLKLKK

SEQ ID NO: 2010882 - protein, 18 aa, Staphylococcus
FDDFEWGVTLFSDDVLQF

SEQ ID NO: 2010883 - protein, 28 aa, Staphylococcus
FDDINDLLNYCWQRIASDMVVDNYDSLT

SEQ ID NO: 2010884 - protein, 18 aa, Staphylococcus
FDDIVSWFVKYEPDLVLL

SEQ ID NO: 2010885 - protein, 17 aa, Staphylococcus
FDDKNVFKLLSQGDTTG

SEQ ID NO: 2010886 - protein, 18 aa, Staphylococcus
FDDLEHVINYAYHNNQNT

SEQ ID NO: 2010887 - protein, 17 aa, Staphylococcus
FDDLRVPNKLTITEIDK

SEQ ID NO: 2010888 - protein, 17 aa, Staphylococcus
FDDLRVPNKLTLTDIDK

SEQ ID NO: 2010889 - protein, 18 aa, Staphylococcus
FDDLRVPNKLTLTSIDKV

SEQ ID NO: 2010890 - protein, 17 aa, Staphylococcus
FDDMISLMSMHKKNGYK

SEQ ID NO: 2010891 - protein, 22 aa, Staphylococcus
FDDPAGKSWSEFQRVRDEIGQK

SEQ ID NO: 2010892 - protein, 17 aa, Staphylococcus
FDDRGFLSSVTFFNENK

SEQ ID NO: 2010893 - protein, 21 aa, Staphylococcus
FDDVNLYIAAAKRRKHEIQTN

SEQ ID NO: 2010894 - protein, 19 aa, Staphylococcus
FDDVSLYIAAAQRKKQDIN

SEQ ID NO: 2010895 - protein, 17 aa, Staphylococcus
FDEAHCISKWGHDFRPS

SEQ ID NO: 2010896 - protein, 17 aa, Staphylococcus
FDEAIHFNQYDAHSIFV

SEQ ID NO: 2010897 - protein, 17 aa, Staphylococcus
FDEARFETIFKKLKKHN

SEQ ID NO: 2010898 - protein, 23 aa, Staphylococcus
FDEEARIPFIKKMQDEGLFASIS

SEQ ID NO: 2010899 - protein, 19 aa, Staphylococcus
FDEEGRIPFIKKMQDKGLF

SEQ ID NO: 2010900 - protein, 24 aa, Staphylococcus
FDEEGRIPFIKKMQEKGLFASISV

SEQ ID NO: 2010901 - protein, 24 aa, Staphylococcus
FDEFCNRAASFGIASWLVDLIHFN

SEQ ID NO: 2010902 - protein, 18 aa, Staphylococcus
FDEIESFYENLFTTNNID

SEQ ID NO: 2010903 - protein, 17 aa, Staphylococcus
FDEINIYGATGGRLDHF

SEQ ID NO: 2010904 - protein, 18 aa, Staphylococcus
FDEKEFREDMAQFGDSLL

SEQ ID NO: 2010905 - protein, 25 aa, Staphylococcus
FDELIPYMKNVRVMVVFGETQEKFA

SEQ ID NO: 2010906 - protein, 18 aa, Staphylococcus
FDELLDYVIISNRDSEEF

SEQ ID NO: 2010907 - protein, 17 aa, Staphylococcus
FDELSWLQDKKVALVGV

SEQ ID NO: 2010908 - protein, 17 aa, Staphylococcus
FDEQEFRSDMSKFGDSL

SEQ ID NO: 2010909 - protein, 20 aa, Staphylococcus
FDERSYFIFGGIAPKHYSHV

SEQ ID NO: 2010910 - protein, 19 aa, Staphylococcus
FDETGEWLPQETLDTIKEY

SEQ ID NO: 2010911 - protein, 19 aa, Staphylococcus
FDEVFDVLVDLGLTKVNGG

SEQ ID NO: 2010912 - protein, 20 aa, Staphylococcus
FDEVFDVLVDLGLTRVNGGF

SEQ ID NO: 2010913 - protein, 20 aa, Staphylococcus
FDFDILVVSLGFESETFGIK

SEQ ID NO: 2010914 - protein, 17 aa, Staphylococcus
FDFEGSFINAIKRIVGN

SEQ ID NO: 2010915 - protein, 21 aa, Staphylococcus
FDFEILKEMLRHHFISDEIIT

SEQ ID NO: 2010916 - protein, 18 aa, Staphylococcus
FDFGNAFNNVPEQLQKLT

SEQ ID NO: 2010917 - protein, 18 aa, Staphylococcus
FDFGRGFGGPRGGGRDRF

SEQ ID NO: 2010918 - protein, 17 aa, Staphylococcus
FDFISEDGFHQFNEFYN

SEQ ID NO: 2010919 - protein, 19 aa, Staphylococcus
FDFLSEVVYQWERMARQFE

SEQ ID NO: 2010920 - protein, 22 aa, Staphylococcus
FDGEEFKNCLKIYQSRQRRFGG

SEQ ID NO: 2010921 - protein, 23 aa, Staphylococcus
FDGELKIGQTVKVAYFKQTEETL

SEQ ID NO: 2010922 - protein, 24 aa, Staphylococcus
FDGGHNWKSWKPLLGDILKYFLDE

SEQ ID NO: 2010923 - protein, 17 aa, Staphylococcus
FDGGHNWKSWKPMLEDI

SEQ ID NO: 2010924 - protein, 19 aa, Staphylococcus
FDGGIGMLQALGATFYDDE

SEQ ID NO: 2010925 - protein, 17 aa, Staphylococcus
FDGGIGMMQALGAQFYN

SEQ ID NO: 2010926 - protein, 18 aa, Staphylococcus
FDGGVGMLQALGAKFYDD

SEQ ID NO: 2010927 - protein, 21 aa, Staphylococcus
FDGVLIPGGFSFGDYLRSGAM

SEQ ID NO: 2010928 - protein, 27 aa, Staphylococcus
FDGVNFPESFKVFGSDHSKVIFCEADD

SEQ ID NO: 2010929 - protein, 17 aa, Staphylococcus
FDGWSMFTLLSQWNQLY

SEQ ID NO: 2010930 - protein, 19 aa, Staphylococcus
FDGYSDFKSYLKFETEQSH

SEQ ID NO: 2010931 - protein, 20 aa, Staphylococcus
FDHGYGRYNFYGLSGDFTEN

SEQ ID NO: 2010932 - protein, 19 aa, Staphylococcus
FDHLCKNNLLAKLKTDLYG

SEQ ID NO: 2010933 - protein, 23 aa, Staphylococcus
FDHLERYKAIVVSTVQQAEDVRH

SEQ ID NO: 2010934 - protein, 17 aa, Staphylococcus
FDHNVILSSDDILNMDI

SEQ ID NO: 2010935 - protein, 17 aa, Staphylococcus
FDHPNNQLHLFSEFLEE

SEQ ID NO: 2010936 - protein, 21 aa, Staphylococcus
FDHQLLRRLVAFMYEQPSTLI

SEQ ID NO: 2010937 - protein, 19 aa, Staphylococcus
FDHYEEVPKSIAEDIIKKN

SEQ ID NO: 2010938 - protein, 26 aa, Staphylococcus
FDIDVPRTDWDWMIYPQGLYDQIMRV

SEQ ID NO: 2010939 - protein, 26 aa, Staphylococcus
FDIEELLARIRAILRRQPKKDTININ

SEQ ID NO: 2010940 - protein, 25 aa, Staphylococcus
FDIEELLARIRAMLRRQPQKNLIDI

SEQ ID NO: 2010941 - protein, 27 aa, Staphylococcus
FDIGHGCTRELPILAIHDISYSFEKTL

SEQ ID NO: 2010942 - protein, 18 aa, Staphylococcus
FDIHRIASIMFTSGTTGP

SEQ ID NO: 2010943 - protein, 17 aa, Staphylococcus
FDIIKVGLTRYLMTFRK

SEQ ID NO: 2010944 - protein, 18 aa, Staphylococcus
FDIKDFPNALAHYENELT

SEQ ID NO: 2010945 - protein, 25 aa, Staphylococcus
FDIKLKYADCLNELNLNKKAEKMFY

SEQ ID NO: 2010946 - protein, 20 aa, Staphylococcus
FDILIVMSHVGVFFDEKLCQ

SEQ ID NO: 2010947 - protein, 17 aa, Staphylococcus
FDINVGIVGDSKVALHQ

SEQ ID NO: 2010948 - protein, 18 aa, Staphylococcus
FDINVGIVGDVKLAFHQL

SEQ ID NO: 2010949 - protein, 25 aa, Staphylococcus
FDIPEELGVLIELFSQKNNISKFNL

SEQ ID NO: 2010950 - protein, 17 aa, Staphylococcus
FDIPFHIDIKKSMTHHP

SEQ ID NO: 2010951 - protein, 18 aa, Staphylococcus
FDIPLKGHSVAVLVNGDI

SEQ ID NO: 2010952 - protein, 20 aa, Staphylococcus
FDISFDRKFEAFLVPTVIGE

SEQ ID NO: 2010953 - protein, 22 aa, Staphylococcus
FDIYKGETLGLVGESGCGKSTT

SEQ ID NO: 2010954 - protein, 23 aa, Staphylococcus
FDIYKGETLGLVGESGCGKSTTG

SEQ ID NO: 2010955 - protein, 21 aa, Staphylococcus
FDKAAKFAMAAGISNALEART

SEQ ID NO: 2010956 - protein, 26 aa, Staphylococcus
FDKAYAQKIIDAFGMSPYIKKKVKKY

SEQ ID NO: 2010957 - protein, 24 aa, Staphylococcus
FDKKISIPYILTRALKNEKNSYIF

SEQ ID NO: 2010958 - protein, 27 aa, Staphylococcus
FDKLKSRLTMMISRFSVYLREATPEAK

SEQ ID NO: 2010959 - protein, 20 aa, Staphylococcus
FDKMMDWLAGVYINSLNIIH

SEQ ID NO: 2010960 - protein, 19 aa, Staphylococcus
FDKPGLLASILNTFVLFNI

SEQ ID NO: 2010961 - protein, 26 aa, Staphylococcus
FDKRFRFKSFILQRSEGNVMIYHSGR

SEQ ID NO: 2010962 - protein, 32 aa, Staphylococcus
FDKTEKMIRLNVEALTILTSLFVRDYENVEGT

SEQ ID NO: 2010963 - protein, 20 aa, Staphylococcus
FDLAIKLNKDIFIVVDGVMY

SEQ ID NO: 2010964 - protein, 23 aa, Staphylococcus
FDLALKRDIFFHHPYESFEPIVD

SEQ ID NO: 2010965 - protein, 20 aa, Staphylococcus
FDLDMLYHMIDIINDTLVSI

SEQ ID NO: 2010966 - protein, 20 aa, Staphylococcus
FDLEMLYHMIDIINDTLVSI

SEQ ID NO: 2010967 - protein, 18 aa, Staphylococcus
FDLGDIFHRVLKFISEKV

SEQ ID NO: 2010968 - protein, 23 aa, Staphylococcus
FDLGHFRGAIRPDITRFRDLPNW

SEQ ID NO: 2010969 - protein, 26 aa, Staphylococcus
FDLGSAEMNLDMAIEMYEGDHQVLKV

SEQ ID NO: 2010970 - protein, 19 aa, Staphylococcus
FDLITIFCDSLNYLPETND

SEQ ID NO: 2010971 - protein, 23 aa, Staphylococcus
FDLKTTEHLFLMSIHNDDNPMIA

SEQ ID NO: 2010972 - protein, 19 aa, Staphylococcus
FDLLEEIRIGSNQPNRLYP

SEQ ID NO: 2010973 - protein, 18 aa, Staphylococcus
FDLLSYGLNYAFKHYEIK

SEQ ID NO: 2010974 - protein, 21 aa, Staphylococcus
FDLMAAILLFHKVKVDGHVVF

SEQ ID NO: 2010975 - protein, 19 aa, Staphylococcus
FDLNFKRAVYAGPIANNEH

SEQ ID NO: 2010976 - protein, 19 aa, Staphylococcus
FDLRESKIHEGNLFIQQLL

SEQ ID NO: 2010977 - protein, 20 aa, Staphylococcus
FDLSFDRKFEAFLVPTVIGE

SEQ ID NO: 2010978 - protein, 17 aa, Staphylococcus
FDLSVMAIYPCLTSGGT

SEQ ID NO: 2010979 - protein, 17 aa, Staphylococcus
FDLSVMAIYPCLVSGGT

SEQ ID NO: 2010980 - protein, 23 aa, Staphylococcus
FDLWKKGMTGFPIIDAAMGELNT

SEQ ID NO: 2010981 - protein, 19 aa, Staphylococcus
FDMLRDMLQHHFISGEIIT

SEQ ID NO: 2010982 - protein, 24 aa, Staphylococcus
FDMYDLEKAREWGITITTVPSYSP

SEQ ID NO: 2010983 - protein, 19 aa, Staphylococcus
FDNAESFAMIRGGHIDLAI

SEQ ID NO: 2010984 - protein, 17 aa, Staphylococcus
FDNAGRQLAQWVQEGKI

SEQ ID NO: 2010985 - protein, 19 aa, Staphylococcus
FDNAIALEQLVEWLENLPQ

SEQ ID NO: 2010986 - protein, 27 aa, Staphylococcus
FDNATYLPRFVFGHYMKSYLEKFDQEY

SEQ ID NO: 2010987 - protein, 19 aa, Staphylococcus
FDNEYFMYGLETFAESNNS

SEQ ID NO: 2010988 - protein, 24 aa, Staphylococcus
FDNFLFSSYAKWGERSGLTLFLPH

SEQ ID NO: 2010989 - protein, 20 aa, Staphylococcus
FDNIKIVGLMTMAPYTDDKD

SEQ ID NO: 2010990 - protein, 18 aa, Staphylococcus
FDNKELFDKLAQVKNDNV

SEQ ID NO: 2010991 - protein, 18 aa, Staphylococcus
FDNKQSIFREWEKFKKDI

SEQ ID NO: 2010992 - protein, 19 aa, Staphylococcus
FDNNHLESFFFIKYRENDH

SEQ ID NO: 2010993 - protein, 19 aa, Staphylococcus
FDNVKRLAQQEGLLVGSSS

SEQ ID NO: 2010994 - protein, 17 aa, Staphylococcus
FDPAGEVDKIFKKLNQI

SEQ ID NO: 2010995 - protein, 17 aa, Staphylococcus
FDPILKSIIRERLKELT

SEQ ID NO: 2010996 - protein, 18 aa, Staphylococcus
FDPPMFARVFRKHLEGGI

SEQ ID NO: 2010997 - protein, 23 aa, Staphylococcus
FDPSLRDIKARYIALEDTLVKVV

SEQ ID NO: 2010998 - protein, 21 aa, Staphylococcus
FDQMIEWLAGVYINSLNVIHY

SEQ ID NO: 2010999 - protein, 19 aa, Staphylococcus
FDQQTTWLSVLPIYHISGL

SEQ ID NO: 2011000 - protein, 25 aa, Staphylococcus
FDQTLALEDCILYTAKTFAYGQPAD

SEQ ID NO: 2011001 - protein, 20 aa, Staphylococcus
FDRDDMEIIAGNHDEAIMSI

SEQ ID NO: 2011002 - protein, 18 aa, Staphylococcus
FDRGESYEPVIFYHDEDQ

SEQ ID NO: 2011003 - protein, 23 aa, Staphylococcus
FDRKLCEELPEIDVIFGSHTHHY

SEQ ID NO: 2011004 - protein, 17 aa, Staphylococcus
FDRLLVATGRQPNIEIV

SEQ ID NO: 2011005 - protein, 19 aa, Staphylococcus
FDRVCPNNVVGELHIGGLG

SEQ ID NO: 2011006 - protein, 34 aa, Staphylococcus
FDRYPNLNMIIGHWGEFIPFFLERMDETLFADHL

SEQ ID NO: 2011007 - protein, 24 aa, Staphylococcus
FDSDLPYKLIAKLLNDFNKRVDNI

SEQ ID NO: 2011008 - protein, 25 aa, Staphylococcus
FDSGELICIATFYSERMEKVKHKGN

SEQ ID NO: 2011009 - protein, 25 aa, Staphylococcus
FDSKEDPNLCVLKINPKTITLMNDD

SEQ ID NO: 2011010 - protein, 25 aa, Staphylococcus
FDSKEDPNLCVLKVVPKTIKLMNDD

SEQ ID NO: 2011011 - protein, 23 aa, Staphylococcus
FDSKGGFYFTDFRGYSTQPQGGV

SEQ ID NO: 2011012 - protein, 19 aa, Staphylococcus
FDSNVYSGFAFGMGPDRIA

SEQ ID NO: 2011013 - protein, 19 aa, Staphylococcus
FDSSISFGVGNKVTEFSQL

SEQ ID NO: 2011014 - protein, 18 aa, Staphylococcus
FDSSLILVGLSNTLLITE

SEQ ID NO: 2011015 - protein, 18 aa, Staphylococcus
FDSTVFPFILRGANILGI

SEQ ID NO: 2011016 - protein, 25 aa, Staphylococcus
FDSVPELKAYTIAKHYADNHLRDSG

SEQ ID NO: 2011017 - protein, 17 aa, Staphylococcus
FDTIVASGYRGALPHGV

SEQ ID NO: 2011018 - protein, 17 aa, Staphylococcus
FDTIVLTGGLGPTKDDL

SEQ ID NO: 2011019 - protein, 17 aa, Staphylococcus
FDTLEFKHDTFIELDNG

SEQ ID NO: 2011020 - protein, 22 aa, Staphylococcus
FDTQTEFFKGNKIIALGKINDL

SEQ ID NO: 2011021 - protein, 20 aa, Staphylococcus
FDVDQFFRKGILRPIDETFI

SEQ ID NO: 2011022 - protein, 25 aa, Staphylococcus
FDVDSKATLSFRTMALINKPYHIKL

SEQ ID NO: 2011023 - protein, 18 aa, Staphylococcus
FDVDVFVMGHDWEGEFDF

SEQ ID NO: 2011024 - protein, 25 aa, Staphylococcus
FDVDVPRTDWDWMIYPQGLYDQIMR

SEQ ID NO: 2011025 - protein, 26 aa, Staphylococcus
FDVDVPRTDWDWMIYPQGLYDQIMRV

SEQ ID NO: 2011026 - protein, 23 aa, Staphylococcus
FDVERFNADFAYTMDGSEYGELQ

SEQ ID NO: 2011027 - protein, 22 aa, Staphylococcus
FDVERFNADFAYTMDGSQLGEL

SEQ ID NO: 2011028 - protein, 20 aa, Staphylococcus
FDVGNLYLNRGCTAAVVGYH

SEQ ID NO: 2011029 - protein, 17 aa, Staphylococcus
FDVHTIYKMSTLFHNQC

SEQ ID NO: 2011030 - protein, 20 aa, Staphylococcus
FDVHTPYKMETLFNNQNYIE

SEQ ID NO: 2011031 - protein, 19 aa, Staphylococcus
FDVHTVFKMETLFNNQTYI

SEQ ID NO: 2011032 - protein, 17 aa, Staphylococcus
FDVINLISKGEFKDSPQ

SEQ ID NO: 2011033 - protein, 17 aa, Staphylococcus
FDVINLISKGEFKDSSK

SEQ ID NO: 2011034 - protein, 17 aa, Staphylococcus
FDVINLISKGEFRDSDK

SEQ ID NO: 2011035 - protein, 20 aa, Staphylococcus
FDVKAKLYDSIAIQDTGHKP

SEQ ID NO: 2011036 - protein, 17 aa, Staphylococcus
FDVLLTFIKSLADRYHV

SEQ ID NO: 2011037 - protein, 18 aa, Staphylococcus
FDVLPLIFQIPGKRVTYH

SEQ ID NO: 2011038 - protein, 17 aa, Staphylococcus
FDVLPLIYKLPHENQMR

SEQ ID NO: 2011039 - protein, 27 aa, Staphylococcus
FDVPDCTCVILARPTDSLVLFMQQAMR

SEQ ID NO: 2011040 - protein, 27 aa, Staphylococcus
FDVRFLPNPFYVEALRPLTGVDDEVYQ

SEQ ID NO: 2011041 - protein, 20 aa, Staphylococcus
FDVYKGETFGLVGESGCGKS

SEQ ID NO: 2011042 - protein, 28 aa, Staphylococcus
FDYGILKRPQFFFAYDIDKYDKGLRGFY

SEQ ID NO: 2011043 - protein, 17 aa, Staphylococcus
FDYGYRGNSKYLFSYFV

SEQ ID NO: 2011044 - protein, 17 aa, Staphylococcus
FDYIIPERLQSFVQIGV

SEQ ID NO: 2011045 - protein, 26 aa, Staphylococcus
FDYIIPIRLQSMIQIGMRVIVPFGPR

SEQ ID NO: 2011046 - protein, 18 aa, Staphylococcus
FDYPCPNLCGAGVAYKVS

SEQ ID NO: 2011047 - protein, 28 aa, Staphylococcus
FDYQAKGIKCVMIAKLPFMNKYNTKHWL

SEQ ID NO: 2011048 - protein, 23 aa, Staphylococcus
FDYTDVIPLPTFTSLRKVSVKIP

SEQ ID NO: 2011049 - protein, 22 aa, Staphylococcus
FDYYRYKKFGILPEMEYAIKRM

SEQ ID NO: 2011050 - protein, 22 aa, Staphylococcus
FEAEGLTVLGYREVPVDINAIA

SEQ ID NO: 2011051 - protein, 17 aa, Staphylococcus
FEAELLPYVESEAGQFN

SEQ ID NO: 2011052 - protein, 17 aa, Staphylococcus
FEAEMFDHQVLRRLVAF

SEQ ID NO: 2011053 - protein, 20 aa, Staphylococcus
FEAKAHWDIVEDLKMADFDR

SEQ ID NO: 2011054 - protein, 18 aa, Staphylococcus
FEALGVPEGQIFNVSFGE

SEQ ID NO: 2011055 - protein, 20 aa, Staphylococcus
FEALYARIGHILIEVSTDGP

SEQ ID NO: 2011056 - protein, 25 aa, Staphylococcus
FEALYARIGHILLEISTDGPGFMGD

SEQ ID NO: 2011057 - protein, 23 aa, Staphylococcus
FEALYARLGHILLEISTDGPGFM

SEQ ID NO: 2011058 - protein, 18 aa, Staphylococcus
FEANSKFDLYGHIHYHMV

SEQ ID NO: 2011059 - protein, 27 aa, Staphylococcus
FEARKPMGKSFKRACEHMDLKPEETVV

SEQ ID NO: 2011060 - protein, 24 aa, Staphylococcus
FEAVYGAGIARIYKLNKDTGEIEK

SEQ ID NO: 2011061 - protein, 21 aa, Staphylococcus
FEAVYGAGIARIYQLNKDTGE

SEQ ID NO: 2011062 - protein, 19 aa, Staphylococcus
FEAVYGAGLARIYQLNPTT

SEQ ID NO: 2011063 - protein, 21 aa, Staphylococcus
FEAVYSAGLLRLYKLDTQTGH

SEQ ID NO: 2011064 - protein, 18 aa, Staphylococcus
FEAYFVGGAVRDYIMHRT

SEQ ID NO: 2011065 - protein, 22 aa, Staphylococcus
FEAYFVGGSVRDYLMGRDIHDI

SEQ ID NO: 2011066 - protein, 17 aa, Staphylococcus
FEAYGWNYILVKDGNDL

SEQ ID NO: 2011067 - protein, 25 aa, Staphylococcus
FECGKAEDVILEWKAQGIKPDVVMV

SEQ ID NO: 2011068 - protein, 18 aa, Staphylococcus
FEDALKRIDINPLGAAAL

SEQ ID NO: 2011069 - protein, 18 aa, Staphylococcus
FEDELNHWAASNATDLLS

SEQ ID NO: 2011070 - protein, 25 aa, Staphylococcus
FEDEWKKKRLKDIVEPLKGNSGENK

SEQ ID NO: 2011071 - protein, 20 aa, Staphylococcus
FEDFKKKYIDELKNNKEQHD

SEQ ID NO: 2011072 - protein, 17 aa, Staphylococcus
FEDIPIQPTLGMEQPWR

SEQ ID NO: 2011073 - protein, 24 aa, Staphylococcus
FEDLKDLVRNGVYVKATGFGRIEV

SEQ ID NO: 2011074 - protein, 22 aa, Staphylococcus
FEDSPFKYVLLVPTDKFQFQGI

SEQ ID NO: 2011075 - protein, 22 aa, Staphylococcus
FEDYFLIVSDLIHFAKTHDVMV

SEQ ID NO: 2011076 - protein, 21 aa, Staphylococcus
FEEAYCKLKDQGALYVVIQKK

SEQ ID NO: 2011077 - protein, 20 aa, Staphylococcus
FEEDALRIIRGLRFQAQLNF

SEQ ID NO: 2011078 - protein, 31 aa, Staphylococcus
FEEDALRILRGLRFEAQLGFTIDTTTFLAMQ

SEQ ID NO: 2011079 - protein, 27 aa, Staphylococcus
FEEDALRILRGLRFQSQLNFKIENHTF

SEQ ID NO: 2011080 - protein, 18 aa, Staphylococcus
FEEGHSYAHYLLIEQAVE

SEQ ID NO: 2011081 - protein, 19 aa, Staphylococcus
FEEGHSYSHFLLIEQTVYA

SEQ ID NO: 2011082 - protein, 25 aa, Staphylococcus
FEEGPRAVLLLHGFTGNSSDVRQLG

SEQ ID NO: 2011083 - protein, 18 aa, Staphylococcus
FEEKRFNTPHTHGTGCTF

SEQ ID NO: 2011084 - protein, 18 aa, Staphylococcus
FEELKLLLDEQFDRIFNN

SEQ ID NO: 2011085 - protein, 18 aa, Staphylococcus
FEELKRTDAANVDGHDNT

SEQ ID NO: 2011086 - protein, 19 aa, Staphylococcus
FEELPLYEIGWRLIPEVWG

SEQ ID NO: 2011087 - protein, 17 aa, Staphylococcus
FEERLKAVLKEIKDSDG

SEQ ID NO: 2011088 - protein, 18 aa, Staphylococcus
FEERLKAVLKEVKDSDGR

SEQ ID NO: 2011089 - protein, 19 aa, Staphylococcus
FEERLKAVLKEVKDSDGRI

SEQ ID NO: 2011090 - protein, 18 aa, Staphylococcus
FEERLKAVLKEVKESDGR

SEQ ID NO: 2011091 - protein, 18 aa, Staphylococcus
FEERLKAVLKEVKESEGR

SEQ ID NO: 2011092 - protein, 19 aa, Staphylococcus
FEERLKYPILLSENLTSLI

SEQ ID NO: 2011093 - protein, 18 aa, Staphylococcus
FEESHGYLAQPISRDKDA

SEQ ID NO: 2011094 - protein, 21 aa, Staphylococcus
FEETPCDFVDGSKGVRLAYEN

SEQ ID NO: 2011095 - protein, 20 aa, Staphylococcus
FEEVAKIISLVLKDPENEKA

SEQ ID NO: 2011096 - protein, 21 aa, Staphylococcus
FEEVAKIISLVVQNPKDEAKL

SEQ ID NO: 2011097 - protein, 20 aa, Staphylococcus
FEEVIYLLWHYRLPNEEELK

SEQ ID NO: 2011098 - protein, 18 aa, Staphylococcus
FEEYYDYILPEIKDKQNE

SEQ ID NO: 2011099 - protein, 19 aa, Staphylococcus
FEGEGLGVIGYRDVPVNKE

SEQ ID NO: 2011100 - protein, 24 aa, Staphylococcus
FEGEIKEKIGFIYSELYLNDKWTV

SEQ ID NO: 2011101 - protein, 27 aa, Staphylococcus
FEGHKWSTRLWSDMDVVRRHVQKTTRH

SEQ ID NO: 2011102 - protein, 18 aa, Staphylococcus
FEGIKFARNQGDNIAIVS

SEQ ID NO: 2011103 - protein, 19 aa, Staphylococcus
FEGTLIFVSHDRYFINQLA

SEQ ID NO: 2011104 - protein, 23 aa, Staphylococcus
FEGTLKIGQTVKVAYFKQTEETL

SEQ ID NO: 2011105 - protein, 25 aa, Staphylococcus
FEHAFYCEACGNMATAKTCPHDASN

SEQ ID NO: 2011106 - protein, 25 aa, Staphylococcus
FEHAFYCEACGNMATAKTCPHDATQ

SEQ ID NO: 2011107 - protein, 25 aa, Staphylococcus
FEHAFYCEACGNMATAKTCPHNASQ

SEQ ID NO: 2011108 - protein, 19 aa, Staphylococcus
FEHAFYCNVCENMATAKTC

SEQ ID NO: 2011109 - protein, 17 aa, Staphylococcus
FEHASKELATWIQEGKI

SEQ ID NO: 2011110 - protein, 25 aa, Staphylococcus
FEHEVAQALALHLEHIYGVQFNQAE

SEQ ID NO: 2011111 - protein, 23 aa, Staphylococcus
FEHGYERYNFYGLSGDFTENSED

SEQ ID NO: 2011112 - protein, 25 aa, Staphylococcus
FEHLSRTSAMLYQIFQHYRENDFAK

SEQ ID NO: 2011113 - protein, 19 aa, Staphylococcus
FEHRAPGVFGAVWTNDEIN

SEQ ID NO: 2011114 - protein, 19 aa, Staphylococcus
FEHRDPGVFGAAWTNEQLN

SEQ ID NO: 2011115 - protein, 21 aa, Staphylococcus
FEHREPGVFGAAWLNDQLSTE

SEQ ID NO: 2011116 - protein, 23 aa, Staphylococcus
FEHRKPGVFGAAWTNSGLNTEVI

SEQ ID NO: 2011117 - protein, 26 aa, Staphylococcus
FEHSKLFIRTKLKHMNQPIVFNDVHF

SEQ ID NO: 2011118 - protein, 20 aa, Staphylococcus
FEIASNWKKKGIKTAEQAYQ

SEQ ID NO: 2011119 - protein, 19 aa, Staphylococcus
FEIASNWKKKGITTAKQAY

SEQ ID NO: 2011120 - protein, 19 aa, Staphylococcus
FEIDCDILVPAAIANQITE

SEQ ID NO: 2011121 - protein, 19 aa, Staphylococcus
FEIDCDILVPAAISNQITE

SEQ ID NO: 2011122 - protein, 21 aa, Staphylococcus
FEIDGDLPLYPGHGPSTTVNN

SEQ ID NO: 2011123 - protein, 23 aa, Staphylococcus
FEIDPKKCIALKISEEKLNKIRK

SEQ ID NO: 2011124 - protein, 19 aa, Staphylococcus
FEIDQRLIPVLKDTMRPYD

SEQ ID NO: 2011125 - protein, 23 aa, Staphylococcus
FEIDQRLIPVLKETLAPYDNVTI

SEQ ID NO: 2011126 - protein, 23 aa, Staphylococcus
FEIDQRLIPVLKETLHPYDNVTI

SEQ ID NO: 2011127 - protein, 23 aa, Staphylococcus
FEIEELFARIRAVLRRQPHKDII

SEQ ID NO: 2011128 - protein, 23 aa, Staphylococcus
FEIEELFARIRAVLRRQPQKDII

SEQ ID NO: 2011129 - protein, 22 aa, Staphylococcus
FEIEQFKALIAHLTQNTIDSEF

SEQ ID NO: 2011130 - protein, 25 aa, Staphylococcus
FEIITTMMFLYFGEIHPVDFVVIEA

SEQ ID NO: 2011131 - protein, 24 aa, Staphylococcus
FEIITTMMFLYFGEIRPVDFVVIE

SEQ ID NO: 2011132 - protein, 24 aa, Staphylococcus
FEIKELLFRIRAVLRRYQINTQNK

SEQ ID NO: 2011133 - protein, 18 aa, Staphylococcus
FEIKQLRPTASRIKNLLK

SEQ ID NO: 2011134 - protein, 17 aa, Staphylococcus
FEIQAKQLLALKEQTGQ

SEQ ID NO: 2011135 - protein, 20 aa, Staphylococcus
FEIQHGVEFDVDIEILAEFI

SEQ ID NO: 2011136 - protein, 23 aa, Staphylococcus
FEIREIRIIKSVLLKGKKSFNNA

SEQ ID NO: 2011137 - protein, 24 aa, Staphylococcus
FEISKRAELFINEFSDVSESDKDV

SEQ ID NO: 2011138 - protein, 19 aa, Staphylococcus
FEISRHAINMANKMKQGFI

SEQ ID NO: 2011139 - protein, 18 aa, Staphylococcus
FEIVPGITSGIAAPAYAG

SEQ ID NO: 2011140 - protein, 17 aa, Staphylococcus
FEKAGSIFGVKEARAKQ

SEQ ID NO: 2011141 - protein, 21 aa, Staphylococcus
FEKAGVPKGAFNLVNGDGEGV

SEQ ID NO: 2011142 - protein, 18 aa, Staphylococcus
FEKDDRVVLVDNPENNEY

SEQ ID NO: 2011143 - protein, 22 aa, Staphylococcus
FEKDKPIAPGMKYKHYSPDTPL

SEQ ID NO: 2011144 - protein, 19 aa, Staphylococcus
FEKFCRMQKKGGTRTRLYF

SEQ ID NO: 2011145 - protein, 19 aa, Staphylococcus
FEKGFDILIESVRRIQNDL

SEQ ID NO: 2011146 - protein, 18 aa, Staphylococcus
FEKGRIYFSQEMLNQYDV

SEQ ID NO: 2011147 - protein, 18 aa, Staphylococcus
FEKLSVLNPEAFAEITDE

SEQ ID NO: 2011148 - protein, 20 aa, Staphylococcus
FEKMRFKDAEIQGGFVDGEA

SEQ ID NO: 2011149 - protein, 21 aa, Staphylococcus
FEKRHTLSNVLNRKGFVVKEV

SEQ ID NO: 2011150 - protein, 17 aa, Staphylococcus
FEKSIGIQRDRVYEERN

SEQ ID NO: 2011151 - protein, 17 aa, Staphylococcus
FEKSKIKPEHYYKLLNL

SEQ ID NO: 2011152 - protein, 17 aa, Staphylococcus
FEKTLARGYRREEVDAF

SEQ ID NO: 2011153 - protein, 18 aa, Staphylococcus
FEKTMARGYRREEVDAFL

SEQ ID NO: 2011154 - protein, 23 aa, Staphylococcus
FEKTMARGYRREEVDAFLDDIIT

SEQ ID NO: 2011155 - protein, 17 aa, Staphylococcus
FEKYAIEMGEAVIDDDF

SEQ ID NO: 2011156 - protein, 23 aa, Staphylococcus
FEKYMRKAFRHKDVTDDLATDLV

SEQ ID NO: 2011157 - protein, 23 aa, Staphylococcus
FEKYPIEAVFGIHVNPFAEEGKV

SEQ ID NO: 2011158 - protein, 20 aa, Staphylococcus
FELAKKVIKGECLIDERNSH

SEQ ID NO: 2011159 - protein, 30 aa, Staphylococcus
FELDEALAIKKCDMLYQMRAFLELREEAII

SEQ ID NO: 2011160 - protein, 32 aa, Staphylococcus
FELDLSALVAGAKFRGEFEERLKAVLKEVKES

SEQ ID NO: 2011161 - protein, 17 aa, Staphylococcus
FELDPIEVRQMFHDLGW

SEQ ID NO: 2011162 - protein, 17 aa, Staphylococcus
FELGEFLPPVKKDILDT

SEQ ID NO: 2011163 - protein, 17 aa, Staphylococcus
FELGQFIPPEKESILTI

SEQ ID NO: 2011164 - protein, 19 aa, Staphylococcus
FELIKQANVKRCLITHLSN

SEQ ID NO: 2011165 - protein, 17 aa, Staphylococcus
FELINIGALSQLTASSL

SEQ ID NO: 2011166 - protein, 24 aa, Staphylococcus
FELKAGEIVGLIGLNGAGKSTTIK

SEQ ID NO: 2011167 - protein, 31 aa, Staphylococcus
FELKSPFWMLAQEVYQEWYLGHQLFNEIEKK

SEQ ID NO: 2011168 - protein, 18 aa, Staphylococcus
FELLDEIEETLNIETYPM

SEQ ID NO: 2011169 - protein, 18 aa, Staphylococcus
FELLDEIEETLNIKTYPM

SEQ ID NO: 2011170 - protein, 17 aa, Staphylococcus
FELLEEIEETLNIDTYP

SEQ ID NO: 2011171 - protein, 17 aa, Staphylococcus
FELLKKQFIGEFISSLN

SEQ ID NO: 2011172 - protein, 25 aa, Staphylococcus
FELNQKFNIITIFCDSLNYLSSSKE

SEQ ID NO: 2011173 - protein, 17 aa, Staphylococcus
FELPKDEVEAFSEFIEE

SEQ ID NO: 2011174 - protein, 17 aa, Staphylococcus
FELPYMQLVVVTERELF

SEQ ID NO: 2011175 - protein, 21 aa, Staphylococcus
FELQARQLLELKKETGHTMDW

SEQ ID NO: 2011176 - protein, 20 aa, Staphylococcus
FELSEGNFFYETDINMPVLN

SEQ ID NO: 2011177 - protein, 18 aa, Staphylococcus
FELSLRPTMLKQYIGQSS

SEQ ID NO: 2011178 - protein, 23 aa, Staphylococcus
FELTEVDDWLYGRGVSDMKGGVA

SEQ ID NO: 2011179 - protein, 23 aa, Staphylococcus
FELTHVNDWLYGRGVSDMKGGMA

SEQ ID NO: 2011180 - protein, 17 aa, Staphylococcus
FELTQKFKKDFPNEKVK

SEQ ID NO: 2011181 - protein, 27 aa, Staphylococcus
FELVSVLKRFKAMLLQKNETVEAMQGY

SEQ ID NO: 2011182 - protein, 17 aa, Staphylococcus
FEMGDIYPSLVASHAFT

SEQ ID NO: 2011183 - protein, 19 aa, Staphylococcus
FEMGIDIDTLVKFNLKKGQ

SEQ ID NO: 2011184 - protein, 19 aa, Staphylococcus
FEMGIDIDTLVKFNLKKNQ

SEQ ID NO: 2011185 - protein, 17 aa, Staphylococcus
FEMGIDMDTYVHFNLKK

SEQ ID NO: 2011186 - protein, 17 aa, Staphylococcus
FEMIHKAYLESTAFGTK

SEQ ID NO: 2011187 - protein, 17 aa, Staphylococcus
FEMLRHMLNQHFISNEI

SEQ ID NO: 2011188 - protein, 18 aa, Staphylococcus
FENEIEPYPGIKMKHTGG

SEQ ID NO: 2011189 - protein, 18 aa, Staphylococcus
FENFKQWFNKDIEFNTYE

SEQ ID NO: 2011190 - protein, 28 aa, Staphylococcus
FENIEWLIKEGYSLLTLPVAYGGEGATI

SEQ ID NO: 2011191 - protein, 22 aa, Staphylococcus
FENIKIVGLMTMAPYTDDEGYI

SEQ ID NO: 2011192 - protein, 24 aa, Staphylococcus
FENIKLKHCIFDHVTFKNCSLPKN

SEQ ID NO: 2011193 - protein, 18 aa, Staphylococcus
FENIKVGDPFADDIKMGS

SEQ ID NO: 2011194 - protein, 19 aa, Staphylococcus
FENIYEWLTNYKIYDVPKT

SEQ ID NO: 2011195 - protein, 49 aa, Staphylococcus
FENKLTFSDEVVEKIAGIAAREVKGILDMKGGFADNFTNAFSSGNNVTT

SEQ ID NO: 2011196 - protein, 17 aa, Staphylococcus
FENKQSIFREWEKFKND

SEQ ID NO: 2011197 - protein, 19 aa, Staphylococcus
FENLANVKITTKGSGFVSQ

SEQ ID NO: 2011198 - protein, 19 aa, Staphylococcus
FENMYDWLSGFKLLNIPTT

SEQ ID NO: 2011199 - protein, 20 aa, Staphylococcus
FENMYEWLSNFKLYKVPKTF

SEQ ID NO: 2011200 - protein, 23 aa, Staphylococcus
FENRFMHVAEFKRMNAKISVEGR

SEQ ID NO: 2011201 - protein, 20 aa, Staphylococcus
FENRGANVTQVWVNSHELTQ

SEQ ID NO: 2011202 - protein, 21 aa, Staphylococcus
FENVSIPLIYNGMPAKKRSVR

SEQ ID NO: 2011203 - protein, 20 aa, Staphylococcus
FEPKAHWDLVEELKMADFER

SEQ ID NO: 2011204 - protein, 21 aa, Staphylococcus
FEPKAHWDLVEELKMADFERA

SEQ ID NO: 2011205 - protein, 18 aa, Staphylococcus
FEPMPREQFLKELEDVDA

SEQ ID NO: 2011206 - protein, 18 aa, Staphylococcus
FEPSPGDHDYTYWDKSIA

SEQ ID NO: 2011207 - protein, 17 aa, Staphylococcus
FEQFKALWNIRDDRYSD

SEQ ID NO: 2011208 - protein, 28 aa, Staphylococcus
FEQFLLKEYSILVAPGIPFGENGRNYVR

SEQ ID NO: 2011209 - protein, 17 aa, Staphylococcus
FEQIKWAIEEQKVSHLF

SEQ ID NO: 2011210 - protein, 17 aa, Staphylococcus
FEQNSGYNSYQVIKEAT

SEQ ID NO: 2011211 - protein, 23 aa, Staphylococcus
FEQTEVQLILSFLRTIDNPLQDI

SEQ ID NO: 2011212 - protein, 24 aa, Staphylococcus
FEQTEVQLVLSFLKTVDNPLQDIY

SEQ ID NO: 2011213 - protein, 25 aa, Staphylococcus
FEQTEVRLILSFLRTVDNPLQDIYL

SEQ ID NO: 2011214 - protein, 17 aa, Staphylococcus
FEQYPYFTANNIHVPIG

SEQ ID NO: 2011215 - protein, 24 aa, Staphylococcus
FERAAKISGARFVYLTKDGALLER

SEQ ID NO: 2011216 - protein, 17 aa, Staphylococcus
FEREDMEMIAGNHDEAV

SEQ ID NO: 2011217 - protein, 17 aa, Staphylococcus
FEREKAYGKHLDIPAGA

SEQ ID NO: 2011218 - protein, 29 aa, Staphylococcus
FERELGFLALHGFLHLLGYDHMNEADEKE

SEQ ID NO: 2011219 - protein, 29 aa, Staphylococcus
FERELGFLALHGFLHLLGYDHMNEQDEKQ

SEQ ID NO: 2011220 - protein, 26 aa, Staphylococcus
FERELGFLALHGFLHLLGYDHMTDED

SEQ ID NO: 2011221 - protein, 20 aa, Staphylococcus
FERIAQMLIEASVDIGNMII

SEQ ID NO: 2011222 - protein, 21 aa, Staphylococcus
FERLSHRIFQEIGGLTEEYAS

SEQ ID NO: 2011223 - protein, 19 aa, Staphylococcus
FERSREGRYAYSLPQSDIK

SEQ ID NO: 2011224 - protein, 24 aa, Staphylococcus
FERSREGRYAYSLPQSDIKTDSVE

SEQ ID NO: 2011225 - protein, 17 aa, Staphylococcus
FERWAEGQLPYLIELGA

SEQ ID NO: 2011226 - protein, 23 aa, Staphylococcus
FERWSEGHLTYLIELGAIEISPT

SEQ ID NO: 2011227 - protein, 23 aa, Staphylococcus
FERWSQGHLPYLIELGAIELCPK

SEQ ID NO: 2011228 - protein, 25 aa, Staphylococcus
FESASSPSFLSCGIQSYLEDIAPSL

SEQ ID NO: 2011229 - protein, 17 aa, Staphylococcus
FESCGHCEYCTTGRETL

SEQ ID NO: 2011230 - protein, 24 aa, Staphylococcus
FESDCGWPSFSKAIDDDEIIELVD

SEQ ID NO: 2011231 - protein, 25 aa, Staphylococcus
FESDCGWPSFSKALADEEIVELVDK

SEQ ID NO: 2011232 - protein, 24 aa, Staphylococcus
FESDCGWPSFSKALDDDEIVELVD

SEQ ID NO: 2011233 - protein, 25 aa, Staphylococcus
FESDCGWPSFSKALSDDEVVELVDK

SEQ ID NO: 2011234 - protein, 21 aa, Staphylococcus
FESELPFSWVYDENGITEEMK

SEQ ID NO: 2011235 - protein, 19 aa, Staphylococcus
FESELPFTWVYDQNGITDT

SEQ ID NO: 2011236 - protein, 27 aa, Staphylococcus
FESINWLINYVKQYPHTVLFVTHDRYF

SEQ ID NO: 2011237 - protein, 27 aa, Staphylococcus
FESITWLINYVKQYPHTVLFVTHDRYF

SEQ ID NO: 2011238 - protein, 23 aa, Staphylococcus
FESLELPLARILGEMEELGIYTD

SEQ ID NO: 2011239 - protein, 29 aa, Staphylococcus
FESLESYGIHIAKRIELIVPTNAYNQDYM

SEQ ID NO: 2011240 - protein, 18 aa, Staphylococcus
FESLRAWLDEEIVADTWI

SEQ ID NO: 2011241 - protein, 24 aa, Staphylococcus
FESNCGWPSFSKALNDDEIIELVD

SEQ ID NO: 2011242 - protein, 24 aa, Staphylococcus
FESNCGWPSFSKSIDDDEIIELVD

SEQ ID NO: 2011243 - protein, 25 aa, Staphylococcus
FESNTSWPLALPVFKMDYAHKEYEA

SEQ ID NO: 2011244 - protein, 24 aa, Staphylococcus
FESNTSWPLAMPVFKMDYAHKEYE

SEQ ID NO: 2011245 - protein, 19 aa, Staphylococcus
FESRIKLLKDYQVNRAMFD

SEQ ID NO: 2011246 - protein, 17 aa, Staphylococcus
FESTFFDHQLLRRLVAF

SEQ ID NO: 2011247 - protein, 21 aa, Staphylococcus
FETAAPLYYRAEPVGCTATIL

SEQ ID NO: 2011248 - protein, 19 aa, Staphylococcus
FETAKRFVEEGATVIISDL

SEQ ID NO: 2011249 - protein, 22 aa, Staphylococcus
FETASPLWYRAEPVGCTATILY

SEQ ID NO: 2011250 - protein, 23 aa, Staphylococcus
FETFAKRRVRLLNVDTPERGQEN

SEQ ID NO: 2011251 - protein, 26 aa, Staphylococcus
FETFKRRVDKSINEWEIDLDQTFYVS

SEQ ID NO: 2011252 - protein, 24 aa, Staphylococcus
FETNTSWPLALPVFKMDYAHKECE

SEQ ID NO: 2011253 - protein, 21 aa, Staphylococcus
FETPGSLAYLDAHIIKLYETP

SEQ ID NO: 2011254 - protein, 18 aa, Staphylococcus
FETVSLWLDEYFQGKNPS

SEQ ID NO: 2011255 - protein, 18 aa, Staphylococcus
FETYDVIVVAGFQGINDN

SEQ ID NO: 2011256 - protein, 19 aa, Staphylococcus
FETYEEIEEAISLSENKSN

SEQ ID NO: 2011257 - protein, 17 aa, Staphylococcus
FETYVSLTCQKCPDVVQ

SEQ ID NO: 2011258 - protein, 25 aa, Staphylococcus
FETYVSLTCQKCPDVVQALNLMSVI

SEQ ID NO: 2011259 - protein, 20 aa, Staphylococcus
FEVFDVLQELGLTKVNGGFV

SEQ ID NO: 2011260 - protein, 18 aa, Staphylococcus
FEVIDYILERHRFTLDKQ

SEQ ID NO: 2011261 - protein, 24 aa, Staphylococcus
FEVKELIYRIKAVLRRYHIHADET

SEQ ID NO: 2011262 - protein, 24 aa, Staphylococcus
FEVKELLFRIKAVLRRYQINAESE

SEQ ID NO: 2011263 - protein, 26 aa, Staphylococcus
FEVKELMFRIKAVLKRYNVNINNEVS

SEQ ID NO: 2011264 - protein, 18 aa, Staphylococcus
FEVLLVKIAEMIKEKPES

SEQ ID NO: 2011265 - protein, 22 aa, Staphylococcus
FEVNSDFSAKVAFENEEAYILM

SEQ ID NO: 2011266 - protein, 20 aa, Staphylococcus
FEVNSFPGCTMFELDAQEVA

SEQ ID NO: 2011267 - protein, 17 aa, Staphylococcus
FEVPKGIEDHLFRITQE

SEQ ID NO: 2011268 - protein, 18 aa, Staphylococcus
FEVQELIFRIKAVLRRYQ

SEQ ID NO: 2011269 - protein, 18 aa, Staphylococcus
FEVTKLYLKNKEIITIDN

SEQ ID NO: 2011270 - protein, 24 aa, Staphylococcus
FEYKDARNYLSFLYSKNLKRTTVS

SEQ ID NO: 2011271 - protein, 17 aa, Staphylococcus
FEYKDARNYLSYLYNKN

SEQ ID NO: 2011272 - protein, 19 aa, Staphylococcus
FEYKDARNYLSYLYSNNLK

SEQ ID NO: 2011273 - protein, 18 aa, Staphylococcus
FEYKDARNYLSYLYSQNL

SEQ ID NO: 2011274 - protein, 20 aa, Staphylococcus
FEYNKVPLFKQWKTTKGIVD

SEQ ID NO: 2011275 - protein, 18 aa, Staphylococcus
FEYSLRPTYLKQYIGQTT

SEQ ID NO: 2011276 - protein, 17 aa, Staphylococcus
FFAKAIHFWSNDAELLM

SEQ ID NO: 2011277 - protein, 19 aa, Staphylococcus
FFDDYAFVLGYFVVNEQLI

SEQ ID NO: 2011278 - protein, 18 aa, Staphylococcus
FFDFTRRIPKRIKTRKLL

SEQ ID NO: 2011279 - protein, 22 aa, Staphylococcus
FFDHQLLRRLVAFMYEQPSTII

SEQ ID NO: 2011280 - protein, 17 aa, Staphylococcus
FFDKAKENFEWIEAQVD

SEQ ID NO: 2011281 - protein, 26 aa, Staphylococcus
FFEEGNRAVLLLHGFTGNSSDVRQLG

SEQ ID NO: 2011282 - protein, 18 aa, Staphylococcus
FFEKALKVMRPVYLNQSK

SEQ ID NO: 2011283 - protein, 24 aa, Staphylococcus
FFELACSMSGYQLGVNPFNQPGVE

SEQ ID NO: 2011284 - protein, 26 aa, Staphylococcus
FFELYTPLLRKGGIVVTDNVLYHGFV

SEQ ID NO: 2011285 - protein, 18 aa, Staphylococcus
FFEMYSWAQIGIHQKPIA

SEQ ID NO: 2011286 - protein, 17 aa, Staphylococcus
FFEPQYNILKSFIEENL

SEQ ID NO: 2011287 - protein, 26 aa, Staphylococcus
FFEVFDVLQELGLTKVNGGFIVTGGS

SEQ ID NO: 2011288 - protein, 25 aa, Staphylococcus
FFEYPKMFHDFALFPIHESHKVIKQ

SEQ ID NO: 2011289 - protein, 27 aa, Staphylococcus
FFFEEGKRAVLLLHGFTGNSADVRQLG

SEQ ID NO: 2011290 - protein, 27 aa, Staphylococcus
FFFQEGKRAVLLLHGFTGNSSDVRQLG

SEQ ID NO: 2011291 - protein, 22 aa, Staphylococcus
FFGERLQGFLVTKYGWVQSYGS

SEQ ID NO: 2011292 - protein, 19 aa, Staphylococcus
FFGESHVKVILTGDTFDDC

SEQ ID NO: 2011293 - protein, 19 aa, Staphylococcus
FFGSALANFGVQSFLNAYV

SEQ ID NO: 2011294 - protein, 24 aa, Staphylococcus
FFHFLEKISVVKFFDNHSANTAVT

SEQ ID NO: 2011295 - protein, 18 aa, Staphylococcus
FFHQLFKLLEDIRIFNEI

SEQ ID NO: 2011296 - protein, 17 aa, Staphylococcus
FFINKLPGITIKELLQT

SEQ ID NO: 2011297 - protein, 24 aa, Staphylococcus
FFKDKEYRLGIGTPAMATGGMGDT

SEQ ID NO: 2011298 - protein, 25 aa, Staphylococcus
FFKEASRFFLKYPYIKLASAPILIR

SEQ ID NO: 2011299 - protein, 30 aa, Staphylococcus
FFKRTKASINEVFSRMQSVSSQIDRITIQL

SEQ ID NO: 2011300 - protein, 20 aa, Staphylococcus
FFKTKREFEQLIAQDQFIEY

SEQ ID NO: 2011301 - protein, 21 aa, Staphylococcus
FFKVKELFKLHQSFYANSIST

SEQ ID NO: 2011302 - protein, 19 aa, Staphylococcus
FFMMNRLNAPFILISDPRI

SEQ ID NO: 2011303 - protein, 19 aa, Staphylococcus
FFMNCTKNGMLPITLGENE

SEQ ID NO: 2011304 - protein, 19 aa, Staphylococcus
FFMSYTIGRFDVSLITLLG

SEQ ID NO: 2011305 - protein, 18 aa, Staphylococcus
FFNDNAYAVLGLITSKTG

SEQ ID NO: 2011306 - protein, 26 aa, Staphylococcus
FFNEVQVPPLWEIKGNYNHAEIIDNG

SEQ ID NO: 2011307 - protein, 17 aa, Staphylococcus
FFNKCKEIISLYDNLPT

SEQ ID NO: 2011308 - protein, 17 aa, Staphylococcus
FFNQCFAALKDLDVSVI

SEQ ID NO: 2011309 - protein, 18 aa, Staphylococcus
FFNQSFSSLDEFINSDIT

SEQ ID NO: 2011310 - protein, 21 aa, Staphylococcus
FFNVFDILQELGLTKVNGGFV

SEQ ID NO: 2011311 - protein, 21 aa, Staphylococcus
FFNVFEVLQDLGLTKVNGGFV

SEQ ID NO: 2011312 - protein, 17 aa, Staphylococcus
FFNYAGIHRPVKIYTTP

SEQ ID NO: 2011313 - protein, 17 aa, Staphylococcus
FFPFLNPQHFVFCGRKN

SEQ ID NO: 2011314 - protein, 25 aa, Staphylococcus
FFPNQEDFTLFKLGDNVTFKAKEKN

SEQ ID NO: 2011315 - protein, 23 aa, Staphylococcus
FFQNVRINRHFDALFDSMSSSLT

SEQ ID NO: 2011316 - protein, 19 aa, Staphylococcus
FFQNVRIQKHFDALFDSVH

SEQ ID NO: 2011317 - protein, 23 aa, Staphylococcus
FFRNFFNIKFNREITVNMESLKE

SEQ ID NO: 2011318 - protein, 23 aa, Staphylococcus
FFSNYRPQFYFRTTDVTGVVQLP

SEQ ID NO: 2011319 - protein, 25 aa, Staphylococcus
FFSRSSNFVKIRGYRINPNEVTSAI

SEQ ID NO: 2011320 - protein, 18 aa, Staphylococcus
FFSSQRALGEYVGINVNA

SEQ ID NO: 2011321 - protein, 18 aa, Staphylococcus
FFTEVKWGDLDYLLLDLP

SEQ ID NO: 2011322 - protein, 19 aa, Staphylococcus
FFTEVLGMRLVKKTVNQDD

SEQ ID NO: 2011323 - protein, 26 aa, Staphylococcus
FFTIVKWNISGTLNYMKPREFVLISV

SEQ ID NO: 2011324 - protein, 18 aa, Staphylococcus
FFTLKEHWGTLQGKTLTY

SEQ ID NO: 2011325 - protein, 25 aa, Staphylococcus
FFTMVKWEISGTLNYMKPREFCLIS

SEQ ID NO: 2011326 - protein, 21 aa, Staphylococcus
FFTVEKWDISEHLTLEKPHPY

SEQ ID NO: 2011327 - protein, 17 aa, Staphylococcus
FFVIIGPSGCGKTTTLK

SEQ ID NO: 2011328 - protein, 17 aa, Staphylococcus
FFVQYGSFKDFKDYKNG

SEQ ID NO: 2011329 - protein, 17 aa, Staphylococcus
FFYCGKDPYRHSLPQEE

SEQ ID NO: 2011330 - protein, 24 aa, Staphylococcus
FGAAPSGIALKFLYGNLDLKANKL

SEQ ID NO: 2011331 - protein, 22 aa, Staphylococcus
FGACPDCDGLGQKLTADIDLIV

SEQ ID NO: 2011332 - protein, 22 aa, Staphylococcus
FGACPTCDGLGQKLTVDLELVV

SEQ ID NO: 2011333 - protein, 22 aa, Staphylococcus
FGACPTCDGLGQKLTVDMDLVV

SEQ ID NO: 2011334 - protein, 21 aa, Staphylococcus
FGACPTCDGLGQRLTVDLDLV

SEQ ID NO: 2011335 - protein, 18 aa, Staphylococcus
FGADIVIHSATKFIGGHG

SEQ ID NO: 2011336 - protein, 17 aa, Staphylococcus
FGADIVTILGVAEDASI

SEQ ID NO: 2011337 - protein, 17 aa, Staphylococcus
FGAESMVLIDLIHQIKP

SEQ ID NO: 2011338 - protein, 19 aa, Staphylococcus
FGAQRIVLKEDYQWMRDMI

SEQ ID NO: 2011339 - protein, 21 aa, Staphylococcus
FGATIPYYFTGHEGPDSCCID

SEQ ID NO: 2011340 - protein, 21 aa, Staphylococcus
FGATIPYYFTGHEGPDSVCID

SEQ ID NO: 2011341 - protein, 25 aa, Staphylococcus
FGAYYRGYCSDITRTFAIGEPDKKL

SEQ ID NO: 2011342 - protein, 25 aa, Staphylococcus
FGAYYRGYCSDITRTFAIGEPDPKM

SEQ ID NO: 2011343 - protein, 25 aa, Staphylococcus
FGAYYRGYCSDITRTFAIGEPDSKM

SEQ ID NO: 2011344 - protein, 17 aa, Staphylococcus
FGCADCYATFKDDIVDI

SEQ ID NO: 2011345 - protein, 18 aa, Staphylococcus
FGCFAPVHVFIDIFKDAG

SEQ ID NO: 2011346 - protein, 24 aa, Staphylococcus
FGCGSSREHAAWAIKDYGFDIIIA

SEQ ID NO: 2011347 - protein, 24 aa, Staphylococcus
FGCGSSREHAAWALKDFGFNIIIA

SEQ ID NO: 2011348 - protein, 23 aa, Staphylococcus
FGCGSSREHAAWALKDYGFSIII

SEQ ID NO: 2011349 - protein, 23 aa, Staphylococcus
FGCGSSREHAAWALKDYGIQIII

SEQ ID NO: 2011350 - protein, 17 aa, Staphylococcus
FGDFVVRKGIVEKVTDG

SEQ ID NO: 2011351 - protein, 21 aa, Staphylococcus
FGDNPLMRWFTNNVAVKMQPD

SEQ ID NO: 2011352 - protein, 17 aa, Staphylococcus
FGDPEAQVLLTRLESDL

SEQ ID NO: 2011353 - protein, 18 aa, Staphylococcus
FGDPEAQVLLTRLESDLM

SEQ ID NO: 2011354 - protein, 17 aa, Staphylococcus
FGDSLLVINDDEIVKVH

SEQ ID NO: 2011355 - protein, 18 aa, Staphylococcus
FGDSLLVINDDEIVKVHV

SEQ ID NO: 2011356 - protein, 17 aa, Staphylococcus
FGDSRTTIFPILGGGER

SEQ ID NO: 2011357 - protein, 18 aa, Staphylococcus
FGDYEIEIQPDFPFNQFP

SEQ ID NO: 2011358 - protein, 25 aa, Staphylococcus
FGEDKLFFAELISKCSSASMTTEAT

SEQ ID NO: 2011359 - protein, 23 aa, Staphylococcus
FGEDKLFFMTAFVNAHHVTTTPI

SEQ ID NO: 2011360 - protein, 21 aa, Staphylococcus
FGELCQLLSSYNITYIIDVNP

SEQ ID NO: 2011361 - protein, 17 aa, Staphylococcus
FGEQHFTTDFLYQTDWQ

SEQ ID NO: 2011362 - protein, 31 aa, Staphylococcus
FGEVGRALYNFIWDEFCDWYIEMSKIPMNGD

SEQ ID NO: 2011363 - protein, 31 aa, Staphylococcus
FGEVGRVLYNFIWDEFCDWYIEMSKIPMNGA

SEQ ID NO: 2011364 - protein, 32 aa, Staphylococcus
FGFATAPLIVLGCVMMRVCHKDTCPVGVATQN

SEQ ID NO: 2011365 - protein, 35 aa, Staphylococcus
FGFATAPLVVLGCIMMRVCHKDTCPVGIATQNKDL

SEQ ID NO: 2011366 - protein, 30 aa, Staphylococcus; identical to SEQ ID NO: 1793556

SEQ ID NO: 2011367 - protein, 34 aa, Staphylococcus
FGFATAPLVVLGCVMMRVCHKDTCPVGIATQNKD

SEQ ID NO: 2011368 - protein, 32 aa, Staphylococcus
FGFATAPLVVLGCVMMRVCHKDTCPVGVATQN

SEQ ID NO: 2011369 - protein, 19 aa, Staphylococcus
FGGDGIQTFIYVVYGNINA

SEQ ID NO: 2011370 - protein, 23 aa, Staphylococcus
FGGFGGGFEDIFSSFFGGGAQRD

SEQ ID NO: 2011371 - protein, 17 aa, Staphylococcus
FGGGFEDIFSSFFGGSR

SEQ ID NO: 2011372 - protein, 18 aa, Staphylococcus
FGGIDHPFDIGGNEMTVE

SEQ ID NO: 2011373 - protein, 31 aa, Staphylococcus
FGGLDLLSPMKCLRIIAMFRLINPSKEIRIA

SEQ ID NO: 2011374 - protein, 17 aa, Staphylococcus
FGGMYASSVNRSMETIL

SEQ ID NO: 2011375 - protein, 23 aa, Staphylococcus
FGGNLPLWLAPVQMEVILVNADL

SEQ ID NO: 2011376 - protein, 18 aa, Staphylococcus
FGGPLYTIHKIFSLITLS

SEQ ID NO: 2011377 - protein, 18 aa, Staphylococcus
FGGQSFIEACAAKVKILR

SEQ ID NO: 2011378 - protein, 17 aa, Staphylococcus
FGGSIKNQGHQFLNILV

SEQ ID NO: 2011379 - protein, 19 aa, Staphylococcus
FGGSIKNQGNRFLNILVVC

SEQ ID NO: 2011380 - protein, 18 aa, Staphylococcus
FGGVVPEVASRHHVEGVT

SEQ ID NO: 2011381 - protein, 30 aa, Staphylococcus
FGGYKSSGIGREWGDFGIEEFLEVKAISGY

SEQ ID NO: 2011382 - protein, 35 aa, Staphylococcus
FGHAVEYQFKIPHGHAVMIGIIYQFIVSNIILNTH

SEQ ID NO: 2011383 - protein, 24 aa, Staphylococcus
FGHDEIKRLVAFQEEVVAHIQPVK

SEQ ID NO: 2011384 - protein, 24 aa, Staphylococcus
FGHDEIKRLVAFQQGIIDYIQPEK

SEQ ID NO: 2011385 - protein, 24 aa, Staphylococcus
FGHEEIKRLVAFQEEVVEHIQPVK

SEQ ID NO: 2011386 - protein, 23 aa, Staphylococcus
FGHEEIKRLVAFQQEIIDHIQPE

SEQ ID NO: 2011387 - protein, 20 aa, Staphylococcus
FGHGPNIEMFEFKDASQASA

SEQ ID NO: 2011388 - protein, 27 aa, Staphylococcus
FGHQLRFDLTKGFPLLTTKKVSFKLVA

SEQ ID NO: 2011389 - protein, 19 aa, Staphylococcus
FGHSAHSYFSRKHQPSNSS

SEQ ID NO: 2011390 - protein, 19 aa, Staphylococcus
FGHSAHSYFSRQNQPSNAS

SEQ ID NO: 2011391 - protein, 19 aa, Staphylococcus
FGHSAHSYFSRQNQPSNSS

SEQ ID NO: 2011392 - protein, 24 aa, Staphylococcus
FGIDSERYVPVLIVAIGKAKNPAH

SEQ ID NO: 2011393 - protein, 17 aa, Staphylococcus
FGIKGGATGGGYAQVLP

SEQ ID NO: 2011394 - protein, 17 aa, Staphylococcus
FGIKGMLDHAFQIENIQ

SEQ ID NO: 2011395 - protein, 19 aa, Staphylococcus
FGINGMKDYAFQIENVDTA

SEQ ID NO: 2011396 - protein, 18 aa, Staphylococcus
FGINPMIIKSVAKQVAEV

SEQ ID NO: 2011397 - protein, 19 aa, Staphylococcus
FGIPAAIGAKLAAPDKTVV

SEQ ID NO: 2011398 - protein, 20 aa, Staphylococcus
FGIPDKYLIRRMHEHDIVVM

SEQ ID NO: 2011399 - protein, 19 aa, Staphylococcus
FGIQADGHFVVINAEQIND

SEQ ID NO: 2011400 - protein, 18 aa, Staphylococcus
FGIVNGLMTTVHAITNDQ

SEQ ID NO: 2011401 - protein, 23 aa, Staphylococcus
FGKAGKTLASFAAGQGQHVALIE

SEQ ID NO: 2011402 - protein, 21 aa, Staphylococcus
FGKIFKEVCVDIMKADIKENI

SEQ ID NO: 2011403 - protein, 21 aa, Staphylococcus
FGKLRKVAMDKGFKHCEAGPM

SEQ ID NO: 2011404 - protein, 21 aa, Staphylococcus
FGKLRKVAMDKGFKHCQAGPL

SEQ ID NO: 2011405 - protein, 21 aa, Staphylococcus
FGKLRKVAMEKGFKHCQAGPL

SEQ ID NO: 2011406 - protein, 21 aa, Staphylococcus
FGKMRKVAMDKGFKHCQAGPL

SEQ ID NO: 2011407 - protein, 18 aa, Staphylococcus
FGKPKAFAEIEGQPFYKK

SEQ ID NO: 2011408 - protein, 18 aa, Staphylococcus
FGKRAMTTFERYFIEDKV

SEQ ID NO: 2011409 - protein, 24 aa, Staphylococcus
FGKRAMTTFERYFIKDKATHKEEK

SEQ ID NO: 2011410 - protein, 20 aa, Staphylococcus
FGLEHFAEYAPTTDADFKVQ

SEQ ID NO: 2011411 - protein, 38 aa, Staphylococcus
FGLEQRTAIKEGLFRKGLRRRYKLIGQIMSINRELNSD

SEQ ID NO: 2011412 - protein, 17 aa, Staphylococcus
FGLKNKEDIVGYIEEDR

SEQ ID NO: 2011413 - protein, 20 aa, Staphylococcus
FGLNKRQGRQLLVFLHAPKH

SEQ ID NO: 2011414 - protein, 17 aa, Staphylococcus
FGLSIKYGLALEAINKI

SEQ ID NO: 2011415 - protein, 30 aa, Staphylococcus
FGMGAIGQAFARRLSGFNTRTLYHNRSRRE

SEQ ID NO: 2011416 - protein, 19 aa, Staphylococcus
FGMVQGVGFRYYTEKIAQK

SEQ ID NO: 2011417 - protein, 18 aa, Staphylococcus
FGMWDFEKKWTKAKYMKA

SEQ ID NO: 2011418 - protein, 21 aa, Staphylococcus
FGNDLLRNFVRRVCNCTGEWT

SEQ ID NO: 2011419 - protein, 19 aa, Staphylococcus
FGNHEVLKDINLEVSQGEV

SEQ ID NO: 2011420 - protein, 25 aa, Staphylococcus
FGNIPSRVPLTSSFTKKGKDGRLKA

SEQ ID NO: 2011421 - protein, 18 aa, Staphylococcus
FGNLKSKHAVIVGAGEMS

SEQ ID NO: 2011422 - protein, 17 aa, Staphylococcus
FGNMYAGSVNRSMDTIL

SEQ ID NO: 2011423 - protein, 20 aa, Staphylococcus
FGNPEIADIVILKKQPENDF

SEQ ID NO: 2011424 - protein, 25 aa, Staphylococcus
FGNTKSLWVWTGFLFEYLERDSAER

SEQ ID NO: 2011425 - protein, 24 aa, Staphylococcus
FGNYEVRLPLVTLESSDRKQLEEA

SEQ ID NO: 2011426 - protein, 17 aa, Staphylococcus
FGPGGRFGDLIYDTLGF

SEQ ID NO: 2011427 - protein, 21 aa, Staphylococcus
FGPKLASSIYQYYGAETLDVL

SEQ ID NO: 2011428 - protein, 19 aa, Staphylococcus
FGPLLPIIVYDDFNEAIDI

SEQ ID NO: 2011429 - protein, 17 aa, Staphylococcus
FGPSGSMLIVDALTNNV

SEQ ID NO: 2011430 - protein, 21 aa, Staphylococcus
FGPTITVKALLKMRMKKKVKK

SEQ ID NO: 2011431 - protein, 23 aa, Staphylococcus
FGPTITVKALLRMRMESKVKQYV

SEQ ID NO: 2011432 - protein, 19 aa, Staphylococcus
FGPTITVKALLSMRMENKV

SEQ ID NO: 2011433 - protein, 17 aa, Staphylococcus
FGPVLAVTTYNDFDQVI

SEQ ID NO: 2011434 - protein, 18 aa, Staphylococcus
FGQLDWLNDQDVALVGVG

SEQ ID NO: 2011435 - protein, 24 aa, Staphylococcus
FGQTKTIWIWTGFQYEYLSQDKGL

SEQ ID NO: 2011436 - protein, 17 aa, Staphylococcus
FGQVQGVGFRYFTERLA

SEQ ID NO: 2011437 - protein, 21 aa, Staphylococcus
FGRDHLEEIYAYTFKAEDAIV

SEQ ID NO: 2011438 - protein, 27 aa, Staphylococcus
FGRSVQKLSLRFMDCHLAHFIASDAHS

SEQ ID NO: 2011439 - protein, 25 aa, Staphylococcus
FGSGQPLVFLHGWPANNTMFEYQAD

SEQ ID NO: 2011440 - protein, 17 aa, Staphylococcus
FGSGYAVFNGLKRMIQF

SEQ ID NO: 2011441 - protein, 21 aa, Staphylococcus
FGSIKHKLLMLAADNYITSFT

SEQ ID NO: 2011442 - protein, 25 aa, Staphylococcus
FGSKITVKALLRMRMSNRVKKYLNI

SEQ ID NO: 2011443 - protein, 23 aa, Staphylococcus
FGSLDRFFGILIEHFKGAFPLWM

SEQ ID NO: 2011444 - protein, 21 aa, Staphylococcus
FGSNDYYALVVLNTMFGGDPS

SEQ ID NO: 2011445 - protein, 18 aa, Staphylococcus
FGSQCICIAVDAKWEDER

SEQ ID NO: 2011446 - protein, 21 aa, Staphylococcus
FGSQIKWNFTKFVIDREGKVV

SEQ ID NO: 2011447 - protein, 17 aa, Staphylococcus
FGSVSGIGACDNVTLIF

SEQ ID NO: 2011448 - protein, 35 aa, Staphylococcus
FGTAGIRSTFGLGPARLNAFTVRKVALGLAQYLNH

SEQ ID NO: 2011449 - protein, 20 aa, Staphylococcus
FGTGSGRVFLVNTENGEIIG

SEQ ID NO: 2011450 - protein, 17 aa, Staphylococcus
FGTGYAIEFTGETIRSL

SEQ ID NO: 2011451 - protein, 18 aa, Staphylococcus
FGTKCSVQLAKPLEQLRI

SEQ ID NO: 2011452 - protein, 37 aa, Staphylococcus
FGTLKLVKRLKRRGALALAGNHEMRWLESKDKKIKRW

SEQ ID NO: 2011453 - protein, 37 aa, Staphylococcus
FGTLKLVKRLKRRGALALAGNHEMRWLNSKDKKIKRW

SEQ ID NO: 2011454 - protein, 24 aa, Staphylococcus
FGTRAELGGALGKGERVNIGVTDN

SEQ ID NO: 2011455 - protein, 23 aa, Staphylococcus
FGTREELGIALGKGERVNVGITD

SEQ ID NO: 2011456 - protein, 23 aa, Staphylococcus
FGVDFGTGYALEFTGETIKKLSM

SEQ ID NO: 2011457 - protein, 18 aa, Staphylococcus
FGVEPVIALNAFIHDTDA

SEQ ID NO: 2011458 - protein, 17 aa, Staphylococcus
FGVEPVVALNAFVHDTE

SEQ ID NO: 2011459 - protein, 25 aa, Staphylococcus
FGVHGDEVIAGFLYLTDLEEVPPKA

SEQ ID NO: 2011460 - protein, 19 aa, Staphylococcus
FGVHTFRLVNKEGQSYFVK

SEQ ID NO: 2011461 - protein, 23 aa, Staphylococcus
FGVINILLQFVMLKEDMKLPKSY

SEQ ID NO: 2011462 - protein, 24 aa, Staphylococcus
FGVKGGYDAGIKFIESLELFSLLA

SEQ ID NO: 2011463 - protein, 22 aa, Staphylococcus
FGVKMALWYQEMLRNLKRFKAV

SEQ ID NO: 2011464 - protein, 17 aa, Staphylococcus
FGVPGDFNLAFLDDIVA

SEQ ID NO: 2011465 - protein, 17 aa, Staphylococcus
FGVPGDFNLAFLDDIVR

SEQ ID NO: 2011466 - protein, 17 aa, Staphylococcus
FGVPGDFNLAFLDDIVS

SEQ ID NO: 2011467 - protein, 18 aa, Staphylococcus
FGVRDEKGRTIFGNLFST

SEQ ID NO: 2011468 - protein, 19 aa, Staphylococcus
FGVVRIHYALKRECNLNVN

SEQ ID NO: 2011469 - protein, 21 aa, Staphylococcus
FGYEESYGYLAGDFVRDKDAV

SEQ ID NO: 2011470 - protein, 21 aa, Staphylococcus
FGYGASYVCALDIYQKFSRIG

SEQ ID NO: 2011471 - protein, 17 aa, Staphylococcus
FGYGGYCLPKDTKQLKA

SEQ ID NO: 2011472 - protein, 24 aa, Staphylococcus
FGYKKEHLEPIFILGKNNKQKRDP

SEQ ID NO: 2011473 - protein, 18 aa, Staphylococcus
FGYQSFRPGQKEIITKIL

SEQ ID NO: 2011474 - protein, 23 aa, Staphylococcus
FGYSKGHLEPIFILGKNNKQKRG

SEQ ID NO: 2011475 - protein, 17 aa, Staphylococcus
FHAAALKQVPSCEFFPM

SEQ ID NO: 2011476 - protein, 18 aa, Staphylococcus
FHAAALKQVPSCEFFPME

SEQ ID NO: 2011477 - protein, 25 aa, Staphylococcus
FHAEYWFNVICMFREDGIYYYCNLS

SEQ ID NO: 2011478 - protein, 17 aa, Staphylococcus
FHAVQGYFTEVFKSLFG

SEQ ID NO: 2011479 - protein, 21 aa, Staphylococcus
FHDKYAWLREYFPFLDPQHFV

SEQ ID NO: 2011480 - protein, 18 aa, Staphylococcus
FHDLGWKTVVGFQTRNPV

SEQ ID NO: 2011481 - protein, 18 aa, Staphylococcus
FHDLQGFGRRNIDMAPDE

SEQ ID NO: 2011482 - protein, 18 aa, Staphylococcus
FHDMPVTIPGSIVTGALE

SEQ ID NO: 2011483 - protein, 18 aa, Staphylococcus
FHEKIWGGSRLKEFGYDL

SEQ ID NO: 2011484 - protein, 17 aa, Staphylococcus
FHEVEWDEALKVVVDNF

SEQ ID NO: 2011485 - protein, 17 aa, Staphylococcus
FHFLPIAVRYDGTKAPA

SEQ ID NO: 2011486 - protein, 21 aa, Staphylococcus
FHGKASFKQAIIDFYQRHYDV

SEQ ID NO: 2011487 - protein, 17 aa, Staphylococcus
FHGKASFRQAIVDFYHR

SEQ ID NO: 2011488 - protein, 31 aa, Staphylococcus
FHGNEAIELIQKVKLNFKNIKIIKALPATEN

SEQ ID NO: 2011489 - protein, 17 aa, Staphylococcus
FHHGMPIIIHGDAAYPG

SEQ ID NO: 2011490 - protein, 19 aa, Staphylococcus
FHHLKVDYLNGEKWSNAKL

SEQ ID NO: 2011491 - protein, 23 aa, Staphylococcus
FHIAYLLPSRVDLANFLYHASQL

SEQ ID NO: 2011492 - protein, 17 aa, Staphylococcus
FHIIKMFVETLVEDEHF

SEQ ID NO: 2011493 - protein, 17 aa, Staphylococcus
FHIKEQFEKSGYEVHEA

SEQ ID NO: 2011494 - protein, 19 aa, Staphylococcus
FHILQMLKLNMQHKTIKDL

SEQ ID NO: 2011495 - protein, 20 aa, Staphylococcus
FHIPRGQWTSIVGHNGSGKS

SEQ ID NO: 2011496 - protein, 17 aa, Staphylococcus
FHISLGGPVTFKNAKQP

SEQ ID NO: 2011497 - protein, 19 aa, Staphylococcus
FHITLPYFLSHEDYLLFNH

SEQ ID NO: 2011498 - protein, 25 aa, Staphylococcus
FHKACNGSLVKAYRQCGFDVNKIVF

SEQ ID NO: 2011499 - protein, 24 aa, Staphylococcus
FHKIKPDVFYFLPSYMAPLKEHND

SEQ ID NO: 2011500 - protein, 27 aa, Staphylococcus
FHKLSKDELKEIVTMMVNKLTQRLSEQ

SEQ ID NO: 2011501 - protein, 29 aa, Staphylococcus
FHKLSKEELKEIVTMMVKKLTDRLSEQNI

SEQ ID NO: 2011502 - protein, 20 aa, Staphylococcus
FHKYEDWKPYLDILDNYPAA

SEQ ID NO: 2011503 - protein, 18 aa, Staphylococcus
FHLHFHLIPRYENDIDGF

SEQ ID NO: 2011504 - protein, 18 aa, Staphylococcus
FHLKNLNKYYGIPLYYKK

SEQ ID NO: 2011505 - protein, 21 aa, Staphylococcus
FHMSPYFAYAERLLASSRLNY

SEQ ID NO: 2011506 - protein, 21 aa, Staphylococcus
FHMSPYFGYAERLLASSGLKY

SEQ ID NO: 2011507 - protein, 23 aa, Staphylococcus
FHPELKQKLALLKSITQIPVVCG

SEQ ID NO: 2011508 - protein, 24 aa, Staphylococcus
FHPELKRKIELIKGVTDVPVVAGF

SEQ ID NO: 2011509 - protein, 18 aa, Staphylococcus
FHPGHVVPGIDFSDDSLL

SEQ ID NO: 2011510 - protein, 21 aa, Staphylococcus
FHPLVRQLKPFGFFDYNALQK

SEQ ID NO: 2011511 - protein, 17 aa, Staphylococcus
FHPQGAKTKVYRFNTEE

SEQ ID NO: 2011512 - protein, 17 aa, Staphylococcus
FHQLFKLLEDVRILELI

SEQ ID NO: 2011513 - protein, 19 aa, Staphylococcus
FHRPNAVVYDLDFLQTLPY

SEQ ID NO: 2011514 - protein, 25 aa, Staphylococcus
FHSEFWFNVICMFREDGIYYYCNLS

SEQ ID NO: 2011515 - protein, 25 aa, Staphylococcus
FHSEFWFNVICMFREDGVYYYCNLS

SEQ ID NO: 2011516 - protein, 18 aa, Staphylococcus
FHSIKVCPLIYWSEDDVW

SEQ ID NO: 2011517 - protein, 21 aa, Staphylococcus
FHSLKALGANVMFASPDEWVD

SEQ ID NO: 2011518 - protein, 25 aa, Staphylococcus
FHTAAPLYYRAEPLGCTATILYKMF

SEQ ID NO: 2011519 - protein, 24 aa, Staphylococcus
FHTKDIPGSHVVIFADDPSESTIE

SEQ ID NO: 2011520 - protein, 18 aa, Staphylococcus
FHTKDIPGSHVVILNAHP

SEQ ID NO: 2011521 - protein, 18 aa, Staphylococcus
FHTKDIPGSHVVILNDSP

SEQ ID NO: 2011522 - protein, 20 aa, Staphylococcus
FHTKDIPGSHVVILNDSPSD

SEQ ID NO: 2011523 - protein, 19 aa, Staphylococcus
FHTKDIPGSHVVILSDDPS

SEQ ID NO: 2011524 - protein, 17 aa, Staphylococcus
FHTRCPIAQEACKTTKP

SEQ ID NO: 2011525 - protein, 18 aa, Staphylococcus
FHTVKVKPGDFFYVPAGT

SEQ ID NO: 2011526 - protein, 24 aa, Staphylococcus
FHVHEPRIKLAWNQLSEDKRDTEF

SEQ ID NO: 2011527 - protein, 24 aa, Staphylococcus
FHWYVKGPNFFSLHVKFEELYNEA

SEQ ID NO: 2011528 - protein, 25 aa, Staphylococcus
FHWYVKGPNFFSLHVKFEELYNEAA

SEQ ID NO: 2011529 - protein, 25 aa, Staphylococcus
FHYFFKDEQKVVGYLKLNINHAQTE

SEQ ID NO: 2011530 - protein, 24 aa, Staphylococcus
FHYFKEAHPYFDQNVVIIGGKNSA

SEQ ID NO: 2011531 - protein, 24 aa, Staphylococcus
FHYFKEAHPYFDQNVVVIGGKNSA

SEQ ID NO: 2011532 - protein, 19 aa, Staphylococcus
FHYFQPKFMLGMTATPERT

SEQ ID NO: 2011533 - protein, 24 aa, Staphylococcus
FIAERPKPLALYLFSEDENCTDRV

SEQ ID NO: 2011534 - protein, 25 aa, Staphylococcus
FIAKHKFSELHVFPYSSRIGTPAAR

SEQ ID NO: 2011535 - protein, 17 aa, Staphylococcus
FIAKLIVTGGVNVKVET

SEQ ID NO: 2011536 - protein, 18 aa, Staphylococcus
FIDAKYRALAPLYDDLEA

SEQ ID NO: 2011537 - protein, 22 aa, Staphylococcus
FIDEKYKALAPLYHTKEDLLHG

SEQ ID NO: 2011538 - protein, 25 aa, Staphylococcus
FIDEYGKRILIGWMGLPDTHYPTDE

SEQ ID NO: 2011539 - protein, 17 aa, Staphylococcus
FIDIKAREAGFEPSAVV

SEQ ID NO: 2011540 - protein, 19 aa, Staphylococcus
FIDKFKFPYLLGKADYIFV

SEQ ID NO: 2011541 - protein, 18 aa, Staphylococcus
FIDKMLWNTRFKVPHFIT

SEQ ID NO: 2011542 - protein, 18 aa, Staphylococcus
FIDLKVKHIYKNSEPPIP

SEQ ID NO: 2011543 - protein, 17 aa, Staphylococcus
FIDMQDFEHQLSLMHES

SEQ ID NO: 2011544 - protein, 23 aa, Staphylococcus
FIDPKYFRKGYGTQILQTLIRED

SEQ ID NO: 2011545 - protein, 19 aa, Staphylococcus
FIDQAFWPENAFSFKRKQY

SEQ ID NO: 2011546 - protein, 18 aa, Staphylococcus
FIDVETMLTLLDLANIYI

SEQ ID NO: 2011547 - protein, 18 aa, Staphylococcus
FIDVETMLTLLDLANIYV

SEQ ID NO: 2011548 - protein, 18 aa, Staphylococcus
FIDVETMLTLLDLSNVYV

SEQ ID NO: 2011549 - protein, 17 aa, Staphylococcus
FIDVLPFDLTDAQKQSV

SEQ ID NO: 2011550 - protein, 20 aa, Staphylococcus
FIEAAKIPVIHTLPAKTILP

SEQ ID NO: 2011551 - protein, 17 aa, Staphylococcus
FIEDLLIAHLGVSILPK

SEQ ID NO: 2011552 - protein, 19 aa, Staphylococcus
FIEKTFLDYYVKNHKSNNN

SEQ ID NO: 2011553 - protein, 20 aa, Staphylococcus
FIENRMGGFFGVKKSSMPNA

SEQ ID NO: 2011554 - protein, 19 aa, Staphylococcus
FIERGIIEVAPLAYMRGRT

SEQ ID NO: 2011555 - protein, 19 aa, Staphylococcus
FIEYKGVRIISVEDLVLPG

SEQ ID NO: 2011556 - protein, 17 aa, Staphylococcus
FIEYLLFHYQFKSRISV

SEQ ID NO: 2011557 - protein, 24 aa, Staphylococcus
FIFIFPYYLKKAMRKGLYKEYTRN

SEQ ID NO: 2011558 - protein, 23 aa, Staphylococcus
FIFKDKKYALSHIELQILNYLYQ

SEQ ID NO: 2011559 - protein, 18 aa, Staphylococcus
FIFMNNIDNVLARVLDPV

SEQ ID NO: 2011560 - protein, 19 aa, Staphylococcus
FIFVMDYHRHELINEQIDG

SEQ ID NO: 2011561 - protein, 19 aa, Staphylococcus
FIGGFPGKFIKDALEKAEI

SEQ ID NO: 2011562 - protein, 24 aa, Staphylococcus
FIGGGIISIEFASIMTKTGADVHV

SEQ ID NO: 2011563 - protein, 18 aa, Staphylococcus
FIGIARGRMQPVQPPTND

SEQ ID NO: 2011564 - protein, 18 aa, Staphylococcus
FIGILCKNAEWLAIVFDI

SEQ ID NO: 2011565 - protein, 20 aa, Staphylococcus
FIGPSCGFYTAHHPLTHQER

SEQ ID NO: 2011566 - protein, 19 aa, Staphylococcus
FIGPSCGLYTAHHPLNYQD

SEQ ID NO: 2011567 - protein, 23 aa, Staphylococcus
FIGSCSFDLARHEFPILKKTPLK

SEQ ID NO: 2011568 - protein, 26 aa, Staphylococcus
FIGSCSFDLVRHEFPVLKRREINSDL

SEQ ID NO: 2011569 - protein, 28 aa, Staphylococcus
FIGTCSFDLVRHEFPILKQIELEDHPQH

SEQ ID NO: 2011570 - protein, 21 aa, Staphylococcus
FIGTCSFDLVRHEFPKLQEIE

SEQ ID NO: 2011571 - protein, 18 aa, Staphylococcus
FIGYKVYGNPVFTMVAGE

SEQ ID NO: 2011572 - protein, 17 aa, Staphylococcus
FIGYKVYGNPVLTMVAG

SEQ ID NO: 2011573 - protein, 17 aa, Staphylococcus
FIGYKVYGNPVLTMVEG

SEQ ID NO: 2011574 - protein, 19 aa, Staphylococcus
FIHGEGALNDAIRISEALF

SEQ ID NO: 2011575 - protein, 18 aa, Staphylococcus
FIHKGMLMLYDIEALKNN

SEQ ID NO: 2011576 - protein, 20 aa, Staphylococcus
FIHRGMLKLYEMDYFKKDTS

SEQ ID NO: 2011577 - protein, 23 aa, Staphylococcus
FIICGLKSAYILKDTSQPFKENA

SEQ ID NO: 2011578 - protein, 17 aa, Staphylococcus
FIIELKYLNGMEKIKDY

SEQ ID NO: 2011579 - protein, 19 aa, Staphylococcus
FIIGFSVAKQHFSIAPEAK

SEQ ID NO: 2011580 - protein, 17 aa, Staphylococcus
FIIGSTIPHLYYKDYSK

SEQ ID NO: 2011581 - protein, 24 aa, Staphylococcus
FIITSFKHKVILIGGTEYAGEMKK

SEQ ID NO: 2011582 - protein, 22 aa, Staphylococcus
FIIWLIYKFYNSLNVYSINEDN

SEQ ID NO: 2011583 - protein, 17 aa, Staphylococcus
FIIYKGVRIINIDDLVL

SEQ ID NO: 2011584 - protein, 18 aa, Staphylococcus
FIKDGRLYHEIYRGEESQ

SEQ ID NO: 2011585 - protein, 20 aa, Staphylococcus
FIKDKVKLYGVEAAGQGIDT

SEQ ID NO: 2011586 - protein, 25 aa, Staphylococcus
FIKEQRLKGLSLKDVCLSVHKKNGK

SEQ ID NO: 2011587 - protein, 19 aa, Staphylococcus
FIKEYTGLPAERVIGSGTV

SEQ ID NO: 2011588 - protein, 24 aa, Staphylococcus
FIKKLTTNVTLMFDGDFAGTEATL

SEQ ID NO: 2011589 - protein, 21 aa, Staphylococcus
FIKKMLESHVKYTHSSKAQDI

SEQ ID NO: 2011590 - protein, 22 aa, Staphylococcus
FIKMAEAYGINGYLIDSPDKLE

SEQ ID NO: 2011591 - protein, 23 aa, Staphylococcus
FIKMAEAYGVKGFLIDQPNQLKS

SEQ ID NO: 2011592 - protein, 18 aa, Staphylococcus
FIKMAIKNIYFEYIIGTG

SEQ ID NO: 2011593 - protein, 21 aa, Staphylococcus
FIKNKRLKGLSLKNVALSVLK

SEQ ID NO: 2011594 - protein, 22 aa, Staphylococcus
FIKNLRQACTWAEEAQVILSIE

SEQ ID NO: 2011595 - protein, 32 aa, Staphylococcus
FIKSELATRMRLRIIPELSFEYDKSIDYGNKI

SEQ ID NO: 2011596 - protein, 31 aa, Staphylococcus; identical to SEQ ID NO: 1804951

SEQ ID NO: 2011597 - protein, 32 aa, Staphylococcus
FIKSELGSRMRLRIIPELNFEYDESIDYGNKI

SEQ ID NO: 2011598 - protein, 32 aa, Staphylococcus
FIKSELGSRMRLRIIPELSFEYDESIEYGNKI

SEQ ID NO: 2011599 - protein, 31 aa, Staphylococcus
FIKSELGSRMRLRIVPELQFEYDHSIEYGNK

SEQ ID NO: 2011600 - protein, 22 aa, Staphylococcus
FIKSKRLKGLSLKDVELSVLKK

SEQ ID NO: 2011601 - protein, 18 aa, Staphylococcus
FIKVLKKKGFNIGEPDDA

SEQ ID NO: 2011602 - protein, 18 aa, Staphylococcus
FIKYRENDHFIKLRLLSK

SEQ ID NO: 2011603 - protein, 22 aa, Staphylococcus
FILDQLPCWLTYTNDKTHQVID

SEQ ID NO: 2011604 - protein, 24 aa, Staphylococcus
FILEFIKYANGFVRVSRFPFYIKG

SEQ ID NO: 2011605 - protein, 21 aa, Staphylococcus
FILRGVSLVGIDSVFTPMKLR

SEQ ID NO: 2011606 - protein, 17 aa, Staphylococcus
FILSLGAKVNKQAKEGK

SEQ ID NO: 2011607 - protein, 24 aa, Staphylococcus
FINACPNLKWISWYATGVNNLPLE

SEQ ID NO: 2011608 - protein, 17 aa, Staphylococcus
FINELQSALSIGEICPV

SEQ ID NO: 2011609 - protein, 24 aa, Staphylococcus
FINEYQPNLCIFTGNQIYAEDNEK

SEQ ID NO: 2011610 - protein, 17 aa, Staphylococcus
FINGEFDILVTTTIIET

SEQ ID NO: 2011611 - protein, 20 aa, Staphylococcus
FINGRYIKNFALNKAITEGY

SEQ ID NO: 2011612 - protein, 22 aa, Staphylococcus
FINHRIIPIIPQQGSLGASGDL

SEQ ID NO: 2011613 - protein, 21 aa, Staphylococcus
FINILEILALEYAKQENMKLY

SEQ ID NO: 2011614 - protein, 17 aa, Staphylococcus
FINKEFQVITGNQTISE

SEQ ID NO: 2011615 - protein, 22 aa, Staphylococcus
FINKVGKLWWVSNVEGNGDKRK

SEQ ID NO: 2011616 - protein, 18 aa, Staphylococcus
FINLSKIGKSYMEKRKTL

SEQ ID NO: 2011617 - protein, 24 aa, Staphylococcus
FINPEVKFSMISSIDIAKIASALF

SEQ ID NO: 2011618 - protein, 18 aa, Staphylococcus
FINPFEVVYYAGGTSNKY

SEQ ID NO: 2011619 - protein, 24 aa, Staphylococcus
FINQGAESFKIWTGKQPNILEMKY

SEQ ID NO: 2011620 - protein, 18 aa, Staphylococcus
FINQLIIYYAPKIIGGSG

SEQ ID NO: 2011621 - protein, 25 aa, Staphylococcus
FINRDLFKFLPFDGSIITMNELREL

SEQ ID NO: 2011622 - protein, 21 aa, Staphylococcus
FINRDLLKYMPFDGSIITISE

SEQ ID NO: 2011623 - protein, 25 aa, Staphylococcus
FIPHAISNISQWKFIEDLLIAHLGV

SEQ ID NO: 2011624 - protein, 25 aa, Staphylococcus
FIPSMPLKRYVYRRFLNMSIGQATA

SEQ ID NO: 2011625 - protein, 17 aa, Staphylococcus
FIPYFPLASGILAGKYE

SEQ ID NO: 2011626 - protein, 26 aa, Staphylococcus
FIQDLKEKCRIPILFVPGNHDYWTSE

SEQ ID NO: 2011627 - protein, 19 aa, Staphylococcus
FIQHVKLLSEHGADYIEIG

SEQ ID NO: 2011628 - protein, 25 aa, Staphylococcus
FIQPDHFYFLPSYMSPLKDHKQHLN

SEQ ID NO: 2011629 - protein, 21 aa, Staphylococcus
FIQVGVRVVVPFGPRTIQGYV

SEQ ID NO: 2011630 - protein, 21 aa, Staphylococcus
FIRHIQFLIYRLTKGENVDAQ

SEQ ID NO: 2011631 - protein, 18 aa, Staphylococcus
FIRKQWAKLGLGLDYSRE

SEQ ID NO: 2011632 - protein, 17 aa, Staphylococcus
FIRREFLETTHLEPPIE

SEQ ID NO: 2011633 - protein, 21 aa, Staphylococcus
FIRSLKGGFKDGSFESKLQRV

SEQ ID NO: 2011634 - protein, 21 aa, Staphylococcus
FIRTLKGGFKDGSFEKKLERV

SEQ ID NO: 2011635 - protein, 18 aa, Staphylococcus
FISDLNMHPIFKVSTSRP

SEQ ID NO: 2011636 - protein, 17 aa, Staphylococcus
FISEDGFHQFNEFYNKH

SEQ ID NO: 2011637 - protein, 18 aa, Staphylococcus
FISIMAGLSINYIREKLE

SEQ ID NO: 2011638 - protein, 18 aa, Staphylococcus
FISLISLGANVMFSSPDE

SEQ ID NO: 2011639 - protein, 18 aa, Staphylococcus
FISLLGGEMLSFYDWYAD

SEQ ID NO: 2011640 - protein, 18 aa, Staphylococcus
FISRIGYVIEPQYLFGHL

SEQ ID NO: 2011641 - protein, 18 aa, Staphylococcus
FISYHIFFETLLRKYNER

SEQ ID NO: 2011642 - protein, 18 aa, Staphylococcus
FITGGILRTMYAWIQDGQ

SEQ ID NO: 2011643 - protein, 17 aa, Staphylococcus
FITHMYGSPGFSNEKLT

SEQ ID NO: 2011644 - protein, 24 aa, Staphylococcus
FITNLDCLIYASGTALYGQIQDMT

SEQ ID NO: 2011645 - protein, 24 aa, Staphylococcus
FITSEDSLNHFIDILSQSEWIKRA

SEQ ID NO: 2011646 - protein, 17 aa, Staphylococcus
FIVASAYGERITSLESK

SEQ ID NO: 2011647 - protein, 24 aa, Staphylococcus
FIVKCPLDNGAEIFAGVPSERYPA

SEQ ID NO: 2011648 - protein, 33 aa, Staphylococcus
FIVLTTEYYWHWDLKYAQLDVFEYKRLMQKLMQ

SEQ ID NO: 2011649 - protein, 20 aa, Staphylococcus
FIVLYRCAYNFNFATEPTIN

SEQ ID NO: 2011650 - protein, 18 aa, Staphylococcus
FIVNDNVALALKVQADGI

SEQ ID NO: 2011651 - protein, 18 aa, Staphylococcus
FIVSSWLGTMGCALPGAI

SEQ ID NO: 2011652 - protein, 20 aa, Staphylococcus
FIVTEPMSFELWIASLLFAT

SEQ ID NO: 2011653 - protein, 18 aa, Staphylococcus
FIYCLEGQITLSLGNQLY

SEQ ID NO: 2011654 - protein, 17 aa, Staphylococcus
FIYEYYGGTIIHGLKPV

SEQ ID NO: 2011655 - protein, 25 aa, Staphylococcus
FIYFYKENRDIVGYFKLNINEAQTE

SEQ ID NO: 2011656 - protein, 20 aa, Staphylococcus
FIYKGIETKLNIVINDEKEQ

SEQ ID NO: 2011657 - protein, 19 aa, Staphylococcus
FIYRFKGYELENIALNMSG

SEQ ID NO: 2011658 - protein, 31 aa, Staphylococcus
FIYSKPRSGYYVSDIESLPVLPKQYVVPTTT

SEQ ID NO: 2011659 - protein, 26 aa, Staphylococcus
FIYSKPRSGYYVSDIQSLPVININNQ

SEQ ID NO: 2011660 - protein, 25 aa, Staphylococcus
FIYSKPRSGYYVSEIQSLPVTNSYP

SEQ ID NO: 2011661 - protein, 21 aa, Staphylococcus
FKAAQGGIMRLFFNEKTPYTM

SEQ ID NO: 2011662 - protein, 17 aa, Staphylococcus
FKADIDRVVTKHDCPSC

SEQ ID NO: 2011663 - protein, 21 aa, Staphylococcus
FKAEGVSIVDHLTASKQFEMF

SEQ ID NO: 2011664 - protein, 17 aa, Staphylococcus
FKAGHTVDVILTESNVF

SEQ ID NO: 2011665 - protein, 27 aa, Staphylococcus
FKAGIQIRFYAVQALKLLKAQFDVDKK

SEQ ID NO: 2011666 - protein, 17 aa, Staphylococcus
FKAGQKEIIKSVLDSNH

SEQ ID NO: 2011667 - protein, 19 aa, Staphylococcus
FKAIFPNDNVIGISELLKD

SEQ ID NO: 2011668 - protein, 29 aa, Staphylococcus
FKAIKKKLPLVKRFVGLTGTPSPNSLLDL

SEQ ID NO: 2011669 - protein, 23 aa, Staphylococcus
FKAILRCDPDIILIGEIRDAQIA

SEQ ID NO: 2011670 - protein, 22 aa, Staphylococcus
FKALRRFFKIYIRGIKGASQLR

SEQ ID NO: 2011671 - protein, 25 aa, Staphylococcus
FKAMRAKSKLLYAIITERQSLTIAY

SEQ ID NO: 2011672 - protein, 20 aa, Staphylococcus
FKAPKSWSNRKKLLAIGQYK

SEQ ID NO: 2011673 - protein, 17 aa, Staphylococcus
FKARKPMGKAFIKAIKQ

SEQ ID NO: 2011674 - protein, 19 aa, Staphylococcus
FKASHKKLYAPISGKHAFN

SEQ ID NO: 2011675 - protein, 18 aa, Staphylococcus
FKASIERSDSCAVPAASV

SEQ ID NO: 2011676 - protein, 21 aa, Staphylococcus
FKASKNFTIVPSWETYQKESD

SEQ ID NO: 2011677 - protein, 21 aa, Staphylococcus
FKASLERLGTDYLDLYLIHWP

SEQ ID NO: 2011678 - protein, 17 aa, Staphylococcus
FKDAEIQGGFVDGEAPE

SEQ ID NO: 2011679 - protein, 30 aa, Staphylococcus
FKDAGFQWREPGCSMCLGMNPDQVPAGVHC

SEQ ID NO: 2011680 - protein, 30 aa, Staphylococcus
FKDAGFQWREPGCSMCLGMNPDQVPEGIHC

SEQ ID NO: 2011681 - protein, 18 aa, Staphylococcus
FKDAKFYSKEAFVAYFIE

SEQ ID NO: 2011682 - protein, 21 aa, Staphylococcus
FKDANKWLEIIHKYNVTVWDS

SEQ ID NO: 2011683 - protein, 24 aa, Staphylococcus
FKDDALRLAHEDLYETKSILENVI

SEQ ID NO: 2011684 - protein, 19 aa, Staphylococcus
FKDEHLPTFDDVVKIANEY

SEQ ID NO: 2011685 - protein, 25 aa, Staphylococcus
FKDFFDFARRLPKRVKTRKLLESLI

SEQ ID NO: 2011686 - protein, 19 aa, Staphylococcus
FKDFFDFTRRIPKRVKSRK

SEQ ID NO: 2011687 - protein, 17 aa, Staphylococcus
FKDFKSFIEKHGNNFKK

SEQ ID NO: 2011688 - protein, 19 aa, Staphylococcus
FKDHPEKVNMLAFEANQND

SEQ ID NO: 2011689 - protein, 17 aa, Staphylococcus
FKDIAHVDWHFTIQNTS

SEQ ID NO: 2011690 - protein, 21 aa, Staphylococcus
FKDIATVNWHFKVQNTTNQDE

SEQ ID NO: 2011691 - protein, 23 aa, Staphylococcus
FKDICLGVPTILGANGVEKVVEI

SEQ ID NO: 2011692 - protein, 22 aa, Staphylococcus
FKDILINEEFFFASTSKKLVRI

SEQ ID NO: 2011693 - protein, 21 aa, Staphylococcus
FKDILINEYIYFASKNKKLVR

SEQ ID NO: 2011694 - protein, 23 aa, Staphylococcus
FKDKAVDGLDCFIGEVGLTGEVR

SEQ ID NO: 2011695 - protein, 23 aa, Staphylococcus
FKDKAVDGLDCFVGEVGLTGEVR

SEQ ID NO: 2011696 - protein, 25 aa, Staphylococcus
FKDKELFESHSFPFGVVTLKHKFFD

SEQ ID NO: 2011697 - protein, 24 aa, Staphylococcus
FKDKELFESHSFPFGVVTLKRKFF

SEQ ID NO: 2011698 - protein, 20 aa, Staphylococcus
FKDKHVISISLELINERYLK

SEQ ID NO: 2011699 - protein, 20 aa, Staphylococcus
FKDKHVITISLEIANERYLK

SEQ ID NO: 2011700 - protein, 20 aa, Staphylococcus
FKDKHVITISLEIVNERYLK

SEQ ID NO: 2011701 - protein, 24 aa, Staphylococcus
FKDKKLIEAHSFPFGVVTLQRKFF

SEQ ID NO: 2011702 - protein, 25 aa, Staphylococcus
FKDKKLKAAHSFPFGVVSLKRQFFG

SEQ ID NO: 2011703 - protein, 24 aa, Staphylococcus
FKDKKLKEAHSFPFGVVTLKRQFF

SEQ ID NO: 2011704 - protein, 19 aa, Staphylococcus
FKDNIEPVPGIRMIHTGGH

SEQ ID NO: 2011705 - protein, 17 aa, Staphylococcus
FKDRGLTSHDVVFKLRK

SEQ ID NO: 2011706 - protein, 17 aa, Staphylococcus
FKDRGMVMAVTKAKEQG

SEQ ID NO: 2011707 - protein, 18 aa, Staphylococcus
FKDRILIPQNDMDKITKK

SEQ ID NO: 2011708 - protein, 17 aa, Staphylococcus
FKDSIANIIHYYQIPPH

SEQ ID NO: 2011709 - protein, 17 aa, Staphylococcus
FKDVLINEVFYVANKNK

SEQ ID NO: 2011710 - protein, 21 aa, Staphylococcus
FKDYFSKDALRHYFGSSSQHS

SEQ ID NO: 2011711 - protein, 21 aa, Staphylococcus
FKDYTFRLSYRDPEDKEKYMD

SEQ ID NO: 2011712 - protein, 21 aa, Staphylococcus
FKEAHPYFNQDVVVIGGKNSA

SEQ ID NO: 2011713 - protein, 21 aa, Staphylococcus
FKEALPYLMTAAEKDENRDSE

SEQ ID NO: 2011714 - protein, 23 aa, Staphylococcus
FKEAQKIGIVLAMNHEVNTYPII

SEQ ID NO: 2011715 - protein, 26 aa, Staphylococcus
FKEDALRILRGLRFQSQLNFTIEGDT

SEQ ID NO: 2011716 - protein, 17 aa, Staphylococcus
FKEDDIELFRDIADKVK

SEQ ID NO: 2011717 - protein, 20 aa, Staphylococcus
FKEDEHFNTFIIDDVVQNEN

SEQ ID NO: 2011718 - protein, 20 aa, Staphylococcus
FKEDIGFDVPFHLTGDLKCD

SEQ ID NO: 2011719 - protein, 24 aa, Staphylococcus
FKEEGHKLIGIRGMPRVGKTESIV

SEQ ID NO: 2011720 - protein, 18 aa, Staphylococcus
FKEEIFGPVLAVTTYNDF

SEQ ID NO: 2011721 - protein, 21 aa, Staphylococcus
FKEEKKIISSVCHGPSAFVGA

SEQ ID NO: 2011722 - protein, 18 aa, Staphylococcus
FKEEPFKKVVVYRDDSDL

SEQ ID NO: 2011723 - protein, 17 aa, Staphylococcus
FKEEVGEDITIVPVSTI

SEQ ID NO: 2011724 - protein, 24 aa, Staphylococcus
FKEFAKDHFDYIVFDEAHRSAAAS

SEQ ID NO: 2011725 - protein, 30 aa, Staphylococcus
FKEGELKQRIYFMYGGKWQRVRFEFNNGII

SEQ ID NO: 2011726 - protein, 19 aa, Staphylococcus
FKEGIKLYDAFTILYLLDP

SEQ ID NO: 2011727 - protein, 19 aa, Staphylococcus
FKEGIYKKDSVYTLKKHKE

SEQ ID NO: 2011728 - protein, 17 aa, Staphylococcus
FKEGKLTTLPDNRYSIQ

SEQ ID NO: 2011729 - protein, 18 aa, Staphylococcus
FKEGNSYSHYLLIEQAIT

SEQ ID NO: 2011730 - protein, 21 aa, Staphylococcus
FKEGVGIDLARLSLEKAETLK

SEQ ID NO: 2011731 - protein, 19 aa, Staphylococcus
FKEIATVQWHFTIADTHNQ

SEQ ID NO: 2011732 - protein, 19 aa, Staphylococcus
FKEIATVTIHFSIKDTTNQ

SEQ ID NO: 2011733 - protein, 21 aa, Staphylococcus
FKEILINEVIILASKNKKLIR

SEQ ID NO: 2011734 - protein, 19 aa, Staphylococcus
FKEKGFYPVAIDAKHGKGL

SEQ ID NO: 2011735 - protein, 25 aa, Staphylococcus
FKEKGRPIPTIAFYSPHTLPYIDDA

SEQ ID NO: 2011736 - protein, 22 aa, Staphylococcus
FKEKIGKFLSLFIRTNKDIYFE

SEQ ID NO: 2011737 - protein, 21 aa, Staphylococcus
FKEKVLREFEMKFQIQQIPFD

SEQ ID NO: 2011738 - protein, 26 aa, Staphylococcus
FKELFPENRVEYFVSFYDYYQPEAYV

SEQ ID NO: 2011739 - protein, 21 aa, Staphylococcus
FKELKEAVIHIEVDGTNYLQD

SEQ ID NO: 2011740 - protein, 19 aa, Staphylococcus
FKELYRVEFIRQRGVYHHF

SEQ ID NO: 2011741 - protein, 22 aa, Staphylococcus
FKEMLINEYIYFASKNKKIVRL

SEQ ID NO: 2011742 - protein, 17 aa, Staphylococcus
FKENRPTLVDVHVDANA

SEQ ID NO: 2011743 - protein, 22 aa, Staphylococcus
FKENVKTAFAYKKSHPEIQVGM

SEQ ID NO: 2011744 - protein, 25 aa, Staphylococcus
FKEQVGYPLIVRPAFTMGGTGGGIC

SEQ ID NO: 2011745 - protein, 18 aa, Staphylococcus
FKERIWGSDNLEKYGYQL

SEQ ID NO: 2011746 - protein, 19 aa, Staphylococcus
FKEVGRIISLALKNPNNDT

SEQ ID NO: 2011747 - protein, 20 aa, Staphylococcus
FKEYFASVVPAGDNKFAALN

SEQ ID NO: 2011748 - protein, 17 aa, Staphylococcus
FKEYLPVNSDTPKLTLN

SEQ ID NO: 2011749 - protein, 17 aa, Staphylococcus
FKFDYIIPERLQSFVQI

SEQ ID NO: 2011750 - protein, 21 aa, Staphylococcus
FKFDYLIPKNLEAFIQVGVRV

SEQ ID NO: 2011751 - protein, 18 aa, Staphylococcus
FKFFEQLHDLPLPKEGEY

SEQ ID NO: 2011752 - protein, 18 aa, Staphylococcus
FKFGERVIDSTGALNLQE

SEQ ID NO: 2011753 - protein, 20 aa, Staphylococcus
FKGDLAEIVKSFLVDFQEKY

SEQ ID NO: 2011754 - protein, 27 aa, Staphylococcus
FKGDTFFPPYTFEEWEVASSEEGVLDE

SEQ ID NO: 2011755 - protein, 25 aa, Staphylococcus
FKGEAKSGPVVAIFGDTKPCPNEHI

SEQ ID NO: 2011756 - protein, 19 aa, Staphylococcus
FKGELIQIPPMYSSVKVNG

SEQ ID NO: 2011757 - protein, 19 aa, Staphylococcus
FKGIGKKTAQSIVNKLGEN

SEQ ID NO: 2011758 - protein, 25 aa, Staphylococcus
FKGLAKPGPIIAIFGDTKPCANEKI

SEQ ID NO: 2011759 - protein, 20 aa, Staphylococcus
FKGNNAITFLLQNIQPHQNL

SEQ ID NO: 2011760 - protein, 19 aa, Staphylococcus
FKGNNAMTILLQNIQPHQN

SEQ ID NO: 2011761 - protein, 20 aa, Staphylococcus
FKGNTWLFFGDQHFTTDFLY

SEQ ID NO: 2011762 - protein, 21 aa, Staphylococcus
FKGNTWLFFGEQHFTTDFLYQ

SEQ ID NO: 2011763 - protein, 20 aa, Staphylococcus
FKGPCLKCLLKQMPSSGESC

SEQ ID NO: 2011764 - protein, 17 aa, Staphylococcus
FKGPKGPTGYMIPTVVE

SEQ ID NO: 2011765 - protein, 23 aa, Staphylococcus
FKGQELKHFIPREHIEGRDIQDI

SEQ ID NO: 2011766 - protein, 18 aa, Staphylococcus
FKGQKMPGRMGGNTVTVQ

SEQ ID NO: 2011767 - protein, 23 aa, Staphylococcus
FKGTELKHFIPREHIEGRDIQDI

SEQ ID NO: 2011768 - protein, 24 aa, Staphylococcus
FKGTGLKFKVPDNLFVSEIKDSGE

SEQ ID NO: 2011769 - protein, 19 aa, Staphylococcus
FKHAALLYDFGYKYLETVE

SEQ ID NO: 2011770 - protein, 21 aa, Staphylococcus
FKHAENVTRKLGFKALSNNDS

SEQ ID NO: 2011771 - protein, 18 aa, Staphylococcus
FKHAYGTILYFEDEDVIK

SEQ ID NO: 2011772 - protein, 20 aa, Staphylococcus
FKHKHLKVFGLTASPDYILN

SEQ ID NO: 2011773 - protein, 21 aa, Staphylococcus
FKHKRALDLIFEYKPDIHSDI

SEQ ID NO: 2011774 - protein, 27 aa, Staphylococcus
FKHLNRFARVPVCGAISSYNHPEDDIG

SEQ ID NO: 2011775 - protein, 17 aa, Staphylococcus
FKHLSPRQKAYIENHQH

SEQ ID NO: 2011776 - protein, 21 aa, Staphylococcus
FKHMHRHSARIVGGALNLADC

SEQ ID NO: 2011777 - protein, 20 aa, Staphylococcus
FKHQGAQVTEVWVNSHEITQ

SEQ ID NO: 2011778 - protein, 18 aa, Staphylococcus
FKHVRDIDLYPSHASVMT

SEQ ID NO: 2011779 - protein, 18 aa, Staphylococcus
FKHVRDIDLYPSRSAVMA

SEQ ID NO: 2011780 - protein, 19 aa, Staphylococcus
FKIAKANGVTTVLNPAPAI

SEQ ID NO: 2011781 - protein, 19 aa, Staphylococcus
FKIDGEFIMVLVRGHHELN

SEQ ID NO: 2011782 - protein, 20 aa, Staphylococcus
FKIDGEFVMILIRGHHELND

SEQ ID NO: 2011783 - protein, 19 aa, Staphylococcus
FKIEILRNDMINVQYILDL

SEQ ID NO: 2011784 - protein, 19 aa, Staphylococcus
FKIIDEQNEIILLTSGMHN

SEQ ID NO: 2011785 - protein, 17 aa, Staphylococcus
FKIKGSIGNGQFAAIPW

SEQ ID NO: 2011786 - protein, 17 aa, Staphylococcus
FKILAEINLSNENDVNI

SEQ ID NO: 2011787 - protein, 18 aa, Staphylococcus
FKILGRSWNGLIINYLSR

SEQ ID NO: 2011788 - protein, 26 aa, Staphylococcus
FKINEAYVKISLIGSGMRDMSGVASK

SEQ ID NO: 2011789 - protein, 25 aa, Staphylococcus
FKINELKSYITFVIVNRDKTTQEVE

SEQ ID NO: 2011790 - protein, 26 aa, Staphylococcus
FKINEYRATMKFMEMFSDYYNFNLKS

SEQ ID NO: 2011791 - protein, 23 aa, Staphylococcus
FKINGPLPFLQLVYFLLAFGEFS

SEQ ID NO: 2011792 - protein, 20 aa, Staphylococcus
FKINLLEVAEHFKSQDDPKI

SEQ ID NO: 2011793 - protein, 22 aa, Staphylococcus
FKIRYLINEVCHKYQIPWVYGA

SEQ ID NO: 2011794 - protein, 19 aa, Staphylococcus
FKISAILSKLRIEYNQYIR

SEQ ID NO: 2011795 - protein, 20 aa, Staphylococcus
FKKAEHDLLTMIKHGVLTVE

SEQ ID NO: 2011796 - protein, 22 aa, Staphylococcus
FKKAEIGDKVIFYQVQTDTGLL

SEQ ID NO: 2011797 - protein, 21 aa, Staphylococcus
FKKAKIGDQVIFYQVQTDTGL

SEQ ID NO: 2011798 - protein, 17 aa, Staphylococcus
FKKALAGLTGLDTHQAD

SEQ ID NO: 2011799 - protein, 17 aa, Staphylococcus
FKKDFKPLLNVKDKSFY

SEQ ID NO: 2011800 - protein, 17 aa, Staphylococcus
FKKEIDEEVTIVPVSTI

SEQ ID NO: 2011801 - protein, 21 aa, Staphylococcus
FKKEREGRLVAEQQVHELKPK

SEQ ID NO: 2011802 - protein, 24 aa, Staphylococcus
FKKERYKSEKIIKGFMDTPTTSEQ

SEQ ID NO: 2011803 - protein, 17 aa, Staphylococcus
FKKFKEIADEVGAKLMV

SEQ ID NO: 2011804 - protein, 22 aa, Staphylococcus
FKKGEPFNGHIVAKVIQSNAKD

SEQ ID NO: 2011805 - protein, 18 aa, Staphylococcus
FKKGKWSSEVDVRNFIQL

SEQ ID NO: 2011806 - protein, 25 aa, Staphylococcus
FKKHGLKYGDKVLIMMPRAIATYEL

SEQ ID NO: 2011807 - protein, 25 aa, Staphylococcus
FKKKVAQSIKEWDINVEQIYYVSKF

SEQ ID NO: 2011808 - protein, 19 aa, Staphylococcus
FKKLNATVINTEYKSIEES

SEQ ID NO: 2011809 - protein, 21 aa, Staphylococcus
FKKMHVRPRHEIVALDLENDI

SEQ ID NO: 2011810 - protein, 19 aa, Staphylococcus
FKKMIKKGAMTPEMLATRQ

SEQ ID NO: 2011811 - protein, 18 aa, Staphylococcus
FKKNHCEAVIEANTGNLL

SEQ ID NO: 2011812 - protein, 21 aa, Staphylococcus
FKKPIITPVLPYKNFYPAEDY

SEQ ID NO: 2011813 - protein, 17 aa, Staphylococcus
FKKRLLLFENEIEIVPG

SEQ ID NO: 2011814 - protein, 19 aa, Staphylococcus
FKKSMSVVFECHIYTLRQV

SEQ ID NO: 2011815 - protein, 20 aa, Staphylococcus
FKKSNIVDHYAIYNNVLIED

SEQ ID NO: 2011816 - protein, 18 aa, Staphylococcus
FKKTVTPVVKSYQPDILL

SEQ ID NO: 2011817 - protein, 22 aa, Staphylococcus
FKKVALEMGGKSPLIVLDDQNI

SEQ ID NO: 2011818 - protein, 19 aa, Staphylococcus
FKKVELVLNDKHVGRVKDY

SEQ ID NO: 2011819 - protein, 19 aa, Staphylococcus
FKKVVEWLNEYFSGNRPQI

SEQ ID NO: 2011820 - protein, 17 aa, Staphylococcus
FKLAKQFDTTVDDLFST

SEQ ID NO: 2011821 - protein, 17 aa, Staphylococcus
FKLDYPLYINAMTGGSE

SEQ ID NO: 2011822 - protein, 19 aa, Staphylococcus
FKLEIPIIKRRPNFEMEER

SEQ ID NO: 2011823 - protein, 17 aa, Staphylococcus
FKLENIASIMFTSGTTG

SEQ ID NO: 2011824 - protein, 26 aa, Staphylococcus
FKLFRVPAEQSIPIWTDSKRDTLQAF

SEQ ID NO: 2011825 - protein, 22 aa, Staphylococcus
FKLIATELLWFIKGDTNIQYLL

SEQ ID NO: 2011826 - protein, 18 aa, Staphylococcus
FKLIEQFVSTMGYVGQID

SEQ ID NO: 2011827 - protein, 17 aa, Staphylococcus
FKLKANHSALRIRVKDD

SEQ ID NO: 2011828 - protein, 17 aa, Staphylococcus
FKLKPDCHCTSKYLNNL

SEQ ID NO: 2011829 - protein, 17 aa, Staphylococcus
FKLKPNCHCTSKYLNNL

SEQ ID NO: 2011830 - protein, 20 aa, Staphylococcus
FKLLEDVRILELIRKERPST

SEQ ID NO: 2011831 - protein, 19 aa, Staphylococcus
FKLLHLSFNPNLRLFLHKY

SEQ ID NO: 2011832 - protein, 21 aa, Staphylococcus
FKLNDLMSEFNISRSTALRDI

SEQ ID NO: 2011833 - protein, 19 aa, Staphylococcus
FKLNSSIKIKHLVDYRLKP

SEQ ID NO: 2011834 - protein, 19 aa, Staphylococcus
FKLPKWLYNKMQNRALNKH

SEQ ID NO: 2011835 - protein, 19 aa, Staphylococcus
FKLPPKVLENYRRINEFHD

SEQ ID NO: 2011836 - protein, 18 aa, Staphylococcus
FKLPVEVDKFNWFHIAKK

SEQ ID NO: 2011837 - protein, 19 aa, Staphylococcus
FKLSAILSKLRVEYKQYIR

SEQ ID NO: 2011838 - protein, 21 aa, Staphylococcus
FKLSDGNLFKTFNLDIPEPKV

SEQ ID NO: 2011839 - protein, 20 aa, Staphylococcus
FKLTFLEDASADRDIKVHDF

SEQ ID NO: 2011840 - protein, 21 aa, Staphylococcus
FKLTLEVALQLGDDVVRTIAM

SEQ ID NO: 2011841 - protein, 22 aa, Staphylococcus
FKLVATELLWFIKGDTNIQYLL

SEQ ID NO: 2011842 - protein, 22 aa, Staphylococcus
FKLVATELLWFIKGDTNIRYLL

SEQ ID NO: 2011843 - protein, 20 aa, Staphylococcus
FKLVWSDSQLSTIYFQPYNS

SEQ ID NO: 2011844 - protein, 23 aa, Staphylococcus
FKMAKEGIAILWITHSDDQSMRH

SEQ ID NO: 2011845 - protein, 19 aa, Staphylococcus
FKMKILKRYFDKENNVVIV

SEQ ID NO: 2011846 - protein, 17 aa, Staphylococcus
FKMKKTKREIWLTEQGI

SEQ ID NO: 2011847 - protein, 17 aa, Staphylococcus
FKMKPIGLIGNSGGILT

SEQ ID NO: 2011848 - protein, 17 aa, Staphylococcus
FKMLCMGFTRKQIKKLT

SEQ ID NO: 2011849 - protein, 21 aa, Staphylococcus
FKMMILPHFKDMAIKDITVPH

SEQ ID NO: 2011850 - protein, 17 aa, Staphylococcus
FKMMQDFIREEDVILAE

SEQ ID NO: 2011851 - protein, 17 aa, Staphylococcus
FKMTKAAFSQRRKTINN

SEQ ID NO: 2011852 - protein, 17 aa, Staphylococcus
FKNADYDKVVIYKNPEE

SEQ ID NO: 2011853 - protein, 28 aa, Staphylococcus
FKNAESKLTVAMGLRINNEPLLMDISKT

SEQ ID NO: 2011854 - protein, 33 aa, Staphylococcus
FKNAESKLTVAMGYRINNEPLLMDIAKTPHALI

SEQ ID NO: 2011855 - protein, 23 aa, Staphylococcus
FKNASEALAEWVREDKIKTQTTV

SEQ ID NO: 2011856 - protein, 22 aa, Staphylococcus
FKNDDVPVWLDRNSPFNIEGGD

SEQ ID NO: 2011857 - protein, 17 aa, Staphylococcus
FKNDEIVGAVDIRHQLN

SEQ ID NO: 2011858 - protein, 21 aa, Staphylococcus
FKNDKVNFIWSHTLKSINDKD

SEQ ID NO: 2011859 - protein, 24 aa, Staphylococcus
FKNGKGRAKGFLVGQIMKASKGQA

SEQ ID NO: 2011860 - protein, 23 aa, Staphylococcus
FKNHLKANSLITIQTLNNEHGTI

SEQ ID NO: 2011861 - protein, 18 aa, Staphylococcus
FKNIKIIKALPATENLNR

SEQ ID NO: 2011862 - protein, 20 aa, Staphylococcus
FKNINELFQFVFNDYYDIDL

SEQ ID NO: 2011863 - protein, 21 aa, Staphylococcus
FKNKEKIMGFGHRVYKDGDPR

SEQ ID NO: 2011864 - protein, 23 aa, Staphylococcus
FKNKELLDSLAYHHYKELSKANL

SEQ ID NO: 2011865 - protein, 21 aa, Staphylococcus
FKNKIAALVLKKDLNQFSQKM

SEQ ID NO: 2011866 - protein, 28 aa, Staphylococcus
FKNKQYFRNGLWKGKKAIIIYTQGGPEI

SEQ ID NO: 2011867 - protein, 17 aa, Staphylococcus
FKNLRYTSSNFRNSMYD

SEQ ID NO: 2011868 - protein, 26 aa, Staphylococcus
FKNNGWDNYPICMAKTQYSFSDDATA

SEQ ID NO: 2011869 - protein, 25 aa, Staphylococcus
FKNPARILGSFFIKHHGYRVRIDDI

SEQ ID NO: 2011870 - protein, 24 aa, Staphylococcus
FKNPERILGSFFIKHHGYRVRIDD

SEQ ID NO: 2011871 - protein, 22 aa, Staphylococcus
FKNRKVADFFAHFAETVFQRYK

SEQ ID NO: 2011872 - protein, 18 aa, Staphylococcus
FKNSCLKMSLQALQSKGK

SEQ ID NO: 2011873 - protein, 17 aa, Staphylococcus
FKNSINYIMNNLDKNLT

SEQ ID NO: 2011874 - protein, 25 aa, Staphylococcus
FKNTESKLTVAMGNRINNEPLLMDI

SEQ ID NO: 2011875 - protein, 33 aa, Staphylococcus
FKNTESKLTVAMGYRINNEPLLMDIAKTPHALI

SEQ ID NO: 2011876 - protein, 21 aa, Staphylococcus
FKNTYGHLAGAWRGKKPIQRN

SEQ ID NO: 2011877 - protein, 24 aa, Staphylococcus
FKNVKRLALQEGILAGSSSGAALQ

SEQ ID NO: 2011878 - protein, 17 aa, Staphylococcus
FKNVLSFTNGIEDKMIY

SEQ ID NO: 2011879 - protein, 21 aa, Staphylococcus
FKPDALMHMAALLSATAEKNP

SEQ ID NO: 2011880 - protein, 17 aa, Staphylococcus
FKPEKRKDIELGEFKPC

SEQ ID NO: 2011881 - protein, 33 aa, Staphylococcus
FKPELYTHCVLVWKKSRIQTPILKNFIKRFKEM

SEQ ID NO: 2011882 - protein, 19 aa, Staphylococcus
FKPGETFKIDVKRVDKSFP

SEQ ID NO: 2011883 - protein, 21 aa, Staphylococcus
FKPIRLDKYFPEWHATYSEVD

SEQ ID NO: 2011884 - protein, 17 aa, Staphylococcus
FKPLLNVKDKSFYTRID

SEQ ID NO: 2011885 - protein, 18 aa, Staphylococcus
FKPMVEVIEHDFTEKSLD

SEQ ID NO: 2011886 - protein, 20 aa, Staphylococcus
FKPNAYQLVSYHGDKPGMVG

SEQ ID NO: 2011887 - protein, 17 aa, Staphylococcus
FKPNGTVIQLWHGTPIK

SEQ ID NO: 2011888 - protein, 22 aa, Staphylococcus
FKPQDRVLLIFGPEGGLSDEEV

SEQ ID NO: 2011889 - protein, 19 aa, Staphylococcus
FKPQHFENAVLFPGNILKS

SEQ ID NO: 2011890 - protein, 21 aa, Staphylococcus
FKPQRFETGFRRKPHEDELMA

SEQ ID NO: 2011891 - protein, 20 aa, Staphylococcus
FKPVILHNILQSIYLLADGM

SEQ ID NO: 2011892 - protein, 19 aa, Staphylococcus
FKQEYWKHLARGPETLCIY

SEQ ID NO: 2011893 - protein, 17 aa, Staphylococcus
FKQGKVLTIEGVQNTST

SEQ ID NO: 2011894 - protein, 25 aa, Staphylococcus
FKQIKTRIYPVGRLDYDTSGLLLLT

SEQ ID NO: 2011895 - protein, 22 aa, Staphylococcus
FKQKVEQSIQDWDIKVDQLFYV

SEQ ID NO: 2011896 - protein, 17 aa, Staphylococcus
FKQLNINSPELFELASL

SEQ ID NO: 2011897 - protein, 28 aa, Staphylococcus
FKQLNMEVIWLIQDCRYHRGRLYLNSFQ

SEQ ID NO: 2011898 - protein, 20 aa, Staphylococcus
FKQPLLDWLNHYPGSNKWLY

SEQ ID NO: 2011899 - protein, 21 aa, Staphylococcus
FKQRAEKCINDIIQRGKTPIV

SEQ ID NO: 2011900 - protein, 19 aa, Staphylococcus
FKQRVEAELSMNYSMSLSG

SEQ ID NO: 2011901 - protein, 34 aa, Staphylococcus
FKQRVNKSIEDWDIKLTDIFYVTKFDHPENELSR

SEQ ID NO: 2011902 - protein, 23 aa, Staphylococcus
FKQSKRGTLRIGASHAPIYSILP

SEQ ID NO: 2011903 - protein, 27 aa, Staphylococcus
FKQSYKALFIRKEMNLEKEGLQLCQYL

SEQ ID NO: 2011904 - protein, 20 aa, Staphylococcus
FKQTYGHLAGAWRGKKPIQR

SEQ ID NO: 2011905 - protein, 26 aa, Staphylococcus
FKQVYKLYFKFVMPVFGKLFAKSKEE

SEQ ID NO: 2011906 - protein, 26 aa, Staphylococcus
FKQVYKLYFRFVMPIFGKLFAKSKEE

SEQ ID NO: 2011907 - protein, 26 aa, Staphylococcus
FKQVYRLYFKFVMPIFGKLFAKSKEE

SEQ ID NO: 2011908 - protein, 17 aa, Staphylococcus
FKQYGLPQVISSVTPQS

SEQ ID NO: 2011909 - protein, 21 aa, Staphylococcus
FKRADGLRVNGDIRRFDKVLC

SEQ ID NO: 2011910 - protein, 19 aa, Staphylococcus
FKRANELGITITIVSNNNE

SEQ ID NO: 2011911 - protein, 20 aa, Staphylococcus
FKRATRMSFIQGQKQAIDEM

SEQ ID NO: 2011912 - protein, 21 aa, Staphylococcus
FKREHMVFPGMVYISHPTEYG

SEQ ID NO: 2011913 - protein, 19 aa, Staphylococcus
FKRFKEIADEVGAKLMVDM

SEQ ID NO: 2011914 - protein, 19 aa, Staphylococcus
FKRHIEIYKSVARSYGHNP

SEQ ID NO: 2011915 - protein, 19 aa, Staphylococcus
FKRIEAIEYSVKYDDGKHF

SEQ ID NO: 2011916 - protein, 22 aa, Staphylococcus
FKRQIQELGFSYDWDREVNTTD

SEQ ID NO: 2011917 - protein, 23 aa, Staphylococcus
FKRSGAKVETHWTVSHGITEAAL

SEQ ID NO: 2011918 - protein, 21 aa, Staphylococcus
FKRTSRKLFNEKVKAVQYDLS

SEQ ID NO: 2011919 - protein, 18 aa, Staphylococcus
FKRVENLDDLLMAIENTY

SEQ ID NO: 2011920 - protein, 17 aa, Staphylococcus
FKSAFWMDEDRIWEIGY

SEQ ID NO: 2011921 - protein, 17 aa, Staphylococcus
FKSAFWMDEERIWEIGY

SEQ ID NO: 2011922 - protein, 33 aa, Staphylococcus
FKSAIQTVIKYRVPVCCFTFGIPSKEIIEQLKG

SEQ ID NO: 2011923 - protein, 19 aa, Staphylococcus
FKSELFFEKRKHFIKVLKK

SEQ ID NO: 2011924 - protein, 21 aa, Staphylococcus
FKSEYQLSLAHFNNIIGYELL

SEQ ID NO: 2011925 - protein, 17 aa, Staphylococcus
FKSFLKFETEIQQQHSS

SEQ ID NO: 2011926 - protein, 17 aa, Staphylococcus
FKSFSINVSSFGFKHGI

SEQ ID NO: 2011927 - protein, 28 aa, Staphylococcus
FKSFYRIYEYYKKFGLFSETIDNFKYGY

SEQ ID NO: 2011928 - protein, 17 aa, Staphylococcus
FKSKRLLTWDSSNKQLY

SEQ ID NO: 2011929 - protein, 21 aa, Staphylococcus
FKSKSHLAPSIFEDVQNSAYE

SEQ ID NO: 2011930 - protein, 17 aa, Staphylococcus
FKSLQKGVQMVYESLLR

SEQ ID NO: 2011931 - protein, 22 aa, Staphylococcus
FKSLRRFFKIYVRGIKGASQLR

SEQ ID NO: 2011932 - protein, 17 aa, Staphylococcus
FKSMGATSIINGGQTMN

SEQ ID NO: 2011933 - protein, 20 aa, Staphylococcus
FKSNIGGFHGRSLKKGDEIN

SEQ ID NO: 2011934 - protein, 21 aa, Staphylococcus
FKSNIMIKQLFVIEPERTDSR

SEQ ID NO: 2011935 - protein, 22 aa, Staphylococcus
FKSNKTIIDYVWDQYPTMNEKD

SEQ ID NO: 2011936 - protein, 20 aa, Staphylococcus
FKSNKTILDYLWDQYPTMNE

SEQ ID NO: 2011937 - protein, 21 aa, Staphylococcus
FKSNKTILDYVWDQYPTMPEK

SEQ ID NO: 2011938 - protein, 21 aa, Staphylococcus
FKSNVKVSLFIGGTDIEKDKQ

SEQ ID NO: 2011939 - protein, 21 aa, Staphylococcus
FKSQGVSIVDHLTAAKQFELF

SEQ ID NO: 2011940 - protein, 21 aa, Staphylococcus
FKSQGVSIVDHLTASKQFEMF

SEQ ID NO: 2011941 - protein, 18 aa, Staphylococcus
FKSVESITNEDLDWADAY

SEQ ID NO: 2011942 - protein, 20 aa, Staphylococcus
FKSVGLAIVDIVVAQYFYKK

SEQ ID NO: 2011943 - protein, 25 aa, Staphylococcus
FKSVKVCPLIHWTWDDVWDYIKAHD

SEQ ID NO: 2011944 - protein, 22 aa, Staphylococcus
FKSYFKQLEYNYGLNVVYQSNI

SEQ ID NO: 2011945 - protein, 20 aa, Staphylococcus
FKSYKLFNEIIRLIIENKSF

SEQ ID NO: 2011946 - protein, 20 aa, Staphylococcus
FKSYLPDLVLLDINLPTLNG

SEQ ID NO: 2011947 - protein, 22 aa, Staphylococcus
FKTDNRGLFAFSLESMSQYGMY

SEQ ID NO: 2011948 - protein, 32 aa, Staphylococcus
FKTDNRGLFAYSLESMSQFGMYFTKINLNLHD

SEQ ID NO: 2011949 - protein, 17 aa, Staphylococcus
FKTFARVKVGNLTEPVM

SEQ ID NO: 2011950 - protein, 18 aa, Staphylococcus
FKTGLRISDVLTLKDNCL

SEQ ID NO: 2011951 - protein, 19 aa, Staphylococcus
FKTIALRTSNIELIKKSLE

SEQ ID NO: 2011952 - protein, 17 aa, Staphylococcus
FKTIEDFLSKNTNKLKA

SEQ ID NO: 2011953 - protein, 19 aa, Staphylococcus
FKTIFKGDIFNVGNQGQHP

SEQ ID NO: 2011954 - protein, 17 aa, Staphylococcus
FKTILPQITETFDGMIL

SEQ ID NO: 2011955 - protein, 18 aa, Staphylococcus
FKTITGLLSTLLNEESEI

SEQ ID NO: 2011956 - protein, 19 aa, Staphylococcus
FKTKEEFEALIKDDQFIEY

SEQ ID NO: 2011957 - protein, 22 aa, Staphylococcus
FKTKISEIGIDFAIDENGHIYL

SEQ ID NO: 2011958 - protein, 17 aa, Staphylococcus
FKTLAIYIRNQYKNPVI

SEQ ID NO: 2011959 - protein, 23 aa, Staphylococcus
FKTNDRILLIFGPEGGFSEKEIT

SEQ ID NO: 2011960 - protein, 21 aa, Staphylococcus
FKTNKLLSGPDIISRGFVYMR

SEQ ID NO: 2011961 - protein, 19 aa, Staphylococcus
FKTSELFQQHFSKSALSQF

SEQ ID NO: 2011962 - protein, 17 aa, Staphylococcus
FKTTVAYNGREALEKIN

SEQ ID NO: 2011963 - protein, 19 aa, Staphylococcus
FKTTYGLIFNDLSWMINQN

SEQ ID NO: 2011964 - protein, 21 aa, Staphylococcus
FKVDELHPIATAAIRQSNNQQ

SEQ ID NO: 2011965 - protein, 19 aa, Staphylococcus
FKVDGEFIIVLVRGNHEIN

SEQ ID NO: 2011966 - protein, 22 aa, Staphylococcus
FKVEKGEFISIMGPSGSGKTTL

SEQ ID NO: 2011967 - protein, 17 aa, Staphylococcus
FKVIARKEVVEEVFDDR

SEQ ID NO: 2011968 - protein, 19 aa, Staphylococcus
FKVIARKEVVEEVFDDRDE

SEQ ID NO: 2011969 - protein, 19 aa, Staphylococcus
FKVIARKEVVEEVFDDREE

SEQ ID NO: 2011970 - protein, 19 aa, Staphylococcus
FKVIFPEYNVIGIGELIEG

SEQ ID NO: 2011971 - protein, 17 aa, Staphylococcus
FKVINYFANRLCDKNAL

SEQ ID NO: 2011972 - protein, 20 aa, Staphylococcus
FKVRFLINEVCHKYEIPWVY

SEQ ID NO: 2011973 - protein, 18 aa, Staphylococcus
FKVSGLVGATDAAELLVD

SEQ ID NO: 2011974 - protein, 18 aa, Staphylococcus
FKVSKWAVEDKIVLTKND

SEQ ID NO: 2011975 - protein, 21 aa, Staphylococcus
FKVSPTHFVKSWLLDERAPKV

SEQ ID NO: 2011976 - protein, 17 aa, Staphylococcus
FKVVKDFVKTVSERALG

SEQ ID NO: 2011977 - protein, 17 aa, Staphylococcus
FKVVNYFANQLCDKQAL

SEQ ID NO: 2011978 - protein, 19 aa, Staphylococcus
FKWIEKHAKSFDVEVKNVS

SEQ ID NO: 2011979 - protein, 17 aa, Staphylococcus
FKYECTREKFIFENGEW

SEQ ID NO: 2011980 - protein, 25 aa, Staphylococcus
FKYETFKMPLKRNILKSRSQNYAMI

SEQ ID NO: 2011981 - protein, 19 aa, Staphylococcus
FKYFRNMYKNFYYSRPEEI

SEQ ID NO: 2011982 - protein, 21 aa, Staphylococcus
FKYKDFEHEIELDFTEDISPV

SEQ ID NO: 2011983 - protein, 20 aa, Staphylococcus
FKYKDFENEIELDFTEGQVI

SEQ ID NO: 2011984 - protein, 22 aa, Staphylococcus
FKYLKKCLNTFEIISTGGGIIE

SEQ ID NO: 2011985 - protein, 22 aa, Staphylococcus
FKYLSGAGVALKIAQALLDHPS

SEQ ID NO: 2011986 - protein, 23 aa, Staphylococcus
FKYPKELHIGFPQKSIEDVDAMY

SEQ ID NO: 2011987 - protein, 22 aa, Staphylococcus
FKYPTEPILDILVGVNNLHDIT

SEQ ID NO: 2011988 - protein, 17 aa, Staphylococcus
FKYTVDRFGVDNIVKEL

SEQ ID NO: 2011989 - protein, 20 aa, Staphylococcus
FKYYKYRKKNILINDMYRYS

SEQ ID NO: 2011990 - protein, 24 aa, Staphylococcus
FLAAGICGLARHWLDTSSLSAESF

SEQ ID NO: 2011991 - protein, 23 aa, Staphylococcus
FLAAGLCGLARHWLDTSELSAEQ

SEQ ID NO: 2011992 - protein, 17 aa, Staphylococcus
FLCEGCYNVAAQRFTYG

SEQ ID NO: 2011993 - protein, 17 aa, Staphylococcus
FLCHDILEELWKSNPNF

SEQ ID NO: 2011994 - protein, 23 aa, Staphylococcus
FLDEPFVGIDFRSEDIIMQKLAA

SEQ ID NO: 2011995 - protein, 20 aa, Staphylococcus
FLDEQYDLFINGEFQPSESG

SEQ ID NO: 2011996 - protein, 22 aa, Staphylococcus
FLDGYWTYSINDVWVGLQKSYR

SEQ ID NO: 2011997 - protein, 21 aa, Staphylococcus
FLDKPPSAWVVLAKPNLGISS

SEQ ID NO: 2011998 - protein, 24 aa, Staphylococcus
FLDKTLERKAVWDKWMDQDMRNES

SEQ ID NO: 2011999 - protein, 25 aa, Staphylococcus
FLDYLKDLRFTGSIRAMEEGEVCFN

SEQ ID NO: 2012000 - protein, 18 aa, Staphylococcus
FLEAAGLYDAHLKDCPQK

SEQ ID NO: 2012001 - protein, 20 aa, Staphylococcus
FLEAAGLYNAHLQSCPNKPI

SEQ ID NO: 2012002 - protein, 26 aa, Staphylococcus
FLEDCPNLKWIAWYATGVNSLPLNYI

SEQ ID NO: 2012003 - protein, 20 aa, Staphylococcus
FLEEPPKNTIAILISTKPEQ

SEQ ID NO: 2012004 - protein, 19 aa, Staphylococcus
FLEEVKRKLSSVVEESLNG

SEQ ID NO: 2012005 - protein, 23 aa, Staphylococcus
FLEEYKGKVLIIVNTATNCALND

SEQ ID NO: 2012006 - protein, 28 aa, Staphylococcus
FLEKGDKCKVSIRFRGRAITHKEIGQRV

SEQ ID NO: 2012007 - protein, 22 aa, Staphylococcus
FLEKIRQALYMSKICSYAQGFA

SEQ ID NO: 2012008 - protein, 21 aa, Staphylococcus
FLELFYKKDFEKITIKEIADA

SEQ ID NO: 2012009 - protein, 23 aa, Staphylococcus
FLENCKVLIDHGYLDGNIMSDRI

SEQ ID NO: 2012010 - protein, 18 aa, Staphylococcus
FLERVPSHVPVLIDEAYF

SEQ ID NO: 2012011 - protein, 25 aa, Staphylococcus
FLETTRNAFFIGRTIDYNVSLEGAL

SEQ ID NO: 2012012 - protein, 21 aa, Staphylococcus
FLEVVIAPLFTKEALDILTKK

SEQ ID NO: 2012013 - protein, 19 aa, Staphylococcus
FLFKHSKGDLGLAHNGNLT

SEQ ID NO: 2012014 - protein, 22 aa, Staphylococcus
FLFSQGRLEQAKSYILNQNETI

SEQ ID NO: 2012015 - protein, 18 aa, Staphylococcus
FLFSQGRLNDARAYILSQ

SEQ ID NO: 2012016 - protein, 21 aa, Staphylococcus
FLFYHDEEYFALKFDLDKHNV

SEQ ID NO: 2012017 - protein, 21 aa, Staphylococcus
FLFYVNRPSIIIGKNQNTIEE

SEQ ID NO: 2012018 - protein, 18 aa, Staphylococcus
FLGDAVLEVTVSRYLFDK

SEQ ID NO: 2012019 - protein, 26 aa, Staphylococcus
FLGKEPTKFLGIINHKVMRKQALEIF

SEQ ID NO: 2012020 - protein, 24 aa, Staphylococcus
FLGPDELDRFFKLYRETEERAGFV

SEQ ID NO: 2012021 - protein, 17 aa, Staphylococcus
FLGWLDLPVDYDKEEFS

SEQ ID NO: 2012022 - protein, 17 aa, Staphylococcus
FLHCLPAFHDTNTTYGQ

SEQ ID NO: 2012023 - protein, 18 aa, Staphylococcus
FLHEDGMRQLISKEDNLF

SEQ ID NO: 2012024 - protein, 18 aa, Staphylococcus
FLHEDGMRQLLTYQDGVF

SEQ ID NO: 2012025 - protein, 26 aa, Staphylococcus
FLHPANLPDGRWPSQIEHKLYLMQQL

SEQ ID NO: 2012026 - protein, 20 aa, Staphylococcus
FLIAKARYARSIKGTKPTFK

SEQ ID NO: 2012027 - protein, 26 aa, Staphylococcus
FLIKRLRNGESLKKTNAFEALLKEQY

SEQ ID NO: 2012028 - protein, 17 aa, Staphylococcus
FLIMGGVPQGERDTETQ

SEQ ID NO: 2012029 - protein, 20 aa, Staphylococcus
FLIQYILPCLRELFDNNHLE

SEQ ID NO: 2012030 - protein, 19 aa, Staphylococcus
FLIVFSDGEPSAFNYSQDG

SEQ ID NO: 2012031 - protein, 20 aa, Staphylococcus
FLKAMELQKLILIANNGPVY

SEQ ID NO: 2012032 - protein, 20 aa, Staphylococcus
FLKDLKFYQEFSLEHPVYQL

SEQ ID NO: 2012033 - protein, 18 aa, Staphylococcus
FLKEAEFKGNTVYNGLDM

SEQ ID NO: 2012034 - protein, 19 aa, Staphylococcus
FLKEEGFDDIEWGEDFGAP

SEQ ID NO: 2012035 - protein, 18 aa, Staphylococcus
FLKEEGFNDIEWGEDFGA

SEQ ID NO: 2012036 - protein, 21 aa, Staphylococcus
FLKENSFTIAGGRFNALLNGE

SEQ ID NO: 2012037 - protein, 27 aa, Staphylococcus
FLKEVEKLCREFGVLLIVDEVATGFGR

SEQ ID NO: 2012038 - protein, 17 aa, Staphylococcus
FLKGNMTSLYMKLTNLY

SEQ ID NO: 2012039 - protein, 19 aa, Staphylococcus
FLKKKEYDIELAYESGLLS

SEQ ID NO: 2012040 - protein, 18 aa, Staphylococcus
FLKQKGYDIELAYEAGLL

SEQ ID NO: 2012041 - protein, 21 aa, Staphylococcus
FLKQRNCLYVLVDPYILENLH

SEQ ID NO: 2012042 - protein, 22 aa, Staphylococcus
FLKRDELNIFLDLYRETEARTG

SEQ ID NO: 2012043 - protein, 17 aa, Staphylococcus
FLLAQYVFENLGYRRYE

SEQ ID NO: 2012044 - protein, 25 aa, Staphylococcus
FLLERLRKAYPDKLIFSGFDEMLIQ

SEQ ID NO: 2012045 - protein, 33 aa, Staphylococcus
FLLESRKLTSIKLKVRFNNHQKLVFKLHINGSI

SEQ ID NO: 2012046 - protein, 24 aa, Staphylococcus
FLLFGDPRLEGGAFYAGSEEYETA

SEQ ID NO: 2012047 - protein, 17 aa, Staphylococcus
FLLKRLKITLKDLRAGK

SEQ ID NO: 2012048 - protein, 17 aa, Staphylococcus
FLLLAKEDWHEGVLGIV

SEQ ID NO: 2012049 - protein, 19 aa, Staphylococcus
FLMSLEEAVELVVHAFKHA

SEQ ID NO: 2012050 - protein, 19 aa, Staphylococcus
FLMSLEEAVELVVHAFKYA

SEQ ID NO: 2012051 - protein, 22 aa, Staphylococcus
FLNDLYRIHLLLDKYSFNEDIE

SEQ ID NO: 2012052 - protein, 24 aa, Staphylococcus
FLNELFELPSKVDICVERKRIVEV

SEQ ID NO: 2012053 - protein, 18 aa, Staphylococcus
FLNHIKKIMTMLDAKDID

SEQ ID NO: 2012054 - protein, 20 aa, Staphylococcus
FLNHMLTLFTFHSGLSIIIE

SEQ ID NO: 2012055 - protein, 33 aa, Staphylococcus
FLNIQPSMLKFILKVFLDLEFIKDENGIIKMNS

SEQ ID NO: 2012056 - protein, 19 aa, Staphylococcus
FLNKPVIYYQFDRNEFLGK

SEQ ID NO: 2012057 - protein, 18 aa, Staphylococcus
FLNLCIEIETTLKPQELL

SEQ ID NO: 2012058 - protein, 20 aa, Staphylococcus
FLNLLRKVNIHLVAFDEAHC

SEQ ID NO: 2012059 - protein, 23 aa, Staphylococcus
FLNQRVIDQYGELVPLTEIDKSL

SEQ ID NO: 2012060 - protein, 18 aa, Staphylococcus
FLNTQSFKVGDKEIELYT

SEQ ID NO: 2012061 - protein, 19 aa, Staphylococcus
FLPGCKRQEMIDQGKLFEK

SEQ ID NO: 2012062 - protein, 18 aa, Staphylococcus
FLPLKRPIHFFMPDKMEY

SEQ ID NO: 2012063 - protein, 20 aa, Staphylococcus
FLPSRIDLMVEAFQKNEETD

SEQ ID NO: 2012064 - protein, 19 aa, Staphylococcus
FLQGSPFCHYLATHIHSSK

SEQ ID NO: 2012065 - protein, 19 aa, Staphylococcus
FLQKINGGMGILLGGVPGV

SEQ ID NO: 2012066 - protein, 18 aa, Staphylococcus
FLQLRDGTGFIQGVVAKA

SEQ ID NO: 2012067 - protein, 18 aa, Staphylococcus
FLQLRDGTGFMQGVVVKS

SEQ ID NO: 2012068 - protein, 18 aa, Staphylococcus
FLQTIEWRGDERAEENIQ

SEQ ID NO: 2012069 - protein, 42 aa, Staphylococcus
FLRIVKEQGGRLVIPEFINPTIKFAMISSIDIARIAAEIFAH

SEQ ID NO: 2012070 - protein, 20 aa, Staphylococcus
FLRKLDYLIHPTFQMIEHNF

SEQ ID NO: 2012071 - protein, 26 aa, Staphylococcus
FLRKQTACNIIFRTAIVKAHHLKFNE

SEQ ID NO: 2012072 - protein, 18 aa, Staphylococcus
FLRPEMKELNSIENELNK

SEQ ID NO: 2012073 - protein, 23 aa, Staphylococcus
FLRPIRKHVGMVFQFPESQLFED

SEQ ID NO: 2012074 - protein, 19 aa, Staphylococcus
FLRSKAHNVDPTFQIGKAG

SEQ ID NO: 2012075 - protein, 21 aa, Staphylococcus
FLSDLGYRHRDAPGIELYPHG

SEQ ID NO: 2012076 - protein, 17 aa, Staphylococcus
FLSFHEYLIYQILPPKH

SEQ ID NO: 2012077 - protein, 18 aa, Staphylococcus
FLSGKARLDMLEQLNKAG

SEQ ID NO: 2012078 - protein, 20 aa, Staphylococcus
FLSSLPVGGLGLDFVHDNGY

SEQ ID NO: 2012079 - protein, 22 aa, Staphylococcus
FLSTLKHWNGAFTFNTNMIEDL

SEQ ID NO: 2012080 - protein, 20 aa, Staphylococcus
FLTAKARYGQSIKGTKPEFT

SEQ ID NO: 2012081 - protein, 19 aa, Staphylococcus
FLTELGVPFERPLETGAIA

SEQ ID NO: 2012082 - protein, 19 aa, Staphylococcus
FLTGGILSVITNWIQHGQQ

SEQ ID NO: 2012083 - protein, 18 aa, Staphylococcus
FLTTYSFKEEIVNYKIVW

SEQ ID NO: 2012084 - protein, 17 aa, Staphylococcus
FLTVATGYYGQHNQLEA

SEQ ID NO: 2012085 - protein, 26 aa, Staphylococcus
FLYDRVNGRATAKVSIPSPNQLFHPN

SEQ ID NO: 2012086 - protein, 19 aa, Staphylococcus
FLYERDIAGYYLVVQEQRN

SEQ ID NO: 2012087 - protein, 19 aa, Staphylococcus
FLYERDMDGYYLIVQEERK

SEQ ID NO: 2012088 - protein, 18 aa, Staphylococcus
FLYERDMDGYYLIVQQER

SEQ ID NO: 2012089 - protein, 19 aa, Staphylococcus
FLYERDMDGYYLIVQQERD

SEQ ID NO: 2012090 - protein, 19 aa, Staphylococcus
FLYERDMDGYYLVVQEERK

SEQ ID NO: 2012091 - protein, 22 aa, Staphylococcus
FLYNMVRVLIAFLIEVGKGKRE

SEQ ID NO: 2012092 - protein, 20 aa, Staphylococcus
FLYNMVRVLMAFLIEVGKGN

SEQ ID NO: 2012093 - protein, 21 aa, Staphylococcus
FLYNMVRVLVAFLIEVGKGKR

SEQ ID NO: 2012094 - protein, 25 aa, Staphylococcus
FLYQDVPYSYALPMFAVNKKNNDIH

SEQ ID NO: 2012095 - protein, 17 aa, Staphylococcus
FLYRQGYNSKFINKKYL

SEQ ID NO: 2012096 - protein, 23 aa, Staphylococcus
FLYSARCPQFKEASVRQKGIENL

SEQ ID NO: 2012097 - protein, 22 aa, Staphylococcus
FLYTHFDEICEILSKYDVAISL

SEQ ID NO: 2012098 - protein, 28 aa, Staphylococcus
FLYYRMKLLNFRKFIIGSTIPHLYYKDY

SEQ ID NO: 2012099 - protein, 17 aa, Staphylococcus
FMASGSFERHLNKMRKI

SEQ ID NO: 2012100 - protein, 17 aa, Staphylococcus
FMDGARLGYGLMSDQSD

SEQ ID NO: 2012101 - protein, 18 aa, Staphylococcus
FMDTLKWCKNKFQVTNQV

SEQ ID NO: 2012102 - protein, 23 aa, Staphylococcus
FMEIPRFKKMIDFANGKVTVNKN

SEQ ID NO: 2012103 - protein, 18 aa, Staphylococcus
FMENGSFERHLNKMRKVY

SEQ ID NO: 2012104 - protein, 21 aa, Staphylococcus
FMEYYGRQMLKLKDGKPVNSR

SEQ ID NO: 2012105 - protein, 17 aa, Staphylococcus
FMGPLDAAIAWSEKGLD

SEQ ID NO: 2012106 - protein, 18 aa, Staphylococcus
FMHHYNFPNFSVGETGPV

SEQ ID NO: 2012107 - protein, 22 aa, Staphylococcus
FMHNRMRMVVSQFLTKDLFIDW

SEQ ID NO: 2012108 - protein, 31 aa, Staphylococcus
FMHRKHPANGFVCYMIGRLVLEYCKDVDEAV

SEQ ID NO: 2012109 - protein, 30 aa, Staphylococcus
FMHRKHPANGFVCYMVGRLVLEYCKDVKEA

SEQ ID NO: 2012110 - protein, 30 aa, Staphylococcus
FMHRKHPGDGFVCYMIGRLVLQYCKDVPEA

SEQ ID NO: 2012111 - protein, 31 aa, Staphylococcus
FMHRKKPANGFVCYMIGRLILELCKNTEEAI

SEQ ID NO: 2012112 - protein, 32 aa, Staphylococcus
FMHRKKPANGFVCYMIGRLILEYCKNVNEAIQ

SEQ ID NO: 2012113 - protein, 31 aa, Staphylococcus
FMHRKKPANGFVCYMVGRLILELCKNVDEAI

SEQ ID NO: 2012114 - protein, 31 aa, Staphylococcus
FMHRKKPGNGFVCYMIGRLILQYCKTVDDAI

SEQ ID NO: 2012115 - protein, 19 aa, Staphylococcus
FMIRDGRMQQLIAPEKEPI

SEQ ID NO: 2012116 - protein, 19 aa, Staphylococcus
FMKAILGFTRMSVRGLNKV

SEQ ID NO: 2012117 - protein, 26 aa, Staphylococcus
FMKKVIDTRAIFKIGGVGLAFKKGKF

SEQ ID NO: 2012118 - protein, 22 aa, Staphylococcus
FMKMAEAYGVKGFLIDHPNKLT

SEQ ID NO: 2012119 - protein, 17 aa, Staphylococcus
FMLDAGLMFPEDEMLGV

SEQ ID NO: 2012120 - protein, 17 aa, Staphylococcus
FMNDQFEQVSVWGPRAR

SEQ ID NO: 2012121 - protein, 19 aa, Staphylococcus
FMNELKINLLDFRKQMDYL

SEQ ID NO: 2012122 - protein, 18 aa, Staphylococcus
FMPYFIKREEQVYLNTWH

SEQ ID NO: 2012123 - protein, 21 aa, Staphylococcus
FMPYLYEYGKLLTQNEKNYIS

SEQ ID NO: 2012124 - protein, 22 aa, Staphylococcus
FMQGRRCPKCAGNLKKTTEQFK

SEQ ID NO: 2012125 - protein, 25 aa, Staphylococcus
FMQWAEEAARLGVRMNAETPADIQA

SEQ ID NO: 2012126 - protein, 17 aa, Staphylococcus
FMRLLARRLDAVVYALG

SEQ ID NO: 2012127 - protein, 19 aa, Staphylococcus
FMTHLKFFSQRLINHESLN

SEQ ID NO: 2012128 - protein, 24 aa, Staphylococcus
FMTIPEASRLVLQAGALATGGEIF

SEQ ID NO: 2012129 - protein, 19 aa, Staphylococcus
FNAEKGFGFIEREDGDDVF

SEQ ID NO: 2012130 - protein, 17 aa, Staphylococcus
FNAEKGFGFIEREDGND

SEQ ID NO: 2012131 - protein, 17 aa, Staphylococcus
FNAEKGFGFIEREDGSD

SEQ ID NO: 2012132 - protein, 19 aa, Staphylococcus
FNAEKGFGFIERENGDDVF

SEQ ID NO: 2012133 - protein, 17 aa, Staphylococcus
FNAEKGFGFIEVEGEND

SEQ ID NO: 2012134 - protein, 18 aa, Staphylococcus
FNAGTFLRNIKVVFEHAK

SEQ ID NO: 2012135 - protein, 20 aa, Staphylococcus
FNAKLLATMCNMPSVREGLA

SEQ ID NO: 2012136 - protein, 17 aa, Staphylococcus
FNALGHQYAKEHQISYI

SEQ ID NO: 2012137 - protein, 20 aa, Staphylococcus
FNALKYAGVSSVDVFVQEVG

SEQ ID NO: 2012138 - protein, 18 aa, Staphylococcus
FNALKYAGVYEVEVTIQQ

SEQ ID NO: 2012139 - protein, 18 aa, Staphylococcus
FNALSFNYYYLGNKEQSK

SEQ ID NO: 2012140 - protein, 17 aa, Staphylococcus
FNATSIYLESLYKLCVE

SEQ ID NO: 2012141 - protein, 25 aa, Staphylococcus
FNAYKELHDLLGYKKARIMRNVSAL

SEQ ID NO: 2012142 - protein, 17 aa, Staphylococcus
FNCLMPQLPSVNLTCDT

SEQ ID NO: 2012143 - protein, 24 aa, Staphylococcus
FNCLPYYDKVMLMDCLLQYTDIPA

SEQ ID NO: 2012144 - protein, 21 aa, Staphylococcus
FNCPHTLAVIGSRKSTLYTTQ

SEQ ID NO: 2012145 - protein, 20 aa, Staphylococcus
FNCVFDILINLELTRVNGGF

SEQ ID NO: 2012146 - protein, 20 aa, Staphylococcus
FNDARLLDMPLLKQTHKTKN

SEQ ID NO: 2012147 - protein, 17 aa, Staphylococcus
FNDARWILIDLANVVVH

SEQ ID NO: 2012148 - protein, 23 aa, Staphylococcus
FNDAWKKMGILGIEMESAGLYLN

SEQ ID NO: 2012149 - protein, 17 aa, Staphylococcus
FNDDGFEGLKINIQQIF

SEQ ID NO: 2012150 - protein, 24 aa, Staphylococcus
FNDEGLKVIGYRDVPVDTQALAEH

SEQ ID NO: 2012151 - protein, 19 aa, Staphylococcus
FNDFEMHFYRYVFPYYDTL

SEQ ID NO: 2012152 - protein, 25 aa, Staphylococcus
FNDIEWVIVSLGAKGMFAKHHNQFY

SEQ ID NO: 2012153 - protein, 26 aa, Staphylococcus
FNDPERLKAGILFTLEEECIKQGHTY

SEQ ID NO: 2012154 - protein, 26 aa, Staphylococcus
FNDPERLKAGLLYTLEEECIKQGHTY

SEQ ID NO: 2012155 - protein, 22 aa, Staphylococcus
FNDSWKNMGILGIEMESAGLYL

SEQ ID NO: 2012156 - protein, 25 aa, Staphylococcus
FNDTSEWKSDFNIYKPHSGVAVETQ

SEQ ID NO: 2012157 - protein, 20 aa, Staphylococcus
FNDTSSWKSDMNIYKAHSGF

SEQ ID NO: 2012158 - protein, 19 aa, Staphylococcus
FNDTTGWNSDFNIYKAHSG

SEQ ID NO: 2012159 - protein, 19 aa, Staphylococcus
FNDVDVFKLLSRGDTTGIF

SEQ ID NO: 2012160 - protein, 18 aa, Staphylococcus
FNDYPIEVERLLDSVQIK

SEQ ID NO: 2012161 - protein, 23 aa, Staphylococcus
FNDYPIEVERLLEMMEIKVHALH

SEQ ID NO: 2012162 - protein, 25 aa, Staphylococcus
FNEALFSYFKKGAVFVNCARGSLVD

SEQ ID NO: 2012163 - protein, 26 aa, Staphylococcus
FNEDLNVFVDWSFILEFIKYANGFVR

SEQ ID NO: 2012164 - protein, 22 aa, Staphylococcus
FNEFERMILLRSIDGRWTDHID

SEQ ID NO: 2012165 - protein, 24 aa, Staphylococcus
FNEGNRYLVMPALSDDLKVVGIKT

SEQ ID NO: 2012166 - protein, 27 aa, Staphylococcus
FNEKHFKLRIEQFLIYKDISNKEVFNR

SEQ ID NO: 2012167 - protein, 19 aa, Staphylococcus
FNEKIIGYIGIWLVIDQAQ

SEQ ID NO: 2012168 - protein, 18 aa, Staphylococcus
FNEKIMLNHFYNIENTKD

SEQ ID NO: 2012169 - protein, 24 aa, Staphylococcus
FNEPEIFEYLTIYLSFIKHYEAPD

SEQ ID NO: 2012170 - protein, 17 aa, Staphylococcus
FNEPMWVEHSTKHITET

SEQ ID NO: 2012171 - protein, 18 aa, Staphylococcus
FNEPQNWDSDFNIYKSHS

SEQ ID NO: 2012172 - protein, 17 aa, Staphylococcus
FNERLNAEILRKNEHKE

SEQ ID NO: 2012173 - protein, 19 aa, Staphylococcus
FNERLNAEILRNGNHSEGN

SEQ ID NO: 2012174 - protein, 21 aa, Staphylococcus
FNESILIRIADYYEQILKSYS

SEQ ID NO: 2012175 - protein, 24 aa, Staphylococcus
FNESLRIFTDMSFTLEYLKYAEHF

SEQ ID NO: 2012176 - protein, 29 aa, Staphylococcus
FNEVKEMYRRVNFLFGDIVKVTPSSKVVG

SEQ ID NO: 2012177 - protein, 17 aa, Staphylococcus
FNEWLQKGASLYICGDE

SEQ ID NO: 2012178 - protein, 22 aa, Staphylococcus
FNEYKLNIKVVLINNGTLGMVK

SEQ ID NO: 2012179 - protein, 27 aa, Staphylococcus
FNEYTKRISMPFLRSPFVHHIHPQPFH

SEQ ID NO: 2012180 - protein, 25 aa, Staphylococcus
FNFKDILFNRITKWTSLSKPKYISQ

SEQ ID NO: 2012181 - protein, 20 aa, Staphylococcus
FNGAFAVGLQKGYDIDQALT

SEQ ID NO: 2012182 - protein, 26 aa, Staphylococcus
FNGAFAVGLQKGYSIAQALKLANLAA

SEQ ID NO: 2012183 - protein, 25 aa, Staphylococcus
FNGEVAKQLFLRDEFNLNGKVDISV

SEQ ID NO: 2012184 - protein, 17 aa, Staphylococcus
FNGGYAVFNGLKRVIDF

SEQ ID NO: 2012185 - protein, 25 aa, Staphylococcus
FNGLKRVIQFIEHFHFSDSDIEYLQ

SEQ ID NO: 2012186 - protein, 17 aa, Staphylococcus
FNGLYIITPFQRIDYSL

SEQ ID NO: 2012187 - protein, 18 aa, Staphylococcus
FNGLYLITPFEQVDYSLE

SEQ ID NO: 2012188 - protein, 17 aa, Staphylococcus
FNGRADHVVNFMHFVAE

SEQ ID NO: 2012189 - protein, 25 aa, Staphylococcus
FNGRHELMDSVFLWQSGNKYRVKAH

SEQ ID NO: 2012190 - protein, 25 aa, Staphylococcus
FNGRHELMDSVFLWQSGSKYRVAAH

SEQ ID NO: 2012191 - protein, 26 aa, Staphylococcus
FNGRHELMDSVFLWQSGTKYRLNVHD

SEQ ID NO: 2012192 - protein, 26 aa, Staphylococcus
FNGRHELMDSVFLWQSGTKYRVNVHD

SEQ ID NO: 2012193 - protein, 26 aa, Staphylococcus
FNGRHELMDSVFLWQSGTKYRVPTHD

SEQ ID NO: 2012194 - protein, 18 aa, Staphylococcus
FNGSRIALNEDKAWMQEM

SEQ ID NO: 2012195 - protein, 27 aa, Staphylococcus
FNGVLCGRATWAGAVQVYIEKGEEAAR

SEQ ID NO: 2012196 - protein, 27 aa, Staphylococcus
FNGVLCGRATWAGSVKVYIEQGEEAAR

SEQ ID NO: 2012197 - protein, 17 aa, Staphylococcus
FNGYRMELEEIEFQLRQ

SEQ ID NO: 2012198 - protein, 20 aa, Staphylococcus
FNHGLPILVMDGSKNKSEVN

SEQ ID NO: 2012199 - protein, 22 aa, Staphylococcus
FNHGLPILVMDGYTDKSTVNHF

SEQ ID NO: 2012200 - protein, 19 aa, Staphylococcus
FNHGMTPIICVGETDEERE

SEQ ID NO: 2012201 - protein, 18 aa, Staphylococcus
FNHLKEVFLEEPFEENQS

SEQ ID NO: 2012202 - protein, 18 aa, Staphylococcus
FNHNLDYQKFCIAQGKTP

SEQ ID NO: 2012203 - protein, 20 aa, Staphylococcus
FNHPIQIVGIDIVREEDGLA

SEQ ID NO: 2012204 - protein, 20 aa, Staphylococcus
FNIAGLMFSNLIIPNRRLLK

SEQ ID NO: 2012205 - protein, 20 aa, Staphylococcus
FNIAGLMFSNLIIRHKGLLN

SEQ ID NO: 2012206 - protein, 27 aa, Staphylococcus
FNIAPKKLKAFPPTFIVHGNQDPDVPF

SEQ ID NO: 2012207 - protein, 17 aa, Staphylococcus
FNIASISGFEVTKSSAI

SEQ ID NO: 2012208 - protein, 27 aa, Staphylococcus
FNIDELRARIRVALRMSRSTETIQSRF

SEQ ID NO: 2012209 - protein, 18 aa, Staphylococcus
FNIFISKYYHGHAITIGM

SEQ ID NO: 2012210 - protein, 22 aa, Staphylococcus
FNIFNFRFMAINAGPYFVKNPS

SEQ ID NO: 2012211 - protein, 22 aa, Staphylococcus
FNIIKQRTKGLMSVGKHVIWLL

SEQ ID NO: 2012212 - protein, 17 aa, Staphylococcus
FNIKCLSTIYTGDLESA

SEQ ID NO: 2012213 - protein, 17 aa, Staphylococcus
FNILGPMIHPYKLDYQV

SEQ ID NO: 2012214 - protein, 21 aa, Staphylococcus
FNINCKIFAPDGFSEEKIAIM

SEQ ID NO: 2012215 - protein, 19 aa, Staphylococcus
FNINLSWIESRPLKTQLGM

SEQ ID NO: 2012216 - protein, 20 aa, Staphylococcus
FNIPKGKWTTIVGHNGSGKS

SEQ ID NO: 2012217 - protein, 24 aa, Staphylococcus
FNIQYRLKCNFNYDGIMKETMHQY

SEQ ID NO: 2012218 - protein, 21 aa, Staphylococcus
FNISNIMAAIIAVWSKGASME

SEQ ID NO: 2012219 - protein, 18 aa, Staphylococcus
FNKAHFQALLAPMKARGI

SEQ ID NO: 2012220 - protein, 24 aa, Staphylococcus
FNKDCFKLSAIISKLRIEYNQYIR

SEQ ID NO: 2012221 - protein, 23 aa, Staphylococcus
FNKEAQPIIELASIIYRGILDEV

SEQ ID NO: 2012222 - protein, 17 aa, Staphylococcus
FNKEKHLIFGYTPMCGT

SEQ ID NO: 2012223 - protein, 19 aa, Staphylococcus
FNKERIKLISFLEDNILQR

SEQ ID NO: 2012224 - protein, 24 aa, Staphylococcus
FNKHNRYLVMPALSDELKIVGLKT

SEQ ID NO: 2012225 - protein, 19 aa, Staphylococcus
FNKKAPYEQRMPKIVIVID

SEQ ID NO: 2012226 - protein, 24 aa, Staphylococcus
FNKKRYAKHLKHVVTNKVCPTCHG

SEQ ID NO: 2012227 - protein, 18 aa, Staphylococcus
FNKKRYAKHLKNVVNNKI

SEQ ID NO: 2012228 - protein, 28 aa, Staphylococcus
FNKNCPIKVRYFYNGRILMMNMMPKKID

SEQ ID NO: 2012229 - protein, 23 aa, Staphylococcus
FNKNEIYKLLSLLENDVDNMKLS

SEQ ID NO: 2012230 - protein, 20 aa, Staphylococcus
FNKPRNVGFRVAMKDNGLDI

SEQ ID NO: 2012231 - protein, 18 aa, Staphylococcus
FNKQHFVIGLKQTLKALN

SEQ ID NO: 2012232 - protein, 18 aa, Staphylococcus
FNKQHFVVGLKQTLKALK

SEQ ID NO: 2012233 - protein, 17 aa, Staphylococcus
FNKQHVVVGLKETLKAL

SEQ ID NO: 2012234 - protein, 26 aa, Staphylococcus
FNKRKGQKYFIVWHGTPLKYMGKDMP

SEQ ID NO: 2012235 - protein, 17 aa, Staphylococcus
FNKRLRTTGGRYLLKTH

SEQ ID NO: 2012236 - protein, 19 aa, Staphylococcus
FNKRLRTTGGRYLLSSHNI

SEQ ID NO: 2012237 - protein, 26 aa, Staphylococcus
FNKYWPADIHLMAKEIVRFHSIIWPI

SEQ ID NO: 2012238 - protein, 26 aa, Staphylococcus
FNLAEEYQCPVIILSDLQLALGKQTV

SEQ ID NO: 2012239 - protein, 27 aa, Staphylococcus
FNLAEEYQCPVIILSDLQLSLGKQTVE

SEQ ID NO: 2012240 - protein, 27 aa, Staphylococcus
FNLAEEYQCPVIILSDLQLSLGKQTVK

SEQ ID NO: 2012241 - protein, 26 aa, Staphylococcus
FNLAEEYQCPVIVLSDLQLSLGKQTV

SEQ ID NO: 2012242 - protein, 18 aa, Staphylococcus
FNLDEYVGLKAEHPQSYH

SEQ ID NO: 2012243 - protein, 31 aa, Staphylococcus
FNLDRAAIEFGKMEFNTHLDLKVYSDNIKTY

SEQ ID NO: 2012244 - protein, 18 aa, Staphylococcus
FNLDRAAMEFGKMDFNTH

SEQ ID NO: 2012245 - protein, 20 aa, Staphylococcus
FNLLNDLAMIFMNSALEALN

SEQ ID NO: 2012246 - protein, 17 aa, Staphylococcus
FNLMFKTFQGVTEGSTN

SEQ ID NO: 2012247 - protein, 20 aa, Staphylococcus
FNLNLSFDLITIFCDSLNYL

SEQ ID NO: 2012248 - protein, 18 aa, Staphylococcus
FNLPLSLLSKYPYELSGG

SEQ ID NO: 2012249 - protein, 19 aa, Staphylococcus
FNLQLPKIFNEATLLFDEY

SEQ ID NO: 2012250 - protein, 18 aa, Staphylococcus
FNLVCPKELNPTDELLAR

SEQ ID NO: 2012251 - protein, 17 aa, Staphylococcus
FNMGIGYTVIVDKKDVS

SEQ ID NO: 2012252 - protein, 25 aa, Staphylococcus
FNMIFQFEHLGLWSTGDSQFDVKSY

SEQ ID NO: 2012253 - protein, 17 aa, Staphylococcus
FNMKYPVYINAMTGGSE

SEQ ID NO: 2012254 - protein, 17 aa, Staphylococcus
FNMNPSEYRSAFGISQH

SEQ ID NO: 2012255 - protein, 27 aa, Staphylococcus
FNMTPYKVQVMGGIAIHKGDIAEMRTG

SEQ ID NO: 2012256 - protein, 19 aa, Staphylococcus
FNNEPLLRVEAPLIQAQLI

SEQ ID NO: 2012257 - protein, 18 aa, Staphylococcus
FNNGNVIRYYDGETYVLY

SEQ ID NO: 2012258 - protein, 18 aa, Staphylococcus
FNNHFYLKIAEEKFENED

SEQ ID NO: 2012259 - protein, 24 aa, Staphylococcus
FNNIKRLDIETIKKDNTSFIKNDI

SEQ ID NO: 2012260 - protein, 17 aa, Staphylococcus
FNNLPFYEIGWRLIPEV

SEQ ID NO: 2012261 - protein, 26 aa, Staphylococcus
FNNPKGMCETCSGLGYVEDIDLHELL

SEQ ID NO: 2012262 - protein, 24 aa, Staphylococcus
FNNTEVNLFFTLCNKLKDKGNLTV

SEQ ID NO: 2012263 - protein, 26 aa, Staphylococcus
FNNTRLVEMVRPKLSSVIQPLYDIGA

SEQ ID NO: 2012264 - protein, 27 aa, Staphylococcus
FNNTRLVEMVRPKLSSVIQPLYDIGAV

SEQ ID NO: 2012265 - protein, 18 aa, Staphylococcus
FNNTRLVEMVRPQLSSVI

SEQ ID NO: 2012266 - protein, 25 aa, Staphylococcus
FNNTRLVEMVRPQLSSVIQPLYDIG

SEQ ID NO: 2012267 - protein, 23 aa, Staphylococcus
FNNYPIEAIFGVHVNPFAEEGQI

SEQ ID NO: 2012268 - protein, 23 aa, Staphylococcus
FNNYPIEAVFGIHVNPFADEGQV

SEQ ID NO: 2012269 - protein, 17 aa, Staphylococcus
FNNYTLREIFQKLKLPK

SEQ ID NO: 2012270 - protein, 22 aa, Staphylococcus
FNPDHFEALLAQVSIKPVINQV

SEQ ID NO: 2012271 - protein, 17 aa, Staphylococcus
FNPELEDFTKLKLGDNV

SEQ ID NO: 2012272 - protein, 19 aa, Staphylococcus
FNPNLDKITTFRDELIQNK

SEQ ID NO: 2012273 - protein, 22 aa, Staphylococcus
FNPNSPHKWGLQAEKVLLQAKE

SEQ ID NO: 2012274 - protein, 17 aa, Staphylococcus
FNPPMFARVFRKHLEGG

SEQ ID NO: 2012275 - protein, 20 aa, Staphylococcus
FNPRTIFLLQHACRENDYEL

SEQ ID NO: 2012276 - protein, 18 aa, Staphylococcus
FNPSQGFRAFKKAKAGDQ

SEQ ID NO: 2012277 - protein, 18 aa, Staphylococcus
FNPSQGFRSFKQAKVGDQ

SEQ ID NO: 2012278 - protein, 18 aa, Staphylococcus
FNPTQGFRAFKKAKAGDK

SEQ ID NO: 2012279 - protein, 18 aa, Staphylococcus
FNPTQGFRAFKKAKIGDQ

SEQ ID NO: 2012280 - protein, 18 aa, Staphylococcus
FNPTQGFRAFKKAKTGDQ

SEQ ID NO: 2012281 - protein, 18 aa, Staphylococcus
FNQASAFKNKLNQKLIQE

SEQ ID NO: 2012282 - protein, 20 aa, Staphylococcus
FNQGELIAIVGPSGSGKSTF

SEQ ID NO: 2012283 - protein, 31 aa, Staphylococcus
FNQGEVCSAGSRLLVQEGIYDELMKRLKDVF

SEQ ID NO: 2012284 - protein, 30 aa, Staphylococcus; identical to SEQ ID NO: 1799202

SEQ ID NO: 2012285 - protein, 32 aa, Staphylococcus
FNQGEVCSAGSRLLVQSSIYDKVMPKLKEAFE

SEQ ID NO: 2012286 - protein, 24 aa, Staphylococcus
FNQGFKTICLRTKNIEEVKATLQK

SEQ ID NO: 2012287 - protein, 19 aa, Staphylococcus
FNQHLDWVMEVANIHYVAI

SEQ ID NO: 2012288 - protein, 27 aa, Staphylococcus
FNQLEAFKEALPFLMTAAEKDDNDDVE

SEQ ID NO: 2012289 - protein, 20 aa, Staphylococcus
FNQMIEFGVLHMKHSDKEKL

SEQ ID NO: 2012290 - protein, 26 aa, Staphylococcus
FNQPIIWLCGGLDRGNDFDELIPYMK

SEQ ID NO: 2012291 - protein, 28 aa, Staphylococcus
FNQPIIWLCGGLDRGNEFDELIPYMKNV

SEQ ID NO: 2012292 - protein, 26 aa, Staphylococcus
FNQRVGISIVDPVRFFTVYRAVQIAG

SEQ ID NO: 2012293 - protein, 20 aa, Staphylococcus
FNQSRIVGLIGKNGVGKTTL

SEQ ID NO: 2012294 - protein, 18 aa, Staphylococcus
FNRDRFILSAGHGSALLY

SEQ ID NO: 2012295 - protein, 17 aa, Staphylococcus
FNREITVNMESLKESEK

SEQ ID NO: 2012296 - protein, 17 aa, Staphylococcus
FNRETSRWDYLISPNRY

SEQ ID NO: 2012297 - protein, 23 aa, Staphylococcus
FNRIDVEGPFYYKREQYQDEFKR

SEQ ID NO: 2012298 - protein, 18 aa, Staphylococcus
FNRIETFVDFDINNHNEK

SEQ ID NO: 2012299 - protein, 25 aa, Staphylococcus
FNRKLSELYGAYVNSFVTKFKDKHV

SEQ ID NO: 2012300 - protein, 18 aa, Staphylococcus
FNRKSRMDESNWDDKMYD

SEQ ID NO: 2012301 - protein, 27 aa, Staphylococcus
FNRPWASAKGKGLWMSIVLRPDVPFDT

SEQ ID NO: 2012302 - protein, 19 aa, Staphylococcus
FNRWCEGQTGFPIIDAAMN

SEQ ID NO: 2012303 - protein, 17 aa, Staphylococcus
FNSDEMMGQEVFDKLQA

SEQ ID NO: 2012304 - protein, 19 aa, Staphylococcus
FNSEKGFGFIERENGGDVF

SEQ ID NO: 2012305 - protein, 25 aa, Staphylococcus
FNSEWSRSQLQDWIKNDLVTVNGKI

SEQ ID NO: 2012306 - protein, 19 aa, Staphylococcus
FNSGKKWFGKTYGNAKENF

SEQ ID NO: 2012307 - protein, 23 aa, Staphylococcus
FNSLALYKEELVLVVSKDHPFAQ

SEQ ID NO: 2012308 - protein, 18 aa, Staphylococcus
FNSLTFISGTLTFNHSFD

SEQ ID NO: 2012309 - protein, 17 aa, Staphylococcus
FNSPHYLEKLIKRKPYQ

SEQ ID NO: 2012310 - protein, 20 aa, Staphylococcus
FNSQHFLLIEAFENYMDNVE

SEQ ID NO: 2012311 - protein, 20 aa, Staphylococcus
FNTAESWDNVGLLIGDESQE

SEQ ID NO: 2012312 - protein, 17 aa, Staphylococcus
FNTAIEEKNRWLGYYGF

SEQ ID NO: 2012313 - protein, 18 aa, Staphylococcus
FNTANAITAWYDLAKLAN

SEQ ID NO: 2012314 - protein, 30 aa, Staphylococcus
FNTARKMGYFDIPKDLLLPINEVENYPKNE

SEQ ID NO: 2012315 - protein, 18 aa, Staphylococcus
FNTEVPFFVDSLEQIVTS

SEQ ID NO: 2012316 - protein, 19 aa, Staphylococcus
FNTFSDWLPYLDLLDSYPA

SEQ ID NO: 2012317 - protein, 17 aa, Staphylococcus
FNTGGDMIDYWMGATPM

SEQ ID NO: 2012318 - protein, 17 aa, Staphylococcus
FNTGGEMIDYWMGATPM

SEQ ID NO: 2012319 - protein, 17 aa, Staphylococcus
FNTLRAMYEKHPIRVDI

SEQ ID NO: 2012320 - protein, 17 aa, Staphylococcus
FNTLRAMYHHHPIKVDI

SEQ ID NO: 2012321 - protein, 18 aa, Staphylococcus
FNTLRAMYQKHPIKVDIA

SEQ ID NO: 2012322 - protein, 24 aa, Staphylococcus
FNTMSDWEYGYLIAELNSGRYFKN

SEQ ID NO: 2012323 - protein, 23 aa, Staphylococcus
FNTNELYKLLSLLENDVDNMKLS

SEQ ID NO: 2012324 - protein, 18 aa, Staphylococcus
FNTNYHYIVPEWDNVTPK

SEQ ID NO: 2012325 - protein, 23 aa, Staphylococcus
FNTRKTILRRAAQFLNEGDTISI

SEQ ID NO: 2012326 - protein, 23 aa, Staphylococcus
FNTRPEEVVGIIAGGQKAMTVAV

SEQ ID NO: 2012327 - protein, 18 aa, Staphylococcus
FNVACLDPNPDSPCKSVA

SEQ ID NO: 2012328 - protein, 19 aa, Staphylococcus
FNVAEGLAQIQIIYDPGLI

SEQ ID NO: 2012329 - protein, 17 aa, Staphylococcus
FNVDLFITSSSREKEIV

SEQ ID NO: 2012330 - protein, 23 aa, Staphylococcus
FNVDLFLRNAHRIPDYASNRVTV

SEQ ID NO: 2012331 - protein, 17 aa, Staphylococcus
FNVDVLKVEVPVNMNFV

SEQ ID NO: 2012332 - protein, 20 aa, Staphylococcus
FNVERFNADFAYTMDGSEFG

SEQ ID NO: 2012333 - protein, 17 aa, Staphylococcus
FNVIAAINVGYIGTLPM

SEQ ID NO: 2012334 - protein, 21 aa, Staphylococcus
FNVLEGTSFNEFVVEFNQSIS

SEQ ID NO: 2012335 - protein, 17 aa, Staphylococcus
FNVNAGIIGDAKIALTE

SEQ ID NO: 2012336 - protein, 23 aa, Staphylococcus
FNVNLFLRNAHRIPDYASNRVTV

SEQ ID NO: 2012337 - protein, 24 aa, Staphylococcus
FNVVCPEPPMLMISVGKQDGALKD

SEQ ID NO: 2012338 - protein, 17 aa, Staphylococcus
FNYAKSINVNAHPVIVG

SEQ ID NO: 2012339 - protein, 17 aa, Staphylococcus
FNYDIFAGVSYTIHAGQ

SEQ ID NO: 2012340 - protein, 18 aa, Staphylococcus
FNYGLPYLIDTLQNLNHP

SEQ ID NO: 2012341 - protein, 25 aa, Staphylococcus
FNYKIPSSVFYTNFNKTIDINKLIV

SEQ ID NO: 2012342 - protein, 17 aa, Staphylococcus
FNYLSGYSVKPVYNKLI

SEQ ID NO: 2012343 - protein, 18 aa, Staphylococcus
FNYNERHNIISIPYDALD

SEQ ID NO: 2012344 - protein, 26 aa, Staphylococcus
FNYPKEFIVAITIIFLINELNISQEE

SEQ ID NO: 2012345 - protein, 25 aa, Staphylococcus
FNYQVPTLMCAKLWSEFKSYKKFVK

SEQ ID NO: 2012346 - protein, 18 aa, Staphylococcus
FNYSIPYVYDEERVGDIK

SEQ ID NO: 2012347 - protein, 18 aa, Staphylococcus
FPAAAGQMSLSHLNDILK

SEQ ID NO: 2012348 - protein, 17 aa, Staphylococcus
FPAIEKRVQEHNFKWAA

SEQ ID NO: 2012349 - protein, 17 aa, Staphylococcus
FPATYGNVNYYTLVVFN

SEQ ID NO: 2012350 - protein, 19 aa, Staphylococcus
FPDDNLLGIDYVIPDITYL

SEQ ID NO: 2012351 - protein, 19 aa, Staphylococcus
FPDHGKFAEIFKMADTPQG

SEQ ID NO: 2012352 - protein, 20 aa, Staphylococcus
FPDIKVLVLTSYVDDEHVIS

SEQ ID NO: 2012353 - protein, 25 aa, Staphylococcus
FPDNMVSGLVGFLGHGGVKSGVVAK

SEQ ID NO: 2012354 - protein, 17 aa, Staphylococcus
FPDNYRGLFEQPTPNTV

SEQ ID NO: 2012355 - protein, 17 aa, Staphylococcus
FPDVQAAILKWPMSVIR

SEQ ID NO: 2012356 - protein, 20 aa, Staphylococcus
FPEDEIGFIALHIASNSEDL

SEQ ID NO: 2012357 - protein, 23 aa, Staphylococcus
FPEFKDEWIEKAFGDFTKTNQGL

SEQ ID NO: 2012358 - protein, 20 aa, Staphylococcus
FPEKLSKYIEKWFKKHDVTV

SEQ ID NO: 2012359 - protein, 21 aa, Staphylococcus
FPEKYMEFIEAYDLEQEKIEW

SEQ ID NO: 2012360 - protein, 17 aa, Staphylococcus
FPELKVTIVDSLNKRIQ

SEQ ID NO: 2012361 - protein, 18 aa, Staphylococcus
FPELKVTIVDSLNKRIQF

SEQ ID NO: 2012362 - protein, 21 aa, Staphylococcus
FPEMFEGVLNHSILKRAQDKE

SEQ ID NO: 2012363 - protein, 21 aa, Staphylococcus
FPEMFEGVLNHSILKRAQDKG

SEQ ID NO: 2012364 - protein, 19 aa, Staphylococcus
FPENSLRPLGRTASGVRGI

SEQ ID NO: 2012365 - protein, 20 aa, Staphylococcus
FPEQEFKFYKKAQFIPTEDR

SEQ ID NO: 2012366 - protein, 17 aa, Staphylococcus
FPERNRIISGLSKGVLL

SEQ ID NO: 2012367 - protein, 25 aa, Staphylococcus
FPERNRLISGLARGLLITEAEKISG

SEQ ID NO: 2012368 - protein, 20 aa, Staphylococcus
FPERNRLISGLSRGVLITEA

SEQ ID NO: 2012369 - protein, 17 aa, Staphylococcus
FPESVEVIGEDSGLHLT

SEQ ID NO: 2012370 - protein, 17 aa, Staphylococcus
FPEVNFWTTFNEIGPIG

SEQ ID NO: 2012371 - protein, 17 aa, Staphylococcus
FPFGVVTLTRMFFENKA

SEQ ID NO: 2012372 - protein, 20 aa, Staphylococcus
FPFIDVETLLTLLDLANIYV

SEQ ID NO: 2012373 - protein, 23 aa, Staphylococcus
FPFILRGANILGIDSVFTPMKVR

SEQ ID NO: 2012374 - protein, 23 aa, Staphylococcus
FPFILRGVSIIGIDSVYTEMRQR

SEQ ID NO: 2012375 - protein, 19 aa, Staphylococcus
FPFNLYRKLVNEIFQSDNK

SEQ ID NO: 2012376 - protein, 24 aa, Staphylococcus
FPFYYRGEVYDPFYGNTLSDQDFT

SEQ ID NO: 2012377 - protein, 17 aa, Staphylococcus
FPGIFRGALEVEATHIN

SEQ ID NO: 2012378 - protein, 19 aa, Staphylococcus
FPGKLLKLHNGGKHHQFGT

SEQ ID NO: 2012379 - protein, 26 aa, Staphylococcus
FPGNLNLTIREYLRFLSKFNSYKQSR

SEQ ID NO: 2012380 - protein, 23 aa, Staphylococcus
FPIPEVIGVRLSNALPQGATATD

SEQ ID NO: 2012381 - protein, 22 aa, Staphylococcus
FPIPEVIGVRLSNELPQGSTAT

SEQ ID NO: 2012382 - protein, 27 aa, Staphylococcus
FPIQLVVLKPYRLGGIDKVLEAIDILK

SEQ ID NO: 2012383 - protein, 19 aa, Staphylococcus
FPIRPEHLMQAINREADND

SEQ ID NO: 2012384 - protein, 20 aa, Staphylococcus
FPIVELDASYYAIQPERNIK

SEQ ID NO: 2012385 - protein, 22 aa, Staphylococcus
FPKAYFTPAHVWLSEQHKDEIQ

SEQ ID NO: 2012386 - protein, 27 aa, Staphylococcus
FPKDRARLVIYPAAMRYAGPREAILHA

SEQ ID NO: 2012387 - protein, 22 aa, Staphylococcus
FPKFCDEMARAGIYKWYIDIIA

SEQ ID NO: 2012388 - protein, 30 aa, Staphylococcus
FPKLQQLGLKWYAVPIISSMDLKIGGITYP

SEQ ID NO: 2012389 - protein, 24 aa, Staphylococcus
FPKLVKVKELFNLYCSLYQEHISK

SEQ ID NO: 2012390 - protein, 18 aa, Staphylococcus
FPKMIAFSNGQDVAEIEQ

SEQ ID NO: 2012391 - protein, 26 aa, Staphylococcus
FPKMIKVKELFYLHHALYPQAMSLKA

SEQ ID NO: 2012392 - protein, 17 aa, Staphylococcus
FPLEIAGLSRGEAKRKA

SEQ ID NO: 2012393 - protein, 24 aa, Staphylococcus
FPLHPEYRTLPMVWYCPPLSPIMN

SEQ ID NO: 2012394 - protein, 21 aa, Staphylococcus
FPLTDVQSAYLIGREQDQVLG

SEQ ID NO: 2012395 - protein, 18 aa, Staphylococcus
FPLVGTLSLVPQIVDNVS

SEQ ID NO: 2012396 - protein, 17 aa, Staphylococcus
FPMWFIRPKYKTKTQSR

SEQ ID NO: 2012397 - protein, 19 aa, Staphylococcus
FPNDFLWGGGLAANQVEGA

SEQ ID NO: 2012398 - protein, 19 aa, Staphylococcus
FPNEHIKDIVSYQTTFQEA

SEQ ID NO: 2012399 - protein, 21 aa, Staphylococcus
FPNNIHWQFGHVLTVFENALS

SEQ ID NO: 2012400 - protein, 23 aa, Staphylococcus
FPNNLKIKVHTFLETIQNLNNNY

SEQ ID NO: 2012401 - protein, 21 aa, Staphylococcus
FPNNYETYEFLSITDTLITDY

SEQ ID NO: 2012402 - protein, 23 aa, Staphylococcus
FPNQINNVLAFPGIFRGALDTES

SEQ ID NO: 2012403 - protein, 23 aa, Staphylococcus
FPNQINNVLAFPGIFRGALDVEA

SEQ ID NO: 2012404 - protein, 25 aa, Staphylococcus
FPNQINNVLAFPGIFRGALDVEATH

SEQ ID NO: 2012405 - protein, 22 aa, Staphylococcus
FPNTFQVLKLTGAGIKDALEKS

SEQ ID NO: 2012406 - protein, 24 aa, Staphylococcus
FPNTLHWQFGHILTIFDSALSIGS

SEQ ID NO: 2012407 - protein, 25 aa, Staphylococcus
FPNTLHWQFGHVLTIFDSALSMGGQ

SEQ ID NO: 2012408 - protein, 20 aa, Staphylococcus
FPPAVKRYFDAVSVAGKSFK

SEQ ID NO: 2012409 - protein, 27 aa, Staphylococcus
FPQDRARLVIYPAAMRYAGPREAILHA

SEQ ID NO: 2012410 - protein, 21 aa, Staphylococcus
FPQENKLRILAYKGELPVGIL

SEQ ID NO: 2012411 - protein, 19 aa, Staphylococcus
FPQESEVPVIMIGPGTGVA

SEQ ID NO: 2012412 - protein, 18 aa, Staphylococcus
FPQLIAFAEGKDIKNINA

SEQ ID NO: 2012413 - protein, 17 aa, Staphylococcus
FPQYRGRGVATQLVKHV

SEQ ID NO: 2012414 - protein, 20 aa, Staphylococcus
FPREIEESARIGIPNKGEWT

SEQ ID NO: 2012415 - protein, 21 aa, Staphylococcus
FPRITYADAVIFLKEQGFDDI

SEQ ID NO: 2012416 - protein, 17 aa, Staphylococcus
FPRNIMSLSPFQMSGGQ

SEQ ID NO: 2012417 - protein, 25 aa, Staphylococcus
FPSKDWARRVYPDLDEEIALEKFID

SEQ ID NO: 2012418 - protein, 24 aa, Staphylococcus
FPSKEFPLLCKIVDATAPLSIHVH

SEQ ID NO: 2012419 - protein, 25 aa, Staphylococcus
FPSLLQWTESLWQFIPSSTNKNQLI

SEQ ID NO: 2012420 - protein, 22 aa, Staphylococcus
FPSPQMYNALSFNHYYLGNEIE

SEQ ID NO: 2012421 - protein, 18 aa, Staphylococcus
FPSSEIAFVVLHFGGSIK

SEQ ID NO: 2012422 - protein, 19 aa, Staphylococcus
FPSTLPHIKLSTNVHITGE

SEQ ID NO: 2012423 - protein, 18 aa, Staphylococcus
FPTHYGKSNYYAFIVFNI

SEQ ID NO: 2012424 - protein, 24 aa, Staphylococcus
FPTKDWARRVYPDMDEEKTYEKFI

SEQ ID NO: 2012425 - protein, 18 aa, Staphylococcus
FPTMVRDFQSVIGNEIKR

SEQ ID NO: 2012426 - protein, 19 aa, Staphylococcus
FPTMVRDFQSVIGQEIKEQ

SEQ ID NO: 2012427 - protein, 19 aa, Staphylococcus
FPTMVRDFQSVIGQEIKSQ

SEQ ID NO: 2012428 - protein, 26 aa, Staphylococcus
FPTYFGKENYYAFVVLNMMFGGDPSS

SEQ ID NO: 2012429 - protein, 20 aa, Staphylococcus
FPVNIELMSRFRTPKEVKET

SEQ ID NO: 2012430 - protein, 17 aa, Staphylococcus
FPVSGIFLVCQDPEIVE

SEQ ID NO: 2012431 - protein, 18 aa, Staphylococcus
FPVVLAAPTGRASKRLQE

SEQ ID NO: 2012432 - protein, 18 aa, Staphylococcus
FPVVYASAVNGTASLDAE

SEQ ID NO: 2012433 - protein, 19 aa, Staphylococcus
FPVVYASAVNGTASLDPEK

SEQ ID NO: 2012434 - protein, 19 aa, Staphylococcus
FPVVYASAVNGTASLDSEK

SEQ ID NO: 2012435 - protein, 19 aa, Staphylococcus
FPVVYASAVNGTASLESDN

SEQ ID NO: 2012436 - protein, 18 aa, Staphylococcus
FPVVYASAVNGTASLNSE

SEQ ID NO: 2012437 - protein, 18 aa, Staphylococcus
FPVVYASAVNGTASVDSE

SEQ ID NO: 2012438 - protein, 23 aa, Staphylococcus
FPYACGSLDSYSKLCHIDGIDLI

SEQ ID NO: 2012439 - protein, 20 aa, Staphylococcus
FPYLTGMSKRLFVNHTGGNK

SEQ ID NO: 2012440 - protein, 19 aa, Staphylococcus
FPYMMQFIDQLPVVAHNAA

SEQ ID NO: 2012441 - protein, 19 aa, Staphylococcus
FPYPSGAGLHVGHPEGYTA

SEQ ID NO: 2012442 - protein, 21 aa, Staphylococcus
FPYSARIGTPAARMDDQIDET

SEQ ID NO: 2012443 - protein, 22 aa, Staphylococcus
FPYSDDVPMLFKLADQDNELAL

SEQ ID NO: 2012444 - protein, 19 aa, Staphylococcus
FPYSKGRLTKFDKHKINEA

SEQ ID NO: 2012445 - protein, 18 aa, Staphylococcus
FPYSKGRMKKEDYEQVEY

SEQ ID NO: 2012446 - protein, 23 aa, Staphylococcus
FPYSPRIGTPAARMDDQIDESVK

SEQ ID NO: 2012447 - protein, 17 aa, Staphylococcus
FPYTIRIVSEVLESNGS

SEQ ID NO: 2012448 - protein, 17 aa, Staphylococcus
FPYTVRIVSEVLESNGS

SEQ ID NO: 2012449 - protein, 26 aa, Staphylococcus
FQADGIKCVMIAKLPFMNKHNTKYWL

SEQ ID NO: 2012450 - protein, 19 aa, Staphylococcus
FQALLAPMKARGIRFAFCT

SEQ ID NO: 2012451 - protein, 18 aa, Staphylococcus
FQALTPLYPEERIILETD

SEQ ID NO: 2012452 - protein, 18 aa, Staphylococcus
FQALTPLYPEERIILETE

SEQ ID NO: 2012453 - protein, 18 aa, Staphylococcus
FQALTPLYPEERIKLETE

SEQ ID NO: 2012454 - protein, 18 aa, Staphylococcus
FQALTPLYPEERILLETE

SEQ ID NO: 2012455 - protein, 18 aa, Staphylococcus
FQALTPLYPEERILLETL

SEQ ID NO: 2012456 - protein, 18 aa, Staphylococcus
FQALTPLYPEERIVLETD

SEQ ID NO: 2012457 - protein, 18 aa, Staphylococcus
FQALTPLYPEERIVLETT

SEQ ID NO: 2012458 - protein, 25 aa, Staphylococcus
FQANGIKCVMIAKLPFMNKNNAKYW

SEQ ID NO: 2012459 - protein, 19 aa, Staphylococcus
FQAQIMPKKLVFSGKQSLK

SEQ ID NO: 2012460 - protein, 20 aa, Staphylococcus
FQAQVMPKKFAFSSKQLVKR

SEQ ID NO: 2012461 - protein, 19 aa, Staphylococcus
FQAYFVGGSVRDYLMNRPI

SEQ ID NO: 2012462 - protein, 26 aa, Staphylococcus
FQCWVAKEAYLKCIGTGLMEGLDYVE

SEQ ID NO: 2012463 - protein, 18 aa, Staphylococcus
FQDLKLPKKDLHLLNMSK

SEQ ID NO: 2012464 - protein, 25 aa, Staphylococcus
FQDLPVNSFIIWGGVSDIHLMYEER

SEQ ID NO: 2012465 - protein, 18 aa, Staphylococcus
FQDVKLPKKELHQLNMSK

SEQ ID NO: 2012466 - protein, 21 aa, Staphylococcus
FQEAIKQLNYVLSINSNHVDA

SEQ ID NO: 2012467 - protein, 18 aa, Staphylococcus
FQEGRDGFVMGEGAGVLV

SEQ ID NO: 2012468 - protein, 19 aa, Staphylococcus
FQEHGHRPLVLIGGGTGMI

SEQ ID NO: 2012469 - protein, 20 aa, Staphylococcus
FQEKVMAADFLVLGTPNYHG

SEQ ID NO: 2012470 - protein, 24 aa, Staphylococcus
FQERIWGGNALTQFGYDIPSDQTG

SEQ ID NO: 2012471 - protein, 18 aa, Staphylococcus
FQERIWGGRALQQQFNYD

SEQ ID NO: 2012472 - protein, 20 aa, Staphylococcus
FQERIWGGTALNQFNYDIPN

SEQ ID NO: 2012473 - protein, 19 aa, Staphylococcus
FQERIWGGTALRDKFDYDI

SEQ ID NO: 2012474 - protein, 19 aa, Staphylococcus
FQETFDFIAKHKFSELHVF

SEQ ID NO: 2012475 - protein, 19 aa, Staphylococcus
FQFAGHFNEPMWVEHSTKH

SEQ ID NO: 2012476 - protein, 19 aa, Staphylococcus
FQFAGHFNEPMWVGEIPDS

SEQ ID NO: 2012477 - protein, 17 aa, Staphylococcus
FQFCDSQFPTGAFSHSF

SEQ ID NO: 2012478 - protein, 24 aa, Staphylococcus
FQFEIPQFRFILDAKDNGELTYQL

SEQ ID NO: 2012479 - protein, 24 aa, Staphylococcus
FQFLYNDFFYLGFIFNYYFTNTIL

SEQ ID NO: 2012480 - protein, 17 aa, Staphylococcus
FQFMKQLNQAGVPVVFV

SEQ ID NO: 2012481 - protein, 28 aa, Staphylococcus
FQFMKRLNHAGIPVVFVINQIDKHNDDE

SEQ ID NO: 2012482 - protein, 19 aa, Staphylococcus
FQFSGHFNEPMWTESPYHS

SEQ ID NO: 2012483 - protein, 18 aa, Staphylococcus
FQGCEHINRAITIERADF

SEQ ID NO: 2012484 - protein, 25 aa, Staphylococcus
FQGDGIKCVMIAKLPFMNQNNTKYW

SEQ ID NO: 2012485 - protein, 17 aa, Staphylococcus
FQGKDAERIAAQLLPNV

SEQ ID NO: 2012486 - protein, 25 aa, Staphylococcus
FQGYDIRNTFTFRITRNADLTIHED

SEQ ID NO: 2012487 - protein, 17 aa, Staphylococcus
FQHFNLLNSKTVFKNVA

SEQ ID NO: 2012488 - protein, 18 aa, Staphylococcus
FQHVKPGKGSAFVRSKLR

SEQ ID NO: 2012489 - protein, 18 aa, Staphylococcus
FQIKLNGYRMELEEIESQ

SEQ ID NO: 2012490 - protein, 17 aa, Staphylococcus
FQIKLNGYRMELEEIET

SEQ ID NO: 2012491 - protein, 18 aa, Staphylococcus
FQIKMNGYRMELEEIEAQ

SEQ ID NO: 2012492 - protein, 18 aa, Staphylococcus
FQIKMNGYRMELEEIETI

SEQ ID NO: 2012493 - protein, 18 aa, Staphylococcus
FQILLRASNAVGYKNYAD

SEQ ID NO: 2012494 - protein, 17 aa, Staphylococcus
FQILVKYKREPELIHAL

SEQ ID NO: 2012495 - protein, 17 aa, Staphylococcus
FQILVKYKSEPELHKAL

SEQ ID NO: 2012496 - protein, 17 aa, Staphylococcus
FQILVKYKSEPQLHQAL

SEQ ID NO: 2012497 - protein, 17 aa, Staphylococcus
FQIPYGKNIALVGANGV

SEQ ID NO: 2012498 - protein, 19 aa, Staphylococcus
FQISLPRFLSHEDYLLFTH

SEQ ID NO: 2012499 - protein, 24 aa, Staphylococcus
FQISNNYLMCYKDGNYHVILFNKI

SEQ ID NO: 2012500 - protein, 19 aa, Staphylococcus
FQITLPYFLSNEDYLIFTH

SEQ ID NO: 2012501 - protein, 22 aa, Staphylococcus
FQKEQLPDLAFTILDNAGAICR

SEQ ID NO: 2012502 - protein, 18 aa, Staphylococcus
FQKLSIAIDDHWTVNQLS

SEQ ID NO: 2012503 - protein, 17 aa, Staphylococcus
FQKLSRIGLNVHLLQET

SEQ ID NO: 2012504 - protein, 18 aa, Staphylococcus
FQKMMKAQEAMDQNSAWD

SEQ ID NO: 2012505 - protein, 17 aa, Staphylococcus
FQKQGAVAFDYGNNIRQ

SEQ ID NO: 2012506 - protein, 20 aa, Staphylococcus
FQKSGLKYNISYASKAFTCI

SEQ ID NO: 2012507 - protein, 17 aa, Staphylococcus
FQKSVWRKLQEIEYGQL

SEQ ID NO: 2012508 - protein, 26 aa, Staphylococcus
FQKYLDKEVQIFTSLIVREDAQLLYG

SEQ ID NO: 2012509 - protein, 26 aa, Staphylococcus
FQKYWPADVHLMAKEIVRFHSIIWPI

SEQ ID NO: 2012510 - protein, 31 aa, Staphylococcus
FQKYWPADVHLMAKEIVRFHSIIWPILLMAL

SEQ ID NO: 2012511 - protein, 20 aa, Staphylococcus
FQLAGHKPFILIGGATGTIG

SEQ ID NO: 2012512 - protein, 17 aa, Staphylococcus
FQLEELTEASLKEGEVD

SEQ ID NO: 2012513 - protein, 22 aa, Staphylococcus
FQLEMNDLLSIQGFGRAQVTDI

SEQ ID NO: 2012514 - protein, 25 aa, Staphylococcus
FQLIAQRMGADWNYKHPSEIMDEIA

SEQ ID NO: 2012515 - protein, 17 aa, Staphylococcus
FQLKQGFSPAFRVEPRE

SEQ ID NO: 2012516 - protein, 20 aa, Staphylococcus
FQLNIPMIIKYDLNNYTYRK

SEQ ID NO: 2012517 - protein, 23 aa, Staphylococcus
FQLTEHQDWLYGRGVSDMKGGMS

SEQ ID NO: 2012518 - protein, 23 aa, Staphylococcus
FQMIAKEFGFDWNYNYPGDIMDE

SEQ ID NO: 2012519 - protein, 24 aa, Staphylococcus
FQNLFKQFHQFAGMTGTAKQGEKE

SEQ ID NO: 2012520 - protein, 17 aa, Staphylococcus
FQPEKYYTLSIKVDGYD

SEQ ID NO: 2012521 - protein, 25 aa, Staphylococcus
FQPGDEILVAFDLYGGTFRLFDFYE

SEQ ID NO: 2012522 - protein, 20 aa, Staphylococcus
FQPLTNCCLIDAKDMLENGF

SEQ ID NO: 2012523 - protein, 28 aa, Staphylococcus
FQPLTNCCLIDAKSMLKNGFEIGNANVT

SEQ ID NO: 2012524 - protein, 17 aa, Staphylococcus
FQPPLVITDEELDQALT

SEQ ID NO: 2012525 - protein, 26 aa, Staphylococcus
FQPVFEEFDVYPAQWLVLKDIAQNAP

SEQ ID NO: 2012526 - protein, 26 aa, Staphylococcus
FQQIFKLLEDMRVLNAIKRIRPSMKE

SEQ ID NO: 2012527 - protein, 20 aa, Staphylococcus
FQQIGLGYIVEWLKIKCQDY

SEQ ID NO: 2012528 - protein, 19 aa, Staphylococcus
FQQKGLKVFGLTASPNYIA

SEQ ID NO: 2012529 - protein, 19 aa, Staphylococcus
FQRQYFQNLWLNAWEETHE

SEQ ID NO: 2012530 - protein, 20 aa, Staphylococcus
FQRRVKSIVNKAQRVSEETA

SEQ ID NO: 2012531 - protein, 26 aa, Staphylococcus
FQSAYHILDLVFWFGKLEILKAHGVN

SEQ ID NO: 2012532 - protein, 23 aa, Staphylococcus
FQSDIKVSLFIGGTDIEKDKQRT

SEQ ID NO: 2012533 - protein, 26 aa, Staphylococcus
FQSNGIKCVMIAKLPFMNKYNTKYWL

SEQ ID NO: 2012534 - protein, 24 aa, Staphylococcus
FQSNGIKCVMIAKLPFMNQNNTKY

SEQ ID NO: 2012535 - protein, 24 aa, Staphylococcus
FQTHAFDYAHHFPGHIIKETPFAK

SEQ ID NO: 2012536 - protein, 17 aa, Staphylococcus
FQTIKGIAKQHLAYATV

SEQ ID NO: 2012537 - protein, 23 aa, Staphylococcus
FQTLEERLPVWIAQSKKMIKENK

SEQ ID NO: 2012538 - protein, 22 aa, Staphylococcus
FQTLEERLPVWIKQSKRAIRNN

SEQ ID NO: 2012539 - protein, 19 aa, Staphylococcus
FQTNIFGMIFLSQAAVPYL

SEQ ID NO: 2012540 - protein, 17 aa, Staphylococcus
FQTRSQFIVQLINKLET

SEQ ID NO: 2012541 - protein, 22 aa, Staphylococcus
FQVKDSLRWNDITENIRLITTD

SEQ ID NO: 2012542 - protein, 19 aa, Staphylococcus
FQYAHGLPSYGEVDKEVPL

SEQ ID NO: 2012543 - protein, 19 aa, Staphylococcus
FQYAMGLPDYGIIYKDVPM

SEQ ID NO: 2012544 - protein, 25 aa, Staphylococcus
FQYKGYRIVSFKGGRMLIHGMKQPQ

SEQ ID NO: 2012545 - protein, 25 aa, Staphylococcus
FQYRFKSRITVWVLNYLKANHDKLN

SEQ ID NO: 2012546 - protein, 21 aa, Staphylococcus
FRAKQIFEWLYEKRVDDIDDM

SEQ ID NO: 2012547 - protein, 26 aa, Staphylococcus
FRAKQIFEWLYQKRVDSIDEMTNLSK

SEQ ID NO: 2012548 - protein, 17 aa, Staphylococcus
FRALRFLRPNEQGQHYV

SEQ ID NO: 2012549 - protein, 21 aa, Staphylococcus
FRASETFTIVPSWETYTKESA

SEQ ID NO: 2012550 - protein, 27 aa, Staphylococcus
FRATYFAEPHIESFPAAAGQMSLSHLN

SEQ ID NO: 2012551 - protein, 19 aa, Staphylococcus
FRDANMIHIKPSINANGGE

SEQ ID NO: 2012552 - protein, 25 aa, Staphylococcus
FRDDALRLAHEDLFETKSILENVIL

SEQ ID NO: 2012553 - protein, 25 aa, Staphylococcus
FRDDALRLAHEDLYETKAILENVIL

SEQ ID NO: 2012554 - protein, 18 aa, Staphylococcus
FRDKLPKTRSGKIMRRVL

SEQ ID NO: 2012555 - protein, 18 aa, Staphylococcus
FRDLGEQVFNQFSSKSFP

SEQ ID NO: 2012556 - protein, 17 aa, Staphylococcus
FRDLGEQVFNQFSTKSF

SEQ ID NO: 2012557 - protein, 34 aa, Staphylococcus
FRDLLKRFYNFSIANPSPFEWLDSLVEIYTDDNK

SEQ ID NO: 2012558 - protein, 17 aa, Staphylococcus
FRDLPEVTYEFQYAMGL

SEQ ID NO: 2012559 - protein, 25 aa, Staphylococcus
FRDVKGQDVLLFIDNIFRFTQAGSE

SEQ ID NO: 2012560 - protein, 19 aa, Staphylococcus
FREDWRTLLDYCNAKIVNT

SEQ ID NO: 2012561 - protein, 17 aa, Staphylococcus
FRERLDIPNSYRMTNIN

SEQ ID NO: 2012562 - protein, 18 aa, Staphylococcus
FRESKASILTSRREGFGL

SEQ ID NO: 2012563 - protein, 19 aa, Staphylococcus
FREYKMIFINCPSRGKSSN

SEQ ID NO: 2012564 - protein, 19 aa, Staphylococcus
FREYKMIFVNCPSRGKSSD

SEQ ID NO: 2012565 - protein, 17 aa, Staphylococcus
FRFEDLFSEEELLNMTV

SEQ ID NO: 2012566 - protein, 20 aa, Staphylococcus
FRGAAEGVIREYLIKEKNYL

SEQ ID NO: 2012567 - protein, 20 aa, Staphylococcus
FRGNRPFTFTNLKTEEGLDN

SEQ ID NO: 2012568 - protein, 23 aa, Staphylococcus
FRGTELYKKTLGIIGAGRIGLGV

SEQ ID NO: 2012569 - protein, 19 aa, Staphylococcus
FRGTNFPKLLASLNADVKI

SEQ ID NO: 2012570 - protein, 17 aa, Staphylococcus
FRHSGIFRDVYIVERPE

SEQ ID NO: 2012571 - protein, 19 aa, Staphylococcus
FRIDHYLGKEMVQNIESLR

SEQ ID NO: 2012572 - protein, 17 aa, Staphylococcus
FRIGRFKEIAVDEMGKI

SEQ ID NO: 2012573 - protein, 18 aa, Staphylococcus
FRIMLPIHDAIMIECNTD

SEQ ID NO: 2012574 - protein, 17 aa, Staphylococcus
FRISKVKLLNAIYDENI

SEQ ID NO: 2012575 - protein, 21 aa, Staphylococcus
FRKDKKYFKVMEKFNTGLTRL

SEQ ID NO: 2012576 - protein, 18 aa, Staphylococcus
FRKGILRPIDETFIGDIV

SEQ ID NO: 2012577 - protein, 17 aa, Staphylococcus
FRKIEVWQIDNTNDTED

SEQ ID NO: 2012578 - protein, 29 aa, Staphylococcus
FRKLIESYPEYKCHIAIKDINDPMIKLLK

SEQ ID NO: 2012579 - protein, 25 aa, Staphylococcus
FRKLIKRKKVDSVIKGYVRKLEITY

SEQ ID NO: 2012580 - protein, 19 aa, Staphylococcus
FRKMSIGLKEMGFKGIDLN

SEQ ID NO: 2012581 - protein, 17 aa, Staphylococcus
FRKQIALAKRVKLPIII

SEQ ID NO: 2012582 - protein, 19 aa, Staphylococcus
FRKSFYHLAPAGRMIKASV

SEQ ID NO: 2012583 - protein, 17 aa, Staphylococcus
FRKSRASLLTSKYEGFG

SEQ ID NO: 2012584 - protein, 18 aa, Staphylococcus
FRLEAESSMFYTDILTPG

SEQ ID NO: 2012585 - protein, 20 aa, Staphylococcus
FRLPVEVDKFNWQLIKAKIE

SEQ ID NO: 2012586 - protein, 20 aa, Staphylococcus
FRLTEALKPLTADYLKRSEA

SEQ ID NO: 2012587 - protein, 17 aa, Staphylococcus
FRLTEQILNRFDIQFTT

SEQ ID NO: 2012588 - protein, 17 aa, Staphylococcus
FRLTRQDLLEWEDQHGR

SEQ ID NO: 2012589 - protein, 23 aa, Staphylococcus
FRMGSMGSVLGEKICRIIEHCTE

SEQ ID NO: 2012590 - protein, 23 aa, Staphylococcus
FRMLEAFYPGRVDLGIGNNPGTP

SEQ ID NO: 2012591 - protein, 18 aa, Staphylococcus
FRNFFTRKWEREIDTNME

SEQ ID NO: 2012592 - protein, 23 aa, Staphylococcus
FRNMIALDREVMIMFKQKDEKSR

SEQ ID NO: 2012593 - protein, 20 aa, Staphylococcus
FRNRKVADYFAYFAETVFKR

SEQ ID NO: 2012594 - protein, 17 aa, Staphylococcus
FRNYLYVFVSNYFVASE

SEQ ID NO: 2012595 - protein, 20 aa, Staphylococcus
FRPNIEIFEHDFTESSLKLS

SEQ ID NO: 2012596 - protein, 17 aa, Staphylococcus
FRPQKIILDESIISENG

SEQ ID NO: 2012597 - protein, 18 aa, Staphylococcus
FRPRVKGRIGGRRNGVLV

SEQ ID NO: 2012598 - protein, 21 aa, Staphylococcus
FRPSYQSVIHRVFSLPQDFTI

SEQ ID NO: 2012599 - protein, 24 aa, Staphylococcus
FRQYMDLLEAIGLFKTYVKHDERQ

SEQ ID NO: 2012600 - protein, 20 aa, Staphylococcus
FRRCSFRKRTRLSSCKAFVN

SEQ ID NO: 2012601 - protein, 21 aa, Staphylococcus
FRRDNLGFVFQDFNVLPTMTN

SEQ ID NO: 2012602 - protein, 22 aa, Staphylococcus
FRREQLGFVFQEFNILESMTNK

SEQ ID NO: 2012603 - protein, 29 aa, Staphylococcus
FRRFRARVLRWPLPVLMVSRSISDSASRS

SEQ ID NO: 2012604 - protein, 30 aa, Staphylococcus
FRRLSNRKHFKSIAKGYVRKLEITYNKKRD

SEQ ID NO: 2012605 - protein, 18 aa, Staphylococcus
FRRVKRIDTIIETFAKVH

SEQ ID NO: 2012606 - protein, 17 aa, Staphylococcus
FRTMALLNRPYHIKLPV

SEQ ID NO: 2012607 - protein, 17 aa, Staphylococcus
FRTMPMVWYCPPLSPIM

SEQ ID NO: 2012608 - protein, 30 aa, Staphylococcus
FRTQLRALLRASAYGKLNIMFPMVATIKEF

SEQ ID NO: 2012609 - protein, 30 aa, Staphylococcus
FRTQLRALLRASAYGKLNIMFPMVATINEF

SEQ ID NO: 2012610 - protein, 23 aa, Staphylococcus
FRTSEVPSAVFGTKKRRPIENGV

SEQ ID NO: 2012611 - protein, 21 aa, Staphylococcus
FRTSNEYPEIVFVGNHLSSSY

SEQ ID NO: 2012612 - protein, 24 aa, Staphylococcus
FRVKDHEAIKHWIQKYQELGIPNS

SEQ ID NO: 2012613 - protein, 23 aa, Staphylococcus
FRVLDPKSTFVVYDSSLDKRVMA

SEQ ID NO: 2012614 - protein, 17 aa, Staphylococcus
FRVPKGYVTGFIGSNGA

SEQ ID NO: 2012615 - protein, 18 aa, Staphylococcus
FRVWSRLNNDFSDTAKQS

SEQ ID NO: 2012616 - protein, 17 aa, Staphylococcus
FRYLSYTEDVGTRSLLS

SEQ ID NO: 2012617 - protein, 17 aa, Staphylococcus
FSALDPISREKLQDDLL

SEQ ID NO: 2012618 - protein, 18 aa, Staphylococcus
FSALDPISREKLQDDLLE

SEQ ID NO: 2012619 - protein, 24 aa, Staphylococcus
FSANFKKFCLALGIDSENFKIGKF

SEQ ID NO: 2012620 - protein, 17 aa, Staphylococcus
FSAQMHSLIAMDASHQR

SEQ ID NO: 2012621 - protein, 17 aa, Staphylococcus
FSAQMHSLIAMDNEQSS

SEQ ID NO: 2012622 - protein, 17 aa, Staphylococcus
FSAQMHSLVAMDAQNKR

SEQ ID NO: 2012623 - protein, 17 aa, Staphylococcus
FSAQMHSLVAMDEQHQR

SEQ ID NO: 2012624 - protein, 20 aa, Staphylococcus
FSAVDGRYLIARNVHKSVFH

SEQ ID NO: 2012625 - protein, 17 aa, Staphylococcus
FSAVITAELAKGRTIYD

SEQ ID NO: 2012626 - protein, 20 aa, Staphylococcus
FSDDVVKAIARVVEKQSDSL

SEQ ID NO: 2012627 - protein, 18 aa, Staphylococcus
FSDEVLKAITNYVEKQSN

SEQ ID NO: 2012628 - protein, 19 aa, Staphylococcus
FSDFEMHFYRYVFPYHDTQ

SEQ ID NO: 2012629 - protein, 17 aa, Staphylococcus
FSDGKTFLSYIEQHHLP

SEQ ID NO: 2012630 - protein, 17 aa, Staphylococcus
FSDKMAKILTGEDGEEA

SEQ ID NO: 2012631 - protein, 18 aa, Staphylococcus
FSDLLIYCAERNVMLAEY

SEQ ID NO: 2012632 - protein, 17 aa, Staphylococcus
FSDLPYDYDRPGSNRQP

SEQ ID NO: 2012633 - protein, 24 aa, Staphylococcus
FSDTRLTPKLNFENRLFIPDASSE

SEQ ID NO: 2012634 - protein, 29 aa, Staphylococcus
FSDYLKPALRLSAIMGLNATFIFTHDSIA

SEQ ID NO: 2012635 - protein, 29 aa, Staphylococcus
FSDYLKPALRLSAIMGLNSTFVFTHDSIA

SEQ ID NO: 2012636 - protein, 18 aa, Staphylococcus
FSDYLLIMKEGQIIDNGP

SEQ ID NO: 2012637 - protein, 20 aa, Staphylococcus
FSEHLEKSGIEFKVRGKNVS

SEQ ID NO: 2012638 - protein, 23 aa, Staphylococcus
FSEKAIVGYWFSIDFNKLKHNIL

SEQ ID NO: 2012639 - protein, 27 aa, Staphylococcus
FSEKAKLAFKLAEAITHISKNGVPDKL

SEQ ID NO: 2012640 - protein, 27 aa, Staphylococcus
FSELFKSELKLAIGPIERGGAGGGIAA

SEQ ID NO: 2012641 - protein, 19 aa, Staphylococcus
FSELHVFPYSSRIGTPAAR

SEQ ID NO: 2012642 - protein, 23 aa, Staphylococcus
FSELNLGPEPEFFLFKLDEKGEP

SEQ ID NO: 2012643 - protein, 18 aa, Staphylococcus
FSERYGWVQDQYDVSWQL

SEQ ID NO: 2012644 - protein, 18 aa, Staphylococcus
FSETSRDGFLLAQDISSY

SEQ ID NO: 2012645 - protein, 23 aa, Staphylococcus
FSEVGQAKGYRVIEIDTNSKIQD

SEQ ID NO: 2012646 - protein, 21 aa, Staphylococcus
FSEVNQAKGYRIVNIDEVNHV

SEQ ID NO: 2012647 - protein, 21 aa, Staphylococcus
FSFLEAAGLYDAHLEDCPFKP

SEQ ID NO: 2012648 - protein, 20 aa, Staphylococcus
FSFNDIEFLPPVTPPNNVIA

SEQ ID NO: 2012649 - protein, 22 aa, Staphylococcus
FSFNSPNGMCETCEGLGYIEDI

SEQ ID NO: 2012650 - protein, 17 aa, Staphylococcus
FSFSELTTEHEIKYIVA

SEQ ID NO: 2012651 - protein, 20 aa, Staphylococcus
FSFSGLKSAVINKLHNLKQK

SEQ ID NO: 2012652 - protein, 20 aa, Staphylococcus
FSFSGLKSAVINQLHNQRQK

SEQ ID NO: 2012653 - protein, 26 aa, Staphylococcus
FSGAEHRKAQNFAEVKLHLDNAKKDL

SEQ ID NO: 2012654 - protein, 21 aa, Staphylococcus
FSGAGALDIYSYRLGQTLIGN

SEQ ID NO: 2012655 - protein, 18 aa, Staphylococcus
FSGATILITGDNFGCGSS

SEQ ID NO: 2012656 - protein, 21 aa, Staphylococcus
FSGDIKHQFTYEVELNQETHY

SEQ ID NO: 2012657 - protein, 18 aa, Staphylococcus
FSGFGGGFEDIFSSFFGG

SEQ ID NO: 2012658 - protein, 25 aa, Staphylococcus
FSGFGGGFEDIFSSFFGGSRQRDPN

SEQ ID NO: 2012659 - protein, 24 aa, Staphylococcus
FSGGMKRRLSLAITLLAHPDLLIL

SEQ ID NO: 2012660 - protein, 23 aa, Staphylococcus
FSGGMKRRLSLAITLLANPNLII

SEQ ID NO: 2012661 - protein, 24 aa, Staphylococcus
FSGGMKRRLSLAITLLSDPSLIIL

SEQ ID NO: 2012662 - protein, 24 aa, Staphylococcus
FSGGMKRRLSLAITLLSKPELIIL

SEQ ID NO: 2012663 - protein, 24 aa, Staphylococcus
FSGGMKRRLSLAITLLSNPNLIIL

SEQ ID NO: 2012664 - protein, 20 aa, Staphylococcus
FSGKYARGIHNEFIDEMNQF

SEQ ID NO: 2012665 - protein, 17 aa, Staphylococcus
FSGLKSAVINKLHNLKQ

SEQ ID NO: 2012666 - protein, 18 aa, Staphylococcus
FSGLKSAVINKLHNQRQK

SEQ ID NO: 2012667 - protein, 18 aa, Staphylococcus
FSGLKSSVINKLHNLRQK

SEQ ID NO: 2012668 - protein, 18 aa, Staphylococcus
FSGMKKRAPKVFRKLNIE

SEQ ID NO: 2012669 - protein, 24 aa, Staphylococcus
FSGMPTTLNFFAWLQHLNDANEIN

SEQ ID NO: 2012670 - protein, 21 aa, Staphylococcus
FSGPLDLLLHLIQKYEIDVYD

SEQ ID NO: 2012671 - protein, 24 aa, Staphylococcus
FSGQKCSACSRVIAVDDVYDDLIE

SEQ ID NO: 2012672 - protein, 26 aa, Staphylococcus
FSHDVALVMMILRLNTMLKGHSGVTT

SEQ ID NO: 2012673 - protein, 21 aa, Staphylococcus
FSHKLITLDAFHIDYKALNID

SEQ ID NO: 2012674 - protein, 25 aa, Staphylococcus
FSHYLKVRPGAFFLTGCGNADKGIT

SEQ ID NO: 2012675 - protein, 25 aa, Staphylococcus
FSHYLKVRPGAFFLTGCGNEDKGIT

SEQ ID NO: 2012676 - protein, 26 aa, Staphylococcus
FSHYLKVRPGAFFLTGCGNPDKGITA

SEQ ID NO: 2012677 - protein, 26 aa, Staphylococcus
FSHYLKVRPGAFFLTGCGNPEKETTH

SEQ ID NO: 2012678 - protein, 25 aa, Staphylococcus
FSHYLKVRPGAFFLTGCGNQDKNIT

SEQ ID NO: 2012679 - protein, 25 aa, Staphylococcus
FSHYLKVRPGAFFLTGCGNVDKGIT

SEQ ID NO: 2012680 - protein, 18 aa, Staphylococcus
FSIEGVDTLVPMLQHTIT

SEQ ID NO: 2012681 - protein, 19 aa, Staphylococcus
FSIFLLWDSLDACPQGKLV

SEQ ID NO: 2012682 - protein, 31 aa, Staphylococcus
FSIMPNFTEKAFLRVDLNDMINALPKQLTKR

SEQ ID NO: 2012683 - protein, 26 aa, Staphylococcus
FSIPTWDFKGACLGIDARKVVEKGIT

SEQ ID NO: 2012684 - protein, 19 aa, Staphylococcus
FSISDLLLYEDIRKIMLKS

SEQ ID NO: 2012685 - protein, 19 aa, Staphylococcus
FSISFEEFAVLTFISQSDD

SEQ ID NO: 2012686 - protein, 17 aa, Staphylococcus
FSITEVDALTGRSIGRP

SEQ ID NO: 2012687 - protein, 21 aa, Staphylococcus
FSKARAVPIYQTSSYVFDNTE

SEQ ID NO: 2012688 - protein, 17 aa, Staphylococcus
FSKASPLSSVFQAQGLM

SEQ ID NO: 2012689 - protein, 17 aa, Staphylococcus
FSKDAGLNELLNIKTPA

SEQ ID NO: 2012690 - protein, 24 aa, Staphylococcus
FSKDLDVDFIFKARKPMGRAFKKA

SEQ ID NO: 2012691 - protein, 23 aa, Staphylococcus
FSKEMKRGDIVYVKKGQTDIVGW

SEQ ID NO: 2012692 - protein, 17 aa, Staphylococcus
FSKFLWSYVDGHPIDLH

SEQ ID NO: 2012693 - protein, 25 aa, Staphylococcus
FSKIYLFSPDIEKITNFRNNLLKDQ

SEQ ID NO: 2012694 - protein, 17 aa, Staphylococcus
FSKKAPLYMTYNKFDTQ

SEQ ID NO: 2012695 - protein, 18 aa, Staphylococcus
FSKNYPLYMTYNRFDTQK

SEQ ID NO: 2012696 - protein, 19 aa, Staphylococcus
FSKQGIFDVIQKFKEDVRS

SEQ ID NO: 2012697 - protein, 25 aa, Staphylococcus
FSKREGQKYYIIWHGTPLKNMGKDM

SEQ ID NO: 2012698 - protein, 17 aa, Staphylococcus
FSKRLKDEGVYVKSIVF

SEQ ID NO: 2012699 - protein, 17 aa, Staphylococcus
FSKRTISAIKHNGALVV

SEQ ID NO: 2012700 - protein, 24 aa, Staphylococcus
FSKSIYPSCRIAYIVLPPKLLEQY

SEQ ID NO: 2012701 - protein, 26 aa, Staphylococcus
FSKSLFPSCRIAFMVLPQNLMQRYHH

SEQ ID NO: 2012702 - protein, 26 aa, Staphylococcus
FSKSLFPSCRIAYIVLPYPILNIYNH

SEQ ID NO: 2012703 - protein, 17 aa, Staphylococcus
FSKSLNVDYIFKAKKPR

SEQ ID NO: 2012704 - protein, 24 aa, Staphylococcus
FSKSLYPSCRMAYIVLPNKLLKLF

SEQ ID NO: 2012705 - protein, 30 aa, Staphylococcus
FSKTLMPSIRMSYMILPTKLVRQFELQNQN

SEQ ID NO: 2012706 - protein, 17 aa, Staphylococcus
FSKTPTFELLKENPSRI

SEQ ID NO: 2012707 - protein, 32 aa, Staphylococcus
FSKYPNIKWIVPHCGALLPIIAQRVAMGNKMF

SEQ ID NO: 2012708 - protein, 17 aa, Staphylococcus
FSLDTILSRIEEVQPAF

SEQ ID NO: 2012709 - protein, 20 aa, Staphylococcus
FSLEGPRLYEPIHGSAPDIA

SEQ ID NO: 2012710 - protein, 19 aa, Staphylococcus
FSLMKRWPKHPSNPNKGYV

SEQ ID NO: 2012711 - protein, 17 aa, Staphylococcus
FSLMVDGLLRQLGSLQE

SEQ ID NO: 2012712 - protein, 21 aa, Staphylococcus
FSLTDLYLFIFNNSIKTLTIV

SEQ ID NO: 2012713 - protein, 17 aa, Staphylococcus
FSLTKSIKQLIEKQHKQ

SEQ ID NO: 2012714 - protein, 22 aa, Staphylococcus
FSMEAFNLYGALSMANAGPNTN

SEQ ID NO: 2012715 - protein, 23 aa, Staphylococcus
FSMFRKPSDVLIHLKEIANELHI

SEQ ID NO: 2012716 - protein, 17 aa, Staphylococcus
FSMLCKALKDFKANTEV

SEQ ID NO: 2012717 - protein, 18 aa, Staphylococcus
FSMQSWKALSIEAQQAHI

SEQ ID NO: 2012718 - protein, 20 aa, Staphylococcus
FSMQVPKLKPGTYTIAIESP

SEQ ID NO: 2012719 - protein, 17 aa, Staphylococcus
FSNEVDYCYRKFSEEND

SEQ ID NO: 2012720 - protein, 18 aa, Staphylococcus
FSNFLWSYVNHQPIDLNY

SEQ ID NO: 2012721 - protein, 22 aa, Staphylococcus
FSNKEIETIQALGGIIKFVNAL

SEQ ID NO: 2012722 - protein, 19 aa, Staphylococcus
FSNKSIYELYALPPHIKQT

SEQ ID NO: 2012723 - protein, 27 aa, Staphylococcus
FSNMVKLLMKEVIKPTSSVSYKVSEWI

SEQ ID NO: 2012724 - protein, 22 aa, Staphylococcus
FSNTYLAMRVSFFNELDMYAEI

SEQ ID NO: 2012725 - protein, 17 aa, Staphylococcus
FSPDEVVSYQRHQGNKF

SEQ ID NO: 2012726 - protein, 21 aa, Staphylococcus
FSPLLEPEIMFIAKEDLPYDA

SEQ ID NO: 2012727 - protein, 17 aa, Staphylococcus
FSPLTGFMGEADYKKVV

SEQ ID NO: 2012728 - protein, 17 aa, Staphylococcus
FSPQSGTISVEFEDGEN

SEQ ID NO: 2012729 - protein, 26 aa, Staphylococcus
FSPREVVLRVKALLRRTLTATSEQNE

SEQ ID NO: 2012730 - protein, 22 aa, Staphylococcus
FSPREVVLRVKALLRRTQVATA

SEQ ID NO: 2012731 - protein, 18 aa, Staphylococcus
FSQEGFLKEFNSMNQRIL

SEQ ID NO: 2012732 - protein, 27 aa, Staphylococcus
FSQLEAFKEALPFLMTAAEQDDRHDVE

SEQ ID NO: 2012733 - protein, 18 aa, Staphylococcus
FSQLFAPLIEPELVFILT

SEQ ID NO: 2012734 - protein, 18 aa, Staphylococcus
FSQPEWGASIHLDTQHVH

SEQ ID NO: 2012735 - protein, 23 aa, Staphylococcus
FSQRIRMPFLRSPFVHHCHPNPF

SEQ ID NO: 2012736 - protein, 26 aa, Staphylococcus
FSRAIPFKRYLYFLIRSVKYDYLRKS

SEQ ID NO: 2012737 - protein, 21 aa, Staphylococcus
FSREECIERVWGFDYDGDDRT

SEQ ID NO: 2012738 - protein, 22 aa, Staphylococcus
FSRGQRVQVATVFGGMPIGRQI

SEQ ID NO: 2012739 - protein, 20 aa, Staphylococcus
FSRNGLREGYVMKQVRERYP

SEQ ID NO: 2012740 - protein, 21 aa, Staphylococcus
FSRNLAAELGQYGITSNVVSG

SEQ ID NO: 2012741 - protein, 19 aa, Staphylococcus
FSRQRYWGEPIPIIHWGDG

SEQ ID NO: 2012742 - protein, 19 aa, Staphylococcus
FSRQRYWGEPIPVIHWEDG

SEQ ID NO: 2012743 - protein, 18 aa, Staphylococcus
FSRSSIVQRLAKIMDKAT

SEQ ID NO: 2012744 - protein, 17 aa, Staphylococcus
FSRTFTGTIHELFNAYT

SEQ ID NO: 2012745 - protein, 23 aa, Staphylococcus
FSSDKIVGAILFEQTMDREVEGK

SEQ ID NO: 2012746 - protein, 26 aa, Staphylococcus
FSSGGKRVRPAFVILSSQFGKEMNED

SEQ ID NO: 2012747 - protein, 25 aa, Staphylococcus
FSSHSDYRFMGIGFDLLSYGLNYAF

SEQ ID NO: 2012748 - protein, 17 aa, Staphylococcus
FSSIGATIADNFNVELP

SEQ ID NO: 2012749 - protein, 28 aa, Staphylococcus
FSSKDDPELCVLKVTPKTIKLMNDPDLD

SEQ ID NO: 2012750 - protein, 23 aa, Staphylococcus
FSSKKELGEYVGINVNATIVAIL

SEQ ID NO: 2012751 - protein, 17 aa, Staphylococcus
FSSPCFELEGVIVNQAK

SEQ ID NO: 2012752 - protein, 18 aa, Staphylococcus
FSSRAKWGERSGLTLFLP

SEQ ID NO: 2012753 - protein, 26 aa, Staphylococcus
FSSRFKNLRFDEDIVFCEEHTYMAHA

SEQ ID NO: 2012754 - protein, 17 aa, Staphylococcus
FSSSIFVNINFFKTLMS

SEQ ID NO: 2012755 - protein, 18 aa, Staphylococcus
FSTECHEQLTAQVYEISD

SEQ ID NO: 2012756 - protein, 29 aa, Staphylococcus
FSTGMKMKLSFAIAFSHHAELYILDEPTS

SEQ ID NO: 2012757 - protein, 28 aa, Staphylococcus
FSTGMKMKLSLAIAFSHHAELFILDEPT

SEQ ID NO: 2012758 - protein, 31 aa, Staphylococcus
FSTIASRLIGEPAWGLFSGVFGKGDNINKVM

SEQ ID NO: 2012759 - protein, 17 aa, Staphylococcus
FSTMKVLDPLGQDVTPD

SEQ ID NO: 2012760 - protein, 19 aa, Staphylococcus
FSTSCGKIASELSFVVSEI

SEQ ID NO: 2012761 - protein, 20 aa, Staphylococcus
FSVDIYKDLIEFMKYEYKNE

SEQ ID NO: 2012762 - protein, 32 aa, Staphylococcus
FSVEAHISFLKELLLDESFYIKVHIYDYDAKR

SEQ ID NO: 2012763 - protein, 19 aa, Staphylococcus
FSVGSVFKTIFKGDIFNVG

SEQ ID NO: 2012764 - protein, 19 aa, Staphylococcus
FSVGVIYGIMQKWNLERIV

SEQ ID NO: 2012765 - protein, 17 aa, Staphylococcus
FSVNQNVHFEVLLVKIA

SEQ ID NO: 2012766 - protein, 24 aa, Staphylococcus
FSVQPDAKFPPSLRNMYKELQDDV

SEQ ID NO: 2012767 - protein, 24 aa, Staphylococcus
FSVQPEGKFPPSLRNMYKELEDDI

SEQ ID NO: 2012768 - protein, 19 aa, Staphylococcus
FSYICYCHNYYPRPDTGLT

SEQ ID NO: 2012769 - protein, 17 aa, Staphylococcus
FSYKRYLENQIRDAFGF

SEQ ID NO: 2012770 - protein, 17 aa, Staphylococcus
FSYPKEYGEIFKTLQES

SEQ ID NO: 2012771 - protein, 17 aa, Staphylococcus
FSYYKSKNLLPIVEEVS

SEQ ID NO: 2012772 - protein, 20 aa, Staphylococcus
FTADNRIYFDAHHYRDLIDH

SEQ ID NO: 2012773 - protein, 22 aa, Staphylococcus
FTADWCPDCKVIEPDLPQLEAK

SEQ ID NO: 2012774 - protein, 17 aa, Staphylococcus
FTAFSMYPSLWENMGLS

SEQ ID NO: 2012775 - protein, 28 aa, Staphylococcus
FTAGKGRSGFMANSFAMRLNQLGKEAFV

SEQ ID NO: 2012776 - protein, 27 aa, Staphylococcus
FTAGKGRSGYVANSFAMRLNQLGKDAS

SEQ ID NO: 2012777 - protein, 17 aa, Staphylococcus
FTALTFSYVVNHNKNKY

SEQ ID NO: 2012778 - protein, 17 aa, Staphylococcus
FTAPRIENLLEMVNTNN

SEQ ID NO: 2012779 - protein, 17 aa, Staphylococcus
FTASFVGHFSAGKSTLI

SEQ ID NO: 2012780 - protein, 19 aa, Staphylococcus
FTATIPYNGKLVVMKDEYT

SEQ ID NO: 2012781 - protein, 20 aa, Staphylococcus
FTATIPYNGKLVVMQDKYTK

SEQ ID NO: 2012782 - protein, 19 aa, Staphylococcus
FTCYAPCYTGHGLPVSEFV

SEQ ID NO: 2012783 - protein, 25 aa, Staphylococcus
FTDDALLRISLEEMLSVLPKQLSKR

SEQ ID NO: 2012784 - protein, 26 aa, Staphylococcus
FTDEEFRGAMKFTQMRYSLRTGRKEN

SEQ ID NO: 2012785 - protein, 18 aa, Staphylococcus
FTDGQPWFPVNPNYKEIN

SEQ ID NO: 2012786 - protein, 18 aa, Staphylococcus
FTDHGTFIIGFSVAKQHF

SEQ ID NO: 2012787 - protein, 26 aa, Staphylococcus
FTDLGVPVIRTSELNQALPYPFIAIQ

SEQ ID NO: 2012788 - protein, 21 aa, Staphylococcus
FTDLLFLNLERAFLSQNFYDV

SEQ ID NO: 2012789 - protein, 27 aa, Staphylococcus
FTDNGWGKYPICMAKTQYSFSDDATAL

SEQ ID NO: 2012790 - protein, 19 aa, Staphylococcus
FTDSTPWFVVNENYKNINV

SEQ ID NO: 2012791 - protein, 18 aa, Staphylococcus
FTDVFKVPNRILDIDTQD

SEQ ID NO: 2012792 - protein, 17 aa, Staphylococcus
FTDVRFQPGEILTVKHD

SEQ ID NO: 2012793 - protein, 23 aa, Staphylococcus
FTEAVKELGERVNITVDVGNSQY

SEQ ID NO: 2012794 - protein, 22 aa, Staphylococcus
FTEDVYDFWRPSGQSYPLVDGA

SEQ ID NO: 2012795 - protein, 25 aa, Staphylococcus
FTEERNVYLPKAFHPLLDRATVVAN

SEQ ID NO: 2012796 - protein, 27 aa, Staphylococcus
FTEFKGEWRKSKLADVVNVYDGTHQTP

SEQ ID NO: 2012797 - protein, 20 aa, Staphylococcus
FTEGQPWFPVNPNYKTINVK

SEQ ID NO: 2012798 - protein, 20 aa, Staphylococcus
FTEGTPWFPVNPNYKTINVA

SEQ ID NO: 2012799 - protein, 19 aa, Staphylococcus
FTEIHIYGATGGRLDHFMG

SEQ ID NO: 2012800 - protein, 17 aa, Staphylococcus
FTEIKHVHKPSGAKPGF

SEQ ID NO: 2012801 - protein, 17 aa, Staphylococcus
FTEREYNVFGKIQPPYT

SEQ ID NO: 2012802 - protein, 22 aa, Staphylococcus
FTESKRFVDIQTIKQFTDIIPN

SEQ ID NO: 2012803 - protein, 22 aa, Staphylococcus
FTETRFQPGELVIIERKNKEPL

SEQ ID NO: 2012804 - protein, 31 aa, Staphylococcus; identical to SEQ ID NO: 1794935

SEQ ID NO: 2012805 - protein, 31 aa, Staphylococcus
FTEVGIFSVMWSEHCSYKHSKPFLKQFPTTS

SEQ ID NO: 2012806 - protein, 18 aa, Staphylococcus
FTEVKWGELDYLILDLPP

SEQ ID NO: 2012807 - protein, 17 aa, Staphylococcus
FTEVLGMRLVKKTVNQD

SEQ ID NO: 2012808 - protein, 28 aa, Staphylococcus
FTFDYVIPKRLAAFVQVGVRVVVPFGPR

SEQ ID NO: 2012809 - protein, 17 aa, Staphylococcus
FTFESRNGQKRTRTMPF

SEQ ID NO: 2012810 - protein, 21 aa, Staphylococcus
FTGDIKTPVKYASRDLKKLFS

SEQ ID NO: 2012811 - protein, 21 aa, Staphylococcus
FTGDIKTPVKYASRELKKLFS

SEQ ID NO: 2012812 - protein, 17 aa, Staphylococcus
FTGERITQNMLKLIANY

SEQ ID NO: 2012813 - protein, 17 aa, Staphylococcus
FTGGHGVMYDFPENKFI

SEQ ID NO: 2012814 - protein, 26 aa, Staphylococcus
FTGNGRIKVYVAFRMPSEKLDDYKVL

SEQ ID NO: 2012815 - protein, 21 aa, Staphylococcus
FTGPCLKCLLQQVPQTGESCA

SEQ ID NO: 2012816 - protein, 18 aa, Staphylococcus
FTGPCLRCLMQETPETAE

SEQ ID NO: 2012817 - protein, 26 aa, Staphylococcus
FTGRVCPAPCEQSCVMKINRNSVAIK

SEQ ID NO: 2012818 - protein, 19 aa, Staphylococcus
FTGSFKYRGAANKVMHLTD

SEQ ID NO: 2012819 - protein, 19 aa, Staphylococcus
FTHLKEVFLEEKFQENQSA

SEQ ID NO: 2012820 - protein, 24 aa, Staphylococcus
FTHWEELKSTWKFVDAIQDEWTMV

SEQ ID NO: 2012821 - protein, 25 aa, Staphylococcus
FTHWEELKSTWKFVDAIQEEWDQVI

SEQ ID NO: 2012822 - protein, 25 aa, Staphylococcus
FTHWEELKSTWKFVDAIQEEWNQNE

SEQ ID NO: 2012823 - protein, 25 aa, Staphylococcus
FTHWEELKSTWKFVDAIQEHWTMID

SEQ ID NO: 2012824 - protein, 25 aa, Staphylococcus
FTHWEELKSTWKFVDAIQEQWNMVE

SEQ ID NO: 2012825 - protein, 25 aa, Staphylococcus
FTHWEELKSTWKFVDIIQEEWTLND

SEQ ID NO: 2012826 - protein, 17 aa, Staphylococcus
FTIHAGLRLHYIPLTVD

SEQ ID NO: 2012827 - protein, 17 aa, Staphylococcus
FTIRLAKGLNIVGLINI

SEQ ID NO: 2012828 - protein, 19 aa, Staphylococcus
FTKANPFSRFIRAKATLSA

SEQ ID NO: 2012829 - protein, 18 aa, Staphylococcus
FTKANPFTRFIRASATFS

SEQ ID NO: 2012830 - protein, 23 aa, Staphylococcus
FTKDRTVYLPKAFHPLLDKQTVV

SEQ ID NO: 2012831 - protein, 20 aa, Staphylococcus
FTKDYDKVFFIIDANVYHQF

SEQ ID NO: 2012832 - protein, 19 aa, Staphylococcus
FTKEEARIQGARCMDCGTP

SEQ ID NO: 2012833 - protein, 17 aa, Staphylococcus
FTKEEFEGLIDFAMTLK

SEQ ID NO: 2012834 - protein, 24 aa, Staphylococcus
FTKTEYDLLYLLATNRNHVLQREQ

SEQ ID NO: 2012835 - protein, 24 aa, Staphylococcus
FTKTEYDLLYLLATNRNRVLQREQ

SEQ ID NO: 2012836 - protein, 24 aa, Staphylococcus
FTKTNMIPRLDLFAQDGSIFTDEP

SEQ ID NO: 2012837 - protein, 19 aa, Staphylococcus
FTKVRPTAALINEKSESII

SEQ ID NO: 2012838 - protein, 17 aa, Staphylococcus
FTLGSAGIIVHDFNVSG

SEQ ID NO: 2012839 - protein, 19 aa, Staphylococcus
FTLSPEAKYPTAIEQNYSV

SEQ ID NO: 2012840 - protein, 17 aa, Staphylococcus
FTLTFKEGVIVDIKAEQ

SEQ ID NO: 2012841 - protein, 17 aa, Staphylococcus
FTLTKLLWIKDNEPNNW

SEQ ID NO: 2012842 - protein, 18 aa, Staphylococcus
FTMNASFEILGERFYCSD

SEQ ID NO: 2012843 - protein, 25 aa, Staphylococcus
FTMPEIQEGVAFAKRYGAKIYVTTN

SEQ ID NO: 2012844 - protein, 17 aa, Staphylococcus
FTNDYRTGLKLFNELEY

SEQ ID NO: 2012845 - protein, 17 aa, Staphylococcus
FTNEKLKAILNCHDGKL

SEQ ID NO: 2012846 - protein, 18 aa, Staphylococcus
FTNGTPWFPVNPNYKTIN

SEQ ID NO: 2012847 - protein, 18 aa, Staphylococcus
FTNLPIDEAIAFLEQIDS

SEQ ID NO: 2012848 - protein, 18 aa, Staphylococcus
FTNYGARIVCWKYHDNNI

SEQ ID NO: 2012849 - protein, 20 aa, Staphylococcus
FTPEREIGNDLLFVENLSKT

SEQ ID NO: 2012850 - protein, 24 aa, Staphylococcus
FTPEREIGNDLLFVENVSKTIDGE

SEQ ID NO: 2012851 - protein, 21 aa, Staphylococcus
FTPFYKIRDLDAIITDKEIFR

SEQ ID NO: 2012852 - protein, 17 aa, Staphylococcus
FTPGHAPGHVVFYHEED

SEQ ID NO: 2012853 - protein, 17 aa, Staphylococcus
FTPIPAMSMLSYASGAR

SEQ ID NO: 2012854 - protein, 20 aa, Staphylococcus
FTPKYHKLSEAERNWLDQQK

SEQ ID NO: 2012855 - protein, 30 aa, Staphylococcus
FTPMGRPGLPEELGGIVVYLASDASSFAQG

SEQ ID NO: 2012856 - protein, 26 aa, Staphylococcus
FTPMKLRERVWRRLATDLKSDKLHDI

SEQ ID NO: 2012857 - protein, 23 aa, Staphylococcus
FTPNEVGAGFEFENAIVGGVVPR

SEQ ID NO: 2012858 - protein, 19 aa, Staphylococcus
FTPNLEKITTFRDELIQNQ

SEQ ID NO: 2012859 - protein, 19 aa, Staphylococcus
FTPQRFEASFRRKPKDQSE

SEQ ID NO: 2012860 - protein, 17 aa, Staphylococcus
FTPWPAKVGTRLNQGQA

SEQ ID NO: 2012861 - protein, 21 aa, Staphylococcus
FTQKISVFDIIKKICTHPYIR

SEQ ID NO: 2012862 - protein, 19 aa, Staphylococcus
FTQMRYSLRTGRKENDLQD

SEQ ID NO: 2012863 - protein, 26 aa, Staphylococcus
FTQNFPDFIEKYGFFDMLQASLHPFD

SEQ ID NO: 2012864 - protein, 25 aa, Staphylococcus
FTQNFPDFIEKYNFFDMLQASLHPF

SEQ ID NO: 2012865 - protein, 21 aa, Staphylococcus
FTQNLQLNWKEDVYNLISKSE

SEQ ID NO: 2012866 - protein, 26 aa, Staphylococcus
FTQPIIWLCGGLDRGNDFDELIPYMN

SEQ ID NO: 2012867 - protein, 17 aa, Staphylococcus
FTRRIPKRIKTRKLLEA

SEQ ID NO: 2012868 - protein, 18 aa, Staphylococcus
FTRRIPKRIKTRKLLESL

SEQ ID NO: 2012869 - protein, 19 aa, Staphylococcus
FTSGTPWIDIPNNFDKINV

SEQ ID NO: 2012870 - protein, 18 aa, Staphylococcus
FTSGTPWIDIPSNYQHIN

SEQ ID NO: 2012871 - protein, 26 aa, Staphylococcus
FTSLESLRIPGYMVVLDTGIKGNTKE

SEQ ID NO: 2012872 - protein, 22 aa, Staphylococcus
FTTGEPWISIPQNYHHINVEQA

SEQ ID NO: 2012873 - protein, 20 aa, Staphylococcus
FTVAEYMPWDEINLKNTLKD

SEQ ID NO: 2012874 - protein, 19 aa, Staphylococcus
FTYCLPEFNTSSNHRFISN

SEQ ID NO: 2012875 - protein, 17 aa, Staphylococcus
FTYGIDNEAQFMAKNID

SEQ ID NO: 2012876 - protein, 17 aa, Staphylococcus
FTYTHIQRVLMQILLNI

SEQ ID NO: 2012877 - protein, 20 aa, Staphylococcus
FVAGILKNARGFTGVCNPLV

SEQ ID NO: 2012878 - protein, 27 aa, Staphylococcus
FVAGKGRSGFVANSFAMRLNQLGKYAH

SEQ ID NO: 2012879 - protein, 18 aa, Staphylococcus
FVAPDGKLTCGEPGQAID

SEQ ID NO: 2012880 - protein, 19 aa, Staphylococcus
FVCGCRNLGEAARRIGEGA

SEQ ID NO: 2012881 - protein, 24 aa, Staphylococcus
FVCGKAEDVIMDWQREGIQPDVVM

SEQ ID NO: 2012882 - protein, 22 aa, Staphylococcus
FVCGKAEEVILEWKSEGIRPDV

SEQ ID NO: 2012883 - protein, 18 aa, Staphylococcus
FVDGKILPLDKVRTKKRA

SEQ ID NO: 2012884 - protein, 18 aa, Staphylococcus
FVDKLKLQFDEAFGQQKY

SEQ ID NO: 2012885 - protein, 35 aa, Staphylococcus
FVDMPVGALWRRGHKPMKAQGLEYVETLSNYVKTN

SEQ ID NO: 2012886 - protein, 17 aa, Staphylococcus
FVDTPIIVISARTEEQT

SEQ ID NO: 2012887 - protein, 17 aa, Staphylococcus
FVDVETMLTLLDLSNIY

SEQ ID NO: 2012888 - protein, 24 aa, Staphylococcus
FVDYAEFCFKEFPEVNFWTTFNEI

SEQ ID NO: 2012889 - protein, 32 aa, Staphylococcus
FVEAYRLLSKLVLRMKAFDEFEFTSSSVGMEE

SEQ ID NO: 2012890 - protein, 20 aa, Staphylococcus
FVEDSGRGYRRVVPSPMPIN

SEQ ID NO: 2012891 - protein, 18 aa, Staphylococcus
FVEDVFLHEGEVKEDEIK

SEQ ID NO: 2012892 - protein, 17 aa, Staphylococcus
FVEEALDGMVERYQPKD

SEQ ID NO: 2012893 - protein, 18 aa, Staphylococcus
FVEGAYLYYLGSFIDSDS

SEQ ID NO: 2012894 - protein, 24 aa, Staphylococcus
FVELADDFQILFVLPLWHKEDKYP

SEQ ID NO: 2012895 - protein, 22 aa, Staphylococcus
FVETWHGLPMKKMVNDLNNKKE

SEQ ID NO: 2012896 - protein, 17 aa, Staphylococcus
FVFEVFDSVAGQIARTR

SEQ ID NO: 2012897 - protein, 17 aa, Staphylococcus
FVFEVFDSVAGQLARTR

SEQ ID NO: 2012898 - protein, 17 aa, Staphylococcus
FVFVLDYYRHNLINEDV

SEQ ID NO: 2012899 - protein, 17 aa, Staphylococcus
FVFVLDYYRHSLVNEKV

SEQ ID NO: 2012900 - protein, 18 aa, Staphylococcus
FVGEHSRYDLMHVQTDRH

SEQ ID NO: 2012901 - protein, 18 aa, Staphylococcus
FVGEHSRYDLMLIQTDRH

SEQ ID NO: 2012902 - protein, 19 aa, Staphylococcus
FVGEHSRYDLMLVQTDRHY

SEQ ID NO: 2012903 - protein, 18 aa, Staphylococcus
FVGMGVPKQEEWIQKNES

SEQ ID NO: 2012904 - protein, 18 aa, Staphylococcus
FVGPNCGFYTATHPLKYN

SEQ ID NO: 2012905 - protein, 18 aa, Staphylococcus
FVGQPLWGSIGYTLPATI

SEQ ID NO: 2012906 - protein, 23 aa, Staphylococcus
FVHIEYYKDGWLENITVKIKNID

SEQ ID NO: 2012907 - protein, 17 aa, Staphylococcus
FVHRNHRNELWFEMSKK

SEQ ID NO: 2012908 - protein, 26 aa, Staphylococcus
FVIAGHYRNGILLSPLIGELMSQWII

SEQ ID NO: 2012909 - protein, 19 aa, Staphylococcus
FVIQGGSHPLPSIQEAFKK

SEQ ID NO: 2012910 - protein, 25 aa, Staphylococcus
FVITCPLDNGLELFIGVPSDRYPSH

SEQ ID NO: 2012911 - protein, 23 aa, Staphylococcus
FVKDTLVFTGIFKMFYISEDENH

SEQ ID NO: 2012912 - protein, 22 aa, Staphylococcus
FVKEELTHLLSITDTVVSRAGS

SEQ ID NO: 2012913 - protein, 18 aa, Staphylococcus
FVKESAEAGIDVFRIFDS

SEQ ID NO: 2012914 - protein, 22 aa, Staphylococcus
FVKIIPEEQVYLAVTVWTAGLR

SEQ ID NO: 2012915 - protein, 21 aa, Staphylococcus
FVKKGDWSLQQLVDYLTIKPA

SEQ ID NO: 2012916 - protein, 18 aa, Staphylococcus
FVKNPMDIVSVGDIVDVW

SEQ ID NO: 2012917 - protein, 22 aa, Staphylococcus
FVKRAFIGSFLFGGNYMSNKFK

SEQ ID NO: 2012918 - protein, 26 aa, Staphylococcus
FVKYAESFGAKGLRVSNQEELEAAIK

SEQ ID NO: 2012919 - protein, 26 aa, Staphylococcus
FVKYAESFGAKGLRVTNQEELEAAIK

SEQ ID NO: 2012920 - protein, 17 aa, Staphylococcus
FVLDEAKAAIEKVETGF

SEQ ID NO: 2012921 - protein, 21 aa, Staphylococcus
FVLGSGMSSKAYGSRSGIINS

SEQ ID NO: 2012922 - protein, 22 aa, Staphylococcus
FVLLKKYFKNAIPRVGDVVKVI

SEQ ID NO: 2012923 - protein, 18 aa, Staphylococcus
FVLNENVTTQLGFKALKQ

SEQ ID NO: 2012924 - protein, 17 aa, Staphylococcus
FVLSFILNDYKKMRTSY

SEQ ID NO: 2012925 - protein, 17 aa, Staphylococcus
FVLTLIGKPQFLILDEP

SEQ ID NO: 2012926 - protein, 23 aa, Staphylococcus
FVMLGHLHHPFSINEDTIKYSGS

SEQ ID NO: 2012927 - protein, 17 aa, Staphylococcus
FVNCLKDNVNKALKSIN

SEQ ID NO: 2012928 - protein, 17 aa, Staphylococcus
FVNESPYEKAWMVKVEI

SEQ ID NO: 2012929 - protein, 22 aa, Staphylococcus
FVNGKRAVPFDCIAQDHKRAYD

SEQ ID NO: 2012930 - protein, 19 aa, Staphylococcus
FVNRTALIEKCWESENYID

SEQ ID NO: 2012931 - protein, 17 aa, Staphylococcus
FVPHFTIAQGLTSQEFE

SEQ ID NO: 2012932 - protein, 24 aa, Staphylococcus
FVPKANLYEVIKYVSQDTASIGIV

SEQ ID NO: 2012933 - protein, 25 aa, Staphylococcus
FVQNLDCLIYAAGQSLYGMVQDMDD

SEQ ID NO: 2012934 - protein, 24 aa, Staphylococcus
FVQWKSPIIRLIYEIIDASNQSIR

SEQ ID NO: 2012935 - protein, 20 aa, Staphylococcus
FVSNTFFTVEKWDISEHLTL

SEQ ID NO: 2012936 - protein, 25 aa, Staphylococcus
FVSWTKKRYGFTFPQEHLVFSHGIV

SEQ ID NO: 2012937 - protein, 20 aa, Staphylococcus
FVTELIKVYQFDYVIHLAAM

SEQ ID NO: 2012938 - protein, 20 aa, Staphylococcus
FVTSGLRLGTPAATTRGFEE

SEQ ID NO: 2012939 - protein, 25 aa, Staphylococcus
FVTTLPFRIDFRDCQTIKEDLIPII

SEQ ID NO: 2012940 - protein, 18 aa, Staphylococcus
FVVLMMDGVPCFLDNKWS

SEQ ID NO: 2012941 - protein, 24 aa, Staphylococcus
FVVNCPLDEGMEIFVGVPSERYPS

SEQ ID NO: 2012942 - protein, 18 aa, Staphylococcus
FVVNGMLIRKDFYSYVRT

SEQ ID NO: 2012943 - protein, 20 aa, Staphylococcus
FVVPTMLYQFILKGLHTAEI

SEQ ID NO: 2012944 - protein, 24 aa, Staphylococcus
FVWFKDALDGYDFLVDKGYDEIVV

SEQ ID NO: 2012945 - protein, 17 aa, Staphylococcus
FVWWFATQPEFDGQGYG

SEQ ID NO: 2012946 - protein, 19 aa, Staphylococcus
FVYERRLPFHAERFHNWLE

SEQ ID NO: 2012947 - protein, 26 aa, Staphylococcus
FVYGLFIYNQWRGMGTLNSIDVINQH

SEQ ID NO: 2012948 - protein, 20 aa, Staphylococcus
FVYKVAAMDFIFKDDPAELK

SEQ ID NO: 2012949 - protein, 22 aa, Staphylococcus
FVYKVAAMDFIFKDDPDELKSR

SEQ ID NO: 2012950 - protein, 20 aa, Staphylococcus
FVYKVAAMDFIFKDDPSELK

SEQ ID NO: 2012951 - protein, 22 aa, Staphylococcus
FVYKVAAMDFIFKDDPSEMKSR

SEQ ID NO: 2012952 - protein, 25 aa, Staphylococcus
FVYSRRLPFHAKRFNDWLEQIPNNI

SEQ ID NO: 2012953 - protein, 25 aa, Staphylococcus
FVYSRRLPFHAKRFNDWLEQMPQNI

SEQ ID NO: 2012954 - protein, 23 aa, Staphylococcus
FWERHIQEIKKSVTVEEIRKNGY

SEQ ID NO: 2012955 - protein, 23 aa, Staphylococcus
FWERYKKEIKKSITVEEIKKNSY

SEQ ID NO: 2012956 - protein, 19 aa, Staphylococcus
FWKDGKMAYYFIKDDKIKD

SEQ ID NO: 2012957 - protein, 18 aa, Staphylococcus
FWNVVNWNKVDELYEAAT

SEQ ID NO: 2012958 - protein, 20 aa, Staphylococcus
FWQKVIRKLIYDNEVLIVVT

SEQ ID NO: 2012959 - protein, 18 aa, Staphylococcus
FYATPRKPAVHHTMGGLS

SEQ ID NO: 2012960 - protein, 23 aa, Staphylococcus
FYAVDWPTLRLVPDEDRIQIVQE

SEQ ID NO: 2012961 - protein, 28 aa, Staphylococcus
FYDACIKANIKPIFGMTVNVTDGLYTIE

SEQ ID NO: 2012962 - protein, 17 aa, Staphylococcus
FYDDLIIKNHKYSQFPL

SEQ ID NO: 2012963 - protein, 18 aa, Staphylococcus
FYDFNLQLPKIFNEATLL

SEQ ID NO: 2012964 - protein, 19 aa, Staphylococcus
FYDKYDLLIYLIKLLTKDY

SEQ ID NO: 2012965 - protein, 24 aa, Staphylococcus
FYDLSELGAIMIKAATKEARYGNE

SEQ ID NO: 2012966 - protein, 20 aa, Staphylococcus
FYDMSVGICHNGNLINAESL

SEQ ID NO: 2012967 - protein, 23 aa, Staphylococcus
FYDNSLEFLALFEKLSLEMNDVM

SEQ ID NO: 2012968 - protein, 23 aa, Staphylococcus
FYDNSLEFLALFEKLSLEMNDVV

SEQ ID NO: 2012969 - protein, 17 aa, Staphylococcus
FYEAFVLNSNEKLESSR

SEQ ID NO: 2012970 - protein, 17 aa, Staphylococcus
FYEEFILHSHEKLKSSL

SEQ ID NO: 2012971 - protein, 19 aa, Staphylococcus
FYEGINFASAYKVPAIFVI

SEQ ID NO: 2012972 - protein, 19 aa, Staphylococcus
FYEIGWRLIPEVWGNGIAT

SEQ ID NO: 2012973 - protein, 17 aa, Staphylococcus
FYEKPSVRRKKKSEAAR

SEQ ID NO: 2012974 - protein, 21 aa, Staphylococcus
FYELLKMDNLTEQRKNDYIDT

SEQ ID NO: 2012975 - protein, 27 aa, Staphylococcus
FYESDFWRFQQTKVIYNRRLNGYQLIN

SEQ ID NO: 2012976 - protein, 24 aa, Staphylococcus
FYESHFWRSNHTKIVYNYQLGGYE

SEQ ID NO: 2012977 - protein, 18 aa, Staphylococcus
FYESRGFVETGHHEFITG

SEQ ID NO: 2012978 - protein, 18 aa, Staphylococcus
FYETLKAQGARVIQIDTT

SEQ ID NO: 2012979 - protein, 19 aa, Staphylococcus
FYEVIHLYKKMAAQISRVQ

SEQ ID NO: 2012980 - protein, 17 aa, Staphylococcus
FYFDIFQYAHSFVTLQV

SEQ ID NO: 2012981 - protein, 29 aa, Staphylococcus
FYFDNPFRFGATVGRYGGRISNATFNLEG

SEQ ID NO: 2012982 - protein, 28 aa, Staphylococcus
FYFENPFNFGATIGRYAGRIKDASFKLD

SEQ ID NO: 2012983 - protein, 22 aa, Staphylococcus
FYFTEFDFHKALSKQELLESID

SEQ ID NO: 2012984 - protein, 17 aa, Staphylococcus
FYGCLFATVDGFNVKSF

SEQ ID NO: 2012985 - protein, 23 aa, Staphylococcus
FYGEVFKVNKHCLIPRPETEEVM

SEQ ID NO: 2012986 - protein, 24 aa, Staphylococcus
FYGKSIQSSPDFGRIVNQKHFNRL

SEQ ID NO: 2012987 - protein, 18 aa, Staphylococcus
FYGVGGFDLLFDKYGDVY

SEQ ID NO: 2012988 - protein, 18 aa, Staphylococcus
FYHFKYPYADGDGYIEIA

SEQ ID NO: 2012989 - protein, 19 aa, Staphylococcus
FYHFKYPYADGDGYIEIAT

SEQ ID NO: 2012990 - protein, 20 aa, Staphylococcus
FYHFKYPYADGDGYIEIATT

SEQ ID NO: 2012991 - protein, 19 aa, Staphylococcus
FYHFKYPYADGEGYIEIAT

SEQ ID NO: 2012992 - protein, 19 aa, Staphylococcus
FYHFKYPYADGNGYIEIAT

SEQ ID NO: 2012993 - protein, 19 aa, Staphylococcus
FYHFNPNWHIIGITYDDID

SEQ ID NO: 2012994 - protein, 17 aa, Staphylococcus
FYHFNPNWHIIGVTYEK

SEQ ID NO: 2012995 - protein, 18 aa, Staphylococcus
FYHIPFPDKYRGMFEQPN

SEQ ID NO: 2012996 - protein, 19 aa, Staphylococcus
FYHIPFPDKYRGMFEQSKS

SEQ ID NO: 2012997 - protein, 18 aa, Staphylococcus
FYHIPFPDKYRGMFEQST

SEQ ID NO: 2012998 - protein, 17 aa, Staphylococcus
FYHIPFPDNYRGMFEQP

SEQ ID NO: 2012999 - protein, 18 aa, Staphylococcus
FYHIPFPDNYRGMFGSNQ

SEQ ID NO: 2013000 - protein, 27 aa, Staphylococcus
FYHQLFRLLEDMRVFNFIKVDRPSTAK

SEQ ID NO: 2013001 - protein, 18 aa, Staphylococcus
FYIEAVATFPEYRGQGIA

SEQ ID NO: 2013002 - protein, 17 aa, Staphylococcus
FYIKIPMVGHVNSLNAS

SEQ ID NO: 2013003 - protein, 17 aa, Staphylococcus
FYINIPMVGHVNSLNAS

SEQ ID NO: 2013004 - protein, 29 aa, Staphylococcus
FYISEVNPRFGGGYPHAYLSGCNFPQFIL

SEQ ID NO: 2013005 - protein, 18 aa, Staphylococcus
FYKAGVMSYYGPAVLTDF

SEQ ID NO: 2013006 - protein, 17 aa, Staphylococcus
FYKDGKMAYYFIKDDEI

SEQ ID NO: 2013007 - protein, 18 aa, Staphylococcus
FYKEGKMAYYFIKDDEIR

SEQ ID NO: 2013008 - protein, 24 aa, Staphylococcus
FYKFYFNLLDKWCMSNDNYYIYLD

SEQ ID NO: 2013009 - protein, 22 aa, Staphylococcus
FYKGLRFFAFYNLSGFKTFSNS

SEQ ID NO: 2013010 - protein, 24 aa, Staphylococcus
FYKSDVCILHKPFINVEPLSFNLN

SEQ ID NO: 2013011 - protein, 22 aa, Staphylococcus
FYLAMAPKFFGVISDYLKSSGL

SEQ ID NO: 2013012 - protein, 20 aa, Staphylococcus
FYLAMAPNFFGVVTDYLKSS

SEQ ID NO: 2013013 - protein, 22 aa, Staphylococcus
FYLAMAPQFFGIISDFLKTSGL

SEQ ID NO: 2013014 - protein, 32 aa, Staphylococcus
FYLKPFLKTKIKGWVRELLWMSIYQYVYLDKV

SEQ ID NO: 2013015 - protein, 31 aa, Staphylococcus
FYLNNPLKFGATIGRYSGRIEAGAFKLNQDR

SEQ ID NO: 2013016 - protein, 31 aa, Staphylococcus
FYLRISTLPLSLGIESCVIRIIPQYFQAKKE

SEQ ID NO: 2013017 - protein, 17 aa, Staphylococcus
FYLSMYVSNQAAIASGR

SEQ ID NO: 2013018 - protein, 21 aa, Staphylococcus
FYMNCTKNAILPIALDRKERE

SEQ ID NO: 2013019 - protein, 18 aa, Staphylococcus
FYMNCTKNAMLPITLDKE

SEQ ID NO: 2013020 - protein, 19 aa, Staphylococcus
FYMNCTKNAMLPIVLDKEA

SEQ ID NO: 2013021 - protein, 19 aa, Staphylococcus
FYMNCTKNAMLPIVLDKPS

SEQ ID NO: 2013022 - protein, 25 aa, Staphylococcus
FYMNCTKNGLLPIVLPEDVRHKLAQ

SEQ ID NO: 2013023 - protein, 20 aa, Staphylococcus
FYMNCTKNGMLPIVLNEQSR

SEQ ID NO: 2013024 - protein, 23 aa, Staphylococcus
FYNRFCTFEKGIASKTIVDKFFK

SEQ ID NO: 2013025 - protein, 18 aa, Staphylococcus
FYNYDPFEQSSINTQALE

SEQ ID NO: 2013026 - protein, 24 aa, Staphylococcus
FYPHYRAQQFFQEYLADAELSHVN

SEQ ID NO: 2013027 - protein, 23 aa, Staphylococcus
FYPLGKDATGFIMYNPDGYMSAQ

SEQ ID NO: 2013028 - protein, 27 aa, Staphylococcus
FYPTILKRVCEVFKINMDKPFKKLTDR

SEQ ID NO: 2013029 - protein, 17 aa, Staphylococcus
FYQEFSLEHPVYQLIDR

SEQ ID NO: 2013030 - protein, 19 aa, Staphylococcus
FYQFILKLPQNVFRLKGFV

SEQ ID NO: 2013031 - protein, 21 aa, Staphylococcus
FYQKFGYNFKDGVSIVDEEGI

SEQ ID NO: 2013032 - protein, 18 aa, Staphylococcus
FYQPKPGTDLVWLGAATK

SEQ ID NO: 2013033 - protein, 19 aa, Staphylococcus
FYQQPKFIQYWVKQINKTL

SEQ ID NO: 2013034 - protein, 19 aa, Staphylococcus
FYQRPIAAVSVYIAKNGNY

SEQ ID NO: 2013035 - protein, 26 aa, Staphylococcus
FYQSLKAQGKKAKWIDTTELDFVNHP

SEQ ID NO: 2013036 - protein, 19 aa, Staphylococcus
FYRLHHSYKKKVVMARFNN

SEQ ID NO: 2013037 - protein, 18 aa, Staphylococcus
FYRMKNFDNNQLLQGMLS

SEQ ID NO: 2013038 - protein, 17 aa, Staphylococcus
FYRRSIGGAATELHQYL

SEQ ID NO: 2013039 - protein, 25 aa, Staphylococcus
FYSDFKREHMVFPGMVYISHPTEYG

SEQ ID NO: 2013040 - protein, 18 aa, Staphylococcus
FYSGLRGMRVRIIDIQDK

SEQ ID NO: 2013041 - protein, 19 aa, Staphylococcus
FYSRQTFRKIMEEYIDQTG

SEQ ID NO: 2013042 - protein, 17 aa, Staphylococcus
FYSSGVIEVLRRWVEND

SEQ ID NO: 2013043 - protein, 18 aa, Staphylococcus
FYSSGVIEVLRRWVENDY

SEQ ID NO: 2013044 - protein, 18 aa, Staphylococcus
FYSTYSIRYSIMGHVHFR

SEQ ID NO: 2013045 - protein, 19 aa, Staphylococcus
FYTETRVTFDPTFEEDTFF

SEQ ID NO: 2013046 - protein, 17 aa, Staphylococcus
FYTFKLMKHNVLPSLLL

SEQ ID NO: 2013047 - protein, 17 aa, Staphylococcus
FYTNDVRFLNQFKAVED

SEQ ID NO: 2013048 - protein, 18 aa, Staphylococcus
FYTNDVRFLSQFKAVEDR

SEQ ID NO: 2013049 - protein, 18 aa, Staphylococcus
FYVDMAKLAEARQVDPNK

SEQ ID NO: 2013050 - protein, 24 aa, Staphylococcus
FYYFKEAHPYFDQNVVVIGGKNSA

SEQ ID NO: 2013051 - protein, 30 aa, Staphylococcus
FYYNRFKHFKDRVLVPLAYIDFDEYIEELN

SEQ ID NO: 2013052 - protein, 19 aa, Staphylococcus
FYYSDIIGCTVFDDEQQPI

SEQ ID NO: 2013053 - protein, 18 aa, Staphylococcus
FYYSDIIGCTVFNNDTPI

SEQ ID NO: 2013054 - protein, 18 aa, Staphylococcus
FYYYAILREGLYRIADTS

SEQ ID NO: 2013055 - protein, 20 aa, Staphylococcus
GAAASNHFEGGAFVRSNDQV

SEQ ID NO: 2013056 - protein, 20 aa, Staphylococcus
GAAASNHFEGGAFVRSNNQV

SEQ ID NO: 2013057 - protein, 20 aa, Staphylococcus
GAAASNHFEGGGFVRSNEDV

SEQ ID NO: 2013058 - protein, 20 aa, Staphylococcus
GAAASNHFEGGGFVRSNNEV

SEQ ID NO: 2013059 - protein, 25 aa, Staphylococcus
GAADMKSGLAALAIALIEIKESNQL

SEQ ID NO: 2013060 - protein, 25 aa, Staphylococcus
GAADMKSGLAALAIALIEMHDAQLL

SEQ ID NO: 2013061 - protein, 25 aa, Staphylococcus
GAADMKSGLAALVLSLIDIHDQGLL

SEQ ID NO: 2013062 - protein, 18 aa, Staphylococcus
GAALAMSILDYTRALGAL

SEQ ID NO: 2013063 - protein, 18 aa, Staphylococcus
GAANFGFDTAWVNRNQNL

SEQ ID NO: 2013064 - protein, 17 aa, Staphylococcus
GAANLALISGDPDLLNG

SEQ ID NO: 2013065 - protein, 24 aa, Staphylococcus
GAASRLVEVGDIVIIMTYAQLNEK

SEQ ID NO: 2013066 - protein, 18 aa, Staphylococcus
GAATAKLLGERGANVVVN

SEQ ID NO: 2013067 - protein, 21 aa, Staphylococcus
GAAYLAGLAVDFWEDKKDIAD

SEQ ID NO: 2013068 - protein, 25 aa, Staphylococcus
GACPECHGKGIIKTELAFMPDFSQT

SEQ ID NO: 2013069 - protein, 26 aa, Staphylococcus
GACPECNGKGVLKTELAFMPDFSQVC

SEQ ID NO: 2013070 - protein, 26 aa, Staphylococcus
GACPQCHGKGVLKTELAFMPDFTQIC

SEQ ID NO: 2013071 - protein, 20 aa, Staphylococcus
GACPTCDGLGQRLTVDMDLV

SEQ ID NO: 2013072 - protein, 18 aa, Staphylococcus
GADGLIFHPYLAGERAPL

SEQ ID NO: 2013073 - protein, 25 aa, Staphylococcus
GADIKKEYYVGFVIDRATDRVTLMA

SEQ ID NO: 2013074 - protein, 24 aa, Staphylococcus
GADKITYMPTWRPWEEAEVFNGHI

SEQ ID NO: 2013075 - protein, 19 aa, Staphylococcus
GADLIIGKIVKYHIQDDVY

SEQ ID NO: 2013076 - protein, 23 aa, Staphylococcus
GADLLKETLPFIIDGSNESIPQD

SEQ ID NO: 2013077 - protein, 18 aa, Staphylococcus
GADLVVHPERDMGRRIAH

SEQ ID NO: 2013078 - protein, 19 aa, Staphylococcus
GADTLRLYEMFMGPLDAAI

SEQ ID NO: 2013079 - protein, 20 aa, Staphylococcus
GADTLRLYEMFMGPLDAAIA

SEQ ID NO: 2013080 - protein, 25 aa, Staphylococcus
GADVKRTVKAEGMIGAQQVARQYAE

SEQ ID NO: 2013081 - protein, 24 aa, Staphylococcus
GAEFLQKFNGGMGILLGGVPGVPK

SEQ ID NO: 2013082 - protein, 17 aa, Staphylococcus
GAEIVGLLGNGSAYYAP

SEQ ID NO: 2013083 - protein, 33 aa, Staphylococcus
GAEKRLEFYRLYLFMVHLLKFGGMYANSVNRSM

SEQ ID NO: 2013084 - protein, 17 aa, Staphylococcus
GAELSKVFHYFKEAHPY

SEQ ID NO: 2013085 - protein, 23 aa, Staphylococcus
GAENIEFKMLCMGFKRKEIKELM

SEQ ID NO: 2013086 - protein, 19 aa, Staphylococcus
GAEPLYFLDYIAANKVVPE

SEQ ID NO: 2013087 - protein, 17 aa, Staphylococcus
GAEPLYFLDYIATNKVV

SEQ ID NO: 2013088 - protein, 27 aa, Staphylococcus
GAESFKEALRWGAEIFHNLKSILSERG

SEQ ID NO: 2013089 - protein, 27 aa, Staphylococcus
GAESFKESLRWGAEIFHNLKSILKNRG

SEQ ID NO: 2013090 - protein, 27 aa, Staphylococcus
GAESFKESLRWGAEIFHNLKSILSERG

SEQ ID NO: 2013091 - protein, 27 aa, Staphylococcus
GAESFKESLRWGAEIFHNLKSILSKRG

SEQ ID NO: 2013092 - protein, 19 aa, Staphylococcus
GAESFKIWTGETADTKAMK

SEQ ID NO: 2013093 - protein, 17 aa, Staphylococcus
GAEVIRTDQTLGMAGAQ

SEQ ID NO: 2013094 - protein, 22 aa, Staphylococcus
GAEVLGVVAIFTYGLAKADEMF

SEQ ID NO: 2013095 - protein, 18 aa, Staphylococcus
GAEYDIFVLVATDILNSD

SEQ ID NO: 2013096 - protein, 18 aa, Staphylococcus
GAFAKHPRYQAGGSSKVN

SEQ ID NO: 2013097 - protein, 26 aa, Staphylococcus
GAFEKYPIEAVFGIHVMPFENEGRVV

SEQ ID NO: 2013098 - protein, 24 aa, Staphylococcus
GAFGEALGAIIVRSKKLNEGEAIL

SEQ ID NO: 2013099 - protein, 25 aa, Staphylococcus
GAFYRPKAVIYDLNFLETLPYTEVL

SEQ ID NO: 2013100 - protein, 28 aa, Staphylococcus
GAFYRPKAVIYDLNFLKTLPYHEILSGY

SEQ ID NO: 2013101 - protein, 24 aa, Staphylococcus
GAGFPSIPLKIVFPELKVTIVDSL

SEQ ID NO: 2013102 - protein, 25 aa, Staphylococcus
GAGFPSIPLKIVYPALKVTIVDSLN

SEQ ID NO: 2013103 - protein, 18 aa, Staphylococcus
GAGFPSIPLKVVYPELKV

SEQ ID NO: 2013104 - protein, 18 aa, Staphylococcus
GAGIPAFYTATGVGTEIA

SEQ ID NO: 2013105 - protein, 19 aa, Staphylococcus
GAGIPAFYTKTGVGTPIAE

SEQ ID NO: 2013106 - protein, 17 aa, Staphylococcus
GAGPIGLLTIVAAKAAG

SEQ ID NO: 2013107 - protein, 17 aa, Staphylococcus
GAGTVKHFGLQDKIDFQ

SEQ ID NO: 2013108 - protein, 26 aa, Staphylococcus
GAGVVKEYPIIPGIDLAGTVVESNSS

SEQ ID NO: 2013109 - protein, 17 aa, Staphylococcus
GAHPGLPDLKGFGRRKM

SEQ ID NO: 2013110 - protein, 24 aa, Staphylococcus
GAHTVVWNGPMGVFEFSNFAQGTI

SEQ ID NO: 2013111 - protein, 28 aa, Staphylococcus
GAHVIKYIRRLDFSGIHPKLAEANIQVM

SEQ ID NO: 2013112 - protein, 17 aa, Staphylococcus
GAIAKGYFADELQAFFL

SEQ ID NO: 2013113 - protein, 18 aa, Staphylococcus
GAIGIVRLSGKEAVEITD

SEQ ID NO: 2013114 - protein, 27 aa, Staphylococcus
GAIGWTPAFYRQWREALNKVGIGRPNY

SEQ ID NO: 2013115 - protein, 20 aa, Staphylococcus
GAIIKPNIPVIYAVKNDEAL

SEQ ID NO: 2013116 - protein, 22 aa, Staphylococcus
GAIKGRQVIINKFAVELNKDIY

SEQ ID NO: 2013117 - protein, 17 aa, Staphylococcus
GAIQEKTFRAGEKVEPA

SEQ ID NO: 2013118 - protein, 19 aa, Staphylococcus
GAIQQVIDYCYQEKLIDHD

SEQ ID NO: 2013119 - protein, 21 aa, Staphylococcus
GAIRFYTKHQFEIRSKEFEVE

SEQ ID NO: 2013120 - protein, 22 aa, Staphylococcus
GAISAGCKFMAAYPITPASEIM

SEQ ID NO: 2013121 - protein, 18 aa, Staphylococcus
GAIVKYDVAFGLENHSVP

SEQ ID NO: 2013122 - protein, 24 aa, Staphylococcus
GAKAFKMKFGHRGANHPVKDLRTG

SEQ ID NO: 2013123 - protein, 23 aa, Staphylococcus
GAKIIKKRMLVFGNGPNIEMFEF

SEQ ID NO: 2013124 - protein, 22 aa, Staphylococcus
GAKIIKKRMMIFGNGPNIELFE

SEQ ID NO: 2013125 - protein, 25 aa, Staphylococcus
GAKIIKKRMMVFGHGPNIEMFEFKD

SEQ ID NO: 2013126 - protein, 25 aa, Staphylococcus
GAKIMALMGLEIIKNQTLFDEIVEE

SEQ ID NO: 2013127 - protein, 23 aa, Staphylococcus
GAKIVEFGGWAMPVQFSSIKEEH

SEQ ID NO: 2013128 - protein, 18 aa, Staphylococcus
GAKIVRQRMIVIGEGANI

SEQ ID NO: 2013129 - protein, 18 aa, Staphylococcus
GAKLMVDMAHIAGLVATG

SEQ ID NO: 2013130 - protein, 25 aa, Staphylococcus
GAKLRKGMTPETAIAYSSEFANNIK

SEQ ID NO: 2013131 - protein, 21 aa, Staphylococcus
GAKNIRFMCLIAAPEGVEKMK

SEQ ID NO: 2013132 - protein, 18 aa, Staphylococcus
GAKTFAFVGGDYSKKAQE

SEQ ID NO: 2013133 - protein, 20 aa, Staphylococcus
GALEMMIFDILQSHRSELNL

SEQ ID NO: 2013134 - protein, 18 aa, Staphylococcus
GALFLASNLASYVHGTTL

SEQ ID NO: 2013135 - protein, 17 aa, Staphylococcus
GALGDYQLIDGLGPEEE

SEQ ID NO: 2013136 - protein, 17 aa, Staphylococcus
GALGDYQLIDGLGPEVE

SEQ ID NO: 2013137 - protein, 24 aa, Staphylococcus
GALGERALKYIIPDTTEFPYTVRI

SEQ ID NO: 2013138 - protein, 18 aa, Staphylococcus
GALGIECRSDDKELLELL

SEQ ID NO: 2013139 - protein, 20 aa, Staphylococcus
GALGIGIANRIMMLENSTYS

SEQ ID NO: 2013140 - protein, 18 aa, Staphylococcus
GALGNKTKQGFYKKVNKK

SEQ ID NO: 2013141 - protein, 21 aa, Staphylococcus
GALHYTPRAKKVIELSMDEAR

SEQ ID NO: 2013142 - protein, 28 aa, Staphylococcus
GALKRLIEGSSFSTGWIFFINAEGIQEM

SEQ ID NO: 2013143 - protein, 19 aa, Staphylococcus
GALLHNDMHLFVSRNESLK

SEQ ID NO: 2013144 - protein, 24 aa, Staphylococcus
GALLKLDFITHSYPHDWRTKKPVI

SEQ ID NO: 2013145 - protein, 18 aa, Staphylococcus
GALNLKREYINQVKSEIY

SEQ ID NO: 2013146 - protein, 17 aa, Staphylococcus
GAMDIGWVAYNEELEKF

SEQ ID NO: 2013147 - protein, 24 aa, Staphylococcus
GAMFGVVPKALWTKKYEVNDKNQI

SEQ ID NO: 2013148 - protein, 24 aa, Staphylococcus
GAMMTYRIMLLFEPYFRENNLIFV

SEQ ID NO: 2013149 - protein, 17 aa, Staphylococcus
GAMSEYQLIDGLGTEEE

SEQ ID NO: 2013150 - protein, 22 aa, Staphylococcus
GANAIYEFLTLNIPMLLIPLGL

SEQ ID NO: 2013151 - protein, 20 aa, Staphylococcus
GANFEKLKAFGLEHKVKEIH

SEQ ID NO: 2013152 - protein, 22 aa, Staphylococcus
GANFEKLKPFGLEHKVKDIHYA

SEQ ID NO: 2013153 - protein, 21 aa, Staphylococcus
GANFEKLKPFGLEHKVKEIHK

SEQ ID NO: 2013154 - protein, 19 aa, Staphylococcus
GANFEKLKTFGLEHRVKEI

SEQ ID NO: 2013155 - protein, 18 aa, Staphylococcus
GANFEKLQTFGLEHQVKD

SEQ ID NO: 2013156 - protein, 23 aa, Staphylococcus
GANIRVGFLYNPNRVQFDSKIKP

SEQ ID NO: 2013157 - protein, 30 aa, Staphylococcus
GANIYRHWSDYFPATNVMRVLYPGRESRFS

SEQ ID NO: 2013158 - protein, 25 aa, Staphylococcus
GANPFPKEWRMHAFFMDALPILNES

SEQ ID NO: 2013159 - protein, 22 aa, Staphylococcus
GANRLIKAGAFEKYPIEAVFGI

SEQ ID NO: 2013160 - protein, 17 aa, Staphylococcus
GANRLIKAGAFNNYPIE

SEQ ID NO: 2013161 - protein, 29 aa, Staphylococcus
GANVKGYFLWSLMDVFSWSNGYEKRYGLF

SEQ ID NO: 2013162 - protein, 21 aa, Staphylococcus
GANYRLLNVTIKQTEEQKFPN

SEQ ID NO: 2013163 - protein, 25 aa, Staphylococcus
GAPKPRLPFEHVFHKNVYNSNAKEQ

SEQ ID NO: 2013164 - protein, 24 aa, Staphylococcus
GAPKPRLPFESVFHENEYNQDKAE

SEQ ID NO: 2013165 - protein, 25 aa, Staphylococcus
GAPLKRGAATIAMLGKVPILPAAYV

SEQ ID NO: 2013166 - protein, 25 aa, Staphylococcus
GAPLKRGASTIAMLGKAPILPAAYV

SEQ ID NO: 2013167 - protein, 19 aa, Staphylococcus
GAPNYKPLPIVISEAEGIW

SEQ ID NO: 2013168 - protein, 26 aa, Staphylococcus
GAQALTCYYGGRVIQGKSVMHGKVDQ

SEQ ID NO: 2013169 - protein, 20 aa, Staphylococcus
GAQALTCYYGGRVIQSDTVM

SEQ ID NO: 2013170 - protein, 19 aa, Staphylococcus
GAQGVQMGTAFLISDESAA

SEQ ID NO: 2013171 - protein, 18 aa, Staphylococcus
GAQGVQMGTAFLTTEESG

SEQ ID NO: 2013172 - protein, 24 aa, Staphylococcus
GAQNKIRVEFKFNEELKSLTTDYL

SEQ ID NO: 2013173 - protein, 23 aa, Staphylococcus
GAQNKIRVEFKFNETLNPLTTDY

SEQ ID NO: 2013174 - protein, 33 aa, Staphylococcus
GAQNKIRVTFRFDELLKPLTIDFLKRSEALDYR

SEQ ID NO: 2013175 - protein, 18 aa, Staphylococcus
GARIVCWKYHDNNIVLGN

SEQ ID NO: 2013176 - protein, 18 aa, Staphylococcus
GARLQFKSGGALYYNRLM

SEQ ID NO: 2013177 - protein, 25 aa, Staphylococcus
GASDMKSGLAAFVISMIELHEQGLP

SEQ ID NO: 2013178 - protein, 17 aa, Staphylococcus
GASFSLIQLEMVTKILL

SEQ ID NO: 2013179 - protein, 22 aa, Staphylococcus
GASGPLYGFSFVKMSQVVNEEI

SEQ ID NO: 2013180 - protein, 23 aa, Staphylococcus
GASGPLYGFSFVKMSSVVKDEID

SEQ ID NO: 2013181 - protein, 18 aa, Staphylococcus
GASGTRLVTTLVNILTQE

SEQ ID NO: 2013182 - protein, 18 aa, Staphylococcus
GASIFKQLQRFFNGEDKE

SEQ ID NO: 2013183 - protein, 23 aa, Staphylococcus
GASIIHKRMMVFGNGPNIEMFEF

SEQ ID NO: 2013184 - protein, 17 aa, Staphylococcus
GASKIFVFDLSEERLEK

SEQ ID NO: 2013185 - protein, 19 aa, Staphylococcus
GASLVQIYSALVFEGPGLT

SEQ ID NO: 2013186 - protein, 25 aa, Staphylococcus
GASQYRKDFCKNFLSEVKVAVIKGN

SEQ ID NO: 2013187 - protein, 31 aa, Staphylococcus
GASRGLGSVIARTLVAKGFQVVINYNQSQTA

SEQ ID NO: 2013188 - protein, 24 aa, Staphylococcus
GASSFKMKFGHRGANHPVKDLRTG

SEQ ID NO: 2013189 - protein, 24 aa, Staphylococcus
GASTHPGAGVPIVLTSAKITAEAM

SEQ ID NO: 2013190 - protein, 20 aa, Staphylococcus
GATALSIGWHLSVVGQLYEQ

SEQ ID NO: 2013191 - protein, 18 aa, Staphylococcus
GATGYLIPTIVKWLQQLT

SEQ ID NO: 2013192 - protein, 17 aa, Staphylococcus
GATIAVSYCDVSTGELK

SEQ ID NO: 2013193 - protein, 19 aa, Staphylococcus
GATMGRFSQEIDRDIRKQL

SEQ ID NO: 2013194 - protein, 24 aa, Staphylococcus
GATSFKMKFGHRGANHPVKDLATG

SEQ ID NO: 2013195 - protein, 24 aa, Staphylococcus
GATSFKMKFGHRGANHPVKDLKTG

SEQ ID NO: 2013196 - protein, 24 aa, Staphylococcus
GATSFKMKFGHRGANHPVKDLRTG

SEQ ID NO: 2013197 - protein, 24 aa, Staphylococcus
GATSFKMKFGHRGANHPVKNLRTG

SEQ ID NO: 2013198 - protein, 19 aa, Staphylococcus
GATVIKHIVKNTGIDSNEI

SEQ ID NO: 2013199 - protein, 18 aa, Staphylococcus
GAVAMLISHNPRILTLND

SEQ ID NO: 2013200 - protein, 19 aa, Staphylococcus
GAVAMLISHQPRILQLNND

SEQ ID NO: 2013201 - protein, 23 aa, Staphylococcus
GAVESRGFITGKFTKELRKEQYT

SEQ ID NO: 2013202 - protein, 20 aa, Staphylococcus
GAVFVNCARGSLVDTQALIS

SEQ ID NO: 2013203 - protein, 18 aa, Staphylococcus
GAVKLITKRDFFLEPDRD

SEQ ID NO: 2013204 - protein, 22 aa, Staphylococcus
GAVKRISYKILQQAKRAQRGIT

SEQ ID NO: 2013205 - protein, 18 aa, Staphylococcus
GAVKSRGVIANKFAVELN

SEQ ID NO: 2013206 - protein, 19 aa, Staphylococcus
GAVNLFKSAGFQIEGELKD

SEQ ID NO: 2013207 - protein, 25 aa, Staphylococcus
GAVNWSCAKPNLLNVAVTRAKKEFY

SEQ ID NO: 2013208 - protein, 26 aa, Staphylococcus
GAVPGLWPHIRLLNQDWIDGGMTSPA

SEQ ID NO: 2013209 - protein, 33 aa, Staphylococcus
GAVVAWNFPILLASWKLAPALAAGNTIVIQPSS

SEQ ID NO: 2013210 - protein, 19 aa, Staphylococcus
GAYFEGMFGKACPTFEEIF

SEQ ID NO: 2013211 - protein, 29 aa, Staphylococcus
GAYKRTKGIYQFDQFRLAIDHVQVDPFAP

SEQ ID NO: 2013212 - protein, 18 aa, Staphylococcus
GAYLKTKDGRGFYGANVE

SEQ ID NO: 2013213 - protein, 23 aa, Staphylococcus
GAYYKGYCSDITRTFAIGEPNPK

SEQ ID NO: 2013214 - protein, 26 aa, Staphylococcus
GCAGGIARPAAAHALHYDKLPDRLVT

SEQ ID NO: 2013215 - protein, 26 aa, Staphylococcus
GCAGGIARPAATHALHYDKLPDRLVT

SEQ ID NO: 2013216 - protein, 20 aa, Staphylococcus
GCDGIHPGYGFLAENGDFAE

SEQ ID NO: 2013217 - protein, 23 aa, Staphylococcus
GCDYHCSWCDSKFTWDGSAKDQI

SEQ ID NO: 2013218 - protein, 24 aa, Staphylococcus
GCDYRCSWCDSAFTWDGSAKDDIE

SEQ ID NO: 2013219 - protein, 24 aa, Staphylococcus
GCDYRCSWCDSAFTWDGSAKEDIK

SEQ ID NO: 2013220 - protein, 24 aa, Staphylococcus
GCDYRCSWCDSAFTWDGSAKEDIQ

SEQ ID NO: 2013221 - protein, 24 aa, Staphylococcus
GCDYRCSWCDSAFTWDGSAKEDIR

SEQ ID NO: 2013222 - protein, 24 aa, Staphylococcus
GCDYRCSWCDSSFTWDGSAKEDIR

SEQ ID NO: 2013223 - protein, 23 aa, Staphylococcus
GCDYRCSWCDSVFTWDGSAKDQI

SEQ ID NO: 2013224 - protein, 17 aa, Staphylococcus
GCEYVDVSETLAIDRAK

SEQ ID NO: 2013225 - protein, 29 aa, Staphylococcus
GCFWCMVKPFISYPGIKSVVSGYSGGHVE

SEQ ID NO: 2013226 - protein, 22 aa, Staphylococcus
GCFWCMVKPFTSYPGIEDVVSG

SEQ ID NO: 2013227 - protein, 23 aa, Staphylococcus
GCFWCMVKPFTSYPGIEDVVSGY

SEQ ID NO: 2013228 - protein, 23 aa, Staphylococcus
GCFWCMVKPFTSYPGIEEVVSGY

SEQ ID NO: 2013229 - protein, 22 aa, Staphylococcus
GCFWCMVKPFTSYPGIESVVSG

SEQ ID NO: 2013230 - protein, 18 aa, Staphylococcus
GCGAPLQSEDKSAPGYVP

SEQ ID NO: 2013231 - protein, 18 aa, Staphylococcus
GCGAPLQSEDPKKPGYVP

SEQ ID NO: 2013232 - protein, 17 aa, Staphylococcus
GCGAPLQSENKNAPGYV

SEQ ID NO: 2013233 - protein, 20 aa, Staphylococcus
GCGKSTLLKALSRLLPVKNG

SEQ ID NO: 2013234 - protein, 17 aa, Staphylococcus
GCGKSTLLKALSRLLSI

SEQ ID NO: 2013235 - protein, 22 aa, Staphylococcus
GCGKSTLLKALSRLLSIKKGQI

SEQ ID NO: 2013236 - protein, 21 aa, Staphylococcus
GCGKSTLLKALSRLLSVKDGT

SEQ ID NO: 2013237 - protein, 21 aa, Staphylococcus
GCGKSTLLKALSRLLSVKNGE

SEQ ID NO: 2013238 - protein, 21 aa, Staphylococcus
GCGKSTLLKALSRLLTIKNGE

SEQ ID NO: 2013239 - protein, 25 aa, Staphylococcus
GCINELRIGETLFRGVDTTTNENIP

SEQ ID NO: 2013240 - protein, 22 aa, Staphylococcus
GCITRPFPTGVRITIGFPEQND

SEQ ID NO: 2013241 - protein, 27 aa, Staphylococcus
GCLQNCGICSNGLYALVDGDIVEGDTP

SEQ ID NO: 2013242 - protein, 21 aa, Staphylococcus
GCLWATEAFFKTIPGVINTEA

SEQ ID NO: 2013243 - protein, 17 aa, Staphylococcus
GCLWGVQAFFKTIPGIV

SEQ ID NO: 2013244 - protein, 19 aa, Staphylococcus
GCLWGVQAFIKTLPGVLST

SEQ ID NO: 2013245 - protein, 18 aa, Staphylococcus
GCLWGVQAFVKTLPGVIN

SEQ ID NO: 2013246 - protein, 26 aa, Staphylococcus
GCMYKAHLPTLIYIPGQLVLNGHTLV

SEQ ID NO: 2013247 - protein, 25 aa, Staphylococcus
GCPNGCARPALAEISFIGKAPGKYN

SEQ ID NO: 2013248 - protein, 25 aa, Staphylococcus
GCPNGCARPALAEVAFIGKAPGKYN

SEQ ID NO: 2013249 - protein, 25 aa, Staphylococcus
GCPNGCARPALAEVAFIGKGPGKYN

SEQ ID NO: 2013250 - protein, 17 aa, Staphylococcus
GCQTGFYVSFIDHDDYE

SEQ ID NO: 2013251 - protein, 17 aa, Staphylococcus
GCQTGFYVSFINHDDYN

SEQ ID NO: 2013252 - protein, 18 aa, Staphylococcus
GCQYVDITETLAIERAKE

SEQ ID NO: 2013253 - protein, 24 aa, Staphylococcus
GCQYVLSVASPVFFEIPDDESEVI

SEQ ID NO: 2013254 - protein, 24 aa, Staphylococcus
GCSKYPECDFVTWDKPIGRDCPKC

SEQ ID NO: 2013255 - protein, 20 aa, Staphylococcus
GCTHYPLLYKPINDYFGGNK

SEQ ID NO: 2013256 - protein, 21 aa, Staphylococcus
GCTHYPLLYKPIYDYFDGEKT

SEQ ID NO: 2013257 - protein, 19 aa, Staphylococcus
GCTHYPLLYQPINDYFGGE

SEQ ID NO: 2013258 - protein, 19 aa, Staphylococcus
GCTHYPLLYQPINDYFGGK

SEQ ID NO: 2013259 - protein, 20 aa, Staphylococcus
GCTHYPLLYQPLNDYFGGDK

SEQ ID NO: 2013260 - protein, 23 aa, Staphylococcus
GDAAHLMSPFAGEGVNMAFYDAY

SEQ ID NO: 2013261 - protein, 23 aa, Staphylococcus
GDAAHLMSPFAGEGVNMALYDAY

SEQ ID NO: 2013262 - protein, 26 aa, Staphylococcus
GDAFAARSQYALGIDFKEAPPWFQVS

SEQ ID NO: 2013263 - protein, 24 aa, Staphylococcus
GDAFAGRSQYALDIDFKQEPPWFK

SEQ ID NO: 2013264 - protein, 21 aa, Staphylococcus
GDAFIGAAISRMLLSDELNIT

SEQ ID NO: 2013265 - protein, 21 aa, Staphylococcus
GDAFIGAVISRLLLAEDTPVT

SEQ ID NO: 2013266 - protein, 18 aa, Staphylococcus
GDAGITFEAFLEKAAIAS

SEQ ID NO: 2013267 - protein, 17 aa, Staphylococcus
GDALFRIIQAVEQGATN

SEQ ID NO: 2013268 - protein, 21 aa, Staphylococcus
GDALIITGSLYFISEVKAKVN

SEQ ID NO: 2013269 - protein, 17 aa, Staphylococcus
GDANPILLIDEDDVEAG

SEQ ID NO: 2013270 - protein, 19 aa, Staphylococcus
GDANVFIFPSLEAGNIGYK

SEQ ID NO: 2013271 - protein, 30 aa, Staphylococcus
GDARFAYDCYRRLLQMFGEVVYNVPMQAFD

SEQ ID NO: 2013272 - protein, 29 aa, Staphylococcus
GDARFAYDCYRRLLQMFGQVVYGIPMNAF

SEQ ID NO: 2013273 - protein, 18 aa, Staphylococcus
GDASLGLNRLVHQAGAET

SEQ ID NO: 2013274 - protein, 23 aa, Staphylococcus
GDATAVPLLLGLGLDEFSMSPTS

SEQ ID NO: 2013275 - protein, 20 aa, Staphylococcus
GDAYLEIQRIYFLPHAQGGG

SEQ ID NO: 2013276 - protein, 19 aa, Staphylococcus
GDCNIKFKSFLLENEIIDE

SEQ ID NO: 2013277 - protein, 17 aa, Staphylococcus
GDDLQYTMTVTFEEAVF

SEQ ID NO: 2013278 - protein, 18 aa, Staphylococcus
GDDRAMASASKMLNSVNR

SEQ ID NO: 2013279 - protein, 23 aa, Staphylococcus
GDDRPEYRKLSAKMLATTLHLLQ

SEQ ID NO: 2013280 - protein, 31 aa, Staphylococcus
GDDVLLRRIYKLPIGFKWENQSNLTLIGDAA

SEQ ID NO: 2013281 - protein, 28 aa, Staphylococcus
GDEAAIFAGDLFRMYSKYAETLNYKTDI

SEQ ID NO: 2013282 - protein, 29 aa, Staphylococcus
GDEAAIFAGDLMRMYSKYAEAHNFKTEIV

SEQ ID NO: 2013283 - protein, 35 aa, Staphylococcus
GDEAAIFAGDLMRMYSKYAEAYGFKTEIVEASESD

SEQ ID NO: 2013284 - protein, 28 aa, Staphylococcus
GDEAAIFAGDLMRMYTKYAEANGFRTEV

SEQ ID NO: 2013285 - protein, 18 aa, Staphylococcus
GDEAFDRLIGFVELDHLY

SEQ ID NO: 2013286 - protein, 20 aa, Staphylococcus
GDEATWFALMNHLVQVSIDY

SEQ ID NO: 2013287 - protein, 29 aa, Staphylococcus
GDEDREMLRWCKNKYPDVKIIKALPADDT

SEQ ID NO: 2013288 - protein, 25 aa, Staphylococcus
GDEIAIPLLLGLGLDEFSMSATSVL

SEQ ID NO: 2013289 - protein, 22 aa, Staphylococcus
GDEILKSAGIEVVYQHEVEAEK

SEQ ID NO: 2013290 - protein, 22 aa, Staphylococcus
GDEKGDAFALVKPHKVNSAMKL

SEQ ID NO: 2013291 - protein, 19 aa, Staphylococcus
GDELGIVWIDTHPDISYPK

SEQ ID NO: 2013292 - protein, 21 aa, Staphylococcus
GDEPTWFALMDHLVDVSITYV

SEQ ID NO: 2013293 - protein, 26 aa, Staphylococcus
GDERAELALDIFASRIHKYIGSYAAR

SEQ ID NO: 2013294 - protein, 32 aa, Staphylococcus
GDETIDFIKQLRLNFKNIKIIKALPATQNIIN

SEQ ID NO: 2013295 - protein, 18 aa, Staphylococcus
GDEVLRYGTSPLVGKPIA

SEQ ID NO: 2013296 - protein, 20 aa, Staphylococcus
GDFALKLSLNRDVEGIVTMC

SEQ ID NO: 2013297 - protein, 17 aa, Staphylococcus
GDFAYADGYEFENLDAN

SEQ ID NO: 2013298 - protein, 17 aa, Staphylococcus
GDFEIPKQLGHQIGIRR

SEQ ID NO: 2013299 - protein, 17 aa, Staphylococcus
GDFGEALHDGNFCVDGI

SEQ ID NO: 2013300 - protein, 24 aa, Staphylococcus
GDFGYELLRLKGFYKDSNKKAEIS

SEQ ID NO: 2013301 - protein, 28 aa, Staphylococcus
GDFHELDHGFDFYAPQTFLDEQGQRILI

SEQ ID NO: 2013302 - protein, 23 aa, Staphylococcus
GDFKPPLNVYFSGYRTAEGFEGF

SEQ ID NO: 2013303 - protein, 25 aa, Staphylococcus
GDFTLELVQRCNFVTAIEIDHKLCK

SEQ ID NO: 2013304 - protein, 19 aa, Staphylococcus
GDGAGGWIDLSRGINTPYS

SEQ ID NO: 2013305 - protein, 22 aa, Staphylococcus
GDGCGECPACQLRANGLNAYLA

SEQ ID NO: 2013306 - protein, 22 aa, Staphylococcus
GDGCGECPACQLRQRGLQHYLE

SEQ ID NO: 2013307 - protein, 23 aa, Staphylococcus
GDGDHGVNMLRGFKSLKDKIDDS

SEQ ID NO: 2013308 - protein, 21 aa, Staphylococcus
GDGDHGVTMNIGYQAVKHTIQ

SEQ ID NO: 2013309 - protein, 20 aa, Staphylococcus
GDGNLGYITAILLSKLYPQA

SEQ ID NO: 2013310 - protein, 25 aa, Staphylococcus
GDGTIKFALTQSHLFSKAAPLSAVF

SEQ ID NO: 2013311 - protein, 19 aa, Staphylococcus
GDGVLRTRAKHEATINGKR

SEQ ID NO: 2013312 - protein, 19 aa, Staphylococcus
GDHGVNMVRGFNALTEALE

SEQ ID NO: 2013313 - protein, 19 aa, Staphylococcus
GDHGVTMDIGYQAVKETIQ

SEQ ID NO: 2013314 - protein, 25 aa, Staphylococcus
GDHLDLLSKIAITFSEEENVDRIVN

SEQ ID NO: 2013315 - protein, 17 aa, Staphylococcus
GDHVVCTFIPSCGKCIP

SEQ ID NO: 2013316 - protein, 26 aa, Staphylococcus
GDHYPKAIKPWILPNFESLVNHEKIT

SEQ ID NO: 2013317 - protein, 25 aa, Staphylococcus
GDICDHYNLWLHVDGAYGLSHILSD

SEQ ID NO: 2013318 - protein, 17 aa, Staphylococcus
GDIDLEVIHTYNVDHKW

SEQ ID NO: 2013319 - protein, 19 aa, Staphylococcus
GDIGKAFARRLKGFEANVM

SEQ ID NO: 2013320 - protein, 20 aa, Staphylococcus
GDIGKAFARRLKGFNTKIMY

SEQ ID NO: 2013321 - protein, 20 aa, Staphylococcus
GDIGKSFARRLQGFNTTILY

SEQ ID NO: 2013322 - protein, 19 aa, Staphylococcus
GDIGPFIEAYLRKEMDNEE

SEQ ID NO: 2013323 - protein, 18 aa, Staphylococcus
GDIGPFIEAYLRQQMDQS

SEQ ID NO: 2013324 - protein, 19 aa, Staphylococcus
GDIHIGQKLYILFQKVGVV

SEQ ID NO: 2013325 - protein, 23 aa, Staphylococcus
GDIIKFQSGFFSRSVKVTESNQE

SEQ ID NO: 2013326 - protein, 17 aa, Staphylococcus
GDIIKYCESIKNDKYGS

SEQ ID NO: 2013327 - protein, 18 aa, Staphylococcus
GDIIPEVIKSVLDRRPDD

SEQ ID NO: 2013328 - protein, 18 aa, Staphylococcus
GDIIPEVVKSILDRRPKD

SEQ ID NO: 2013329 - protein, 19 aa, Staphylococcus
GDIKRVVAHLPNFESESDT

SEQ ID NO: 2013330 - protein, 20 aa, Staphylococcus
GDILLQVLLHASIGKKEGYM

SEQ ID NO: 2013331 - protein, 18 aa, Staphylococcus
GDILLQVLLHTSIGKKDG

SEQ ID NO: 2013332 - protein, 19 aa, Staphylococcus
GDILLQVLLHTSIGKKEGY

SEQ ID NO: 2013333 - protein, 19 aa, Staphylococcus
GDILLQVMLHTSIGKKEGY

SEQ ID NO: 2013334 - protein, 18 aa, Staphylococcus
GDIMYGCGQKSQPIESLE

SEQ ID NO: 2013335 - protein, 19 aa, Staphylococcus
GDIPFPYFMSYVSGAGLSL

SEQ ID NO: 2013336 - protein, 17 aa, Staphylococcus
GDIQRVGADIFLCTPDN

SEQ ID NO: 2013337 - protein, 18 aa, Staphylococcus
GDIQRVGSDIFLCTPDNV

SEQ ID NO: 2013338 - protein, 17 aa, Staphylococcus
GDITFRAIETLKDADFI

SEQ ID NO: 2013339 - protein, 20 aa, Staphylococcus
GDIVSSWTGIPVSKLVETER

SEQ ID NO: 2013340 - protein, 24 aa, Staphylococcus
GDKAIEKDGYWFIQGRIDFQIKLN

SEQ ID NO: 2013341 - protein, 17 aa, Staphylococcus
GDKDIKKVIAVPQKLVN

SEQ ID NO: 2013342 - protein, 23 aa, Staphylococcus
GDKEYFKRYAITDSGISPRPIPG

SEQ ID NO: 2013343 - protein, 17 aa, Staphylococcus
GDKFKLNGSHGHKKVSR

SEQ ID NO: 2013344 - protein, 18 aa, Staphylococcus
GDKKGFAYVLDRPLTGRI

SEQ ID NO: 2013345 - protein, 20 aa, Staphylococcus
GDKSLTYWREAHIAFFKPYY

SEQ ID NO: 2013346 - protein, 17 aa, Staphylococcus
GDKVMHKSWGEGMVSNV

SEQ ID NO: 2013347 - protein, 25 aa, Staphylococcus
GDLDVIYGHLSKWLVHEGQRVHPGT

SEQ ID NO: 2013348 - protein, 21 aa, Staphylococcus
GDLFKDFGRQFFEQFPDSTSI

SEQ ID NO: 2013349 - protein, 21 aa, Staphylococcus
GDLHFKIDLVEVAKQFIQYEN

SEQ ID NO: 2013350 - protein, 17 aa, Staphylococcus
GDLPGVIEKLDYFKDLG

SEQ ID NO: 2013351 - protein, 17 aa, Staphylococcus
GDLRKPLILNQKYGLGI

SEQ ID NO: 2013352 - protein, 17 aa, Staphylococcus
GDLRREQNLNIKRLMEI

SEQ ID NO: 2013353 - protein, 25 aa, Staphylococcus
GDLYLCEVFGGRVFKVDVAKKKLST

SEQ ID NO: 2013354 - protein, 18 aa, Staphylococcus
GDMEYGFADMEIYEQITP

SEQ ID NO: 2013355 - protein, 19 aa, Staphylococcus
GDMIDYWMGATPMGRPGEP

SEQ ID NO: 2013356 - protein, 18 aa, Staphylococcus
GDMLFQLFQHYRTENVHE

SEQ ID NO: 2013357 - protein, 17 aa, Staphylococcus
GDMTDFSFNNEFDVITI

SEQ ID NO: 2013358 - protein, 18 aa, Staphylococcus
GDMTFKLLPDLAPKTVEN

SEQ ID NO: 2013359 - protein, 23 aa, Staphylococcus
GDNCGVASFKIAEDGELTLINKC

SEQ ID NO: 2013360 - protein, 21 aa, Staphylococcus
GDNCGYSFAFEATRDHTRLAV

SEQ ID NO: 2013361 - protein, 17 aa, Staphylococcus
GDNFDVLIGKNFETARF

SEQ ID NO: 2013362 - protein, 28 aa, Staphylococcus
GDNGDSRFYLSLQDELMVRFGSERLQKM

SEQ ID NO: 2013363 - protein, 24 aa, Staphylococcus
GDNGFGYDPIFYVPSLNKTMAQLS

SEQ ID NO: 2013364 - protein, 18 aa, Staphylococcus
GDNIGALLRGVSRDDVQR

SEQ ID NO: 2013365 - protein, 22 aa, Staphylococcus
GDPAIFIKFKYTDFTTFLEYTN

SEQ ID NO: 2013366 - protein, 22 aa, Staphylococcus
GDPDLLTIKGLKAIKKADVILY

SEQ ID NO: 2013367 - protein, 20 aa, Staphylococcus
GDPLLKFDLDYIKENAKSVV

SEQ ID NO: 2013368 - protein, 20 aa, Staphylococcus
GDPLVKFNLEYISNNAKSVI

SEQ ID NO: 2013369 - protein, 19 aa, Staphylococcus
GDPRANLKRVLKEMEDMGF

SEQ ID NO: 2013370 - protein, 20 aa, Staphylococcus
GDQATLFAGCGIVKDSDPDS

SEQ ID NO: 2013371 - protein, 20 aa, Staphylococcus
GDQATLFAGCGIVKNSDPDS

SEQ ID NO: 2013372 - protein, 18 aa, Staphylococcus
GDQGRIWNDGTIEFLGRI

SEQ ID NO: 2013373 - protein, 20 aa, Staphylococcus
GDQIRCRLRSKGITINDIAN

SEQ ID NO: 2013374 - protein, 21 aa, Staphylococcus
GDQIRCRLRSKGQYVINDIAN

SEQ ID NO: 2013375 - protein, 17 aa, Staphylococcus
GDRFIVESIDRLGRNYD

SEQ ID NO: 2013376 - protein, 17 aa, Staphylococcus
GDRKVLCAMSGGVDSSV

SEQ ID NO: 2013377 - protein, 24 aa, Staphylococcus
GDRMYEFLDKLIAVSLPRVRDFHG

SEQ ID NO: 2013378 - protein, 24 aa, Staphylococcus
GDRYDVGEKLGFVKTTIEYALKDE

SEQ ID NO: 2013379 - protein, 24 aa, Staphylococcus
GDRYDVGEKLGFVKTTIEYALKDQ

SEQ ID NO: 2013380 - protein, 23 aa, Staphylococcus
GDRYRSTPELSFAVRYLNADAGV

SEQ ID NO: 2013381 - protein, 18 aa, Staphylococcus
GDSELAVWSQANIAGQPL

SEQ ID NO: 2013382 - protein, 19 aa, Staphylococcus
GDSELAVWSQTSIAGQNLY

SEQ ID NO: 2013383 - protein, 18 aa, Staphylococcus
GDSFTFDKVLFVGGDAVK

SEQ ID NO: 2013384 - protein, 23 aa, Staphylococcus
GDSFTSAVIYSWLNDFSLQDIIK

SEQ ID NO: 2013385 - protein, 27 aa, Staphylococcus
GDSGIGRSVAILFAKEGANVAIGYYDE

SEQ ID NO: 2013386 - protein, 18 aa, Staphylococcus
GDSIAVYPPQTLKQEEMT

SEQ ID NO: 2013387 - protein, 24 aa, Staphylococcus
GDSIKNIQIISALRKKNYVLSTND

SEQ ID NO: 2013388 - protein, 22 aa, Staphylococcus
GDSKPDWEIFQLIANKLGADWD

SEQ ID NO: 2013389 - protein, 23 aa, Staphylococcus
GDSKPDWEIFQLIAQRMGADWNY

SEQ ID NO: 2013390 - protein, 33 aa, Staphylococcus
GDSKPDWKIFQLIANRLGFNWNYKHPSEIMDEI

SEQ ID NO: 2013391 - protein, 21 aa, Staphylococcus
GDSKPDWVIFQMIAKEFGFDW

SEQ ID NO: 2013392 - protein, 22 aa, Staphylococcus
GDSLNWLKRTMFDDESFDDIVQ

SEQ ID NO: 2013393 - protein, 30 aa, Staphylococcus
GDTEGRYGTFAKYFTKNDVPAFAICHGPQI

SEQ ID NO: 2013394 - protein, 26 aa, Staphylococcus
GDTFAEMAIKVAHYLDIDEISFGSES

SEQ ID NO: 2013395 - protein, 25 aa, Staphylococcus
GDTFFPPYTFEDWEVESSVEGQLDE

SEQ ID NO: 2013396 - protein, 23 aa, Staphylococcus
GDTFFPPYTFEDWTVASSEEGQL

SEQ ID NO: 2013397 - protein, 25 aa, Staphylococcus
GDTFFPPYTFEEWEVESSVDGELDE

SEQ ID NO: 2013398 - protein, 25 aa, Staphylococcus
GDTFFPPYTFEEWEVESSVEGKLDE

SEQ ID NO: 2013399 - protein, 25 aa, Staphylococcus
GDTFFPPYTFENWEVESAVKGELDD

SEQ ID NO: 2013400 - protein, 24 aa, Staphylococcus
GDTFFPPYTFKDWEVASSNKGVLD

SEQ ID NO: 2013401 - protein, 17 aa, Staphylococcus
GDTIGIIGGGQLGKMMA

SEQ ID NO: 2013402 - protein, 17 aa, Staphylococcus
GDTIGIIGGGQLGKMMT

SEQ ID NO: 2013403 - protein, 23 aa, Staphylococcus
GDTKPCPNEHIIANDADIMVHEA

SEQ ID NO: 2013404 - protein, 17 aa, Staphylococcus
GDTKVIDFCPIDQIKAF

SEQ ID NO: 2013405 - protein, 29 aa, Staphylococcus
GDTLKPLPAYWIPFAQQLFQNWTDMMEKN

SEQ ID NO: 2013406 - protein, 17 aa, Staphylococcus
GDTLLIKMERSIETYEV

SEQ ID NO: 2013407 - protein, 18 aa, Staphylococcus
GDTLPIYLKKNPNFKFPF

SEQ ID NO: 2013408 - protein, 22 aa, Staphylococcus
GDTPEFHHYYAIGKQTATVLKN

SEQ ID NO: 2013409 - protein, 17 aa, Staphylococcus
GDTPLVIPMNNDKSIIK

SEQ ID NO: 2013410 - protein, 19 aa, Staphylococcus
GDTRGGAALSIRSVTDNAY

SEQ ID NO: 2013411 - protein, 19 aa, Staphylococcus
GDTVRPALQIIKTKPGVSR

SEQ ID NO: 2013412 - protein, 18 aa, Staphylococcus
GDVDDIRESPALDIYHLL

SEQ ID NO: 2013413 - protein, 18 aa, Staphylococcus
GDVKRYVGNYEQFIEQRD

SEQ ID NO: 2013414 - protein, 17 aa, Staphylococcus
GDVLALTHDSARKAGRI

SEQ ID NO: 2013415 - protein, 18 aa, Staphylococcus
GDVPRVKEALNISMNTVL

SEQ ID NO: 2013416 - protein, 32 aa, Staphylococcus
GDVRFAYDCYRRLLQMFGEVVYNIPMVAFDTY

SEQ ID NO: 2013417 - protein, 19 aa, Staphylococcus
GDVSSHVYFEVKFPKLDIE

SEQ ID NO: 2013418 - protein, 19 aa, Staphylococcus
GDVVFRKGDKVLQLVNRPS

SEQ ID NO: 2013419 - protein, 17 aa, Staphylococcus
GDVVKVIDDLMGLNVDL

SEQ ID NO: 2013420 - protein, 21 aa, Staphylococcus
GDYDAVITLGCVIRGATSHYD

SEQ ID NO: 2013421 - protein, 25 aa, Staphylococcus
GDYDFLPKIYKAIQAEVLFNKIAMR

SEQ ID NO: 2013422 - protein, 17 aa, Staphylococcus
GDYEKRVTYGLSGSDAN

SEQ ID NO: 2013423 - protein, 26 aa, Staphylococcus
GDYFKKEAIEFAWEFLTSDKWMAMEP

SEQ ID NO: 2013424 - protein, 26 aa, Staphylococcus
GDYFKKEAIEFAWEFLTSDKWMGMEP

SEQ ID NO: 2013425 - protein, 27 aa, Staphylococcus
GDYFKKEAIHFAWEFLTSENWMGMEPE

SEQ ID NO: 2013426 - protein, 24 aa, Staphylococcus
GDYFPHRLGHGLGLEEHEYQDVSS

SEQ ID NO: 2013427 - protein, 17 aa, Staphylococcus
GDYGKILLIGGSANMGG

SEQ ID NO: 2013428 - protein, 24 aa, Staphylococcus
GDYIAMQIIQHWTKVNKYNDTKEK

SEQ ID NO: 2013429 - protein, 19 aa, Staphylococcus
GDYKNILVVGADKLSKITD

SEQ ID NO: 2013430 - protein, 23 aa, Staphylococcus
GDYPAWELGLQIIREDQEFDFDF

SEQ ID NO: 2013431 - protein, 25 aa, Staphylococcus
GDYPEWELGLQIIKPEQEFDFDFDI

SEQ ID NO: 2013432 - protein, 22 aa, Staphylococcus
GDYPKWKMYIQVMTEEQAKNHK

SEQ ID NO: 2013433 - protein, 22 aa, Staphylococcus
GDYPKWKMYIQVMTEEQARNHK

SEQ ID NO: 2013434 - protein, 23 aa, Staphylococcus
GDYRRVALYGIDFLMEEKLNDYN

SEQ ID NO: 2013435 - protein, 24 aa, Staphylococcus
GDYRRVALYGVDFLMEEKLKDFNT

SEQ ID NO: 2013436 - protein, 23 aa, Staphylococcus
GDYRRVALYGVDFLMEQKLHDFH

SEQ ID NO: 2013437 - protein, 17 aa, Staphylococcus
GDYRVKSPYVGRFNISN

SEQ ID NO: 2013438 - protein, 23 aa, Staphylococcus
GEAADLKFHLAIAKAAQNSMLFD

SEQ ID NO: 2013439 - protein, 19 aa, Staphylococcus
GEAFIKYLNENNIPDLVLL

SEQ ID NO: 2013440 - protein, 25 aa, Staphylococcus
GEAFNVKLDDGMAFLTGVVSRKKQV

SEQ ID NO: 2013441 - protein, 17 aa, Staphylococcus
GEAIAWHLSKILELEDS

SEQ ID NO: 2013442 - protein, 20 aa, Staphylococcus
GEAICRRLAEDGFKVGVADY

SEQ ID NO: 2013443 - protein, 20 aa, Staphylococcus
GEAIKAYLSIAPKNTILITD

SEQ ID NO: 2013444 - protein, 20 aa, Staphylococcus
GEAIKAYLSIAPKNTVLITD

SEQ ID NO: 2013445 - protein, 18 aa, Staphylococcus
GEAIRLVRTNVELFENLE

SEQ ID NO: 2013446 - protein, 18 aa, Staphylococcus
GEAIRYIEKLGFDAIHEH

SEQ ID NO: 2013447 - protein, 29 aa, Staphylococcus
GEAKFAEGIEVGQVFKLGTKYSETMNATF

SEQ ID NO: 2013448 - protein, 17 aa, Staphylococcus
GEALIVEGVNFKELNRY

SEQ ID NO: 2013449 - protein, 20 aa, Staphylococcus
GEALLFLLGLTNSMAGFEKL

SEQ ID NO: 2013450 - protein, 17 aa, Staphylococcus
GEAMFRIVEAVEQGGTQ

SEQ ID NO: 2013451 - protein, 21 aa, Staphylococcus
GEAQTGITIMYMVKKLDAGNI

SEQ ID NO: 2013452 - protein, 19 aa, Staphylococcus
GEATGGIAWDNEAQQKTSA

SEQ ID NO: 2013453 - protein, 18 aa, Staphylococcus
GEAVAFATYGSFRDWPAY

SEQ ID NO: 2013454 - protein, 17 aa, Staphylococcus
GEAYNVVPDACEMSIDI

SEQ ID NO: 2013455 - protein, 21 aa, Staphylococcus
GECDACFTGNYPIEIVDHQLP

SEQ ID NO: 2013456 - protein, 28 aa, Staphylococcus
GECEYCKSGKYNLCPDVEFLATPPVDGA

SEQ ID NO: 2013457 - protein, 24 aa, Staphylococcus
GEDKAEFLTAFVINDSAVIGKIRS

SEQ ID NO: 2013458 - protein, 23 aa, Staphylococcus
GEDLRKEKFAVVNADDDFSEYLT

SEQ ID NO: 2013459 - protein, 18 aa, Staphylococcus
GEDYSKLDVISRMYPSPE

SEQ ID NO: 2013460 - protein, 19 aa, Staphylococcus
GEEALKYVDFNSGKIAKQL

SEQ ID NO: 2013461 - protein, 19 aa, Staphylococcus
GEEALNYLTKRGFTEELIK

SEQ ID NO: 2013462 - protein, 24 aa, Staphylococcus
GEEAMMRWFVENDILKVNQETYLY

SEQ ID NO: 2013463 - protein, 19 aa, Staphylococcus
GEEFFWNMMEEINEEEDFV

SEQ ID NO: 2013464 - protein, 18 aa, Staphylococcus
GEEFFWSMMEEINEEEDF

SEQ ID NO: 2013465 - protein, 24 aa, Staphylococcus
GEETEVKSVLGIIGDEGESTESSS

SEQ ID NO: 2013466 - protein, 20 aa, Staphylococcus
GEFDYYIALVLQGSDHYTEN

SEQ ID NO: 2013467 - protein, 20 aa, Staphylococcus
GEFELPFTLSKQQQYASDAI

SEQ ID NO: 2013468 - protein, 22 aa, Staphylococcus
GEFLAGGILSVILNWIQYGQQS

SEQ ID NO: 2013469 - protein, 21 aa, Staphylococcus
GEFSLRGGIIDIYPLIGQPVR

SEQ ID NO: 2013470 - protein, 21 aa, Staphylococcus
GEFSLRGGIIDIYPLIGSPVR

SEQ ID NO: 2013471 - protein, 20 aa, Staphylococcus
GEFSLRGGIVDIYPLIGKPV

SEQ ID NO: 2013472 - protein, 21 aa, Staphylococcus
GEGIKASGIDRSELFVTTKVW

SEQ ID NO: 2013473 - protein, 25 aa, Staphylococcus
GEGISELFKSMGATHIISGGQTMNP

SEQ ID NO: 2013474 - protein, 25 aa, Staphylococcus
GEGISELFTSMGVTHIISGGQTMNP

SEQ ID NO: 2013475 - protein, 17 aa, Staphylococcus
GEGRNASYLANLGYDVM

SEQ ID NO: 2013476 - protein, 21 aa, Staphylococcus
GEGYPVVLIHTAYDNAAIFKD

SEQ ID NO: 2013477 - protein, 20 aa, Staphylococcus
GEHFGDFVVRAGIVEEVRDG

SEQ ID NO: 2013478 - protein, 17 aa, Staphylococcus
GEHGDSELAVWSQANIA

SEQ ID NO: 2013479 - protein, 25 aa, Staphylococcus
GEHKCLDCAFLAAKFPLMNQLYCNY

SEQ ID NO: 2013480 - protein, 25 aa, Staphylococcus
GEHLDLLSKIAITFSEEENVDRIIN

SEQ ID NO: 2013481 - protein, 25 aa, Staphylococcus
GEHLDLLSKIAITFSEEENVERIIN

SEQ ID NO: 2013482 - protein, 24 aa, Staphylococcus
GEHLLKHGLNVFVVQLPKNMDPDE

SEQ ID NO: 2013483 - protein, 25 aa, Staphylococcus
GEHRIKFKVIDHIGAGSVSQKEVGQ

SEQ ID NO: 2013484 - protein, 23 aa, Staphylococcus
GEIAANWEGQAFNRFEEQFQQLS

SEQ ID NO: 2013485 - protein, 23 aa, Staphylococcus
GEIAVRIIRACHELGIQTVAIYS

SEQ ID NO: 2013486 - protein, 24 aa, Staphylococcus
GEIAVRIIRACHELGLQTVAIYSE

SEQ ID NO: 2013487 - protein, 24 aa, Staphylococcus
GEIAVRIIRACKDLGLHTVAIYSE

SEQ ID NO: 2013488 - protein, 25 aa, Staphylococcus
GEIAVRIIRACRELGIETVAIYAKG

SEQ ID NO: 2013489 - protein, 26 aa, Staphylococcus
GEIAVRIIRACRELNIETVAIYAIGD

SEQ ID NO: 2013490 - protein, 25 aa, Staphylococcus
GEIAVRIIRACREMGIETVAVYAKG

SEQ ID NO: 2013491 - protein, 19 aa, Staphylococcus
GEIAVRIIRACRESGVKTV

SEQ ID NO: 2013492 - protein, 20 aa, Staphylococcus
GEICPVCGNEIQSLEKHIDF

SEQ ID NO: 2013493 - protein, 17 aa, Staphylococcus
GEIDAVITMPEFIKEFL

SEQ ID NO: 2013494 - protein, 22 aa, Staphylococcus
GEIDGRTAIIIDDIIDTAGTIT

SEQ ID NO: 2013495 - protein, 17 aa, Staphylococcus
GEIDIGILELTDEIKQH

SEQ ID NO: 2013496 - protein, 18 aa, Staphylococcus
GEIDWCIMEPEMNFTAFL

SEQ ID NO: 2013497 - protein, 19 aa, Staphylococcus
GEIEWRHVETAFIEFEAVF

SEQ ID NO: 2013498 - protein, 23 aa, Staphylococcus
GEIFRVINEFSPKLKLVTENPKA

SEQ ID NO: 2013499 - protein, 18 aa, Staphylococcus
GEIGEQFFNQHPEAKNRN

SEQ ID NO: 2013500 - protein, 18 aa, Staphylococcus
GEIGPFIEAYLRTQMDNR

SEQ ID NO: 2013501 - protein, 19 aa, Staphylococcus
GEIGPFIESYLRYTMNQSD

SEQ ID NO: 2013502 - protein, 20 aa, Staphylococcus
GEIIRLLIQNNINLIAMHTN

SEQ ID NO: 2013503 - protein, 19 aa, Staphylococcus
GEIKFNGKNILNFKNDIGY

SEQ ID NO: 2013504 - protein, 22 aa, Staphylococcus
GEIKIPEFINPEVKFSMISSID

SEQ ID NO: 2013505 - protein, 19 aa, Staphylococcus
GEIKRVIAHLPNFESDTDT

SEQ ID NO: 2013506 - protein, 19 aa, Staphylococcus
GEIKRVIAHLPNFESETDT

SEQ ID NO: 2013507 - protein, 19 aa, Staphylococcus
GEIKRVVAHLPNFESDTDT

SEQ ID NO: 2013508 - protein, 17 aa, Staphylococcus
GEIMPIYDAAMKYKENG

SEQ ID NO: 2013509 - protein, 17 aa, Staphylococcus
GEIRDAYIAKCVIQASL

SEQ ID NO: 2013510 - protein, 21 aa, Staphylococcus
GEISAPIVIGRDHLDSGSVAS

SEQ ID NO: 2013511 - protein, 17 aa, Staphylococcus
GEISLKAIRDYKPLLKG

SEQ ID NO: 2013512 - protein, 17 aa, Staphylococcus
GEISPLFEGNHDNMISS

SEQ ID NO: 2013513 - protein, 19 aa, Staphylococcus
GEITFGANLQIGYYDQKQA

SEQ ID NO: 2013514 - protein, 17 aa, Staphylococcus
GEIYDPFVKPALSKQDF

SEQ ID NO: 2013515 - protein, 19 aa, Staphylococcus
GEIYPPLIPSHGYVGNVKS

SEQ ID NO: 2013516 - protein, 25 aa, Staphylococcus
GEKAFFKKCDDIGVYGVIIPDLPFE

SEQ ID NO: 2013517 - protein, 18 aa, Staphylococcus
GEKEGRLVVGGKVDDEIG

SEQ ID NO: 2013518 - protein, 17 aa, Staphylococcus
GEKFKDEHLPTFDDVVK

SEQ ID NO: 2013519 - protein, 20 aa, Staphylococcus
GEKGDVALFFGLSGTGKTTL

SEQ ID NO: 2013520 - protein, 19 aa, Staphylococcus
GEKGEFYLSMYVSNQAAIA

SEQ ID NO: 2013521 - protein, 20 aa, Staphylococcus
GEKGKVVLVTAMSPTPAGEG

SEQ ID NO: 2013522 - protein, 19 aa, Staphylococcus
GEKHPKVLVGRDTRVSGEM

SEQ ID NO: 2013523 - protein, 17 aa, Staphylococcus
GEKQAAIDLKVILEYGE

SEQ ID NO: 2013524 - protein, 18 aa, Staphylococcus
GEKQGKKLFVYGGAEHPH

SEQ ID NO: 2013525 - protein, 21 aa, Staphylococcus
GEKQLKQGFSPAFNIDNKSDQ

SEQ ID NO: 2013526 - protein, 23 aa, Staphylococcus
GEKQRVAIMRAFMNDPKIILADE

SEQ ID NO: 2013527 - protein, 23 aa, Staphylococcus
GEKQRVAIMRAFMNEPKIILADE

SEQ ID NO: 2013528 - protein, 23 aa, Staphylococcus
GEKQRVAIMRAFMNHPKIILADE

SEQ ID NO: 2013529 - protein, 23 aa, Staphylococcus
GEKQRVAIMRAFMNQPKIILADE

SEQ ID NO: 2013530 - protein, 20 aa, Staphylococcus
GEKQRVAIMRAFTNNPKIIL

SEQ ID NO: 2013531 - protein, 25 aa, Staphylococcus
GEKVKVALCQLILSPFNLLILDEPT

SEQ ID NO: 2013532 - protein, 17 aa, Staphylococcus
GEKVSLIATVPKEQTDK

SEQ ID NO: 2013533 - protein, 27 aa, Staphylococcus
GEKYLPRKFKIGIAVPPSNDIDVFSQD

SEQ ID NO: 2013534 - protein, 20 aa, Staphylococcus
GELDEGLFYKFYFSYNPAKR

SEQ ID NO: 2013535 - protein, 25 aa, Staphylococcus
GELDRYPLAKFKRSNSGTCYNQRPI

SEQ ID NO: 2013536 - protein, 22 aa, Staphylococcus
GELEIPKPYIVFVTLLNTKGKQ

SEQ ID NO: 2013537 - protein, 39 aa, Staphylococcus
GELFATAMNRKGYYLYGYRHFSSRIKGGHTNNKIRVSTS

SEQ ID NO: 2013538 - protein, 24 aa, Staphylococcus
GELIEFKSGVLGLAQNLEESNVGV

SEQ ID NO: 2013539 - protein, 20 aa, Staphylococcus
GELLDAASIKLAGRDITSDI

SEQ ID NO: 2013540 - protein, 18 aa, Staphylococcus
GELLFGDTVAVFGAGPIG

SEQ ID NO: 2013541 - protein, 20 aa, Staphylococcus
GELLGLIGPSGCGKTTTIKC

SEQ ID NO: 2013542 - protein, 18 aa, Staphylococcus
GELLMCDIIEAFIDAKYK

SEQ ID NO: 2013543 - protein, 18 aa, Staphylococcus
GELLMCDIIEAFINAEYK

SEQ ID NO: 2013544 - protein, 20 aa, Staphylococcus
GELNGALGVEKIFNSYLNGK

SEQ ID NO: 2013545 - protein, 20 aa, Staphylococcus
GELNGALGVEKIFNSYLNGQ

SEQ ID NO: 2013546 - protein, 22 aa, Staphylococcus
GELPAMVMTDAIVRLLPGVLGN

SEQ ID NO: 2013547 - protein, 19 aa, Staphylococcus
GELPKGGRRRGNVEMYEEL

SEQ ID NO: 2013548 - protein, 19 aa, Staphylococcus
GELTFFISSMLDLIYEGQN

SEQ ID NO: 2013549 - protein, 25 aa, Staphylococcus
GELTFPSFIKQLLLQIPYFEKNQSQ

SEQ ID NO: 2013550 - protein, 19 aa, Staphylococcus
GELTPVFFGSALANFGVQS

SEQ ID NO: 2013551 - protein, 18 aa, Staphylococcus
GELVRRFEFEDVDKDLIK

SEQ ID NO: 2013552 - protein, 19 aa, Staphylococcus
GELYKDMLINLVDEHLGWR

SEQ ID NO: 2013553 - protein, 23 aa, Staphylococcus
GEMAEKGLIYKGKKPVYWSPSSE

SEQ ID NO: 2013554 - protein, 24 aa, Staphylococcus
GEMALGRNVVVGFMTWDGYNYEDA

SEQ ID NO: 2013555 - protein, 19 aa, Staphylococcus
GEMIDYWMGATPMGRPGEP

SEQ ID NO: 2013556 - protein, 21 aa, Staphylococcus
GEMKKRYGLIHVDRDNDGNGS

SEQ ID NO: 2013557 - protein, 21 aa, Staphylococcus
GEMKKRYGLIHVDRDNKGQGT

SEQ ID NO: 2013558 - protein, 17 aa, Staphylococcus
GEMLSFYDWYADLPPAS

SEQ ID NO: 2013559 - protein, 19 aa, Staphylococcus
GEMNECLILIQKLNDRMVE

SEQ ID NO: 2013560 - protein, 19 aa, Staphylococcus
GEMSIDDWASMSIEDQLEH

SEQ ID NO: 2013561 - protein, 24 aa, Staphylococcus
GENDEVLEFYGLKVLVDKYDVPVL

SEQ ID NO: 2013562 - protein, 24 aa, Staphylococcus
GENDEVLEYFGLKVLVDKYDAPVL

SEQ ID NO: 2013563 - protein, 19 aa, Staphylococcus
GENEAVVQMGIIKMKLPIE

SEQ ID NO: 2013564 - protein, 26 aa, Staphylococcus
GENERYLEVWNLVFSEFNHNKDHSYT

SEQ ID NO: 2013565 - protein, 18 aa, Staphylococcus
GENFPIAIKLNSADFQRG

SEQ ID NO: 2013566 - protein, 17 aa, Staphylococcus
GENGEWTFELPVTETEK

SEQ ID NO: 2013567 - protein, 18 aa, Staphylococcus
GENIYPYEIETIAKTHKE

SEQ ID NO: 2013568 - protein, 19 aa, Staphylococcus
GENIYPYEIETVAKTFNGI

SEQ ID NO: 2013569 - protein, 19 aa, Staphylococcus
GENIYPYQIETVAKQFNEI

SEQ ID NO: 2013570 - protein, 20 aa, Staphylococcus
GENKYEVIRVMKPDDINIQS

SEQ ID NO: 2013571 - protein, 18 aa, Staphylococcus
GENMFDLNTFQVVKNSID

SEQ ID NO: 2013572 - protein, 17 aa, Staphylococcus
GENTFKVSAYRKAAQSL

SEQ ID NO: 2013573 - protein, 24 aa, Staphylococcus
GEPCNECDICKSITQGSNSDVIEI

SEQ ID NO: 2013574 - protein, 19 aa, Staphylococcus
GEPFEPMPKLLAVSEQVTK

SEQ ID NO: 2013575 - protein, 19 aa, Staphylococcus
GEPFEPMPQIMAVSEQVTK

SEQ ID NO: 2013576 - protein, 17 aa, Staphylococcus
GEPFTGHGVTYLQREGL

SEQ ID NO: 2013577 - protein, 24 aa, Staphylococcus
GEPGTRQGDGWAEPYVKDTALFYD

SEQ ID NO: 2013578 - protein, 19 aa, Staphylococcus
GEPHGSGTMEYITVFDGTL

SEQ ID NO: 2013579 - protein, 18 aa, Staphylococcus
GEPIPIIHWEDGSMSTVP

SEQ ID NO: 2013580 - protein, 17 aa, Staphylococcus
GEPIPIIHWEDGTMTTV

SEQ ID NO: 2013581 - protein, 18 aa, Staphylococcus
GEPIPIIHWEDGTMTTVP

SEQ ID NO: 2013582 - protein, 18 aa, Staphylococcus
GEPIPVIHWEDGSMTTVP

SEQ ID NO: 2013583 - protein, 22 aa, Staphylococcus
GEPIRNAILWNDTRTTQQCQSI

SEQ ID NO: 2013584 - protein, 25 aa, Staphylococcus
GEPKPRLPFEHIFHKNSYDASNDKQ

SEQ ID NO: 2013585 - protein, 25 aa, Staphylococcus
GEPLDFAKSGPFIISNHGCYKDILT

SEQ ID NO: 2013586 - protein, 22 aa, Staphylococcus
GEPLDFSKAGPFIISNPGCHKA

SEQ ID NO: 2013587 - protein, 20 aa, Staphylococcus
GEPLDIGYAVTFFASQEAKF

SEQ ID NO: 2013588 - protein, 22 aa, Staphylococcus
GEPMFSKKSIKNIVKPLLKYAK

SEQ ID NO: 2013589 - protein, 27 aa, Staphylococcus
GEPMFSKKSIKNVVKPLLKYAYDRGIY

SEQ ID NO: 2013590 - protein, 27 aa, Staphylococcus
GEPMFSKKSIKNVVKPLLKYAYQRGIY

SEQ ID NO: 2013591 - protein, 19 aa, Staphylococcus
GEPMFSKKSIRNVVKPLLK

SEQ ID NO: 2013592 - protein, 21 aa, Staphylococcus
GEPMVECFKASFEATDDQFLR

SEQ ID NO: 2013593 - protein, 20 aa, Staphylococcus
GEPTYPEFILHDIVQGKDRG

SEQ ID NO: 2013594 - protein, 25 aa, Staphylococcus
GEQKFGLRLPGEFNREDIKQAVNLA

SEQ ID NO: 2013595 - protein, 26 aa, Staphylococcus
GEQKFGLRLPGEFNREDMTKAVTLAH

SEQ ID NO: 2013596 - protein, 23 aa, Staphylococcus
GEQKRLTVGLVLNKQKKLYIFDE

SEQ ID NO: 2013597 - protein, 17 aa, Staphylococcus
GEQMSIFDAAMKYKENG

SEQ ID NO: 2013598 - protein, 24 aa, Staphylococcus
GEQRVSFNVIDHIGAGSVSDKTVG

SEQ ID NO: 2013599 - protein, 17 aa, Staphylococcus
GEQSLICGTRYGNVMAS

SEQ ID NO: 2013600 - protein, 20 aa, Staphylococcus
GEQTKTIAFIIPRHDAYYAS

SEQ ID NO: 2013601 - protein, 17 aa, Staphylococcus
GEQTPGVSFSFDERLTI

SEQ ID NO: 2013602 - protein, 26 aa, Staphylococcus
GERGLKREIIKPVAKIAEELVQTLQK

SEQ ID NO: 2013603 - protein, 17 aa, Staphylococcus
GERIICQIFEDILHVDQ

SEQ ID NO: 2013604 - protein, 24 aa, Staphylococcus
GERMYEFLDKLIAVSLPRVRDFHG

SEQ ID NO: 2013605 - protein, 17 aa, Staphylococcus
GERRFRALQSLQKSHAD

SEQ ID NO: 2013606 - protein, 17 aa, Staphylococcus
GERRFRALQSLSKTHAD

SEQ ID NO: 2013607 - protein, 17 aa, Staphylococcus
GERRRLIDSPKVATYDL

SEQ ID NO: 2013608 - protein, 17 aa, Staphylococcus
GERRSHIIVGEIKTYLS

SEQ ID NO: 2013609 - protein, 17 aa, Staphylococcus
GERSVCYVHSGMSLEEK

SEQ ID NO: 2013610 - protein, 26 aa, Staphylococcus
GERVIVYWHHYLRPEVKFDGIDALVS

SEQ ID NO: 2013611 - protein, 17 aa, Staphylococcus
GESALHYQTKYTIAAMF

SEQ ID NO: 2013612 - protein, 21 aa, Staphylococcus
GESIRFKWISVEDAINESKQF

SEQ ID NO: 2013613 - protein, 21 aa, Staphylococcus
GESKPDWQIMQMIANKMGFDW

SEQ ID NO: 2013614 - protein, 18 aa, Staphylococcus
GESLLTIHSNRENVDDVI

SEQ ID NO: 2013615 - protein, 17 aa, Staphylococcus
GESLTAPLLNHITRNVY

SEQ ID NO: 2013616 - protein, 20 aa, Staphylococcus
GESLTAPVLNQIMLDVYSQF

SEQ ID NO: 2013617 - protein, 20 aa, Staphylococcus
GESRRFERPKAFAEVEGQMF

SEQ ID NO: 2013618 - protein, 27 aa, Staphylococcus
GESSQFSNLEWLGLEWDESVDKDKGYG

SEQ ID NO: 2013619 - protein, 18 aa, Staphylococcus
GESVKSYGNHLNTLKTNM

SEQ ID NO: 2013620 - protein, 20 aa, Staphylococcus
GETDMLWRTYQGINRLKYVF

SEQ ID NO: 2013621 - protein, 24 aa, Staphylococcus
GETEFKIVPLLIFSAMHYLVDIPE

SEQ ID NO: 2013622 - protein, 17 aa, Staphylococcus
GETFKTKSLHITEEEII

SEQ ID NO: 2013623 - protein, 27 aa, Staphylococcus
GETMNLYDIIDEFKALGNYEYDEIENR

SEQ ID NO: 2013624 - protein, 21 aa, Staphylococcus
GETNGVIKMVIDKATHHILGI

SEQ ID NO: 2013625 - protein, 19 aa, Staphylococcus
GEVIAGWTGIPLTKINETE

SEQ ID NO: 2013626 - protein, 27 aa, Staphylococcus
GEVIFPRETMIGSMAYYISHAKNEKNF

SEQ ID NO: 2013627 - protein, 22 aa, Staphylococcus
GEVIKAKPGFNVIAAINEGYVG

SEQ ID NO: 2013628 - protein, 21 aa, Staphylococcus
GEVIPGEYDKIVFRDLPNTLD

SEQ ID NO: 2013629 - protein, 17 aa, Staphylococcus
GEVITFIGRSGSGKTTL

SEQ ID NO: 2013630 - protein, 18 aa, Staphylococcus
GEVKDCIDYALCVNNKGE

SEQ ID NO: 2013631 - protein, 18 aa, Staphylococcus
GEVLGLIGKNGSGKSTLI

SEQ ID NO: 2013632 - protein, 18 aa, Staphylococcus
GEVLIKVHYSGINYKDAL

SEQ ID NO: 2013633 - protein, 18 aa, Staphylococcus
GEVLLQIAKKELFESYGI

SEQ ID NO: 2013634 - protein, 18 aa, Staphylococcus
GEVRDCIEHAVCVNERGE

SEQ ID NO: 2013635 - protein, 18 aa, Staphylococcus
GEVSDPFGGSKSAYLEIY

SEQ ID NO: 2013636 - protein, 24 aa, Staphylococcus
GEVSEGRGIISYEMGSDGNGGKYL

SEQ ID NO: 2013637 - protein, 24 aa, Staphylococcus
GEVSEGRGILSYELGSDGSGAKHL

SEQ ID NO: 2013638 - protein, 23 aa, Staphylococcus
GEVSRIYLNFSDPWPKKRHAKRR

SEQ ID NO: 2013639 - protein, 22 aa, Staphylococcus
GEVVSGFTLDGRYFVSGLNKVD

SEQ ID NO: 2013640 - protein, 19 aa, Staphylococcus
GEVYTIFYEQIYKAVQKQI

SEQ ID NO: 2013641 - protein, 24 aa, Staphylococcus
GEWDLPLVGSGAFELQEKKIGIFG

SEQ ID NO: 2013642 - protein, 17 aa, Staphylococcus
GEWKPVIHDAISHRLVV

SEQ ID NO: 2013643 - protein, 17 aa, Staphylococcus
GEYAKTRMKAWENQHEF

SEQ ID NO: 2013644 - protein, 25 aa, Staphylococcus
GEYASLVAAGVLDFEDAVKIVRKRG

SEQ ID NO: 2013645 - protein, 22 aa, Staphylococcus
GEYDAVITLGCVIRGATSHYDY

SEQ ID NO: 2013646 - protein, 19 aa, Staphylococcus
GEYHIRKPLVIYEATTLLL

SEQ ID NO: 2013647 - protein, 19 aa, Staphylococcus
GEYHRPVVIHRGVVSTMER

SEQ ID NO: 2013648 - protein, 17 aa, Staphylococcus
GEYKLRQAIAHYLFNSR

SEQ ID NO: 2013649 - protein, 17 aa, Staphylococcus
GEYKLSHRVCKNCGSYN

SEQ ID NO: 2013650 - protein, 20 aa, Staphylococcus
GEYRDCYVMGLLKNQWSYSN

SEQ ID NO: 2013651 - protein, 22 aa, Staphylococcus
GEYRDCYVMGLLKRNWVNQHDD

SEQ ID NO: 2013652 - protein, 20 aa, Staphylococcus
GEYVSLVASGVLKFEDAVKI

SEQ ID NO: 2013653 - protein, 18 aa, Staphylococcus
GEYWMCEKHDLYGFQNNV

SEQ ID NO: 2013654 - protein, 25 aa, Staphylococcus
GEYYLPDVISLILAENGVAEVYHTD

SEQ ID NO: 2013655 - protein, 21 aa, Staphylococcus
GEYYLPDVVTLILEDNGKAEV

SEQ ID NO: 2013656 - protein, 19 aa, Staphylococcus
GFAEGKLFLEYLENNEQPD

SEQ ID NO: 2013657 - protein, 25 aa, Staphylococcus
GFAIRQEVLEELGFDFSNSYNPNFD

SEQ ID NO: 2013658 - protein, 33 aa, Staphylococcus
GFAISIGIYRDGKPYAGLVYDVMKDVLYHAKVG

SEQ ID NO: 2013659 - protein, 20 aa, Staphylococcus
GFDDFEWGVTLFADDPLQFK

SEQ ID NO: 2013660 - protein, 20 aa, Staphylococcus
GFDEGHSYSHFLLIEQAITA

SEQ ID NO: 2013661 - protein, 20 aa, Staphylococcus
GFDEGHSYSHYLLIEQAINA

SEQ ID NO: 2013662 - protein, 26 aa, Staphylococcus
GFDEGNRPIGSFLFVGPTGVGKTELA

SEQ ID NO: 2013663 - protein, 27 aa, Staphylococcus
GFDEGNRPIGSFLFVGPTGVGKTELAK

SEQ ID NO: 2013664 - protein, 25 aa, Staphylococcus
GFDGVKGEVLVNAFSKQDVMLSTTS

SEQ ID NO: 2013665 - protein, 18 aa, Staphylococcus
GFDGVLIPGGFSFGDYLR

SEQ ID NO: 2013666 - protein, 19 aa, Staphylococcus
GFDHGYRGNSKYLFNHFIK

SEQ ID NO: 2013667 - protein, 18 aa, Staphylococcus
GFDIKSLLRSGATHQKLK

SEQ ID NO: 2013668 - protein, 24 aa, Staphylococcus
GFDKSEALILLLPYMYKEQEKAKK

SEQ ID NO: 2013669 - protein, 20 aa, Staphylococcus
GFDRTKWYSINYENLNNLVA

SEQ ID NO: 2013670 - protein, 18 aa, Staphylococcus
GFDSLQWPVHEDGTDEPL

SEQ ID NO: 2013671 - protein, 18 aa, Staphylococcus
GFDVPSMHTMYIDKPMKG

SEQ ID NO: 2013672 - protein, 23 aa, Staphylococcus
GFEAYFVGGSVRDYLMNRHIHDI

SEQ ID NO: 2013673 - protein, 22 aa, Staphylococcus
GFEDYRFRLSYRDPEDKEKYFD

SEQ ID NO: 2013674 - protein, 21 aa, Staphylococcus
GFEGLKINIQQIFPKQSLPYN

SEQ ID NO: 2013675 - protein, 27 aa, Staphylococcus
GFGDEVKRRIFLGTFALSSGYYDAFYK

SEQ ID NO: 2013676 - protein, 27 aa, Staphylococcus
GFGDEVKRRIFLGTFALSSGYYDAFYN

SEQ ID NO: 2013677 - protein, 17 aa, Staphylococcus
GFGGGLTWGAIVIKWGK

SEQ ID NO: 2013678 - protein, 26 aa, Staphylococcus
GFGKEVKRRILLGTFALSSGYYDAYY

SEQ ID NO: 2013679 - protein, 19 aa, Staphylococcus
GFGKYHGKYSFYTFTHEKS

SEQ ID NO: 2013680 - protein, 28 aa, Staphylococcus
GFGNYELRLPLLPLEAAETKVLINAYEQ

SEQ ID NO: 2013681 - protein, 27 aa, Staphylococcus
GFGNYELRLPLLPLEDADAKVLINVFE

SEQ ID NO: 2013682 - protein, 27 aa, Staphylococcus
GFGNYELRLPLLPLEKEKANVLVNAYK

SEQ ID NO: 2013683 - protein, 25 aa, Staphylococcus
GFGNYEVRLPLVTLEDSDRQKLEQA

SEQ ID NO: 2013684 - protein, 25 aa, Staphylococcus
GFGRIGRLAFRRIQDVEGIDVVAVN

SEQ ID NO: 2013685 - protein, 24 aa, Staphylococcus
GFGRIGRLAFRRIQDVEGLEVVAV

SEQ ID NO: 2013686 - protein, 25 aa, Staphylococcus
GFGRIGRLAFRRIQDVEGLEVVAVN

SEQ ID NO: 2013687 - protein, 25 aa, Staphylococcus
GFGRIGRLAFRRIQNVDGIDVVAVN

SEQ ID NO: 2013688 - protein, 18 aa, Staphylococcus
GFHAKGYIFDHDNYSSMI

SEQ ID NO: 2013689 - protein, 23 aa, Staphylococcus
GFHELKIDLSKYLPKETTVYNVE

SEQ ID NO: 2013690 - protein, 22 aa, Staphylococcus
GFHELKIGLSKFLPKEASVYNV

SEQ ID NO: 2013691 - protein, 19 aa, Staphylococcus
GFIDQSFLQYEGFENLLKP

SEQ ID NO: 2013692 - protein, 23 aa, Staphylococcus
GFIHFPRSKRHVSMNQLKLLSKR

SEQ ID NO: 2013693 - protein, 19 aa, Staphylococcus
GFIQKGLQPIIAHPERNDY

SEQ ID NO: 2013694 - protein, 21 aa, Staphylococcus
GFIYELYVFEGYRRQGVAKKL

SEQ ID NO: 2013695 - protein, 20 aa, Staphylococcus
GFKENFTATRIRGHSTYLKR

SEQ ID NO: 2013696 - protein, 19 aa, Staphylococcus
GFKREDLWTNRKRGEEFFW

SEQ ID NO: 2013697 - protein, 17 aa, Staphylococcus
GFLAEYDALPGLGHACG

SEQ ID NO: 2013698 - protein, 19 aa, Staphylococcus
GFLGGKIGDFIAEKLNHNQ

SEQ ID NO: 2013699 - protein, 18 aa, Staphylococcus
GFLLGKDLNVEFDLEFPL

SEQ ID NO: 2013700 - protein, 21 aa, Staphylococcus
GFLNHVACFHIPNYHKTLMLS

SEQ ID NO: 2013701 - protein, 21 aa, Staphylococcus
GFMFETFELFEQSTLKRQFPE

SEQ ID NO: 2013702 - protein, 17 aa, Staphylococcus
GFNFKKSLGQNFLVDVN

SEQ ID NO: 2013703 - protein, 19 aa, Staphylococcus
GFNIFDFSKVYSVNSNGHI

SEQ ID NO: 2013704 - protein, 18 aa, Staphylococcus
GFNIKSFIRSGVTDDELR

SEQ ID NO: 2013705 - protein, 25 aa, Staphylococcus
GFNIVFQDYCLFPHLNARENILYGL

SEQ ID NO: 2013706 - protein, 21 aa, Staphylococcus
GFNKGDIVTGTFPWQKVVNVK

SEQ ID NO: 2013707 - protein, 25 aa, Staphylococcus
GFNKSEALLILFPYIYKKNDVAMKW

SEQ ID NO: 2013708 - protein, 25 aa, Staphylococcus
GFNLSCGEIKAIFEQLGFKTQQNGD

SEQ ID NO: 2013709 - protein, 25 aa, Staphylococcus
GFNRSEAILILFPYIFKEQSRAMKW

SEQ ID NO: 2013710 - protein, 18 aa, Staphylococcus
GFNSLQWPVHKDGTDEPL

SEQ ID NO: 2013711 - protein, 20 aa, Staphylococcus
GFPDHGKFAEIFKISDTPQG

SEQ ID NO: 2013712 - protein, 17 aa, Staphylococcus
GFPDITHELEWLPHLFV

SEQ ID NO: 2013713 - protein, 24 aa, Staphylococcus
GFPDLKGFGRRKMALSYQEIYNAI

SEQ ID NO: 2013714 - protein, 17 aa, Staphylococcus
GFPRLGRKREWKKAIEG

SEQ ID NO: 2013715 - protein, 17 aa, Staphylococcus
GFPRLGRKREWKKAIES

SEQ ID NO: 2013716 - protein, 26 aa, Staphylococcus
GFQCFDLANQWWLYLFNHTLKGVGAA

SEQ ID NO: 2013717 - protein, 18 aa, Staphylococcus
GFQHLQFRRIIIEDQHIE

SEQ ID NO: 2013718 - protein, 26 aa, Staphylococcus
GFQTHLKWGAQKDVIRLIPGLENVEI

SEQ ID NO: 2013719 - protein, 26 aa, Staphylococcus
GFQTHLKWGAQKEVIKLIPGLENVDI

SEQ ID NO: 2013720 - protein, 20 aa, Staphylococcus
GFSDICLGVPTILSKKGIEK

SEQ ID NO: 2013721 - protein, 18 aa, Staphylococcus
GFSDICLGVPTVLSEKGI

SEQ ID NO: 2013722 - protein, 17 aa, Staphylococcus
GFSFEIGKCKSMDVRQR

SEQ ID NO: 2013723 - protein, 18 aa, Staphylococcus
GFSREDLWTNRKRGEEFF

SEQ ID NO: 2013724 - protein, 25 aa, Staphylococcus
GFSYPSEFGNIFKVLIENVKSDHEV

SEQ ID NO: 2013725 - protein, 22 aa, Staphylococcus
GFTCYVPAYKGHGLMLDELMAF

SEQ ID NO: 2013726 - protein, 19 aa, Staphylococcus
GFTGHIIRRGVTAADASIN

SEQ ID NO: 2013727 - protein, 18 aa, Staphylococcus
GFTLPKMLWMQQHEPELW

SEQ ID NO: 2013728 - protein, 17 aa, Staphylococcus
GFTLPKMLWVQQHEPEI

SEQ ID NO: 2013729 - protein, 20 aa, Staphylococcus
GFTTICPMPNTRPVPDSVEN

SEQ ID NO: 2013730 - protein, 17 aa, Staphylococcus
GFTVYRMSATVEQPNGN

SEQ ID NO: 2013731 - protein, 29 aa, Staphylococcus
GFTYKLDADFTPKFVVGYVETKDKHPDAD

SEQ ID NO: 2013732 - protein, 22 aa, Staphylococcus
GFVIEPQFLFSNLINKIEAQTF

SEQ ID NO: 2013733 - protein, 18 aa, Staphylococcus
GFVKKDRVINALSREEFK

SEQ ID NO: 2013734 - protein, 24 aa, Staphylococcus
GFVPKTISKISQWNFIENLLTEGL

SEQ ID NO: 2013735 - protein, 18 aa, Staphylococcus
GFVSCGGLSPTGQPLLRD

SEQ ID NO: 2013736 - protein, 24 aa, Staphylococcus
GFVSEFKGDNLIIINRDRTPYDQS

SEQ ID NO: 2013737 - protein, 19 aa, Staphylococcus
GFVYIKGYEDLAFFEPFIL

SEQ ID NO: 2013738 - protein, 19 aa, Staphylococcus
GGADVVIDCVGMDGQVAQD

SEQ ID NO: 2013739 - protein, 17 aa, Staphylococcus
GGAEMNVAIGLSGLGID

SEQ ID NO: 2013740 - protein, 21 aa, Staphylococcus
GGAHRLIKAKAFDNYPIEAVF

SEQ ID NO: 2013741 - protein, 23 aa, Staphylococcus
GGAKSDFWLQLQADVFNTSVKKL

SEQ ID NO: 2013742 - protein, 24 aa, Staphylococcus
GGAKSEFWLQLQADVFNTTVRKLK

SEQ ID NO: 2013743 - protein, 25 aa, Staphylococcus
GGAKSEFWLQMQADIFNASIRKLKH

SEQ ID NO: 2013744 - protein, 17 aa, Staphylococcus
GGALRHLEPEALLLPLF

SEQ ID NO: 2013745 - protein, 23 aa, Staphylococcus
GGANRLIKAGAFNNYPIEAIFGV

SEQ ID NO: 2013746 - protein, 23 aa, Staphylococcus
GGANRLIKAGAFNQYPIEAVFGI

SEQ ID NO: 2013747 - protein, 23 aa, Staphylococcus
GGANRLIRAGAFEKYPIEAVFGI

SEQ ID NO: 2013748 - protein, 17 aa, Staphylococcus
GGANVADVIPVFAVNKE

SEQ ID NO: 2013749 - protein, 17 aa, Staphylococcus
GGARGLGQVISKTLAEQ

SEQ ID NO: 2013750 - protein, 24 aa, Staphylococcus
GGASGPLYGFGFVKMAQVAEDEIT

SEQ ID NO: 2013751 - protein, 17 aa, Staphylococcus
GGAVAKRAKAFDMDILY

SEQ ID NO: 2013752 - protein, 18 aa, Staphylococcus
GGAYEIYLPDMQRFAHIL

SEQ ID NO: 2013753 - protein, 18 aa, Staphylococcus
GGCELVLHSPIVVAASES

SEQ ID NO: 2013754 - protein, 25 aa, Staphylococcus
GGCYALKLSLNRDVKGIITMCSPMY

SEQ ID NO: 2013755 - protein, 19 aa, Staphylococcus
GGDGSYRGAQRISEECPEI

SEQ ID NO: 2013756 - protein, 19 aa, Staphylococcus
GGDGSYRGAQRISEETKDI

SEQ ID NO: 2013757 - protein, 19 aa, Staphylococcus
GGDGSYRGAQRISEETTDI

SEQ ID NO: 2013758 - protein, 21 aa, Staphylococcus
GGDIQRVGNDIFLCTPDNVEV

SEQ ID NO: 2013759 - protein, 20 aa, Staphylococcus
GGDISPLLQGGHDNMVSSIT

SEQ ID NO: 2013760 - protein, 17 aa, Staphylococcus
GGEGFVYIKGYEDLAFF

SEQ ID NO: 2013761 - protein, 21 aa, Staphylococcus
GGEKIRLRWAQLVNTDYNLLV

SEQ ID NO: 2013762 - protein, 18 aa, Staphylococcus
GGELKHGTIALIEEGTPV

SEQ ID NO: 2013763 - protein, 23 aa, Staphylococcus
GGEPMFSKKSIRNVVKPLLKYAY

SEQ ID NO: 2013764 - protein, 24 aa, Staphylococcus
GGEQKRLYLLRLLVHQPNVLLLDE

SEQ ID NO: 2013765 - protein, 36 aa, Staphylococcus
GGERALSAIALLFAILKVRSAPFVILDEVEAALDEA

SEQ ID NO: 2013766 - protein, 20 aa, Staphylococcus
GGERAVLLLHSFTGTIQDIK

SEQ ID NO: 2013767 - protein, 25 aa, Staphylococcus
GGERQRICLARQLMYIPDVLLLDEA

SEQ ID NO: 2013768 - protein, 18 aa, Staphylococcus
GGESFKGSAGQFVRKNIK

SEQ ID NO: 2013769 - protein, 17 aa, Staphylococcus
GGESFQASLALALGLSE

SEQ ID NO: 2013770 - protein, 19 aa, Staphylococcus
GGEVKDCIDYALCVNEKGD

SEQ ID NO: 2013771 - protein, 20 aa, Staphylococcus
GGFEDIFSSFFGGSRQRDPN

SEQ ID NO: 2013772 - protein, 18 aa, Staphylococcus
GGFEPLAHVSEGKNVVLG

SEQ ID NO: 2013773 - protein, 17 aa, Staphylococcus
GGFIIPDIQFVKAVKQI

SEQ ID NO: 2013774 - protein, 22 aa, Staphylococcus
GGFKARQVIINKFAVELNKDIY

SEQ ID NO: 2013775 - protein, 18 aa, Staphylococcus
GGFSDIFYMNCTKNGMLP

SEQ ID NO: 2013776 - protein, 17 aa, Staphylococcus
GGGGIPVIKRNDTYEGV

SEQ ID NO: 2013777 - protein, 20 aa, Staphylococcus
GGGGVNWSFFEQGLVDEISV

SEQ ID NO: 2013778 - protein, 17 aa, Staphylococcus
GGGKGIRVARTEKELEN

SEQ ID NO: 2013779 - protein, 19 aa, Staphylococcus
GGGKSTLLRCINLLEQPDS

SEQ ID NO: 2013780 - protein, 22 aa, Staphylococcus
GGGLARIGGYIAGRLDLIERCG

SEQ ID NO: 2013781 - protein, 18 aa, Staphylococcus
GGGMRQSKSILAQKDELT

SEQ ID NO: 2013782 - protein, 19 aa, Staphylococcus
GGGMSTAGLILIENIKTEY

SEQ ID NO: 2013783 - protein, 19 aa, Staphylococcus
GGGMSTAGLILVENIKTEY

SEQ ID NO: 2013784 - protein, 22 aa, Staphylococcus
GGGNTALDWARDIAKIAKSVTV

SEQ ID NO: 2013785 - protein, 20 aa, Staphylococcus
GGGTRGNGRIEFKDINIETV

SEQ ID NO: 2013786 - protein, 38 aa, Staphylococcus
GGHAIDACGLNGLRIANCSFEGFLDIDGDRFFSEAVQL

SEQ ID NO: 2013787 - protein, 20 aa, Staphylococcus
GGHAKLELTEDDYLAAGVDI

SEQ ID NO: 2013788 - protein, 36 aa, Staphylococcus
GGHALDACGINGLYIKNCKFKGFFDVNGDRSFSEAI

SEQ ID NO: 2013789 - protein, 18 aa, Staphylococcus
GGHGTIWDFKDNKDLQEL

SEQ ID NO: 2013790 - protein, 19 aa, Staphylococcus
GGHHMAAGMTMEIDYIEAL

SEQ ID NO: 2013791 - protein, 22 aa, Staphylococcus
GGHLNHSLFWEFLTPNSEEKGT

SEQ ID NO: 2013792 - protein, 17 aa, Staphylococcus
GGIDRGTLILSEQSIVP

SEQ ID NO: 2013793 - protein, 21 aa, Staphylococcus
GGIKGRQVIINKFATELNKDM

SEQ ID NO: 2013794 - protein, 23 aa, Staphylococcus
GGIKGRQVIINKFAVELNKDIYT

SEQ ID NO: 2013795 - protein, 19 aa, Staphylococcus
GGIKTDWGIIAADKLADST

SEQ ID NO: 2013796 - protein, 31 aa, Staphylococcus
GGINRIAFRHAERLAALKFSMLCQEAGLEVH

SEQ ID NO: 2013797 - protein, 17 aa, Staphylococcus
GGIPGYIILSLVPNNYT

SEQ ID NO: 2013798 - protein, 22 aa, Staphylococcus
GGIRGRQVIINKFMTELNKDLY

SEQ ID NO: 2013799 - protein, 25 aa, Staphylococcus
GGIRIKRAKLRGERSEGMICSLQEI

SEQ ID NO: 2013800 - protein, 18 aa, Staphylococcus
GGITECKKIISMAEAYDI

SEQ ID NO: 2013801 - protein, 18 aa, Staphylococcus
GGIYEWLHTPPGYDSETF

SEQ ID NO: 2013802 - protein, 20 aa, Staphylococcus
GGKASYPSTVLMTVTLAKVA

SEQ ID NO: 2013803 - protein, 26 aa, Staphylococcus
GGKGLLCVYEGFLKAMKGEKVETTAP

SEQ ID NO: 2013804 - protein, 25 aa, Staphylococcus
GGKGLLCVYEGFLKGLKGEKVEANK

SEQ ID NO: 2013805 - protein, 25 aa, Staphylococcus
GGKGLLCVYEGFLKGLKGEKVEAQA

SEQ ID NO: 2013806 - protein, 24 aa, Staphylococcus
GGKGLLCVYEGFLKGLKGEQVEAQ

SEQ ID NO: 2013807 - protein, 25 aa, Staphylococcus
GGKGLLCVYEGFLKGLTGQTIEAKK

SEQ ID NO: 2013808 - protein, 21 aa, Staphylococcus
GGKLANIDFGFEKWGFKQGAN

SEQ ID NO: 2013809 - protein, 25 aa, Staphylococcus
GGKLGSGRQWYSWIHIDDLVRAILF

SEQ ID NO: 2013810 - protein, 25 aa, Staphylococcus
GGKLGSGRQWYSWIHIDDLVRALLH

SEQ ID NO: 2013811 - protein, 20 aa, Staphylococcus
GGKLPANFLNLERHIDVFTP

SEQ ID NO: 2013812 - protein, 20 aa, Staphylococcus
GGKLPANFLNLERHIEVFTP

SEQ ID NO: 2013813 - protein, 20 aa, Staphylococcus
GGKLPANFLNLKRHIEVCTP

SEQ ID NO: 2013814 - protein, 21 aa, Staphylococcus
GGKLPANFLNLKRHIEVFTPK

SEQ ID NO: 2013815 - protein, 24 aa, Staphylococcus
GGKVRPGFEGGQLPLFRRLPKRGF

SEQ ID NO: 2013816 - protein, 18 aa, Staphylococcus
GGKVVVLGCPAEEGGENG

SEQ ID NO: 2013817 - protein, 21 aa, Staphylococcus
GGLALGLAVEGFRPVMEIQFL

SEQ ID NO: 2013818 - protein, 20 aa, Staphylococcus
GGLALGLAVTGYRPVMEIQF

SEQ ID NO: 2013819 - protein, 24 aa, Staphylococcus
GGLGGAFKAFFPSHFEDGIQVVID

SEQ ID NO: 2013820 - protein, 22 aa, Staphylococcus
GGLPKRPFRPFDESHRDALDTL

SEQ ID NO: 2013821 - protein, 17 aa, Staphylococcus
GGLPMSAIVGRKEIIES

SEQ ID NO: 2013822 - protein, 17 aa, Staphylococcus
GGLPMSAIVGRSEIMDY

SEQ ID NO: 2013823 - protein, 19 aa, Staphylococcus
GGLRYCINSAAIQFIPYDK

SEQ ID NO: 2013824 - protein, 19 aa, Staphylococcus
GGLRYCINSAAIQFIPYEK

SEQ ID NO: 2013825 - protein, 19 aa, Staphylococcus
GGLRYCINSAAVQFIPYDK

SEQ ID NO: 2013826 - protein, 20 aa, Staphylococcus
GGLRYLKQLQVGVVAETGRE

SEQ ID NO: 2013827 - protein, 21 aa, Staphylococcus
GGLRYLKQLQVGVVAETGRER

SEQ ID NO: 2013828 - protein, 17 aa, Staphylococcus
GGMAVCLETSQPTIPVF

SEQ ID NO: 2013829 - protein, 18 aa, Staphylococcus
GGMDSFDGGVGMLQALGA

SEQ ID NO: 2013830 - protein, 17 aa, Staphylococcus
GGMIVCLETSQPTLPVF

SEQ ID NO: 2013831 - protein, 17 aa, Staphylococcus
GGMIVCLETSQPTTPVF

SEQ ID NO: 2013832 - protein, 21 aa, Staphylococcus
GGMKQRLGIAQAILHRPKFLV

SEQ ID NO: 2013833 - protein, 17 aa, Staphylococcus
GGMVVCLETSQPTLPLF

SEQ ID NO: 2013834 - protein, 18 aa, Staphylococcus
GGNIVPHIHLPVQSGNDA

SEQ ID NO: 2013835 - protein, 20 aa, Staphylococcus
GGNIVPNFRPVHGHTTCITN

SEQ ID NO: 2013836 - protein, 21 aa, Staphylococcus
GGNLKALYTLVTKELGLTYRP

SEQ ID NO: 2013837 - protein, 26 aa, Staphylococcus
GGNMGVSGSVAYMFDDTATFAIEGKS

SEQ ID NO: 2013838 - protein, 26 aa, Staphylococcus
GGNMGVSGSVAYMFDHTATFGVEGKS

SEQ ID NO: 2013839 - protein, 27 aa, Staphylococcus
GGNMGVSGSVSYMFDHTATFAFEGKSA

SEQ ID NO: 2013840 - protein, 26 aa, Staphylococcus
GGNMGVSGSVSYMFDHTATFGVEGKS

SEQ ID NO: 2013841 - protein, 19 aa, Staphylococcus
GGPKGIMPGIAGLETIQTF

SEQ ID NO: 2013842 - protein, 23 aa, Staphylococcus
GGPSGDLYVVFRVKPSEVFKRDG

SEQ ID NO: 2013843 - protein, 19 aa, Staphylococcus
GGQAFYLYNKVQSIYEKKE

SEQ ID NO: 2013844 - protein, 20 aa, Staphylococcus
GGQAKWFLQDVEVLINGSRE

SEQ ID NO: 2013845 - protein, 24 aa, Staphylococcus
GGQAYWSFGGLFLVNSKVQRRYGV

SEQ ID NO: 2013846 - protein, 19 aa, Staphylococcus
GGQGTRLGYKGPKGSFEIK

SEQ ID NO: 2013847 - protein, 19 aa, Staphylococcus
GGQGTRLGYQGPKGSFEIK

SEQ ID NO: 2013848 - protein, 23 aa, Staphylococcus
GGREHVLAFKLKQSPLINEIHVI

SEQ ID NO: 2013849 - protein, 23 aa, Staphylococcus
GGRGGRGNSRFATPRNPAPDFSE

SEQ ID NO: 2013850 - protein, 26 aa, Staphylococcus
GGRGVSYCAVCDGAFFKNKNLFVIGG

SEQ ID NO: 2013851 - protein, 27 aa, Staphylococcus
GGRIATRRVELLLEYAKQIHIVSPQIT

SEQ ID NO: 2013852 - protein, 22 aa, Staphylococcus
GGRIMRLHFEGILEERLDELGE

SEQ ID NO: 2013853 - protein, 20 aa, Staphylococcus
GGRTFRWLINNGVEENPYQG

SEQ ID NO: 2013854 - protein, 26 aa, Staphylococcus
GGSALKDKYFGLAISCGQPENHYSHS

SEQ ID NO: 2013855 - protein, 24 aa, Staphylococcus
GGSDITGAIIARGIKASLYENFTD

SEQ ID NO: 2013856 - protein, 22 aa, Staphylococcus
GGSDITGAIVARGVRADLYENF

SEQ ID NO: 2013857 - protein, 25 aa, Staphylococcus
GGSFKASDVPSAIFGTKQRRPLENG

SEQ ID NO: 2013858 - protein, 22 aa, Staphylococcus
GGSGFLGMRIISELLKDCYEVR

SEQ ID NO: 2013859 - protein, 19 aa, Staphylococcus
GGSGLHLKLDQVPTREPNI

SEQ ID NO: 2013860 - protein, 25 aa, Staphylococcus
GGSGLHLRLDQVPTREPGISPYEMM

SEQ ID NO: 2013861 - protein, 26 aa, Staphylococcus
GGSMHIGHLIPFMMMKRFQLAGHKPF

SEQ ID NO: 2013862 - protein, 17 aa, Staphylococcus
GGSMLILAKELQTAKNI

SEQ ID NO: 2013863 - protein, 23 aa, Staphylococcus
GGSMSTYAYRHMKNPMVVEEITA

SEQ ID NO: 2013864 - protein, 23 aa, Staphylococcus
GGSRLKDGILAIDLLRRPEMTYN

SEQ ID NO: 2013865 - protein, 23 aa, Staphylococcus
GGSRLKDGILALELLRRPEMTYD

SEQ ID NO: 2013866 - protein, 20 aa, Staphylococcus
GGSVASAFAAMYPEMADSIT

SEQ ID NO: 2013867 - protein, 20 aa, Staphylococcus
GGSVNPGGGMPMVTLSGQQV

SEQ ID NO: 2013868 - protein, 18 aa, Staphylococcus
GGTARVFLGDVTKKAEME

SEQ ID NO: 2013869 - protein, 22 aa, Staphylococcus
GGTGFLGMRIISELLKQGYDVR

SEQ ID NO: 2013870 - protein, 22 aa, Staphylococcus
GGTPWLDQKHTVFGQLIEGEAT

SEQ ID NO: 2013871 - protein, 22 aa, Staphylococcus
GGTPWLDQKHTVFGQLIEGKDT

SEQ ID NO: 2013872 - protein, 19 aa, Staphylococcus
GGTRYRPEVLEAKVEGYSI

SEQ ID NO: 2013873 - protein, 24 aa, Staphylococcus
GGTSFKMKFGHRGANHPVKDLRSG

SEQ ID NO: 2013874 - protein, 20 aa, Staphylococcus
GGTTCKLGIFDTHLEQLHKW

SEQ ID NO: 2013875 - protein, 21 aa, Staphylococcus
GGTTCKLGIFNGELEQLHKWS

SEQ ID NO: 2013876 - protein, 22 aa, Staphylococcus
GGTTYKIYFGFADRQSYEDFKT

SEQ ID NO: 2013877 - protein, 28 aa, Staphylococcus
GGTYRALTKVFTRFGIDVDFVDTTKIEN

SEQ ID NO: 2013878 - protein, 24 aa, Staphylococcus
GGTYRLCTQFLPGLNIEVTTVDTT

SEQ ID NO: 2013879 - protein, 19 aa, Staphylococcus
GGVEPYVILATFVVTGDNE

SEQ ID NO: 2013880 - protein, 17 aa, Staphylococcus
GGVGYTLKDPNRIDEVV

SEQ ID NO: 2013881 - protein, 20 aa, Staphylococcus
GGVIGMEFASLLNDFGTDVT

SEQ ID NO: 2013882 - protein, 20 aa, Staphylococcus
GGVILRWLRDEILASEVETA

SEQ ID NO: 2013883 - protein, 21 aa, Staphylococcus
GGVILRWLRDEILASEVETAK

SEQ ID NO: 2013884 - protein, 20 aa, Staphylococcus
GGVILRWLRDELLASEVETA

SEQ ID NO: 2013885 - protein, 25 aa, Staphylococcus
GGVMLQHYSPFKVIEQFHLISNIAP

SEQ ID NO: 2013886 - protein, 24 aa, Staphylococcus
GGVRPGFEGGQLPLFRRLPKRGFT

SEQ ID NO: 2013887 - protein, 22 aa, Staphylococcus
GGVSLKEIWPKTMMSKIQPGLF

SEQ ID NO: 2013888 - protein, 23 aa, Staphylococcus
GGVSLKEIWPKTMMSKLQPGLFL

SEQ ID NO: 2013889 - protein, 17 aa, Staphylococcus
GGWNAIFWCNHDQPRVV

SEQ ID NO: 2013890 - protein, 26 aa, Staphylococcus
GGWQFPEGIKVIGVKSVHEALKYALT

SEQ ID NO: 2013891 - protein, 23 aa, Staphylococcus
GGWQFPEGIKVVGVSTVHDALKY

SEQ ID NO: 2013892 - protein, 19 aa, Staphylococcus
GGWTFPEGIQVIGVSSVHE

SEQ ID NO: 2013893 - protein, 25 aa, Staphylococcus
GGYIALEFASLFANLGTHVSVLESS

SEQ ID NO: 2013894 - protein, 20 aa, Staphylococcus
GGYKGRPLSKGDLIYLKENP

SEQ ID NO: 2013895 - protein, 20 aa, Staphylococcus
GGYLKEGKRKAGQVMNRSML

SEQ ID NO: 2013896 - protein, 22 aa, Staphylococcus
GGYLTKIRTGAISGVATKYLSR

SEQ ID NO: 2013897 - protein, 18 aa, Staphylococcus
GGYTGLWEGFIKRNYGDE

SEQ ID NO: 2013898 - protein, 24 aa, Staphylococcus
GGYVKGPFPYFVSFIGHAPSKNPK

SEQ ID NO: 2013899 - protein, 19 aa, Staphylococcus
GHAEIKMAQELGVDVIVTD

SEQ ID NO: 2013900 - protein, 21 aa, Staphylococcus
GHAGQSLAAFAPKGLTIHHNG

SEQ ID NO: 2013901 - protein, 21 aa, Staphylococcus
GHAIAKGCDLNGMMAEIMGKK

SEQ ID NO: 2013902 - protein, 21 aa, Staphylococcus
GHAIAKGCDLNGMMAEIMGKR

SEQ ID NO: 2013903 - protein, 20 aa, Staphylococcus
GHAIAKGCDLNGMMTEIMGK

SEQ ID NO: 2013904 - protein, 17 aa, Staphylococcus
GHAKLELTDDDYLSAGV

SEQ ID NO: 2013905 - protein, 18 aa, Staphylococcus
GHAKLELTDDDYLSAGVD

SEQ ID NO: 2013906 - protein, 26 aa, Staphylococcus
GHALDACGINGLYIKNCNFKGFNDFD

SEQ ID NO: 2013907 - protein, 26 aa, Staphylococcus
GHALDACGLNGLHITDCSFEGFLDID

SEQ ID NO: 2013908 - protein, 22 aa, Staphylococcus
GHAPDLIKSAAYANILPSSTNP

SEQ ID NO: 2013909 - protein, 18 aa, Staphylococcus
GHAPDLIKSAAYPNILPS

SEQ ID NO: 2013910 - protein, 21 aa, Staphylococcus
GHARGPMAHGSHFHRAPGSVG

SEQ ID NO: 2013911 - protein, 23 aa, Staphylococcus
GHDEIKMVQDLGVDVIVTDHHEI

SEQ ID NO: 2013912 - protein, 26 aa, Staphylococcus
GHDFADCPNFVKGHVPELYIENDRIK

SEQ ID NO: 2013913 - protein, 27 aa, Staphylococcus
GHDIVCAGASAVLFGSVNAIMGLTSEK

SEQ ID NO: 2013914 - protein, 20 aa, Staphylococcus
GHDMGGVIAREFTEKHENHV

SEQ ID NO: 2013915 - protein, 19 aa, Staphylococcus
GHDNRANLIASIGEGHPVV

SEQ ID NO: 2013916 - protein, 21 aa, Staphylococcus
GHEAMEKYGLSNIVVHAPYII

SEQ ID NO: 2013917 - protein, 17 aa, Staphylococcus
GHELFDIMMQNIEEDTC

SEQ ID NO: 2013918 - protein, 17 aa, Staphylococcus
GHELFDIMMQNIEEDTS

SEQ ID NO: 2013919 - protein, 18 aa, Staphylococcus
GHFAPLGDFDLMVKAKKA

SEQ ID NO: 2013920 - protein, 26 aa, Staphylococcus
GHFGRTDVALPWERVDKVDVLKEAVQ

SEQ ID NO: 2013921 - protein, 19 aa, Staphylococcus
GHGAKAFYKDGYMNDVDAL

SEQ ID NO: 2013922 - protein, 17 aa, Staphylococcus
GHGAYLFDVDGNKYIDY

SEQ ID NO: 2013923 - protein, 27 aa, Staphylococcus
GHGELWLKGNNVMDGYLYPKGLKDAFV

SEQ ID NO: 2013924 - protein, 24 aa, Staphylococcus
GHGLPLTELIAFDINDWWHDAQNG

SEQ ID NO: 2013925 - protein, 20 aa, Staphylococcus
GHGPFSHSFEKIFDTDHEAF

SEQ ID NO: 2013926 - protein, 19 aa, Staphylococcus
GHGVIKIDRYPIFVPNALI

SEQ ID NO: 2013927 - protein, 23 aa, Staphylococcus
GHHEKWTYLPFKLTEQDGKLYGR

SEQ ID NO: 2013928 - protein, 17 aa, Staphylococcus
GHHMAAGMTMEIDNIDA

SEQ ID NO: 2013929 - protein, 23 aa, Staphylococcus
GHHSRELMVIFVTNGKKFKQGDI

SEQ ID NO: 2013930 - protein, 19 aa, Staphylococcus
GHIACDARSHLNCDTHASQ

SEQ ID NO: 2013931 - protein, 27 aa, Staphylococcus
GHIIAYRSSGGFGVRLDAGDGFQGAEI

SEQ ID NO: 2013932 - protein, 17 aa, Staphylococcus
GHIPRLNYHTRRLCHSC

SEQ ID NO: 2013933 - protein, 25 aa, Staphylococcus
GHISKIKNLRMGYLTQQMTLNSSAS

SEQ ID NO: 2013934 - protein, 25 aa, Staphylococcus
GHKAIEQRTSFGLGEVILDALNKDT

SEQ ID NO: 2013935 - protein, 22 aa, Staphylococcus
GHKFGGPKGVGVLLVKENTPIQ

SEQ ID NO: 2013936 - protein, 24 aa, Staphylococcus
GHKIKRSGFFYAPTILDHINLEDS

SEQ ID NO: 2013937 - protein, 17 aa, Staphylococcus
GHLCDYILFDSAWVGYE

SEQ ID NO: 2013938 - protein, 21 aa, Staphylococcus
GHLLIQWYSKGIYKFRYHILE

SEQ ID NO: 2013939 - protein, 21 aa, Staphylococcus
GHLLSLPGWAGMLYYRAQQND

SEQ ID NO: 2013940 - protein, 18 aa, Staphylococcus
GHMIKSTPFAKLIQHKDL

SEQ ID NO: 2013941 - protein, 18 aa, Staphylococcus
GHNAYGYLKAEKGVHRLV

SEQ ID NO: 2013942 - protein, 20 aa, Staphylococcus
GHPGLPMGAAPMAYTLWTRH

SEQ ID NO: 2013943 - protein, 25 aa, Staphylococcus
GHPIGASGARILVTLLHQLNEEKQS

SEQ ID NO: 2013944 - protein, 25 aa, Staphylococcus
GHPIGASGARILVTLLHQLNETTKT

SEQ ID NO: 2013945 - protein, 18 aa, Staphylococcus
GHPMLKKRHMAFRITTYE

SEQ ID NO: 2013946 - protein, 23 aa, Staphylococcus
GHPVEFNPLLQMNRGVKLTTTIA

SEQ ID NO: 2013947 - protein, 26 aa, Staphylococcus
GHQIRFDLTKGFPLLTTKKVSFKLIA

SEQ ID NO: 2013948 - protein, 28 aa, Staphylococcus
GHQLRFDLSEGFPLLTTKKVSFKLLATE

SEQ ID NO: 2013949 - protein, 20 aa, Staphylococcus
GHRELPIRADFVGKNIPTAK

SEQ ID NO: 2013950 - protein, 19 aa, Staphylococcus
GHRELPIRADFVGKNIPTS

SEQ ID NO: 2013951 - protein, 18 aa, Staphylococcus
GHSERFGKAKAFAEIDGQ

SEQ ID NO: 2013952 - protein, 19 aa, Staphylococcus
GHSERFGKPKAFAEIEGQP

SEQ ID NO: 2013953 - protein, 18 aa, Staphylococcus
GHSERFGQPKAFATIDNE

SEQ ID NO: 2013954 - protein, 38 aa, Staphylococcus
GHSKRFGSPKAFACIHGEMFYKRIINTLTETNLFDDII

SEQ ID NO: 2013955 - protein, 17 aa, Staphylococcus
GHSMGGQMIRLLEHYLR

SEQ ID NO: 2013956 - protein, 21 aa, Staphylococcus
GHSMGGYTVALYGTQHPNKVD

SEQ ID NO: 2013957 - protein, 22 aa, Staphylococcus
GHSPGSLTYVFDEFAVVGDTLF

SEQ ID NO: 2013958 - protein, 22 aa, Staphylococcus
GHSPGSLTYVFEDFAVVGDTLF

SEQ ID NO: 2013959 - protein, 18 aa, Staphylococcus
GHSRFPVIDENWRLVGIV

SEQ ID NO: 2013960 - protein, 22 aa, Staphylococcus
GHTMPKVGIGTFRVENNDECKE

SEQ ID NO: 2013961 - protein, 22 aa, Staphylococcus
GHTMPKVGLGTFRVENNDDCTK

SEQ ID NO: 2013962 - protein, 22 aa, Staphylococcus
GHTMPQLGLGVFRVENNDTAKD

SEQ ID NO: 2013963 - protein, 17 aa, Staphylococcus
GHTRFPIVNEDFKLVGI

SEQ ID NO: 2013964 - protein, 17 aa, Staphylococcus
GHTYLSLDYAIEVTLDM

SEQ ID NO: 2013965 - protein, 25 aa, Staphylococcus
GHVFAKVRHAIRCPGFIENGATIYN

SEQ ID NO: 2013966 - protein, 20 aa, Staphylococcus
GHVPGNMLSLLDGTLQRQFS

SEQ ID NO: 2013967 - protein, 31 aa, Staphylococcus
GHVQSLVIIIRSVFKYVFKYYDLQDISVLDK

SEQ ID NO: 2013968 - protein, 20 aa, Staphylococcus
GHVRISYAYDMTLLKEGMQR

SEQ ID NO: 2013969 - protein, 21 aa, Staphylococcus
GHYHCSCGFKRELPKYEVSSF

SEQ ID NO: 2013970 - protein, 22 aa, Staphylococcus
GHYRNGILLSPIIGRDIANWLL

SEQ ID NO: 2013971 - protein, 21 aa, Staphylococcus
GIACPSFAPMVEQMRYKDPII

SEQ ID NO: 2013972 - protein, 28 aa, Staphylococcus
GIAFDLLEYALNYAFTHFDLRKVYFKIR

SEQ ID NO: 2013973 - protein, 34 aa, Staphylococcus
GIAFSINGNEHYKLPILGIHNMKNAAIAIAIGHE

SEQ ID NO: 2013974 - protein, 20 aa, Staphylococcus
GIAGDEAIAGLLYLTDLSVD

SEQ ID NO: 2013975 - protein, 25 aa, Staphylococcus
GIAIIKLLYSYGVRNMIMCDSKGAI

SEQ ID NO: 2013976 - protein, 24 aa, Staphylococcus
GIAIVKLLYSYGVRDMIMCDSKGA

SEQ ID NO: 2013977 - protein, 24 aa, Staphylococcus
GIAIVKLLYSYGVRNMIMCDSKGA

SEQ ID NO: 2013978 - protein, 25 aa, Staphylococcus
GIAIVKLLYSYGVRNMVMCDSRGAI

SEQ ID NO: 2013979 - protein, 25 aa, Staphylococcus
GIAKDVFSSFPFKSFYRIYEYYKKF

SEQ ID NO: 2013980 - protein, 19 aa, Staphylococcus
GIALLAFFSAALTRGIDVV

SEQ ID NO: 2013981 - protein, 23 aa, Staphylococcus
GIALSTDEKILWVTETTTNRLHR

SEQ ID NO: 2013982 - protein, 23 aa, Staphylococcus
GIALSTDEKVLWVTETTTNRLHR

SEQ ID NO: 2013983 - protein, 20 aa, Staphylococcus
GIARTGYEVLDLDGNQIGEV

SEQ ID NO: 2013984 - protein, 29 aa, Staphylococcus
GIAVDAYGAGSFIVATKVKGMIAAEVSDE

SEQ ID NO: 2013985 - protein, 30 aa, Staphylococcus
GIAVDAYGAGSFIVATKVKGMIAAEVSDER

SEQ ID NO: 2013986 - protein, 17 aa, Staphylococcus
GICDLSSVIGCRDDIMV

SEQ ID NO: 2013987 - protein, 25 aa, Staphylococcus
GICPEDCGYCGQSRDMKRKDRYALI

SEQ ID NO: 2013988 - protein, 24 aa, Staphylococcus
GICPEDCGYCGQSREMKQKQRYSL

SEQ ID NO: 2013989 - protein, 26 aa, Staphylococcus
GICPEDCGYCGQSVKMKEKQRYALVD

SEQ ID NO: 2013990 - protein, 22 aa, Staphylococcus
GIDDAAAIALALSHTKFDVKMI

SEQ ID NO: 2013991 - protein, 20 aa, Staphylococcus
GIDKGFYGVGGFDLLFDKYG

SEQ ID NO: 2013992 - protein, 21 aa, Staphylococcus
GIDLKPGVIGTIVSAQKLSNE

SEQ ID NO: 2013993 - protein, 24 aa, Staphylococcus
GIDPSLRKEIWKQLRELTSEDKSV

SEQ ID NO: 2013994 - protein, 18 aa, Staphylococcus
GIDRSELFVTTKVWIENV

SEQ ID NO: 2013995 - protein, 18 aa, Staphylococcus
GIDSCPMEGFDLDKVTEI

SEQ ID NO: 2013996 - protein, 18 aa, Staphylococcus
GIDVIWLSPMYKSPNDDN

SEQ ID NO: 2013997 - protein, 25 aa, Staphylococcus
GIDWNIKKGDKWVLYGLNGAGKTTL

SEQ ID NO: 2013998 - protein, 23 aa, Staphylococcus
GIEAAEAFAKAGIETTIVDIADR

SEQ ID NO: 2013999 - protein, 18 aa, Staphylococcus
GIEAGRLSYEAGRIPVKY

SEQ ID NO: 2014000 - protein, 17 aa, Staphylococcus
GIEAVICGIGINMNQEA

SEQ ID NO: 2014001 - protein, 17 aa, Staphylococcus
GIEAVICGIGINMNQEP

SEQ ID NO: 2014002 - protein, 20 aa, Staphylococcus
GIEDIRYFYTNDVRFLEQFK

SEQ ID NO: 2014003 - protein, 23 aa, Staphylococcus
GIEDLRDLWQIKMLNENPDLSKE

SEQ ID NO: 2014004 - protein, 30 aa, Staphylococcus
GIEIPDARYKDWFPNFTLGDLICDDTATGL

SEQ ID NO: 2014005 - protein, 18 aa, Staphylococcus
GIELGIPEHLVWRQPFPG

SEQ ID NO: 2014006 - protein, 20 aa, Staphylococcus
GIELSELGLGCMSLGTDINQ

SEQ ID NO: 2014007 - protein, 20 aa, Staphylococcus
GIENIEFKMLCMGFTRKQIK

SEQ ID NO: 2014008 - protein, 25 aa, Staphylococcus
GIENRDARFVCVISMSAPNETTQTF

SEQ ID NO: 2014009 - protein, 19 aa, Staphylococcus
GIEREAWLNVVNTLLNEGY

SEQ ID NO: 2014010 - protein, 18 aa, Staphylococcus
GIEVDAKFLFGAKIKITW

SEQ ID NO: 2014011 - protein, 40 aa, Staphylococcus
GIFDRYPNLNIIIGHWGEFIPFFLERMDTILVAEHLAHPI

SEQ ID NO: 2014012 - protein, 17 aa, Staphylococcus
GIFLMTKYVIPVMEKQE

SEQ ID NO: 2014013 - protein, 19 aa, Staphylococcus
GIFLQKFPLTFEINNHMVT

SEQ ID NO: 2014014 - protein, 22 aa, Staphylococcus
GIFSYARSLLKTNITIDSGEEK

SEQ ID NO: 2014015 - protein, 23 aa, Staphylococcus
GIFYYEVSTFWSGKFTIKVKDGF

SEQ ID NO: 2014016 - protein, 26 aa, Staphylococcus
GIGAGKFDMGINWFFKTPEREKQFLY

SEQ ID NO: 2014017 - protein, 24 aa, Staphylococcus
GIGCSGRLSGYINAYGVHAIHGRA

SEQ ID NO: 2014018 - protein, 21 aa, Staphylococcus
GIGCSGRLSGYINSYGVHGIH

SEQ ID NO: 2014019 - protein, 23 aa, Staphylococcus
GIGCSGRLSGYVNSYGVHAIHGR

SEQ ID NO: 2014020 - protein, 24 aa, Staphylococcus
GIGCSGRLSGYVNSYGVHGIHGRS

SEQ ID NO: 2014021 - protein, 24 aa, Staphylococcus
GIGDMRQGYEYSRSANPTRSALEG

SEQ ID NO: 2014022 - protein, 20 aa, Staphylococcus
GIGFALSIERLLLALEEEGI

SEQ ID NO: 2014023 - protein, 20 aa, Staphylococcus
GIGFALSIERLLLALEEENI

SEQ ID NO: 2014024 - protein, 19 aa, Staphylococcus
GIGPKPCYQIIEDMIGQGL

SEQ ID NO: 2014025 - protein, 23 aa, Staphylococcus
GIGSQLVKAVVDYARDNNLKVSA

SEQ ID NO: 2014026 - protein, 24 aa, Staphylococcus
GIGTCWKSPAYIFEPKIRKALNIE

SEQ ID NO: 2014027 - protein, 23 aa, Staphylococcus
GIGTCWKSPEYIFSPKVRKVLGV

SEQ ID NO: 2014028 - protein, 17 aa, Staphylococcus
GIGTIGLYMAPQAKHVY

SEQ ID NO: 2014029 - protein, 17 aa, Staphylococcus
GIGVSRTLSAIVEQHHD

SEQ ID NO: 2014030 - protein, 18 aa, Staphylococcus
GIGVSRTLSAIVEQNNDE

SEQ ID NO: 2014031 - protein, 18 aa, Staphylococcus
GIHAFKLAFINQAVNYDL

SEQ ID NO: 2014032 - protein, 21 aa, Staphylococcus
GIHAFKVAFIKQAVNNDLPYH

SEQ ID NO: 2014033 - protein, 17 aa, Staphylococcus
GIHARPATMLVQTASKF

SEQ ID NO: 2014034 - protein, 18 aa, Staphylococcus
GIHFPYLTIDDIMKIYQG

SEQ ID NO: 2014035 - protein, 20 aa, Staphylococcus
GIHHIPFPDSYRGMFNSTEP

SEQ ID NO: 2014036 - protein, 19 aa, Staphylococcus
GIIDIALKMGAHIELLNQT

SEQ ID NO: 2014037 - protein, 23 aa, Staphylococcus
GIIDRVDHRYVYVNLGRTEAVLS

SEQ ID NO: 2014038 - protein, 18 aa, Staphylococcus
GIIGDGKKSFVFGPCSVE

SEQ ID NO: 2014039 - protein, 18 aa, Staphylococcus
GIIGREFTETYQYRTISL

SEQ ID NO: 2014040 - protein, 23 aa, Staphylococcus
GIIIPKRRSVALTQIVAKASTGA

SEQ ID NO: 2014041 - protein, 18 aa, Staphylococcus
GIIIPLQIFIKTHPIEWQ

SEQ ID NO: 2014042 - protein, 24 aa, Staphylococcus
GIIKEALHKLGFDDGMYDLIKEPL

SEQ ID NO: 2014043 - protein, 20 aa, Staphylococcus
GIIKRKCEINQPKWMHSTLK

SEQ ID NO: 2014044 - protein, 22 aa, Staphylococcus
GIIPGAETIPMDKIESNIDYFN

SEQ ID NO: 2014045 - protein, 25 aa, Staphylococcus
GIISVEFASIMIKSGVEVTMIHHSD

SEQ ID NO: 2014046 - protein, 21 aa, Staphylococcus
GIIWPKSVTPFDLHLITINPK

SEQ ID NO: 2014047 - protein, 18 aa, Staphylococcus
GIIYSRPGAMMASPDEFT

SEQ ID NO: 2014048 - protein, 29 aa, Staphylococcus
GIKASKHIGGFPVSGLFLRCTNPDVIQQH

SEQ ID NO: 2014049 - protein, 26 aa, Staphylococcus
GIKQSKHIGGFPVSGLFLRCTNKDVI

SEQ ID NO: 2014050 - protein, 23 aa, Staphylococcus
GIKSKVQHGAGWWFNDTKRGMLR

SEQ ID NO: 2014051 - protein, 17 aa, Staphylococcus
GIKSLLEKIVYPTEAYE

SEQ ID NO: 2014052 - protein, 21 aa, Staphylococcus
GIKVGMIHGGLTPRERKQQMK

SEQ ID NO: 2014053 - protein, 18 aa, Staphylococcus
GIKVIGGEHPLSLLDSHP

SEQ ID NO: 2014054 - protein, 22 aa, Staphylococcus
GILKEGMIAFIPPVVDRSKLEC

SEQ ID NO: 2014055 - protein, 22 aa, Staphylococcus
GILKEGMIHFIPPKVQKTKLTK

SEQ ID NO: 2014056 - protein, 22 aa, Staphylococcus
GILKSGAGYLPIDPDYPQERTH

SEQ ID NO: 2014057 - protein, 17 aa, Staphylococcus
GILKSRAKHEALIKGKR

SEQ ID NO: 2014058 - protein, 22 aa, Staphylococcus
GILSQRLFTDFSDVYTDINRVE

SEQ ID NO: 2014059 - protein, 19 aa, Staphylococcus
GILYYKKNRLHTMNQSNII

SEQ ID NO: 2014060 - protein, 25 aa, Staphylococcus
GIMKSELNLPIGIIPGGTFNDFVKT

SEQ ID NO: 2014061 - protein, 17 aa, Staphylococcus
GIMSGHIPTVAALKTGY

SEQ ID NO: 2014062 - protein, 25 aa, Staphylococcus
GIMTEIPFQFFKAHVNLDLPNEGDY

SEQ ID NO: 2014063 - protein, 24 aa, Staphylococcus
GIMTKCPKCKKIMYTKELSENLNV

SEQ ID NO: 2014064 - protein, 24 aa, Staphylococcus
GIMTKCPNCKKIMYTKELTENLNV

SEQ ID NO: 2014065 - protein, 17 aa, Staphylococcus
GINAAGMHEFLIHLIGV

SEQ ID NO: 2014066 - protein, 32 aa, Staphylococcus
GINGEIRPGIVHRIDMDTSGLLMVAKNDIAHR

SEQ ID NO: 2014067 - protein, 18 aa, Staphylococcus
GINLKPGVVGTIVSAQTL

SEQ ID NO: 2014068 - protein, 24 aa, Staphylococcus
GINTRVIIVTTFKRPGYFEKAVAN

SEQ ID NO: 2014069 - protein, 31 aa, Staphylococcus
GIPDTGFFRFWIQGIFARWTDNPNIEDLIQA

SEQ ID NO: 2014070 - protein, 22 aa, Staphylococcus
GIPETIDYIAQYQVHTFDNSIF

SEQ ID NO: 2014071 - protein, 21 aa, Staphylococcus
GIPLGHEFNSLVLAILQVSGR

SEQ ID NO: 2014072 - protein, 27 aa, Staphylococcus
GIPLYFKKGKCFNLTDAGDLLYRNSNK

SEQ ID NO: 2014073 - protein, 23 aa, Staphylococcus
GIPTIAIGVALRYMHSNVSVLHT

SEQ ID NO: 2014074 - protein, 22 aa, Staphylococcus
GIPTISIGVALRYMHSNVSVLH

SEQ ID NO: 2014075 - protein, 21 aa, Staphylococcus
GIPTITIGVALRYMHSNVSVL

SEQ ID NO: 2014076 - protein, 22 aa, Staphylococcus
GIPTITIGVALRYMHSNVSVMH

SEQ ID NO: 2014077 - protein, 19 aa, Staphylococcus
GIPTITLGVALRYMHSNVS

SEQ ID NO: 2014078 - protein, 23 aa, Staphylococcus
GIQLSHGHYIYFLDGDDWLDLNI

SEQ ID NO: 2014079 - protein, 18 aa, Staphylococcus
GIRCTIGIGSNMLLSKVA

SEQ ID NO: 2014080 - protein, 25 aa, Staphylococcus
GIRHFGENRLEGFKEKKEALPKDAV

SEQ ID NO: 2014081 - protein, 17 aa, Staphylococcus
GIRNGFAELEANKDNLI

SEQ ID NO: 2014082 - protein, 27 aa, Staphylococcus
GIRVSNREIILFAPTWRGNNVNKPEDS

SEQ ID NO: 2014083 - protein, 26 aa, Staphylococcus
GISDLELIGIGGFSPLTGFMNKADYT

SEQ ID NO: 2014084 - protein, 18 aa, Staphylococcus
GISEIFKSMGATSIINGG

SEQ ID NO: 2014085 - protein, 19 aa, Staphylococcus
GISEWRSRKDALKGKINWV

SEQ ID NO: 2014086 - protein, 23 aa, Staphylococcus
GISFSGQMHGLVALDKEGHPVRH

SEQ ID NO: 2014087 - protein, 19 aa, Staphylococcus
GISKARGIDVVKDYLNVPT

SEQ ID NO: 2014088 - protein, 26 aa, Staphylococcus
GISPNEFKFGLSFLTRSVALSRFPWL

SEQ ID NO: 2014089 - protein, 29 aa, Staphylococcus
GISSFVYRRRLPFHAERFNAWLEQMPDNI

SEQ ID NO: 2014090 - protein, 20 aa, Staphylococcus
GISSPDIFKELNLKDDYDVH

SEQ ID NO: 2014091 - protein, 24 aa, Staphylococcus
GITAFAEACILAFSQTKKNKIVVS

SEQ ID NO: 2014092 - protein, 18 aa, Staphylococcus
GITDLRKIGLRDKTVEFE

SEQ ID NO: 2014093 - protein, 34 aa, Staphylococcus
GITEFPFSELISFKEVQDQLGLKHHTELIVNEEV

SEQ ID NO: 2014094 - protein, 33 aa, Staphylococcus
GITEFPFSELISFKEVQEELGLKHETEVLINEL

SEQ ID NO: 2014095 - protein, 25 aa, Staphylococcus
GITLREGDELVGLAVATEDSEDEVL

SEQ ID NO: 2014096 - protein, 25 aa, Staphylococcus
GITLREGDEVVGLDVAHANSEDEVL

SEQ ID NO: 2014097 - protein, 20 aa, Staphylococcus
GITLREGDTVVGLDVAHSES

SEQ ID NO: 2014098 - protein, 25 aa, Staphylococcus
GITLREGDVVVGLDVAHAESEDEVL

SEQ ID NO: 2014099 - protein, 27 aa, Staphylococcus
GITQFRIVPLLIFRAMHYIGDIPNILS

SEQ ID NO: 2014100 - protein, 17 aa, Staphylococcus
GITQHIGAYQIKNAGKK

SEQ ID NO: 2014101 - protein, 25 aa, Staphylococcus
GITSFAEACILAFNQTRKNKIVVSK

SEQ ID NO: 2014102 - protein, 25 aa, Staphylococcus
GITVNAYCPGIVKTPMMEDIAQKTA

SEQ ID NO: 2014103 - protein, 18 aa, Staphylococcus
GITYPTAPFNGWYMVTEI

SEQ ID NO: 2014104 - protein, 25 aa, Staphylococcus
GITYTCAPFNGWYMVTEIAVRNFTD

SEQ ID NO: 2014105 - protein, 17 aa, Staphylococcus
GIVCPVSGTANWTDIRQ

SEQ ID NO: 2014106 - protein, 18 aa, Staphylococcus
GIVCPVSGTANWTDIRQF

SEQ ID NO: 2014107 - protein, 17 aa, Staphylococcus
GIVDCFAQAVSIPENQK

SEQ ID NO: 2014108 - protein, 24 aa, Staphylococcus
GIVGRTGQILGEYDINIASMHLGR

SEQ ID NO: 2014109 - protein, 24 aa, Staphylococcus
GIVGRTGQILGEYGINIASMHLGR

SEQ ID NO: 2014110 - protein, 18 aa, Staphylococcus
GIVIPLYAKYGIALEAHL

SEQ ID NO: 2014111 - protein, 17 aa, Staphylococcus
GIWEAIDESCIAWHCAD

SEQ ID NO: 2014112 - protein, 26 aa, Staphylococcus
GIWFDGELVGVIGLHYLDLVNKKTSI

SEQ ID NO: 2014113 - protein, 20 aa, Staphylococcus
GIYGEVARSQMIVVQSYDVQ

SEQ ID NO: 2014114 - protein, 20 aa, Staphylococcus
GIYGKKWLDDEIFNIENFRK

SEQ ID NO: 2014115 - protein, 32 aa, Staphylococcus
GIYKFRYHILEAIKIVFEYQSIYEKMRFKDTE

SEQ ID NO: 2014116 - protein, 23 aa, Staphylococcus
GIYLRAYTYIRTMGAEGLKEVSE

SEQ ID NO: 2014117 - protein, 23 aa, Staphylococcus
GIYLRAYTYIRTMGAEGLREVSE

SEQ ID NO: 2014118 - protein, 22 aa, Staphylococcus
GIYLRAYTYIRTMGAQGLKEVS

SEQ ID NO: 2014119 - protein, 20 aa, Staphylococcus
GIYPHTVFELAKRIVPSEKV

SEQ ID NO: 2014120 - protein, 28 aa, Staphylococcus
GIYRVEKWEAFPYISFIPAREKTIISLR

SEQ ID NO: 2014121 - protein, 19 aa, Staphylococcus
GIYSYELYHFFDVDTIIRV

SEQ ID NO: 2014122 - protein, 18 aa, Staphylococcus
GIYSYELYHFFNVDTIIR

SEQ ID NO: 2014123 - protein, 20 aa, Staphylococcus
GIYSYELYNTFDVDTIIRVG

SEQ ID NO: 2014124 - protein, 19 aa, Staphylococcus
GIYVPGVAGVRIEDDILVT

SEQ ID NO: 2014125 - protein, 18 aa, Staphylococcus
GKADHVVNFMHFIAEELR

SEQ ID NO: 2014126 - protein, 20 aa, Staphylococcus
GKADIAFSLNKGRAALRHIK

SEQ ID NO: 2014127 - protein, 17 aa, Staphylococcus
GKAFGYDLERYVPVMIV

SEQ ID NO: 2014128 - protein, 23 aa, Staphylococcus
GKAFYRIHLEIDSDAPVPSQDIL

SEQ ID NO: 2014129 - protein, 35 aa, Staphylococcus
GKAHAENVIFIGLLCKDGQWHAVIFDIGRGHTREL

SEQ ID NO: 2014130 - protein, 20 aa, Staphylococcus
GKAIGDFQIWTAIQNAKYKY

SEQ ID NO: 2014131 - protein, 23 aa, Staphylococcus
GKAIRQLLRYCFTYHTHYIDASG

SEQ ID NO: 2014132 - protein, 17 aa, Staphylococcus
GKAIVIVVNKWDTVDKE

SEQ ID NO: 2014133 - protein, 19 aa, Staphylococcus
GKAKFDFGTVKFVQAFHSS

SEQ ID NO: 2014134 - protein, 29 aa, Staphylococcus
GKAKRALVARLRQSPSYQYELEVIAKDEA

SEQ ID NO: 2014135 - protein, 22 aa, Staphylococcus
GKAKRDVMISGLGFITIDEGAK

SEQ ID NO: 2014136 - protein, 25 aa, Staphylococcus
GKALFAAAFISHFSGSVPHLHFDIA

SEQ ID NO: 2014137 - protein, 22 aa, Staphylococcus
GKALFAAAFITHFSGQTPHIHF

SEQ ID NO: 2014138 - protein, 22 aa, Staphylococcus
GKALFAAAFVTHFSGQTPHIHF

SEQ ID NO: 2014139 - protein, 25 aa, Staphylococcus
GKALFAASFISHFSGSVPHLHFDIA

SEQ ID NO: 2014140 - protein, 23 aa, Staphylococcus
GKALFAATFINHFAGETPHMHFD

SEQ ID NO: 2014141 - protein, 21 aa, Staphylococcus
GKALFAATLITHFSGSTPHIH

SEQ ID NO: 2014142 - protein, 20 aa, Staphylococcus
GKANISFGYINWLDNDFTLG

SEQ ID NO: 2014143 - protein, 19 aa, Staphylococcus
GKAQHVVHFMYFIAEELRE

SEQ ID NO: 2014144 - protein, 25 aa, Staphylococcus
GKARDSIKVYSWIGGDRPSDVAREA

SEQ ID NO: 2014145 - protein, 20 aa, Staphylococcus
GKASHRGVVSTASYEARKYG

SEQ ID NO: 2014146 - protein, 18 aa, Staphylococcus
GKATGTLIGGCFEVLNNL

SEQ ID NO: 2014147 - protein, 23 aa, Staphylococcus
GKAVESYGIVGMASRQQVRDGIA

SEQ ID NO: 2014148 - protein, 17 aa, Staphylococcus
GKAYCPNHGIEIESQTV

SEQ ID NO: 2014149 - protein, 24 aa, Staphylococcus
GKAYLDGYASLWVNVHGHNNARLN

SEQ ID NO: 2014150 - protein, 17 aa, Staphylococcus
GKCPNCGSWNQMEEIVE

SEQ ID NO: 2014151 - protein, 21 aa, Staphylococcus
GKDAERIAAQLLPNVTKSQPS

SEQ ID NO: 2014152 - protein, 26 aa, Staphylococcus
GKDAFKLYDTYGFPIELTEEIADNEG

SEQ ID NO: 2014153 - protein, 25 aa, Staphylococcus
GKDAFKLYDTYGFPIELTEELATQE

SEQ ID NO: 2014154 - protein, 21 aa, Staphylococcus
GKDAFKLYDTYGFPVELTEEI

SEQ ID NO: 2014155 - protein, 21 aa, Staphylococcus
GKDALPSMIYKLFKNANQITE

SEQ ID NO: 2014156 - protein, 19 aa, Staphylococcus
GKDARRRREILGQKLHIGH

SEQ ID NO: 2014157 - protein, 19 aa, Staphylococcus
GKDAVYRCVCGHTETQAQM

SEQ ID NO: 2014158 - protein, 17 aa, Staphylococcus
GKDHHRTLVAYSLGNFL

SEQ ID NO: 2014159 - protein, 17 aa, Staphylococcus
GKDKLAHHPRLILQSNI

SEQ ID NO: 2014160 - protein, 24 aa, Staphylococcus
GKDLKVAIVVSRFNDFITGRLLEG

SEQ ID NO: 2014161 - protein, 20 aa, Staphylococcus
GKDLMLRLEKELSKLHEAFT

SEQ ID NO: 2014162 - protein, 18 aa, Staphylococcus
GKDLQPVIIGNGNTIKAQ

SEQ ID NO: 2014163 - protein, 19 aa, Staphylococcus
GKDNPNCFEVEGMPVSQLI

SEQ ID NO: 2014164 - protein, 25 aa, Staphylococcus
GKDPFRVGLKLQDNGWVYVQGLTHY

SEQ ID NO: 2014165 - protein, 17 aa, Staphylococcus
GKDPGYHTLVIKDSEAT

SEQ ID NO: 2014166 - protein, 19 aa, Staphylococcus
GKDSPILYLDGFNFENKKA

SEQ ID NO: 2014167 - protein, 19 aa, Staphylococcus
GKDSTIFLHCLPAFHDTNT

SEQ ID NO: 2014168 - protein, 23 aa, Staphylococcus
GKDTLRPLIRFNTRQNDSSAAMV

SEQ ID NO: 2014169 - protein, 18 aa, Staphylococcus
GKEAKKVYFVIGTDNNQD

SEQ ID NO: 2014170 - protein, 19 aa, Staphylococcus
GKEAVYRCVCGHTETQAQM

SEQ ID NO: 2014171 - protein, 17 aa, Staphylococcus
GKEDFTSFCHLDDLTAV

SEQ ID NO: 2014172 - protein, 20 aa, Staphylococcus
GKEFYEDIGRKGGEGNSKYE

SEQ ID NO: 2014173 - protein, 25 aa, Staphylococcus
GKEGLRLNQFYKELMVSTGSLEIEH

SEQ ID NO: 2014174 - protein, 25 aa, Staphylococcus
GKEGLRLSQFYKELMVSTGSIEIEH

SEQ ID NO: 2014175 - protein, 25 aa, Staphylococcus
GKEGLRLTQFYKELMVSTGTIQIEH

SEQ ID NO: 2014176 - protein, 19 aa, Staphylococcus
GKEGPCIDKGQSVIYKGPF

SEQ ID NO: 2014177 - protein, 18 aa, Staphylococcus
GKEGPCIDKNQSVIYKGP

SEQ ID NO: 2014178 - protein, 21 aa, Staphylococcus
GKEIKKAIGKDNTFSIMDIQA

SEQ ID NO: 2014179 - protein, 17 aa, Staphylococcus
GKEILKKGAQSVIISLG

SEQ ID NO: 2014180 - protein, 19 aa, Staphylococcus
GKEKAALINMIEQYNLNDI

SEQ ID NO: 2014181 - protein, 23 aa, Staphylococcus
GKEKIKEAFGFNSRQLITSSAMV

SEQ ID NO: 2014182 - protein, 22 aa, Staphylococcus
GKEKRDVMISGLGFITIDEGAK

SEQ ID NO: 2014183 - protein, 23 aa, Staphylococcus
GKELFKRMLPDVLIKLEKAGYET

SEQ ID NO: 2014184 - protein, 22 aa, Staphylococcus
GKELFKRMLPEVLVKMEKAGFE

SEQ ID NO: 2014185 - protein, 24 aa, Staphylococcus
GKELRDTLHYEMKWNTSKIDVLIR

SEQ ID NO: 2014186 - protein, 21 aa, Staphylococcus
GKELVAAVVNYARDNQLKIIA

SEQ ID NO: 2014187 - protein, 31 aa, Staphylococcus
GKERMPIEVVYGFAQLKRAAALANYDLGKLS

SEQ ID NO: 2014188 - protein, 30 aa, Staphylococcus
GKERMPIEVVYGFAQLKRGAALANHALGKL

SEQ ID NO: 2014189 - protein, 30 aa, Staphylococcus; identical to SEQ ID NO: 1805702

SEQ ID NO: 2014190 - protein, 29 aa, Staphylococcus
GKERMPIEVVYGFAQLKRGAALANNELGK

SEQ ID NO: 2014191 - protein, 26 aa, Staphylococcus
GKEVKLRLKGYPAVVVQHEIDHINGI

SEQ ID NO: 2014192 - protein, 18 aa, Staphylococcus
GKEVLYENFVTKDIILDW

SEQ ID NO: 2014193 - protein, 23 aa, Staphylococcus
GKEVSRIGSTFGKTNRVIIDTDD

SEQ ID NO: 2014194 - protein, 20 aa, Staphylococcus
GKFGCANCYATFKDDIVDIV

SEQ ID NO: 2014195 - protein, 20 aa, Staphylococcus
GKFGCANCYATFKEDIIDIV

SEQ ID NO: 2014196 - protein, 25 aa, Staphylococcus
GKFGCANCYAVFKEDIVDIVRRVQG

SEQ ID NO: 2014197 - protein, 19 aa, Staphylococcus
GKFGCSNCYATFKDDILDI

SEQ ID NO: 2014198 - protein, 20 aa, Staphylococcus
GKFGTVSGIGACSSAELNFY

SEQ ID NO: 2014199 - protein, 18 aa, Staphylococcus
GKFLPVETDEEWDMIEEV

SEQ ID NO: 2014200 - protein, 27 aa, Staphylococcus
GKFNMIFQFEHLGLWSTGDSKFDVLSY

SEQ ID NO: 2014201 - protein, 27 aa, Staphylococcus
GKFPEELAEKFILFFSKKNEVVFDPFM

SEQ ID NO: 2014202 - protein, 17 aa, Staphylococcus
GKFPGLVEPDESYHGIS

SEQ ID NO: 2014203 - protein, 17 aa, Staphylococcus
GKFPGLVEPDESYHGVS

SEQ ID NO: 2014204 - protein, 17 aa, Staphylococcus
GKFSQWIASKILIPTPF

SEQ ID NO: 2014205 - protein, 22 aa, Staphylococcus
GKGDALRFKSDITHSYTNHGED

SEQ ID NO: 2014206 - protein, 22 aa, Staphylococcus
GKGEDLFGILCHVDVVPAGEGW

SEQ ID NO: 2014207 - protein, 26 aa, Staphylococcus
GKGFQELKIAISRYLPNDAINNNHLE

SEQ ID NO: 2014208 - protein, 23 aa, Staphylococcus
GKGHGEGAVFVGRVNLYVVLDND

SEQ ID NO: 2014209 - protein, 22 aa, Staphylococcus
GKGHVRISYAYELDALKEAMRR

SEQ ID NO: 2014210 - protein, 17 aa, Staphylococcus
GKGIYIFELNEDNGEIQ

SEQ ID NO: 2014211 - protein, 20 aa, Staphylococcus
GKGIYRFELEDLKGTIKEVQ

SEQ ID NO: 2014212 - protein, 19 aa, Staphylococcus
GKGKVVLVTAMSPTPAGEG

SEQ ID NO: 2014213 - protein, 20 aa, Staphylococcus
GKGLAGLVIRTGSRKIVEDV

SEQ ID NO: 2014214 - protein, 17 aa, Staphylococcus
GKGLIITGSLYFISEVK

SEQ ID NO: 2014215 - protein, 21 aa, Staphylococcus
GKGRNGKSIFVEVISEILGDY

SEQ ID NO: 2014216 - protein, 23 aa, Staphylococcus
GKGRTFFIKTFGCQMNAHDTEVM

SEQ ID NO: 2014217 - protein, 19 aa, Staphylococcus
GKGSAYLGTNGFQINETVT

SEQ ID NO: 2014218 - protein, 26 aa, Staphylococcus
GKGVRVVSMPNWFAFEQQSDDYKESV

SEQ ID NO: 2014219 - protein, 26 aa, Staphylococcus
GKGVRVVSMPNWFAFEQQSEDYKESV

SEQ ID NO: 2014220 - protein, 18 aa, Staphylococcus
GKGVYRFQLDEETGKITE

SEQ ID NO: 2014221 - protein, 19 aa, Staphylococcus
GKHAFAEKLKQLGYDITAE

SEQ ID NO: 2014222 - protein, 21 aa, Staphylococcus
GKHAFAEKLKTLGYDIEPKQQ

SEQ ID NO: 2014223 - protein, 25 aa, Staphylococcus
GKHAFAEKLTALGYDVDPEEQKTLF

SEQ ID NO: 2014224 - protein, 18 aa, Staphylococcus
GKHALEFVEQIRKKLTKE

SEQ ID NO: 2014225 - protein, 22 aa, Staphylococcus
GKHIPSDVKVIGFNDLDVNQYV

SEQ ID NO: 2014226 - protein, 23 aa, Staphylococcus
GKHPLEFFSSSPIFYSNNNPFGI

SEQ ID NO: 2014227 - protein, 28 aa, Staphylococcus
GKHPLQITDLMCHMLIMLKRGSGVGYEL

SEQ ID NO: 2014228 - protein, 23 aa, Staphylococcus
GKHRVSGIVTFGHLLTRAVARDV

SEQ ID NO: 2014229 - protein, 18 aa, Staphylococcus
GKHSYRLDGDNVRHGLNK

SEQ ID NO: 2014230 - protein, 19 aa, Staphylococcus
GKHVHPKITAIVVPGSRTV

SEQ ID NO: 2014231 - protein, 21 aa, Staphylococcus
GKHVLPGFIDIHIHGGYGEDA

SEQ ID NO: 2014232 - protein, 21 aa, Staphylococcus
GKIAQFRYDHYLQLYNEIADR

SEQ ID NO: 2014233 - protein, 20 aa, Staphylococcus
GKIAQFRYEHYLQLFNEISN

SEQ ID NO: 2014234 - protein, 23 aa, Staphylococcus
GKIDEIKAFIDLHDIDVVVANDE

SEQ ID NO: 2014235 - protein, 19 aa, Staphylococcus
GKIFGEIKGQLDAAFDEEE

SEQ ID NO: 2014236 - protein, 19 aa, Staphylococcus
GKIGRKAISTYLPKIKQSY

SEQ ID NO: 2014237 - protein, 19 aa, Staphylococcus
GKIGRKSREDKNNWDDFLY

SEQ ID NO: 2014238 - protein, 19 aa, Staphylococcus
GKIIEYINHVYIMLNKPKG

SEQ ID NO: 2014239 - protein, 27 aa, Staphylococcus
GKIIMFGGGGYNIWTVVPRAWSHVYLA

SEQ ID NO: 2014240 - protein, 20 aa, Staphylococcus
GKIINIGSMQSYRAGKNIFP

SEQ ID NO: 2014241 - protein, 17 aa, Staphylococcus
GKILEELIYNNRIIGGV

SEQ ID NO: 2014242 - protein, 20 aa, Staphylococcus
GKILYRDQNIFDAKYSKEKL

SEQ ID NO: 2014243 - protein, 26 aa, Staphylococcus
GKIMKMTWPKSSKILYAPISGFHAFD

SEQ ID NO: 2014244 - protein, 25 aa, Staphylococcus
GKINDLRIGDTLFRGENTTSGQPMP

SEQ ID NO: 2014245 - protein, 25 aa, Staphylococcus
GKINELRIGEALFRGIDTTTNEPIA

SEQ ID NO: 2014246 - protein, 25 aa, Staphylococcus
GKINELRIGETLFRGVDTTTDKPVS

SEQ ID NO: 2014247 - protein, 18 aa, Staphylococcus
GKIPADYTSKEKLPHQAA

SEQ ID NO: 2014248 - protein, 18 aa, Staphylococcus
GKIPGGFKKREGRPADEA

SEQ ID NO: 2014249 - protein, 17 aa, Staphylococcus
GKIPGGFKKREGRPGDE

SEQ ID NO: 2014250 - protein, 23 aa, Staphylococcus
GKIPIIAGGTGLYIQSLIYDYPF

SEQ ID NO: 2014251 - protein, 20 aa, Staphylococcus
GKIPYICYKTSNSRWVNIRT

SEQ ID NO: 2014252 - protein, 23 aa, Staphylococcus
GKISEGAICYTGDILDTSRSNVF

SEQ ID NO: 2014253 - protein, 23 aa, Staphylococcus
GKISEGAICYTGDILNPERSNVF

SEQ ID NO: 2014254 - protein, 24 aa, Staphylococcus
GKISEGAICYTGDILNVERSNIYT

SEQ ID NO: 2014255 - protein, 23 aa, Staphylococcus
GKISEGTICYTGDILNPERSNIY

SEQ ID NO: 2014256 - protein, 23 aa, Staphylococcus
GKISEGTICYTGDILNPERSNVF

SEQ ID NO: 2014257 - protein, 23 aa, Staphylococcus
GKISEGTICYTGDILNPNRSDIY

SEQ ID NO: 2014258 - protein, 17 aa, Staphylococcus
GKISMTMHAFPQEIREL

SEQ ID NO: 2014259 - protein, 25 aa, Staphylococcus
GKITRNAGVRIIRDGIVLFEGELDT

SEQ ID NO: 2014260 - protein, 24 aa, Staphylococcus
GKITRNAGVRVIRDGIVLFEGELD

SEQ ID NO: 2014261 - protein, 24 aa, Staphylococcus
GKITRNAGVRVIRDGIVQFEGELD

SEQ ID NO: 2014262 - protein, 25 aa, Staphylococcus
GKIVLNCIHKGIYLLDVPLSEYQAQ

SEQ ID NO: 2014263 - protein, 18 aa, Staphylococcus
GKKATDWLITQGQFSYKK

SEQ ID NO: 2014264 - protein, 18 aa, Staphylococcus
GKKDELYVFNGYAGSDKD

SEQ ID NO: 2014265 - protein, 23 aa, Staphylococcus
GKKDLIARCGYRLTAPGIGKEAG

SEQ ID NO: 2014266 - protein, 24 aa, Staphylococcus
GKKEAVDFYLAKGVIDRVAQKLNL

SEQ ID NO: 2014267 - protein, 24 aa, Staphylococcus
GKKFGKSESGAVWLDAEKTTPYEF

SEQ ID NO: 2014268 - protein, 24 aa, Staphylococcus
GKKFGKSESGAVWLDPEKTSPYEF

SEQ ID NO: 2014269 - protein, 24 aa, Staphylococcus
GKKFGKTEGGAVWLDAAKTSPYEF

SEQ ID NO: 2014270 - protein, 20 aa, Staphylococcus
GKKGALSYIQDIWGYIAPNT

SEQ ID NO: 2014271 - protein, 19 aa, Staphylococcus
GKKGVAITFVNPIEMDYIR

SEQ ID NO: 2014272 - protein, 23 aa, Staphylococcus
GKKHKEAILSWLNAAEIDPKRRG

SEQ ID NO: 2014273 - protein, 25 aa, Staphylococcus
GKKIPDEFVVGYGLDYAEHYRNLPY

SEQ ID NO: 2014274 - protein, 26 aa, Staphylococcus
GKKIPDEFVVGYGLDYGEHYRNLPYI

SEQ ID NO: 2014275 - protein, 27 aa, Staphylococcus
GKKIPDEFVVGYGLDYGELYRNLPYIG

SEQ ID NO: 2014276 - protein, 18 aa, Staphylococcus
GKKIVICASTGNTSASAA

SEQ ID NO: 2014277 - protein, 21 aa, Staphylococcus
GKKKICGFLTEMVANYDAIEA

SEQ ID NO: 2014278 - protein, 20 aa, Staphylococcus
GKKPRVKFEKVFADHFMSLY

SEQ ID NO: 2014279 - protein, 25 aa, Staphylococcus
GKKPRVKFEKVFADHYLKLYDETKN

SEQ ID NO: 2014280 - protein, 19 aa, Staphylococcus
GKKRIEVPEARRDITDRKI

SEQ ID NO: 2014281 - protein, 23 aa, Staphylococcus
GKKRMPTANFLSGYQEDLVGKEL

SEQ ID NO: 2014282 - protein, 20 aa, Staphylococcus
GKKSVAIRLNYLDTEDTLTD

SEQ ID NO: 2014283 - protein, 27 aa, Staphylococcus
GKKTALALEMIHTYSLIHDDLPAMDND

SEQ ID NO: 2014284 - protein, 19 aa, Staphylococcus
GKKVCGFLTEMVANYDAIE

SEQ ID NO: 2014285 - protein, 17 aa, Staphylococcus
GKKWLDDKLFNIDNFTK

SEQ ID NO: 2014286 - protein, 19 aa, Staphylococcus
GKKWNGVIINYLFEAPSFY

SEQ ID NO: 2014287 - protein, 17 aa, Staphylococcus
GKKYKSKIHQWLENADI

SEQ ID NO: 2014288 - protein, 17 aa, Staphylococcus
GKLADQIFRDELANAPI

SEQ ID NO: 2014289 - protein, 17 aa, Staphylococcus
GKLAVYMPTYRENHQAN

SEQ ID NO: 2014290 - protein, 20 aa, Staphylococcus
GKLDEIIDALTLAEQTDKLK

SEQ ID NO: 2014291 - protein, 25 aa, Staphylococcus
GKLEFRLLKGTSLVMVHLYDYIPKL

SEQ ID NO: 2014292 - protein, 26 aa, Staphylococcus
GKLEFRLLKNNAIVLVHLYDYIPKMF

SEQ ID NO: 2014293 - protein, 23 aa, Staphylococcus
GKLGSGQQWYSWIHIDDLIRGII

SEQ ID NO: 2014294 - protein, 17 aa, Staphylococcus
GKLIFKDISCAINDQHL

SEQ ID NO: 2014295 - protein, 18 aa, Staphylococcus
GKLIPIETDEEWDMIEEV

SEQ ID NO: 2014296 - protein, 20 aa, Staphylococcus
GKLIPLFKILGKIIKNMKPV

SEQ ID NO: 2014297 - protein, 20 aa, Staphylococcus
GKLISETFIADGQKGKNGQD

SEQ ID NO: 2014298 - protein, 19 aa, Staphylococcus
GKLISETFISDGQNGKDGQ

SEQ ID NO: 2014299 - protein, 17 aa, Staphylococcus
GKLKGLITIKDIEKVLE

SEQ ID NO: 2014300 - protein, 22 aa, Staphylococcus
GKLKPKAIIVGKPLVNMGTIAA

SEQ ID NO: 2014301 - protein, 21 aa, Staphylococcus
GKLKSKHAVIIGAGEMSELSL

SEQ ID NO: 2014302 - protein, 23 aa, Staphylococcus
GKLLDHLEHLAIEHERQGITLTC

SEQ ID NO: 2014303 - protein, 17 aa, Staphylococcus
GKLLLFDIVDAFIKAEY

SEQ ID NO: 2014304 - protein, 18 aa, Staphylococcus
GKLLLKNIHESFKEKVAE

SEQ ID NO: 2014305 - protein, 23 aa, Staphylococcus
GKLNEVLLAMGISDRQIEGSIRI

SEQ ID NO: 2014306 - protein, 20 aa, Staphylococcus
GKLNEVLMSMGLPDNKIEGS

SEQ ID NO: 2014307 - protein, 17 aa, Staphylococcus
GKLPEEVEYLSGILTGE

SEQ ID NO: 2014308 - protein, 18 aa, Staphylococcus
GKLRPSFDSTGIYPRVEH

SEQ ID NO: 2014309 - protein, 17 aa, Staphylococcus
GKLTNHKVYGEWKALLA

SEQ ID NO: 2014310 - protein, 19 aa, Staphylococcus
GKLWLKCDSHLAISGSIKA

SEQ ID NO: 2014311 - protein, 17 aa, Staphylococcus
GKLYRSGDLARYTHDGQ

SEQ ID NO: 2014312 - protein, 19 aa, Staphylococcus
GKMKVTLNKTGNWLDSLKF

SEQ ID NO: 2014313 - protein, 23 aa, Staphylococcus
GKNCPYNNTALCFGHAEDIQLLD

SEQ ID NO: 2014314 - protein, 24 aa, Staphylococcus
GKNDEVLEFFGLKVLVDKHDAPVL

SEQ ID NO: 2014315 - protein, 18 aa, Staphylococcus
GKNDWAFETKDKSFVAQI

SEQ ID NO: 2014316 - protein, 18 aa, Staphylococcus
GKNIALIFEKDSTRTRCA

SEQ ID NO: 2014317 - protein, 20 aa, Staphylococcus
GKNILPGFIDIHIHGGYGED

SEQ ID NO: 2014318 - protein, 23 aa, Staphylococcus
GKNKGLKQSLAFEFKEQENVLIL

SEQ ID NO: 2014319 - protein, 23 aa, Staphylococcus
GKNKVGSRFGCIWHGKDKASIQQ

SEQ ID NO: 2014320 - protein, 20 aa, Staphylococcus
GKNLKIIANYGAGFNNVDID

SEQ ID NO: 2014321 - protein, 20 aa, Staphylococcus
GKNLKIITNYGAGFNNVDVD

SEQ ID NO: 2014322 - protein, 23 aa, Staphylococcus
GKNLKVAIVVSRFNDFITGRLLE

SEQ ID NO: 2014323 - protein, 19 aa, Staphylococcus
GKNLMLRLEKELSKLHEAF

SEQ ID NO: 2014324 - protein, 20 aa, Staphylococcus
GKNLMLRLEKELSKLHEAFT

SEQ ID NO: 2014325 - protein, 25 aa, Staphylococcus
GKNPFPKDWRMHAFFMDALPILNEK

SEQ ID NO: 2014326 - protein, 25 aa, Staphylococcus
GKNPFPKEWRMHAFFMDALPILNES

SEQ ID NO: 2014327 - protein, 26 aa, Staphylococcus
GKNPFPKEWRMHAFFVDALPILNESR

SEQ ID NO: 2014328 - protein, 18 aa, Staphylococcus
GKNPIKVILAQNGNIDFN

SEQ ID NO: 2014329 - protein, 17 aa, Staphylococcus
GKNVWFGVREFAMGAAV

SEQ ID NO: 2014330 - protein, 19 aa, Staphylococcus
GKNYGVVMEELRLLARSVF

SEQ ID NO: 2014331 - protein, 22 aa, Staphylococcus
GKPCKDLAIGFSNLDVEKYELL

SEQ ID NO: 2014332 - protein, 17 aa, Staphylococcus
GKPDAILSISDEQAIGL

SEQ ID NO: 2014333 - protein, 22 aa, Staphylococcus
GKPEDIVNCAIYLASDESNWTN

SEQ ID NO: 2014334 - protein, 23 aa, Staphylococcus
GKPEELVGALLFLVSKEASSFVN

SEQ ID NO: 2014335 - protein, 17 aa, Staphylococcus
GKPLPGIEAAIVDDQGN

SEQ ID NO: 2014336 - protein, 18 aa, Staphylococcus
GKPLPNRRNVVLTHNQNF

SEQ ID NO: 2014337 - protein, 22 aa, Staphylococcus
GKPLPNRRNVVLTRNKSFKPEG

SEQ ID NO: 2014338 - protein, 21 aa, Staphylococcus
GKPNIKAQVKLFKKTNYLKQD

SEQ ID NO: 2014339 - protein, 21 aa, Staphylococcus
GKPTIVTAFSYEMFMKFLSDI

SEQ ID NO: 2014340 - protein, 21 aa, Staphylococcus
GKPYAGFVYDVMRDVLYHTKV

SEQ ID NO: 2014341 - protein, 20 aa, Staphylococcus
GKPYLWGAWILLAAMNEEHM

SEQ ID NO: 2014342 - protein, 17 aa, Staphylococcus
GKQILGIDPAFRTGCKL

SEQ ID NO: 2014343 - protein, 25 aa, Staphylococcus
GKQKSDIGMFFPFTVTGNVIGKAAE

SEQ ID NO: 2014344 - protein, 20 aa, Staphylococcus
GKQLMLRLEKELSKLHEAFT

SEQ ID NO: 2014345 - protein, 18 aa, Staphylococcus
GKQNGIIVIIKDGDGKEI

SEQ ID NO: 2014346 - protein, 19 aa, Staphylococcus
GKQRTDKRVYDWVQEVEAL

SEQ ID NO: 2014347 - protein, 18 aa, Staphylococcus
GKQSEIMQVYPLLDITRE

SEQ ID NO: 2014348 - protein, 21 aa, Staphylococcus
GKQSIICFDQSFHGRTYGAMS

SEQ ID NO: 2014349 - protein, 17 aa, Staphylococcus
GKQVLSLIPNASVVAKF

SEQ ID NO: 2014350 - protein, 22 aa, Staphylococcus
GKRAMTTFERYFIKDKTAHKET

SEQ ID NO: 2014351 - protein, 27 aa, Staphylococcus
GKRFERTRHNIGFEVIDYILDKNQFTL

SEQ ID NO: 2014352 - protein, 19 aa, Staphylococcus
GKRILRAETAPLYALSAIS

SEQ ID NO: 2014353 - protein, 22 aa, Staphylococcus
GKRIRPLLLIETLKMLSNNSDY

SEQ ID NO: 2014354 - protein, 22 aa, Staphylococcus
GKRIRPVLVLLTLEVLNENYKK

SEQ ID NO: 2014355 - protein, 20 aa, Staphylococcus
GKRKGMPYTQHLVRSHLNYL

SEQ ID NO: 2014356 - protein, 18 aa, Staphylococcus
GKRLTGFSNLEEKLANRK

SEQ ID NO: 2014357 - protein, 23 aa, Staphylococcus
GKRMEPEYRKLIKGEKVQSLEKT

SEQ ID NO: 2014358 - protein, 26 aa, Staphylococcus
GKRNFPSIRTLFLLLVGFKNSKLSNQ

SEQ ID NO: 2014359 - protein, 18 aa, Staphylococcus
GKRRLAYEIEDFKEGFYF

SEQ ID NO: 2014360 - protein, 24 aa, Staphylococcus
GKRSVARNIFFEKALKVMRPVYLN

SEQ ID NO: 2014361 - protein, 25 aa, Staphylococcus
GKRTARAAIEIAVDMVNEGLITRKE

SEQ ID NO: 2014362 - protein, 19 aa, Staphylococcus
GKRTSICSVGMVKVINNQI

SEQ ID NO: 2014363 - protein, 19 aa, Staphylococcus
GKRTSICSVGMVKVVDNEI

SEQ ID NO: 2014364 - protein, 21 aa, Staphylococcus
GKRVRPLLLLLTLDMLNKDYQ

SEQ ID NO: 2014365 - protein, 23 aa, Staphylococcus
GKRYRLCDVYKYFDVADSTVRKR

SEQ ID NO: 2014366 - protein, 17 aa, Staphylococcus
GKSAVTIVVEGRKNGNQ

SEQ ID NO: 2014367 - protein, 17 aa, Staphylococcus
GKSECWYIIDAEEDAEI

SEQ ID NO: 2014368 - protein, 19 aa, Staphylococcus
GKSFILGAIANQLKAKSVA

SEQ ID NO: 2014369 - protein, 18 aa, Staphylococcus
GKSFILGAIANQLKSKHV

SEQ ID NO: 2014370 - protein, 24 aa, Staphylococcus
GKSHAFLLPLIERIDPSIQEPQAI

SEQ ID NO: 2014371 - protein, 21 aa, Staphylococcus
GKSHLAYAVAKAIKQQGYSVA

SEQ ID NO: 2014372 - protein, 17 aa, Staphylococcus
GKSLLIALIRQQVKPDK

SEQ ID NO: 2014373 - protein, 19 aa, Staphylococcus
GKSLLTRTILGMKPSQLSY

SEQ ID NO: 2014374 - protein, 25 aa, Staphylococcus
GKSLSRLGGGIGTRGPGETKLETDR

SEQ ID NO: 2014375 - protein, 23 aa, Staphylococcus
GKSMNRPALQRMLHDANKGHIDC

SEQ ID NO: 2014376 - protein, 23 aa, Staphylococcus
GKSMNRPELQRMLNDAKNGKLDC

SEQ ID NO: 2014377 - protein, 23 aa, Staphylococcus
GKSPYPRDAFNMARYIDDEPSHV

SEQ ID NO: 2014378 - protein, 17 aa, Staphylococcus
GKSQSFIANKLRLLKLA

SEQ ID NO: 2014379 - protein, 23 aa, Staphylococcus
GKSRSIPIFVFLNDNFEQENVWG

SEQ ID NO: 2014380 - protein, 19 aa, Staphylococcus
GKSSAPREVSAWRPEVMQA

SEQ ID NO: 2014381 - protein, 21 aa, Staphylococcus
GKSSLLKCLIGEFNATGEMYL

SEQ ID NO: 2014382 - protein, 28 aa, Staphylococcus
GKSSVIGTMGYLLPKYIDIQFLYYRMKL

SEQ ID NO: 2014383 - protein, 21 aa, Staphylococcus
GKSSYKRALSLGHILDSNGKK

SEQ ID NO: 2014384 - protein, 20 aa, Staphylococcus
GKSTLLKALSRLLSIKEGAI

SEQ ID NO: 2014385 - protein, 23 aa, Staphylococcus
GKSTLLLQICAALSQNKNVLYIT

SEQ ID NO: 2014386 - protein, 24 aa, Staphylococcus
GKSTLLLQICASLSQQLNVLYITG

SEQ ID NO: 2014387 - protein, 24 aa, Staphylococcus
GKSTLLLQICASLSQSKNVLYITG

SEQ ID NO: 2014388 - protein, 22 aa, Staphylococcus
GKSTLLLQICSALSQNKKVLYI

SEQ ID NO: 2014389 - protein, 18 aa, Staphylococcus
GKSTLLRCMNLLETPTSG

SEQ ID NO: 2014390 - protein, 19 aa, Staphylococcus
GKSTLLSAITKLMSIDSGT

SEQ ID NO: 2014391 - protein, 19 aa, Staphylococcus
GKSTLLSAVSRLFEYEKGT

SEQ ID NO: 2014392 - protein, 19 aa, Staphylococcus
GKSTLLSAVSRLFEYENGT

SEQ ID NO: 2014393 - protein, 18 aa, Staphylococcus
GKSYPRIINELIQHQSTN

SEQ ID NO: 2014394 - protein, 17 aa, Staphylococcus
GKSYPRIISELLGEPPL

SEQ ID NO: 2014395 - protein, 18 aa, Staphylococcus
GKSYPRILSELITDNDLL

SEQ ID NO: 2014396 - protein, 25 aa, Staphylococcus
GKTDTPLRYVLPFNEGNRYLVMPAL

SEQ ID NO: 2014397 - protein, 18 aa, Staphylococcus
GKTEIARRMARLVGAPFI

SEQ ID NO: 2014398 - protein, 26 aa, Staphylococcus
GKTETPLRHVLPFNKHNRYLVMPALS

SEQ ID NO: 2014399 - protein, 25 aa, Staphylococcus
GKTETPLRYVLPFNKENRYLVMPAL

SEQ ID NO: 2014400 - protein, 21 aa, Staphylococcus
GKTGAFGIPLIEKVADQEGVQ

SEQ ID NO: 2014401 - protein, 21 aa, Staphylococcus
GKTGAFGIPLIEKVVDKEGVQ

SEQ ID NO: 2014402 - protein, 21 aa, Staphylococcus
GKTGAFGIPLIEKVVGEQGVQ

SEQ ID NO: 2014403 - protein, 21 aa, Staphylococcus
GKTGAFGIPLIEKVVGKSGVQ

SEQ ID NO: 2014404 - protein, 21 aa, Staphylococcus
GKTGAFGIPLIEKVVGQQGVQ

SEQ ID NO: 2014405 - protein, 20 aa, Staphylococcus
GKTGAFGIPLIEKVVGQSGV

SEQ ID NO: 2014406 - protein, 21 aa, Staphylococcus
GKTGAFGIPLIEKVVNKSGVQ

SEQ ID NO: 2014407 - protein, 22 aa, Staphylococcus
GKTGEMQLHLNVYKQKYCKTCG

SEQ ID NO: 2014408 - protein, 17 aa, Staphylococcus
GKTGIEVLAESKTLKLQ

SEQ ID NO: 2014409 - protein, 18 aa, Staphylococcus
GKTGKMQLHLNVYKQKTC

SEQ ID NO: 2014410 - protein, 18 aa, Staphylococcus
GKTHLMHAIGHYVLDNNP

SEQ ID NO: 2014411 - protein, 18 aa, Staphylococcus
GKTHLMHAIGHYVLENNR

SEQ ID NO: 2014412 - protein, 25 aa, Staphylococcus
GKTIYHCGDTGLFSDMKLIADRHPV

SEQ ID NO: 2014413 - protein, 22 aa, Staphylococcus
GKTKRIGITRLHMEEDAGKSTH

SEQ ID NO: 2014414 - protein, 18 aa, Staphylococcus
GKTLAKFAANQGQRVAVV

SEQ ID NO: 2014415 - protein, 18 aa, Staphylococcus
GKTLAKYVASQGQHVALV

SEQ ID NO: 2014416 - protein, 17 aa, Staphylococcus
GKTMIFDAIVFSLFGKA

SEQ ID NO: 2014417 - protein, 23 aa, Staphylococcus
GKTNRKAQFVCVISMSAPNEPTH

SEQ ID NO: 2014418 - protein, 19 aa, Staphylococcus
GKTQGEDAVKVYLESDHAF

SEQ ID NO: 2014419 - protein, 17 aa, Staphylococcus
GKTQVEVILDLKLIFST

SEQ ID NO: 2014420 - protein, 18 aa, Staphylococcus
GKTQYGFIGAGSDMEGFL

SEQ ID NO: 2014421 - protein, 20 aa, Staphylococcus
GKTTLLDSIRHTKVTAGEAG

SEQ ID NO: 2014422 - protein, 19 aa, Staphylococcus
GKTTLLRLIAGLEQPDSGT

SEQ ID NO: 2014423 - protein, 24 aa, Staphylococcus
GKTTTFRMILGLSEPTEGHITYDG

SEQ ID NO: 2014424 - protein, 24 aa, Staphylococcus
GKTTTFRMILGLSETTTGHITYEG

SEQ ID NO: 2014425 - protein, 23 aa, Staphylococcus
GKTTTFRMILGLTPITKGSITYN

SEQ ID NO: 2014426 - protein, 20 aa, Staphylococcus
GKTTTFRMILGLTPLTEGSV

SEQ ID NO: 2014427 - protein, 23 aa, Staphylococcus
GKTTTIKCLLGMEKLNSGTTEIF

SEQ ID NO: 2014428 - protein, 19 aa, Staphylococcus
GKTVIPVERYGVKVISMAF

SEQ ID NO: 2014429 - protein, 18 aa, Staphylococcus
GKTVMGFYRQRSHDIIDM

SEQ ID NO: 2014430 - protein, 20 aa, Staphylococcus
GKTYKAEVTLGVSTTTEDQT

SEQ ID NO: 2014431 - protein, 18 aa, Staphylococcus
GKVAIYVPTYREHKQANR

SEQ ID NO: 2014432 - protein, 17 aa, Staphylococcus
GKVAVVLIAHGSRSYTQ

SEQ ID NO: 2014433 - protein, 19 aa, Staphylococcus
GKVDAAIFNLGYLPKGDKS

SEQ ID NO: 2014434 - protein, 19 aa, Staphylococcus
GKVDLCLNTLPLWNKNIQY

SEQ ID NO: 2014435 - protein, 17 aa, Staphylococcus
GKVESGLREVLNETSQY

SEQ ID NO: 2014436 - protein, 20 aa, Staphylococcus
GKVGIDFFKNRSIEVEYALP

SEQ ID NO: 2014437 - protein, 17 aa, Staphylococcus
GKVIQLWHGTPIKRLFL

SEQ ID NO: 2014438 - protein, 20 aa, Staphylococcus
GKVITCKELTLPYNEELNGI

SEQ ID NO: 2014439 - protein, 17 aa, Staphylococcus
GKVKEAVNNVIDKVKGN

SEQ ID NO: 2014440 - protein, 24 aa, Staphylococcus
GKVKRIEKYGAFVELFPGKDALVH

SEQ ID NO: 2014441 - protein, 26 aa, Staphylococcus
GKVKRLHLPQGFNIRVDSLLYAGYQV

SEQ ID NO: 2014442 - protein, 27 aa, Staphylococcus
GKVLMFGGGGYNIWQVVPRAWSHIFLA

SEQ ID NO: 2014443 - protein, 23 aa, Staphylococcus
GKVLYLEIGIGYTTPQFVKHPFQ

SEQ ID NO: 2014444 - protein, 20 aa, Staphylococcus
GKVMTCNELTLPYHEALKGI

SEQ ID NO: 2014445 - protein, 17 aa, Staphylococcus
GKVSLFLINSLREVADV

SEQ ID NO: 2014446 - protein, 19 aa, Staphylococcus
GKVTGIKKFGAFVELPEGK

SEQ ID NO: 2014447 - protein, 17 aa, Staphylococcus
GKVVYRGIVKFGRKAKG

SEQ ID NO: 2014448 - protein, 19 aa, Staphylococcus
GKWFFNRYSPVTNIKAVGN

SEQ ID NO: 2014449 - protein, 17 aa, Staphylococcus
GKWKVRTYGAKRAADDY

SEQ ID NO: 2014450 - protein, 17 aa, Staphylococcus
GKWSSEVDVRNFIQLNY

SEQ ID NO: 2014451 - protein, 18 aa, Staphylococcus
GKWSYLYRAIDAEEHTLD

SEQ ID NO: 2014452 - protein, 18 aa, Staphylococcus
GKWSYLYRAIDAEGYTLD

SEQ ID NO: 2014453 - protein, 17 aa, Staphylococcus
GKWSYLYRAIDTEGHTL

SEQ ID NO: 2014454 - protein, 17 aa, Staphylococcus
GKWTSIVGHNGSGKSTI

SEQ ID NO: 2014455 - protein, 19 aa, Staphylococcus
GKWYYDFGYEGKRYKKKGF

SEQ ID NO: 2014456 - protein, 17 aa, Staphylococcus
GKYARGINNNFIQSFKN

SEQ ID NO: 2014457 - protein, 19 aa, Staphylococcus
GKYDMRFFNTIGAAAQLQQ

SEQ ID NO: 2014458 - protein, 20 aa, Staphylococcus
GKYDSCAFMKEMKNFTKDIV

SEQ ID NO: 2014459 - protein, 22 aa, Staphylococcus
GKYEGLERFECRKQLVEDLKEQ

SEQ ID NO: 2014460 - protein, 20 aa, Staphylococcus
GKYGVLIRPEHVHIEEATHS

SEQ ID NO: 2014461 - protein, 18 aa, Staphylococcus
GKYHIYKVNAPIVEGSFT

SEQ ID NO: 2014462 - protein, 23 aa, Staphylococcus
GKYHPHGDLSIYDAMVRMAQTFS

SEQ ID NO: 2014463 - protein, 27 aa, Staphylococcus
GKYKAEYRQGYFTSFERKNEADGIAEY

SEQ ID NO: 2014464 - protein, 24 aa, Staphylococcus
GKYKAEYRQGYWNSIDRTNDAEDI

SEQ ID NO: 2014465 - protein, 20 aa, Staphylococcus
GKYKDCYVMGLLKTKWIEQR

SEQ ID NO: 2014466 - protein, 19 aa, Staphylococcus
GKYLPKRQIVEIEEFEAAV

SEQ ID NO: 2014467 - protein, 19 aa, Staphylococcus
GKYRLKLTLEQNGQLNYVL

SEQ ID NO: 2014468 - protein, 22 aa, Staphylococcus
GKYSAKERLVLNIINYEKVAEE

SEQ ID NO: 2014469 - protein, 19 aa, Staphylococcus
GKYYIRLLLKVIIKSATKK

SEQ ID NO: 2014470 - protein, 24 aa, Staphylococcus
GKYYLIEPPFRGFPDFIETTVDGF

SEQ ID NO: 2014471 - protein, 18 aa, Staphylococcus
GLADKVPYLTEDELKNRG

SEQ ID NO: 2014472 - protein, 20 aa, Staphylococcus
GLAHAGWRGTYGQIVIEMIN

SEQ ID NO: 2014473 - protein, 19 aa, Staphylococcus
GLALLKEIIYNPIVEDGKF

SEQ ID NO: 2014474 - protein, 28 aa, Staphylococcus
GLANKISLKFAKKIYTTFEDTLKYLPKE

SEQ ID NO: 2014475 - protein, 17 aa, Staphylococcus
GLCELLVDWLNNETEDF

SEQ ID NO: 2014476 - protein, 17 aa, Staphylococcus
GLCNHWLSTSRDTAENF

SEQ ID NO: 2014477 - protein, 18 aa, Staphylococcus
GLDALKFLIEERGVKSIG

SEQ ID NO: 2014478 - protein, 18 aa, Staphylococcus
GLDFKASKFPYAANGRAL

SEQ ID NO: 2014479 - protein, 30 aa, Staphylococcus
GLDGEIPGAISFAPFNLVLRFGLDSQDVED

SEQ ID NO: 2014480 - protein, 35 aa, Staphylococcus
GLDKIFKDAGFDWREPGCSMCLGMNPDQVPNGVHC

SEQ ID NO: 2014481 - protein, 19 aa, Staphylococcus
GLDKRQGRQLLEYLGAPKH

SEQ ID NO: 2014482 - protein, 18 aa, Staphylococcus
GLDPRAVRDVRELIVKKA

SEQ ID NO: 2014483 - protein, 25 aa, Staphylococcus
GLDQFKLRVSEYNDLDLVNSLIAHA

SEQ ID NO: 2014484 - protein, 21 aa, Staphylococcus
GLDQSIPFLIAGGIDVDKIKQ

SEQ ID NO: 2014485 - protein, 26 aa, Staphylococcus
GLDVVWQFAEKVIFPYVEDDELVGVV

SEQ ID NO: 2014486 - protein, 23 aa, Staphylococcus
GLEAGLPIKEAFKQAVSAGTATA

SEQ ID NO: 2014487 - protein, 23 aa, Staphylococcus
GLEAMTIHRLIGWSQETKPEDVL

SEQ ID NO: 2014488 - protein, 27 aa, Staphylococcus
GLEATFGVKCDFEFSKDYPALYNDPDF

SEQ ID NO: 2014489 - protein, 23 aa, Staphylococcus
GLEDDALCFYDIGSSEMNIDMAI

SEQ ID NO: 2014490 - protein, 21 aa, Staphylococcus
GLEEELKMLLIPKDPNDDKNV

SEQ ID NO: 2014491 - protein, 18 aa, Staphylococcus
GLEIAKSFIEQGAKVVFS

SEQ ID NO: 2014492 - protein, 18 aa, Staphylococcus
GLEISAGIAKGSFSDGTN

SEQ ID NO: 2014493 - protein, 23 aa, Staphylococcus
GLEISELGLGCMSLGTKKKHAQA

SEQ ID NO: 2014494 - protein, 18 aa, Staphylococcus
GLELGLSLEEAFCQAVAS

SEQ ID NO: 2014495 - protein, 19 aa, Staphylococcus
GLEPPKELIEAATEMNTPL

SEQ ID NO: 2014496 - protein, 22 aa, Staphylococcus
GLEPSLAFKIMEAVRKGKGLQE

SEQ ID NO: 2014497 - protein, 21 aa, Staphylococcus
GLEPSMAFKIMESVRKGKGLT

SEQ ID NO: 2014498 - protein, 21 aa, Staphylococcus
GLEPTQLVVIAARPSVGKTGF

SEQ ID NO: 2014499 - protein, 20 aa, Staphylococcus
GLETVLRRFIYQVSAEIGID

SEQ ID NO: 2014500 - protein, 18 aa, Staphylococcus
GLEVFRALYNKFPDETEL

SEQ ID NO: 2014501 - protein, 25 aa, Staphylococcus
GLEVVWKFAQKVIFPYVEHNELIGV

SEQ ID NO: 2014502 - protein, 32 aa, Staphylococcus
GLFATYLYPKRMFWIKGQSFAINIDPFDMNVE

SEQ ID NO: 2014503 - protein, 26 aa, Staphylococcus
GLFAYSLESMSQFGMYFTKINLNLHE

SEQ ID NO: 2014504 - protein, 26 aa, Staphylococcus
GLFAYSLESMSQFGMYFTKMNLNLHE

SEQ ID NO: 2014505 - protein, 19 aa, Staphylococcus
GLFHAYRLAIAPTQSISYV

SEQ ID NO: 2014506 - protein, 17 aa, Staphylococcus
GLFKDARKRLKNGELDY

SEQ ID NO: 2014507 - protein, 18 aa, Staphylococcus
GLFKEARKKLKNGDLDYL

SEQ ID NO: 2014508 - protein, 24 aa, Staphylococcus
GLFKHLPQNFNVMRYHSLIANRQQ

SEQ ID NO: 2014509 - protein, 18 aa, Staphylococcus
GLFLRCKNPDVINRHHAK

SEQ ID NO: 2014510 - protein, 26 aa, Staphylococcus
GLFPKIKGNFLVVGMKLIATILGKRR

SEQ ID NO: 2014511 - protein, 18 aa, Staphylococcus
GLFQDGVEFVNDTNQHTH

SEQ ID NO: 2014512 - protein, 17 aa, Staphylococcus
GLFTTVQDIGRKGYMNV

SEQ ID NO: 2014513 - protein, 25 aa, Staphylococcus
GLGAVWHFAEKVIFPYVEDDELIGV

SEQ ID NO: 2014514 - protein, 25 aa, Staphylococcus
GLGEIGSAVARRAKAFDMNILYTGP

SEQ ID NO: 2014515 - protein, 22 aa, Staphylococcus
GLGHACGHNIIGTASTFAGIAL

SEQ ID NO: 2014516 - protein, 21 aa, Staphylococcus
GLGIEGLKILKNVKDKFGLNV

SEQ ID NO: 2014517 - protein, 21 aa, Staphylococcus
GLGIEGLKILKNVKDKFNLNV

SEQ ID NO: 2014518 - protein, 25 aa, Staphylococcus
GLGIKEGLEATGLERKDLFITSKLY

SEQ ID NO: 2014519 - protein, 24 aa, Staphylococcus
GLGPGRLNAFTVRKVAAGLANYLK

SEQ ID NO: 2014520 - protein, 20 aa, Staphylococcus
GLGQYFECVEVFNQIIDQVK

SEQ ID NO: 2014521 - protein, 23 aa, Staphylococcus
GLGRFGGSIVRELNALGMDVMAI

SEQ ID NO: 2014522 - protein, 26 aa, Staphylococcus
GLGTYLMTWLFAKYRNMTMYVGTSDT

SEQ ID NO: 2014523 - protein, 19 aa, Staphylococcus
GLGVIKRLQSFGMTVLAYD

SEQ ID NO: 2014524 - protein, 19 aa, Staphylococcus
GLHLTLRLNNGMTEQEAID

SEQ ID NO: 2014525 - protein, 25 aa, Staphylococcus
GLHVKQDWVDMGFGIANTIAKIVDQ

SEQ ID NO: 2014526 - protein, 26 aa, Staphylococcus
GLIAKLDYLKDLGIDVIWLSPMYQSP

SEQ ID NO: 2014527 - protein, 23 aa, Staphylococcus
GLIDRVDHRYVYVNLGRIEAVLS

SEQ ID NO: 2014528 - protein, 17 aa, Staphylococcus
GLIERIGLKGSKITVEY

SEQ ID NO: 2014529 - protein, 20 aa, Staphylococcus
GLIGGKGRRANLFGLFNKAI

SEQ ID NO: 2014530 - protein, 19 aa, Staphylococcus
GLIGKRFTEKYPFKTISLT

SEQ ID NO: 2014531 - protein, 24 aa, Staphylococcus
GLIHKVYSVFGFDYSIELSTRPDD

SEQ ID NO: 2014532 - protein, 28 aa, Staphylococcus
GLIIGKDARRKREILGRKLHIGHSNGKQ

SEQ ID NO: 2014533 - protein, 21 aa, Staphylococcus
GLILMKLRYQDLIDASYEDLY

SEQ ID NO: 2014534 - protein, 17 aa, Staphylococcus
GLINALRIVDKDLSDIK

SEQ ID NO: 2014535 - protein, 23 aa, Staphylococcus
GLIPEDWGGDTIFVPLSALNGDG

SEQ ID NO: 2014536 - protein, 23 aa, Staphylococcus
GLIPEDWGGDTIFVPLSALSGEG

SEQ ID NO: 2014537 - protein, 20 aa, Staphylococcus
GLIPEDWGGETIFVPLSALS

SEQ ID NO: 2014538 - protein, 23 aa, Staphylococcus
GLISIGAEVMRLGIISTPGVAYL

SEQ ID NO: 2014539 - protein, 18 aa, Staphylococcus
GLISIGAEVMRLGVISTP

SEQ ID NO: 2014540 - protein, 19 aa, Staphylococcus
GLISIGAEVMRLGVISTPG

SEQ ID NO: 2014541 - protein, 18 aa, Staphylococcus
GLITQLAVLYGITPEGMK

SEQ ID NO: 2014542 - protein, 20 aa, Staphylococcus
GLKAIICIHDTTLGPALGGC

SEQ ID NO: 2014543 - protein, 21 aa, Staphylococcus
GLKGEHKWADTRAMQKALNYA

SEQ ID NO: 2014544 - protein, 20 aa, Staphylococcus
GLKILKNVKEKFGLNIVSEI

SEQ ID NO: 2014545 - protein, 25 aa, Staphylococcus
GLKKCMTKYDFANFLKLLYQEYTKL

SEQ ID NO: 2014546 - protein, 17 aa, Staphylococcus
GLKPVHRRILYGLNEQG

SEQ ID NO: 2014547 - protein, 26 aa, Staphylococcus
GLKQAVKRLAGVKGISVQKLDQSDVV

SEQ ID NO: 2014548 - protein, 22 aa, Staphylococcus
GLKRMIQFIENFHFSDSDIEYL

SEQ ID NO: 2014549 - protein, 18 aa, Staphylococcus
GLKRSDLFITSKLWLDDY

SEQ ID NO: 2014550 - protein, 22 aa, Staphylococcus
GLKTDVMLAAYGYQMMDEYIVN

SEQ ID NO: 2014551 - protein, 21 aa, Staphylococcus
GLKTGRSNIIAFIVPDQNPFF

SEQ ID NO: 2014552 - protein, 19 aa, Staphylococcus
GLKTLHLRIDRSQENAQKL

SEQ ID NO: 2014553 - protein, 20 aa, Staphylococcus
GLKVLTEVELSYLISEAPII

SEQ ID NO: 2014554 - protein, 23 aa, Staphylococcus
GLLAPRIDTMFAKKQITFGDNPL

SEQ ID NO: 2014555 - protein, 19 aa, Staphylococcus
GLLDYCYGVAGTVGVLLIP

SEQ ID NO: 2014556 - protein, 17 aa, Staphylococcus
GLLEGFKELGFETYFAI

SEQ ID NO: 2014557 - protein, 19 aa, Staphylococcus
GLLEYGRIRLLATAGEEIV

SEQ ID NO: 2014558 - protein, 24 aa, Staphylococcus
GLLGLECARGLLDQGMDVTVLHLA

SEQ ID NO: 2014559 - protein, 24 aa, Staphylococcus
GLLGLECARGLLDQGMEVTVIHLA

SEQ ID NO: 2014560 - protein, 24 aa, Staphylococcus
GLLGLECARGLLDQGMNVTVVHLA

SEQ ID NO: 2014561 - protein, 23 aa, Staphylococcus
GLLGLECARGLMDQGMDVTVLHL

SEQ ID NO: 2014562 - protein, 23 aa, Staphylococcus
GLLGLECARGLMDQGMEVTVLHL

SEQ ID NO: 2014563 - protein, 19 aa, Staphylococcus
GLLIPSIIAENGYRYYSES

SEQ ID NO: 2014564 - protein, 17 aa, Staphylococcus
GLLKERGINHDVLADLL

SEQ ID NO: 2014565 - protein, 27 aa, Staphylococcus
GLLLEIQNRLGIEVSIMDFDRDEWATP

SEQ ID NO: 2014566 - protein, 20 aa, Staphylococcus
GLLNKYNVIFKGHIEDQSDY

SEQ ID NO: 2014567 - protein, 20 aa, Staphylococcus
GLLPHRFNSVMVNDYKYNRY

SEQ ID NO: 2014568 - protein, 17 aa, Staphylococcus
GLLPRAHGSGLFTRGQT

SEQ ID NO: 2014569 - protein, 20 aa, Staphylococcus
GLLSKDNPVEFIAIASGKGG

SEQ ID NO: 2014570 - protein, 23 aa, Staphylococcus
GLLSNMASLVFLLGDLEVKDLSA

SEQ ID NO: 2014571 - protein, 23 aa, Staphylococcus
GLLSNMASLVFLLGDLNVKDLSE

SEQ ID NO: 2014572 - protein, 24 aa, Staphylococcus
GLLTGRATIKFGKPIYLSDIPKEL

SEQ ID NO: 2014573 - protein, 20 aa, Staphylococcus
GLMKRYKLLLNKVNIESFEN

SEQ ID NO: 2014574 - protein, 20 aa, Staphylococcus
GLMRKFVCYLNEGYMTPFGI

SEQ ID NO: 2014575 - protein, 23 aa, Staphylococcus
GLNAGLFLIHFLNELNLDSQAAK

SEQ ID NO: 2014576 - protein, 27 aa, Staphylococcus
GLNALKRPNPGKVKKTGIERLFGMMLP

SEQ ID NO: 2014577 - protein, 18 aa, Staphylococcus
GLNDAIQFLSYRKRTEKE

SEQ ID NO: 2014578 - protein, 25 aa, Staphylococcus
GLNDELKKVISILETLDFKIKIIGS

SEQ ID NO: 2014579 - protein, 17 aa, Staphylococcus
GLNEYLDDLGFNLVGYG

SEQ ID NO: 2014580 - protein, 21 aa, Staphylococcus
GLNPHSVFNIGKRVILSGKTS

SEQ ID NO: 2014581 - protein, 21 aa, Staphylococcus
GLNPMRKRIAQNMRESLANTA

SEQ ID NO: 2014582 - protein, 20 aa, Staphylococcus
GLNSIMRAKRIILLAFGERK

SEQ ID NO: 2014583 - protein, 18 aa, Staphylococcus
GLNSKLNTVITLIGEEMD

SEQ ID NO: 2014584 - protein, 17 aa, Staphylococcus
GLPDPKHQFSFPQVTLA

SEQ ID NO: 2014585 - protein, 19 aa, Staphylococcus
GLPHIRISNPEMKKRILNG

SEQ ID NO: 2014586 - protein, 17 aa, Staphylococcus
GLPHPKDEFSFPQVTLA

SEQ ID NO: 2014587 - protein, 22 aa, Staphylococcus
GLPKDFIDYLFIDEAGQALPQA

SEQ ID NO: 2014588 - protein, 18 aa, Staphylococcus
GLPLRSEYHEQYLADAVN

SEQ ID NO: 2014589 - protein, 20 aa, Staphylococcus
GLQACKRADIKPGSTVVIMG

SEQ ID NO: 2014590 - protein, 29 aa, Staphylococcus
GLQIGTDVPFCIYNKTAICEGRGEKIKFL

SEQ ID NO: 2014591 - protein, 19 aa, Staphylococcus
GLQKEVDFAVKLGLVDKED

SEQ ID NO: 2014592 - protein, 18 aa, Staphylococcus
GLQKGYDIDQALTFANLA

SEQ ID NO: 2014593 - protein, 19 aa, Staphylococcus
GLQLEGLIFDREHNLFLCE

SEQ ID NO: 2014594 - protein, 27 aa, Staphylococcus
GLQSIMRAKRIILLAFGERKQEAIDRL

SEQ ID NO: 2014595 - protein, 18 aa, Staphylococcus
GLRGFYMDYMKDLPGPIY

SEQ ID NO: 2014596 - protein, 18 aa, Staphylococcus
GLRGFYMNYMEDLPGEII

SEQ ID NO: 2014597 - protein, 25 aa, Staphylococcus
GLRHFGENRLEGFLEKKSALPNDVT

SEQ ID NO: 2014598 - protein, 19 aa, Staphylococcus
GLRHKQLPAFSVQYHPEAR

SEQ ID NO: 2014599 - protein, 21 aa, Staphylococcus
GLRPHDNFNVVRDFNLNNNHL

SEQ ID NO: 2014600 - protein, 26 aa, Staphylococcus
GLRPQDSFEVIKEFQLTTEHLEILNR

SEQ ID NO: 2014601 - protein, 26 aa, Staphylococcus
GLRPQDSFEVIQDFYLNSQHLEILNR

SEQ ID NO: 2014602 - protein, 18 aa, Staphylococcus
GLRVGVIRDWEAKWYAEK

SEQ ID NO: 2014603 - protein, 17 aa, Staphylococcus
GLRYCINSAAVQFIPYE

SEQ ID NO: 2014604 - protein, 23 aa, Staphylococcus
GLSGRPLFERNLKLVKLAYQETK

SEQ ID NO: 2014605 - protein, 28 aa, Staphylococcus
GLSGRPLFKRNLELVKWAYQQTKGQFLI

SEQ ID NO: 2014606 - protein, 28 aa, Staphylococcus
GLSGRPLFKRNLELVKWAYQQTNGEFLI

SEQ ID NO: 2014607 - protein, 17 aa, Staphylococcus
GLSLLQIPEGVDWNGEE

SEQ ID NO: 2014608 - protein, 25 aa, Staphylococcus
GLSNEIKPGGLLYFHVHDERLSFKD

SEQ ID NO: 2014609 - protein, 23 aa, Staphylococcus
GLSRDRADIILPAVSVFKTLYKK

SEQ ID NO: 2014610 - protein, 24 aa, Staphylococcus
GLSRDRVDIILPAVSVFKVLFNKI

SEQ ID NO: 2014611 - protein, 24 aa, Staphylococcus
GLSRLARRGSGSASRSIYGGFVEW

SEQ ID NO: 2014612 - protein, 25 aa, Staphylococcus
GLSSEVKPGGLLYFHIHDERLKFEK

SEQ ID NO: 2014613 - protein, 17 aa, Staphylococcus
GLSYLKAIHNFAPNINA

SEQ ID NO: 2014614 - protein, 19 aa, Staphylococcus
GLTEIALRFNQGINTDGDA

SEQ ID NO: 2014615 - protein, 20 aa, Staphylococcus
GLTEIALRFNQGINTDGDAL

SEQ ID NO: 2014616 - protein, 21 aa, Staphylococcus
GLTELAVRFNQGLNIDGGALK

SEQ ID NO: 2014617 - protein, 20 aa, Staphylococcus
GLTESKLYYHFDSLKKKGLI

SEQ ID NO: 2014618 - protein, 18 aa, Staphylococcus
GLTKLMNSYGLNAKHLER

SEQ ID NO: 2014619 - protein, 17 aa, Staphylococcus
GLTKYLVSQLMLSNEAR

SEQ ID NO: 2014620 - protein, 18 aa, Staphylococcus
GLTLIQIPEGVDWEGEEV

SEQ ID NO: 2014621 - protein, 20 aa, Staphylococcus
GLTMRLVAPSVTFSTGHFKD

SEQ ID NO: 2014622 - protein, 18 aa, Staphylococcus
GLTRKGQKSFILIGDDKK

SEQ ID NO: 2014623 - protein, 19 aa, Staphylococcus
GLTRKWEKRFILISDKENQ

SEQ ID NO: 2014624 - protein, 19 aa, Staphylococcus
GLVIQKFGTTYVLTTKKDA

SEQ ID NO: 2014625 - protein, 17 aa, Staphylococcus
GLVNSRQEGKYVYYQIK

SEQ ID NO: 2014626 - protein, 20 aa, Staphylococcus
GLVPNTAWLQDAIELNGRGE

SEQ ID NO: 2014627 - protein, 25 aa, Staphylococcus
GLVRDILRAPGFFRNLTVMPHAQEV

SEQ ID NO: 2014628 - protein, 25 aa, Staphylococcus
GLVREILNAPGFFRQLPVLPAAQEV

SEQ ID NO: 2014629 - protein, 18 aa, Staphylococcus
GLYGLKKEELPSVWEDLG

SEQ ID NO: 2014630 - protein, 17 aa, Staphylococcus
GLYIKNDIASIALINAC

SEQ ID NO: 2014631 - protein, 17 aa, Staphylococcus
GLYKKARSGEIKEFTGI

SEQ ID NO: 2014632 - protein, 24 aa, Staphylococcus
GLYKKARTGEIPEFTGISAPYEPP

SEQ ID NO: 2014633 - protein, 19 aa, Staphylococcus
GLYLLDFISTLNLNQTARE

SEQ ID NO: 2014634 - protein, 23 aa, Staphylococcus
GLYLLEFLATLNLNKSAKDFVDF

SEQ ID NO: 2014635 - protein, 27 aa, Staphylococcus
GLYLNDCRYFGEDTLTFLSWMKNINHY

SEQ ID NO: 2014636 - protein, 31 aa, Staphylococcus
GLYPSDSPGGWQIIGRTPLKVFDQYSEPMTL

SEQ ID NO: 2014637 - protein, 21 aa, Staphylococcus
GMAAIQLICNLFKPGDEVLVA

SEQ ID NO: 2014638 - protein, 20 aa, Staphylococcus
GMAEALKLADAHRDENNVHL

SEQ ID NO: 2014639 - protein, 25 aa, Staphylococcus
GMAHPEGYRKALRLMKQAEKFGRPI

SEQ ID NO: 2014640 - protein, 25 aa, Staphylococcus
GMAHPEGYRKALRLMKQAEKFKRPI

SEQ ID NO: 2014641 - protein, 26 aa, Staphylococcus
GMAHPEGYRKALRLMKQAEKFNRPIF

SEQ ID NO: 2014642 - protein, 17 aa, Staphylococcus
GMAKSRRKMLEKMERID

SEQ ID NO: 2014643 - protein, 21 aa, Staphylococcus
GMDQLKESIQHFVDVESKTIL

SEQ ID NO: 2014644 - protein, 21 aa, Staphylococcus
GMEAIDRKGLIAILTSSIGND

SEQ ID NO: 2014645 - protein, 17 aa, Staphylococcus
GMEEPYNDINMWDYKAL

SEQ ID NO: 2014646 - protein, 18 aa, Staphylococcus
GMERPSTGVISWKKDIKI

SEQ ID NO: 2014647 - protein, 21 aa, Staphylococcus
GMEVMKRGVTIEAIHFHSPPF

SEQ ID NO: 2014648 - protein, 30 aa, Staphylococcus
GMFPKWKGVPATFALKLITMILGKRRRVNW

SEQ ID NO: 2014649 - protein, 24 aa, Staphylococcus
GMFSPMVYNKVKWIDIRHSAGKLL

SEQ ID NO: 2014650 - protein, 29 aa, Staphylococcus
GMFTEARALKFFKYFYSQRGPILDYTNLS

SEQ ID NO: 2014651 - protein, 23 aa, Staphylococcus
GMGKCCVTGCSDLEINITDKVVH

SEQ ID NO: 2014652 - protein, 23 aa, Staphylococcus
GMGKCCVTGCSDLEINTVAKTVY

SEQ ID NO: 2014653 - protein, 20 aa, Staphylococcus
GMGKCCVTGCSDVEIDTVNK

SEQ ID NO: 2014654 - protein, 24 aa, Staphylococcus
GMGKCCVTGCSNLNIDTENKVVNY

SEQ ID NO: 2014655 - protein, 34 aa, Staphylococcus
GMGRIGRMVLRIALHKEDLNVVAINASYPPETIA

SEQ ID NO: 2014656 - protein, 30 aa, Staphylococcus
GMGRIGRMVLRIALHNENFNVVAINASYPP

SEQ ID NO: 2014657 - protein, 34 aa, Staphylococcus
GMGRIGRMVLRIALKNEALNVVAINASYPPETIA

SEQ ID NO: 2014658 - protein, 30 aa, Staphylococcus; identical to SEQ ID NO: 1805841

SEQ ID NO: 2014659 - protein, 24 aa, Staphylococcus
GMGRIGRMVLRIALKNENLSVKAI

SEQ ID NO: 2014660 - protein, 26 aa, Staphylococcus
GMGRIGRMVLRIALKNKDLNVVAINA

SEQ ID NO: 2014661 - protein, 22 aa, Staphylococcus
GMGRIGRMVLRIASKNDDLNVV

SEQ ID NO: 2014662 - protein, 19 aa, Staphylococcus
GMGRLGIKSLEEYKEVIDL

SEQ ID NO: 2014663 - protein, 24 aa, Staphylococcus
GMGTTCVCALVFDKTVVVANVGDS

SEQ ID NO: 2014664 - protein, 19 aa, Staphylococcus
GMHTLSISFKLWVEEGKYG

SEQ ID NO: 2014665 - protein, 25 aa, Staphylococcus
GMIEEFKVTVWYTAPTALRMLMSAG

SEQ ID NO: 2014666 - protein, 18 aa, Staphylococcus
GMINLCFEIFDDKIKIVI

SEQ ID NO: 2014667 - protein, 18 aa, Staphylococcus
GMKQRVALCRAQVHQPKV

SEQ ID NO: 2014668 - protein, 26 aa, Staphylococcus
GMLASLKAGCGYVPIDVSMPEDRISS

SEQ ID NO: 2014669 - protein, 20 aa, Staphylococcus
GMLMAYEVTRDLQLQDVEIE

SEQ ID NO: 2014670 - protein, 25 aa, Staphylococcus
GMLVKRPLAISGDRITLGFKEDQYK

SEQ ID NO: 2014671 - protein, 23 aa, Staphylococcus
GMNEYGLSMAYNFMHRKKPANGF

SEQ ID NO: 2014672 - protein, 22 aa, Staphylococcus
GMPKDFRHMHGFGSHTYSMYND

SEQ ID NO: 2014673 - protein, 25 aa, Staphylococcus
GMQHYGIEVADRIELIVPECEHNHD

SEQ ID NO: 2014674 - protein, 27 aa, Staphylococcus
GMQTLGVALPWAISAALVRPNTQVVSV

SEQ ID NO: 2014675 - protein, 25 aa, Staphylococcus
GMQTMKFDMCGAANVVGMIDIIERL

SEQ ID NO: 2014676 - protein, 20 aa, Staphylococcus
GMREPWRIIHIAKDRLGEMS

SEQ ID NO: 2014677 - protein, 25 aa, Staphylococcus
GMREPWRMIHITKDRLGDMSEAITP

SEQ ID NO: 2014678 - protein, 19 aa, Staphylococcus
GMRFYGFHGVLEAENDIGQ

SEQ ID NO: 2014679 - protein, 20 aa, Staphylococcus
GMRFYGYHGALHAENELGQI

SEQ ID NO: 2014680 - protein, 20 aa, Staphylococcus
GMRFYGYHGALPAENEIGQI

SEQ ID NO: 2014681 - protein, 20 aa, Staphylococcus
GMRFYGYHGVLPSENEIGQI

SEQ ID NO: 2014682 - protein, 21 aa, Staphylococcus
GMRFYSYHGALPAENEIGQIF

SEQ ID NO: 2014683 - protein, 19 aa, Staphylococcus
GMSCDHCKHSIEKALNGLD

SEQ ID NO: 2014684 - protein, 25 aa, Staphylococcus
GMSEKMDGLELFHPERMASRILGMG

SEQ ID NO: 2014685 - protein, 17 aa, Staphylococcus
GMSGGVCYVFPNNLELF

SEQ ID NO: 2014686 - protein, 19 aa, Staphylococcus
GMSGGVCYVFPSDVEAFKA

SEQ ID NO: 2014687 - protein, 26 aa, Staphylococcus
GMSRLVKDKCDFYIKIPMVGHVNSLN

SEQ ID NO: 2014688 - protein, 24 aa, Staphylococcus
GMSRLVKEKCDFYINIPMVGHVNS

SEQ ID NO: 2014689 - protein, 19 aa, Staphylococcus
GMSVKEAFRNAVASGTATA

SEQ ID NO: 2014690 - protein, 29 aa, Staphylococcus
GMSVQETRPGFKLVRPLLNVTKRVIRQYQ

SEQ ID NO: 2014691 - protein, 18 aa, Staphylococcus
GMTAPQCAGIIHTDFERG

SEQ ID NO: 2014692 - protein, 20 aa, Staphylococcus
GMTAVILPHMFTYGYLTSVT

SEQ ID NO: 2014693 - protein, 23 aa, Staphylococcus
GMTMVIVTHAMRFAKEVSNKVVF

SEQ ID NO: 2014694 - protein, 24 aa, Staphylococcus
GMTSFAEACILAFSQTKKKKVVVS

SEQ ID NO: 2014695 - protein, 17 aa, Staphylococcus
GNADFIIEDFKEASINT

SEQ ID NO: 2014696 - protein, 17 aa, Staphylococcus
GNADVTYGLAIDGEKVT

SEQ ID NO: 2014697 - protein, 21 aa, Staphylococcus
GNAGHDWFFNKMEKLGFEHEG

SEQ ID NO: 2014698 - protein, 19 aa, Staphylococcus
GNAGLSLYSSSKFAVRGLT

SEQ ID NO: 2014699 - protein, 31 aa, Staphylococcus
GNAIKALCEKLNISLSEVICFGDSLNDQSMF

SEQ ID NO: 2014700 - protein, 23 aa, Staphylococcus
GNAKELQEILGIDYEGLAPQQLK

SEQ ID NO: 2014701 - protein, 28 aa, Staphylococcus
GNALRALCKKEDIDISKTIAFGDSLNDY

SEQ ID NO: 2014702 - protein, 29 aa, Staphylococcus
GNALRFESRICGADMNPYLAYAALIGAGL

SEQ ID NO: 2014703 - protein, 18 aa, Staphylococcus
GNALTKFFNLNAIFNDKA

SEQ ID NO: 2014704 - protein, 23 aa, Staphylococcus
GNAQRRRRVFIFGYKQDLNYADL

SEQ ID NO: 2014705 - protein, 23 aa, Staphylococcus
GNAYKFYVDHDMDYWVYDNENVK

SEQ ID NO: 2014706 - protein, 17 aa, Staphylococcus
GNDKVMFIEPMTMMNLS

SEQ ID NO: 2014707 - protein, 22 aa, Staphylococcus
GNDRLSYVTIYEGKYHQVKRMF

SEQ ID NO: 2014708 - protein, 17 aa, Staphylococcus
GNEEALNILNEWSNYVA

SEQ ID NO: 2014709 - protein, 23 aa, Staphylococcus
GNELGIRLKQPIDLQYGDILYQD

SEQ ID NO: 2014710 - protein, 18 aa, Staphylococcus
GNESVSYYHGIKTVFTKE

SEQ ID NO: 2014711 - protein, 21 aa, Staphylococcus
GNETRVAWEVALESEGTPTSL

SEQ ID NO: 2014712 - protein, 21 aa, Staphylococcus
GNETRVAWEVALESESTPTSL

SEQ ID NO: 2014713 - protein, 22 aa, Staphylococcus
GNETRVAWEVALESKQTPTSLV

SEQ ID NO: 2014714 - protein, 21 aa, Staphylococcus
GNETRVAWEVALETENTPTSL

SEQ ID NO: 2014715 - protein, 26 aa, Staphylococcus
GNEVKLRLKGYPAIVFQHEIDHLNGV

SEQ ID NO: 2014716 - protein, 18 aa, Staphylococcus
GNEVLPITFIEGNIAKTG

SEQ ID NO: 2014717 - protein, 35 aa, Staphylococcus
GNEVLYRKVLEFFHPEFKKEYVILAEEGAESDDDD

SEQ ID NO: 2014718 - protein, 32 aa, Staphylococcus
GNEVLYRKVLEFYHPEFDKEYVILAEEGESTD

SEQ ID NO: 2014719 - protein, 21 aa, Staphylococcus
GNFEKRVTFGLSGSDANDGVI

SEQ ID NO: 2014720 - protein, 26 aa, Staphylococcus
GNFERTRHEAIFSMGVIRHYREKGLG

SEQ ID NO: 2014721 - protein, 22 aa, Staphylococcus
GNFPKWKMYIQVMTEEQARNHK

SEQ ID NO: 2014722 - protein, 22 aa, Staphylococcus
GNGFIGQSFMKYDGFETLLEKK

SEQ ID NO: 2014723 - protein, 19 aa, Staphylococcus
GNGHIKIKGGIFDMNGSKY

SEQ ID NO: 2014724 - protein, 19 aa, Staphylococcus
GNGKFLYSPFSTFDNESII

SEQ ID NO: 2014725 - protein, 17 aa, Staphylococcus
GNGRRDAMFLNWNTYKA

SEQ ID NO: 2014726 - protein, 20 aa, Staphylococcus
GNGRVGRFIMAKMLSDELDE

SEQ ID NO: 2014727 - protein, 17 aa, Staphylococcus
GNGVIALLLAAKSHQKI

SEQ ID NO: 2014728 - protein, 17 aa, Staphylococcus
GNGVIALLLSAKGSQTI

SEQ ID NO: 2014729 - protein, 22 aa, Staphylococcus
GNGVIPLLLSHKGQHPIDAIEI

SEQ ID NO: 2014730 - protein, 20 aa, Staphylococcus
GNGVIPLLLSHKGSQTIEGI

SEQ ID NO: 2014731 - protein, 18 aa, Staphylococcus
GNGVIPLVLSNKGQQMID

SEQ ID NO: 2014732 - protein, 19 aa, Staphylococcus
GNGWAMAGSHMALIVQINQ

SEQ ID NO: 2014733 - protein, 30 aa, Staphylococcus
GNHELRWLERKDKPAIQWHQFINELPYYKV

SEQ ID NO: 2014734 - protein, 19 aa, Staphylococcus
GNHELRWLERQDSEAQAWH

SEQ ID NO: 2014735 - protein, 18 aa, Staphylococcus
GNHPIPTIAFYSPNCLPI

SEQ ID NO: 2014736 - protein, 22 aa, Staphylococcus
GNIDPALIPFIMEKTGKNAEEV

SEQ ID NO: 2014737 - protein, 21 aa, Staphylococcus
GNIDPALIPFIMQKTGQNAEE

SEQ ID NO: 2014738 - protein, 20 aa, Staphylococcus
GNIENGTILTFFNWPNAHKG

SEQ ID NO: 2014739 - protein, 18 aa, Staphylococcus
GNIGRGFIGQILSDNNVE

SEQ ID NO: 2014740 - protein, 23 aa, Staphylococcus
GNIGRGFIGYILADNDVKVTFAD

SEQ ID NO: 2014741 - protein, 22 aa, Staphylococcus
GNIGRGFIGYILSDNNIDVTFA

SEQ ID NO: 2014742 - protein, 23 aa, Staphylococcus
GNIIAEVFNRFSITDTSMMLDRM

SEQ ID NO: 2014743 - protein, 24 aa, Staphylococcus
GNIIALKQRAKWRNIKLNVVEVNE

SEQ ID NO: 2014744 - protein, 25 aa, Staphylococcus
GNIIKASNVQYLFKQNNYIPSNVFL

SEQ ID NO: 2014745 - protein, 20 aa, Staphylococcus
GNIIREAKSLIGQDEQEINN

SEQ ID NO: 2014746 - protein, 19 aa, Staphylococcus
GNIKETFLFTDIKSLKTGF

SEQ ID NO: 2014747 - protein, 19 aa, Staphylococcus
GNIKILRQDIQFVGKKIEN

SEQ ID NO: 2014748 - protein, 17 aa, Staphylococcus
GNIKSTWIDDGEPTIQI

SEQ ID NO: 2014749 - protein, 20 aa, Staphylococcus
GNILKSNAFVKLLNIEGHSA

SEQ ID NO: 2014750 - protein, 17 aa, Staphylococcus
GNINAMRRGERSIENLT

SEQ ID NO: 2014751 - protein, 18 aa, Staphylococcus
GNISIEFETPANLNSIEK

SEQ ID NO: 2014752 - protein, 18 aa, Staphylococcus
GNIVKAFIILQNGYTGDD

SEQ ID NO: 2014753 - protein, 21 aa, Staphylococcus
GNIVKATSFAKLIKYENYEFT

SEQ ID NO: 2014754 - protein, 30 aa, Staphylococcus
GNKGYAKKAFKMAIDYAFLVLNLNKVYLYV

SEQ ID NO: 2014755 - protein, 24 aa, Staphylococcus
GNKHILKDIGFKIPITGEMIGIMG

SEQ ID NO: 2014756 - protein, 22 aa, Staphylococcus
GNKNSKVDFGFGQWGLKQREGE

SEQ ID NO: 2014757 - protein, 21 aa, Staphylococcus
GNKRYLTINIESFNYIFNNDF

SEQ ID NO: 2014758 - protein, 18 aa, Staphylococcus
GNLDEIIDALTLSEQTDK

SEQ ID NO: 2014759 - protein, 21 aa, Staphylococcus
GNLDPALIPFIMEKTGKNADE

SEQ ID NO: 2014760 - protein, 23 aa, Staphylococcus
GNLDPALLLAPWPVIEERLKNIL

SEQ ID NO: 2014761 - protein, 21 aa, Staphylococcus
GNLDPSLLLAPWDVIEQRVRE

SEQ ID NO: 2014762 - protein, 19 aa, Staphylococcus
GNLELKIVEKIEEIANKDI

SEQ ID NO: 2014763 - protein, 19 aa, Staphylococcus
GNLFLLLAKENWHEGVLGI

SEQ ID NO: 2014764 - protein, 17 aa, Staphylococcus
GNLGFGQYFTDYMLSFD

SEQ ID NO: 2014765 - protein, 18 aa, Staphylococcus
GNLGFGQYFTDYMLSVDY

SEQ ID NO: 2014766 - protein, 21 aa, Staphylococcus
GNLKVNFKSGDVFVNHKPVSL

SEQ ID NO: 2014767 - protein, 19 aa, Staphylococcus
GNLLFGDTVAIFGAGPIGL

SEQ ID NO: 2014768 - protein, 19 aa, Staphylococcus
GNLLLCEVFGGTIFHVNLP

SEQ ID NO: 2014769 - protein, 19 aa, Staphylococcus
GNLLPLVVALDLNKSYVTC

SEQ ID NO: 2014770 - protein, 21 aa, Staphylococcus
GNLLVCPMCGHEWSETENKEN

SEQ ID NO: 2014771 - protein, 20 aa, Staphylococcus
GNLNGEWCINDVNAVSKIAA

SEQ ID NO: 2014772 - protein, 18 aa, Staphylococcus
GNLSLFFNEIEKSFINIM

SEQ ID NO: 2014773 - protein, 21 aa, Staphylococcus
GNLTKDVELLDGLYDQNKKYF

SEQ ID NO: 2014774 - protein, 19 aa, Staphylococcus
GNMARVWSEAELAAITEDL

SEQ ID NO: 2014775 - protein, 18 aa, Staphylococcus
GNMIKPWYVNSIDNPVND

SEQ ID NO: 2014776 - protein, 20 aa, Staphylococcus
GNMLKPWYVNSISNPVSKDT

SEQ ID NO: 2014777 - protein, 26 aa, Staphylococcus
GNMPNLWPQVSSLRVRTLILTGEKDE

SEQ ID NO: 2014778 - protein, 32 aa, Staphylococcus
GNNAPVFFIQDAIKFPDFVHALKPEPHNEMPQ

SEQ ID NO: 2014779 - protein, 22 aa, Staphylococcus
GNNFGIGIDFHGRVHKPMAKLL

SEQ ID NO: 2014780 - protein, 25 aa, Staphylococcus
GNNGWCAGFTMAALLNATKNTSQYR

SEQ ID NO: 2014781 - protein, 19 aa, Staphylococcus
GNNIYPARIERLLHNHPDI

SEQ ID NO: 2014782 - protein, 19 aa, Staphylococcus
GNNTPVFFFRDPKLFISLN

SEQ ID NO: 2014783 - protein, 19 aa, Staphylococcus
GNNTPVFFFRDSKLFVSLN

SEQ ID NO: 2014784 - protein, 19 aa, Staphylococcus
GNNVMNGYLYPTGLSDTFE

SEQ ID NO: 2014785 - protein, 19 aa, Staphylococcus
GNPELLNKVGRLIATIYMD

SEQ ID NO: 2014786 - protein, 24 aa, Staphylococcus
GNPKAVVHSHGWGYAHMQMAPKHW

SEQ ID NO: 2014787 - protein, 18 aa, Staphylococcus
GNPKAVVHTHGWGYAHMQ

SEQ ID NO: 2014788 - protein, 17 aa, Staphylococcus
GNPKPRMYRLIEDDALI

SEQ ID NO: 2014789 - protein, 24 aa, Staphylococcus
GNPKRFKRNIAIYRAVAESRGYDL

SEQ ID NO: 2014790 - protein, 21 aa, Staphylococcus
GNPLSMKGGIALLEVLEQDGV

SEQ ID NO: 2014791 - protein, 20 aa, Staphylococcus
GNPLSMRAGIALLEVLEQDG

SEQ ID NO: 2014792 - protein, 30 aa, Staphylococcus
GNPLYHWSQLELKMYFDIEDLLTSDNAEAI

SEQ ID NO: 2014793 - protein, 17 aa, Staphylococcus
GNPQPRMYRLLEDDALI

SEQ ID NO: 2014794 - protein, 25 aa, Staphylococcus
GNPRILAERFLKGEIITEYNNEIIS

SEQ ID NO: 2014795 - protein, 18 aa, Staphylococcus
GNPSACFTGFELFVKPAV

SEQ ID NO: 2014796 - protein, 23 aa, Staphylococcus
GNPSPMTAYGIYIALKRTVAEKF

SEQ ID NO: 2014797 - protein, 23 aa, Staphylococcus
GNPSPMTAYGIYIAMKRTAKEKF

SEQ ID NO: 2014798 - protein, 23 aa, Staphylococcus
GNQSVRYLLNMFVPPDDTMSQLV

SEQ ID NO: 2014799 - protein, 22 aa, Staphylococcus
GNRRIYGFRGFVNGPIDGSRVY

SEQ ID NO: 2014800 - protein, 18 aa, Staphylococcus
GNRTFSTWMENLAQIVSR

SEQ ID NO: 2014801 - protein, 23 aa, Staphylococcus
GNRYDVGEKLGFVKTTIEYALKD

SEQ ID NO: 2014802 - protein, 18 aa, Staphylococcus
GNSAELAKIVLKDLDYNW

SEQ ID NO: 2014803 - protein, 17 aa, Staphylococcus
GNSAMQVTFEFELNDKL

SEQ ID NO: 2014804 - protein, 23 aa, Staphylococcus
GNSEVGISWLLKHAQQRIPELSH

SEQ ID NO: 2014805 - protein, 29 aa, Staphylococcus
GNSGVILSQLFRGFCKNIEDAKVIDAQQF

SEQ ID NO: 2014806 - protein, 28 aa, Staphylococcus
GNSGVILSQLFRGFCKNIEDEKEINAQQ

SEQ ID NO: 2014807 - protein, 27 aa, Staphylococcus
GNSGVILSQLFRGFCKNIETENEINAQ

SEQ ID NO: 2014808 - protein, 28 aa, Staphylococcus
GNSGVILSQLFRGFCKNIETESEIDAQQ

SEQ ID NO: 2014809 - protein, 22 aa, Staphylococcus
GNSGVILSQLFRGFSKSLETYE

SEQ ID NO: 2014810 - protein, 18 aa, Staphylococcus
GNSHIHIKGGTFDMNGSN

SEQ ID NO: 2014811 - protein, 25 aa, Staphylococcus
GNSLSFRAFYALPLLQNKAGIHTNA

SEQ ID NO: 2014812 - protein, 26 aa, Staphylococcus
GNSLSFRAFYALPLLTNRAGIHTNAV

SEQ ID NO: 2014813 - protein, 27 aa, Staphylococcus
GNSNTRSAIYLHMCKLAANPDIAIFET

SEQ ID NO: 2014814 - protein, 21 aa, Staphylococcus
GNSRYLFNHFAKHFSKLPIYF

SEQ ID NO: 2014815 - protein, 17 aa, Staphylococcus
GNSRYLFNYFAKHHSRY

SEQ ID NO: 2014816 - protein, 20 aa, Staphylococcus
GNTALDWARDIAQIANSVTV

SEQ ID NO: 2014817 - protein, 22 aa, Staphylococcus
GNTDAMIKYLLPKATVTTPNLF

SEQ ID NO: 2014818 - protein, 21 aa, Staphylococcus
GNTDAMIKYLLPKATVVTPNL

SEQ ID NO: 2014819 - protein, 23 aa, Staphylococcus
GNTGTPWLGPDVQDLTRALYNEH

SEQ ID NO: 2014820 - protein, 22 aa, Staphylococcus
GNTGTPWLGPDVQDLTRELYEA

SEQ ID NO: 2014821 - protein, 25 aa, Staphylococcus
GNTLKTGTKIIGKVGVPLTILTTIF

SEQ ID NO: 2014822 - protein, 23 aa, Staphylococcus
GNTYKIYFGFANRTAYEDFKASE

SEQ ID NO: 2014823 - protein, 27 aa, Staphylococcus
GNTYLPRKFKIGIAVPPSNDIDVYSQD

SEQ ID NO: 2014824 - protein, 20 aa, Staphylococcus
GNVCGMMPHPERALKTLLGT

SEQ ID NO: 2014825 - protein, 21 aa, Staphylococcus
GNVIAEVFNRFSITDTSMMLD

SEQ ID NO: 2014826 - protein, 18 aa, Staphylococcus
GNVNFISRLLEGHYPDTS

SEQ ID NO: 2014827 - protein, 18 aa, Staphylococcus
GNVSRGTFYLHYKDKYDL

SEQ ID NO: 2014828 - protein, 25 aa, Staphylococcus
GNVTFPSMLRRGKLTISVSTDGASP

SEQ ID NO: 2014829 - protein, 23 aa, Staphylococcus
GNVYCRKFFDSTVAKRIDFIQIY

SEQ ID NO: 2014830 - protein, 18 aa, Staphylococcus
GNVYVRGYDDLKFFETYI

SEQ ID NO: 2014831 - protein, 19 aa, Staphylococcus
GNWNFTLFIQNGRVKDTED

SEQ ID NO: 2014832 - protein, 19 aa, Staphylococcus
GNYAELRLSVDTANTDAQT

SEQ ID NO: 2014833 - protein, 19 aa, Staphylococcus
GNYEYCFYETEGKGQFKPV

SEQ ID NO: 2014834 - protein, 23 aa, Staphylococcus
GNYKDVIDILALEGVITSETQAA

SEQ ID NO: 2014835 - protein, 23 aa, Staphylococcus
GNYKDVIDILALEKVISKDTQHQ

SEQ ID NO: 2014836 - protein, 27 aa, Staphylococcus
GNYLIPRNVHKSVFHGLELANQKATLT

SEQ ID NO: 2014837 - protein, 19 aa, Staphylococcus
GNYNYFVFNGMRSKGNQEL

SEQ ID NO: 2014838 - protein, 27 aa, Staphylococcus
GNYPEITAATFACFGYGWHIDVGIHAI

SEQ ID NO: 2014839 - protein, 22 aa, Staphylococcus
GNYRKPGAGAYPLRGHNNVQGC

SEQ ID NO: 2014840 - protein, 19 aa, Staphylococcus
GNYVRKRIDAWTEQFNTVG

SEQ ID NO: 2014841 - protein, 19 aa, Staphylococcus
GPAGLFASFYAGLRGMSVR

SEQ ID NO: 2014842 - protein, 23 aa, Staphylococcus
GPCGRSLCCATFLGDFEPVSIKM

SEQ ID NO: 2014843 - protein, 23 aa, Staphylococcus
GPCGRSLCCSTFLGDFQPVSIKM

SEQ ID NO: 2014844 - protein, 22 aa, Staphylococcus
GPDAIRYAGLQERLENLGMNVQ

SEQ ID NO: 2014845 - protein, 21 aa, Staphylococcus
GPDVKPQIMAFTKSYGRPFEE

SEQ ID NO: 2014846 - protein, 19 aa, Staphylococcus
GPEIYKQKLYQAGVEPNII

SEQ ID NO: 2014847 - protein, 19 aa, Staphylococcus
GPEIYKQKLYQLGIEPKII

SEQ ID NO: 2014848 - protein, 26 aa, Staphylococcus
GPFAQLRPGADLGKKVKVGNFVEVKK

SEQ ID NO: 2014849 - protein, 23 aa, Staphylococcus
GPFAQLRPGAQLGADVKVGNFVE

SEQ ID NO: 2014850 - protein, 20 aa, Staphylococcus
GPFAQLRPGSNLGADVKVGN

SEQ ID NO: 2014851 - protein, 25 aa, Staphylococcus
GPFAQLRPGSNLGKDVKVGNFVEVK

SEQ ID NO: 2014852 - protein, 19 aa, Staphylococcus
GPFAQLRPGSNLGSDVKVG

SEQ ID NO: 2014853 - protein, 22 aa, Staphylococcus
GPFAQLRPGSNLGTEVKVGNFV

SEQ ID NO: 2014854 - protein, 18 aa, Staphylococcus
GPFAQLRPNAHLGNEVKV

SEQ ID NO: 2014855 - protein, 22 aa, Staphylococcus
GPFDLVIILTKAMRSEEMLRDL

SEQ ID NO: 2014856 - protein, 22 aa, Staphylococcus
GPFKSLKGVDYFSTMQQAINRY

SEQ ID NO: 2014857 - protein, 20 aa, Staphylococcus
GPFPRMTYNEAMSRYGSDKP

SEQ ID NO: 2014858 - protein, 17 aa, Staphylococcus
GPFQFKQTDQFILDHTD

SEQ ID NO: 2014859 - protein, 29 aa, Staphylococcus
GPFQGHPACMHISIGKGVCGTAVANNQTQ

SEQ ID NO: 2014860 - protein, 29 aa, Staphylococcus
GPFQGHPACVHIAIGKGVCGTAVAQNQTQ

SEQ ID NO: 2014861 - protein, 20 aa, Staphylococcus
GPFRSCPVSGVLQPGQTVRY

SEQ ID NO: 2014862 - protein, 19 aa, Staphylococcus
GPFWGYGASIATSLANVYG

SEQ ID NO: 2014863 - protein, 25 aa, Staphylococcus
GPFYRYDPDQCILCGRCVEACQDIE

SEQ ID NO: 2014864 - protein, 17 aa, Staphylococcus
GPFYRYDPNQCILCGRC

SEQ ID NO: 2014865 - protein, 23 aa, Staphylococcus
GPGEVTGLLAALVGDSGKVIGID

SEQ ID NO: 2014866 - protein, 17 aa, Staphylococcus
GPGHLVRRTFVEGSAVP

SEQ ID NO: 2014867 - protein, 17 aa, Staphylococcus
GPGLRYIIFTQGCLLRC

SEQ ID NO: 2014868 - protein, 17 aa, Staphylococcus
GPGQVFKDLIDSKVVPR

SEQ ID NO: 2014869 - protein, 26 aa, Staphylococcus
GPGSFLPELLDQMYLLDYQTFEKYVR

SEQ ID NO: 2014870 - protein, 18 aa, Staphylococcus
GPIDIQLLGIGENGHIGF

SEQ ID NO: 2014871 - protein, 18 aa, Staphylococcus
GPIHFNLPFREPLTPDLE

SEQ ID NO: 2014872 - protein, 21 aa, Staphylococcus
GPIKLHIVPFTALQKQINKSV

SEQ ID NO: 2014873 - protein, 17 aa, Staphylococcus
GPKGRNVVLDKEYAAPL

SEQ ID NO: 2014874 - protein, 24 aa, Staphylococcus
GPKRFKLPVVPANMQTVMNEKLAE

SEQ ID NO: 2014875 - protein, 23 aa, Staphylococcus
GPLADFYASHGFIVIQPTFLDSR

SEQ ID NO: 2014876 - protein, 20 aa, Staphylococcus
GPLDAAIAWSDKGLDGSRRF

SEQ ID NO: 2014877 - protein, 21 aa, Staphylococcus
GPLDAAIAWSEKGLDGSRRFL

SEQ ID NO: 2014878 - protein, 20 aa, Staphylococcus
GPLDLLLHLIQKFEIDIYDI

SEQ ID NO: 2014879 - protein, 22 aa, Staphylococcus
GPLDLTFLFGLVDHLSHKLSYL

SEQ ID NO: 2014880 - protein, 17 aa, Staphylococcus
GPLHGGANEQVMKMLSE

SEQ ID NO: 2014881 - protein, 19 aa, Staphylococcus
GPLIDSGLNKQWRYHYQID

SEQ ID NO: 2014882 - protein, 26 aa, Staphylococcus
GPLLHYRMVHELPTFFSSNFDYSELE

SEQ ID NO: 2014883 - protein, 26 aa, Staphylococcus
GPLLHYRMVHELPTFFSSNLNLEELE

SEQ ID NO: 2014884 - protein, 26 aa, Staphylococcus
GPLLHYRMVHELPTFFTSNLSYDELE

SEQ ID NO: 2014885 - protein, 26 aa, Staphylococcus
GPLLHYRMVHELPTLFSSNLDFNALE

SEQ ID NO: 2014886 - protein, 27 aa, Staphylococcus
GPLLHYRMVQELPTFFSSNLSFEELEH

SEQ ID NO: 2014887 - protein, 22 aa, Staphylococcus
GPLPEQWIKKWRAYSPVNLPKH

SEQ ID NO: 2014888 - protein, 25 aa, Staphylococcus
GPLRARTAGPAFFWGTFDVSAIVVY

SEQ ID NO: 2014889 - protein, 19 aa, Staphylococcus
GPLSLMTPIGMIRDEGLLG

SEQ ID NO: 2014890 - protein, 24 aa, Staphylococcus
GPLYRGLPTLECSRYMHPLKSAQL

SEQ ID NO: 2014891 - protein, 19 aa, Staphylococcus
GPMGEKLWNDCLTVSTNAR

SEQ ID NO: 2014892 - protein, 18 aa, Staphylococcus
GPNIEMFEFQNAKQRKPE

SEQ ID NO: 2014893 - protein, 26 aa, Staphylococcus
GPPKDRRAGVITFNLADIHPHDVATA

SEQ ID NO: 2014894 - protein, 26 aa, Staphylococcus
GPPKDRRAGVITFNLSDIHPHDVATA

SEQ ID NO: 2014895 - protein, 18 aa, Staphylococcus
GPQLTEFAERHQIPVVTT

SEQ ID NO: 2014896 - protein, 22 aa, Staphylococcus
GPQRGPVHFNLPFREPLTPDFD

SEQ ID NO: 2014897 - protein, 19 aa, Staphylococcus
GPRGPLLMQDIYFLEQMSH

SEQ ID NO: 2014898 - protein, 18 aa, Staphylococcus
GPRGPVLMQDVYLLEQLA

SEQ ID NO: 2014899 - protein, 19 aa, Staphylococcus
GPRILRAETAPLYALSAIS

SEQ ID NO: 2014900 - protein, 17 aa, Staphylococcus
GPSDSNYLFDEFLDMMR

SEQ ID NO: 2014901 - protein, 25 aa, Staphylococcus
GPSEKYKKLWEYYATIAENDYEAVL

SEQ ID NO: 2014902 - protein, 25 aa, Staphylococcus
GPSETGIGFALSIERLLLALEEEGI

SEQ ID NO: 2014903 - protein, 19 aa, Staphylococcus
GPSEVLGGSASEFSPTQLA

SEQ ID NO: 2014904 - protein, 25 aa, Staphylococcus
GPSGKFIKRSLIIENNIQFPLNLHF

SEQ ID NO: 2014905 - protein, 31 aa, Staphylococcus
GPSKRIIDVGCGYGPIGLMIAKVSPHHQMTM

SEQ ID NO: 2014906 - protein, 21 aa, Staphylococcus
GPSLDRPGDLAAILSGLQPGD

SEQ ID NO: 2014907 - protein, 23 aa, Staphylococcus
GPSLERPGDLAAILSGLKPGDVL

SEQ ID NO: 2014908 - protein, 22 aa, Staphylococcus
GPSLERPGDLAAILSGLQPGDV

SEQ ID NO: 2014909 - protein, 21 aa, Staphylococcus
GPSPRNSVFYNQMLREDIRRN

SEQ ID NO: 2014910 - protein, 18 aa, Staphylococcus
GPSSMWFDAEGHRMSAPD

SEQ ID NO: 2014911 - protein, 24 aa, Staphylococcus
GPSVKYRDGQIVFDKSCSANKKVT

SEQ ID NO: 2014912 - protein, 17 aa, Staphylococcus
GPTAMRYQNVIQLLNQI

SEQ ID NO: 2014913 - protein, 18 aa, Staphylococcus
GPTGSMIMTIVNWLRQSK

SEQ ID NO: 2014914 - protein, 19 aa, Staphylococcus
GPTGYLIQSIVDWLRQEIK

SEQ ID NO: 2014915 - protein, 18 aa, Staphylococcus
GPTGYLVPTIVEWMRHLK

SEQ ID NO: 2014916 - protein, 18 aa, Staphylococcus
GPVKILCPGKVYRRDSDD

SEQ ID NO: 2014917 - protein, 24 aa, Staphylococcus
GPVLPSLRGLFDYFVEDITSKNKI

SEQ ID NO: 2014918 - protein, 26 aa, Staphylococcus
GPVNNGGVILRWLRDELLASEVETAK

SEQ ID NO: 2014919 - protein, 20 aa, Staphylococcus
GPVRAVLELAGITDILSKSL

SEQ ID NO: 2014920 - protein, 20 aa, Staphylococcus
GPVVIDFPKDMGILSTNAQV

SEQ ID NO: 2014921 - protein, 18 aa, Staphylococcus
GPVVIDFPKDMGVLKTSV

SEQ ID NO: 2014922 - protein, 17 aa, Staphylococcus
GPWHIHRMLEAAEALPI

SEQ ID NO: 2014923 - protein, 17 aa, Staphylococcus
GPWHIHRMLEAAEELPI

SEQ ID NO: 2014924 - protein, 17 aa, Staphylococcus
GPWHIHRMLEAAEGLPI

SEQ ID NO: 2014925 - protein, 17 aa, Staphylococcus
GPWHIHRMLEVAEALPI

SEQ ID NO: 2014926 - protein, 23 aa, Staphylococcus
GPYKGEPNLGFKEMEEIGESTGL

SEQ ID NO: 2014927 - protein, 25 aa, Staphylococcus
GPYMMHWFMINYCFDNGYDRYNFYG

SEQ ID NO: 2014928 - protein, 25 aa, Staphylococcus
GPYMMHWFMMNYCFDHGYDRYNFYG

SEQ ID NO: 2014929 - protein, 18 aa, Staphylococcus
GPYMMHWHMMNYCFEHGY

SEQ ID NO: 2014930 - protein, 24 aa, Staphylococcus
GPYTKAAVMSIAFDLPLPTVDGNV

SEQ ID NO: 2014931 - protein, 21 aa, Staphylococcus
GPYTQAAVMSIAFNQPLATVD

SEQ ID NO: 2014932 - protein, 25 aa, Staphylococcus
GPYYGSKTESCFFSIFVSPDYQEHG

SEQ ID NO: 2014933 - protein, 18 aa, Staphylococcus
GQAEVRQTFKVSKVGTIA

SEQ ID NO: 2014934 - protein, 22 aa, Staphylococcus
GQAEVRQTFKVSKVGTIAGSYV

SEQ ID NO: 2014935 - protein, 25 aa, Staphylococcus
GQAHLKPFYESFGFHSVSDTYMEDG

SEQ ID NO: 2014936 - protein, 19 aa, Staphylococcus
GQAKWFLQDFEVLINGQRE

SEQ ID NO: 2014937 - protein, 19 aa, Staphylococcus
GQAKWFLQDVEVLINGERE

SEQ ID NO: 2014938 - protein, 19 aa, Staphylococcus
GQALHAGIIGFEHPVTHEY

SEQ ID NO: 2014939 - protein, 20 aa, Staphylococcus
GQALHAGLIGFEHPVTGEYI

SEQ ID NO: 2014940 - protein, 22 aa, Staphylococcus
GQALQNINLMFGFDETEGLCSV

SEQ ID NO: 2014941 - protein, 25 aa, Staphylococcus
GQAPYKFLLSHGFVMDGEGKKMSKS

SEQ ID NO: 2014942 - protein, 18 aa, Staphylococcus
GQCTYYVFDRVKEDHHLI

SEQ ID NO: 2014943 - protein, 24 aa, Staphylococcus
GQDLKIGIVVSRFNDFITGRLLDG

SEQ ID NO: 2014944 - protein, 18 aa, Staphylococcus
GQDVLLFIDNIFRFTQAG

SEQ ID NO: 2014945 - protein, 19 aa, Staphylococcus
GQEALKYIDFNSGKISKQL

SEQ ID NO: 2014946 - protein, 18 aa, Staphylococcus
GQEIEFFGPEIDSFRQIV

SEQ ID NO: 2014947 - protein, 18 aa, Staphylococcus
GQEIEFFGPEIESFKQIV

SEQ ID NO: 2014948 - protein, 18 aa, Staphylococcus
GQEIEFFGPEIESFKQVI

SEQ ID NO: 2014949 - protein, 24 aa, Staphylococcus
GQEWLNQAPFSFDLSVMAIYPCLF

SEQ ID NO: 2014950 - protein, 24 aa, Staphylococcus
GQEWLNQAPFSFDLSVMAIYPCLT

SEQ ID NO: 2014951 - protein, 26 aa, Staphylococcus
GQEWLNQAPFSFDLSVMAIYPCLVSG

SEQ ID NO: 2014952 - protein, 19 aa, Staphylococcus
GQFFIGLVEYREEDRVKLV

SEQ ID NO: 2014953 - protein, 23 aa, Staphylococcus
GQFGMAWEIGYLRGLADKGVSLR

SEQ ID NO: 2014954 - protein, 26 aa, Staphylococcus
GQFNLKSGVGTAKFKKGLAATKTLDV

SEQ ID NO: 2014955 - protein, 32 aa, Staphylococcus
GQFPAGSMLPKIQAAIEFAKTGKEAIICSLSD

SEQ ID NO: 2014956 - protein, 22 aa, Staphylococcus
GQFPLWKAIPAAVSLKLIALCL

SEQ ID NO: 2014957 - protein, 18 aa, Staphylococcus
GQGFAMSVGMAMAEDHLA

SEQ ID NO: 2014958 - protein, 20 aa, Staphylococcus
GQGFAMSVGMAMAEKHLAGK

SEQ ID NO: 2014959 - protein, 25 aa, Staphylococcus
GQGHLKGHILRIGHMGKVSPFDILS

SEQ ID NO: 2014960 - protein, 18 aa, Staphylococcus
GQGIAGKLLEQFEKLAKR

SEQ ID NO: 2014961 - protein, 18 aa, Staphylococcus
GQGIPIILLHGLNGNLAG

SEQ ID NO: 2014962 - protein, 25 aa, Staphylococcus
GQGKLKGKILRIGHLGTIDTADILQ

SEQ ID NO: 2014963 - protein, 25 aa, Staphylococcus
GQGKLKGKILRIGHMGKVSPFDMLS

SEQ ID NO: 2014964 - protein, 25 aa, Staphylococcus
GQGKLKGTILRIGHMGKVSPSEEGL

SEQ ID NO: 2014965 - protein, 19 aa, Staphylococcus
GQGLDQVWRVASLNQAIAL

SEQ ID NO: 2014966 - protein, 25 aa, Staphylococcus
GQGMSGGVAYIFPDDVEQFKAYHAL

SEQ ID NO: 2014967 - protein, 24 aa, Staphylococcus
GQGMSGGVSYIFPSDIEAFKKANQ

SEQ ID NO: 2014968 - protein, 24 aa, Staphylococcus
GQGMSGGVSYIFPSSIEEFKKVNS

SEQ ID NO: 2014969 - protein, 24 aa, Staphylococcus
GQGMSGGVSYVFPSDISQFKTQHA

SEQ ID NO: 2014970 - protein, 24 aa, Staphylococcus
GQGMSGGVSYVFPSDVAQFKAQNQ

SEQ ID NO: 2014971 - protein, 26 aa, Staphylococcus
GQGPAFPFPECGAMSQAYIGYQLQES

SEQ ID NO: 2014972 - protein, 26 aa, Staphylococcus
GQGQEWLNQAPFSFDLSVMAIYPCLT

SEQ ID NO: 2014973 - protein, 18 aa, Staphylococcus
GQGTRLGYDGPKGSFEIE

SEQ ID NO: 2014974 - protein, 21 aa, Staphylococcus
GQGYPVVLVHTAFENASIFQN

SEQ ID NO: 2014975 - protein, 18 aa, Staphylococcus
GQHHVFNPLTIFKLQHAC

SEQ ID NO: 2014976 - protein, 21 aa, Staphylococcus
GQHIIPGFIDIHMHGGYGEDA

SEQ ID NO: 2014977 - protein, 18 aa, Staphylococcus
GQIAVIGPTAMRYQNVIQ

SEQ ID NO: 2014978 - protein, 25 aa, Staphylococcus
GQIFYKKSLEIMNLFDNLPKEVNQL

SEQ ID NO: 2014979 - protein, 17 aa, Staphylococcus
GQIGRGMHGDWKVIPTH

SEQ ID NO: 2014980 - protein, 18 aa, Staphylococcus
GQILNLASGIFFANSYEV

SEQ ID NO: 2014981 - protein, 19 aa, Staphylococcus
GQKAVDAWLETLKAGGSKN

SEQ ID NO: 2014982 - protein, 18 aa, Staphylococcus
GQKISVKALLSMRMENKV

SEQ ID NO: 2014983 - protein, 23 aa, Staphylococcus
GQKKRSRNILDFADYEHFALQIL

SEQ ID NO: 2014984 - protein, 21 aa, Staphylococcus
GQKLFLPYIDCHRWFVKYLYS

SEQ ID NO: 2014985 - protein, 17 aa, Staphylococcus
GQKSFILIGDDKKEKPY

SEQ ID NO: 2014986 - protein, 23 aa, Staphylococcus
GQKTVNVKLIYWVKGQGTIDINL

SEQ ID NO: 2014987 - protein, 19 aa, Staphylococcus
GQLEYYERKIFKQDTPPDN

SEQ ID NO: 2014988 - protein, 17 aa, Staphylococcus
GQLKPGYNLQIATNSQF

SEQ ID NO: 2014989 - protein, 21 aa, Staphylococcus
GQLKVGQTVKVAYFKQTEETL

SEQ ID NO: 2014990 - protein, 24 aa, Staphylococcus
GQLLALPGWAGMMYYRAEENESER

SEQ ID NO: 2014991 - protein, 18 aa, Staphylococcus
GQLNLSIFHDGERSVARD

SEQ ID NO: 2014992 - protein, 20 aa, Staphylococcus
GQLPDSSVFVSDFDDILDKL

SEQ ID NO: 2014993 - protein, 17 aa, Staphylococcus
GQLPGTKVYPWIAETRG

SEQ ID NO: 2014994 - protein, 18 aa, Staphylococcus
GQLPGTKVYPWIAETRGS

SEQ ID NO: 2014995 - protein, 18 aa, Staphylococcus
GQLPGTKVYPWIAEVRGS

SEQ ID NO: 2014996 - protein, 18 aa, Staphylococcus
GQLQQCFTVNDFRALEQQ

SEQ ID NO: 2014997 - protein, 18 aa, Staphylococcus
GQLRKSYTAKEWMKHIQY

SEQ ID NO: 2014998 - protein, 20 aa, Staphylococcus
GQLVQKCLKELNIEVTEEHY

SEQ ID NO: 2014999 - protein, 18 aa, Staphylococcus
GQLYNEFKELFPENRVEY

SEQ ID NO: 2015000 - protein, 17 aa, Staphylococcus
GQMQCKLFLENPENNDS

SEQ ID NO: 2015001 - protein, 17 aa, Staphylococcus
GQNACKPPLKEREINAT

SEQ ID NO: 2015002 - protein, 21 aa, Staphylococcus
GQNASFIFAVCEYLKHEDNPK

SEQ ID NO: 2015003 - protein, 27 aa, Staphylococcus
GQNKLSFKYMDRILLNWKKNNVKTIDD

SEQ ID NO: 2015004 - protein, 23 aa, Staphylococcus
GQPAELAPAYVFLATNADSSYIT

SEQ ID NO: 2015005 - protein, 33 aa, Staphylococcus
GQPDFINRLFDIEGVKSVFYVMDFISVDKEEYA

SEQ ID NO: 2015006 - protein, 21 aa, Staphylococcus
GQPGICILGPLVNEIDKMVLD

SEQ ID NO: 2015007 - protein, 25 aa, Staphylococcus
GQPLFKRNLELVKWAYQQTNGKFLI

SEQ ID NO: 2015008 - protein, 17 aa, Staphylococcus
GQPLYKYFGGFNGKQLP

SEQ ID NO: 2015009 - protein, 17 aa, Staphylococcus
GQPLYKYLGGFNGKQLP

SEQ ID NO: 2015010 - protein, 21 aa, Staphylococcus
GQPVECVGPYVLFASEDGSYL

SEQ ID NO: 2015011 - protein, 20 aa, Staphylococcus
GQPVELSGTYVLLASEESSY

SEQ ID NO: 2015012 - protein, 22 aa, Staphylococcus
GQPYAGFVYDVMRDILYHTKVG

SEQ ID NO: 2015013 - protein, 17 aa, Staphylococcus
GQQLLPYHTHARVGIAL

SEQ ID NO: 2015014 - protein, 22 aa, Staphylococcus
GQQQRVCIARTLAIEPDVILMD

SEQ ID NO: 2015015 - protein, 23 aa, Staphylococcus
GQQRLTTITIIFKALQSYAKRKI

SEQ ID NO: 2015016 - protein, 24 aa, Staphylococcus
GQQRYYNFFGIGAFDSNAIQTGKS

SEQ ID NO: 2015017 - protein, 19 aa, Staphylococcus
GQRQPRRVVFFSVTEKDIA

SEQ ID NO: 2015018 - protein, 19 aa, Staphylococcus
GQSDFTFIIGGSNGLHKDV

SEQ ID NO: 2015019 - protein, 18 aa, Staphylococcus
GQSERFGAPKAFAEIDGK

SEQ ID NO: 2015020 - protein, 23 aa, Staphylococcus
GQSERFGEPKAFAQINAQPFYKR

SEQ ID NO: 2015021 - protein, 18 aa, Staphylococcus
GQSLAAYAPHGLTIHHTG

SEQ ID NO: 2015022 - protein, 17 aa, Staphylococcus
GQSLELYTPYLETIYSI

SEQ ID NO: 2015023 - protein, 22 aa, Staphylococcus
GQSLQCCSLKFVHPIKHNKITI

SEQ ID NO: 2015024 - protein, 24 aa, Staphylococcus
GQSLRYTISLIRKEELAFMKAEFE

SEQ ID NO: 2015025 - protein, 23 aa, Staphylococcus
GQSPMKRYYLAVKGQIIMTQDFM

SEQ ID NO: 2015026 - protein, 24 aa, Staphylococcus
GQSPRLAEKMHAAMIMDRVISQVN

SEQ ID NO: 2015027 - protein, 26 aa, Staphylococcus
GQSPYKFLLSHGFVMDGEGKKMSKSL

SEQ ID NO: 2015028 - protein, 21 aa, Staphylococcus
GQSPYKMLLSHGFVMDGEGKK

SEQ ID NO: 2015029 - protein, 23 aa, Staphylococcus
GQSSTARASFYIYNTKEDIDQLV

SEQ ID NO: 2015030 - protein, 18 aa, Staphylococcus
GQSVKRLVEAGADAIKFL

SEQ ID NO: 2015031 - protein, 21 aa, Staphylococcus
GQSYSYLIFVQETWSMLYENK

SEQ ID NO: 2015032 - protein, 17 aa, Staphylococcus
GQTAILFDEVDSGVSGQ

SEQ ID NO: 2015033 - protein, 27 aa, Staphylococcus
GQTEGVFFHERRALSHFEKRYATRSQL

SEQ ID NO: 2015034 - protein, 19 aa, Staphylococcus
GQTIKFKGFMTLYVEAKDD

SEQ ID NO: 2015035 - protein, 18 aa, Staphylococcus
GQTIKFKGFMTLYVESKD

SEQ ID NO: 2015036 - protein, 17 aa, Staphylococcus
GQTLFFGGLARIDYVSG

SEQ ID NO: 2015037 - protein, 18 aa, Staphylococcus
GQTLFFGGLARIDYVSGG

SEQ ID NO: 2015038 - protein, 19 aa, Staphylococcus
GQVARRIDKDILRNLAEKV

SEQ ID NO: 2015039 - protein, 22 aa, Staphylococcus
GQVCTCPERIFVHEDIHDTFVD

SEQ ID NO: 2015040 - protein, 24 aa, Staphylococcus
GQVFQGEILLFLLGLTNSMAGFEK

SEQ ID NO: 2015041 - protein, 17 aa, Staphylococcus
GQVGHLAFRIPKDSMSH

SEQ ID NO: 2015042 - protein, 19 aa, Staphylococcus
GQVLHTFSTMKVLDPLGQD

SEQ ID NO: 2015043 - protein, 20 aa, Staphylococcus
GQVLNLAAAIYIYNDHEVYY

SEQ ID NO: 2015044 - protein, 17 aa, Staphylococcus
GQYCRLEKLAQCHIQDL

SEQ ID NO: 2015045 - protein, 21 aa, Staphylococcus
GQYFDHVWVYASKRYFHNQEP

SEQ ID NO: 2015046 - protein, 27 aa, Staphylococcus
GQYGIAWEIGLLKGLADHGIELRLSEQ

SEQ ID NO: 2015047 - protein, 19 aa, Staphylococcus
GQYLFDLKINLANLQKEIG

SEQ ID NO: 2015048 - protein, 19 aa, Staphylococcus
GQYLFDLKINLANLQKQIG

SEQ ID NO: 2015049 - protein, 17 aa, Staphylococcus
GQYLFDLRINLENMQKK

SEQ ID NO: 2015050 - protein, 17 aa, Staphylococcus
GQYNLCPHMEFMATPPY

SEQ ID NO: 2015051 - protein, 43 aa, Staphylococcus
GQYPKWKGIPAGISLKLISIFTGKRKRLKWVNQLVYKSFNKKI

SEQ ID NO: 2015052 - protein, 17 aa, Staphylococcus
GQYRGMATWKYDKARGR

SEQ ID NO: 2015053 - protein, 22 aa, Staphylococcus
GQYTHFDILPLIYKMPNSKIKY

SEQ ID NO: 2015054 - protein, 19 aa, Staphylococcus
GRAAEIFAKGYGSKVVAYD

SEQ ID NO: 2015055 - protein, 22 aa, Staphylococcus
GRAAYTSIYFLLTYHNISHFHR

SEQ ID NO: 2015056 - protein, 20 aa, Staphylococcus
GRADHVVNFMHFVAEELREI

SEQ ID NO: 2015057 - protein, 28 aa, Staphylococcus
GRANGFCIYNDVAITIAYLIKHYNQRVL

SEQ ID NO: 2015058 - protein, 21 aa, Staphylococcus
GRASKRLQEATGLEAMTIHRL

SEQ ID NO: 2015059 - protein, 19 aa, Staphylococcus
GRDGFIMGEGAGIVVLESL

SEQ ID NO: 2015060 - protein, 20 aa, Staphylococcus
GRDGFVMGEGAGILFIESLE

SEQ ID NO: 2015061 - protein, 18 aa, Staphylococcus
GRDGFVMGEGAGILVIES

SEQ ID NO: 2015062 - protein, 19 aa, Staphylococcus
GRDGFVMGEGAGIVVIESL

SEQ ID NO: 2015063 - protein, 18 aa, Staphylococcus
GRDGFVMGEGAGIVVVES

SEQ ID NO: 2015064 - protein, 17 aa, Staphylococcus
GRDGFVMGEGAGVLVIE

SEQ ID NO: 2015065 - protein, 25 aa, Staphylococcus
GRDGLKSECILLFSERDRGLHEYFI

SEQ ID NO: 2015066 - protein, 24 aa, Staphylococcus
GRDGLKSECILLYSERDKGLHEYF

SEQ ID NO: 2015067 - protein, 20 aa, Staphylococcus
GRDIANWILTGVKPHRYESF

SEQ ID NO: 2015068 - protein, 18 aa, Staphylococcus
GRDIGTVVLPDAELKIYM

SEQ ID NO: 2015069 - protein, 18 aa, Staphylococcus
GRDIGTVVLPDAELKVYM

SEQ ID NO: 2015070 - protein, 17 aa, Staphylococcus
GRDIGTVVLPNAELKVY

SEQ ID NO: 2015071 - protein, 18 aa, Staphylococcus
GRDSRTQAILPLRGKILN

SEQ ID NO: 2015072 - protein, 24 aa, Staphylococcus
GRDSRTQAILPLRGKILNVEKSRL

SEQ ID NO: 2015073 - protein, 17 aa, Staphylococcus
GRDTIFNSIFGKTFDTV

SEQ ID NO: 2015074 - protein, 21 aa, Staphylococcus
GREAYPGDVFYLHSRLLERAA

SEQ ID NO: 2015075 - protein, 19 aa, Staphylococcus
GREGVLTYDVLDYIKEIMS

SEQ ID NO: 2015076 - protein, 27 aa, Staphylococcus
GREIMSIGVGLGFFGVAGFDLLLDEHH

SEQ ID NO: 2015077 - protein, 24 aa, Staphylococcus
GREKQKIRPCLVVNNQMTINGTDF

SEQ ID NO: 2015078 - protein, 18 aa, Staphylococcus
GRETLCRDVQNAGYTVDG

SEQ ID NO: 2015079 - protein, 24 aa, Staphylococcus
GREVSIFCTFWGLNALKRPNPGKV

SEQ ID NO: 2015080 - protein, 23 aa, Staphylococcus
GREWGDYGIDEFLEIKSIAGYYK

SEQ ID NO: 2015081 - protein, 18 aa, Staphylococcus
GRFENTFNRWMEEIRDWT

SEQ ID NO: 2015082 - protein, 18 aa, Staphylococcus
GRFGVNLRYPQGFEFEEA

SEQ ID NO: 2015083 - protein, 18 aa, Staphylococcus
GRFHKLKPKRFMEVAEFN

SEQ ID NO: 2015084 - protein, 18 aa, Staphylococcus
GRFKETFHAVQDHFTTVF

SEQ ID NO: 2015085 - protein, 23 aa, Staphylococcus
GRFLNVGENEWGLRDWYSVDDIE

SEQ ID NO: 2015086 - protein, 22 aa, Staphylococcus
GRFNYDILVVGLGFVSETFGIK

SEQ ID NO: 2015087 - protein, 21 aa, Staphylococcus
GRGGRGNSRFASPRNPAPDFS

SEQ ID NO: 2015088 - protein, 21 aa, Staphylococcus
GRGGRGNSRFATPRNPAPDFS

SEQ ID NO: 2015089 - protein, 17 aa, Staphylococcus
GRGQELFDLCLKAKHLE

SEQ ID NO: 2015090 - protein, 20 aa, Staphylococcus
GRGSEAIYEGFKLKEDPEAK

SEQ ID NO: 2015091 - protein, 24 aa, Staphylococcus
GRGYRKVVPSPLPVSILEHQLIST

SEQ ID NO: 2015092 - protein, 26 aa, Staphylococcus
GRHIYLNRYGELMLNYIDSAFRELNE

SEQ ID NO: 2015093 - protein, 24 aa, Staphylococcus
GRHPEFREAGLFHIAYLLPSRQDL

SEQ ID NO: 2015094 - protein, 24 aa, Staphylococcus
GRICPAPCEQSCVMKINRDSVAIK

SEQ ID NO: 2015095 - protein, 20 aa, Staphylococcus
GRIFKRVLEDSGVFKQSTEG

SEQ ID NO: 2015096 - protein, 25 aa, Staphylococcus
GRIGAATGKIYAGFGAKVVGFDAYP

SEQ ID NO: 2015097 - protein, 18 aa, Staphylococcus
GRIGGRAAEIFAKGYGSK

SEQ ID NO: 2015098 - protein, 20 aa, Staphylococcus
GRIGGRRNGVLVSMDQGKAS

SEQ ID NO: 2015099 - protein, 18 aa, Staphylococcus
GRIGSIVAQIFAEGYRSE

SEQ ID NO: 2015100 - protein, 21 aa, Staphylococcus
GRIIGKRPGYEPDIDKLCQLV

SEQ ID NO: 2015101 - protein, 20 aa, Staphylococcus
GRIIGKRPGYQPNIEQLMQL

SEQ ID NO: 2015102 - protein, 17 aa, Staphylococcus
GRIKPYITIFSKDNPPQ

SEQ ID NO: 2015103 - protein, 18 aa, Staphylococcus
GRILSVAISGEAAFKRFT

SEQ ID NO: 2015104 - protein, 26 aa, Staphylococcus
GRINDLRIGESLFRGVNTVDQQPIHY

SEQ ID NO: 2015105 - protein, 25 aa, Staphylococcus
GRINELRIGEALFRGIDTTTNQSIP

SEQ ID NO: 2015106 - protein, 25 aa, Staphylococcus
GRINELRIGETLFRGVETTTNQSIA

SEQ ID NO: 2015107 - protein, 18 aa, Staphylococcus
GRIPIKYTAQASSPTEGL

SEQ ID NO: 2015108 - protein, 20 aa, Staphylococcus
GRIYFSQEMLNQYDVNIEDV

SEQ ID NO: 2015109 - protein, 30 aa, Staphylococcus
GRKAQEAYLSYRLEQEYSKDDIFQIYLNKI

SEQ ID NO: 2015110 - protein, 21 aa, Staphylococcus
GRKGYEHDGVIPGGALDPLSH

SEQ ID NO: 2015111 - protein, 18 aa, Staphylococcus
GRKILILADVLELGENSQ

SEQ ID NO: 2015112 - protein, 20 aa, Staphylococcus
GRKKAVVIHGAGGMDEASLS

SEQ ID NO: 2015113 - protein, 21 aa, Staphylococcus
GRKPIKTMWAKHEQYDTVLNQ

SEQ ID NO: 2015114 - protein, 20 aa, Staphylococcus
GRKPIKTSWAKHEQYEQVLH

SEQ ID NO: 2015115 - protein, 19 aa, Staphylococcus
GRLAEQIFEDLAFPRHEND

SEQ ID NO: 2015116 - protein, 18 aa, Staphylococcus
GRLAILDHMLQTIDTSRS

SEQ ID NO: 2015117 - protein, 17 aa, Staphylococcus
GRLDRIEVEKVLLYDDF

SEQ ID NO: 2015118 - protein, 17 aa, Staphylococcus
GRLEAETTFVTKVGKEG

SEQ ID NO: 2015119 - protein, 19 aa, Staphylococcus
GRLLKDFIKFLERNNNHVW

SEQ ID NO: 2015120 - protein, 19 aa, Staphylococcus
GRLLKSFITYLKQANEQEL

SEQ ID NO: 2015121 - protein, 21 aa, Staphylococcus
GRLLLYSSKDIVNWHFQGEIK

SEQ ID NO: 2015122 - protein, 17 aa, Staphylococcus
GRLLMAEVIDHGQGFDP

SEQ ID NO: 2015123 - protein, 19 aa, Staphylococcus
GRLNIKRTRSELVESGQDD

SEQ ID NO: 2015124 - protein, 18 aa, Staphylococcus
GRLPEAIVACVGGGSNAI

SEQ ID NO: 2015125 - protein, 17 aa, Staphylococcus
GRLPMIASGGINSVESA

SEQ ID NO: 2015126 - protein, 18 aa, Staphylococcus
GRLPNAVVACVGGGSNAI

SEQ ID NO: 2015127 - protein, 20 aa, Staphylococcus
GRLQREVGKYNNFIIQYEKL

SEQ ID NO: 2015128 - protein, 19 aa, Staphylococcus
GRLSPEKGFDLLIEAVFEL

SEQ ID NO: 2015129 - protein, 17 aa, Staphylococcus
GRLSTTFMKAHHLSEQL

SEQ ID NO: 2015130 - protein, 17 aa, Staphylococcus
GRLVIGVNPILAAHTLY

SEQ ID NO: 2015131 - protein, 22 aa, Staphylococcus
GRMGNFLENMVDWNIGRNRYWG

SEQ ID NO: 2015132 - protein, 26 aa, Staphylococcus
GRMRKLCRPETPAIIVTRDLEPPEEL

SEQ ID NO: 2015133 - protein, 17 aa, Staphylococcus
GRMSAQIGAEFLQKYKG

SEQ ID NO: 2015134 - protein, 17 aa, Staphylococcus
GRMVKDFVVNIYGQNFE

SEQ ID NO: 2015135 - protein, 19 aa, Staphylococcus
GRNASYLANLGYDVMTYDL

SEQ ID NO: 2015136 - protein, 25 aa, Staphylococcus
GRNKIVKFVGCYHGHSDSLLIKAGS

SEQ ID NO: 2015137 - protein, 21 aa, Staphylococcus
GRNPISIIIPCHRVVGKDGSL

SEQ ID NO: 2015138 - protein, 20 aa, Staphylococcus
GRPAPFPDNIMKKVEEESTL

SEQ ID NO: 2015139 - protein, 18 aa, Staphylococcus
GRPFEPMPQLLAVSELVT

SEQ ID NO: 2015140 - protein, 29 aa, Staphylococcus
GRPGYLRFKVSVLPRRASFSGKQSLKRML

SEQ ID NO: 2015141 - protein, 22 aa, Staphylococcus
GRPLRNAILWNDTRTTPQCETI

SEQ ID NO: 2015142 - protein, 29 aa, Staphylococcus
GRPLTRQGIWKMIKQYGLKANINKTLTPH

SEQ ID NO: 2015143 - protein, 20 aa, Staphylococcus
GRPNVGKSTIFNRIVGERVS

SEQ ID NO: 2015144 - protein, 17 aa, Staphylococcus
GRQATHEDIVWIINQLD

SEQ ID NO: 2015145 - protein, 23 aa, Staphylococcus
GRQHKGVGWVLSYDKDEVINTQF

SEQ ID NO: 2015146 - protein, 19 aa, Staphylococcus
GRRANLFGLFNKAIEFENS

SEQ ID NO: 2015147 - protein, 21 aa, Staphylococcus
GRRRIYGFRGLVDGAIDEERV

SEQ ID NO: 2015148 - protein, 17 aa, Staphylococcus
GRRRPSQTVGRTLNSGW

SEQ ID NO: 2015149 - protein, 19 aa, Staphylococcus
GRSGKGLLRQTPKQAETRK

SEQ ID NO: 2015150 - protein, 18 aa, Staphylococcus
GRSLPLAQGVKMANKDLT

SEQ ID NO: 2015151 - protein, 23 aa, Staphylococcus
GRSPISIIVPCHRVVGKDGSLTG

SEQ ID NO: 2015152 - protein, 20 aa, Staphylococcus
GRSRWKGVRPTVRGSVMNPN

SEQ ID NO: 2015153 - protein, 20 aa, Staphylococcus
GRSWNGLIINYLSRCEDQSA

SEQ ID NO: 2015154 - protein, 19 aa, Staphylococcus
GRSYFKLIVKGEGGHGSSP

SEQ ID NO: 2015155 - protein, 20 aa, Staphylococcus
GRTAGHLMSMLVTLKGLPLA

SEQ ID NO: 2015156 - protein, 17 aa, Staphylococcus
GRTAYKGPLQDTVYQLM

SEQ ID NO: 2015157 - protein, 27 aa, Staphylococcus
GRTGMLSLRLNKAFSVAKFLENLDICI

SEQ ID NO: 2015158 - protein, 26 aa, Staphylococcus
GRTGMLSLRLNKAYSVPKFLENLETC

SEQ ID NO: 2015159 - protein, 18 aa, Staphylococcus
GRTGYPIIDAAMHELKQT

SEQ ID NO: 2015160 - protein, 17 aa, Staphylococcus
GRTITGVINVRKDLSNA

SEQ ID NO: 2015161 - protein, 19 aa, Staphylococcus
GRTKALLKRIKFLDEEMNI

SEQ ID NO: 2015162 - protein, 19 aa, Staphylococcus
GRTKSLLKRIDFLNDEFDF

SEQ ID NO: 2015163 - protein, 19 aa, Staphylococcus
GRTKSLLKRIKFLEEKLNK

SEQ ID NO: 2015164 - protein, 19 aa, Staphylococcus
GRTLLGLKSPQKMKSIAKK

SEQ ID NO: 2015165 - protein, 17 aa, Staphylococcus
GRTLTAVLNVRKDLSNA

SEQ ID NO: 2015166 - protein, 18 aa, Staphylococcus
GRTRPSLVSDAFEAFIGA

SEQ ID NO: 2015167 - protein, 21 aa, Staphylococcus
GRTSFSFRFEDLFTKEEWLHM

SEQ ID NO: 2015168 - protein, 22 aa, Staphylococcus
GRTYHKFGTLGHVTHGYGNNDE

SEQ ID NO: 2015169 - protein, 18 aa, Staphylococcus
GRVAFATKIVQDHYKQGF

SEQ ID NO: 2015170 - protein, 18 aa, Staphylococcus
GRVFSFGPTFRAEKSKTR

SEQ ID NO: 2015171 - protein, 17 aa, Staphylococcus
GRVGWNLVTSMTDIEAQ

SEQ ID NO: 2015172 - protein, 18 aa, Staphylococcus
GRVKRSALSNFSHINKNG

SEQ ID NO: 2015173 - protein, 18 aa, Staphylococcus
GRVLVFNKRGYPIGQILM

SEQ ID NO: 2015174 - protein, 22 aa, Staphylococcus
GRVNNKCIIGGMNVYPEEVERV

SEQ ID NO: 2015175 - protein, 27 aa, Staphylococcus
GRVNSHGKYEIKLPKDITLNINDKISI

SEQ ID NO: 2015176 - protein, 21 aa, Staphylococcus
GRVSFAAKIIQDYFAEGFKGI

SEQ ID NO: 2015177 - protein, 20 aa, Staphylococcus
GRVTFLPRHQVTSIDIEDNQ

SEQ ID NO: 2015178 - protein, 25 aa, Staphylococcus
GRVVKGIQFKGLRDIGNPVDFALYY

SEQ ID NO: 2015179 - protein, 24 aa, Staphylococcus
GRVVRLTDFGAFVEIAAGVQGLVH

SEQ ID NO: 2015180 - protein, 20 aa, Staphylococcus
GRVYVIRLEQHIIGYVTYHY

SEQ ID NO: 2015181 - protein, 18 aa, Staphylococcus
GRWSNFDKTECGLHVPDK

SEQ ID NO: 2015182 - protein, 17 aa, Staphylococcus
GRWSSFEKTECGLHVAD

SEQ ID NO: 2015183 - protein, 17 aa, Staphylococcus
GRYAYSLPQSDIEDITI

SEQ ID NO: 2015184 - protein, 19 aa, Staphylococcus
GRYFAKLEVTMYCQNEKVA

SEQ ID NO: 2015185 - protein, 23 aa, Staphylococcus
GRYFTHDALRNFLERVPSHIPVI

SEQ ID NO: 2015186 - protein, 18 aa, Staphylococcus
GRYGVNLRYPQGFEFEEA

SEQ ID NO: 2015187 - protein, 17 aa, Staphylococcus
GRYIKNFLLNKAILEGY

SEQ ID NO: 2015188 - protein, 25 aa, Staphylococcus
GRYTYKLQNMYYLRISTLPLSLGNE

SEQ ID NO: 2015189 - protein, 27 aa, Staphylococcus
GRYTYKLRSVYYLRISTLPLSIGSESC

SEQ ID NO: 2015190 - protein, 19 aa, Staphylococcus
GRYYIQRFLARKFGLEVDE

SEQ ID NO: 2015191 - protein, 18 aa, Staphylococcus
GSAEIAIERAIEINDNVA

SEQ ID NO: 2015192 - protein, 25 aa, Staphylococcus
GSAHFKAIFDFANFVQCGEDTQACY

SEQ ID NO: 2015193 - protein, 17 aa, Staphylococcus
GSAHKIAKEVLNVDDKI

SEQ ID NO: 2015194 - protein, 19 aa, Staphylococcus
GSAIQWLRDGLRMINSAPQ

SEQ ID NO: 2015195 - protein, 20 aa, Staphylococcus
GSAIQWLRDGLRMINSAPQS

SEQ ID NO: 2015196 - protein, 24 aa, Staphylococcus
GSAKPRLPLEHVFHRNQYNSDKEK

SEQ ID NO: 2015197 - protein, 17 aa, Staphylococcus
GSARSIEQVSMFEILSA

SEQ ID NO: 2015198 - protein, 17 aa, Staphylococcus
GSARSIEQVSMFEILSD

SEQ ID NO: 2015199 - protein, 18 aa, Staphylococcus
GSASAIIVESCFVEDHGR

SEQ ID NO: 2015200 - protein, 23 aa, Staphylococcus
GSCNLVIQRGCPIEETLMSLGGK

SEQ ID NO: 2015201 - protein, 21 aa, Staphylococcus
GSCSWKVFVKNGVITWENQQI

SEQ ID NO: 2015202 - protein, 21 aa, Staphylococcus
GSCSWKVFVKNGVITWENQQT

SEQ ID NO: 2015203 - protein, 17 aa, Staphylococcus
GSDAFVFESNHDVDMLR

SEQ ID NO: 2015204 - protein, 19 aa, Staphylococcus
GSDAVGDWAILNALINTAA

SEQ ID NO: 2015205 - protein, 17 aa, Staphylococcus
GSDIPYLYYYMGPSGKF

SEQ ID NO: 2015206 - protein, 25 aa, Staphylococcus
GSDITGAIIARGIRASLYENFTDVS

SEQ ID NO: 2015207 - protein, 17 aa, Staphylococcus
GSDITGAIIARGVKASL

SEQ ID NO: 2015208 - protein, 17 aa, Staphylococcus
GSDITGAIIARGVRASL

SEQ ID NO: 2015209 - protein, 18 aa, Staphylococcus
GSDLIIGEVVMYHIDEAV

SEQ ID NO: 2015210 - protein, 24 aa, Staphylococcus
GSDLKVAIVVSRFNDFITNRLLDG

SEQ ID NO: 2015211 - protein, 18 aa, Staphylococcus
GSDQYRGWFNSSITTSVA

SEQ ID NO: 2015212 - protein, 23 aa, Staphylococcus
GSEAAYQLAERGIKVNLIEMRPV

SEQ ID NO: 2015213 - protein, 24 aa, Staphylococcus
GSEAAYQLAERGIKVNLIEMRPVK

SEQ ID NO: 2015214 - protein, 23 aa, Staphylococcus
GSEFPIVIMPIVKQYYRMLQRPI

SEQ ID NO: 2015215 - protein, 23 aa, Staphylococcus
GSEFPIVIMPTVKQYFRMLQRPI

SEQ ID NO: 2015216 - protein, 20 aa, Staphylococcus
GSEFPIVIMPVVKQYFRMLQ

SEQ ID NO: 2015217 - protein, 25 aa, Staphylococcus
GSEIGALLIKYLLEYTNVPNHSVVI

SEQ ID NO: 2015218 - protein, 24 aa, Staphylococcus
GSEIGALMIKYLVDYRTLPKQPVM

SEQ ID NO: 2015219 - protein, 19 aa, Staphylococcus
GSEIKRGEESYLILNVEDI

SEQ ID NO: 2015220 - protein, 23 aa, Staphylococcus
GSEIRCRLRSKGIVINDIAQKFG

SEQ ID NO: 2015221 - protein, 33 aa, Staphylococcus
GSEISDWNKTGWGKIPMSLGFTYSSNTLMMHLQ

SEQ ID NO: 2015222 - protein, 25 aa, Staphylococcus
GSEKWPIFLERSLVDQIITVSDKDG

SEQ ID NO: 2015223 - protein, 21 aa, Staphylococcus
GSEKWPSFLEKSLVEGIFTIS

SEQ ID NO: 2015224 - protein, 23 aa, Staphylococcus
GSEKWPVFLEKSIVDDIITVSDN

SEQ ID NO: 2015225 - protein, 25 aa, Staphylococcus
GSEKWPVFLKRNLVDDIITVSDVDG

SEQ ID NO: 2015226 - protein, 24 aa, Staphylococcus
GSELKIAIVVSRFNDFITNRLLEG

SEQ ID NO: 2015227 - protein, 20 aa, Staphylococcus
GSESIRIIAMASNEKPERQD

SEQ ID NO: 2015228 - protein, 19 aa, Staphylococcus
GSFEIEGISLFELQARQLL

SEQ ID NO: 2015229 - protein, 19 aa, Staphylococcus
GSFEIEGVSLFELQARQLI

SEQ ID NO: 2015230 - protein, 19 aa, Staphylococcus
GSFEIEGVSLFELQARQLL

SEQ ID NO: 2015231 - protein, 23 aa, Staphylococcus
GSFSDRMSRLLIGEDGEQAVLTR

SEQ ID NO: 2015232 - protein, 19 aa, Staphylococcus
GSGATAFVYNGKFNAEKYL

SEQ ID NO: 2015233 - protein, 21 aa, Staphylococcus
GSGHAAWHAALTLKHAGKEVA

SEQ ID NO: 2015234 - protein, 22 aa, Staphylococcus
GSGHVRISYAYDLDTIKEGMDR

SEQ ID NO: 2015235 - protein, 21 aa, Staphylococcus
GSGIAEMIAHFGIQQQETLVI

SEQ ID NO: 2015236 - protein, 21 aa, Staphylococcus
GSGILSIACHLLGVRHIKAID

SEQ ID NO: 2015237 - protein, 21 aa, Staphylococcus
GSGILSIACHLLGVRHIKAVD

SEQ ID NO: 2015238 - protein, 22 aa, Staphylococcus
GSGKSLAYLLAALMYNIETDKH

SEQ ID NO: 2015239 - protein, 22 aa, Staphylococcus
GSGKSLAYLLAALMYNIETGRH

SEQ ID NO: 2015240 - protein, 24 aa, Staphylococcus
GSGKSMLFDAIVFALYGKASTSSR

SEQ ID NO: 2015241 - protein, 26 aa, Staphylococcus
GSGKSNITDAIKWVLGEQSAKSLRGA

SEQ ID NO: 2015242 - protein, 26 aa, Staphylococcus
GSGKSNVTDAIKWVLGEQSAKSLRGS

SEQ ID NO: 2015243 - protein, 23 aa, Staphylococcus
GSGKSSLISAAFEQEQRAIFIDQ

SEQ ID NO: 2015244 - protein, 20 aa, Staphylococcus
GSGKSSLISAGFEHQDNVTF

SEQ ID NO: 2015245 - protein, 37 aa, Staphylococcus
GSGKSTFARCFCGLAKGFKGSVSWQQCHAKRKQLLKH

SEQ ID NO: 2015246 - protein, 24 aa, Staphylococcus
GSGKTMLFDGIVYALFGKASTEGR

SEQ ID NO: 2015247 - protein, 24 aa, Staphylococcus
GSGKTVVAAICMYALKTAGFQSAL

SEQ ID NO: 2015248 - protein, 23 aa, Staphylococcus
GSGKTVVAAICMYALKTAGYQSA

SEQ ID NO: 2015249 - protein, 24 aa, Staphylococcus
GSGKTVVAALCMFALKTAGYQSAL

SEQ ID NO: 2015250 - protein, 21 aa, Staphylococcus
GSGLEAVIHACRMIQAGAGHI

SEQ ID NO: 2015251 - protein, 23 aa, Staphylococcus
GSGLESIIYACRMVQAGAGHIYI

SEQ ID NO: 2015252 - protein, 25 aa, Staphylococcus
GSGMLCALGAQFLDSKNQPLKLGGG

SEQ ID NO: 2015253 - protein, 18 aa, Staphylococcus
GSGPTVYAFAQKESQAKK

SEQ ID NO: 2015254 - protein, 19 aa, Staphylococcus
GSGTGWLLEIVISNEHYET

SEQ ID NO: 2015255 - protein, 20 aa, Staphylococcus
GSGTGWLLEIVISNEHYHTF

SEQ ID NO: 2015256 - protein, 18 aa, Staphylococcus
GSHASWIVTFHKQLTFLP

SEQ ID NO: 2015257 - protein, 19 aa, Staphylococcus
GSHFHRAPGSVGMASDASK

SEQ ID NO: 2015258 - protein, 18 aa, Staphylococcus
GSHPLPSIQEAFKKYGIN

SEQ ID NO: 2015259 - protein, 17 aa, Staphylococcus
GSHSAEMLVRMGVGSLT

SEQ ID NO: 2015260 - protein, 19 aa, Staphylococcus
GSHVAELLARMGAHQITIV

SEQ ID NO: 2015261 - protein, 18 aa, Staphylococcus
GSIATFGVLGVAAYKHFE

SEQ ID NO: 2015262 - protein, 27 aa, Staphylococcus
GSICKLPHAEPFLASWFAEIIAEIDPV

SEQ ID NO: 2015263 - protein, 19 aa, Staphylococcus
GSIEFLEVIGLEGSTYLLK

SEQ ID NO: 2015264 - protein, 22 aa, Staphylococcus
GSIEFLEVLGLEGSTYLLKGPN

SEQ ID NO: 2015265 - protein, 17 aa, Staphylococcus
GSIEFLEVTGLQGSTYM

SEQ ID NO: 2015266 - protein, 27 aa, Staphylococcus
GSIEKGKLADLVLWNPAFFGVKPELVV

SEQ ID NO: 2015267 - protein, 18 aa, Staphylococcus
GSIELHKKFNFTHAGTIK

SEQ ID NO: 2015268 - protein, 23 aa, Staphylococcus
GSIGHLNPTIAVCKELVARGEEV

SEQ ID NO: 2015269 - protein, 28 aa, Staphylococcus
GSIKNFRVTKIFGFFGLKREEVNEAYAG

SEQ ID NO: 2015270 - protein, 28 aa, Staphylococcus
GSIKNFRVTKIFGYFGLKREEIEEAQAG

SEQ ID NO: 2015271 - protein, 17 aa, Staphylococcus
GSIPCFLDDQWSEVTIH

SEQ ID NO: 2015272 - protein, 26 aa, Staphylococcus
GSIPKPKDWWELKKILKFDDKYDKVV

SEQ ID NO: 2015273 - protein, 21 aa, Staphylococcus
GSIPLVNRITNQVAFVRYHGR

SEQ ID NO: 2015274 - protein, 22 aa, Staphylococcus
GSIRGDLGLTVGRNIIHGSDSV

SEQ ID NO: 2015275 - protein, 20 aa, Staphylococcus
GSIRGDLGLTVGRNVIHGSD

SEQ ID NO: 2015276 - protein, 20 aa, Staphylococcus
GSIRIRPEYFEVYREDELLE

SEQ ID NO: 2015277 - protein, 17 aa, Staphylococcus
GSITGAPKLSTMKYIEQ

SEQ ID NO: 2015278 - protein, 24 aa, Staphylococcus
GSITKRLGLDKGYQFNEPLVEFFY

SEQ ID NO: 2015279 - protein, 18 aa, Staphylococcus
GSIVGFFTPELFHGIGSA

SEQ ID NO: 2015280 - protein, 19 aa, Staphylococcus
GSIVGFFTPELFHGVGSAG

SEQ ID NO: 2015281 - protein, 18 aa, Staphylococcus
GSIVKYDVAFGLENHAVP

SEQ ID NO: 2015282 - protein, 18 aa, Staphylococcus
GSIVKYDVAFGLENHSVP

SEQ ID NO: 2015283 - protein, 18 aa, Staphylococcus
GSIYVATLHSVYEKNFSG

SEQ ID NO: 2015284 - protein, 34 aa, Staphylococcus
GSKEYYSDMLLRNELNVLLTRGVNGLYIYAVDDQ

SEQ ID NO: 2015285 - protein, 19 aa, Staphylococcus
GSKIVPFLPIKEEKDLNVV

SEQ ID NO: 2015286 - protein, 17 aa, Staphylococcus
GSKRAAMMRDFYQHALK

SEQ ID NO: 2015287 - protein, 31 aa, Staphylococcus
GSKRVFNMIPYKVQVMGGIAIHGGDISEMRT

SEQ ID NO: 2015288 - protein, 31 aa, Staphylococcus
GSKRVFNMIPYKVQVMGGIAIHHGDIAEMRT

SEQ ID NO: 2015289 - protein, 32 aa, Staphylococcus
GSKRVFNMIPYRVQVMGGIAIHKGDIAEMRTG

SEQ ID NO: 2015290 - protein, 21 aa, Staphylococcus
GSKSFAKRIMEKYGIPTAEYV

SEQ ID NO: 2015291 - protein, 17 aa, Staphylococcus
GSKTIIYFYPRDNTPTC

SEQ ID NO: 2015292 - protein, 29 aa, Staphylococcus
GSKVCLANILRICARYDNLNIVEDAYGIN

SEQ ID NO: 2015293 - protein, 22 aa, Staphylococcus
GSLEDEIYCIYTSGTTGMPKGV

SEQ ID NO: 2015294 - protein, 25 aa, Staphylococcus
GSLESEVKFTAHMDVQDKLSDEIED

SEQ ID NO: 2015295 - protein, 18 aa, Staphylococcus
GSLGPIFDKDIKIIADNY

SEQ ID NO: 2015296 - protein, 17 aa, Staphylococcus
GSLGPYGAYLSDGSEYT

SEQ ID NO: 2015297 - protein, 19 aa, Staphylococcus
GSLHAPQGRDVIVKLNKGD

SEQ ID NO: 2015298 - protein, 21 aa, Staphylococcus
GSLKGFIWAHYEPQLKIVQIE

SEQ ID NO: 2015299 - protein, 24 aa, Staphylococcus
GSLKNKLAALVLKKDLDTFTKKMD

SEQ ID NO: 2015300 - protein, 18 aa, Staphylococcus
GSLNREKYGITFNQQLET

SEQ ID NO: 2015301 - protein, 17 aa, Staphylococcus
GSLPHELYLRLKKYVSE

SEQ ID NO: 2015302 - protein, 22 aa, Staphylococcus
GSLPLQLSDLVCHLTQLMKYGG

SEQ ID NO: 2015303 - protein, 18 aa, Staphylococcus
GSLRCDANISLRPYGQEE

SEQ ID NO: 2015304 - protein, 20 aa, Staphylococcus
GSLRLDGRLMHDYKTKQWMR

SEQ ID NO: 2015305 - protein, 23 aa, Staphylococcus
GSMLPKIEAAIDFVESGEHKEAI

SEQ ID NO: 2015306 - protein, 19 aa, Staphylococcus
GSMLPKVEASIQFIENNPK

SEQ ID NO: 2015307 - protein, 23 aa, Staphylococcus
GSMLPKVEASLQFIENNPEGKVI

SEQ ID NO: 2015308 - protein, 17 aa, Staphylococcus
GSMNIFFVENGKIVTPA

SEQ ID NO: 2015309 - protein, 17 aa, Staphylococcus
GSMNIFFVENGKLVTPA

SEQ ID NO: 2015310 - protein, 17 aa, Staphylococcus
GSMNIFFVENGKLVTPE

SEQ ID NO: 2015311 - protein, 28 aa, Staphylococcus
GSMQSYRAGKNIFPYAASKHGVVGITRA

SEQ ID NO: 2015312 - protein, 29 aa, Staphylococcus
GSNAIYEFLTLRLPMLLIPLGLDQSRGDQ

SEQ ID NO: 2015313 - protein, 18 aa, Staphylococcus
GSNYAGVRAFTASAGPGL

SEQ ID NO: 2015314 - protein, 30 aa, Staphylococcus
GSNYLKDDILKFGFYDKERYIVVDADNIKD

SEQ ID NO: 2015315 - protein, 19 aa, Staphylococcus
GSPIGQILMPGRDQGHMLR

SEQ ID NO: 2015316 - protein, 24 aa, Staphylococcus
GSPKFFKRMLVDFINKTNYTCDIV

SEQ ID NO: 2015317 - protein, 19 aa, Staphylococcus
GSPKGLTFINANDISSMGI

SEQ ID NO: 2015318 - protein, 26 aa, Staphylococcus
GSPKPRLPFEHVFHANKYDSDKDSQR

SEQ ID NO: 2015319 - protein, 25 aa, Staphylococcus
GSPKPRLPFELIFHKNVYNSNKAHQ

SEQ ID NO: 2015320 - protein, 20 aa, Staphylococcus
GSQALTCYYGGEVIQGLKIM

SEQ ID NO: 2015321 - protein, 25 aa, Staphylococcus
GSQKNRFPWVVAAFPSKDWARRVYP

SEQ ID NO: 2015322 - protein, 17 aa, Staphylococcus
GSQLLRYVEEDFLRDTL

SEQ ID NO: 2015323 - protein, 18 aa, Staphylococcus
GSQYRTAIFYTNEDQRET

SEQ ID NO: 2015324 - protein, 26 aa, Staphylococcus
GSRISDWNKTGWGKISETLGFTYSSN

SEQ ID NO: 2015325 - protein, 22 aa, Staphylococcus
GSSAAMAVAFVRASFDYLDEPL

SEQ ID NO: 2015326 - protein, 17 aa, Staphylococcus
GSSARALVISGYTNVSV

SEQ ID NO: 2015327 - protein, 23 aa, Staphylococcus
GSSKSNGVLSPWSKREAEDYYEV

SEQ ID NO: 2015328 - protein, 22 aa, Staphylococcus
GSSRGLGAVIVKTLATQGFEVI

SEQ ID NO: 2015329 - protein, 21 aa, Staphylococcus
GSSSVYLKSPWHSLIELQSIP

SEQ ID NO: 2015330 - protein, 21 aa, Staphylococcus
GSSVGHKNLEFTFVENQEENI

SEQ ID NO: 2015331 - protein, 21 aa, Staphylococcus
GSSYSYLIFVQETWSMLHNNR

SEQ ID NO: 2015332 - protein, 18 aa, Staphylococcus
GSTAYKFRQLNAVTNTKK

SEQ ID NO: 2015333 - protein, 27 aa, Staphylococcus
GSTFNGVLCGRATWRGATDHFAEGDAA

SEQ ID NO: 2015334 - protein, 17 aa, Staphylococcus
GSTFQWRKQGQRHAFNP

SEQ ID NO: 2015335 - protein, 17 aa, Staphylococcus
GSTIGIIGGGQLGKMMA

SEQ ID NO: 2015336 - protein, 17 aa, Staphylococcus
GSTLAFVLAQKELADIV

SEQ ID NO: 2015337 - protein, 17 aa, Staphylococcus
GSTLLEAMCTRMTAHSS

SEQ ID NO: 2015338 - protein, 22 aa, Staphylococcus
GSTPRTGGMGATYSTSDNNVKV

SEQ ID NO: 2015339 - protein, 27 aa, Staphylococcus
GSTYLPRKFKIGIAVPPSNDIDVYSQD

SEQ ID NO: 2015340 - protein, 23 aa, Staphylococcus
GSVAYMFEYTAVFGIEDKSADDI

SEQ ID NO: 2015341 - protein, 19 aa, Staphylococcus
GSVEPGVAWKNGPVPEEYA

SEQ ID NO: 2015342 - protein, 19 aa, Staphylococcus
GSVGMASDASRVFKGQKAP

SEQ ID NO: 2015343 - protein, 28 aa, Staphylococcus
GSVKNFRVTKLFGFFGLKREEIQEAHAG

SEQ ID NO: 2015344 - protein, 23 aa, Staphylococcus
GSVKTQLADYVFIGAGGGAIPLL

SEQ ID NO: 2015345 - protein, 18 aa, Staphylococcus
GSVNAILGLTSEKPDIDY

SEQ ID NO: 2015346 - protein, 18 aa, Staphylococcus
GSVTAGFAIYDTIQHIKP

SEQ ID NO: 2015347 - protein, 19 aa, Staphylococcus
GSVVIYRGVTEFPFSDLIS

SEQ ID NO: 2015348 - protein, 17 aa, Staphylococcus
GSWICEIEELSAFQKST

SEQ ID NO: 2015349 - protein, 19 aa, Staphylococcus
GSYALSRPLFIYVKDKSLK

SEQ ID NO: 2015350 - protein, 19 aa, Staphylococcus
GSYEEKIDWLLPQLNETGP

SEQ ID NO: 2015351 - protein, 18 aa, Staphylococcus
GSYFKKNVGMPIKELNKI

SEQ ID NO: 2015352 - protein, 17 aa, Staphylococcus
GSYGLGIIGELNEPMNI

SEQ ID NO: 2015353 - protein, 23 aa, Staphylococcus
GSYLTKIRTGAISGVATKYLARE

SEQ ID NO: 2015354 - protein, 24 aa, Staphylococcus
GSYQPSRCFALPVIQKGHIFIKRV

SEQ ID NO: 2015355 - protein, 18 aa, Staphylococcus
GSYSSGTAEREWLEDKGY

SEQ ID NO: 2015356 - protein, 25 aa, Staphylococcus
GSYTGLRIGVTTAKTLAYALQTDLY

SEQ ID NO: 2015357 - protein, 18 aa, Staphylococcus
GTADWTIALSRAVGPNGE

SEQ ID NO: 2015358 - protein, 20 aa, Staphylococcus
GTAEIDGAAQFIDYLNKNDI

SEQ ID NO: 2015359 - protein, 17 aa, Staphylococcus
GTAFANFGSDVTILEGA

SEQ ID NO: 2015360 - protein, 29 aa, Staphylococcus
GTAGIRGKFGIGPGRMNAFTVRKVALGLA

SEQ ID NO: 2015361 - protein, 29 aa, Staphylococcus
GTAGIRGKFGLGEGRLNKFTVNKVAIGLS

SEQ ID NO: 2015362 - protein, 29 aa, Staphylococcus
GTAGIRGKLGLGEGRLNRFTVSKVALGLA

SEQ ID NO: 2015363 - protein, 21 aa, Staphylococcus
GTAGIRGLLGLGPGRLNAFTV

SEQ ID NO: 2015364 - protein, 27 aa, Staphylococcus
GTAGIRGQFGLGPGRLNRYTIQRLALG

SEQ ID NO: 2015365 - protein, 20 aa, Staphylococcus
GTALQLPPFYEARRHEIEAA

SEQ ID NO: 2015366 - protein, 18 aa, Staphylococcus
GTANEFRHFAGSYAVQWE

SEQ ID NO: 2015367 - protein, 22 aa, Staphylococcus
GTDARMLYWFTDKEYPVIRKPQ

SEQ ID NO: 2015368 - protein, 26 aa, Staphylococcus
GTDDEPGWWREIIDGGYMPIYDYQFL

SEQ ID NO: 2015369 - protein, 21 aa, Staphylococcus
GTDEHPGWWREIIDGGYMPIY

SEQ ID NO: 2015370 - protein, 17 aa, Staphylococcus
GTDIFLCTPDNVEVAGS

SEQ ID NO: 2015371 - protein, 18 aa, Staphylococcus
GTDIKAAVLDNGLNFVDY

SEQ ID NO: 2015372 - protein, 22 aa, Staphylococcus
GTDIPFCILGKTALCKGKGEII

SEQ ID NO: 2015373 - protein, 34 aa, Staphylococcus
GTDKRVSPDLFIKRLNFYDFLLLCSDGLTDYVRN

SEQ ID NO: 2015374 - protein, 23 aa, Staphylococcus
GTDLKVAIVVSRFNDFITNRLLD

SEQ ID NO: 2015375 - protein, 17 aa, Staphylococcus
GTDLPGQIARKVDQNIL

SEQ ID NO: 2015376 - protein, 18 aa, Staphylococcus
GTDLPGQVARRIDKDILR

SEQ ID NO: 2015377 - protein, 25 aa, Staphylococcus
GTDQFKRIRIGVGRPTSGMSVPDYV

SEQ ID NO: 2015378 - protein, 22 aa, Staphylococcus
GTDVSFCIYNKTAYCTGRGEKV

SEQ ID NO: 2015379 - protein, 28 aa, Staphylococcus
GTDYLDLFLIHWPCEADDLFIESYKAME

SEQ ID NO: 2015380 - protein, 19 aa, Staphylococcus
GTEAAVAYQSGFNCNMAAI

SEQ ID NO: 2015381 - protein, 20 aa, Staphylococcus
GTEITSNFYNRMFKQHPELK

SEQ ID NO: 2015382 - protein, 18 aa, Staphylococcus
GTELAGLNILDFYTESQT

SEQ ID NO: 2015383 - protein, 18 aa, Staphylococcus
GTELRGPIFKGLPTIEVH

SEQ ID NO: 2015384 - protein, 24 aa, Staphylococcus
GTEPKIKIYFSLNVNNIDSLIKEF

SEQ ID NO: 2015385 - protein, 24 aa, Staphylococcus
GTEPKIKLYFSLEVENIDEITQQF

SEQ ID NO: 2015386 - protein, 24 aa, Staphylococcus
GTEPKIKVYFSLNVGDLNKVVTEF

SEQ ID NO: 2015387 - protein, 25 aa, Staphylococcus
GTEQFKRIRIGVGRPTNGMSVPDYV

SEQ ID NO: 2015388 - protein, 23 aa, Staphylococcus
GTERLVRAAIQYAIDNGRKSVTL

SEQ ID NO: 2015389 - protein, 22 aa, Staphylococcus
GTERLVRAAIQYAIDNNRKAVT

SEQ ID NO: 2015390 - protein, 22 aa, Staphylococcus
GTERLVRAAIQYAIDNNRKTVT

SEQ ID NO: 2015391 - protein, 23 aa, Staphylococcus
GTERLVRAAIQYALDNNRKSVTL

SEQ ID NO: 2015392 - protein, 21 aa, Staphylococcus
GTERLVRAAIQYAVDNNRKSL

SEQ ID NO: 2015393 - protein, 22 aa, Staphylococcus
GTERLVRSAIQYAIDNDRKSVT

SEQ ID NO: 2015394 - protein, 22 aa, Staphylococcus
GTERLVRSAIQYAIDNNRKSVT

SEQ ID NO: 2015395 - protein, 31 aa, Staphylococcus
GTESQDWVSMLLRMYQRYCEQSGFKVETVDY

SEQ ID NO: 2015396 - protein, 17 aa, Staphylococcus
GTFLYSARCPQFKDESV

SEQ ID NO: 2015397 - protein, 17 aa, Staphylococcus
GTFLYSARCPQFKEASV

SEQ ID NO: 2015398 - protein, 25 aa, Staphylococcus
GTFTHLHLIKPLGFSTDDKMLKRAG

SEQ ID NO: 2015399 - protein, 20 aa, Staphylococcus
GTGAGSDFLGWIDLPVDYDK

SEQ ID NO: 2015400 - protein, 27 aa, Staphylococcus
GTGAGVRRIEAFTGKSAFLHLEDIQNK

SEQ ID NO: 2015401 - protein, 28 aa, Staphylococcus
GTGAGVRRIEALTGKAAFLYFEDIQNKF

SEQ ID NO: 2015402 - protein, 28 aa, Staphylococcus
GTGAGVRRIEALTGKAAFLYLEEIQNKF

SEQ ID NO: 2015403 - protein, 28 aa, Staphylococcus
GTGAGVRRIEALTGKAAFLYLEHIQEQF

SEQ ID NO: 2015404 - protein, 27 aa, Staphylococcus
GTGAGVRRIEALTGKSAFLYLEDIQSK

SEQ ID NO: 2015405 - protein, 27 aa, Staphylococcus
GTGAGVRRIEALTGKSAFLYLETIQSQ

SEQ ID NO: 2015406 - protein, 27 aa, Staphylococcus
GTGAGVRRIEALTGRAAFLYLEGIQHK

SEQ ID NO: 2015407 - protein, 22 aa, Staphylococcus
GTGCTFSAVIAAELAKGRSIYE

SEQ ID NO: 2015408 - protein, 18 aa, Staphylococcus
GTGCTFSAVITAELAKGR

SEQ ID NO: 2015409 - protein, 19 aa, Staphylococcus
GTGCTFSAVITAELAKGRT

SEQ ID NO: 2015410 - protein, 18 aa, Staphylococcus
GTGIGVAITACKLKGIRA

SEQ ID NO: 2015411 - protein, 25 aa, Staphylococcus
GTGIKEMIEHFGIQQEETLVIGDSD

SEQ ID NO: 2015412 - protein, 18 aa, Staphylococcus
GTGIPVILIHGLDGNLAG

SEQ ID NO: 2015413 - protein, 19 aa, Staphylococcus
GTGLHCFFKGTLPENRKSK

SEQ ID NO: 2015414 - protein, 20 aa, Staphylococcus
GTGMLRVLGVRFFDENEEAL

SEQ ID NO: 2015415 - protein, 20 aa, Staphylococcus
GTGQSYDWQILKSLPTDINY

SEQ ID NO: 2015416 - protein, 23 aa, Staphylococcus
GTGRIGSIVAEIFGKGYNSKVVA

SEQ ID NO: 2015417 - protein, 21 aa, Staphylococcus
GTGRIGSIVAKIFANGYGSEV

SEQ ID NO: 2015418 - protein, 33 aa, Staphylococcus
GTGTRVLGGLTYRESHFALEFLHNSNLVTSMDL

SEQ ID NO: 2015419 - protein, 18 aa, Staphylococcus
GTGVAPFRACMQEREELG

SEQ ID NO: 2015420 - protein, 17 aa, Staphylococcus
GTGWLLEIVISSNHYDI

SEQ ID NO: 2015421 - protein, 24 aa, Staphylococcus
GTHGFGYDPIFFVPDKKRTMAELT

SEQ ID NO: 2015422 - protein, 25 aa, Staphylococcus
GTHPHVIQPIEWVKSEHGHHQTLVA

SEQ ID NO: 2015423 - protein, 24 aa, Staphylococcus
GTHPHVIQPVEWIKGKDHHRTLVA

SEQ ID NO: 2015424 - protein, 24 aa, Staphylococcus
GTHPHVIQPVKWVKGKDNHKTLVA

SEQ ID NO: 2015425 - protein, 24 aa, Staphylococcus
GTHSSKALLLYRLIEGLISENSNA

SEQ ID NO: 2015426 - protein, 18 aa, Staphylococcus
GTICFDGHHVDQSIKHRL

SEQ ID NO: 2015427 - protein, 17 aa, Staphylococcus
GTICFDGQQINQDIIDR

SEQ ID NO: 2015428 - protein, 18 aa, Staphylococcus
GTICFKGEPVSDKILNSL

SEQ ID NO: 2015429 - protein, 18 aa, Staphylococcus
GTICFNGQYIEDELSNQI

SEQ ID NO: 2015430 - protein, 22 aa, Staphylococcus
GTICGDDTCLLICHDEESANAI

SEQ ID NO: 2015431 - protein, 23 aa, Staphylococcus
GTICGDDTCLLICKDEDASNTIK

SEQ ID NO: 2015432 - protein, 23 aa, Staphylococcus
GTICGDDTCLLICRDEEASHTIK

SEQ ID NO: 2015433 - protein, 23 aa, Staphylococcus
GTICGDDTCLLICRNEEASEEIK

SEQ ID NO: 2015434 - protein, 17 aa, Staphylococcus
GTIEIPMTLATVGGGTK

SEQ ID NO: 2015435 - protein, 17 aa, Staphylococcus
GTIENYFVPDAQNQGMY

SEQ ID NO: 2015436 - protein, 26 aa, Staphylococcus
GTIEPLKDLRIMGKFGDSVTTDHISP

SEQ ID NO: 2015437 - protein, 26 aa, Staphylococcus
GTIEPLKNLRVMGKFGDSVTTDHISP

SEQ ID NO: 2015438 - protein, 17 aa, Staphylococcus
GTIIGFYTPELFHGIGS

SEQ ID NO: 2015439 - protein, 23 aa, Staphylococcus
GTIIIKFFLCLDKEEQLQRFKDR

SEQ ID NO: 2015440 - protein, 17 aa, Staphylococcus
GTIKLKGIHVNGLEVEM

SEQ ID NO: 2015441 - protein, 19 aa, Staphylococcus
GTIKLKGINVNGLEVEINN

SEQ ID NO: 2015442 - protein, 25 aa, Staphylococcus
GTIKLRRISVEGIDVNFNHGLPILV

SEQ ID NO: 2015443 - protein, 17 aa, Staphylococcus
GTIKLTTRQAFQFHGIL

SEQ ID NO: 2015444 - protein, 26 aa, Staphylococcus
GTIPYENPLFLGMGGMHGSYAANMAL

SEQ ID NO: 2015445 - protein, 24 aa, Staphylococcus
GTIPYTVFIDPPFSRVGLTAKEAQ

SEQ ID NO: 2015446 - protein, 20 aa, Staphylococcus
GTIRGDLGLTVGRNVIHGSD

SEQ ID NO: 2015447 - protein, 21 aa, Staphylococcus
GTIRGDYGLTVGRNIIHGSDS

SEQ ID NO: 2015448 - protein, 17 aa, Staphylococcus
GTISFDGYHVDQRIEER

SEQ ID NO: 2015449 - protein, 20 aa, Staphylococcus
GTITPQGFFAVIEKPKYDVK

SEQ ID NO: 2015450 - protein, 23 aa, Staphylococcus
GTKDFEFPNVIRAIQYTATETTP

SEQ ID NO: 2015451 - protein, 28 aa, Staphylococcus
GTKDRYIEMTSDFLALYGTYTRTWQGKT

SEQ ID NO: 2015452 - protein, 24 aa, Staphylococcus
GTKLLKFAERLAINDGFDKISLTV

SEQ ID NO: 2015453 - protein, 17 aa, Staphylococcus
GTKYSETMNATFLDNQG

SEQ ID NO: 2015454 - protein, 17 aa, Staphylococcus
GTLCFDGQHIDNRIISR

SEQ ID NO: 2015455 - protein, 25 aa, Staphylococcus
GTLDEAYRKSLMIKVFEHTNEYDAA

SEQ ID NO: 2015456 - protein, 36 aa, Staphylococcus
GTLEKENVIFIGLICRKADWHVVIFDIGRGNTKEIS

SEQ ID NO: 2015457 - protein, 18 aa, Staphylococcus
GTLFKLEATHGLTEDQMI

SEQ ID NO: 2015458 - protein, 27 aa, Staphylococcus
GTLFKLEMLLLMLKKPKGAYSINRLRE

SEQ ID NO: 2015459 - protein, 17 aa, Staphylococcus
GTLGFLVVHIPFISSEN

SEQ ID NO: 2015460 - protein, 20 aa, Staphylococcus
GTLIKRLNINHVQSKIDNHI

SEQ ID NO: 2015461 - protein, 23 aa, Staphylococcus
GTLKAAFNLCQSVIPQFIERQNG

SEQ ID NO: 2015462 - protein, 17 aa, Staphylococcus
GTLKECLDMSIVEEAGL

SEQ ID NO: 2015463 - protein, 25 aa, Staphylococcus
GTLLKDRIDYALFDIKLFYANETNL

SEQ ID NO: 2015464 - protein, 17 aa, Staphylococcus
GTLRATLDYVKQRKQFG

SEQ ID NO: 2015465 - protein, 24 aa, Staphylococcus
GTLSKAIGVVGGYVAGSKQLIDWL

SEQ ID NO: 2015466 - protein, 24 aa, Staphylococcus
GTLSKAIGVVGGYVAGTKALIDWL

SEQ ID NO: 2015467 - protein, 24 aa, Staphylococcus
GTLSKAIGVVGGYVAGTQELIDWL

SEQ ID NO: 2015468 - protein, 24 aa, Staphylococcus
GTLSKAIGVVGGYVAGTQSLIDWL

SEQ ID NO: 2015469 - protein, 17 aa, Staphylococcus
GTLVKKQAMMRGFLVAE

SEQ ID NO: 2015470 - protein, 19 aa, Staphylococcus
GTMEAADRLYGITMQESGV

SEQ ID NO: 2015471 - protein, 17 aa, Staphylococcus
GTMFYENRLLKKIKDAA

SEQ ID NO: 2015472 - protein, 22 aa, Staphylococcus
GTMILSPRFRDYLLELVDTFDI

SEQ ID NO: 2015473 - protein, 18 aa, Staphylococcus
GTMLKMKPVLKFEDGKIV

SEQ ID NO: 2015474 - protein, 18 aa, Staphylococcus
GTMLKMKPVLRFEDGKIV

SEQ ID NO: 2015475 - protein, 19 aa, Staphylococcus
GTMSECLILIQSINDRMVE

SEQ ID NO: 2015476 - protein, 17 aa, Staphylococcus
GTMSFAIADVIGKGIPA

SEQ ID NO: 2015477 - protein, 17 aa, Staphylococcus
GTMSFAVADVIGKGIPA

SEQ ID NO: 2015478 - protein, 19 aa, Staphylococcus
GTNEVKSDMDIFNIPSDDL

SEQ ID NO: 2015479 - protein, 24 aa, Staphylococcus
GTNFGEDILRMYGNIDIEKAKEYQ

SEQ ID NO: 2015480 - protein, 29 aa, Staphylococcus
GTNLHKGAMLKQAFGVASPQDYRDVYETL

SEQ ID NO: 2015481 - protein, 24 aa, Staphylococcus
GTNLKVAIVVSRFNDFITNRLLDG

SEQ ID NO: 2015482 - protein, 17 aa, Staphylococcus
GTNRLYTQLSLIGTRTH

SEQ ID NO: 2015483 - protein, 17 aa, Staphylococcus
GTPIKRLFLDSKEPHQN

SEQ ID NO: 2015484 - protein, 23 aa, Staphylococcus
GTPSIDIPFWIHRDDVAAINRTV

SEQ ID NO: 2015485 - protein, 22 aa, Staphylococcus
GTPWLDQKHTVFGQMVEGETTL

SEQ ID NO: 2015486 - protein, 26 aa, Staphylococcus
GTQELIDWLKVQSRPFLFSTSLTPES

SEQ ID NO: 2015487 - protein, 18 aa, Staphylococcus
GTQLKSSGFTVMVPPDRI

SEQ ID NO: 2015488 - protein, 18 aa, Staphylococcus
GTQYRGAFEENIQKLLDN

SEQ ID NO: 2015489 - protein, 17 aa, Staphylococcus
GTRLVIVHLYDYIPKLL

SEQ ID NO: 2015490 - protein, 25 aa, Staphylococcus
GTRQDLKEAFQFAAEGKVIPKVQTR

SEQ ID NO: 2015491 - protein, 24 aa, Staphylococcus
GTRQDLKEAFQFSAEGKVVPKVKT

SEQ ID NO: 2015492 - protein, 20 aa, Staphylococcus
GTRQKLNILQALVKPCDVLI

SEQ ID NO: 2015493 - protein, 24 aa, Staphylococcus
GTRREYYIFFLLCEGKSINEIAKI

SEQ ID NO: 2015494 - protein, 23 aa, Staphylococcus
GTRREYYIFFLLCEGKSMNEIAK

SEQ ID NO: 2015495 - protein, 25 aa, Staphylococcus
GTRTRLYFKVLKEYKAFFPNYQEQS

SEQ ID NO: 2015496 - protein, 25 aa, Staphylococcus
GTSDMKAGLAALVIAMIEINQSGAL

SEQ ID NO: 2015497 - protein, 26 aa, Staphylococcus
GTSDMKGGLAALVIAMIEIKASNLLQ

SEQ ID NO: 2015498 - protein, 26 aa, Staphylococcus
GTSDMKSGLMALAIAMIELKENDALP

SEQ ID NO: 2015499 - protein, 22 aa, Staphylococcus
GTSELKSSLIGINPNWVTKPII

SEQ ID NO: 2015500 - protein, 19 aa, Staphylococcus
GTSIFPTPVVGMVGLIEDI

SEQ ID NO: 2015501 - protein, 20 aa, Staphylococcus
GTSIFPTPVVGMVGLIEDIQ

SEQ ID NO: 2015502 - protein, 19 aa, Staphylococcus
GTSIFPTPVVGMVGLIENI

SEQ ID NO: 2015503 - protein, 31 aa, Staphylococcus
GTSIIHKRMMVFGCGPNIEMFEFQHAQQHEP

SEQ ID NO: 2015504 - protein, 17 aa, Staphylococcus
GTSNEFRHFAGSYAIQW

SEQ ID NO: 2015505 - protein, 26 aa, Staphylococcus
GTTAADASINWALGLMNEGSQIIDNT

SEQ ID NO: 2015506 - protein, 17 aa, Staphylococcus
GTTCKLGIFNTNLDRIE

SEQ ID NO: 2015507 - protein, 26 aa, Staphylococcus
GTTDMKGGLAALVIAMIEIKASGHLQ

SEQ ID NO: 2015508 - protein, 21 aa, Staphylococcus
GTTIKRIVKMLKDSGAKEVHV

SEQ ID NO: 2015509 - protein, 17 aa, Staphylococcus
GTVDAILFQNKENFYTV

SEQ ID NO: 2015510 - protein, 20 aa, Staphylococcus
GTVEEWFKAEGDVVEQGESI

SEQ ID NO: 2015511 - protein, 26 aa, Staphylococcus
GTVIHDWRMLTTFSEHKYAPSLPILK

SEQ ID NO: 2015512 - protein, 28 aa, Staphylococcus
GTVKNFRVTKIFGFFGLKREEIEEAQAG

SEQ ID NO: 2015513 - protein, 28 aa, Staphylococcus
GTVKNFRVTKIFGYFGLKREEIEEAQAG

SEQ ID NO: 2015514 - protein, 19 aa, Staphylococcus
GTVSPLLKRMENVDLIKRE

SEQ ID NO: 2015515 - protein, 17 aa, Staphylococcus
GTVVPHRGIDRLVHEPN

SEQ ID NO: 2015516 - protein, 18 aa, Staphylococcus
GTVYPLLRRLVKSGELAT

SEQ ID NO: 2015517 - protein, 24 aa, Staphylococcus
GTYMCIAAACGEDITINNIIPTHV

SEQ ID NO: 2015518 - protein, 24 aa, Staphylococcus
GTYMCIAAACGEEVTIKNIVPKHL

SEQ ID NO: 2015519 - protein, 27 aa, Staphylococcus
GTYRALTKVFNRFGIDAEFIDTTNIEA

SEQ ID NO: 2015520 - protein, 27 aa, Staphylococcus
GTYRALTKVFTRFGLDVDFVDTTNIEN

SEQ ID NO: 2015521 - protein, 26 aa, Staphylococcus
GTYRALTKVFTRFGVEVDFVDTTHIE

SEQ ID NO: 2015522 - protein, 27 aa, Staphylococcus
GTYRALTKVFTRYGIDVDFVDTTHIEN

SEQ ID NO: 2015523 - protein, 27 aa, Staphylococcus
GTYRALTKVFTRYGIEVDFVDTSYIEN

SEQ ID NO: 2015524 - protein, 25 aa, Staphylococcus
GTYTHLHLIKPLGFSTDDKMLKRAG

SEQ ID NO: 2015525 - protein, 24 aa, Staphylococcus
GTYTMPCARTLEPVDVPLDVTTSE

SEQ ID NO: 2015526 - protein, 27 aa, Staphylococcus
GTYTMPCARTLVPVDVPLDVRTSEVFD

SEQ ID NO: 2015527 - protein, 28 aa, Staphylococcus
GTYTMPCARTLVPVEVPLDVETSEVFDL

SEQ ID NO: 2015528 - protein, 27 aa, Staphylococcus
GTYTMPCARTLVPVEVPLDVRTSEIFD

SEQ ID NO: 2015529 - protein, 23 aa, Staphylococcus
GVAEIMTALTYLVEHPEVKHGRI

SEQ ID NO: 2015530 - protein, 18 aa, Staphylococcus
GVAEPLAVVDACLTPVLS

SEQ ID NO: 2015531 - protein, 23 aa, Staphylococcus
GVALSTDEKILWVTETTTNRLHR

SEQ ID NO: 2015532 - protein, 20 aa, Staphylococcus
GVAPGKPWKNGPVPEDKAIY

SEQ ID NO: 2015533 - protein, 18 aa, Staphylococcus
GVAPSILAACKIAGVNRV

SEQ ID NO: 2015534 - protein, 18 aa, Staphylococcus
GVAYKVSQALLKNNVPPY

SEQ ID NO: 2015535 - protein, 17 aa, Staphylococcus
GVCTVGGSIRELLTIHL

SEQ ID NO: 2015536 - protein, 19 aa, Staphylococcus
GVCYVFPNNLELFKRKNQL

SEQ ID NO: 2015537 - protein, 18 aa, Staphylococcus
GVDAIHPGYGFLSENEQF

SEQ ID NO: 2015538 - protein, 19 aa, Staphylococcus
GVDDFGLGRLLEYKQIDKM

SEQ ID NO: 2015539 - protein, 18 aa, Staphylococcus
GVDFGTGYAIEFTGETIR

SEQ ID NO: 2015540 - protein, 24 aa, Staphylococcus
GVDFRLIEPAAFYHTLQHFTGSKE

SEQ ID NO: 2015541 - protein, 23 aa, Staphylococcus
GVDFRLIEPKAFYHTLQHFTGSK

SEQ ID NO: 2015542 - protein, 23 aa, Staphylococcus
GVDFRLVEPEAFYHTLQHFTGSK

SEQ ID NO: 2015543 - protein, 20 aa, Staphylococcus
GVDGFRFDVINLISKGEFKD

SEQ ID NO: 2015544 - protein, 25 aa, Staphylococcus
GVDHKEVIEALSLLEYDNQEDKWNV

SEQ ID NO: 2015545 - protein, 26 aa, Staphylococcus
GVDIKEVFLKLPIIGTEVYDESNEIE

SEQ ID NO: 2015546 - protein, 27 aa, Staphylococcus
GVDIKEVFLKLPIIGTEVYDESNEIEF

SEQ ID NO: 2015547 - protein, 26 aa, Staphylococcus
GVDIKEVFLKLPIVSTEVFDETNEIE

SEQ ID NO: 2015548 - protein, 25 aa, Staphylococcus
GVDLVKLQLLVAMGEPLPFTQDDIT

SEQ ID NO: 2015549 - protein, 25 aa, Staphylococcus
GVDPAFRTGCKLAVINPFGSFVAKG

SEQ ID NO: 2015550 - protein, 23 aa, Staphylococcus
GVDPAFRTGCKLAVINPFGTFIA

SEQ ID NO: 2015551 - protein, 24 aa, Staphylococcus
GVDPAFRTGCKLAVINPFGTFVAK

SEQ ID NO: 2015552 - protein, 23 aa, Staphylococcus
GVDPAFRTGCKLAVINPYGTFID

SEQ ID NO: 2015553 - protein, 23 aa, Staphylococcus
GVDPAFRTGCKLAVINPYGTFVA

SEQ ID NO: 2015554 - protein, 19 aa, Staphylococcus
GVDSCPMEGFDLDKVTEIL

SEQ ID NO: 2015555 - protein, 27 aa, Staphylococcus
GVDSLENRARFGLEVMQAVQKVIDEEA

SEQ ID NO: 2015556 - protein, 27 aa, Staphylococcus
GVDSLENRARFGLQVMQAVQNVIDQQA

SEQ ID NO: 2015557 - protein, 17 aa, Staphylococcus
GVDTAYKAIMKPVEGTI

SEQ ID NO: 2015558 - protein, 24 aa, Staphylococcus
GVEFDFSTPFGDYRVKSPYVGRFN

SEQ ID NO: 2015559 - protein, 29 aa, Staphylococcus
GVEKAFAIQAGREIRVIVSPDEIDDLKSY

SEQ ID NO: 2015560 - protein, 24 aa, Staphylococcus
GVEKIKMLFRYSDNTDMTLDDIRN

SEQ ID NO: 2015561 - protein, 23 aa, Staphylococcus
GVENIEFKMLCMGFKRKEIKQLM

SEQ ID NO: 2015562 - protein, 24 aa, Staphylococcus
GVENLCPFSRDGQMRFLDNNQGGG

SEQ ID NO: 2015563 - protein, 19 aa, Staphylococcus
GVEYKVYKNTMMRRAAEQA

SEQ ID NO: 2015564 - protein, 19 aa, Staphylococcus
GVEYKVYKNTMVRRAAEKA

SEQ ID NO: 2015565 - protein, 19 aa, Staphylococcus
GVFALKLSLNRDVKGIVTM

SEQ ID NO: 2015566 - protein, 25 aa, Staphylococcus
GVFGAAWLNKNLKTEMIVDGVHSHP

SEQ ID NO: 2015567 - protein, 23 aa, Staphylococcus
GVFGGSISYGCLDTPKAPGQIHV

SEQ ID NO: 2015568 - protein, 19 aa, Staphylococcus
GVFGGSISYGCLGEPQAPG

SEQ ID NO: 2015569 - protein, 25 aa, Staphylococcus
GVGFLDHMLTLFSFHSGINLQINVQ

SEQ ID NO: 2015570 - protein, 20 aa, Staphylococcus
GVGGSLATLFGIKYPQEVLG

SEQ ID NO: 2015571 - protein, 20 aa, Staphylococcus
GVGIGVPGPVDFETGIVHGA

SEQ ID NO: 2015572 - protein, 20 aa, Staphylococcus
GVGIGVPGPVDFETGIVNGA

SEQ ID NO: 2015573 - protein, 20 aa, Staphylococcus
GVGIGVPGPVDFETGVVNGA

SEQ ID NO: 2015574 - protein, 20 aa, Staphylococcus
GVGIGVPGPVNFETGEVNGA

SEQ ID NO: 2015575 - protein, 19 aa, Staphylococcus
GVGLGGLIILNLLEKTELP

SEQ ID NO: 2015576 - protein, 20 aa, Staphylococcus
GVGSMAAVLGLDFDEVDKIC

SEQ ID NO: 2015577 - protein, 21 aa, Staphylococcus
GVGSPDALIECSIRGMDMFDC

SEQ ID NO: 2015578 - protein, 17 aa, Staphylococcus
GVGSYKLKHYCPNFLER

SEQ ID NO: 2015579 - protein, 19 aa, Staphylococcus
GVGYEIQTPNSYRFQKYMD

SEQ ID NO: 2015580 - protein, 17 aa, Staphylococcus
GVGYQSVKLIVDERYQN

SEQ ID NO: 2015581 - protein, 18 aa, Staphylococcus
GVGYQSVKLIVEERKANG

SEQ ID NO: 2015582 - protein, 20 aa, Staphylococcus
GVHDLPFVCVIINNKYAISV

SEQ ID NO: 2015583 - protein, 18 aa, Staphylococcus
GVHNLPFICVIENNKYAI

SEQ ID NO: 2015584 - protein, 20 aa, Staphylococcus
GVHNLPFVCVIINNKYAISV

SEQ ID NO: 2015585 - protein, 19 aa, Staphylococcus
GVHQLPFVCVIINNKYAIS

SEQ ID NO: 2015586 - protein, 17 aa, Staphylococcus
GVHTCLDTSAGCVNDTP

SEQ ID NO: 2015587 - protein, 17 aa, Staphylococcus
GVHYIKGGMYGLAQGLL

SEQ ID NO: 2015588 - protein, 26 aa, Staphylococcus
GVIEKLDYFKDLGIDVIWLSPMYKSP

SEQ ID NO: 2015589 - protein, 21 aa, Staphylococcus
GVIEKLDYLKDLGIDVIWLSP

SEQ ID NO: 2015590 - protein, 30 aa, Staphylococcus; identical to SEQ ID NO: 1806083

SEQ ID NO: 2015591 - protein, 26 aa, Staphylococcus
GVIEKLDYLKDLGIDVIWLSPMYQSP

SEQ ID NO: 2015592 - protein, 24 aa, Staphylococcus
GVIGLEFASLMIDLGVHVHVIESS

SEQ ID NO: 2015593 - protein, 19 aa, Staphylococcus
GVIGLEFASLMTDLGVDIT

SEQ ID NO: 2015594 - protein, 21 aa, Staphylococcus
GVIGMSIARQLSATNYDIAII

SEQ ID NO: 2015595 - protein, 23 aa, Staphylococcus
GVIGYKLATLLANHQNINVIITS

SEQ ID NO: 2015596 - protein, 17 aa, Staphylococcus
GVIKYPILNERMNQLPV

SEQ ID NO: 2015597 - protein, 22 aa, Staphylococcus
GVINILLQFVMLKEDMKLPKSY

SEQ ID NO: 2015598 - protein, 18 aa, Staphylococcus
GVIPGGALDTLGHEIANR

SEQ ID NO: 2015599 - protein, 29 aa, Staphylococcus
GVIYIPEFINKAVKFAMISSIDIAKIAAH

SEQ ID NO: 2015600 - protein, 19 aa, Staphylococcus
GVKDASALISILSTNVDKE

SEQ ID NO: 2015601 - protein, 22 aa, Staphylococcus
GVKDASALISILSTNVDKEVID

SEQ ID NO: 2015602 - protein, 21 aa, Staphylococcus
GVKDASALISILSTNVDQEVI

SEQ ID NO: 2015603 - protein, 18 aa, Staphylococcus
GVKEARAKQMLNKLLDKL

SEQ ID NO: 2015604 - protein, 32 aa, Staphylococcus
GVKKIDLALDFGKPSFLDVFHIVKSHMAIEKM

SEQ ID NO: 2015605 - protein, 31 aa, Staphylococcus
GVKLVDFWATWCGPCKMIAPVLEELAGDYEG

SEQ ID NO: 2015606 - protein, 33 aa, Staphylococcus; identical to SEQ ID NO: 1651595

SEQ ID NO: 2015607 - protein, 17 aa, Staphylococcus
GVKSIFYVMDFLAVDKK

SEQ ID NO: 2015608 - protein, 26 aa, Staphylococcus
GVKVKREDAVWDLKQIFAEFGEGDFH

SEQ ID NO: 2015609 - protein, 26 aa, Staphylococcus
GVKVKRKDAVWDLKKVFAEFGEGDFH

SEQ ID NO: 2015610 - protein, 26 aa, Staphylococcus
GVKVLARGPVFKGLLTASSNQVLDDK

SEQ ID NO: 2015611 - protein, 27 aa, Staphylococcus
GVKVLNFGSGHAWGMIGLEIETEELGT

SEQ ID NO: 2015612 - protein, 28 aa, Staphylococcus
GVKVRFLGRDEFHIFLDLYRETEARTGF

SEQ ID NO: 2015613 - protein, 24 aa, Staphylococcus
GVLDAAECVPTFGVSRDIVIGLIA

SEQ ID NO: 2015614 - protein, 20 aa, Staphylococcus
GVLDAAECVPTFNTRPEEVV

SEQ ID NO: 2015615 - protein, 18 aa, Staphylococcus
GVLDAAECVPTFNTSPDE

SEQ ID NO: 2015616 - protein, 17 aa, Staphylococcus
GVLETRPELSFPADLYL

SEQ ID NO: 2015617 - protein, 17 aa, Staphylococcus
GVLFYHEHTGIKDIYRG

SEQ ID NO: 2015618 - protein, 17 aa, Staphylococcus
GVLGARMTGAGFAGCAI

SEQ ID NO: 2015619 - protein, 18 aa, Staphylococcus
GVLGARMTGAGFAGCAIA

SEQ ID NO: 2015620 - protein, 23 aa, Staphylococcus
GVLKETYPSVFIVELDQDIYNFE

SEQ ID NO: 2015621 - protein, 24 aa, Staphylococcus
GVLKNVKAVLGFHNYPSLDIGEFA

SEQ ID NO: 2015622 - protein, 21 aa, Staphylococcus
GVLKYKKRKAESINKLDHTED

SEQ ID NO: 2015623 - protein, 24 aa, Staphylococcus
GVLNEFDKIIGIDRIKVVHVNDSK

SEQ ID NO: 2015624 - protein, 24 aa, Staphylococcus
GVLNEFDKIIGLDRIKVVHVNDSK

SEQ ID NO: 2015625 - protein, 23 aa, Staphylococcus
GVLTVESKSGYGLDKENELKQLK

SEQ ID NO: 2015626 - protein, 23 aa, Staphylococcus
GVLTVESKSGYGLDKENELKQLR

SEQ ID NO: 2015627 - protein, 20 aa, Staphylococcus
GVMADLHFAPTFNAAKNLLD

SEQ ID NO: 2015628 - protein, 19 aa, Staphylococcus
GVMHACGHDAHTAYMLILG

SEQ ID NO: 2015629 - protein, 17 aa, Staphylococcus
GVNAGLHLLHFLGSLNL

SEQ ID NO: 2015630 - protein, 19 aa, Staphylococcus
GVNEIMKRWAEGVPLTDKR

SEQ ID NO: 2015631 - protein, 29 aa, Staphylococcus
GVNFKELNRYIAAHVYLYYRYHKKHITKK

SEQ ID NO: 2015632 - protein, 18 aa, Staphylococcus
GVNGLYINQCKFLGFNDP

SEQ ID NO: 2015633 - protein, 32 aa, Staphylococcus
GVNLVDFWATWCGPCKMIAPVLEELAGDYDGK

SEQ ID NO: 2015634 - protein, 23 aa, Staphylococcus
GVPADQWLQVRSEYIQNRKKGGA

SEQ ID NO: 2015635 - protein, 17 aa, Staphylococcus
GVPEELQGAALYLASDA

SEQ ID NO: 2015636 - protein, 23 aa, Staphylococcus
GVPENLMGPLIFLASEASDYVTG

SEQ ID NO: 2015637 - protein, 21 aa, Staphylococcus
GVPIAYKPTDRILKDATYVVF

SEQ ID NO: 2015638 - protein, 20 aa, Staphylococcus
GVPIAYKPTDRVLKDATYVV

SEQ ID NO: 2015639 - protein, 19 aa, Staphylococcus
GVPIKAPVAGIAMGLVTRD

SEQ ID NO: 2015640 - protein, 20 aa, Staphylococcus
GVPIKAPVAGIAMGLVTRED

SEQ ID NO: 2015641 - protein, 19 aa, Staphylococcus
GVPKGKVTIIGGGQAGTNA

SEQ ID NO: 2015642 - protein, 23 aa, Staphylococcus
GVPLDLPALFKGYYKDEARTKAA

SEQ ID NO: 2015643 - protein, 20 aa, Staphylococcus
GVPLGHEFNSLVLALLQVSG

SEQ ID NO: 2015644 - protein, 24 aa, Staphylococcus
GVPSDQWLRVRAEYLQNRKQDQHN

SEQ ID NO: 2015645 - protein, 23 aa, Staphylococcus
GVPSDQWLRVRSEYIQNRNANGE

SEQ ID NO: 2015646 - protein, 26 aa, Staphylococcus
GVQCFDLANQYWLYLFNHGLKGVGAA

SEQ ID NO: 2015647 - protein, 26 aa, Staphylococcus
GVQEVRAWTFRKGMTAPQCAGIIHTD

SEQ ID NO: 2015648 - protein, 26 aa, Staphylococcus
GVQEVRAWTFVQGMTAPQCAGIIHTD

SEQ ID NO: 2015649 - protein, 24 aa, Staphylococcus
GVQFPRDHFEEITPEQVKETFQTN

SEQ ID NO: 2015650 - protein, 17 aa, Staphylococcus
GVQSLILAPTRELAMQV

SEQ ID NO: 2015651 - protein, 26 aa, Staphylococcus
GVQTFKPELLKILGRTHKTQDIYNAV

SEQ ID NO: 2015652 - protein, 26 aa, Staphylococcus
GVQTFKPELLKILGRTHNTQDIYNAV

SEQ ID NO: 2015653 - protein, 23 aa, Staphylococcus
GVQTWRNGTPINHRCTNAQPKFY

SEQ ID NO: 2015654 - protein, 24 aa, Staphylococcus
GVRPKILLHSCCAPCSTYTLEYLS

SEQ ID NO: 2015655 - protein, 25 aa, Staphylococcus
GVSDMKGGVASLFYVLERLNLEGIH

SEQ ID NO: 2015656 - protein, 21 aa, Staphylococcus
GVSKGYFGVAGFDLLLDDKND

SEQ ID NO: 2015657 - protein, 21 aa, Staphylococcus
GVSLKEIWPKTMMSKLEPGLF

SEQ ID NO: 2015658 - protein, 20 aa, Staphylococcus
GVSNLYELAEYVQLSEKYII

SEQ ID NO: 2015659 - protein, 19 aa, Staphylococcus
GVSNLYELAQYVQLNEEHV

SEQ ID NO: 2015660 - protein, 20 aa, Staphylococcus
GVSNLYELAQYVQLSEEHVL

SEQ ID NO: 2015661 - protein, 21 aa, Staphylococcus
GVSPRPIPGVKGGIHHVTGVE

SEQ ID NO: 2015662 - protein, 22 aa, Staphylococcus
GVSPRPIPGVKGGIHHVTGVEH

SEQ ID NO: 2015663 - protein, 17 aa, Staphylococcus
GVSSTARTSFYVYNNKQ

SEQ ID NO: 2015664 - protein, 18 aa, Staphylococcus
GVSYDVFFVLGGDGTVNE

SEQ ID NO: 2015665 - protein, 26 aa, Staphylococcus
GVTAADASINWALGLMNEGSQIIDNT

SEQ ID NO: 2015666 - protein, 21 aa, Staphylococcus
GVTCPTCKKGDVVERKSKKNR

SEQ ID NO: 2015667 - protein, 24 aa, Staphylococcus
GVTKFYQKKGIGLALINAVEAWAL

SEQ ID NO: 2015668 - protein, 18 aa, Staphylococcus
GVTLAAGYSLNWLKHTFF

SEQ ID NO: 2015669 - protein, 18 aa, Staphylococcus
GVTLAAGYSLNWLKQTFF

SEQ ID NO: 2015670 - protein, 18 aa, Staphylococcus
GVTLAAGYSLNWLKRTFF

SEQ ID NO: 2015671 - protein, 18 aa, Staphylococcus
GVTLAAGYSLNWLKTTFF

SEQ ID NO: 2015672 - protein, 18 aa, Staphylococcus
GVTTIFNVKHIYRGYTNI

SEQ ID NO: 2015673 - protein, 18 aa, Staphylococcus
GVTTIYNVKHIYRGYTDI

SEQ ID NO: 2015674 - protein, 18 aa, Staphylococcus
GVTTIYNVRHIYRGYTDI

SEQ ID NO: 2015675 - protein, 25 aa, Staphylococcus
GVTVKEVLIGFKFIAKAIRELREDE

SEQ ID NO: 2015676 - protein, 18 aa, Staphylococcus
GVVFKNNRWHCVQCETDD

SEQ ID NO: 2015677 - protein, 36 aa, Staphylococcus
GVVGAVVAWNFPLLLASWKLAPALAAGNTVVIQPSS

SEQ ID NO: 2015678 - protein, 20 aa, Staphylococcus
GVVLRWLRDELLASEVETAK

SEQ ID NO: 2015679 - protein, 20 aa, Staphylococcus
GVVLRWLRNELLASEVETAK

SEQ ID NO: 2015680 - protein, 24 aa, Staphylococcus
GVVTRPFGFEGRKRQTQAAAGVES

SEQ ID NO: 2015681 - protein, 20 aa, Staphylococcus
GVVTRPFGFEGRKRSTQAAA

SEQ ID NO: 2015682 - protein, 21 aa, Staphylococcus
GVWEHNAQAFNFYKKQGLSVT

SEQ ID NO: 2015683 - protein, 17 aa, Staphylococcus
GVWEHNQQALSFYKKHG

SEQ ID NO: 2015684 - protein, 18 aa, Staphylococcus
GVWLMSWSKIKLSESTIK

SEQ ID NO: 2015685 - protein, 17 aa, Staphylococcus
GVWYITRLECIYEKDSL

SEQ ID NO: 2015686 - protein, 24 aa, Staphylococcus
GVYGKRWLDEEVFHVDQFNKMGRK

SEQ ID NO: 2015687 - protein, 18 aa, Staphylococcus
GVYQRYALSDLPFPNKTK

SEQ ID NO: 2015688 - protein, 17 aa, Staphylococcus
GWGKNILGDEWQVYSGG

SEQ ID NO: 2015689 - protein, 19 aa, Staphylococcus
GWHDLKIIPYAPFEVSPAA

SEQ ID NO: 2015690 - protein, 19 aa, Staphylococcus
GWHDLKITPYAPIELDPAA

SEQ ID NO: 2015691 - protein, 19 aa, Staphylococcus
GWHDLKIVPYAPFEISPAA

SEQ ID NO: 2015692 - protein, 21 aa, Staphylococcus
GWILHIPSVYLGIAQAARDYA

SEQ ID NO: 2015693 - protein, 19 aa, Staphylococcus
GWQELKIVPYAPFEISPAA

SEQ ID NO: 2015694 - protein, 22 aa, Staphylococcus
GWRYMLDKCDELLKESKAHLLN

SEQ ID NO: 2015695 - protein, 20 aa, Staphylococcus
GWRYMLDKCEELLAESKKHI

SEQ ID NO: 2015696 - protein, 18 aa, Staphylococcus
GWTKKDMTDQEWRDVRYL

SEQ ID NO: 2015697 - protein, 19 aa, Staphylococcus
GWVPDYPDPTAFLQTMTTG

SEQ ID NO: 2015698 - protein, 18 aa, Staphylococcus
GWYIPNRFSEGYGPNELA

SEQ ID NO: 2015699 - protein, 17 aa, Staphylococcus
GYADGGIGFIGLANNHT

SEQ ID NO: 2015700 - protein, 27 aa, Staphylococcus
GYAKKAFKMAVDYAFLVLNMHKVYLYV

SEQ ID NO: 2015701 - protein, 19 aa, Staphylococcus
GYAKKLLKAGLEFLNQRDV

SEQ ID NO: 2015702 - protein, 18 aa, Staphylococcus
GYAPEYLLSINYFEDDPK

SEQ ID NO: 2015703 - protein, 20 aa, Staphylococcus
GYAPGFPYLTGMNEALYVNH

SEQ ID NO: 2015704 - protein, 18 aa, Staphylococcus
GYARVSGKPGVVVVTSGP

SEQ ID NO: 2015705 - protein, 19 aa, Staphylococcus
GYARVSGKPGVVVVTSGPG

SEQ ID NO: 2015706 - protein, 22 aa, Staphylococcus
GYCKQCLKPLATHDTRCSECVK

SEQ ID NO: 2015707 - protein, 27 aa, Staphylococcus
GYDIVCAGASAVLFGSVNAILSLTSEK

SEQ ID NO: 2015708 - protein, 21 aa, Staphylococcus
GYDKGHLEPIFILGKNNKQKR

SEQ ID NO: 2015709 - protein, 22 aa, Staphylococcus
GYDKGHLEPIFILGKNNKQKRD

SEQ ID NO: 2015710 - protein, 22 aa, Staphylococcus
GYDLAKLMSYNNGWGHIVADGS

SEQ ID NO: 2015711 - protein, 18 aa, Staphylococcus
GYDLERYVPVMIVAIGKK

SEQ ID NO: 2015712 - protein, 17 aa, Staphylococcus
GYDLLIEAARRIQDDLR

SEQ ID NO: 2015713 - protein, 24 aa, Staphylococcus
GYDMMSQIRWLSVLDLKGKSEDQL

SEQ ID NO: 2015714 - protein, 21 aa, Staphylococcus
GYDQLRLKGFYKDSNKKAEIS

SEQ ID NO: 2015715 - protein, 17 aa, Staphylococcus
GYDQVLWLDGVEQKYVE

SEQ ID NO: 2015716 - protein, 18 aa, Staphylococcus
GYDVIGIFMKNWDDTDEN

SEQ ID NO: 2015717 - protein, 18 aa, Staphylococcus
GYDVIGIFMKNWDNTDEN

SEQ ID NO: 2015718 - protein, 17 aa, Staphylococcus
GYEQGISIAGEIKQHHH

SEQ ID NO: 2015719 - protein, 18 aa, Staphylococcus
GYERLDMSNSEFGSIPSR

SEQ ID NO: 2015720 - protein, 18 aa, Staphylococcus
GYESESFEQFLLKEYSIL

SEQ ID NO: 2015721 - protein, 17 aa, Staphylococcus
GYEYEGVIPGGALDTLG

SEQ ID NO: 2015722 - protein, 18 aa, Staphylococcus
GYFARPTIFNNVDNSMTI

SEQ ID NO: 2015723 - protein, 20 aa, Staphylococcus
GYFGRGLQKASIEMMECNLV

SEQ ID NO: 2015724 - protein, 26 aa, Staphylococcus
GYFMLEVAKLKVVFEDEAFKYARSKS

SEQ ID NO: 2015725 - protein, 27 aa, Staphylococcus
GYFNLAPEEFIVWVLGFVKNIADLKQK

SEQ ID NO: 2015726 - protein, 27 aa, Staphylococcus
GYFNLAPEEFIVWVLGFVKSIEELKQK

SEQ ID NO: 2015727 - protein, 27 aa, Staphylococcus
GYFNMAPEEFIIWVLGFTKSIQDLKHK

SEQ ID NO: 2015728 - protein, 23 aa, Staphylococcus
GYFPHFDKKIGFYNILRHSSSTY

SEQ ID NO: 2015729 - protein, 23 aa, Staphylococcus
GYFPHFDKKISFYNNLRHSSSTY

SEQ ID NO: 2015730 - protein, 24 aa, Staphylococcus
GYFTEVFKSLFGGGQAELRLTDDD

SEQ ID NO: 2015731 - protein, 19 aa, Staphylococcus
GYFWFEGRADDIIISSGYT

SEQ ID NO: 2015732 - protein, 26 aa, Staphylococcus
GYGDFFPHRLGHGLGLEEHEYQDVSS

SEQ ID NO: 2015733 - protein, 17 aa, Staphylococcus
GYGDLFININVVTPTKI

SEQ ID NO: 2015734 - protein, 19 aa, Staphylococcus
GYGDLKFFEPFVIESEEHL

SEQ ID NO: 2015735 - protein, 19 aa, Staphylococcus
GYGDLKFFETFILDSDEKL

SEQ ID NO: 2015736 - protein, 26 aa, Staphylococcus
GYGDYFPHRLGHGLGLEEHEYQDVSS

SEQ ID NO: 2015737 - protein, 26 aa, Staphylococcus
GYGEYFPHRLGHGLGLEEHEYQDVSS

SEQ ID NO: 2015738 - protein, 17 aa, Staphylococcus
GYGKRPVIENINFELKK

SEQ ID NO: 2015739 - protein, 21 aa, Staphylococcus
GYGKTECWYILDAKDDAEIIY

SEQ ID NO: 2015740 - protein, 21 aa, Staphylococcus
GYGVARSYRGKGYASTLLGQA

SEQ ID NO: 2015741 - protein, 24 aa, Staphylococcus
GYHEVPPNKCPNCESSHIRQVGTG

SEQ ID NO: 2015742 - protein, 23 aa, Staphylococcus
GYHFKMYPEDFVPFFEEKVTIEQ

SEQ ID NO: 2015743 - protein, 25 aa, Staphylococcus
GYHPDYEFLQSIGIEINQNEYGTAP

SEQ ID NO: 2015744 - protein, 17 aa, Staphylococcus
GYIESEARFFVQGKEIE

SEQ ID NO: 2015745 - protein, 19 aa, Staphylococcus
GYIHKKGHVGVVSRSGTLT

SEQ ID NO: 2015746 - protein, 19 aa, Staphylococcus
GYIHWYLTDEKVIGIGDAS

SEQ ID NO: 2015747 - protein, 18 aa, Staphylococcus
GYIHWYLTDEKVLGIGDA

SEQ ID NO: 2015748 - protein, 26 aa, Staphylococcus
GYINCNHDLDFALAIRTMMIDETHVN

SEQ ID NO: 2015749 - protein, 23 aa, Staphylococcus
GYIYFTPIGGWWNQVMLSQKVTI

SEQ ID NO: 2015750 - protein, 17 aa, Staphylococcus
GYKGPKGSFEIKGVSLF

SEQ ID NO: 2015751 - protein, 17 aa, Staphylococcus
GYKHFVTAIEMIDKLQF

SEQ ID NO: 2015752 - protein, 18 aa, Staphylococcus
GYKIMFNTLRAMYQKHPI

SEQ ID NO: 2015753 - protein, 22 aa, Staphylococcus
GYKKSGIGREIYKDAIKNYQQV

SEQ ID NO: 2015754 - protein, 22 aa, Staphylococcus
GYKLMFNTLRAMYSEHPVRVDI

SEQ ID NO: 2015755 - protein, 22 aa, Staphylococcus
GYKLMFNTLRAMYSNHPIRVDI

SEQ ID NO: 2015756 - protein, 19 aa, Staphylococcus
GYKPKEIVRLLNIKDKVVY

SEQ ID NO: 2015757 - protein, 17 aa, Staphylococcus
GYKPMGLLLANHIIEQD

SEQ ID NO: 2015758 - protein, 17 aa, Staphylococcus
GYKSMPEHVNMMDKSMK

SEQ ID NO: 2015759 - protein, 23 aa, Staphylococcus
GYKVMKYPLNLSGIYDISVLHLD

SEQ ID NO: 2015760 - protein, 18 aa, Staphylococcus
GYLFVFVLDYYRHNLINE

SEQ ID NO: 2015761 - protein, 20 aa, Staphylococcus
GYLFVFVLDYYRHQMINERT

SEQ ID NO: 2015762 - protein, 27 aa, Staphylococcus
GYLPEALFNFIALLGWSPEGEDEIFSK

SEQ ID NO: 2015763 - protein, 20 aa, Staphylococcus
GYLSVLGLVVAKDFQHQGIA

SEQ ID NO: 2015764 - protein, 19 aa, Staphylococcus
GYMKTELTKPFFEQGGAMI

SEQ ID NO: 2015765 - protein, 25 aa, Staphylococcus
GYMNIAQNEVITWVLGYNKNIDDLI

SEQ ID NO: 2015766 - protein, 17 aa, Staphylococcus
GYMQKIFSQEIKFKDEN

SEQ ID NO: 2015767 - protein, 19 aa, Staphylococcus
GYMRLIGADLLDAYERRIL

SEQ ID NO: 2015768 - protein, 23 aa, Staphylococcus
GYNDCPFKHYANHGLRLNERTKY

SEQ ID NO: 2015769 - protein, 19 aa, Staphylococcus
GYNDCPFQHYATYGLRLNE

SEQ ID NO: 2015770 - protein, 18 aa, Staphylococcus
GYNKWRQTKQLNIADFSI

SEQ ID NO: 2015771 - protein, 26 aa, Staphylococcus
GYNMSGFRVGFAVGNRDMIQALKKYQ

SEQ ID NO: 2015772 - protein, 18 aa, Staphylococcus
GYNYFTFEGLRSKGNKEL

SEQ ID NO: 2015773 - protein, 23 aa, Staphylococcus
GYPGRRYYGGCQYVDITETLAIE

SEQ ID NO: 2015774 - protein, 22 aa, Staphylococcus
GYPMPRLGLGVYKVTDEEMETA

SEQ ID NO: 2015775 - protein, 18 aa, Staphylococcus
GYQCPQCGNDDPKSVDVV

SEQ ID NO: 2015776 - protein, 26 aa, Staphylococcus
GYQFVLEPTYCFSIITSATQYPDKLK

SEQ ID NO: 2015777 - protein, 17 aa, Staphylococcus
GYQGPKGSFEIKGISLF

SEQ ID NO: 2015778 - protein, 21 aa, Staphylococcus
GYQKPMREFFDYIFNEIGNIN

SEQ ID NO: 2015779 - protein, 21 aa, Staphylococcus
GYQQCPFKHYASHGLRLNERS

SEQ ID NO: 2015780 - protein, 19 aa, Staphylococcus
GYQSARWVLIDLADVVVHI

SEQ ID NO: 2015781 - protein, 23 aa, Staphylococcus
GYRDICLGVPTVLGKQGVERVIE

SEQ ID NO: 2015782 - protein, 23 aa, Staphylococcus
GYRSAEGFEGYFMMNSLEAPFLL

SEQ ID NO: 2015783 - protein, 23 aa, Staphylococcus
GYRSEPHERLFALLIQADGEPVL

SEQ ID NO: 2015784 - protein, 23 aa, Staphylococcus
GYRSEPHERLFALLIQASGETVL

SEQ ID NO: 2015785 - protein, 26 aa, Staphylococcus
GYRSLHIVVSIPVFLADRVEVTPVEI

SEQ ID NO: 2015786 - protein, 27 aa, Staphylococcus
GYRSLHIVVSIPVFLADSVEIIPVEIQ

SEQ ID NO: 2015787 - protein, 26 aa, Staphylococcus
GYRSLHIVVSIPVFLSNKVEKLPVEI

SEQ ID NO: 2015788 - protein, 19 aa, Staphylococcus
GYRSLHIVVTIPVYLVHSV

SEQ ID NO: 2015789 - protein, 26 aa, Staphylococcus
GYRSLHLVVSIPVFLTDNVEQVPVEI

SEQ ID NO: 2015790 - protein, 20 aa, Staphylococcus
GYRSLHLVVTIPVFLSDSVQ

SEQ ID NO: 2015791 - protein, 24 aa, Staphylococcus
GYRTAEGFEGFFMMNRLNAPFILI

SEQ ID NO: 2015792 - protein, 19 aa, Staphylococcus
GYRVLKYPLNLVGISNIKK

SEQ ID NO: 2015793 - protein, 18 aa, Staphylococcus
GYSAFYIGSKAGIEKEMI

SEQ ID NO: 2015794 - protein, 27 aa, Staphylococcus
GYSDAFSFNSPNGMCETCEGLGYIEDI

SEQ ID NO: 2015795 - protein, 18 aa, Staphylococcus
GYSIKSKMGMQTMKFDMC

SEQ ID NO: 2015796 - protein, 23 aa, Staphylococcus
GYSKTIWIWTGFLFEYLKHQTDE

SEQ ID NO: 2015797 - protein, 23 aa, Staphylococcus
GYSLSWLKHTFFAADSYDDVIKL

SEQ ID NO: 2015798 - protein, 26 aa, Staphylococcus
GYSMGGRTALYYALHGKIKLEGLILE

SEQ ID NO: 2015799 - protein, 27 aa, Staphylococcus
GYSMGGRVALYYALHGSIELAGLILES

SEQ ID NO: 2015800 - protein, 18 aa, Staphylococcus
GYSPEYLLSVDHLNDNKE

SEQ ID NO: 2015801 - protein, 24 aa, Staphylococcus
GYSQMSQIRWLSVLDLKDKTETQI

SEQ ID NO: 2015802 - protein, 18 aa, Staphylococcus
GYTATDIISRYKRMQGYN

SEQ ID NO: 2015803 - protein, 18 aa, Staphylococcus
GYTCPQCGNHNPETVDVV

SEQ ID NO: 2015804 - protein, 24 aa, Staphylococcus
GYTETYPGVFAFIGSNSEYDLHHP

SEQ ID NO: 2015805 - protein, 39 aa, Staphylococcus
GYTKGRFSFNVKGGRCEACKGDGIIKIEMHFLPDVYVPC

SEQ ID NO: 2015806 - protein, 19 aa, Staphylococcus
GYTKQLSFDYGLKGIKANA

SEQ ID NO: 2015807 - protein, 18 aa, Staphylococcus
GYTPKLSVILVGNDGASQ

SEQ ID NO: 2015808 - protein, 18 aa, Staphylococcus
GYTRYFLSEHHNLKDVVG

SEQ ID NO: 2015809 - protein, 23 aa, Staphylococcus
GYTRYWVAEHHNVFSVASSAPEI

SEQ ID NO: 2015810 - protein, 19 aa, Staphylococcus
GYTSPARFVRAAYFRQYIE

SEQ ID NO: 2015811 - protein, 32 aa, Staphylococcus
GYVAGTKALIDWLKAQSRPFLFSTSLAPGDTK

SEQ ID NO: 2015812 - protein, 28 aa, Staphylococcus
GYVARGMLDAAVCGEVFTSPTPDKILDA

SEQ ID NO: 2015813 - protein, 18 aa, Staphylococcus
GYVETLLHRRRYIPDITS

SEQ ID NO: 2015814 - protein, 20 aa, Staphylococcus
GYVGHHLLVKFGHHQTIFPS

SEQ ID NO: 2015815 - protein, 19 aa, Staphylococcus
GYVGHHLLVKFGYHQTIFP

SEQ ID NO: 2015816 - protein, 25 aa, Staphylococcus
GYVKNARFKPFFENMEILEASFDLL

SEQ ID NO: 2015817 - protein, 24 aa, Staphylococcus
GYVPQCPHCDISLTYHKSTDQLKC

SEQ ID NO: 2015818 - protein, 24 aa, Staphylococcus
GYVPQCPHCDISLTYHKTTDQLKC

SEQ ID NO: 2015819 - protein, 19 aa, Staphylococcus
GYVPQCPNCDISLTYHKTS

SEQ ID NO: 2015820 - protein, 17 aa, Staphylococcus
GYVQTGRDFFKLKVNGQ

SEQ ID NO: 2015821 - protein, 17 aa, Staphylococcus
GYVYSDKLLKYRFDNHH

SEQ ID NO: 2015822 - protein, 22 aa, Staphylococcus
GYWLNYELHEQFKLKDSSAQLT

SEQ ID NO: 2015823 - protein, 19 aa, Staphylococcus
GYWTYSMNDAWVGIQKAYG

SEQ ID NO: 2015824 - protein, 18 aa, Staphylococcus
GYYADTGISFVVGEPDNP

SEQ ID NO: 2015825 - protein, 17 aa, Staphylococcus
GYYEEKLKTLNEVDITH

SEQ ID NO: 2015826 - protein, 21 aa, Staphylococcus
GYYFDNFMVGPFVEDFKKAIK

SEQ ID NO: 2015827 - protein, 17 aa, Staphylococcus
GYYGFGAGASGYVDGER

SEQ ID NO: 2015828 - protein, 27 aa, Staphylococcus
GYYYISHQWFPLGAVHGLKYWFNYKSD

SEQ ID NO: 2015829 - protein, 31 aa, Staphylococcus
HAAERICDNIKYYFGLTCEKPYDFGENKDNF

SEQ ID NO: 2015830 - protein, 23 aa, Staphylococcus
HAAKSYYLKKGYKKTPHVITNAP

SEQ ID NO: 2015831 - protein, 20 aa, Staphylococcus
HADGLRLVKHAKRIMLSEPE

SEQ ID NO: 2015832 - protein, 19 aa, Staphylococcus
HADYLIALAQYYPYGPEYF

SEQ ID NO: 2015833 - protein, 20 aa, Staphylococcus
HAEAGDIIYFVLKETPFYAV

SEQ ID NO: 2015834 - protein, 17 aa, Staphylococcus
HAEDGYQLLKYIDLSVT

SEQ ID NO: 2015835 - protein, 20 aa, Staphylococcus
HAEGKWTGMCGEMAGDQTAI

SEQ ID NO: 2015836 - protein, 22 aa, Staphylococcus
HAELRSEKPFKYKYELTEENHH

SEQ ID NO: 2015837 - protein, 19 aa, Staphylococcus
HAFAEKLKALGYDISPDDQ

SEQ ID NO: 2015838 - protein, 19 aa, Staphylococcus
HAFAEKLKSLGYDIEPQNQ

SEQ ID NO: 2015839 - protein, 18 aa, Staphylococcus
HAFAEKLKSLGYDISTED

SEQ ID NO: 2015840 - protein, 25 aa, Staphylococcus
HAGAIGLKVHEDWGATPSALDHALQ

SEQ ID NO: 2015841 - protein, 25 aa, Staphylococcus
HAGAIGLKVHEDWGATPSALRHALD

SEQ ID NO: 2015842 - protein, 25 aa, Staphylococcus
HAGAIGLKVHEDWGATPSALSHALD

SEQ ID NO: 2015843 - protein, 17 aa, Staphylococcus
HAGLSWLTILKKKEAYE

SEQ ID NO: 2015844 - protein, 21 aa, Staphylococcus
HAGQSLGAFAPKGLLIHHTGD

SEQ ID NO: 2015845 - protein, 25 aa, Staphylococcus
HAGQVCSAGARIIVHNDIKEKFEAA

SEQ ID NO: 2015846 - protein, 24 aa, Staphylococcus
HAGQVCSAGSRIIVQNSIKDKFEK

SEQ ID NO: 2015847 - protein, 25 aa, Staphylococcus
HAGQVCSAGSRILVHNDIKADFEKA

SEQ ID NO: 2015848 - protein, 25 aa, Staphylococcus
HAGQVCSAGSRILVHNDIKEDFEKA

SEQ ID NO: 2015849 - protein, 25 aa, Staphylococcus
HAGQVCSAGSRILVHNDIKGDFEKA

SEQ ID NO: 2015850 - protein, 17 aa, Staphylococcus
HAGSLKGFIWAHYEPQL

SEQ ID NO: 2015851 - protein, 25 aa, Staphylococcus
HAHRKVTGKWSWLVPSLSPTLVPNY

SEQ ID NO: 2015852 - protein, 20 aa, Staphylococcus
HAIAKGCDLNGMMAEIMGKR

SEQ ID NO: 2015853 - protein, 19 aa, Staphylococcus
HAIFGSGAYRVSSREMWRD

SEQ ID NO: 2015854 - protein, 20 aa, Staphylococcus
HAIFRLKDQILMAIDNTNGT

SEQ ID NO: 2015855 - protein, 17 aa, Staphylococcus
HAIFRLKDQVFMAIDNM

SEQ ID NO: 2015856 - protein, 25 aa, Staphylococcus
HAIQRANIKLGDFVVLSGAGTLGLG

SEQ ID NO: 2015857 - protein, 18 aa, Staphylococcus
HAIREVTGAVLMVDDLKN

SEQ ID NO: 2015858 - protein, 17 aa, Staphylococcus
HAKFQKRDEKVFEEMDD

SEQ ID NO: 2015859 - protein, 21 aa, Staphylococcus
HAKHVKVIANMAVGFDNIDVK

SEQ ID NO: 2015860 - protein, 18 aa, Staphylococcus
HAKKVIVAGGAWSTQLLK

SEQ ID NO: 2015861 - protein, 27 aa, Staphylococcus
HAKKWLKVRNGCLYNKIPEILGVSATG

SEQ ID NO: 2015862 - protein, 25 aa, Staphylococcus
HAKQFMVWQLLSSMKNKYGYKKDNI

SEQ ID NO: 2015863 - protein, 25 aa, Staphylococcus
HAKQMSEFIFAYILDDYKKMRTSYI

SEQ ID NO: 2015864 - protein, 41 aa, Staphylococcus
HAKSIFYLRISTLPLSLGIESCVIRLIPQYFTSKREYKDFN

SEQ ID NO: 2015865 - protein, 25 aa, Staphylococcus
HAKVKRIEKYGAFVELFPGKDALLH

SEQ ID NO: 2015866 - protein, 20 aa, Staphylococcus
HALEKCELLYEQGYGSMIEV

SEQ ID NO: 2015867 - protein, 33 aa, Staphylococcus
HALFRTLAFTGIRRGELMALTWNDIDFTNQTLS

SEQ ID NO: 2015868 - protein, 30 aa, Staphylococcus
HALIQKPMILFTRLKKPLSITSSGQTREIN

SEQ ID NO: 2015869 - protein, 24 aa, Staphylococcus
HALISESYCSNLFARILNVNFKDY

SEQ ID NO: 2015870 - protein, 17 aa, Staphylococcus
HALKRRLIQTADSIAND

SEQ ID NO: 2015871 - protein, 18 aa, Staphylococcus
HALQEILLPLADVATPNL

SEQ ID NO: 2015872 - protein, 18 aa, Staphylococcus
HALVNLFYQYLLTCELTD

SEQ ID NO: 2015873 - protein, 17 aa, Staphylococcus
HAMEAIYAAKKNAFEEA

SEQ ID NO: 2015874 - protein, 21 aa, Staphylococcus
HANHGDYGYDIVCAGASAVLF

SEQ ID NO: 2015875 - protein, 28 aa, Staphylococcus
HANRLKKIPLRININGIRGKSTITRMAY

SEQ ID NO: 2015876 - protein, 17 aa, Staphylococcus
HANVIEFVDKVKHQFTE

SEQ ID NO: 2015877 - protein, 17 aa, Staphylococcus
HAPCTELSMGMSNDYQI

SEQ ID NO: 2015878 - protein, 18 aa, Staphylococcus
HAPEHLHALISRFEAESH

SEQ ID NO: 2015879 - protein, 22 aa, Staphylococcus
HAPNYRKHWHVIFHLSNGKLLV

SEQ ID NO: 2015880 - protein, 20 aa, Staphylococcus
HAQCMDLAIDYVMWLTDNQT

SEQ ID NO: 2015881 - protein, 20 aa, Staphylococcus
HAQFPAGVGDYLYERLRLTA

SEQ ID NO: 2015882 - protein, 29 aa, Staphylococcus
HAQGLGFRGDIFGGYILYNCGFIQSENRF

SEQ ID NO: 2015883 - protein, 28 aa, Staphylococcus
HAQGLGFRGDIFGGYILYNLGFIESENR

SEQ ID NO: 2015884 - protein, 38 aa, Staphylococcus
HAQGLGFRGDIFGGYILYRLGFIESEGRYFIDGKEIQN

SEQ ID NO: 2015885 - protein, 18 aa, Staphylococcus
HAQIKLYAPILGQHAFDR

SEQ ID NO: 2015886 - protein, 23 aa, Staphylococcus
HARDMKLILDLVVNHTSDEHPWF

SEQ ID NO: 2015887 - protein, 22 aa, Staphylococcus
HARDMLKRERLFFDKMQAHIGE

SEQ ID NO: 2015888 - protein, 19 aa, Staphylococcus
HARDMLKRERLFYDKMQAH

SEQ ID NO: 2015889 - protein, 19 aa, Staphylococcus
HARDMLKRERVFFDKMQAH

SEQ ID NO: 2015890 - protein, 18 aa, Staphylococcus
HARELIRLIQQLRKKKNL

SEQ ID NO: 2015891 - protein, 19 aa, Staphylococcus
HARELKVNNALLYTDSKLI

SEQ ID NO: 2015892 - protein, 21 aa, Staphylococcus
HAREMLKRERLFFDKMQAHIG

SEQ ID NO: 2015893 - protein, 19 aa, Staphylococcus
HARFYTRSRTRKDLDFLTK

SEQ ID NO: 2015894 - protein, 20 aa, Staphylococcus
HASKELATWIQEGKIKTKVS

SEQ ID NO: 2015895 - protein, 21 aa, Staphylococcus
HASLIRFSEKALRPLGRTAAG

SEQ ID NO: 2015896 - protein, 26 aa, Staphylococcus
HASLLPKYRGGAPIHQAIIDGEAQTG

SEQ ID NO: 2015897 - protein, 26 aa, Staphylococcus
HASLLPKYRGGAPIHQAIIDGEEKTG

SEQ ID NO: 2015898 - protein, 26 aa, Staphylococcus
HASLLPKYRGGAPIHQAIIDGETETG

SEQ ID NO: 2015899 - protein, 25 aa, Staphylococcus
HASLLPKYRGGAPIHQAIIDGEVQT

SEQ ID NO: 2015900 - protein, 26 aa, Staphylococcus
HASLLPKYRGGAPIHQAIMDGQTETG

SEQ ID NO: 2015901 - protein, 21 aa, Staphylococcus
HATIFLMNAVYDFDTVRNNNI

SEQ ID NO: 2015902 - protein, 24 aa, Staphylococcus
HATKEIKDGILITVDAAQGKIFEG

SEQ ID NO: 2015903 - protein, 23 aa, Staphylococcus
HAVEIKNKIGFIYSELYLNDKWN

SEQ ID NO: 2015904 - protein, 25 aa, Staphylococcus
HAVFKHGMTPIICVGETNEQRESGK

SEQ ID NO: 2015905 - protein, 26 aa, Staphylococcus
HAVLYICRKLGITFYLLVEQKANISL

SEQ ID NO: 2015906 - protein, 24 aa, Staphylococcus
HAVQRANIQLGDFVVLSGAGTLGL

SEQ ID NO: 2015907 - protein, 24 aa, Staphylococcus
HAYGELKVALAHQFPYDIEGYCDG

SEQ ID NO: 2015908 - protein, 17 aa, Staphylococcus
HAYMAMAAYCDKESYEG

SEQ ID NO: 2015909 - protein, 18 aa, Staphylococcus
HAYQFLLDEGYIYSKPRS

SEQ ID NO: 2015910 - protein, 18 aa, Staphylococcus
HAYVKLWKHHGAQDEATQ

SEQ ID NO: 2015911 - protein, 30 aa, Staphylococcus
HCIDACGINGLYIKQCRFIGFRDVDGDRWF

SEQ ID NO: 2015912 - protein, 17 aa, Staphylococcus
HCLARKPKCDICPLLDD

SEQ ID NO: 2015913 - protein, 21 aa, Staphylococcus
HCPTIPPSVKKEHWGFDDPAG

SEQ ID NO: 2015914 - protein, 18 aa, Staphylococcus
HCRYDCLGKRYRYKVYQA

SEQ ID NO: 2015915 - protein, 21 aa, Staphylococcus
HDACGIGFYANMDNIRSHDVI

SEQ ID NO: 2015916 - protein, 17 aa, Staphylococcus
HDAKLYMVEDVYVFDHY

SEQ ID NO: 2015917 - protein, 21 aa, Staphylococcus
HDALIKTAALLLKYDDTNDQE

SEQ ID NO: 2015918 - protein, 23 aa, Staphylococcus
HDASFYAACELFNQITRNPKSKL

SEQ ID NO: 2015919 - protein, 19 aa, Staphylococcus
HDASLPFGDYYRRLMQDQL

SEQ ID NO: 2015920 - protein, 30 aa, Staphylococcus
HDAVRPFLTRRIIKENIESVLKYGAVDTVI

SEQ ID NO: 2015921 - protein, 20 aa, Staphylococcus
HDAYCIERAKQLKVMVHINE

SEQ ID NO: 2015922 - protein, 17 aa, Staphylococcus
HDDLGLAVANSMAAIEN

SEQ ID NO: 2015923 - protein, 18 aa, Staphylococcus
HDDLGMAVANSLAAIEGG

SEQ ID NO: 2015924 - protein, 18 aa, Staphylococcus
HDDLGMAVANSLAAIENG

SEQ ID NO: 2015925 - protein, 18 aa, Staphylococcus
HDDLGMAVSNSLAAIEGG

SEQ ID NO: 2015926 - protein, 18 aa, Staphylococcus
HDDLLVPFRTWRNNNANE

SEQ ID NO: 2015927 - protein, 21 aa, Staphylococcus
HDEIKRLVEFQQQIVDHLQPV

SEQ ID NO: 2015928 - protein, 24 aa, Staphylococcus
HDESVNLMNCFKVLDAVSIPQGAV

SEQ ID NO: 2015929 - protein, 26 aa, Staphylococcus
HDFERWSFHLQIYFLAERFKEQKRMF

SEQ ID NO: 2015930 - protein, 23 aa, Staphylococcus
HDFNPLYFKKLWLEAWEETHERK

SEQ ID NO: 2015931 - protein, 17 aa, Staphylococcus
HDFPKMIAFSNGQDVAE

SEQ ID NO: 2015932 - protein, 17 aa, Staphylococcus
HDFRPSYQNVIQKVFTL

SEQ ID NO: 2015933 - protein, 17 aa, Staphylococcus
HDFRPSYQNVIQKVMTL

SEQ ID NO: 2015934 - protein, 17 aa, Staphylococcus
HDFRPSYQQVIDKVMCL

SEQ ID NO: 2015935 - protein, 17 aa, Staphylococcus
HDFRPSYQSVIHRVFSL

SEQ ID NO: 2015936 - protein, 18 aa, Staphylococcus
HDFVGLAHAGWRGTYGQI

SEQ ID NO: 2015937 - protein, 27 aa, Staphylococcus
HDGEPCNECAICKGITQGTNGDVIEID

SEQ ID NO: 2015938 - protein, 24 aa, Staphylococcus
HDGHTTALLLFVKRCKLLADKGEL

SEQ ID NO: 2015939 - protein, 29 aa, Staphylococcus
HDGHTTALMLFVKRCKAMADKGTLPHNIV

SEQ ID NO: 2015940 - protein, 23 aa, Staphylococcus
HDGHTTALMLFVKRCKDQADKGL

SEQ ID NO: 2015941 - protein, 29 aa, Staphylococcus
HDGHTTALMLFVKRCKVMADQHQLPHNVV

SEQ ID NO: 2015942 - protein, 24 aa, Staphylococcus
HDGKERLNYGASWFEHSKLFIRTK

SEQ ID NO: 2015943 - protein, 24 aa, Staphylococcus
HDGKERLNYGASWFEHSNLYIRTK

SEQ ID NO: 2015944 - protein, 22 aa, Staphylococcus
HDGNGRIGRFIILKQCLDNDIE

SEQ ID NO: 2015945 - protein, 34 aa, Staphylococcus
HDGRERLNYGSTWFEFSQLYIRTQLELMSTPITI

SEQ ID NO: 2015946 - protein, 23 aa, Staphylococcus
HDGTKLGFMSFFTKAAVAALKKY

SEQ ID NO: 2015947 - protein, 20 aa, Staphylococcus
HDHVKAVIVKSELTRNEEFD

SEQ ID NO: 2015948 - protein, 23 aa, Staphylococcus
HDIEFIKKWVDNFDEYYESLTPF

SEQ ID NO: 2015949 - protein, 18 aa, Staphylococcus
HDIHMASVLGVAVRLKEI

SEQ ID NO: 2015950 - protein, 24 aa, Staphylococcus
HDIIKRFLESKGIYEPTEKMISAI

SEQ ID NO: 2015951 - protein, 21 aa, Staphylococcus
HDIKEAYDFYVSQLGLAHISK

SEQ ID NO: 2015952 - protein, 17 aa, Staphylococcus
HDIKVTAWMPLMRNRGL

SEQ ID NO: 2015953 - protein, 17 aa, Staphylococcus
HDIQQHGYRCCINASTI

SEQ ID NO: 2015954 - protein, 26 aa, Staphylococcus
HDIVCAGASAVLFGSVNAILGLTSEK

SEQ ID NO: 2015955 - protein, 25 aa, Staphylococcus
HDIVCAGASAVLFGSVNAIMGLTSE

SEQ ID NO: 2015956 - protein, 22 aa, Staphylococcus
HDKAFKHPKFYQQIFRLLEDSR

SEQ ID NO: 2015957 - protein, 21 aa, Staphylococcus
HDKAKVEAMSLGISTDTPSLM

SEQ ID NO: 2015958 - protein, 25 aa, Staphylococcus
HDKEITVPVAIHLDHGSSFEKCKEA

SEQ ID NO: 2015959 - protein, 18 aa, Staphylococcus
HDKIKLQLDKDVKDIPGA

SEQ ID NO: 2015960 - protein, 18 aa, Staphylococcus
HDKIPWPNYVNYAASKGG

SEQ ID NO: 2015961 - protein, 23 aa, Staphylococcus
HDKLALVLVQFPPWFDCSMENVT

SEQ ID NO: 2015962 - protein, 26 aa, Staphylococcus
HDKQRTQVQLAFCIDVRSEPFRRHLE

SEQ ID NO: 2015963 - protein, 22 aa, Staphylococcus
HDKRSASIYVAFDVKDSKGTID

SEQ ID NO: 2015964 - protein, 19 aa, Staphylococcus
HDLDYVFFGHIFKTPSKPN

SEQ ID NO: 2015965 - protein, 27 aa, Staphylococcus
HDLIYCEDCGKAIRPDIVLYGEMLDQS

SEQ ID NO: 2015966 - protein, 20 aa, Staphylococcus
HDLSSLKGTFTVQANSIDTK

SEQ ID NO: 2015967 - protein, 24 aa, Staphylococcus
HDNGCIKLAYINLAEYLTRLEKQR

SEQ ID NO: 2015968 - protein, 26 aa, Staphylococcus
HDPLSELITTEWPAKVSVFDKNVETY

SEQ ID NO: 2015969 - protein, 24 aa, Staphylococcus
HDPVAASFAKRVIMLKDGNIHSEI

SEQ ID NO: 2015970 - protein, 20 aa, Staphylococcus
HDPVAASFSNRVVMLKDGQI

SEQ ID NO: 2015971 - protein, 20 aa, Staphylococcus
HDPYHLKGLKGYIKSPYPTY

SEQ ID NO: 2015972 - protein, 19 aa, Staphylococcus
HDQGEIVIEGHAIKDFNHN

SEQ ID NO: 2015973 - protein, 18 aa, Staphylococcus
HDQPRVVSRFGDDSSESL

SEQ ID NO: 2015974 - protein, 18 aa, Staphylococcus
HDQPRVVSRFGDDSTEAL

SEQ ID NO: 2015975 - protein, 18 aa, Staphylococcus
HDQPRVVSRFGDDSTEEN

SEQ ID NO: 2015976 - protein, 17 aa, Staphylococcus
HDQPRVVSRFGDDTNEL

SEQ ID NO: 2015977 - protein, 18 aa, Staphylococcus
HDQPRVVTRFGDDTSEPL

SEQ ID NO: 2015978 - protein, 30 aa, Staphylococcus
HDQSFLSNVEKLVWMGGTFLDKGNVEEPEH

SEQ ID NO: 2015979 - protein, 25 aa, Staphylococcus
HDRDRSGVCSVQLAERVEPGDKLKV

SEQ ID NO: 2015980 - protein, 18 aa, Staphylococcus
HDRGMKLILDLVVNHTSD

SEQ ID NO: 2015981 - protein, 31 aa, Staphylococcus
HDRYPKLKDLNLKWYAVPIISNMDLQIGGIT

SEQ ID NO: 2015982 - protein, 23 aa, Staphylococcus
HDSHPQNGFVMYERDFEKDLKLM

SEQ ID NO: 2015983 - protein, 21 aa, Staphylococcus
HDSLDHLWRVASLNQAIALNI

SEQ ID NO: 2015984 - protein, 24 aa, Staphylococcus
HDSNLKVWIDYVNKTYFSYEPGKE

SEQ ID NO: 2015985 - protein, 17 aa, Staphylococcus
HDSRQVLPDSFKHGDAV

SEQ ID NO: 2015986 - protein, 18 aa, Staphylococcus
HDSTVHGLELMFDKMHQI

SEQ ID NO: 2015987 - protein, 23 aa, Staphylococcus
HDVEEIVLLNGWGKTQGEDAVKV

SEQ ID NO: 2015988 - protein, 24 aa, Staphylococcus
HDVEIQFQYGLVLCHLEMFEQAIK

SEQ ID NO: 2015989 - protein, 17 aa, Staphylococcus
HDVKFYMIEDVYVFDHY

SEQ ID NO: 2015990 - protein, 17 aa, Staphylococcus
HDVTPLPFDLFNKQLET

SEQ ID NO: 2015991 - protein, 19 aa, Staphylococcus
HDWTKLGTSIVDIVENGVS

SEQ ID NO: 2015992 - protein, 23 aa, Staphylococcus
HDWYDIMEELSIYREGFQDIQHL

SEQ ID NO: 2015993 - protein, 21 aa, Staphylococcus
HEAKAHLIASAFSDAANAANL

SEQ ID NO: 2015994 - protein, 18 aa, Staphylococcus
HEALLCLDATTGQSALSQ

SEQ ID NO: 2015995 - protein, 19 aa, Staphylococcus
HEAMDKYGLSNLVVHAPYI

SEQ ID NO: 2015996 - protein, 18 aa, Staphylococcus
HEAMKEYGLSNIIVHAPY

SEQ ID NO: 2015997 - protein, 26 aa, Staphylococcus
HEDGIPVYLGMPMGVVIEAEGKTIYH

SEQ ID NO: 2015998 - protein, 23 aa, Staphylococcus
HEDHSIHLLLFNAPYQRSSTQDV

SEQ ID NO: 2015999 - protein, 17 aa, Staphylococcus
HEDVDFIFGYPGGAVLP

SEQ ID NO: 2016000 - protein, 19 aa, Staphylococcus
HEEASWMYDLELFQDTSEK

SEQ ID NO: 2016001 - protein, 19 aa, Staphylococcus
HEEFEFEKNDGYRSENSRQ

SEQ ID NO: 2016002 - protein, 29 aa, Staphylococcus
HEEGSKDPHIWLDPVLNKKMVKAIKDDLV

SEQ ID NO: 2016003 - protein, 21 aa, Staphylococcus
HEEIKRLVDFQQEIIDYLQPE

SEQ ID NO: 2016004 - protein, 17 aa, Staphylococcus
HEFETPLVEFFYKNDDL

SEQ ID NO: 2016005 - protein, 19 aa, Staphylococcus
HEFMFARPVNRTNDMIKHH

SEQ ID NO: 2016006 - protein, 17 aa, Staphylococcus
HEGHARGKVVIKVTEPE

SEQ ID NO: 2016007 - protein, 21 aa, Staphylococcus
HEGSCWCVRAYHNHKLTKASN

SEQ ID NO: 2016008 - protein, 31 aa, Staphylococcus
HEHAQGLGFRGDIFGGYILYNLGFIESEARY

SEQ ID NO: 2016009 - protein, 20 aa, Staphylococcus
HEIEDAKTIIGLQYILLNYN

SEQ ID NO: 2016010 - protein, 24 aa, Staphylococcus
HEIGETLPEAFAIVHPMHPEFNYP

SEQ ID NO: 2016011 - protein, 23 aa, Staphylococcus
HEIKYALENHIGYFVIDSLEEID

SEQ ID NO: 2016012 - protein, 23 aa, Staphylococcus
HEISIYPFLCYLDKELVAIGYLD

SEQ ID NO: 2016013 - protein, 17 aa, Staphylococcus
HEKADILYIGFISSKGA

SEQ ID NO: 2016014 - protein, 17 aa, Staphylococcus
HELCHYHLHLSGKGYQH

SEQ ID NO: 2016015 - protein, 22 aa, Staphylococcus
HELFYKLIDLVTEIAHKHNATI

SEQ ID NO: 2016016 - protein, 22 aa, Staphylococcus
HELHPDLILMDLLMEDMDGVEA

SEQ ID NO: 2016017 - protein, 21 aa, Staphylococcus
HELILRGEIMNVVIKEESEHD

SEQ ID NO: 2016018 - protein, 22 aa, Staphylococcus
HELKDEAGVVWVIDPIDGTLNF

SEQ ID NO: 2016019 - protein, 23 aa, Staphylococcus
HELKPDLILMDLLMDDMDGVEAT

SEQ ID NO: 2016020 - protein, 24 aa, Staphylococcus
HELKPDLILMDLLMDDMDGVEATE

SEQ ID NO: 2016021 - protein, 17 aa, Staphylococcus
HELKVALEQPIFEGIEW

SEQ ID NO: 2016022 - protein, 23 aa, Staphylococcus
HELNNGLRLFVIPKKGFQKTYVT

SEQ ID NO: 2016023 - protein, 19 aa, Staphylococcus
HELRMKTVKQMSPAKHVIN

SEQ ID NO: 2016024 - protein, 19 aa, Staphylococcus
HEMGSTLPDAFAIVHPMHP

SEQ ID NO: 2016025 - protein, 24 aa, Staphylococcus
HENESMMFYTCILDMIKFEETSEL

SEQ ID NO: 2016026 - protein, 20 aa, Staphylococcus
HENFFKKHHLNFDLLVDDEF

SEQ ID NO: 2016027 - protein, 26 aa, Staphylococcus
HENGIPVYLGMPMGVVIEAEGKTIYH

SEQ ID NO: 2016028 - protein, 23 aa, Staphylococcus
HEPEFKDAMNLADFFDAPYELFV

SEQ ID NO: 2016029 - protein, 20 aa, Staphylococcus
HEPFTCISLLLNDNKTISIR

SEQ ID NO: 2016030 - protein, 18 aa, Staphylococcus
HEPYRQHLILEFEKVKIL

SEQ ID NO: 2016031 - protein, 23 aa, Staphylococcus
HEQRRAEFLAGRFACKEAFSKAL

SEQ ID NO: 2016032 - protein, 24 aa, Staphylococcus
HERIMKAIKLYGKRVKPIIEDYFN

SEQ ID NO: 2016033 - protein, 18 aa, Staphylococcus
HERIPSKLILLGDGPELL

SEQ ID NO: 2016034 - protein, 17 aa, Staphylococcus
HESHFGEKMGMKFHTDV

SEQ ID NO: 2016035 - protein, 25 aa, Staphylococcus
HESLKRYLLEETFELFEAIDNEDDW

SEQ ID NO: 2016036 - protein, 22 aa, Staphylococcus
HESLLRALKDNGLEEIEAEGQE

SEQ ID NO: 2016037 - protein, 23 aa, Staphylococcus
HESLLRALKDNGLEEIESEGQAF

SEQ ID NO: 2016038 - protein, 17 aa, Staphylococcus
HETKDLLGFASVYENSL

SEQ ID NO: 2016039 - protein, 30 aa, Staphylococcus
HETSHKAYIKKWALDTCINHIARTISQTKF

SEQ ID NO: 2016040 - protein, 25 aa, Staphylococcus
HETWAPKLAMRLVLGEMSTVVLDTQ

SEQ ID NO: 2016041 - protein, 22 aa, Staphylococcus
HETWVPAFVLRTVLGEMSTVVL

SEQ ID NO: 2016042 - protein, 22 aa, Staphylococcus
HETWVPSFLMRLALGEMSTVVL

SEQ ID NO: 2016043 - protein, 18 aa, Staphylococcus
HETYEFQYAFGLPDYQII

SEQ ID NO: 2016044 - protein, 24 aa, Staphylococcus
HEVQSHGFQCCLNASNITEDMLKR

SEQ ID NO: 2016045 - protein, 17 aa, Staphylococcus
HEVVVHTSLIVREDAQL

SEQ ID NO: 2016046 - protein, 36 aa, Staphylococcus; identical to SEQ ID NO: 1806206

SEQ ID NO: 2016047 - protein, 25 aa, Staphylococcus
HEWTREIGDAFGLGEIYPPLIPSHG

SEQ ID NO: 2016048 - protein, 30 aa, Staphylococcus
HFADSDVPTGLWLGELVHFYDLMHQNHVQI

SEQ ID NO: 2016049 - protein, 21 aa, Staphylococcus
HFAPSVMVAFGYRKDEPKGKV

SEQ ID NO: 2016050 - protein, 18 aa, Staphylococcus
HFDIPKGASHKVDLIAAQ

SEQ ID NO: 2016051 - protein, 19 aa, Staphylococcus
HFDKTINFYNVLRHASSTY

SEQ ID NO: 2016052 - protein, 23 aa, Staphylococcus
HFDLEVLYKMIGIINDTLVSIRF

SEQ ID NO: 2016053 - protein, 24 aa, Staphylococcus
HFDVARFNADFAYTMDGSQYGELQ

SEQ ID NO: 2016054 - protein, 18 aa, Staphylococcus
HFEDGIQVVIDYIKLDQY

SEQ ID NO: 2016055 - protein, 21 aa, Staphylococcus
HFEKRYAKRSQLREFNVEEMN

SEQ ID NO: 2016056 - protein, 42 aa, Staphylococcus
HFENKLTFSDEVIEKIAGIAAREVRGILDMKGGFTDSISSAF

SEQ ID NO: 2016057 - protein, 19 aa, Staphylococcus
HFETIALNFDTYVSKKVAY

SEQ ID NO: 2016058 - protein, 19 aa, Staphylococcus
HFGDELIPVLNWQQNLVYD

SEQ ID NO: 2016059 - protein, 26 aa, Staphylococcus
HFGISGPAALRCSQFIYKEQKQQKTQ

SEQ ID NO: 2016060 - protein, 26 aa, Staphylococcus
HFGISGPAALRCSQFVYKEQKNQKKQ

SEQ ID NO: 2016061 - protein, 26 aa, Staphylococcus
HFGISGPAALRCSQFVYKEQKNQKTK

SEQ ID NO: 2016062 - protein, 27 aa, Staphylococcus
HFGVSGPAALRCSQFVYKEQKNQKKNE

SEQ ID NO: 2016063 - protein, 26 aa, Staphylococcus
HFGVSGPAALRCSQFVYKEQKNQKKQ

SEQ ID NO: 2016064 - protein, 27 aa, Staphylococcus
HFGVSGPAALRCSQFVYKEQKNQKKQD

SEQ ID NO: 2016065 - protein, 26 aa, Staphylococcus
HFGVSGPGALRCSQFVYKEQKSQKKQ

SEQ ID NO: 2016066 - protein, 17 aa, Staphylococcus
HFHDLWRATKNPDILNV

SEQ ID NO: 2016067 - protein, 18 aa, Staphylococcus
HFIRATLESLCYQTRDVM

SEQ ID NO: 2016068 - protein, 23 aa, Staphylococcus
HFISCAGGIRFLAVKDGKNAADM

SEQ ID NO: 2016069 - protein, 17 aa, Staphylococcus
HFKDYTLIECELETGRT

SEQ ID NO: 2016070 - protein, 25 aa, Staphylococcus
HFKLTEAGELLFRNSNKLLYLMQET

SEQ ID NO: 2016071 - protein, 24 aa, Staphylococcus
HFKSAYHILDMIFWFGNLNILSAN

SEQ ID NO: 2016072 - protein, 19 aa, Staphylococcus
HFLELREEAIILLKQGTTK

SEQ ID NO: 2016073 - protein, 25 aa, Staphylococcus
HFLMFKYRKLHQVIILGPFLLQRPS

SEQ ID NO: 2016074 - protein, 18 aa, Staphylococcus
HFLNKSAMHHIIIEATGI

SEQ ID NO: 2016075 - protein, 26 aa, Staphylococcus
HFNDQWKRMGILGIEMESAALYLNAT

SEQ ID NO: 2016076 - protein, 25 aa, Staphylococcus
HFNFKKADVSFKWFPGFSKEQKQKS

SEQ ID NO: 2016077 - protein, 18 aa, Staphylococcus
HFNHKNELIEFITQHAQA

SEQ ID NO: 2016078 - protein, 21 aa, Staphylococcus
HFNLLKLGDNVLFHPKNPNDT

SEQ ID NO: 2016079 - protein, 24 aa, Staphylococcus
HFNWKDVEKSFSWYESGNVNMAHE

SEQ ID NO: 2016080 - protein, 24 aa, Staphylococcus
HFNYFKDYFLTDGGVKNWEQISEK

SEQ ID NO: 2016081 - protein, 27 aa, Staphylococcus
HFPADLYFEGSDQYRGWFNSSITTAVA

SEQ ID NO: 2016082 - protein, 23 aa, Staphylococcus
HFPCLNCTKSIIQAGIKKIYYAK

SEQ ID NO: 2016083 - protein, 23 aa, Staphylococcus
HFPCLNCTKSIIQAGIKQIYYAE

SEQ ID NO: 2016084 - protein, 23 aa, Staphylococcus
HFPCLNCTKSIIQAGIKRIYYAQ

SEQ ID NO: 2016085 - protein, 22 aa, Staphylococcus
HFPCLNCTKSIIQAGITTIYYA

SEQ ID NO: 2016086 - protein, 22 aa, Staphylococcus
HFPCLNCTKSIIQSGIDTIYYA

SEQ ID NO: 2016087 - protein, 17 aa, Staphylococcus
HFPKKLTLRDVTKAIEL

SEQ ID NO: 2016088 - protein, 21 aa, Staphylococcus
HFRVDFDQRFACNCGKYGCLE

SEQ ID NO: 2016089 - protein, 24 aa, Staphylococcus
HFSNLDVPFIYRVHEQPKSERLRQ

SEQ ID NO: 2016090 - protein, 24 aa, Staphylococcus
HFSRSDSPLYFTLHHDELKYIRIL

SEQ ID NO: 2016091 - protein, 27 aa, Staphylococcus
HFSSGMKMKLSLAIALSHHAELFILDE

SEQ ID NO: 2016092 - protein, 30 aa, Staphylococcus
HFSYKRYLENQIRAAFGFEGTPVHIIARKR

SEQ ID NO: 2016093 - protein, 18 aa, Staphylococcus
HFSYKRYLENQIRNAFGF

SEQ ID NO: 2016094 - protein, 18 aa, Staphylococcus
HFTTDFLYQTEWQAWLKE

SEQ ID NO: 2016095 - protein, 18 aa, Staphylococcus
HFTTDFLYQTEWQEWLKD

SEQ ID NO: 2016096 - protein, 19 aa, Staphylococcus
HFTTDFLYQTEWQEWLKDG

SEQ ID NO: 2016097 - protein, 17 aa, Staphylococcus
HFVRATLESLCYQTRDV

SEQ ID NO: 2016098 - protein, 21 aa, Staphylococcus
HFYDMSVAICHNGNLINAQSL

SEQ ID NO: 2016099 - protein, 20 aa, Staphylococcus
HGAAEGKAVITAKADDGSGK

SEQ ID NO: 2016100 - protein, 28 aa, Staphylococcus
HGAFPIFYWKEFEDIIAKHGGTTPANRE

SEQ ID NO: 2016101 - protein, 19 aa, Staphylococcus
HGAFSIRIDDQLDVELIHE

SEQ ID NO: 2016102 - protein, 18 aa, Staphylococcus
HGAGCTFAAATTANLANG

SEQ ID NO: 2016103 - protein, 25 aa, Staphylococcus
HGALGERALKYIIPDTSDFPYTVRI

SEQ ID NO: 2016104 - protein, 23 aa, Staphylococcus
HGALGERALRHIIPDTSKFPYTI

SEQ ID NO: 2016105 - protein, 24 aa, Staphylococcus
HGALGERALSHIIPDLKDFPYTVR

SEQ ID NO: 2016106 - protein, 29 aa, Staphylococcus
HGAMMTYRIMAMFEPYFREYQMIFVNCPG

SEQ ID NO: 2016107 - protein, 19 aa, Staphylococcus
HGANLRVGYYDQKQAEFKS

SEQ ID NO: 2016108 - protein, 19 aa, Staphylococcus
HGDLWGGNYMFLKNGDPAL

SEQ ID NO: 2016109 - protein, 20 aa, Staphylococcus
HGDSELAVWSQANIAGMPVF

SEQ ID NO: 2016110 - protein, 20 aa, Staphylococcus
HGDSELAVWSQANVAGISVF

SEQ ID NO: 2016111 - protein, 19 aa, Staphylococcus
HGEHHVACIHSGMDEHERA

SEQ ID NO: 2016112 - protein, 19 aa, Staphylococcus
HGEKGLFIVPLNGLKKWLT

SEQ ID NO: 2016113 - protein, 22 aa, Staphylococcus
HGELHLDIDFALYGKAGSQISD

SEQ ID NO: 2016114 - protein, 29 aa, Staphylococcus
HGFAKQAFKMAIDYAFLVLNMHKVYLYVD

SEQ ID NO: 2016115 - protein, 19 aa, Staphylococcus
HGFELMFDKMNAVLEEIEE

SEQ ID NO: 2016116 - protein, 18 aa, Staphylococcus
HGFLGFQIQQQGRTVQQQ

SEQ ID NO: 2016117 - protein, 21 aa, Staphylococcus
HGFNHYSRFINLFKDSYGYTP

SEQ ID NO: 2016118 - protein, 23 aa, Staphylococcus
HGFRETKVYMGLILERPAYLQLK

SEQ ID NO: 2016119 - protein, 20 aa, Staphylococcus
HGGCTFCSAAGSGDFAGNRV

SEQ ID NO: 2016120 - protein, 17 aa, Staphylococcus
HGHAGQSLAAFAPSGLL

SEQ ID NO: 2016121 - protein, 17 aa, Staphylococcus
HGIDLIKIDNDETNIVF

SEQ ID NO: 2016122 - protein, 17 aa, Staphylococcus
HGIDLKKANALLLEEVG

SEQ ID NO: 2016123 - protein, 19 aa, Staphylococcus
HGIDLKKANALLLQSMGVP

SEQ ID NO: 2016124 - protein, 23 aa, Staphylococcus
HGIDLKKANSLLLQSVGVPESNI

SEQ ID NO: 2016125 - protein, 24 aa, Staphylococcus
HGIDLKLANALLLKNSGVPAENIN

SEQ ID NO: 2016126 - protein, 24 aa, Staphylococcus
HGIDLKRANALLLENAGVPKDNIY

SEQ ID NO: 2016127 - protein, 17 aa, Staphylococcus
HGIDRYNFYGISGDFSE

SEQ ID NO: 2016128 - protein, 21 aa, Staphylococcus
HGIDRYNFYGISGHFTEDAED

SEQ ID NO: 2016129 - protein, 17 aa, Staphylococcus
HGKETFKQAIVDFYQRQ

SEQ ID NO: 2016130 - protein, 23 aa, Staphylococcus
HGKILYLEIGIGYTTPQFVKHPF

SEQ ID NO: 2016131 - protein, 22 aa, Staphylococcus
HGKLYKAVRGFGAYVNGEPLSS

SEQ ID NO: 2016132 - protein, 26 aa, Staphylococcus
HGKQPDMHLSVWKGLWNSIKKNGTTA

SEQ ID NO: 2016133 - protein, 21 aa, Staphylococcus
HGKTTLLDSIRHTKVTAGEAG

SEQ ID NO: 2016134 - protein, 22 aa, Staphylococcus
HGKTTLLDSIRHTKVTAGEAGG

SEQ ID NO: 2016135 - protein, 22 aa, Staphylococcus
HGKTTLLDSIRHTKVTEGEAGG

SEQ ID NO: 2016136 - protein, 18 aa, Staphylococcus
HGKTYAHHFCIYECSVGK

SEQ ID NO: 2016137 - protein, 26 aa, Staphylococcus
HGLAEIWPDLNFPSSEIAFVVLHFGG

SEQ ID NO: 2016138 - protein, 18 aa, Staphylococcus
HGLHVVETLAGLKPTPVS

SEQ ID NO: 2016139 - protein, 23 aa, Staphylococcus
HGLIEERYLLFILEQANIDNETT

SEQ ID NO: 2016140 - protein, 17 aa, Staphylococcus
HGLIEERYLLFLIEQAH

SEQ ID NO: 2016141 - protein, 18 aa, Staphylococcus
HGLKCCLNASTIDASILQ

SEQ ID NO: 2016142 - protein, 20 aa, Staphylococcus
HGLREPWRVVHIAKDRLGDM

SEQ ID NO: 2016143 - protein, 20 aa, Staphylococcus
HGLYHAYRLAIAPTQSISYV

SEQ ID NO: 2016144 - protein, 19 aa, Staphylococcus
HGMKEPYNDIRMWDYKALP

SEQ ID NO: 2016145 - protein, 19 aa, Staphylococcus
HGMLLRILLGDGPSDLVNL

SEQ ID NO: 2016146 - protein, 24 aa, Staphylococcus
HGNELPISAAYFIINPYEVVYYAG

SEQ ID NO: 2016147 - protein, 25 aa, Staphylococcus
HGNELPISAGFFIINPFEVVYYAGG

SEQ ID NO: 2016148 - protein, 26 aa, Staphylococcus
HGNELPISAGFFIINPFEVVYYAGGT

SEQ ID NO: 2016149 - protein, 25 aa, Staphylococcus
HGNSVPRFHITWGTGPGLVEPFSNY

SEQ ID NO: 2016150 - protein, 19 aa, Staphylococcus
HGPKAGLSDNAIFIMLRSN

SEQ ID NO: 2016151 - protein, 21 aa, Staphylococcus
HGQIYKIRRSIALNPSDNQIS

SEQ ID NO: 2016152 - protein, 23 aa, Staphylococcus
HGQPIAFALDFLKLGVSELANVS

SEQ ID NO: 2016153 - protein, 20 aa, Staphylococcus
HGQTVFNLKGKIQGASDSPL

SEQ ID NO: 2016154 - protein, 25 aa, Staphylococcus
HGRDRSGVCSVQFAERIQPGDTVPI

SEQ ID NO: 2016155 - protein, 25 aa, Staphylococcus
HGRDRSGVCSVQFAERLQPGDTVPI

SEQ ID NO: 2016156 - protein, 25 aa, Staphylococcus
HGRDRTGVCSVQFAERIQEGDTVPI

SEQ ID NO: 2016157 - protein, 25 aa, Staphylococcus
HGRDRTGVCSVQFAERVQPGDTVPI

SEQ ID NO: 2016158 - protein, 20 aa, Staphylococcus
HGRHRARVALDLFASKIHKY

SEQ ID NO: 2016159 - protein, 20 aa, Staphylococcus
HGRLKGYKMLVTGGDSAIGR

SEQ ID NO: 2016160 - protein, 18 aa, Staphylococcus
HGRVGIALYGSRPYSKLS

SEQ ID NO: 2016161 - protein, 26 aa, Staphylococcus
HGSADMKSGLAALAISLIEIKKAGTL

SEQ ID NO: 2016162 - protein, 21 aa, Staphylococcus
HGSESIQLIKAIRKLNPTIKI

SEQ ID NO: 2016163 - protein, 22 aa, Staphylococcus
HGSFCEGIKNSVEMIFGAQDYI

SEQ ID NO: 2016164 - protein, 25 aa, Staphylococcus
HGSLLPIMHLYQFIAAFIDVPIHIS

SEQ ID NO: 2016165 - protein, 29 aa, Staphylococcus
HGSLLPIMHLYRFVSTFSNESFQISNNYL

SEQ ID NO: 2016166 - protein, 17 aa, Staphylococcus
HGSLNTFYCNQCHQQYS

SEQ ID NO: 2016167 - protein, 23 aa, Staphylococcus
HGSMNRYAIIHLNEWGTIKNPNP

SEQ ID NO: 2016168 - protein, 17 aa, Staphylococcus
HGTEIYFKDDAYKLSIG

SEQ ID NO: 2016169 - protein, 28 aa, Staphylococcus
HGTELGIRLRQPIDLQYGDILYQDETNM

SEQ ID NO: 2016170 - protein, 24 aa, Staphylococcus
HGTGCTFSAVIAAELAKGRSIYEA

SEQ ID NO: 2016171 - protein, 24 aa, Staphylococcus
HGTIPGNMKLMFDESLNRNYSIII

SEQ ID NO: 2016172 - protein, 34 aa, Staphylococcus
HGTVKLYDALRESFNIPALKAWQSTKENAGNDAP

SEQ ID NO: 2016173 - protein, 25 aa, Staphylococcus
HGVAYKEVLTGFKYIAEAIRNMSED

SEQ ID NO: 2016174 - protein, 22 aa, Staphylococcus
HGVDFGTGYALEFSGETIRSLS

SEQ ID NO: 2016175 - protein, 17 aa, Staphylococcus
HGVKVISMAFFVEENAP

SEQ ID NO: 2016176 - protein, 17 aa, Staphylococcus
HGVSLTTLFAPLLEPEI

SEQ ID NO: 2016177 - protein, 22 aa, Staphylococcus
HGVYDFKVEPIESGIKVDDHEI

SEQ ID NO: 2016178 - protein, 19 aa, Staphylococcus
HGYDRYNFYGLSGDFTENS

SEQ ID NO: 2016179 - protein, 23 aa, Staphylococcus
HHALLFKDMDGLEILLLANNHRN

SEQ ID NO: 2016180 - protein, 25 aa, Staphylococcus
HHCLYLRVDPYLPYQYRNHDGEITE

SEQ ID NO: 2016181 - protein, 24 aa, Staphylococcus
HHDLHAGQTIGLFSYGSGSVGEFF

SEQ ID NO: 2016182 - protein, 18 aa, Staphylococcus
HHFSSGIISGLKIKMALD

SEQ ID NO: 2016183 - protein, 17 aa, Staphylococcus
HHHEAICGIDFAGPEVG

SEQ ID NO: 2016184 - protein, 17 aa, Staphylococcus
HHHPIKVDIAGSVESIY

SEQ ID NO: 2016185 - protein, 17 aa, Staphylococcus
HHHPIRVDIAGSVESIY

SEQ ID NO: 2016186 - protein, 24 aa, Staphylococcus
HHIALPAYKRIEAISDENSFKEFD

SEQ ID NO: 2016187 - protein, 23 aa, Staphylococcus
HHIALPAYKRIEAITDENSFVEF

SEQ ID NO: 2016188 - protein, 21 aa, Staphylococcus
HHIEGLFSIAGFKEDAHDIDE

SEQ ID NO: 2016189 - protein, 26 aa, Staphylococcus
HHIEGRIFISLAVKFSKARLIDNLII

SEQ ID NO: 2016190 - protein, 24 aa, Staphylococcus
HHIKIIYLETCNLKSILSDIYQRG

SEQ ID NO: 2016191 - protein, 25 aa, Staphylococcus
HHIMIATGRPYRASQIYYHELNMNT

SEQ ID NO: 2016192 - protein, 17 aa, Staphylococcus
HHIPKHELLILCTGSQG

SEQ ID NO: 2016193 - protein, 18 aa, Staphylococcus
HHIVRQGLEFLISTVEGL

SEQ ID NO: 2016194 - protein, 18 aa, Staphylococcus
HHIVRQGLEFLLSTVDDL

SEQ ID NO: 2016195 - protein, 18 aa, Staphylococcus
HHIVRQGLEFLLSTVEDI

SEQ ID NO: 2016196 - protein, 35 aa, Staphylococcus
HHKEIEFVCAFIFYAELSLEEWLNLSDELKLRYLN

SEQ ID NO: 2016197 - protein, 19 aa, Staphylococcus
HHKGMRLILDLVVNHTSDE

SEQ ID NO: 2016198 - protein, 20 aa, Staphylococcus
HHKLKAGAFTKQYGDKVFPI

SEQ ID NO: 2016199 - protein, 19 aa, Staphylococcus
HHLDIGFDLNYLYKEAKQS

SEQ ID NO: 2016200 - protein, 18 aa, Staphylococcus
HHLDIGFDLNYLYPDAKH

SEQ ID NO: 2016201 - protein, 34 aa, Staphylococcus
HHLFDRYTFNHFKKGSVFVNCARGSLVDTHALLS

SEQ ID NO: 2016202 - protein, 19 aa, Staphylococcus
HHLKIVGGFQFSNHKSDDE

SEQ ID NO: 2016203 - protein, 24 aa, Staphylococcus
HHLTRLTMHAQYYATPFYEKLGYI

SEQ ID NO: 2016204 - protein, 18 aa, Staphylococcus
HHMDCYRLEDAEEDLGFE

SEQ ID NO: 2016205 - protein, 18 aa, Staphylococcus
HHMDCYRLEDSDEDLGFD

SEQ ID NO: 2016206 - protein, 18 aa, Staphylococcus
HHMDCYRLEDSDEDLGFN

SEQ ID NO: 2016207 - protein, 17 aa, Staphylococcus
HHMDCYRLEDSEEDLGF

SEQ ID NO: 2016208 - protein, 17 aa, Staphylococcus
HHMDCYRLEGMEEDLGF

SEQ ID NO: 2016209 - protein, 17 aa, Staphylococcus
HHMDCYRLENTEEDLGF

SEQ ID NO: 2016210 - protein, 18 aa, Staphylococcus
HHMQRSFSHIELPDKAFL

SEQ ID NO: 2016211 - protein, 18 aa, Staphylococcus
HHMQRSFSHIELPDNAYL

SEQ ID NO: 2016212 - protein, 17 aa, Staphylococcus
HHMQRSFSHIELPEHAY

SEQ ID NO: 2016213 - protein, 18 aa, Staphylococcus
HHMQRSFSHIELPETAYL

SEQ ID NO: 2016214 - protein, 17 aa, Staphylococcus
HHMTIVFDPNFRKKLWN

SEQ ID NO: 2016215 - protein, 22 aa, Staphylococcus
HHNFAGGLSYHVLTMLKIAKSL

SEQ ID NO: 2016216 - protein, 18 aa, Staphylococcus
HHQIQELLAFEMDDALIK

SEQ ID NO: 2016217 - protein, 23 aa, Staphylococcus
HHRKASDIFNMINESTLPNRVKE

SEQ ID NO: 2016218 - protein, 27 aa, Staphylococcus
HHSIKQGYCLLVGFGKSSTEQEIETLA

SEQ ID NO: 2016219 - protein, 27 aa, Staphylococcus
HHSSIEMQLRDAASYVKDLYKTEMGIA

SEQ ID NO: 2016220 - protein, 17 aa, Staphylococcus
HHTHARVGIALYGSRPY

SEQ ID NO: 2016221 - protein, 22 aa, Staphylococcus
HHTYSWDRYYLDHVSDDALTKI

SEQ ID NO: 2016222 - protein, 18 aa, Staphylococcus
HHVKKVIAQSIAFTYEPG

SEQ ID NO: 2016223 - protein, 23 aa, Staphylococcus
HHYLWRFAKKMPKSGHIEIFDRS

SEQ ID NO: 2016224 - protein, 19 aa, Staphylococcus
HHYNECPNFVKGHIPELYI

SEQ ID NO: 2016225 - protein, 20 aa, Staphylococcus
HHYTAIIVDGCPDYFTTLGY

SEQ ID NO: 2016226 - protein, 24 aa, Staphylococcus
HHYVGLAHAGWRGTYGQIVSEMLK

SEQ ID NO: 2016227 - protein, 23 aa, Staphylococcus
HIADLRPSGKYVMAHLDEVGGIP

SEQ ID NO: 2016228 - protein, 20 aa, Staphylococcus
HIAFKSHHINFIYNQMDKTE

SEQ ID NO: 2016229 - protein, 18 aa, Staphylococcus
HIAGLKVTAIEDFEKGEK

SEQ ID NO: 2016230 - protein, 19 aa, Staphylococcus
HIDDCINLTIGQPDFSMPD

SEQ ID NO: 2016231 - protein, 25 aa, Staphylococcus
HIDESRILFGAGLDEVILMISRAVL

SEQ ID NO: 2016232 - protein, 18 aa, Staphylococcus
HIDVWVEAYTNYFKAMIG

SEQ ID NO: 2016233 - protein, 22 aa, Staphylococcus
HIEEIRGQRICLYYDEDTFDSL

SEQ ID NO: 2016234 - protein, 21 aa, Staphylococcus
HIEIFDRSWYGRILVERVEGF

SEQ ID NO: 2016235 - protein, 21 aa, Staphylococcus
HIEIFDRSWYGRVLVERVEGF

SEQ ID NO: 2016236 - protein, 27 aa, Staphylococcus
HIETTIWYKLLVNLGINSITALGGNTA

SEQ ID NO: 2016237 - protein, 27 aa, Staphylococcus
HIETYIWYKLLVNLGINSVTAAGRQTA

SEQ ID NO: 2016238 - protein, 24 aa, Staphylococcus
HIEYRPFIMQSLFEEKRLIKLQPQ

SEQ ID NO: 2016239 - protein, 18 aa, Staphylococcus
HIFHSKSVIFAIGGGIIN

SEQ ID NO: 2016240 - protein, 18 aa, Staphylococcus
HIFKLDPAKPISDEDLMK

SEQ ID NO: 2016241 - protein, 18 aa, Staphylococcus
HIGHPLIGDDLYDGFHPR

SEQ ID NO: 2016242 - protein, 17 aa, Staphylococcus
HIGPKKRRSVLEKRMKD

SEQ ID NO: 2016243 - protein, 17 aa, Staphylococcus
HIHEVDHSIDITAININ

SEQ ID NO: 2016244 - protein, 20 aa, Staphylococcus
HIHLDTEIYLRMYSEQDEFY

SEQ ID NO: 2016245 - protein, 28 aa, Staphylococcus
HIHRMLEAAEGLPINVGFTGKGQAHNHT

SEQ ID NO: 2016246 - protein, 28 aa, Staphylococcus
HIHRMLEVAEALPINVGFTGKGQAVNHT

SEQ ID NO: 2016247 - protein, 26 aa, Staphylococcus
HIHVKQLIRCCRYFIDILRKSTNGRI

SEQ ID NO: 2016248 - protein, 18 aa, Staphylococcus
HIHVRQLIRLSRYFVDTL

SEQ ID NO: 2016249 - protein, 25 aa, Staphylococcus
HIIDIPTKVFNRLGIEPNTEPIRGG

SEQ ID NO: 2016250 - protein, 18 aa, Staphylococcus
HIILDGWSLSIVLNDVNR

SEQ ID NO: 2016251 - protein, 25 aa, Staphylococcus
HIIVHPRFNLQPDVVDQPLLHIDLN

SEQ ID NO: 2016252 - protein, 23 aa, Staphylococcus
HIKASGQSIGFIPTMGALHEGHL

SEQ ID NO: 2016253 - protein, 24 aa, Staphylococcus
HIKDIKPLPALIMYGTEDKILETD

SEQ ID NO: 2016254 - protein, 23 aa, Staphylococcus
HIKEIIEGKSLDGFNITIPHKER

SEQ ID NO: 2016255 - protein, 17 aa, Staphylococcus
HIKEPKCHVKQQLENGY

SEQ ID NO: 2016256 - protein, 17 aa, Staphylococcus
HIKHYVQDRLLLNINRL

SEQ ID NO: 2016257 - protein, 19 aa, Staphylococcus
HIKIRSGVYQDLTDADFIV

SEQ ID NO: 2016258 - protein, 22 aa, Staphylococcus
HIKIRYLPCPCKIKHDEEKFNA

SEQ ID NO: 2016259 - protein, 18 aa, Staphylococcus
HIKVKFKNGTEYIAVSGG

SEQ ID NO: 2016260 - protein, 23 aa, Staphylococcus
HIKYLDCLIYSSGTALYGLLQDM

SEQ ID NO: 2016261 - protein, 23 aa, Staphylococcus
HILEGLRIALDHIDEIIRVIRES

SEQ ID NO: 2016262 - protein, 22 aa, Staphylococcus
HILEGLRIALDHIDEIISTIRE

SEQ ID NO: 2016263 - protein, 17 aa, Staphylococcus
HILELFIKGYLTDYHSF

SEQ ID NO: 2016264 - protein, 21 aa, Staphylococcus
HILHIIKHISYRHGQNNEVSL

SEQ ID NO: 2016265 - protein, 19 aa, Staphylococcus
HIMTLDMAKEISMIQRSEI

SEQ ID NO: 2016266 - protein, 17 aa, Staphylococcus
HINEPKCNVKAELENGN

SEQ ID NO: 2016267 - protein, 22 aa, Staphylococcus
HINRIKQMLTRFYAENIEHRRW

SEQ ID NO: 2016268 - protein, 20 aa, Staphylococcus
HIPDTALLECFKHELYEFIE

SEQ ID NO: 2016269 - protein, 21 aa, Staphylococcus
HIPEDAFRLVGSMDDVIAKAK

SEQ ID NO: 2016270 - protein, 21 aa, Staphylococcus
HIPEDAFRLVGSMDDVLEKAK

SEQ ID NO: 2016271 - protein, 21 aa, Staphylococcus
HIPEDAFRLVGSMEDVIAKAK

SEQ ID NO: 2016272 - protein, 21 aa, Staphylococcus
HIPEDAFRLVGSMEDVLAKAK

SEQ ID NO: 2016273 - protein, 21 aa, Staphylococcus
HIPEDAFRLVGSMQDVIAKAK

SEQ ID NO: 2016274 - protein, 21 aa, Staphylococcus
HIPEDAFRLVGSMQDVIEKAK

SEQ ID NO: 2016275 - protein, 24 aa, Staphylococcus
HIPFATGRFRPVNDSVKIERVAVR

SEQ ID NO: 2016276 - protein, 26 aa, Staphylococcus
HIPFCVRICTYCDFNKYFIQNQPVDE

SEQ ID NO: 2016277 - protein, 26 aa, Staphylococcus
HIPGKEQWFFPPRPHTHHVKWLDNNH

SEQ ID NO: 2016278 - protein, 24 aa, Staphylococcus
HIQGRPVIEARAFKEGLISIQDKS

SEQ ID NO: 2016279 - protein, 21 aa, Staphylococcus
HIQHPIKVILFATEEKTFKAL

SEQ ID NO: 2016280 - protein, 30 aa, Staphylococcus
HIQVLLLTFFFKYMKPLVEAGRVFIALPPL

SEQ ID NO: 2016281 - protein, 30 aa, Staphylococcus
HIQVLLLTFFFKYMRPLVQAGRVFIALPPL

SEQ ID NO: 2016282 - protein, 19 aa, Staphylococcus
HIRDGLCDLIETYFGDVEI

SEQ ID NO: 2016283 - protein, 20 aa, Staphylococcus
HIRGLSPWPVAYTVMDDGNM

SEQ ID NO: 2016284 - protein, 26 aa, Staphylococcus
HIRQLMKFKSRSAINIDEVEPVEAIV

SEQ ID NO: 2016285 - protein, 25 aa, Staphylococcus
HIRTELRIRDDVPFITDNGNYILDC

SEQ ID NO: 2016286 - protein, 25 aa, Staphylococcus
HISEPMAKYFIKRAGVIIEGQEQFV

SEQ ID NO: 2016287 - protein, 22 aa, Staphylococcus
HISGGRVGWNLVTSMTDLEAKN

SEQ ID NO: 2016288 - protein, 25 aa, Staphylococcus
HISKIKNLRIGYLTQQMTLDSSLTV

SEQ ID NO: 2016289 - protein, 17 aa, Staphylococcus
HISKLPQALFMSTNQYY

SEQ ID NO: 2016290 - protein, 23 aa, Staphylococcus
HISPCSGVICGMGESDEDIIDMA

SEQ ID NO: 2016291 - protein, 22 aa, Staphylococcus
HISPCSGVICGMGESNEDIIDM

SEQ ID NO: 2016292 - protein, 22 aa, Staphylococcus
HISPCSGVICGMGETNEDIIDM

SEQ ID NO: 2016293 - protein, 27 aa, Staphylococcus
HITGEDYFRLGIPFSTRNNSEDFKKMG

SEQ ID NO: 2016294 - protein, 21 aa, Staphylococcus
HIVDLALQKEVDFIIIAGDLF

SEQ ID NO: 2016295 - protein, 18 aa, Staphylococcus
HIVFDVMLASYIIDPSRT

SEQ ID NO: 2016296 - protein, 17 aa, Staphylococcus
HIVRQGLEFLLSTVEDL

SEQ ID NO: 2016297 - protein, 17 aa, Staphylococcus
HIVRQGLEFLLSTVEEF

SEQ ID NO: 2016298 - protein, 19 aa, Staphylococcus
HIVSAWNPTEIETMALPPC

SEQ ID NO: 2016299 - protein, 32 aa, Staphylococcus
HIVSIDFFTIVKWEISGTLNYMKPREFCLVSV

SEQ ID NO: 2016300 - protein, 19 aa, Staphylococcus
HIYQSFGLKHLKLVINSIG

SEQ ID NO: 2016301 - protein, 17 aa, Staphylococcus
HKAEFDFLTDTQKNGSE

SEQ ID NO: 2016302 - protein, 25 aa, Staphylococcus
HKAKTGALLKFSILSAADIANVNKE

SEQ ID NO: 2016303 - protein, 21 aa, Staphylococcus
HKALKQFGFMVNFDEVVLEGY

SEQ ID NO: 2016304 - protein, 18 aa, Staphylococcus
HKAPELLEHTLYIMEAGD

SEQ ID NO: 2016305 - protein, 19 aa, Staphylococcus
HKARIDTIRKVADRLGKTI

SEQ ID NO: 2016306 - protein, 18 aa, Staphylococcus
HKDCVFLVDTFHTLKSGV

SEQ ID NO: 2016307 - protein, 20 aa, Staphylococcus
HKDIGWEIFTDEVIRTISEE

SEQ ID NO: 2016308 - protein, 36 aa, Staphylococcus
HKDRAEFLIRVAAIIRRRKEEISAVMVYEAGKPWDE

SEQ ID NO: 2016309 - protein, 21 aa, Staphylococcus
HKDVDILICDTAGRLQNKANL

SEQ ID NO: 2016310 - protein, 21 aa, Staphylococcus
HKECKWTGMCGEMAGDATAVP

SEQ ID NO: 2016311 - protein, 19 aa, Staphylococcus
HKEDILPMDIIVIARQPAK

SEQ ID NO: 2016312 - protein, 18 aa, Staphylococcus
HKEFQRRDQEVFDNITED

SEQ ID NO: 2016313 - protein, 20 aa, Staphylococcus
HKEGKWTGMCGEMAGDEIAI

SEQ ID NO: 2016314 - protein, 21 aa, Staphylococcus
HKEGKWTGMCGEMAGDETAIP

SEQ ID NO: 2016315 - protein, 25 aa, Staphylococcus
HKELSFGKNFGVVIEEMRLLNRAVF

SEQ ID NO: 2016316 - protein, 25 aa, Staphylococcus
HKESILKWLEQTGIDPKRRGETLSI

SEQ ID NO: 2016317 - protein, 23 aa, Staphylococcus
HKFAGGKGINVSRVLSTLEIPST

SEQ ID NO: 2016318 - protein, 19 aa, Staphylococcus
HKFDAFKNWFKEDVHFNTY

SEQ ID NO: 2016319 - protein, 17 aa, Staphylococcus
HKFDSLIEEAFKQLATT

SEQ ID NO: 2016320 - protein, 18 aa, Staphylococcus
HKFERGFIQIKLDVKKGK

SEQ ID NO: 2016321 - protein, 25 aa, Staphylococcus
HKFGGPKGAGILLVKDHTPLEFNQL

SEQ ID NO: 2016322 - protein, 21 aa, Staphylococcus
HKFGGPKGVGILLVKEKTPIR

SEQ ID NO: 2016323 - protein, 20 aa, Staphylococcus
HKFGGPKGVGVLLLKEETKL

SEQ ID NO: 2016324 - protein, 20 aa, Staphylococcus
HKFSEGIFEYTHHDLGETIA

SEQ ID NO: 2016325 - protein, 20 aa, Staphylococcus
HKFYDEFCQFGRNGDASETV

SEQ ID NO: 2016326 - protein, 28 aa, Staphylococcus
HKGHRLIQLPDKWYKGIVMPTIQSQHLF

SEQ ID NO: 2016327 - protein, 21 aa, Staphylococcus
HKGKHIITSKIEHHSVLHVFE

SEQ ID NO: 2016328 - protein, 22 aa, Staphylococcus
HKGKMALRVYPTWEEDLNPSAA

SEQ ID NO: 2016329 - protein, 24 aa, Staphylococcus
HKGSMPMELFLRLKKQEQADRLMI

SEQ ID NO: 2016330 - protein, 21 aa, Staphylococcus
HKGYGTSLLEKGLQEFESEYD

SEQ ID NO: 2016331 - protein, 23 aa, Staphylococcus
HKHGKELLVDMIAVQDLETRAKE

SEQ ID NO: 2016332 - protein, 20 aa, Staphylococcus
HKHHIPWVYGAAVGSKGTVY

SEQ ID NO: 2016333 - protein, 19 aa, Staphylococcus
HKHKPEIEQYLSLLAQQEV

SEQ ID NO: 2016334 - protein, 19 aa, Staphylococcus
HKIAHIDFIDRQVIQECLG

SEQ ID NO: 2016335 - protein, 21 aa, Staphylococcus
HKIERHEFNMYGYLHRISNFS

SEQ ID NO: 2016336 - protein, 19 aa, Staphylococcus
HKIGALGIVNGENLGQVAS

SEQ ID NO: 2016337 - protein, 20 aa, Staphylococcus
HKIKSIGVAHANVLDFVDKL

SEQ ID NO: 2016338 - protein, 17 aa, Staphylococcus
HKINPLWRIYSLVRFSK

SEQ ID NO: 2016339 - protein, 21 aa, Staphylococcus
HKIPPTIISRAQRFDFKAIGT

SEQ ID NO: 2016340 - protein, 20 aa, Staphylococcus
HKIPPTIISRAQRFDFKAIN

SEQ ID NO: 2016341 - protein, 21 aa, Staphylococcus
HKIPPTIISRAQRFDFKAISM

SEQ ID NO: 2016342 - protein, 21 aa, Staphylococcus
HKIPPTIISRAQRFDFKAIST

SEQ ID NO: 2016343 - protein, 23 aa, Staphylococcus
HKISDLFLERIDKLLNYPETCPH

SEQ ID NO: 2016344 - protein, 23 aa, Staphylococcus
HKKLDEIYVNYDLFVSASTSEGF

SEQ ID NO: 2016345 - protein, 18 aa, Staphylococcus
HKKVTEGIDNLIIDKKYD

SEQ ID NO: 2016346 - protein, 22 aa, Staphylococcus
HKLAEIKWKELGQHVSQIVPLD

SEQ ID NO: 2016347 - protein, 22 aa, Staphylococcus
HKLDRPGYFYAPTVLDHVKQTD

SEQ ID NO: 2016348 - protein, 24 aa, Staphylococcus
HKLFERGILLGYLQGRRQMIHAVE

SEQ ID NO: 2016349 - protein, 18 aa, Staphylococcus
HKLKKRMGYHVLKYPLNL

SEQ ID NO: 2016350 - protein, 17 aa, Staphylococcus
HKLKPKRFMEVAEFNDI

SEQ ID NO: 2016351 - protein, 22 aa, Staphylococcus
HKLPDVKWKDLGQHISQLVPIE

SEQ ID NO: 2016352 - protein, 18 aa, Staphylococcus
HKLQSYPYVSFIPVNEVV

SEQ ID NO: 2016353 - protein, 19 aa, Staphylococcus
HKLRHTFATHMLNEGADLR

SEQ ID NO: 2016354 - protein, 25 aa, Staphylococcus
HKLRYCENCGDVIRPDIVLYGEMLD

SEQ ID NO: 2016355 - protein, 27 aa, Staphylococcus
HKLSKDELKEIVTMMVNKLTLRLSEQN

SEQ ID NO: 2016356 - protein, 26 aa, Staphylococcus
HKLSKDELKEIVTMMVNKLTQRLSEQ

SEQ ID NO: 2016357 - protein, 26 aa, Staphylococcus
HKLSKDELKQIVTMMVNKLTNRLSEQ

SEQ ID NO: 2016358 - protein, 27 aa, Staphylococcus
HKLTKDELKEIVTMMVNKLTKRLSEQD

SEQ ID NO: 2016359 - protein, 17 aa, Staphylococcus
HKLYYPKELILNIDNLE

SEQ ID NO: 2016360 - protein, 25 aa, Staphylococcus
HKMTKIDFFFLNKFQNIINIEHELK

SEQ ID NO: 2016361 - protein, 18 aa, Staphylococcus
HKNAAGIIYCSTRKQVEE

SEQ ID NO: 2016362 - protein, 19 aa, Staphylococcus
HKNIGWELFTDEVIKAISD

SEQ ID NO: 2016363 - protein, 23 aa, Staphylococcus
HKNINGLFLKNGEWTRMVTEFPD

SEQ ID NO: 2016364 - protein, 20 aa, Staphylococcus
HKNKKILLLTAHRRENLGEP

SEQ ID NO: 2016365 - protein, 18 aa, Staphylococcus
HKNLEIFEGDLGNLDSLK

SEQ ID NO: 2016366 - protein, 17 aa, Staphylococcus
HKPDLPVALQTIQVLFN

SEQ ID NO: 2016367 - protein, 19 aa, Staphylococcus
HKPKLIVAGASAYSRTIDF

SEQ ID NO: 2016368 - protein, 20 aa, Staphylococcus
HKPRFAGSKPFNVVMTPSDK

SEQ ID NO: 2016369 - protein, 24 aa, Staphylococcus
HKPVKNFRIRKSVGTERTFATDIN

SEQ ID NO: 2016370 - protein, 19 aa, Staphylococcus
HKQAFLIGGGHDIAYAQYL

SEQ ID NO: 2016371 - protein, 33 aa, Staphylococcus
HKQDIINNIHLIRANAYLVIMVVVFTSGHVEHL

SEQ ID NO: 2016372 - protein, 20 aa, Staphylococcus
HKQTFLLGGGHDIAYAQYLA

SEQ ID NO: 2016373 - protein, 21 aa, Staphylococcus
HKRANVRTVIVKFDDLEHVIN

SEQ ID NO: 2016374 - protein, 19 aa, Staphylococcus
HKRFTLVFFNNIENMIKIS

SEQ ID NO: 2016375 - protein, 23 aa, Staphylococcus
HKRTKFLPELQFAILDEVDSIIL

SEQ ID NO: 2016376 - protein, 24 aa, Staphylococcus
HKRWSRAEMGQFIMGGQRYNDENG

SEQ ID NO: 2016377 - protein, 19 aa, Staphylococcus
HKRYKVMNIPIVPEINPPE

SEQ ID NO: 2016378 - protein, 19 aa, Staphylococcus
HKSAVIWFTGLSGSGKSTV

SEQ ID NO: 2016379 - protein, 25 aa, Staphylococcus
HKSDDEWRAYGLNHFVLPEVLISTE

SEQ ID NO: 2016380 - protein, 21 aa, Staphylococcus
HKSDDEWRQFGLNHFVLPKVL

SEQ ID NO: 2016381 - protein, 26 aa, Staphylococcus
HKSKVTFDLPIVWAQSTRYLNSQDSD

SEQ ID NO: 2016382 - protein, 18 aa, Staphylococcus
HKSLFFYTTLTYKPSHCD

SEQ ID NO: 2016383 - protein, 21 aa, Staphylococcus
HKSLRIYDGLNHELLNVSSYR

SEQ ID NO: 2016384 - protein, 18 aa, Staphylococcus
HKSVVIWFTGLSGSGKST

SEQ ID NO: 2016385 - protein, 22 aa, Staphylococcus
HKSVYISALVKDGGRPVYMQTA

SEQ ID NO: 2016386 - protein, 18 aa, Staphylococcus
HKSYTICVNNYRAVGGGN

SEQ ID NO: 2016387 - protein, 20 aa, Staphylococcus
HKTIVYKGWLRSDQIKGLYL

SEQ ID NO: 2016388 - protein, 24 aa, Staphylococcus
HKTLRGPRGGLILCKEKYKKEIDK

SEQ ID NO: 2016389 - protein, 25 aa, Staphylococcus
HKTLRGPRGGMILCKEEYKKAIDKT

SEQ ID NO: 2016390 - protein, 22 aa, Staphylococcus
HKTLRGPRGGMILTKEEYAKQI

SEQ ID NO: 2016391 - protein, 23 aa, Staphylococcus
HKTPKKRGYFFAMWCKDDDNNNR

SEQ ID NO: 2016392 - protein, 17 aa, Staphylococcus
HKTVFLKDMEEMGFSKS

SEQ ID NO: 2016393 - protein, 20 aa, Staphylococcus
HKVESLRASYYMMGAMLGRF

SEQ ID NO: 2016394 - protein, 18 aa, Staphylococcus
HKVMDAKEKLGYFPNKNA

SEQ ID NO: 2016395 - protein, 21 aa, Staphylococcus
HKVVKEGGSIIMLSECSDGYP

SEQ ID NO: 2016396 - protein, 22 aa, Staphylococcus
HKVWRKHVMKHMRVKEGSQALD

SEQ ID NO: 2016397 - protein, 22 aa, Staphylococcus
HKYDHPDRIHLAQIIAQATNQL

SEQ ID NO: 2016398 - protein, 17 aa, Staphylococcus
HKYDLYEANIWSLFDEI

SEQ ID NO: 2016399 - protein, 19 aa, Staphylococcus
HKYLPLLHRYTKLRQELLG

SEQ ID NO: 2016400 - protein, 21 aa, Staphylococcus
HKYVLRIGKELERGIEGYSLY

SEQ ID NO: 2016401 - protein, 24 aa, Staphylococcus
HLAARQGLPYVFAGHFAPQQMKEA

SEQ ID NO: 2016402 - protein, 25 aa, Staphylococcus
HLAKRLKEQLFLVAEEEGIIVGFAN

SEQ ID NO: 2016403 - protein, 17 aa, Staphylococcus
HLANPNLPFGGIGASGI

SEQ ID NO: 2016404 - protein, 18 aa, Staphylococcus
HLARCIRDYVNGGLVKVL

SEQ ID NO: 2016405 - protein, 20 aa, Staphylococcus
HLATAIAIAMKARKLILMTD

SEQ ID NO: 2016406 - protein, 18 aa, Staphylococcus
HLCVELGYIQRKHRQNYK

SEQ ID NO: 2016407 - protein, 23 aa, Staphylococcus
HLDELFILGLIYLYPNAYNMAQL

SEQ ID NO: 2016408 - protein, 23 aa, Staphylococcus
HLDEYFKHLNIHPNIVLETDRFE

SEQ ID NO: 2016409 - protein, 21 aa, Staphylococcus
HLDIKFSEFKIDTMSITAHKF

SEQ ID NO: 2016410 - protein, 23 aa, Staphylococcus
HLDIPAGAAVRFEPGDEKEVQLV

SEQ ID NO: 2016411 - protein, 22 aa, Staphylococcus
HLDIPAGAAVRFEPGDEKKVQL

SEQ ID NO: 2016412 - protein, 21 aa, Staphylococcus
HLDIPAGAAVRFEPGDVKQVQ

SEQ ID NO: 2016413 - protein, 26 aa, Staphylococcus
HLDMYFWKPNWQMMRYDEQIKIHKQL

SEQ ID NO: 2016414 - protein, 17 aa, Staphylococcus
HLDRGYVDLHGKLEALG

SEQ ID NO: 2016415 - protein, 18 aa, Staphylococcus
HLDRGYVNFHEKLKSLGA

SEQ ID NO: 2016416 - protein, 18 aa, Staphylococcus
HLDRGYVNFHGKLKELGA

SEQ ID NO: 2016417 - protein, 17 aa, Staphylococcus
HLDRGYVNFNGKLKSLG

SEQ ID NO: 2016418 - protein, 17 aa, Staphylococcus
HLDRGYVNLHGKLKDLG

SEQ ID NO: 2016419 - protein, 25 aa, Staphylococcus
HLDRKLSERRIFPAIDIARSSTRKE

SEQ ID NO: 2016420 - protein, 22 aa, Staphylococcus
HLDTDLFFRNIKKLDDAKIDAV

SEQ ID NO: 2016421 - protein, 19 aa, Staphylococcus
HLDVYKGFEQGAVDYIKKP

SEQ ID NO: 2016422 - protein, 18 aa, Staphylococcus
HLEALLAQVSIKPVINQV

SEQ ID NO: 2016423 - protein, 21 aa, Staphylococcus
HLEERWKEMGYFNPITRILGY

SEQ ID NO: 2016424 - protein, 25 aa, Staphylococcus
HLEGIKRLGIIPEHRKSFEPIKSIV

SEQ ID NO: 2016425 - protein, 22 aa, Staphylococcus
HLEKKRVVIFAAGIGNPYFSTD

SEQ ID NO: 2016426 - protein, 23 aa, Staphylococcus
HLEKQTAFNFFSLFNFNEPVSKV

SEQ ID NO: 2016427 - protein, 24 aa, Staphylococcus
HLELYKAWPEIGGIVHTHSTEAVG

SEQ ID NO: 2016428 - protein, 23 aa, Staphylococcus
HLEMHGKTPISIDYYRASIGGAA

SEQ ID NO: 2016429 - protein, 23 aa, Staphylococcus
HLENRIVQFYTDLNTDGRFLNVG

SEQ ID NO: 2016430 - protein, 25 aa, Staphylococcus
HLERYKVPMRWIKVPHMIWTSSGKI

SEQ ID NO: 2016431 - protein, 27 aa, Staphylococcus
HLESRRLPGRHYAKFNLHGEIDYAVNE

SEQ ID NO: 2016432 - protein, 18 aa, Staphylococcus
HLESRYLPSRQYAKFNLQ

SEQ ID NO: 2016433 - protein, 29 aa, Staphylococcus
HLETSPRYIYCGTIGLLLPDDKMIFNIPI

SEQ ID NO: 2016434 - protein, 21 aa, Staphylococcus
HLFDHGVCLPSGSDMTDEQQT

SEQ ID NO: 2016435 - protein, 25 aa, Staphylococcus
HLFSEKDLDAIVVLSDYNRRYLSGF

SEQ ID NO: 2016436 - protein, 25 aa, Staphylococcus
HLFSKAAPLSAVFDVQSLLDIEWND

SEQ ID NO: 2016437 - protein, 23 aa, Staphylococcus
HLFSKAAPMSAVFQAQTLIDLEW

SEQ ID NO: 2016438 - protein, 27 aa, Staphylococcus
HLFTGYEVLNTFTFRITRNADLTIHED

SEQ ID NO: 2016439 - protein, 24 aa, Staphylococcus
HLGEGKKSIAIRLNYLDTENTLTD

SEQ ID NO: 2016440 - protein, 17 aa, Staphylococcus
HLGSGGLGLGCFGKKIS

SEQ ID NO: 2016441 - protein, 24 aa, Staphylococcus
HLHFIEGRHAYQLFYALDSSMHVE

SEQ ID NO: 2016442 - protein, 20 aa, Staphylococcus
HLHHPFSIQSDYVFYSGSLL

SEQ ID NO: 2016443 - protein, 19 aa, Staphylococcus
HLHHPILCANIFDHNNAPL

SEQ ID NO: 2016444 - protein, 19 aa, Staphylococcus
HLHLKGIHFHVGSQIEGTE

SEQ ID NO: 2016445 - protein, 18 aa, Staphylococcus
HLHPQKKHEGLFIINQQL

SEQ ID NO: 2016446 - protein, 18 aa, Staphylococcus
HLHQYPELSLHEFETTKY

SEQ ID NO: 2016447 - protein, 19 aa, Staphylococcus
HLHVMGGLQERIWNPLQIM

SEQ ID NO: 2016448 - protein, 26 aa, Staphylococcus
HLHYLRPKLLIDFEKQLFIFKDKKYA

SEQ ID NO: 2016449 - protein, 19 aa, Staphylococcus
HLIEAAAYNVARKNQDVKL

SEQ ID NO: 2016450 - protein, 19 aa, Staphylococcus
HLIEATAYNVARKNKDVRL

SEQ ID NO: 2016451 - protein, 19 aa, Staphylococcus
HLIEATAYNVARKNKNVRL

SEQ ID NO: 2016452 - protein, 18 aa, Staphylococcus
HLIEMTGVSAVQVDMDSN

SEQ ID NO: 2016453 - protein, 17 aa, Staphylococcus
HLIKYMLSMFIPEDAIM

SEQ ID NO: 2016454 - protein, 25 aa, Staphylococcus
HLIPETRKSTILNQKRVGDPVHLET

SEQ ID NO: 2016455 - protein, 23 aa, Staphylococcus
HLIPETRRSTILADKKQGDFVHL

SEQ ID NO: 2016456 - protein, 23 aa, Staphylococcus
HLIPETRRSTILSNKKMGDEVHL

SEQ ID NO: 2016457 - protein, 25 aa, Staphylococcus
HLIPETRRSTILSSKKVGDNVHLES

SEQ ID NO: 2016458 - protein, 24 aa, Staphylococcus
HLIPETRRSTILSSKQNGDQVHLE

SEQ ID NO: 2016459 - protein, 18 aa, Staphylococcus
HLIPYFKSIDVFEMTTQD

SEQ ID NO: 2016460 - protein, 26 aa, Staphylococcus
HLIQSHAVEGFILLYSKENDEIANLL

SEQ ID NO: 2016461 - protein, 17 aa, Staphylococcus
HLITRPTQFDVIVTENL

SEQ ID NO: 2016462 - protein, 19 aa, Staphylococcus
HLIVVPMFLYDGRLVNKVK

SEQ ID NO: 2016463 - protein, 18 aa, Staphylococcus
HLKDWSLNRLLKTDRIIL

SEQ ID NO: 2016464 - protein, 24 aa, Staphylococcus
HLKEDAKFIFLDFIASENIQTLTA

SEQ ID NO: 2016465 - protein, 21 aa, Staphylococcus
HLKEPKCKVKEELDVGNIAQF

SEQ ID NO: 2016466 - protein, 22 aa, Staphylococcus
HLKHLRVSKILGTPKQRLAALN

SEQ ID NO: 2016467 - protein, 25 aa, Staphylococcus
HLKKLKEVVARLSIEEFKTMLIDES

SEQ ID NO: 2016468 - protein, 25 aa, Staphylococcus
HLKKRLKEQLFLVAEEDDEIIGFAN

SEQ ID NO: 2016469 - protein, 18 aa, Staphylococcus
HLKNEIREAKSFYHLGPV

SEQ ID NO: 2016470 - protein, 20 aa, Staphylococcus
HLKSQFESLGLLVQEDNASK

SEQ ID NO: 2016471 - protein, 19 aa, Staphylococcus
HLKTLPVRFKQATANAERL

SEQ ID NO: 2016472 - protein, 18 aa, Staphylococcus
HLKTLPVRFNQSVENTKK

SEQ ID NO: 2016473 - protein, 19 aa, Staphylococcus
HLKTLPVRFRQSTSNAEKL

SEQ ID NO: 2016474 - protein, 24 aa, Staphylococcus
HLLARAVARDVGRIIGFDEKTLNE

SEQ ID NO: 2016475 - protein, 28 aa, Staphylococcus
HLLARAVARDVGRIMGFDEITLAEISKL

SEQ ID NO: 2016476 - protein, 27 aa, Staphylococcus
HLLARAVGRDVGRIMGFDETTLNEISK

SEQ ID NO: 2016477 - protein, 20 aa, Staphylococcus
HLLIQWYSKGIYKFRYLIIE

SEQ ID NO: 2016478 - protein, 24 aa, Staphylococcus
HLLNEMPKAWVVIAKPNVGISTAC

SEQ ID NO: 2016479 - protein, 25 aa, Staphylococcus
HLLNHGIPSYGYRIESPTTPGTIDV

SEQ ID NO: 2016480 - protein, 21 aa, Staphylococcus
HLLNVFSYTGAFSVVSATKAK

SEQ ID NO: 2016481 - protein, 23 aa, Staphylococcus
HLLPRTGAYHEIWLDGEKVLDSS

SEQ ID NO: 2016482 - protein, 19 aa, Staphylococcus
HLLSLLSAEGVQWIVLAGY

SEQ ID NO: 2016483 - protein, 26 aa, Staphylococcus
HLMIPCKPDHPFVYWATFANAAQLLE

SEQ ID NO: 2016484 - protein, 23 aa, Staphylococcus
HLMNLKELFLVQLQERSIPFEVN

SEQ ID NO: 2016485 - protein, 17 aa, Staphylococcus
HLMNLKNLFLVSLQERS

SEQ ID NO: 2016486 - protein, 25 aa, Staphylococcus
HLMSRVRRYPIPLVLEISNIDSVMP

SEQ ID NO: 2016487 - protein, 25 aa, Staphylococcus
HLMSRVRRYPLPLVLEISNIESIIP

SEQ ID NO: 2016488 - protein, 17 aa, Staphylococcus
HLMVSKVKGAFEKFDVN

SEQ ID NO: 2016489 - protein, 17 aa, Staphylococcus
HLMVSKVKGSFTQFNAE

SEQ ID NO: 2016490 - protein, 23 aa, Staphylococcus
HLNEHLKRIGGHIGYGVRPDYRG

SEQ ID NO: 2016491 - protein, 26 aa, Staphylococcus
HLNERLKLQLFDEVRTVFNAQMTKNK

SEQ ID NO: 2016492 - protein, 25 aa, Staphylococcus
HLNERLKLQLQDEVKSIYNGQMTKN

SEQ ID NO: 2016493 - protein, 21 aa, Staphylococcus
HLNLIDCAIFNLGYLPKGDKS

SEQ ID NO: 2016494 - protein, 20 aa, Staphylococcus
HLNNICYRIKLNEPNAYQKF

SEQ ID NO: 2016495 - protein, 20 aa, Staphylococcus
HLNNRLNLQLLDEVKSVYNS

SEQ ID NO: 2016496 - protein, 18 aa, Staphylococcus
HLNPLWVTAYDDYPMQSI

SEQ ID NO: 2016497 - protein, 25 aa, Staphylococcus
HLNTFARIPVCGAISTYNADEPEYE

SEQ ID NO: 2016498 - protein, 18 aa, Staphylococcus
HLNVLYAIIDYHKTNHQG

SEQ ID NO: 2016499 - protein, 17 aa, Staphylococcus
HLPEALIAQTPLKNRDE

SEQ ID NO: 2016500 - protein, 20 aa, Staphylococcus
HLPVSYRITAQRPIDMIYPI

SEQ ID NO: 2016501 - protein, 20 aa, Staphylococcus
HLQNILPIPVIGVIEPGART

SEQ ID NO: 2016502 - protein, 19 aa, Staphylococcus
HLQPLGVKNYIVEPEGSIL

SEQ ID NO: 2016503 - protein, 20 aa, Staphylococcus
HLQTLLPIPVIGVIEPGART

SEQ ID NO: 2016504 - protein, 23 aa, Staphylococcus
HLRLLYKNEVLDFYKEGKMAYYF

SEQ ID NO: 2016505 - protein, 31 aa, Staphylococcus
HLRVKKFGGYYIECHLLSKIQFIYKILHEIH

SEQ ID NO: 2016506 - protein, 21 aa, Staphylococcus
HLSCLKGCGLVNSRQEGKYVY

SEQ ID NO: 2016507 - protein, 22 aa, Staphylococcus
HLSELYGAYIHSFVSKFKDKHV

SEQ ID NO: 2016508 - protein, 24 aa, Staphylococcus
HLSILPEVFKAFEGLYNQYYNQDF

SEQ ID NO: 2016509 - protein, 19 aa, Staphylococcus
HLSKSLKLARDLYNNGERN

SEQ ID NO: 2016510 - protein, 18 aa, Staphylococcus
HLSQLQALVKRRYQLNVS

SEQ ID NO: 2016511 - protein, 18 aa, Staphylococcus
HLSQYGIEIARVTPKSIT

SEQ ID NO: 2016512 - protein, 17 aa, Staphylococcus
HLTELHGAPGFEDDIKA

SEQ ID NO: 2016513 - protein, 19 aa, Staphylococcus
HLTGKPVIESRAFKDGLIS

SEQ ID NO: 2016514 - protein, 35 aa, Staphylococcus
HLTNELLQRFKFDKAFISCGSFDKNDCYEFDLEEA

SEQ ID NO: 2016515 - protein, 19 aa, Staphylococcus
HLVIIGGGYIALEFASMFA

SEQ ID NO: 2016516 - protein, 23 aa, Staphylococcus
HLVKAKRAGQSMIYSLDDQHVAT

SEQ ID NO: 2016517 - protein, 24 aa, Staphylococcus
HLVRPDLPASRIAQYIRRDIYEAT

SEQ ID NO: 2016518 - protein, 21 aa, Staphylococcus
HLVVTIPVFLSDSVQITPVEI

SEQ ID NO: 2016519 - protein, 20 aa, Staphylococcus
HLYELEIRDLVTLMYEIEDD

SEQ ID NO: 2016520 - protein, 24 aa, Staphylococcus
HLYFDDYLLIWAPNHHHLKQLHRV

SEQ ID NO: 2016521 - protein, 21 aa, Staphylococcus
HLYFTEFDFPKALTKDELSEQ

SEQ ID NO: 2016522 - protein, 19 aa, Staphylococcus
HLYGKLEALEPFEAAEIKK

SEQ ID NO: 2016523 - protein, 18 aa, Staphylococcus
HLYHDFAKDMPIYDYHCH

SEQ ID NO: 2016524 - protein, 19 aa, Staphylococcus
HLYPLKTKWDIHIIDIFNN

SEQ ID NO: 2016525 - protein, 27 aa, Staphylococcus
HLYQIPCTCLRFFNIYGPRQNPTSDYS

SEQ ID NO: 2016526 - protein, 17 aa, Staphylococcus
HMASLRKKLNYSEDDAH

SEQ ID NO: 2016527 - protein, 23 aa, Staphylococcus
HMDPCKIWRSKGESALHYQTKYT

SEQ ID NO: 2016528 - protein, 18 aa, Staphylococcus
HMDYRLKGIAFDLLEYAL

SEQ ID NO: 2016529 - protein, 25 aa, Staphylococcus
HMEKEKPDVIVIAGDLYDTSYPSKE

SEQ ID NO: 2016530 - protein, 20 aa, Staphylococcus
HMFQYLPNFFQNRSSEDNMY

SEQ ID NO: 2016531 - protein, 23 aa, Staphylococcus
HMHKGKHIITTKIEHHSVLHVFE

SEQ ID NO: 2016532 - protein, 25 aa, Staphylococcus
HMIKEGFIDPKYKALAPLCATPESL

SEQ ID NO: 2016533 - protein, 26 aa, Staphylococcus
HMIQLGLFNHIPFFESIDMNKFIVTE

SEQ ID NO: 2016534 - protein, 20 aa, Staphylococcus
HMKMAPKHWLSIKEDDLVWA

SEQ ID NO: 2016535 - protein, 25 aa, Staphylococcus
HMLNHGIPSFGYRIEAPYTSGKIDV

SEQ ID NO: 2016536 - protein, 24 aa, Staphylococcus
HMNVPYELGVLISKKKYWYKSPDF

SEQ ID NO: 2016537 - protein, 24 aa, Staphylococcus
HMPSHCPSCEHELVRIEGEVALRC

SEQ ID NO: 2016538 - protein, 29 aa, Staphylococcus
HMPTHCPSCGHELVRIEGEVALRCINPKC

SEQ ID NO: 2016539 - protein, 33 aa, Staphylococcus
HMQSIRVTDRLMQICRNIAPAVVTFFATPYYPA

SEQ ID NO: 2016540 - protein, 18 aa, Staphylococcus
HMSLSFQFVENIASGKMK

SEQ ID NO: 2016541 - protein, 18 aa, Staphylococcus
HMTPSINFDPILKSIIRE

SEQ ID NO: 2016542 - protein, 21 aa, Staphylococcus
HMWSQTMLDQFAIEVKNGALV

SEQ ID NO: 2016543 - protein, 23 aa, Staphylococcus
HMYKDDVKIMSWSPMAGGKLFDL

SEQ ID NO: 2016544 - protein, 19 aa, Staphylococcus
HMYREMAKEGIFLPPSQFE

SEQ ID NO: 2016545 - protein, 17 aa, Staphylococcus
HMYRQLLGMDIGNYSVF

SEQ ID NO: 2016546 - protein, 26 aa, Staphylococcus
HNAGMKFPMKSFEDMEWNEFIHKTDD

SEQ ID NO: 2016547 - protein, 19 aa, Staphylococcus
HNANIATCWFNYRNKTNST

SEQ ID NO: 2016548 - protein, 20 aa, Staphylococcus
HNEILKVLANYSVPIATGER

SEQ ID NO: 2016549 - protein, 19 aa, Staphylococcus
HNESGILYHVFEKHQDADA

SEQ ID NO: 2016550 - protein, 18 aa, Staphylococcus
HNETCFILAQNGYGLLPQ

SEQ ID NO: 2016551 - protein, 17 aa, Staphylococcus
HNFASGLSYHVLTMLEI

SEQ ID NO: 2016552 - protein, 17 aa, Staphylococcus
HNFASGLSYHVLTMLKV

SEQ ID NO: 2016553 - protein, 17 aa, Staphylococcus
HNFASGLSYHVLTMLRI

SEQ ID NO: 2016554 - protein, 19 aa, Staphylococcus
HNFASGLSYHVLTMLRIAK

SEQ ID NO: 2016555 - protein, 17 aa, Staphylococcus
HNFASGLSYHVLTMLRV

SEQ ID NO: 2016556 - protein, 23 aa, Staphylococcus
HNFDNSNGRWVRNFNEKLTSEQI

SEQ ID NO: 2016557 - protein, 23 aa, Staphylococcus
HNFLLETRFLFFVVKDESEGPVF

SEQ ID NO: 2016558 - protein, 23 aa, Staphylococcus
HNFYPQQYTGLSFNHFQKTSESF

SEQ ID NO: 2016559 - protein, 17 aa, Staphylococcus
HNIDPIFQIGKAGINDN

SEQ ID NO: 2016560 - protein, 17 aa, Staphylococcus
HNIIFASARPIRDLIPV

SEQ ID NO: 2016561 - protein, 23 aa, Staphylococcus
HNIKATDIMKHWPTHPNNPYKGY

SEQ ID NO: 2016562 - protein, 17 aa, Staphylococcus
HNIKRLQASVVPENTHA

SEQ ID NO: 2016563 - protein, 20 aa, Staphylococcus
HNIMLKNIITYLIEHIDNHR

SEQ ID NO: 2016564 - protein, 17 aa, Staphylococcus
HNIPFEIVPGITSGIAA

SEQ ID NO: 2016565 - protein, 24 aa, Staphylococcus
HNKGVAPGKPWKNGPVPMDKAIYG

SEQ ID NO: 2016566 - protein, 17 aa, Staphylococcus
HNKRPHYGLQYHPESFA

SEQ ID NO: 2016567 - protein, 19 aa, Staphylococcus
HNLFLLLCNGVSFEKAGSI

SEQ ID NO: 2016568 - protein, 24 aa, Staphylococcus
HNLLSLKIFNYIPFFNELDMTCVY

SEQ ID NO: 2016569 - protein, 24 aa, Staphylococcus
HNLNEFSKHLGLMFQIKDDLLDVY

SEQ ID NO: 2016570 - protein, 24 aa, Staphylococcus
HNLTEIRKHIGIVFQNPENQFVGS

SEQ ID NO: 2016571 - protein, 21 aa, Staphylococcus
HNMVKQLYSPVQFIKSTEWLI

SEQ ID NO: 2016572 - protein, 19 aa, Staphylococcus
HNNDVFKPFMHPLVIDLSL

SEQ ID NO: 2016573 - protein, 25 aa, Staphylococcus
HNPANLMGIRAFRKLLPGIPHVAVF

SEQ ID NO: 2016574 - protein, 24 aa, Staphylococcus
HNPANLMGIRAFRKLLPNIPHVAV

SEQ ID NO: 2016575 - protein, 24 aa, Staphylococcus
HNPANLMGVRAFRKLLPNIPHVVV

SEQ ID NO: 2016576 - protein, 18 aa, Staphylococcus
HNPFDLTKVWYKDDYPLI

SEQ ID NO: 2016577 - protein, 18 aa, Staphylococcus
HNPNRWLASFQWHQPNST

SEQ ID NO: 2016578 - protein, 25 aa, Staphylococcus
HNQDKILICGDLFISDAQHLHIPIK

SEQ ID NO: 2016579 - protein, 19 aa, Staphylococcus
HNQLSYGLTHVDIYQPNAE

SEQ ID NO: 2016580 - protein, 17 aa, Staphylococcus
HNRMRMVVSQFLTKDLF

SEQ ID NO: 2016581 - protein, 20 aa, Staphylococcus
HNRRDLGGLIFVDLRDREGY

SEQ ID NO: 2016582 - protein, 19 aa, Staphylococcus
HNVDPTFQIGKAGINDNMV

SEQ ID NO: 2016583 - protein, 20 aa, Staphylococcus
HNVTRFLIVKNHTHFEDDTN

SEQ ID NO: 2016584 - protein, 20 aa, Staphylococcus
HNWGNYKLVFNTRHKANIET

SEQ ID NO: 2016585 - protein, 20 aa, Staphylococcus
HNWGNYKLVFNTRHNANIDT

SEQ ID NO: 2016586 - protein, 39 aa, Staphylococcus
HNWNLQLGDLAMIWRAGCIIRARFLQKIKDAYDNNSELQ

SEQ ID NO: 2016587 - protein, 25 aa, Staphylococcus
HNYYPRPDTGLALNLFEQRNNLIRK

SEQ ID NO: 2016588 - protein, 17 aa, Staphylococcus
HPACVHIEIGKGVCGTA

SEQ ID NO: 2016589 - protein, 20 aa, Staphylococcus
HPALLPKYKGIDAIGQAYES

SEQ ID NO: 2016590 - protein, 23 aa, Staphylococcus
HPANCLMARIGNRITLDQQQAFD

SEQ ID NO: 2016591 - protein, 29 aa, Staphylococcus
HPDCDKHHLRLCGGFQFSKHKSDDEWRAY

SEQ ID NO: 2016592 - protein, 19 aa, Staphylococcus
HPDYNFLESIGIEINTNEY

SEQ ID NO: 2016593 - protein, 22 aa, Staphylococcus
HPEFGDKVAKFIAENTGYPFVS

SEQ ID NO: 2016594 - protein, 18 aa, Staphylococcus
HPEFGDKVAKFISENTGY

SEQ ID NO: 2016595 - protein, 26 aa, Staphylococcus
HPEIKHGKIRVGFTPDEEIGRGPHQF

SEQ ID NO: 2016596 - protein, 25 aa, Staphylococcus
HPEIKHGRIRIAFTPDEEIGKGPHH

SEQ ID NO: 2016597 - protein, 26 aa, Staphylococcus
HPEIKHGRIRIAFTPDEEIGRGPHKF

SEQ ID NO: 2016598 - protein, 26 aa, Staphylococcus
HPEIKHGRIRVGFTPDEEIGRGPHKF

SEQ ID NO: 2016599 - protein, 25 aa, Staphylococcus
HPEKKRLPYSMLTASRLAKEKHVDW

SEQ ID NO: 2016600 - protein, 25 aa, Staphylococcus
HPENELSRLSQYLVEKDNYREPIEN

SEQ ID NO: 2016601 - protein, 26 aa, Staphylococcus
HPEVKHGRIRVAFTPDEEIGRGPHKF

SEQ ID NO: 2016602 - protein, 25 aa, Staphylococcus
HPFDFLSDVVYQWERFAKRFESFGT

SEQ ID NO: 2016603 - protein, 18 aa, Staphylococcus
HPFDSWQEYWAFESRFVV

SEQ ID NO: 2016604 - protein, 30 aa, Staphylococcus
HPFRVKLALRTSRQYELRQLMSIINACAET

SEQ ID NO: 2016605 - protein, 22 aa, Staphylococcus
HPGAQIGRRLFIDHGMGVVIGE

SEQ ID NO: 2016606 - protein, 17 aa, Staphylococcus
HPHKITIFVGDWRVVES

SEQ ID NO: 2016607 - protein, 23 aa, Staphylococcus
HPIAKAQLEYHFYQIVSHGAAIM

SEQ ID NO: 2016608 - protein, 17 aa, Staphylococcus
HPIALNWDAEALVTNHF

SEQ ID NO: 2016609 - protein, 18 aa, Staphylococcus
HPIEIIGVDIVREKDGLA

SEQ ID NO: 2016610 - protein, 22 aa, Staphylococcus
HPIKNLIHYFAIHRVGGIPCFF

SEQ ID NO: 2016611 - protein, 25 aa, Staphylococcus
HPILKSRFILDNGVYRQVIDKRKYE

SEQ ID NO: 2016612 - protein, 21 aa, Staphylococcus
HPKMMLKVILYVYTQSVFSGR

SEQ ID NO: 2016613 - protein, 22 aa, Staphylococcus
HPLEKLGRYLIDSFVNIDGTGN

SEQ ID NO: 2016614 - protein, 17 aa, Staphylococcus
HPLFRYLTSQAKGMLSE

SEQ ID NO: 2016615 - protein, 19 aa, Staphylococcus
HPLIHSGFAHETVKEKMEE

SEQ ID NO: 2016616 - protein, 20 aa, Staphylococcus
HPLQLADLVCHIIALLRYGG

SEQ ID NO: 2016617 - protein, 17 aa, Staphylococcus
HPLVNLLKQPTHLQLDY

SEQ ID NO: 2016618 - protein, 17 aa, Staphylococcus
HPMREFAKAQLLEDKQR

SEQ ID NO: 2016619 - protein, 22 aa, Staphylococcus
HPMSPLAKIFWMKHEQPEIFQH

SEQ ID NO: 2016620 - protein, 27 aa, Staphylococcus
HPNGIYLSGALLMFAGNKSYYLYGASS

SEQ ID NO: 2016621 - protein, 25 aa, Staphylococcus
HPNGKRWFTKDVFAVNVKKIESKQD

SEQ ID NO: 2016622 - protein, 21 aa, Staphylococcus
HPNLEFHVAALTEMSMKLLSL

SEQ ID NO: 2016623 - protein, 21 aa, Staphylococcus
HPNNQLHLFSEFLEEKDKLRE

SEQ ID NO: 2016624 - protein, 20 aa, Staphylococcus
HPQGELALRQQIAHYLFNSR

SEQ ID NO: 2016625 - protein, 22 aa, Staphylococcus
HPQGELYLRRAIADYIYEARGV

SEQ ID NO: 2016626 - protein, 27 aa, Staphylococcus
HPQKKGLRLALDWSNRVNELIGRLPSL

SEQ ID NO: 2016627 - protein, 20 aa, Staphylococcus
HPRFIEKAIHELTLEKSPNL

SEQ ID NO: 2016628 - protein, 20 aa, Staphylococcus
HPRMLERSFVLIPLNDIATN

SEQ ID NO: 2016629 - protein, 17 aa, Staphylococcus
HPSAYEVLYSVGEFNED

SEQ ID NO: 2016630 - protein, 18 aa, Staphylococcus
HPSIAAALEPFRKQFEIV

SEQ ID NO: 2016631 - protein, 19 aa, Staphylococcus
HPSLSEVLMELGLKVEGRA

SEQ ID NO: 2016632 - protein, 19 aa, Staphylococcus
HPSLSEVLMELGLKVENRS

SEQ ID NO: 2016633 - protein, 19 aa, Staphylococcus
HPSPLSAYRGFFGSKPYSR

SEQ ID NO: 2016634 - protein, 20 aa, Staphylococcus
HPTAAFVAARAGAMAKHTDH

SEQ ID NO: 2016635 - protein, 17 aa, Staphylococcus
HPVIASRIKRGHKLYNN

SEQ ID NO: 2016636 - protein, 26 aa, Staphylococcus
HPVQWQLKLKLLLKHNLPKHYLMSYL

SEQ ID NO: 2016637 - protein, 23 aa, Staphylococcus
HPVYRKPMKQWVLKITEYADRLL

SEQ ID NO: 2016638 - protein, 24 aa, Staphylococcus
HPVYRKPMKQWVLKITEYADRLLE

SEQ ID NO: 2016639 - protein, 20 aa, Staphylococcus
HPYESFQPIVDFIREAADDP

SEQ ID NO: 2016640 - protein, 19 aa, Staphylococcus
HPYIEIVKFEYAMGQGGIG

SEQ ID NO: 2016641 - protein, 30 aa, Staphylococcus
HPYQFELNKDFNFSAAHYIPSEDAGKCMRT

SEQ ID NO: 2016642 - protein, 20 aa, Staphylococcus
HPYRVKLALNQARNYQLENL

SEQ ID NO: 2016643 - protein, 19 aa, Staphylococcus
HPYTLIIISHDLSVIQRIC

SEQ ID NO: 2016644 - protein, 19 aa, Staphylococcus
HQAFQNWKKVDAHERSAKL

SEQ ID NO: 2016645 - protein, 22 aa, Staphylococcus
HQEGDYALTVFKRDKVTGNIEI

SEQ ID NO: 2016646 - protein, 19 aa, Staphylococcus
HQEGNYALTVFRRDTNSGM

SEQ ID NO: 2016647 - protein, 17 aa, Staphylococcus
HQEVPPNQCPNCESEHI

SEQ ID NO: 2016648 - protein, 24 aa, Staphylococcus
HQEWLNQAPFSFDLSVMAIYPCLT

SEQ ID NO: 2016649 - protein, 17 aa, Staphylococcus
HQFILKKLKQSKSVSVK

SEQ ID NO: 2016650 - protein, 22 aa, Staphylococcus
HQFPIGTIMPVSRRIDLLNWAS

SEQ ID NO: 2016651 - protein, 22 aa, Staphylococcus
HQGDLFMDPDFVIGHEPMGIVE

SEQ ID NO: 2016652 - protein, 26 aa, Staphylococcus
HQGKMAFRVYPDWETDLNVTALKTQQ

SEQ ID NO: 2016653 - protein, 22 aa, Staphylococcus
HQGKPIACGRFRNDNTSVKVER

SEQ ID NO: 2016654 - protein, 23 aa, Staphylococcus
HQGKRIILLTVHRRENVGQPMIN

SEQ ID NO: 2016655 - protein, 21 aa, Staphylococcus
HQHLYKAIENEGAFDNDQAMK

SEQ ID NO: 2016656 - protein, 25 aa, Staphylococcus
HQHQCLYVKIDPYWIYQIYDKDINP

SEQ ID NO: 2016657 - protein, 17 aa, Staphylococcus
HQHQCLYVKLDPYWIYQ

SEQ ID NO: 2016658 - protein, 23 aa, Staphylococcus
HQIELDALLSYLSQLANKYEIKY

SEQ ID NO: 2016659 - protein, 17 aa, Staphylococcus
HQIGLGIELTPPRSTIN

SEQ ID NO: 2016660 - protein, 19 aa, Staphylococcus
HQIHVVPLNLTIDGKSYVD

SEQ ID NO: 2016661 - protein, 17 aa, Staphylococcus
HQIQGLGPVIIKVNELL

SEQ ID NO: 2016662 - protein, 17 aa, Staphylococcus
HQIQGLGPVILKVNELP

SEQ ID NO: 2016663 - protein, 18 aa, Staphylococcus
HQIQGLGPVLLKVNELLL

SEQ ID NO: 2016664 - protein, 24 aa, Staphylococcus
HQIRKLNDCIEVLEAQRNIELHKA

SEQ ID NO: 2016665 - protein, 24 aa, Staphylococcus
HQKLVFKLHINGSINIDMDEYNGD

SEQ ID NO: 2016666 - protein, 25 aa, Staphylococcus
HQLDYPMLCANIFENGEPFTGQGIT

SEQ ID NO: 2016667 - protein, 18 aa, Staphylococcus
HQLGKVKSKLLVKSKKHL

SEQ ID NO: 2016668 - protein, 26 aa, Staphylococcus
HQLIIKFSSAWSFLIPEILQIDEVKL

SEQ ID NO: 2016669 - protein, 27 aa, Staphylococcus
HQLIIKFSSAWSFLVPEILQLDEKTIQ

SEQ ID NO: 2016670 - protein, 26 aa, Staphylococcus
HQLIIKFSSGWSFLVPEILQIDEETI

SEQ ID NO: 2016671 - protein, 26 aa, Staphylococcus
HQLIIKISSAWSFLVPEILQIDEDKL

SEQ ID NO: 2016672 - protein, 26 aa, Staphylococcus
HQLIIKISSAWSFLVPEILQIDEEKL

SEQ ID NO: 2016673 - protein, 17 aa, Staphylococcus
HQLKIDDVIGVGIGVPG

SEQ ID NO: 2016674 - protein, 18 aa, Staphylococcus
HQLLRRLVAFMYETPATL

SEQ ID NO: 2016675 - protein, 27 aa, Staphylococcus
HQLVIKYSSAWSFLVPEILQLDQSTIE

SEQ ID NO: 2016676 - protein, 24 aa, Staphylococcus
HQLYRFKHHFDLIIVDEVDAFPLV

SEQ ID NO: 2016677 - protein, 23 aa, Staphylococcus
HQLYRFKNHFDLIFVDEVDAFPL

SEQ ID NO: 2016678 - protein, 23 aa, Staphylococcus
HQLYRFKNHFEVIFVDEVDAFPL

SEQ ID NO: 2016679 - protein, 22 aa, Staphylococcus
HQLYRFKQHFDVIFIDEVDAFP

SEQ ID NO: 2016680 - protein, 33 aa, Staphylococcus
HQMKSRIKIIVECKAGKAIKSFDERKEINNVQN

SEQ ID NO: 2016681 - protein, 25 aa, Staphylococcus
HQNGRPINPIKWLKAHPGKKGGKSS

SEQ ID NO: 2016682 - protein, 21 aa, Staphylococcus
HQRALAVRLRQMFQDNVSDIM

SEQ ID NO: 2016683 - protein, 20 aa, Staphylococcus
HQRYGFKYSSEEIIITNGAS

SEQ ID NO: 2016684 - protein, 20 aa, Staphylococcus
HQSFKMIVNAIDLAESKNDI

SEQ ID NO: 2016685 - protein, 24 aa, Staphylococcus
HQTFFKCLFSIKNADEYKQKLQKF

SEQ ID NO: 2016686 - protein, 19 aa, Staphylococcus
HQTIDAICEIFKQAHTIFL

SEQ ID NO: 2016687 - protein, 26 aa, Staphylococcus
HQTKVVLFESLKAWLEAEMVADVWVD

SEQ ID NO: 2016688 - protein, 17 aa, Staphylococcus
HQTLKLNDLRSRVRLET

SEQ ID NO: 2016689 - protein, 24 aa, Staphylococcus
HQVVIRCIFAYFNVIGEEEALDYN

SEQ ID NO: 2016690 - protein, 19 aa, Staphylococcus
HQVVIRCIFVYLEQITKDE

SEQ ID NO: 2016691 - protein, 24 aa, Staphylococcus
HQVVIRCIMVYFGYINKEEALIKV

SEQ ID NO: 2016692 - protein, 17 aa, Staphylococcus
HQYGHAFYNSASDQDVF

SEQ ID NO: 2016693 - protein, 19 aa, Staphylococcus
HQYLKRDLGVIGVDLHLHA

SEQ ID NO: 2016694 - protein, 23 aa, Staphylococcus
HQYSNCIFYYYMVDKQSRMKSNN

SEQ ID NO: 2016695 - protein, 17 aa, Staphylococcus
HQYSYMLSRCAFVGIHT

SEQ ID NO: 2016696 - protein, 18 aa, Staphylococcus
HRAQERFKAVKTPRFYLN

SEQ ID NO: 2016697 - protein, 26 aa, Staphylococcus
HRCHEEGIKFIGPHLDHLDMFGDKVK

SEQ ID NO: 2016698 - protein, 18 aa, Staphylococcus
HRDMGFSQPEWGASIHLD

SEQ ID NO: 2016699 - protein, 35 aa, Staphylococcus
HRDRAELLLRVAAIIRRRKEEISAVMVYEAGKPWD

SEQ ID NO: 2016700 - protein, 18 aa, Staphylococcus
HRELPIRADFVGKNIPTS

SEQ ID NO: 2016701 - protein, 19 aa, Staphylococcus
HRFEECPNFVKGHVPELYI

SEQ ID NO: 2016702 - protein, 23 aa, Staphylococcus
HRFKHSKCLKTWENIIEATSFKS

SEQ ID NO: 2016703 - protein, 21 aa, Staphylococcus
HRHPLPVPKFKYFKLNMNRTQ

SEQ ID NO: 2016704 - protein, 17 aa, Staphylococcus
HRIFVKNEFDSIEYDNA

SEQ ID NO: 2016705 - protein, 18 aa, Staphylococcus
HRIGMMLAIASLLSDKPL

SEQ ID NO: 2016706 - protein, 22 aa, Staphylococcus
HRIKDCIPVYAIPVGFSESTSQ

SEQ ID NO: 2016707 - protein, 17 aa, Staphylococcus
HRIKEIINDKALSGFNV

SEQ ID NO: 2016708 - protein, 19 aa, Staphylococcus
HRINHHHMRNGVTIIDPNT

SEQ ID NO: 2016709 - protein, 22 aa, Staphylococcus
HRKEMKATLSNILKMHQEVKTN

SEQ ID NO: 2016710 - protein, 19 aa, Staphylococcus
HRKWLECIFLHHFIFIGHD

SEQ ID NO: 2016711 - protein, 24 aa, Staphylococcus
HRKYQALRTKFWISDNGSVYQVIK

SEQ ID NO: 2016712 - protein, 18 aa, Staphylococcus
HRLRDRSDIIAARKKALK

SEQ ID NO: 2016713 - protein, 17 aa, Staphylococcus
HRMLPHPINLVRVRLTG

SEQ ID NO: 2016714 - protein, 25 aa, Staphylococcus
HRNELWFEMSKKLEGLPRHTSTHAA

SEQ ID NO: 2016715 - protein, 22 aa, Staphylococcus
HRNKKFILLTAHRRENIGQPMI

SEQ ID NO: 2016716 - protein, 18 aa, Staphylococcus
HRNQALVYYREVVKHHQL

SEQ ID NO: 2016717 - protein, 29 aa, Staphylococcus
HRNQALVYYREVVKYHQLDIHAFEEVLTV

SEQ ID NO: 2016718 - protein, 19 aa, Staphylococcus
HRNVFSFGPTFRAEKSKTR

SEQ ID NO: 2016719 - protein, 21 aa, Staphylococcus
HRQKVPFPKFTFDDHSDLRYS

SEQ ID NO: 2016720 - protein, 18 aa, Staphylococcus
HRQPFLLIDRVVEYEEGK

SEQ ID NO: 2016721 - protein, 24 aa, Staphylococcus
HRQPLPVPRFKYFKLNTTRVQTQF

SEQ ID NO: 2016722 - protein, 24 aa, Staphylococcus
HRRQPRPPARRALPRAQHPREPAP

SEQ ID NO: 2016723 - protein, 17 aa, Staphylococcus
HRSKGYGQILLSYAEER

SEQ ID NO: 2016724 - protein, 23 aa, Staphylococcus
HRTFDEVVQWFKHVRDIDLYPSR

SEQ ID NO: 2016725 - protein, 30 aa, Staphylococcus
HRVDPPCVYYWKCGGCQLQHMSYEAQLAMK

SEQ ID NO: 2016726 - protein, 21 aa, Staphylococcus
HRVILNFYDTLTINDVINDTL

SEQ ID NO: 2016727 - protein, 17 aa, Staphylococcus
HRWKLEKEFEPQMEDQE

SEQ ID NO: 2016728 - protein, 28 aa, Staphylococcus
HRYEEDHIFCLTLGTGIGGAFYSEASGI

SEQ ID NO: 2016729 - protein, 18 aa, Staphylococcus
HRYFEFDNAIALEQLVEW

SEQ ID NO: 2016730 - protein, 21 aa, Staphylococcus
HRYPDIPFYLQVGNPYLADDV

SEQ ID NO: 2016731 - protein, 21 aa, Staphylococcus
HRYPNIPFYLQVGNPYLDDDV

SEQ ID NO: 2016732 - protein, 18 aa, Staphylococcus
HSAEIRYFSSHTDYRHEG

SEQ ID NO: 2016733 - protein, 22 aa, Staphylococcus
HSAGKLLARHIVPYPPGVPILF

SEQ ID NO: 2016734 - protein, 32 aa, Staphylococcus
HSAPLLYLSVIKLKEHFSGYGLNLFSHPDLFN

SEQ ID NO: 2016735 - protein, 22 aa, Staphylococcus
HSDAPIAFQEFMILPTGAESFK

SEQ ID NO: 2016736 - protein, 29 aa, Staphylococcus
HSDDPKFKRWVIGSILSRTYYHNMVTHLL

SEQ ID NO: 2016737 - protein, 25 aa, Staphylococcus
HSDFKASEVPSAIFGTKKPRPLENG

SEQ ID NO: 2016738 - protein, 18 aa, Staphylococcus
HSDYICFYPMNKRRNETY

SEQ ID NO: 2016739 - protein, 19 aa, Staphylococcus
HSDYLKVFGHLFQYLKKNR

SEQ ID NO: 2016740 - protein, 29 aa, Staphylococcus
HSEDPRFKRWVIGSILSRTYYHNMVTHLL

SEQ ID NO: 2016741 - protein, 23 aa, Staphylococcus
HSEFKIAGVTLFASDAFDKNKDN

SEQ ID NO: 2016742 - protein, 22 aa, Staphylococcus
HSEHKTKCCFSTYDMVLPFPIK

SEQ ID NO: 2016743 - protein, 21 aa, Staphylococcus
HSELTYLTFVYKVSAMDFIFK

SEQ ID NO: 2016744 - protein, 23 aa, Staphylococcus
HSEQNGMINICFELFDDKIKIII

SEQ ID NO: 2016745 - protein, 17 aa, Staphylococcus
HSESFNQFMEWSEKTAR

SEQ ID NO: 2016746 - protein, 20 aa, Staphylococcus
HSETCPISANAMDQFNKFLY

SEQ ID NO: 2016747 - protein, 24 aa, Staphylococcus
HSETLPVIIWFYGGGFLNGHGSAE

SEQ ID NO: 2016748 - protein, 21 aa, Staphylococcus
HSFEGLFTWQLKHYNNLLNSG

SEQ ID NO: 2016749 - protein, 23 aa, Staphylococcus
HSFPTPEVKPVITAFAKSYDRPY

SEQ ID NO: 2016750 - protein, 21 aa, Staphylococcus
HSFPTPPTKPVIMAFTKSYDR

SEQ ID NO: 2016751 - protein, 19 aa, Staphylococcus
HSFPTPPVKPVLMAFTKSY

SEQ ID NO: 2016752 - protein, 21 aa, Staphylococcus
HSGFGLGLERTVAWLSGVEHV

SEQ ID NO: 2016753 - protein, 23 aa, Staphylococcus
HSGKEIKDDILLHLIERDDVLVS

SEQ ID NO: 2016754 - protein, 24 aa, Staphylococcus
HSIDEIYNLPGHVFIFGGQSLFDK

SEQ ID NO: 2016755 - protein, 17 aa, Staphylococcus
HSIEIAKNEGIKIKFIE

SEQ ID NO: 2016756 - protein, 22 aa, Staphylococcus
HSIKATEIMSKWPKHPNNPYKG

SEQ ID NO: 2016757 - protein, 21 aa, Staphylococcus
HSIKRAINRFEMSDVQPKIKE

SEQ ID NO: 2016758 - protein, 17 aa, Staphylococcus
HSINALLHLKNVSVYDG

SEQ ID NO: 2016759 - protein, 24 aa, Staphylococcus
HSIRDIKKSIAILMMHQLEETLTE

SEQ ID NO: 2016760 - protein, 27 aa, Staphylococcus
HSKAGVKLLWASCRELYNVIQADEVGA

SEQ ID NO: 2016761 - protein, 17 aa, Staphylococcus
HSKANVHYESWLSTYNH

SEQ ID NO: 2016762 - protein, 19 aa, Staphylococcus
HSKIALVVKRIGGKLTSFV

SEQ ID NO: 2016763 - protein, 18 aa, Staphylococcus
HSKPFLKQFPTTGEHVLM

SEQ ID NO: 2016764 - protein, 18 aa, Staphylococcus
HSKPFLKQFPTTGERILM

SEQ ID NO: 2016765 - protein, 17 aa, Staphylococcus
HSKPFLKQFPTTSEHVL

SEQ ID NO: 2016766 - protein, 23 aa, Staphylococcus
HSKQELRRAYDLHPEIIGVNNRD

SEQ ID NO: 2016767 - protein, 23 aa, Staphylococcus
HSLINRKYMAVLYQKTHFPKLVK

SEQ ID NO: 2016768 - protein, 20 aa, Staphylococcus
HSLLKYNLDYILIGDTAINY

SEQ ID NO: 2016769 - protein, 22 aa, Staphylococcus
HSLPKLKYPSFERFLDTYDNQN

SEQ ID NO: 2016770 - protein, 26 aa, Staphylococcus
HSLRHSFCSILIHHGFSILYISKHLG

SEQ ID NO: 2016771 - protein, 21 aa, Staphylococcus
HSMGNLSFAYFMKYYGNDKQL

SEQ ID NO: 2016772 - protein, 17 aa, Staphylococcus
HSNIALFLVPTMLHQLL

SEQ ID NO: 2016773 - protein, 22 aa, Staphylococcus
HSPFDRMKRDGIQFNAAAENLA

SEQ ID NO: 2016774 - protein, 18 aa, Staphylococcus
HSPVKVIVIPTNEEVMIA

SEQ ID NO: 2016775 - protein, 18 aa, Staphylococcus
HSQHKWLARFDWCKPKSI

SEQ ID NO: 2016776 - protein, 24 aa, Staphylococcus
HSQLRNFLYRNGLFEASYWSVFDA

SEQ ID NO: 2016777 - protein, 17 aa, Staphylococcus
HSQRCDCGAQLEASMKY

SEQ ID NO: 2016778 - protein, 22 aa, Staphylococcus
HSRFGHSLGVYEIVRRMIDESF

SEQ ID NO: 2016779 - protein, 26 aa, Staphylococcus
HSRPIKIGLAALVDRGHRELPIRADF

SEQ ID NO: 2016780 - protein, 24 aa, Staphylococcus
HSRSLRVAHGLEIERLLRQNEEIK

SEQ ID NO: 2016781 - protein, 24 aa, Staphylococcus
HSSKGLEFPFVIYSGLSKKYNEKD

SEQ ID NO: 2016782 - protein, 26 aa, Staphylococcus
HSSKGLEFPFVIYSGLSKRFNKNDLS

SEQ ID NO: 2016783 - protein, 35 aa, Staphylococcus
HSSKGLEFPFVIYSGLSRKFRRDDLHRPVILNQSY

SEQ ID NO: 2016784 - protein, 23 aa, Staphylococcus
HSSKGLEFPYVIYSGLSKNFNKE

SEQ ID NO: 2016785 - protein, 17 aa, Staphylococcus
HSVGLTSFIIKSLRNDD

SEQ ID NO: 2016786 - protein, 24 aa, Staphylococcus
HSYRDLPIRMAEFGQVHRHELSGS

SEQ ID NO: 2016787 - protein, 27 aa, Staphylococcus
HSYRELPIRLAELGTMHRYEASGAVSG

SEQ ID NO: 2016788 - protein, 24 aa, Staphylococcus
HTAFAFKVVPDLLYPEYITIGKNC

SEQ ID NO: 2016789 - protein, 18 aa, Staphylococcus
HTARALLNYLPKGLDMSF

SEQ ID NO: 2016790 - protein, 17 aa, Staphylococcus
HTATAMKVFDVEANEVN

SEQ ID NO: 2016791 - protein, 17 aa, Staphylococcus
HTATAMKVFNVEANEVD

SEQ ID NO: 2016792 - protein, 20 aa, Staphylococcus
HTEAGILYQIIAWHQDYDVA

SEQ ID NO: 2016793 - protein, 23 aa, Staphylococcus
HTEIKRTICVITKKGNHKPDLPV

SEQ ID NO: 2016794 - protein, 19 aa, Staphylococcus
HTEKPFFHKLVSFLTSGPV

SEQ ID NO: 2016795 - protein, 24 aa, Staphylococcus
HTELKRTICAVIHKDNHKPELKAL

SEQ ID NO: 2016796 - protein, 26 aa, Staphylococcus
HTELKRTICSIIRRDNRKNDIQLMLS

SEQ ID NO: 2016797 - protein, 25 aa, Staphylococcus
HTENRGMIPYTVFIDPPLSRVGMTA

SEQ ID NO: 2016798 - protein, 24 aa, Staphylococcus
HTFIIENPQLWWPIGYGEQPLYTV

SEQ ID NO: 2016799 - protein, 23 aa, Staphylococcus
HTFSRTQAFLDEFADALSKADHV

SEQ ID NO: 2016800 - protein, 20 aa, Staphylococcus
HTFSRTQAFLDEFATSLSKA

SEQ ID NO: 2016801 - protein, 22 aa, Staphylococcus
HTFSRTQAFLNEFADSLSKADH

SEQ ID NO: 2016802 - protein, 29 aa, Staphylococcus
HTGDVVFPSILRRGRLTLSISTNGASPTL

SEQ ID NO: 2016803 - protein, 23 aa, Staphylococcus
HTGLIRLYFDAVYQERKYGQSYV

SEQ ID NO: 2016804 - protein, 21 aa, Staphylococcus
HTGSTLAFIIAERALADVVLL

SEQ ID NO: 2016805 - protein, 17 aa, Staphylococcus
HTGVIAFEVKDTEAAKQ

SEQ ID NO: 2016806 - protein, 21 aa, Staphylococcus
HTHARIGIALYGSRPYSTINE

SEQ ID NO: 2016807 - protein, 17 aa, Staphylococcus
HTHHVKWLDNNHRSPNI

SEQ ID NO: 2016808 - protein, 17 aa, Staphylococcus
HTIEFIKKKKEGVNVLS

SEQ ID NO: 2016809 - protein, 17 aa, Staphylococcus
HTIESRGLFAMDGQATS

SEQ ID NO: 2016810 - protein, 18 aa, Staphylococcus
HTILKNKGPRRVSPFFVP

SEQ ID NO: 2016811 - protein, 25 aa, Staphylococcus
HTKDLRKKAVYSFMAMMEQIHAKSY

SEQ ID NO: 2016812 - protein, 24 aa, Staphylococcus
HTKEMPGGFGHYIQVHGGDLDVIY

SEQ ID NO: 2016813 - protein, 20 aa, Staphylococcus
HTKRIKVGSGGIMLPNHAPL

SEQ ID NO: 2016814 - protein, 25 aa, Staphylococcus
HTKWHCPIIFYTCIRENDLTYKQLV

SEQ ID NO: 2016815 - protein, 21 aa, Staphylococcus
HTLDFVKPLNFMENAESGKSQ

SEQ ID NO: 2016816 - protein, 20 aa, Staphylococcus
HTLFIMFKATIKNEVIDIQM

SEQ ID NO: 2016817 - protein, 22 aa, Staphylococcus
HTLIFFIYCMTRYYDVTYLKES

SEQ ID NO: 2016818 - protein, 26 aa, Staphylococcus
HTLLTIGRYPICYINIEMDPILVDVN

SEQ ID NO: 2016819 - protein, 17 aa, Staphylococcus
HTLRHSFATHLLENGAD

SEQ ID NO: 2016820 - protein, 22 aa, Staphylococcus
HTLYDFPSHQLTTIGVTGTNGK

SEQ ID NO: 2016821 - protein, 25 aa, Staphylococcus
HTMGIRIWETLNFDFINKVPQSKKS

SEQ ID NO: 2016822 - protein, 18 aa, Staphylococcus
HTMIDGAVFREESEDIMA

SEQ ID NO: 2016823 - protein, 18 aa, Staphylococcus
HTMIDGSIFREESENIMA

SEQ ID NO: 2016824 - protein, 25 aa, Staphylococcus
HTMKVASFLLTFPFNHNAELNKLSE

SEQ ID NO: 2016825 - protein, 17 aa, Staphylococcus
HTNIALIKYWGKADEAL

SEQ ID NO: 2016826 - protein, 17 aa, Staphylococcus
HTNIALIKYWGKADEKL

SEQ ID NO: 2016827 - protein, 17 aa, Staphylococcus
HTNIALIKYWGKADENL

SEQ ID NO: 2016828 - protein, 17 aa, Staphylococcus
HTNIALIKYWGKADETL

SEQ ID NO: 2016829 - protein, 17 aa, Staphylococcus
HTNIALIKYWGKADETY

SEQ ID NO: 2016830 - protein, 25 aa, Staphylococcus
HTPGHSPGSLSFVFDEFAVVGDTLF

SEQ ID NO: 2016831 - protein, 29 aa, Staphylococcus
HTPSQMGIRKPEFSSAISTISSSITFDEL

SEQ ID NO: 2016832 - protein, 34 aa, Staphylococcus
HTQYLGFELDVHWIWRAGLNPIEVIPNYANRIRA

SEQ ID NO: 2016833 - protein, 22 aa, Staphylococcus
HTRSKIGGFNGRALKKDDHIQV

SEQ ID NO: 2016834 - protein, 22 aa, Staphylococcus
HTSHAKTLFSTHYHELTTLDQS

SEQ ID NO: 2016835 - protein, 26 aa, Staphylococcus
HTSKIFKRAFSLDGLYNGNLLEIGYP

SEQ ID NO: 2016836 - protein, 23 aa, Staphylococcus
HTSYKAKLLLQVHDELIFEVPKS

SEQ ID NO: 2016837 - protein, 25 aa, Staphylococcus
HTTDLRKKAVYAFMAMMEQIHAKSY

SEQ ID NO: 2016838 - protein, 25 aa, Staphylococcus
HTTDLRKKAVYSFMQMMEQIHAKSY

SEQ ID NO: 2016839 - protein, 26 aa, Staphylococcus
HTTEIFKRAFALETIYGGQILEIGYP

SEQ ID NO: 2016840 - protein, 18 aa, Staphylococcus
HTTYGAILVKLAMKDNKI

SEQ ID NO: 2016841 - protein, 21 aa, Staphylococcus
HTVKKWQHWFDMDIVSEDEKV

SEQ ID NO: 2016842 - protein, 24 aa, Staphylococcus
HTVKNRLSSGWGFDDAIQAPIGTT

SEQ ID NO: 2016843 - protein, 17 aa, Staphylococcus
HTYGQREIYDFIDDAHR

SEQ ID NO: 2016844 - protein, 25 aa, Staphylococcus
HVAQEVLKGLSFKVEKGEFISIMGP

SEQ ID NO: 2016845 - protein, 23 aa, Staphylococcus
HVDALRVQHYFSPRKTFNNQGEP

SEQ ID NO: 2016846 - protein, 18 aa, Staphylococcus
HVDKTVVGKEWFDGTPCE

SEQ ID NO: 2016847 - protein, 19 aa, Staphylococcus
HVDYRVFCMNQCLNQIEDV

SEQ ID NO: 2016848 - protein, 17 aa, Staphylococcus
HVEGVVWVVDPIDGTLN

SEQ ID NO: 2016849 - protein, 24 aa, Staphylococcus
HVERVSKRLGICRWKDSVKEVESR

SEQ ID NO: 2016850 - protein, 23 aa, Staphylococcus
HVFARLKYALKPIVTAVQGKALG

SEQ ID NO: 2016851 - protein, 18 aa, Staphylococcus
HVFKLDPAKSISDDDLDA

SEQ ID NO: 2016852 - protein, 19 aa, Staphylococcus
HVFKLDPAKVINDSDLDAI

SEQ ID NO: 2016853 - protein, 26 aa, Staphylococcus
HVGDTCPICGNEIESLNEHIKFDEIA

SEQ ID NO: 2016854 - protein, 19 aa, Staphylococcus
HVGGTCLNVGCIPSKTLLE

SEQ ID NO: 2016855 - protein, 19 aa, Staphylococcus
HVGHLRSIIELLKKHDIEA

SEQ ID NO: 2016856 - protein, 23 aa, Staphylococcus
HVHEPRIKFDNWSKIDEDKLNKE

SEQ ID NO: 2016857 - protein, 17 aa, Staphylococcus
HVHEPRINYKHWTDIDD

SEQ ID NO: 2016858 - protein, 22 aa, Staphylococcus
HVIGVVLSGYFKSIGLYKTFNH

SEQ ID NO: 2016859 - protein, 24 aa, Staphylococcus
HVIPEMLTENFIPRAELRETTMTI

SEQ ID NO: 2016860 - protein, 24 aa, Staphylococcus
HVKVKGRISVITFHSLEDRLCKQI

SEQ ID NO: 2016861 - protein, 29 aa, Staphylococcus
HVLEMKAPRFGSKLQGFIHLVWDVRDEIN

SEQ ID NO: 2016862 - protein, 18 aa, Staphylococcus
HVLLRGRHPYEFVKDLRK

SEQ ID NO: 2016863 - protein, 18 aa, Staphylococcus
HVLVKFEEEIHCEIVNKD

SEQ ID NO: 2016864 - protein, 19 aa, Staphylococcus
HVMNCYRISNRPLYNKYKS

SEQ ID NO: 2016865 - protein, 24 aa, Staphylococcus
HVMRAFRDTLQFYPVPQHAFVTLM

SEQ ID NO: 2016866 - protein, 17 aa, Staphylococcus
HVMSPFAGEGVNMALYD

SEQ ID NO: 2016867 - protein, 17 aa, Staphylococcus
HVNDEIIGVLDIDAPIT

SEQ ID NO: 2016868 - protein, 28 aa, Staphylococcus
HVNDFKKYFGHWDHLNYLGDLGVIEKEI

SEQ ID NO: 2016869 - protein, 19 aa, Staphylococcus
HVNDLKDFIQDDVPKVMGV

SEQ ID NO: 2016870 - protein, 17 aa, Staphylococcus
HVNEAWVDHNGHMNDAE

SEQ ID NO: 2016871 - protein, 27 aa, Staphylococcus
HVNNIKKFGVEPVVAINAFIHDTDAEI

SEQ ID NO: 2016872 - protein, 26 aa, Staphylococcus
HVPEHIAKFLLGIFIASREDEFTTID

SEQ ID NO: 2016873 - protein, 24 aa, Staphylococcus
HVPSTKFVNHFKLTKVSGAYWRGN

SEQ ID NO: 2016874 - protein, 32 aa, Staphylococcus
HVPYGEAVKGMGIPKGITLIVGGGYHGKSTLL

SEQ ID NO: 2016875 - protein, 38 aa, Staphylococcus
HVQGLGFRGDIFGGYILYKCGFIQSEHRFFVDGQEIED

SEQ ID NO: 2016876 - protein, 18 aa, Staphylococcus
HVRANWKDVTDIIAAQIL

SEQ ID NO: 2016877 - protein, 25 aa, Staphylococcus
HVRARLYPELPRTEYICFYPMDKRR

SEQ ID NO: 2016878 - protein, 18 aa, Staphylococcus
HVRSNWKDVTDIIAAQLL

SEQ ID NO: 2016879 - protein, 17 aa, Staphylococcus
HVRWFDDKGRLRSEDHY

SEQ ID NO: 2016880 - protein, 23 aa, Staphylococcus
HVSELKQRIPTILEVKTDAYQST

SEQ ID NO: 2016881 - protein, 19 aa, Staphylococcus
HVSGIVTFGHLLARAVARD

SEQ ID NO: 2016882 - protein, 17 aa, Staphylococcus
HVSIAGRLMTKRGKGKA

SEQ ID NO: 2016883 - protein, 20 aa, Staphylococcus
HVTCRDRNLIGLQSHLLGLS

SEQ ID NO: 2016884 - protein, 17 aa, Staphylococcus
HVTELINEVALLQFMNG

SEQ ID NO: 2016885 - protein, 18 aa, Staphylococcus
HVTKRISVLEAMLPSAIK

SEQ ID NO: 2016886 - protein, 23 aa, Staphylococcus
HVTQRPFIMNSLFSNKNLQKYEE

SEQ ID NO: 2016887 - protein, 20 aa, Staphylococcus
HVVAAVGLAQNFSACRALVS

SEQ ID NO: 2016888 - protein, 18 aa, Staphylococcus
HVVFLGFDYGYRGNSKYL

SEQ ID NO: 2016889 - protein, 29 aa, Staphylococcus
HVVLSGAYKDIGWFRWVTPTTKQRLNQLM

SEQ ID NO: 2016890 - protein, 20 aa, Staphylococcus
HVWFKDVIDGYDYLVDQGYE

SEQ ID NO: 2016891 - protein, 24 aa, Staphylococcus
HVYGVACPGFVPLVEQMRYDDPTI

SEQ ID NO: 2016892 - protein, 21 aa, Staphylococcus
HVYKLTVKAVVGIPITINTWY

SEQ ID NO: 2016893 - protein, 19 aa, Staphylococcus
HVYLYYRHTALKMTKREIF

SEQ ID NO: 2016894 - protein, 20 aa, Staphylococcus
HVYQAGYLYDFDKSNQYSNH

SEQ ID NO: 2016895 - protein, 18 aa, Staphylococcus
HWCQNKFQITNQVSVDDT

SEQ ID NO: 2016896 - protein, 19 aa, Staphylococcus
HWLGYCTNELVQINPQEKY

SEQ ID NO: 2016897 - protein, 23 aa, Staphylococcus
HWLKNESYDSLSLTGGNAGVIAE

SEQ ID NO: 2016898 - protein, 21 aa, Staphylococcus
HWYMMNYCFDHGYGRYNFYGL

SEQ ID NO: 2016899 - protein, 29 aa, Staphylococcus
HYAKHIKSNFGIKEVYVIPGNADMHEEVK

SEQ ID NO: 2016900 - protein, 19 aa, Staphylococcus
HYDEVRFNQQFQKLQDKNI

SEQ ID NO: 2016901 - protein, 21 aa, Staphylococcus
HYDISTALTYFANELSMKSQY

SEQ ID NO: 2016902 - protein, 24 aa, Staphylococcus
HYDKLPDRLVTVFAGQDKEATQRA

SEQ ID NO: 2016903 - protein, 24 aa, Staphylococcus
HYDKLPNRLVTVFAGQDKEATQQA

SEQ ID NO: 2016904 - protein, 24 aa, Staphylococcus
HYDKLPQRLVTVFAGQDKEATQKA

SEQ ID NO: 2016905 - protein, 18 aa, Staphylococcus
HYEDKYILLESMEDEYAK

SEQ ID NO: 2016906 - protein, 18 aa, Staphylococcus
HYEIIKFFIEINEEKRQE

SEQ ID NO: 2016907 - protein, 21 aa, Staphylococcus
HYEKRYAKRSQLRDFNVEKMS

SEQ ID NO: 2016908 - protein, 30 aa, Staphylococcus
HYEPRIFNLYLRHELPIIHLIQQREYELAI

SEQ ID NO: 2016909 - protein, 17 aa, Staphylococcus
HYFKEAHPYFNQDVVVI

SEQ ID NO: 2016910 - protein, 17 aa, Staphylococcus
HYFKERWHNIPDFNYKS

SEQ ID NO: 2016911 - protein, 19 aa, Staphylococcus
HYFTIVPLLLFSGRHYLED

SEQ ID NO: 2016912 - protein, 25 aa, Staphylococcus
HYFYPKARPIIELAAVAYREILPVV

SEQ ID NO: 2016913 - protein, 29 aa, Staphylococcus
HYGELAFLNACEQAGVYGLIIPDLPHELV

SEQ ID NO: 2016914 - protein, 18 aa, Staphylococcus
HYGIAFHIGYLRGLFDKG

SEQ ID NO: 2016915 - protein, 17 aa, Staphylococcus
HYGIAFHLGFLKGVADA

SEQ ID NO: 2016916 - protein, 22 aa, Staphylococcus
HYICPHCKTSEFFDDGSVGSGF

SEQ ID NO: 2016917 - protein, 24 aa, Staphylococcus
HYICPQCKTSEFFNDGSVGSGFDL

SEQ ID NO: 2016918 - protein, 18 aa, Staphylococcus
HYIMVSTYDARREAFDPS

SEQ ID NO: 2016919 - protein, 29 aa, Staphylococcus
HYIYSGSIGKIMPGVLCYGKETHVGNPLD

SEQ ID NO: 2016920 - protein, 19 aa, Staphylococcus
HYKHLFAILELAKKQGLDK

SEQ ID NO: 2016921 - protein, 19 aa, Staphylococcus
HYKHLFAILELAKKQGVEK

SEQ ID NO: 2016922 - protein, 21 aa, Staphylococcus
HYKHLFALLELAKQKGLDKVY

SEQ ID NO: 2016923 - protein, 17 aa, Staphylococcus
HYKHLFALLELAKQRGI

SEQ ID NO: 2016924 - protein, 22 aa, Staphylococcus
HYKKKHIFDSLNMTFQNNLITI

SEQ ID NO: 2016925 - protein, 18 aa, Staphylococcus
HYLHHAYPLTLMEHPHQT

SEQ ID NO: 2016926 - protein, 20 aa, Staphylococcus
HYLQHEWKGVHLQPFKFEDT

SEQ ID NO: 2016927 - protein, 17 aa, Staphylococcus
HYNGLLVDFCKQVGAKT

SEQ ID NO: 2016928 - protein, 19 aa, Staphylococcus
HYNYDIFGGVSYNIKVSEP

SEQ ID NO: 2016929 - protein, 22 aa, Staphylococcus
HYNYDIWSGIAYTIKAGNPKGE

SEQ ID NO: 2016930 - protein, 26 aa, Staphylococcus
HYPGSNKWLYRFDWSNLSSKDFKSPY

SEQ ID NO: 2016931 - protein, 19 aa, Staphylococcus
HYPNAKLYPTIKRDMVEEL

SEQ ID NO: 2016932 - protein, 19 aa, Staphylococcus
HYPQYNYIWVFSKPNNNII

SEQ ID NO: 2016933 - protein, 19 aa, Staphylococcus
HYQALQVLHTYSKIRNDYE

SEQ ID NO: 2016934 - protein, 19 aa, Staphylococcus
HYQIPILGTHNMRNAAIAI

SEQ ID NO: 2016935 - protein, 17 aa, Staphylococcus
HYSPFKVAENFKMLEAL

SEQ ID NO: 2016936 - protein, 18 aa, Staphylococcus
HYSWLKAADIIGIGIDQI

SEQ ID NO: 2016937 - protein, 21 aa, Staphylococcus
HYTNEVMIIFVTNGSKFKEAE

SEQ ID NO: 2016938 - protein, 18 aa, Staphylococcus
HYTRRLYRKLGYANTENY

SEQ ID NO: 2016939 - protein, 27 aa, Staphylococcus
HYTTELKRCINKVIILLPLNKPCKINL

SEQ ID NO: 2016940 - protein, 18 aa, Staphylococcus
HYVLWRMKVEGEISDKEF

SEQ ID NO: 2016941 - protein, 20 aa, Staphylococcus
HYVYKCKLVNIGAEGIMVSL

SEQ ID NO: 2016942 - protein, 17 aa, Staphylococcus
HYYLQGFEESMYTRQQV

SEQ ID NO: 2016943 - protein, 23 aa, Staphylococcus
HYYRDGFQYPTYVTALNKAKKIS

SEQ ID NO: 2016944 - protein, 23 aa, Staphylococcus
HYYYQPKFLEFWTNQIDDTLKQI

SEQ ID NO: 2016945 - protein, 24 aa, Staphylococcus
IAAEIRLGIVSGEILADTLLTENQ

SEQ ID NO: 2016946 - protein, 18 aa, Staphylococcus
IAAELRFQIVNSTLEPDT

SEQ ID NO: 2016947 - protein, 38 aa, Staphylococcus
IAAFKKRIPILGVCLGFQCIYDYFGGRIIHGKRPVHGH

SEQ ID NO: 2016948 - protein, 17 aa, Staphylococcus
IAAFKPDIILSVNGVDI

SEQ ID NO: 2016949 - protein, 20 aa, Staphylococcus
IAAGVQGLVHISEISRKHIG

SEQ ID NO: 2016950 - protein, 18 aa, Staphylococcus
IAAIKARGTKRLTVVSNN

SEQ ID NO: 2016951 - protein, 24 aa, Staphylococcus
IAAKAAGASKIFAFDLSDERLEKA

SEQ ID NO: 2016952 - protein, 20 aa, Staphylococcus
IAAKAAGASKIFVFDLSEER

SEQ ID NO: 2016953 - protein, 17 aa, Staphylococcus
IAAKAVAFGEALEQDFK

SEQ ID NO: 2016954 - protein, 18 aa, Staphylococcus
IAALKLGVSLIPASEMLR

SEQ ID NO: 2016955 - protein, 23 aa, Staphylococcus
IAALRRAGVRITPQRQAIIRYLI

SEQ ID NO: 2016956 - protein, 25 aa, Staphylococcus
IAAMAPCPYVYAMIAKRAMKDPNLN

SEQ ID NO: 2016957 - protein, 26 aa, Staphylococcus
IAAMAPCPYVYAVIGKRAIKDNQLNK

SEQ ID NO: 2016958 - protein, 24 aa, Staphylococcus
IAAMAPCPYVYEVIALRAIEDPEL

SEQ ID NO: 2016959 - protein, 18 aa, Staphylococcus
IAANNLHIAFKIQSLEIM

SEQ ID NO: 2016960 - protein, 27 aa, Staphylococcus
IAANRFRVKCVIFAPEGFSEEKISIMK

SEQ ID NO: 2016961 - protein, 25 aa, Staphylococcus
IAANRYQLNCVIFAPEGFSEEKISI

SEQ ID NO: 2016962 - protein, 23 aa, Staphylococcus
IAAPHRRNVLLIGDGSLQLTVQS

SEQ ID NO: 2016963 - protein, 17 aa, Staphylococcus
IAAQFLFAKELGLKMTS

SEQ ID NO: 2016964 - protein, 20 aa, Staphylococcus
IAAQILKYFNVEKVNLLSNN

SEQ ID NO: 2016965 - protein, 21 aa, Staphylococcus
IAARARGRYGGRPEKLNKQDL

SEQ ID NO: 2016966 - protein, 19 aa, Staphylococcus
IAAYGLKWFESFDECVDKF

SEQ ID NO: 2016967 - protein, 27 aa, Staphylococcus
IACDYILCKAFGKMASNIEKYTSQGSL

SEQ ID NO: 2016968 - protein, 19 aa, Staphylococcus
IACINSRSNFYGRVNEIVN

SEQ ID NO: 2016969 - protein, 18 aa, Staphylococcus
IACTMSMDVMGIKKEELR

SEQ ID NO: 2016970 - protein, 20 aa, Staphylococcus
IADEVVCVFDAYEQSGAPTE

SEQ ID NO: 2016971 - protein, 17 aa, Staphylococcus
IADEVVCVFDAYEQSGI

SEQ ID NO: 2016972 - protein, 30 aa, Staphylococcus
IADEVYPSIIERGGGYRKIDIDTFPNEGLL

SEQ ID NO: 2016973 - protein, 19 aa, Staphylococcus
IADEYLDVFQIGARNMQNF

SEQ ID NO: 2016974 - protein, 20 aa, Staphylococcus
IADFVKSWIGNKLKNDEEIQ

SEQ ID NO: 2016975 - protein, 25 aa, Staphylococcus
IADGCGECPACKLRARGLNAYLEEK

SEQ ID NO: 2016976 - protein, 21 aa, Staphylococcus
IADGDIKWREVVGNFYGGFEK

SEQ ID NO: 2016977 - protein, 21 aa, Staphylococcus
IADGKRKILFDSSREGANVDS

SEQ ID NO: 2016978 - protein, 25 aa, Staphylococcus
IADGLKIGMIHGGLSPRERKQQMKR

SEQ ID NO: 2016979 - protein, 18 aa, Staphylococcus
IADGWKLEKEFNPEMSEE

SEQ ID NO: 2016980 - protein, 19 aa, Staphylococcus
IADILALTVDEAITFFNKN

SEQ ID NO: 2016981 - protein, 20 aa, Staphylococcus
IADIRKKLNIVNQGLLNPDK

SEQ ID NO: 2016982 - protein, 26 aa, Staphylococcus
IADLEHGKHGFAFGSGMAAVSAVMML

SEQ ID NO: 2016983 - protein, 18 aa, Staphylococcus
IADLLSKEMVESMAKDSI

SEQ ID NO: 2016984 - protein, 24 aa, Staphylococcus
IADPKRRNLLLIGDGSLQLTVQGI

SEQ ID NO: 2016985 - protein, 23 aa, Staphylococcus
IADPQRRNVLLIGDGSLQLTVQS

SEQ ID NO: 2016986 - protein, 20 aa, Staphylococcus
IADVRWKELGQHVSQIVSLE

SEQ ID NO: 2016987 - protein, 20 aa, Staphylococcus
IAEARKAEAIGEVPIGAVIV

SEQ ID NO: 2016988 - protein, 21 aa, Staphylococcus
IAEDIEGVFIRAPHIEATHGD

SEQ ID NO: 2016989 - protein, 26 aa, Staphylococcus
IAEDLAEPFPFCRVDFLVSENDVKFG

SEQ ID NO: 2016990 - protein, 19 aa, Staphylococcus
IAEEAFRALKPIFGAKNDV

SEQ ID NO: 2016991 - protein, 17 aa, Staphylococcus
IAEEFKTTHIVEKWEQL

SEQ ID NO: 2016992 - protein, 25 aa, Staphylococcus
IAEEHLRMVNLIAHKDKYPIQLSGG

SEQ ID NO: 2016993 - protein, 25 aa, Staphylococcus
IAEELREILASLGLETVEELVGRTD

SEQ ID NO: 2016994 - protein, 27 aa, Staphylococcus
IAEELREILASLGLRTVEELVGRTDLL

SEQ ID NO: 2016995 - protein, 18 aa, Staphylococcus
IAEELVIIEKPMRAYSDN

SEQ ID NO: 2016996 - protein, 19 aa, Staphylococcus
IAEELVIIEKPMRVFSKES

SEQ ID NO: 2016997 - protein, 28 aa, Staphylococcus
IAEEMREILASLGLKRVEDLIGRTDLLE

SEQ ID NO: 2016998 - protein, 17 aa, Staphylococcus
IAEFEMLPQTDIELSAD

SEQ ID NO: 2016999 - protein, 17 aa, Staphylococcus
IAEGLSFATEKLDELDA

SEQ ID NO: 2017000 - protein, 27 aa, Staphylococcus
IAEHFDRLEVPFIYRVHEQPKSERLRQ

SEQ ID NO: 2017001 - protein, 24 aa, Staphylococcus
IAEIAHLFKSFTFTVNGTLSIEKA

SEQ ID NO: 2017002 - protein, 21 aa, Staphylococcus
IAEIRKKLNIVNQGLLDPDKF

SEQ ID NO: 2017003 - protein, 37 aa, Staphylococcus
IAEKYYPSYSIRNGWCYGDTGIMNTIWLLGLALNNEN

SEQ ID NO: 2017004 - protein, 17 aa, Staphylococcus
IAELGLAIESGMNAEDI

SEQ ID NO: 2017005 - protein, 18 aa, Staphylococcus
IAELKLVRFEFIPFEADI

SEQ ID NO: 2017006 - protein, 26 aa, Staphylococcus
IAELNIRLQIPVIMISGNHDGKERLN

SEQ ID NO: 2017007 - protein, 17 aa, Staphylococcus
IAEPSVCLLNIGTEAAK

SEQ ID NO: 2017008 - protein, 29 aa, Staphylococcus
IAESALRQIPTYVRKHFKQAKTIMITLFG

SEQ ID NO: 2017009 - protein, 21 aa, Staphylococcus
IAESVSLLFNVDCEVKFEEGY

SEQ ID NO: 2017010 - protein, 21 aa, Staphylococcus
IAESVSLLFNVTCEVKFEEGY

SEQ ID NO: 2017011 - protein, 17 aa, Staphylococcus
IAFADSRIRKETIAAED

SEQ ID NO: 2017012 - protein, 19 aa, Staphylococcus
IAFDEAHCISKWGHDFRPS

SEQ ID NO: 2017013 - protein, 20 aa, Staphylococcus
IAFDEAHCISKWGHDFRPSY

SEQ ID NO: 2017014 - protein, 21 aa, Staphylococcus
IAFDLLSYAIHYAFEHYSIDK

SEQ ID NO: 2017015 - protein, 17 aa, Staphylococcus
IAFHGGIPDTGFYRFWY

SEQ ID NO: 2017016 - protein, 17 aa, Staphylococcus
IAFKVIKVKKNFAIGKL

SEQ ID NO: 2017017 - protein, 24 aa, Staphylococcus
IAFNGRNPKECIALQVNGDSMNKV

SEQ ID NO: 2017018 - protein, 20 aa, Staphylococcus
IAFNLLSYAINYAFKNEGIE

SEQ ID NO: 2017019 - protein, 27 aa, Staphylococcus
IAFPGVKGEVLVNAFSKLDIMVSTTSA

SEQ ID NO: 2017020 - protein, 27 aa, Staphylococcus
IAFPGVKGEVLVNAFSKLDVMVSTTSA

SEQ ID NO: 2017021 - protein, 18 aa, Staphylococcus
IAFRIPKGSMDRWQAWLK

SEQ ID NO: 2017022 - protein, 17 aa, Staphylococcus
IAGDFNAFNALAAYSVL

SEQ ID NO: 2017023 - protein, 17 aa, Staphylococcus
IAGDFNAYNAIAAYSVL

SEQ ID NO: 2017024 - protein, 18 aa, Staphylococcus
IAGDGAFQMVMQDFATAV

SEQ ID NO: 2017025 - protein, 18 aa, Staphylococcus
IAGDPSIEYALYNPNKKV

SEQ ID NO: 2017026 - protein, 20 aa, Staphylococcus
IAGELTSFVHLGTGNYNDKT

SEQ ID NO: 2017027 - protein, 18 aa, Staphylococcus
IAGFGVYRGIKYFSGTGE

SEQ ID NO: 2017028 - protein, 19 aa, Staphylococcus
IAGILKNARGFTAVCNPLV

SEQ ID NO: 2017029 - protein, 19 aa, Staphylococcus
IAGKLPVILDPKWTSEQFK

SEQ ID NO: 2017030 - protein, 18 aa, Staphylococcus
IAGKRYINLSSNNYLGLA

SEQ ID NO: 2017031 - protein, 18 aa, Staphylococcus
IAGMKEKGMFLVPTLLAP

SEQ ID NO: 2017032 - protein, 22 aa, Staphylococcus
IAGPVMFLASDWSRFMTGQVLY

SEQ ID NO: 2017033 - protein, 21 aa, Staphylococcus
IAGSYAERVPVIAITGAPTQA

SEQ ID NO: 2017034 - protein, 21 aa, Staphylococcus
IAGSYAERVPVIAITGAPTRA

SEQ ID NO: 2017035 - protein, 20 aa, Staphylococcus
IAGTIRRGRTPEEDQNNAHQ

SEQ ID NO: 2017036 - protein, 27 aa, Staphylococcus
IAHELYKKKKYVLARLISQITRFFTGI

SEQ ID NO: 2017037 - protein, 20 aa, Staphylococcus
IAHIGAALPKVANAIKKAFN

SEQ ID NO: 2017038 - protein, 25 aa, Staphylococcus
IAHKLYNKKRYVLARIISQISRFFT

SEQ ID NO: 2017039 - protein, 24 aa, Staphylococcus
IAHKLYNKKRYVLARIISQVSRFF

SEQ ID NO: 2017040 - protein, 18 aa, Staphylococcus
IAHPLQLIEACFDPVLAN

SEQ ID NO: 2017041 - protein, 24 aa, Staphylococcus
IAHTLDKLLSCLYFEEDEIIVIND

SEQ ID NO: 2017042 - protein, 27 aa, Staphylococcus
IAIATGRPRTETIVPFESFGLKSFFNE

SEQ ID NO: 2017043 - protein, 24 aa, Staphylococcus
IAIDHGFHHYSRFIQLFKDTYGNT

SEQ ID NO: 2017044 - protein, 17 aa, Staphylococcus
IAIDLAYGYEAQVRPRL

SEQ ID NO: 2017045 - protein, 24 aa, Staphylococcus
IAIDLRGKELFKSLVDEIDAIKTR

SEQ ID NO: 2017046 - protein, 25 aa, Staphylococcus
IAIDLRGKELFKSLVEEIDAIKSRN

SEQ ID NO: 2017047 - protein, 22 aa, Staphylococcus
IAIKELLAKGIDRIDYIGDIHT

SEQ ID NO: 2017048 - protein, 17 aa, Staphylococcus
IAIKRGKQFIVSPDPNL

SEQ ID NO: 2017049 - protein, 19 aa, Staphylococcus
IAIKRGRDILVSPDPNISI

SEQ ID NO: 2017050 - protein, 22 aa, Staphylococcus
IAIKRGREIIVSPDPNMNIEIG

SEQ ID NO: 2017051 - protein, 17 aa, Staphylococcus
IAIPLWFENELWGVLLL

SEQ ID NO: 2017052 - protein, 24 aa, Staphylococcus
IAISGNYPALLVFHKDTFGTIGRV

SEQ ID NO: 2017053 - protein, 20 aa, Staphylococcus
IAISHYYFGYIHPFYDGNGR

SEQ ID NO: 2017054 - protein, 21 aa, Staphylococcus
IAKDTRFKVGITVEDLTRNEE

SEQ ID NO: 2017055 - protein, 24 aa, Staphylococcus
IAKEEIFGPVAPIISFDTIAEAIK

SEQ ID NO: 2017056 - protein, 17 aa, Staphylococcus
IAKEMRTRMTPAHRLLD

SEQ ID NO: 2017057 - protein, 24 aa, Staphylococcus
IAKESAVALGLKGDTVISGGGSDG

SEQ ID NO: 2017058 - protein, 25 aa, Staphylococcus
IAKFKEVYQIFSDVLGVPLKGNQQD

SEQ ID NO: 2017059 - protein, 27 aa, Staphylococcus
IAKGWNIKDAVYLNHNFVPFKNGVYLA

SEQ ID NO: 2017060 - protein, 20 aa, Staphylococcus
IAKIASALFKDPKTYNHQDI

SEQ ID NO: 2017061 - protein, 18 aa, Staphylococcus
IAKISVAVGKSFLDAVGS

SEQ ID NO: 2017062 - protein, 17 aa, Staphylococcus
IAKKAGFTGVQIHAAHG

SEQ ID NO: 2017063 - protein, 19 aa, Staphylococcus
IAKLCYIIWQDMELELTQT

SEQ ID NO: 2017064 - protein, 24 aa, Staphylococcus
IAKLKAVYRRVYQFNLEEKRTMTW

SEQ ID NO: 2017065 - protein, 20 aa, Staphylococcus
IAKRQRKLESYKDKERLENQ

SEQ ID NO: 2017066 - protein, 17 aa, Staphylococcus
IAKRVATQLKMIYVDTG

SEQ ID NO: 2017067 - protein, 18 aa, Staphylococcus
IAKSCLVSSMTVSRVINQ

SEQ ID NO: 2017068 - protein, 24 aa, Staphylococcus
IAKSEKWYSKTLGFKSVFKFRNDK

SEQ ID NO: 2017069 - protein, 24 aa, Staphylococcus
IAKSIRFGATMVMIGSLFAAHEES

SEQ ID NO: 2017070 - protein, 22 aa, Staphylococcus
IAKTKRRAIVIGGGLLGLECAR

SEQ ID NO: 2017071 - protein, 17 aa, Staphylococcus
IAKTLGVTLNDLFWEVE

SEQ ID NO: 2017072 - protein, 19 aa, Staphylococcus
IAKTVSQLATYFGVSMDYL

SEQ ID NO: 2017073 - protein, 20 aa, Staphylococcus
IAKVRGGLHNSKVVNGILRN

SEQ ID NO: 2017074 - protein, 20 aa, Staphylococcus
IALALMRISKAILNNENNVL

SEQ ID NO: 2017075 - protein, 17 aa, Staphylococcus
IALDHIDEIISIIRESD

SEQ ID NO: 2017076 - protein, 18 aa, Staphylococcus
IALDSNWNHAFMAEEINI

SEQ ID NO: 2017077 - protein, 17 aa, Staphylococcus
IALGASLQHVIVDSEKD

SEQ ID NO: 2017078 - protein, 18 aa, Staphylococcus
IALIELKLSGDLSKGTIR

SEQ ID NO: 2017079 - protein, 25 aa, Staphylococcus
IALLRYGGGISYQLIATGSIYISLF

SEQ ID NO: 2017080 - protein, 18 aa, Staphylococcus
IALNLEGYEDFAIDVSNY

SEQ ID NO: 2017081 - protein, 29 aa, Staphylococcus
IALPKSNVIRLIFDEGFVALRPSGTEPKL

SEQ ID NO: 2017082 - protein, 26 aa, Staphylococcus
IALRTEPKLSLPSARSIIAIAVGYPN

SEQ ID NO: 2017083 - protein, 18 aa, Staphylococcus
IALYKEREMSVGYQYGED

SEQ ID NO: 2017084 - protein, 20 aa, Staphylococcus
IALYKEREMSVGYQYGEDTA

SEQ ID NO: 2017085 - protein, 17 aa, Staphylococcus
IAMESILSRIVEVDYMQ

SEQ ID NO: 2017086 - protein, 19 aa, Staphylococcus
IAMIEIKASNLLQQGTIRL

SEQ ID NO: 2017087 - protein, 25 aa, Staphylococcus
IAMIQFKLEIPIIKRRPSFEMEDRL

SEQ ID NO: 2017088 - protein, 17 aa, Staphylococcus
IAMRIVGAKSLEMERPL

SEQ ID NO: 2017089 - protein, 24 aa, Staphylococcus
IANAVIRKKLGFKQHNHPVGVFML

SEQ ID NO: 2017090 - protein, 23 aa, Staphylococcus
IANDTKYGLAGYVIGQDKDTLIK

SEQ ID NO: 2017091 - protein, 17 aa, Staphylococcus
IANDVRWLASGPRAGLA

SEQ ID NO: 2017092 - protein, 30 aa, Staphylococcus
IANDYWKYHDHWLGYCTNELVQISSEEKYY

SEQ ID NO: 2017093 - protein, 23 aa, Staphylococcus
IANEVKLPVVLYNVPSRTNMTID

SEQ ID NO: 2017094 - protein, 23 aa, Staphylococcus
IANEVKLPVVLYNVPSRTNMTIE

SEQ ID NO: 2017095 - protein, 23 aa, Staphylococcus
IANEYKIPTFVLGVGLGGLIVLN

SEQ ID NO: 2017096 - protein, 19 aa, Staphylococcus
IANEYKIPTFVMGVGLGGL

SEQ ID NO: 2017097 - protein, 19 aa, Staphylococcus
IANEYKIPTYVLGIGLGGL

SEQ ID NO: 2017098 - protein, 19 aa, Staphylococcus
IANEYKLPTFVMGVGLGGL

SEQ ID NO: 2017099 - protein, 23 aa, Staphylococcus
IANIKAGNGITLMPVSLTSRISN

SEQ ID NO: 2017100 - protein, 30 aa, Staphylococcus
IANKELTPELAFKLGRYGGYVLAHNEGADR

SEQ ID NO: 2017101 - protein, 30 aa, Staphylococcus
IANKELTPELAFKLGRYGGYVLAHNENEAH

SEQ ID NO: 2017102 - protein, 24 aa, Staphylococcus
IANKLRLLKLAPKVITRLREGKIT

SEQ ID NO: 2017103 - protein, 24 aa, Staphylococcus
IANKLRLLKLAPKVKQKLSEGKIT

SEQ ID NO: 2017104 - protein, 23 aa, Staphylococcus
IANLEAELGYKLFDRSRKGTLPT

SEQ ID NO: 2017105 - protein, 18 aa, Staphylococcus
IANLPKAGGAVVQTEDEI

SEQ ID NO: 2017106 - protein, 23 aa, Staphylococcus
IANNFKKGNKIGVTGSIQTGSYE

SEQ ID NO: 2017107 - protein, 17 aa, Staphylococcus
IANNSMLSNGLKINKNE

SEQ ID NO: 2017108 - protein, 26 aa, Staphylococcus
IANQLGIDMKDVMAIGDNMNDVSMLE

SEQ ID NO: 2017109 - protein, 25 aa, Staphylococcus
IANSKRLPINRSFTLEYLVGTEFYN

SEQ ID NO: 2017110 - protein, 17 aa, Staphylococcus
IANSLNIDMTDSFNETM

SEQ ID NO: 2017111 - protein, 21 aa, Staphylococcus
IANSVTVIFRKPEVSGYEAMT

SEQ ID NO: 2017112 - protein, 17 aa, Staphylococcus
IANVMGMTVMGVNTTGH

SEQ ID NO: 2017113 - protein, 17 aa, Staphylococcus
IANYCVQFAYSENGGIR

SEQ ID NO: 2017114 - protein, 18 aa, Staphylococcus
IANYCVQFAYSEQLGLKY

SEQ ID NO: 2017115 - protein, 17 aa, Staphylococcus
IAPEVLSVIASIATSEV

SEQ ID NO: 2017116 - protein, 24 aa, Staphylococcus
IAPFGASIPYYFTGHEGPDSCCID

SEQ ID NO: 2017117 - protein, 22 aa, Staphylococcus
IAPIEDIRFLFLPQDLPKHEKI

SEQ ID NO: 2017118 - protein, 24 aa, Staphylococcus
IAPIFGLDKRQGRQLLEYLEAPTH

SEQ ID NO: 2017119 - protein, 18 aa, Staphylococcus
IAPIFGLNKRQGRQLLKY

SEQ ID NO: 2017120 - protein, 23 aa, Staphylococcus
IAPKLGLTVESRLKILEPKQDTK

SEQ ID NO: 2017121 - protein, 18 aa, Staphylococcus
IAPKPCYQIIEDMIAQGL

SEQ ID NO: 2017122 - protein, 18 aa, Staphylococcus
IAPLFGLDKRQGRQLLEY

SEQ ID NO: 2017123 - protein, 17 aa, Staphylococcus
IAPLFGLNKRQGKQLLA

SEQ ID NO: 2017124 - protein, 24 aa, Staphylococcus
IAPLFGLNKRQGRALLKYLDAPAH

SEQ ID NO: 2017125 - protein, 24 aa, Staphylococcus
IAPSPEWMQMRLIKAGIRPINNVV

SEQ ID NO: 2017126 - protein, 21 aa, Staphylococcus
IAPSPIWMQARLMKAGIRPIN

SEQ ID NO: 2017127 - protein, 19 aa, Staphylococcus
IAPSYFAFVGIRNEEKDWV

SEQ ID NO: 2017128 - protein, 18 aa, Staphylococcus
IAPTILFKSFDAGYQETL

SEQ ID NO: 2017129 - protein, 18 aa, Staphylococcus
IAQALKLANLAASHSVTG

SEQ ID NO: 2017130 - protein, 25 aa, Staphylococcus
IAQANLRLATMSGQRYHLQRRKSLS

SEQ ID NO: 2017131 - protein, 25 aa, Staphylococcus
IAQANLRLATMSGQRYQLQRREALS

SEQ ID NO: 2017132 - protein, 21 aa, Staphylococcus
IAQCFAVIHWPGGETQLESIA

SEQ ID NO: 2017133 - protein, 17 aa, Staphylococcus
IAQCVLESLNLKVVIFE

SEQ ID NO: 2017134 - protein, 21 aa, Staphylococcus
IAQFRYDHYLQLFKEISNRKE

SEQ ID NO: 2017135 - protein, 17 aa, Staphylococcus
IAQHVYEKLGFQYGGKR

SEQ ID NO: 2017136 - protein, 18 aa, Staphylococcus
IAQKQSYVLPIMKKLFDY

SEQ ID NO: 2017137 - protein, 24 aa, Staphylococcus
IAQLEKFGPYMVISPNIALVHAST

SEQ ID NO: 2017138 - protein, 26 aa, Staphylococcus
IAQREFKQFFPKSGWVEHDANEIWTS

SEQ ID NO: 2017139 - protein, 29 aa, Staphylococcus
IAQTCYQFNLPFIITRAISDLADGDAGIT

SEQ ID NO: 2017140 - protein, 30 aa, Staphylococcus
IAQTCYQFNLPFIVTRAVSDLANGKAEMSF

SEQ ID NO: 2017141 - protein, 18 aa, Staphylococcus
IAQTINRFGFTIRGIYGE

SEQ ID NO: 2017142 - protein, 24 aa, Staphylococcus
IAREDIWLTPHIAFYTDAAVKNLI

SEQ ID NO: 2017143 - protein, 19 aa, Staphylococcus
IARHEILRTQYIVDGNEVK

SEQ ID NO: 2017144 - protein, 18 aa, Staphylococcus
IARIFNEPVENIFIIEEG

SEQ ID NO: 2017145 - protein, 18 aa, Staphylococcus
IARIFNEPVENVFIFEEG

SEQ ID NO: 2017146 - protein, 18 aa, Staphylococcus
IARIFNEPVESIFIIEEE

SEQ ID NO: 2017147 - protein, 19 aa, Staphylococcus
IARIFNEPVESIFIIEEED

SEQ ID NO: 2017148 - protein, 32 aa, Staphylococcus
IARKAQEAYLSYRLEQEYSKDEIFEMYLNKIY

SEQ ID NO: 2017149 - protein, 18 aa, Staphylococcus
IARKLGEALQITNILRDV

SEQ ID NO: 2017150 - protein, 26 aa, Staphylococcus
IARNISEAAYLLWLLSPDDLGISTNH

SEQ ID NO: 2017151 - protein, 26 aa, Staphylococcus
IARQRPSIQPAIQMRKEVRLNYTKTQ

SEQ ID NO: 2017152 - protein, 20 aa, Staphylococcus
IARRMARLVGAPFIKVEATK

SEQ ID NO: 2017153 - protein, 17 aa, Staphylococcus
IARRVAESHSMIYVDTG

SEQ ID NO: 2017154 - protein, 17 aa, Staphylococcus
IASCCGKSREFYFHNDA

SEQ ID NO: 2017155 - protein, 31 aa, Staphylococcus
IASDLRMMMAALKIATDFERMGDNVASIANI

SEQ ID NO: 2017156 - protein, 19 aa, Staphylococcus
IASDTIVYYGMKAHAHEFE

SEQ ID NO: 2017157 - protein, 18 aa, Staphylococcus
IASDWFRDRHFDFFNYKY

SEQ ID NO: 2017158 - protein, 19 aa, Staphylococcus
IASELIKWKEYIRDQYRPE

SEQ ID NO: 2017159 - protein, 19 aa, Staphylococcus
IASELSFVVSEIIELSDTT

SEQ ID NO: 2017160 - protein, 17 aa, Staphylococcus
IASFCNEIFPDLNSLLD

SEQ ID NO: 2017161 - protein, 18 aa, Staphylococcus
IASFKPDIIVSVHGVDVH

SEQ ID NO: 2017162 - protein, 20 aa, Staphylococcus
IASGGELSRIMLALKSIFVE

SEQ ID NO: 2017163 - protein, 20 aa, Staphylococcus
IASGGELSRIMLALKSIFVK

SEQ ID NO: 2017164 - protein, 22 aa, Staphylococcus
IASGGELSRIMLALKSIFVKSR

SEQ ID NO: 2017165 - protein, 17 aa, Staphylococcus
IASGGIRSKEDLERLEK

SEQ ID NO: 2017166 - protein, 24 aa, Staphylococcus
IASKEAKINHYVMVSTYDSRRQAF

SEQ ID NO: 2017167 - protein, 17 aa, Staphylococcus
IASLKIESDGTLSLINK

SEQ ID NO: 2017168 - protein, 20 aa, Staphylococcus
IASNRSGIVIGTDHSAENIT

SEQ ID NO: 2017169 - protein, 17 aa, Staphylococcus
IASQGYKTSFFSLETTG

SEQ ID NO: 2017170 - protein, 18 aa, Staphylococcus
IASQLSKWIIKDLKENNE

SEQ ID NO: 2017171 - protein, 17 aa, Staphylococcus
IASSLVFTSLNDFKNAY

SEQ ID NO: 2017172 - protein, 19 aa, Staphylococcus
IASSPIHLEHKLKMTQEEL

SEQ ID NO: 2017173 - protein, 27 aa, Staphylococcus
IASVVGGKAVECYGIVGMASRHQVRDG

SEQ ID NO: 2017174 - protein, 24 aa, Staphylococcus
IASYRMHKGLHMLTFEGINNINDI

SEQ ID NO: 2017175 - protein, 29 aa, Staphylococcus
IATDLRLMMAALKIASDFERIGDNAANIA

SEQ ID NO: 2017176 - protein, 27 aa, Staphylococcus
IATDLRMMIAALKIASEFERIGDNAAS

SEQ ID NO: 2017177 - protein, 30 aa, Staphylococcus
IATDLRMMIAALKISTDFERMGDNAANIAH

SEQ ID NO: 2017178 - protein, 31 aa, Staphylococcus
IATDLRMMMAALKISTDFERMGDNAAHIAHI

SEQ ID NO: 2017179 - protein, 30 aa, Staphylococcus
IATDLRMMMAALKISTDFERMGDNAANIAH

SEQ ID NO: 2017180 - protein, 19 aa, Staphylococcus
IATEIGYPVIIKATAGGGG

SEQ ID NO: 2017181 - protein, 18 aa, Staphylococcus
IATFRLREGMPIGAKVTL

SEQ ID NO: 2017182 - protein, 19 aa, Staphylococcus
IATFRLREGMPIGAKVTLR

SEQ ID NO: 2017183 - protein, 19 aa, Staphylococcus
IATGRPFRASKPYYEQLKL

SEQ ID NO: 2017184 - protein, 20 aa, Staphylococcus
IATGRPYRASQIYYHELNMN

SEQ ID NO: 2017185 - protein, 26 aa, Staphylococcus
IATILGKRRRLQWVNDLAFKPFNKRI

SEQ ID NO: 2017186 - protein, 17 aa, Staphylococcus
IATPLGIVKDWSKGEID

SEQ ID NO: 2017187 - protein, 20 aa, Staphylococcus
IATQIAKAYGLRVITTASRN

SEQ ID NO: 2017188 - protein, 29 aa, Staphylococcus
IATQLSNFGYMWECPDFFNLNQTDVLLFC

SEQ ID NO: 2017189 - protein, 18 aa, Staphylococcus
IATQVAKEYGLRVITTAG

SEQ ID NO: 2017190 - protein, 19 aa, Staphylococcus
IATRLLKFNTLPISHLIYL

SEQ ID NO: 2017191 - protein, 19 aa, Staphylococcus
IATRLLKFNTLPITHLVYL

SEQ ID NO: 2017192 - protein, 19 aa, Staphylococcus
IATSPIHLEHKLKMSQEEV

SEQ ID NO: 2017193 - protein, 19 aa, Staphylococcus
IATSPIHLEHKLKMTQEEV

SEQ ID NO: 2017194 - protein, 19 aa, Staphylococcus
IATSSSRSNIQPTLEALDL

SEQ ID NO: 2017195 - protein, 19 aa, Staphylococcus
IATVCAADLSILAQKQPGE

SEQ ID NO: 2017196 - protein, 27 aa, Staphylococcus
IATVSKGGHLKIRLVANKGRGYALAEQ

SEQ ID NO: 2017197 - protein, 17 aa, Staphylococcus
IAVKCIFFNQPYLKKKI

SEQ ID NO: 2017198 - protein, 17 aa, Staphylococcus
IAVKCVFFNQPYLKNKI

SEQ ID NO: 2017199 - protein, 22 aa, Staphylococcus
IAVLPIGYADGYLRSMQGSYVN

SEQ ID NO: 2017200 - protein, 23 aa, Staphylococcus
IAVPLDLPALFKGYFKEPERTAA

SEQ ID NO: 2017201 - protein, 23 aa, Staphylococcus
IAVPLDLPALFKGYYKDEERTKA

SEQ ID NO: 2017202 - protein, 22 aa, Staphylococcus
IAVTGLARFDRLPLKPKKQLKK

SEQ ID NO: 2017203 - protein, 17 aa, Staphylococcus
IAYAVSFLASNRAKYIT

SEQ ID NO: 2017204 - protein, 17 aa, Staphylococcus
IAYKQKGNARFFLITDA

SEQ ID NO: 2017205 - protein, 24 aa, Staphylococcus
IAYKVMPDLFYPQLITIGNNSVIG

SEQ ID NO: 2017206 - protein, 27 aa, Staphylococcus
IAYLKEHPSHFIDPVLILHGKEDGLVS

SEQ ID NO: 2017207 - protein, 18 aa, Staphylococcus
IAYPEYIRRSELHKRALI

SEQ ID NO: 2017208 - protein, 17 aa, Staphylococcus
IAYPKRQAIAIVGDGAF

SEQ ID NO: 2017209 - protein, 18 aa, Staphylococcus
ICAERSSLVAAISQGYNP

SEQ ID NO: 2017210 - protein, 20 aa, Staphylococcus
ICAPTIQLDALISLVNDGKA

SEQ ID NO: 2017211 - protein, 21 aa, Staphylococcus
ICAPTIQLDALISLVNDGKAK

SEQ ID NO: 2017212 - protein, 22 aa, Staphylococcus
ICAPTIQLDALITLVKEGKAEG

SEQ ID NO: 2017213 - protein, 22 aa, Staphylococcus
ICAPTIQLDALITLVKEGKATG

SEQ ID NO: 2017214 - protein, 26 aa, Staphylococcus
ICAVEKELGYRLKLISGGNSSMLPQL

SEQ ID NO: 2017215 - protein, 19 aa, Staphylococcus
ICCIDRKGYEWVIQTTKKA

SEQ ID NO: 2017216 - protein, 26 aa, Staphylococcus
ICEHFKAVYLDEAYKPFPQEPIDQLT

SEQ ID NO: 2017217 - protein, 27 aa, Staphylococcus
ICEIFKQAHTIFLYGYGSSYVCALEFY

SEQ ID NO: 2017218 - protein, 18 aa, Staphylococcus
ICGILSSSHGEIFLDGAQ

SEQ ID NO: 2017219 - protein, 18 aa, Staphylococcus
ICGVKSAYILKSTQATFK

SEQ ID NO: 2017220 - protein, 17 aa, Staphylococcus
ICIEEILTLPFFSDKKV

SEQ ID NO: 2017221 - protein, 22 aa, Staphylococcus
ICIGMAASMGSFLLAAGAKGKR

SEQ ID NO: 2017222 - protein, 23 aa, Staphylococcus
ICIGMAASMGSFLLAAGAKGKRY

SEQ ID NO: 2017223 - protein, 23 aa, Staphylococcus
ICIGMAASMGSFLLAAGTKGKRF

SEQ ID NO: 2017224 - protein, 20 aa, Staphylococcus
ICILPEGILGLLDNNLQAID

SEQ ID NO: 2017225 - protein, 17 aa, Staphylococcus
ICITSGAIQGLKLIADG

SEQ ID NO: 2017226 - protein, 18 aa, Staphylococcus
ICKEISFGDQLIEPANIN

SEQ ID NO: 2017227 - protein, 22 aa, Staphylococcus
ICNCIKNAGLDYDVFKEDLQKN

SEQ ID NO: 2017228 - protein, 22 aa, Staphylococcus
ICNCIKNAGLDYEVFKEDLQTS

SEQ ID NO: 2017229 - protein, 18 aa, Staphylococcus
ICNDAIELNDYFKDGEVS

SEQ ID NO: 2017230 - protein, 18 aa, Staphylococcus
ICNDAIELTDYFKSHEVS

SEQ ID NO: 2017231 - protein, 17 aa, Staphylococcus
ICNDAMELTDYFKDGEV

SEQ ID NO: 2017232 - protein, 22 aa, Staphylococcus
ICPTCKGQRLNSKILSSKIMSK

SEQ ID NO: 2017233 - protein, 27 aa, Staphylococcus
ICQHFKRANNIFIFGYGASYVCATDLY

SEQ ID NO: 2017234 - protein, 25 aa, Staphylococcus
ICRGNYKSTWAISGGYEAIAPYLFK

SEQ ID NO: 2017235 - protein, 19 aa, Staphylococcus
ICRRCFRLKNYNEVQDVGM

SEQ ID NO: 2017236 - protein, 24 aa, Staphylococcus
ICSEDCGYCGQSREMKHKQRYTLV

SEQ ID NO: 2017237 - protein, 20 aa, Staphylococcus
ICSGLIKADKYEWLIQKATE

SEQ ID NO: 2017238 - protein, 25 aa, Staphylococcus
ICTSIQYPNCYYFSTVVKKNQTEIF

SEQ ID NO: 2017239 - protein, 19 aa, Staphylococcus
ICTVEYWHNGYIITYTGFI

SEQ ID NO: 2017240 - protein, 19 aa, Staphylococcus
ICVDLGVGYFMNKFNNNRN

SEQ ID NO: 2017241 - protein, 21 aa, Staphylococcus
ICVSDPLKLLIQYQGYSGFEI

SEQ ID NO: 2017242 - protein, 22 aa, Staphylococcus
ICVVDRKGYEWVIQSTRKAEVG

SEQ ID NO: 2017243 - protein, 18 aa, Staphylococcus
ICYNESLGPIQTCDTCAV

SEQ ID NO: 2017244 - protein, 17 aa, Staphylococcus
IDAAFVYGNEEMVGQGI

SEQ ID NO: 2017245 - protein, 24 aa, Staphylococcus
IDACGVDGLVITRCNFEGFLDVNG

SEQ ID NO: 2017246 - protein, 26 aa, Staphylococcus
IDADIKIRYIREIDDLVDLVKDRIET

SEQ ID NO: 2017247 - protein, 22 aa, Staphylococcus
IDAEGTMYCKRYFNNNEKNKIN

SEQ ID NO: 2017248 - protein, 25 aa, Staphylococcus
IDAEILAMVMHIYQSFGLKHLKLVI

SEQ ID NO: 2017249 - protein, 25 aa, Staphylococcus
IDAFKHIPFFNSFNMQRVHIDEPLE

SEQ ID NO: 2017250 - protein, 28 aa, Staphylococcus
IDAGLYFEGKNAIPREDVARVLNEVSTS

SEQ ID NO: 2017251 - protein, 21 aa, Staphylococcus
IDAHNDWVNMLGVVPVIRALR

SEQ ID NO: 2017252 - protein, 26 aa, Staphylococcus
IDAISRLQLPINIVGVIASAENMISS

SEQ ID NO: 2017253 - protein, 24 aa, Staphylococcus
IDAKGQHILPGFIDIHIHGGYGED

SEQ ID NO: 2017254 - protein, 20 aa, Staphylococcus
IDAKLVCLEKPNSHIDQRLK

SEQ ID NO: 2017255 - protein, 18 aa, Staphylococcus
IDALFTLGNEAAHISHTG

SEQ ID NO: 2017256 - protein, 17 aa, Staphylococcus
IDALKIAQKQSYVLPIM

SEQ ID NO: 2017257 - protein, 24 aa, Staphylococcus
IDALQLRFILDWNSQAHRPQFEYD

SEQ ID NO: 2017258 - protein, 20 aa, Staphylococcus
IDALRYSVEMLMINNKKQKK

SEQ ID NO: 2017259 - protein, 18 aa, Staphylococcus
IDALVNYISALGYLSDDD

SEQ ID NO: 2017260 - protein, 18 aa, Staphylococcus
IDALVNYISALGYLSEDD

SEQ ID NO: 2017261 - protein, 23 aa, Staphylococcus
IDAMSSFGGIPIKVNDLGIDYLI

SEQ ID NO: 2017262 - protein, 24 aa, Staphylococcus
IDANYMIGMSFSQLDAQREALPFF

SEQ ID NO: 2017263 - protein, 22 aa, Staphylococcus
IDAYGAGSFIVATKIKGMIAAE

SEQ ID NO: 2017264 - protein, 19 aa, Staphylococcus
IDAYRRQVKINGWEEDAGL

SEQ ID NO: 2017265 - protein, 23 aa, Staphylococcus
IDCERLVEVLFEILVESDVLAAS

SEQ ID NO: 2017266 - protein, 20 aa, Staphylococcus
IDCHPEVNILIGENAQGKTN

SEQ ID NO: 2017267 - protein, 19 aa, Staphylococcus
IDCNGGIRFLGTKDDKNTA

SEQ ID NO: 2017268 - protein, 18 aa, Staphylococcus
IDDAAAISIALNHPDLDL

SEQ ID NO: 2017269 - protein, 17 aa, Staphylococcus
IDDAKALKEKLENIEVE

SEQ ID NO: 2017270 - protein, 17 aa, Staphylococcus
IDDLAALVYYPEEKLKL

SEQ ID NO: 2017271 - protein, 18 aa, Staphylococcus
IDDLAALVYYPEEKLKLV

SEQ ID NO: 2017272 - protein, 18 aa, Staphylococcus
IDDLFDMFIFKNERLKDK

SEQ ID NO: 2017273 - protein, 18 aa, Staphylococcus
IDDLGHVKIIFKTTLQET

SEQ ID NO: 2017274 - protein, 22 aa, Staphylococcus
IDDLKAHGFWIVGTEADNATDY

SEQ ID NO: 2017275 - protein, 18 aa, Staphylococcus
IDDLRYNLGKSLIKIDHH

SEQ ID NO: 2017276 - protein, 22 aa, Staphylococcus
IDDLVEACWLVLHNDNVNGNVY

SEQ ID NO: 2017277 - protein, 18 aa, Staphylococcus
IDDNGYRYYHSQDISKLQ

SEQ ID NO: 2017278 - protein, 23 aa, Staphylococcus
IDDNIPKIYALRGPSGIGKTTVL

SEQ ID NO: 2017279 - protein, 24 aa, Staphylococcus
IDDRLKGQIAVIGPTAMNYQNVIR

SEQ ID NO: 2017280 - protein, 23 aa, Staphylococcus
IDDSEIVYLALHIYHFENQISSS

SEQ ID NO: 2017281 - protein, 26 aa, Staphylococcus
IDDTTLKCTLNFRNREDKVIDTIEFK

SEQ ID NO: 2017282 - protein, 23 aa, Staphylococcus
IDDYFELLLLFFKQINEIESIDL

SEQ ID NO: 2017283 - protein, 24 aa, Staphylococcus
IDEADLMIDLGLIDEVDYVATRLD

SEQ ID NO: 2017284 - protein, 23 aa, Staphylococcus
IDEADLMIDLGLIDQVDQIAARL

SEQ ID NO: 2017285 - protein, 24 aa, Staphylococcus
IDEADLMIDLGLIEDVDYIASRLE

SEQ ID NO: 2017286 - protein, 26 aa, Staphylococcus
IDEAHFAPSVMVAFGYRETEPKDKVR

SEQ ID NO: 2017287 - protein, 25 aa, Staphylococcus
IDEAKAMGAMALFGEKYGDVVRVVN

SEQ ID NO: 2017288 - protein, 17 aa, Staphylococcus
IDEALAFLKKIKSGKAR

SEQ ID NO: 2017289 - protein, 18 aa, Staphylococcus
IDEAMKLGDRICLLNEGH

SEQ ID NO: 2017290 - protein, 24 aa, Staphylococcus
IDEDFLLVKREIFSSGKSICKVNN

SEQ ID NO: 2017291 - protein, 20 aa, Staphylococcus
IDEDVAYRLASKYGSNVDDL

SEQ ID NO: 2017292 - protein, 20 aa, Staphylococcus
IDEFDELAYLFLKDGQQSHY

SEQ ID NO: 2017293 - protein, 17 aa, Staphylococcus
IDEFGFDQMIYKMTSEP

SEQ ID NO: 2017294 - protein, 19 aa, Staphylococcus
IDEGCLLEDGHCIRTIHAE

SEQ ID NO: 2017295 - protein, 18 aa, Staphylococcus
IDEGCLMEDNHCIRTIHA

SEQ ID NO: 2017296 - protein, 19 aa, Staphylococcus
IDEGLEWVLIQGQIGIELW

SEQ ID NO: 2017297 - protein, 19 aa, Staphylococcus
IDEGLEWVLIQGQLGIELW

SEQ ID NO: 2017298 - protein, 19 aa, Staphylococcus
IDEKYDLFINGEFQASDSG

SEQ ID NO: 2017299 - protein, 21 aa, Staphylococcus
IDELAERILAIGGAPIATMKK

SEQ ID NO: 2017300 - protein, 25 aa, Staphylococcus
IDELHPSVIISFYPQFAVHPDHEAT

SEQ ID NO: 2017301 - protein, 21 aa, Staphylococcus
IDELKAFIEFHDIDVVVTNDE

SEQ ID NO: 2017302 - protein, 25 aa, Staphylococcus
IDELMLRYGNLQSYYEEHGGYEIDA

SEQ ID NO: 2017303 - protein, 22 aa, Staphylococcus
IDELNIYYSHYVSVLENKPTTK

SEQ ID NO: 2017304 - protein, 22 aa, Staphylococcus
IDELTIYYSHYVSVLENKPTTK

SEQ ID NO: 2017305 - protein, 18 aa, Staphylococcus
IDEPETFLHPKAQAKIIN

SEQ ID NO: 2017306 - protein, 25 aa, Staphylococcus
IDEPLEFEMWIAIMLAQQPITDTLK

SEQ ID NO: 2017307 - protein, 23 aa, Staphylococcus
IDEPMHFDTWIALINSKFDEQQS

SEQ ID NO: 2017308 - protein, 26 aa, Staphylococcus
IDEPVGEGFRWLTLVSPNQPDGAQLV

SEQ ID NO: 2017309 - protein, 22 aa, Staphylococcus
IDERFFRCHNSFVINLNNIEEV

SEQ ID NO: 2017310 - protein, 22 aa, Staphylococcus
IDESKLNFLWVTDWPLLEYDED

SEQ ID NO: 2017311 - protein, 18 aa, Staphylococcus
IDESRIAWHVADGTRPGS

SEQ ID NO: 2017312 - protein, 19 aa, Staphylococcus
IDETGTFFDLFRMAEEKHG

SEQ ID NO: 2017313 - protein, 25 aa, Staphylococcus
IDETHPSVIISFYPNYSVHPDHEAT

SEQ ID NO: 2017314 - protein, 20 aa, Staphylococcus
IDETLCTQWQGFNYEVNMKK

SEQ ID NO: 2017315 - protein, 17 aa, Staphylococcus
IDEVILVGGSTRIPAVQ

SEQ ID NO: 2017316 - protein, 20 aa, Staphylococcus
IDEVILVGGSTRIPAVQEAV

SEQ ID NO: 2017317 - protein, 17 aa, Staphylococcus
IDEVTVFVINGDKIDES

SEQ ID NO: 2017318 - protein, 17 aa, Staphylococcus
IDFAINNNIDWVVIGPE

SEQ ID NO: 2017319 - protein, 21 aa, Staphylococcus
IDFIDRASIQQCLGYLHDNGA

SEQ ID NO: 2017320 - protein, 21 aa, Staphylococcus
IDFITCDWCLSSLGQATLQSR

SEQ ID NO: 2017321 - protein, 19 aa, Staphylococcus
IDFITEAQLAYIQNEIQDI

SEQ ID NO: 2017322 - protein, 23 aa, Staphylococcus
IDFKEAPPWFQVSPTHFVKSWLL

SEQ ID NO: 2017323 - protein, 24 aa, Staphylococcus
IDFKLKDHRSALRIRVKDNTYEMT

SEQ ID NO: 2017324 - protein, 21 aa, Staphylococcus
IDFKQSLMGGGFQIDNPNAIA

SEQ ID NO: 2017325 - protein, 17 aa, Staphylococcus
IDFRHCSEKIEMEDEPV

SEQ ID NO: 2017326 - protein, 26 aa, Staphylococcus
IDFYPPRFENTFNRWMEEIRDWTISR

SEQ ID NO: 2017327 - protein, 31 aa, Staphylococcus
IDGACYIVALPEIFDRVDVFQAELPFSWVYD

SEQ ID NO: 2017328 - protein, 19 aa, Staphylococcus
IDGADEFDSDLNLIKGGGG

SEQ ID NO: 2017329 - protein, 26 aa, Staphylococcus
IDGEIWSTLCSFGYAQQNIDLLNQID

SEQ ID NO: 2017330 - protein, 18 aa, Staphylococcus
IDGFRFDVINLISKGEFK

SEQ ID NO: 2017331 - protein, 19 aa, Staphylococcus
IDGIPEMYFHSYVAGATIN

SEQ ID NO: 2017332 - protein, 19 aa, Staphylococcus
IDGIPEMYFHSYVTGATIS

SEQ ID NO: 2017333 - protein, 19 aa, Staphylococcus
IDGKEIKKVIAVPQKLVNI

SEQ ID NO: 2017334 - protein, 21 aa, Staphylococcus
IDGKKSLLFGPFAGFSPKFLK

SEQ ID NO: 2017335 - protein, 19 aa, Staphylococcus
IDGKMFYEQIITVLDSMNM

SEQ ID NO: 2017336 - protein, 21 aa, Staphylococcus
IDGKNGFLFVLSGVSASKYEI

SEQ ID NO: 2017337 - protein, 21 aa, Staphylococcus
IDGKRTILFGPFAGFSPKFLK

SEQ ID NO: 2017338 - protein, 23 aa, Staphylococcus
IDGLHGRFDMGGVYRKRTVSVPI

SEQ ID NO: 2017339 - protein, 18 aa, Staphylococcus
IDGLLEFFKSELSDSDTI

SEQ ID NO: 2017340 - protein, 17 aa, Staphylococcus
IDGLLFRTPMSSSDLSS

SEQ ID NO: 2017341 - protein, 17 aa, Staphylococcus
IDGLNAKMIRRHPHIFG

SEQ ID NO: 2017342 - protein, 21 aa, Staphylococcus
IDGLYQFLFEFIFDIDERYIR

SEQ ID NO: 2017343 - protein, 20 aa, Staphylococcus
IDGMDHFKIRYLINEACHKH

SEQ ID NO: 2017344 - protein, 19 aa, Staphylococcus
IDGMDHFKIRYLINESCNK

SEQ ID NO: 2017345 - protein, 19 aa, Staphylococcus
IDGMDHFKIRYLINEVCHK

SEQ ID NO: 2017346 - protein, 20 aa, Staphylococcus
IDGMDHFKIRYLINEVCHKY

SEQ ID NO: 2017347 - protein, 19 aa, Staphylococcus
IDGTNAFRLFNAEGDGVGG

SEQ ID NO: 2017348 - protein, 19 aa, Staphylococcus
IDGTNAFRVFNGEGDGIGG

SEQ ID NO: 2017349 - protein, 18 aa, Staphylococcus
IDHDVLYASCKAYVEAHA

SEQ ID NO: 2017350 - protein, 22 aa, Staphylococcus
IDHFIMKLRIVKFARTPDYNEL

SEQ ID NO: 2017351 - protein, 19 aa, Staphylococcus
IDHFRELYLPDINPDNPRQ

SEQ ID NO: 2017352 - protein, 18 aa, Staphylococcus
IDHFRELYLPEINPDNPR

SEQ ID NO: 2017353 - protein, 29 aa, Staphylococcus
IDHHKLAMVLVQFPPWFDCTAQNIKYILY

SEQ ID NO: 2017354 - protein, 19 aa, Staphylococcus
IDHINGIMFYDHIDPNNPL

SEQ ID NO: 2017355 - protein, 18 aa, Staphylococcus
IDHLAEGIVNYFDNDTSR

SEQ ID NO: 2017356 - protein, 22 aa, Staphylococcus
IDHLLETDISFATQFASYKEQI

SEQ ID NO: 2017357 - protein, 19 aa, Staphylococcus
IDHLMGVPIIGQYFENDPN

SEQ ID NO: 2017358 - protein, 19 aa, Staphylococcus
IDHLMGVPILAKYFKENPD

SEQ ID NO: 2017359 - protein, 20 aa, Staphylococcus
IDHLMGVPILAQYFKNETDI

SEQ ID NO: 2017360 - protein, 21 aa, Staphylococcus
IDHLNGIMFYDHIDAEHPLTP

SEQ ID NO: 2017361 - protein, 19 aa, Staphylococcus
IDHLNGIMFYDHIDDANPL

SEQ ID NO: 2017362 - protein, 21 aa, Staphylococcus
IDHLYCSPIPTGNGKIKIAHG

SEQ ID NO: 2017363 - protein, 18 aa, Staphylococcus
IDHLYGIPGDSIDAVVDN

SEQ ID NO: 2017364 - protein, 19 aa, Staphylococcus
IDHPPEYFIVLATIGTIAD

SEQ ID NO: 2017365 - protein, 21 aa, Staphylococcus
IDHTLNIPLVKAYMGMNSDVL

SEQ ID NO: 2017366 - protein, 24 aa, Staphylococcus
IDICAKHGANLFVTGSYFFNQDDY

SEQ ID NO: 2017367 - protein, 23 aa, Staphylococcus
IDIDELFDMFIFKNDRLKAKMKE

SEQ ID NO: 2017368 - protein, 17 aa, Staphylococcus
IDIDTFVTYELDDLFDE

SEQ ID NO: 2017369 - protein, 18 aa, Staphylococcus
IDIEGMLKNGFDIGNAQV

SEQ ID NO: 2017370 - protein, 24 aa, Staphylococcus
IDIFPKTRLDVELDKSDSITSSIP

SEQ ID NO: 2017371 - protein, 23 aa, Staphylococcus
IDIFPKTRLNLSLSTNDVITDTI

SEQ ID NO: 2017372 - protein, 23 aa, Staphylococcus
IDIGEDITQLAFYERGELVDADA

SEQ ID NO: 2017373 - protein, 24 aa, Staphylococcus
IDIGEDLTQIAFYERGELVDADSI

SEQ ID NO: 2017374 - protein, 18 aa, Staphylococcus
IDIGEDLTQVAFYERGEL

SEQ ID NO: 2017375 - protein, 20 aa, Staphylococcus
IDIKEILKPSINPVNDQSKE

SEQ ID NO: 2017376 - protein, 18 aa, Staphylococcus
IDILICDTAGRLQNKSNL

SEQ ID NO: 2017377 - protein, 30 aa, Staphylococcus
IDILKEKNIKFVVGGMYEFGLSRYFTAMLA

SEQ ID NO: 2017378 - protein, 25 aa, Staphylococcus
IDILKLLIEYAQFELLDIEWSGAIN

SEQ ID NO: 2017379 - protein, 25 aa, Staphylococcus
IDILNPYLCIIFCNSRENANELAQS

SEQ ID NO: 2017380 - protein, 23 aa, Staphylococcus
IDILNPYLCIVFCNSRDNADELA

SEQ ID NO: 2017381 - protein, 19 aa, Staphylococcus
IDIPEVNQVVMLRPTESSI

SEQ ID NO: 2017382 - protein, 17 aa, Staphylococcus
IDIPSDVTVTFDGHTAT

SEQ ID NO: 2017383 - protein, 17 aa, Staphylococcus
IDIPSDVTVTFDGQTAT

SEQ ID NO: 2017384 - protein, 19 aa, Staphylococcus
IDIPSDVTVTFDKNNVTVK

SEQ ID NO: 2017385 - protein, 20 aa, Staphylococcus
IDIRRYLHEHPELSFHETET

SEQ ID NO: 2017386 - protein, 17 aa, Staphylococcus
IDISSSLIRERIKNNQT

SEQ ID NO: 2017387 - protein, 18 aa, Staphylococcus
IDITDKWIIQIAYDTLII

SEQ ID NO: 2017388 - protein, 24 aa, Staphylococcus
IDITRPRGTVVIVSIFSHPIQFDP

SEQ ID NO: 2017389 - protein, 17 aa, Staphylococcus
IDIVNDFGKVFAVQSSM

SEQ ID NO: 2017390 - protein, 17 aa, Staphylococcus
IDIYVNLSYSFPYIICA

SEQ ID NO: 2017391 - protein, 18 aa, Staphylococcus
IDKAIQFIDYMTGLSMNN

SEQ ID NO: 2017392 - protein, 19 aa, Staphylococcus
IDKALEQIAEFNLLKENGI

SEQ ID NO: 2017393 - protein, 25 aa, Staphylococcus
IDKDGKRILIGWMGLPESDYPTDSE

SEQ ID NO: 2017394 - protein, 18 aa, Staphylococcus
IDKDILRNLAEKVDDVVF

SEQ ID NO: 2017395 - protein, 23 aa, Staphylococcus
IDKESYWKHLALGPETLCIYMGV

SEQ ID NO: 2017396 - protein, 18 aa, Staphylococcus
IDKFLSESNDAWSRSQLQ

SEQ ID NO: 2017397 - protein, 17 aa, Staphylococcus
IDKGEIDTLVLGFCDMQ

SEQ ID NO: 2017398 - protein, 21 aa, Staphylococcus
IDKGQSVIYKGPFKHIEDDDD

SEQ ID NO: 2017399 - protein, 18 aa, Staphylococcus
IDKHDIFGVIGYSGAGKS

SEQ ID NO: 2017400 - protein, 21 aa, Staphylococcus
IDKIYFTSHMDTVIPGINVKP

SEQ ID NO: 2017401 - protein, 17 aa, Staphylococcus
IDKKIVRLLDSIKIMID

SEQ ID NO: 2017402 - protein, 21 aa, Staphylococcus
IDKKYLCICYGKTEKEGVIDA

SEQ ID NO: 2017403 - protein, 28 aa, Staphylococcus
IDKLDYIQYLGVDYIWLTPIYESPMNDN

SEQ ID NO: 2017404 - protein, 22 aa, Staphylococcus
IDKLKESLDYFASVESKVVLQH

SEQ ID NO: 2017405 - protein, 21 aa, Staphylococcus
IDKMYRRFSILTTISNNQPVG

SEQ ID NO: 2017406 - protein, 22 aa, Staphylococcus
IDKSNVRFVIHYNMPGDLESYY

SEQ ID NO: 2017407 - protein, 26 aa, Staphylococcus
IDKSPAQVVIRWNIDNGVITIPKSVT

SEQ ID NO: 2017408 - protein, 18 aa, Staphylococcus
IDKVIDWLNNEDIESLNL

SEQ ID NO: 2017409 - protein, 21 aa, Staphylococcus
IDKYEVAGSYRRYKEMSKDLD

SEQ ID NO: 2017410 - protein, 18 aa, Staphylococcus
IDKYPFKRVENLDDLLMA

SEQ ID NO: 2017411 - protein, 17 aa, Staphylococcus
IDLAAALYIATKDEVYY

SEQ ID NO: 2017412 - protein, 17 aa, Staphylococcus
IDLAEKIKKMQYAPYII

SEQ ID NO: 2017413 - protein, 19 aa, Staphylococcus
IDLALTLGQPSFLEVYEVL

SEQ ID NO: 2017414 - protein, 24 aa, Staphylococcus
IDLDFPINVEKVILSGCYGDIGWF

SEQ ID NO: 2017415 - protein, 19 aa, Staphylococcus
IDLDGTMYLGTDEIDGAAQ

SEQ ID NO: 2017416 - protein, 22 aa, Staphylococcus
IDLEGSISLPGIYGEVARSQMI

SEQ ID NO: 2017417 - protein, 23 aa, Staphylococcus
IDLEHLKTLMTNRVGLVTCMQVN

SEQ ID NO: 2017418 - protein, 19 aa, Staphylococcus
IDLFKELDFKQMLNQIDVS

SEQ ID NO: 2017419 - protein, 20 aa, Staphylococcus
IDLLERFNHRPIQFQDIFNS

SEQ ID NO: 2017420 - protein, 23 aa, Staphylococcus
IDLNFFNYVPFFRSLDMKQTKVN

SEQ ID NO: 2017421 - protein, 18 aa, Staphylococcus
IDLPLKYDALEVDPSSGV

SEQ ID NO: 2017422 - protein, 22 aa, Staphylococcus
IDLRGKELFKSLIHEMDLIKSN

SEQ ID NO: 2017423 - protein, 21 aa, Staphylococcus
IDLRSVSPWDQGTVLESVKKT

SEQ ID NO: 2017424 - protein, 21 aa, Staphylococcus
IDLSERVRVADFKDLLLQRHP

SEQ ID NO: 2017425 - protein, 23 aa, Staphylococcus
IDLSYLPRPAILINDVSDMVGRQ

SEQ ID NO: 2017426 - protein, 20 aa, Staphylococcus
IDLTDGLECTAKFRYRQKDT

SEQ ID NO: 2017427 - protein, 23 aa, Staphylococcus
IDLTRTWEILGEIIGESASDELI

SEQ ID NO: 2017428 - protein, 20 aa, Staphylococcus
IDLYKEREMSVGYQYGEDTA

SEQ ID NO: 2017429 - protein, 17 aa, Staphylococcus
IDLYPSRSAVMAAAEKG

SEQ ID NO: 2017430 - protein, 20 aa, Staphylococcus
IDMAKKVKNGFLEKGYQVYF

SEQ ID NO: 2017431 - protein, 21 aa, Staphylococcus
IDMCASKIKLLNDLKSSFNLN

SEQ ID NO: 2017432 - protein, 18 aa, Staphylococcus
IDMGKGDILHFCSVDLVD

SEQ ID NO: 2017433 - protein, 25 aa, Staphylococcus
IDMLNPYLCIIFCNSRENANELADS

SEQ ID NO: 2017434 - protein, 20 aa, Staphylococcus
IDMNKFIVTEPMSFELWIAS

SEQ ID NO: 2017435 - protein, 22 aa, Staphylococcus
IDMRSDIPLARGLGSSASELVG

SEQ ID NO: 2017436 - protein, 25 aa, Staphylococcus
IDMTLPYYAGLSFRTLMPKYPKLFP

SEQ ID NO: 2017437 - protein, 17 aa, Staphylococcus
IDNCIKYTRPERQELNS

SEQ ID NO: 2017438 - protein, 18 aa, Staphylococcus
IDNFIAKRMETFDAKGDE

SEQ ID NO: 2017439 - protein, 23 aa, Staphylococcus
IDNFKHSYGTILYFEDQSVVKGL

SEQ ID NO: 2017440 - protein, 23 aa, Staphylococcus
IDNFKHSYGTILYYEDQDVITGL

SEQ ID NO: 2017441 - protein, 19 aa, Staphylococcus
IDNFRWAGVPFYIRTGKRM

SEQ ID NO: 2017442 - protein, 23 aa, Staphylococcus
IDNFRWAGVPFYIRTGKRMKSKS

SEQ ID NO: 2017443 - protein, 23 aa, Staphylococcus
IDNFRWAGVPFYIRTGKRMKSKT

SEQ ID NO: 2017444 - protein, 18 aa, Staphylococcus
IDNGDFLQGSPFCHYLAT

SEQ ID NO: 2017445 - protein, 18 aa, Staphylococcus
IDNIYDWLADYKLLEKPK

SEQ ID NO: 2017446 - protein, 23 aa, Staphylococcus
IDNNLSALSFNYLVSHDALGSII

SEQ ID NO: 2017447 - protein, 26 aa, Staphylococcus
IDNNRIKIRYNMCPCKIKHDEERFNS

SEQ ID NO: 2017448 - protein, 24 aa, Staphylococcus
IDNRLDSALIIYGAWLAGIEAVMI

SEQ ID NO: 2017449 - protein, 23 aa, Staphylococcus
IDPAFRTGCKLAVINPFGTFIAK

SEQ ID NO: 2017450 - protein, 22 aa, Staphylococcus
IDPAFRTGCKLAVINPFGTFVA

SEQ ID NO: 2017451 - protein, 34 aa, Staphylococcus; identical to SEQ ID NO: 1806574

SEQ ID NO: 2017452 - protein, 33 aa, Staphylococcus
IDPDVLRFFMISVHYRSPINYNLELVNAAKSGL

SEQ ID NO: 2017453 - protein, 34 aa, Staphylococcus
IDPDVLRFFMISVHYRSPINYNLELVSAAKSGLE

SEQ ID NO: 2017454 - protein, 33 aa, Staphylococcus
IDPDVLRFFMISVHYRSPINYNMELVEAAKSGL

SEQ ID NO: 2017455 - protein, 33 aa, Staphylococcus
IDPDVLRFFMISVHYRSPINYNMELVSAAKSGL

SEQ ID NO: 2017456 - protein, 23 aa, Staphylococcus
IDPEYYAVIDFKGFEKMIDELAP

SEQ ID NO: 2017457 - protein, 18 aa, Staphylococcus
IDPHVIKLLKDYKVNVQD

SEQ ID NO: 2017458 - protein, 24 aa, Staphylococcus
IDPIKFDLLFERFLNPERVTMPDI

SEQ ID NO: 2017459 - protein, 24 aa, Staphylococcus
IDPIKFNLLFERFLNPERVTMPDI

SEQ ID NO: 2017460 - protein, 24 aa, Staphylococcus
IDPIRFNLLFERFLNPERVTMPDI

SEQ ID NO: 2017461 - protein, 19 aa, Staphylococcus
IDPKHVDAIYNLGLASYMK

SEQ ID NO: 2017462 - protein, 18 aa, Staphylococcus
IDPMKFLPEDGSLQLTSG

SEQ ID NO: 2017463 - protein, 21 aa, Staphylococcus
IDPNGRLSFMIVKKHKVLTLE

SEQ ID NO: 2017464 - protein, 17 aa, Staphylococcus
IDPQHIIAFGDEDNDIE

SEQ ID NO: 2017465 - protein, 17 aa, Staphylococcus
IDPRRRGETLSIKEFAN

SEQ ID NO: 2017466 - protein, 18 aa, Staphylococcus
IDPRRRGETLSIKEFANL

SEQ ID NO: 2017467 - protein, 17 aa, Staphylococcus
IDPRRRGETLSIQDFAQ

SEQ ID NO: 2017468 - protein, 23 aa, Staphylococcus
IDPSLRRDIWKQLKHLTKKGKSV

SEQ ID NO: 2017469 - protein, 18 aa, Staphylococcus
IDPTWKNKFINGLDDIAI

SEQ ID NO: 2017470 - protein, 18 aa, Staphylococcus
IDQEALEIAEKCTSKINS

SEQ ID NO: 2017471 - protein, 17 aa, Staphylococcus
IDQFSIFLLWDSLDACP

SEQ ID NO: 2017472 - protein, 17 aa, Staphylococcus
IDQHIPYTVLSENIYTH

SEQ ID NO: 2017473 - protein, 18 aa, Staphylococcus
IDQINWVGFYLIENEALI

SEQ ID NO: 2017474 - protein, 17 aa, Staphylococcus
IDQLPKHELRVILTSLF

SEQ ID NO: 2017475 - protein, 18 aa, Staphylococcus
IDQLRAKGYKVFLATGRS

SEQ ID NO: 2017476 - protein, 18 aa, Staphylococcus
IDQMRGLNHQIIDYISQL

SEQ ID NO: 2017477 - protein, 22 aa, Staphylococcus
IDQRRIEWKRVLDMNDRELRKV

SEQ ID NO: 2017478 - protein, 20 aa, Staphylococcus
IDQRSSYGLGEVLKAALDNQ

SEQ ID NO: 2017479 - protein, 20 aa, Staphylococcus
IDQYEFIYGIIGWHPVDAID

SEQ ID NO: 2017480 - protein, 17 aa, Staphylococcus
IDRDALAGITINNQEQY

SEQ ID NO: 2017481 - protein, 30 aa, Staphylococcus
IDREKMSFGVINILLQFVMLKEDMKLPKSY

SEQ ID NO: 2017482 - protein, 23 aa, Staphylococcus
IDRFKEIILKTIFGEATQVEEYI

SEQ ID NO: 2017483 - protein, 32 aa, Staphylococcus
IDRIKAHRLDENFRKALMIKVFAHTNEYDHAI

SEQ ID NO: 2017484 - protein, 17 aa, Staphylococcus
IDRKGGYVIHRLAGSPE

SEQ ID NO: 2017485 - protein, 17 aa, Staphylococcus
IDRKGLIAILTSSIGND

SEQ ID NO: 2017486 - protein, 17 aa, Staphylococcus
IDRQLFYQFILRLPDNV

SEQ ID NO: 2017487 - protein, 18 aa, Staphylococcus
IDRQLFYQFILRLPDNVL

SEQ ID NO: 2017488 - protein, 39 aa, Staphylococcus
IDRQLFYQFIMRLPDSVLRLKGFVKFRDLPEVTYEFQYA

SEQ ID NO: 2017489 - protein, 18 aa, Staphylococcus
IDRSFLIDYIRYVNRFVR

SEQ ID NO: 2017490 - protein, 22 aa, Staphylococcus
IDRVPSIEKVRMVSSGTEATLD

SEQ ID NO: 2017491 - protein, 22 aa, Staphylococcus
IDRVPSIEKVRMVSSGTEATQD

SEQ ID NO: 2017492 - protein, 17 aa, Staphylococcus
IDRYNFYGISGDFSEDA

SEQ ID NO: 2017493 - protein, 18 aa, Staphylococcus
IDRYNFYGISGHFTDDAE

SEQ ID NO: 2017494 - protein, 17 aa, Staphylococcus
IDRYNFYGISGNFSDDA

SEQ ID NO: 2017495 - protein, 17 aa, Staphylococcus
IDRYNFYGISGNFSEDA

SEQ ID NO: 2017496 - protein, 17 aa, Staphylococcus
IDRYNFYGVSGDFSEDA

SEQ ID NO: 2017497 - protein, 19 aa, Staphylococcus
IDSALNLNHLYHIVFTSGA

SEQ ID NO: 2017498 - protein, 17 aa, Staphylococcus
IDSCPIEGFDVDTVTQI

SEQ ID NO: 2017499 - protein, 17 aa, Staphylococcus
IDSCPMEGFDLDKVTEI

SEQ ID NO: 2017500 - protein, 19 aa, Staphylococcus
IDSGLDIDALKVVSKGINK

SEQ ID NO: 2017501 - protein, 22 aa, Staphylococcus
IDSGSTTIHFARALTQKSNLTI

SEQ ID NO: 2017502 - protein, 21 aa, Staphylococcus
IDSIRIRPEFFEVYKDEELLE

SEQ ID NO: 2017503 - protein, 23 aa, Staphylococcus
IDSKFPFDNIKWLVEEGYSVLTL

SEQ ID NO: 2017504 - protein, 20 aa, Staphylococcus
IDSLLEFFKTALSDSDNIHI

SEQ ID NO: 2017505 - protein, 18 aa, Staphylococcus
IDSLPLIRSTYMSYDSSI

SEQ ID NO: 2017506 - protein, 17 aa, Staphylococcus
IDSLRLIDVEAGEISKL

SEQ ID NO: 2017507 - protein, 24 aa, Staphylococcus
IDSLSYYQFFILKLVVGEKRIKEA

SEQ ID NO: 2017508 - protein, 19 aa, Staphylococcus
IDSLSYYQFYILKLVVGKK

SEQ ID NO: 2017509 - protein, 24 aa, Staphylococcus
IDSPFKVDLFIKSNIELTKDIYPA

SEQ ID NO: 2017510 - protein, 25 aa, Staphylococcus
IDSREYKELISLMTKIKVSKQLAND

SEQ ID NO: 2017511 - protein, 17 aa, Staphylococcus
IDSSGLNAIEAETSVKH

SEQ ID NO: 2017512 - protein, 18 aa, Staphylococcus
IDSSHFHAGFKIPDVSEE

SEQ ID NO: 2017513 - protein, 29 aa, Staphylococcus
IDSSIPFERAAVFGCAVITGIGAVINTAQ

SEQ ID NO: 2017514 - protein, 18 aa, Staphylococcus
IDSSLMAMQLMLVAKQYG

SEQ ID NO: 2017515 - protein, 22 aa, Staphylococcus
IDSYNLWWYGGIEGKTISVNIA

SEQ ID NO: 2017516 - protein, 17 aa, Staphylococcus
IDSYPIVPINFKERFEY

SEQ ID NO: 2017517 - protein, 24 aa, Staphylococcus
IDTAESFKAFIYYIEQHKTVFKHL

SEQ ID NO: 2017518 - protein, 24 aa, Staphylococcus
IDTAGLGIKTSRYLKEINQDIVDY

SEQ ID NO: 2017519 - protein, 17 aa, Staphylococcus
IDTARRAADVVLNISSA

SEQ ID NO: 2017520 - protein, 25 aa, Staphylococcus
IDTDGRMKALVSITLDEAFVIHDLR

SEQ ID NO: 2017521 - protein, 30 aa, Staphylococcus
IDTELPVDVTICSGLIKADKYEWLLQKSTE

SEQ ID NO: 2017522 - protein, 18 aa, Staphylococcus
IDTGMGLERMASIAQNVR

SEQ ID NO: 2017523 - protein, 18 aa, Staphylococcus
IDTGMGLERMASISQNVR

SEQ ID NO: 2017524 - protein, 18 aa, Staphylococcus
IDTGMGLERMASLAQNVR

SEQ ID NO: 2017525 - protein, 18 aa, Staphylococcus
IDTGMGLERMASVAQNVR

SEQ ID NO: 2017526 - protein, 19 aa, Staphylococcus
IDTIQILGGIIKFVNALNI

SEQ ID NO: 2017527 - protein, 22 aa, Staphylococcus
IDTLKDYGCERIFSEKVSGRKT

SEQ ID NO: 2017528 - protein, 20 aa, Staphylococcus
IDTLVLGFCDMQGRLMGKRI

SEQ ID NO: 2017529 - protein, 21 aa, Staphylococcus
IDTNYMIGMSFNQLDAPTESL

SEQ ID NO: 2017530 - protein, 21 aa, Staphylococcus
IDTRAVFKLGGIGLAFKKGKF

SEQ ID NO: 2017531 - protein, 22 aa, Staphylococcus
IDTSCARGEWGFNPKYDLESMT

SEQ ID NO: 2017532 - protein, 22 aa, Staphylococcus
IDTSCSRGEWGFNPKYDLASMT

SEQ ID NO: 2017533 - protein, 20 aa, Staphylococcus
IDTSCSRNEWGFNPQYDLPK

SEQ ID NO: 2017534 - protein, 25 aa, Staphylococcus
IDTSKRNYICFFEKSKIKPEHYYKL

SEQ ID NO: 2017535 - protein, 19 aa, Staphylococcus
IDTSMGFTPLAGVTMGTRS

SEQ ID NO: 2017536 - protein, 19 aa, Staphylococcus
IDTVELFKIAFPTDKSYQL

SEQ ID NO: 2017537 - protein, 20 aa, Staphylococcus
IDTVELFKIAFPTDKSYQLS

SEQ ID NO: 2017538 - protein, 18 aa, Staphylococcus
IDVAYKAGASVILLIVNI

SEQ ID NO: 2017539 - protein, 19 aa, Staphylococcus
IDVDYVFYPSVEEMYPDEL

SEQ ID NO: 2017540 - protein, 23 aa, Staphylococcus
IDVEALKSIGLYPGPKYQEVKSY

SEQ ID NO: 2017541 - protein, 27 aa, Staphylococcus
IDVEGPFPRMTYAEAMDRYGSDKPDTR

SEQ ID NO: 2017542 - protein, 18 aa, Staphylococcus
IDVEGPFPRMTYNEAMSR

SEQ ID NO: 2017543 - protein, 25 aa, Staphylococcus
IDVEIRKGRLTSMIGPNGAGKSTLL

SEQ ID NO: 2017544 - protein, 21 aa, Staphylococcus
IDVESLRGAFTTDVDCGFIKF

SEQ ID NO: 2017545 - protein, 17 aa, Staphylococcus
IDVFDFEGSFINALKRI

SEQ ID NO: 2017546 - protein, 18 aa, Staphylococcus
IDVGCLIEDDHCIRTIHA

SEQ ID NO: 2017547 - protein, 18 aa, Staphylococcus
IDVGNAIYKSFTLIGHAQ

SEQ ID NO: 2017548 - protein, 23 aa, Staphylococcus
IDVILRRNVDILQQWIEQKKGPF

SEQ ID NO: 2017549 - protein, 24 aa, Staphylococcus
IDVILRRNVDILQQWIEQKKGPFA

SEQ ID NO: 2017550 - protein, 19 aa, Staphylococcus
IDVITCLENIVSMKKEIIN

SEQ ID NO: 2017551 - protein, 24 aa, Staphylococcus
IDVKGQNVLPGFIDIHIHGGYGED

SEQ ID NO: 2017552 - protein, 18 aa, Staphylococcus
IDVKRVDKSFPMDTYALQ

SEQ ID NO: 2017553 - protein, 18 aa, Staphylococcus
IDVKSFRSEHHIAPQIEL

SEQ ID NO: 2017554 - protein, 23 aa, Staphylococcus
IDVPHQLPIDWISIPYGTALKGQ

SEQ ID NO: 2017555 - protein, 17 aa, Staphylococcus
IDVPMSLVKPHAINNGS

SEQ ID NO: 2017556 - protein, 20 aa, Staphylococcus
IDVRGRVLGVSQKTRYNQQE

SEQ ID NO: 2017557 - protein, 22 aa, Staphylococcus
IDVSCARAEWGFDPQYDLSAMT

SEQ ID NO: 2017558 - protein, 24 aa, Staphylococcus
IDVSRVARDYALTGLEFACGIPGS

SEQ ID NO: 2017559 - protein, 17 aa, Staphylococcus
IDVTKEWYLCKFSNQIL

SEQ ID NO: 2017560 - protein, 19 aa, Staphylococcus
IDVTLELKLLADVGLVGFP

SEQ ID NO: 2017561 - protein, 30 aa, Staphylococcus
IDVVKHDFTGISFLNLVDFDALYGHRRDKE

SEQ ID NO: 2017562 - protein, 17 aa, Staphylococcus
IDVVLRLNPGVEAHTHE

SEQ ID NO: 2017563 - protein, 18 aa, Staphylococcus
IDVVRRISGGGAVYHDTG

SEQ ID NO: 2017564 - protein, 24 aa, Staphylococcus
IDWALKVTGTYDFKHRAINDLSGG

SEQ ID NO: 2017565 - protein, 18 aa, Staphylococcus
IDWALNVTGTSEFRHRSI

SEQ ID NO: 2017566 - protein, 21 aa, Staphylococcus
IDWAMRVTGTYDFKLRSINDL

SEQ ID NO: 2017567 - protein, 26 aa, Staphylococcus
IDWTINLFYEHGWILVEDRIRELQQQ

SEQ ID NO: 2017568 - protein, 19 aa, Staphylococcus
IDYAIKHGIPVSINHDSPY

SEQ ID NO: 2017569 - protein, 18 aa, Staphylococcus
IDYAIKHNIPVGINHDSP

SEQ ID NO: 2017570 - protein, 19 aa, Staphylococcus
IDYAIKHNIPVPIQHDSPY

SEQ ID NO: 2017571 - protein, 17 aa, Staphylococcus
IDYAIKHNIPVSINHDS

SEQ ID NO: 2017572 - protein, 19 aa, Staphylococcus
IDYAIKHNIPVSINYDSPY

SEQ ID NO: 2017573 - protein, 19 aa, Staphylococcus
IDYALKHNIPVSINHDSPY

SEQ ID NO: 2017574 - protein, 17 aa, Staphylococcus
IDYAVNEAWHFIETSLQ

SEQ ID NO: 2017575 - protein, 19 aa, Staphylococcus
IDYCIVINFSSRFANVTAE

SEQ ID NO: 2017576 - protein, 22 aa, Staphylococcus
IDYCLCKDNSGAMFVFDGTNDI

SEQ ID NO: 2017577 - protein, 21 aa, Staphylococcus
IDYDELIIGLGCEDKYHNVPG

SEQ ID NO: 2017578 - protein, 21 aa, Staphylococcus
IDYDKFTMHAAIFKEEDNMNI

SEQ ID NO: 2017579 - protein, 22 aa, Staphylococcus
IDYDKFTMHAAIFKKEQNMNIF

SEQ ID NO: 2017580 - protein, 20 aa, Staphylococcus
IDYDKFTVHAAIFKEENHMN

SEQ ID NO: 2017581 - protein, 19 aa, Staphylococcus
IDYDYLIEFCINQQLDKVV

SEQ ID NO: 2017582 - protein, 20 aa, Staphylococcus
IDYFFLNKFQHIIDIEHDLK

SEQ ID NO: 2017583 - protein, 20 aa, Staphylococcus
IDYFFLNKFQNIINIEHELK

SEQ ID NO: 2017584 - protein, 23 aa, Staphylococcus
IDYKETIDALTLLQYDNDAEKWK

SEQ ID NO: 2017585 - protein, 23 aa, Staphylococcus
IDYPVGVTPLDFLVSAIEKERYV

SEQ ID NO: 2017586 - protein, 21 aa, Staphylococcus
IDYQLRFDQYISKSIAYSLEE

SEQ ID NO: 2017587 - protein, 20 aa, Staphylococcus
IDYVLSWGPLILGHKNEQVI

SEQ ID NO: 2017588 - protein, 20 aa, Staphylococcus
IDYVLSWGPLILGHKNKQVI

SEQ ID NO: 2017589 - protein, 20 aa, Staphylococcus
IDYVLSWGPLILGHKNKRVI

SEQ ID NO: 2017590 - protein, 20 aa, Staphylococcus
IDYVLSWGPLILGHKNPQVI

SEQ ID NO: 2017591 - protein, 25 aa, Staphylococcus
IDYVSCSPFRVPGAILAAAQSQVES

SEQ ID NO: 2017592 - protein, 23 aa, Staphylococcus
IDYVSCSPFRVSGAILATAQSQA

SEQ ID NO: 2017593 - protein, 19 aa, Staphylococcus
IDYWLKRFAITENRHKRID

SEQ ID NO: 2017594 - protein, 19 aa, Staphylococcus
IDYWLKRFDITENREKKIE

SEQ ID NO: 2017595 - protein, 19 aa, Staphylococcus
IDYYNKFIHRFPTIEALSE

SEQ ID NO: 2017596 - protein, 21 aa, Staphylococcus
IDYYQFRAGSASAIIVESCFV

SEQ ID NO: 2017597 - protein, 23 aa, Staphylococcus
IEAAEAFAKAGIETKMIDITDRL

SEQ ID NO: 2017598 - protein, 24 aa, Staphylococcus
IEAAEAFAKAGIQTKVIDVADRIL

SEQ ID NO: 2017599 - protein, 18 aa, Staphylococcus
IEAAEAFTKAGIDTTIMD

SEQ ID NO: 2017600 - protein, 19 aa, Staphylococcus
IEAAERLGFPEARIPLSQA

SEQ ID NO: 2017601 - protein, 24 aa, Staphylococcus
IEAEALGYQAEWIAALTHQALNGI

SEQ ID NO: 2017602 - protein, 24 aa, Staphylococcus
IEAESLAYQSEWIASLTHQALNGI

SEQ ID NO: 2017603 - protein, 17 aa, Staphylococcus
IEAGDTIAIVGPSGSGK

SEQ ID NO: 2017604 - protein, 25 aa, Staphylococcus
IEAGLRSGNKYAPFPEEINRQMVSN

SEQ ID NO: 2017605 - protein, 18 aa, Staphylococcus
IEAGNPFFKTGHDGCATG

SEQ ID NO: 2017606 - protein, 23 aa, Staphylococcus
IEAGPRITSKFLQTDFINQLIIY

SEQ ID NO: 2017607 - protein, 18 aa, Staphylococcus
IEAIICGIGINMNHDVSD

SEQ ID NO: 2017608 - protein, 26 aa, Staphylococcus
IEAIKTEVPLPVIGIVKRDYEGSDVF

SEQ ID NO: 2017609 - protein, 26 aa, Staphylococcus
IEAILKDQHRLLPSIALLEGEYGFSD

SEQ ID NO: 2017610 - protein, 19 aa, Staphylococcus
IEAMGGKVPDSMKSSQNNS

SEQ ID NO: 2017611 - protein, 20 aa, Staphylococcus
IEAMGGKVPNSMKSSHNTNV

SEQ ID NO: 2017612 - protein, 25 aa, Staphylococcus
IEANYKYARGVAVYGDIKDGTNDHG

SEQ ID NO: 2017613 - protein, 17 aa, Staphylococcus
IEAPFLIVNPLLPEHEV

SEQ ID NO: 2017614 - protein, 20 aa, Staphylococcus
IEAPVGRNGIKATFKGNEEG

SEQ ID NO: 2017615 - protein, 20 aa, Staphylococcus
IEAQKLLKLVGMAEFENEYL

SEQ ID NO: 2017616 - protein, 36 aa, Staphylococcus
IEARAYRLLRVGSFLLSEDGYKIFVHESERKQEPRL

SEQ ID NO: 2017617 - protein, 19 aa, Staphylococcus
IEARCQCLSKEEIQSLNQL

SEQ ID NO: 2017618 - protein, 19 aa, Staphylococcus
IEARCQCLTPKEIESLNQL

SEQ ID NO: 2017619 - protein, 17 aa, Staphylococcus
IEARGFKREDLWTNRKR

SEQ ID NO: 2017620 - protein, 17 aa, Staphylococcus
IEARGFSREDLWTNRKR

SEQ ID NO: 2017621 - protein, 36 aa, Staphylococcus
IEARPYRLLRVGSFLLSKEGYKIFVHESERKSEPRL

SEQ ID NO: 2017622 - protein, 24 aa, Staphylococcus
IEASDLKRTPSFSVDKPNETSGIT

SEQ ID NO: 2017623 - protein, 20 aa, Staphylococcus
IEASIKKAGLAEDIPEIKIE

SEQ ID NO: 2017624 - protein, 19 aa, Staphylococcus
IEATNQFCFKPLTKKLERE

SEQ ID NO: 2017625 - protein, 18 aa, Staphylococcus
IEAYKPDILLSVHGVDIH

SEQ ID NO: 2017626 - protein, 18 aa, Staphylococcus
IEAYYARIEADLHLQSKE

SEQ ID NO: 2017627 - protein, 22 aa, Staphylococcus
IECDTYRKYGHFEGDEQKVKSP

SEQ ID NO: 2017628 - protein, 23 aa, Staphylococcus
IECDTYRKYGHFEGDEQKVKSPN

SEQ ID NO: 2017629 - protein, 17 aa, Staphylococcus
IECDVIFFATPSNVSKH

SEQ ID NO: 2017630 - protein, 17 aa, Staphylococcus
IECVLVVVNPSWDNLQY

SEQ ID NO: 2017631 - protein, 19 aa, Staphylococcus
IECYIHIDLIKGLSHDEFA

SEQ ID NO: 2017632 - protein, 24 aa, Staphylococcus
IEDAHVDWELGIVWKQGKRLSYAA

SEQ ID NO: 2017633 - protein, 18 aa, Staphylococcus
IEDASYAINEFIKPKISV

SEQ ID NO: 2017634 - protein, 23 aa, Staphylococcus
IEDAYIYAAAYAFDQATDAEKQN

SEQ ID NO: 2017635 - protein, 23 aa, Staphylococcus
IEDEARKALVERFNGILTNDGAE

SEQ ID NO: 2017636 - protein, 20 aa, Staphylococcus
IEDECKRVDGGKVKAHELYE

SEQ ID NO: 2017637 - protein, 18 aa, Staphylococcus
IEDEIKRDISCNLGSLNI

SEQ ID NO: 2017638 - protein, 23 aa, Staphylococcus
IEDFKEGYYYIVRINTENSEATD

SEQ ID NO: 2017639 - protein, 17 aa, Staphylococcus
IEDGRLNVILMVGVNGV

SEQ ID NO: 2017640 - protein, 26 aa, Staphylococcus
IEDHISKKDARRMDRFTQYAVVAARQ

SEQ ID NO: 2017641 - protein, 17 aa, Staphylococcus
IEDHLFRITQEGISNTL

SEQ ID NO: 2017642 - protein, 26 aa, Staphylococcus
IEDIPGELIMKILAFDSDLGKIDLVG

SEQ ID NO: 2017643 - protein, 27 aa, Staphylococcus
IEDIPGELIMKVLAFNPDLEKIERIGQ

SEQ ID NO: 2017644 - protein, 28 aa, Staphylococcus
IEDIPGELIMKVLAFNPDLEKINAIGAE

SEQ ID NO: 2017645 - protein, 18 aa, Staphylococcus
IEDIRHFYTNDVRFLDQF

SEQ ID NO: 2017646 - protein, 18 aa, Staphylococcus
IEDIRHFYTNDVRFLNQF

SEQ ID NO: 2017647 - protein, 19 aa, Staphylococcus
IEDIRYFYTNDVRFLDQFK

SEQ ID NO: 2017648 - protein, 24 aa, Staphylococcus
IEDKGEIFPSFEIPTTHPGFKALQ

SEQ ID NO: 2017649 - protein, 24 aa, Staphylococcus
IEDKGEIFPSFTIPLEHPGFKQLQ

SEQ ID NO: 2017650 - protein, 24 aa, Staphylococcus
IEDKGEIFPSFTIPTEHPGFKQLQ

SEQ ID NO: 2017651 - protein, 18 aa, Staphylococcus
IEDLKDFKIKGSIGNGQF

SEQ ID NO: 2017652 - protein, 23 aa, Staphylococcus
IEDLKEGMKLSGTVRNVVDFGAF

SEQ ID NO: 2017653 - protein, 17 aa, Staphylococcus
IEDPFGCSFEVYEKTFQ

SEQ ID NO: 2017654 - protein, 26 aa, Staphylococcus
IEDSLKRLIMPSIEREVRGDLTQKAE

SEQ ID NO: 2017655 - protein, 23 aa, Staphylococcus
IEDTFPFIKYQLMVQDTEALASI

SEQ ID NO: 2017656 - protein, 24 aa, Staphylococcus
IEDYFMYDSWLAIYIIDQTFNYPK

SEQ ID NO: 2017657 - protein, 19 aa, Staphylococcus
IEDYRACFDEEIFANRYSD

SEQ ID NO: 2017658 - protein, 25 aa, Staphylococcus
IEDYRDCFDEELFAAKYADILDKYD

SEQ ID NO: 2017659 - protein, 25 aa, Staphylococcus
IEDYRECFDEELFASRYSDILDKYD

SEQ ID NO: 2017660 - protein, 26 aa, Staphylococcus
IEDYRPSVRVFKDFISNITAHLGDIK

SEQ ID NO: 2017661 - protein, 22 aa, Staphylococcus
IEEAAMLSAYFSKAGSSAQVPV

SEQ ID NO: 2017662 - protein, 19 aa, Staphylococcus
IEEAFAVALEAAFLNGTGK

SEQ ID NO: 2017663 - protein, 24 aa, Staphylococcus
IEEAKASGAMALFGEKYGDVVRVV

SEQ ID NO: 2017664 - protein, 17 aa, Staphylococcus
IEEEFKKKVPTTVATDK

SEQ ID NO: 2017665 - protein, 21 aa, Staphylococcus
IEEFKQIILKTIFGEHEVEEY

SEQ ID NO: 2017666 - protein, 17 aa, Staphylococcus
IEEGDMITLDFGAYYNG

SEQ ID NO: 2017667 - protein, 29 aa, Staphylococcus
IEEGMPGLTICGGYQFLGSKYITPDGTEL

SEQ ID NO: 2017668 - protein, 19 aa, Staphylococcus
IEEGVKDILTRFFNNEPFQ

SEQ ID NO: 2017669 - protein, 19 aa, Staphylococcus
IEEGYKPAMVIATAGTTNT

SEQ ID NO: 2017670 - protein, 26 aa, Staphylococcus
IEEHIPKKEARRMDRFTQYAVVAARE

SEQ ID NO: 2017671 - protein, 24 aa, Staphylococcus
IEEIEQFPKLLFISGKDDEIIPYT

SEQ ID NO: 2017672 - protein, 19 aa, Staphylococcus
IEEILTLPFFSDKKVVVIK

SEQ ID NO: 2017673 - protein, 22 aa, Staphylococcus
IEEIRKQLNVVNVQLIDPDKFE

SEQ ID NO: 2017674 - protein, 27 aa, Staphylococcus
IEELKRCITELGFKGALIMGHPNGGFL

SEQ ID NO: 2017675 - protein, 26 aa, Staphylococcus
IEEMCNRLKKVFGIYSISPVLKIEKT

SEQ ID NO: 2017676 - protein, 21 aa, Staphylococcus
IEENICKGFVLIDKKTDYLEQ

SEQ ID NO: 2017677 - protein, 19 aa, Staphylococcus
IEEPGIRFEDTMFLLNTLA

SEQ ID NO: 2017678 - protein, 19 aa, Staphylococcus
IEERLKAILDQGIAHGKHI

SEQ ID NO: 2017679 - protein, 35 aa, Staphylococcus
IEERSLLYEKMKHYFIFNFPQRPGALKEFVNDVLG

SEQ ID NO: 2017680 - protein, 19 aa, Staphylococcus
IEESPCAAISESMREAMCN

SEQ ID NO: 2017681 - protein, 26 aa, Staphylococcus
IEETFGVTCEFEFKKDYPALYNDPEF

SEQ ID NO: 2017682 - protein, 26 aa, Staphylococcus
IEEWKEWLRHVFKQDIANLSIHLRTR

SEQ ID NO: 2017683 - protein, 23 aa, Staphylococcus
IEEYRDCFNEETFAARYSDILNK

SEQ ID NO: 2017684 - protein, 22 aa, Staphylococcus
IEEYRHKLSYIPEAPVIYEELT

SEQ ID NO: 2017685 - protein, 24 aa, Staphylococcus
IEEYRSCFDEELFASRYSDILDKY

SEQ ID NO: 2017686 - protein, 26 aa, Staphylococcus
IEFACVSLGYFREWRTKNIYREMSHA

SEQ ID NO: 2017687 - protein, 19 aa, Staphylococcus
IEFGSTRIKTVAIDDDFNT

SEQ ID NO: 2017688 - protein, 19 aa, Staphylococcus
IEFGSTRIKTVAVDENCVT

SEQ ID NO: 2017689 - protein, 21 aa, Staphylococcus
IEFIAPMRTFYLLARECLISE

SEQ ID NO: 2017690 - protein, 24 aa, Staphylococcus
IEFNHPRINRIIYFHSPQSEKQLS

SEQ ID NO: 2017691 - protein, 17 aa, Staphylococcus
IEFRHCSEKIEMEDEPV

SEQ ID NO: 2017692 - protein, 21 aa, Staphylococcus
IEGANKFIAPSMRGGMTYVNM

SEQ ID NO: 2017693 - protein, 25 aa, Staphylococcus
IEGANLPSVIGWRTIQDTEQIIDIA

SEQ ID NO: 2017694 - protein, 17 aa, Staphylococcus
IEGARDFEFEHNGDRLG

SEQ ID NO: 2017695 - protein, 18 aa, Staphylococcus
IEGARPLVNHSWFEELSI

SEQ ID NO: 2017696 - protein, 25 aa, Staphylococcus
IEGDQITCLYPFSLNPTHFKVTIPD

SEQ ID NO: 2017697 - protein, 20 aa, Staphylococcus
IEGFTLRLESKFNTEQMLNI

SEQ ID NO: 2017698 - protein, 25 aa, Staphylococcus
IEGIDKFHVAGSFRRVKEMSKDLDY

SEQ ID NO: 2017699 - protein, 24 aa, Staphylococcus
IEGIKSIFQAMNFISVDKKADYEW

SEQ ID NO: 2017700 - protein, 18 aa, Staphylococcus
IEGKDCINHIDGNPKNNN

SEQ ID NO: 2017701 - protein, 20 aa, Staphylococcus
IEGKEIKKIIAVPQKLVNIV

SEQ ID NO: 2017702 - protein, 20 aa, Staphylococcus
IEGKEIKKVIAVPQKLVNIV

SEQ ID NO: 2017703 - protein, 17 aa, Staphylococcus
IEGKVAIYVPTYREHKQ

SEQ ID NO: 2017704 - protein, 24 aa, Staphylococcus
IEGLEELSHYWATVRPYYADFESD

SEQ ID NO: 2017705 - protein, 20 aa, Staphylococcus
IEGLGGIRIEDDILITKNGN

SEQ ID NO: 2017706 - protein, 22 aa, Staphylococcus
IEGLMSKLIDDIRHLSVELRPS

SEQ ID NO: 2017707 - protein, 24 aa, Staphylococcus
IEGLRTLWQEKILKENPDLKSHMI

SEQ ID NO: 2017708 - protein, 19 aa, Staphylococcus
IEGNSGLFVAMPSKRTPDG

SEQ ID NO: 2017709 - protein, 17 aa, Staphylococcus
IEGPIIWVDDTLLALQE

SEQ ID NO: 2017710 - protein, 17 aa, Staphylococcus
IEGPIIWVEDTLKALQD

SEQ ID NO: 2017711 - protein, 25 aa, Staphylococcus
IEGQCLHCSKLCFEHPVNKKMIHIE

SEQ ID NO: 2017712 - protein, 17 aa, Staphylococcus
IEGQLILQHFTKTVNVE

SEQ ID NO: 2017713 - protein, 18 aa, Staphylococcus
IEGRTDLRDELTITIDGA

SEQ ID NO: 2017714 - protein, 19 aa, Staphylococcus
IEGTNAFRLFNAEGDGVGG

SEQ ID NO: 2017715 - protein, 19 aa, Staphylococcus
IEHFNIPQSATLVIGDSDN

SEQ ID NO: 2017716 - protein, 17 aa, Staphylococcus
IEHIDNIVLPSKAAHPN

SEQ ID NO: 2017717 - protein, 17 aa, Staphylococcus
IEHKPKLIVAGASAYSR

SEQ ID NO: 2017718 - protein, 20 aa, Staphylococcus
IEHLKGDYLYQERDHEDIEL

SEQ ID NO: 2017719 - protein, 25 aa, Staphylococcus
IEHLLEIRGLGIINVMTLFGAGSIL

SEQ ID NO: 2017720 - protein, 21 aa, Staphylococcus
IEHNAHVLVIFQGPDAYISST

SEQ ID NO: 2017721 - protein, 24 aa, Staphylococcus
IEHNLSIMCEADWIIDVGPGPGLD

SEQ ID NO: 2017722 - protein, 18 aa, Staphylococcus
IEHNLTALTFNYLRSQDV

SEQ ID NO: 2017723 - protein, 17 aa, Staphylococcus
IEHYGGNIVPNFRPVHG

SEQ ID NO: 2017724 - protein, 17 aa, Staphylococcus
IEIAPLAYMRGRTLDDA

SEQ ID NO: 2017725 - protein, 18 aa, Staphylococcus
IEIDDVNLIMGFVKVFGK

SEQ ID NO: 2017726 - protein, 23 aa, Staphylococcus
IEIDEDFLLVKREIFSTGKSICR

SEQ ID NO: 2017727 - protein, 17 aa, Staphylococcus
IEIEAILKGALEQPDSL

SEQ ID NO: 2017728 - protein, 21 aa, Staphylococcus
IEIGDTIVPFTPFTQLSEHRY

SEQ ID NO: 2017729 - protein, 17 aa, Staphylococcus
IEIGELSGELAIQLIEG

SEQ ID NO: 2017730 - protein, 21 aa, Staphylococcus
IEIGGDCFDHVTISGGNPALI

SEQ ID NO: 2017731 - protein, 23 aa, Staphylococcus
IEIGPGKVLSGLIKKINRDIKLT

SEQ ID NO: 2017732 - protein, 22 aa, Staphylococcus
IEIGPGKVLSGLIKKINRDVKL

SEQ ID NO: 2017733 - protein, 18 aa, Staphylococcus
IEIIDLGKGFNLHEVNVN

SEQ ID NO: 2017734 - protein, 26 aa, Staphylococcus
IEIIEFAKSINFEFASYMSASKFYKD

SEQ ID NO: 2017735 - protein, 24 aa, Staphylococcus
IEIIYPSHIVKVFINLYKNNQSIY

SEQ ID NO: 2017736 - protein, 21 aa, Staphylococcus
IEIKQAPFFELYGPGDTQSES

SEQ ID NO: 2017737 - protein, 21 aa, Staphylococcus
IEIKRGELLQGDIEREEDDKS

SEQ ID NO: 2017738 - protein, 22 aa, Staphylococcus
IEIKSYRVLHKVSKEQLNLVDL

SEQ ID NO: 2017739 - protein, 17 aa, Staphylococcus
IEIKTVIGFGAPNKEGS

SEQ ID NO: 2017740 - protein, 26 aa, Staphylococcus
IEILHVLKRFKAMLIQKNESVESMQG

SEQ ID NO: 2017741 - protein, 26 aa, Staphylococcus
IEILHVLKRFKAMLIQKNETVESMQG

SEQ ID NO: 2017742 - protein, 21 aa, Staphylococcus
IEILKPAVMMNLLGKDLDLLE

SEQ ID NO: 2017743 - protein, 17 aa, Staphylococcus
IEILKYIIRNCEKVLWG

SEQ ID NO: 2017744 - protein, 17 aa, Staphylococcus
IEILTSEGIVFQSFDEV

SEQ ID NO: 2017745 - protein, 23 aa, Staphylococcus
IEIMHKSEWIKHADIYIDGFYNF

SEQ ID NO: 2017746 - protein, 20 aa, Staphylococcus
IEINAYIPGIGHNLQEHSVV

SEQ ID NO: 2017747 - protein, 17 aa, Staphylococcus
IEIPFAESIGTSLDLEN

SEQ ID NO: 2017748 - protein, 17 aa, Staphylococcus
IEIPIDLLPYLFFQFAK

SEQ ID NO: 2017749 - protein, 27 aa, Staphylococcus
IEIPLELLPYLFFQFAKDGKRLYDDNS

SEQ ID NO: 2017750 - protein, 17 aa, Staphylococcus
IEIPSDVTVDIKGNVIT

SEQ ID NO: 2017751 - protein, 17 aa, Staphylococcus
IEIPSYINSIRTWHNIR

SEQ ID NO: 2017752 - protein, 18 aa, Staphylococcus
IEIQQWFKRANELGITIT

SEQ ID NO: 2017753 - protein, 20 aa, Staphylococcus
IEIRRYLHEHPELSFHEEET

SEQ ID NO: 2017754 - protein, 20 aa, Staphylococcus
IEIRRYLHQHPELSFKEQET

SEQ ID NO: 2017755 - protein, 21 aa, Staphylococcus
IEIRRYLHQHPELSFKEVETP

SEQ ID NO: 2017756 - protein, 17 aa, Staphylococcus
IEISELGLGCMSLGTEY

SEQ ID NO: 2017757 - protein, 17 aa, Staphylococcus
IEITEVYAANKLSQNRT

SEQ ID NO: 2017758 - protein, 17 aa, Staphylococcus
IEITGNEAFNFVQYILS

SEQ ID NO: 2017759 - protein, 17 aa, Staphylococcus
IEKAGGTARVFLGDVTK

SEQ ID NO: 2017760 - protein, 25 aa, Staphylococcus
IEKAGQRAVLLPGDLRNEQFNYDLV

SEQ ID NO: 2017761 - protein, 19 aa, Staphylococcus
IEKALNIIEDIPLFERTQT

SEQ ID NO: 2017762 - protein, 17 aa, Staphylococcus
IEKANGELLQFNSEAEI

SEQ ID NO: 2017763 - protein, 25 aa, Staphylococcus
IEKAPNLKIAITAGVGSDHVDLEAA

SEQ ID NO: 2017764 - protein, 23 aa, Staphylococcus
IEKDSEILLAFAQKNYNDKERIE

SEQ ID NO: 2017765 - protein, 27 aa, Staphylococcus
IEKERIAGTCTNWGCNAKILLENPFEV

SEQ ID NO: 2017766 - protein, 18 aa, Staphylococcus
IEKGFNLKGIKQIITNNQ

SEQ ID NO: 2017767 - protein, 24 aa, Staphylococcus
IEKGHEIMKAHGLSNIVVHAPYII

SEQ ID NO: 2017768 - protein, 21 aa, Staphylococcus
IEKGKEMTFEANVVVEPEVQL

SEQ ID NO: 2017769 - protein, 26 aa, Staphylococcus
IEKGNIWLDPGIGFAKSRSEEKEVMA

SEQ ID NO: 2017770 - protein, 23 aa, Staphylococcus
IEKGSEVLKTFSPEFYTEGYGYV

SEQ ID NO: 2017771 - protein, 18 aa, Staphylococcus
IEKGWFKEEALEIEMIEP

SEQ ID NO: 2017772 - protein, 24 aa, Staphylococcus
IEKGYCLLVGVGKNSTEADIEVLA

SEQ ID NO: 2017773 - protein, 24 aa, Staphylococcus
IEKHHLKVIGGFQFSSHKSDDEWR

SEQ ID NO: 2017774 - protein, 25 aa, Staphylococcus
IEKIKEAFSMKDFKIVVTGNNGVGK

SEQ ID NO: 2017775 - protein, 21 aa, Staphylococcus
IEKKEARRMDRFTQYAVVAAR

SEQ ID NO: 2017776 - protein, 17 aa, Staphylococcus
IEKKFLVSRYKITQHFT

SEQ ID NO: 2017777 - protein, 20 aa, Staphylococcus
IEKKLVRWNKIVKEAAEQSY

SEQ ID NO: 2017778 - protein, 27 aa, Staphylococcus
IEKLDYIQYLGVDYIWLTPVYESPMND

SEQ ID NO: 2017779 - protein, 24 aa, Staphylococcus
IEKLTFMHAYNCICANVPAQIACI

SEQ ID NO: 2017780 - protein, 25 aa, Staphylococcus
IEKLTFMHAYNCICANVPAQIACIA

SEQ ID NO: 2017781 - protein, 17 aa, Staphylococcus
IEKLVWMGGTFLEKGNV

SEQ ID NO: 2017782 - protein, 24 aa, Staphylococcus
IEKMKLPGITLYPETERFYPNGNF

SEQ ID NO: 2017783 - protein, 23 aa, Staphylococcus
IEKMKLPGITLYPETERFYPNGV

SEQ ID NO: 2017784 - protein, 20 aa, Staphylococcus
IEKPDIIVVAGDLYDTSYPS

SEQ ID NO: 2017785 - protein, 25 aa, Staphylococcus
IEKQGRVCLLEDFISKSNNDRVIEI

SEQ ID NO: 2017786 - protein, 25 aa, Staphylococcus
IEKQLKLANEMGVTIDARYGDVTKQ

SEQ ID NO: 2017787 - protein, 17 aa, Staphylococcus
IEKSKHAQREWERVPQP

SEQ ID NO: 2017788 - protein, 23 aa, Staphylococcus
IEKSKQAQLEWEKIPQPTRAEHV

SEQ ID NO: 2017789 - protein, 17 aa, Staphylococcus
IEKVEILISPNKGEPLK

SEQ ID NO: 2017790 - protein, 25 aa, Staphylococcus
IEKVHFVGTFTVEFFIDKSNHLYVN

SEQ ID NO: 2017791 - protein, 18 aa, Staphylococcus
IEKYEHVMHIVSEVRGEI

SEQ ID NO: 2017792 - protein, 20 aa, Staphylococcus
IEKYKHASIFYSLGNLTSAD

SEQ ID NO: 2017793 - protein, 17 aa, Staphylococcus
IEKYKIATPIKVSIDTN

SEQ ID NO: 2017794 - protein, 26 aa, Staphylococcus
IEKYLGKRYKVIASMGHVRDLPRSQM

SEQ ID NO: 2017795 - protein, 17 aa, Staphylococcus
IELAGLILESTSPGIQS

SEQ ID NO: 2017796 - protein, 18 aa, Staphylococcus
IELDIKNDFDLFIVTMGE

SEQ ID NO: 2017797 - protein, 17 aa, Staphylococcus
IELEDVNLIMGFVKVFG

SEQ ID NO: 2017798 - protein, 26 aa, Staphylococcus
IELFREFEAKYGIDYECPIYNFGDQD

SEQ ID NO: 2017799 - protein, 17 aa, Staphylococcus
IELGEIENIINLVEGVS

SEQ ID NO: 2017800 - protein, 27 aa, Staphylococcus
IELKRIKLYYKRFFGLEPSALETNHSV

SEQ ID NO: 2017801 - protein, 19 aa, Staphylococcus
IELMNAGFQHLQFRRIIIE

SEQ ID NO: 2017802 - protein, 20 aa, Staphylococcus
IELNEAGLIELDFNKMIDAI

SEQ ID NO: 2017803 - protein, 17 aa, Staphylococcus
IELNEMCTAITPCNVIG

SEQ ID NO: 2017804 - protein, 24 aa, Staphylococcus
IELPYGAVPIDFAYAIHSEVGNKM

SEQ ID NO: 2017805 - protein, 24 aa, Staphylococcus
IELPYGAVPIDFAYAVHSEVGNKM

SEQ ID NO: 2017806 - protein, 25 aa, Staphylococcus
IELRTEPKLSLPTARSIIAIAVGYP

SEQ ID NO: 2017807 - protein, 17 aa, Staphylococcus
IELSSGISLPAGELAKL

SEQ ID NO: 2017808 - protein, 17 aa, Staphylococcus
IELTEEIADNEGLTVDM

SEQ ID NO: 2017809 - protein, 22 aa, Staphylococcus
IELTSGTGIFVIIVRSFSHYTT

SEQ ID NO: 2017810 - protein, 20 aa, Staphylococcus
IELVKVGGRISVITFHSLED

SEQ ID NO: 2017811 - protein, 17 aa, Staphylococcus
IELWAAEVVLKLQDTHP

SEQ ID NO: 2017812 - protein, 17 aa, Staphylococcus
IELYKAREMSVGYKFGP

SEQ ID NO: 2017813 - protein, 21 aa, Staphylococcus
IEMAEASGLHLLTHEERNPLQ

SEQ ID NO: 2017814 - protein, 36 aa, Staphylococcus
IEMIKGILGKIPFFGICLGHQLFALSQGGTSFKMKF

SEQ ID NO: 2017815 - protein, 24 aa, Staphylococcus
IEMISLIQCFSLLNMPLKQIKQNV

SEQ ID NO: 2017816 - protein, 27 aa, Staphylococcus
IEMLNFLLTAGAFGFVIANNASISGAA

SEQ ID NO: 2017817 - protein, 21 aa, Staphylococcus
IEMLQHAKVGYFVNNESMDVS

SEQ ID NO: 2017818 - protein, 17 aa, Staphylococcus
IEMNARIQVEHTVTEMR

SEQ ID NO: 2017819 - protein, 17 aa, Staphylococcus
IEMNRTLMPFAYIFRCI

SEQ ID NO: 2017820 - protein, 17 aa, Staphylococcus
IEMPESFTDFKMGIQIR

SEQ ID NO: 2017821 - protein, 18 aa, Staphylococcus
IEMSRDILYQRINTRVDI

SEQ ID NO: 2017822 - protein, 19 aa, Staphylococcus
IEMTEAFAAQSIPVKDHLK

SEQ ID NO: 2017823 - protein, 17 aa, Staphylococcus
IEMVQALGVDVIVTDHH

SEQ ID NO: 2017824 - protein, 20 aa, Staphylococcus
IEMWTAEVVISLKEEYPDLK

SEQ ID NO: 2017825 - protein, 17 aa, Staphylococcus
IENEGAFDNDQAMKQPI

SEQ ID NO: 2017826 - protein, 22 aa, Staphylococcus
IENFKFFVQYGNFKDINDYGDG

SEQ ID NO: 2017827 - protein, 21 aa, Staphylococcus
IENGFQCCLNASIVSEQLLQQ

SEQ ID NO: 2017828 - protein, 17 aa, Staphylococcus
IENIIFDFAKKGVAILW

SEQ ID NO: 2017829 - protein, 26 aa, Staphylococcus
IENIMPYKAAPEFWGYEDTIKIFLQH

SEQ ID NO: 2017830 - protein, 23 aa, Staphylococcus
IENISLPALKSFSKGGFLTPTAM

SEQ ID NO: 2017831 - protein, 17 aa, Staphylococcus
IENRIVQFYTDLNTDGR

SEQ ID NO: 2017832 - protein, 25 aa, Staphylococcus
IENRPIFQEALNFVRMGDRLVVESI

SEQ ID NO: 2017833 - protein, 17 aa, Staphylococcus
IENRVVQFYTDLNTDGR

SEQ ID NO: 2017834 - protein, 19 aa, Staphylococcus
IENSYLIYRYINGLNLHKE

SEQ ID NO: 2017835 - protein, 17 aa, Staphylococcus
IENVKWTSMVNHYQQWD

SEQ ID NO: 2017836 - protein, 18 aa, Staphylococcus
IEPGARTAIMTTKNNDVL

SEQ ID NO: 2017837 - protein, 17 aa, Staphylococcus
IEPKKIYFIYSKLDKAA

SEQ ID NO: 2017838 - protein, 22 aa, Staphylococcus
IEPLNYDSLMKFGSNAQSSMSQ

SEQ ID NO: 2017839 - protein, 25 aa, Staphylococcus
IEPNDPIIHFALAELLYFDGQYLRA

SEQ ID NO: 2017840 - protein, 23 aa, Staphylococcus
IEPNDPIIHYALAELLYYDGQYL

SEQ ID NO: 2017841 - protein, 21 aa, Staphylococcus
IEPRTHLTIGNLVTADDTVKK

SEQ ID NO: 2017842 - protein, 19 aa, Staphylococcus
IEPSPIWVQARLIKAGIRP

SEQ ID NO: 2017843 - protein, 18 aa, Staphylococcus
IEQACEVFEQKLDAFEKL

SEQ ID NO: 2017844 - protein, 19 aa, Staphylococcus
IEQACEVFEQKLEAFEKLM

SEQ ID NO: 2017845 - protein, 19 aa, Staphylococcus
IEQACKVFEQKLDAFEKLM

SEQ ID NO: 2017846 - protein, 17 aa, Staphylococcus
IEQAPSLVFFSEDVHEE

SEQ ID NO: 2017847 - protein, 29 aa, Staphylococcus
IEQFRQLFILPQGEFKKFLFSKSSAKQEI

SEQ ID NO: 2017848 - protein, 17 aa, Staphylococcus
IEQGDMITLDFGAYYHG

SEQ ID NO: 2017849 - protein, 19 aa, Staphylococcus
IEQIHRSYIQAGADVIQTN

SEQ ID NO: 2017850 - protein, 25 aa, Staphylococcus
IEQKKGPFAPDFIKVWKERYKKIRN

SEQ ID NO: 2017851 - protein, 25 aa, Staphylococcus
IEQKKGPFAPDFIKVWKQRYKKIRN

SEQ ID NO: 2017852 - protein, 25 aa, Staphylococcus
IEQKKGPFAPDFIKVWKQRYKKVRD

SEQ ID NO: 2017853 - protein, 24 aa, Staphylococcus
IEQVKPRLDAMIQEFKADEVLVVP

SEQ ID NO: 2017854 - protein, 17 aa, Staphylococcus
IEQVSMFEILNAHQDLI

SEQ ID NO: 2017855 - protein, 17 aa, Staphylococcus
IEQVSMFEILNAHSDLI

SEQ ID NO: 2017856 - protein, 17 aa, Staphylococcus
IEQVSMFEILSAHQDLI

SEQ ID NO: 2017857 - protein, 24 aa, Staphylococcus
IEQYCQFNGYELVDIYADRGISGK

SEQ ID NO: 2017858 - protein, 18 aa, Staphylococcus
IEQYLSLLAQQEVKVTFT

SEQ ID NO: 2017859 - protein, 20 aa, Staphylococcus
IERAKTIIIHRHVRPDPDAY

SEQ ID NO: 2017860 - protein, 22 aa, Staphylococcus
IERCYCVIPLELFEDEAPLKRT

SEQ ID NO: 2017861 - protein, 17 aa, Staphylococcus
IEREAWLNIVDTLLDEG

SEQ ID NO: 2017862 - protein, 25 aa, Staphylococcus
IERFKEVYQIFSDVLGVPLKGQEAD

SEQ ID NO: 2017863 - protein, 22 aa, Staphylococcus
IERFKIELHKYIQTNRNERNKG

SEQ ID NO: 2017864 - protein, 22 aa, Staphylococcus
IERIGAAGGRLHTGRSRNDQVA

SEQ ID NO: 2017865 - protein, 19 aa, Staphylococcus
IERIKAIVPIWKKEIWEDG

SEQ ID NO: 2017866 - protein, 22 aa, Staphylococcus
IERKGLKLVGAKLMTVPQALAE

SEQ ID NO: 2017867 - protein, 19 aa, Staphylococcus
IERLKRYGSLVYDTQQNGE

SEQ ID NO: 2017868 - protein, 22 aa, Staphylococcus
IERLPLQWRSFFTNGKVIDLYE

SEQ ID NO: 2017869 - protein, 17 aa, Staphylococcus
IERLRDLNITFTLLRPT

SEQ ID NO: 2017870 - protein, 17 aa, Staphylococcus
IERLRPYAIEHAVPIVD

SEQ ID NO: 2017871 - protein, 27 aa, Staphylococcus
IERMEKRYKGPIAFEYNHINNNKERTW

SEQ ID NO: 2017872 - protein, 17 aa, Staphylococcus
IERRLEKHLSEKIEIAK

SEQ ID NO: 2017873 - protein, 18 aa, Staphylococcus
IERSCKFYGNNYLSKKAE

SEQ ID NO: 2017874 - protein, 21 aa, Staphylococcus
IERVKNIKLGNGFDSETEMGP

SEQ ID NO: 2017875 - protein, 23 aa, Staphylococcus
IERVPSIEKIRMVSSGTEATLDT

SEQ ID NO: 2017876 - protein, 23 aa, Staphylococcus
IERVPSIEKVRMVSSGTEATLDT

SEQ ID NO: 2017877 - protein, 20 aa, Staphylococcus
IERYPTRRIELRDHLLSEEQ

SEQ ID NO: 2017878 - protein, 18 aa, Staphylococcus
IESAERLGFPEARIPLSQ

SEQ ID NO: 2017879 - protein, 22 aa, Staphylococcus
IESCSLRSSHKKMIDVNLTTKP

SEQ ID NO: 2017880 - protein, 22 aa, Staphylococcus
IESDEVDLFFNIGGAPEGVVLG

SEQ ID NO: 2017881 - protein, 24 aa, Staphylococcus
IESEIKKNSSYERIYDKAKNEGMS

SEQ ID NO: 2017882 - protein, 22 aa, Staphylococcus
IESGHFYTLLGPSGCGKTTILK

SEQ ID NO: 2017883 - protein, 18 aa, Staphylococcus
IESGKGFIGQQFMNDKAF

SEQ ID NO: 2017884 - protein, 25 aa, Staphylococcus
IESGKLADLVLWDPAFFGVKPELVV

SEQ ID NO: 2017885 - protein, 26 aa, Staphylococcus
IESIFKLLSTEGIIVLVIYHGHKEGQ

SEQ ID NO: 2017886 - protein, 20 aa, Staphylococcus
IESIKWLNKKLHSHGKRLEK

SEQ ID NO: 2017887 - protein, 20 aa, Staphylococcus
IESKGIKSVRARVGNIRDSL

SEQ ID NO: 2017888 - protein, 20 aa, Staphylococcus
IESKGIKSVRARVGQIRDAL

SEQ ID NO: 2017889 - protein, 22 aa, Staphylococcus
IESKRGGGGYIRITKIENKDAS

SEQ ID NO: 2017890 - protein, 19 aa, Staphylococcus
IESLCGRTYLFRYQSSIFE

SEQ ID NO: 2017891 - protein, 20 aa, Staphylococcus
IESNLSALSFEYLKSHDALG

SEQ ID NO: 2017892 - protein, 24 aa, Staphylococcus
IESNLSALSFKYLTSHDALGSIIV

SEQ ID NO: 2017893 - protein, 17 aa, Staphylococcus
IESNVWLGANVVVLPGV

SEQ ID NO: 2017894 - protein, 19 aa, Staphylococcus
IESPIGRNGIKATFKGKEN

SEQ ID NO: 2017895 - protein, 19 aa, Staphylococcus
IESQLPGIQYFPISSGKLR

SEQ ID NO: 2017896 - protein, 23 aa, Staphylococcus
IESRFPYENVQWLIDEGYTLLTL

SEQ ID NO: 2017897 - protein, 19 aa, Staphylococcus
IESRGLFAMDGQATSIYTE

SEQ ID NO: 2017898 - protein, 17 aa, Staphylococcus
IESRKKYLIKQQELENN

SEQ ID NO: 2017899 - protein, 27 aa, Staphylococcus
IESRLQHTLKLPVNIVGSKSLANYLLK

SEQ ID NO: 2017900 - protein, 23 aa, Staphylococcus
IESRPLKTQLGMYHFFVQADTPI

SEQ ID NO: 2017901 - protein, 30 aa, Staphylococcus
IESRPYRVLKVGSFLLSKDGYKIFVHESER

SEQ ID NO: 2017902 - protein, 22 aa, Staphylococcus
IESSKYYQGRLDRIEVEKVLLY

SEQ ID NO: 2017903 - protein, 19 aa, Staphylococcus
IESVCWTGRIEQVKEKPLI

SEQ ID NO: 2017904 - protein, 19 aa, Staphylococcus
IESVLKYGAVDTVITATDT

SEQ ID NO: 2017905 - protein, 18 aa, Staphylococcus
IESYKLYIDNGGSTKLVL

SEQ ID NO: 2017906 - protein, 17 aa, Staphylococcus
IETAKIVVIESYIPDDF

SEQ ID NO: 2017907 - protein, 17 aa, Staphylococcus
IETAKIVVIESYMPEAY

SEQ ID NO: 2017908 - protein, 29 aa, Staphylococcus
IETARKAGIPVIFVRVAFSKNFSEVSPNN

SEQ ID NO: 2017909 - protein, 25 aa, Staphylococcus
IETCKEVAPRLEIHLSTQQSLSNYK

SEQ ID NO: 2017910 - protein, 17 aa, Staphylococcus
IETCKKVAPELEIHLST

SEQ ID NO: 2017911 - protein, 17 aa, Staphylococcus
IETFVDFDINNHNEKGD

SEQ ID NO: 2017912 - protein, 25 aa, Staphylococcus
IETIKRYHFDKVFIGMNGVDLEKGL

SEQ ID NO: 2017913 - protein, 17 aa, Staphylococcus
IETLDLISKKHFKNREK

SEQ ID NO: 2017914 - protein, 24 aa, Staphylococcus
IETLKEAKPYLFADNKPVGNKPAD

SEQ ID NO: 2017915 - protein, 18 aa, Staphylococcus
IETLKQVDIIACEDTRVT

SEQ ID NO: 2017916 - protein, 26 aa, Staphylococcus
IETMALPPCHTMFQFYVQDGKLSCQL

SEQ ID NO: 2017917 - protein, 22 aa, Staphylococcus
IETPLARKMIRENLPEDTTIDI

SEQ ID NO: 2017918 - protein, 22 aa, Staphylococcus
IETPLARMMIKEHMPEGTNVYV

SEQ ID NO: 2017919 - protein, 19 aa, Staphylococcus
IETPLARMMIKENLPEGTK

SEQ ID NO: 2017920 - protein, 19 aa, Staphylococcus
IETPLARMMIKENMPEGTK

SEQ ID NO: 2017921 - protein, 19 aa, Staphylococcus
IETPLARMMIKESLPEGTT

SEQ ID NO: 2017922 - protein, 20 aa, Staphylococcus
IETPLARMMIKESLPEGTTV

SEQ ID NO: 2017923 - protein, 19 aa, Staphylococcus
IETPLARMMIKESMPEGTV

SEQ ID NO: 2017924 - protein, 20 aa, Staphylococcus
IETPRACLIADQLAQHCDFF

SEQ ID NO: 2017925 - protein, 32 aa, Staphylococcus
IETPRACLIAGELAEHCDFFSFGTNDLTQLAY

SEQ ID NO: 2017926 - protein, 19 aa, Staphylococcus
IETPRACLIAQQLAQHCDF

SEQ ID NO: 2017927 - protein, 32 aa, Staphylococcus
IETPRACLIASELAKECDFFSFGTNDLTQLTF

SEQ ID NO: 2017928 - protein, 17 aa, Staphylococcus
IETPRACLISDELAKHC

SEQ ID NO: 2017929 - protein, 20 aa, Staphylococcus
IETQRYAYDFIKINKDSGMS

SEQ ID NO: 2017930 - protein, 23 aa, Staphylococcus
IETRRLGVGKGDFQVSERDPMLI

SEQ ID NO: 2017931 - protein, 25 aa, Staphylococcus
IEVATYLKDLFEAHHINAEIDVIEG

SEQ ID NO: 2017932 - protein, 20 aa, Staphylococcus
IEVEDPLKLIVRANGHTGFE

SEQ ID NO: 2017933 - protein, 18 aa, Staphylococcus
IEVFKGDHIAVIGPNGVG

SEQ ID NO: 2017934 - protein, 21 aa, Staphylococcus
IEVLPGTSFNEFVIKLDKPVK

SEQ ID NO: 2017935 - protein, 24 aa, Staphylococcus
IEVNTRLVLEKGLTMFGSSRSGAQ

SEQ ID NO: 2017936 - protein, 27 aa, Staphylococcus
IEVPIELLPYLFFQFAKDGKRMYDDNA

SEQ ID NO: 2017937 - protein, 21 aa, Staphylococcus
IEVRLGDGLAVINHDDEIDNI

SEQ ID NO: 2017938 - protein, 17 aa, Staphylococcus
IEVRQMFHDLGWKTVVG

SEQ ID NO: 2017939 - protein, 19 aa, Staphylococcus
IEVTLDWIFHNDIPLAYKT

SEQ ID NO: 2017940 - protein, 19 aa, Staphylococcus
IEVTLDWIFHNNIPLAYKT

SEQ ID NO: 2017941 - protein, 20 aa, Staphylococcus
IEVTLELKLLADVGLVGFPS

SEQ ID NO: 2017942 - protein, 20 aa, Staphylococcus
IEVTRFNKKASREVTTSEFV

SEQ ID NO: 2017943 - protein, 20 aa, Staphylococcus
IEVTRFNKKASREVTTTEFV

SEQ ID NO: 2017944 - protein, 24 aa, Staphylococcus
IEVTRPRGTSVIVAIFGHPVEFNP

SEQ ID NO: 2017945 - protein, 25 aa, Staphylococcus
IEVVVLKPFRLGGIDKVMDLIKMLN

SEQ ID NO: 2017946 - protein, 20 aa, Staphylococcus
IEVYFEKEIEPVSLSTLNKH

SEQ ID NO: 2017947 - protein, 19 aa, Staphylococcus
IEWLLAQGVDHFIEIGPGK

SEQ ID NO: 2017948 - protein, 18 aa, Staphylococcus
IEWQLQFRLLELRDELTC

SEQ ID NO: 2017949 - protein, 20 aa, Staphylococcus
IEWSLNVTGITEFRHQSIND

SEQ ID NO: 2017950 - protein, 17 aa, Staphylococcus
IEYAKNKGYHLINYYDI

SEQ ID NO: 2017951 - protein, 24 aa, Staphylococcus
IEYDAIVPTQLWPTLETKSIKNLY

SEQ ID NO: 2017952 - protein, 21 aa, Staphylococcus
IEYDALVPTQLWPTLETKKIK

SEQ ID NO: 2017953 - protein, 21 aa, Staphylococcus
IEYDGRTGLDKALNKSYDLII

SEQ ID NO: 2017954 - protein, 17 aa, Staphylococcus
IEYEPNLTLYDYFKTWC

SEQ ID NO: 2017955 - protein, 20 aa, Staphylococcus
IEYGPRIQPIIIKSQALMQG

SEQ ID NO: 2017956 - protein, 17 aa, Staphylococcus
IEYKNFYPAETYHQDYY

SEQ ID NO: 2017957 - protein, 30 aa, Staphylococcus
IEYKYKIPHGHAVMIGIVYQFIVANHLLKT

SEQ ID NO: 2017958 - protein, 23 aa, Staphylococcus
IEYNHLRINKIVYFHTPQSSKQL

SEQ ID NO: 2017959 - protein, 17 aa, Staphylococcus
IEYNLGFRLKVVSGGNS

SEQ ID NO: 2017960 - protein, 26 aa, Staphylococcus
IEYSKRIKNSPLWDTKDNTLTDFTAE

SEQ ID NO: 2017961 - protein, 21 aa, Staphylococcus
IEYYMGIPIEKSFSLMSSVDL

SEQ ID NO: 2017962 - protein, 28 aa, Staphylococcus
IEYYREIVFKLAAKRNLIRVADQIAKDG

SEQ ID NO: 2017963 - protein, 17 aa, Staphylococcus
IFAELYQHCDIYLDINQ

SEQ ID NO: 2017964 - protein, 25 aa, Staphylococcus
IFAESRLQTNLIHRVDEAVQIQPNL

SEQ ID NO: 2017965 - protein, 18 aa, Staphylococcus
IFAKYVPTAMMFVPSING

SEQ ID NO: 2017966 - protein, 19 aa, Staphylococcus
IFANGALKAAERLVTKPKG

SEQ ID NO: 2017967 - protein, 19 aa, Staphylococcus
IFARKGAAASNHFEGGAFV

SEQ ID NO: 2017968 - protein, 25 aa, Staphylococcus
IFARKGAAASNHFEGGAFVRSNDEV

SEQ ID NO: 2017969 - protein, 25 aa, Staphylococcus
IFARKGAAASNHFEGGAFVRSNNQV

SEQ ID NO: 2017970 - protein, 19 aa, Staphylococcus
IFARKGAAASNHFEGGGFV

SEQ ID NO: 2017971 - protein, 37 aa, Staphylococcus
IFATAMNRKGYYLYGYRHFSSRIKGGHTNNKIRVSLT

SEQ ID NO: 2017972 - protein, 28 aa, Staphylococcus
IFAVGRVELRDAIPVIVTVAYDLTGKFE

SEQ ID NO: 2017973 - protein, 19 aa, Staphylococcus
IFAYKRLKQNQIISNPFAI

SEQ ID NO: 2017974 - protein, 19 aa, Staphylococcus
IFAYKRLKQNQIISNPFAM

SEQ ID NO: 2017975 - protein, 24 aa, Staphylococcus
IFAYKRLKQNQVISNPFAIETQHL

SEQ ID NO: 2017976 - protein, 25 aa, Staphylococcus
IFDEKRLSKSPAMFDRQKLAWVNNQ

SEQ ID NO: 2017977 - protein, 19 aa, Staphylococcus
IFDENRLQKSPAFFDKKKL

SEQ ID NO: 2017978 - protein, 20 aa, Staphylococcus
IFDEQRLSKSPAMFDRQKLA

SEQ ID NO: 2017979 - protein, 33 aa, Staphylococcus
IFDEVMTGFRVGYHCAQGYFNVIPDLTCLGKVI

SEQ ID NO: 2017980 - protein, 28 aa, Staphylococcus
IFDEVMTGFRVGYNCAQGYFDVTPDLTC

SEQ ID NO: 2017981 - protein, 29 aa, Staphylococcus
IFDEVMTGFRVGYNCAQGYFGVTPDLTCL

SEQ ID NO: 2017982 - protein, 20 aa, Staphylococcus
IFDKEILLNHGILTDNHHQG

SEQ ID NO: 2017983 - protein, 20 aa, Staphylococcus
IFDLILKFADYGFARAHAVS

SEQ ID NO: 2017984 - protein, 19 aa, Staphylococcus
IFDLILKFADYGFPRAHAV

SEQ ID NO: 2017985 - protein, 24 aa, Staphylococcus
IFDLSLKRDIFFHHPYESFEPIVD

SEQ ID NO: 2017986 - protein, 25 aa, Staphylococcus
IFDWAGTMIDFGCFAPVHVFIDIFK

SEQ ID NO: 2017987 - protein, 17 aa, Staphylococcus
IFEDCFNAAVKRSKELS

SEQ ID NO: 2017988 - protein, 18 aa, Staphylococcus
IFEDCLNAAVKRSIELSK

SEQ ID NO: 2017989 - protein, 28 aa, Staphylococcus
IFEGVTFPESFKVFGSEHSKVIFCEADD

SEQ ID NO: 2017990 - protein, 24 aa, Staphylococcus
IFEIASNWKKLGIKTAQQAYDYAL

SEQ ID NO: 2017991 - protein, 23 aa, Staphylococcus
IFEKEGPRIMSLEPQDDNRDGVA

SEQ ID NO: 2017992 - protein, 19 aa, Staphylococcus
IFESIPYLYGDEISKSYGG

SEQ ID NO: 2017993 - protein, 22 aa, Staphylococcus
IFEYIIRKNLNISFKLEDLNLI

SEQ ID NO: 2017994 - protein, 17 aa, Staphylococcus
IFFIISLSGETTQLSDI

SEQ ID NO: 2017995 - protein, 21 aa, Staphylococcus
IFGDAFFQNFIKSINENNESE

SEQ ID NO: 2017996 - protein, 17 aa, Staphylococcus
IFGDIARRCKVILDKVG

SEQ ID NO: 2017997 - protein, 17 aa, Staphylococcus
IFGFGRIGQLVAERLKP

SEQ ID NO: 2017998 - protein, 19 aa, Staphylococcus
IFGPILPIITYDDFDEAID

SEQ ID NO: 2017999 - protein, 19 aa, Staphylococcus
IFGPILPIITYDDFDEAIQ

SEQ ID NO: 2018000 - protein, 19 aa, Staphylococcus
IFGPLLPIISYDQFDEAFE

SEQ ID NO: 2018001 - protein, 19 aa, Staphylococcus
IFGRKGAAASNHFEGGGFV

SEQ ID NO: 2018002 - protein, 24 aa, Staphylococcus
IFGSLDRFFGILIEHFKGAFPLWM

SEQ ID NO: 2018003 - protein, 18 aa, Staphylococcus
IFGVVPKPLWSKKYSVNN

SEQ ID NO: 2018004 - protein, 17 aa, Staphylococcus
IFHEKVWGGSKLQQFGY

SEQ ID NO: 2018005 - protein, 18 aa, Staphylococcus
IFHYGKISTFELSKILMW

SEQ ID NO: 2018006 - protein, 20 aa, Staphylococcus
IFISLAVKFSKARLIDNIII

SEQ ID NO: 2018007 - protein, 31 aa, Staphylococcus; identical to SEQ ID NO: 1806709

SEQ ID NO: 2018008 - protein, 18 aa, Staphylococcus
IFKPFNYLDSLDFFQKLL

SEQ ID NO: 2018009 - protein, 18 aa, Staphylococcus
IFKQLNINEPELFELESL

SEQ ID NO: 2018010 - protein, 18 aa, Staphylococcus
IFKVPAVSNQSYYKKLDN

SEQ ID NO: 2018011 - protein, 18 aa, Staphylococcus
IFLDSNFLKEDVVIVDTP

SEQ ID NO: 2018012 - protein, 18 aa, Staphylococcus
IFLHCLPAFHDTQTEYGQ

SEQ ID NO: 2018013 - protein, 17 aa, Staphylococcus
IFLRPETAQGIFVNYKN

SEQ ID NO: 2018014 - protein, 25 aa, Staphylococcus
IFMKKGRPSTQLTLICKTENASKFE

SEQ ID NO: 2018015 - protein, 17 aa, Staphylococcus
IFMSYLQFFQLPYKKKI

SEQ ID NO: 2018016 - protein, 23 aa, Staphylococcus
IFMVPARGLIGYTTEFMSMTSGY

SEQ ID NO: 2018017 - protein, 23 aa, Staphylococcus
IFMVPARGLIGYTTEFMSQTRGY

SEQ ID NO: 2018018 - protein, 17 aa, Staphylococcus
IFNEFKTVSNVASTQID

SEQ ID NO: 2018019 - protein, 26 aa, Staphylococcus
IFNGDIGIIVGIFWAKENALNKDVII

SEQ ID NO: 2018020 - protein, 26 aa, Staphylococcus
IFNGDIGIIVGIFWAKENALNKDVMV

SEQ ID NO: 2018021 - protein, 26 aa, Staphylococcus
IFNGDIGVIVGIFWAKENALNKDVIV

SEQ ID NO: 2018022 - protein, 26 aa, Staphylococcus
IFNGDIGVIVGIFWAKENALNKDVLI

SEQ ID NO: 2018023 - protein, 26 aa, Staphylococcus
IFNGDIGVIVGVFWAKENALNKDVLV

SEQ ID NO: 2018024 - protein, 17 aa, Staphylococcus
IFNGSAWEFDELTNQYY

SEQ ID NO: 2018025 - protein, 19 aa, Staphylococcus
IFNHGMTPIICVGESDEER

SEQ ID NO: 2018026 - protein, 25 aa, Staphylococcus
IFNHLFKQAITFAKRAHHETDIADN

SEQ ID NO: 2018027 - protein, 23 aa, Staphylococcus
IFNHLFKQAITFAKRAHSETDIA

SEQ ID NO: 2018028 - protein, 24 aa, Staphylococcus
IFNHLFKQAITFAKRAHSETDIAD

SEQ ID NO: 2018029 - protein, 22 aa, Staphylococcus
IFNKNVYFLLNIRHGVKNKIKK

SEQ ID NO: 2018030 - protein, 25 aa, Staphylococcus
IFNNIKRLNIETIKQENTSFIKEDS

SEQ ID NO: 2018031 - protein, 26 aa, Staphylococcus
IFNVKFLKNRVAALKENILFEKMGIT

SEQ ID NO: 2018032 - protein, 23 aa, Staphylococcus
IFNYDILVVALGFETETFGINGM

SEQ ID NO: 2018033 - protein, 19 aa, Staphylococcus
IFPELKVTIVDSLNKRIQF

SEQ ID NO: 2018034 - protein, 18 aa, Staphylococcus
IFPFICKLDDPKEVDDPT

SEQ ID NO: 2018035 - protein, 19 aa, Staphylococcus
IFPFYCKLDDPKEVDDETM

SEQ ID NO: 2018036 - protein, 24 aa, Staphylococcus
IFQEEIIGYLGLWIVIDQAQITTI

SEQ ID NO: 2018037 - protein, 17 aa, Staphylococcus
IFQGLEFTERRPFQDVL

SEQ ID NO: 2018038 - protein, 23 aa, Staphylococcus
IFQGLEFTGERPFDDVLLHGLVR

SEQ ID NO: 2018039 - protein, 21 aa, Staphylococcus
IFQKLKLPKKDLHQLNMSKDI

SEQ ID NO: 2018040 - protein, 21 aa, Staphylococcus
IFRAVGPPGKVFKRSLVMDHH

SEQ ID NO: 2018041 - protein, 18 aa, Staphylococcus
IFRHIAYERPKFDIKINL

SEQ ID NO: 2018042 - protein, 25 aa, Staphylococcus
IFRIKRNEMSLLLYISSDWFHERGY

SEQ ID NO: 2018043 - protein, 23 aa, Staphylococcus
IFRLGEGQFDIHLIPETKRATIL

SEQ ID NO: 2018044 - protein, 31 aa, Staphylococcus; identical to SEQ ID NO: 1806722

SEQ ID NO: 2018045 - protein, 30 aa, Staphylococcus
IFRRTKASINEVFSRMQSVSSQIDRITIQL

SEQ ID NO: 2018046 - protein, 23 aa, Staphylococcus
IFSRTHLIEKIWGYDYEGDERTI

SEQ ID NO: 2018047 - protein, 17 aa, Staphylococcus
IFTLAMYELGKYVTEQL

SEQ ID NO: 2018048 - protein, 18 aa, Staphylococcus
IFTNQAFDGFEVEQVKDL

SEQ ID NO: 2018049 - protein, 18 aa, Staphylococcus
IFTREFKATAEQIFKAYT

SEQ ID NO: 2018050 - protein, 18 aa, Staphylococcus
IFVAHNVDFDLNFIKKAF

SEQ ID NO: 2018051 - protein, 21 aa, Staphylococcus
IFVGMGFPKQEEWIHKHNSKF

SEQ ID NO: 2018052 - protein, 19 aa, Staphylococcus
IFVGMGFPKQEEWIQKHRH

SEQ ID NO: 2018053 - protein, 17 aa, Staphylococcus
IFVNINFFKTLMSKVNY

SEQ ID NO: 2018054 - protein, 17 aa, Staphylococcus
IFWLDCDIDVIFKRVTN

SEQ ID NO: 2018055 - protein, 18 aa, Staphylococcus
IFWLGHLDILSAHSAPGD

SEQ ID NO: 2018056 - protein, 20 aa, Staphylococcus
IFYDKCVEALAILDDLSLEM

SEQ ID NO: 2018057 - protein, 17 aa, Staphylococcus
IFYLEEEDLLPLERMGS

SEQ ID NO: 2018058 - protein, 19 aa, Staphylococcus
IFYPHVAKHARRSVNPPKD

SEQ ID NO: 2018059 - protein, 28 aa, Staphylococcus
IFYREYFKNRIVSFVEWFDTKDRLRSVD

SEQ ID NO: 2018060 - protein, 18 aa, Staphylococcus
IFYYELHRKQLLNQVKKH

SEQ ID NO: 2018061 - protein, 24 aa, Staphylococcus
IGAAGHFLYLAGIRGDMAMNGQNN

SEQ ID NO: 2018062 - protein, 21 aa, Staphylococcus
IGADCYLEPSLSASCKIINRF

SEQ ID NO: 2018063 - protein, 21 aa, Staphylococcus
IGADCYLEPSLSASIKIINRF

SEQ ID NO: 2018064 - protein, 22 aa, Staphylococcus
IGADCYLEPSLSASMKIINRFS

SEQ ID NO: 2018065 - protein, 21 aa, Staphylococcus
IGADCYLEPSLSASVKIINRF

SEQ ID NO: 2018066 - protein, 19 aa, Staphylococcus
IGAELNESFDYNVYVHHRD

SEQ ID NO: 2018067 - protein, 17 aa, Staphylococcus
IGAEVDGMITLNLVGGR

SEQ ID NO: 2018068 - protein, 19 aa, Staphylococcus
IGAEVMRLGIISTPGVAYL

SEQ ID NO: 2018069 - protein, 17 aa, Staphylococcus
IGAEVMRLGVISTPGVA

SEQ ID NO: 2018070 - protein, 18 aa, Staphylococcus
IGAEVMRLGVISTPGVAY

SEQ ID NO: 2018071 - protein, 21 aa, Staphylococcus
IGAFTEREWGFNGIFDKTNGG

SEQ ID NO: 2018072 - protein, 26 aa, Staphylococcus
IGAGRIGIGVAQRLQSFGMKVLAYDP

SEQ ID NO: 2018073 - protein, 24 aa, Staphylococcus
IGAGRIGLGVAERLKSFGMTVLAY

SEQ ID NO: 2018074 - protein, 32 aa, Staphylococcus
IGAGRIGLGVAKRAQSFGMHILAFDPYLSEDK

SEQ ID NO: 2018075 - protein, 25 aa, Staphylococcus
IGAGRIGLGVAKRAQSFGMQILAFD

SEQ ID NO: 2018076 - protein, 19 aa, Staphylococcus
IGAHPGFPDLKGFGRRKMA

SEQ ID NO: 2018077 - protein, 26 aa, Staphylococcus
IGAINRFDINFGRKFEAFLVPTVIGE

SEQ ID NO: 2018078 - protein, 20 aa, Staphylococcus
IGAITKMWTITGVAGPEDEN

SEQ ID NO: 2018079 - protein, 17 aa, Staphylococcus
IGALCGEAIVFTNNNEP

SEQ ID NO: 2018080 - protein, 22 aa, Staphylococcus
IGALGICAGGGYTVSAARTERR

SEQ ID NO: 2018081 - protein, 22 aa, Staphylococcus
IGALGKTFSKGLLMGARGNSGV

SEQ ID NO: 2018082 - protein, 21 aa, Staphylococcus
IGALIESPGVYPFMSGYDNLK

SEQ ID NO: 2018083 - protein, 25 aa, Staphylococcus
IGALTGELFAGFGAKVVGYDLYPND

SEQ ID NO: 2018084 - protein, 19 aa, Staphylococcus
IGANYAGVRAFTASSGPGL

SEQ ID NO: 2018085 - protein, 22 aa, Staphylococcus
IGANYAGVRGFTASAGPGLSLM

SEQ ID NO: 2018086 - protein, 18 aa, Staphylococcus
IGASGARLVTSLVNELHQ

SEQ ID NO: 2018087 - protein, 18 aa, Staphylococcus
IGASGARLVTTLVNALAQ

SEQ ID NO: 2018088 - protein, 26 aa, Staphylococcus
IGCHRVSPHLQDWAREGVLLLNTVLT

SEQ ID NO: 2018089 - protein, 25 aa, Staphylococcus
IGCKRTVSHLQDWAREGVLLLNTVL

SEQ ID NO: 2018090 - protein, 24 aa, Staphylococcus
IGCPIGNYIPEWNDLVYRGDFKAA

SEQ ID NO: 2018091 - protein, 17 aa, Staphylococcus
IGCSFTFEHALLEAGIP

SEQ ID NO: 2018092 - protein, 17 aa, Staphylococcus
IGCSFTFEHALLEAGLP

SEQ ID NO: 2018093 - protein, 20 aa, Staphylococcus
IGCSGRLSGYINSYGVHAIH

SEQ ID NO: 2018094 - protein, 20 aa, Staphylococcus
IGCSGRLSGYINSYGVHGIH

SEQ ID NO: 2018095 - protein, 24 aa, Staphylococcus
IGDAAHLMSPFAGEGVNMALYDAY

SEQ ID NO: 2018096 - protein, 18 aa, Staphylococcus
IGDDIALYGEDGELYGTL

SEQ ID NO: 2018097 - protein, 19 aa, Staphylococcus
IGDEYVILLRMHYLIANAL

SEQ ID NO: 2018098 - protein, 25 aa, Staphylococcus
IGDGCGECPACKLRARGLHHYLESK

SEQ ID NO: 2018099 - protein, 17 aa, Staphylococcus
IGDGGTAFQIIDIAVNP

SEQ ID NO: 2018100 - protein, 20 aa, Staphylococcus
IGDKVHLEADMLFKYVQKAI

SEQ ID NO: 2018101 - protein, 18 aa, Staphylococcus
IGDKVTHKSWGEGMVSNV

SEQ ID NO: 2018102 - protein, 17 aa, Staphylococcus
IGDLPVVAHNAAFDMNV

SEQ ID NO: 2018103 - protein, 18 aa, Staphylococcus
IGDLRSYNIRHIGHHRAK

SEQ ID NO: 2018104 - protein, 18 aa, Staphylococcus
IGDRIQFSLNYEALSQSM

SEQ ID NO: 2018105 - protein, 24 aa, Staphylococcus
IGDTCPVCGNEIHSLGEHINFDLI

SEQ ID NO: 2018106 - protein, 27 aa, Staphylococcus
IGDYFKREAIEFAWEFLTSDRWMGMEP

SEQ ID NO: 2018107 - protein, 29 aa, Staphylococcus
IGEALGYPLDRYVPVMIVAIGKKAKEPRE

SEQ ID NO: 2018108 - protein, 17 aa, Staphylococcus
IGEANPLDSYLNIERII

SEQ ID NO: 2018109 - protein, 17 aa, Staphylococcus
IGEANPLDSYLNIPRII

SEQ ID NO: 2018110 - protein, 22 aa, Staphylococcus
IGEFSLRGGIIDIYPLIGQPVR

SEQ ID NO: 2018111 - protein, 22 aa, Staphylococcus
IGEFSLRGGIIDIYPLIGSPVR

SEQ ID NO: 2018112 - protein, 36 aa, Staphylococcus
IGEGASRLEIMKSLLERFSLEMKLVDRVCYLTDMVG

SEQ ID NO: 2018113 - protein, 23 aa, Staphylococcus
IGEHGDSELAVWSKANIAGISVF

SEQ ID NO: 2018114 - protein, 18 aa, Staphylococcus
IGEHGDSELAVWSQANVA

SEQ ID NO: 2018115 - protein, 18 aa, Staphylococcus
IGEHGDSELAVWSQTSIA

SEQ ID NO: 2018116 - protein, 31 aa, Staphylococcus
IGEHGQHAIPVWSKVHIHGMELSEFEALSDR

SEQ ID NO: 2018117 - protein, 24 aa, Staphylococcus
IGEILKCTLGDEFVAAKPTGICAC

SEQ ID NO: 2018118 - protein, 17 aa, Staphylococcus
IGEIPKNWKVIKTKHAF

SEQ ID NO: 2018119 - protein, 17 aa, Staphylococcus
IGELLALQPENIDFKNK

SEQ ID NO: 2018120 - protein, 24 aa, Staphylococcus
IGEYDFPDKIAFNVLKRENEYSVF

SEQ ID NO: 2018121 - protein, 21 aa, Staphylococcus
IGFAKSRAEERIVMDRLDELV

SEQ ID NO: 2018122 - protein, 19 aa, Staphylococcus
IGFIIGPRLNAVGRLEDAS

SEQ ID NO: 2018123 - protein, 18 aa, Staphylococcus
IGFLAEYDSLPGLGHACG

SEQ ID NO: 2018124 - protein, 17 aa, Staphylococcus
IGFNVLVGGGMGMTHGN

SEQ ID NO: 2018125 - protein, 23 aa, Staphylococcus
IGFRGEASLRYKELLKESLPDIE

SEQ ID NO: 2018126 - protein, 17 aa, Staphylococcus
IGFSDIYFYVDFLNKNE

SEQ ID NO: 2018127 - protein, 24 aa, Staphylococcus
IGGDHRPYHGFKRFNTPRDISDSL

SEQ ID NO: 2018128 - protein, 19 aa, Staphylococcus
IGGEVKATTFATVGASALE

SEQ ID NO: 2018129 - protein, 25 aa, Staphylococcus
IGGGARNDFWLQLQADIFNAKVSKL

SEQ ID NO: 2018130 - protein, 18 aa, Staphylococcus
IGGGFKLDEWLGSTSTDF

SEQ ID NO: 2018131 - protein, 17 aa, Staphylococcus
IGGGSKSNFWLQLQADV

SEQ ID NO: 2018132 - protein, 17 aa, Staphylococcus
IGGHIGYGVRPDYRGHG

SEQ ID NO: 2018133 - protein, 17 aa, Staphylococcus
IGGKGRRANLYGLFNKA

SEQ ID NO: 2018134 - protein, 18 aa, Staphylococcus
IGGKGRRANLYGLYNKAI

SEQ ID NO: 2018135 - protein, 21 aa, Staphylococcus
IGGKWKIPIIFHLLESDILRL

SEQ ID NO: 2018136 - protein, 21 aa, Staphylococcus
IGGKWKIPIIFHLLQDKVLRL

SEQ ID NO: 2018137 - protein, 22 aa, Staphylococcus
IGGQLGVVFSWLRRKCKESPEE

SEQ ID NO: 2018138 - protein, 22 aa, Staphylococcus
IGGQVGVIFYWLRNGCKESPEV

SEQ ID NO: 2018139 - protein, 20 aa, Staphylococcus
IGGSEWFNLLNLNLGYRVLK

SEQ ID NO: 2018140 - protein, 17 aa, Staphylococcus
IGGTAKDKLIFALPGST

SEQ ID NO: 2018141 - protein, 17 aa, Staphylococcus
IGGVGLDGRAMVTKNSF

SEQ ID NO: 2018142 - protein, 24 aa, Staphylococcus
IGGWTFPEGIKVVGVSSVHEALKY

SEQ ID NO: 2018143 - protein, 24 aa, Staphylococcus
IGHDMGGLIAKHFTDKYGSMVATL

SEQ ID NO: 2018144 - protein, 17 aa, Staphylococcus
IGHLHLKAADIGQSRHY

SEQ ID NO: 2018145 - protein, 18 aa, Staphylococcus
IGHTRWATHGVPNHENSH

SEQ ID NO: 2018146 - protein, 18 aa, Staphylococcus
IGIAGFFGLPIRKEVLDE

SEQ ID NO: 2018147 - protein, 17 aa, Staphylococcus
IGIAGFFGLPIRKKALD

SEQ ID NO: 2018148 - protein, 17 aa, Staphylococcus
IGIDFAIDENGHIYLLE

SEQ ID NO: 2018149 - protein, 24 aa, Staphylococcus
IGIFGLGRIGRLVGERLKPFDVNI

SEQ ID NO: 2018150 - protein, 25 aa, Staphylococcus
IGIHAFKLAFIQSAVDRELPYHLAV

SEQ ID NO: 2018151 - protein, 25 aa, Staphylococcus
IGIHAFKLAYIKSAVDRELPYHLAI

SEQ ID NO: 2018152 - protein, 25 aa, Staphylococcus
IGIHAFKLGFIMSAVDRELPYHLAI

SEQ ID NO: 2018153 - protein, 23 aa, Staphylococcus
IGILGICGGGGYAVNASLTDKRI

SEQ ID NO: 2018154 - protein, 26 aa, Staphylococcus
IGILSEIKLLGNEILIINITDKAGNI

SEQ ID NO: 2018155 - protein, 18 aa, Staphylococcus
IGIVLSMPHEVNTYTLIQ

SEQ ID NO: 2018156 - protein, 24 aa, Staphylococcus
IGKDARRKREILGRKLHIGHSNGK

SEQ ID NO: 2018157 - protein, 20 aa, Staphylococcus
IGKDARRKREVIGRKLHIGH

SEQ ID NO: 2018158 - protein, 20 aa, Staphylococcus
IGKELERGIEGYSLYSGISG

SEQ ID NO: 2018159 - protein, 24 aa, Staphylococcus
IGKGHIRISYAYDMPVLQEGMRRL

SEQ ID NO: 2018160 - protein, 18 aa, Staphylococcus
IGKGHVRISYAYDMTLLK

SEQ ID NO: 2018161 - protein, 17 aa, Staphylococcus
IGKGIPAALAMSMIKFG

SEQ ID NO: 2018162 - protein, 22 aa, Staphylococcus
IGKGLCLLVGVGQDSTEKDVEA

SEQ ID NO: 2018163 - protein, 22 aa, Staphylococcus
IGKKLGYPAHMSRLTRVSSGGF

SEQ ID NO: 2018164 - protein, 18 aa, Staphylococcus
IGKPTFFNLIGPIINPFA

SEQ ID NO: 2018165 - protein, 19 aa, Staphylococcus
IGKQLGYPAHMSLLTRINS

SEQ ID NO: 2018166 - protein, 17 aa, Staphylococcus
IGKRLFIDHGMGVVIGE

SEQ ID NO: 2018167 - protein, 22 aa, Staphylococcus
IGKRSSYGLGELISKALDNDAE

SEQ ID NO: 2018168 - protein, 19 aa, Staphylococcus
IGKSGCGKSTLLNIIGGFL

SEQ ID NO: 2018169 - protein, 24 aa, Staphylococcus
IGKSPAQVIIRWNVQHGVVVIPKS

SEQ ID NO: 2018170 - protein, 26 aa, Staphylococcus
IGKSPAQVVIRWNIEHGVVTIPKSVT

SEQ ID NO: 2018171 - protein, 22 aa, Staphylococcus
IGKTEPHASVTIQFPNKQIITG

SEQ ID NO: 2018172 - protein, 17 aa, Staphylococcus
IGLAHSISAGLDYPGIG

SEQ ID NO: 2018173 - protein, 26 aa, Staphylococcus
IGLDIPRVLGDIIICTDVAKEQAESY

SEQ ID NO: 2018174 - protein, 27 aa, Staphylococcus
IGLDLPFSIRMARTLLGSTDFITYEGL

SEQ ID NO: 2018175 - protein, 17 aa, Staphylococcus
IGLEIHEKPMLAKTAKT

SEQ ID NO: 2018176 - protein, 27 aa, Staphylococcus
IGLEKDIYKQMAWEGFKPFEVTNITEE

SEQ ID NO: 2018177 - protein, 24 aa, Staphylococcus
IGLFKDHLFLMFGVMHEGKDKAER

SEQ ID NO: 2018178 - protein, 24 aa, Staphylococcus
IGLFLTEDGRIFAVNNVCPHKQGP

SEQ ID NO: 2018179 - protein, 19 aa, Staphylococcus
IGLHKAVILKAAFELGERM

SEQ ID NO: 2018180 - protein, 24 aa, Staphylococcus
IGLIDCLHPTPALGGYPKDEALEF

SEQ ID NO: 2018181 - protein, 22 aa, Staphylococcus
IGLILLKLRYENIKSKNKNTPL

SEQ ID NO: 2018182 - protein, 18 aa, Staphylococcus
IGLKNWNFAFAYSVQLVE

SEQ ID NO: 2018183 - protein, 20 aa, Staphylococcus
IGLKPCYLPQTGKPSFDIED

SEQ ID NO: 2018184 - protein, 24 aa, Staphylococcus
IGLLDRLHPTPALGGYPKEKAVEF

SEQ ID NO: 2018185 - protein, 20 aa, Staphylococcus
IGLLLMKLRFQDLTEDSTPQ

SEQ ID NO: 2018186 - protein, 36 aa, Staphylococcus; identical to SEQ ID NO: 1806754

SEQ ID NO: 2018187 - protein, 24 aa, Staphylococcus
IGLPANLFFGTSIPTSILVFKKCR

SEQ ID NO: 2018188 - protein, 18 aa, Staphylococcus
IGLTMRGIAPSVTFSTGH

SEQ ID NO: 2018189 - protein, 20 aa, Staphylococcus
IGLVPNTSWIGDAVELNNRG

SEQ ID NO: 2018190 - protein, 19 aa, Staphylococcus
IGLYKAIILQAAFELGERL

SEQ ID NO: 2018191 - protein, 29 aa, Staphylococcus
IGLYKAVILKAAFELGERMYARDFNEKIK

SEQ ID NO: 2018192 - protein, 24 aa, Staphylococcus
IGLYKEEIEVIPIIADVQDKERMK

SEQ ID NO: 2018193 - protein, 24 aa, Staphylococcus
IGMARGFRAPLKFYEAHQKDKLEE

SEQ ID NO: 2018194 - protein, 23 aa, Staphylococcus
IGMGKLTSGLFWIDSDTFANLDS

SEQ ID NO: 2018195 - protein, 25 aa, Staphylococcus
IGMQTMKFDMCGAANVVAMIEVAHQ

SEQ ID NO: 2018196 - protein, 25 aa, Staphylococcus
IGMQTMKFDMCGAANVVGMIDAISR

SEQ ID NO: 2018197 - protein, 22 aa, Staphylococcus
IGMRKFFLKQCQSYISNAYIDT

SEQ ID NO: 2018198 - protein, 19 aa, Staphylococcus
IGMSIARQLSQSHLDIAIV

SEQ ID NO: 2018199 - protein, 19 aa, Staphylococcus
IGMSIARQLSQSHLDIALI

SEQ ID NO: 2018200 - protein, 27 aa, Staphylococcus
IGNAIKGARGYITFGQPLDIPIIADSY

SEQ ID NO: 2018201 - protein, 22 aa, Staphylococcus
IGNARPAINYDVVRRYFEYKGY

SEQ ID NO: 2018202 - protein, 23 aa, Staphylococcus
IGNARPAINYDVVRRYFEYKGYD

SEQ ID NO: 2018203 - protein, 23 aa, Staphylococcus
IGNARPAINYDVVRRYFEYKGYT

SEQ ID NO: 2018204 - protein, 23 aa, Staphylococcus
IGNARPAINYDVVRRYFEYQGYD

SEQ ID NO: 2018205 - protein, 23 aa, Staphylococcus
IGNARPAINYDVVRRYFEYQGYE

SEQ ID NO: 2018206 - protein, 22 aa, Staphylococcus
IGNDAHTSWNNALKGVNGIDEI

SEQ ID NO: 2018207 - protein, 18 aa, Staphylococcus
IGNEPFAVLLGDDIMESD

SEQ ID NO: 2018208 - protein, 21 aa, Staphylococcus
IGNLSTWLKRRHLLNECKQLQ

SEQ ID NO: 2018209 - protein, 20 aa, Staphylococcus
IGNMIIDAFILRDPGNYKDV

SEQ ID NO: 2018210 - protein, 22 aa, Staphylococcus
IGNMIIDAFILRDPGNYKDVID

SEQ ID NO: 2018211 - protein, 18 aa, Staphylococcus
IGNMIIDGFVLRDPGNYK

SEQ ID NO: 2018212 - protein, 18 aa, Staphylococcus
IGNPASWTKATNALDESN

SEQ ID NO: 2018213 - protein, 18 aa, Staphylococcus
IGNSVGRNTMAIISDMSQ

SEQ ID NO: 2018214 - protein, 17 aa, Staphylococcus
IGNVTINGFPNVEKRTK

SEQ ID NO: 2018215 - protein, 19 aa, Staphylococcus
IGPDIWKAASRVIDAAVEK

SEQ ID NO: 2018216 - protein, 22 aa, Staphylococcus
IGPDIWKAASRVIDAAVEQAYN

SEQ ID NO: 2018217 - protein, 18 aa, Staphylococcus
IGPDIWKAASRVVDAAVE

SEQ ID NO: 2018218 - protein, 23 aa, Staphylococcus
IGPGNRFPHAASLAVAEAPAEAY

SEQ ID NO: 2018219 - protein, 23 aa, Staphylococcus
IGPGNRFPHAASLAVAEAPAQAY

SEQ ID NO: 2018220 - protein, 18 aa, Staphylococcus
IGPKGRNVVLDKEYGAPL

SEQ ID NO: 2018221 - protein, 18 aa, Staphylococcus
IGPKGRNVVLDKEYTSPL

SEQ ID NO: 2018222 - protein, 29 aa, Staphylococcus
IGPLLHYRMVQELPTFFSSNLNFEELEHH

SEQ ID NO: 2018223 - protein, 28 aa, Staphylococcus
IGPLLHYRMVQELPTFFSSNLSFEELEY

SEQ ID NO: 2018224 - protein, 19 aa, Staphylococcus
IGPRQLFKIPHLSIQPHVR

SEQ ID NO: 2018225 - protein, 20 aa, Staphylococcus
IGPSEVLGGSASEFSPTDLA

SEQ ID NO: 2018226 - protein, 25 aa, Staphylococcus
IGQALINAAEAWALNRHIRRLEASI

SEQ ID NO: 2018227 - protein, 17 aa, Staphylococcus
IGQIDGYNAQSFIDAHF

SEQ ID NO: 2018228 - protein, 17 aa, Staphylococcus
IGQIFIVDVTLKVDLKD

SEQ ID NO: 2018229 - protein, 17 aa, Staphylococcus
IGQIFLVDVTLKVDLSK

SEQ ID NO: 2018230 - protein, 17 aa, Staphylococcus
IGQIFLVDVTLKVDLTK

SEQ ID NO: 2018231 - protein, 21 aa, Staphylococcus
IGQLIGMRASSNYVRHGEKKA

SEQ ID NO: 2018232 - protein, 20 aa, Staphylococcus
IGRAKGMIGNIMRLKPTGTL

SEQ ID NO: 2018233 - protein, 18 aa, Staphylococcus
IGRAPEFYGPDLTQSITN

SEQ ID NO: 2018234 - protein, 18 aa, Staphylococcus
IGRFKEIAVDEMGKINYL

SEQ ID NO: 2018235 - protein, 23 aa, Staphylococcus
IGRGMSINRMYWRARRRESIFMT

SEQ ID NO: 2018236 - protein, 24 aa, Staphylococcus
IGRGMTVNRMFWRARRRESIFISY

SEQ ID NO: 2018237 - protein, 17 aa, Staphylococcus
IGRLKSLTHDKVLQDTK

SEQ ID NO: 2018238 - protein, 17 aa, Staphylococcus
IGRLKTVLLKRPGKELE

SEQ ID NO: 2018239 - protein, 21 aa, Staphylococcus
IGRLPNKDVRQWYHDHNPSLF

SEQ ID NO: 2018240 - protein, 17 aa, Staphylococcus
IGSDIGVRVWSYKDAAG

SEQ ID NO: 2018241 - protein, 25 aa, Staphylococcus
IGSEKWPAFLDRDLVDGIFTISDKD

SEQ ID NO: 2018242 - protein, 26 aa, Staphylococcus
IGSEKWPSFLPKALVSDIIKVSDDAA

SEQ ID NO: 2018243 - protein, 20 aa, Staphylococcus
IGSEPWRFVVVQNEEMREKL

SEQ ID NO: 2018244 - protein, 25 aa, Staphylococcus
IGSEVFKLWVDYLFEQNFVHRLGIS

SEQ ID NO: 2018245 - protein, 22 aa, Staphylococcus
IGSGHAAWHAALTLKHAGKDVA

SEQ ID NO: 2018246 - protein, 17 aa, Staphylococcus
IGSGLGMIGFDVNYGNP

SEQ ID NO: 2018247 - protein, 19 aa, Staphylococcus
IGSIEFLKVVGLNGSTYEL

SEQ ID NO: 2018248 - protein, 25 aa, Staphylococcus
IGSKKFDMGINWFFKTPEREKQFLY

SEQ ID NO: 2018249 - protein, 19 aa, Staphylococcus
IGSNYAGVRGFTASAGPGL

SEQ ID NO: 2018250 - protein, 20 aa, Staphylococcus
IGSPRPRFRKSGKFVQTYMP

SEQ ID NO: 2018251 - protein, 24 aa, Staphylococcus
IGSPRPRFSMRGKYVQTYMPKTYT

SEQ ID NO: 2018252 - protein, 24 aa, Staphylococcus
IGSSEMNIDMAIDMYDGNYKIVKV

SEQ ID NO: 2018253 - protein, 26 aa, Staphylococcus
IGTDIPFCIYNKTAVCTGRGECVTFL

SEQ ID NO: 2018254 - protein, 19 aa, Staphylococcus
IGTDVKLGLSGIFDDQIKT

SEQ ID NO: 2018255 - protein, 23 aa, Staphylococcus
IGTGIPAALAMSMIKFGMDSYGH

SEQ ID NO: 2018256 - protein, 25 aa, Staphylococcus
IGTGRIGLGVAKRAKSFGMKIIAFD

SEQ ID NO: 2018257 - protein, 19 aa, Staphylococcus
IGTGRIGLGVIKRLQSFGM

SEQ ID NO: 2018258 - protein, 27 aa, Staphylococcus
IGTQMPEFERMILLRSIDTHWTDHIDT

SEQ ID NO: 2018259 - protein, 22 aa, Staphylococcus
IGTRYIKLIFEFLKKERNANAV

SEQ ID NO: 2018260 - protein, 20 aa, Staphylococcus
IGTVTPRPIAFVTSQDENGN

SEQ ID NO: 2018261 - protein, 19 aa, Staphylococcus
IGTVVLPDAELKVFMIASV

SEQ ID NO: 2018262 - protein, 17 aa, Staphylococcus
IGTVVLPNAELKVYMIA

SEQ ID NO: 2018263 - protein, 20 aa, Staphylococcus
IGVCNFLPEHIETLEKETGV

SEQ ID NO: 2018264 - protein, 25 aa, Staphylococcus
IGVDFRLIEPVAFYHTLQHFTGSKD

SEQ ID NO: 2018265 - protein, 19 aa, Staphylococcus
IGVEEVRAINEFAINGLYP

SEQ ID NO: 2018266 - protein, 17 aa, Staphylococcus
IGVFGTFSAGKSSLINA

SEQ ID NO: 2018267 - protein, 18 aa, Staphylococcus
IGVIEIKQGYGTFVTQKE

SEQ ID NO: 2018268 - protein, 18 aa, Staphylococcus
IGVIEMKQGYGTFIKQIE

SEQ ID NO: 2018269 - protein, 17 aa, Staphylococcus
IGVKGEVLLVEQPSLKL

SEQ ID NO: 2018270 - protein, 21 aa, Staphylococcus
IGVKQGFFGVAGFDLLLDQHG

SEQ ID NO: 2018271 - protein, 27 aa, Staphylococcus
IGVLKQEVYQFVALMKSLGKEVTQQQA

SEQ ID NO: 2018272 - protein, 18 aa, Staphylococcus
IGVPGPVNFKTGVVNGAV

SEQ ID NO: 2018273 - protein, 23 aa, Staphylococcus
IGVSKGFFGVAGFDLLVDKNNDV

SEQ ID NO: 2018274 - protein, 22 aa, Staphylococcus
IGVTCPKCKEGDVVERKSKKNR

SEQ ID NO: 2018275 - protein, 20 aa, Staphylococcus
IGWHPVDAIDFTEARLSWIE

SEQ ID NO: 2018276 - protein, 17 aa, Staphylococcus
IGYAVTFFASQEAKFIT

SEQ ID NO: 2018277 - protein, 19 aa, Staphylococcus
IGYEIKPAGGVFVSGGSMA

SEQ ID NO: 2018278 - protein, 23 aa, Staphylococcus
IGYEIKTGAPLIYELDDDLKVTN

SEQ ID NO: 2018279 - protein, 23 aa, Staphylococcus
IGYEIKTGAPLIYELDDNLNVID

SEQ ID NO: 2018280 - protein, 26 aa, Staphylococcus
IGYHPDYKFLQSIGIDIHTNEFGTAP

SEQ ID NO: 2018281 - protein, 19 aa, Staphylococcus
IGYIEAMKVMNEITSDVSG

SEQ ID NO: 2018282 - protein, 28 aa, Staphylococcus
IGYPFIVKTRFGGYDGKGQVLVKDATHL

SEQ ID NO: 2018283 - protein, 18 aa, Staphylococcus
IGYTRAKYGYDFQTMAVL

SEQ ID NO: 2018284 - protein, 18 aa, Staphylococcus
IGYTRAKYGYDYQTMAVL

SEQ ID NO: 2018285 - protein, 18 aa, Staphylococcus
IHACWLANIEIAMINTRL

SEQ ID NO: 2018286 - protein, 18 aa, Staphylococcus
IHAEMTITEAFDIREDLI

SEQ ID NO: 2018287 - protein, 20 aa, Staphylococcus
IHALEHARELNVSNALLHTD

SEQ ID NO: 2018288 - protein, 19 aa, Staphylococcus
IHALFQWLNQFNFDYENIA

SEQ ID NO: 2018289 - protein, 19 aa, Staphylococcus
IHAQICVDLGVGYFMNKFN

SEQ ID NO: 2018290 - protein, 17 aa, Staphylococcus
IHARPATMLVQTASKFD

SEQ ID NO: 2018291 - protein, 18 aa, Staphylococcus
IHASKSYVGQLLEDVGFK

SEQ ID NO: 2018292 - protein, 18 aa, Staphylococcus
IHAVPDLDSKNISRIGST

SEQ ID NO: 2018293 - protein, 18 aa, Staphylococcus
IHCILHITPSINFDDTLR

SEQ ID NO: 2018294 - protein, 18 aa, Staphylococcus
IHDLMSFLSILADKYNVQ

SEQ ID NO: 2018295 - protein, 23 aa, Staphylococcus
IHERMAVFDLYFRNMPFDSGYAV

SEQ ID NO: 2018296 - protein, 24 aa, Staphylococcus
IHERMAVFDLYFRSMPFDSGYAVF

SEQ ID NO: 2018297 - protein, 24 aa, Staphylococcus
IHERMAVFDLYFRSMPFNGGYAVF

SEQ ID NO: 2018298 - protein, 27 aa, Staphylococcus
IHFRELCQLLSQYSITFIIDVNPSLLN

SEQ ID NO: 2018299 - protein, 17 aa, Staphylococcus
IHGEYRMLKAHGQSGIE

SEQ ID NO: 2018300 - protein, 17 aa, Staphylococcus
IHGEYRMLKAHGQTGID

SEQ ID NO: 2018301 - protein, 17 aa, Staphylococcus
IHGFLDPVVRELPIEDV

SEQ ID NO: 2018302 - protein, 22 aa, Staphylococcus
IHGGARSNSAFQYKEMSHQEKH

SEQ ID NO: 2018303 - protein, 32 aa, Staphylococcus
IHGNAKNHWYEWLKHNLTLEGYYVQLFNLHSS

SEQ ID NO: 2018304 - protein, 18 aa, Staphylococcus
IHGRKEWETYYARESLEQ

SEQ ID NO: 2018305 - protein, 18 aa, Staphylococcus
IHGYIFPTDFSKRDQYLP

SEQ ID NO: 2018306 - protein, 23 aa, Staphylococcus
IHIDVYCSIKHGIKIAKVASKIQ

SEQ ID NO: 2018307 - protein, 23 aa, Staphylococcus
IHIIEIQTIISFRTHKNQVIAIR

SEQ ID NO: 2018308 - protein, 24 aa, Staphylococcus
IHINKGEFLAIVGPNGAGKSTLLK

SEQ ID NO: 2018309 - protein, 21 aa, Staphylococcus
IHKANEIIGVLDIDAPIKNRF

SEQ ID NO: 2018310 - protein, 25 aa, Staphylococcus
IHKRWSRLELGQFILGGQRFSDKNR

SEQ ID NO: 2018311 - protein, 24 aa, Staphylococcus
IHLEELAELVGLAPSYLSRLFKQE

SEQ ID NO: 2018312 - protein, 22 aa, Staphylococcus
IHLEKGKMLGFLGRNGAGKTTT

SEQ ID NO: 2018313 - protein, 25 aa, Staphylococcus
IHLIPETRKSTILSDKKVGDAVHLE

SEQ ID NO: 2018314 - protein, 17 aa, Staphylococcus
IHLKFYKAGVMSYYGPA

SEQ ID NO: 2018315 - protein, 17 aa, Staphylococcus
IHLLHLLKGTPMVKQYD

SEQ ID NO: 2018316 - protein, 18 aa, Staphylococcus
IHLRVIDVQNEITLLNEG

SEQ ID NO: 2018317 - protein, 24 aa, Staphylococcus
IHLSRFSEEIIFWSSDEAKFITLS

SEQ ID NO: 2018318 - protein, 24 aa, Staphylococcus
IHLTAPSKYYVWGAGPKANPYFYQ

SEQ ID NO: 2018319 - protein, 20 aa, Staphylococcus
IHLWMKKDITIHDFDADPGW

SEQ ID NO: 2018320 - protein, 19 aa, Staphylococcus
IHMRRRRGEIDFDINEAKV

SEQ ID NO: 2018321 - protein, 23 aa, Staphylococcus
IHNHIRGLAPWPVAYTTMDDKNM

SEQ ID NO: 2018322 - protein, 22 aa, Staphylococcus
IHNHIRGLSPWPVGYTTMDDTN

SEQ ID NO: 2018323 - protein, 23 aa, Staphylococcus
IHNHKQTFLLGGGHDIAYAQYLA

SEQ ID NO: 2018324 - protein, 18 aa, Staphylococcus
IHNILQITWLKRLESSTQ

SEQ ID NO: 2018325 - protein, 25 aa, Staphylococcus
IHNITGRATLEAVINSNNYSEIDKI

SEQ ID NO: 2018326 - protein, 18 aa, Staphylococcus
IHNNRVIAALIMEKDISN

SEQ ID NO: 2018327 - protein, 18 aa, Staphylococcus
IHPDERSAAFFAMGLMKG

SEQ ID NO: 2018328 - protein, 17 aa, Staphylococcus
IHPDERSASFFALGLIK

SEQ ID NO: 2018329 - protein, 18 aa, Staphylococcus
IHPHIKIGSRNLVGHTHR

SEQ ID NO: 2018330 - protein, 33 aa, Staphylococcus
IHPKYLYRREMRKVFGDIQFDYAIDYSGYAFFW

SEQ ID NO: 2018331 - protein, 18 aa, Staphylococcus
IHPSEFKKSATVDSLTDH

SEQ ID NO: 2018332 - protein, 18 aa, Staphylococcus
IHPSEFKTSVTVDSQTDH

SEQ ID NO: 2018333 - protein, 27 aa, Staphylococcus
IHQAESWLRSNIKDINFHLYNYAQENP

SEQ ID NO: 2018334 - protein, 26 aa, Staphylococcus
IHQANIRLDIMSGRRYQLKRRESISQ

SEQ ID NO: 2018335 - protein, 17 aa, Staphylococcus
IHQRFYLEQTLITERIK

SEQ ID NO: 2018336 - protein, 20 aa, Staphylococcus
IHREKMNFGVINILLQFVML

SEQ ID NO: 2018337 - protein, 23 aa, Staphylococcus
IHRHYLIRDGLRESLKALDLKLL

SEQ ID NO: 2018338 - protein, 18 aa, Staphylococcus
IHRKDMRTTLANILNLHQ

SEQ ID NO: 2018339 - protein, 22 aa, Staphylococcus
IHRKLKTLVDVGLGYVTLGQPA

SEQ ID NO: 2018340 - protein, 20 aa, Staphylococcus
IHRLLRFSPSFMKYSKVDKQ

SEQ ID NO: 2018341 - protein, 17 aa, Staphylococcus
IHRMLEAAEDLPINVGF

SEQ ID NO: 2018342 - protein, 19 aa, Staphylococcus
IHRMLPHPINLVRVKVTGT

SEQ ID NO: 2018343 - protein, 17 aa, Staphylococcus
IHSEMTITEAFDIDETM

SEQ ID NO: 2018344 - protein, 18 aa, Staphylococcus
IHSFELGQFIPPEKESIL

SEQ ID NO: 2018345 - protein, 20 aa, Staphylococcus
IHSHSFPFGVVTLTRKFFGD

SEQ ID NO: 2018346 - protein, 19 aa, Staphylococcus
IHSKGHVQSLVIIIRSVFK

SEQ ID NO: 2018347 - protein, 17 aa, Staphylococcus
IHSLYLYGEDTGIVDSN

SEQ ID NO: 2018348 - protein, 22 aa, Staphylococcus
IHSMQPAKSCLVDTKENERECN

SEQ ID NO: 2018349 - protein, 19 aa, Staphylococcus
IHSRKAPKLENVRFSVLAL

SEQ ID NO: 2018350 - protein, 26 aa, Staphylococcus
IHTENRIEGFFSIAGFGPDAKDIDKD

SEQ ID NO: 2018351 - protein, 36 aa, Staphylococcus
IHTRQPYLIYMLGFMPGFPYLGGLDERLHTPRRSEP

SEQ ID NO: 2018352 - protein, 24 aa, Staphylococcus
IHVAQRIQFVLTRQLESYIMMELT

SEQ ID NO: 2018353 - protein, 32 aa, Staphylococcus
IHVFLKRNLPSYAVPNFIKYIEDFPITINGKI

SEQ ID NO: 2018354 - protein, 23 aa, Staphylococcus
IHVKQFIRVCRYFVDQLRQSQSG

SEQ ID NO: 2018355 - protein, 26 aa, Staphylococcus
IHVKQLIRCCRYFIDLIRQSEFGRII

SEQ ID NO: 2018356 - protein, 22 aa, Staphylococcus
IHVNLLPREGFRIKDANFFELY

SEQ ID NO: 2018357 - protein, 26 aa, Staphylococcus
IHYDTEYYAGLSFRTLMPKLPILTPH

SEQ ID NO: 2018358 - protein, 20 aa, Staphylococcus
IHYRTRIVTLEGDIVNPGGS

SEQ ID NO: 2018359 - protein, 17 aa, Staphylococcus
IIAELSLELIKTQEELN

SEQ ID NO: 2018360 - protein, 17 aa, Staphylococcus
IIANYGAGFNNVDVKYA

SEQ ID NO: 2018361 - protein, 17 aa, Staphylococcus
IIAPSYYEPRVEDFELC

SEQ ID NO: 2018362 - protein, 21 aa, Staphylococcus
IIARYPTRRLHLEHHHLIEKT

SEQ ID NO: 2018363 - protein, 21 aa, Staphylococcus
IIASCPFAKAVLEKDEQVQDV

SEQ ID NO: 2018364 - protein, 19 aa, Staphylococcus
IIASCPFAKDVLEKNDDYQ

SEQ ID NO: 2018365 - protein, 19 aa, Staphylococcus
IIASCPFAKDVLEKNDSYQ

SEQ ID NO: 2018366 - protein, 21 aa, Staphylococcus
IIASCPFAKHVLETNDDYQDV

SEQ ID NO: 2018367 - protein, 19 aa, Staphylococcus
IIASPVYWYSLSASMKAFF

SEQ ID NO: 2018368 - protein, 19 aa, Staphylococcus
IIDAFKFRFATKEFDTTKK

SEQ ID NO: 2018369 - protein, 17 aa, Staphylococcus
IIDALTLAEQTDKLKEL

SEQ ID NO: 2018370 - protein, 17 aa, Staphylococcus
IIDALTLSEQTEKLKEL

SEQ ID NO: 2018371 - protein, 19 aa, Staphylococcus
IIDEFDELPYLYLEKGDSI

SEQ ID NO: 2018372 - protein, 22 aa, Staphylococcus
IIDELNMDYHLLTSIDETLESY

SEQ ID NO: 2018373 - protein, 25 aa, Staphylococcus
IIDETLCTLWQGFDYEVDMSAPHFD

SEQ ID NO: 2018374 - protein, 17 aa, Staphylococcus
IIDGCRLSKAKIIRVNH

SEQ ID NO: 2018375 - protein, 23 aa, Staphylococcus
IIDGEFQFDAAIVPAVAEKKAPG

SEQ ID NO: 2018376 - protein, 19 aa, Staphylococcus
IIDICKREKINGVLSLIDP

SEQ ID NO: 2018377 - protein, 26 aa, Staphylococcus
IIDIPKKVFADLEIKPNTAPIRGGTD

SEQ ID NO: 2018378 - protein, 24 aa, Staphylococcus
IIDIVPSYRAILITFDNMNIDGTE

SEQ ID NO: 2018379 - protein, 24 aa, Staphylococcus
IIDLDIRAQFGINIIAIKRGKEIV

SEQ ID NO: 2018380 - protein, 24 aa, Staphylococcus
IIDLDIRAQYGINIIAIKRGKQFI

SEQ ID NO: 2018381 - protein, 18 aa, Staphylococcus
IIDLKVKHIYKDSEPPIP

SEQ ID NO: 2018382 - protein, 18 aa, Staphylococcus
IIDLKVKHIYKDSEPPIS

SEQ ID NO: 2018383 - protein, 24 aa, Staphylococcus
IIDMEAEGLLQLINPTIIRQSDET

SEQ ID NO: 2018384 - protein, 23 aa, Staphylococcus
IIDMEVEGLLQLFNPKIKSESND

SEQ ID NO: 2018385 - protein, 20 aa, Staphylococcus
IIDSAWRWHNQHPNGYQEDT

SEQ ID NO: 2018386 - protein, 23 aa, Staphylococcus
IIDSIRIRPEFFEVYKDDELLEL

SEQ ID NO: 2018387 - protein, 19 aa, Staphylococcus
IIDVLPIRSEESVFIQLAD

SEQ ID NO: 2018388 - protein, 24 aa, Staphylococcus
IIEAFKPDIILSVHGVDIHFQDPL

SEQ ID NO: 2018389 - protein, 18 aa, Staphylococcus
IIEDFPILNQKVNGKRLA

SEQ ID NO: 2018390 - protein, 19 aa, Staphylococcus
IIEEYRACFEEETFANRYS

SEQ ID NO: 2018391 - protein, 17 aa, Staphylococcus
IIEFCRFIPSMPLKRYV

SEQ ID NO: 2018392 - protein, 17 aa, Staphylococcus
IIEGARNRGVPVDVVVI

SEQ ID NO: 2018393 - protein, 19 aa, Staphylococcus
IIEIAPLAYMRGRTLDDAF

SEQ ID NO: 2018394 - protein, 17 aa, Staphylococcus
IIEIKPLSQLYNQRNTK

SEQ ID NO: 2018395 - protein, 23 aa, Staphylococcus
IIEINCHGGILTINRILELTMTY

SEQ ID NO: 2018396 - protein, 23 aa, Staphylococcus
IIEINCHGGILTINRVLELTMTH

SEQ ID NO: 2018397 - protein, 19 aa, Staphylococcus
IIEKCHEHQLPVILDSSGD

SEQ ID NO: 2018398 - protein, 17 aa, Staphylococcus
IIEKFPIQLVVLKPYRL

SEQ ID NO: 2018399 - protein, 17 aa, Staphylococcus
IIEKIRYADSLNVDTII

SEQ ID NO: 2018400 - protein, 29 aa, Staphylococcus
IIEKLDYIKYLGVDYIWLTPIYESPMNDN

SEQ ID NO: 2018401 - protein, 28 aa, Staphylococcus
IIEKLDYIQYLGVDYIWLTPVYESPMND

SEQ ID NO: 2018402 - protein, 19 aa, Staphylococcus
IIEKPMRVFSKESDQMLRE

SEQ ID NO: 2018403 - protein, 17 aa, Staphylococcus
IIEKYGLNRQHHRFLFF

SEQ ID NO: 2018404 - protein, 20 aa, Staphylococcus
IIELAHRMKLGEPIDITQRF

SEQ ID NO: 2018405 - protein, 20 aa, Staphylococcus
IIELAHRMKLGQPIDITQRF

SEQ ID NO: 2018406 - protein, 20 aa, Staphylococcus
IIELLIKYYGQYVTIYEIAQ

SEQ ID NO: 2018407 - protein, 17 aa, Staphylococcus
IIELRIDQRESFEIADL

SEQ ID NO: 2018408 - protein, 17 aa, Staphylococcus
IIELRIDQWTNLNEIAI

SEQ ID NO: 2018409 - protein, 17 aa, Staphylococcus
IIENCKRIGFYPKTVAN

SEQ ID NO: 2018410 - protein, 18 aa, Staphylococcus
IIENCKRIGFYPKTVANI

SEQ ID NO: 2018411 - protein, 17 aa, Staphylococcus
IIEPFSIRDNELNFKTK

SEQ ID NO: 2018412 - protein, 18 aa, Staphylococcus
IIERASWTHFYVFRDEET

SEQ ID NO: 2018413 - protein, 21 aa, Staphylococcus
IIERLKAAQIVTMGTATSVDE

SEQ ID NO: 2018414 - protein, 17 aa, Staphylococcus
IIETCKKVAPKLEIHLS

SEQ ID NO: 2018415 - protein, 18 aa, Staphylococcus
IIETCKKVAPKLEIHLST

SEQ ID NO: 2018416 - protein, 17 aa, Staphylococcus
IIETCKQVAPKLEIHLS

SEQ ID NO: 2018417 - protein, 24 aa, Staphylococcus
IIETCKRVAPNLEIHLSTQQSLTN

SEQ ID NO: 2018418 - protein, 18 aa, Staphylococcus
IIFIIKHLSYRNGRNNDV

SEQ ID NO: 2018419 - protein, 19 aa, Staphylococcus
IIFNFVHLLEQYPFEAITT

SEQ ID NO: 2018420 - protein, 18 aa, Staphylococcus
IIFNRTFEAPINEVFEAY

SEQ ID NO: 2018421 - protein, 20 aa, Staphylococcus
IIGGAKFVRQGFISKGQNTL

SEQ ID NO: 2018422 - protein, 18 aa, Staphylococcus
IIGHRFDINVGIVGDSKV

SEQ ID NO: 2018423 - protein, 27 aa, Staphylococcus
IIGKGIARTGYEVFDLEGNHIGEVTSG

SEQ ID NO: 2018424 - protein, 27 aa, Staphylococcus
IIGLKYKSGFIRGFNKTIIFTSFNDIN

SEQ ID NO: 2018425 - protein, 17 aa, Staphylococcus
IIGLSVGNLNEYEKSDL

SEQ ID NO: 2018426 - protein, 17 aa, Staphylococcus
IIGPIFQPVVNRARSSR

SEQ ID NO: 2018427 - protein, 23 aa, Staphylococcus
IIGRGGGSIEDLWNFNEEDVVKA

SEQ ID NO: 2018428 - protein, 20 aa, Staphylococcus
IIGSCGLDSIRVIKGQFGAH

SEQ ID NO: 2018429 - protein, 21 aa, Staphylococcus
IIGSCGLDSIRVIKGQFGAHI

SEQ ID NO: 2018430 - protein, 17 aa, Staphylococcus
IIGSTAWYDYSYAHERF

SEQ ID NO: 2018431 - protein, 18 aa, Staphylococcus
IIGTKGIEDLAWLSHMTQ

SEQ ID NO: 2018432 - protein, 18 aa, Staphylococcus
IIGVKILGADSFSRIQPI

SEQ ID NO: 2018433 - protein, 17 aa, Staphylococcus
IIGVKYTAPNFFLLERI

SEQ ID NO: 2018434 - protein, 20 aa, Staphylococcus
IIGWHPVDAIDFTEERLEWI

SEQ ID NO: 2018435 - protein, 25 aa, Staphylococcus
IIGYEIKTGAPLVYELDDNLNVTNK

SEQ ID NO: 2018436 - protein, 25 aa, Staphylococcus
IIGYEIKTGAPLVYELTDELEVKDK

SEQ ID NO: 2018437 - protein, 18 aa, Staphylococcus
IIGYLGMWIVIDQAQITT

SEQ ID NO: 2018438 - protein, 17 aa, Staphylococcus
IIHIAKDRLGEMSRDVT

SEQ ID NO: 2018439 - protein, 25 aa, Staphylococcus
IIHLLDRMGVMFNRTPEGLLDFRRF

SEQ ID NO: 2018440 - protein, 24 aa, Staphylococcus
IIHPREIFAAALRYTSNSLIVVHN

SEQ ID NO: 2018441 - protein, 18 aa, Staphylococcus
IIHPREVFNIAIRESSNA

SEQ ID NO: 2018442 - protein, 21 aa, Staphylococcus
IIHRLSKVYGIKSISPVLKTE

SEQ ID NO: 2018443 - protein, 21 aa, Staphylococcus
IIHRLTKVYGIKSISPVIKTD

SEQ ID NO: 2018444 - protein, 17 aa, Staphylococcus
IIHSPKPIHGHTTTLRH

SEQ ID NO: 2018445 - protein, 17 aa, Staphylococcus
IIIDAIGQLIGMRASSN

SEQ ID NO: 2018446 - protein, 17 aa, Staphylococcus
IIIDEMSMVDTWLFHQF

SEQ ID NO: 2018447 - protein, 17 aa, Staphylococcus
IIIDRFHIVQSLNRALN

SEQ ID NO: 2018448 - protein, 18 aa, Staphylococcus
IIIEENFSFYNVDLDDGP

SEQ ID NO: 2018449 - protein, 18 aa, Staphylococcus
IIIENGKVLACFPKHFFG

SEQ ID NO: 2018450 - protein, 19 aa, Staphylococcus
IIIEQDVATVFKLLSTTEG

SEQ ID NO: 2018451 - protein, 20 aa, Staphylococcus
IIIHGGGPFINQALEQQGVD

SEQ ID NO: 2018452 - protein, 19 aa, Staphylococcus
IIIHKDINISIAVADEDKL

SEQ ID NO: 2018453 - protein, 19 aa, Staphylococcus
IIIHKDINISIAVAHENKL

SEQ ID NO: 2018454 - protein, 17 aa, Staphylococcus
IIIPCHRVVGKNGSLTG

SEQ ID NO: 2018455 - protein, 25 aa, Staphylococcus
IIIQPGETFSFWNLVGKIDKKRGYR

SEQ ID NO: 2018456 - protein, 19 aa, Staphylococcus
IIISAPFYPAYLTRKRIEQ

SEQ ID NO: 2018457 - protein, 22 aa, Staphylococcus
IIKAERPTHVSLVPQTLKWLMD

SEQ ID NO: 2018458 - protein, 30 aa, Staphylococcus
IIKAFDIYLKKGYSSKLLVYGKDKEGNLNT

SEQ ID NO: 2018459 - protein, 28 aa, Staphylococcus
IIKEGIPAKARRKGGHPAKRIFQAIRIA

SEQ ID NO: 2018460 - protein, 27 aa, Staphylococcus
IIKEGIPAKARRKGGHPAKRVFQAIRI

SEQ ID NO: 2018461 - protein, 17 aa, Staphylococcus
IIKEHRGLGYGKLLMNS

SEQ ID NO: 2018462 - protein, 20 aa, Staphylococcus
IIKHLVKYAKKVTVLLTTDG

SEQ ID NO: 2018463 - protein, 25 aa, Staphylococcus
IIKKCLNLPYTKMRRYLKKLDRYIK

SEQ ID NO: 2018464 - protein, 21 aa, Staphylococcus
IIKKLLKKAFEDLGLHRIELG

SEQ ID NO: 2018465 - protein, 19 aa, Staphylococcus
IIKMKKLKSLKIILSNFKK

SEQ ID NO: 2018466 - protein, 23 aa, Staphylococcus
IIKNEYPTHVSLVPQTLKWLMDA

SEQ ID NO: 2018467 - protein, 20 aa, Staphylococcus
IIKNHVPFVYAVKNEEALKY

SEQ ID NO: 2018468 - protein, 22 aa, Staphylococcus
IIKPAFFMDNFLRIITVEDGVI

SEQ ID NO: 2018469 - protein, 22 aa, Staphylococcus
IIKPSFFMDNFLRITKVENGEI

SEQ ID NO: 2018470 - protein, 17 aa, Staphylococcus
IIKQFHIDRLKWKDLFH

SEQ ID NO: 2018471 - protein, 17 aa, Staphylococcus
IIKQRFNIEPLVHITCR

SEQ ID NO: 2018472 - protein, 19 aa, Staphylococcus
IIKRHRLLEQFLIEVLNYN

SEQ ID NO: 2018473 - protein, 19 aa, Staphylococcus
IIKTWKKAYQDIADVFISV

SEQ ID NO: 2018474 - protein, 19 aa, Staphylococcus
IIKTWKKAYQEIADIFISV

SEQ ID NO: 2018475 - protein, 24 aa, Staphylococcus
IIKVKVLDFNSLEFTDVDQIYISD

SEQ ID NO: 2018476 - protein, 20 aa, Staphylococcus
IILAEGFKNADYDKVVIYKN

SEQ ID NO: 2018477 - protein, 17 aa, Staphylococcus
IILAEIFEKAGVPKGAF

SEQ ID NO: 2018478 - protein, 21 aa, Staphylococcus
IILEKDIYKATALTMNYADFT

SEQ ID NO: 2018479 - protein, 24 aa, Staphylococcus
IILEKDIYKATAMTMNYEGFTVAI

SEQ ID NO: 2018480 - protein, 19 aa, Staphylococcus
IILKAAFELGERMYIPDLD

SEQ ID NO: 2018481 - protein, 18 aa, Staphylococcus
IILLAFGERKRDAIHQLL

SEQ ID NO: 2018482 - protein, 18 aa, Staphylococcus
IILNESLTAVVAVPLWLE

SEQ ID NO: 2018483 - protein, 19 aa, Staphylococcus
IILVPSIGTVPGFDEEQLK

SEQ ID NO: 2018484 - protein, 20 aa, Staphylococcus
IILVSRSFNGIVGPIYAYEG

SEQ ID NO: 2018485 - protein, 35 aa, Staphylococcus
IIMFGGGGYNLWRVVPRAWSHLYLSLINEPIQQGY

SEQ ID NO: 2018486 - protein, 24 aa, Staphylococcus
IIMKEEPIKLLALITSNYRLYYQC

SEQ ID NO: 2018487 - protein, 25 aa, Staphylococcus
IIMKEEPIKLLALITSNYRLYYQCK

SEQ ID NO: 2018488 - protein, 31 aa, Staphylococcus
IIMSELKINLLEFRKEMDLLEGTGLVKSYVN

SEQ ID NO: 2018489 - protein, 17 aa, Staphylococcus
IINGRYDPIINDKNHYK

SEQ ID NO: 2018490 - protein, 23 aa, Staphylococcus
IINIRRLIGLISEFHEMYPNITF

SEQ ID NO: 2018491 - protein, 24 aa, Staphylococcus
IINLDIRAQYGINIIAIKRAKEFI

SEQ ID NO: 2018492 - protein, 18 aa, Staphylococcus
IINLKSWPTNNAKKGYFE

SEQ ID NO: 2018493 - protein, 19 aa, Staphylococcus
IINLYFPFIDVETMLTLLD

SEQ ID NO: 2018494 - protein, 20 aa, Staphylococcus
IINLYLPFVDVETMLTLLDL

SEQ ID NO: 2018495 - protein, 18 aa, Staphylococcus
IINPFEVVYYAGGTANEF

SEQ ID NO: 2018496 - protein, 23 aa, Staphylococcus
IINRDAFEMGRELLVQVRKRQVK

SEQ ID NO: 2018497 - protein, 19 aa, Staphylococcus
IINRFKSEGMTILYTTHYI

SEQ ID NO: 2018498 - protein, 17 aa, Staphylococcus
IIPDRIEAGTFIIAAAI

SEQ ID NO: 2018499 - protein, 24 aa, Staphylococcus
IIPEMLTEKFIPRSELRETTMAIL

SEQ ID NO: 2018500 - protein, 18 aa, Staphylococcus
IIPHRQPFLLIDRVVEYE

SEQ ID NO: 2018501 - protein, 22 aa, Staphylococcus
IIPHRQPFLLIDRVVEYEEGKR

SEQ ID NO: 2018502 - protein, 25 aa, Staphylococcus
IIPILKRKKGIIIVGDMQHQDAREL

SEQ ID NO: 2018503 - protein, 33 aa, Staphylococcus
IIPKKLANELGVDLIMCGTSGLNAVERFIVGSV

SEQ ID NO: 2018504 - protein, 17 aa, Staphylococcus
IIPKKLASELGVDLIMC

SEQ ID NO: 2018505 - protein, 17 aa, Staphylococcus
IIPSCPFAKKVIEETPE

SEQ ID NO: 2018506 - protein, 25 aa, Staphylococcus
IIPSTFIEYYAKIMAPFVNENQLIF

SEQ ID NO: 2018507 - protein, 17 aa, Staphylococcus
IIQCLTKSADIYILDEP

SEQ ID NO: 2018508 - protein, 24 aa, Staphylococcus
IIQDFKHYCALLFEKGAIMEDPYQ

SEQ ID NO: 2018509 - protein, 19 aa, Staphylococcus
IIQHKAKKIYVVFNNNSGG

SEQ ID NO: 2018510 - protein, 20 aa, Staphylococcus
IIQIRFHSVLDLKDKSPQDV

SEQ ID NO: 2018511 - protein, 23 aa, Staphylococcus
IIQKLRHFFDLEVNPEIINKTLN

SEQ ID NO: 2018512 - protein, 25 aa, Staphylococcus
IIQLDIRAQYGISIIAIKRGRDILV

SEQ ID NO: 2018513 - protein, 19 aa, Staphylococcus
IIQLVWKEKGNWKIPIKTL

SEQ ID NO: 2018514 - protein, 17 aa, Staphylococcus
IIQRFNKKFSEKGYTQD

SEQ ID NO: 2018515 - protein, 19 aa, Staphylococcus
IIRDIEKYQSLSLNKYKGH

SEQ ID NO: 2018516 - protein, 18 aa, Staphylococcus
IIRDLRMGTYDVVVGINL

SEQ ID NO: 2018517 - protein, 23 aa, Staphylococcus
IIRGLRAVSDFEYELRLTSMNKK

SEQ ID NO: 2018518 - protein, 19 aa, Staphylococcus
IIRGLRFQSQLTFDIHTET

SEQ ID NO: 2018519 - protein, 17 aa, Staphylococcus
IIRKVYGNLIYDKDIDS

SEQ ID NO: 2018520 - protein, 24 aa, Staphylococcus
IIRRYPTRRLHVEDGILKEIEGEH

SEQ ID NO: 2018521 - protein, 17 aa, Staphylococcus
IIRSFIKRELAIHGFEM

SEQ ID NO: 2018522 - protein, 20 aa, Staphylococcus
IIRSLLGIAVPTQIATHDSD

SEQ ID NO: 2018523 - protein, 23 aa, Staphylococcus
IISAGRLEFEKGFDILIESVRRI

SEQ ID NO: 2018524 - protein, 21 aa, Staphylococcus
IISAPHFKADPSIDGTNSETF

SEQ ID NO: 2018525 - protein, 21 aa, Staphylococcus
IISCPQCSAPMAASNTTNTLK

SEQ ID NO: 2018526 - protein, 21 aa, Staphylococcus
IISGLKIKMALDVEAREPIIL

SEQ ID NO: 2018527 - protein, 17 aa, Staphylococcus
IISIEFASITIKSGVET

SEQ ID NO: 2018528 - protein, 22 aa, Staphylococcus
IISNPGCHKAVLNILNENGGYQ

SEQ ID NO: 2018529 - protein, 31 aa, Staphylococcus
IISRYKRMLGYNVLHPMGWDAFGLPAEQYAL

SEQ ID NO: 2018530 - protein, 19 aa, Staphylococcus
IISTITVRFPWESKRRISI

SEQ ID NO: 2018531 - protein, 20 aa, Staphylococcus
IISTITVRYPWGSVRSISGY

SEQ ID NO: 2018532 - protein, 18 aa, Staphylococcus
IISVFRAKDIPYFKLNSS

SEQ ID NO: 2018533 - protein, 17 aa, Staphylococcus
IISVFRAQDEPYFKIND

SEQ ID NO: 2018534 - protein, 18 aa, Staphylococcus
IISYEAMVSYAGKSSMEV

SEQ ID NO: 2018535 - protein, 17 aa, Staphylococcus
IITEAGYGEYFVHRLGH

SEQ ID NO: 2018536 - protein, 18 aa, Staphylococcus
IITEKKLSGFNVTIPHKE

SEQ ID NO: 2018537 - protein, 23 aa, Staphylococcus
IITGNFLLALGLQHLSEIKDKRV

SEQ ID NO: 2018538 - protein, 17 aa, Staphylococcus
IITKGPVLFGFFGHSSI

SEQ ID NO: 2018539 - protein, 19 aa, Staphylococcus
IITKMGFEDYFLIVSDLIQ

SEQ ID NO: 2018540 - protein, 18 aa, Staphylococcus
IITKRMIFDYAQTALKVK

SEQ ID NO: 2018541 - protein, 19 aa, Staphylococcus
IITNMGFEDYFLIVSDLIH

SEQ ID NO: 2018542 - protein, 18 aa, Staphylococcus
IITSPAFNGEKILGAILF

SEQ ID NO: 2018543 - protein, 19 aa, Staphylococcus
IIVGGTGLYIQSLIYDYAF

SEQ ID NO: 2018544 - protein, 25 aa, Staphylococcus
IIVGMLPWKRINTVNEEKISKISNT

SEQ ID NO: 2018545 - protein, 17 aa, Staphylococcus
IIVICLSSGISGSYQSA

SEQ ID NO: 2018546 - protein, 25 aa, Staphylococcus
IIVPRITNPYFAYLIDAIDKKIKGT

SEQ ID NO: 2018547 - protein, 18 aa, Staphylococcus
IIVYDDFNEAIDIIQSKS

SEQ ID NO: 2018548 - protein, 19 aa, Staphylococcus
IIWIAFKTGLRISDVLTLK

SEQ ID NO: 2018549 - protein, 20 aa, Staphylococcus
IIWIAFKTGLRISDVLTLKD

SEQ ID NO: 2018550 - protein, 19 aa, Staphylococcus
IIYHRVVEMLEEGKAISKI

SEQ ID NO: 2018551 - protein, 17 aa, Staphylococcus
IIYRGERIINWDPEART

SEQ ID NO: 2018552 - protein, 17 aa, Staphylococcus
IIYRGERIINWDPKART

SEQ ID NO: 2018553 - protein, 17 aa, Staphylococcus
IIYRGERIINWDPQART

SEQ ID NO: 2018554 - protein, 17 aa, Staphylococcus
IIYRGERIINWDPVART

SEQ ID NO: 2018555 - protein, 20 aa, Staphylococcus
IIYRRLDEIPQLRTISITGG

SEQ ID NO: 2018556 - protein, 19 aa, Staphylococcus
IIYYDGEAALALLRLYQRD

SEQ ID NO: 2018557 - protein, 19 aa, Staphylococcus
IIYYDGEAVLALLRLYQKD

SEQ ID NO: 2018558 - protein, 17 aa, Staphylococcus
IKAATIIDAENMKKSDK

SEQ ID NO: 2018559 - protein, 17 aa, Staphylococcus
IKAATIIDAEQVKKSDK

SEQ ID NO: 2018560 - protein, 24 aa, Staphylococcus
IKADGKMIVIDGGFSKVYQSTTGI

SEQ ID NO: 2018561 - protein, 24 aa, Staphylococcus
IKADGKMLVIDGGFSKAYQSTTGI

SEQ ID NO: 2018562 - protein, 18 aa, Staphylococcus
IKADRLLEPYGITQEQAQ

SEQ ID NO: 2018563 - protein, 17 aa, Staphylococcus
IKADTIFKQEVEDLEKE

SEQ ID NO: 2018564 - protein, 22 aa, Staphylococcus
IKAERDYRTLLKALAHINVYPK

SEQ ID NO: 2018565 - protein, 18 aa, Staphylococcus
IKAFEKFEQLPLDTLKQL

SEQ ID NO: 2018566 - protein, 17 aa, Staphylococcus
IKAGAFDQFPIEAVFGI

SEQ ID NO: 2018567 - protein, 23 aa, Staphylococcus
IKAGCGYVPIDTSVPIERVEMIM

SEQ ID NO: 2018568 - protein, 20 aa, Staphylococcus
IKAGCGYVPIDTSVPNERTA

SEQ ID NO: 2018569 - protein, 21 aa, Staphylococcus
IKAGDIIKNMAPLVGGKGGGR

SEQ ID NO: 2018570 - protein, 19 aa, Staphylococcus
IKAGMTVAEADALSRDYIE

SEQ ID NO: 2018571 - protein, 17 aa, Staphylococcus
IKAGVVINPGTPVELIK

SEQ ID NO: 2018572 - protein, 27 aa, Staphylococcus
IKAHTEVPVVAGFGIRTAAHVKDIIEA

SEQ ID NO: 2018573 - protein, 17 aa, Staphylococcus
IKAIEELGERMGIQTPI

SEQ ID NO: 2018574 - protein, 18 aa, Staphylococcus
IKAIPQFELVGQHLNEEY

SEQ ID NO: 2018575 - protein, 17 aa, Staphylococcus
IKAKAFDNYPIEAVFGI

SEQ ID NO: 2018576 - protein, 20 aa, Staphylococcus
IKAKHIITGVCETDFSGYPD

SEQ ID NO: 2018577 - protein, 20 aa, Staphylococcus
IKALCEKLNVSLSEVICFGD

SEQ ID NO: 2018578 - protein, 18 aa, Staphylococcus
IKALCKKENIKLEEVVVF

SEQ ID NO: 2018579 - protein, 22 aa, Staphylococcus
IKALDGSYHFETYVSLTCQKCP

SEQ ID NO: 2018580 - protein, 21 aa, Staphylococcus
IKALIFAIPCETYKFKVIGPF

SEQ ID NO: 2018581 - protein, 22 aa, Staphylococcus
IKALKQKVKFAIWEKYDDNHRV

SEQ ID NO: 2018582 - protein, 18 aa, Staphylococcus
IKALLESKMLHLGADGPS

SEQ ID NO: 2018583 - protein, 17 aa, Staphylococcus
IKANLPPSRGLGSSAAV

SEQ ID NO: 2018584 - protein, 17 aa, Staphylococcus
IKAQILILGVIPIEDIN

SEQ ID NO: 2018585 - protein, 19 aa, Staphylococcus
IKARLESKMLELGADGPSF

SEQ ID NO: 2018586 - protein, 20 aa, Staphylococcus
IKASEAPSHISGQQDNNIVN

SEQ ID NO: 2018587 - protein, 20 aa, Staphylococcus
IKASEKMAGQTIIQLDIRAQ

SEQ ID NO: 2018588 - protein, 18 aa, Staphylococcus
IKASKTLLNQMVKQGSIT

SEQ ID NO: 2018589 - protein, 18 aa, Staphylococcus
IKASNLLQQGTIRLLATA

SEQ ID NO: 2018590 - protein, 18 aa, Staphylococcus
IKATREYFNVPDLFETRH

SEQ ID NO: 2018591 - protein, 17 aa, Staphylococcus
IKAVNEFDVGNLYLNRG

SEQ ID NO: 2018592 - protein, 21 aa, Staphylococcus
IKDAELRGIASSGMVCSMKEL

SEQ ID NO: 2018593 - protein, 30 aa, Staphylococcus
IKDAELRGVASSGMICSMKELGLPNAPQEK

SEQ ID NO: 2018594 - protein, 26 aa, Staphylococcus
IKDAELRGVASSGMICSMKELNLPNA

SEQ ID NO: 2018595 - protein, 27 aa, Staphylococcus
IKDAELRGVASSGMICSMKELNLPNAP

SEQ ID NO: 2018596 - protein, 26 aa, Staphylococcus
IKDAELRGVASSGMICSMRELNLPNA

SEQ ID NO: 2018597 - protein, 21 aa, Staphylococcus
IKDASAGSWFGEKFKDEHLPT

SEQ ID NO: 2018598 - protein, 26 aa, Staphylococcus
IKDAYDLGIRAIMFFGVPNNKDDVGS

SEQ ID NO: 2018599 - protein, 20 aa, Staphylococcus
IKDCEVRKTFEIASEKHTEK

SEQ ID NO: 2018600 - protein, 39 aa, Staphylococcus
IKDDKQRISIMYSMPKWIVKHWVTHYGVDTTERIAQSML

SEQ ID NO: 2018601 - protein, 17 aa, Staphylococcus
IKDFPILDQKVNGKRLA

SEQ ID NO: 2018602 - protein, 22 aa, Staphylococcus
IKDGCDCKMIALAKESTENFKK

SEQ ID NO: 2018603 - protein, 24 aa, Staphylococcus
IKDHIVFLGFDYGFRGNSRYLFNH

SEQ ID NO: 2018604 - protein, 27 aa, Staphylococcus
IKDIRMREVISYFATYVFEKNAEIPAL

SEQ ID NO: 2018605 - protein, 25 aa, Staphylococcus
IKDKLDLVEGWKRDGLTDEQIARNF

SEQ ID NO: 2018606 - protein, 17 aa, Staphylococcus
IKDKVIDIMNMFANHHD

SEQ ID NO: 2018607 - protein, 24 aa, Staphylococcus
IKDLGRKRAIVVHGANGMDEATLS

SEQ ID NO: 2018608 - protein, 18 aa, Staphylococcus
IKDLSFSIPQGFVTGFIG

SEQ ID NO: 2018609 - protein, 27 aa, Staphylococcus
IKDSLKRLIMPSIEREIRSDLTEKAEN

SEQ ID NO: 2018610 - protein, 18 aa, Staphylococcus
IKDVDNFIDLLTKIYDES

SEQ ID NO: 2018611 - protein, 18 aa, Staphylococcus
IKDVENFIDLLSKIYDES

SEQ ID NO: 2018612 - protein, 26 aa, Staphylococcus
IKDVKSIFHVIDFLAIDKYPKANWEE

SEQ ID NO: 2018613 - protein, 31 aa, Staphylococcus
IKEAIKDSLKRLIMPSIEREIRSDLTEKAET

SEQ ID NO: 2018614 - protein, 25 aa, Staphylococcus
IKEAKIRFECQLEQMILLGSEDDGA

SEQ ID NO: 2018615 - protein, 22 aa, Staphylococcus
IKEALETFGGVKRRFNETKVGN

SEQ ID NO: 2018616 - protein, 24 aa, Staphylococcus
IKEATIVLIKLHITKMIKNQARYG

SEQ ID NO: 2018617 - protein, 27 aa, Staphylococcus
IKEAVKGSLSRLGLDHLDLYQLHGGTI

SEQ ID NO: 2018618 - protein, 26 aa, Staphylococcus
IKEAYDLGIRGVMFFGVPNEKDAIGT

SEQ ID NO: 2018619 - protein, 21 aa, Staphylococcus
IKECPHLRDVEELYLQRNRFV

SEQ ID NO: 2018620 - protein, 24 aa, Staphylococcus
IKEDGRLSISLIGGFTYNAIEGEY

SEQ ID NO: 2018621 - protein, 29 aa, Staphylococcus
IKEDGRLSLDLIGGFSYNAIEGEYCEIEI

SEQ ID NO: 2018622 - protein, 19 aa, Staphylococcus
IKEDLRMSTSIVALSGETR

SEQ ID NO: 2018623 - protein, 22 aa, Staphylococcus
IKEDVAMALGFFDGLHKGHAQV

SEQ ID NO: 2018624 - protein, 25 aa, Staphylococcus
IKEEFKRVVNLIIDVYNDFNFENYS

SEQ ID NO: 2018625 - protein, 17 aa, Staphylococcus
IKEEGPAHHRLFTSEVI

SEQ ID NO: 2018626 - protein, 18 aa, Staphylococcus
IKEELSYAEEVFKKLNAT

SEQ ID NO: 2018627 - protein, 28 aa, Staphylococcus
IKEFKLDTKVIIVTTFKRPGYFEKAVAN

SEQ ID NO: 2018628 - protein, 24 aa, Staphylococcus
IKEGIKQKPLRDMIRQVLDQVTIQ

SEQ ID NO: 2018629 - protein, 18 aa, Staphylococcus
IKEGIKQKQLRDHIRQSL

SEQ ID NO: 2018630 - protein, 18 aa, Staphylococcus
IKEGIKQKTMRDIIRKVL

SEQ ID NO: 2018631 - protein, 24 aa, Staphylococcus
IKEGKPIFRYGGDFGEALHDGNFC

SEQ ID NO: 2018632 - protein, 18 aa, Staphylococcus
IKEGRGVAKSVHRYLQKQ

SEQ ID NO: 2018633 - protein, 20 aa, Staphylococcus
IKEGVEFADRYGAKIYVTTN

SEQ ID NO: 2018634 - protein, 21 aa, Staphylococcus
IKEGVEFANRYGAKIYVTTNI

SEQ ID NO: 2018635 - protein, 31 aa, Staphylococcus
IKEGVKGSLKRLGLDHLDLYQLHGGTIDDPL

SEQ ID NO: 2018636 - protein, 18 aa, Staphylococcus
IKEHFTVKELQRIFEYII

SEQ ID NO: 2018637 - protein, 20 aa, Staphylococcus
IKEHMSSLVYKLEEMGVKLD

SEQ ID NO: 2018638 - protein, 21 aa, Staphylococcus
IKEIIKKIRGGNHVTSQNPEV

SEQ ID NO: 2018639 - protein, 20 aa, Staphylococcus
IKEIIKRVRGGNHVTSQNPE

SEQ ID NO: 2018640 - protein, 19 aa, Staphylococcus
IKEIINDKALSGFNVTIPH

SEQ ID NO: 2018641 - protein, 18 aa, Staphylococcus
IKEIPEINKYVSIDGGMS

SEQ ID NO: 2018642 - protein, 20 aa, Staphylococcus
IKEIVLMGGSTGRGNVTPLA

SEQ ID NO: 2018643 - protein, 22 aa, Staphylococcus
IKEKFNYLFMVTKRCITLLEEA

SEQ ID NO: 2018644 - protein, 17 aa, Staphylococcus
IKEKLLSLEYVRTELNN

SEQ ID NO: 2018645 - protein, 17 aa, Staphylococcus
IKEKLLSLEYVRTELSN

SEQ ID NO: 2018646 - protein, 18 aa, Staphylococcus
IKELEPYHPLFIEEPVLP

SEQ ID NO: 2018647 - protein, 30 aa, Staphylococcus
IKELIVNYNLSYIVDDAWDYAANVNANNTI

SEQ ID NO: 2018648 - protein, 23 aa, Staphylococcus
IKELKHRKCKIIFANNETITLNV

SEQ ID NO: 2018649 - protein, 28 aa, Staphylococcus
IKELMSYLFEVIDPYSLNKQGQDVGEKY

SEQ ID NO: 2018650 - protein, 18 aa, Staphylococcus
IKEMYYLDVASPGAERPI

SEQ ID NO: 2018651 - protein, 25 aa, Staphylococcus
IKENGRLALDLIGGFHFNAIEGEYC

SEQ ID NO: 2018652 - protein, 17 aa, Staphylococcus
IKEQLIFPEIDYDKVSK

SEQ ID NO: 2018653 - protein, 19 aa, Staphylococcus
IKEQLIFPEIDYDKVSKVR

SEQ ID NO: 2018654 - protein, 19 aa, Staphylococcus
IKERRWAREDQDTSDLAYE

SEQ ID NO: 2018655 - protein, 27 aa, Staphylococcus
IKESDADVIQFNWRPIAGGDEKLMKVL

SEQ ID NO: 2018656 - protein, 19 aa, Staphylococcus
IKESDSWFKLLENTSPIDM

SEQ ID NO: 2018657 - protein, 19 aa, Staphylococcus
IKETAPMTSLQQQLKSSVD

SEQ ID NO: 2018658 - protein, 21 aa, Staphylococcus
IKETFPQVTLIAGNVATAEGT

SEQ ID NO: 2018659 - protein, 20 aa, Staphylococcus
IKETPERFEFIVKIHQALTL

SEQ ID NO: 2018660 - protein, 22 aa, Staphylococcus
IKEVDEETALVWLCNPNNPTGT

SEQ ID NO: 2018661 - protein, 17 aa, Staphylococcus
IKEVIAFDDLPNGIDRV

SEQ ID NO: 2018662 - protein, 17 aa, Staphylococcus
IKEVMRIATQQDIDIYY

SEQ ID NO: 2018663 - protein, 18 aa, Staphylococcus
IKEWVPLMVEGRTSHVPI

SEQ ID NO: 2018664 - protein, 21 aa, Staphylococcus
IKEYCNFHHFEVKDIYADRGI

SEQ ID NO: 2018665 - protein, 20 aa, Staphylococcus
IKEYPEVISENALIQNEMIE

SEQ ID NO: 2018666 - protein, 20 aa, Staphylococcus
IKFEFKKDSKGFSFAINDIL

SEQ ID NO: 2018667 - protein, 18 aa, Staphylococcus
IKFEKIDFSFTKVRPTAA

SEQ ID NO: 2018668 - protein, 27 aa, Staphylococcus
IKFEMPYDEAVDWMLKALEPMGDEYLE

SEQ ID NO: 2018669 - protein, 17 aa, Staphylococcus
IKFFPYQTGHAAGIPKD

SEQ ID NO: 2018670 - protein, 18 aa, Staphylococcus
IKFIFLDFISSENIQTLT

SEQ ID NO: 2018671 - protein, 17 aa, Staphylococcus
IKFNANMFHNYANNHDT

SEQ ID NO: 2018672 - protein, 20 aa, Staphylococcus
IKFNEFADDIILLLDYLYID

SEQ ID NO: 2018673 - protein, 18 aa, Staphylococcus
IKFNKLLVESAHLTLQRQ

SEQ ID NO: 2018674 - protein, 19 aa, Staphylococcus
IKFNLYKTALVFATYPNFN

SEQ ID NO: 2018675 - protein, 24 aa, Staphylococcus
IKFPDSEAIFITLHLLGSKVSTNA

SEQ ID NO: 2018676 - protein, 17 aa, Staphylococcus
IKFTEKWYFPLQPFQKF

SEQ ID NO: 2018677 - protein, 19 aa, Staphylococcus
IKGARVVGIAGGDKKVNYL

SEQ ID NO: 2018678 - protein, 18 aa, Staphylococcus
IKGARVVGIAGGTKKVNY

SEQ ID NO: 2018679 - protein, 21 aa, Staphylococcus
IKGDNVINGYLYPKNLTDTFE

SEQ ID NO: 2018680 - protein, 21 aa, Staphylococcus
IKGDNVMNGYLYPKDLDNTFE

SEQ ID NO: 2018681 - protein, 19 aa, Staphylococcus
IKGFISAIVDIYRASYGKR

SEQ ID NO: 2018682 - protein, 21 aa, Staphylococcus
IKGGFRTGRKNLLQILKAYES

SEQ ID NO: 2018683 - protein, 20 aa, Staphylococcus
IKGGGGALFREKVIDELAAR

SEQ ID NO: 2018684 - protein, 20 aa, Staphylococcus
IKGGGGALFREKVIDEMADR

SEQ ID NO: 2018685 - protein, 20 aa, Staphylococcus
IKGGGGALFREKVIDEMAEK

SEQ ID NO: 2018686 - protein, 20 aa, Staphylococcus
IKGGGGALFREKVIDEMAHR

SEQ ID NO: 2018687 - protein, 21 aa, Staphylococcus
IKGGYRLGRNTLLNILKSYEK

SEQ ID NO: 2018688 - protein, 17 aa, Staphylococcus
IKGISFLIAGGLTDQHI

SEQ ID NO: 2018689 - protein, 21 aa, Staphylococcus
IKGKKAVLYFYPRDNTPTCTT

SEQ ID NO: 2018690 - protein, 17 aa, Staphylococcus
IKGKLFKLLEFSNMEES

SEQ ID NO: 2018691 - protein, 25 aa, Staphylococcus
IKGKNVMDGYLFPKVKMDTFEDGYF

SEQ ID NO: 2018692 - protein, 23 aa, Staphylococcus
IKGKPCIDYNGFIVHVSITHTEH

SEQ ID NO: 2018693 - protein, 19 aa, Staphylococcus
IKGKRIKVIGIDKKDPLEM

SEQ ID NO: 2018694 - protein, 23 aa, Staphylococcus
IKGKTILDVGCNQGGFLRKLYDT

SEQ ID NO: 2018695 - protein, 27 aa, Staphylococcus
IKGKVARLTNFGAFIDIGGVDGLVHVS

SEQ ID NO: 2018696 - protein, 34 aa, Staphylococcus; identical to SEQ ID NO: 1795324

SEQ ID NO: 2018697 - protein, 19 aa, Staphylococcus
IKGLNRATSTYKFAGGKGI

SEQ ID NO: 2018698 - protein, 23 aa, Staphylococcus
IKGNASEILALINNDAKMKGTDS

SEQ ID NO: 2018699 - protein, 17 aa, Staphylococcus
IKGPDGIYFRFNFIKEA

SEQ ID NO: 2018700 - protein, 20 aa, Staphylococcus
IKGSFSSGTAERGWLEEKGY

SEQ ID NO: 2018701 - protein, 19 aa, Staphylococcus
IKGTGPRYCPSIEDKYVRF

SEQ ID NO: 2018702 - protein, 19 aa, Staphylococcus
IKGVAQLLFKRIPKLPFTL

SEQ ID NO: 2018703 - protein, 19 aa, Staphylococcus
IKGVARPALVVTLPTINGK

SEQ ID NO: 2018704 - protein, 19 aa, Staphylococcus
IKGVARPALVVTLPTVSGK

SEQ ID NO: 2018705 - protein, 17 aa, Staphylococcus
IKGVGYQSVKLIVDERY

SEQ ID NO: 2018706 - protein, 17 aa, Staphylococcus
IKGVGYQSVKLIVEERK

SEQ ID NO: 2018707 - protein, 19 aa, Staphylococcus
IKGVSRPALVVTLPTIDGK

SEQ ID NO: 2018708 - protein, 18 aa, Staphylococcus
IKGVSRPALVVTLPTMDG

SEQ ID NO: 2018709 - protein, 18 aa, Staphylococcus
IKGYCGSIKNGQYGNDID

SEQ ID NO: 2018710 - protein, 27 aa, Staphylococcus
IKGYILYQLYGKYVMDYSIGSATGMMN

SEQ ID NO: 2018711 - protein, 23 aa, Staphylococcus
IKHAAHLADKCIEIGVNYLKEGI

SEQ ID NO: 2018712 - protein, 22 aa, Staphylococcus
IKHADIYIDGFYNFSTLEYQII

SEQ ID NO: 2018713 - protein, 24 aa, Staphylococcus
IKHAGGLHQFMNWDGPILTDSGGF

SEQ ID NO: 2018714 - protein, 22 aa, Staphylococcus
IKHAKFPVLLVGMRSSSEKVTE

SEQ ID NO: 2018715 - protein, 18 aa, Staphylococcus
IKHAYIYSFEKKDQSEAI

SEQ ID NO: 2018716 - protein, 25 aa, Staphylococcus
IKHDNIWIDPGIGFAKSRAEERIVM

SEQ ID NO: 2018717 - protein, 23 aa, Staphylococcus
IKHDPGICILGHIINYMDDEKII

SEQ ID NO: 2018718 - protein, 21 aa, Staphylococcus
IKHDVPCGFDKYVAIGAQTAN

SEQ ID NO: 2018719 - protein, 23 aa, Staphylococcus
IKHEARYGGTLFDLYYDAQGQSY

SEQ ID NO: 2018720 - protein, 20 aa, Staphylococcus
IKHELCHYHLHLSGKGYQHK

SEQ ID NO: 2018721 - protein, 18 aa, Staphylococcus
IKHGIKFKTIALTEKEFV

SEQ ID NO: 2018722 - protein, 20 aa, Staphylococcus
IKHIAQRSAGFDTYDLNLAT

SEQ ID NO: 2018723 - protein, 24 aa, Staphylococcus
IKHKCNLSERLGFIFRTSTNTFMV

SEQ ID NO: 2018724 - protein, 19 aa, Staphylococcus
IKHLDCLIYSSGTSLYGML

SEQ ID NO: 2018725 - protein, 22 aa, Staphylococcus
IKHLLEKGFNLKAIKQILMNDD

SEQ ID NO: 2018726 - protein, 22 aa, Staphylococcus
IKHLRHLGKLILIVHHDLSKAE

SEQ ID NO: 2018727 - protein, 17 aa, Staphylococcus
IKHNIKPGGTITYSTCT

SEQ ID NO: 2018728 - protein, 23 aa, Staphylococcus
IKHNLRKVIAQSIAFTYEAGEGL

SEQ ID NO: 2018729 - protein, 24 aa, Staphylococcus
IKHPELIKEITYREMRELSYAGFG

SEQ ID NO: 2018730 - protein, 22 aa, Staphylococcus
IKHQRAPIQIYFNAQRIIGLTS

SEQ ID NO: 2018731 - protein, 20 aa, Staphylococcus
IKHQYGHAFYDSASEQDVFS

SEQ ID NO: 2018732 - protein, 19 aa, Staphylococcus
IKHQYGHAFYDSASSQDVF

SEQ ID NO: 2018733 - protein, 19 aa, Staphylococcus
IKHRCAYNLSGMSFEPEEI

SEQ ID NO: 2018734 - protein, 19 aa, Staphylococcus
IKHRGASYHFGRVPFTSTL

SEQ ID NO: 2018735 - protein, 24 aa, Staphylococcus
IKHSDLIHGFEVTKLYLKNKEIIT

SEQ ID NO: 2018736 - protein, 17 aa, Staphylococcus
IKHSIEIAKNEGIKIKF

SEQ ID NO: 2018737 - protein, 23 aa, Staphylococcus
IKHVHKPSGAKPGFVTYDNQKTL

SEQ ID NO: 2018738 - protein, 17 aa, Staphylococcus
IKIANHFDLNKLAYIHG

SEQ ID NO: 2018739 - protein, 20 aa, Staphylococcus
IKIASPLIFNLQSIKEIDQH

SEQ ID NO: 2018740 - protein, 23 aa, Staphylococcus
IKIFPATRLNLELVKSDVITEKT

SEQ ID NO: 2018741 - protein, 18 aa, Staphylococcus
IKIGNPRIMAEKLLKGEI

SEQ ID NO: 2018742 - protein, 18 aa, Staphylococcus
IKIGTPICEIESASENNS

SEQ ID NO: 2018743 - protein, 17 aa, Staphylococcus
IKIGVIIDKIIENSANI

SEQ ID NO: 2018744 - protein, 20 aa, Staphylococcus
IKIHLLHLLKGTPMVKQYEK

SEQ ID NO: 2018745 - protein, 20 aa, Staphylococcus
IKIKAFEAHASQTGPFLKEL

SEQ ID NO: 2018746 - protein, 23 aa, Staphylococcus
IKIKELNIHRPLEGMSDTSSYPE

SEQ ID NO: 2018747 - protein, 22 aa, Staphylococcus
IKIKGKWSYLYRAIDAEGHTLD

SEQ ID NO: 2018748 - protein, 17 aa, Staphylococcus
IKIKLPKNYFKTNGKSY

SEQ ID NO: 2018749 - protein, 25 aa, Staphylococcus
IKIKYLPCPCKIKYDEARFDSQLVT

SEQ ID NO: 2018750 - protein, 18 aa, Staphylococcus
IKILIPLFKENIFYDSGV

SEQ ID NO: 2018751 - protein, 19 aa, Staphylococcus
IKILKPFGTDFEKPLFELD

SEQ ID NO: 2018752 - protein, 17 aa, Staphylococcus
IKILKSGLSRELSTTDI

SEQ ID NO: 2018753 - protein, 20 aa, Staphylococcus
IKIQRYRKNVKFGVDITHLF

SEQ ID NO: 2018754 - protein, 21 aa, Staphylococcus
IKIRYLPCPCKVKYDEERLNS

SEQ ID NO: 2018755 - protein, 17 aa, Staphylococcus
IKISDVMTKEGLITAPV

SEQ ID NO: 2018756 - protein, 20 aa, Staphylococcus
IKITLLRLSKHKFIEKDSFK

SEQ ID NO: 2018757 - protein, 22 aa, Staphylococcus
IKIYRCAKPGAGEKAAQWTKDN

SEQ ID NO: 2018758 - protein, 23 aa, Staphylococcus
IKKAEVILYDRLVNPLILQYAPA

SEQ ID NO: 2018759 - protein, 17 aa, Staphylococcus
IKKAFAQLPDLSECESL

SEQ ID NO: 2018760 - protein, 19 aa, Staphylococcus
IKKAGTLNQGTIRFMATAG

SEQ ID NO: 2018761 - protein, 20 aa, Staphylococcus
IKKDLERFIDVLAQKAKDYK

SEQ ID NO: 2018762 - protein, 21 aa, Staphylococcus
IKKDLGLTFLEIIILEQLKYL

SEQ ID NO: 2018763 - protein, 18 aa, Staphylococcus
IKKDMLFIPFKGENVDGH

SEQ ID NO: 2018764 - protein, 17 aa, Staphylococcus
IKKDPYGTVLIIGPFNY

SEQ ID NO: 2018765 - protein, 18 aa, Staphylococcus
IKKELSYAEEIFNKLNAT

SEQ ID NO: 2018766 - protein, 18 aa, Staphylococcus
IKKELVYAEEVFKKLNAT

SEQ ID NO: 2018767 - protein, 19 aa, Staphylococcus
IKKFLKVIKKAIQFINTHL

SEQ ID NO: 2018768 - protein, 26 aa, Staphylococcus
IKKFPFIKSEEEFLTILNLAKQRNAV

SEQ ID NO: 2018769 - protein, 27 aa, Staphylococcus
IKKGDLYAGDFNKMFYGVPYNMNYEIS

SEQ ID NO: 2018770 - protein, 20 aa, Staphylococcus
IKKGEVLAIIGPSGSGKSTL

SEQ ID NO: 2018771 - protein, 18 aa, Staphylococcus
IKKHGGYEINSYIKKNGQ

SEQ ID NO: 2018772 - protein, 24 aa, Staphylococcus
IKKIIRHNINLIALHTNLDNYVYG

SEQ ID NO: 2018773 - protein, 23 aa, Staphylococcus
IKKKRLLPEMKLPSKRKLSQHLC

SEQ ID NO: 2018774 - protein, 22 aa, Staphylococcus
IKKKVRRSKIFVVVKNVEAAKK

SEQ ID NO: 2018775 - protein, 20 aa, Staphylococcus
IKKKYVVKLKGYLMREEVKS

SEQ ID NO: 2018776 - protein, 20 aa, Staphylococcus
IKKLFLLGIVANINQSLDEE

SEQ ID NO: 2018777 - protein, 18 aa, Staphylococcus
IKKLKLDNIHAFQHDATE

SEQ ID NO: 2018778 - protein, 24 aa, Staphylococcus
IKKLRNELLFEFNLTLDANETLDM

SEQ ID NO: 2018779 - protein, 18 aa, Staphylococcus
IKKLRQVGYKVFIATGRS

SEQ ID NO: 2018780 - protein, 23 aa, Staphylococcus
IKKLTSNITLMFDGDFAGREATL

SEQ ID NO: 2018781 - protein, 21 aa, Staphylococcus
IKKLYPFIFSVLFEVIETLNK

SEQ ID NO: 2018782 - protein, 20 aa, Staphylococcus
IKKRKGIIVEGSETAINNAI

SEQ ID NO: 2018783 - protein, 18 aa, Staphylococcus
IKKYKLDAQFIIVNEAGA

SEQ ID NO: 2018784 - protein, 22 aa, Staphylococcus
IKKYQESFFTFPAASSHHHNFA

SEQ ID NO: 2018785 - protein, 17 aa, Staphylococcus
IKLALKELKSWTKTQQV

SEQ ID NO: 2018786 - protein, 21 aa, Staphylococcus
IKLASAPILIRKGHTLSAQNL

SEQ ID NO: 2018787 - protein, 25 aa, Staphylococcus
IKLCAEAGASMFVAGSYFFKHHDYA

SEQ ID NO: 2018788 - protein, 23 aa, Staphylococcus
IKLDFDLPVIMLTARDALTDKER

SEQ ID NO: 2018789 - protein, 17 aa, Staphylococcus
IKLDRPIGRDVYNRLYS

SEQ ID NO: 2018790 - protein, 17 aa, Staphylococcus
IKLEGLILESASPGIQD

SEQ ID NO: 2018791 - protein, 22 aa, Staphylococcus
IKLEPMSTFPVIRDLQVDRTRM

SEQ ID NO: 2018792 - protein, 28 aa, Staphylococcus
IKLEQKFELLFVRWVPRNQNKEANHHAK

SEQ ID NO: 2018793 - protein, 20 aa, Staphylococcus
IKLFKGNAIVNGRKSLYTLY

SEQ ID NO: 2018794 - protein, 20 aa, Staphylococcus
IKLFKGNAIVNGRQSPYTLY

SEQ ID NO: 2018795 - protein, 17 aa, Staphylococcus
IKLGERFDSMLPEDEVP

SEQ ID NO: 2018796 - protein, 18 aa, Staphylococcus
IKLGNGFDSDTEMGPVIS

SEQ ID NO: 2018797 - protein, 23 aa, Staphylococcus
IKLGSGGVMLPHYSPFKVAENFK

SEQ ID NO: 2018798 - protein, 20 aa, Staphylococcus
IKLGTGGLIRAYSGAVRDAI

SEQ ID NO: 2018799 - protein, 21 aa, Staphylococcus
IKLHEKFGFSHSGTIKYAGYK

SEQ ID NO: 2018800 - protein, 39 aa, Staphylococcus
IKLKEAYRGLARLQLFEHVMAPLADFPVRKIVDAHHIIA

SEQ ID NO: 2018801 - protein, 17 aa, Staphylococcus
IKLKIKELCNLKEIQHT

SEQ ID NO: 2018802 - protein, 18 aa, Staphylococcus
IKLLDGLYQQNKDYFDDV

SEQ ID NO: 2018803 - protein, 19 aa, Staphylococcus
IKLLEPYRVTKELIEKTGN

SEQ ID NO: 2018804 - protein, 19 aa, Staphylococcus
IKLLFLEKYIDYLDESPSL

SEQ ID NO: 2018805 - protein, 21 aa, Staphylococcus
IKLLGLAFNFMCFKSKAPTLN

SEQ ID NO: 2018806 - protein, 21 aa, Staphylococcus
IKLMASGGVSFSGETPHDVQL

SEQ ID NO: 2018807 - protein, 17 aa, Staphylococcus
IKLNHAFTNEDLHNLFK

SEQ ID NO: 2018808 - protein, 19 aa, Staphylococcus
IKLPELSSLADLLVQLSDF

SEQ ID NO: 2018809 - protein, 17 aa, Staphylococcus
IKLPKNYFKTNGKSYPL

SEQ ID NO: 2018810 - protein, 26 aa, Staphylococcus
IKLPNKLLKLFGKLSIFNKLYGNLVY

SEQ ID NO: 2018811 - protein, 18 aa, Staphylococcus
IKLRHEHDIITYGDIEPM

SEQ ID NO: 2018812 - protein, 19 aa, Staphylococcus
IKLSDEFSSEKIIQRLNSV

SEQ ID NO: 2018813 - protein, 17 aa, Staphylococcus
IKLSEDILEQFEAVKDD

SEQ ID NO: 2018814 - protein, 17 aa, Staphylococcus
IKLSSAVTVLSSDDPVR

SEQ ID NO: 2018815 - protein, 17 aa, Staphylococcus
IKLSYYHNVSRKKQEIF

SEQ ID NO: 2018816 - protein, 20 aa, Staphylococcus
IKLTDLRSGKEREELYHYEE

SEQ ID NO: 2018817 - protein, 20 aa, Staphylococcus
IKLTELGDWGLVEKRIVSTS

SEQ ID NO: 2018818 - protein, 19 aa, Staphylococcus
IKLVDEFSSTKIIREVDRL

SEQ ID NO: 2018819 - protein, 20 aa, Staphylococcus
IKLYDVFTILYLIDADLFNV

SEQ ID NO: 2018820 - protein, 17 aa, Staphylococcus
IKLYPLDIFSLFNEEDW

SEQ ID NO: 2018821 - protein, 19 aa, Staphylococcus
IKMAEAYGVKSFLIDHPNK

SEQ ID NO: 2018822 - protein, 19 aa, Staphylococcus
IKMALWYTEMKRNLKRFKE

SEQ ID NO: 2018823 - protein, 19 aa, Staphylococcus
IKMAQELGVDVIVTDHHEI

SEQ ID NO: 2018824 - protein, 22 aa, Staphylococcus
IKMHALRAGVTLIKDQGKTVDI

SEQ ID NO: 2018825 - protein, 24 aa, Staphylococcus
IKMICAKCKINRSTFYDNFQDKYD

SEQ ID NO: 2018826 - protein, 24 aa, Staphylococcus
IKMICAYSGINRSTFYAHFTDKYD

SEQ ID NO: 2018827 - protein, 21 aa, Staphylococcus
IKMICAYSGINRTTFYDYFVD

SEQ ID NO: 2018828 - protein, 23 aa, Staphylococcus
IKMICAYSGVNRSTFYDHYKDKY

SEQ ID NO: 2018829 - protein, 25 aa, Staphylococcus
IKMKDKSLVPFEWITKYQSNIAIVF

SEQ ID NO: 2018830 - protein, 29 aa, Staphylococcus
IKMLQEIGLDLPFSMKINQLLGFDDHFIT

SEQ ID NO: 2018831 - protein, 20 aa, Staphylococcus
IKMSESVLNQFKAVKDDKEK

SEQ ID NO: 2018832 - protein, 20 aa, Staphylococcus
IKNAGLRLKFLKSETSGVAV

SEQ ID NO: 2018833 - protein, 18 aa, Staphylococcus
IKNAGQVCTCPERIFVHE

SEQ ID NO: 2018834 - protein, 23 aa, Staphylococcus
IKNAKFPVLLAGMRSSSSDETNA

SEQ ID NO: 2018835 - protein, 21 aa, Staphylococcus
IKNDIDVEKIIQRVTRNKKKY

SEQ ID NO: 2018836 - protein, 34 aa, Staphylococcus
IKNDKQRMAVEYSIPKWIIEHWITHYGVETTRKM

SEQ ID NO: 2018837 - protein, 17 aa, Staphylococcus
IKNEDIIAFKNGIELSD

SEQ ID NO: 2018838 - protein, 24 aa, Staphylococcus
IKNIPDCINLTIGQPDFPMPDVVK

SEQ ID NO: 2018839 - protein, 18 aa, Staphylococcus
IKNKEFVVHIVDESIVKE

SEQ ID NO: 2018840 - protein, 19 aa, Staphylococcus
IKNKIGFVYSETYFNEKWT

SEQ ID NO: 2018841 - protein, 26 aa, Staphylococcus
IKNKVHFVGTFTVEFFIDKNNDLYVN

SEQ ID NO: 2018842 - protein, 21 aa, Staphylococcus
IKNLADRGTKVIAIIDDAYFG

SEQ ID NO: 2018843 - protein, 25 aa, Staphylococcus
IKNLEAELGIPLFNRVGRTIKLNKY

SEQ ID NO: 2018844 - protein, 22 aa, Staphylococcus
IKNLLAMCYLYLSKYDIAKDMF

SEQ ID NO: 2018845 - protein, 21 aa, Staphylococcus
IKNNEFRLQQEINNAWKSHYV

SEQ ID NO: 2018846 - protein, 24 aa, Staphylococcus
IKNNEIEAYFLPQGVIATHYRQTN

SEQ ID NO: 2018847 - protein, 25 aa, Staphylococcus
IKNPNPRGKGAIARTMFMTERPFRE

SEQ ID NO: 2018848 - protein, 18 aa, Staphylococcus
IKNTIAFKDLKHSIETVL

SEQ ID NO: 2018849 - protein, 25 aa, Staphylococcus
IKNTIKMMLILSIARPPLFKNDFYF

SEQ ID NO: 2018850 - protein, 24 aa, Staphylococcus
IKNTRTGSIGFLIVHIPHISEDGF

SEQ ID NO: 2018851 - protein, 18 aa, Staphylococcus
IKNWVPLMMEGRKSEEPI

SEQ ID NO: 2018852 - protein, 17 aa, Staphylococcus
IKNYLFKNSDLQIAYNF

SEQ ID NO: 2018853 - protein, 17 aa, Staphylococcus
IKNYLFKNSDLQISYNF

SEQ ID NO: 2018854 - protein, 25 aa, Staphylococcus
IKNYPEYNYIWVFKNPDKNIIPGNA

SEQ ID NO: 2018855 - protein, 22 aa, Staphylococcus
IKPAQTFDLPYGRLEEGSFADL

SEQ ID NO: 2018856 - protein, 20 aa, Staphylococcus
IKPDLAIAVDVAIAYDTPGM

SEQ ID NO: 2018857 - protein, 22 aa, Staphylococcus
IKPELGQACNQLADISGLSENE

SEQ ID NO: 2018858 - protein, 23 aa, Staphylococcus
IKPFMDRLVCGIKEQHNIPVILF

SEQ ID NO: 2018859 - protein, 19 aa, Staphylococcus
IKPKAAIKMVAEDRQSKTS

SEQ ID NO: 2018860 - protein, 26 aa, Staphylococcus
IKPLDSEGLLSFGTHLQQNMSQFSHQ

SEQ ID NO: 2018861 - protein, 20 aa, Staphylococcus
IKPLPHVIDIPKKVFSDLGI

SEQ ID NO: 2018862 - protein, 18 aa, Staphylococcus
IKPLPTLIMTGSEDIISE

SEQ ID NO: 2018863 - protein, 19 aa, Staphylococcus
IKPLPTLLMYGTEDKILET

SEQ ID NO: 2018864 - protein, 20 aa, Staphylococcus
IKPLSLMYMHYDYWLTYEYK

SEQ ID NO: 2018865 - protein, 19 aa, Staphylococcus
IKPNFTIVSAPHFKADPEV

SEQ ID NO: 2018866 - protein, 19 aa, Staphylococcus
IKPPRYSSFSVKRRNNYEV

SEQ ID NO: 2018867 - protein, 21 aa, Staphylococcus
IKPSFFMDNFLRIAKKENQQI

SEQ ID NO: 2018868 - protein, 17 aa, Staphylococcus
IKPSKIFDLPYGTLEEG

SEQ ID NO: 2018869 - protein, 27 aa, Staphylococcus
IKPTSPCGICRQVLKELCDDDMPIYMT

SEQ ID NO: 2018870 - protein, 23 aa, Staphylococcus
IKQEKAHIIGIDLGKYHYLTASN

SEQ ID NO: 2018871 - protein, 23 aa, Staphylococcus
IKQEKSHIIGIDLGKYHYLTASN

SEQ ID NO: 2018872 - protein, 25 aa, Staphylococcus
IKQELNDRLGWELEEAKSFEFEDNG

SEQ ID NO: 2018873 - protein, 20 aa, Staphylococcus
IKQFPKIMFMSGKEDQIIPY

SEQ ID NO: 2018874 - protein, 23 aa, Staphylococcus
IKQGIDIIEPVPLFQQTKDDLNA

SEQ ID NO: 2018875 - protein, 19 aa, Staphylococcus
IKQGYIFISYCYQILKEHI

SEQ ID NO: 2018876 - protein, 21 aa, Staphylococcus
IKQIRYHSVLDLKNKTSKDIL

SEQ ID NO: 2018877 - protein, 17 aa, Staphylococcus
IKQLFNLHLERLQLIKL

SEQ ID NO: 2018878 - protein, 22 aa, Staphylococcus
IKQMKAGSVIVDIAIDQGGIFE

SEQ ID NO: 2018879 - protein, 18 aa, Staphylococcus
IKQNLDRIVKSQSNQKKL

SEQ ID NO: 2018880 - protein, 18 aa, Staphylococcus
IKQPGVLYGDYVVPFGGE

SEQ ID NO: 2018881 - protein, 17 aa, Staphylococcus
IKQRYPNVIVFVDNCYG

SEQ ID NO: 2018882 - protein, 26 aa, Staphylococcus
IKQTPSPDCLMIFQHHNLFPWKNIYD

SEQ ID NO: 2018883 - protein, 20 aa, Staphylococcus
IKQWFPKQVTPYNIKLVENE

SEQ ID NO: 2018884 - protein, 27 aa, Staphylococcus
IKQYAPEFEKIIGLPIMLIHKQHCVIT

SEQ ID NO: 2018885 - protein, 19 aa, Staphylococcus
IKRAKEFIVSPDPNLSIEI

SEQ ID NO: 2018886 - protein, 21 aa, Staphylococcus
IKRAKLRGERSEGMICSLQEI

SEQ ID NO: 2018887 - protein, 19 aa, Staphylococcus
IKRDKDVIISPDPNMNIEL

SEQ ID NO: 2018888 - protein, 22 aa, Staphylococcus
IKRFPESSLEYGADYVVQSYHK

SEQ ID NO: 2018889 - protein, 17 aa, Staphylococcus
IKRGELIQSDIEREEDD

SEQ ID NO: 2018890 - protein, 23 aa, Staphylococcus
IKRGHKLYGNKLVVFDIRRHEMA

SEQ ID NO: 2018891 - protein, 20 aa, Staphylococcus
IKRGKEIIVSPDPNINIEIG

SEQ ID NO: 2018892 - protein, 25 aa, Staphylococcus
IKRIKERIGDIQWGDNLIITGTDIE

SEQ ID NO: 2018893 - protein, 21 aa, Staphylococcus
IKRKTGARGLRSIIEEALIDI

SEQ ID NO: 2018894 - protein, 22 aa, Staphylococcus
IKRKTTEFDDMVSLMLMHHKNN

SEQ ID NO: 2018895 - protein, 22 aa, Staphylococcus
IKRKVHEALKLVKLEGYESRTI

SEQ ID NO: 2018896 - protein, 21 aa, Staphylococcus
IKRLMEISSYRGIRHRRGLPV

SEQ ID NO: 2018897 - protein, 17 aa, Staphylococcus
IKRLWISSITAKAIRNG

SEQ ID NO: 2018898 - protein, 30 aa, Staphylococcus
IKRLYFFSIANPNPFEWLDQLSQPYKNEGQ

SEQ ID NO: 2018899 - protein, 27 aa, Staphylococcus
IKRMEKRYKGPIAFEYTHINNNTERTW

SEQ ID NO: 2018900 - protein, 20 aa, Staphylococcus
IKRSLTLDFIALRQHYPNAV

SEQ ID NO: 2018901 - protein, 28 aa, Staphylococcus
IKRTFKEWKIPIIFVTHSNFEAEVLADK

SEQ ID NO: 2018902 - protein, 18 aa, Staphylococcus
IKRVISWLEPSYNQRKAE

SEQ ID NO: 2018903 - protein, 22 aa, Staphylococcus
IKSAQHFDGIGFNFRQDSHQFN

SEQ ID NO: 2018904 - protein, 20 aa, Staphylococcus
IKSDNLFYRRDIGNKAIAKE

SEQ ID NO: 2018905 - protein, 17 aa, Staphylococcus
IKSEHAINQYKEYIDKC

SEQ ID NO: 2018906 - protein, 21 aa, Staphylococcus
IKSERLMIGQIVFDDVKDTED

SEQ ID NO: 2018907 - protein, 17 aa, Staphylococcus
IKSETSSFIGIDKNTRE

SEQ ID NO: 2018908 - protein, 17 aa, Staphylococcus
IKSEVQEILKLIDYIYS

SEQ ID NO: 2018909 - protein, 18 aa, Staphylococcus
IKSIESILFASKIDYKCV

SEQ ID NO: 2018910 - protein, 17 aa, Staphylococcus
IKSKDPFEKPSIVFNYL

SEQ ID NO: 2018911 - protein, 18 aa, Staphylococcus
IKSKDPFVKPDFVFNYLS

SEQ ID NO: 2018912 - protein, 21 aa, Staphylococcus
IKSKIKQIVIMGGSSGRGNVT

SEQ ID NO: 2018913 - protein, 17 aa, Staphylococcus
IKSKLLLPQTSVEDDIE

SEQ ID NO: 2018914 - protein, 19 aa, Staphylococcus
IKSLEEYKEVIDLIQSHPH

SEQ ID NO: 2018915 - protein, 20 aa, Staphylococcus
IKSLGRRVFLDSGTLTPLLK

SEQ ID NO: 2018916 - protein, 21 aa, Staphylococcus
IKSLIDLLEIYPFENISIKMI

SEQ ID NO: 2018917 - protein, 25 aa, Staphylococcus
IKSLKISFNKVFGYFIEITRANLKG

SEQ ID NO: 2018918 - protein, 25 aa, Staphylococcus
IKSLKISYNKVFGYFIEITRANLQG

SEQ ID NO: 2018919 - protein, 20 aa, Staphylococcus
IKSLLQMLLLYAIPDPIISD

SEQ ID NO: 2018920 - protein, 17 aa, Staphylococcus
IKSLNEIGVRYVDVSGR

SEQ ID NO: 2018921 - protein, 19 aa, Staphylococcus
IKSNIRYFRDTGAEYEEAK

SEQ ID NO: 2018922 - protein, 21 aa, Staphylococcus
IKSPMVGTFFLQDEKELTNPI

SEQ ID NO: 2018923 - protein, 24 aa, Staphylococcus
IKSPRRAGTVIIRVEVDEHDPRMS

SEQ ID NO: 2018924 - protein, 20 aa, Staphylococcus
IKSQEIFDLEGYEQFENDED

SEQ ID NO: 2018925 - protein, 21 aa, Staphylococcus
IKSQYATLVVRPNHKTDIINN

SEQ ID NO: 2018926 - protein, 20 aa, Staphylococcus
IKSRLLLGTGKFEDEATQTK

SEQ ID NO: 2018927 - protein, 17 aa, Staphylococcus
IKSSLAIAKDQNIEVNI

SEQ ID NO: 2018928 - protein, 20 aa, Staphylococcus
IKSTIFIADMNEFQQINEVY

SEQ ID NO: 2018929 - protein, 17 aa, Staphylococcus
IKSYITHSVPKVMGVDY

SEQ ID NO: 2018930 - protein, 17 aa, Staphylococcus
IKSYKGTHLKLHHMDCY

SEQ ID NO: 2018931 - protein, 20 aa, Staphylococcus
IKTEGQPAVNDWLNTLKSGG

SEQ ID NO: 2018932 - protein, 17 aa, Staphylococcus
IKTELAFMPDFTQTCDV

SEQ ID NO: 2018933 - protein, 22 aa, Staphylococcus
IKTENGFDYIVTGSGFLYNMVR

SEQ ID NO: 2018934 - protein, 22 aa, Staphylococcus
IKTEPGFARTINYCIDQMQLPH

SEQ ID NO: 2018935 - protein, 17 aa, Staphylococcus
IKTLGYAIQCRITTEDP

SEQ ID NO: 2018936 - protein, 19 aa, Staphylococcus
IKTLLNYTEHIHVVSPVIT

SEQ ID NO: 2018937 - protein, 19 aa, Staphylococcus
IKTNAIFKKSIINDDLADA

SEQ ID NO: 2018938 - protein, 20 aa, Staphylococcus
IKTNLNLPSDKKVIMYAPTW

SEQ ID NO: 2018939 - protein, 21 aa, Staphylococcus
IKTPRLDALFEKYAIEIGEAV

SEQ ID NO: 2018940 - protein, 20 aa, Staphylococcus
IKTPVKYASGELKKLFSQVE

SEQ ID NO: 2018941 - protein, 17 aa, Staphylococcus
IKTRGAYLAYRIQEKIN

SEQ ID NO: 2018942 - protein, 18 aa, Staphylococcus
IKTRNGLFKSRFAQRTPN

SEQ ID NO: 2018943 - protein, 18 aa, Staphylococcus
IKTSGALPKDEAFESAIT

SEQ ID NO: 2018944 - protein, 29 aa, Staphylococcus
IKTSLNQFGYMWECPDYFELDGHDIIMFC

SEQ ID NO: 2018945 - protein, 23 aa, Staphylococcus
IKTTHGQMLTFHFDKNLKSQLQN

SEQ ID NO: 2018946 - protein, 23 aa, Staphylococcus
IKTVCYNFMPVFDWTRSQLDYRL

SEQ ID NO: 2018947 - protein, 18 aa, Staphylococcus
IKTVIGFGAPNKEGSHGV

SEQ ID NO: 2018948 - protein, 25 aa, Staphylococcus
IKTVTELGKAFALCATEPTAQELND

SEQ ID NO: 2018949 - protein, 21 aa, Staphylococcus
IKTWIPCEIENEFMDHGIKGV

SEQ ID NO: 2018950 - protein, 19 aa, Staphylococcus
IKTWSRRSTIFPNFIGITF

SEQ ID NO: 2018951 - protein, 22 aa, Staphylococcus
IKTYIFYQLFEKYVIDYSMASA

SEQ ID NO: 2018952 - protein, 17 aa, Staphylococcus
IKVAKVIVRDDIAVEDE

SEQ ID NO: 2018953 - protein, 17 aa, Staphylococcus
IKVASISPELFFQKGKF

SEQ ID NO: 2018954 - protein, 26 aa, Staphylococcus
IKVATRLGHVKGYFIYPYKEEMKNRN

SEQ ID NO: 2018955 - protein, 23 aa, Staphylococcus
IKVCPLIHWTWDNVWDYIKSNEL

SEQ ID NO: 2018956 - protein, 21 aa, Staphylococcus
IKVCPLIYWSEDDVWQYIKQH

SEQ ID NO: 2018957 - protein, 20 aa, Staphylococcus
IKVDIAGSVESIYNITKDDL

SEQ ID NO: 2018958 - protein, 20 aa, Staphylococcus
IKVDIAGSVESIYSITKDDL

SEQ ID NO: 2018959 - protein, 18 aa, Staphylococcus
IKVEDNFRPNIEIFEHDF

SEQ ID NO: 2018960 - protein, 17 aa, Staphylococcus
IKVEEGQEIFVEKLDVN

SEQ ID NO: 2018961 - protein, 21 aa, Staphylococcus
IKVFEELSADFAIDFDESQSI

SEQ ID NO: 2018962 - protein, 20 aa, Staphylococcus
IKVHAAGLCHSDLSVINGSR

SEQ ID NO: 2018963 - protein, 20 aa, Staphylococcus
IKVIHTYDVEHRWTVEYEAK

SEQ ID NO: 2018964 - protein, 22 aa, Staphylococcus
IKVIRNYLGLIIQKQIIKTSKA

SEQ ID NO: 2018965 - protein, 22 aa, Staphylococcus
IKVIRNYLGLIIQKQIIKTSKS

SEQ ID NO: 2018966 - protein, 26 aa, Staphylococcus
IKVKLIQRLAFASGHLGMVGGQALDM

SEQ ID NO: 2018967 - protein, 23 aa, Staphylococcus
IKVLARGPVFKGLLTSNSNEALD

SEQ ID NO: 2018968 - protein, 27 aa, Staphylococcus
IKVLEIKGSELVRGRGGPRCMSQPIYR

SEQ ID NO: 2018969 - protein, 18 aa, Staphylococcus
IKVLLKSVDYYPVDINSK

SEQ ID NO: 2018970 - protein, 21 aa, Staphylococcus
IKVLPDFKMKAQIIRDDFEQK

SEQ ID NO: 2018971 - protein, 19 aa, Staphylococcus
IKVSGDFTIENEASDSIVT

SEQ ID NO: 2018972 - protein, 22 aa, Staphylococcus
IKVSLEIVENVNLLRIDVPMSL

SEQ ID NO: 2018973 - protein, 20 aa, Staphylococcus
IKVTAWMPLMRNRGLLDDPV

SEQ ID NO: 2018974 - protein, 19 aa, Staphylococcus
IKVVKAVKDATGLGLKDAK

SEQ ID NO: 2018975 - protein, 17 aa, Staphylococcus
IKVYLFESFISGEHIFR

SEQ ID NO: 2018976 - protein, 24 aa, Staphylococcus
IKWKQYNVNLVFFLAISKKDLEVA

SEQ ID NO: 2018977 - protein, 17 aa, Staphylococcus
IKWNFTKFLVDREGNVV

SEQ ID NO: 2018978 - protein, 19 aa, Staphylococcus
IKWNVPEILPEYITEYHEV

SEQ ID NO: 2018979 - protein, 19 aa, Staphylococcus
IKWVHQHIKDFGGDPNNIT

SEQ ID NO: 2018980 - protein, 17 aa, Staphylococcus
IKYAGYKFDQWLDLTFY

SEQ ID NO: 2018981 - protein, 19 aa, Staphylococcus
IKYDPVLNKLNFSLSYIVN

SEQ ID NO: 2018982 - protein, 19 aa, Staphylococcus
IKYFSSHMDYRLKGIAFDL

SEQ ID NO: 2018983 - protein, 23 aa, Staphylococcus
IKYIIEQGGKLVLFSHLGKVKEE

SEQ ID NO: 2018984 - protein, 21 aa, Staphylococcus
IKYKDFENMKESAMFINVGRG

SEQ ID NO: 2018985 - protein, 19 aa, Staphylococcus
IKYKGQMYYNGTVISKIKQ

SEQ ID NO: 2018986 - protein, 26 aa, Staphylococcus
IKYLLKYNNNIWNEWAFEKYIQSEDY

SEQ ID NO: 2018987 - protein, 17 aa, Staphylococcus
IKYLTLYAFSTENWTRP

SEQ ID NO: 2018988 - protein, 20 aa, Staphylococcus
IKYPILNERMNQLPVLTDLY

SEQ ID NO: 2018989 - protein, 21 aa, Staphylococcus
IKYRKRSVLEDSFAINMTPFF

SEQ ID NO: 2018990 - protein, 20 aa, Staphylococcus
IKYSGSLLQYSFSEVGQPKG

SEQ ID NO: 2018991 - protein, 21 aa, Staphylococcus
IKYSGSLLQYSFSEVNQAKGY

SEQ ID NO: 2018992 - protein, 21 aa, Staphylococcus
IKYSIMGHVHFRKSLVENNIT

SEQ ID NO: 2018993 - protein, 19 aa, Staphylococcus
IKYSNWLNQLFHGIEYRMQ

SEQ ID NO: 2018994 - protein, 22 aa, Staphylococcus
IKYTKDFALMFAPNINSYKRFA

SEQ ID NO: 2018995 - protein, 20 aa, Staphylococcus
IKYWGKADEALIIPMNNSLS

SEQ ID NO: 2018996 - protein, 18 aa, Staphylococcus
IKYWGKADEKLIIPMNNS

SEQ ID NO: 2018997 - protein, 19 aa, Staphylococcus
IKYWGKADENLIIPMNNSL

SEQ ID NO: 2018998 - protein, 22 aa, Staphylococcus
ILAACKIAGVNRVFQVGGAQSI

SEQ ID NO: 2018999 - protein, 23 aa, Staphylococcus
ILACEAWSELGHIPKEDVKKIRQ

SEQ ID NO: 2019000 - protein, 24 aa, Staphylococcus
ILALKRKRVTAVRFNIQRGGIESL

SEQ ID NO: 2019001 - protein, 20 aa, Staphylococcus
ILANMAFRPILSDDIKLTQS

SEQ ID NO: 2019002 - protein, 19 aa, Staphylococcus
ILASEAWSELGYIPKEDVQ

SEQ ID NO: 2019003 - protein, 25 aa, Staphylococcus
ILAYKGELPVGILDLIVSASAMEID

SEQ ID NO: 2019004 - protein, 25 aa, Staphylococcus
ILCGCQGVNGGGWAHYVGQEKCRPI

SEQ ID NO: 2019005 - protein, 31 aa, Staphylococcus
ILDACSAPGGKACHIAELLAPSGHVDATDIH

SEQ ID NO: 2019006 - protein, 19 aa, Staphylococcus
ILDDYGIKYDQIIVRGSAK

SEQ ID NO: 2019007 - protein, 21 aa, Staphylococcus
ILDELEISPASSWFKKLIKRM

SEQ ID NO: 2019008 - protein, 17 aa, Staphylococcus
ILDELKNTLGHVKNEEV

SEQ ID NO: 2019009 - protein, 17 aa, Staphylococcus
ILDELKNTLGHVKSEEV

SEQ ID NO: 2019010 - protein, 18 aa, Staphylococcus
ILDFAGWQFQMENIKQVA

SEQ ID NO: 2019011 - protein, 20 aa, Staphylococcus
ILDHNKWKQVAFVVPDSLSH

SEQ ID NO: 2019012 - protein, 25 aa, Staphylococcus
ILDHVREIGSLVMATTHYPELKAYS

SEQ ID NO: 2019013 - protein, 26 aa, Staphylococcus
ILDIEMPEMTGLEVLAKVREGNDSTK

SEQ ID NO: 2019014 - protein, 24 aa, Staphylococcus
ILDIEMPGLTGLEVLVKIKEFKLD

SEQ ID NO: 2019015 - protein, 19 aa, Staphylococcus
ILDILSCGELCAYDLLQHF

SEQ ID NO: 2019016 - protein, 20 aa, Staphylococcus
ILDIVRYHFNLHINEDALSY

SEQ ID NO: 2019017 - protein, 20 aa, Staphylococcus
ILDLCAGNGVIALLLSAKGS

SEQ ID NO: 2019018 - protein, 19 aa, Staphylococcus
ILDLGCGTGSLTHQLTGLG

SEQ ID NO: 2019019 - protein, 20 aa, Staphylococcus
ILDLPDYTFPLFGMAVGEPA

SEQ ID NO: 2019020 - protein, 25 aa, Staphylococcus
ILDLPEYTFPLFGMAIGEPADDEQG

SEQ ID NO: 2019021 - protein, 20 aa, Staphylococcus
ILDNFKFDVEITTMTDNDAL

SEQ ID NO: 2019022 - protein, 19 aa, Staphylococcus
ILDPTKLWPEDEIPVKVVG

SEQ ID NO: 2019023 - protein, 20 aa, Staphylococcus
ILDPTKLWPEDQVPVKIVGK

SEQ ID NO: 2019024 - protein, 22 aa, Staphylococcus
ILDQLPCWLTYTNGDTHQVIDD

SEQ ID NO: 2019025 - protein, 22 aa, Staphylococcus
ILDQLPCWLTYTNGETHKVIDD

SEQ ID NO: 2019026 - protein, 23 aa, Staphylococcus
ILDQLPCWLTYTNGETHKVIDDN

SEQ ID NO: 2019027 - protein, 25 aa, Staphylococcus
ILDVLVEPFFEWVVEADAWYGPQLE

SEQ ID NO: 2019028 - protein, 26 aa, Staphylococcus
ILDVMVEPFFEWVIEKDAWYGEELEH

SEQ ID NO: 2019029 - protein, 25 aa, Staphylococcus
ILDVMVEPFFEWVVEKDAWYGEELE

SEQ ID NO: 2019030 - protein, 25 aa, Staphylococcus
ILDVMVEPFFEWVVEKDAWYGQELD

SEQ ID NO: 2019031 - protein, 18 aa, Staphylococcus
ILEALSAGTPVLASDIIA

SEQ ID NO: 2019032 - protein, 17 aa, Staphylococcus
ILEAQYNLIFSMTTVAK

SEQ ID NO: 2019033 - protein, 19 aa, Staphylococcus
ILEAYQLMARNEGVFSEPA

SEQ ID NO: 2019034 - protein, 17 aa, Staphylococcus
ILECETFVQIHHLATHF

SEQ ID NO: 2019035 - protein, 29 aa, Staphylococcus
ILECIEAELDLAICITEHIPVIDMVKVKR

SEQ ID NO: 2019036 - protein, 38 aa, Staphylococcus
ILEDLPFISGFVGSCSFDLVRHAFPVLKEIELTDHPQH

SEQ ID NO: 2019037 - protein, 18 aa, Staphylococcus
ILEEAWKLNPSFSKNDAV

SEQ ID NO: 2019038 - protein, 20 aa, Staphylococcus
ILEEREADTLFNLVDQSRSY

SEQ ID NO: 2019039 - protein, 19 aa, Staphylococcus
ILEEREAEQLFKLVDSNRD

SEQ ID NO: 2019040 - protein, 19 aa, Staphylococcus
ILEGAECNNDLLAHKIMNS

SEQ ID NO: 2019041 - protein, 21 aa, Staphylococcus
ILEGFTLPKMLWMKQNEPSLW

SEQ ID NO: 2019042 - protein, 32 aa, Staphylococcus
ILEGYHTLLMIGRYPICYINIEMDPILVDVNV

SEQ ID NO: 2019043 - protein, 25 aa, Staphylococcus
ILEHKRLDALIVLSDFNRRYLSGFT

SEQ ID NO: 2019044 - protein, 25 aa, Staphylococcus
ILEIIPSYRAIMLTIDITQSDATEI

SEQ ID NO: 2019045 - protein, 19 aa, Staphylococcus
ILELCSYVMHFAAGQVIDH

SEQ ID NO: 2019046 - protein, 26 aa, Staphylococcus
ILELPKHTFPLFGMALGIPEDDENGS

SEQ ID NO: 2019047 - protein, 18 aa, Staphylococcus
ILEMSKSGIINIEQHQNF

SEQ ID NO: 2019048 - protein, 17 aa, Staphylococcus
ILEMSKSGIVNINQNNQ

SEQ ID NO: 2019049 - protein, 18 aa, Staphylococcus
ILEMSKSGVINIEQVRSF

SEQ ID NO: 2019050 - protein, 26 aa, Staphylococcus
ILEQLDIPPIDVFGLKSAINDIHELN

SEQ ID NO: 2019051 - protein, 22 aa, Staphylococcus
ILEQLPCWLTYTNDKTHQVIDD

SEQ ID NO: 2019052 - protein, 18 aa, Staphylococcus
ILESLRPILLQYAKERTE

SEQ ID NO: 2019053 - protein, 19 aa, Staphylococcus
ILESYGIDYDQIIVRGNAK

SEQ ID NO: 2019054 - protein, 17 aa, Staphylococcus
ILEVLSYLDELKRNRIT

SEQ ID NO: 2019055 - protein, 24 aa, Staphylococcus
ILFDAPICNMVRTGISLYGYYPSE

SEQ ID NO: 2019056 - protein, 18 aa, Staphylococcus
ILFGIKEDVDYIAASFVR

SEQ ID NO: 2019057 - protein, 19 aa, Staphylococcus
ILFHLRIAPDEAHAVEMMN

SEQ ID NO: 2019058 - protein, 25 aa, Staphylococcus
ILFQKVGVVPVEFISEAVIQTSDDN

SEQ ID NO: 2019059 - protein, 18 aa, Staphylococcus
ILGADSFSRIQPINNGIS

SEQ ID NO: 2019060 - protein, 27 aa, Staphylococcus
ILGDFKAPMGCRSFLPAWRDAQGQFEN

SEQ ID NO: 2019061 - protein, 26 aa, Staphylococcus
ILGDFKAPMGCRSFLPAWRNENGEYE

SEQ ID NO: 2019062 - protein, 29 aa, Staphylococcus
ILGEGLLRKALEDMIKRLKLEDNVFLVGQ

SEQ ID NO: 2019063 - protein, 18 aa, Staphylococcus
ILGGEPFCNLNISLKIAR

SEQ ID NO: 2019064 - protein, 18 aa, Staphylococcus
ILGGEPFCNVDITLKCAQ

SEQ ID NO: 2019065 - protein, 20 aa, Staphylococcus
ILGGEPFCNVDITLKVARAF

SEQ ID NO: 2019066 - protein, 18 aa, Staphylococcus
ILGGKSFIDDIFVAIDED

SEQ ID NO: 2019067 - protein, 21 aa, Staphylococcus
ILGICRGAQILNVYFGGTLYQ

SEQ ID NO: 2019068 - protein, 18 aa, Staphylococcus
ILGKSPFFGICLGHQLFA

SEQ ID NO: 2019069 - protein, 17 aa, Staphylococcus
ILGKTALCKGKGEIIEY

SEQ ID NO: 2019070 - protein, 24 aa, Staphylococcus
ILGSPRLGAHFVDYLVTLKDQGGN

SEQ ID NO: 2019071 - protein, 20 aa, Staphylococcus
ILGVCLGAQAITCYYGGHVI

SEQ ID NO: 2019072 - protein, 20 aa, Staphylococcus
ILGVCLGAQALTCYYGGRVI

SEQ ID NO: 2019073 - protein, 19 aa, Staphylococcus
ILHGPVCAVIMKEKYGIDD

SEQ ID NO: 2019074 - protein, 19 aa, Staphylococcus
ILHIVDQLKGIPFTEKMEK

SEQ ID NO: 2019075 - protein, 18 aa, Staphylococcus
ILHRPKFLVLDEPVSALD

SEQ ID NO: 2019076 - protein, 19 aa, Staphylococcus
ILHTYKTLISLRHHHDIIT

SEQ ID NO: 2019077 - protein, 19 aa, Staphylococcus
ILICDEITASLDVNAERKL

SEQ ID NO: 2019078 - protein, 19 aa, Staphylococcus
ILIDLANVVVHVFHKDERD

SEQ ID NO: 2019079 - protein, 26 aa, Staphylococcus
ILIEHFKGAFPLWMAPVQVNIIGVSD

SEQ ID NO: 2019080 - protein, 25 aa, Staphylococcus
ILIEHFKGAFPLWMAPVQVNLIGVS

SEQ ID NO: 2019081 - protein, 24 aa, Staphylococcus
ILIGDPRLEGGSFYLGSETFEQGI

SEQ ID NO: 2019082 - protein, 17 aa, Staphylococcus
ILIHHQFSRVQSLAKSY

SEQ ID NO: 2019083 - protein, 17 aa, Staphylococcus
ILIKGSRGMKLEEVSDA

SEQ ID NO: 2019084 - protein, 17 aa, Staphylococcus
ILIKSEHAINQYKEYID

SEQ ID NO: 2019085 - protein, 18 aa, Staphylococcus
ILINEMWNKKTILGINEV

SEQ ID NO: 2019086 - protein, 21 aa, Staphylococcus
ILINYDLHWNPVRMIQRNGRI

SEQ ID NO: 2019087 - protein, 26 aa, Staphylococcus
ILIRSNVMGLNILKGYLWSDYMIENI

SEQ ID NO: 2019088 - protein, 18 aa, Staphylococcus
ILKARIINKYPHVNVNLL

SEQ ID NO: 2019089 - protein, 20 aa, Staphylococcus
ILKDEVKAVKNLPQYILNKT

SEQ ID NO: 2019090 - protein, 26 aa, Staphylococcus
ILKDIYKRGIGSLLIEAGPRITSKFL

SEQ ID NO: 2019091 - protein, 18 aa, Staphylococcus
ILKDIYRQGNIVTAKKKK

SEQ ID NO: 2019092 - protein, 25 aa, Staphylococcus
ILKDRYGLKQIINKVLETYNIYPNI

SEQ ID NO: 2019093 - protein, 27 aa, Staphylococcus
ILKENIMVINIYDWLSNFRLLTGSYYS

SEQ ID NO: 2019094 - protein, 18 aa, Staphylococcus
ILKENIYMHFSRTYLRLM

SEQ ID NO: 2019095 - protein, 19 aa, Staphylococcus
ILKEPKLSLIKQYEALLQT

SEQ ID NO: 2019096 - protein, 23 aa, Staphylococcus
ILKFAQAHQIEWIIIGPEQPLID

SEQ ID NO: 2019097 - protein, 22 aa, Staphylococcus
ILKFMLKVFYELGFVTEENGII

SEQ ID NO: 2019098 - protein, 18 aa, Staphylococcus
ILKGYLWSDYMIENIDEE

SEQ ID NO: 2019099 - protein, 25 aa, Staphylococcus
ILKKSLDYLSRIGVQEALVTCTEDN

SEQ ID NO: 2019100 - protein, 26 aa, Staphylococcus
ILKLQVPNCDKQFMSYIGTTYVDDER

SEQ ID NO: 2019101 - protein, 31 aa, Staphylococcus
ILKNECRTSFKFHGEVAMQLFLSDNFILPSR

SEQ ID NO: 2019102 - protein, 19 aa, Staphylococcus
ILKQCLDNDIELIVVNSEY

SEQ ID NO: 2019103 - protein, 25 aa, Staphylococcus
ILKQRFPNAYIHMIGFSRGGIQGLL

SEQ ID NO: 2019104 - protein, 20 aa, Staphylococcus
ILKSEGFIKNVEFVEDDKQG

SEQ ID NO: 2019105 - protein, 19 aa, Staphylococcus
ILKSEGFIKNVEYVEDDKQ

SEQ ID NO: 2019106 - protein, 20 aa, Staphylococcus
ILKSEGFIKNVEYVEDDKQG

SEQ ID NO: 2019107 - protein, 18 aa, Staphylococcus
ILKTLDLDGYMVVIDTGV

SEQ ID NO: 2019108 - protein, 18 aa, Staphylococcus
ILKVDGFLNHQIDARLMH

SEQ ID NO: 2019109 - protein, 18 aa, Staphylococcus
ILKYLKQYATVILTSHDE

SEQ ID NO: 2019110 - protein, 17 aa, Staphylococcus
ILLATGFVNKICNQPLI

SEQ ID NO: 2019111 - protein, 19 aa, Staphylococcus
ILLDLMLPEMDGITVASKL

SEQ ID NO: 2019112 - protein, 18 aa, Staphylococcus
ILLDRELDIPNGEDETTL

SEQ ID NO: 2019113 - protein, 19 aa, Staphylococcus
ILLHSCCAPCSTYTLEFLT

SEQ ID NO: 2019114 - protein, 20 aa, Staphylococcus
ILLHSCCAPCSTYTLEFLTQ

SEQ ID NO: 2019115 - protein, 17 aa, Staphylococcus
ILLNWKKNNVKTIDDSK

SEQ ID NO: 2019116 - protein, 17 aa, Staphylococcus
ILLNWKKNNVKTIDDTN

SEQ ID NO: 2019117 - protein, 17 aa, Staphylococcus
ILLNWKKNNVKTIEDSK

SEQ ID NO: 2019118 - protein, 18 aa, Staphylococcus
ILMGLDIGDFPGVGKASK

SEQ ID NO: 2019119 - protein, 25 aa, Staphylococcus
ILMYHVECGREFYIRPADFKRRKRC

SEQ ID NO: 2019120 - protein, 23 aa, Staphylococcus
ILNDLFKYYDFILIDTPPVNTVT

SEQ ID NO: 2019121 - protein, 23 aa, Staphylococcus
ILNEEGIIILVIYHGHDEGKIER

SEQ ID NO: 2019122 - protein, 21 aa, Staphylococcus
ILNFPQRPGALKEFVNDVLGP

SEQ ID NO: 2019123 - protein, 25 aa, Staphylococcus
ILNFPQRPGALKEFVNDVLGPQDDI

SEQ ID NO: 2019124 - protein, 24 aa, Staphylococcus
ILNFPQRPGALREFVNDVLGPQDD

SEQ ID NO: 2019125 - protein, 25 aa, Staphylococcus
ILNFPQRPGALREFVNDVLGPQDDI

SEQ ID NO: 2019126 - protein, 25 aa, Staphylococcus
ILNFPQRPGALREFVNEVLGPKDDI

SEQ ID NO: 2019127 - protein, 18 aa, Staphylococcus
ILNGCVCCDLKIDLVNQI

SEQ ID NO: 2019128 - protein, 24 aa, Staphylococcus
ILNGITRKVIKWISEDEDIPFKEE

SEQ ID NO: 2019129 - protein, 23 aa, Staphylococcus
ILNGITRKVIKWISEDKNIPFIE

SEQ ID NO: 2019130 - protein, 24 aa, Staphylococcus
ILNGITRKVIKWVAEDYNIPFNEE

SEQ ID NO: 2019131 - protein, 17 aa, Staphylococcus
ILNHSFNTFSDWLPYLD

SEQ ID NO: 2019132 - protein, 19 aa, Staphylococcus
ILNIHPSLLPKYKGKDAIG

SEQ ID NO: 2019133 - protein, 17 aa, Staphylococcus
ILNKEGYQLGVLELYVI

SEQ ID NO: 2019134 - protein, 19 aa, Staphylococcus
ILNLYFPFIDVETLLTLLD

SEQ ID NO: 2019135 - protein, 20 aa, Staphylococcus
ILNMSSINGVIGFAGKSAYN

SEQ ID NO: 2019136 - protein, 20 aa, Staphylococcus
ILNNKFLFFIDFIPKKTNVY

SEQ ID NO: 2019137 - protein, 22 aa, Staphylococcus
ILNPYLCIIFCNSRESADELAE

SEQ ID NO: 2019138 - protein, 27 aa, Staphylococcus
ILNRAFKLSPIYQGEFLEIGYPRLDLT

SEQ ID NO: 2019139 - protein, 21 aa, Staphylococcus
ILNRAKEEFRKVMPHIDEKEF

SEQ ID NO: 2019140 - protein, 17 aa, Staphylococcus
ILNRHNIPFDGMISELF

SEQ ID NO: 2019141 - protein, 17 aa, Staphylococcus
ILNRMNLSVSGLRRGKD

SEQ ID NO: 2019142 - protein, 24 aa, Staphylococcus
ILNYPETCPHGGVIPRDHHYKEKY

SEQ ID NO: 2019143 - protein, 21 aa, Staphylococcus
ILPAVSVFKVLFNKIEASQFT

SEQ ID NO: 2019144 - protein, 18 aa, Staphylococcus
ILPFGVVGEYVLKGSTVT

SEQ ID NO: 2019145 - protein, 25 aa, Staphylococcus
ILPKTNIGGWTFPDNIQVIGVSTVH

SEQ ID NO: 2019146 - protein, 17 aa, Staphylococcus
ILPLIAKGYGNKEIAEK

SEQ ID NO: 2019147 - protein, 28 aa, Staphylococcus
ILPSKYAYDFLKFCFRNPKTCPLLDVSE

SEQ ID NO: 2019148 - protein, 17 aa, Staphylococcus
ILQALVKPCDVLILDEP

SEQ ID NO: 2019149 - protein, 21 aa, Staphylococcus
ILQELGLTKVNGGFVVTGGSA

SEQ ID NO: 2019150 - protein, 17 aa, Staphylococcus
ILQKLPINKMNSLSIHK

SEQ ID NO: 2019151 - protein, 17 aa, Staphylococcus
ILQLIKIGIKHKTIMEL

SEQ ID NO: 2019152 - protein, 18 aa, Staphylococcus
ILQLIKYKGRMTYNNEEL

SEQ ID NO: 2019153 - protein, 25 aa, Staphylococcus
ILQLIKYKGVMTFQGQELRKIKDAA

SEQ ID NO: 2019154 - protein, 23 aa, Staphylococcus
ILQLMMLQPKFAILDEIDSGLDI

SEQ ID NO: 2019155 - protein, 25 aa, Staphylococcus
ILQMLREFQHLQLIIITHDSYLLKA

SEQ ID NO: 2019156 - protein, 23 aa, Staphylococcus
ILQPLYRRGKFLSIQMYNALSYN

SEQ ID NO: 2019157 - protein, 24 aa, Staphylococcus
ILQQAEAWLDCYFSGEKPQSSLKL

SEQ ID NO: 2019158 - protein, 20 aa, Staphylococcus
ILQTHAFELLMVSLERYDLE

SEQ ID NO: 2019159 - protein, 19 aa, Staphylococcus
ILREPGFFKKLKVMSDAQD

SEQ ID NO: 2019160 - protein, 32 aa, Staphylococcus
ILRTRIKGLGKDRMTAIFPKLVFSIKKGTNFS

SEQ ID NO: 2019161 - protein, 18 aa, Staphylococcus
ILSAVLMLEHLGWQEAAD

SEQ ID NO: 2019162 - protein, 24 aa, Staphylococcus
ILSDREVRLHISFDNLIFDGWSMF

SEQ ID NO: 2019163 - protein, 22 aa, Staphylococcus
ILSECIILSSLLNKTSITQQYL

SEQ ID NO: 2019164 - protein, 31 aa, Staphylococcus
ILSELGIDIDEDFLLVKREIFSSGKSICRLN

SEQ ID NO: 2019165 - protein, 18 aa, Staphylococcus
ILSEYGHEQIRLFLEKVR

SEQ ID NO: 2019166 - protein, 19 aa, Staphylococcus
ILSEYGHEQIRLFLQKAGE

SEQ ID NO: 2019167 - protein, 17 aa, Staphylococcus
ILSGCYQTIGWFKRVDH

SEQ ID NO: 2019168 - protein, 17 aa, Staphylococcus
ILSGGFWNNGVTSALIN

SEQ ID NO: 2019169 - protein, 22 aa, Staphylococcus
ILSGKRCPKCDVINRSGENHWK

SEQ ID NO: 2019170 - protein, 23 aa, Staphylococcus
ILSKRELEILPLIAKGYGNKDIA

SEQ ID NO: 2019171 - protein, 26 aa, Staphylococcus
ILSKRELEILPLIAKGYGNKEIAEKL

SEQ ID NO: 2019172 - protein, 18 aa, Staphylococcus
ILSKVLVRATQQWPNDKA

SEQ ID NO: 2019173 - protein, 25 aa, Staphylococcus
ILSLAMCLRESFNFEDAASELEQAV

SEQ ID NO: 2019174 - protein, 17 aa, Staphylococcus
ILSMLSTLGQSMFYPKG

SEQ ID NO: 2019175 - protein, 23 aa, Staphylococcus
ILSQCIIKPSLLHKTHITQQQLK

SEQ ID NO: 2019176 - protein, 18 aa, Staphylococcus
ILSQLNFNQFNLVEAQCK

SEQ ID NO: 2019177 - protein, 17 aa, Staphylococcus
ILSRSSEELSHIYTMSE

SEQ ID NO: 2019178 - protein, 18 aa, Staphylococcus
ILSSVLMLEHLGWQEAAD

SEQ ID NO: 2019179 - protein, 21 aa, Staphylococcus
ILSTIYIKLNHAFTNEDLHNL

SEQ ID NO: 2019180 - protein, 18 aa, Staphylococcus
ILSVTGWYGKRFVNSEQI

SEQ ID NO: 2019181 - protein, 18 aa, Staphylococcus
ILTAIKIARIFNEPVENI

SEQ ID NO: 2019182 - protein, 18 aa, Staphylococcus
ILTAIKIARIFNEPVESI

SEQ ID NO: 2019183 - protein, 19 aa, Staphylococcus
ILTAIKIARIFNEPVESIF

SEQ ID NO: 2019184 - protein, 19 aa, Staphylococcus
ILTAMKIARIFGESVEDVF

SEQ ID NO: 2019185 - protein, 25 aa, Staphylococcus
ILTDERYFGGSFERLQQLSKQTSLP

SEQ ID NO: 2019186 - protein, 17 aa, Staphylococcus
ILTEPKLSLIKQYEALL

SEQ ID NO: 2019187 - protein, 25 aa, Staphylococcus
ILTERLKQHFPAIVSIKQNVNDTHS

SEQ ID NO: 2019188 - protein, 23 aa, Staphylococcus
ILTGEYVVNAWQGKKEEIDFFIA

SEQ ID NO: 2019189 - protein, 20 aa, Staphylococcus
ILTGNFLLALGLEQLSEVNH

SEQ ID NO: 2019190 - protein, 23 aa, Staphylococcus
ILTGNFLLALGLKQLSKIEDHRV

SEQ ID NO: 2019191 - protein, 23 aa, Staphylococcus
ILTGNFLLALGLQHLSEIKDARV

SEQ ID NO: 2019192 - protein, 17 aa, Staphylococcus
ILTLIAMEKPESRNSKD

SEQ ID NO: 2019193 - protein, 20 aa, Staphylococcus
ILTLSGTIANLSFLDDTISA

SEQ ID NO: 2019194 - protein, 23 aa, Staphylococcus
ILTPTLDELFAYYAKKYGEEVSE

SEQ ID NO: 2019195 - protein, 19 aa, Staphylococcus
ILTRKSGKIPADYTSKEKL

SEQ ID NO: 2019196 - protein, 20 aa, Staphylococcus
ILTSICKKWYINSFKYFRNM

SEQ ID NO: 2019197 - protein, 21 aa, Staphylococcus
ILTSICKKWYINSFKYFRNMY

SEQ ID NO: 2019198 - protein, 22 aa, Staphylococcus
ILTSICKKWYINSFKYFRNMYK

SEQ ID NO: 2019199 - protein, 28 aa, Staphylococcus
ILTSIPLWKNQMAIALTLLRQRHAVRSQ

SEQ ID NO: 2019200 - protein, 28 aa, Staphylococcus
ILTSIPLWKNQMAIALTLMRQRQAMSAQ

SEQ ID NO: 2019201 - protein, 24 aa, Staphylococcus
ILTYIKRHYGFFHAIFVSHPNRDL

SEQ ID NO: 2019202 - protein, 25 aa, Staphylococcus
ILVDAPCSGFGVLRHKPEIKYTQSK

SEQ ID NO: 2019203 - protein, 25 aa, Staphylococcus
ILVDAPCSGLGVLRHKPEIKYEQSQ

SEQ ID NO: 2019204 - protein, 21 aa, Staphylococcus
ILVDMTKLLAPILAHTSEEVW

SEQ ID NO: 2019205 - protein, 24 aa, Staphylococcus
ILVKDRYDKFVFLFENEFATRWFE

SEQ ID NO: 2019206 - protein, 23 aa, Staphylococcus
ILVKDRYDQLVFLFENEFATRWF

SEQ ID NO: 2019207 - protein, 17 aa, Staphylococcus
ILVKNAYVFTGEKVTKE

SEQ ID NO: 2019208 - protein, 19 aa, Staphylococcus
ILVLPKLATEIGLNEAIVL

SEQ ID NO: 2019209 - protein, 18 aa, Staphylococcus
ILVRRLVEENGTEHEGEL

SEQ ID NO: 2019210 - protein, 25 aa, Staphylococcus
ILWNNEMRAFTGWGKQSGTTINDNY

SEQ ID NO: 2019211 - protein, 18 aa, Staphylococcus
ILYKKIVPEEGIVKQFSH

SEQ ID NO: 2019212 - protein, 18 aa, Staphylococcus
ILYLGGFNFPNKRAKLYP

SEQ ID NO: 2019213 - protein, 24 aa, Staphylococcus
ILYRSHDLLSWDYIGPVDMSNGQQ

SEQ ID NO: 2019214 - protein, 18 aa, Staphylococcus
ILYSFNYFKSSLVKFKTV

SEQ ID NO: 2019215 - protein, 17 aa, Staphylococcus
IMAHKDCGMGCLDVSTV

SEQ ID NO: 2019216 - protein, 18 aa, Staphylococcus
IMAKEYRDGLMAAVALKY

SEQ ID NO: 2019217 - protein, 27 aa, Staphylococcus
IMASLHFDVPCLFAKKAKPSTLKDGFY

SEQ ID NO: 2019218 - protein, 24 aa, Staphylococcus
IMDEIARLTPLYAGVSYDRLQGFD

SEQ ID NO: 2019219 - protein, 18 aa, Staphylococcus
IMDEVRRNTNEGGTAANV

SEQ ID NO: 2019220 - protein, 18 aa, Staphylococcus
IMDGTFINGCHLGGGLHH

SEQ ID NO: 2019221 - protein, 24 aa, Staphylococcus
IMDLPFKPKQLVIVGAEYIALEFA

SEQ ID NO: 2019222 - protein, 19 aa, Staphylococcus
IMEGIKYLIDHPEIKHGRI

SEQ ID NO: 2019223 - protein, 31 aa, Staphylococcus
IMEKEMAVAMGIKWGMLYRDAVTTGVDPTLL

SEQ ID NO: 2019224 - protein, 17 aa, Staphylococcus
IMEMVRSLIEVMRTNWS

SEQ ID NO: 2019225 - protein, 18 aa, Staphylococcus
IMEPEMNFTAFLNQIDAI

SEQ ID NO: 2019226 - protein, 21 aa, Staphylococcus
IMFTDGFELKGLNRAKETYKF

SEQ ID NO: 2019227 - protein, 18 aa, Staphylococcus
IMGLDITPKFLTAEQLAE

SEQ ID NO: 2019228 - protein, 17 aa, Staphylococcus
IMGMTFHLVCPKELNPT

SEQ ID NO: 2019229 - protein, 17 aa, Staphylococcus
IMGMTFHLVCPKELRPK

SEQ ID NO: 2019230 - protein, 18 aa, Staphylococcus
IMHAINWIIKNEEEIIFE

SEQ ID NO: 2019231 - protein, 17 aa, Staphylococcus
IMIECNDKGIAQNVAQL

SEQ ID NO: 2019232 - protein, 24 aa, Staphylococcus
IMIGDHVWIGAGAIVLPGVTIGDN

SEQ ID NO: 2019233 - protein, 23 aa, Staphylococcus
IMIKIEAKLPPSRGLGSSAAVAV

SEQ ID NO: 2019234 - protein, 18 aa, Staphylococcus
IMIPLVSTVEEFKTLKDT

SEQ ID NO: 2019235 - protein, 17 aa, Staphylococcus
IMIPLVSTVEEFTTLKA

SEQ ID NO: 2019236 - protein, 24 aa, Staphylococcus
IMISSELPEVIGMSDRVAVVHEGN

SEQ ID NO: 2019237 - protein, 23 aa, Staphylococcus
IMKEEPIKLLALITSNFRLYYQC

SEQ ID NO: 2019238 - protein, 17 aa, Staphylococcus
IMKESDNALVFCVGNIH

SEQ ID NO: 2019239 - protein, 26 aa, Staphylococcus
IMKFTEGAFKQWGYDLAENEFGDKVF

SEQ ID NO: 2019240 - protein, 27 aa, Staphylococcus
IMKFTEGAFKQWGYDVAHNEFADKVFT

SEQ ID NO: 2019241 - protein, 27 aa, Staphylococcus
IMKFTEGAFKQWGYDVAHNEFGDKVFT

SEQ ID NO: 2019242 - protein, 28 aa, Staphylococcus
IMKFTEGSFKQWGYDLAHNEFADKVFTW

SEQ ID NO: 2019243 - protein, 28 aa, Staphylococcus
IMKFTEGSFKQWGYDLAHNEFADQVFTW

SEQ ID NO: 2019244 - protein, 27 aa, Staphylococcus
IMKFTEGSFKQWGYDLAHNEFGDRVFT

SEQ ID NO: 2019245 - protein, 27 aa, Staphylococcus
IMKFTEGSFKQWGYDLAHNEFSDKVFT

SEQ ID NO: 2019246 - protein, 25 aa, Staphylococcus
IMKKNRPATQLTIICKVEDKLRIEE

SEQ ID NO: 2019247 - protein, 18 aa, Staphylococcus
IMKNYNWEYFKAQINKKF

SEQ ID NO: 2019248 - protein, 26 aa, Staphylococcus
IMLAARACLFSGSGLITVATHPTNHA

SEQ ID NO: 2019249 - protein, 18 aa, Staphylococcus
IMLELTKIKGATVKLNSI

SEQ ID NO: 2019250 - protein, 28 aa, Staphylococcus
IMLIDRITGRMLPGTKMQAGLNQALEAK

SEQ ID NO: 2019251 - protein, 19 aa, Staphylococcus
IMMPRAIATYELYIAALKL

SEQ ID NO: 2019252 - protein, 25 aa, Staphylococcus
IMMPRAIMTYELYLAALKLGIAIIP

SEQ ID NO: 2019253 - protein, 32 aa, Staphylococcus
IMNELKINLLEFREYMDLLEGIGLIKTFVKHD

SEQ ID NO: 2019254 - protein, 17 aa, Staphylococcus
IMNELKMNLSEFRQYMD

SEQ ID NO: 2019255 - protein, 24 aa, Staphylococcus
IMNKPIEELRIISCHIGNGASIAA

SEQ ID NO: 2019256 - protein, 19 aa, Staphylococcus
IMNKRKSILINELEKNGES

SEQ ID NO: 2019257 - protein, 19 aa, Staphylococcus
IMNPFDWYKAHDINLIIDD

SEQ ID NO: 2019258 - protein, 25 aa, Staphylococcus
IMNYKELIQRTAVVLNKRLPIVDLP

SEQ ID NO: 2019259 - protein, 18 aa, Staphylococcus
IMNYREVYGPSPMTLHSP

SEQ ID NO: 2019260 - protein, 17 aa, Staphylococcus
IMNYSLSEIKAIYTDTF

SEQ ID NO: 2019261 - protein, 18 aa, Staphylococcus
IMPKKIFQYFKAHFEHIE

SEQ ID NO: 2019262 - protein, 22 aa, Staphylococcus
IMPVVKEIAYKHCALEVPPAGY

SEQ ID NO: 2019263 - protein, 18 aa, Staphylococcus
IMQAIIYDVIGYEVKPLF

SEQ ID NO: 2019264 - protein, 23 aa, Staphylococcus
IMQESCAMLEEFGIPFDKKVVSA

SEQ ID NO: 2019265 - protein, 17 aa, Staphylococcus
IMQKWNLERIVEFGIYN

SEQ ID NO: 2019266 - protein, 25 aa, Staphylococcus
IMQMIANKMGFDWNYSHPSEIMDEM

SEQ ID NO: 2019267 - protein, 17 aa, Staphylococcus
IMQPFKVYPEGFPEELV

SEQ ID NO: 2019268 - protein, 18 aa, Staphylococcus
IMQPFKVYPNGFPDELVK

SEQ ID NO: 2019269 - protein, 17 aa, Staphylococcus
IMQPFKVYPNGFPEELI

SEQ ID NO: 2019270 - protein, 18 aa, Staphylococcus
IMQVYPLLDITREEAATI

SEQ ID NO: 2019271 - protein, 17 aa, Staphylococcus
IMRERRVDTIFVVNNHN

SEQ ID NO: 2019272 - protein, 23 aa, Staphylococcus
IMRFRYWECPIGCYEWQDIADYF

SEQ ID NO: 2019273 - protein, 18 aa, Staphylococcus
IMRRHRIDTIFVVNNQNK

SEQ ID NO: 2019274 - protein, 26 aa, Staphylococcus
IMSCENCFLEALEIGKGSFQVFIRTK

SEQ ID NO: 2019275 - protein, 25 aa, Staphylococcus
IMSYLFEVIDPYSLNQQGQDIGEKY

SEQ ID NO: 2019276 - protein, 25 aa, Staphylococcus
IMTACTKVLIRYVFEEFDINRVEIQ

SEQ ID NO: 2019277 - protein, 20 aa, Staphylococcus
IMTEIPFKFFDQLDEINIPG

SEQ ID NO: 2019278 - protein, 19 aa, Staphylococcus
IMTEIPFKFFEQLHDLPLP

SEQ ID NO: 2019279 - protein, 17 aa, Staphylococcus
IMTKRGKGKAGFAHVQD

SEQ ID NO: 2019280 - protein, 24 aa, Staphylococcus
IMTQCTKALIDYAFHELKLNRVEI

SEQ ID NO: 2019281 - protein, 21 aa, Staphylococcus
IMTSICKKWYINSFKYFRNMY

SEQ ID NO: 2019282 - protein, 22 aa, Staphylococcus
IMTYFYKIVKWLMQYMKQQPTE

SEQ ID NO: 2019283 - protein, 25 aa, Staphylococcus
IMVAYKFGVPCLFAKKAKPNTLNKG

SEQ ID NO: 2019284 - protein, 19 aa, Staphylococcus
IMVEVKPLLNYVKSAEEHQ

SEQ ID NO: 2019285 - protein, 17 aa, Staphylococcus
IMWDERLSTMAAERSLL

SEQ ID NO: 2019286 - protein, 21 aa, Staphylococcus
IMYGHEPINLIGLEQLVDDSQ

SEQ ID NO: 2019287 - protein, 17 aa, Staphylococcus
INAAIGIDQLDKYDENL

SEQ ID NO: 2019288 - protein, 19 aa, Staphylococcus
INADVYFNAKIVTHNKEQM

SEQ ID NO: 2019289 - protein, 22 aa, Staphylococcus
INAGIDTCWFNFRNKKNETTIQ

SEQ ID NO: 2019290 - protein, 17 aa, Staphylococcus
INAGRLSYEAGRIPIKY

SEQ ID NO: 2019291 - protein, 28 aa, Staphylococcus
INAIGAYILKIENTFPLITIKRFIPNAD

SEQ ID NO: 2019292 - protein, 18 aa, Staphylococcus
INAKLIIIDEMSMVDTWL

SEQ ID NO: 2019293 - protein, 23 aa, Staphylococcus
INALKWVHTFIKYFGGNSNNITL

SEQ ID NO: 2019294 - protein, 28 aa, Staphylococcus
INAMLRLFKTNVLTSQFKNSSYLIDLLE

SEQ ID NO: 2019295 - protein, 24 aa, Staphylococcus
INAMYRNDLVFGIGPAGTGKTFLA

SEQ ID NO: 2019296 - protein, 19 aa, Staphylococcus
INASNLFSGQIFARLPQDM

SEQ ID NO: 2019297 - protein, 18 aa, Staphylococcus
INATLIKSKSEYISLGLI

SEQ ID NO: 2019298 - protein, 18 aa, Staphylococcus
INAYIPGIGHNLQEHSVV

SEQ ID NO: 2019299 - protein, 18 aa, Staphylococcus
INCGKEYTKSYVMEHKLR

SEQ ID NO: 2019300 - protein, 19 aa, Staphylococcus
INCGKEYTKSYVMGHKLRY

SEQ ID NO: 2019301 - protein, 24 aa, Staphylococcus
INCIDRKGYEWMIHSTKKAEVGSK

SEQ ID NO: 2019302 - protein, 20 aa, Staphylococcus
INCKYVLMTYYNIIVSYGEE

SEQ ID NO: 2019303 - protein, 20 aa, Staphylococcus
INCKYVLMTYYNVILSYGEK

SEQ ID NO: 2019304 - protein, 23 aa, Staphylococcus
INCNHDLDFALAIRTMLIDDTYV

SEQ ID NO: 2019305 - protein, 23 aa, Staphylococcus
INCNQNLDFALAIRTMLIDDTTV

SEQ ID NO: 2019306 - protein, 18 aa, Staphylococcus
INCYHKLALYYIKKDTDI

SEQ ID NO: 2019307 - protein, 26 aa, Staphylococcus
INDFAFKEKVPWIYGGVVQSTYIEAA

SEQ ID NO: 2019308 - protein, 27 aa, Staphylococcus
INDFSYRYRIPWIYGGVVQSTYVETAF

SEQ ID NO: 2019309 - protein, 22 aa, Staphylococcus
INDIPGQVFIFGGQTLFEEMID

SEQ ID NO: 2019310 - protein, 21 aa, Staphylococcus
INDIRAAKDLKTYAHEIYAQA

SEQ ID NO: 2019311 - protein, 21 aa, Staphylococcus
INDIRLKLCLLDILDSSEFIQ

SEQ ID NO: 2019312 - protein, 17 aa, Staphylococcus
INDTLLMQFFTFNDEEE

SEQ ID NO: 2019313 - protein, 25 aa, Staphylococcus
INEAEKFILALGLNHVRVRYHQNIA

SEQ ID NO: 2019314 - protein, 26 aa, Staphylococcus
INEALKHLIECGANVVGLNCHHGPHH

SEQ ID NO: 2019315 - protein, 25 aa, Staphylococcus
INEAYVKISLIGSGMRDMSGVASKA

SEQ ID NO: 2019316 - protein, 25 aa, Staphylococcus
INEDFKGQCNYLLLRPTSKNRYTQL

SEQ ID NO: 2019317 - protein, 26 aa, Staphylococcus
INEELGITILINLHFVDLAKEYGSRI

SEQ ID NO: 2019318 - protein, 28 aa, Staphylococcus
INEELGITILINLHFVDLALEYGTRIIG

SEQ ID NO: 2019319 - protein, 25 aa, Staphylococcus
INEFVKPKISVPVHYNTFPLIEQDP

SEQ ID NO: 2019320 - protein, 20 aa, Staphylococcus
INEGEFFVIIGPSGCGKTTT

SEQ ID NO: 2019321 - protein, 17 aa, Staphylococcus
INEGFNLIISDTVGFIQ

SEQ ID NO: 2019322 - protein, 17 aa, Staphylococcus
INEGHKVYIGFRNESRG

SEQ ID NO: 2019323 - protein, 22 aa, Staphylococcus
INEHPDRFVGFATLPINEPKAA

SEQ ID NO: 2019324 - protein, 17 aa, Staphylococcus
INEKDLDLMFAVNLKGP

SEQ ID NO: 2019325 - protein, 22 aa, Staphylococcus
INEKRYTLVFFNNIELMVETYQ

SEQ ID NO: 2019326 - protein, 28 aa, Staphylococcus
INELKELPFEFKVLITYRSNSQGGKGHV

SEQ ID NO: 2019327 - protein, 17 aa, Staphylococcus
INELPIVEEFRSAQYEA

SEQ ID NO: 2019328 - protein, 25 aa, Staphylococcus
INEPFMYRLVDIVADIMEPYYPNVK

SEQ ID NO: 2019329 - protein, 18 aa, Staphylococcus
INEVSNRDYVLWLNQNKE

SEQ ID NO: 2019330 - protein, 25 aa, Staphylococcus
INEWDLDILRTFYVSKFDYPENQID

SEQ ID NO: 2019331 - protein, 23 aa, Staphylococcus
INEYFQREVIPFSPDAKMDRKKD

SEQ ID NO: 2019332 - protein, 18 aa, Staphylococcus
INEYYWVSTYVMKGIWRN

SEQ ID NO: 2019333 - protein, 21 aa, Staphylococcus
INFASCYSDYIIALKDGYVIK

SEQ ID NO: 2019334 - protein, 20 aa, Staphylococcus
INFASCYSDYIVALKKGEIV

SEQ ID NO: 2019335 - protein, 17 aa, Staphylococcus
INFDLVRIINLSLRAKY

SEQ ID NO: 2019336 - protein, 33 aa, Staphylococcus
INFGISEGVDFIAASFVRRPSDVLDIRKLLEAK

SEQ ID NO: 2019337 - protein, 19 aa, Staphylococcus
INFKNERLGMLLGGEIASE

SEQ ID NO: 2019338 - protein, 23 aa, Staphylococcus
INFKQLDILGSLTTHRIETKIKE

SEQ ID NO: 2019339 - protein, 21 aa, Staphylococcus
INFKVAEALSGTVTPQGIFAI

SEQ ID NO: 2019340 - protein, 25 aa, Staphylococcus
INFMAKHGRGLICTPISTDIAERLE

SEQ ID NO: 2019341 - protein, 23 aa, Staphylococcus
INFPSNKFNNGFTLQDTPGVDSN

SEQ ID NO: 2019342 - protein, 18 aa, Staphylococcus
INGDWTKLGTSIVSIVEN

SEQ ID NO: 2019343 - protein, 19 aa, Staphylococcus
INGEFRAIFDKEDCYHVQK

SEQ ID NO: 2019344 - protein, 24 aa, Staphylococcus
INGEIRPGIVHRIDKDTSGLLMVA

SEQ ID NO: 2019345 - protein, 17 aa, Staphylococcus
INGGMGILLGGVPGVPK

SEQ ID NO: 2019346 - protein, 19 aa, Staphylococcus
INGILSYTLSDEMLRHTGK

SEQ ID NO: 2019347 - protein, 17 aa, Staphylococcus
INGLERLGQYWDTVRHY

SEQ ID NO: 2019348 - protein, 18 aa, Staphylococcus
INGLGAMVTTFGVGELSA

SEQ ID NO: 2019349 - protein, 26 aa, Staphylococcus
INGLYPDITIYLDVSVAVGRERILKN

SEQ ID NO: 2019350 - protein, 18 aa, Staphylococcus
INGQKKWIGGANVADVIP

SEQ ID NO: 2019351 - protein, 23 aa, Staphylococcus
INGRPKHIYSIYRKMVKQKKQFD

SEQ ID NO: 2019352 - protein, 18 aa, Staphylococcus
INGTNAFRLFNAEGDGVG

SEQ ID NO: 2019353 - protein, 18 aa, Staphylococcus
INGVIGFAGKSAYNSAKH

SEQ ID NO: 2019354 - protein, 18 aa, Staphylococcus
INGWSFDNWLEEVACGDR

SEQ ID NO: 2019355 - protein, 18 aa, Staphylococcus
INHAIRLLICTNDSITSI

SEQ ID NO: 2019356 - protein, 22 aa, Staphylococcus
INHAKIAVFGLTYKGDVDDIRE

SEQ ID NO: 2019357 - protein, 26 aa, Staphylococcus
INHAMAWKKLMQAFGYPQKTKNDFYA

SEQ ID NO: 2019358 - protein, 17 aa, Staphylococcus
INHDLLRGVAASGNRNW

SEQ ID NO: 2019359 - protein, 24 aa, Staphylococcus
INHFKLYQFFKVILTYIKRHYGFF

SEQ ID NO: 2019360 - protein, 24 aa, Staphylococcus
INHHKRIIFSLLRKYNIRYDTDEY

SEQ ID NO: 2019361 - protein, 20 aa, Staphylococcus
INHIIEFAKTQGIEMLMTTI

SEQ ID NO: 2019362 - protein, 17 aa, Staphylococcus
INHQPLEIEAIQGFIFR

SEQ ID NO: 2019363 - protein, 18 aa, Staphylococcus
INHRPKVSVLISTYNKEK

SEQ ID NO: 2019364 - protein, 26 aa, Staphylococcus
INHRRVKEWLKRAAKKYGLEAEDVVL

SEQ ID NO: 2019365 - protein, 26 aa, Staphylococcus
INHRRVKEWLKRSAKKYGLEAEEVVL

SEQ ID NO: 2019366 - protein, 24 aa, Staphylococcus
INHVLELTMSYGARLAEPGEYTKR

SEQ ID NO: 2019367 - protein, 17 aa, Staphylococcus
INIGCIPSKTLVHDGIE

SEQ ID NO: 2019368 - protein, 17 aa, Staphylococcus
INIGCIPSKTLVHEGLG

SEQ ID NO: 2019369 - protein, 29 aa, Staphylococcus
INIIEILKSSGFIPVKGWIFNGDIQNDLD

SEQ ID NO: 2019370 - protein, 21 aa, Staphylococcus
INILEILALEYAKDKGYELYN

SEQ ID NO: 2019371 - protein, 26 aa, Staphylococcus
ININSRLGGLLDCYDIPENAKLACLT

SEQ ID NO: 2019372 - protein, 17 aa, Staphylococcus
INIPSDVTVTFDNNHVT

SEQ ID NO: 2019373 - protein, 17 aa, Staphylococcus
INIPTDVTVTFDGHTAT

SEQ ID NO: 2019374 - protein, 17 aa, Staphylococcus
INIPYVLNQALKNEKNS

SEQ ID NO: 2019375 - protein, 23 aa, Staphylococcus
INIQEIIQSLGLDETRIIVEHNE

SEQ ID NO: 2019376 - protein, 22 aa, Staphylococcus
INIRPLLNLAEKFYGDNPAFRP

SEQ ID NO: 2019377 - protein, 19 aa, Staphylococcus
INISIAVADKDKLYVPVIK

SEQ ID NO: 2019378 - protein, 19 aa, Staphylococcus
INISIAVAVEDKLFTPVIH

SEQ ID NO: 2019379 - protein, 21 aa, Staphylococcus
INKAAKFLIALYNVFIEKDCS

SEQ ID NO: 2019380 - protein, 21 aa, Staphylococcus
INKAPRKAIIEPSIQNFHYAI

SEQ ID NO: 2019381 - protein, 18 aa, Staphylococcus
INKCEELLGFQIEDPLNS

SEQ ID NO: 2019382 - protein, 24 aa, Staphylococcus
INKDKEVIGFFVLHQYYQHEGYDT

SEQ ID NO: 2019383 - protein, 24 aa, Staphylococcus
INKEMFKRQGGYGRGRRMQIEKDA

SEQ ID NO: 2019384 - protein, 26 aa, Staphylococcus
INKIERLVWMGGTFLEKGNVEEPEHD

SEQ ID NO: 2019385 - protein, 24 aa, Staphylococcus
INKNGKIAIGFKEDDELIAVRLTT

SEQ ID NO: 2019386 - protein, 18 aa, Staphylococcus
INKNSLRETLNFIDSKSE

SEQ ID NO: 2019387 - protein, 24 aa, Staphylococcus
INKNVREALDMVINRKEIAKNISK

SEQ ID NO: 2019388 - protein, 18 aa, Staphylococcus
INKPLKAIILTHAHFDHI

SEQ ID NO: 2019389 - protein, 23 aa, Staphylococcus
INKRRVKEWLKKTAKKYGLDPEA

SEQ ID NO: 2019390 - protein, 26 aa, Staphylococcus
INKRRVKEWLKKTARKYGLDAEDVIL

SEQ ID NO: 2019391 - protein, 29 aa, Staphylococcus
INKRYWECPIGCYHWEDLAAYFGTNKTSI

SEQ ID NO: 2019392 - protein, 20 aa, Staphylococcus
INKSRFIAHIKPVSSEDEAK

SEQ ID NO: 2019393 - protein, 17 aa, Staphylococcus
INKTFGLIFSQRVLLAL

SEQ ID NO: 2019394 - protein, 18 aa, Staphylococcus
INKYGADSLRWALISDSA

SEQ ID NO: 2019395 - protein, 23 aa, Staphylococcus
INLAKIRGGSVYNKVPDEAVISY

SEQ ID NO: 2019396 - protein, 29 aa, Staphylococcus
INLALRATYLFDLNLDYIIMDGEIMLIDR

SEQ ID NO: 2019397 - protein, 18 aa, Staphylococcus
INLDRPLCLNELADLVGL

SEQ ID NO: 2019398 - protein, 20 aa, Staphylococcus
INLELTRVNGGFVVTGGSSN

SEQ ID NO: 2019399 - protein, 21 aa, Staphylococcus
INLFPMQKWFFSQEFHNIHHW

SEQ ID NO: 2019400 - protein, 17 aa, Staphylococcus
INLGRKAEQIFYENIVN

SEQ ID NO: 2019401 - protein, 18 aa, Staphylococcus
INLIKLAIDQHIPYQVLR

SEQ ID NO: 2019402 - protein, 19 aa, Staphylococcus
INLIKLAIDQHIPYQVLRD

SEQ ID NO: 2019403 - protein, 18 aa, Staphylococcus
INLIKLAIDQHIPYTVLS

SEQ ID NO: 2019404 - protein, 17 aa, Staphylococcus
INLIKLAMDQHIPYQVL

SEQ ID NO: 2019405 - protein, 24 aa, Staphylococcus
INLKEIRLSPTIEEHDFQTKLKNG

SEQ ID NO: 2019406 - protein, 19 aa, Staphylococcus
INLKGMFFVTQAVLKVMKA

SEQ ID NO: 2019407 - protein, 27 aa, Staphylococcus
INLKGTRKEAVLLLHSFTGTIRDVKPL

SEQ ID NO: 2019408 - protein, 24 aa, Staphylococcus
INLKSSGRMVGIISHVSELKQRIP

SEQ ID NO: 2019409 - protein, 18 aa, Staphylococcus
INLLKWVHHHIAYFGGNP

SEQ ID NO: 2019410 - protein, 17 aa, Staphylococcus
INLLLTFGDEAVHIYEN

SEQ ID NO: 2019411 - protein, 18 aa, Staphylococcus
INLLRKLIAIKLGSRIKV

SEQ ID NO: 2019412 - protein, 20 aa, Staphylococcus
INLMNCFKILDSVSIPQGAV

SEQ ID NO: 2019413 - protein, 23 aa, Staphylococcus
INLREVNNAVTLVLNGQLIAYYI

SEQ ID NO: 2019414 - protein, 24 aa, Staphylococcus
INLRKDAKWSNGDPVTANDFVFAW

SEQ ID NO: 2019415 - protein, 22 aa, Staphylococcus
INLRYPQKFEFEEAIQRFTKEI

SEQ ID NO: 2019416 - protein, 26 aa, Staphylococcus
INLSEPKALIGFAGRRVIEQTINEKL

SEQ ID NO: 2019417 - protein, 20 aa, Staphylococcus
INLVGGRYFGLHAMYDTDNI

SEQ ID NO: 2019418 - protein, 27 aa, Staphylococcus
INLVKSNGVKRFKFKDNKSELELDFTE

SEQ ID NO: 2019419 - protein, 18 aa, Staphylococcus
INLYEWLSDYNVYNVPKT

SEQ ID NO: 2019420 - protein, 25 aa, Staphylococcus
INNAWKSHYVALSILKSIREDNERM

SEQ ID NO: 2019421 - protein, 17 aa, Staphylococcus
INNELEDIFTIMLRNSY

SEQ ID NO: 2019422 - protein, 17 aa, Staphylococcus
INNFCLELIKSYDITKE

SEQ ID NO: 2019423 - protein, 18 aa, Staphylococcus
INNGLPMLEIDGEMDKAQ

SEQ ID NO: 2019424 - protein, 23 aa, Staphylococcus
INNGYKVAICEQMEDPKQTKGMV

SEQ ID NO: 2019425 - protein, 26 aa, Staphylococcus
INNNVYKWAYVNSILVSWYQEGINSV

SEQ ID NO: 2019426 - protein, 26 aa, Staphylococcus
INNRVKEVIAGFDFTYGKFGKGNMSV

SEQ ID NO: 2019427 - protein, 22 aa, Staphylococcus
INNSRIGNKVNIIQSVINDSSV

SEQ ID NO: 2019428 - protein, 18 aa, Staphylococcus
INNVKWKSLVTHYENGEP

SEQ ID NO: 2019429 - protein, 18 aa, Staphylococcus
INNYPFPNTFQVLKLTGA

SEQ ID NO: 2019430 - protein, 19 aa, Staphylococcus
INPDCKLTPLHMFYTEDTY

SEQ ID NO: 2019431 - protein, 19 aa, Staphylococcus
INPDIIIDGMDNFKVRFLI

SEQ ID NO: 2019432 - protein, 17 aa, Staphylococcus
INPEFEIGAMISHVPIY

SEQ ID NO: 2019433 - protein, 21 aa, Staphylococcus
INPELIGGIRVKVGTTVIDGS

SEQ ID NO: 2019434 - protein, 17 aa, Staphylococcus
INPFEVVYYAGGTSNRY

SEQ ID NO: 2019435 - protein, 18 aa, Staphylococcus
INPFKLTYQVLGVYDPSR

SEQ ID NO: 2019436 - protein, 25 aa, Staphylococcus
INPLSGEKLPIWIADYVLSTYGTGA

SEQ ID NO: 2019437 - protein, 25 aa, Staphylococcus
INPLSGERLPIWIADYVLSSIWYGS

SEQ ID NO: 2019438 - protein, 25 aa, Staphylococcus
INPLSGKKLPIWIADYVLSTYGTGA

SEQ ID NO: 2019439 - protein, 17 aa, Staphylococcus
INPLVDFIHYLNVEYNK

SEQ ID NO: 2019440 - protein, 19 aa, Staphylococcus
INPSLPMVAIGGITEDNIE

SEQ ID NO: 2019441 - protein, 17 aa, Staphylococcus
INPVEIVKSGGEFPRDF

SEQ ID NO: 2019442 - protein, 19 aa, Staphylococcus
INQAIRFSDYLLIMKEGQI

SEQ ID NO: 2019443 - protein, 25 aa, Staphylococcus
INQELGITILINLHFVDLAREYGTR

SEQ ID NO: 2019444 - protein, 22 aa, Staphylococcus
INQELPLTIVIIGEQIDINQLR

SEQ ID NO: 2019445 - protein, 23 aa, Staphylococcus
INQFKEHIDLFIIDTPSEQYGGT

SEQ ID NO: 2019446 - protein, 17 aa, Staphylococcus
INQGLHFNPKVNLNERV

SEQ ID NO: 2019447 - protein, 29 aa, Staphylococcus
INQHRGGFCYEMNHFFGTYLEEKGFTVYR

SEQ ID NO: 2019448 - protein, 30 aa, Staphylococcus
INQHRGGFCYEMNHLFGTYLEKKGFDVHRA

SEQ ID NO: 2019449 - protein, 18 aa, Staphylococcus
INQIKEWYGSQIGQDYHA

SEQ ID NO: 2019450 - protein, 28 aa, Staphylococcus
INQKEIEEIYPLFPLQEEMLYSSVGDYS

SEQ ID NO: 2019451 - protein, 24 aa, Staphylococcus
INQLVELLKGFTFTVNGTLSIEKA

SEQ ID NO: 2019452 - protein, 30 aa, Staphylococcus
INQNIFLVLVCPHGPLKSKTINRVRNSSAR

SEQ ID NO: 2019453 - protein, 20 aa, Staphylococcus
INQPKGYKRLVIKDKNEIST

SEQ ID NO: 2019454 - protein, 17 aa, Staphylococcus
INQQPVISWEGTLRPSI

SEQ ID NO: 2019455 - protein, 20 aa, Staphylococcus
INQRLKGIVDYESIQINEKL

SEQ ID NO: 2019456 - protein, 25 aa, Staphylococcus
INQSRNGVMMIVRQAVSVINHLFES

SEQ ID NO: 2019457 - protein, 20 aa, Staphylococcus
INRDAFEMGKEVLIQVRKRQ

SEQ ID NO: 2019458 - protein, 23 aa, Staphylococcus
INRDANIQVGQWGELALNTLLNV

SEQ ID NO: 2019459 - protein, 20 aa, Staphylococcus
INRELINHIIEFAKTQGIEM

SEQ ID NO: 2019460 - protein, 19 aa, Staphylococcus
INREYRFQILVKYKSEPEL

SEQ ID NO: 2019461 - protein, 26 aa, Staphylococcus
INRIKERGHHLFLDLKLHDIPNTVKQ

SEQ ID NO: 2019462 - protein, 22 aa, Staphylococcus
INRILELTMTYGARMADPGEYT

SEQ ID NO: 2019463 - protein, 22 aa, Staphylococcus
INRILELTMTYGARMAEPGEYT

SEQ ID NO: 2019464 - protein, 25 aa, Staphylococcus
INRLIPLSEGYIYFKDKPISDYPVY

SEQ ID NO: 2019465 - protein, 17 aa, Staphylococcus
INRMSSPFMDLSAIQPI

SEQ ID NO: 2019466 - protein, 23 aa, Staphylococcus
INRVLRLATYIAEQEQSQHMLTI

SEQ ID NO: 2019467 - protein, 24 aa, Staphylococcus
INSDLALNLSIYGRAYEIVYRDMK

SEQ ID NO: 2019468 - protein, 25 aa, Staphylococcus
INSELPVQVTICSGLIKADKYEWLI

SEQ ID NO: 2019469 - protein, 24 aa, Staphylococcus
INSIKRALLQLALNHLNADSVSED

SEQ ID NO: 2019470 - protein, 23 aa, Staphylococcus
INSPELFGFDSLNEYGALKAPIS

SEQ ID NO: 2019471 - protein, 25 aa, Staphylococcus
INSRLEFLYNVGLEYLTLNRASGSL

SEQ ID NO: 2019472 - protein, 22 aa, Staphylococcus
INSRSFTGGKYVVFAIPHTTKD

SEQ ID NO: 2019473 - protein, 25 aa, Staphylococcus
INSVNEFGPYIVIAPEIAIAHARPN

SEQ ID NO: 2019474 - protein, 18 aa, Staphylococcus
INTAEEFNERLNAEILRK

SEQ ID NO: 2019475 - protein, 23 aa, Staphylococcus
INTGELKFPVFVKPNSGSASLNI

SEQ ID NO: 2019476 - protein, 19 aa, Staphylococcus
INTKDDFKMTTFKITQSRN

SEQ ID NO: 2019477 - protein, 19 aa, Staphylococcus
INTNEKLLLFVMSDGCTVC

SEQ ID NO: 2019478 - protein, 26 aa, Staphylococcus
INTNPKFKAITFLTSKNASISFPQVL

SEQ ID NO: 2019479 - protein, 28 aa, Staphylococcus
INTSAFKIKQLVIHLILIMKRKEPEKIS

SEQ ID NO: 2019480 - protein, 18 aa, Staphylococcus
INTVISIGGGAKSDFWLQ

SEQ ID NO: 2019481 - protein, 20 aa, Staphylococcus
INTYDWFKENLISIDDIENY

SEQ ID NO: 2019482 - protein, 17 aa, Staphylococcus
INVARVANELGLSVTCT

SEQ ID NO: 2019483 - protein, 19 aa, Staphylococcus
INVDARVSVLGHIQRGGSP

SEQ ID NO: 2019484 - protein, 22 aa, Staphylococcus
INVEALKAIGLEPGPKYQEVKI

SEQ ID NO: 2019485 - protein, 17 aa, Staphylococcus
INVISNFETAVQKLKDL

SEQ ID NO: 2019486 - protein, 24 aa, Staphylococcus
INVKMKGSGFVFKQSVSPNESLKG

SEQ ID NO: 2019487 - protein, 17 aa, Staphylococcus
INVKSLIQLTRGFINQL

SEQ ID NO: 2019488 - protein, 29 aa, Staphylococcus
INVLCCTPTEYRMMAKLSNLDKYDIHHLH

SEQ ID NO: 2019489 - protein, 25 aa, Staphylococcus
INVPEARLLVISPYDKTSVADIEKA

SEQ ID NO: 2019490 - protein, 25 aa, Staphylococcus
INVPEARLLVISPYDKTSVDDIEKA

SEQ ID NO: 2019491 - protein, 25 aa, Staphylococcus
INVPEARLLVISPYDKTSVKDIERA

SEQ ID NO: 2019492 - protein, 32 aa, Staphylococcus
INVPGFRKGKVPRPIFEQRFGVEALYQDAVDI

SEQ ID NO: 2019493 - protein, 26 aa, Staphylococcus
INVPGFRKGKVPRQIFEQRFGVEALY

SEQ ID NO: 2019494 - protein, 19 aa, Staphylococcus
INVPIFLKLTSDMDEEGLK

SEQ ID NO: 2019495 - protein, 17 aa, Staphylococcus
INVPIFLKLTSDMELEG

SEQ ID NO: 2019496 - protein, 24 aa, Staphylococcus
INVSCSPSIFAKLIYLVATHNIDV

SEQ ID NO: 2019497 - protein, 20 aa, Staphylococcus
INYFIGNCHILKFEYRNNEF

SEQ ID NO: 2019498 - protein, 20 aa, Staphylococcus
INYGCPVISYNVRYGPSELI

SEQ ID NO: 2019499 - protein, 20 aa, Staphylococcus
INYGKWAYRSITEDKKLDFD

SEQ ID NO: 2019500 - protein, 17 aa, Staphylococcus
INYHIFFETLLRKYNER

SEQ ID NO: 2019501 - protein, 23 aa, Staphylococcus
INYLYRYIGQHIMNMIPVSWENV

SEQ ID NO: 2019502 - protein, 22 aa, Staphylococcus
INYNINCSISYDSLYKYIYNAL

SEQ ID NO: 2019503 - protein, 25 aa, Staphylococcus
IPAAPRGVPQIEVTFDIDKNGIVNV

SEQ ID NO: 2019504 - protein, 24 aa, Staphylococcus
IPALKKDKIVLCDRYIDSSLAYQG

SEQ ID NO: 2019505 - protein, 25 aa, Staphylococcus
IPALKNNKVVLCDRYIDSSLAYQGY

SEQ ID NO: 2019506 - protein, 25 aa, Staphylococcus
IPALKQHKIVLCDRYIDSSLAYQGY

SEQ ID NO: 2019507 - protein, 25 aa, Staphylococcus
IPAQFGGPHCGFFATTKKLMRKVPG

SEQ ID NO: 2019508 - protein, 18 aa, Staphylococcus
IPASITGVNFYRKRGYDY

SEQ ID NO: 2019509 - protein, 19 aa, Staphylococcus
IPCEIVPGITTASAAAATL

SEQ ID NO: 2019510 - protein, 20 aa, Staphylococcus
IPCFLDDQWSEVTIHQLIET

SEQ ID NO: 2019511 - protein, 17 aa, Staphylococcus
IPCVMRNAIGSGNALIS

SEQ ID NO: 2019512 - protein, 18 aa, Staphylococcus
IPDASISFEVFADDIETM

SEQ ID NO: 2019513 - protein, 21 aa, Staphylococcus
IPDDEFDEFIIWDSSYHPKMI

SEQ ID NO: 2019514 - protein, 26 aa, Staphylococcus
IPDDLKMFGPNWVERFVRTQIEEAIS

SEQ ID NO: 2019515 - protein, 23 aa, Staphylococcus
IPDFKSPQQFQAFLQDLNAWMQE

SEQ ID NO: 2019516 - protein, 22 aa, Staphylococcus
IPDIFWSIELDLNMDSNDVKEE

SEQ ID NO: 2019517 - protein, 19 aa, Staphylococcus
IPDIILLDLVMPEMNGIEV

SEQ ID NO: 2019518 - protein, 21 aa, Staphylococcus
IPDITKRSAPQVPYAHSSPNR

SEQ ID NO: 2019519 - protein, 24 aa, Staphylococcus
IPDLPFELGEQLKERFKDSSVKII

SEQ ID NO: 2019520 - protein, 20 aa, Staphylococcus
IPDLPFELTQKFKKDFPNEK

SEQ ID NO: 2019521 - protein, 20 aa, Staphylococcus
IPDNMKVALKHIKNVEILVP

SEQ ID NO: 2019522 - protein, 17 aa, Staphylococcus
IPDPVFDVLSWKEVLNK

SEQ ID NO: 2019523 - protein, 17 aa, Staphylococcus
IPDSAFCKGTVRTFDTE

SEQ ID NO: 2019524 - protein, 21 aa, Staphylococcus
IPDSLGICIHTSYGSIVYTGE

SEQ ID NO: 2019525 - protein, 26 aa, Staphylococcus
IPDTGFFRFWYQGIVARWPETEIEDL

SEQ ID NO: 2019526 - protein, 30 aa, Staphylococcus
IPDTGFYRFRIQGIFARWPNNPNIEDLIQA

SEQ ID NO: 2019527 - protein, 19 aa, Staphylococcus
IPDTVGFSYPSEFGNIFKV

SEQ ID NO: 2019528 - protein, 21 aa, Staphylococcus
IPEASRLVLQAGALAKGGEVF

SEQ ID NO: 2019529 - protein, 20 aa, Staphylococcus
IPEDAFRLVGSMEEVIAKAK

SEQ ID NO: 2019530 - protein, 23 aa, Staphylococcus
IPEEGQYAVGMFFTNEKIKGSQH

SEQ ID NO: 2019531 - protein, 25 aa, Staphylococcus
IPEGKRILVDRVWPRGISKAHAQLD

SEQ ID NO: 2019532 - protein, 17 aa, Staphylococcus
IPEGVDWEGEEVKVVVG

SEQ ID NO: 2019533 - protein, 18 aa, Staphylococcus
IPEGVDWNGETVKVVVGI

SEQ ID NO: 2019534 - protein, 18 aa, Staphylococcus
IPEGVLIRAVEPEDGIEG

SEQ ID NO: 2019535 - protein, 19 aa, Staphylococcus
IPEGVQWGDDVAKVVVGIA

SEQ ID NO: 2019536 - protein, 18 aa, Staphylococcus
IPELKDKLQAFLKPLDLD

SEQ ID NO: 2019537 - protein, 22 aa, Staphylococcus
IPEMLTENFIPRTELRETTMTI

SEQ ID NO: 2019538 - protein, 22 aa, Staphylococcus
IPEMYFYRYVSGATISVMKYWV

SEQ ID NO: 2019539 - protein, 19 aa, Staphylococcus
IPESIKEDFLTAVKEEFSQ

SEQ ID NO: 2019540 - protein, 25 aa, Staphylococcus
IPESVFKQKGLKVFGLTASPQYIAN

SEQ ID NO: 2019541 - protein, 20 aa, Staphylococcus
IPESYLRKFDYLVFPDNVAI

SEQ ID NO: 2019542 - protein, 17 aa, Staphylococcus
IPEVAGIHFYNNSDKGK

SEQ ID NO: 2019543 - protein, 20 aa, Staphylococcus
IPEVIGVRLTNALPQGATAT

SEQ ID NO: 2019544 - protein, 19 aa, Staphylococcus
IPEVIGVRLTNTLPQGSTA

SEQ ID NO: 2019545 - protein, 18 aa, Staphylococcus
IPEYQHLEIFPVGRLDKD

SEQ ID NO: 2019546 - protein, 20 aa, Staphylococcus
IPFAGSNGFENAGGMTEKEV

SEQ ID NO: 2019547 - protein, 20 aa, Staphylococcus
IPFDDPKVFALLSQGETTGI

SEQ ID NO: 2019548 - protein, 18 aa, Staphylococcus
IPFIKNMHDQGLFASISV

SEQ ID NO: 2019549 - protein, 18 aa, Staphylococcus
IPFNIEGIDSLSLSGHKF

SEQ ID NO: 2019550 - protein, 20 aa, Staphylococcus
IPGAETIPMNSIPDNLNYFN

SEQ ID NO: 2019551 - protein, 23 aa, Staphylococcus
IPGEGNYAVGLFFSKEKVKDSIH

SEQ ID NO: 2019552 - protein, 23 aa, Staphylococcus
IPGKDLDEAFTILKRGGTIASLV

SEQ ID NO: 2019553 - protein, 18 aa, Staphylococcus
IPGKRIIREGDLVNIDVS

SEQ ID NO: 2019554 - protein, 17 aa, Staphylococcus
IPGLYAYEAGQAAVGDL

SEQ ID NO: 2019555 - protein, 20 aa, Staphylococcus
IPGMTGLEILAQIRAKGINT

SEQ ID NO: 2019556 - protein, 20 aa, Staphylococcus
IPGNGKFLYSPFSIFDNESI

SEQ ID NO: 2019557 - protein, 20 aa, Staphylococcus
IPGNGKFLYSPFSKFDNESI

SEQ ID NO: 2019558 - protein, 23 aa, Staphylococcus
IPGPASRLSWLGDILTTANNIHA

SEQ ID NO: 2019559 - protein, 18 aa, Staphylococcus
IPGSHVVILNAHPSETTI

SEQ ID NO: 2019560 - protein, 17 aa, Staphylococcus
IPGTSLVGIEVPNVSPT

SEQ ID NO: 2019561 - protein, 18 aa, Staphylococcus
IPGVIAVIPLKEEGDEVI

SEQ ID NO: 2019562 - protein, 20 aa, Staphylococcus
IPGVLFKLEKTHGLTEDQMV

SEQ ID NO: 2019563 - protein, 18 aa, Staphylococcus
IPHEGFYEFQEIHRPLVL

SEQ ID NO: 2019564 - protein, 20 aa, Staphylococcus
IPHEGYYEFKHEHRPLRLVN

SEQ ID NO: 2019565 - protein, 24 aa, Staphylococcus
IPHGHAVMIGIIYQFIVANTLLDT

SEQ ID NO: 2019566 - protein, 23 aa, Staphylococcus
IPHGHAVMIGILYQFIVANELLN

SEQ ID NO: 2019567 - protein, 20 aa, Staphylococcus
IPHIELMPSGGVSLDNLEDW

SEQ ID NO: 2019568 - protein, 18 aa, Staphylococcus
IPHRSSFSYIMMDKNLNH

SEQ ID NO: 2019569 - protein, 20 aa, Staphylococcus
IPIDHCYKCDYDGDFETTEN

SEQ ID NO: 2019570 - protein, 21 aa, Staphylococcus
IPIDKLNIWGGAIATGHPYAA

SEQ ID NO: 2019571 - protein, 24 aa, Staphylococcus
IPIDLLPYLFFQFAKDGKRLYEDY

SEQ ID NO: 2019572 - protein, 21 aa, Staphylococcus
IPIDRCYECGYEGDFETTAQG

SEQ ID NO: 2019573 - protein, 17 aa, Staphylococcus
IPIFIFMNDQFEQVSVW

SEQ ID NO: 2019574 - protein, 20 aa, Staphylococcus
IPIITGYGLTEAPLVSVNTA

SEQ ID NO: 2019575 - protein, 22 aa, Staphylococcus
IPIKEPCLVYWGGDNELTNDHH

SEQ ID NO: 2019576 - protein, 19 aa, Staphylococcus
IPIKFNVSKRIYKDILNEL

SEQ ID NO: 2019577 - protein, 19 aa, Staphylococcus
IPIKLSYYSALLANKVLPK

SEQ ID NO: 2019578 - protein, 17 aa, Staphylococcus
IPILKHISEALNLEVRV

SEQ ID NO: 2019579 - protein, 17 aa, Staphylococcus
IPIRLIGVTVGNLEQSS

SEQ ID NO: 2019580 - protein, 17 aa, Staphylococcus
IPITINTWYVVKDNEVY

SEQ ID NO: 2019581 - protein, 19 aa, Staphylococcus
IPKDLRHMHGFGSHTYSMY

SEQ ID NO: 2019582 - protein, 21 aa, Staphylococcus
IPKDLRHMHGFGSHTYSMYNN

SEQ ID NO: 2019583 - protein, 17 aa, Staphylococcus
IPKEVLTVITGVAGSGK

SEQ ID NO: 2019584 - protein, 17 aa, Staphylococcus
IPKGKWTSIVGHNGSGK

SEQ ID NO: 2019585 - protein, 21 aa, Staphylococcus
IPKGLALDYIYGYTIINDITD

SEQ ID NO: 2019586 - protein, 26 aa, Staphylococcus
IPKHKIWLDPGIGFAKSRKEENEVMA

SEQ ID NO: 2019587 - protein, 25 aa, Staphylococcus
IPKHKIWLDPGIGFPKSRKEKNEVM

SEQ ID NO: 2019588 - protein, 19 aa, Staphylococcus
IPKHLITVFTGRSGSGKSS

SEQ ID NO: 2019589 - protein, 21 aa, Staphylococcus
IPKIKDMLTHFYAENIEHRRW

SEQ ID NO: 2019590 - protein, 19 aa, Staphylococcus
IPKIKEMVPSFGLKLTEHE

SEQ ID NO: 2019591 - protein, 17 aa, Staphylococcus
IPKKSRLLVDIYANVLN

SEQ ID NO: 2019592 - protein, 22 aa, Staphylococcus
IPKLFWPIYYFIQAPIQGLLMR

SEQ ID NO: 2019593 - protein, 19 aa, Staphylococcus
IPKLKEAFENIKVGDPFDK

SEQ ID NO: 2019594 - protein, 21 aa, Staphylococcus
IPKLLSYTTEVGWQGIPKDTK

SEQ ID NO: 2019595 - protein, 21 aa, Staphylococcus
IPKLLWPLYYFFQAPVQGLIM

SEQ ID NO: 2019596 - protein, 24 aa, Staphylococcus
IPKNPKRVLVLTANYGNFKKLGVK

SEQ ID NO: 2019597 - protein, 20 aa, Staphylococcus
IPKNWKVIKTKHAFKSKKNI

SEQ ID NO: 2019598 - protein, 17 aa, Staphylococcus
IPKQLGFKALKEEELRQ

SEQ ID NO: 2019599 - protein, 21 aa, Staphylococcus
IPKSLVFYVFGSIIGGFLEWQ

SEQ ID NO: 2019600 - protein, 21 aa, Staphylococcus
IPKYPKKIAILTASTGAAIRD

SEQ ID NO: 2019601 - protein, 17 aa, Staphylococcus
IPLFGNPGIEDTVGDNS

SEQ ID NO: 2019602 - protein, 22 aa, Staphylococcus
IPLFINETLILFPLKHHRAPIQ

SEQ ID NO: 2019603 - protein, 22 aa, Staphylococcus
IPLIETLGGIPIYMDTTQSEFK

SEQ ID NO: 2019604 - protein, 21 aa, Staphylococcus
IPLKIKEPLNFEVRGEAYMPR

SEQ ID NO: 2019605 - protein, 20 aa, Staphylococcus
IPLNELYFEYQLYDNTDNII

SEQ ID NO: 2019606 - protein, 18 aa, Staphylococcus
IPLQNFKNGNLIVDLQER

SEQ ID NO: 2019607 - protein, 19 aa, Staphylococcus
IPLTEKWIIQIAYDKFIIM

SEQ ID NO: 2019608 - protein, 17 aa, Staphylococcus
IPLVKAYMGMNSDVLTF

SEQ ID NO: 2019609 - protein, 25 aa, Staphylococcus
IPLVNRITSDIAFVRYHGRNVHGWT

SEQ ID NO: 2019610 - protein, 19 aa, Staphylococcus
IPLVNRITSSTAFVRYHGR

SEQ ID NO: 2019611 - protein, 19 aa, Staphylococcus
IPLVNRITTETAFVRYHGR

SEQ ID NO: 2019612 - protein, 23 aa, Staphylococcus
IPLWFENELWGVLLLGQRQNKPL

SEQ ID NO: 2019613 - protein, 20 aa, Staphylococcus
IPMCGVPYHSADGYIETLIS

SEQ ID NO: 2019614 - protein, 19 aa, Staphylococcus
IPMCGVPYHSANSYIETLI

SEQ ID NO: 2019615 - protein, 22 aa, Staphylococcus
IPMDLERIASIMFTSGTTGLQK

SEQ ID NO: 2019616 - protein, 27 aa, Staphylococcus
IPMLEILKKLDIHNACVVVTRYFGGIK

SEQ ID NO: 2019617 - protein, 17 aa, Staphylococcus
IPMNPSISLFVTVDNAM

SEQ ID NO: 2019618 - protein, 18 aa, Staphylococcus
IPMRKCILTNEMQPKKDM

SEQ ID NO: 2019619 - protein, 17 aa, Staphylococcus
IPNDYKFTDENSLIQAL

SEQ ID NO: 2019620 - protein, 17 aa, Staphylococcus
IPNERIKVYVNKVEQTT

SEQ ID NO: 2019621 - protein, 18 aa, Staphylococcus
IPNIGGYVAQAAEWGHQA

SEQ ID NO: 2019622 - protein, 27 aa, Staphylococcus
IPNIHNYRSALYIKHLEQYVNEIITHK

SEQ ID NO: 2019623 - protein, 22 aa, Staphylococcus
IPNILKRGKLTLSVATQGASPK

SEQ ID NO: 2019624 - protein, 18 aa, Staphylococcus
IPNIMRKKVKVVKEQPID

SEQ ID NO: 2019625 - protein, 18 aa, Staphylococcus
IPNKGEWTEKHLRYTVKG

SEQ ID NO: 2019626 - protein, 21 aa, Staphylococcus
IPNKWTEMMEWSFQTRSQFIV

SEQ ID NO: 2019627 - protein, 20 aa, Staphylococcus
IPNTISKISQWNFIENLLNA

SEQ ID NO: 2019628 - protein, 21 aa, Staphylococcus
IPNTRVRKSLNQMTNLIKFED

SEQ ID NO: 2019629 - protein, 17 aa, Staphylococcus
IPNYRKHWHVIFHLNNG

SEQ ID NO: 2019630 - protein, 28 aa, Staphylococcus
IPPKLPARIPIGSPINGTTVYVIQGQRL

SEQ ID NO: 2019631 - protein, 24 aa, Staphylococcus
IPPNLRNKYQWSTKFLIKVEDNFR

SEQ ID NO: 2019632 - protein, 17 aa, Staphylococcus
IPPNPSELIASEKFENI

SEQ ID NO: 2019633 - protein, 24 aa, Staphylococcus
IPQEAKLACLTIDTAMRHLDEVST

SEQ ID NO: 2019634 - protein, 25 aa, Staphylococcus
IPQHKVWLDPGIGFAKTREEEKEVM

SEQ ID NO: 2019635 - protein, 24 aa, Staphylococcus
IPQKAHIDLDFPINVEHVVLSGAY

SEQ ID NO: 2019636 - protein, 26 aa, Staphylococcus
IPQSKIWLDPGIGFAKTRDEENEVMA

SEQ ID NO: 2019637 - protein, 17 aa, Staphylococcus
IPQSLALKNAKETEDGQ

SEQ ID NO: 2019638 - protein, 23 aa, Staphylococcus
IPREKRIVISLTYVYGIGTSTAK

SEQ ID NO: 2019639 - protein, 23 aa, Staphylococcus
IPREKRIVISLTYVYGIGTSTAN

SEQ ID NO: 2019640 - protein, 23 aa, Staphylococcus
IPREKRIVISLTYVYGIGTTTAN

SEQ ID NO: 2019641 - protein, 23 aa, Staphylococcus
IPREKRVVISLTYIYGIGTSTAQ

SEQ ID NO: 2019642 - protein, 24 aa, Staphylococcus
IPREKRVVISLTYIYGVGKSTAAK

SEQ ID NO: 2019643 - protein, 17 aa, Staphylococcus
IPRFINLYHQGRLPVNE

SEQ ID NO: 2019644 - protein, 17 aa, Staphylococcus
IPRLNVLDLQRLIRVIP

SEQ ID NO: 2019645 - protein, 19 aa, Staphylococcus
IPRLNVLDLQRLIRVIPKP

SEQ ID NO: 2019646 - protein, 18 aa, Staphylococcus
IPRQEVQDQIALAINEEV

SEQ ID NO: 2019647 - protein, 20 aa, Staphylococcus
IPSEDAGKCMRTHGHTYFVN

SEQ ID NO: 2019648 - protein, 18 aa, Staphylococcus
IPSGRVVIFGGGSAAVNA

SEQ ID NO: 2019649 - protein, 20 aa, Staphylococcus
IPSHLKIKHFSSGMKMKLSL

SEQ ID NO: 2019650 - protein, 23 aa, Staphylococcus
IPSILKRGKLSISVSTNGASPKL

SEQ ID NO: 2019651 - protein, 18 aa, Staphylococcus
IPSIRPIARLGYYDYTVV

SEQ ID NO: 2019652 - protein, 19 aa, Staphylococcus
IPSKALLHASHRYDETKNS

SEQ ID NO: 2019653 - protein, 19 aa, Staphylococcus
IPSKALLHVSHVFQEAQHS

SEQ ID NO: 2019654 - protein, 19 aa, Staphylococcus
IPSKISYTEGITVGELADK

SEQ ID NO: 2019655 - protein, 25 aa, Staphylococcus
IPSMRLKRSIYRKFLKMAIGQNTAF

SEQ ID NO: 2019656 - protein, 20 aa, Staphylococcus
IPSREMWQNIKLNEAHVNTS

SEQ ID NO: 2019657 - protein, 17 aa, Staphylococcus
IPSSLPVFGEVTSGELT

SEQ ID NO: 2019658 - protein, 29 aa, Staphylococcus
IPSTALGFTGGFPGEFIKDTLAANEIYTD

SEQ ID NO: 2019659 - protein, 17 aa, Staphylococcus
IPSYKLKTIDARNALPD

SEQ ID NO: 2019660 - protein, 18 aa, Staphylococcus
IPTDYSERSAISIGSLLA

SEQ ID NO: 2019661 - protein, 20 aa, Staphylococcus
IPTEIRPDMNVLSQREQKLY

SEQ ID NO: 2019662 - protein, 20 aa, Staphylococcus
IPTFVMGVGLGGLILLNVLE

SEQ ID NO: 2019663 - protein, 18 aa, Staphylococcus
IPTKDIQKAIPFGTAKIN

SEQ ID NO: 2019664 - protein, 27 aa, Staphylococcus
IPTKVIKHAGRVSCKLFMENSNKTIHV

SEQ ID NO: 2019665 - protein, 17 aa, Staphylococcus
IPTSILVFKKCREDDDN

SEQ ID NO: 2019666 - protein, 20 aa, Staphylococcus
IPTTSQPAVGEWIQRYEKLR

SEQ ID NO: 2019667 - protein, 19 aa, Staphylococcus
IPTVILGVGYEHIHTTSER

SEQ ID NO: 2019668 - protein, 18 aa, Staphylococcus
IPTYRDLLHFSDKKLEKL

SEQ ID NO: 2019669 - protein, 19 aa, Staphylococcus
IPVALRLNPDYNVLSVKGN

SEQ ID NO: 2019670 - protein, 19 aa, Staphylococcus
IPVDEVIGAMDRVGRNLPA

SEQ ID NO: 2019671 - protein, 30 aa, Staphylococcus
IPVFDAYRYEAFKPYSPAFRKSSMPDGLHF

SEQ ID NO: 2019672 - protein, 17 aa, Staphylococcus
IPVIFIINQIDKHNEDE

SEQ ID NO: 2019673 - protein, 17 aa, Staphylococcus
IPVKYVGLGEKLDDLQP

SEQ ID NO: 2019674 - protein, 17 aa, Staphylococcus
IPVMAHLGLTPQSVGVM

SEQ ID NO: 2019675 - protein, 17 aa, Staphylococcus
IPVMAKCRIGHITEARV

SEQ ID NO: 2019676 - protein, 18 aa, Staphylococcus
IPVNGIRKQIAKNMVTSV

SEQ ID NO: 2019677 - protein, 23 aa, Staphylococcus
IPVNYDLVPKCVYTYPEIASIGK

SEQ ID NO: 2019678 - protein, 25 aa, Staphylococcus
IPVVKNFNSRLLIGGNGSIVQNDDG

SEQ ID NO: 2019679 - protein, 17 aa, Staphylococcus
IPWMSRTAMVFADVYTV

SEQ ID NO: 2019680 - protein, 28 aa, Staphylococcus
IPYANRFVRILGFPFYYRGEVYDPFETE

SEQ ID NO: 2019681 - protein, 17 aa, Staphylococcus
IPYCLHLTGKPVIESRA

SEQ ID NO: 2019682 - protein, 25 aa, Staphylococcus
IPYEPMTGGIFLWLKTPESYTGEQF

SEQ ID NO: 2019683 - protein, 21 aa, Staphylococcus
IPYEYEVISVFNLDEKEIREI

SEQ ID NO: 2019684 - protein, 18 aa, Staphylococcus
IPYGYPRISYLLHYQNDK

SEQ ID NO: 2019685 - protein, 19 aa, Staphylococcus
IPYIFKYNDAPAITIDDLN

SEQ ID NO: 2019686 - protein, 17 aa, Staphylococcus
IPYNEIESINMTDDGIS

SEQ ID NO: 2019687 - protein, 19 aa, Staphylococcus
IPYVRKILKTDMKVSDLNN

SEQ ID NO: 2019688 - protein, 19 aa, Staphylococcus
IQAAERLGFPEARIPLSQA

SEQ ID NO: 2019689 - protein, 24 aa, Staphylococcus
IQAARLRVMLDYMWEDIQENGEYM

SEQ ID NO: 2019690 - protein, 23 aa, Staphylococcus
IQAARMRVMLNYMWEDIQENGEY

SEQ ID NO: 2019691 - protein, 21 aa, Staphylococcus
IQAEKAFEFILIQTAFSEKLA

SEQ ID NO: 2019692 - protein, 19 aa, Staphylococcus
IQAGLGRSGKLFACDWDNV

SEQ ID NO: 2019693 - protein, 20 aa, Staphylococcus
IQAIHELPFNKGLDRVCTNI

SEQ ID NO: 2019694 - protein, 20 aa, Staphylococcus
IQALAKRGTNVIALVDDAYY

SEQ ID NO: 2019695 - protein, 24 aa, Staphylococcus
IQALFKGHVEAVIYTAGSNGASIY

SEQ ID NO: 2019696 - protein, 22 aa, Staphylococcus
IQANPLLVILIMIFSSGHVENV

SEQ ID NO: 2019697 - protein, 17 aa, Staphylococcus
IQAPFEVPDEFLMAIEL

SEQ ID NO: 2019698 - protein, 17 aa, Staphylococcus
IQASRIDKANGFQAMAL

SEQ ID NO: 2019699 - protein, 18 aa, Staphylococcus
IQDPEWLKTVAEKYPGRI

SEQ ID NO: 2019700 - protein, 20 aa, Staphylococcus
IQDVPYLVAGGMTKEKIQQF

SEQ ID NO: 2019701 - protein, 26 aa, Staphylococcus
IQDWWKDVEAAYHFLQAEGYQEIDVI

SEQ ID NO: 2019702 - protein, 17 aa, Staphylococcus
IQEAFKDKILIPHNDEN

SEQ ID NO: 2019703 - protein, 24 aa, Staphylococcus
IQEALNIIEPVPLFDRTKNDIKDT

SEQ ID NO: 2019704 - protein, 17 aa, Staphylococcus
IQEALSHYMLDIENANL

SEQ ID NO: 2019705 - protein, 19 aa, Staphylococcus
IQEAMKLGDRICLLNDGHV

SEQ ID NO: 2019706 - protein, 18 aa, Staphylococcus
IQEAMKLGDRICLLNDGR

SEQ ID NO: 2019707 - protein, 18 aa, Staphylococcus
IQEAMKLGDRICLLNEGH

SEQ ID NO: 2019708 - protein, 18 aa, Staphylococcus
IQEAMKLGDRICLLNNGH

SEQ ID NO: 2019709 - protein, 18 aa, Staphylococcus
IQEAMKLGDRICVMNQGH

SEQ ID NO: 2019710 - protein, 18 aa, Staphylococcus
IQEEGAQLLIDFITNNDI

SEQ ID NO: 2019711 - protein, 25 aa, Staphylococcus
IQEGFKKLKDGREFQHLYEAALARS

SEQ ID NO: 2019712 - protein, 18 aa, Staphylococcus
IQELFKKLRLKRDDIQQR

SEQ ID NO: 2019713 - protein, 19 aa, Staphylococcus
IQELLAFEMDDALIKQLQE

SEQ ID NO: 2019714 - protein, 21 aa, Staphylococcus
IQEMSDQFSIFIIEPDGDDIK

SEQ ID NO: 2019715 - protein, 30 aa, Staphylococcus
IQESIYRLGVEYLDLYLIHWPNPKQGKYVE

SEQ ID NO: 2019716 - protein, 19 aa, Staphylococcus
IQETFYLSSNIAVSVALIA

SEQ ID NO: 2019717 - protein, 17 aa, Staphylococcus
IQFDVMLSSYIIDPSRT

SEQ ID NO: 2019718 - protein, 21 aa, Staphylococcus
IQFGSLNLKGLNAGEGRVLTP

SEQ ID NO: 2019719 - protein, 17 aa, Staphylococcus
IQFKLEIPIIKRRPNFE

SEQ ID NO: 2019720 - protein, 35 aa, Staphylococcus
IQFKQAIDLIIKYRVPVCCFTFGIPDEETIQKLKE

SEQ ID NO: 2019721 - protein, 18 aa, Staphylococcus
IQFQIKHLMVSKVKGTFS

SEQ ID NO: 2019722 - protein, 17 aa, Staphylococcus
IQFSDGLTVLSGETGAG

SEQ ID NO: 2019723 - protein, 18 aa, Staphylococcus
IQFTEWYNNYFVTKRISM

SEQ ID NO: 2019724 - protein, 26 aa, Staphylococcus
IQGARCMDCGTPFCQTGLPYGKETIG

SEQ ID NO: 2019725 - protein, 17 aa, Staphylococcus
IQGEIIGIMGPNGAGKS

SEQ ID NO: 2019726 - protein, 30 aa, Staphylococcus
IQGFGNAGSFLAKFLFDKGAKIVGISDAYG

SEQ ID NO: 2019727 - protein, 24 aa, Staphylococcus
IQGIPRMVEKAIQYENLNQQALNE

SEQ ID NO: 2019728 - protein, 25 aa, Staphylococcus
IQGKKGVLFWQIIRFIQNTYPKYLL

SEQ ID NO: 2019729 - protein, 18 aa, Staphylococcus
IQGNVNWMRARQRQLIQT

SEQ ID NO: 2019730 - protein, 26 aa, Staphylococcus
IQGPDFPTAGIILGKSGIRRAFETGR

SEQ ID NO: 2019731 - protein, 23 aa, Staphylococcus
IQGPDFPTGGIIQGVDGIKKAYE

SEQ ID NO: 2019732 - protein, 25 aa, Staphylococcus
IQGPDFPTSGLILGKSGIRRAYETG

SEQ ID NO: 2019733 - protein, 19 aa, Staphylococcus
IQGQFPFENIKWLVDEGYT

SEQ ID NO: 2019734 - protein, 19 aa, Staphylococcus
IQGQIFISLAVKFSKARLI

SEQ ID NO: 2019735 - protein, 17 aa, Staphylococcus
IQGYGIQQGHLIGGNLE

SEQ ID NO: 2019736 - protein, 18 aa, Staphylococcus
IQGYYIVVGERRFRASQI

SEQ ID NO: 2019737 - protein, 19 aa, Staphylococcus
IQHECKEPVSLQPSLDIKR

SEQ ID NO: 2019738 - protein, 21 aa, Staphylococcus
IQHLPVAMIINQKRLGGNSRS

SEQ ID NO: 2019739 - protein, 22 aa, Staphylococcus
IQHPNVNIKYIFSHSKQDQPIK

SEQ ID NO: 2019740 - protein, 18 aa, Staphylococcus
IQIEGAQLLINYLSTNDL

SEQ ID NO: 2019741 - protein, 17 aa, Staphylococcus
IQIGITFVSNNKISGTY

SEQ ID NO: 2019742 - protein, 25 aa, Staphylococcus
IQIGTDIPFCIYNRTAVCKGRGEKI

SEQ ID NO: 2019743 - protein, 27 aa, Staphylococcus
IQIGTDVPFCIYNQTALCTGLGEKIEF

SEQ ID NO: 2019744 - protein, 23 aa, Staphylococcus
IQIIKSVILKAKRSFNDLYGEVY

SEQ ID NO: 2019745 - protein, 24 aa, Staphylococcus
IQIPELEIGAGEWITITGKNGSGK

SEQ ID NO: 2019746 - protein, 21 aa, Staphylococcus
IQIPTCIIVGELDGKFCKIAK

SEQ ID NO: 2019747 - protein, 21 aa, Staphylococcus
IQIVLQLKDLVSMTNAQVEDI

SEQ ID NO: 2019748 - protein, 20 aa, Staphylococcus
IQKHIPEFTLDYDVDPVRQA

SEQ ID NO: 2019749 - protein, 17 aa, Staphylococcus
IQKIIKFNEDLRTMTKQ

SEQ ID NO: 2019750 - protein, 18 aa, Staphylococcus
IQKPKKKQLLKMKNKKKQ

SEQ ID NO: 2019751 - protein, 17 aa, Staphylococcus
IQKRVYIKLSTTEREPF

SEQ ID NO: 2019752 - protein, 17 aa, Staphylococcus
IQKWISCDIDEAYLEHQ

SEQ ID NO: 2019753 - protein, 19 aa, Staphylococcus
IQLAEDIAFGFYITTSTLR

SEQ ID NO: 2019754 - protein, 17 aa, Staphylococcus
IQLAKKHNIGIGAHPGL

SEQ ID NO: 2019755 - protein, 23 aa, Staphylococcus
IQLFKDHRKIFIGGEKALAKHIK

SEQ ID NO: 2019756 - protein, 18 aa, Staphylococcus
IQLGILFNQGEVCSAGSR

SEQ ID NO: 2019757 - protein, 18 aa, Staphylococcus
IQLIFQYLFSQGRLPEAR

SEQ ID NO: 2019758 - protein, 17 aa, Staphylococcus
IQLIIRGICCLKPGIPG

SEQ ID NO: 2019759 - protein, 17 aa, Staphylococcus
IQLILNFYRNKTIQDVL

SEQ ID NO: 2019760 - protein, 17 aa, Staphylococcus
IQLKRPVMTEAQLNVIE

SEQ ID NO: 2019761 - protein, 25 aa, Staphylococcus
IQLLKEIPHRSSFSYILMDQSLNHA

SEQ ID NO: 2019762 - protein, 25 aa, Staphylococcus
IQLLKELPHRSSFSYILMDKESNYA

SEQ ID NO: 2019763 - protein, 17 aa, Staphylococcus
IQLLPLIIYGYNEQEGS

SEQ ID NO: 2019764 - protein, 27 aa, Staphylococcus
IQLNYAQCLVKLGFGSRAEHLFYENII

SEQ ID NO: 2019765 - protein, 20 aa, Staphylococcus
IQLRRYLHQYPELSFEEKQT

SEQ ID NO: 2019766 - protein, 17 aa, Staphylococcus
IQLTPHIAFFSDEAVRN

SEQ ID NO: 2019767 - protein, 23 aa, Staphylococcus
IQLTYRLNSDFTTIIGTPMFHVL

SEQ ID NO: 2019768 - protein, 17 aa, Staphylococcus
IQLVSDFASKMYGKQSE

SEQ ID NO: 2019769 - protein, 23 aa, Staphylococcus
IQMAAQCLIQAIGGEGYVYIKGY

SEQ ID NO: 2019770 - protein, 23 aa, Staphylococcus
IQMAAQCLIQAIGGEGYVYVKGY

SEQ ID NO: 2019771 - protein, 18 aa, Staphylococcus
IQNAGLVTRIIKAEPTGQ

SEQ ID NO: 2019772 - protein, 22 aa, Staphylococcus
IQNDYDCFFCIVDQHAITVPQD

SEQ ID NO: 2019773 - protein, 26 aa, Staphylococcus
IQNKIWYKLLVNLGINSITAIGHQPA

SEQ ID NO: 2019774 - protein, 25 aa, Staphylococcus
IQNLKDLRNGVAIEVPTYDYSKHTR

SEQ ID NO: 2019775 - protein, 20 aa, Staphylococcus
IQNLLIPLTFHFSTDELMII

SEQ ID NO: 2019776 - protein, 23 aa, Staphylococcus
IQNLMDLRNGIPVEVPTYDYVNH

SEQ ID NO: 2019777 - protein, 22 aa, Staphylococcus
IQNRIIPKILKRTNLIGQSQTG

SEQ ID NO: 2019778 - protein, 24 aa, Staphylococcus
IQNRIIPRIKKGVNLIGQSQTGTG

SEQ ID NO: 2019779 - protein, 23 aa, Staphylococcus
IQNRRLRRPDLTFATLDHNVPTI

SEQ ID NO: 2019780 - protein, 17 aa, Staphylococcus
IQPAISVEEVYLILQKE

SEQ ID NO: 2019781 - protein, 25 aa, Staphylococcus
IQPEMSKLKIRYELFQDEEKMDTYL

SEQ ID NO: 2019782 - protein, 23 aa, Staphylococcus
IQPGDDVGRAFSYETTEYILDQL

SEQ ID NO: 2019783 - protein, 23 aa, Staphylococcus
IQPGDDVGRAFSYETTEYILEQL

SEQ ID NO: 2019784 - protein, 25 aa, Staphylococcus
IQPHFKITAPFTDDALLRISLEEML

SEQ ID NO: 2019785 - protein, 24 aa, Staphylococcus
IQPILKEKFENLGLAVKEDHASEQ

SEQ ID NO: 2019786 - protein, 25 aa, Staphylococcus
IQPILKEKFENLGLIVKEDNASEQE

SEQ ID NO: 2019787 - protein, 24 aa, Staphylococcus
IQPILKKKFEELGLNVTEDHASEK

SEQ ID NO: 2019788 - protein, 24 aa, Staphylococcus
IQPILKKKFIDLGLNVVEDNASKR

SEQ ID NO: 2019789 - protein, 20 aa, Staphylococcus
IQPKFFLPIHGEYRMLTAHG

SEQ ID NO: 2019790 - protein, 21 aa, Staphylococcus
IQPKYFLPIHGEYRMLKAHGE

SEQ ID NO: 2019791 - protein, 17 aa, Staphylococcus
IQPPTAYQFFNDPMLSV

SEQ ID NO: 2019792 - protein, 17 aa, Staphylococcus
IQPVEIVRKLPIDTNKS

SEQ ID NO: 2019793 - protein, 17 aa, Staphylococcus
IQPVEIVRNLPIDINRS

SEQ ID NO: 2019794 - protein, 19 aa, Staphylococcus
IQQAILRTRIKGLGKDRMT

SEQ ID NO: 2019795 - protein, 18 aa, Staphylococcus
IQQFPRVKLGVINQNKVE

SEQ ID NO: 2019796 - protein, 26 aa, Staphylococcus
IQQGLGRTGKWSSVEHFNFTPDLITF

SEQ ID NO: 2019797 - protein, 23 aa, Staphylococcus
IQQGLGRTGRWSSVDHFNFTPDL

SEQ ID NO: 2019798 - protein, 26 aa, Staphylococcus
IQQGMGRTGKWSSIEHFNFEPDLVAY

SEQ ID NO: 2019799 - protein, 27 aa, Staphylococcus
IQQGYLPLNWINKWKHYSSVTLPKRWE

SEQ ID NO: 2019800 - protein, 26 aa, Staphylococcus
IQQGYLPLNWINKWKLYSTVKLPKRW

SEQ ID NO: 2019801 - protein, 22 aa, Staphylococcus
IQQHGYRCCINASTITQFELST

SEQ ID NO: 2019802 - protein, 29 aa, Staphylococcus
IQQKTAEYDFRWQPDILSRSIRDLKVAVI

SEQ ID NO: 2019803 - protein, 17 aa, Staphylococcus
IQQKYSQQFLKYTRIVK

SEQ ID NO: 2019804 - protein, 17 aa, Staphylococcus
IQQRFTLNMLYPYIDEI

SEQ ID NO: 2019805 - protein, 24 aa, Staphylococcus
IQQRFTLNMLYPYIDEIHINKNKT

SEQ ID NO: 2019806 - protein, 25 aa, Staphylococcus
IQQSCGRLGYAFSKENWLHLVKEII

SEQ ID NO: 2019807 - protein, 17 aa, Staphylococcus
IQRAAAALGSWRLEGCT

SEQ ID NO: 2019808 - protein, 18 aa, Staphylococcus
IQRARLQISDAFYSDKTK

SEQ ID NO: 2019809 - protein, 22 aa, Staphylococcus
IQREGYKQFEFVTDELTDLLAI

SEQ ID NO: 2019810 - protein, 21 aa, Staphylococcus
IQRFHIEAFLSQPIKQCSKGT

SEQ ID NO: 2019811 - protein, 24 aa, Staphylococcus
IQRFKEVYQIFSDVLGVPLEGKEN

SEQ ID NO: 2019812 - protein, 24 aa, Staphylococcus
IQRHEILRTQYIIDHNEVKQRIAK

SEQ ID NO: 2019813 - protein, 21 aa, Staphylococcus
IQRIEHMIRNALIIEDNGDNN

SEQ ID NO: 2019814 - protein, 21 aa, Staphylococcus
IQRIEHMIRNALIIEDSGDNN

SEQ ID NO: 2019815 - protein, 21 aa, Staphylococcus
IQRIEHMIRNALIIEDTGDNN

SEQ ID NO: 2019816 - protein, 30 aa, Staphylococcus
IQRKLKDYDFRWEPSILSRSISDLTVAVIG

SEQ ID NO: 2019817 - protein, 18 aa, Staphylococcus
IQRSFNISFYQGQKQAIE

SEQ ID NO: 2019818 - protein, 23 aa, Staphylococcus
IQRTGLSKLIITNVINKSLIGGI

SEQ ID NO: 2019819 - protein, 18 aa, Staphylococcus
IQSAERLGFPEARIPLSQ

SEQ ID NO: 2019820 - protein, 17 aa, Staphylococcus
IQSDVLITVDANQGKIF

SEQ ID NO: 2019821 - protein, 26 aa, Staphylococcus
IQSEVPAHVQAGWMLTTIASIGELER

SEQ ID NO: 2019822 - protein, 26 aa, Staphylococcus
IQSEVPAHVQAGWMLTTIASVGELER

SEQ ID NO: 2019823 - protein, 25 aa, Staphylococcus
IQSEVPAHVQAGWMLTTISSVGELE

SEQ ID NO: 2019824 - protein, 25 aa, Staphylococcus
IQSEVPAHVQASWMLTTISSIGELE

SEQ ID NO: 2019825 - protein, 19 aa, Staphylococcus
IQSGEAFTRAFRVSQNNYY

SEQ ID NO: 2019826 - protein, 26 aa, Staphylococcus
IQSGFARTGKTFAIEHFDVEPDLITV

SEQ ID NO: 2019827 - protein, 20 aa, Staphylococcus
IQSIIKKICNLSQTIQSNNS

SEQ ID NO: 2019828 - protein, 19 aa, Staphylococcus
IQSLEIMDYIERIYVQVVE

SEQ ID NO: 2019829 - protein, 25 aa, Staphylococcus
IQSLKKDGYKIGIVTSDSRKGVLQF

SEQ ID NO: 2019830 - protein, 24 aa, Staphylococcus
IQSNPEAYILLGYNETTNNSFVEI

SEQ ID NO: 2019831 - protein, 19 aa, Staphylococcus
IQSPEYWYKNINYQEDLDD

SEQ ID NO: 2019832 - protein, 18 aa, Staphylococcus
IQSRGFVYVRESEALLNE

SEQ ID NO: 2019833 - protein, 17 aa, Staphylococcus
IQSRGFVYVRESEDLLK

SEQ ID NO: 2019834 - protein, 17 aa, Staphylococcus
IQSRGFVYVRESEELLK

SEQ ID NO: 2019835 - protein, 17 aa, Staphylococcus
IQSRGFVYVRESEELLN

SEQ ID NO: 2019836 - protein, 17 aa, Staphylococcus
IQSRKAEIVDYVTQAID

SEQ ID NO: 2019837 - protein, 32 aa, Staphylococcus
IQSSILTSIPLWKNQMAIALTLMRQKNAVTAQ

SEQ ID NO: 2019838 - protein, 17 aa, Staphylococcus
IQSSILTSIPLWKNQMS

SEQ ID NO: 2019839 - protein, 25 aa, Staphylococcus
IQTFKRQIQELGFSYDWDREVNTTD

SEQ ID NO: 2019840 - protein, 25 aa, Staphylococcus
IQTIYKIINLIGFVPYKIDTYMHQF

SEQ ID NO: 2019841 - protein, 24 aa, Staphylococcus
IQTKDMYRLLGLAKYEDRFVVPTS

SEQ ID NO: 2019842 - protein, 24 aa, Staphylococcus
IQTKEMYRLLGLAKYEDRFVVPSS

SEQ ID NO: 2019843 - protein, 18 aa, Staphylococcus
IQTKHAIEQGYYDGDDAE

SEQ ID NO: 2019844 - protein, 19 aa, Staphylococcus
IQTNFQFRDGEIIRGKKSL

SEQ ID NO: 2019845 - protein, 23 aa, Staphylococcus
IQTPNSYRFQQFYNQAVTIYTSL

SEQ ID NO: 2019846 - protein, 21 aa, Staphylococcus
IQTRGYIPVIVHPERNKAIAQ

SEQ ID NO: 2019847 - protein, 17 aa, Staphylococcus
IQVDTIIMSLVMLHVPD

SEQ ID NO: 2019848 - protein, 27 aa, Staphylococcus
IQVGLGRTGKMFAMEWENTEPDIYLLG

SEQ ID NO: 2019849 - protein, 20 aa, Staphylococcus
IQVPGAFPKFGTRDGTITKN

SEQ ID NO: 2019850 - protein, 17 aa, Staphylococcus
IQVPGSFPKFGTTDGTI

SEQ ID NO: 2019851 - protein, 20 aa, Staphylococcus
IQVPNWYLSYYRRFPEKLEN

SEQ ID NO: 2019852 - protein, 17 aa, Staphylococcus
IQVYFKTMSPFITLDIF

SEQ ID NO: 2019853 - protein, 17 aa, Staphylococcus
IQWANSNFDDFSILLAG

SEQ ID NO: 2019854 - protein, 23 aa, Staphylococcus
IQWLFQGHVQAVIYTKGAEGAAI

SEQ ID NO: 2019855 - protein, 19 aa, Staphylococcus
IQYIVGFQSFYGYQFQVNE

SEQ ID NO: 2019856 - protein, 20 aa, Staphylococcus
IQYIVGFQSFYGYRFTVSDR

SEQ ID NO: 2019857 - protein, 25 aa, Staphylococcus
IQYLDLKPYLLYKIKDCSKGTRQKL

SEQ ID NO: 2019858 - protein, 19 aa, Staphylococcus
IRAGVPLQDIDKIARDIIS

SEQ ID NO: 2019859 - protein, 26 aa, Staphylococcus
IRAIPLRINKPLTFEVRGEAYMPKKS

SEQ ID NO: 2019860 - protein, 24 aa, Staphylococcus
IRAKEGITDGLIRLSIGIEDTEDL

SEQ ID NO: 2019861 - protein, 17 aa, Staphylococcus
IRALIDLSDLATVIPIE

SEQ ID NO: 2019862 - protein, 20 aa, Staphylococcus
IRALIDLSDLITVMPIERAI

SEQ ID NO: 2019863 - protein, 21 aa, Staphylococcus
IRALIDLSDLITVMPIERAIK

SEQ ID NO: 2019864 - protein, 22 aa, Staphylococcus
IRANTHLVIMVIVFSSGHVENV

SEQ ID NO: 2019865 - protein, 22 aa, Staphylococcus
IRAPQWRGGGVVFGPTPRSYGY

SEQ ID NO: 2019866 - protein, 17 aa, Staphylococcus
IRDAFGFEGTPIHIIPR

SEQ ID NO: 2019867 - protein, 18 aa, Staphylococcus
IRDAFGFEGTPIRIIPRK

SEQ ID NO: 2019868 - protein, 26 aa, Staphylococcus
IRDEDIWMLFGTLPIYPCINDENDQK

SEQ ID NO: 2019869 - protein, 23 aa, Staphylococcus
IRDGKWKSWGPYLLAGKDVHGSK

SEQ ID NO: 2019870 - protein, 26 aa, Staphylococcus
IRDGRARVSVGARSSVFAPFKNLGII

SEQ ID NO: 2019871 - protein, 26 aa, Staphylococcus
IRDGRARVSVGARSSVFAPFTNLGMI

SEQ ID NO: 2019872 - protein, 27 aa, Staphylococcus
IRDGYKLDFPESVVSFFKGEIGQPTSG

SEQ ID NO: 2019873 - protein, 22 aa, Staphylococcus
IRDKNTWMLFGTLPIYPCINDE

SEQ ID NO: 2019874 - protein, 24 aa, Staphylococcus
IRDLDIRAQFGINIIAIKRGREII

SEQ ID NO: 2019875 - protein, 25 aa, Staphylococcus
IRDLKFNIDICFKVVKHWDEDTYLE

SEQ ID NO: 2019876 - protein, 18 aa, Staphylococcus
IRDMLKERNIILEDTPQG

SEQ ID NO: 2019877 - protein, 18 aa, Staphylococcus
IRDNECVFLDAGSTTLEM

SEQ ID NO: 2019878 - protein, 32 aa, Staphylococcus
IRDVFGYHVSKGWMCVQVFFIRQGNMIQRDAT

SEQ ID NO: 2019879 - protein, 34 aa, Staphylococcus
IRDVFGYNVSKGWMCIQVFFIRQGNLIQRDATMI

SEQ ID NO: 2019880 - protein, 34 aa, Staphylococcus
IRDVFGYNVSKGWMCVQVFFIRQGNMIKRDATMI

SEQ ID NO: 2019881 - protein, 35 aa, Staphylococcus
IRDVFGYSISKGWMCIQVFFIRQGNMIKRDATMIP

SEQ ID NO: 2019882 - protein, 34 aa, Staphylococcus
IRDVFGYSVSKGWMCIQVFFIRQGNMIKRDTTMI

SEQ ID NO: 2019883 - protein, 33 aa, Staphylococcus
IRDVFGYSVSKGWMCIQVFFIRQGNMIQRDATM

SEQ ID NO: 2019884 - protein, 23 aa, Staphylococcus
IRDVSKRVLAHILGVELPNPSIV

SEQ ID NO: 2019885 - protein, 23 aa, Staphylococcus
IREAAKLADKCIEIGTEFLKVGV

SEQ ID NO: 2019886 - protein, 17 aa, Staphylococcus
IREAGILMLDDIGAEEV

SEQ ID NO: 2019887 - protein, 19 aa, Staphylococcus
IREAKSFYHLGPVTQNNLN

SEQ ID NO: 2019888 - protein, 17 aa, Staphylococcus
IREALMYVSSPLEEAEE

SEQ ID NO: 2019889 - protein, 23 aa, Staphylococcus
IREGQGFPVILIHGLDGNMASLY

SEQ ID NO: 2019890 - protein, 30 aa, Staphylococcus
IREKLRKKEIVKYPFNVNGYFLSIENDLFS

SEQ ID NO: 2019891 - protein, 19 aa, Staphylococcus
IREKYNWTQELLKEIEDHL

SEQ ID NO: 2019892 - protein, 17 aa, Staphylococcus
IRELIFREFYYVLMTQY

SEQ ID NO: 2019893 - protein, 19 aa, Staphylococcus
IRELMFREFYYVLMTQYPN

SEQ ID NO: 2019894 - protein, 18 aa, Staphylococcus
IREMLKGQCEYRDVEEAI

SEQ ID NO: 2019895 - protein, 26 aa, Staphylococcus
IREPCWKIQRKYGIKHLVKRMSSSGK

SEQ ID NO: 2019896 - protein, 26 aa, Staphylococcus
IREPCWKIQTKYGIKDLVKRMSTSGK

SEQ ID NO: 2019897 - protein, 17 aa, Staphylococcus
IREQAGAYLIVDDLKNL

SEQ ID NO: 2019898 - protein, 18 aa, Staphylococcus
IRESPALDIYHLLQEENF

SEQ ID NO: 2019899 - protein, 17 aa, Staphylococcus
IRETGGLPDADKFDTAI

SEQ ID NO: 2019900 - protein, 17 aa, Staphylococcus
IRETGGLPSDDKFEATI

SEQ ID NO: 2019901 - protein, 25 aa, Staphylococcus
IRFFPENFETYEFLTATDALITDYS

SEQ ID NO: 2019902 - protein, 30 aa, Staphylococcus
IRFLFNEVCHKLHLPWVYGAAVGGKGSIYA

SEQ ID NO: 2019903 - protein, 23 aa, Staphylococcus
IRFLKGNALKPLIKENIKLDGLI

SEQ ID NO: 2019904 - protein, 17 aa, Staphylococcus
IRFSDHLIAMKGGDIVS

SEQ ID NO: 2019905 - protein, 17 aa, Staphylococcus
IRFSKKVTEGGFHELKI

SEQ ID NO: 2019906 - protein, 17 aa, Staphylococcus
IRFSYSYIDESDINRSL

SEQ ID NO: 2019907 - protein, 25 aa, Staphylococcus
IRGAGGKKPNGWILHIPSTYLGIAQ

SEQ ID NO: 2019908 - protein, 23 aa, Staphylococcus
IRGAKILALMGLELIENEKLFNE

SEQ ID NO: 2019909 - protein, 18 aa, Staphylococcus
IRGEIIKAFVALRPDYQE

SEQ ID NO: 2019910 - protein, 22 aa, Staphylococcus
IRGGCSPIGMKHSFPTIIDESA

SEQ ID NO: 2019911 - protein, 23 aa, Staphylococcus
IRGICCLKPGIPGISENIEVVSI

SEQ ID NO: 2019912 - protein, 18 aa, Staphylococcus
IRGLRAVSDFEYELRLTS

SEQ ID NO: 2019913 - protein, 21 aa, Staphylococcus
IRGLSPWPVAYTKLDDTNMKL

SEQ ID NO: 2019914 - protein, 26 aa, Staphylococcus
IRGREIKGHIPSGEWGVPENLMGPLI

SEQ ID NO: 2019915 - protein, 17 aa, Staphylococcus
IRGSDAFIFESNHDVDM

SEQ ID NO: 2019916 - protein, 17 aa, Staphylococcus
IRGVRILGMNQRGQQYL

SEQ ID NO: 2019917 - protein, 23 aa, Staphylococcus
IRHFGENRLEGFQQKKAALPDDV

SEQ ID NO: 2019918 - protein, 18 aa, Staphylococcus
IRHGLAIQAVEKVKASKH

SEQ ID NO: 2019919 - protein, 25 aa, Staphylococcus
IRHILKEKKGLIIVGDMQHQAIDQI

SEQ ID NO: 2019920 - protein, 17 aa, Staphylococcus
IRHIQFLIRRLNKKEYI

SEQ ID NO: 2019921 - protein, 17 aa, Staphylococcus
IRHIQFLIRRLNKKEYV

SEQ ID NO: 2019922 - protein, 17 aa, Staphylococcus
IRHIQFLIRRLQKGEII

SEQ ID NO: 2019923 - protein, 21 aa, Staphylococcus
IRHLGAKASYVLAEKYETIER

SEQ ID NO: 2019924 - protein, 21 aa, Staphylococcus
IRHLGVKASQVIAERFETMDR

SEQ ID NO: 2019925 - protein, 21 aa, Staphylococcus
IRHMVEANIAKGYHFMVITDH

SEQ ID NO: 2019926 - protein, 19 aa, Staphylococcus
IRHSNMLAWLFNPNEVHGL

SEQ ID NO: 2019927 - protein, 23 aa, Staphylococcus
IRHVHKPSGAKPGFVTYDNQKTL

SEQ ID NO: 2019928 - protein, 17 aa, Staphylococcus
IRIAFSCVEKDDIPHVF

SEQ ID NO: 2019929 - protein, 18 aa, Staphylococcus
IRIAGGREVNLQSLQPFA

SEQ ID NO: 2019930 - protein, 17 aa, Staphylococcus
IRIAGGREVNLRSLQAI

SEQ ID NO: 2019931 - protein, 18 aa, Staphylococcus
IRIAGGREVNLRSLQATA

SEQ ID NO: 2019932 - protein, 18 aa, Staphylococcus
IRIAGGREVNLRSLQPLA

SEQ ID NO: 2019933 - protein, 17 aa, Staphylococcus
IRIANDTKYGLAGYVIG

SEQ ID NO: 2019934 - protein, 23 aa, Staphylococcus
IRIEAPIPGTSLVGIEVPNLNPT

SEQ ID NO: 2019935 - protein, 23 aa, Staphylococcus
IRIEAPIPGTSLVGIEVPNQDPT

SEQ ID NO: 2019936 - protein, 23 aa, Staphylococcus
IRIEAPIPGTSLVGIEVPNQNAT

SEQ ID NO: 2019937 - protein, 23 aa, Staphylococcus
IRIEAPIPGTSLVGIEVPNQNPA

SEQ ID NO: 2019938 - protein, 23 aa, Staphylococcus
IRIEAPIPGTSLVGIEVPNQNSS

SEQ ID NO: 2019939 - protein, 17 aa, Staphylococcus
IRIGFLIGPEYLIEKLT

SEQ ID NO: 2019940 - protein, 18 aa, Staphylococcus
IRIGFLIGPEYLIEKLTF

SEQ ID NO: 2019941 - protein, 17 aa, Staphylococcus
IRIGFLMGPEYLIEKLT

SEQ ID NO: 2019942 - protein, 20 aa, Staphylococcus
IRIGNPASWTKATAALNESH

SEQ ID NO: 2019943 - protein, 17 aa, Staphylococcus
IRIGNPASWTKATNALD

SEQ ID NO: 2019944 - protein, 22 aa, Staphylococcus
IRIPENQKYGAFHGKESFKEAI

SEQ ID NO: 2019945 - protein, 17 aa, Staphylococcus
IRIPVLIINGEYDVEDF

SEQ ID NO: 2019946 - protein, 19 aa, Staphylococcus
IRKAFKPAEPGNVILSADY

SEQ ID NO: 2019947 - protein, 18 aa, Staphylococcus
IRKAFKPSSEDSVILSAD

SEQ ID NO: 2019948 - protein, 17 aa, Staphylococcus
IRKAFKPTDKDSVILSA

SEQ ID NO: 2019949 - protein, 18 aa, Staphylococcus
IRKAFKPTSDDYVILSAD

SEQ ID NO: 2019950 - protein, 18 aa, Staphylococcus
IRKAFKPTSNDSVILSAD

SEQ ID NO: 2019951 - protein, 18 aa, Staphylococcus
IRKAFKPTSTDSVILSAD

SEQ ID NO: 2019952 - protein, 21 aa, Staphylococcus
IRKDALFHLANEYGIEESSAN

SEQ ID NO: 2019953 - protein, 24 aa, Staphylococcus
IRKDVACHTCDGEGAKPGTKKKTC

SEQ ID NO: 2019954 - protein, 19 aa, Staphylococcus
IRKEILIVEDIVKPVSEET

SEQ ID NO: 2019955 - protein, 25 aa, Staphylococcus
IRKGPNIKLPSFDLLEEPEPHEVDE

SEQ ID NO: 2019956 - protein, 27 aa, Staphylococcus
IRKGPNLKLPSVELLDDPEIHEIDEEW

SEQ ID NO: 2019957 - protein, 20 aa, Staphylococcus
IRKKDIGFIFQEYNLLHTLT

SEQ ID NO: 2019958 - protein, 23 aa, Staphylococcus
IRKKFKTDRLSTIEAEISEIKID

SEQ ID NO: 2019959 - protein, 26 aa, Staphylococcus
IRKLKMIGHYIGMSFQIVDDILDFTS

SEQ ID NO: 2019960 - protein, 17 aa, Staphylococcus
IRKMIGYLPQDFDFYPN

SEQ ID NO: 2019961 - protein, 21 aa, Staphylococcus
IRKRFKTSRLSSIEAEISEIK

SEQ ID NO: 2019962 - protein, 24 aa, Staphylococcus
IRKRVGDRKVLCAMSGGVDSSVVA

SEQ ID NO: 2019963 - protein, 26 aa, Staphylococcus
IRKVPELDVPAYLFLGVLGMTGQTAY

SEQ ID NO: 2019964 - protein, 26 aa, Staphylococcus
IRKVSKRLGKTVAILLDTKGPEIRTH

SEQ ID NO: 2019965 - protein, 22 aa, Staphylococcus
IRLDRHFPDWHETYSKVEALNK

SEQ ID NO: 2019966 - protein, 17 aa, Staphylococcus
IRLEQHIIGYVTYHYPD

SEQ ID NO: 2019967 - protein, 18 aa, Staphylococcus
IRLGNGFDETTEMGPVIS

SEQ ID NO: 2019968 - protein, 25 aa, Staphylococcus
IRLIAADLVDFDWIDGFDIECRNEE

SEQ ID NO: 2019969 - protein, 25 aa, Staphylococcus
IRLIAADLVDFEWIDGFDIECRNEE

SEQ ID NO: 2019970 - protein, 17 aa, Staphylococcus
IRLIPFGSLEHTKDVIT

SEQ ID NO: 2019971 - protein, 20 aa, Staphylococcus
IRLKILHSIRQSNTKSLCVC

SEQ ID NO: 2019972 - protein, 19 aa, Staphylococcus
IRLKYRYLDLRRPELAQTF

SEQ ID NO: 2019973 - protein, 18 aa, Staphylococcus
IRLKYRYLDLRRQELAQT

SEQ ID NO: 2019974 - protein, 19 aa, Staphylococcus
IRLKYRYLDLRRQELAQTF

SEQ ID NO: 2019975 - protein, 33 aa, Staphylococcus
IRLLEREEVEWIILAGYMRLIGPDLLDAYEGKI

SEQ ID NO: 2019976 - protein, 19 aa, Staphylococcus
IRLLICTNDSITSISEQSG

SEQ ID NO: 2019977 - protein, 19 aa, Staphylococcus
IRLLLKVIIKSATKKSERS

SEQ ID NO: 2019978 - protein, 17 aa, Staphylococcus
IRLLPPLTISSQEINRA

SEQ ID NO: 2019979 - protein, 19 aa, Staphylococcus
IRLLYARIGKPFCPNHGIE

SEQ ID NO: 2019980 - protein, 20 aa, Staphylococcus
IRLLYARVGKPYCPHHGIEI

SEQ ID NO: 2019981 - protein, 26 aa, Staphylococcus
IRLLYARVGKPYCPNHHIEIESQTVQ

SEQ ID NO: 2019982 - protein, 21 aa, Staphylococcus
IRLNKELNKIFNLEVSLKEFV

SEQ ID NO: 2019983 - protein, 20 aa, Staphylococcus
IRLTQKFNIPQGYQAIQLLQ

SEQ ID NO: 2019984 - protein, 22 aa, Staphylococcus
IRLVIFRFSKDAGLNELLNIKT

SEQ ID NO: 2019985 - protein, 19 aa, Staphylococcus
IRMECKLNQIVTLGDAQEG

SEQ ID NO: 2019986 - protein, 19 aa, Staphylococcus
IRMWDYKALPKVFGGDNVV

SEQ ID NO: 2019987 - protein, 18 aa, Staphylococcus
IRNAVDFGYATDPLAFVR

SEQ ID NO: 2019988 - protein, 25 aa, Staphylococcus
IRNFGENRLEGFKAKKEALPDDAIM

SEQ ID NO: 2019989 - protein, 28 aa, Staphylococcus
IRNFKPEEYWKIEGEFRYKKTKFTAKFL

SEQ ID NO: 2019990 - protein, 28 aa, Staphylococcus
IRNFKPEEYWKIEGNFRYKKSTFSAKFL

SEQ ID NO: 2019991 - protein, 28 aa, Staphylococcus
IRNFKPEEYWTIEGEFRYKKSKFNAKFL

SEQ ID NO: 2019992 - protein, 28 aa, Staphylococcus
IRNFKPEEYWTIEGEFRYKKSKFTAKFL

SEQ ID NO: 2019993 - protein, 28 aa, Staphylococcus
IRNFKPEEYWTIEGEFRYQKSKFTAKFL

SEQ ID NO: 2019994 - protein, 19 aa, Staphylococcus
IRNKIGILNKKEMKQQAEQ

SEQ ID NO: 2019995 - protein, 19 aa, Staphylococcus
IRNLLAMCYLYLSEYEIAK

SEQ ID NO: 2019996 - protein, 19 aa, Staphylococcus
IRNLLAMCYLYLSEYETAK

SEQ ID NO: 2019997 - protein, 24 aa, Staphylococcus
IRNQKKENVAVCFFGDGAANEGNF

SEQ ID NO: 2019998 - protein, 26 aa, Staphylococcus
IRNRYQWSKTFLKKVNRLLHPSFKIR

SEQ ID NO: 2019999 - protein, 18 aa, Staphylococcus
IRNVQALNNYASFKNMAP

SEQ ID NO: 2020000 - protein, 33 aa, Staphylococcus
IRPEDLQAYGLIPEFIGRVPIVANLETLDVEAL

SEQ ID NO: 2020001 - protein, 33 aa, Staphylococcus
IRPEDLQAYGLIPEFIGRVPVVANLETLDVKAL

SEQ ID NO: 2020002 - protein, 25 aa, Staphylococcus
IRPIRQKVGLVFQFPESQLFEDNIE

SEQ ID NO: 2020003 - protein, 21 aa, Staphylococcus
IRPNLGRKIFINYLNKRKHSE

SEQ ID NO: 2020004 - protein, 19 aa, Staphylococcus
IRPPFNVGRLSEYAALAAL

SEQ ID NO: 2020005 - protein, 20 aa, Staphylococcus
IRPQDPFNVFQPDKLSVTQL

SEQ ID NO: 2020006 - protein, 20 aa, Staphylococcus
IRPYEGHLWIMDPIDGTANL

SEQ ID NO: 2020007 - protein, 17 aa, Staphylococcus
IRPYLIQIHEKYNVQYI

SEQ ID NO: 2020008 - protein, 20 aa, Staphylococcus
IRQELLPGKNLMILQKAIVN

SEQ ID NO: 2020009 - protein, 17 aa, Staphylococcus
IRQGLCDKERDKVIRGG

SEQ ID NO: 2020010 - protein, 17 aa, Staphylococcus
IRQKYIDFFVEKGHMVE

SEQ ID NO: 2020011 - protein, 18 aa, Staphylococcus
IRQKYLDFFVEKGHMIEP

SEQ ID NO: 2020012 - protein, 18 aa, Staphylococcus
IRQKYLDFFVEKGHMVEP

SEQ ID NO: 2020013 - protein, 17 aa, Staphylococcus
IRQLCQELHDFYKEHNT

SEQ ID NO: 2020014 - protein, 19 aa, Staphylococcus
IRQLEGFGVHTYRLVNDEG

SEQ ID NO: 2020015 - protein, 22 aa, Staphylococcus
IRQLTDFDCSFTILRSTQLSQL

SEQ ID NO: 2020016 - protein, 23 aa, Staphylococcus
IRQNDEIVLLEGFMDVIKSDYAG

SEQ ID NO: 2020017 - protein, 19 aa, Staphylococcus
IRQNLDRIVKSQANQKKLS

SEQ ID NO: 2020018 - protein, 19 aa, Staphylococcus
IRQPLCYHPALTNWIQKRI

SEQ ID NO: 2020019 - protein, 23 aa, Staphylococcus
IRQPMREDMSFLTRFINQKNINE

SEQ ID NO: 2020020 - protein, 18 aa, Staphylococcus
IRQQWAKLGLGLDYDRER

SEQ ID NO: 2020021 - protein, 18 aa, Staphylococcus
IRQQWAKLGLGLDYSRER

SEQ ID NO: 2020022 - protein, 24 aa, Staphylococcus
IRRELLDHYAELGIDEQDLVILIK

SEQ ID NO: 2020023 - protein, 22 aa, Staphylococcus
IRRELLDHYSELGLDEQDLIIL

SEQ ID NO: 2020024 - protein, 28 aa, Staphylococcus
IRRERERKFLKRKKFKEALQQKREQEDT

SEQ ID NO: 2020025 - protein, 18 aa, Staphylococcus
IRRHLHQYPELSFEESHT

SEQ ID NO: 2020026 - protein, 18 aa, Staphylococcus
IRRILKRMDRYIKFESNP

SEQ ID NO: 2020027 - protein, 18 aa, Staphylococcus
IRRMLKEQPDKFIKNSLH

SEQ ID NO: 2020028 - protein, 23 aa, Staphylococcus
IRRNAYYLDCIRLHKVKGKEVLL

SEQ ID NO: 2020029 - protein, 21 aa, Staphylococcus
IRRSELHKRALIGKKRNDKRK

SEQ ID NO: 2020030 - protein, 25 aa, Staphylococcus
IRSASEIQLDLGYTVEELIDVVREL

SEQ ID NO: 2020031 - protein, 17 aa, Staphylococcus
IRSDKNLVPILMLTAKD

SEQ ID NO: 2020032 - protein, 18 aa, Staphylococcus
IRSFVNIIAHLINETFDK

SEQ ID NO: 2020033 - protein, 18 aa, Staphylococcus
IRSHACGMGEPFSEEVSL

SEQ ID NO: 2020034 - protein, 21 aa, Staphylococcus
IRSTMSRVHFKDREFPLHNTS

SEQ ID NO: 2020035 - protein, 23 aa, Staphylococcus
IRSYVFHPYAMVKDHRTNEETGK

SEQ ID NO: 2020036 - protein, 25 aa, Staphylococcus
IRTANGRPVVYCLDKVATDYLTCAA

SEQ ID NO: 2020037 - protein, 21 aa, Staphylococcus
IRTDLDIPPFIQALTSIEDTM

SEQ ID NO: 2020038 - protein, 21 aa, Staphylococcus
IRTDLDIPPFIQALTSIEETM

SEQ ID NO: 2020039 - protein, 21 aa, Staphylococcus
IRTEALLFAASRREHLVEKVI

SEQ ID NO: 2020040 - protein, 17 aa, Staphylococcus
IRTEAMLFAASRREHLV

SEQ ID NO: 2020041 - protein, 18 aa, Staphylococcus
IRTEAMLFAASRREHLVE

SEQ ID NO: 2020042 - protein, 18 aa, Staphylococcus
IRTIMEFLIGNIEKNMEF

SEQ ID NO: 2020043 - protein, 19 aa, Staphylococcus
IRTIPEYDNEAIIQLFEET

SEQ ID NO: 2020044 - protein, 18 aa, Staphylococcus
IRTNITFSTADKDVKGIV

SEQ ID NO: 2020045 - protein, 19 aa, Staphylococcus
IRTPVGRNGIVATFKGQGD

SEQ ID NO: 2020046 - protein, 20 aa, Staphylococcus
IRTRFKTERLSRIEAEIAEI

SEQ ID NO: 2020047 - protein, 17 aa, Staphylococcus
IRTRRDGDKFKLNGSHG

SEQ ID NO: 2020048 - protein, 27 aa, Staphylococcus
IRTYLKRPDLLMAYPLSEQDKEIIESF

SEQ ID NO: 2020049 - protein, 17 aa, Staphylococcus
IRVAFSCVEKDDIPHVF

SEQ ID NO: 2020050 - protein, 19 aa, Staphylococcus
IRVARNILKQKAMDPFNGG

SEQ ID NO: 2020051 - protein, 19 aa, Staphylococcus
IRVDIAGSVESIYDITKDD

SEQ ID NO: 2020052 - protein, 19 aa, Staphylococcus
IRVDIAGSVESIYHITKDD

SEQ ID NO: 2020053 - protein, 17 aa, Staphylococcus
IRVLPYASITTRQAGKE

SEQ ID NO: 2020054 - protein, 17 aa, Staphylococcus
IRVNIVYEIPLSEVVFD

SEQ ID NO: 2020055 - protein, 18 aa, Staphylococcus
IRVPEDLQIVSFNNTRLV

SEQ ID NO: 2020056 - protein, 20 aa, Staphylococcus
IRVVSMPNWHAFEQQSKEYK

SEQ ID NO: 2020057 - protein, 20 aa, Staphylococcus
IRWFEDLRTIFINQYMNYSE

SEQ ID NO: 2020058 - protein, 26 aa, Staphylococcus
IRWLRCDIKSLNLLGNVLAKEYAVKY

SEQ ID NO: 2020059 - protein, 17 aa, Staphylococcus
IRYAQEQGITVVIATGR

SEQ ID NO: 2020060 - protein, 24 aa, Staphylococcus
IRYCEKCGQIIRPDIVLYGEMLNQ

SEQ ID NO: 2020061 - protein, 17 aa, Staphylococcus
IRYGITVEGLLRDSPSI

SEQ ID NO: 2020062 - protein, 25 aa, Staphylococcus
IRYSDSVLLSTKFKAPRWLVNPIKN

SEQ ID NO: 2020063 - protein, 17 aa, Staphylococcus
IRYSIMGHVHFRNRFDE

SEQ ID NO: 2020064 - protein, 29 aa, Staphylococcus
IRYYLESMALDFKVGGLLNKKKKTEEERA

SEQ ID NO: 2020065 - protein, 17 aa, Staphylococcus
ISAGRLSYEAGRIPVKY

SEQ ID NO: 2020066 - protein, 20 aa, Staphylococcus
ISAGSKFMAAYPITPASEIM

SEQ ID NO: 2020067 - protein, 18 aa, Staphylococcus
ISAIKRDGALIVNEVPVT

SEQ ID NO: 2020068 - protein, 18 aa, Staphylococcus
ISAIRGGTIVGEHDVLFA

SEQ ID NO: 2020069 - protein, 18 aa, Staphylococcus
ISAKKGWLNQKERFSQVI

SEQ ID NO: 2020070 - protein, 17 aa, Staphylococcus
ISAKLIIIDEMSMVDTW

SEQ ID NO: 2020071 - protein, 18 aa, Staphylococcus
ISALYQFLVSRLIEDQID

SEQ ID NO: 2020072 - protein, 19 aa, Staphylococcus
ISAMMFKGNAAKINFDPKE

SEQ ID NO: 2020073 - protein, 25 aa, Staphylococcus
ISAMMFKGSASKLNFEPKEGDEVLL

SEQ ID NO: 2020074 - protein, 24 aa, Staphylococcus
ISANEKYDLFVLVVTDIINSDSKI

SEQ ID NO: 2020075 - protein, 18 aa, Staphylococcus
ISAQFLFAKELGLKMTDL

SEQ ID NO: 2020076 - protein, 19 aa, Staphylococcus
ISCDKGFSVINIKKYLMNR

SEQ ID NO: 2020077 - protein, 18 aa, Staphylococcus
ISDAYGFSSSASYSKKFK

SEQ ID NO: 2020078 - protein, 21 aa, Staphylococcus
ISDGRPKLMGIKQIIDSYINH

SEQ ID NO: 2020079 - protein, 22 aa, Staphylococcus
ISDGRPKLMGIREIIDSYLNHQ

SEQ ID NO: 2020080 - protein, 22 aa, Staphylococcus
ISDGRPKLMGLREIIDSYLNHQ

SEQ ID NO: 2020081 - protein, 22 aa, Staphylococcus
ISDGRPKLMGLREIIESYLNHQ

SEQ ID NO: 2020082 - protein, 22 aa, Staphylococcus
ISDKIMYSSIGFETLGYEEDAY

SEQ ID NO: 2020083 - protein, 35 aa, Staphylococcus
ISDLFVQRLDAILNYPDTCPHGGIIPRSNEYKEKY

SEQ ID NO: 2020084 - protein, 23 aa, Staphylococcus
ISDLKFEIPQIIVEDSVQAFKQL

SEQ ID NO: 2020085 - protein, 18 aa, Staphylococcus
ISDLKVAVIGTGRIGSIV

SEQ ID NO: 2020086 - protein, 19 aa, Staphylococcus
ISDLRFVDDTCQFDMIVEC

SEQ ID NO: 2020087 - protein, 18 aa, Staphylococcus
ISDRIAVMHFGKIVEIGS

SEQ ID NO: 2020088 - protein, 19 aa, Staphylococcus
ISDRIAVMHFGKIVEIGSA

SEQ ID NO: 2020089 - protein, 18 aa, Staphylococcus
ISDRIAVMHFGKIVELGP

SEQ ID NO: 2020090 - protein, 18 aa, Staphylococcus
ISDRIAVMHFGKIVELGS

SEQ ID NO: 2020091 - protein, 18 aa, Staphylococcus
ISDRIAVMHFGKIVELGT

SEQ ID NO: 2020092 - protein, 24 aa, Staphylococcus
ISDTGWQELPLMSGVEADTDLGPS

SEQ ID NO: 2020093 - protein, 17 aa, Staphylococcus
ISDVKVIFRAKLNASDD

SEQ ID NO: 2020094 - protein, 31 aa, Staphylococcus
ISDWNKEGWGNIPMTLGFTYSSNTLMMHLQD

SEQ ID NO: 2020095 - protein, 17 aa, Staphylococcus
ISDYLSINEDFGTKEEL

SEQ ID NO: 2020096 - protein, 21 aa, Staphylococcus
ISEALKIPIFTYKNELPYING

SEQ ID NO: 2020097 - protein, 22 aa, Staphylococcus
ISEDAKFGKFVVEPLERGYGTT

SEQ ID NO: 2020098 - protein, 18 aa, Staphylococcus
ISEFELYDGVIINKESSG

SEQ ID NO: 2020099 - protein, 22 aa, Staphylococcus
ISEGRPVLMGIRQFIDSYLNHQ

SEQ ID NO: 2020100 - protein, 21 aa, Staphylococcus
ISEGYKPGDFESITVTVDSDK

SEQ ID NO: 2020101 - protein, 17 aa, Staphylococcus
ISEHSMLVDLGRNDIHR

SEQ ID NO: 2020102 - protein, 21 aa, Staphylococcus
ISEIDRFYQLFKMAEERHHFK

SEQ ID NO: 2020103 - protein, 17 aa, Staphylococcus
ISEKIIIGGDLNIITPK

SEQ ID NO: 2020104 - protein, 17 aa, Staphylococcus
ISELGLAIEAGMNAEDI

SEQ ID NO: 2020105 - protein, 17 aa, Staphylococcus
ISELGLAIESGMNAEDL

SEQ ID NO: 2020106 - protein, 24 aa, Staphylococcus
ISEMSDRMGFRLKGENIAPEESAD

SEQ ID NO: 2020107 - protein, 18 aa, Staphylococcus
ISESKLHLDDLHNSQVTL

SEQ ID NO: 2020108 - protein, 20 aa, Staphylococcus
ISESVIASVIDYCHEQRLID

SEQ ID NO: 2020109 - protein, 22 aa, Staphylococcus
ISESVKLLFNVECEVKFEEGYP

SEQ ID NO: 2020110 - protein, 17 aa, Staphylococcus
ISESYAEMISETDYESI

SEQ ID NO: 2020111 - protein, 33 aa, Staphylococcus; identical to SEQ ID NO: 1807317

SEQ ID NO: 2020112 - protein, 19 aa, Staphylococcus
ISEVIAWLNANTFESISLT

SEQ ID NO: 2020113 - protein, 24 aa, Staphylococcus
ISEVKEFFKDASIQTYQQATEKCI

SEQ ID NO: 2020114 - protein, 22 aa, Staphylococcus
ISFDKPIHVVVCEVKSKAKDLS

SEQ ID NO: 2020115 - protein, 20 aa, Staphylococcus
ISFEVPKGFVTGFIGGNGAG

SEQ ID NO: 2020116 - protein, 21 aa, Staphylococcus
ISFNIPRGFVTGFIGANGSGK

SEQ ID NO: 2020117 - protein, 20 aa, Staphylococcus
ISFSGQMHGLVIVDKDGHVL

SEQ ID NO: 2020118 - protein, 21 aa, Staphylococcus
ISFSGQMHGLVPLNSEHKPIR

SEQ ID NO: 2020119 - protein, 23 aa, Staphylococcus
ISGACGRLMCCLKYENDYYEEAR

SEQ ID NO: 2020120 - protein, 19 aa, Staphylococcus
ISGDGAFQMVMQDFATAVQ

SEQ ID NO: 2020121 - protein, 26 aa, Staphylococcus
ISGDSVNLYAMITWAFRAIQQLNKKI

SEQ ID NO: 2020122 - protein, 28 aa, Staphylococcus
ISGEAAFKRFTMIGPLTFQIRDQKESVQ

SEQ ID NO: 2020123 - protein, 20 aa, Staphylococcus
ISGGRVGWNLVTSMTDAEAQ

SEQ ID NO: 2020124 - protein, 24 aa, Staphylococcus
ISGHYRNGILLSPIIGRDIANWIL

SEQ ID NO: 2020125 - protein, 26 aa, Staphylococcus
ISGKELRDTLHFEMLWDTSKIDVIIR

SEQ ID NO: 2020126 - protein, 23 aa, Staphylococcus
ISGKIFFSSMGFETLGLESKSSK

SEQ ID NO: 2020127 - protein, 17 aa, Staphylococcus
ISGKPIIESRMFKDGLI

SEQ ID NO: 2020128 - protein, 17 aa, Staphylococcus
ISGMMHGYLVFDEHDDL

SEQ ID NO: 2020129 - protein, 23 aa, Staphylococcus
ISGNRIVPLFVFYKKIFWGKKKL

SEQ ID NO: 2020130 - protein, 17 aa, Staphylococcus
ISGRPKHIYSIYRKMMK

SEQ ID NO: 2020131 - protein, 19 aa, Staphylococcus
ISGTFRAIFENENKTRFFV

SEQ ID NO: 2020132 - protein, 17 aa, Staphylococcus
ISHGEIDAVITMPEFIK

SEQ ID NO: 2020133 - protein, 19 aa, Staphylococcus
ISHIQTRLSEFVDEINHVD

SEQ ID NO: 2020134 - protein, 20 aa, Staphylococcus
ISHLSRRIFFNDQHIKDSEI

SEQ ID NO: 2020135 - protein, 18 aa, Staphylococcus
ISHSQLLNRGPRRVSPFF

SEQ ID NO: 2020136 - protein, 17 aa, Staphylococcus
ISIARGRMQPVQPPTDD

SEQ ID NO: 2020137 - protein, 17 aa, Staphylococcus
ISIEEFFVLYKVFEGEK

SEQ ID NO: 2020138 - protein, 20 aa, Staphylococcus
ISIFHIKRFDSELFVFKDKG

SEQ ID NO: 2020139 - protein, 19 aa, Staphylococcus
ISIGLIFTLMDGIAYLKEH

SEQ ID NO: 2020140 - protein, 17 aa, Staphylococcus
ISIGLPILDSVRKGTDL

SEQ ID NO: 2020141 - protein, 17 aa, Staphylococcus
ISIGLPILEAVNAGTDL

SEQ ID NO: 2020142 - protein, 17 aa, Staphylococcus
ISIISGFLGSGKTTLLT

SEQ ID NO: 2020143 - protein, 25 aa, Staphylococcus
ISILFKKHLGMSFKNYITSLKIALS

SEQ ID NO: 2020144 - protein, 22 aa, Staphylococcus
ISIPNERGFLPGNGAITSVITV

SEQ ID NO: 2020145 - protein, 22 aa, Staphylococcus
ISIRIPEELLQFEGQTKSKLGT

SEQ ID NO: 2020146 - protein, 17 aa, Staphylococcus
ISISIISGFLGSGKTTL

SEQ ID NO: 2020147 - protein, 17 aa, Staphylococcus
ISISYVIDAENGNKAVE

SEQ ID NO: 2020148 - protein, 18 aa, Staphylococcus
ISISYVIDAENGQRAVEE

SEQ ID NO: 2020149 - protein, 18 aa, Staphylococcus
ISISYVIDAKNGERAVEK

SEQ ID NO: 2020150 - protein, 17 aa, Staphylococcus
ISISYVIDAQNGDRAVQ

SEQ ID NO: 2020151 - protein, 17 aa, Staphylococcus
ISKDLLIPINEVENYPK

SEQ ID NO: 2020152 - protein, 17 aa, Staphylococcus
ISKDLRNKYDWTSEFLD

SEQ ID NO: 2020153 - protein, 19 aa, Staphylococcus
ISKDSPRIMALKPQDDNRD

SEQ ID NO: 2020154 - protein, 17 aa, Staphylococcus
ISKEERADYLLEISRKI

SEQ ID NO: 2020155 - protein, 17 aa, Staphylococcus
ISKEERADYLLEISRRI

SEQ ID NO: 2020156 - protein, 21 aa, Staphylococcus
ISKERLAHFNIDIKQQYQQGV

SEQ ID NO: 2020157 - protein, 18 aa, Staphylococcus
ISKFDVKVISLISMTAND

SEQ ID NO: 2020158 - protein, 17 aa, Staphylococcus
ISKHLFLSYGTIRNYTS

SEQ ID NO: 2020159 - protein, 24 aa, Staphylococcus
ISKIPRFPFDKFEKGERELGTQMK

SEQ ID NO: 2020160 - protein, 19 aa, Staphylococcus
ISKKLGLSLNIINKAKTMI

SEQ ID NO: 2020161 - protein, 21 aa, Staphylococcus
ISKKNAMRTAVKRAKTAISTD

SEQ ID NO: 2020162 - protein, 18 aa, Staphylococcus
ISKLKRKHIHLTMQDIYQ

SEQ ID NO: 2020163 - protein, 20 aa, Staphylococcus
ISKLQGVNGIHIMNLDQSDV

SEQ ID NO: 2020164 - protein, 30 aa, Staphylococcus
ISKLRKMLNIWKQEGKTIIIAEHRLHYLMD

SEQ ID NO: 2020165 - protein, 19 aa, Staphylococcus
ISKMILLDRLFEMLQLNKS

SEQ ID NO: 2020166 - protein, 22 aa, Staphylococcus
ISKNRLVQIANYIKSIFNADMR

SEQ ID NO: 2020167 - protein, 23 aa, Staphylococcus
ISKNSYELLHFVLDKIRQGISAQ

SEQ ID NO: 2020168 - protein, 20 aa, Staphylococcus
ISKQFWAYLVRTGHLTEPGD

SEQ ID NO: 2020169 - protein, 18 aa, Staphylococcus
ISKQFWAYLVRTGQLENP

SEQ ID NO: 2020170 - protein, 22 aa, Staphylococcus
ISKSFDGEDIFNHVNFEVKTGE

SEQ ID NO: 2020171 - protein, 22 aa, Staphylococcus
ISKSFDGEDIFTDVDFEVKTGE

SEQ ID NO: 2020172 - protein, 22 aa, Staphylococcus
ISKSFDGEDIFTNVDFEIKTGE

SEQ ID NO: 2020173 - protein, 22 aa, Staphylococcus
ISKSFDGEDIFTNVDFEVKTGE

SEQ ID NO: 2020174 - protein, 23 aa, Staphylococcus
ISKSFDGEDIFTRVNFEVKTGER

SEQ ID NO: 2020175 - protein, 25 aa, Staphylococcus
ISKSLCYPIDGIIYSAGLGFFKSIQ

SEQ ID NO: 2020176 - protein, 28 aa, Staphylococcus
ISKTGTIEVYKLFFIETYQTVYQMTSMV

SEQ ID NO: 2020177 - protein, 18 aa, Staphylococcus
ISKVFGVKSISPVMKIEK

SEQ ID NO: 2020178 - protein, 18 aa, Staphylococcus
ISKYVALHPGDIIATGTP

SEQ ID NO: 2020179 - protein, 20 aa, Staphylococcus
ISLDDFRILKSELFGDRSRH

SEQ ID NO: 2020180 - protein, 21 aa, Staphylococcus
ISLDDFRILKSTLYGDQSRTT

SEQ ID NO: 2020181 - protein, 25 aa, Staphylococcus
ISLDDFRIVKDQLFGNGERSTENRG

SEQ ID NO: 2020182 - protein, 19 aa, Staphylococcus
ISLDVFVHGEFERNDMVEF

SEQ ID NO: 2020183 - protein, 23 aa, Staphylococcus
ISLEKSKAFEFIIEGDTLIPPFI

SEQ ID NO: 2020184 - protein, 18 aa, Staphylococcus
ISLEPCTHFGSTPPCVNK

SEQ ID NO: 2020185 - protein, 20 aa, Staphylococcus
ISLIEIKKAGTLNQGTIRFM

SEQ ID NO: 2020186 - protein, 27 aa, Staphylococcus
ISLKTLSAIACRGGLLKPIVGGTYYIN

SEQ ID NO: 2020187 - protein, 18 aa, Staphylococcus
ISLLCLDLGITLEEYQKV

SEQ ID NO: 2020188 - protein, 22 aa, Staphylococcus
ISLNCHPDVNILIGENAQGKTN

SEQ ID NO: 2020189 - protein, 26 aa, Staphylococcus
ISLRTEPKLSLPTARSIIAIAVGYPN

SEQ ID NO: 2020190 - protein, 17 aa, Staphylococcus
ISLSYAKGIGATRAGVI

SEQ ID NO: 2020191 - protein, 19 aa, Staphylococcus
ISLTYKLSDYLTHVVNKEI

SEQ ID NO: 2020192 - protein, 17 aa, Staphylococcus
ISLYGYYPSAYVKEKVE

SEQ ID NO: 2020193 - protein, 18 aa, Staphylococcus
ISLYNVFVEKDCSIVEIN

SEQ ID NO: 2020194 - protein, 24 aa, Staphylococcus
ISMKRAGADLIITYFAKDICRYLD

SEQ ID NO: 2020195 - protein, 23 aa, Staphylococcus
ISMNKLKPFLSIISHPKSFYSLV

SEQ ID NO: 2020196 - protein, 27 aa, Staphylococcus
ISMNRISKELGIGMGTLYRHFKDKSDL

SEQ ID NO: 2020197 - protein, 20 aa, Staphylococcus
ISMVTAYDYPSAKQVEAADI

SEQ ID NO: 2020198 - protein, 23 aa, Staphylococcus
ISNAKFPVLLAGMRSSSEAETEA

SEQ ID NO: 2020199 - protein, 24 aa, Staphylococcus
ISNDEYKETLGFIPNLSEEMKQMF

SEQ ID NO: 2020200 - protein, 29 aa, Staphylococcus
ISNEIPFERAAVFGCAVITGIGAVMNTAQ

SEQ ID NO: 2020201 - protein, 17 aa, Staphylococcus
ISNESPMAKSLIGKKLD

SEQ ID NO: 2020202 - protein, 18 aa, Staphylococcus
ISNGLAYQIKHIVELIEQ

SEQ ID NO: 2020203 - protein, 18 aa, Staphylococcus
ISNGYKVAICEQMEDPRQ

SEQ ID NO: 2020204 - protein, 17 aa, Staphylococcus
ISNKGCYEEILAIINDE

SEQ ID NO: 2020205 - protein, 17 aa, Staphylococcus
ISNKTLYLLDVLQKLPI

SEQ ID NO: 2020206 - protein, 22 aa, Staphylococcus
ISNLKGFRFNVNGTLPIDKAFV

SEQ ID NO: 2020207 - protein, 18 aa, Staphylococcus
ISNNFSFQFYNSGIMKNG

SEQ ID NO: 2020208 - protein, 23 aa, Staphylococcus
ISNRGHDSIAIFTVVDDGKGINP

SEQ ID NO: 2020209 - protein, 21 aa, Staphylococcus
ISNTAEFGDYVSGPRIITPDV

SEQ ID NO: 2020210 - protein, 23 aa, Staphylococcus
ISNTESYGLVHFDIYKPNAEETH

SEQ ID NO: 2020211 - protein, 19 aa, Staphylococcus
ISNTPILTIELEDMLKVLP

SEQ ID NO: 2020212 - protein, 29 aa, Staphylococcus
ISPCGKCYYCKKGIYAHCEKDGGWILGHL

SEQ ID NO: 2020213 - protein, 25 aa, Staphylococcus
ISPDDFKFGLSFLTKAVSLSRFQWL

SEQ ID NO: 2020214 - protein, 22 aa, Staphylococcus
ISPEGASALLWKDSNLAKIAAE

SEQ ID NO: 2020215 - protein, 19 aa, Staphylococcus
ISPELFFQKGRFKEQENVV

SEQ ID NO: 2020216 - protein, 20 aa, Staphylococcus
ISPGPCKPSDYPVLSTIISH

SEQ ID NO: 2020217 - protein, 27 aa, Staphylococcus
ISPKEAKNIFGKYVFHTNEFHLSDHEL

SEQ ID NO: 2020218 - protein, 17 aa, Staphylococcus
ISPKPKDAPGFPVRAFA

SEQ ID NO: 2020219 - protein, 24 aa, Staphylococcus
ISPSVWYPDFVKFMKSQPIINSTH

SEQ ID NO: 2020220 - protein, 22 aa, Staphylococcus
ISPSVWYPEFIDFMKQQQAINA

SEQ ID NO: 2020221 - protein, 18 aa, Staphylococcus
ISPWNFAYAIMAGTTVAP

SEQ ID NO: 2020222 - protein, 19 aa, Staphylococcus
ISQAKGIGFDLDFEDVDKV

SEQ ID NO: 2020223 - protein, 17 aa, Staphylococcus
ISQDLWDKVQARKKQVS

SEQ ID NO: 2020224 - protein, 20 aa, Staphylococcus
ISQFKPDAILSISDEQAIGI

SEQ ID NO: 2020225 - protein, 21 aa, Staphylococcus
ISRAREAGVDRMFVVGFDTKT

SEQ ID NO: 2020226 - protein, 17 aa, Staphylococcus
ISREQMGVFKLLNEHGS

SEQ ID NO: 2020227 - protein, 26 aa, Staphylococcus
ISRPGLEMAGYFSHYAADRIQLLGTT

SEQ ID NO: 2020228 - protein, 23 aa, Staphylococcus
ISRPGLEMAGYFSHYASDRIQLL

SEQ ID NO: 2020229 - protein, 23 aa, Staphylococcus
ISRQRVWGVPLPVFYTENGDIIM

SEQ ID NO: 2020230 - protein, 28 aa, Staphylococcus
ISSCGKCYYCKKGIYAHCENDGGWILGH

SEQ ID NO: 2020231 - protein, 29 aa, Staphylococcus
ISSCGKCYYCKKGIYAHCENGGGWILGHL

SEQ ID NO: 2020232 - protein, 25 aa, Staphylococcus
ISSDEFKFGLSFLTRSVSLARFPWL

SEQ ID NO: 2020233 - protein, 24 aa, Staphylococcus
ISSEEKYYRFGIQNVSSHLDYIKQ

SEQ ID NO: 2020234 - protein, 27 aa, Staphylococcus
ISSEIIKEFNLSPIVRKILESKSITQY

SEQ ID NO: 2020235 - protein, 17 aa, Staphylococcus
ISSEILLKAAKIGVGVI

SEQ ID NO: 2020236 - protein, 27 aa, Staphylococcus
ISSFVYRRKLPFNAERFKDWFDHLPSN

SEQ ID NO: 2020237 - protein, 20 aa, Staphylococcus
ISSGKLRRYISWDNIKDIFK

SEQ ID NO: 2020238 - protein, 33 aa, Staphylococcus
ISSIFKDLLKQVCSLKYVLRVNDLLVPDIEIKL

SEQ ID NO: 2020239 - protein, 20 aa, Staphylococcus
ISSKRKAVVHGFTQLMIEHQ

SEQ ID NO: 2020240 - protein, 17 aa, Staphylococcus
ISSLKNRGAKNIRFMCL

SEQ ID NO: 2020241 - protein, 18 aa, Staphylococcus
ISSSFIKVIDGVRILFVA

SEQ ID NO: 2020242 - protein, 18 aa, Staphylococcus
ISSYRFIIHNSGATRDSI

SEQ ID NO: 2020243 - protein, 19 aa, Staphylococcus
ISSYYKFKQPSLLYDQQIQ

SEQ ID NO: 2020244 - protein, 23 aa, Staphylococcus
ISTEEAFKQLIEFENDFDQKLKN

SEQ ID NO: 2020245 - protein, 29 aa, Staphylococcus
ISTGVGMAYIRKGELVSGVNGNFGEIGHT

SEQ ID NO: 2020246 - protein, 17 aa, Staphylococcus
ISTLGWDPGDQIQISED

SEQ ID NO: 2020247 - protein, 20 aa, Staphylococcus
ISTLHSFCLKIIQQHYDVID

SEQ ID NO: 2020248 - protein, 26 aa, Staphylococcus
ISTNLNGAVVFLGFDYGFRGNSRYLF

SEQ ID NO: 2020249 - protein, 21 aa, Staphylococcus
ISTPMFHVLGFNDLTIPLLMA

SEQ ID NO: 2020250 - protein, 19 aa, Staphylococcus
ISTRFSKNYVDSIVASTNL

SEQ ID NO: 2020251 - protein, 18 aa, Staphylococcus
ISTTASFVVASADSSIIK

SEQ ID NO: 2020252 - protein, 17 aa, Staphylococcus
ISTTVSFIVASAGIPVI

SEQ ID NO: 2020253 - protein, 17 aa, Staphylococcus
ISTTVSFVVAAANVNVL

SEQ ID NO: 2020254 - protein, 29 aa, Staphylococcus
ISTYDLLYRVGFNPDVDFVIRVGKPALSK

SEQ ID NO: 2020255 - protein, 20 aa, Staphylococcus
ISVAVGKSFLDAVGSSVGPL

SEQ ID NO: 2020256 - protein, 19 aa, Staphylococcus
ISVDLPFAQKRWCAANGLD

SEQ ID NO: 2020257 - protein, 25 aa, Staphylococcus
ISVELRPSSLDDLGLEAAFKSYFKH

SEQ ID NO: 2020258 - protein, 17 aa, Staphylococcus
ISVIASIAVSEVEGVTG

SEQ ID NO: 2020259 - protein, 17 aa, Staphylococcus
ISVKGARSNNLKGIDVD

SEQ ID NO: 2020260 - protein, 19 aa, Staphylococcus
ISVNCGKGTYIRTLATDIG

SEQ ID NO: 2020261 - protein, 25 aa, Staphylococcus
ISVPEARLLVISPYDKSSVGNIEKA

SEQ ID NO: 2020262 - protein, 19 aa, Staphylococcus
ISVPLQYLIAAALEVTDVT

SEQ ID NO: 2020263 - protein, 19 aa, Staphylococcus
ISVSGDYPALLVFHQDTFG

SEQ ID NO: 2020264 - protein, 17 aa, Staphylococcus
ISVTTWGRYRYYKIDND

SEQ ID NO: 2020265 - protein, 27 aa, Staphylococcus
ISVWKQFKSVFYFGTFDSPKQHDTIPV

SEQ ID NO: 2020266 - protein, 22 aa, Staphylococcus
ISWRVARGFVVGKKLKKKPTLI

SEQ ID NO: 2020267 - protein, 17 aa, Staphylococcus
ISYAIKLFNYILKNKNT

SEQ ID NO: 2020268 - protein, 24 aa, Staphylococcus
ISYASKAFTCLQMVKLVQEEGLEL

SEQ ID NO: 2020269 - protein, 26 aa, Staphylococcus
ISYFKFLNKFLNKIGIIRKVYGNLIY

SEQ ID NO: 2020270 - protein, 26 aa, Staphylococcus
ISYGLGFQLEHIVKWISEGHSTEEIV

SEQ ID NO: 2020271 - protein, 18 aa, Staphylococcus
ISYGLGYQIEHIVDLVEK

SEQ ID NO: 2020272 - protein, 25 aa, Staphylococcus
ISYHKDLPGMVGLTGQLLGKHDINI

SEQ ID NO: 2020273 - protein, 17 aa, Staphylococcus
ISYIPKVGYYDKITHAH

SEQ ID NO: 2020274 - protein, 25 aa, Staphylococcus
ISYLSSDLFKGIGKKTAQNIVNALG

SEQ ID NO: 2020275 - protein, 25 aa, Staphylococcus
ISYLSSDLFKGIGKKTAQNIVNTLG

SEQ ID NO: 2020276 - protein, 26 aa, Staphylococcus
ISYPQEPRMPFSIITASRLASEKHVD

SEQ ID NO: 2020277 - protein, 18 aa, Staphylococcus
ISYQAAKVALDIFDEHMD

SEQ ID NO: 2020278 - protein, 25 aa, Staphylococcus
ITACKLKGIRAALAHDVYSAERAQL

SEQ ID NO: 2020279 - protein, 46 aa, Staphylococcus
ITAENVIFIGLLCRNGQWFAIVYEIGFGRTRELSILNIVDISYSFE

SEQ ID NO: 2020280 - protein, 18 aa, Staphylococcus
ITAFGTGIGGEFDLSKAR

SEQ ID NO: 2020281 - protein, 22 aa, Staphylococcus
ITAIGFCRDGNFSVYSHPERIE

SEQ ID NO: 2020282 - protein, 18 aa, Staphylococcus
ITAIGFIRDGNFNIYSHP

SEQ ID NO: 2020283 - protein, 18 aa, Staphylococcus
ITARSLLSKVLVRATKKW

SEQ ID NO: 2020284 - protein, 25 aa, Staphylococcus
ITASEPAKIFGLVHKGSIAVGKDAD

SEQ ID NO: 2020285 - protein, 17 aa, Staphylococcus
ITASWFTSSLFNVFIDL

SEQ ID NO: 2020286 - protein, 19 aa, Staphylococcus
ITAVGFIRDGNFNIYSHPE

SEQ ID NO: 2020287 - protein, 23 aa, Staphylococcus
ITCETCTHYLYFYKEELDDIGAI

SEQ ID NO: 2020288 - protein, 17 aa, Staphylococcus
ITCPLDEGVELFVGVPS

SEQ ID NO: 2020289 - protein, 17 aa, Staphylococcus
ITDEFKLAEELKHIDKH

SEQ ID NO: 2020290 - protein, 23 aa, Staphylococcus
ITDEGLEGWGEPVIEGKAATVKA

SEQ ID NO: 2020291 - protein, 26 aa, Staphylococcus
ITDERRGDNGFGYDPVFYVPEKGRTM

SEQ ID NO: 2020292 - protein, 23 aa, Staphylococcus
ITDKTILVSIMFVNNEVGTVQNM

SEQ ID NO: 2020293 - protein, 19 aa, Staphylococcus
ITDNGLLHFTNLGGVANDI

SEQ ID NO: 2020294 - protein, 28 aa, Staphylococcus
ITDYAKSIPFEFASYMSASKFFKDYALK

SEQ ID NO: 2020295 - protein, 18 aa, Staphylococcus
ITDYCREKGFLTLTYQDG

SEQ ID NO: 2020296 - protein, 32 aa, Staphylococcus
ITDYSSICFYAYAGGSKVIFFWGDKEESEKQY

SEQ ID NO: 2020297 - protein, 20 aa, Staphylococcus
ITDYSSIFFDFLVTDKPIIF

SEQ ID NO: 2020298 - protein, 17 aa, Staphylococcus
ITDYSSVMFDFANTKKP

SEQ ID NO: 2020299 - protein, 19 aa, Staphylococcus
ITEDHFVKIALRIKDEDLV

SEQ ID NO: 2020300 - protein, 25 aa, Staphylococcus
ITEETIGFVIGPRLNAVGRLDDASL

SEQ ID NO: 2020301 - protein, 25 aa, Staphylococcus
ITEIIPSYRAILIYFDNKRIEGNEL

SEQ ID NO: 2020302 - protein, 22 aa, Staphylococcus
ITEKVLIDFIKKLADLYEVTYL

SEQ ID NO: 2020303 - protein, 17 aa, Staphylococcus
ITENSDLEGRAFLHNYD

SEQ ID NO: 2020304 - protein, 29 aa, Staphylococcus
ITEPEPSFSTCFGAPFLPLNPTVYADLLG

SEQ ID NO: 2020305 - protein, 30 aa, Staphylococcus
ITEPVPSFSTCFGAPFLPLNPKRYAELLGQ

SEQ ID NO: 2020306 - protein, 21 aa, Staphylococcus
ITERHARAVLVLPEDEQEELI

SEQ ID NO: 2020307 - protein, 18 aa, Staphylococcus
ITERVLRSETDMLKKQDL

SEQ ID NO: 2020308 - protein, 32 aa, Staphylococcus
ITETGSVVLPGRFFVDIIKKLPGKDVKLSTNE

SEQ ID NO: 2020309 - protein, 17 aa, Staphylococcus
ITFEQYVSFGRVLVSEN

SEQ ID NO: 2020310 - protein, 17 aa, Staphylococcus
ITFKKLGIKVHFVDPSH

SEQ ID NO: 2020311 - protein, 23 aa, Staphylococcus
ITFLKSQGYHIVTIKHHGHDKDD

SEQ ID NO: 2020312 - protein, 25 aa, Staphylococcus
ITFPSNEAETLFTFENGQVIRGKKQ

SEQ ID NO: 2020313 - protein, 20 aa, Staphylococcus
ITGAEFKAELNGEPVPHQTV

SEQ ID NO: 2020314 - protein, 18 aa, Staphylococcus
ITGALLHPSKNILLKEPI

SEQ ID NO: 2020315 - protein, 19 aa, Staphylococcus
ITGAQAWIGTLLQMKPVLK

SEQ ID NO: 2020316 - protein, 19 aa, Staphylococcus
ITGAQAWIGTMLKMKPVLK

SEQ ID NO: 2020317 - protein, 20 aa, Staphylococcus
ITGAQAWVGTLLKMKPVLKF

SEQ ID NO: 2020318 - protein, 19 aa, Staphylococcus
ITGAQAWVGTMLKMKPVLR

SEQ ID NO: 2020319 - protein, 18 aa, Staphylococcus
ITGDGAFQMVMQDFATAV

SEQ ID NO: 2020320 - protein, 17 aa, Staphylococcus
ITGHKFGGPKGVGVLLV

SEQ ID NO: 2020321 - protein, 23 aa, Staphylococcus
ITGHYRNGILLSPIIGQDIANWL

SEQ ID NO: 2020322 - protein, 23 aa, Staphylococcus
ITGHYRNGILLSPVIGRDIANWL

SEQ ID NO: 2020323 - protein, 25 aa, Staphylococcus
ITGKFKKMHVRMMPKQEPPYTRLID

SEQ ID NO: 2020324 - protein, 27 aa, Staphylococcus
ITGLEIPRVLGDIIICTDVAQEQATTY

SEQ ID NO: 2020325 - protein, 22 aa, Staphylococcus
ITGNEAFNFVQYILSNDANNLT

SEQ ID NO: 2020326 - protein, 18 aa, Staphylococcus
ITGSMGKSSTRLMLTAAL

SEQ ID NO: 2020327 - protein, 17 aa, Staphylococcus
ITGSVGFDDFEWGVTLF

SEQ ID NO: 2020328 - protein, 29 aa, Staphylococcus
ITGYDIIFFWVARMIFQGLEFTERRPFQD

SEQ ID NO: 2020329 - protein, 18 aa, Staphylococcus
ITGYPGWAHYGASKAGQL

SEQ ID NO: 2020330 - protein, 27 aa, Staphylococcus
ITHELEWLPHLFVAGGLDDLELGPFGR

SEQ ID NO: 2020331 - protein, 22 aa, Staphylococcus
ITHEMHVIRRICDEVAVMENGK

SEQ ID NO: 2020332 - protein, 22 aa, Staphylococcus
ITHEMHVIRRVCDEVAVMESGR

SEQ ID NO: 2020333 - protein, 20 aa, Staphylococcus
ITHEMHVIRRVCDQVAVMEN

SEQ ID NO: 2020334 - protein, 18 aa, Staphylococcus
ITHGEVDAVLSIASGADE

SEQ ID NO: 2020335 - protein, 19 aa, Staphylococcus
ITHHFKLATILALTATAPP

SEQ ID NO: 2020336 - protein, 19 aa, Staphylococcus
ITHIQQFIAKREIKYQTEA

SEQ ID NO: 2020337 - protein, 18 aa, Staphylococcus
ITHLVYLNSAARITPNTS

SEQ ID NO: 2020338 - protein, 19 aa, Staphylococcus
ITHYFDFISEDGFHQFNEF

SEQ ID NO: 2020339 - protein, 17 aa, Staphylococcus
ITIAYLIKHYNQRVLCI

SEQ ID NO: 2020340 - protein, 22 aa, Staphylococcus
ITIEPGEFVILSGASGSGKSTL

SEQ ID NO: 2020341 - protein, 31 aa, Staphylococcus
ITIESFINFACPFCKNYFKAADHALTPHIES

SEQ ID NO: 2020342 - protein, 26 aa, Staphylococcus
ITIHGFKHYVALLFHKGAIIEDKYET

SEQ ID NO: 2020343 - protein, 17 aa, Staphylococcus
ITIIEWSQFIQDLLPKE

SEQ ID NO: 2020344 - protein, 17 aa, Staphylococcus
ITIKELLLTLEISKQGS

SEQ ID NO: 2020345 - protein, 24 aa, Staphylococcus
ITIKPKTRMAQIFKTSSFYVNSFH

SEQ ID NO: 2020346 - protein, 26 aa, Staphylococcus
ITINGKIDFKEIESIVKRELNFNIDI

SEQ ID NO: 2020347 - protein, 23 aa, Staphylococcus
ITKARQHLAGSFNDNVDVTTSKP

SEQ ID NO: 2020348 - protein, 24 aa, Staphylococcus
ITKDFKALIKFNIRKPNPLLSQYF

SEQ ID NO: 2020349 - protein, 22 aa, Staphylococcus
ITKDPKYLIGRVIARPYVGEPG

SEQ ID NO: 2020350 - protein, 21 aa, Staphylococcus
ITKEEYELIVSLGKGQTKIPR

SEQ ID NO: 2020351 - protein, 19 aa, Staphylococcus
ITKFFHLKKGNTVLFTSDS

SEQ ID NO: 2020352 - protein, 17 aa, Staphylococcus
ITKGLRVPGAFNGFELG

SEQ ID NO: 2020353 - protein, 19 aa, Staphylococcus
ITKLDIQRVLENGYDQADY

SEQ ID NO: 2020354 - protein, 21 aa, Staphylococcus
ITKLTKPLLINAASFFENEEF

SEQ ID NO: 2020355 - protein, 18 aa, Staphylococcus
ITKRLGFEKGHTFETPLV

SEQ ID NO: 2020356 - protein, 20 aa, Staphylococcus
ITKSMVFKIDGEFIMVLVRG

SEQ ID NO: 2020357 - protein, 18 aa, Staphylococcus
ITLAREFDTENVVYIGSS

SEQ ID NO: 2020358 - protein, 32 aa, Staphylococcus; identical to SEQ ID NO: 1668719

SEQ ID NO: 2020359 - protein, 25 aa, Staphylococcus
ITLEKEIPVSAGLGGGSADAAATMR

SEQ ID NO: 2020360 - protein, 22 aa, Staphylococcus
ITLKEGWLYRKMIIKTENERMK

SEQ ID NO: 2020361 - protein, 23 aa, Staphylococcus
ITLNEFYVLYFLKKSEGHSLSIS

SEQ ID NO: 2020362 - protein, 33 aa, Staphylococcus
ITLPKANVLKIYFKEGFIALRPSGTEPKIKLYV

SEQ ID NO: 2020363 - protein, 23 aa, Staphylococcus
ITLRPFVVAIKILQLAKELGVLE

SEQ ID NO: 2020364 - protein, 20 aa, Staphylococcus
ITLTCKASFIPFYEKHGYTN

SEQ ID NO: 2020365 - protein, 23 aa, Staphylococcus
ITMQIEMMYHLNISRMTTSEVHG

SEQ ID NO: 2020366 - protein, 27 aa, Staphylococcus
ITNCLPVFKILFEKRSLHFNVYLLGGE

SEQ ID NO: 2020367 - protein, 23 aa, Staphylococcus
ITNCLPVFKILMNKQSLHFRVYL

SEQ ID NO: 2020368 - protein, 18 aa, Staphylococcus
ITNDISFMQSTILRKKIL

SEQ ID NO: 2020369 - protein, 18 aa, Staphylococcus
ITNFPFYYRGEVYDPFYG

SEQ ID NO: 2020370 - protein, 18 aa, Staphylococcus
ITNFSFYYRGEVYDPFDG

SEQ ID NO: 2020371 - protein, 18 aa, Staphylococcus
ITNGGIFGSMMSTPIING

SEQ ID NO: 2020372 - protein, 17 aa, Staphylococcus
ITNGGVFGSMMSTPIIN

SEQ ID NO: 2020373 - protein, 23 aa, Staphylococcus
ITNGLEPLIFKNCHTEHIVPISP

SEQ ID NO: 2020374 - protein, 20 aa, Staphylococcus
ITNLLQLRQRYFISVTTMKD

SEQ ID NO: 2020375 - protein, 18 aa, Staphylococcus
ITNQVAFVRYHGRNRHGW

SEQ ID NO: 2020376 - protein, 18 aa, Staphylococcus
ITNWFINFYHLIMAQQFG

SEQ ID NO: 2020377 - protein, 17 aa, Staphylococcus
ITPDIPEKVLINASVSI

SEQ ID NO: 2020378 - protein, 30 aa, Staphylococcus
ITPDSIGLILGFLAERFLKNNESMHIADIA

SEQ ID NO: 2020379 - protein, 26 aa, Staphylococcus
ITPDSIGLILGFLVERFMQDKEEMHV

SEQ ID NO: 2020380 - protein, 24 aa, Staphylococcus
ITPDSIGLILGFLVQKFMAKSQEL

SEQ ID NO: 2020381 - protein, 24 aa, Staphylococcus
ITPDSIGLILGFLVQKFTENNEEL

SEQ ID NO: 2020382 - protein, 24 aa, Staphylococcus
ITPDSIGLILGFLVQKFTENNKEL

SEQ ID NO: 2020383 - protein, 24 aa, Staphylococcus
ITPDSIGLILGFLVQRFTQDNDEL

SEQ ID NO: 2020384 - protein, 25 aa, Staphylococcus
ITPDSIGLILGYLVERFTEGKKELN

SEQ ID NO: 2020385 - protein, 24 aa, Staphylococcus
ITPEGMKGLILKSLTSGQRISYEE

SEQ ID NO: 2020386 - protein, 17 aa, Staphylococcus
ITPFSNKVRPLFEAHQV

SEQ ID NO: 2020387 - protein, 25 aa, Staphylococcus
ITPKEIYNLVVYQLGALDGFCKVHQ

SEQ ID NO: 2020388 - protein, 18 aa, Staphylococcus
ITPKLMLQGSVDLLNEVS

SEQ ID NO: 2020389 - protein, 17 aa, Staphylococcus
ITPQLLKHNHIVDRVNS

SEQ ID NO: 2020390 - protein, 24 aa, Staphylococcus
ITPYPPGIPLFFTGERITQNMLKL

SEQ ID NO: 2020391 - protein, 24 aa, Staphylococcus
ITQIPVVCGFGIRTPEQVSEIIQY

SEQ ID NO: 2020392 - protein, 18 aa, Staphylococcus
ITQMKYSLDFVKAELSGY

SEQ ID NO: 2020393 - protein, 20 aa, Staphylococcus
ITQPLDIVFIAVKTYQLETV

SEQ ID NO: 2020394 - protein, 24 aa, Staphylococcus
ITQSKCLVLFTSYRMMHMVQELLN

SEQ ID NO: 2020395 - protein, 20 aa, Staphylococcus
ITRGDIFVRGAIKEHMASLV

SEQ ID NO: 2020396 - protein, 19 aa, Staphylococcus
ITRGDIFVRGAIKEHMSSL

SEQ ID NO: 2020397 - protein, 21 aa, Staphylococcus
ITRIKQMLTRFYAENIEHRRW

SEQ ID NO: 2020398 - protein, 20 aa, Staphylococcus
ITRKNIELINDFKKYSMALP

SEQ ID NO: 2020399 - protein, 18 aa, Staphylococcus
ITRMAYSVLREDHYRVIG

SEQ ID NO: 2020400 - protein, 20 aa, Staphylococcus
ITRPFPTGVRITIGFPEQND

SEQ ID NO: 2020401 - protein, 19 aa, Staphylococcus
ITRPFPTGVRITVGFPEQN

SEQ ID NO: 2020402 - protein, 17 aa, Staphylococcus
ITRTFGIGKPKAQLKEI

SEQ ID NO: 2020403 - protein, 17 aa, Staphylococcus
ITRTKQLLVDAFQKVSK

SEQ ID NO: 2020404 - protein, 19 aa, Staphylococcus
ITSAFIMKNVKGIKVAVIE

SEQ ID NO: 2020405 - protein, 18 aa, Staphylococcus
ITSDWFKNHDYVFFDYKY

SEQ ID NO: 2020406 - protein, 27 aa, Staphylococcus
ITSELEWLPQLFVAGGLADLELGPFAR

SEQ ID NO: 2020407 - protein, 25 aa, Staphylococcus
ITSEPRIKMGMLESTSQWMGKVIKQ

SEQ ID NO: 2020408 - protein, 24 aa, Staphylococcus
ITSFAEACILAFNHTKKNKIVVSK

SEQ ID NO: 2020409 - protein, 18 aa, Staphylococcus
ITSLKKRGAKNIRFMCLI

SEQ ID NO: 2020410 - protein, 26 aa, Staphylococcus
ITSLPNQYKLLGLLLYAIPKSIRNLG

SEQ ID NO: 2020411 - protein, 25 aa, Staphylococcus
ITSQSTKHFWVWSKKFVNKAYISVQ

SEQ ID NO: 2020412 - protein, 21 aa, Staphylococcus
ITSSIPPHFDKYISELANFDD

SEQ ID NO: 2020413 - protein, 18 aa, Staphylococcus
ITSSTAFVRYHGRNQHGW

SEQ ID NO: 2020414 - protein, 17 aa, Staphylococcus
ITSTARMDGLLNISDYD

SEQ ID NO: 2020415 - protein, 27 aa, Staphylococcus
ITSYRIHKGFHMLKFEGINNINDIEQY

SEQ ID NO: 2020416 - protein, 17 aa, Staphylococcus
ITTERKGDYGFGYDPIF

SEQ ID NO: 2020417 - protein, 18 aa, Staphylococcus
ITTETAFVRYHGRNRQGW

SEQ ID NO: 2020418 - protein, 17 aa, Staphylococcus
ITTHLGSVFGIKKSKKQ

SEQ ID NO: 2020419 - protein, 29 aa, Staphylococcus
ITTKDALKLFVYDYSDYYILKVLNIYSVL

SEQ ID NO: 2020420 - protein, 24 aa, Staphylococcus
ITTKDRNAVLMSEDDYDAIMETLY

SEQ ID NO: 2020421 - protein, 24 aa, Staphylococcus
ITTRSCEILRKVMLENKKSTKWDS

SEQ ID NO: 2020422 - protein, 18 aa, Staphylococcus
ITVAREYKTNNVVYIGSS

SEQ ID NO: 2020423 - protein, 19 aa, Staphylococcus
ITVDSYLKWINDDINQHTI

SEQ ID NO: 2020424 - protein, 19 aa, Staphylococcus
ITVIPTMVSPSMKLTRDIP

SEQ ID NO: 2020425 - protein, 18 aa, Staphylococcus
ITVYAHTLIPPLIAYIQD

SEQ ID NO: 2020426 - protein, 18 aa, Staphylococcus
ITYDIAQQVVDDYLQIDE

SEQ ID NO: 2020427 - protein, 20 aa, Staphylococcus
ITYFIKAIIFKTLQQAKQIG

SEQ ID NO: 2020428 - protein, 24 aa, Staphylococcus
ITYMKRQGLTIGVIGLTTQFIPHW

SEQ ID NO: 2020429 - protein, 26 aa, Staphylococcus
ITYNYDEFYQLLLIKLWEISKIYTPS

SEQ ID NO: 2020430 - protein, 26 aa, Staphylococcus
ITYNYDEFYQLLLIQLWHLTHHYQPS

SEQ ID NO: 2020431 - protein, 17 aa, Staphylococcus
ITYPTAPFNGWYMVTEI

SEQ ID NO: 2020432 - protein, 17 aa, Staphylococcus
IVAAGAWTSKLLTQYSL

SEQ ID NO: 2020433 - protein, 18 aa, Staphylococcus
IVAAGGIMDGRGVLASMI

SEQ ID NO: 2020434 - protein, 20 aa, Staphylococcus
IVAAPVLALSLSFDHRQIDG

SEQ ID NO: 2020435 - protein, 20 aa, Staphylococcus
IVAAPVLSLSLSFDHRQIDG

SEQ ID NO: 2020436 - protein, 17 aa, Staphylococcus
IVADCKKVLEALSQRFT

SEQ ID NO: 2020437 - protein, 20 aa, Staphylococcus
IVADCKKVLEALVTEHQSHA

SEQ ID NO: 2020438 - protein, 25 aa, Staphylococcus
IVAGRGELHLSILIENMRREGFELQ

SEQ ID NO: 2020439 - protein, 23 aa, Staphylococcus
IVAHPNMQFHIAALTEMSSKLMA

SEQ ID NO: 2020440 - protein, 18 aa, Staphylococcus
IVAKAIGIPPSLIHGEMA

SEQ ID NO: 2020441 - protein, 17 aa, Staphylococcus
IVAKRVDAFVTVSHAAK

SEQ ID NO: 2020442 - protein, 17 aa, Staphylococcus
IVANMAVGYDNIDISLA

SEQ ID NO: 2020443 - protein, 21 aa, Staphylococcus
IVAPFDIRDVFLARIDNEIKS

SEQ ID NO: 2020444 - protein, 20 aa, Staphylococcus
IVASGYRGALPHGVASDKII

SEQ ID NO: 2020445 - protein, 20 aa, Staphylococcus
IVASGYRGALPHGVASDKKI

SEQ ID NO: 2020446 - protein, 20 aa, Staphylococcus
IVASGYRGALPHGVASDKRI

SEQ ID NO: 2020447 - protein, 23 aa, Staphylococcus
IVASRIVETYGLPTLILNIDDEQ

SEQ ID NO: 2020448 - protein, 18 aa, Staphylococcus
IVASRLDKGISFTEFAYQ

SEQ ID NO: 2020449 - protein, 23 aa, Staphylococcus
IVCGLKSAYILKDTSEAFKKDAH

SEQ ID NO: 2020450 - protein, 33 aa, Staphylococcus
IVCHYGETLFFKACERAGVYGLIIPDLPFELGQ

SEQ ID NO: 2020451 - protein, 17 aa, Staphylococcus
IVCPVSGTANWTDIRQF

SEQ ID NO: 2020452 - protein, 20 aa, Staphylococcus
IVCYNFMPVFDWTRSQLDYR

SEQ ID NO: 2020453 - protein, 18 aa, Staphylococcus
IVDDKWNYAARVDATNTI

SEQ ID NO: 2020454 - protein, 22 aa, Staphylococcus
IVDGCPDYFTTLGYASAAQHHI

SEQ ID NO: 2020455 - protein, 24 aa, Staphylococcus
IVDIALKEEVDFVLIAGDLFDSNN

SEQ ID NO: 2020456 - protein, 20 aa, Staphylococcus
IVDMEMEGLLQLINPKIKKQ

SEQ ID NO: 2020457 - protein, 18 aa, Staphylococcus
IVDMEMEGLLQLINPTII

SEQ ID NO: 2020458 - protein, 24 aa, Staphylococcus
IVDVALKEDVDFMLIVGDLFDSEN

SEQ ID NO: 2020459 - protein, 25 aa, Staphylococcus
IVDVGCGYGPIGLTIAKVCPHHKVT

SEQ ID NO: 2020460 - protein, 22 aa, Staphylococcus
IVEALYRKGYAITVIGNEANRK

SEQ ID NO: 2020461 - protein, 17 aa, Staphylococcus
IVEDFVIIEKPMRAYSD

SEQ ID NO: 2020462 - protein, 25 aa, Staphylococcus
IVEEVLKKSGYRDMLEREQTLESRS

SEQ ID NO: 2020463 - protein, 23 aa, Staphylococcus
IVEEVLTKTGYRDMLEREQTLES

SEQ ID NO: 2020464 - protein, 20 aa, Staphylococcus
IVEFGGWAMPVQFTSIKKEH

SEQ ID NO: 2020465 - protein, 18 aa, Staphylococcus
IVEHGAFQYLSSVTDDYD

SEQ ID NO: 2020466 - protein, 25 aa, Staphylococcus
IVEHMKRSGFEIVSINHDNSWVCIV

SEQ ID NO: 2020467 - protein, 22 aa, Staphylococcus
IVEIKPRMNIATGHQYLQAIVD

SEQ ID NO: 2020468 - protein, 24 aa, Staphylococcus
IVEKELKRTPSFQVSKPEEDTGIT

SEQ ID NO: 2020469 - protein, 24 aa, Staphylococcus
IVEKELKRTPSFSVSKPDEEAGVT

SEQ ID NO: 2020470 - protein, 25 aa, Staphylococcus
IVEKGELGGVCLNVGCIPSKALLHA

SEQ ID NO: 2020471 - protein, 25 aa, Staphylococcus
IVEKGELGGVCLNVGCIPSKALLHV

SEQ ID NO: 2020472 - protein, 26 aa, Staphylococcus
IVEKSLRGAVIWDELKDRLNENAYGL

SEQ ID NO: 2020473 - protein, 18 aa, Staphylococcus
IVELKKLISGRNVATSYH

SEQ ID NO: 2020474 - protein, 18 aa, Staphylococcus
IVEPLSLDEAYLDITHLV

SEQ ID NO: 2020475 - protein, 17 aa, Staphylococcus
IVERGGIDQIVIESTGI

SEQ ID NO: 2020476 - protein, 17 aa, Staphylococcus
IVESITLESVNETSKMG

SEQ ID NO: 2020477 - protein, 32 aa, Staphylococcus
IVETGSVVLPGRFFVDIIKKLPGKEVKLSTNE

SEQ ID NO: 2020478 - protein, 17 aa, Staphylococcus
IVFDVMLASYIIDPSRT

SEQ ID NO: 2020479 - protein, 18 aa, Staphylococcus
IVFIGRLSPEKGIDLLIQ

SEQ ID NO: 2020480 - protein, 19 aa, Staphylococcus
IVFNAHIPITMVGLDVARG

SEQ ID NO: 2020481 - protein, 17 aa, Staphylococcus
IVFSGAMVVGGQLSYEN

SEQ ID NO: 2020482 - protein, 17 aa, Staphylococcus
IVFTFNIGKVPMKQIKT

SEQ ID NO: 2020483 - protein, 17 aa, Staphylococcus
IVGCKPEQVTSPYMNHH

SEQ ID NO: 2020484 - protein, 19 aa, Staphylococcus
IVGDNFFKKTKPNLQIINV

SEQ ID NO: 2020485 - protein, 19 aa, Staphylococcus
IVGEFEFERSFRMGEVIYL

SEQ ID NO: 2020486 - protein, 26 aa, Staphylococcus
IVGGDCPKVKAKPCITQVKYSLEFLG

SEQ ID NO: 2020487 - protein, 17 aa, Staphylococcus
IVGGGVIGMEFASLLND

SEQ ID NO: 2020488 - protein, 18 aa, Staphylococcus
IVGHTAWYDYSYADDKFD

SEQ ID NO: 2020489 - protein, 18 aa, Staphylococcus
IVGHTAWYDYSYADKKFE

SEQ ID NO: 2020490 - protein, 23 aa, Staphylococcus
IVGHTGWYDYAFANGKFSLEKLE

SEQ ID NO: 2020491 - protein, 18 aa, Staphylococcus
IVGHTGWYDYSYADKRFS

SEQ ID NO: 2020492 - protein, 24 aa, Staphylococcus
IVGKIGRKAIAEYLPKIKQSHRPT

SEQ ID NO: 2020493 - protein, 18 aa, Staphylococcus
IVGLGAHLKQGERHAEVQ

SEQ ID NO: 2020494 - protein, 17 aa, Staphylococcus
IVGLMTMAPYTDDKDYI

SEQ ID NO: 2020495 - protein, 20 aa, Staphylococcus
IVGNSGWYDYTFASSEYTTE

SEQ ID NO: 2020496 - protein, 18 aa, Staphylococcus
IVGNTGWYDYSYASPEFS

SEQ ID NO: 2020497 - protein, 24 aa, Staphylococcus
IVGRGGGSIEDLWNFNEEEVVKAI

SEQ ID NO: 2020498 - protein, 23 aa, Staphylococcus
IVGRTGALLGREQINIASMSLGR

SEQ ID NO: 2020499 - protein, 18 aa, Staphylococcus
IVGSFLRPEALKKARAQF

SEQ ID NO: 2020500 - protein, 27 aa, Staphylococcus
IVGYEIKTGAPLIYELDDNLGFVSKHY

SEQ ID NO: 2020501 - protein, 25 aa, Staphylococcus
IVGYEIKTGAPLIYELTDDLQVIDK

SEQ ID NO: 2020502 - protein, 25 aa, Staphylococcus
IVGYEIKTGAPLVYELTDDLEVKDK

SEQ ID NO: 2020503 - protein, 17 aa, Staphylococcus
IVHEAFYLANSGRKGPV

SEQ ID NO: 2020504 - protein, 17 aa, Staphylococcus
IVHEAFYLANTGRKGPV

SEQ ID NO: 2020505 - protein, 24 aa, Staphylococcus
IVHECREAGLPCYFTMDAGPNVKV

SEQ ID NO: 2020506 - protein, 27 aa, Staphylococcus
IVHECRKMGVPCYFTMDAGPNVKVLVE

SEQ ID NO: 2020507 - protein, 19 aa, Staphylococcus
IVIGGMYEYGLSRYFTAML

SEQ ID NO: 2020508 - protein, 21 aa, Staphylococcus
IVINFSSRFADVTAEDFVQNY

SEQ ID NO: 2020509 - protein, 26 aa, Staphylococcus
IVINFSSRFANVTAEEFIKDYIINNH

SEQ ID NO: 2020510 - protein, 18 aa, Staphylococcus
IVIPCHRVVGQDNHLTGY

SEQ ID NO: 2020511 - protein, 30 aa, Staphylococcus
IVITFNYRLGALGFLDWSYFNAHYDKNNGL

SEQ ID NO: 2020512 - protein, 17 aa, Staphylococcus
IVIVGGGKVATKRASTL

SEQ ID NO: 2020513 - protein, 18 aa, Staphylococcus
IVIYTFNDTTGWNSDFNI

SEQ ID NO: 2020514 - protein, 25 aa, Staphylococcus
IVKDLQPKFELMRQFIYPGTTGVTV

SEQ ID NO: 2020515 - protein, 26 aa, Staphylococcus
IVKELNTRLGWEISEAREFKFEHNGD

SEQ ID NO: 2020516 - protein, 22 aa, Staphylococcus
IVKGHNAYGYLKAEKGVHRLVR

SEQ ID NO: 2020517 - protein, 18 aa, Staphylococcus
IVKIGVFGTFSAGKSSLI

SEQ ID NO: 2020518 - protein, 19 aa, Staphylococcus
IVKKCKLYEDVGFKKDPIK

SEQ ID NO: 2020519 - protein, 26 aa, Staphylococcus
IVKKFPIPHISTGDMFRKAIKDQTEL

SEQ ID NO: 2020520 - protein, 19 aa, Staphylococcus
IVKLISDYDLKYIIDGDFD

SEQ ID NO: 2020521 - protein, 24 aa, Staphylococcus
IVLARRRLIKFDKKISIPYILTRA

SEQ ID NO: 2020522 - protein, 21 aa, Staphylococcus
IVLDLKGKVQITRETTETLLS

SEQ ID NO: 2020523 - protein, 32 aa, Staphylococcus
IVLFLNRRGYASFMLCRDCGYVPQCPNCDISL

SEQ ID NO: 2020524 - protein, 17 aa, Staphylococcus
IVLIEWSQFISEYLPET

SEQ ID NO: 2020525 - protein, 23 aa, Staphylococcus
IVLPEMWNNGYALNQLKDKADID

SEQ ID NO: 2020526 - protein, 23 aa, Staphylococcus
IVLRKTISGYHIVVGERRFRAAT

SEQ ID NO: 2020527 - protein, 25 aa, Staphylococcus
IVLTTEYYWHWDLKNSGLDVYEYKK

SEQ ID NO: 2020528 - protein, 27 aa, Staphylococcus
IVLTTEYYWHWDLKQAKLDVFEYKKVM

SEQ ID NO: 2020529 - protein, 33 aa, Staphylococcus
IVMGHEAYYPKFGFKKASHWGIQAPFEVPDELL

SEQ ID NO: 2020530 - protein, 19 aa, Staphylococcus
IVMSSRIRLARNLENHVHP

SEQ ID NO: 2020531 - protein, 22 aa, Staphylococcus
IVNCNQLGAGVQLELTSALRKQ

SEQ ID NO: 2020532 - protein, 23 aa, Staphylococcus
IVNCTKNGVGVQIELTSSLRKSL

SEQ ID NO: 2020533 - protein, 22 aa, Staphylococcus
IVNDAIEKARHLSFQTEDMKRQ

SEQ ID NO: 2020534 - protein, 24 aa, Staphylococcus
IVNDFKKLLSVESMHVDRKGKTQV

SEQ ID NO: 2020535 - protein, 17 aa, Staphylococcus
IVNEARSARAYGSAALE

SEQ ID NO: 2020536 - protein, 19 aa, Staphylococcus
IVNERYLKDQTPLFEHGLD

SEQ ID NO: 2020537 - protein, 17 aa, Staphylococcus
IVNEVLDNTEFVHQSFF

SEQ ID NO: 2020538 - protein, 17 aa, Staphylococcus
IVNFKNGEHCFASVRNV

SEQ ID NO: 2020539 - protein, 19 aa, Staphylococcus
IVNGACYILALPEIFNKVD

SEQ ID NO: 2020540 - protein, 17 aa, Staphylococcus
IVNKAGNVCGMMPHPER

SEQ ID NO: 2020541 - protein, 24 aa, Staphylococcus
IVNLDIRAQYGINIIAIKRGKEII

SEQ ID NO: 2020542 - protein, 18 aa, Staphylococcus
IVNRVAPWNFKRTKFPQV

SEQ ID NO: 2020543 - protein, 18 aa, Staphylococcus
IVNTWPNGLIVLSGQSGV

SEQ ID NO: 2020544 - protein, 25 aa, Staphylococcus
IVPDRRLAALKTHFYRYSLAERQRV

SEQ ID NO: 2020545 - protein, 22 aa, Staphylococcus
IVPELQRRGLYRHQYKGSTLRE

SEQ ID NO: 2020546 - protein, 23 aa, Staphylococcus
IVPENQSAVILFKSLGFIIEGEL

SEQ ID NO: 2020547 - protein, 18 aa, Staphylococcus
IVPIWKKEIWEDGSEWQG

SEQ ID NO: 2020548 - protein, 24 aa, Staphylococcus
IVPKTRRVASLIVHKLYNYPSEQL

SEQ ID NO: 2020549 - protein, 21 aa, Staphylococcus
IVPLSELFFRDEQTLGDDEQE

SEQ ID NO: 2020550 - protein, 21 aa, Staphylococcus
IVPTTHILKGMKRRYAALMGI

SEQ ID NO: 2020551 - protein, 32 aa, Staphylococcus
IVQALHFFSLVFKNPYLRQEEEIRYIIFNINE

SEQ ID NO: 2020552 - protein, 18 aa, Staphylococcus
IVQEEVFGPVVTVEGFDN

SEQ ID NO: 2020553 - protein, 17 aa, Staphylococcus
IVQEVKRDKAAIKDIEM

SEQ ID NO: 2020554 - protein, 18 aa, Staphylococcus
IVQFYTDLNTDGRFLNVG

SEQ ID NO: 2020555 - protein, 17 aa, Staphylococcus
IVQKEHLVVLEAAFTLA

SEQ ID NO: 2020556 - protein, 24 aa, Staphylococcus
IVQWLEKYQTLGIGNSGLVDRFYF

SEQ ID NO: 2020557 - protein, 22 aa, Staphylococcus
IVRAKGIVWLAQYNHVACLLSQ

SEQ ID NO: 2020558 - protein, 23 aa, Staphylococcus
IVRAKGIVWLAQYNQVACLLSQA

SEQ ID NO: 2020559 - protein, 38 aa, Staphylococcus
IVRDADRLDAIGAIGIARAFQFSGHFNEPMWTESPHSD

SEQ ID NO: 2020560 - protein, 26 aa, Staphylococcus
IVRDADRLDAIGAIGIARTFQFSGHF

SEQ ID NO: 2020561 - protein, 26 aa, Staphylococcus
IVRGTTCKRIVKMLKDSGADEVHVRI

SEQ ID NO: 2020562 - protein, 17 aa, Staphylococcus
IVRHSPCDVLVVRTEEL

SEQ ID NO: 2020563 - protein, 26 aa, Staphylococcus
IVRHYRPEKVILFFTESIWFGNENIP

SEQ ID NO: 2020564 - protein, 17 aa, Staphylococcus
IVRMLKDAGANKIHVRI

SEQ ID NO: 2020565 - protein, 18 aa, Staphylococcus
IVRMLKDSGAKEVHVRIA

SEQ ID NO: 2020566 - protein, 19 aa, Staphylococcus
IVRNLPIDINRSGRVIVNQ

SEQ ID NO: 2020567 - protein, 31 aa, Staphylococcus
IVRQFKDDFLRAAKVLAQWVKEGKIKSKTSI

SEQ ID NO: 2020568 - protein, 26 aa, Staphylococcus
IVRRYCFDKAFLGMNGIDLKHGLTTP

SEQ ID NO: 2020569 - protein, 19 aa, Staphylococcus
IVRSLLGIAVPTQIATHDS

SEQ ID NO: 2020570 - protein, 18 aa, Staphylococcus
IVSAWNPTEIDSMALPPC

SEQ ID NO: 2020571 - protein, 18 aa, Staphylococcus
IVSLPGAGTRIEVKAPLN

SEQ ID NO: 2020572 - protein, 22 aa, Staphylococcus
IVSNHGPFTWGKNASQAIYHSV

SEQ ID NO: 2020573 - protein, 25 aa, Staphylococcus
IVSSELAKSVARHHGVAYKEVLTGF

SEQ ID NO: 2020574 - protein, 24 aa, Staphylococcus
IVSVLKRFKAMLLQKNESVETMQG

SEQ ID NO: 2020575 - protein, 25 aa, Staphylococcus
IVTEPSYRDDIDWGNINQPIEEEKF

SEQ ID NO: 2020576 - protein, 19 aa, Staphylococcus
IVTFYSRSKERLWTKGETS

SEQ ID NO: 2020577 - protein, 20 aa, Staphylococcus
IVTGTFPWQKVVNVKAKHAI

SEQ ID NO: 2020578 - protein, 27 aa, Staphylococcus
IVTHPKFAVPMPHRLFDYFNAFIGTSD

SEQ ID NO: 2020579 - protein, 30 aa, Staphylococcus
IVTHPKFIVPMPHRIFDFFNAYIGTKDFDE

SEQ ID NO: 2020580 - protein, 20 aa, Staphylococcus
IVTLQFLFIPPLSWSNKKRL

SEQ ID NO: 2020581 - protein, 18 aa, Staphylococcus
IVTMAGLINALRITDKSL

SEQ ID NO: 2020582 - protein, 25 aa, Staphylococcus
IVTRLKGGDPFLFGRGAEEAEVLAD

SEQ ID NO: 2020583 - protein, 18 aa, Staphylococcus
IVTSDSRKGVLQFLEDTN

SEQ ID NO: 2020584 - protein, 20 aa, Staphylococcus
IVTSGALTRYNLKLFGEPDR

SEQ ID NO: 2020585 - protein, 18 aa, Staphylococcus
IVVEFKKLILGSNVKQSY

SEQ ID NO: 2020586 - protein, 20 aa, Staphylococcus
IVVGMLPWKKINTVSTEHID

SEQ ID NO: 2020587 - protein, 25 aa, Staphylococcus
IVVGNTYGRIRAMVNDLGKRIKSAG

SEQ ID NO: 2020588 - protein, 25 aa, Staphylococcus
IVVGNTYGRIRAMVNDLGQRIKTAG

SEQ ID NO: 2020589 - protein, 19 aa, Staphylococcus
IVVGNTYGRVRAMVNDAGK

SEQ ID NO: 2020590 - protein, 19 aa, Staphylococcus
IVVGNTYGRVRAMVNDLGQ

SEQ ID NO: 2020591 - protein, 17 aa, Staphylococcus
IVVKNAFIFTGEKVSKD

SEQ ID NO: 2020592 - protein, 30 aa, Staphylococcus
IVVTFNYRLGAWGFLDWSFFKSNYDCNNGL

SEQ ID NO: 2020593 - protein, 19 aa, Staphylococcus
IVVTIPVYLVHSVEIVPVE

SEQ ID NO: 2020594 - protein, 27 aa, Staphylococcus
IVWATAAPGWQKWVWSPFLSTMTSGAT

SEQ ID NO: 2020595 - protein, 17 aa, Staphylococcus
IVYKGWLRSDQIKSLFI

SEQ ID NO: 2020596 - protein, 26 aa, Staphylococcus
IVYVKKGQTDIVGWGVVSSNHQYKND

SEQ ID NO: 2020597 - protein, 17 aa, Staphylococcus
IVYWCIQHDCYLLDVPL

SEQ ID NO: 2020598 - protein, 18 aa, Staphylococcus
IVYYDGEAALALMRLYQQ

SEQ ID NO: 2020599 - protein, 23 aa, Staphylococcus
IVYYKEVVDFFIIDTPSDQFGGT

SEQ ID NO: 2020600 - protein, 23 aa, Staphylococcus
IWDFPKNHFPSIMEAKAHYSNRV

SEQ ID NO: 2020601 - protein, 23 aa, Staphylococcus
IWEGTHYTFGFSRMFDSTCTTCG

SEQ ID NO: 2020602 - protein, 18 aa, Staphylococcus
IWEQVNVFMLPKDYLRYC

SEQ ID NO: 2020603 - protein, 25 aa, Staphylococcus
IWFEREAKDLLPEGFTHPGSPNGEF

SEQ ID NO: 2020604 - protein, 36 aa, Staphylococcus
IWHGLPLTEAFLFSRGHFKGNQFPEGVNALSPQIII

SEQ ID NO: 2020605 - protein, 37 aa, Staphylococcus; identical to SEQ ID NO: 1647312

SEQ ID NO: 2020606 - protein, 18 aa, Staphylococcus
IWKAASRVIDAAVEKAYN

SEQ ID NO: 2020607 - protein, 21 aa, Staphylococcus
IWKKEIWEDGAQWQGHQHGNH

SEQ ID NO: 2020608 - protein, 18 aa, Staphylococcus
IWLDCDIEILYKRIKNDS

SEQ ID NO: 2020609 - protein, 21 aa, Staphylococcus
IWLKDHPLSFEWGGASMIEDK

SEQ ID NO: 2020610 - protein, 29 aa, Staphylococcus
IWLKEPRWKCIYRVIKRVIIHNLKRHRIG

SEQ ID NO: 2020611 - protein, 32 aa, Staphylococcus
IWMSTFHSMCVKILRRDADRIGIERNFTIIDP

SEQ ID NO: 2020612 - protein, 20 aa, Staphylococcus
IWNDGTIEFLGRIDNQVKIK

SEQ ID NO: 2020613 - protein, 24 aa, Staphylococcus
IWNFDVKDLLTFKKEMIFYENCII

SEQ ID NO: 2020614 - protein, 17 aa, Staphylococcus
IWNIMSYLFEVIDPYSL

SEQ ID NO: 2020615 - protein, 17 aa, Staphylococcus
IWQAHQIHLHIGQDIDV

SEQ ID NO: 2020616 - protein, 19 aa, Staphylococcus
IWRASRRVLDAAVEKAYNG

SEQ ID NO: 2020617 - protein, 17 aa, Staphylococcus
IWRSMKDLIDYDMIKNG

SEQ ID NO: 2020618 - protein, 25 aa, Staphylococcus
IWSDKELIGVIGLHYLDLVNKRTSI

SEQ ID NO: 2020619 - protein, 19 aa, Staphylococcus
IWTDAQWRSIYAKGQDVLV

SEQ ID NO: 2020620 - protein, 18 aa, Staphylococcus
IWYDAHGDLNIPEESPSG

SEQ ID NO: 2020621 - protein, 25 aa, Staphylococcus
IYAHGEIHLDIDFALYGYPSDSLHD

SEQ ID NO: 2020622 - protein, 21 aa, Staphylococcus
IYASTIFEYAISLKIITDNPF

SEQ ID NO: 2020623 - protein, 17 aa, Staphylococcus
IYAVCRVIDDSIDVHHD

SEQ ID NO: 2020624 - protein, 23 aa, Staphylococcus
IYCLEGCVTLTLGKERYQAYEGD

SEQ ID NO: 2020625 - protein, 21 aa, Staphylococcus
IYDFDILVVALGFVSETFGID

SEQ ID NO: 2020626 - protein, 25 aa, Staphylococcus
IYDIERLKPFGIDFNKPLFELDDVN

SEQ ID NO: 2020627 - protein, 24 aa, Staphylococcus
IYDKVMPKLKEAFENIKVGDPFDE

SEQ ID NO: 2020628 - protein, 18 aa, Staphylococcus
IYDNYVFLFENEFATRWF

SEQ ID NO: 2020629 - protein, 29 aa, Staphylococcus
IYDRPRGKFRFPIDLGQDAETYDEAVYRE

SEQ ID NO: 2020630 - protein, 26 aa, Staphylococcus
IYDRPRGKFRFPIDVGQDENYEEAIY

SEQ ID NO: 2020631 - protein, 21 aa, Staphylococcus
IYDVIGYEVKPLFITEDELAD

SEQ ID NO: 2020632 - protein, 26 aa, Staphylococcus
IYDYDYKRVHFFLRMIRQDGEVAATN

SEQ ID NO: 2020633 - protein, 18 aa, Staphylococcus
IYDYIRLLYTRVGKAYCP

SEQ ID NO: 2020634 - protein, 17 aa, Staphylococcus
IYEAGFLTGIYHGDLSY

SEQ ID NO: 2020635 - protein, 18 aa, Staphylococcus
IYEAWAHDGIKPLPFKIY

SEQ ID NO: 2020636 - protein, 25 aa, Staphylococcus
IYEHFGRPWIAPPMRVDGSEFDRDL

SEQ ID NO: 2020637 - protein, 19 aa, Staphylococcus
IYEIGWRLIPEVWGNGIAT

SEQ ID NO: 2020638 - protein, 17 aa, Staphylococcus
IYELAGWHTELYLNAKT

SEQ ID NO: 2020639 - protein, 19 aa, Staphylococcus
IYELIQPPTAYQFFNDPML

SEQ ID NO: 2020640 - protein, 19 aa, Staphylococcus
IYESFKLPNDDQRLKQLQQ

SEQ ID NO: 2020641 - protein, 28 aa, Staphylococcus
IYETYPYKRGLYSGGVGYINCNQNLDFA

SEQ ID NO: 2020642 - protein, 25 aa, Staphylococcus
IYEVIGYEVKPRFITEEELSKYMKT

SEQ ID NO: 2020643 - protein, 35 aa, Staphylococcus
IYFHSLPWGVDYIKPEIVLMYELLRPGEYGTEESN

SEQ ID NO: 2020644 - protein, 23 aa, Staphylococcus
IYFLKQALRSLGYMGILKNIEGI

SEQ ID NO: 2020645 - protein, 17 aa, Staphylococcus
IYFSKARLNEFNVSIAD

SEQ ID NO: 2020646 - protein, 18 aa, Staphylococcus
IYGAKGLAWVKVTDEGLT

SEQ ID NO: 2020647 - protein, 20 aa, Staphylococcus
IYGAKGLAWVKVVDEGLSGP

SEQ ID NO: 2020648 - protein, 17 aa, Staphylococcus
IYGAKGLAWVKVVEDGF

SEQ ID NO: 2020649 - protein, 20 aa, Staphylococcus
IYGAKGLAWVKVVEDGLSGP

SEQ ID NO: 2020650 - protein, 18 aa, Staphylococcus
IYGAKGLAWVKVVEEGLS

SEQ ID NO: 2020651 - protein, 18 aa, Staphylococcus
IYGDVKWTKPITVEETAY

SEQ ID NO: 2020652 - protein, 17 aa, Staphylococcus
IYGFIVIDQNQSEWYDE

SEQ ID NO: 2020653 - protein, 19 aa, Staphylococcus
IYGNHLWTGYPTGMIYSRP

SEQ ID NO: 2020654 - protein, 21 aa, Staphylococcus
IYHAVPLYKEKLMLVVDKNSK

SEQ ID NO: 2020655 - protein, 18 aa, Staphylococcus
IYHNIPYYLPETLNELID

SEQ ID NO: 2020656 - protein, 18 aa, Staphylococcus
IYHRVVEMLEEGQAISKI

SEQ ID NO: 2020657 - protein, 17 aa, Staphylococcus
IYIDEALVTYDNLLMDP

SEQ ID NO: 2020658 - protein, 17 aa, Staphylococcus
IYIDRNDTNIILNNLIK

SEQ ID NO: 2020659 - protein, 25 aa, Staphylococcus
IYIDVYCALKHGINISKTANQIQSA

SEQ ID NO: 2020660 - protein, 21 aa, Staphylococcus
IYIEIGSGMGKFITTIASQHP

SEQ ID NO: 2020661 - protein, 20 aa, Staphylococcus
IYIEIGSGMGQFITTLASKF

SEQ ID NO: 2020662 - protein, 20 aa, Staphylococcus
IYIEIGSGMGQFITTLASKH

SEQ ID NO: 2020663 - protein, 20 aa, Staphylococcus
IYIKFRVQDTLAPIESIQQH

SEQ ID NO: 2020664 - protein, 17 aa, Staphylococcus
IYISTISVGAVFDVHTE

SEQ ID NO: 2020665 - protein, 19 aa, Staphylococcus
IYKANVHSLLPIKPQTIDM

SEQ ID NO: 2020666 - protein, 18 aa, Staphylococcus
IYKATALTMNYADFTVAI

SEQ ID NO: 2020667 - protein, 21 aa, Staphylococcus
IYKDGSVILGCYVLKEINIDK

SEQ ID NO: 2020668 - protein, 22 aa, Staphylococcus
IYKEGAIQLGQWIAEQNHTLIF

SEQ ID NO: 2020669 - protein, 18 aa, Staphylococcus
IYKEPLLSEAVRYSIATE

SEQ ID NO: 2020670 - protein, 22 aa, Staphylococcus
IYKGDALYQYRSFNHQDYQDVI

SEQ ID NO: 2020671 - protein, 23 aa, Staphylococcus
IYKGKRKGMPYTQHLVRSHLNYL

SEQ ID NO: 2020672 - protein, 18 aa, Staphylococcus
IYKKYPIRYSIMGHVHFR

SEQ ID NO: 2020673 - protein, 18 aa, Staphylococcus
IYKQTAAYGHFGRTDVAL

SEQ ID NO: 2020674 - protein, 20 aa, Staphylococcus
IYLAALKLGLVIIPSSEMLR

SEQ ID NO: 2020675 - protein, 17 aa, Staphylococcus
IYLDLAPVVTTGKNRLV

SEQ ID NO: 2020676 - protein, 17 aa, Staphylococcus
IYLHPAIPPDNVIDTYY

SEQ ID NO: 2020677 - protein, 17 aa, Staphylococcus
IYLKRHAQGYQTLMYMF

SEQ ID NO: 2020678 - protein, 18 aa, Staphylococcus
IYLRAYTYIRTMGAEGLK

SEQ ID NO: 2020679 - protein, 22 aa, Staphylococcus
IYLRAYTYIRTMGAKGLKEVSE

SEQ ID NO: 2020680 - protein, 17 aa, Staphylococcus
IYLRAYTYIRTMGNKGL

SEQ ID NO: 2020681 - protein, 19 aa, Staphylococcus
IYMGIKRLNYIINQIRRYT

SEQ ID NO: 2020682 - protein, 20 aa, Staphylococcus
IYMRLERVGTTFKIKTWKYK

SEQ ID NO: 2020683 - protein, 24 aa, Staphylococcus
IYNDDYWLFFLIKLTTNAIKPNGI

SEQ ID NO: 2020684 - protein, 25 aa, Staphylococcus
IYNDGKPYAGFVYDVMNDKLYHAKV

SEQ ID NO: 2020685 - protein, 17 aa, Staphylococcus
IYNDLPIGFTEEEQVAF

SEQ ID NO: 2020686 - protein, 19 aa, Staphylococcus
IYNKWKGMGTLSSIDVINQ

SEQ ID NO: 2020687 - protein, 35 aa, Staphylococcus
IYNMIRDRGEWVISRQRVWGVPLPVFYAENGDIIM

SEQ ID NO: 2020688 - protein, 22 aa, Staphylococcus
IYNMLRRFDAHITVNVDGLAAS

SEQ ID NO: 2020689 - protein, 17 aa, Staphylococcus
IYNNVPVVAYGVDRDIP

SEQ ID NO: 2020690 - protein, 21 aa, Staphylococcus
IYNPNIKKVIFASSAAIYGHL

SEQ ID NO: 2020691 - protein, 27 aa, Staphylococcus
IYNRPRGKFRFPMHVSEEASYNDLDND

SEQ ID NO: 2020692 - protein, 18 aa, Staphylococcus
IYNYRARKYNKWIHQDYL

SEQ ID NO: 2020693 - protein, 18 aa, Staphylococcus
IYNYRARKYNKWKHQSYV

SEQ ID NO: 2020694 - protein, 18 aa, Staphylococcus
IYNYRARKYNKWLQQDYF

SEQ ID NO: 2020695 - protein, 19 aa, Staphylococcus
IYNYRARKYNKWLQQDYLV

SEQ ID NO: 2020696 - protein, 19 aa, Staphylococcus
IYPHTVFELAKRIIPSEKV

SEQ ID NO: 2020697 - protein, 27 aa, Staphylococcus
IYPLKNCTRIIPFSSISYIDLLEENEH

SEQ ID NO: 2020698 - protein, 27 aa, Staphylococcus
IYPLKNCTRIIPFSSISYLDLLDRNEQ

SEQ ID NO: 2020699 - protein, 19 aa, Staphylococcus
IYPYQIESVAKYFPEIEDA

SEQ ID NO: 2020700 - protein, 18 aa, Staphylococcus
IYQAFSLTPFENIKVVIL

SEQ ID NO: 2020701 - protein, 25 aa, Staphylococcus
IYQRLKFYLIDLFRKEQLKIDCLDI

SEQ ID NO: 2020702 - protein, 18 aa, Staphylococcus
IYQSFGLKHLKLVINSIG

SEQ ID NO: 2020703 - protein, 18 aa, Staphylococcus
IYQSFGLKHLKLVINSVG

SEQ ID NO: 2020704 - protein, 22 aa, Staphylococcus
IYQYGKYATWALREKSHNEISW

SEQ ID NO: 2020705 - protein, 20 aa, Staphylococcus
IYRANVKALLPLKPQTIDMP

SEQ ID NO: 2020706 - protein, 20 aa, Staphylococcus
IYRMTPELQDDVGTVGYVEF

SEQ ID NO: 2020707 - protein, 19 aa, Staphylococcus
IYRRWKDKDTMIIDMFLNE

SEQ ID NO: 2020708 - protein, 27 aa, Staphylococcus
IYSHMLWEGFQPFKIVKIEELSSDIKA

SEQ ID NO: 2020709 - protein, 24 aa, Staphylococcus
IYSKPRSGYFVSDIETLPIIKRNH

SEQ ID NO: 2020710 - protein, 23 aa, Staphylococcus
IYSKPRSGYYVSDIESLPIVTKE

SEQ ID NO: 2020711 - protein, 25 aa, Staphylococcus
IYSKPRSGYYVSDIESLPVINRETY

SEQ ID NO: 2020712 - protein, 18 aa, Staphylococcus
IYSKVWGYETFVDDNTLM

SEQ ID NO: 2020713 - protein, 17 aa, Staphylococcus
IYSLFDAIERRNNKNVL

SEQ ID NO: 2020714 - protein, 19 aa, Staphylococcus
IYSLLNRSLLYSAIILHDI

SEQ ID NO: 2020715 - protein, 21 aa, Staphylococcus
IYSLRYEEMQDWLVEHGQQKF

SEQ ID NO: 2020716 - protein, 32 aa, Staphylococcus
IYSSVRLLWSRIGEPFVGYSDSFSFNSPNGMC

SEQ ID NO: 2020717 - protein, 19 aa, Staphylococcus
IYTAEQFLDDVFMNEEDYD

SEQ ID NO: 2020718 - protein, 19 aa, Staphylococcus
IYTDWSFTLEYMKYVNKFM

SEQ ID NO: 2020719 - protein, 23 aa, Staphylococcus
IYTEEAFEAFKLNQTKQIIVRRV

SEQ ID NO: 2020720 - protein, 21 aa, Staphylococcus
IYTEMLWDGFQPFKVETIEQV

SEQ ID NO: 2020721 - protein, 18 aa, Staphylococcus
IYTEQHFLDALHNHLNKA

SEQ ID NO: 2020722 - protein, 17 aa, Staphylococcus
IYTGIAFMQLHNGQFVS

SEQ ID NO: 2020723 - protein, 19 aa, Staphylococcus
IYTKGPKGAQAFTKHQFTT

SEQ ID NO: 2020724 - protein, 25 aa, Staphylococcus
IYTRKIKAVKVFLQHGVLGTKNLSN

SEQ ID NO: 2020725 - protein, 18 aa, Staphylococcus
IYTRLEAASVGLSESQAK

SEQ ID NO: 2020726 - protein, 23 aa, Staphylococcus
IYVKEAYELGKYMAEQGYELVFG

SEQ ID NO: 2020727 - protein, 21 aa, Staphylococcus
IYVNLSYSFPYIICAIDHLPI

SEQ ID NO: 2020728 - protein, 17 aa, Staphylococcus
IYVPGVAGVRIEDDILV

SEQ ID NO: 2020729 - protein, 19 aa, Staphylococcus
IYVVYDWTGGTILGKQALL

SEQ ID NO: 2020730 - protein, 21 aa, Staphylococcus
IYYPDMERLDFYLSEQRQPIE

SEQ ID NO: 2020731 - protein, 21 aa, Staphylococcus
IYYSFALPYGKPFAIESVNNA

SEQ ID NO: 2020732 - protein, 18 aa, Staphylococcus
IYYYCNLSSPFVSDEEAL

SEQ ID NO: 2020733 - protein, 17 aa, Staphylococcus
KAAFSMTQIAKVLDEAN

SEQ ID NO: 2020734 - protein, 25 aa, Staphylococcus
KAAGQFGSGWAWLVVDKDGKLEIVS

SEQ ID NO: 2020735 - protein, 25 aa, Staphylococcus
KAAIYRECAQRCFNFFERVIEIENK

SEQ ID NO: 2020736 - protein, 19 aa, Staphylococcus
KAAKFLISLYNVFVEKDCS

SEQ ID NO: 2020737 - protein, 19 aa, Staphylococcus
KAAKFLLSLYNVFVEKDCS

SEQ ID NO: 2020738 - protein, 18 aa, Staphylococcus
KAAKFLVSLYNVFIEKDC

SEQ ID NO: 2020739 - protein, 20 aa, Staphylococcus
KAAKKLLHYGVDGIISDIPE

SEQ ID NO: 2020740 - protein, 25 aa, Staphylococcus
KAALLRARRTYAFTELFMFELRMQW

SEQ ID NO: 2020741 - protein, 18 aa, Staphylococcus
KAALPDDVVMHFIGSLQT

SEQ ID NO: 2020742 - protein, 18 aa, Staphylococcus
KAALPEDAVMHFIGSLQS

SEQ ID NO: 2020743 - protein, 20 aa, Staphylococcus
KAAQRLGFKFEGIFRNHKVY

SEQ ID NO: 2020744 - protein, 20 aa, Staphylococcus
KAAQSLIKLGVDGIITDIPD

SEQ ID NO: 2020745 - protein, 22 aa, Staphylococcus
KAARHLLREGGRFIVVHRADRL

SEQ ID NO: 2020746 - protein, 19 aa, Staphylococcus
KAAVLDNGLNFVDYQKIPT

SEQ ID NO: 2020747 - protein, 18 aa, Staphylococcus
KAAYKNKEVDGFTTNPSL

SEQ ID NO: 2020748 - protein, 22 aa, Staphylococcus
KADGKMLVIDGGFSKAYQSTTG

SEQ ID NO: 2020749 - protein, 31 aa, Staphylococcus
KADHRAVHNYARYVSRFIVGYLTGNPITITH

SEQ ID NO: 2020750 - protein, 19 aa, Staphylococcus
KADIATAVNMYLNDCDKIM

SEQ ID NO: 2020751 - protein, 20 aa, Staphylococcus
KADIGVKNGYIFAIGKAGNP

SEQ ID NO: 2020752 - protein, 19 aa, Staphylococcus
KADIGVKNGYIFKIGKAGN

SEQ ID NO: 2020753 - protein, 19 aa, Staphylococcus
KADILKQTKLQRVEDLYRP

SEQ ID NO: 2020754 - protein, 20 aa, Staphylococcus
KADILLWVLRPEMQELNSIE

SEQ ID NO: 2020755 - protein, 24 aa, Staphylococcus
KADKRVPYHLNLKIHGAEADEVTA

SEQ ID NO: 2020756 - protein, 19 aa, Staphylococcus
KADLAEIVSDFLTAFQEKY

SEQ ID NO: 2020757 - protein, 20 aa, Staphylococcus
KADLLLWVLRPEMKELNIIE

SEQ ID NO: 2020758 - protein, 22 aa, Staphylococcus
KADLYFDSYGSIPREDVASVLK

SEQ ID NO: 2020759 - protein, 24 aa, Staphylococcus
KADNDIKIAIVMNLCNTTKSDAQS

SEQ ID NO: 2020760 - protein, 18 aa, Staphylococcus
KADNVLQDRLRSLSNVDI

SEQ ID NO: 2020761 - protein, 19 aa, Staphylococcus
KADPSLSYFNQYRSIMIQS

SEQ ID NO: 2020762 - protein, 17 aa, Staphylococcus
KADSLVGSFYDQQSYQF

SEQ ID NO: 2020763 - protein, 25 aa, Staphylococcus
KADTNLKRSFSFIAQLAKQFNVDII

SEQ ID NO: 2020764 - protein, 20 aa, Staphylococcus
KAEAEEIIKDMIELVLENKK

SEQ ID NO: 2020765 - protein, 18 aa, Staphylococcus
KAEDKKKFVLGSVSHKVA

SEQ ID NO: 2020766 - protein, 20 aa, Staphylococcus
KAEDKLILLFTGPLTDLAKA

SEQ ID NO: 2020767 - protein, 19 aa, Staphylococcus
KAEDMPKFDAVKYGKYHKD

SEQ ID NO: 2020768 - protein, 30 aa, Staphylococcus
KAEEIYKPYIEGFIKMLAPIAPHISEELWS

SEQ ID NO: 2020769 - protein, 18 aa, Staphylococcus
KAEFVDALAELKAIAPSP

SEQ ID NO: 2020770 - protein, 22 aa, Staphylococcus
KAEGKIKFFHIIATGNLAVKHP

SEQ ID NO: 2020771 - protein, 19 aa, Staphylococcus
KAELAGVLHDYCKYDDLST

SEQ ID NO: 2020772 - protein, 20 aa, Staphylococcus
KAELSALIRMNGALSLSNQQ

SEQ ID NO: 2020773 - protein, 25 aa, Staphylococcus
KAEMRLTEIGFIFQASHLVPYLTVL

SEQ ID NO: 2020774 - protein, 24 aa, Staphylococcus
KAEPAKHYPKCALCIENEGYQGSV

SEQ ID NO: 2020775 - protein, 19 aa, Staphylococcus
KAEVKGVSVLVESKEVKQR

SEQ ID NO: 2020776 - protein, 21 aa, Staphylococcus
KAFAEEVVKAIPDASISFEVF

SEQ ID NO: 2020777 - protein, 25 aa, Staphylococcus
KAFASSGRYGGFLNHDLGIKHADKQ

SEQ ID NO: 2020778 - protein, 19 aa, Staphylococcus
KAFDGRGNYTLGVKEQLIF

SEQ ID NO: 2020779 - protein, 25 aa, Staphylococcus
KAFINGKAGERFCIRNSGADVVVEG

SEQ ID NO: 2020780 - protein, 25 aa, Staphylococcus
KAFINGKAGERFCIRNSGVQAVVEG

SEQ ID NO: 2020781 - protein, 24 aa, Staphylococcus
KAFMKDNKPVFAICHGPQVLIDTD

SEQ ID NO: 2020782 - protein, 29 aa, Staphylococcus
KAFVASAIKNGWKMNEFVGPVDHGAYNRI

SEQ ID NO: 2020783 - protein, 17 aa, Staphylococcus
KAGEKIPKGLALDYVYG

SEQ ID NO: 2020784 - protein, 25 aa, Staphylococcus
KAGKFPEWIKIDFVYYLEEASFDDV

SEQ ID NO: 2020785 - protein, 17 aa, Staphylococcus
KAGLIGFSRNLAAELGQ

SEQ ID NO: 2020786 - protein, 21 aa, Staphylococcus
KAGLKGGGSYVEYRTDDARLT

SEQ ID NO: 2020787 - protein, 17 aa, Staphylococcus
KAGTGILGYAVDKGVEL

SEQ ID NO: 2020788 - protein, 30 aa, Staphylococcus
KAGTLNRLTSIFVRRQFNIVTLSATPTLEE

SEQ ID NO: 2020789 - protein, 19 aa, Staphylococcus
KAGVDGLHFDVMDGQFVPN

SEQ ID NO: 2020790 - protein, 27 aa, Staphylococcus
KAGVDVFRIFDSLNWVDQMKVANEAVQ

SEQ ID NO: 2020791 - protein, 28 aa, Staphylococcus
KAGVIMLTKSLAMEWSKYNIKVNTIAPG

SEQ ID NO: 2020792 - protein, 20 aa, Staphylococcus
KAGVQLRLDCAHIIEQQGRK

SEQ ID NO: 2020793 - protein, 23 aa, Staphylococcus
KAGWSQVKMKAVLHNEAIKNVTQ

SEQ ID NO: 2020794 - protein, 17 aa, Staphylococcus
KAHGMTIDALKFVQNHP

SEQ ID NO: 2020795 - protein, 17 aa, Staphylococcus
KAHGYELELDRLKKQET

SEQ ID NO: 2020796 - protein, 19 aa, Staphylococcus
KAHILKYQFINQVNHAPFI

SEQ ID NO: 2020797 - protein, 18 aa, Staphylococcus
KAHILKYQFMNQVNHAPF

SEQ ID NO: 2020798 - protein, 19 aa, Staphylococcus
KAHNLDSFITLVKTKRYTY

SEQ ID NO: 2020799 - protein, 21 aa, Staphylococcus
KAHSITAIWNFEKQNYFLKNL

SEQ ID NO: 2020800 - protein, 21 aa, Staphylococcus
KAHSITAIWNFEKQNYYLKKV

SEQ ID NO: 2020801 - protein, 19 aa, Staphylococcus
KAHVKGVSVLVESKEVKQR

SEQ ID NO: 2020802 - protein, 22 aa, Staphylococcus
KAIACGIPGLQVDGMDALAVYQ

SEQ ID NO: 2020803 - protein, 26 aa, Staphylococcus
KAIAEMKLAVGLLVEKKLSHMRIHSI

SEQ ID NO: 2020804 - protein, 25 aa, Staphylococcus
KAIDELPIIALLCTQASGTSMIKDA

SEQ ID NO: 2020805 - protein, 22 aa, Staphylococcus
KAIDIAHQYVYVSLIAGPKENS

SEQ ID NO: 2020806 - protein, 17 aa, Staphylococcus
KAIDIPIIAMGGVQNAQ

SEQ ID NO: 2020807 - protein, 19 aa, Staphylococcus
KAIDYIIDYCLCKDNSGAM

SEQ ID NO: 2020808 - protein, 25 aa, Staphylococcus
KAIDYVKDFAEELGYPTSVTNKGAL

SEQ ID NO: 2020809 - protein, 19 aa, Staphylococcus
KAIEAHLPEKFHFNENYKP

SEQ ID NO: 2020810 - protein, 24 aa, Staphylococcus
KAIEFYKRSGFKKVTEHKFQMGDE

SEQ ID NO: 2020811 - protein, 21 aa, Staphylococcus
KAIEGSFGVEIFIRTKKQLIT

SEQ ID NO: 2020812 - protein, 26 aa, Staphylococcus
KAIEKIEIAELFSLQAKKALYHFNNY

SEQ ID NO: 2020813 - protein, 21 aa, Staphylococcus
KAIELFKQYGVETISMNRISK

SEQ ID NO: 2020814 - protein, 19 aa, Staphylococcus
KAIEYWKEEGLDRVVLARE

SEQ ID NO: 2020815 - protein, 19 aa, Staphylococcus
KAIFEQLGFKTIQNADTLT

SEQ ID NO: 2020816 - protein, 23 aa, Staphylococcus
KAIGTKLMPNFVIQEDLTEDKQV

SEQ ID NO: 2020817 - protein, 18 aa, Staphylococcus
KAIICIHDTTLGPALGGC

SEQ ID NO: 2020818 - protein, 25 aa, Staphylococcus
KAIIKGEGQGFVQLVIDEKYKEILG

SEQ ID NO: 2020819 - protein, 25 aa, Staphylococcus
KAIILQAAFELGERLNASSTIDKVK

SEQ ID NO: 2020820 - protein, 17 aa, Staphylococcus
KAIKKDLGLTFLEIIIL

SEQ ID NO: 2020821 - protein, 20 aa, Staphylococcus
KAILDKGFKIDIVTDQTSAH

SEQ ID NO: 2020822 - protein, 22 aa, Staphylococcus
KAILRCDPDIILIGEIRDAEVA

SEQ ID NO: 2020823 - protein, 22 aa, Staphylococcus
KAILRCDPDIILIGEIRDAIIA

SEQ ID NO: 2020824 - protein, 22 aa, Staphylococcus
KAILRCDPDVILIGEIRDAEIA

SEQ ID NO: 2020825 - protein, 22 aa, Staphylococcus
KAILRCDPDVILIGEIRDAEVA

SEQ ID NO: 2020826 - protein, 23 aa, Staphylococcus
KAILRCDPDVILIGEIRDASIAK

SEQ ID NO: 2020827 - protein, 23 aa, Staphylococcus
KAILRCDPDVILIGEIRDAYIAK

SEQ ID NO: 2020828 - protein, 17 aa, Staphylococcus
KAILVKNAYVFTGEKVT

SEQ ID NO: 2020829 - protein, 20 aa, Staphylococcus
KAIMERRKLLLYAVTGAGKT

SEQ ID NO: 2020830 - protein, 23 aa, Staphylococcus
KAIMLPPGLAFVAYNDRAKARFA

SEQ ID NO: 2020831 - protein, 23 aa, Staphylococcus
KAIMLPPGLAFVAYNDRALKRFK

SEQ ID NO: 2020832 - protein, 23 aa, Staphylococcus
KAIMLPPGLAFVAYNNRALERFQ

SEQ ID NO: 2020833 - protein, 23 aa, Staphylococcus
KAIMLPPGLAFVAYSTRAKSRFK

SEQ ID NO: 2020834 - protein, 22 aa, Staphylococcus
KAIMLPPGVAFVAYSDRAKDRF

SEQ ID NO: 2020835 - protein, 18 aa, Staphylococcus
KAINCLERSDGEPCNECA

SEQ ID NO: 2020836 - protein, 17 aa, Staphylococcus
KAINEFIPKANIVKVSD

SEQ ID NO: 2020837 - protein, 19 aa, Staphylococcus
KAIPDASISFEVFADDLET

SEQ ID NO: 2020838 - protein, 19 aa, Staphylococcus
KAIPGIPQSLALKNAKETE

SEQ ID NO: 2020839 - protein, 25 aa, Staphylococcus
KAIPRFPKKIAILTADTGAAIRDIH

SEQ ID NO: 2020840 - protein, 24 aa, Staphylococcus
KAIQEYYPNFELDYDVDPERQNIA

SEQ ID NO: 2020841 - protein, 24 aa, Staphylococcus
KAITLKAAFEIGERINSVSQQEVF

SEQ ID NO: 2020842 - protein, 28 aa, Staphylococcus
KAIVKEIGVKCPKCDDGQVVERKSKKGR

SEQ ID NO: 2020843 - protein, 28 aa, Staphylococcus
KAKAFAEIDGQLFYQRIVQTLQETNMFN

SEQ ID NO: 2020844 - protein, 23 aa, Staphylococcus
KAKDIHSGIKLVRHLIDSGQAMK

SEQ ID NO: 2020845 - protein, 20 aa, Staphylococcus
KAKEIFNNLLSKQVDGIIFL

SEQ ID NO: 2020846 - protein, 24 aa, Staphylococcus
KAKELGLIPKLRFVDSEVAGVNPK

SEQ ID NO: 2020847 - protein, 19 aa, Staphylococcus
KAKELHKDLLIVADTCLCE

SEQ ID NO: 2020848 - protein, 19 aa, Staphylococcus
KAKELYPKVRMYYERSEPV

SEQ ID NO: 2020849 - protein, 18 aa, Staphylococcus
KAKFDFGSVKYVQAFHSS

SEQ ID NO: 2020850 - protein, 24 aa, Staphylococcus
KAKGLRPRAIRAMIVGIPNVGKST

SEQ ID NO: 2020851 - protein, 17 aa, Staphylococcus
KAKIKESNKVICIIGEN

SEQ ID NO: 2020852 - protein, 18 aa, Staphylococcus
KAKKFISLSIEYTPEIGQ

SEQ ID NO: 2020853 - protein, 20 aa, Staphylococcus
KAKKFISLSIKYTPEIGQGR

SEQ ID NO: 2020854 - protein, 23 aa, Staphylococcus
KAKKYKYTLMMGRTHGVHAEPTT

SEQ ID NO: 2020855 - protein, 24 aa, Staphylococcus
KAKLHPAICFTLLGYHLGVDIETI

SEQ ID NO: 2020856 - protein, 24 aa, Staphylococcus
KAKMRVAVRRLLKKYGYPPDLQKM

SEQ ID NO: 2020857 - protein, 33 aa, Staphylococcus
KAKNEGYRALAITDTHVLYGFPKFYDACIAKDI

SEQ ID NO: 2020858 - protein, 19 aa, Staphylococcus
KAKNKRGKIGVEHAHPKDI

SEQ ID NO: 2020859 - protein, 19 aa, Staphylococcus
KAKNKRGKIGVEHAKPEDI

SEQ ID NO: 2020860 - protein, 19 aa, Staphylococcus
KAKNLKYAITAGIGSDHVD

SEQ ID NO: 2020861 - protein, 27 aa, Staphylococcus
KAKQKALELVELVGLKGRESAYPSELS

SEQ ID NO: 2020862 - protein, 25 aa, Staphylococcus
KAKQKRLDIERVFKQSMLNDDLLKA

SEQ ID NO: 2020863 - protein, 19 aa, Staphylococcus
KAKRYKQARGMGGHVRSNW

SEQ ID NO: 2020864 - protein, 20 aa, Staphylococcus
KAKSAGFSHFIPYSNDIKIN

SEQ ID NO: 2020865 - protein, 22 aa, Staphylococcus
KAKSEYASDDFIVGYRLSPEEA

SEQ ID NO: 2020866 - protein, 17 aa, Staphylococcus
KAKSISVSSFTDMQLNV

SEQ ID NO: 2020867 - protein, 20 aa, Staphylococcus
KAKSVVISGSLPKGVDSNYY

SEQ ID NO: 2020868 - protein, 24 aa, Staphylococcus
KAKVEEMLEFVGLADKMHQFPDEL

SEQ ID NO: 2020869 - protein, 24 aa, Staphylococcus
KAKYDVPVIMFGVGASHLINEWND

SEQ ID NO: 2020870 - protein, 24 aa, Staphylococcus
KAKYHIKDKLAVYVPTYRESKIAN

SEQ ID NO: 2020871 - protein, 24 aa, Staphylococcus
KALAAGGHAVMLGSLLAGTEESPG

SEQ ID NO: 2020872 - protein, 26 aa, Staphylococcus
KALADFRKKEVGFIFQNYSVLNTLTV

SEQ ID NO: 2020873 - protein, 18 aa, Staphylococcus
KALAEKGNYDYFSFEAIR

SEQ ID NO: 2020874 - protein, 17 aa, Staphylococcus
KALDFKINATLIKSKRD

SEQ ID NO: 2020875 - protein, 22 aa, Staphylococcus
KALDIFESSPVYGFDAKVTGSV

SEQ ID NO: 2020876 - protein, 20 aa, Staphylococcus
KALEAVWDYAYDKVGYLGTN

SEQ ID NO: 2020877 - protein, 18 aa, Staphylococcus
KALEKRLSTKKEVFDEAR

SEQ ID NO: 2020878 - protein, 19 aa, Staphylococcus
KALELASLIVDKPYRNEGL

SEQ ID NO: 2020879 - protein, 19 aa, Staphylococcus
KALEPMGDEYLEVVKEGLN

SEQ ID NO: 2020880 - protein, 23 aa, Staphylococcus
KALFDKDPRVVLVDNPANNEYPL

SEQ ID NO: 2020881 - protein, 22 aa, Staphylococcus
KALFELPNYISCHYSNIDEIIL

SEQ ID NO: 2020882 - protein, 17 aa, Staphylococcus
KALFIVYSNPLALGVLT

SEQ ID NO: 2020883 - protein, 20 aa, Staphylococcus
KALFKILEDMHLKSDYEQQV

SEQ ID NO: 2020884 - protein, 18 aa, Staphylococcus
KALGAKRVMPLAVSGPFH

SEQ ID NO: 2020885 - protein, 17 aa, Staphylococcus
KALGGGCELVLHSPIVV

SEQ ID NO: 2020886 - protein, 17 aa, Staphylococcus
KALIKAYGLDANISVPA

SEQ ID NO: 2020887 - protein, 18 aa, Staphylococcus
KALLDRYPSAVVYNTYGP

SEQ ID NO: 2020888 - protein, 19 aa, Staphylococcus
KALLKHMGPQGWWPADTRE

SEQ ID NO: 2020889 - protein, 17 aa, Staphylococcus
KALLRAIFQDIFNTEAS

SEQ ID NO: 2020890 - protein, 24 aa, Staphylococcus
KALLSRALAGTVMSKLIFTLPGST

SEQ ID NO: 2020891 - protein, 23 aa, Staphylococcus
KALMLPPGLAFAAYSDRAKDRFA

SEQ ID NO: 2020892 - protein, 25 aa, Staphylococcus
KALNHFRLGISVSKKLGNAVVRNRI

SEQ ID NO: 2020893 - protein, 21 aa, Staphylococcus
KALNNPIFNDIEWVIVSLGAK

SEQ ID NO: 2020894 - protein, 18 aa, Staphylococcus
KALQHRINHHHMRNGVTI

SEQ ID NO: 2020895 - protein, 26 aa, Staphylococcus
KALQKRINLFHMRNGVTIIDPDSTFI

SEQ ID NO: 2020896 - protein, 18 aa, Staphylococcus
KALSEADLILFVLNNNEP

SEQ ID NO: 2020897 - protein, 19 aa, Staphylococcus
KALSEADLILFVLNYNEGL

SEQ ID NO: 2020898 - protein, 18 aa, Staphylococcus
KALSHLDVQLSIDTYRSE

SEQ ID NO: 2020899 - protein, 17 aa, Staphylococcus
KALSMWMTLKCGIVNLP

SEQ ID NO: 2020900 - protein, 18 aa, Staphylococcus
KALSMWMTLKCGIVNLPY

SEQ ID NO: 2020901 - protein, 21 aa, Staphylococcus
KALSVGKWVRAQGRIEEDTFV

SEQ ID NO: 2020902 - protein, 18 aa, Staphylococcus
KALTSPLMTAEWEEKLLS

SEQ ID NO: 2020903 - protein, 17 aa, Staphylococcus
KALVSALKKYPALNSEF

SEQ ID NO: 2020904 - protein, 17 aa, Staphylococcus
KALVSALKKYPALNTSF

SEQ ID NO: 2020905 - protein, 18 aa, Staphylococcus
KALYEMIDYFYFLVENDQ

SEQ ID NO: 2020906 - protein, 19 aa, Staphylococcus
KAMCCSTGVCGPEPDETLI

SEQ ID NO: 2020907 - protein, 17 aa, Staphylococcus
KAMESPQKFFDLSDKKH

SEQ ID NO: 2020908 - protein, 25 aa, Staphylococcus
KAMKAEGYDYFGLLYIGAILTSEGP

SEQ ID NO: 2020909 - protein, 24 aa, Staphylococcus
KAMKLEGYHYFGLLYIGAILTSEG

SEQ ID NO: 2020910 - protein, 18 aa, Staphylococcus
KAMKSWETKTPFRDLIEQ

SEQ ID NO: 2020911 - protein, 24 aa, Staphylococcus
KAMKYAACEFLKILELENVIVKAP

SEQ ID NO: 2020912 - protein, 20 aa, Staphylococcus
KAMSEAKCIKNRQVFPQDTN

SEQ ID NO: 2020913 - protein, 22 aa, Staphylococcus
KAMYLKFIDFYKELLITYSKNY

SEQ ID NO: 2020914 - protein, 19 aa, Staphylococcus
KANEELGYRYRIKGTVVQG

SEQ ID NO: 2020915 - protein, 22 aa, Staphylococcus
KANGKMLVIDGGFSKAYQSTTG

SEQ ID NO: 2020916 - protein, 20 aa, Staphylococcus
KANHICKSIINGKSVKGLYI

SEQ ID NO: 2020917 - protein, 21 aa, Staphylococcus
KANKRGIPFDRLHEEMYDIAG

SEQ ID NO: 2020918 - protein, 26 aa, Staphylococcus
KANNYKESWIKFNNPYYKNAPFPVLY

SEQ ID NO: 2020919 - protein, 27 aa, Staphylococcus
KANSLEHLLFGLGIRHLGVKASQVLAE

SEQ ID NO: 2020920 - protein, 18 aa, Staphylococcus
KANVKHYVMVSTYDSRRE

SEQ ID NO: 2020921 - protein, 20 aa, Staphylococcus
KANYPRATFYNYFDDINDLL

SEQ ID NO: 2020922 - protein, 24 aa, Staphylococcus
KANYWKGVEAVGGHIVFEDDGFRF

SEQ ID NO: 2020923 - protein, 17 aa, Staphylococcus
KAPLRMHRLLQGDVGSG

SEQ ID NO: 2020924 - protein, 20 aa, Staphylococcus
KAPQKMSIKPGSKPFNVVMT

SEQ ID NO: 2020925 - protein, 21 aa, Staphylococcus
KAQAFKAGFPASVKEVVISGL

SEQ ID NO: 2020926 - protein, 21 aa, Staphylococcus
KAQALGCQFAFYGHTHIAKYE

SEQ ID NO: 2020927 - protein, 22 aa, Staphylococcus
KAQAPFQIPIVYGDEYGPDLAS

SEQ ID NO: 2020928 - protein, 19 aa, Staphylococcus
KAQDDFKTVVLPAFRPDDV

SEQ ID NO: 2020929 - protein, 20 aa, Staphylococcus
KAQEGVTFLISSHILSELVK

SEQ ID NO: 2020930 - protein, 23 aa, Staphylococcus
KAQFPAGVGEYLYERLCLTANHM

SEQ ID NO: 2020931 - protein, 19 aa, Staphylococcus
KAQFPERNYITNITKKTAP

SEQ ID NO: 2020932 - protein, 17 aa, Staphylococcus
KAQFSFPQVTLAAEERT

SEQ ID NO: 2020933 - protein, 19 aa, Staphylococcus
KAQGGKLIYSTWKDGMNPI

SEQ ID NO: 2020934 - protein, 17 aa, Staphylococcus
KAQGKEIGLSLLEKDKV

SEQ ID NO: 2020935 - protein, 20 aa, Staphylococcus
KAQHVVNFMYFIAEELREIL

SEQ ID NO: 2020936 - protein, 20 aa, Staphylococcus
KAQKSHIWFHTKDIPGSHVV

SEQ ID NO: 2020937 - protein, 19 aa, Staphylococcus
KAQNYAEVRLKLDNHAHQL

SEQ ID NO: 2020938 - protein, 23 aa, Staphylococcus
KAQRIGIRVADLLDKETFEKLLK

SEQ ID NO: 2020939 - protein, 23 aa, Staphylococcus
KAQRIGIRVADLLEKETFERRLK

SEQ ID NO: 2020940 - protein, 24 aa, Staphylococcus
KARAREILDDLGILKNGVFTHEID

SEQ ID NO: 2020941 - protein, 19 aa, Staphylococcus
KAREIWYLCRQYDAQQALD

SEQ ID NO: 2020942 - protein, 25 aa, Staphylococcus
KARIKEWDFPFVIKPGDDLPTAGGY

SEQ ID NO: 2020943 - protein, 25 aa, Staphylococcus
KARMERSAARLGFKFDGDLWQNEIN

SEQ ID NO: 2020944 - protein, 20 aa, Staphylococcus
KARVQRRVEELQQINIYPLR

SEQ ID NO: 2020945 - protein, 19 aa, Staphylococcus
KASDFRPIRLDRYFPEWHQ

SEQ ID NO: 2020946 - protein, 19 aa, Staphylococcus
KASEKMAGQSIVNLDIRAQ

SEQ ID NO: 2020947 - protein, 26 aa, Staphylococcus
KASELRLNEIGFIFQSSHLVPYLKVK

SEQ ID NO: 2020948 - protein, 18 aa, Staphylococcus
KASERICESIKYYLGLTE

SEQ ID NO: 2020949 - protein, 19 aa, Staphylococcus
KASESAGWIKELTEGGHAE

SEQ ID NO: 2020950 - protein, 18 aa, Staphylococcus
KASFNVIQSVLPQFIEHK

SEQ ID NO: 2020951 - protein, 17 aa, Staphylococcus
KASGGVRNLEDFHKMLN

SEQ ID NO: 2020952 - protein, 17 aa, Staphylococcus
KASGGVRNLEDFNQMLE

SEQ ID NO: 2020953 - protein, 18 aa, Staphylococcus
KASGYAFLVVPSNIFEGE

SEQ ID NO: 2020954 - protein, 18 aa, Staphylococcus
KASHRGVVSTASYEARKY

SEQ ID NO: 2020955 - protein, 17 aa, Staphylococcus
KASHVVRDLSNKNLVLK

SEQ ID NO: 2020956 - protein, 19 aa, Staphylococcus
KASLETFGVESDRLEIQIM

SEQ ID NO: 2020957 - protein, 21 aa, Staphylococcus
KASLLKARRTYAFTELFMFEL

SEQ ID NO: 2020958 - protein, 28 aa, Staphylococcus
KASNRLGTPLKRRVPGIELMEHCLKIAH

SEQ ID NO: 2020959 - protein, 25 aa, Staphylococcus
KASNYRSAGTIEFLVTEDAHYFIEM

SEQ ID NO: 2020960 - protein, 24 aa, Staphylococcus
KASNYRSAGTIEFLVTEEAHYFIE

SEQ ID NO: 2020961 - protein, 24 aa, Staphylococcus
KASNYRSAGTIEFLVTKDAHYFIE

SEQ ID NO: 2020962 - protein, 24 aa, Staphylococcus
KASQYRSAGTIEFLVTEDAHYFIE

SEQ ID NO: 2020963 - protein, 33 aa, Staphylococcus
KASRAEYKKDISLWKTDALRTIAEDLDLYSYKY

SEQ ID NO: 2020964 - protein, 19 aa, Staphylococcus
KASVETYGIDADRLEIQIM

SEQ ID NO: 2020965 - protein, 24 aa, Staphylococcus
KATDCAGLLRADFFVTDDNQIFIN

SEQ ID NO: 2020966 - protein, 17 aa, Staphylococcus
KATDCSGLVRADFFVTE

SEQ ID NO: 2020967 - protein, 24 aa, Staphylococcus
KATDFKVGGLFNKAKKKEEAQTER

SEQ ID NO: 2020968 - protein, 17 aa, Staphylococcus
KATDIMKNWPTHKNNPY

SEQ ID NO: 2020969 - protein, 21 aa, Staphylococcus
KATEEYEKFTGRLNVLEERKR

SEQ ID NO: 2020970 - protein, 23 aa, Staphylococcus
KATEMYLEQGFEKDAKIQYFVCT

SEQ ID NO: 2020971 - protein, 22 aa, Staphylococcus
KATHALETLAFKQVVHQEEQAL

SEQ ID NO: 2020972 - protein, 18 aa, Staphylococcus
KATHIIGVTRQFKSGGHA

SEQ ID NO: 2020973 - protein, 18 aa, Staphylococcus
KATHIYNLISGQRANDFN

SEQ ID NO: 2020974 - protein, 17 aa, Staphylococcus
KATIFISDMNDFQYINE

SEQ ID NO: 2020975 - protein, 18 aa, Staphylococcus
KATIRKGPNIKLPSLELL

SEQ ID NO: 2020976 - protein, 21 aa, Staphylococcus
KATKFLLALYNVFIEKDCSIV

SEQ ID NO: 2020977 - protein, 18 aa, Staphylococcus
KATLEALLDFDSYSIRHD

SEQ ID NO: 2020978 - protein, 21 aa, Staphylococcus
KATPKDIFFIISLSGETTQLS

SEQ ID NO: 2020979 - protein, 22 aa, Staphylococcus
KATPLYFLQHGIVFLKPRDNSN

SEQ ID NO: 2020980 - protein, 21 aa, Staphylococcus
KATQIGIPVMAHLGLTPQSVG

SEQ ID NO: 2020981 - protein, 26 aa, Staphylococcus
KAVAEMKLAVGLLVEKKLSHMRIHSI

SEQ ID NO: 2020982 - protein, 34 aa, Staphylococcus
KAVAKALKAYPMLNSSWNGSEIIIHKDINISIAV

SEQ ID NO: 2020983 - protein, 21 aa, Staphylococcus
KAVEILKDLDIEPMTPVEARE

SEQ ID NO: 2020984 - protein, 21 aa, Staphylococcus
KAVGHADVTYGLAIDKQNVTR

SEQ ID NO: 2020985 - protein, 22 aa, Staphylococcus
KAVGHADVTYGLAIHKDQVTRK

SEQ ID NO: 2020986 - protein, 20 aa, Staphylococcus
KAVGMSRPFLNHVENEGVEQ

SEQ ID NO: 2020987 - protein, 21 aa, Staphylococcus
KAVGMSRPFLNQVEHAGITST

SEQ ID NO: 2020988 - protein, 21 aa, Staphylococcus
KAVGMSRPFLNQVENGGITTT

SEQ ID NO: 2020989 - protein, 21 aa, Staphylococcus
KAVGMSRPFLNQVEQAGITQT

SEQ ID NO: 2020990 - protein, 21 aa, Staphylococcus
KAVGMSRPFLNQVEQSGITNT

SEQ ID NO: 2020991 - protein, 22 aa, Staphylococcus
KAVILKAAFELGERMNATHLSE

SEQ ID NO: 2020992 - protein, 24 aa, Staphylococcus
KAVKIAKTLGLFVSCDLNFRDALW

SEQ ID NO: 2020993 - protein, 26 aa, Staphylococcus
KAVKTPRFYLNLNKYFDSIEQNSTPF

SEQ ID NO: 2020994 - protein, 19 aa, Staphylococcus
KAVLEAKVKGLIRSNISSG

SEQ ID NO: 2020995 - protein, 20 aa, Staphylococcus
KAVNHFVLMFLQGHTDYQLN

SEQ ID NO: 2020996 - protein, 19 aa, Staphylococcus
KAVRDVRELIIKKAQEGVT

SEQ ID NO: 2020997 - protein, 21 aa, Staphylococcus
KAVTHSHGWGFAHMKMAPEHW

SEQ ID NO: 2020998 - protein, 21 aa, Staphylococcus
KAVTHSHGWGYAHLQMAPKHW

SEQ ID NO: 2020999 - protein, 21 aa, Staphylococcus
KAVTHTHGWGFAHMKMAPKHW

SEQ ID NO: 2021000 - protein, 21 aa, Staphylococcus
KAVVHTHGWGYAHMQMAPKHW

SEQ ID NO: 2021001 - protein, 30 aa, Staphylococcus
KAWDNRYGCLIAIEILELLKDIELDVDLYV

SEQ ID NO: 2021002 - protein, 29 aa, Staphylococcus
KAWDNRYGCVLAIEILELLKDIELDVDLY

SEQ ID NO: 2021003 - protein, 18 aa, Staphylococcus
KAYFNELTFNDELRNSIK

SEQ ID NO: 2021004 - protein, 25 aa, Staphylococcus
KAYFNRLRFVQFSGNGSEILTKDIF

SEQ ID NO: 2021005 - protein, 19 aa, Staphylococcus
KAYGSRSGIINSLSSETDK

SEQ ID NO: 2021006 - protein, 17 aa, Staphylococcus
KAYHALETLDFDALSHP

SEQ ID NO: 2021007 - protein, 26 aa, Staphylococcus
KAYIKRMALNVVVEYVARTIAQSEFR

SEQ ID NO: 2021008 - protein, 25 aa, Staphylococcus
KAYINGKAGERFCIRNSGADVVVEG

SEQ ID NO: 2021009 - protein, 22 aa, Staphylococcus
KAYKKSKIWLGVWENNPQAIKF

SEQ ID NO: 2021010 - protein, 22 aa, Staphylococcus
KAYMKAEMTPYISHFVENKLGG

SEQ ID NO: 2021011 - protein, 19 aa, Staphylococcus
KAYMKDQMTPFVDEFIENR

SEQ ID NO: 2021012 - protein, 18 aa, Staphylococcus
KAYMKKKVDDFSLKAVDI

SEQ ID NO: 2021013 - protein, 27 aa, Staphylococcus
KAYNDFLESEIARWIKIQEDIGLDVLV

SEQ ID NO: 2021014 - protein, 20 aa, Staphylococcus
KAYPDIFKPFNYLDSLDFFQ

SEQ ID NO: 2021015 - protein, 21 aa, Staphylococcus
KAYYKWRIDETYIKIKGKWSY

SEQ ID NO: 2021016 - protein, 20 aa, Staphylococcus
KAYYKWRIDETYIKIRGKWN

SEQ ID NO: 2021017 - protein, 19 aa, Staphylococcus
KAYYKWRVDETYIKIKGKW

SEQ ID NO: 2021018 - protein, 19 aa, Staphylococcus
KAYYSYRMDDLIVSYLIQA

SEQ ID NO: 2021019 - protein, 19 aa, Staphylococcus
KCGYISLTERGKVIGNEVF

SEQ ID NO: 2021020 - protein, 20 aa, Staphylococcus
KCMTKFGFNAVFDRCVITQS

SEQ ID NO: 2021021 - protein, 19 aa, Staphylococcus
KCNFKFKHPSSQLVEHIKM

SEQ ID NO: 2021022 - protein, 18 aa, Staphylococcus
KCNLKFSIQDNIIEIIYP

SEQ ID NO: 2021023 - protein, 25 aa, Staphylococcus
KCRPIEGWNTIAFAKDWQGPPRLQN

SEQ ID NO: 2021024 - protein, 25 aa, Staphylococcus
KCRPIEGWNTVAFAKDWQAPPRLQN

SEQ ID NO: 2021025 - protein, 25 aa, Staphylococcus
KCRPIEGWSTIAFAKDWQGPPRLQN

SEQ ID NO: 2021026 - protein, 23 aa, Staphylococcus
KCTTCKKAARFLDEHGVSYESID

SEQ ID NO: 2021027 - protein, 21 aa, Staphylococcus
KDADICLHLGDSEFKYNDTEL

SEQ ID NO: 2021028 - protein, 18 aa, Staphylococcus
KDADLLFKRHRFLNDHGF

SEQ ID NO: 2021029 - protein, 19 aa, Staphylococcus
KDAESYGVKVKRKDAVWDL

SEQ ID NO: 2021030 - protein, 19 aa, Staphylococcus
KDAEYKKDETFGLNIPVEI

SEQ ID NO: 2021031 - protein, 19 aa, Staphylococcus
KDAIQRFTLTDYKVSSKTN

SEQ ID NO: 2021032 - protein, 17 aa, Staphylococcus
KDAISYIIASGKDAGDI

SEQ ID NO: 2021033 - protein, 22 aa, Staphylococcus
KDAKFPVLLAGMRSSSEKETEA

SEQ ID NO: 2021034 - protein, 19 aa, Staphylococcus
KDAKIQYFVCTNHQQEACR

SEQ ID NO: 2021035 - protein, 24 aa, Staphylococcus
KDAKLDRDIAYWKQVGDYAEIRGG

SEQ ID NO: 2021036 - protein, 20 aa, Staphylococcus
KDAKLRGVDSSGMICSMKEL

SEQ ID NO: 2021037 - protein, 25 aa, Staphylococcus
KDALQIVPLIIKFKNLLYENNITLK

SEQ ID NO: 2021038 - protein, 19 aa, Staphylococcus
KDALTSIAMIDAIQKSSES

SEQ ID NO: 2021039 - protein, 25 aa, Staphylococcus
KDAMEMERLFSGLKKEGAILMPKTE

SEQ ID NO: 2021040 - protein, 19 aa, Staphylococcus
KDAQIAFYVAQWPLVRLDH

SEQ ID NO: 2021041 - protein, 20 aa, Staphylococcus
KDARHKREKLGRKLHIGHSN

SEQ ID NO: 2021042 - protein, 17 aa, Staphylococcus
KDAVYRCVCGHTETQEQ

SEQ ID NO: 2021043 - protein, 19 aa, Staphylococcus
KDCGMGCLDVSTVKDAMKE

SEQ ID NO: 2021044 - protein, 24 aa, Staphylococcus
KDCKYVLSVASPVFFDIPEDETEV

SEQ ID NO: 2021045 - protein, 20 aa, Staphylococcus
KDDAFYVLATRNGMIKKSNV

SEQ ID NO: 2021046 - protein, 24 aa, Staphylococcus
KDDEIIWLYQYFTDINIAPTTYTV

SEQ ID NO: 2021047 - protein, 24 aa, Staphylococcus
KDDEKRYPVKMAHNKIIPTKRIPD

SEQ ID NO: 2021048 - protein, 18 aa, Staphylococcus
KDDGIEGFNYCPRIRYKN

SEQ ID NO: 2021049 - protein, 30 aa, Staphylococcus
KDDGIYIDVFCEFKYGINISKTATKIQETI

SEQ ID NO: 2021050 - protein, 26 aa, Staphylococcus
KDDKKRIALEYSLPKWLVNHWVTHYG

SEQ ID NO: 2021051 - protein, 18 aa, Staphylococcus
KDDKLVACVTLRQLRQVG

SEQ ID NO: 2021052 - protein, 17 aa, Staphylococcus
KDDLVHKDPVHRRYYEH

SEQ ID NO: 2021053 - protein, 19 aa, Staphylococcus
KDDPEVIVYAGMSLAQKND

SEQ ID NO: 2021054 - protein, 20 aa, Staphylococcus
KDDQCPVCHFQKYDVLNDKL

SEQ ID NO: 2021055 - protein, 27 aa, Staphylococcus
KDDSFILGIQWHPEMLWKESSMDELFL

SEQ ID NO: 2021056 - protein, 23 aa, Staphylococcus
KDDWKTYDFNSGYFMAIQVNGVN

SEQ ID NO: 2021057 - protein, 23 aa, Staphylococcus
KDEAFKGQIIMKLDDVLAMVKEA

SEQ ID NO: 2021058 - protein, 21 aa, Staphylococcus
KDEDIPVWLDRQTPFNIEGGD

SEQ ID NO: 2021059 - protein, 27 aa, Staphylococcus
KDEDYWRVKVDNWSMPWNYQIKPKRKV

SEQ ID NO: 2021060 - protein, 17 aa, Staphylococcus
KDEEVRKVVHFKNLTVD

SEQ ID NO: 2021061 - protein, 24 aa, Staphylococcus
KDEFELIRLFGKRGRGLYNKARGI

SEQ ID NO: 2021062 - protein, 17 aa, Staphylococcus
KDEFIWNLVDEIRLKKQ

SEQ ID NO: 2021063 - protein, 22 aa, Staphylococcus
KDEFTTMILMFLESWYLNVASF

SEQ ID NO: 2021064 - protein, 19 aa, Staphylococcus
KDEHFSFLMFGPGTAPHQI

SEQ ID NO: 2021065 - protein, 19 aa, Staphylococcus
KDEHFSFLMFGPGTVPHQV

SEQ ID NO: 2021066 - protein, 18 aa, Staphylococcus
KDEHGRLLAAAAIGTSKD

SEQ ID NO: 2021067 - protein, 20 aa, Staphylococcus
KDEHGRLLVAAAIGIAKDTD

SEQ ID NO: 2021068 - protein, 20 aa, Staphylococcus
KDEHGRLLVGAAIGIAKDTD

SEQ ID NO: 2021069 - protein, 24 aa, Staphylococcus
KDEHKIAPAVITWIEEQQHFKNIE

SEQ ID NO: 2021070 - protein, 19 aa, Staphylococcus
KDEIDAVKNLPQYILDKTI

SEQ ID NO: 2021071 - protein, 20 aa, Staphylococcus
KDEKPDVVVISGDIYDTTYP

SEQ ID NO: 2021072 - protein, 22 aa, Staphylococcus
KDELCELDRKIGDGDHGVTMDI

SEQ ID NO: 2021073 - protein, 20 aa, Staphylococcus
KDELREFIEAAKIPVIHTLP

SEQ ID NO: 2021074 - protein, 19 aa, Staphylococcus
KDELREFVEAAKIPVIHTL

SEQ ID NO: 2021075 - protein, 18 aa, Staphylococcus
KDELYVIATNQFSEVEQK

SEQ ID NO: 2021076 - protein, 19 aa, Staphylococcus
KDENNVIVGQTILNNGQTT

SEQ ID NO: 2021077 - protein, 23 aa, Staphylococcus
KDERELIRIFGKRGHGLYQKARG

SEQ ID NO: 2021078 - protein, 18 aa, Staphylococcus
KDERVEGTAGGGMVTVTV

SEQ ID NO: 2021079 - protein, 24 aa, Staphylococcus
KDESVDLYDGYSFIGLGSDGGFAE

SEQ ID NO: 2021080 - protein, 21 aa, Staphylococcus
KDETFKSFSINVTSFGFKHGI

SEQ ID NO: 2021081 - protein, 25 aa, Staphylococcus
KDETIKQLYNQVAIYKEQSNRDKEQ

SEQ ID NO: 2021082 - protein, 18 aa, Staphylococcus
KDEVFGLSVPKDIKDVPK

SEQ ID NO: 2021083 - protein, 19 aa, Staphylococcus
KDEVKSRFGCIWNADSKEE

SEQ ID NO: 2021084 - protein, 29 aa, Staphylococcus
KDEVREFIEAFKIPTIVTLPAKGILADDH

SEQ ID NO: 2021085 - protein, 17 aa, Staphylococcus
KDEVVGIGVDFTSCTVV

SEQ ID NO: 2021086 - protein, 23 aa, Staphylococcus
KDEYKDLLNQLGLTEIENQLPSE

SEQ ID NO: 2021087 - protein, 22 aa, Staphylococcus
KDEYRKIGQFVLVNYPEFTNAP

SEQ ID NO: 2021088 - protein, 18 aa, Staphylococcus
KDFDEFYSTYSIRYSIMG

SEQ ID NO: 2021089 - protein, 18 aa, Staphylococcus
KDFENLHQLFIVSQVEVE

SEQ ID NO: 2021090 - protein, 22 aa, Staphylococcus
KDFFDRDRFVLSAGHGSALLYS

SEQ ID NO: 2021091 - protein, 18 aa, Staphylococcus
KDFHMFAPHTIYKEYGLT

SEQ ID NO: 2021092 - protein, 18 aa, Staphylococcus
KDFKAFDVEGLDERMEAL

SEQ ID NO: 2021093 - protein, 18 aa, Staphylococcus
KDFKAFDVEGLDNRMEAL

SEQ ID NO: 2021094 - protein, 22 aa, Staphylococcus
KDFKAFEVEGLDARMEALNEYV

SEQ ID NO: 2021095 - protein, 22 aa, Staphylococcus
KDFKKLKYVPVYNYNDYIKGQL

SEQ ID NO: 2021096 - protein, 17 aa, Staphylococcus
KDFKLTFLEDASADRDI

SEQ ID NO: 2021097 - protein, 17 aa, Staphylococcus
KDFKPLLNVKDKSFYTR

SEQ ID NO: 2021098 - protein, 20 aa, Staphylococcus
KDFKRLGVKGDFNNPYITLK

SEQ ID NO: 2021099 - protein, 22 aa, Staphylococcus
KDFNQREAFYIMATRNGMIKKS

SEQ ID NO: 2021100 - protein, 24 aa, Staphylococcus
KDFPNEKVKLISLIAMTTSEERIK

SEQ ID NO: 2021101 - protein, 25 aa, Staphylococcus
KDFPNNKFPTGWKVIENMPETVPQK

SEQ ID NO: 2021102 - protein, 24 aa, Staphylococcus
KDFQHMKIFPVGRVGKDTEGLILL

SEQ ID NO: 2021103 - protein, 19 aa, Staphylococcus
KDFQNWVARPSHVEEHKAM

SEQ ID NO: 2021104 - protein, 20 aa, Staphylococcus
KDGDPRAKYLKEMSRKITAE

SEQ ID NO: 2021105 - protein, 24 aa, Staphylococcus
KDGDPRAKYLREMSRKITEETGQS

SEQ ID NO: 2021106 - protein, 25 aa, Staphylococcus
KDGDPRAKYLREMSRKITSETGRSE

SEQ ID NO: 2021107 - protein, 18 aa, Staphylococcus
KDGEVLLVENTRFEDLDG

SEQ ID NO: 2021108 - protein, 20 aa, Staphylococcus
KDGGRYDGLLGVVAALQVVQ

SEQ ID NO: 2021109 - protein, 22 aa, Staphylococcus
KDGKHPIRVILSRSGDVDFSLD

SEQ ID NO: 2021110 - protein, 24 aa, Staphylococcus
KDGKPGLDIQPSFYMYQDDGEYTL

SEQ ID NO: 2021111 - protein, 17 aa, Staphylococcus
KDGKQLLDEGFGLIHAV

SEQ ID NO: 2021112 - protein, 17 aa, Staphylococcus
KDGKRGTYYFRITYYDR

SEQ ID NO: 2021113 - protein, 21 aa, Staphylococcus
KDGKSGSYIYIYEMNSDGSRG

SEQ ID NO: 2021114 - protein, 17 aa, Staphylococcus
KDGKWDRKTYRGTELYN

SEQ ID NO: 2021115 - protein, 23 aa, Staphylococcus
KDGLKGASIHLDFPSVGGTQNLI

SEQ ID NO: 2021116 - protein, 24 aa, Staphylococcus
KDGLKGTDIHLDFPSVGATQNIIM

SEQ ID NO: 2021117 - protein, 20 aa, Staphylococcus
KDGNMVLNIFVYDVVNDQWI

SEQ ID NO: 2021118 - protein, 21 aa, Staphylococcus
KDGQTGAYVRIYLTNPDGTRG

SEQ ID NO: 2021119 - protein, 22 aa, Staphylococcus
KDGREGVLTYDVVKYIETILNL

SEQ ID NO: 2021120 - protein, 19 aa, Staphylococcus
KDGRIVGLGAHLKKGDKHA

SEQ ID NO: 2021121 - protein, 26 aa, Staphylococcus
KDGRLFICYLGDFKSTGGIFATTDKG

SEQ ID NO: 2021122 - protein, 26 aa, Staphylococcus
KDGRLFICYLGDFKTTGGIFSTTEEG

SEQ ID NO: 2021123 - protein, 26 aa, Staphylococcus
KDGRLFTCYLGDFKTTGGIFATDAHG

SEQ ID NO: 2021124 - protein, 19 aa, Staphylococcus
KDGRLFVCYLGDFESTGGI

SEQ ID NO: 2021125 - protein, 19 aa, Staphylococcus
KDGRMIFAIPREEKAYIGT

SEQ ID NO: 2021126 - protein, 17 aa, Staphylococcus
KDGRPRIDTARRAADVV

SEQ ID NO: 2021127 - protein, 17 aa, Staphylococcus
KDGRQAIQYLKQNGLGR

SEQ ID NO: 2021128 - protein, 18 aa, Staphylococcus
KDGRQAIQYLKQNHLGRA

SEQ ID NO: 2021129 - protein, 17 aa, Staphylococcus
KDGSGPYHKALKNHLIN

SEQ ID NO: 2021130 - protein, 27 aa, Staphylococcus
KDGTMILRPSFRDYLLQLVNQYDIPHQ

SEQ ID NO: 2021131 - protein, 28 aa, Staphylococcus
KDGTMLLRPTFRDYLLDLAKQYDIKHQY

SEQ ID NO: 2021132 - protein, 20 aa, Staphylococcus
KDGTMSFAIADVIGKGIPAA

SEQ ID NO: 2021133 - protein, 19 aa, Staphylococcus
KDGTMSFAVADVIGTGIPA

SEQ ID NO: 2021134 - protein, 26 aa, Staphylococcus
KDGYLSFNPIGGWWNQVMLSQKVTVT

SEQ ID NO: 2021135 - protein, 24 aa, Staphylococcus
KDGYRIGYGGGYYDRFLSEHPSHT

SEQ ID NO: 2021136 - protein, 21 aa, Staphylococcus
KDGYRSIDYIAYIDAEKLYNY

SEQ ID NO: 2021137 - protein, 23 aa, Staphylococcus
KDHAYKEHIGVVFDDLRVPDKLE

SEQ ID NO: 2021138 - protein, 17 aa, Staphylococcus
KDHFAKRGIKIHENVLL

SEQ ID NO: 2021139 - protein, 23 aa, Staphylococcus
KDHGAEATCHFCNQKYNYTEAEL

SEQ ID NO: 2021140 - protein, 20 aa, Staphylococcus
KDHIREIVLMGGSSGRGNVT

SEQ ID NO: 2021141 - protein, 25 aa, Staphylococcus
KDHKGDIEYLKYAKDYGFSDKVIAH

SEQ ID NO: 2021142 - protein, 25 aa, Staphylococcus
KDHPQLKICACLGLANEEQAEKLKA

SEQ ID NO: 2021143 - protein, 21 aa, Staphylococcus
KDHQITLRVGEDIDVDEFLNK

SEQ ID NO: 2021144 - protein, 25 aa, Staphylococcus
KDIAFPSVSLICHELNISKNRFYKH

SEQ ID NO: 2021145 - protein, 18 aa, Staphylococcus
KDIDLVWHYIHTMINQTA

SEQ ID NO: 2021146 - protein, 17 aa, Staphylococcus
KDIDVILRRNVDILQQW

SEQ ID NO: 2021147 - protein, 22 aa, Staphylococcus
KDIEGKIIIPGFFGVSKNDYVV

SEQ ID NO: 2021148 - protein, 25 aa, Staphylococcus
KDIEHSNAFYLKRGIAVIHKKPTPV

SEQ ID NO: 2021149 - protein, 24 aa, Staphylococcus
KDIEKALSVLYIIDERVKHFNAKV

SEQ ID NO: 2021150 - protein, 18 aa, Staphylococcus
KDIEMLLMTMIKEIEKEI

SEQ ID NO: 2021151 - protein, 19 aa, Staphylococcus
KDIFGKLSYIGSTVKTLMD

SEQ ID NO: 2021152 - protein, 20 aa, Staphylococcus
KDIFGKLSYIGSTVKTLMDP

SEQ ID NO: 2021153 - protein, 26 aa, Staphylococcus
KDIFKLRQKSAMVFQNYNLFKNKTIL

SEQ ID NO: 2021154 - protein, 17 aa, Staphylococcus
KDIFKVVNYFANQLCDK

SEQ ID NO: 2021155 - protein, 19 aa, Staphylococcus
KDIGWEIFTDEIIQAVSRY

SEQ ID NO: 2021156 - protein, 20 aa, Staphylococcus
KDIGYICALVRDEMQSATKP

SEQ ID NO: 2021157 - protein, 19 aa, Staphylococcus
KDIIAEKEIDGFNVTIPHK

SEQ ID NO: 2021158 - protein, 19 aa, Staphylococcus
KDIIEDINKIYGLDHKQVS

SEQ ID NO: 2021159 - protein, 19 aa, Staphylococcus
KDIIEDINKIYGLDQKQVN

SEQ ID NO: 2021160 - protein, 19 aa, Staphylococcus
KDIIEYAYQIGIDSIGFTT

SEQ ID NO: 2021161 - protein, 27 aa, Staphylococcus
KDIIIKEILEIASTKEIVRFISTHPDE

SEQ ID NO: 2021162 - protein, 17 aa, Staphylococcus
KDIKAHTEVPVVAGFGI

SEQ ID NO: 2021163 - protein, 18 aa, Staphylococcus
KDIKCAILTVSDTRDYET

SEQ ID NO: 2021164 - protein, 23 aa, Staphylococcus
KDIKFPEIMTFIQSDLYLEIAEA

SEQ ID NO: 2021165 - protein, 25 aa, Staphylococcus
KDIKLHIKHLINRLIFNIKLENNVS

SEQ ID NO: 2021166 - protein, 21 aa, Staphylococcus
KDIKVIVGGMYEYGLSRYFTA

SEQ ID NO: 2021167 - protein, 17 aa, Staphylococcus
KDIKWYANSGHVITIDK

SEQ ID NO: 2021168 - protein, 19 aa, Staphylococcus
KDIKWYANSGHVITIDKEK

SEQ ID NO: 2021169 - protein, 18 aa, Staphylococcus
KDILNRFFNNEPFQDKDV

SEQ ID NO: 2021170 - protein, 24 aa, Staphylococcus
KDILNRYHIGGARYQGGNKQQVQA

SEQ ID NO: 2021171 - protein, 19 aa, Staphylococcus
KDIMFEFNIGKVPMKQIKT

SEQ ID NO: 2021172 - protein, 32 aa, Staphylococcus
KDINIKVLVDYRFKAKNFKAIVANRVKSYTPL

SEQ ID NO: 2021173 - protein, 27 aa, Staphylococcus
KDINLEIHKGEFIAIMGPSGSGKSTLI

SEQ ID NO: 2021174 - protein, 21 aa, Staphylococcus
KDIQKAIPFGTAKINVNTENQ

SEQ ID NO: 2021175 - protein, 19 aa, Staphylococcus
KDIRMSFPDSDRINNVYGE

SEQ ID NO: 2021176 - protein, 21 aa, Staphylococcus
KDIRYKDLGLLIVDEEQRFGV

SEQ ID NO: 2021177 - protein, 20 aa, Staphylococcus
KDITRAAVRIAKKAANEDTF

SEQ ID NO: 2021178 - protein, 19 aa, Staphylococcus
KDIVFSPKLLSWIEQRGLD

SEQ ID NO: 2021179 - protein, 17 aa, Staphylococcus
KDIVNWHFQGEIKTSLN

SEQ ID NO: 2021180 - protein, 28 aa, Staphylococcus
KDIYSKMLWEGFQPFKIEKIEQLSSDIK

SEQ ID NO: 2021181 - protein, 18 aa, Staphylococcus
KDKAQRLLNEIGLSHRLD

SEQ ID NO: 2021182 - protein, 28 aa, Staphylococcus
KDKDIDLRVNELLEMVGLDPEIYKNRLP

SEQ ID NO: 2021183 - protein, 23 aa, Staphylococcus
KDKDVLCIHFPKSNIDIYSQIKG

SEQ ID NO: 2021184 - protein, 24 aa, Staphylococcus
KDKDYKEHVGVVFDDLRVPNKLTI

SEQ ID NO: 2021185 - protein, 18 aa, Staphylococcus
KDKFGLNVVSEIVNPADF

SEQ ID NO: 2021186 - protein, 18 aa, Staphylococcus
KDKFYEHHHWVAEHLNPQ

SEQ ID NO: 2021187 - protein, 17 aa, Staphylococcus
KDKGCHAGYLIKVLNNW

SEQ ID NO: 2021188 - protein, 18 aa, Staphylococcus
KDKHVITLTLELVNERYL

SEQ ID NO: 2021189 - protein, 21 aa, Staphylococcus
KDKILEIIEHMSYRSGKNNDI

SEQ ID NO: 2021190 - protein, 17 aa, Staphylococcus
KDKKPFDEKEFREDMAQ

SEQ ID NO: 2021191 - protein, 28 aa, Staphylococcus
KDKLFELDGDLPLFPGHGQYTTVDDEQL

SEQ ID NO: 2021192 - protein, 29 aa, Staphylococcus
KDKLFELEGDLPLFPGHGPYTTVDDEQLN

SEQ ID NO: 2021193 - protein, 20 aa, Staphylococcus
KDKLKDWKSIDIVDFSKDLA

SEQ ID NO: 2021194 - protein, 19 aa, Staphylococcus
KDKLLSYATSKWIKFMTER

SEQ ID NO: 2021195 - protein, 19 aa, Staphylococcus
KDKMKQAFVDKAVAINDIS

SEQ ID NO: 2021196 - protein, 20 aa, Staphylococcus
KDKMKTAFIDKAVAINDISN

SEQ ID NO: 2021197 - protein, 21 aa, Staphylococcus
KDKMLSWVLPHYKGLSREGMK

SEQ ID NO: 2021198 - protein, 28 aa, Staphylococcus
KDKNTSRIYAKFGKEIYVAAKSGEPDPE

SEQ ID NO: 2021199 - protein, 27 aa, Staphylococcus
KDKQALMRARRTYAFTELFMFELRMQW

SEQ ID NO: 2021200 - protein, 20 aa, Staphylococcus
KDKQFQIAVNEEFVKSDDIV

SEQ ID NO: 2021201 - protein, 26 aa, Staphylococcus
KDKRAKLHPAICFTMLGHYLGVDIET

SEQ ID NO: 2021202 - protein, 28 aa, Staphylococcus
KDKRGIDEFLIRLSIGIENYSDIEADII

SEQ ID NO: 2021203 - protein, 25 aa, Staphylococcus
KDKRYSDDVDIIFILGGDGTVNELV

SEQ ID NO: 2021204 - protein, 28 aa, Staphylococcus
KDKSITFTHEFMYTRALYDDDVIKYHRY

SEQ ID NO: 2021205 - protein, 31 aa, Staphylococcus
KDLAETLHSIFLEVVIAPKFDKEALDILTQK

SEQ ID NO: 2021206 - protein, 17 aa, Staphylococcus
KDLAIGFSNLDVEKHVN

SEQ ID NO: 2021207 - protein, 19 aa, Staphylococcus
KDLDKGLLATYCQTYSNYK

SEQ ID NO: 2021208 - protein, 21 aa, Staphylococcus
KDLEVKLGKLLDANKFGMWDF

SEQ ID NO: 2021209 - protein, 19 aa, Staphylococcus
KDLFEVIQAIHELPFNKGL

SEQ ID NO: 2021210 - protein, 23 aa, Staphylococcus
KDLGIEVGDFISFDPRTVITQSG

SEQ ID NO: 2021211 - protein, 17 aa, Staphylococcus
KDLGRKKAVVIHGAGGM

SEQ ID NO: 2021212 - protein, 17 aa, Staphylococcus
KDLIASFSRALINDLNV

SEQ ID NO: 2021213 - protein, 19 aa, Staphylococcus
KDLIKTYLVEKNFDVLDVT

SEQ ID NO: 2021214 - protein, 17 aa, Staphylococcus
KDLIPKAKSVVISGSLP

SEQ ID NO: 2021215 - protein, 20 aa, Staphylococcus
KDLKEQGVYQYTEIMPPSNL

SEQ ID NO: 2021216 - protein, 22 aa, Staphylococcus
KDLKGQKAVLYFYPRDNTPTCT

SEQ ID NO: 2021217 - protein, 17 aa, Staphylococcus
KDLKGYTHLANWADSQY

SEQ ID NO: 2021218 - protein, 22 aa, Staphylococcus
KDLKIQVWDTLEYVDSNTINVY

SEQ ID NO: 2021219 - protein, 23 aa, Staphylococcus
KDLKLPLELYVELVYSVQNEMVF

SEQ ID NO: 2021220 - protein, 17 aa, Staphylococcus
KDLKTALHIPVLFVPGN

SEQ ID NO: 2021221 - protein, 22 aa, Staphylococcus
KDLKTRVMQALKEVHLEEHYDK

SEQ ID NO: 2021222 - protein, 17 aa, Staphylococcus
KDLLGGKGANLSEMKRL

SEQ ID NO: 2021223 - protein, 19 aa, Staphylococcus
KDLLKEYPVPLYKGEKVSK

SEQ ID NO: 2021224 - protein, 17 aa, Staphylococcus
KDLNDFLGINYYMSDWM

SEQ ID NO: 2021225 - protein, 17 aa, Staphylococcus
KDLQCLEDIVVKTSYYE

SEQ ID NO: 2021226 - protein, 20 aa, Staphylococcus
KDLRNIKSYEEVIKIKKAAE

SEQ ID NO: 2021227 - protein, 21 aa, Staphylococcus
KDLRNKYDWTSEFLDTIDYYF

SEQ ID NO: 2021228 - protein, 25 aa, Staphylococcus
KDLRRLGLHVYHNIEFALMSLSEED

SEQ ID NO: 2021229 - protein, 17 aa, Staphylococcus
KDLSKKLAESFQVVLID

SEQ ID NO: 2021230 - protein, 20 aa, Staphylococcus
KDLTDEFVEPFIIEGQNEGV

SEQ ID NO: 2021231 - protein, 20 aa, Staphylococcus
KDLTELVLTLGSQMVVLAQK

SEQ ID NO: 2021232 - protein, 22 aa, Staphylococcus
KDLVLLGVKTRGEFLAKSIQSK

SEQ ID NO: 2021233 - protein, 28 aa, Staphylococcus
KDLYSKSEFELIRWFGKKGRGLYQKVRG

SEQ ID NO: 2021234 - protein, 17 aa, Staphylococcus
KDMALNWAKENDVEVSF

SEQ ID NO: 2021235 - protein, 24 aa, Staphylococcus
KDNESLRFTYTFSEDTELTGNINL

SEQ ID NO: 2021236 - protein, 23 aa, Staphylococcus
KDNGWDHYPICMAKTQYSFSDDQ

SEQ ID NO: 2021237 - protein, 20 aa, Staphylococcus
KDNKAIMGFYRQRSHDIIDM

SEQ ID NO: 2021238 - protein, 23 aa, Staphylococcus
KDNLKKRLLKLLKIADNNCMISN

SEQ ID NO: 2021239 - protein, 28 aa, Staphylococcus
KDNNKGLNYFIAVIKNWIADDVDTKEKA

SEQ ID NO: 2021240 - protein, 18 aa, Staphylococcus
KDNPLEFEWGGTSMIEDK

SEQ ID NO: 2021241 - protein, 19 aa, Staphylococcus
KDNRYLTDILENYVLERGI

SEQ ID NO: 2021242 - protein, 18 aa, Staphylococcus
KDNSEFFEGVDMNLVDWL

SEQ ID NO: 2021243 - protein, 18 aa, Staphylococcus
KDNSEFFEGVNMNLVDWL

SEQ ID NO: 2021244 - protein, 17 aa, Staphylococcus
KDNSLPPVMLGSHIDTV

SEQ ID NO: 2021245 - protein, 18 aa, Staphylococcus
KDNVDIFKGPKGDTGEQG

SEQ ID NO: 2021246 - protein, 17 aa, Staphylococcus
KDNVLIRQLDYFDVESM

SEQ ID NO: 2021247 - protein, 21 aa, Staphylococcus
KDNYEIIKFFIEINEEKRQAH

SEQ ID NO: 2021248 - protein, 25 aa, Staphylococcus
KDPMEMERLFSGLKKEGAILMPKTE

SEQ ID NO: 2021249 - protein, 19 aa, Staphylococcus
KDPRIGFLTITDVQLTNDL

SEQ ID NO: 2021250 - protein, 19 aa, Staphylococcus
KDPRVGFITITDVDLTNDL

SEQ ID NO: 2021251 - protein, 26 aa, Staphylococcus
KDPYRVGLKLRDGGWVYVQGLTHYEI

SEQ ID NO: 2021252 - protein, 25 aa, Staphylococcus
KDPYRVGLKLREGGWVYVQGLTHYE

SEQ ID NO: 2021253 - protein, 18 aa, Staphylococcus
KDQCPSNMDLPVSEQPYV

SEQ ID NO: 2021254 - protein, 21 aa, Staphylococcus
KDQGYDVIGIFMKNWDDTDEN

SEQ ID NO: 2021255 - protein, 18 aa, Staphylococcus
KDQLKIHHDIIATSRNTS

SEQ ID NO: 2021256 - protein, 24 aa, Staphylococcus
KDQMKSQIPLGRFGEDTDIANTVA

SEQ ID NO: 2021257 - protein, 24 aa, Staphylococcus
KDRDFRPPLYIEAEVIGVDYNLLT

SEQ ID NO: 2021258 - protein, 25 aa, Staphylococcus
KDRFEKIFKALKERNIEFIAASGNQ

SEQ ID NO: 2021259 - protein, 19 aa, Staphylococcus
KDRGVCLYGPHRDDLGFNV

SEQ ID NO: 2021260 - protein, 21 aa, Staphylococcus
KDRIIKPLSYLYENNLRRKGL

SEQ ID NO: 2021261 - protein, 17 aa, Staphylococcus
KDRLHMNAYGLSGGQQQ

SEQ ID NO: 2021262 - protein, 19 aa, Staphylococcus
KDRLNHLDVKFSFNREDET

SEQ ID NO: 2021263 - protein, 19 aa, Staphylococcus
KDRMFEIVKDFEADSLMHM

SEQ ID NO: 2021264 - protein, 22 aa, Staphylococcus
KDRSIRKIARFSSYETASDLVP

SEQ ID NO: 2021265 - protein, 26 aa, Staphylococcus
KDSDHYGLWTFKKVWGTYLSEKIGEF

SEQ ID NO: 2021266 - protein, 23 aa, Staphylococcus
KDSDILSCLHIQGRPVIEARAFK

SEQ ID NO: 2021267 - protein, 26 aa, Staphylococcus
KDSDVLVCTVIGFPLGANTSATKAFE

SEQ ID NO: 2021268 - protein, 24 aa, Staphylococcus
KDSEELEELLTLDADLIVTAAFGQ

SEQ ID NO: 2021269 - protein, 23 aa, Staphylococcus
KDSEILINLGYHLLMQNSAITLN

SEQ ID NO: 2021270 - protein, 24 aa, Staphylococcus
KDSEIPEHFIHFINLATPRPIVYT

SEQ ID NO: 2021271 - protein, 18 aa, Staphylococcus
KDSLKFNKKIQMIFQDPY

SEQ ID NO: 2021272 - protein, 23 aa, Staphylococcus
KDSLRTSKVFWRSFDRNGLNYRD

SEQ ID NO: 2021273 - protein, 26 aa, Staphylococcus
KDSQYLIDILENFVLERGIYGKRWID

SEQ ID NO: 2021274 - protein, 26 aa, Staphylococcus
KDSRHKAYYEKRYKQLIADLDDINHE

SEQ ID NO: 2021275 - protein, 21 aa, Staphylococcus
KDSRIPMDQKFIFNPYETKSI

SEQ ID NO: 2021276 - protein, 21 aa, Staphylococcus
KDSRIPMDQKFIFNPYETQSI

SEQ ID NO: 2021277 - protein, 18 aa, Staphylococcus
KDSSGPYHKGLRSQLVQL

SEQ ID NO: 2021278 - protein, 19 aa, Staphylococcus
KDSSVKIISLIAMTASDDR

SEQ ID NO: 2021279 - protein, 17 aa, Staphylococcus
KDSTGICFIGERNFKEF

SEQ ID NO: 2021280 - protein, 17 aa, Staphylococcus
KDSTGICFIGERNFKSF

SEQ ID NO: 2021281 - protein, 25 aa, Staphylococcus
KDSVISAMMFKGNANQLTFEPKEGD

SEQ ID NO: 2021282 - protein, 20 aa, Staphylococcus
KDSVKPGGVIVYSTCTIEQM

SEQ ID NO: 2021283 - protein, 25 aa, Staphylococcus
KDSVLFKHSLSYNAVIDIVQRAQQE

SEQ ID NO: 2021284 - protein, 19 aa, Staphylococcus
KDSVVVIVAHIIWIRCCLY

SEQ ID NO: 2021285 - protein, 18 aa, Staphylococcus
KDSYPIDTIRGLNGIIID

SEQ ID NO: 2021286 - protein, 29 aa, Staphylococcus
KDTERYCLYRKFYPNSQVVKFEDFFTPGV

SEQ ID NO: 2021287 - protein, 26 aa, Staphylococcus
KDTFELPGKFKGFYTDGVILIDKYLS

SEQ ID NO: 2021288 - protein, 19 aa, Staphylococcus
KDTGAFCASPYFTHSYVFI

SEQ ID NO: 2021289 - protein, 25 aa, Staphylococcus
KDTKPARIKLKWSSHLINDIKKLRN

SEQ ID NO: 2021290 - protein, 20 aa, Staphylococcus
KDTLEYQVASSLAQQLSTIY

SEQ ID NO: 2021291 - protein, 18 aa, Staphylococcus
KDTLKSLPLVSIDHLGLS

SEQ ID NO: 2021292 - protein, 21 aa, Staphylococcus
KDTLVQLAFCIDVRSEPFRRH

SEQ ID NO: 2021293 - protein, 17 aa, Staphylococcus
KDTSLFIDWIDQAEAII

SEQ ID NO: 2021294 - protein, 20 aa, Staphylococcus
KDTWMLFGTLPIYPCIQDED

SEQ ID NO: 2021295 - protein, 18 aa, Staphylococcus
KDTYAVNIAEKWNAELKS

SEQ ID NO: 2021296 - protein, 21 aa, Staphylococcus
KDTYHFPRVWLEKDSYDFSFS

SEQ ID NO: 2021297 - protein, 17 aa, Staphylococcus
KDVEAAIKMADNNTLQF

SEQ ID NO: 2021298 - protein, 17 aa, Staphylococcus
KDVEAAIKMAQKGSINH

SEQ ID NO: 2021299 - protein, 20 aa, Staphylococcus
KDVFGKLSYIGSTVKTLMNP

SEQ ID NO: 2021300 - protein, 18 aa, Staphylococcus
KDVFITKCMAFAIDSTID

SEQ ID NO: 2021301 - protein, 24 aa, Staphylococcus
KDVIIKAIRLMKVLDDAKILDASI

SEQ ID NO: 2021302 - protein, 31 aa, Staphylococcus
KDVKEAIQFLKELPHRSSFSYILMDKHLNHA

SEQ ID NO: 2021303 - protein, 25 aa, Staphylococcus
KDVKEYGLYHAYRLAIAPTQSISYV

SEQ ID NO: 2021304 - protein, 25 aa, Staphylococcus
KDVKLRLKGYPAIVVQHEIDHLNGI

SEQ ID NO: 2021305 - protein, 20 aa, Staphylococcus
KDVLIDLGLIVGKDARHKRE

SEQ ID NO: 2021306 - protein, 33 aa, Staphylococcus
KDVRKAVFDMMNWWFDKGIDGFRVDAITHIKKT

SEQ ID NO: 2021307 - protein, 20 aa, Staphylococcus
KDVTCHTCDGEGAKPGTSKK

SEQ ID NO: 2021308 - protein, 19 aa, Staphylococcus
KDVTDIIAAQILYTIKKDG

SEQ ID NO: 2021309 - protein, 19 aa, Staphylococcus
KDVTNVSGIVLTKLDGTAK

SEQ ID NO: 2021310 - protein, 25 aa, Staphylococcus
KDVVKETPLQFDLYLSQKYDCNVYL

SEQ ID NO: 2021311 - protein, 18 aa, Staphylococcus
KDVVVGIMGYEYRTINDQ

SEQ ID NO: 2021312 - protein, 17 aa, Staphylococcus
KDVWPVQGDELFVTLRI

SEQ ID NO: 2021313 - protein, 19 aa, Staphylococcus
KDWIERWQSIEAQSRKAIT

SEQ ID NO: 2021314 - protein, 23 aa, Staphylococcus
KDYATISFLNWFLDEQVEEEAMF

SEQ ID NO: 2021315 - protein, 17 aa, Staphylococcus
KDYDLLLSVSDIGLVFL

SEQ ID NO: 2021316 - protein, 24 aa, Staphylococcus
KDYDYPKQAYAFFDHKKVKVVLNN

SEQ ID NO: 2021317 - protein, 23 aa, Staphylococcus
KDYFDELNLYIAAAQEKKQAILE

SEQ ID NO: 2021318 - protein, 22 aa, Staphylococcus
KDYGFDIIIAGSYSDIFYMNCT

SEQ ID NO: 2021319 - protein, 29 aa, Staphylococcus
KDYGFNIIIAGSFSDIFFMNCTKNGMLPI

SEQ ID NO: 2021320 - protein, 24 aa, Staphylococcus
KDYGFNIIIAGSFSDIFYMNCTKN

SEQ ID NO: 2021321 - protein, 25 aa, Staphylococcus
KDYGFNIIIAGSFSDIFYMNCTKNG

SEQ ID NO: 2021322 - protein, 19 aa, Staphylococcus
KDYGFSIIIAGSYSDIFYM

SEQ ID NO: 2021323 - protein, 23 aa, Staphylococcus
KDYIKEIVLMGGSAARGNVTPLA

SEQ ID NO: 2021324 - protein, 19 aa, Staphylococcus
KDYIKSFKMSGLVNSDEDV

SEQ ID NO: 2021325 - protein, 21 aa, Staphylococcus
KDYIQPRMTMITPIDKSDDEL

SEQ ID NO: 2021326 - protein, 21 aa, Staphylococcus
KDYIQPRMTMITPIDKSDEEI

SEQ ID NO: 2021327 - protein, 21 aa, Staphylococcus
KDYIQPRMTMITPIDKSDEEL

SEQ ID NO: 2021328 - protein, 21 aa, Staphylococcus
KDYIQPRMTMITPIDKTDDEI

SEQ ID NO: 2021329 - protein, 20 aa, Staphylococcus
KDYIQPRMTMITPIDQTDEE

SEQ ID NO: 2021330 - protein, 22 aa, Staphylococcus
KDYIQPRMTMITPIEKTDVALI

SEQ ID NO: 2021331 - protein, 19 aa, Staphylococcus
KDYKTTLQIYSHVTEQMDK

SEQ ID NO: 2021332 - protein, 22 aa, Staphylococcus
KDYLRYCLTGEIYTEYSDAAAT

SEQ ID NO: 2021333 - protein, 20 aa, Staphylococcus
KDYLRYCLTNQINMEYSDAA

SEQ ID NO: 2021334 - protein, 24 aa, Staphylococcus
KDYLRYRLTGNIHMEYSDAASTLL

SEQ ID NO: 2021335 - protein, 23 aa, Staphylococcus
KDYLVPRPKEKVLVIASDTARYG

SEQ ID NO: 2021336 - protein, 21 aa, Staphylococcus
KDYMVPLLMKFEVQGTKKDVE

SEQ ID NO: 2021337 - protein, 18 aa, Staphylococcus
KDYNAMLETMYLQSNLAN

SEQ ID NO: 2021338 - protein, 24 aa, Staphylococcus
KDYPDIVKRIAFHEPPINTFLPDA

SEQ ID NO: 2021339 - protein, 26 aa, Staphylococcus
KDYPELKLGIITPFLGHTHRWNEQNQ

SEQ ID NO: 2021340 - protein, 26 aa, Staphylococcus
KDYQFALDHLHVFKPEARSIIELAAR

SEQ ID NO: 2021341 - protein, 25 aa, Staphylococcus
KDYSKYGIDIAKIFEVGILHGQSKD

SEQ ID NO: 2021342 - protein, 23 aa, Staphylococcus
KDYTFHLKHHIKFNDGSNFDAKA

SEQ ID NO: 2021343 - protein, 20 aa, Staphylococcus
KDYTKCKLIGLDNLMDDNEI

SEQ ID NO: 2021344 - protein, 18 aa, Staphylococcus
KDYVDAGVKVEDLAERIT

SEQ ID NO: 2021345 - protein, 21 aa, Staphylococcus
KDYVRYCLTGKIHMEYSDAAS

SEQ ID NO: 2021346 - protein, 24 aa, Staphylococcus
KEAASFDYAVHFNKTNPLAGDPEN

SEQ ID NO: 2021347 - protein, 20 aa, Staphylococcus
KEADGSLTYMNQCLPSTEGT

SEQ ID NO: 2021348 - protein, 22 aa, Staphylococcus
KEADKNSLILFDELGAGTDPSE

SEQ ID NO: 2021349 - protein, 22 aa, Staphylococcus
KEADVFIGVSIADLLTKEMVQS

SEQ ID NO: 2021350 - protein, 21 aa, Staphylococcus
KEADYGLGMLGELEETMNTMA

SEQ ID NO: 2021351 - protein, 22 aa, Staphylococcus
KEAEAFPKLTLNAWSLSDLELI

SEQ ID NO: 2021352 - protein, 17 aa, Staphylococcus
KEAEIDGSTIFIPSGTF

SEQ ID NO: 2021353 - protein, 18 aa, Staphylococcus
KEAFAVAIEKTAIQGLGA

SEQ ID NO: 2021354 - protein, 25 aa, Staphylococcus
KEAHKRLNSAIIITGKEDVVIQDNQ

SEQ ID NO: 2021355 - protein, 20 aa, Staphylococcus
KEAHPYFDQNVVIIGGKNSA

SEQ ID NO: 2021356 - protein, 20 aa, Staphylococcus
KEAIDRNGLIALLESQNTSD

SEQ ID NO: 2021357 - protein, 20 aa, Staphylococcus
KEAIDRQGLIAILTIPVNNN

SEQ ID NO: 2021358 - protein, 18 aa, Staphylococcus
KEAIRIAEIANHAGVCDM

SEQ ID NO: 2021359 - protein, 21 aa, Staphylococcus
KEAKLDIPVFVVSDYENDKDA

SEQ ID NO: 2021360 - protein, 21 aa, Staphylococcus
KEALERLGEAAIQATRDGHTI

SEQ ID NO: 2021361 - protein, 22 aa, Staphylococcus
KEALFREIYRVLKDGGKAVISD

SEQ ID NO: 2021362 - protein, 21 aa, Staphylococcus
KEALHKLGFDEGMYELIKEPL

SEQ ID NO: 2021363 - protein, 17 aa, Staphylococcus
KEALPKDAVLHFIGSLQ

SEQ ID NO: 2021364 - protein, 22 aa, Staphylococcus
KEALQRMAMMRSYMRAQVTNQP

SEQ ID NO: 2021365 - protein, 23 aa, Staphylococcus
KEANIRFECKLDQMIQLGTKNDG

SEQ ID NO: 2021366 - protein, 21 aa, Staphylococcus
KEARKLIDLNIDGIITDIPDR

SEQ ID NO: 2021367 - protein, 18 aa, Staphylococcus
KEARRMDRFTQYAVVAAR

SEQ ID NO: 2021368 - protein, 18 aa, Staphylococcus
KEARRMLDEAGFPNAKII

SEQ ID NO: 2021369 - protein, 18 aa, Staphylococcus
KEARRMLDEAGFTDAKII

SEQ ID NO: 2021370 - protein, 18 aa, Staphylococcus
KEARRMLDEAGFTEAKII

SEQ ID NO: 2021371 - protein, 17 aa, Staphylococcus
KEASDQFDIEWLDREDG

SEQ ID NO: 2021372 - protein, 18 aa, Staphylococcus
KEAVDFYIAKGVVDRVAE

SEQ ID NO: 2021373 - protein, 17 aa, Staphylococcus
KEAVKLSVQPLIDSGAV

SEQ ID NO: 2021374 - protein, 17 aa, Staphylococcus
KEAVTHFNVIEHFKDYT

SEQ ID NO: 2021375 - protein, 17 aa, Staphylococcus
KEAVYRCVCGHSETQAQ

SEQ ID NO: 2021376 - protein, 17 aa, Staphylococcus
KEAWMDALGDFIQKVPT

SEQ ID NO: 2021377 - protein, 25 aa, Staphylococcus
KEAYDLGIRAIMFFGVPNDKDDVGS

SEQ ID NO: 2021378 - protein, 25 aa, Staphylococcus
KEAYEALQGVWLMEMAELAATRKAE

SEQ ID NO: 2021379 - protein, 20 aa, Staphylococcus
KEDALRIIRGLRFQSQLTFD

SEQ ID NO: 2021380 - protein, 23 aa, Staphylococcus
KEDESHVAIAGRLMTKRGKGKAG

SEQ ID NO: 2021381 - protein, 24 aa, Staphylococcus
KEDFDAIVDYCRQNNFFAMTYQDG

SEQ ID NO: 2021382 - protein, 20 aa, Staphylococcus
KEDFDIPVIMLTARDALSDK

SEQ ID NO: 2021383 - protein, 18 aa, Staphylococcus
KEDFDKIVDFCRENNLFV

SEQ ID NO: 2021384 - protein, 18 aa, Staphylococcus
KEDFEYCVNYIKSSDSIM

SEQ ID NO: 2021385 - protein, 20 aa, Staphylococcus
KEDFYFMPLLQFSDDVSEYA

SEQ ID NO: 2021386 - protein, 19 aa, Staphylococcus
KEDFYFMTLNQFYDDMVTY

SEQ ID NO: 2021387 - protein, 22 aa, Staphylococcus
KEDGHKLIGIRGMPRVGKTESI

SEQ ID NO: 2021388 - protein, 22 aa, Staphylococcus
KEDGVFLFDVHTVFKMETLFNN

SEQ ID NO: 2021389 - protein, 24 aa, Staphylococcus
KEDHGAEAICHFCGNKYNYSEAEL

SEQ ID NO: 2021390 - protein, 36 aa, Staphylococcus
KEDIKLFAELGFKVLRISISWPRIFPNGDELEPNEK

SEQ ID NO: 2021391 - protein, 17 aa, Staphylococcus
KEDKIDEIARMISGASV

SEQ ID NO: 2021392 - protein, 20 aa, Staphylococcus
KEDKVVFIIDECHRTQFGDM

SEQ ID NO: 2021393 - protein, 20 aa, Staphylococcus
KEDKVVFIIDECHRTQFGSM

SEQ ID NO: 2021394 - protein, 24 aa, Staphylococcus
KEDLTAAGVNLVFNVDTKRFEDIE

SEQ ID NO: 2021395 - protein, 21 aa, Staphylococcus
KEDNPSIVIHYDIRHLSSEFA

SEQ ID NO: 2021396 - protein, 20 aa, Staphylococcus
KEDRQYFCDVFQTLLNQLME

SEQ ID NO: 2021397 - protein, 23 aa, Staphylococcus
KEDSRPSWTYLFENPILHKEEFN

SEQ ID NO: 2021398 - protein, 19 aa, Staphylococcus
KEDVFKNSINYIMNNLDKN

SEQ ID NO: 2021399 - protein, 34 aa, Staphylococcus
KEDVKLFSEMGLKCLRTSIAWTRIFPNGDEEEPN

SEQ ID NO: 2021400 - protein, 19 aa, Staphylococcus
KEEEMRFVDSWLVTTKFKL

SEQ ID NO: 2021401 - protein, 22 aa, Staphylococcus
KEEESHVAIAGRIMTKRGKGKA

SEQ ID NO: 2021402 - protein, 18 aa, Staphylococcus
KEEFQLIVELGKGNIQLP

SEQ ID NO: 2021403 - protein, 19 aa, Staphylococcus
KEEFSKFKMVVASSNNGAV

SEQ ID NO: 2021404 - protein, 17 aa, Staphylococcus
KEEGIPCTMFDVEDVQA

SEQ ID NO: 2021405 - protein, 22 aa, Staphylococcus
KEEIERWDYLISPNRYSTEIFE

SEQ ID NO: 2021406 - protein, 23 aa, Staphylococcus
KEEIKLKSIHLVEYIDDLYPFYL

SEQ ID NO: 2021407 - protein, 19 aa, Staphylococcus
KEEINAIIKKCLNLPYTKM

SEQ ID NO: 2021408 - protein, 26 aa, Staphylococcus
KEEIYRKSVENCFNYFKTFILESNND

SEQ ID NO: 2021409 - protein, 27 aa, Staphylococcus
KEEKIKELQEFVARFSANASKSKQATS

SEQ ID NO: 2021410 - protein, 23 aa, Staphylococcus
KEEKLEVLLVRFLNFKNTHKDLL

SEQ ID NO: 2021411 - protein, 25 aa, Staphylococcus
KEEKQCPTCQMTLKDIAHVGKFGCA

SEQ ID NO: 2021412 - protein, 24 aa, Staphylococcus
KEEKRCPTCHMTLKDIAHVGKFGC

SEQ ID NO: 2021413 - protein, 20 aa, Staphylococcus
KEELCLDLAETDLEFIGTVV

SEQ ID NO: 2021414 - protein, 25 aa, Staphylococcus
KEELLKILPDINVVMWDERLSTMAA

SEQ ID NO: 2021415 - protein, 17 aa, Staphylococcus
KEELLTFEEMVRISKLY

SEQ ID NO: 2021416 - protein, 26 aa, Staphylococcus
KEELPNVWKDLGMRSASAYGKKTRSV

SEQ ID NO: 2021417 - protein, 18 aa, Staphylococcus
KEELPSVWEDLGMRSASA

SEQ ID NO: 2021418 - protein, 22 aa, Staphylococcus
KEELRRILAQENGCLYCKAKGS

SEQ ID NO: 2021419 - protein, 23 aa, Staphylococcus
KEEMRRLDSLIIKAADAARVPAG

SEQ ID NO: 2021420 - protein, 23 aa, Staphylococcus
KEEMRRLDSLIIKAADKARVPAG

SEQ ID NO: 2021421 - protein, 23 aa, Staphylococcus
KEEMRRLDSLIIKAADQAKVPAG

SEQ ID NO: 2021422 - protein, 23 aa, Staphylococcus
KEEMRRLDSLIIQAADKARVPAG

SEQ ID NO: 2021423 - protein, 19 aa, Staphylococcus
KEENGLWFIQGRIDFQIKL

SEQ ID NO: 2021424 - protein, 28 aa, Staphylococcus
KEENIDLYDGYSFIGLGADGGFAHYANA

SEQ ID NO: 2021425 - protein, 23 aa, Staphylococcus
KEENIDLYDGYSFIGLGSDGGFA

SEQ ID NO: 2021426 - protein, 24 aa, Staphylococcus
KEENIDLYDGYSFIGLGSDGGFAE

SEQ ID NO: 2021427 - protein, 25 aa, Staphylococcus
KEENLDLYDGYTFIGLGSDGGFAEF

SEQ ID NO: 2021428 - protein, 20 aa, Staphylococcus
KEEVDLEPGGKINFFVQTYG

SEQ ID NO: 2021429 - protein, 18 aa, Staphylococcus
KEEVPEGYYTVPLGKADV

SEQ ID NO: 2021430 - protein, 21 aa, Staphylococcus
KEEYASFIRKQWAKLGLGLDY

SEQ ID NO: 2021431 - protein, 24 aa, Staphylococcus
KEEYEWLQQSAFNFPDRDELKALF

SEQ ID NO: 2021432 - protein, 26 aa, Staphylococcus
KEEYPDLKLGVIAPFENHIERWNEQN

SEQ ID NO: 2021433 - protein, 21 aa, Staphylococcus
KEFCTKIAWIEGGKLKEFGDI

SEQ ID NO: 2021434 - protein, 24 aa, Staphylococcus
KEFDAADIAGAFLVVAATNNKAVN

SEQ ID NO: 2021435 - protein, 23 aa, Staphylococcus
KEFEPGETYTLFTHTYNGIKRNG

SEQ ID NO: 2021436 - protein, 20 aa, Staphylococcus
KEFFELYSKIVVEIPTDKPI

SEQ ID NO: 2021437 - protein, 19 aa, Staphylococcus
KEFFPSLKAHHDILGRERG

SEQ ID NO: 2021438 - protein, 18 aa, Staphylococcus
KEFIESEGNLELKIVEKI

SEQ ID NO: 2021439 - protein, 26 aa, Staphylococcus
KEFIQEFLDRCRIAKMISRYMITNET

SEQ ID NO: 2021440 - protein, 24 aa, Staphylococcus
KEFKDKDVLVVAGFQGVNDELELT

SEQ ID NO: 2021441 - protein, 17 aa, Staphylococcus
KEFKKLNGDEMTPYATI

SEQ ID NO: 2021442 - protein, 27 aa, Staphylococcus
KEFKLMDQLYCQYRYQGVMKDVLQQYK

SEQ ID NO: 2021443 - protein, 22 aa, Staphylococcus
KEFMQGLKYYKAINVDSEGGVE

SEQ ID NO: 2021444 - protein, 21 aa, Staphylococcus
KEFNHSVEVLKDITKSVDKLF

SEQ ID NO: 2021445 - protein, 17 aa, Staphylococcus
KEFPEVNFWTTFNEIGP

SEQ ID NO: 2021446 - protein, 18 aa, Staphylococcus
KEFRGVYINSPLDCAPQI

SEQ ID NO: 2021447 - protein, 17 aa, Staphylococcus
KEFRLHKFDSLIEEAFK

SEQ ID NO: 2021448 - protein, 21 aa, Staphylococcus
KEFYNFTIVFTEYYAPYEKKA

SEQ ID NO: 2021449 - protein, 18 aa, Staphylococcus
KEGDEVLIEARVSVYERQ

SEQ ID NO: 2021450 - protein, 22 aa, Staphylococcus
KEGDNGFGYDPIFYVPEKNKTM

SEQ ID NO: 2021451 - protein, 24 aa, Staphylococcus
KEGDPRAKYLREMSRKITEETGQS

SEQ ID NO: 2021452 - protein, 25 aa, Staphylococcus
KEGDPRAKYLREMSRKITSETGRSE

SEQ ID NO: 2021453 - protein, 17 aa, Staphylococcus
KEGDSVVFQEYAGSEIK

SEQ ID NO: 2021454 - protein, 20 aa, Staphylococcus
KEGEHCGVAAFKKEASGSLT

SEQ ID NO: 2021455 - protein, 18 aa, Staphylococcus
KEGFHICNGELFGKHRKG

SEQ ID NO: 2021456 - protein, 25 aa, Staphylococcus
KEGHISTSLIQRHFQIGYNRAARIV

SEQ ID NO: 2021457 - protein, 22 aa, Staphylococcus
KEGKDHFLRVSIDKEGGVDLND

SEQ ID NO: 2021458 - protein, 40 aa, Staphylococcus
KEGKDSFIKKIFKRAKASANEIFSRMQSVGSQVDRISIEL

SEQ ID NO: 2021459 - protein, 17 aa, Staphylococcus
KEGKFNMIFQFEHLGLW

SEQ ID NO: 2021460 - protein, 18 aa, Staphylococcus
KEGKGVKNYNHYKKKARQ

SEQ ID NO: 2021461 - protein, 20 aa, Staphylococcus
KEGKLKFGKEYGKQKAYVRD

SEQ ID NO: 2021462 - protein, 23 aa, Staphylococcus
KEGKPVLGVCNGFQILTEIGLLP

SEQ ID NO: 2021463 - protein, 24 aa, Staphylococcus
KEGLKGANIHLDFPSVGATQNIIM

SEQ ID NO: 2021464 - protein, 24 aa, Staphylococcus
KEGLKRFDTLVFTGGLGPTKDDLT

SEQ ID NO: 2021465 - protein, 18 aa, Staphylococcus
KEGLRLNQFYKELMLSTG

SEQ ID NO: 2021466 - protein, 23 aa, Staphylococcus
KEGLRLNQFYKELMVSTGSLEIE

SEQ ID NO: 2021467 - protein, 20 aa, Staphylococcus
KEGLSTIIILDGLEDPHNLG

SEQ ID NO: 2021468 - protein, 25 aa, Staphylococcus
KEGPKVIEFNARFGDPEAQVLLSRL

SEQ ID NO: 2021469 - protein, 26 aa, Staphylococcus
KEGQPEFINRLFDIDGVKSIFYVMDF

SEQ ID NO: 2021470 - protein, 25 aa, Staphylococcus
KEGQYRSMTKWEYLPSKARLRGTIE

SEQ ID NO: 2021471 - protein, 17 aa, Staphylococcus
KEGRECQFIAVKLPYGK

SEQ ID NO: 2021472 - protein, 18 aa, Staphylococcus
KEGTFIYDGDEPLLEPHV

SEQ ID NO: 2021473 - protein, 23 aa, Staphylococcus
KEGTRLRTLFPYINEASENHKKR

SEQ ID NO: 2021474 - protein, 26 aa, Staphylococcus
KEGTTLKILFHAGLGTMNCLRYLIDD

SEQ ID NO: 2021475 - protein, 30 aa, Staphylococcus
KEGVKGSLQRLGLDYIDLYQLHGGTIDDPL

SEQ ID NO: 2021476 - protein, 21 aa, Staphylococcus
KEGYYFYITNEFLKPNNKIKY

SEQ ID NO: 2021477 - protein, 17 aa, Staphylococcus
KEHFEICIQDIRNSESI

SEQ ID NO: 2021478 - protein, 24 aa, Staphylococcus
KEHFFKEIIIRNIKGYTLSDKFMS

SEQ ID NO: 2021479 - protein, 18 aa, Staphylococcus
KEHHIELIVDDPVEKVDR

SEQ ID NO: 2021480 - protein, 17 aa, Staphylococcus
KEHIIENVIHKSRFIAH

SEQ ID NO: 2021481 - protein, 20 aa, Staphylococcus
KEHMAFPGMVYISHPTEYGT

SEQ ID NO: 2021482 - protein, 19 aa, Staphylococcus
KEHPDVVKQIAFHEPPINT

SEQ ID NO: 2021483 - protein, 24 aa, Staphylococcus
KEIADVFYFTEFDFPKAITADEFK

SEQ ID NO: 2021484 - protein, 24 aa, Staphylococcus
KEIAELFRKGALNNNAKILLTNST

SEQ ID NO: 2021485 - protein, 25 aa, Staphylococcus
KEIAELKARIFAGLSENGVAIINGD

SEQ ID NO: 2021486 - protein, 19 aa, Staphylococcus
KEIAERAPLKRNIDQEEVG

SEQ ID NO: 2021487 - protein, 18 aa, Staphylococcus
KEIAKAMHSMGFRVVLAG

SEQ ID NO: 2021488 - protein, 21 aa, Staphylococcus
KEIARELKLIRVELQKQNEPT

SEQ ID NO: 2021489 - protein, 21 aa, Staphylococcus
KEICKRFKEIYVEEVHQPFPQ

SEQ ID NO: 2021490 - protein, 19 aa, Staphylococcus
KEIDAIPIVRLKDNQKFEV

SEQ ID NO: 2021491 - protein, 22 aa, Staphylococcus
KEIDFPAIVEWYKKNNFDTSFE

SEQ ID NO: 2021492 - protein, 17 aa, Staphylococcus
KEIDIVNDFGKVFAVQS

SEQ ID NO: 2021493 - protein, 25 aa, Staphylococcus
KEIDWALTVTGTYDFRHRSINDLSG

SEQ ID NO: 2021494 - protein, 26 aa, Staphylococcus
KEIEAQSRFALLLGNEGEGVNQELLQ

SEQ ID NO: 2021495 - protein, 21 aa, Staphylococcus
KEIEGFGELFRYLSYAEDVGT

SEQ ID NO: 2021496 - protein, 24 aa, Staphylococcus
KEIEHSYCPGRFDLSIDGKKFAGI

SEQ ID NO: 2021497 - protein, 23 aa, Staphylococcus
KEIEMGQPLNLIGNLQINEWNGN

SEQ ID NO: 2021498 - protein, 28 aa, Staphylococcus
KEIEPLFDHALPYYKQFINEVVQFLNNE

SEQ ID NO: 2021499 - protein, 24 aa, Staphylococcus
KEIERSYCPGKFDLSIDGKKFAGI

SEQ ID NO: 2021500 - protein, 20 aa, Staphylococcus
KEIETAFHINFTIKDAMENT

SEQ ID NO: 2021501 - protein, 21 aa, Staphylococcus
KEIFRAMGVAVPEGRVAFTAE

SEQ ID NO: 2021502 - protein, 20 aa, Staphylococcus
KEIFRSMGVAVPEGRVAFTA

SEQ ID NO: 2021503 - protein, 21 aa, Staphylococcus
KEIFRSMGVAVPEGRVAFTAK

SEQ ID NO: 2021504 - protein, 20 aa, Staphylococcus
KEIFRSMGVPVPEGRVAFTA

SEQ ID NO: 2021505 - protein, 21 aa, Staphylococcus
KEIGDFPIVAIGGVTENNAQA

SEQ ID NO: 2021506 - protein, 19 aa, Staphylococcus
KEIGYKFKIISGGNSSMLP

SEQ ID NO: 2021507 - protein, 25 aa, Staphylococcus
KEIIDFGVVIGKAFVNGRYINTKLG

SEQ ID NO: 2021508 - protein, 20 aa, Staphylococcus
KEIIESLEAPAHLFTTGANP

SEQ ID NO: 2021509 - protein, 24 aa, Staphylococcus
KEIIPHRQPFLLIDRVVEYEEGQR

SEQ ID NO: 2021510 - protein, 20 aa, Staphylococcus
KEIIPIYNFVREKEFPTQHE

SEQ ID NO: 2021511 - protein, 19 aa, Staphylococcus
KEIKEAIAQKDFKRMGEVI

SEQ ID NO: 2021512 - protein, 31 aa, Staphylococcus
KEIKFKAFLEHALKLGADYVATGHYARLKRY

SEQ ID NO: 2021513 - protein, 31 aa, Staphylococcus
KEIKFKAFLEHALKLGADYVATGHYARVRRH

SEQ ID NO: 2021514 - protein, 21 aa, Staphylococcus
KEIKGYAWEFLYYSPELETLP

SEQ ID NO: 2021515 - protein, 30 aa, Staphylococcus
KEIKKPLSEISMKVYSEFDINQDEAKELIE

SEQ ID NO: 2021516 - protein, 22 aa, Staphylococcus
KEIKYALDVLKLDGVGLLSNYN

SEQ ID NO: 2021517 - protein, 24 aa, Staphylococcus
KEILAKCKYIKPFLPEKVNGKKWS

SEQ ID NO: 2021518 - protein, 27 aa, Staphylococcus
KEILDLPEYAFPLFGMAVGEPADDENG

SEQ ID NO: 2021519 - protein, 21 aa, Staphylococcus
KEILVRRLVEENGTEHEGELD

SEQ ID NO: 2021520 - protein, 21 aa, Staphylococcus
KEILYPGIGHIDFPSVLETTS

SEQ ID NO: 2021521 - protein, 19 aa, Staphylococcus
KEINLPVIGIVKRDYTNSS

SEQ ID NO: 2021522 - protein, 18 aa, Staphylococcus
KEIPNVLFQMLLRASNAV

SEQ ID NO: 2021523 - protein, 23 aa, Staphylococcus
KEISFSVSGNGAYSKLKFENGAH

SEQ ID NO: 2021524 - protein, 23 aa, Staphylococcus
KEISFSVSGSGAYSKLKFENGAH

SEQ ID NO: 2021525 - protein, 22 aa, Staphylococcus
KEISSPMVGTFFLQDSKELTDP

SEQ ID NO: 2021526 - protein, 18 aa, Staphylococcus
KEITSLKMGNIEDQVETI

SEQ ID NO: 2021527 - protein, 20 aa, Staphylococcus
KEIVEESGQFDLVFIQANLT

SEQ ID NO: 2021528 - protein, 27 aa, Staphylococcus
KEIVEMAQRLAGAGAQAGFSSDEIMSV

SEQ ID NO: 2021529 - protein, 20 aa, Staphylococcus
KEKALNILVVCSSGIGTSRV

SEQ ID NO: 2021530 - protein, 32 aa, Staphylococcus
KEKEDIPIEWLKRYANHLIIIFKGVEEHHQLF

SEQ ID NO: 2021531 - protein, 22 aa, Staphylococcus
KEKEIMSVPVLLVMNKDKEENR

SEQ ID NO: 2021532 - protein, 20 aa, Staphylococcus
KEKFEAALIERVKNIKLGNG

SEQ ID NO: 2021533 - protein, 27 aa, Staphylococcus
KEKFEYKRITSGMFYFGLEIPMKYPGL

SEQ ID NO: 2021534 - protein, 18 aa, Staphylococcus
KEKFKVDSIEEVFIKAEK

SEQ ID NO: 2021535 - protein, 17 aa, Staphylococcus
KEKFRVIYYDGEAALAL

SEQ ID NO: 2021536 - protein, 19 aa, Staphylococcus
KEKGFTMKELANKSGISES

SEQ ID NO: 2021537 - protein, 18 aa, Staphylococcus
KEKGIMVLDDSYEIGQAF

SEQ ID NO: 2021538 - protein, 22 aa, Staphylococcus
KEKHPKLIVTRTVKKGTGKYFG

SEQ ID NO: 2021539 - protein, 19 aa, Staphylococcus
KEKHPRLLVTRTVKKGTGK

SEQ ID NO: 2021540 - protein, 17 aa, Staphylococcus
KEKILARIGDYYYGSDD

SEQ ID NO: 2021541 - protein, 30 aa, Staphylococcus
KEKILFPVLERRGIYILPRKMWADDDIIRN

SEQ ID NO: 2021542 - protein, 18 aa, Staphylococcus
KEKILSLGDVCIALPGGP

SEQ ID NO: 2021543 - protein, 20 aa, Staphylococcus
KEKISRITIGYTRDRKPVTV

SEQ ID NO: 2021544 - protein, 21 aa, Staphylococcus
KEKISRITVGYTRERKPITVA

SEQ ID NO: 2021545 - protein, 28 aa, Staphylococcus
KEKKAKELIKLVDLPEEFLDRYPSQLSG

SEQ ID NO: 2021546 - protein, 19 aa, Staphylococcus
KEKKIPREVLIDAIEAALI

SEQ ID NO: 2021547 - protein, 19 aa, Staphylococcus
KEKLEMMGQEITFYEYPRM

SEQ ID NO: 2021548 - protein, 24 aa, Staphylococcus
KEKLKRLFEQAGFSNIKVRSFTGG

SEQ ID NO: 2021549 - protein, 24 aa, Staphylococcus
KEKLKRLFSQAGFSNIKVRSFTGG

SEQ ID NO: 2021550 - protein, 23 aa, Staphylococcus
KEKLNYRCNPIHIIIEVEFNLLI

SEQ ID NO: 2021551 - protein, 18 aa, Staphylococcus
KEKLRTNVGMVFQQPNPF

SEQ ID NO: 2021552 - protein, 20 aa, Staphylococcus
KEKLRTNVGMVFQQPNPFPK

SEQ ID NO: 2021553 - protein, 17 aa, Staphylococcus
KEKLTYLSDEKMKEIDN

SEQ ID NO: 2021554 - protein, 17 aa, Staphylococcus
KEKLTYLSDKKMKEVNN

SEQ ID NO: 2021555 - protein, 24 aa, Staphylococcus
KEKMAELADAFILAPGGAGSLEEF

SEQ ID NO: 2021556 - protein, 28 aa, Staphylococcus
KEKMPIEVVYGFAQLKRGAALANNELGK

SEQ ID NO: 2021557 - protein, 17 aa, Staphylococcus
KEKNEFINTMGWFTNIY

SEQ ID NO: 2021558 - protein, 23 aa, Staphylococcus
KEKPYIMPVWSMKGRALKVRDQD

SEQ ID NO: 2021559 - protein, 22 aa, Staphylococcus
KEKQFFVIEHLARSMVKEAKTI

SEQ ID NO: 2021560 - protein, 23 aa, Staphylococcus
KEKQRLRTLFPYIKEASENHKKR

SEQ ID NO: 2021561 - protein, 21 aa, Staphylococcus
KEKRDVMISGLGFITIGPGAK

SEQ ID NO: 2021562 - protein, 33 aa, Staphylococcus; identical to SEQ ID NO: 1807734

SEQ ID NO: 2021563 - protein, 24 aa, Staphylococcus
KEKSYQLLLDLGFSRDIMSLSPFQ

SEQ ID NO: 2021564 - protein, 26 aa, Staphylococcus
KEKVEIALLHLRRLVELKGEKIGVME

SEQ ID NO: 2021565 - protein, 37 aa, Staphylococcus
KEKYFEGCMPFEVMAARGRKTLLFGPMKPVGLEDPKT

SEQ ID NO: 2021566 - protein, 37 aa, Staphylococcus
KEKYFEGCMPFEVMAGRGRKTLLFGPMKPVGLEDPKT

SEQ ID NO: 2021567 - protein, 18 aa, Staphylococcus
KEKYRIVYYDGEAALALL

SEQ ID NO: 2021568 - protein, 17 aa, Staphylococcus
KELAEEIGYPVVLKAAS

SEQ ID NO: 2021569 - protein, 22 aa, Staphylococcus
KELAENLNVCFNCDHHIALTAH

SEQ ID NO: 2021570 - protein, 23 aa, Staphylococcus
KELASFYVACELFKQMDYSPDSK

SEQ ID NO: 2021571 - protein, 18 aa, Staphylococcus
KELDECSSEIIIINKSGI

SEQ ID NO: 2021572 - protein, 22 aa, Staphylococcus
KELDEHFPLVVWQTGSGTQSNM

SEQ ID NO: 2021573 - protein, 20 aa, Staphylococcus
KELDFYIPLNKVVKDCSIGE

SEQ ID NO: 2021574 - protein, 20 aa, Staphylococcus
KELDSLWQLRNMFRDTTDFT

SEQ ID NO: 2021575 - protein, 26 aa, Staphylococcus
KELDYGFDFYAPQTFLDKQGNRILIG

SEQ ID NO: 2021576 - protein, 21 aa, Staphylococcus
KELEQALAFVVETAVNQVGVD

SEQ ID NO: 2021577 - protein, 21 aa, Staphylococcus
KELESALTFVVETAVNQVGVD

SEQ ID NO: 2021578 - protein, 23 aa, Staphylococcus
KELFELDCDILVPAAISNQITEE

SEQ ID NO: 2021579 - protein, 18 aa, Staphylococcus
KELFFITKILKIEITNPI

SEQ ID NO: 2021580 - protein, 24 aa, Staphylococcus
KELFKRVLPDVLIKLEKAGYETSA

SEQ ID NO: 2021581 - protein, 19 aa, Staphylococcus
KELGSTHIVVGRPITKSEN

SEQ ID NO: 2021582 - protein, 30 aa, Staphylococcus
KELGYPFIVKTRFGGYDGKGQILVENESNL

SEQ ID NO: 2021583 - protein, 21 aa, Staphylococcus
KELIIQLATLYGLTADGMKKV

SEQ ID NO: 2021584 - protein, 19 aa, Staphylococcus
KELIKSFKMSGLVNSDEEV

SEQ ID NO: 2021585 - protein, 20 aa, Staphylococcus
KELIRFNAEYAKIEGELSYR

SEQ ID NO: 2021586 - protein, 17 aa, Staphylococcus
KELKELLDEVSAASDYI

SEQ ID NO: 2021587 - protein, 17 aa, Staphylococcus
KELKKGSIENISKKQLS

SEQ ID NO: 2021588 - protein, 17 aa, Staphylococcus
KELKRLGVNATIRREQG

SEQ ID NO: 2021589 - protein, 23 aa, Staphylococcus
KELKRVLKPQGVYYATFADLTDN

SEQ ID NO: 2021590 - protein, 23 aa, Staphylococcus
KELKSHLINLCKINDIPYKVDIY

SEQ ID NO: 2021591 - protein, 24 aa, Staphylococcus
KELKTHLVNLCKFNHIPYKIDIYP

SEQ ID NO: 2021592 - protein, 21 aa, Staphylococcus
KELLDNEIITWSQKEFEPQDV

SEQ ID NO: 2021593 - protein, 22 aa, Staphylococcus
KELLEQWLYDESIDFPIDASNI

SEQ ID NO: 2021594 - protein, 19 aa, Staphylococcus
KELLGYARFRHDPEGDFGR

SEQ ID NO: 2021595 - protein, 31 aa, Staphylococcus
KELLLKCDITYGQLYRWKRKNLIPDEWFIRK

SEQ ID NO: 2021596 - protein, 26 aa, Staphylococcus
KELLMMRRNIGMIFQHFNLVKRSTVL

SEQ ID NO: 2021597 - protein, 21 aa, Staphylococcus
KELLQLIPPDKLKPFINNILG

SEQ ID NO: 2021598 - protein, 18 aa, Staphylococcus
KELLQRYDIESKIIEIEG

SEQ ID NO: 2021599 - protein, 19 aa, Staphylococcus
KELLVDMIAVQNLEQRAAE

SEQ ID NO: 2021600 - protein, 21 aa, Staphylococcus
KELNIDFSKFVQRKKKVVQTL

SEQ ID NO: 2021601 - protein, 17 aa, Staphylococcus
KELNKNKVWLGVWEHNQ

SEQ ID NO: 2021602 - protein, 23 aa, Staphylococcus
KELNTELFIKKGRNIVLTENGKL

SEQ ID NO: 2021603 - protein, 17 aa, Staphylococcus
KELPGIHGAVAEVIDVP

SEQ ID NO: 2021604 - protein, 24 aa, Staphylococcus
KELPMEYAVEMNRLIKFEMEGSIG

SEQ ID NO: 2021605 - protein, 17 aa, Staphylococcus
KELQDFGLETELDNNGY

SEQ ID NO: 2021606 - protein, 21 aa, Staphylococcus
KELQEVGLLEQIRTGFNKPNK

SEQ ID NO: 2021607 - protein, 28 aa, Staphylococcus
KELQGAHTVVWNGPMGVFEFSNFAQGTI

SEQ ID NO: 2021608 - protein, 19 aa, Staphylococcus
KELSSVFNFHHLKVDYPDG

SEQ ID NO: 2021609 - protein, 22 aa, Staphylococcus
KELSTILKFSFGIAPRKVEYGD

SEQ ID NO: 2021610 - protein, 22 aa, Staphylococcus
KELSTKCEYVLVVSPVQRREKK

SEQ ID NO: 2021611 - protein, 17 aa, Staphylococcus
KELTVQFVPSQNADKLE

SEQ ID NO: 2021612 - protein, 19 aa, Staphylococcus
KEMAEMYPVLVNDVEITNG

SEQ ID NO: 2021613 - protein, 18 aa, Staphylococcus
KEMEKSDVLVTVHDIKQY

SEQ ID NO: 2021614 - protein, 18 aa, Staphylococcus
KEMFGRQKLILDNYGLTR

SEQ ID NO: 2021615 - protein, 23 aa, Staphylococcus
KEMGTCFKESFEATEDQLLPLGL

SEQ ID NO: 2021616 - protein, 17 aa, Staphylococcus
KEMKGYGPSKHLMTYGE

SEQ ID NO: 2021617 - protein, 17 aa, Staphylococcus
KEMKINLTKEIKLLLLS

SEQ ID NO: 2021618 - protein, 17 aa, Staphylococcus
KEMKVKPSVESKSETRH

SEQ ID NO: 2021619 - protein, 22 aa, Staphylococcus
KEMPHIKVVMLTSFIEDKEVYR

SEQ ID NO: 2021620 - protein, 17 aa, Staphylococcus
KEMQFRKLGKYPPYYYL

SEQ ID NO: 2021621 - protein, 21 aa, Staphylococcus
KEMQLMFPGSIHYQIRQPLCY

SEQ ID NO: 2021622 - protein, 21 aa, Staphylococcus
KEMRDNILYYKDLGIDLKGIC

SEQ ID NO: 2021623 - protein, 21 aa, Staphylococcus
KEMRTRMTPAHRLLDYGCGTG

SEQ ID NO: 2021624 - protein, 17 aa, Staphylococcus
KEMVPSFGMKLSENEAL

SEQ ID NO: 2021625 - protein, 22 aa, Staphylococcus
KENALDLIQFVAPIKTIITDIL

SEQ ID NO: 2021626 - protein, 26 aa, Staphylococcus
KENDLAHGEFGKWLENLNLDWNTANR

SEQ ID NO: 2021627 - protein, 26 aa, Staphylococcus
KENDLAHGEFGKWLKSINLNQNVANK

SEQ ID NO: 2021628 - protein, 23 aa, Staphylococcus
KENDVLLEMCPKSNIQTKAITGL

SEQ ID NO: 2021629 - protein, 17 aa, Staphylococcus
KENDVYETFDYLSYNKQ

SEQ ID NO: 2021630 - protein, 24 aa, Staphylococcus
KENELRINIIHKFCENPNKEIEVI

SEQ ID NO: 2021631 - protein, 27 aa, Staphylococcus
KENFDAIVDYCREKGFLVLTYDEGYII

SEQ ID NO: 2021632 - protein, 20 aa, Staphylococcus
KENFKEVCEFIGRSEPLLTR

SEQ ID NO: 2021633 - protein, 24 aa, Staphylococcus
KENGFTVVDAFGFDAPKTKEFKNV

SEQ ID NO: 2021634 - protein, 19 aa, Staphylococcus
KENGFTVVDSFGFETPKTK

SEQ ID NO: 2021635 - protein, 21 aa, Staphylococcus
KENGLDILSFVAPIKTIITDL

SEQ ID NO: 2021636 - protein, 24 aa, Staphylococcus
KENGVRIALTEVWEKGGKGGVDLA

SEQ ID NO: 2021637 - protein, 25 aa, Staphylococcus
KENGWDNYPICMAKTQYSFTDDATE

SEQ ID NO: 2021638 - protein, 17 aa, Staphylococcus
KENGYRSLHIVVSIPVF

SEQ ID NO: 2021639 - protein, 26 aa, Staphylococcus
KENHPQLKVCACLGLANEDQASRLKE

SEQ ID NO: 2021640 - protein, 21 aa, Staphylococcus
KENIEGYAFVSLGKPNVKAQV

SEQ ID NO: 2021641 - protein, 21 aa, Staphylococcus
KENIMLPLSVLKLNKEEMNKR

SEQ ID NO: 2021642 - protein, 18 aa, Staphylococcus
KENKAKFTMQVLSINSKG

SEQ ID NO: 2021643 - protein, 22 aa, Staphylococcus
KENNDLVVVNVDWGIPNERNVT

SEQ ID NO: 2021644 - protein, 20 aa, Staphylococcus
KENNDYVVVNVDWGIPNERN

SEQ ID NO: 2021645 - protein, 21 aa, Staphylococcus
KENNLKGRILVSTEGINGTLS

SEQ ID NO: 2021646 - protein, 22 aa, Staphylococcus
KENNLKGRILVSTEGINGTLSG

SEQ ID NO: 2021647 - protein, 24 aa, Staphylococcus
KENNVRIALTEVWEKGGKGGVDLA

SEQ ID NO: 2021648 - protein, 22 aa, Staphylococcus
KENPHLTVLVVGGFVSQDSNAI

SEQ ID NO: 2021649 - protein, 25 aa, Staphylococcus
KENPLDYLLCFYRDFDNDFIRSLQL

SEQ ID NO: 2021650 - protein, 19 aa, Staphylococcus
KENVAVCFFGDGAANEGNF

SEQ ID NO: 2021651 - protein, 21 aa, Staphylococcus
KENVKGLYLYGSFGTGKSFIL

SEQ ID NO: 2021652 - protein, 19 aa, Staphylococcus
KENVLSIYESFKLPNDDQR

SEQ ID NO: 2021653 - protein, 18 aa, Staphylococcus
KENWKKAKKELGKKKVTF

SEQ ID NO: 2021654 - protein, 18 aa, Staphylococcus
KENWKKAKRELKLKTFTF

SEQ ID NO: 2021655 - protein, 24 aa, Staphylococcus
KEPEKVFKFFHIILKYIYRKKSFF

SEQ ID NO: 2021656 - protein, 20 aa, Staphylococcus
KEPILFQWQDDFVVGVMLAS

SEQ ID NO: 2021657 - protein, 17 aa, Staphylococcus
KEPLRYGENPQQDAYFV

SEQ ID NO: 2021658 - protein, 18 aa, Staphylococcus
KEQFDSMSVAERTELFIN

SEQ ID NO: 2021659 - protein, 17 aa, Staphylococcus
KEQFGFLLDAFKYGAPP

SEQ ID NO: 2021660 - protein, 19 aa, Staphylococcus
KEQFKSHDFKVLDGTSFNE

SEQ ID NO: 2021661 - protein, 21 aa, Staphylococcus
KEQFPNTKYDYYKGLDDEVKK

SEQ ID NO: 2021662 - protein, 24 aa, Staphylococcus
KEQGKRKFLNLGHTFGHAIEYQYK

SEQ ID NO: 2021663 - protein, 18 aa, Staphylococcus
KEQHKVPGISGSVKGAII

SEQ ID NO: 2021664 - protein, 20 aa, Staphylococcus
KEQIVGLLIENYPSRYKIYD

SEQ ID NO: 2021665 - protein, 19 aa, Staphylococcus
KEQKDRYIIEDDYDSEFRY

SEQ ID NO: 2021666 - protein, 18 aa, Staphylococcus
KEQLAFVNAVKSQLDLYQ

SEQ ID NO: 2021667 - protein, 26 aa, Staphylococcus
KEQLLFPLNHLFRKIELNEMCTAITP

SEQ ID NO: 2021668 - protein, 20 aa, Staphylococcus
KEQPDALLILGDTNSCLAAV

SEQ ID NO: 2021669 - protein, 17 aa, Staphylococcus
KEQPDKFIKNSLHGLIE

SEQ ID NO: 2021670 - protein, 26 aa, Staphylococcus
KEQPIYEGSMCICGTGGDRSGSFNIS

SEQ ID NO: 2021671 - protein, 18 aa, Staphylococcus
KEQPYFELLDLLNDDNEE

SEQ ID NO: 2021672 - protein, 19 aa, Staphylococcus
KEQQELVRFAVAEFGQLDV

SEQ ID NO: 2021673 - protein, 24 aa, Staphylococcus
KEQTCEFCGNLFDVELVKENIDAR

SEQ ID NO: 2021674 - protein, 18 aa, Staphylococcus
KERDIEGFSHMKKSELID

SEQ ID NO: 2021675 - protein, 19 aa, Staphylococcus
KERDVKRSGYLVITSDKGL

SEQ ID NO: 2021676 - protein, 18 aa, Staphylococcus
KERELKRQQLLKEAEARN

SEQ ID NO: 2021677 - protein, 24 aa, Staphylococcus
KERFNLYLDEEFEMGIDMDTYVHF

SEQ ID NO: 2021678 - protein, 18 aa, Staphylococcus
KERFNLYLDNEFEMGIDI

SEQ ID NO: 2021679 - protein, 18 aa, Staphylococcus
KERFVPFGEFCRQSIEQY

SEQ ID NO: 2021680 - protein, 19 aa, Staphylococcus
KERFVPFGEFCRQSIEQYL

SEQ ID NO: 2021681 - protein, 23 aa, Staphylococcus
KERHKGSMPRELYLRLKKYVQNK

SEQ ID NO: 2021682 - protein, 23 aa, Staphylococcus
KERHLAALSFLTFVALDDNGKPV

SEQ ID NO: 2021683 - protein, 23 aa, Staphylococcus
KERHLAALSFLTFVALDENGKPT

SEQ ID NO: 2021684 - protein, 23 aa, Staphylococcus
KERIDDVVTSFVWFNDDYFTHEP

SEQ ID NO: 2021685 - protein, 28 aa, Staphylococcus
KERIEIPEGLKLDGEVIVQYGQLIDGKI

SEQ ID NO: 2021686 - protein, 28 aa, Staphylococcus
KERIEKAPNLKLVITAGVGSDHVDLQAA

SEQ ID NO: 2021687 - protein, 22 aa, Staphylococcus
KERIKDALIPKHKNNTFFALDD

SEQ ID NO: 2021688 - protein, 19 aa, Staphylococcus
KERIKDMIVKVAKSLSLTT

SEQ ID NO: 2021689 - protein, 24 aa, Staphylococcus
KERIKSQKVEIERLVKQQESTQQQ

SEQ ID NO: 2021690 - protein, 18 aa, Staphylococcus
KERIPVVIKNTNRPQDPG

SEQ ID NO: 2021691 - protein, 26 aa, Staphylococcus
KERLEGEHFGDFVIRSGVVAKVHDGR

SEQ ID NO: 2021692 - protein, 26 aa, Staphylococcus
KERLEGEHFGDFVIRSGVVAKVHGGQ

SEQ ID NO: 2021693 - protein, 24 aa, Staphylococcus
KERPMDRLLCGDVGYGKTEVALRA

SEQ ID NO: 2021694 - protein, 24 aa, Staphylococcus
KERPMDRLLCGDVGYGKTEVAVRA

SEQ ID NO: 2021695 - protein, 26 aa, Staphylococcus
KERVPKIIDRSCRFYGSSYNFKKEDT

SEQ ID NO: 2021696 - protein, 20 aa, Staphylococcus
KERYETLANRALEYLEKYKK

SEQ ID NO: 2021697 - protein, 19 aa, Staphylococcus
KERYEVYHGVRIQDKALVA

SEQ ID NO: 2021698 - protein, 27 aa, Staphylococcus
KESDHYGLWTFKKVWGTYLSEKIGEFD

SEQ ID NO: 2021699 - protein, 21 aa, Staphylococcus
KESDNALVFCVGNIHGPGGRI

SEQ ID NO: 2021700 - protein, 23 aa, Staphylococcus
KESELLIKLGYQLLMYQQPLTSE

SEQ ID NO: 2021701 - protein, 22 aa, Staphylococcus
KESFTLPILGTHNMKNATIAIA

SEQ ID NO: 2021702 - protein, 20 aa, Staphylococcus
KESHELLEICLGPDSPDSLI

SEQ ID NO: 2021703 - protein, 18 aa, Staphylococcus
KESIYKGAIIDLEVHDVE

SEQ ID NO: 2021704 - protein, 21 aa, Staphylococcus
KESKHNVQIIELLEKQIDTLN

SEQ ID NO: 2021705 - protein, 18 aa, Staphylococcus
KESLDLSKRMKWYTVIQA

SEQ ID NO: 2021706 - protein, 20 aa, Staphylococcus
KESLGFDQQTTWLSVLPIYH

SEQ ID NO: 2021707 - protein, 18 aa, Staphylococcus
KESLRYGENPQQSAYFVR

SEQ ID NO: 2021708 - protein, 25 aa, Staphylococcus
KESMLNKKQLKMFAIHNNIQSLKNN

SEQ ID NO: 2021709 - protein, 24 aa, Staphylococcus
KESNIKLIYWLKGSGRVILNLKKF

SEQ ID NO: 2021710 - protein, 27 aa, Staphylococcus
KESNLPFELIGAIPVLIKKNGNIDEKI

SEQ ID NO: 2021711 - protein, 19 aa, Staphylococcus
KESNVPIMFISSRTDNMDQ

SEQ ID NO: 2021712 - protein, 21 aa, Staphylococcus
KESRELVGILTNRDLRFIEDF

SEQ ID NO: 2021713 - protein, 20 aa, Staphylococcus
KESRVKGTDFIIVRELTSGL

SEQ ID NO: 2021714 - protein, 23 aa, Staphylococcus
KESTELFEGPSINLAKIRGGSVY

SEQ ID NO: 2021715 - protein, 19 aa, Staphylococcus
KESVISAMMFKGSASKLNF

SEQ ID NO: 2021716 - protein, 20 aa, Staphylococcus
KESVLKNMKASIIAEDDVLA

SEQ ID NO: 2021717 - protein, 21 aa, Staphylococcus
KESYEGFANFYIEQAKEERFH

SEQ ID NO: 2021718 - protein, 18 aa, Staphylococcus
KETFGVVRIHYALKRECN

SEQ ID NO: 2021719 - protein, 18 aa, Staphylococcus
KETFKALKDIGVTYVDVS

SEQ ID NO: 2021720 - protein, 24 aa, Staphylococcus
KETFMTNIFGMMFLSQAAVPHLSK

SEQ ID NO: 2021721 - protein, 30 aa, Staphylococcus
KETGAYCASPFASHSYVFISWTGKMNETFV

SEQ ID NO: 2021722 - protein, 19 aa, Staphylococcus
KETGITIMYMVKKLDAGNI

SEQ ID NO: 2021723 - protein, 23 aa, Staphylococcus
KETGVQYLATWVSTGGGITPLLD

SEQ ID NO: 2021724 - protein, 18 aa, Staphylococcus
KETIKNTFDSASTFGRKI

SEQ ID NO: 2021725 - protein, 22 aa, Staphylococcus
KETKPYGNIVCYRNLKDNTDKA

SEQ ID NO: 2021726 - protein, 17 aa, Staphylococcus
KETLDYFIDAMIQIAEE

SEQ ID NO: 2021727 - protein, 21 aa, Staphylococcus
KETLEIYAPLADRLGINTIKW

SEQ ID NO: 2021728 - protein, 33 aa, Staphylococcus; identical to SEQ ID NO: 1807791

SEQ ID NO: 2021729 - protein, 23 aa, Staphylococcus
KETNEWIGFIGLNYIPKDSQYPF

SEQ ID NO: 2021730 - protein, 23 aa, Staphylococcus
KETNGWLGFVGLNYVPKESKYTF

SEQ ID NO: 2021731 - protein, 19 aa, Staphylococcus
KETPDRFEFIVKIHQALTL

SEQ ID NO: 2021732 - protein, 24 aa, Staphylococcus
KETPKLEALKHLFYKMQQLESDYI

SEQ ID NO: 2021733 - protein, 17 aa, Staphylococcus
KETRQSIAKDLSMLGSN

SEQ ID NO: 2021734 - protein, 20 aa, Staphylococcus
KETVAILSGGFWNNGVTSAL

SEQ ID NO: 2021735 - protein, 22 aa, Staphylococcus
KETVAILSGGFWNNGVTTALIN

SEQ ID NO: 2021736 - protein, 17 aa, Staphylococcus
KETYKDNVYLIGHSMGG

SEQ ID NO: 2021737 - protein, 19 aa, Staphylococcus
KETYKLWRQTLLEVGVGRP

SEQ ID NO: 2021738 - protein, 22 aa, Staphylococcus
KETYPQLGRLIGFIPKDQAVDV

SEQ ID NO: 2021739 - protein, 26 aa, Staphylococcus
KEVAKAESVSICWAMGITQQDIGSDS

SEQ ID NO: 2021740 - protein, 17 aa, Staphylococcus
KEVDSIIDLIKSLDNET

SEQ ID NO: 2021741 - protein, 20 aa, Staphylococcus
KEVDYLKQFIEHKLLQYIDE

SEQ ID NO: 2021742 - protein, 18 aa, Staphylococcus
KEVEIPRNKIAKARHAVL

SEQ ID NO: 2021743 - protein, 24 aa, Staphylococcus
KEVIEEVGHALQVFSEGKTETPLR

SEQ ID NO: 2021744 - protein, 24 aa, Staphylococcus
KEVIIKFRIHDDLINYDNIEILTY

SEQ ID NO: 2021745 - protein, 19 aa, Staphylococcus
KEVKDKFGDFNVIVNNAGL

SEQ ID NO: 2021746 - protein, 29 aa, Staphylococcus
KEVKDSDGRIILFIDEIHILVGAGKTEGA

SEQ ID NO: 2021747 - protein, 20 aa, Staphylococcus
KEVKNEVGIDIKIVPEEDEA

SEQ ID NO: 2021748 - protein, 24 aa, Staphylococcus
KEVKQLILPIQFNKVFMIDFKAFE

SEQ ID NO: 2021749 - protein, 21 aa, Staphylococcus
KEVLDRLANMHINFPTDEAFK

SEQ ID NO: 2021750 - protein, 17 aa, Staphylococcus
KEVLHDVTMFSGQSHGI

SEQ ID NO: 2021751 - protein, 18 aa, Staphylococcus
KEVLTVITGVAGSGKSTL

SEQ ID NO: 2021752 - protein, 20 aa, Staphylococcus
KEVMTRPIVTNALTHGLSLV

SEQ ID NO: 2021753 - protein, 27 aa, Staphylococcus
KEVNKTAAQVIIKWNMQHNVVVIPKSV

SEQ ID NO: 2021754 - protein, 25 aa, Staphylococcus
KEVNRLINDLIYFVRDTIMNKTAQR

SEQ ID NO: 2021755 - protein, 22 aa, Staphylococcus
KEVREARNITFGLFRLSVGLET

SEQ ID NO: 2021756 - protein, 20 aa, Staphylococcus
KEVVARGANPCIISMEGLDK

SEQ ID NO: 2021757 - protein, 18 aa, Staphylococcus
KEVVPVFWIAGEDHDFDE

SEQ ID NO: 2021758 - protein, 25 aa, Staphylococcus
KEWRDFSKDLGYWVDMDSPYITLEN

SEQ ID NO: 2021759 - protein, 25 aa, Staphylococcus
KEYADHIIDAFGMRPYIKKKVKKYS

SEQ ID NO: 2021760 - protein, 23 aa, Staphylococcus
KEYDRLIKFLGGIRDMKTMPQAL

SEQ ID NO: 2021761 - protein, 25 aa, Staphylococcus
KEYELCPGRVLLVMMNDVYQIKSEN

SEQ ID NO: 2021762 - protein, 23 aa, Staphylococcus
KEYGFKSVCVNPTHVEYSAEQLK

SEQ ID NO: 2021763 - protein, 24 aa, Staphylococcus
KEYGSRIIGLRAGELVYDGPASEA

SEQ ID NO: 2021764 - protein, 18 aa, Staphylococcus
KEYGVLLIDAQDPKLRHL

SEQ ID NO: 2021765 - protein, 24 aa, Staphylococcus
KEYMDFTEIIPISALEGLNVDHFI

SEQ ID NO: 2021766 - protein, 17 aa, Staphylococcus
KEYPVIRKPQGANIGEQ

SEQ ID NO: 2021767 - protein, 21 aa, Staphylococcus
KEYRDGLMAAVALKYPGYDFE

SEQ ID NO: 2021768 - protein, 25 aa, Staphylococcus
KEYSDHIIDAFGMRPYIKKKVKKYS

SEQ ID NO: 2021769 - protein, 21 aa, Staphylococcus
KEYTTRLTLNQMILMYDQIIE

SEQ ID NO: 2021770 - protein, 19 aa, Staphylococcus
KEYVFGKGGGMKLADELNT

SEQ ID NO: 2021771 - protein, 18 aa, Staphylococcus
KEYWDYKINKRKKEEEKY

SEQ ID NO: 2021772 - protein, 21 aa, Staphylococcus
KFADLRFDEDVVFCEEHTFIV

SEQ ID NO: 2021773 - protein, 21 aa, Staphylococcus
KFAEACGGAGYTLTDPSDIDT

SEQ ID NO: 2021774 - protein, 25 aa, Staphylococcus
KFAGGKGINVSRVLKTLGVDSTALG

SEQ ID NO: 2021775 - protein, 20 aa, Staphylococcus
KFAKELGHTITELFPTEVPI

SEQ ID NO: 2021776 - protein, 17 aa, Staphylococcus
KFALLLHDCPKKGMHDV

SEQ ID NO: 2021777 - protein, 18 aa, Staphylococcus
KFANRVIFVDEWKRTIDG

SEQ ID NO: 2021778 - protein, 19 aa, Staphylococcus
KFASIQMFNALSFNYYYLG

SEQ ID NO: 2021779 - protein, 20 aa, Staphylococcus
KFDAIVGRRVLMYLPGAYEA

SEQ ID NO: 2021780 - protein, 20 aa, Staphylococcus
KFDEPFYRKMADQKYKMQDF

SEQ ID NO: 2021781 - protein, 22 aa, Staphylococcus
KFDHLKESLGLIDLSEIHVEGQ

SEQ ID NO: 2021782 - protein, 20 aa, Staphylococcus
KFDKQVLFTGIFNSEKDAQT

SEQ ID NO: 2021783 - protein, 30 aa, Staphylococcus
KFDMPYEEAKSWMLKALEPMGEEYLNVVKE

SEQ ID NO: 2021784 - protein, 21 aa, Staphylococcus
KFDVERFNADFAYTMDGSEFG

SEQ ID NO: 2021785 - protein, 24 aa, Staphylococcus
KFEADWCPDCKAMDMWIDPITEKY

SEQ ID NO: 2021786 - protein, 18 aa, Staphylococcus
KFEAFKLEKINENNEKYG

SEQ ID NO: 2021787 - protein, 19 aa, Staphylococcus
KFEDVRIVRDMRNSVNRLV

SEQ ID NO: 2021788 - protein, 25 aa, Staphylococcus
KFEGLIHRFRRSFLLNDNFEKINLK

SEQ ID NO: 2021789 - protein, 21 aa, Staphylococcus
KFEKMMDWLAGVYINSLNIIH

SEQ ID NO: 2021790 - protein, 31 aa, Staphylococcus
KFEKVKRLFDHIDIPTAKDWKALQEQVQQHG

SEQ ID NO: 2021791 - protein, 19 aa, Staphylococcus
KFELREMTHLKSTYSKHMF

SEQ ID NO: 2021792 - protein, 24 aa, Staphylococcus
KFEMFKMEIQPGGKMHSDPHHPGS

SEQ ID NO: 2021793 - protein, 19 aa, Staphylococcus
KFENKEFQILSGHQSIQEA

SEQ ID NO: 2021794 - protein, 25 aa, Staphylococcus
KFESSCGWPSFSKALNDDEIVELVD

SEQ ID NO: 2021795 - protein, 19 aa, Staphylococcus
KFETLPIDSQCYIETRGTN

SEQ ID NO: 2021796 - protein, 23 aa, Staphylococcus
KFEVMSIPTLIVFKDGKPVDKVV

SEQ ID NO: 2021797 - protein, 32 aa, Staphylococcus
KFGGLDLLSPMKCLRIIAMFRLINPTKEIRIA

SEQ ID NO: 2021798 - protein, 26 aa, Staphylococcus
KFGHRKSLWVWTGFLYEYLSHDAGIR

SEQ ID NO: 2021799 - protein, 24 aa, Staphylococcus
KFGINLRYPKGFEFETALERFKNE

SEQ ID NO: 2021800 - protein, 19 aa, Staphylococcus
KFGKNEVLKGINLEIKKGE

SEQ ID NO: 2021801 - protein, 20 aa, Staphylococcus
KFGTEIWSEEAFVQKQNEIE

SEQ ID NO: 2021802 - protein, 27 aa, Staphylococcus
KFGVNGIRISIAWSRIFPNGYGDVNPK

SEQ ID NO: 2021803 - protein, 17 aa, Staphylococcus
KFIDLCVDLGIMGIPSF

SEQ ID NO: 2021804 - protein, 24 aa, Staphylococcus
KFIESLELFSLLANVGDAKSLVIH

SEQ ID NO: 2021805 - protein, 20 aa, Staphylococcus
KFIHPGFNVIMYESYLNLAQ

SEQ ID NO: 2021806 - protein, 27 aa, Staphylococcus
KFIRTSHLYKAYDIWARDNHQYRMSSR

SEQ ID NO: 2021807 - protein, 17 aa, Staphylococcus
KFITHSYPHDWRTKKPV

SEQ ID NO: 2021808 - protein, 19 aa, Staphylococcus
KFIVGDTHPDWISIEEEKA

SEQ ID NO: 2021809 - protein, 20 aa, Staphylococcus
KFKADAVLLATGRKPNTDGL

SEQ ID NO: 2021810 - protein, 23 aa, Staphylococcus
KFKADLNDLMPYLIKEKVWDAHL

SEQ ID NO: 2021811 - protein, 18 aa, Staphylococcus
KFKAGLEKSRQNFQEQLN

SEQ ID NO: 2021812 - protein, 18 aa, Staphylococcus
KFKDALHLADFFNAPYQM

SEQ ID NO: 2021813 - protein, 35 aa, Staphylococcus
KFKEAINMIIKYNVPICSFTFGIPDALTIEKLKEH

SEQ ID NO: 2021814 - protein, 19 aa, Staphylococcus
KFKHWLKQDYIYLIEYARL

SEQ ID NO: 2021815 - protein, 27 aa, Staphylococcus
KFKKDGTCNPVLFQIHTHFWNQFQQQF

SEQ ID NO: 2021816 - protein, 20 aa, Staphylococcus
KFKLTVLVDMFGRETPVEVE

SEQ ID NO: 2021817 - protein, 26 aa, Staphylococcus
KFKNAESKLTVAMGNRINNEPLLMDI

SEQ ID NO: 2021818 - protein, 18 aa, Staphylococcus
KFKQALIELFELAETPQA

SEQ ID NO: 2021819 - protein, 20 aa, Staphylococcus
KFKQYGMPQVISYAKPSKLE

SEQ ID NO: 2021820 - protein, 22 aa, Staphylococcus
KFKTTTITFKFMTPLNYETITQ

SEQ ID NO: 2021821 - protein, 20 aa, Staphylococcus
KFLEKEFSSLSWINNQEVAL

SEQ ID NO: 2021822 - protein, 25 aa, Staphylococcus
KFMQDEIPVHMKIIYDEDSHKILGA

SEQ ID NO: 2021823 - protein, 19 aa, Staphylococcus
KFNALTFISGTLTFNHSFD

SEQ ID NO: 2021824 - protein, 24 aa, Staphylococcus
KFNGLKGQGILFVRNIHQLEPIVH

SEQ ID NO: 2021825 - protein, 19 aa, Staphylococcus
KFNGLKGQGILIIDNKEKI

SEQ ID NO: 2021826 - protein, 24 aa, Staphylococcus
KFNGLKGQGLLIIKNIQNIEPVVH

SEQ ID NO: 2021827 - protein, 19 aa, Staphylococcus
KFNGLKGQGLLLIDNKDKL

SEQ ID NO: 2021828 - protein, 19 aa, Staphylococcus
KFNGLKGQGLLLIDNVRKL

SEQ ID NO: 2021829 - protein, 24 aa, Staphylococcus
KFNGLKGQGLLLVRNIHNLEPVIH

SEQ ID NO: 2021830 - protein, 26 aa, Staphylococcus
KFNKLKIPILLNRFIKKIKPDIVQTW

SEQ ID NO: 2021831 - protein, 26 aa, Staphylococcus
KFNMIFQFEHLGLWNTGDVKFDVKSY

SEQ ID NO: 2021832 - protein, 26 aa, Staphylococcus
KFNMIFQFEHLGLWSTGDQKFNVNAY

SEQ ID NO: 2021833 - protein, 26 aa, Staphylococcus
KFNMIFQFEHLGLWSTGDSKFDVKSY

SEQ ID NO: 2021834 - protein, 26 aa, Staphylococcus
KFNMIFQFEHLGLWSTGDSQFDVSAY

SEQ ID NO: 2021835 - protein, 21 aa, Staphylococcus
KFNMTDINAAIGIDQLDKYDE

SEQ ID NO: 2021836 - protein, 19 aa, Staphylococcus
KFNNELIATGAIGPYYGSK

SEQ ID NO: 2021837 - protein, 21 aa, Staphylococcus
KFNQTELIAIIGPSGSGKSTF

SEQ ID NO: 2021838 - protein, 32 aa, Staphylococcus
KFNQYMGPYAMHWHMINYCFDNGYARYNFYGL

SEQ ID NO: 2021839 - protein, 19 aa, Staphylococcus
KFNSLTFISGTLTFNHKFD

SEQ ID NO: 2021840 - protein, 19 aa, Staphylococcus
KFNSTLYSLGYPWQHNDNT

SEQ ID NO: 2021841 - protein, 17 aa, Staphylococcus
KFPITLDSTTWIFDDRK

SEQ ID NO: 2021842 - protein, 18 aa, Staphylococcus
KFPKGWKIVENKPSTIPK

SEQ ID NO: 2021843 - protein, 23 aa, Staphylococcus
KFQEILKEFNIKSEIPKNKVARF

SEQ ID NO: 2021844 - protein, 18 aa, Staphylococcus
KFRAGLEKSRENFQAQLN

SEQ ID NO: 2021845 - protein, 17 aa, Staphylococcus
KFRGIRTNITFSTADKD

SEQ ID NO: 2021846 - protein, 34 aa, Staphylococcus
KFSGKGFAKNAFKMAIDYAFLVLNLHKIYLFVDV

SEQ ID NO: 2021847 - protein, 21 aa, Staphylococcus
KFSMIRIVHKPTIFIDKLQSN

SEQ ID NO: 2021848 - protein, 27 aa, Staphylococcus
KFSNGKEFRHGCDCSMIAAGKEAEQQR

SEQ ID NO: 2021849 - protein, 25 aa, Staphylococcus
KFSRLPESLNFISWLQHLQDSGIID

SEQ ID NO: 2021850 - protein, 19 aa, Staphylococcus
KFTEVFKMPNKDIKIDSQN

SEQ ID NO: 2021851 - protein, 17 aa, Staphylococcus
KFVKAVCHLGKDIFGDK

SEQ ID NO: 2021852 - protein, 17 aa, Staphylococcus
KFVLGSVSHKVAKRAQI

SEQ ID NO: 2021853 - protein, 26 aa, Staphylococcus
KFVPEGIEGRIAYKGSLQDTIYQLMG

SEQ ID NO: 2021854 - protein, 20 aa, Staphylococcus
KFYALDMFPYPSGAGLHVGH

SEQ ID NO: 2021855 - protein, 27 aa, Staphylococcus
KFYDRKEIKDLLSYLRIIANSNDDISL

SEQ ID NO: 2021856 - protein, 27 aa, Staphylococcus
KFYDRKEIKDLLSYLRLVANSNDDISL

SEQ ID NO: 2021857 - protein, 26 aa, Staphylococcus
KFYDRKEIKDLLSYLRVVANSNDEIS

SEQ ID NO: 2021858 - protein, 23 aa, Staphylococcus
KFYFFSDIEAIIFDHYRSYFSHK

SEQ ID NO: 2021859 - protein, 20 aa, Staphylococcus
KFYINGRGGLSLYVLEKTQS

SEQ ID NO: 2021860 - protein, 19 aa, Staphylococcus
KFYIPENVYIIGTMNDIDR

SEQ ID NO: 2021861 - protein, 21 aa, Staphylococcus
KFYQHNTFRLEAESSMFYTDI

SEQ ID NO: 2021862 - protein, 24 aa, Staphylococcus
KFYVNGRLPAVSNIGSDHYFGAIS

SEQ ID NO: 2021863 - protein, 21 aa, Staphylococcus
KGAIIKPNIPVIYAVKNEEAL

SEQ ID NO: 2021864 - protein, 18 aa, Staphylococcus
KGALSYIHDIWGYIAPNT

SEQ ID NO: 2021865 - protein, 17 aa, Staphylococcus
KGALSYIQDIWGYIAPN

SEQ ID NO: 2021866 - protein, 20 aa, Staphylococcus
KGAQHALDLLGLATLSLLDT

SEQ ID NO: 2021867 - protein, 18 aa, Staphylococcus
KGASYFDNAESFAMIRGG

SEQ ID NO: 2021868 - protein, 20 aa, Staphylococcus
KGAVMKLGDNKARRVSSISS

SEQ ID NO: 2021869 - protein, 18 aa, Staphylococcus
KGAVMKLGDNKGRKVSST

SEQ ID NO: 2021870 - protein, 20 aa, Staphylococcus
KGAVMKLGDNKGRRVSSTSS

SEQ ID NO: 2021871 - protein, 20 aa, Staphylococcus
KGAVMKLGDNKGRRVSSVST

SEQ ID NO: 2021872 - protein, 17 aa, Staphylococcus
KGAWNVYERAGFMHAAT

SEQ ID NO: 2021873 - protein, 17 aa, Staphylococcus
KGAYWDGKMYVFDERIS

SEQ ID NO: 2021874 - protein, 27 aa, Staphylococcus
KGCHAGYLIKVLNNWAKENVKTKEDAE

SEQ ID NO: 2021875 - protein, 18 aa, Staphylococcus
KGDDLQYTMTIDFEEAVF

SEQ ID NO: 2021876 - protein, 19 aa, Staphylococcus
KGDDLQYTMTITFDEAVFG

SEQ ID NO: 2021877 - protein, 19 aa, Staphylococcus
KGDDLQYTMTLEFDEAVFG

SEQ ID NO: 2021878 - protein, 19 aa, Staphylococcus
KGDDLQYTMTLEFEEAVFG

SEQ ID NO: 2021879 - protein, 18 aa, Staphylococcus
KGDDLQYTMTVTFEEAAF

SEQ ID NO: 2021880 - protein, 21 aa, Staphylococcus
KGDEVLPITFIEDGIAKTGAY

SEQ ID NO: 2021881 - protein, 20 aa, Staphylococcus
KGDEVYKKLQGSWICEIEEL

SEQ ID NO: 2021882 - protein, 19 aa, Staphylococcus
KGDILHFCSVDLVDSPMKQ

SEQ ID NO: 2021883 - protein, 25 aa, Staphylococcus
KGDKCKVSIRFRGRAITHKEIGQRQ

SEQ ID NO: 2021884 - protein, 23 aa, Staphylococcus
KGDKRRARAAAENIVPNSTGAAK

SEQ ID NO: 2021885 - protein, 20 aa, Staphylococcus
KGDKRRARAAAQNIVPNSTG

SEQ ID NO: 2021886 - protein, 20 aa, Staphylococcus
KGDLAEIVKDFLINFQEKYE

SEQ ID NO: 2021887 - protein, 19 aa, Staphylococcus
KGDLHLCWDKVDDLLTDTT

SEQ ID NO: 2021888 - protein, 20 aa, Staphylococcus
KGDMTFKLFPNIAPKTVENF

SEQ ID NO: 2021889 - protein, 18 aa, Staphylococcus
KGDMTFKLLPDVAPKTVE

SEQ ID NO: 2021890 - protein, 22 aa, Staphylococcus
KGDPKIDYLVTWNIPEGITMDQ

SEQ ID NO: 2021891 - protein, 21 aa, Staphylococcus
KGDRGKVVLVTAMSPTPAGEG

SEQ ID NO: 2021892 - protein, 32 aa, Staphylococcus
KGDSFVNPFMKEVWKYDIDVAKAAAKAGFQDI

SEQ ID NO: 2021893 - protein, 18 aa, Staphylococcus
KGDTVGYIEAMKVLNEVT

SEQ ID NO: 2021894 - protein, 19 aa, Staphylococcus
KGDVAPNFKVLDNSLNEVT

SEQ ID NO: 2021895 - protein, 18 aa, Staphylococcus
KGDVIGYIEAMKVMNEVT

SEQ ID NO: 2021896 - protein, 18 aa, Staphylococcus
KGDVLASGLTLLQIPEGV

SEQ ID NO: 2021897 - protein, 22 aa, Staphylococcus
KGDYCGYSFAFEAMHDHTHLAV

SEQ ID NO: 2021898 - protein, 24 aa, Staphylococcus
KGDYCGYSFAYECKNHHTRLAVVD

SEQ ID NO: 2021899 - protein, 18 aa, Staphylococcus
KGDYGRILLIGGNANLGG

SEQ ID NO: 2021900 - protein, 21 aa, Staphylococcus
KGEAIKAYLSIAPKNTVLITD

SEQ ID NO: 2021901 - protein, 22 aa, Staphylococcus
KGEDAFKLYDTYGFPVELTEEL

SEQ ID NO: 2021902 - protein, 24 aa, Staphylococcus
KGEEILKFSNLVAAKVTTKHGAIE

SEQ ID NO: 2021903 - protein, 19 aa, Staphylococcus
KGEEQYIFGDCAINPELDA

SEQ ID NO: 2021904 - protein, 24 aa, Staphylococcus
KGEKIRWKLLYIADPDYMVRPPFF

SEQ ID NO: 2021905 - protein, 33 aa, Staphylococcus
KGENRLKLIHHWINGRMPLIGIGSIFTPEDALN

SEQ ID NO: 2021906 - protein, 24 aa, Staphylococcus
KGEPLKSLGKIASGGELSRIMLAL

SEQ ID NO: 2021907 - protein, 20 aa, Staphylococcus
KGESICVILPTHKFKDFKSF

SEQ ID NO: 2021908 - protein, 20 aa, Staphylococcus
KGETKIPRYFFLSETEDFEP

SEQ ID NO: 2021909 - protein, 22 aa, Staphylococcus
KGEVAYANSYVKWYAEEAKRVY

SEQ ID NO: 2021910 - protein, 17 aa, Staphylococcus
KGEVEGMPGKTMPNFSI

SEQ ID NO: 2021911 - protein, 21 aa, Staphylococcus
KGEYCGYSFAYEVEQNHTKLA

SEQ ID NO: 2021912 - protein, 19 aa, Staphylococcus
KGFIKEIDTLLPVFQDILN

SEQ ID NO: 2021913 - protein, 22 aa, Staphylococcus
KGFKFAEAIYDLAGKAIMKKYF

SEQ ID NO: 2021914 - protein, 23 aa, Staphylococcus
KGFRRISFEKLVLETPIPDDSTI

SEQ ID NO: 2021915 - protein, 19 aa, Staphylococcus
KGFTGHIIRRGVTEADASI

SEQ ID NO: 2021916 - protein, 21 aa, Staphylococcus
KGFYRAFSKLHMMTFKHNAMT

SEQ ID NO: 2021917 - protein, 20 aa, Staphylococcus
KGGFRTGRKNLLQILKAYES

SEQ ID NO: 2021918 - protein, 18 aa, Staphylococcus
KGGGGALFREKVIDAMAE

SEQ ID NO: 2021919 - protein, 18 aa, Staphylococcus
KGGLGCIGAGYFTTKKLE

SEQ ID NO: 2021920 - protein, 17 aa, Staphylococcus
KGGTVFLLPGDITDEDF

SEQ ID NO: 2021921 - protein, 20 aa, Staphylococcus
KGHFEEHDFDVEIFDLAEQP

SEQ ID NO: 2021922 - protein, 21 aa, Staphylococcus
KGHISKILAAYHQYYAVNKAV

SEQ ID NO: 2021923 - protein, 21 aa, Staphylococcus
KGHKVMEQYGLSNIVVHAPYI

SEQ ID NO: 2021924 - protein, 19 aa, Staphylococcus
KGIDFEIADGEFVILNGAS

SEQ ID NO: 2021925 - protein, 30 aa, Staphylococcus
KGIDVPGPFPRMTYSEAMSRYGSDKPDTRF

SEQ ID NO: 2021926 - protein, 21 aa, Staphylococcus
KGIDVSGPFPRMTYEEAMRRY

SEQ ID NO: 2021927 - protein, 18 aa, Staphylococcus
KGIGKGVGEVISEYRETG

SEQ ID NO: 2021928 - protein, 18 aa, Staphylococcus
KGIGKGVGEVISEYRQTG

SEQ ID NO: 2021929 - protein, 22 aa, Staphylococcus
KGIHFANPIGLAAGFDKSCEVP

SEQ ID NO: 2021930 - protein, 31 aa, Staphylococcus
KGIIEKLDYLHFLGVDYIWLTPIYESPMNDN

SEQ ID NO: 2021931 - protein, 18 aa, Staphylococcus
KGIIEVMQNQLLLNQPQS

SEQ ID NO: 2021932 - protein, 20 aa, Staphylococcus
KGIITQAWSPLGRASEVIKD

SEQ ID NO: 2021933 - protein, 22 aa, Staphylococcus
KGIKKNLDFDWVVAIKIIAKKN

SEQ ID NO: 2021934 - protein, 32 aa, Staphylococcus
KGILGKIPFFGICLGHQLFALSQGASSFKMKF

SEQ ID NO: 2021935 - protein, 32 aa, Staphylococcus
KGILGKIPFFGICLGHQLFALSQGATSFKMKF

SEQ ID NO: 2021936 - protein, 24 aa, Staphylococcus
KGINEYLKNMLFVMAENRHLSILP

SEQ ID NO: 2021937 - protein, 21 aa, Staphylococcus
KGIPAALAMSMIKFGMDSYGH

SEQ ID NO: 2021938 - protein, 19 aa, Staphylococcus
KGIVKRSALSNFSHINKNG

SEQ ID NO: 2021939 - protein, 20 aa, Staphylococcus
KGIVKRSSLSNFSRINKNGK

SEQ ID NO: 2021940 - protein, 18 aa, Staphylococcus
KGIYAFRDTILNAIQDVF

SEQ ID NO: 2021941 - protein, 27 aa, Staphylococcus
KGIYKFRYLIIEAIKTVFGYTSLYEKM

SEQ ID NO: 2021942 - protein, 23 aa, Staphylococcus
KGKAIEISSDFVVVAHAVEKFNQ

SEQ ID NO: 2021943 - protein, 21 aa, Staphylococcus
KGKDEVILFAGFPENIESEGF

SEQ ID NO: 2021944 - protein, 18 aa, Staphylococcus
KGKDFIFDATVTVEPEVK

SEQ ID NO: 2021945 - protein, 18 aa, Staphylococcus
KGKDFIFEATVTVEPEVQ

SEQ ID NO: 2021946 - protein, 17 aa, Staphylococcus
KGKEIDFTFTQRNGQSR

SEQ ID NO: 2021947 - protein, 18 aa, Staphylococcus
KGKEVIVSMSQVEGTPEK

SEQ ID NO: 2021948 - protein, 21 aa, Staphylococcus
KGKFGCAQCYTTFKEDIVDIV

SEQ ID NO: 2021949 - protein, 23 aa, Staphylococcus
KGKFISLQLFHALSYNYYFLGNK

SEQ ID NO: 2021950 - protein, 35 aa, Staphylococcus
KGKGKLRIGAIHKRWSRLEMGQFIMGGQRFTDEKR

SEQ ID NO: 2021951 - protein, 18 aa, Staphylococcus
KGKGRLNNQITSIIFDYL

SEQ ID NO: 2021952 - protein, 23 aa, Staphylococcus
KGKIARQLLDHFEGFSPLITNEI

SEQ ID NO: 2021953 - protein, 29 aa, Staphylococcus
KGKIRYWGVSNYSGWALAKTHTLAVANHM

SEQ ID NO: 2021954 - protein, 28 aa, Staphylococcus
KGKIRYWGVSNYSGWNLAQTHTYAAQNN

SEQ ID NO: 2021955 - protein, 24 aa, Staphylococcus
KGKNYRIASAILNLKGDNTSTEAF

SEQ ID NO: 2021956 - protein, 23 aa, Staphylococcus
KGKPCIEYPGFIVHVSITHTQHY

SEQ ID NO: 2021957 - protein, 23 aa, Staphylococcus
KGKSEAFPFLMIGPGQGPHQIDE

SEQ ID NO: 2021958 - protein, 17 aa, Staphylococcus
KGKSKKVEYAWTDDELD

SEQ ID NO: 2021959 - protein, 22 aa, Staphylococcus
KGKSKKVEYAWTDDELEKLQKQ

SEQ ID NO: 2021960 - protein, 22 aa, Staphylococcus
KGKSKKVEYAWTDEELEKLQKK

SEQ ID NO: 2021961 - protein, 19 aa, Staphylococcus
KGKVTGIKKFGAFVELPEG

SEQ ID NO: 2021962 - protein, 21 aa, Staphylococcus
KGKVTGIKKFGAFVELPEGKS

SEQ ID NO: 2021963 - protein, 17 aa, Staphylococcus
KGLDGRYYVDGKRLTGF

SEQ ID NO: 2021964 - protein, 23 aa, Staphylococcus
KGLDIIGLINIQFVLAHDGVYVL

SEQ ID NO: 2021965 - protein, 21 aa, Staphylococcus
KGLEIADNWNMLGMRATESHD

SEQ ID NO: 2021966 - protein, 24 aa, Staphylococcus
KGLEIQRYGSIYMLTSKKECAPFI

SEQ ID NO: 2021967 - protein, 24 aa, Staphylococcus
KGLFGVGTVHHVAWNAEDEAEHKE

SEQ ID NO: 2021968 - protein, 28 aa, Staphylococcus
KGLFHQLPETFKVMRYHSLKAHAQTFPN

SEQ ID NO: 2021969 - protein, 27 aa, Staphylococcus
KGLGKDRITAIFPKLVFSIKRGVNLNE

SEQ ID NO: 2021970 - protein, 27 aa, Staphylococcus
KGLGKDRVTAIFPKLVFSIKDGINLKK

SEQ ID NO: 2021971 - protein, 26 aa, Staphylococcus
KGLGKNRITAIFPKLVFTIKKGVNFS

SEQ ID NO: 2021972 - protein, 19 aa, Staphylococcus
KGLKEWSFGLFEGDSVQLL

SEQ ID NO: 2021973 - protein, 18 aa, Staphylococcus
KGLLTPREYELAKQRFSG

SEQ ID NO: 2021974 - protein, 17 aa, Staphylococcus
KGLLVPVVKHADRKSIF

SEQ ID NO: 2021975 - protein, 19 aa, Staphylococcus
KGLNGYRKTDLDLEIEREL

SEQ ID NO: 2021976 - protein, 24 aa, Staphylococcus
KGLNHSRYLLIEFPPNEIPNYTQS

SEQ ID NO: 2021977 - protein, 32 aa, Staphylococcus
KGLNRARETYKFAGGKGINVSRVLKTLDVSST

SEQ ID NO: 2021978 - protein, 19 aa, Staphylococcus
KGLNVTRVLSQVGEPVTAS

SEQ ID NO: 2021979 - protein, 22 aa, Staphylococcus
KGLPKADIVLIGISRTSKTPLS

SEQ ID NO: 2021980 - protein, 23 aa, Staphylococcus
KGLPTDYIMPEFLRDIFKEKLLR

SEQ ID NO: 2021981 - protein, 20 aa, Staphylococcus
KGLQLDTSKPVLLYAPTWKS

SEQ ID NO: 2021982 - protein, 17 aa, Staphylococcus
KGLRDRVILELLYGTGI

SEQ ID NO: 2021983 - protein, 27 aa, Staphylococcus
KGLVVNVCDIFDFEGSFIHALKRIVGN

SEQ ID NO: 2021984 - protein, 19 aa, Staphylococcus
KGLWKDKKAIILYTQGGPE

SEQ ID NO: 2021985 - protein, 19 aa, Staphylococcus
KGLYAKARSGEIKEFTGIN

SEQ ID NO: 2021986 - protein, 24 aa, Staphylococcus
KGMEVSRQRLVGITKDVIDKQYLD

SEQ ID NO: 2021987 - protein, 17 aa, Staphylococcus
KGMGIPKGITLIVGGGY

SEQ ID NO: 2021988 - protein, 24 aa, Staphylococcus
KGMGKGRTFLIKTYGCQMNAHDTE

SEQ ID NO: 2021989 - protein, 25 aa, Staphylococcus
KGMGTTCVCALVFDNYIVVANIGDS

SEQ ID NO: 2021990 - protein, 17 aa, Staphylococcus
KGMKYSQIHIFSNVGHT

SEQ ID NO: 2021991 - protein, 19 aa, Staphylococcus
KGMTAPQCAGIIHTDFERG

SEQ ID NO: 2021992 - protein, 21 aa, Staphylococcus
KGMVKREVIRVVTPGTIMNQG

SEQ ID NO: 2021993 - protein, 20 aa, Staphylococcus
KGNANYAWIEHMISKLAPNG

SEQ ID NO: 2021994 - protein, 19 aa, Staphylococcus
KGNEHMYLITDAMRAKGME

SEQ ID NO: 2021995 - protein, 19 aa, Staphylococcus
KGNELLNAVGRAFENDMVI

SEQ ID NO: 2021996 - protein, 28 aa, Staphylococcus
KGNIALPLDFPGLFKGYFKDEKRTKDAH

SEQ ID NO: 2021997 - protein, 26 aa, Staphylococcus
KGNIALPLDFPGLFKGYYKDEERTKA

SEQ ID NO: 2021998 - protein, 25 aa, Staphylococcus
KGNISTTRFKKFLTQAFGNASQSFN

SEQ ID NO: 2021999 - protein, 24 aa, Staphylococcus
KGNITIQNPILWQPLDAYLYHMKV

SEQ ID NO: 2022000 - protein, 22 aa, Staphylococcus
KGNKLQLLAAIEAFNKDFTKSH

SEQ ID NO: 2022001 - protein, 18 aa, Staphylococcus
KGNNYVDRFCKIRNSTIG

SEQ ID NO: 2022002 - protein, 22 aa, Staphylococcus
KGNVIRFLPPLVITDQELNKGL

SEQ ID NO: 2022003 - protein, 31 aa, Staphylococcus
KGNYSSDVAMQFASAGWGWHIETAIHLIRIV

SEQ ID NO: 2022004 - protein, 24 aa, Staphylococcus
KGPAKPGPIISIFGDTKPCQSELS

SEQ ID NO: 2022005 - protein, 23 aa, Staphylococcus
KGPAKPGPIVTIFGDTKPCDNEY

SEQ ID NO: 2022006 - protein, 20 aa, Staphylococcus
KGPEIFRQKLYQVGIEPNII

SEQ ID NO: 2022007 - protein, 22 aa, Staphylococcus
KGPEVFKQKLYQVGIEEEIIER

SEQ ID NO: 2022008 - protein, 25 aa, Staphylococcus
KGPEVFKQKLYQVGVEPNIIDRYVK

SEQ ID NO: 2022009 - protein, 18 aa, Staphylococcus
KGPGHLVRRTFAEGSAVP

SEQ ID NO: 2022010 - protein, 18 aa, Staphylococcus
KGPGHLVRRTFTEGSSVP

SEQ ID NO: 2022011 - protein, 17 aa, Staphylococcus
KGPGHLVRRTFVEGTAV

SEQ ID NO: 2022012 - protein, 18 aa, Staphylococcus
KGPTGYMIPTIVEWLKSL

SEQ ID NO: 2022013 - protein, 20 aa, Staphylococcus
KGPTGYMIPTVVEWLKQQYQ

SEQ ID NO: 2022014 - protein, 19 aa, Staphylococcus
KGPVLFGFFGHSSIAIDHD

SEQ ID NO: 2022015 - protein, 21 aa, Staphylococcus
KGPVVIDFPKDMGILSTNVGL

SEQ ID NO: 2022016 - protein, 20 aa, Staphylococcus
KGPVVIDFPKDVGILKSEVD

SEQ ID NO: 2022017 - protein, 19 aa, Staphylococcus
KGQALARLLDVWEMQPSEL

SEQ ID NO: 2022018 - protein, 27 aa, Staphylococcus
KGQALRRLLTEWGMSSTELMAFGDANN

SEQ ID NO: 2022019 - protein, 19 aa, Staphylococcus
KGQGLLLIDNVRKLTPIIQ

SEQ ID NO: 2022020 - protein, 32 aa, Staphylococcus
KGQHKLLIDRCGQEMLKRTSIVINNNNIEVRL

SEQ ID NO: 2022021 - protein, 19 aa, Staphylococcus
KGQIAVIGPTAMHYQNVIQ

SEQ ID NO: 2022022 - protein, 18 aa, Staphylococcus
KGQLFKLLEFSNMEETDV

SEQ ID NO: 2022023 - protein, 20 aa, Staphylococcus
KGQMYKVVDKFDRVCPNNVV

SEQ ID NO: 2022024 - protein, 18 aa, Staphylococcus
KGQRICLYFDEQLVEDVT

SEQ ID NO: 2022025 - protein, 20 aa, Staphylococcus
KGQYLFDLKINLANLKEQIG

SEQ ID NO: 2022026 - protein, 24 aa, Staphylococcus
KGREIPYDICIFATGSKAFVLPIP

SEQ ID NO: 2022027 - protein, 24 aa, Staphylococcus
KGRIKDWDYPFVIKPGDELPTAGG

SEQ ID NO: 2022028 - protein, 21 aa, Staphylococcus
KGRQFLLLAKENWHEGVLGIV

SEQ ID NO: 2022029 - protein, 19 aa, Staphylococcus
KGRRLNVFYSTQVAIEPPT

SEQ ID NO: 2022030 - protein, 19 aa, Staphylococcus
KGRWHCIQCESTVSEDYYT

SEQ ID NO: 2022031 - protein, 20 aa, Staphylococcus
KGRYLFIPIHKIADVRWKEL

SEQ ID NO: 2022032 - protein, 18 aa, Staphylococcus
KGSAYLGTNGFQINEHKT

SEQ ID NO: 2022033 - protein, 23 aa, Staphylococcus
KGSEELEALLQLDSDLIVTAAFG

SEQ ID NO: 2022034 - protein, 23 aa, Staphylococcus
KGSENGPTIAFRADFDALPVQEL

SEQ ID NO: 2022035 - protein, 19 aa, Staphylococcus
KGSEVGRNFEELARIIDGV

SEQ ID NO: 2022036 - protein, 20 aa, Staphylococcus
KGSEVGRSFEEIARIIDGVN

SEQ ID NO: 2022037 - protein, 18 aa, Staphylococcus
KGSFEIEDTSLFEIQAKQ

SEQ ID NO: 2022038 - protein, 20 aa, Staphylococcus
KGSFEIEGVSLFELQARQLI

SEQ ID NO: 2022039 - protein, 30 aa, Staphylococcus
KGSFEIKGISLFELQARQLLKLQHQTGHLI

SEQ ID NO: 2022040 - protein, 33 aa, Staphylococcus
KGSFEIKGVSLFELQARQLLKLKKETGHLINWY

SEQ ID NO: 2022041 - protein, 18 aa, Staphylococcus
KGSICVCGTGGDKSNSFN

SEQ ID NO: 2022042 - protein, 24 aa, Staphylococcus
KGSIINAYCHMWGYFKKISTEQEK

SEQ ID NO: 2022043 - protein, 22 aa, Staphylococcus
KGSIPREDVASVIKEVLATDDY

SEQ ID NO: 2022044 - protein, 17 aa, Staphylococcus
KGSIVIYQGVTEFPFAD

SEQ ID NO: 2022045 - protein, 17 aa, Staphylococcus
KGSIVIYQGVTEFPFSK

SEQ ID NO: 2022046 - protein, 23 aa, Staphylococcus
KGSKDARFKLGIETKDLTRNDEV

SEQ ID NO: 2022047 - protein, 18 aa, Staphylococcus
KGSLVGITGHMRSYKYEK

SEQ ID NO: 2022048 - protein, 18 aa, Staphylococcus
KGSMDFRITSKGRSSHSS

SEQ ID NO: 2022049 - protein, 17 aa, Staphylococcus
KGSMDYQIVSRGQAAHS

SEQ ID NO: 2022050 - protein, 25 aa, Staphylococcus
KGSMLPKVEAALQFIEKNPEGSVLI

SEQ ID NO: 2022051 - protein, 20 aa, Staphylococcus
KGSMPHELYLRLKKKMSQGR

SEQ ID NO: 2022052 - protein, 19 aa, Staphylococcus
KGSMPKELYLRLKKHMQEG

SEQ ID NO: 2022053 - protein, 23 aa, Staphylococcus
KGSVARKGFNLGKEFQKLEQDGG

SEQ ID NO: 2022054 - protein, 31 aa, Staphylococcus
KGTDLPGQIARRVDPTILRKLAANVDDIVFI

SEQ ID NO: 2022055 - protein, 25 aa, Staphylococcus
KGTDLPGQIARRVDQNILRKLSEQV

SEQ ID NO: 2022056 - protein, 18 aa, Staphylococcus
KGTDLPIDVHLMIEEPEK

SEQ ID NO: 2022057 - protein, 27 aa, Staphylococcus
KGTDVLVCTVIGFPLGASTKEVKAFET

SEQ ID NO: 2022058 - protein, 20 aa, Staphylococcus
KGTEAAIAYQSGFNCNMAAI

SEQ ID NO: 2022059 - protein, 25 aa, Staphylococcus
KGTFEAWGSAYGHGVSGVNLAAKTG

SEQ ID NO: 2022060 - protein, 22 aa, Staphylococcus
KGTFEAYGSAYGHGVSGVNLAA

SEQ ID NO: 2022061 - protein, 18 aa, Staphylococcus
KGTFSFLASQQIVSEPSI

SEQ ID NO: 2022062 - protein, 18 aa, Staphylococcus
KGTFSYLASQKFVNQNQI

SEQ ID NO: 2022063 - protein, 26 aa, Staphylococcus
KGTGIKEMIEHFGIAQQETLVIGDSD

SEQ ID NO: 2022064 - protein, 19 aa, Staphylococcus
KGTGLGLFGMNERAELVNG

SEQ ID NO: 2022065 - protein, 19 aa, Staphylococcus
KGTHTKIVHDFAYSAFGFD

SEQ ID NO: 2022066 - protein, 22 aa, Staphylococcus
KGTHYKKRMHPTLLKISQENDK

SEQ ID NO: 2022067 - protein, 23 aa, Staphylococcus
KGTKHKILLMVDWKDGREGILTY

SEQ ID NO: 2022068 - protein, 22 aa, Staphylococcus
KGTLPHNIVFIFQPAEETGGGA

SEQ ID NO: 2022069 - protein, 22 aa, Staphylococcus
KGTMEFSDRLYGVTMQESGVSK

SEQ ID NO: 2022070 - protein, 23 aa, Staphylococcus
KGTPRLVAKEGYYITANEDFVAP

SEQ ID NO: 2022071 - protein, 25 aa, Staphylococcus
KGTRMKSKLYKVLHKVADKTMIEHV

SEQ ID NO: 2022072 - protein, 21 aa, Staphylococcus
KGTTYKIYFGFSERQAYEDFK

SEQ ID NO: 2022073 - protein, 18 aa, Staphylococcus
KGTVEVILFQNQDNFYTV

SEQ ID NO: 2022074 - protein, 20 aa, Staphylococcus
KGTYHIGKALVIYDSTTLLL

SEQ ID NO: 2022075 - protein, 17 aa, Staphylococcus
KGVAQLLFKKVPKLPYT

SEQ ID NO: 2022076 - protein, 26 aa, Staphylococcus
KGVDIDGRYGFQCWDLPNYIFQRYWH

SEQ ID NO: 2022077 - protein, 17 aa, Staphylococcus
KGVEAINIPSSVKEQAR

SEQ ID NO: 2022078 - protein, 23 aa, Staphylococcus
KGVEFKIGTPIVAANEKGFVVKV

SEQ ID NO: 2022079 - protein, 21 aa, Staphylococcus
KGVEWDYLDDALFTFDSGYIE

SEQ ID NO: 2022080 - protein, 21 aa, Staphylococcus
KGVKDCSSWKGKPKHKNWPKT

SEQ ID NO: 2022081 - protein, 20 aa, Staphylococcus
KGVKEGKRHQTLLGATGTGK

SEQ ID NO: 2022082 - protein, 25 aa, Staphylococcus
KGVRVVSMPNWFAFDKQSDDYKESV

SEQ ID NO: 2022083 - protein, 25 aa, Staphylococcus
KGVRVVSMPNWFAFEQQPEEYKESV

SEQ ID NO: 2022084 - protein, 25 aa, Staphylococcus
KGVRVVSMPNWFAFEQQSDEYKESV

SEQ ID NO: 2022085 - protein, 25 aa, Staphylococcus
KGVSKTGLGPFAFDEWRYLEDGSEN

SEQ ID NO: 2022086 - protein, 19 aa, Staphylococcus
KGVTIRLTPIVAKYNDKKE

SEQ ID NO: 2022087 - protein, 20 aa, Staphylococcus
KGVVPFLKIDKGLDEQKDGV

SEQ ID NO: 2022088 - protein, 19 aa, Staphylococcus
KGVVPFLKVDKGLAEEQNG

SEQ ID NO: 2022089 - protein, 20 aa, Staphylococcus
KGVVPFLKVDKGLAEEQNGV

SEQ ID NO: 2022090 - protein, 19 aa, Staphylococcus
KGVVPFLKVDKGLAEQQNG

SEQ ID NO: 2022091 - protein, 20 aa, Staphylococcus
KGVVPFLKVDKGLAEQQNGV

SEQ ID NO: 2022092 - protein, 25 aa, Staphylococcus
KGVVPSLMCANVWPKFKLFQKFQQE

SEQ ID NO: 2022093 - protein, 20 aa, Staphylococcus
KGWHDLKIVPYAPLEVSPAA

SEQ ID NO: 2022094 - protein, 22 aa, Staphylococcus
KGWTHLRLWSLRGYTVNETKSL

SEQ ID NO: 2022095 - protein, 18 aa, Staphylococcus
KGYAITVIGNEANRKYLQ

SEQ ID NO: 2022096 - protein, 22 aa, Staphylococcus
KGYDKYAHKISRYIMGANQYLK

SEQ ID NO: 2022097 - protein, 19 aa, Staphylococcus
KGYEIQGPVVIDIPVNYKD

SEQ ID NO: 2022098 - protein, 24 aa, Staphylococcus
KGYFADELQAFFLQNGVTSGIINL

SEQ ID NO: 2022099 - protein, 24 aa, Staphylococcus
KGYFARPTIFINVDNHMTIAQEEI

SEQ ID NO: 2022100 - protein, 19 aa, Staphylococcus
KGYGLMMMVDILSGSLLGL

SEQ ID NO: 2022101 - protein, 20 aa, Staphylococcus
KGYGSSLLKKGLEQFDSKYD

SEQ ID NO: 2022102 - protein, 23 aa, Staphylococcus
KGYKIANIPLVLEVDIPDEVFKH

SEQ ID NO: 2022103 - protein, 23 aa, Staphylococcus
KGYKIANIPLVLEVTIPESVFQH

SEQ ID NO: 2022104 - protein, 20 aa, Staphylococcus
KGYTHMYLITDAMRAKGMKD

SEQ ID NO: 2022105 - protein, 19 aa, Staphylococcus
KGYTHYVKVPTLIINGRYD

SEQ ID NO: 2022106 - protein, 21 aa, Staphylococcus
KGYVGHQLFIKFGHHQTIFPE

SEQ ID NO: 2022107 - protein, 20 aa, Staphylococcus
KHAGGLHKFMNWNGPILTDS

SEQ ID NO: 2022108 - protein, 21 aa, Staphylococcus
KHALNEFTNSYVALGTQMSNL

SEQ ID NO: 2022109 - protein, 18 aa, Staphylococcus
KHALPPNLWEQFNKGFYP

SEQ ID NO: 2022110 - protein, 19 aa, Staphylococcus
KHCHGSSIMALYVQTASSY

SEQ ID NO: 2022111 - protein, 18 aa, Staphylococcus
KHCHGSSIMGLYVQTASS

SEQ ID NO: 2022112 - protein, 25 aa, Staphylococcus
KHDFPAGDFPLVIRTRRDGDKFELN

SEQ ID NO: 2022113 - protein, 18 aa, Staphylococcus
KHDGILPKALLRAIFQDI

SEQ ID NO: 2022114 - protein, 21 aa, Staphylococcus
KHDIGKLDILINCAGITGADK

SEQ ID NO: 2022115 - protein, 18 aa, Staphylococcus
KHDLPALPPYAMFGENLT

SEQ ID NO: 2022116 - protein, 24 aa, Staphylococcus
KHDRHVTGKWSWLAPPLSPTLTSN

SEQ ID NO: 2022117 - protein, 23 aa, Staphylococcus
KHEENLCCPVEYDTKYLKIIPDE

SEQ ID NO: 2022118 - protein, 18 aa, Staphylococcus
KHELCHYHLHILDKGYKH

SEQ ID NO: 2022119 - protein, 19 aa, Staphylococcus
KHEQPDIFNRTAMFADIKT

SEQ ID NO: 2022120 - protein, 23 aa, Staphylococcus
KHEQPEIFQHTAYFLDIKSYILH

SEQ ID NO: 2022121 - protein, 25 aa, Staphylococcus
KHFEKELNCRLGISQLPTHGLSIRI

SEQ ID NO: 2022122 - protein, 33 aa, Staphylococcus
KHFIEILADVDVKLMLVSGTGRLYVNNNRTLRV

SEQ ID NO: 2022123 - protein, 33 aa, Staphylococcus
KHFPDYNKYLILWKLEVLPSFQSRGLGTELVDY

SEQ ID NO: 2022124 - protein, 17 aa, Staphylococcus
KHFRKSFYHLAPAGRMI

SEQ ID NO: 2022125 - protein, 26 aa, Staphylococcus
KHFYDKYELLKYLLKLTHDDYFATDI

SEQ ID NO: 2022126 - protein, 18 aa, Staphylococcus
KHGAEFFAVATLDEAIEL

SEQ ID NO: 2022127 - protein, 17 aa, Staphylococcus
KHGEKIPKGLALDYVYG

SEQ ID NO: 2022128 - protein, 20 aa, Staphylococcus
KHGEKSRFKNILNNFQTNDR

SEQ ID NO: 2022129 - protein, 17 aa, Staphylococcus
KHGFKFRDKPYFYEMQK

SEQ ID NO: 2022130 - protein, 21 aa, Staphylococcus
KHGFLRYPYIETFKDIDEVIQ

SEQ ID NO: 2022131 - protein, 24 aa, Staphylococcus
KHGFNHFPHFIALFNKKYGITPGQ

SEQ ID NO: 2022132 - protein, 26 aa, Staphylococcus
KHGFNHFPRFIALFSKKYGMTPGQAR

SEQ ID NO: 2022133 - protein, 21 aa, Staphylococcus
KHGFNHYSRFIKLFKDAYGQT

SEQ ID NO: 2022134 - protein, 18 aa, Staphylococcus
KHGKTILNDLNWHIEAGD

SEQ ID NO: 2022135 - protein, 21 aa, Staphylococcus
KHGLKKGDKVLIMMPRAIATY

SEQ ID NO: 2022136 - protein, 23 aa, Staphylococcus
KHGLYFKGGETVQSLSGDDNGNV

SEQ ID NO: 2022137 - protein, 21 aa, Staphylococcus
KHGRHRARVALDLFASKIHKY

SEQ ID NO: 2022138 - protein, 25 aa, Staphylococcus
KHGTGLPKLFGFQAEGASPIVQNKV

SEQ ID NO: 2022139 - protein, 19 aa, Staphylococcus
KHHFIALAHAGWRGTYGQI

SEQ ID NO: 2022140 - protein, 19 aa, Staphylococcus
KHHFSELHVFPYSARTGTP

SEQ ID NO: 2022141 - protein, 27 aa, Staphylococcus
KHHFVALAHAGWRGTVGRIVEEILKHV

SEQ ID NO: 2022142 - protein, 18 aa, Staphylococcus
KHHLTIISGLAKGADMMA

SEQ ID NO: 2022143 - protein, 29 aa, Staphylococcus
KHHPRFADADIPIWYDRHMPYQMEGGDQL

SEQ ID NO: 2022144 - protein, 18 aa, Staphylococcus
KHHTCLITPVNQDTILTT

SEQ ID NO: 2022145 - protein, 20 aa, Staphylococcus
KHHYIGLAHAGWRGTYGEIV

SEQ ID NO: 2022146 - protein, 20 aa, Staphylococcus
KHIEIYAPITGKFVDIEDIP

SEQ ID NO: 2022147 - protein, 19 aa, Staphylococcus
KHIELMKSFMLNKQEKQRA

SEQ ID NO: 2022148 - protein, 19 aa, Staphylococcus
KHIGGFPIIGQFIACTNPE

SEQ ID NO: 2022149 - protein, 17 aa, Staphylococcus
KHIGVAIPKVANAIKKA

SEQ ID NO: 2022150 - protein, 17 aa, Staphylococcus
KHIKKYIPKTFVIAGNV

SEQ ID NO: 2022151 - protein, 20 aa, Staphylococcus
KHIPQSFVIAGNVGTPEGVR

SEQ ID NO: 2022152 - protein, 17 aa, Staphylococcus
KHITNWFQHLDDIIPNL

SEQ ID NO: 2022153 - protein, 17 aa, Staphylococcus
KHIYTTVFYDKHEKNGV

SEQ ID NO: 2022154 - protein, 20 aa, Staphylococcus
KHKAPELLERAHYIMEAGDY

SEQ ID NO: 2022155 - protein, 24 aa, Staphylococcus
KHKDKRIILLTAHRRENIGEPMVH

SEQ ID NO: 2022156 - protein, 17 aa, Staphylococcus
KHKGFKEGLSKDYIQPR

SEQ ID NO: 2022157 - protein, 23 aa, Staphylococcus
KHKGKMAIRVYPSWEKNLNKTAL

SEQ ID NO: 2022158 - protein, 24 aa, Staphylococcus
KHKNIKYGLIIDGLLRHFKTVQET

SEQ ID NO: 2022159 - protein, 23 aa, Staphylococcus
KHKRSRNVLDFADYEHFALQILT

SEQ ID NO: 2022160 - protein, 19 aa, Staphylococcus
KHLDRGYVNFHEKLKSLGA

SEQ ID NO: 2022161 - protein, 22 aa, Staphylococcus
KHLDVPLFIGIMPVTSYNNALF

SEQ ID NO: 2022162 - protein, 28 aa, Staphylococcus
KHLEAAVILSDFNRRYLSGFTGTSGALI

SEQ ID NO: 2022163 - protein, 18 aa, Staphylococcus
KHLEMMKVAVQFEDAESF

SEQ ID NO: 2022164 - protein, 18 aa, Staphylococcus
KHLEMMKVAVQFQDAEAY

SEQ ID NO: 2022165 - protein, 28 aa, Staphylococcus
KHLENVPGFKALRFLRPKTVGRHYIIVT

SEQ ID NO: 2022166 - protein, 23 aa, Staphylococcus
KHLKDGRAYHSLYQAALARSEAD

SEQ ID NO: 2022167 - protein, 23 aa, Staphylococcus
KHLKFHKAEPISVDFYRESIGGT

SEQ ID NO: 2022168 - protein, 26 aa, Staphylococcus
KHLKKNRPDCLIGVCGCMSQEESVVN

SEQ ID NO: 2022169 - protein, 24 aa, Staphylococcus
KHLNIPIFIGIMPIASYNNALFLH

SEQ ID NO: 2022170 - protein, 26 aa, Staphylococcus
KHLNQFARIPVCGAISGYNNTEIEYG

SEQ ID NO: 2022171 - protein, 26 aa, Staphylococcus
KHLNRHARIPVCGTISNYNNTEQEKG

SEQ ID NO: 2022172 - protein, 25 aa, Staphylococcus
KHLNTFARIPVCGTISKYNDKEVSY

SEQ ID NO: 2022173 - protein, 21 aa, Staphylococcus
KHLNVPLFIGIMPIASYNNAL

SEQ ID NO: 2022174 - protein, 28 aa, Staphylococcus
KHLQDVPGFKALRFLRPQAKHKHYIIVT

SEQ ID NO: 2022175 - protein, 26 aa, Staphylococcus
KHLRELRQQVGLVFQFPESQLFEDSV

SEQ ID NO: 2022176 - protein, 19 aa, Staphylococcus
KHLSAPSIRQFSSRISGIK

SEQ ID NO: 2022177 - protein, 26 aa, Staphylococcus
KHLSDEGVQWIVLAGYMRLVGQDLLQ

SEQ ID NO: 2022178 - protein, 18 aa, Staphylococcus
KHLSLRHETDIIPYVYQN

SEQ ID NO: 2022179 - protein, 20 aa, Staphylococcus
KHLTAFSNRTGKSFSSHDHL

SEQ ID NO: 2022180 - protein, 22 aa, Staphylococcus
KHMLGYQIQDWFEKMSVFVELA

SEQ ID NO: 2022181 - protein, 18 aa, Staphylococcus
KHMMHITISYPLSDDRLL

SEQ ID NO: 2022182 - protein, 24 aa, Staphylococcus
KHNEAPISLAFYRRSIGGAATELH

SEQ ID NO: 2022183 - protein, 17 aa, Staphylococcus
KHNLPLFMDGARLGYGL

SEQ ID NO: 2022184 - protein, 17 aa, Staphylococcus
KHPEKYYFFVLQRVTEQ

SEQ ID NO: 2022185 - protein, 19 aa, Staphylococcus
KHPIIDYILEYRQLSKLQS

SEQ ID NO: 2022186 - protein, 20 aa, Staphylococcus
KHPIRVILSKSGKLDFNQQL

SEQ ID NO: 2022187 - protein, 20 aa, Staphylococcus
KHPLVDRCVVVGYNDPKFGE

SEQ ID NO: 2022188 - protein, 17 aa, Staphylococcus
KHPRLIVTRTVKKGTGK

SEQ ID NO: 2022189 - protein, 17 aa, Staphylococcus
KHPRVLVGRDTRVSGEM

SEQ ID NO: 2022190 - protein, 17 aa, Staphylococcus
KHPSLTENLEWVPGVYV

SEQ ID NO: 2022191 - protein, 24 aa, Staphylococcus
KHQDKRIILLTAHRRENIGEPMEH

SEQ ID NO: 2022192 - protein, 19 aa, Staphylococcus
KHQFTHLTWNIQVYSVVHD

SEQ ID NO: 2022193 - protein, 31 aa, Staphylococcus
KHQIMLMIDWKDRREGVITYDVLNYIEEIIK

SEQ ID NO: 2022194 - protein, 21 aa, Staphylococcus
KHQKPAIAICATSDKFDLFAN

SEQ ID NO: 2022195 - protein, 27 aa, Staphylococcus
KHREISPRLRLVIPLKRNVNADEYEAV

SEQ ID NO: 2022196 - protein, 17 aa, Staphylococcus
KHRKGDDCLFCLEVLSE

SEQ ID NO: 2022197 - protein, 19 aa, Staphylococcus
KHRPVIIYFYGGGFVNGHG

SEQ ID NO: 2022198 - protein, 18 aa, Staphylococcus
KHRTIPMFGTGYSRQSIS

SEQ ID NO: 2022199 - protein, 19 aa, Staphylococcus
KHSEGFYWQEHEVKLVFFL

SEQ ID NO: 2022200 - protein, 24 aa, Staphylococcus
KHSESKLTVAMGNRINNEPLLMDI

SEQ ID NO: 2022201 - protein, 23 aa, Staphylococcus
KHSKGYGIVGCMCQPAFEFEHFE

SEQ ID NO: 2022202 - protein, 17 aa, Staphylococcus
KHSKRGIEFPGGKVEIN

SEQ ID NO: 2022203 - protein, 17 aa, Staphylococcus
KHSLILFDELGAGTDPS

SEQ ID NO: 2022204 - protein, 20 aa, Staphylococcus
KHSNEFYDDLIIKNHKYSQF

SEQ ID NO: 2022205 - protein, 19 aa, Staphylococcus
KHSSGHLYFNLKDNNSVVN

SEQ ID NO: 2022206 - protein, 19 aa, Staphylococcus
KHTKNIICLTNHTEEALLM

SEQ ID NO: 2022207 - protein, 18 aa, Staphylococcus
KHTNALYQVCLEIIEKYN

SEQ ID NO: 2022208 - protein, 19 aa, Staphylococcus
KHTNLIGAIIPRMNSHAVD

SEQ ID NO: 2022209 - protein, 17 aa, Staphylococcus
KHTPIISQDLWDKVQAR

SEQ ID NO: 2022210 - protein, 32 aa, Staphylococcus
KHVAKRPFLDKALDRKAVWDKWMEQDLNNNNS

SEQ ID NO: 2022211 - protein, 22 aa, Staphylococcus
KHVDFSTAFSRKKEVVNALNQK

SEQ ID NO: 2022212 - protein, 19 aa, Staphylococcus
KHVKLGFTTREGGYSLYPE

SEQ ID NO: 2022213 - protein, 18 aa, Staphylococcus
KHVMKEMRVKKNSVALDV

SEQ ID NO: 2022214 - protein, 19 aa, Staphylococcus
KHVPKRAFLDKTLERKAVW

SEQ ID NO: 2022215 - protein, 20 aa, Staphylococcus
KHVPQRPFLEKTLERKAVWD

SEQ ID NO: 2022216 - protein, 17 aa, Staphylococcus
KHVSDYIGVMYLGHIVE

SEQ ID NO: 2022217 - protein, 27 aa, Staphylococcus
KHWLKMTYKISIEEFVVLFKVYEGKKI

SEQ ID NO: 2022218 - protein, 20 aa, Staphylococcus
KHYLPGNILVMNRFDDSMIA

SEQ ID NO: 2022219 - protein, 23 aa, Staphylococcus
KHYPHLNYIWVFSKPENNNIPGN

SEQ ID NO: 2022220 - protein, 23 aa, Staphylococcus
KHYRKKCIFESLDMTFENLQLTV

SEQ ID NO: 2022221 - protein, 20 aa, Staphylococcus
KHYVMVSTYDSRREAFDQSG

SEQ ID NO: 2022222 - protein, 19 aa, Staphylococcus
KHYVMVSTYDSRREAFDSA

SEQ ID NO: 2022223 - protein, 23 aa, Staphylococcus
KIAEIPLTREEYRLEQNEKKRCE

SEQ ID NO: 2022224 - protein, 21 aa, Staphylococcus
KIAESVQLLFNVDCQVKFEEG

SEQ ID NO: 2022225 - protein, 19 aa, Staphylococcus
KIAFPKRQAISISGDGAFQ

SEQ ID NO: 2022226 - protein, 22 aa, Staphylococcus
KIAGAILKKDLDAFSKKMDYSE

SEQ ID NO: 2022227 - protein, 20 aa, Staphylococcus
KIAGDFNAFNAIAAYAVLKE

SEQ ID NO: 2022228 - protein, 26 aa, Staphylococcus
KIAHFCSMCGPKFCSMKLSHDIRDSY

SEQ ID NO: 2022229 - protein, 26 aa, Staphylococcus
KIAHFCSMCGPKFCSMRLSHDIRDSY

SEQ ID NO: 2022230 - protein, 21 aa, Staphylococcus
KIAILPIGYADGYLRSMQGAF

SEQ ID NO: 2022231 - protein, 17 aa, Staphylococcus
KIAKGKVQKHLKNIKDK

SEQ ID NO: 2022232 - protein, 30 aa, Staphylococcus
KIAKSLCDIYPLLNRSLLYSAIILHDIGKV

SEQ ID NO: 2022233 - protein, 24 aa, Staphylococcus
KIANEYKIPTFVLGVGLGGLILIN

SEQ ID NO: 2022234 - protein, 18 aa, Staphylococcus
KIANGLKVSFTELTQEND

SEQ ID NO: 2022235 - protein, 18 aa, Staphylococcus
KIAQFILNSPHKVVNMNS

SEQ ID NO: 2022236 - protein, 18 aa, Staphylococcus
KIARIFGERIEDIFICEE

SEQ ID NO: 2022237 - protein, 19 aa, Staphylococcus
KIARIFGESVEDVFIIEEE

SEQ ID NO: 2022238 - protein, 20 aa, Staphylococcus
KIASDSLVYYGMKAHAHEFE

SEQ ID NO: 2022239 - protein, 19 aa, Staphylococcus
KIASETRVYYGMKAHAHEF

SEQ ID NO: 2022240 - protein, 23 aa, Staphylococcus
KIDAFYHRFCSVDKGTASQYIGD

SEQ ID NO: 2022241 - protein, 18 aa, Staphylococcus
KIDAPIVEGSFTAAVKLS

SEQ ID NO: 2022242 - protein, 20 aa, Staphylococcus
KIDDVIGVGIGVPGPVDFET

SEQ ID NO: 2022243 - protein, 19 aa, Staphylococcus
KIDEIARMISGASVTELTR

SEQ ID NO: 2022244 - protein, 23 aa, Staphylococcus
KIDEIKAFIEFHDIDVVVTNDEL

SEQ ID NO: 2022245 - protein, 24 aa, Staphylococcus
KIDELKKLITFVIVNRESDYQSVE

SEQ ID NO: 2022246 - protein, 19 aa, Staphylococcus
KIDFLIVIYHGGLDKISQT

SEQ ID NO: 2022247 - protein, 18 aa, Staphylococcus
KIDIKKLREDAAIMMSCK

SEQ ID NO: 2022248 - protein, 31 aa, Staphylococcus
KIDIPRVRFTTSHPWDFTDHMIDVIAKGGNI

SEQ ID NO: 2022249 - protein, 21 aa, Staphylococcus
KIDQCVLQFGDIKIMIADDTE

SEQ ID NO: 2022250 - protein, 18 aa, Staphylococcus
KIDRYPIFIPNALIDETI

SEQ ID NO: 2022251 - protein, 18 aa, Staphylococcus
KIDRYPVFIPQALTGEEI

SEQ ID NO: 2022252 - protein, 18 aa, Staphylococcus
KIDVKKMREDAAIMMSCK

SEQ ID NO: 2022253 - protein, 20 aa, Staphylococcus
KIDYIFCTFNTDLYYEKMID

SEQ ID NO: 2022254 - protein, 22 aa, Staphylococcus
KIEAIFPQITISYFSEEIDIAN

SEQ ID NO: 2022255 - protein, 23 aa, Staphylococcus
KIEEIKAFIEFHDIDVVVTNDEL

SEQ ID NO: 2022256 - protein, 17 aa, Staphylococcus
KIEEIRGQRICIYYDEV

SEQ ID NO: 2022257 - protein, 26 aa, Staphylococcus
KIEGEVKIQYTLRMIPVYSTEQPVET

SEQ ID NO: 2022258 - protein, 21 aa, Staphylococcus
KIEGIPEMYFHSYVSGATISI

SEQ ID NO: 2022259 - protein, 21 aa, Staphylococcus
KIEILKPAVMMNLLGKDLDLL

SEQ ID NO: 2022260 - protein, 19 aa, Staphylococcus
KIEKHDIFGVIGYSGAGKS

SEQ ID NO: 2022261 - protein, 19 aa, Staphylococcus
KIELFKNLAHVEGFEKYLH

SEQ ID NO: 2022262 - protein, 25 aa, Staphylococcus
KIEPERIHYGYKFESMDTLEDGKVK

SEQ ID NO: 2022263 - protein, 21 aa, Staphylococcus
KIESRLTGVVKYAEKYLNDEG

SEQ ID NO: 2022264 - protein, 26 aa, Staphylococcus
KIETDGRMKALVSITLDKAFVIHDLR

SEQ ID NO: 2022265 - protein, 19 aa, Staphylococcus
KIEWLEFTFDAEKRIHNKR

SEQ ID NO: 2022266 - protein, 24 aa, Staphylococcus
KIFEFKSPYLKLTRDGEKLLQYAL

SEQ ID NO: 2022267 - protein, 20 aa, Staphylococcus
KIFEHREFTLILYVNDIVGM

SEQ ID NO: 2022268 - protein, 23 aa, Staphylococcus
KIFIPSNLFLLGTVNTSDQNVFV

SEQ ID NO: 2022269 - protein, 32 aa, Staphylococcus
KIFKEAGFEWREPGCSMCLGMNPDQVPEGVHC

SEQ ID NO: 2022270 - protein, 29 aa, Staphylococcus
KIFMNGREVFKFAVRIMGEASNNAVAKAN

SEQ ID NO: 2022271 - protein, 29 aa, Staphylococcus
KIFMNGREVFKFAVRIMGEASRNVVEKAG

SEQ ID NO: 2022272 - protein, 17 aa, Staphylococcus
KIFRAVGPPGKIIKASI

SEQ ID NO: 2022273 - protein, 19 aa, Staphylococcus
KIFRNCSGRIIFATFASNI

SEQ ID NO: 2022274 - protein, 28 aa, Staphylococcus
KIGDQMPEFERMILLRSIDTHWTDHIDT

SEQ ID NO: 2022275 - protein, 22 aa, Staphylococcus
KIGEEGVLCLLSDSTNALVPNF

SEQ ID NO: 2022276 - protein, 19 aa, Staphylococcus
KIGGRRNGALISMDQGSAS

SEQ ID NO: 2022277 - protein, 20 aa, Staphylococcus
KIGGVPFLKSVDDIPLDENI

SEQ ID NO: 2022278 - protein, 20 aa, Staphylococcus
KIGIERDFTYTDLKGNIEKY

SEQ ID NO: 2022279 - protein, 26 aa, Staphylococcus
KIGIMPGYIHKRGHVGVVSRSGTLTY

SEQ ID NO: 2022280 - protein, 23 aa, Staphylococcus
KIGKDKRKSTIIVGDSLTSDVLG

SEQ ID NO: 2022281 - protein, 20 aa, Staphylococcus
KIGLAALVDRGHRELPIRAD

SEQ ID NO: 2022282 - protein, 18 aa, Staphylococcus
KIGYWVEDFYDYAQQQWH

SEQ ID NO: 2022283 - protein, 19 aa, Staphylococcus
KIHAAGLCHSDLSVINGSR

SEQ ID NO: 2022284 - protein, 25 aa, Staphylococcus
KIHGGARSNSTFQYKEMSHKEKHTH

SEQ ID NO: 2022285 - protein, 24 aa, Staphylococcus
KIHGGARSNSVFQFKEKSHQEKHA

SEQ ID NO: 2022286 - protein, 27 aa, Staphylococcus
KIHNLKKGYKLGVLISKKKYWYRLPKF

SEQ ID NO: 2022287 - protein, 18 aa, Staphylococcus
KIIDILITVNREMKKKQE

SEQ ID NO: 2022288 - protein, 23 aa, Staphylococcus
KIIDLRLQTRLSYTESQIKFYKT

SEQ ID NO: 2022289 - protein, 26 aa, Staphylococcus
KIIDVGCGYGPIGLMIAKVSPHHEVT

SEQ ID NO: 2022290 - protein, 27 aa, Staphylococcus
KIIEQSQCKRAIILPNNKNILMASEQA

SEQ ID NO: 2022291 - protein, 25 aa, Staphylococcus
KIIEWLTSEKVEWIVLAGYMKLIGE

SEQ ID NO: 2022292 - protein, 22 aa, Staphylococcus
KIIFKRTFKAPINDVFDAYTNP

SEQ ID NO: 2022293 - protein, 18 aa, Staphylococcus
KIIFSRTFTGTIHELFNA

SEQ ID NO: 2022294 - protein, 22 aa, Staphylococcus
KIIFSRVFDARIQDVFNAYTTK

SEQ ID NO: 2022295 - protein, 20 aa, Staphylococcus
KIIGFAYCYTLLRPDGKTMF

SEQ ID NO: 2022296 - protein, 17 aa, Staphylococcus
KIIGLFITHGHEDHIGG

SEQ ID NO: 2022297 - protein, 19 aa, Staphylococcus
KIIKKVRITNLLLNPKKCL

SEQ ID NO: 2022298 - protein, 19 aa, Staphylococcus
KIILDRFHIVQSLNRALNM

SEQ ID NO: 2022299 - protein, 20 aa, Staphylococcus
KIINRFSKQPIHVAASKQRG

SEQ ID NO: 2022300 - protein, 18 aa, Staphylococcus
KIIWDIGGIAPKPCYQII

SEQ ID NO: 2022301 - protein, 28 aa, Staphylococcus
KIKDAILYIETIFPMITIQNFKPQSDMR

SEQ ID NO: 2022302 - protein, 21 aa, Staphylococcus
KIKDDGIYCYSEDPTDGLVEV

SEQ ID NO: 2022303 - protein, 19 aa, Staphylococcus
KIKERGHDIFLDLKLHDIP

SEQ ID NO: 2022304 - protein, 18 aa, Staphylococcus
KIKGIAQREFKQFFPKSG

SEQ ID NO: 2022305 - protein, 23 aa, Staphylococcus
KIKNIAEMLSLRIAQGEQLIVVV

SEQ ID NO: 2022306 - protein, 19 aa, Staphylococcus
KIKNLKVGYLTQQMTLDTN

SEQ ID NO: 2022307 - protein, 17 aa, Staphylococcus
KIKNLPVAMTINQKRFN

SEQ ID NO: 2022308 - protein, 25 aa, Staphylococcus
KIKPDEFYFLPSYMAPLKDHKDFLE

SEQ ID NO: 2022309 - protein, 21 aa, Staphylococcus
KIKPIGTLREGYLEIVHNSRT

SEQ ID NO: 2022310 - protein, 19 aa, Staphylococcus
KIKQSYRPTVSIVNAENAA

SEQ ID NO: 2022311 - protein, 20 aa, Staphylococcus
KIKQSYRPTVSIVNAENAAH

SEQ ID NO: 2022312 - protein, 19 aa, Staphylococcus
KIKSKDPFEKPSIIFNYLS

SEQ ID NO: 2022313 - protein, 18 aa, Staphylococcus
KIKSKDPFEKPSIVFNYL

SEQ ID NO: 2022314 - protein, 19 aa, Staphylococcus
KIKSLPMVMVMLYASLGSV

SEQ ID NO: 2022315 - protein, 18 aa, Staphylococcus
KIKTEVSIAHGFHEIPTA

SEQ ID NO: 2022316 - protein, 24 aa, Staphylococcus
KILDIGTGAGFLAILCGNLGSDVT

SEQ ID NO: 2022317 - protein, 26 aa, Staphylococcus
KILFGNNNFILWKYNNVIYNVFSDNF

SEQ ID NO: 2022318 - protein, 20 aa, Staphylococcus
KILLCDEATSALDPATTDSI

SEQ ID NO: 2022319 - protein, 20 aa, Staphylococcus
KILMALDIGDFPGVGKASEK

SEQ ID NO: 2022320 - protein, 19 aa, Staphylococcus
KILPQAFALVREGAKRVFN

SEQ ID NO: 2022321 - protein, 17 aa, Staphylococcus
KILPRRVTGTSAKYQRM

SEQ ID NO: 2022322 - protein, 19 aa, Staphylococcus
KILRNAELVKSERQGQSKI

SEQ ID NO: 2022323 - protein, 31 aa, Staphylococcus
KILRSHFGVVPLESMIRLFEKECETYDIPLE

SEQ ID NO: 2022324 - protein, 24 aa, Staphylococcus
KILSKRELEILPLIAKGYGNKDIA

SEQ ID NO: 2022325 - protein, 21 aa, Staphylococcus
KILTELNIRLMAQRISINVSD

SEQ ID NO: 2022326 - protein, 22 aa, Staphylococcus
KIMNDKCLFINVGRGTIVEEKI

SEQ ID NO: 2022327 - protein, 24 aa, Staphylococcus
KIMPEVFDAPGYKLTLMDEYQEYI

SEQ ID NO: 2022328 - protein, 20 aa, Staphylococcus
KIMQESCAMLEQFEIPYEKK

SEQ ID NO: 2022329 - protein, 24 aa, Staphylococcus
KIMTEELYFKAWEGLYHEIHNEPE

SEQ ID NO: 2022330 - protein, 20 aa, Staphylococcus
KIMTEHLNIFVGLTDEAQNA

SEQ ID NO: 2022331 - protein, 19 aa, Staphylococcus
KINAKELIDTLNLDHLDID

SEQ ID NO: 2022332 - protein, 27 aa, Staphylococcus
KINDKAMRWQLGVIWKKEKYINYATRE

SEQ ID NO: 2022333 - protein, 22 aa, Staphylococcus
KINDVVTSFVWFDDEYFTHEPN

SEQ ID NO: 2022334 - protein, 23 aa, Staphylococcus
KINEEMQRIGFTSIEQVEKVTAQ

SEQ ID NO: 2022335 - protein, 20 aa, Staphylococcus
KINEGEFFILIGPSGCGKTT

SEQ ID NO: 2022336 - protein, 20 aa, Staphylococcus
KINFGDGVSRFDLKKEGEKH

SEQ ID NO: 2022337 - protein, 26 aa, Staphylococcus
KINIIPTVTYVWRIRTGESVSISQDR

SEQ ID NO: 2022338 - protein, 24 aa, Staphylococcus
KINKRVDIMLGHGLFNEVQDLVEQ

SEQ ID NO: 2022339 - protein, 25 aa, Staphylococcus
KINPDLIGGFRVKVGTTVMDGSVKN

SEQ ID NO: 2022340 - protein, 22 aa, Staphylococcus
KINPELIGGFRVKVGTTVLDGS

SEQ ID NO: 2022341 - protein, 23 aa, Staphylococcus
KINPELIGGIRVKVGTKVMDASI

SEQ ID NO: 2022342 - protein, 18 aa, Staphylococcus
KINQEVSEINWLQVMSKF

SEQ ID NO: 2022343 - protein, 26 aa, Staphylococcus
KINVLCCTPTEYRMMAKLDNLDKYNL

SEQ ID NO: 2022344 - protein, 24 aa, Staphylococcus
KIPAEQRQTMLFSATMPKAIQALV

SEQ ID NO: 2022345 - protein, 24 aa, Staphylococcus
KIPAEQRQTMLFSATMPKAIQTLV

SEQ ID NO: 2022346 - protein, 18 aa, Staphylococcus
KIPELRKRIKSVAEHNYK

SEQ ID NO: 2022347 - protein, 25 aa, Staphylococcus
KIPHGHAVMIGILYQFIVANQMLHT

SEQ ID NO: 2022348 - protein, 23 aa, Staphylococcus
KIPKALALDYIYGYTIINDITDR

SEQ ID NO: 2022349 - protein, 22 aa, Staphylococcus
KIPKALALDYVYGYTIINDITD

SEQ ID NO: 2022350 - protein, 22 aa, Staphylococcus
KIPKENITSLIFPTEAIAEKEC

SEQ ID NO: 2022351 - protein, 22 aa, Staphylococcus
KIPKGLALDYVYGYTIINDITD

SEQ ID NO: 2022352 - protein, 19 aa, Staphylococcus
KIPKNQWTSIVGHNGSGKS

SEQ ID NO: 2022353 - protein, 20 aa, Staphylococcus
KIPKRISGLKAKKNTQNHEI

SEQ ID NO: 2022354 - protein, 25 aa, Staphylococcus
KIPLRREAVVLLGMIEDPKILPYIY

SEQ ID NO: 2022355 - protein, 20 aa, Staphylococcus
KIPPNFKQYMLELANYDHDL

SEQ ID NO: 2022356 - protein, 19 aa, Staphylococcus
KIPSTIVYLPEFIRTLKNG

SEQ ID NO: 2022357 - protein, 23 aa, Staphylococcus
KIQAQLAFCIDVRSEPFRRHLEG

SEQ ID NO: 2022358 - protein, 18 aa, Staphylococcus
KIQLIIRGICCLKPGVPG

SEQ ID NO: 2022359 - protein, 18 aa, Staphylococcus
KIQLVIRGICCLKPGIPG

SEQ ID NO: 2022360 - protein, 24 aa, Staphylococcus
KIQRPPEDMLHIGFTSGTTGMPKA

SEQ ID NO: 2022361 - protein, 26 aa, Staphylococcus
KIQTDGRMKALVSITLDDAFVVHDLR

SEQ ID NO: 2022362 - protein, 26 aa, Staphylococcus
KIQTDGRMKALVSITLDESFVVHDLR

SEQ ID NO: 2022363 - protein, 20 aa, Staphylococcus
KIREAFKDKILIPKNDLDHH

SEQ ID NO: 2022364 - protein, 20 aa, Staphylococcus
KIREHGVLKAGFTDHAEDIP

SEQ ID NO: 2022365 - protein, 25 aa, Staphylococcus
KIRFLKKPPSAWVVLAKPNLGISSA

SEQ ID NO: 2022366 - protein, 19 aa, Staphylococcus
KIRVAFTPDEEIGRGPHEF

SEQ ID NO: 2022367 - protein, 19 aa, Staphylococcus
KIRVKQVIGTLDIDITDIT

SEQ ID NO: 2022368 - protein, 21 aa, Staphylococcus
KISFNDIEFLPPVTPPNNVIA

SEQ ID NO: 2022369 - protein, 20 aa, Staphylococcus
KISIEEFVVLFKVYEGKKIS

SEQ ID NO: 2022370 - protein, 18 aa, Staphylococcus
KISIKGARSNNLKGVDVD

SEQ ID NO: 2022371 - protein, 21 aa, Staphylococcus
KISRKNLYRDVKIEAKDDGIY

SEQ ID NO: 2022372 - protein, 19 aa, Staphylococcus
KISSTIVYLPEFIRTLKGG

SEQ ID NO: 2022373 - protein, 24 aa, Staphylococcus
KISTCVKGKFSWGHINSDQRLTKP

SEQ ID NO: 2022374 - protein, 20 aa, Staphylococcus
KISYHLKKLVSAQILIPEKY

SEQ ID NO: 2022375 - protein, 22 aa, Staphylococcus
KITCVEAAPKMLPMFSDDLVNH

SEQ ID NO: 2022376 - protein, 20 aa, Staphylococcus
KITCVEAAPTMLPMFDDELV

SEQ ID NO: 2022377 - protein, 26 aa, Staphylococcus
KITERHARALLSLTFEQQEEMVQTII

SEQ ID NO: 2022378 - protein, 22 aa, Staphylococcus
KITERHARAMLSLSEEDQEILV

SEQ ID NO: 2022379 - protein, 23 aa, Staphylococcus
KITERHARAVLPLSNEAQEQLIE

SEQ ID NO: 2022380 - protein, 24 aa, Staphylococcus
KITERHARAVLSLKEADQEQLIEQ

SEQ ID NO: 2022381 - protein, 23 aa, Staphylococcus
KITERHARAVLSLKEDDQEKLIE

SEQ ID NO: 2022382 - protein, 23 aa, Staphylococcus
KITERHARAVLVLSEEDQEALIE

SEQ ID NO: 2022383 - protein, 27 aa, Staphylococcus
KITGAGCLLGGIITSFLFRNNHPQQET

SEQ ID NO: 2022384 - protein, 21 aa, Staphylococcus
KITHAHAYGGPVAAMDSVEAT

SEQ ID NO: 2022385 - protein, 20 aa, Staphylococcus
KITHFRDYRLHLQDSSDTRE

SEQ ID NO: 2022386 - protein, 25 aa, Staphylococcus
KITITGILYMLDWLNTHRIDSRIDG

SEQ ID NO: 2022387 - protein, 23 aa, Staphylococcus
KITKEKYPRLIVTRTVKKGSGKY

SEQ ID NO: 2022388 - protein, 22 aa, Staphylococcus
KITRNAGVRVIRDGIVQFEGEL

SEQ ID NO: 2022389 - protein, 23 aa, Staphylococcus
KITRNAGVRVIRDGIVVFEGQLD

SEQ ID NO: 2022390 - protein, 19 aa, Staphylococcus
KITRVERRSKYILFHIETN

SEQ ID NO: 2022391 - protein, 30 aa, Staphylococcus
KIVAACKAVDCTILRIGMLPMNYMGSKEST

SEQ ID NO: 2022392 - protein, 19 aa, Staphylococcus
KIVDFCRENNLFVLTYQDG

SEQ ID NO: 2022393 - protein, 22 aa, Staphylococcus
KIVGEIHGPLKYITEDIDLSLD

SEQ ID NO: 2022394 - protein, 18 aa, Staphylococcus
KIVKRLAKDMSIGVITND

SEQ ID NO: 2022395 - protein, 17 aa, Staphylococcus
KIVKVLLDNKWISTEQG

SEQ ID NO: 2022396 - protein, 25 aa, Staphylococcus
KIVLARRRLIKFNKDINIPYVLNQA

SEQ ID NO: 2022397 - protein, 25 aa, Staphylococcus
KIVLARRRLVKFANNINIAHVLERA

SEQ ID NO: 2022398 - protein, 26 aa, Staphylococcus
KIVLARRRMIQFKKDIDIAYVLENAL

SEQ ID NO: 2022399 - protein, 24 aa, Staphylococcus
KIVNNHRGGFCYELNTLFQTYLKA

SEQ ID NO: 2022400 - protein, 18 aa, Staphylococcus
KIVNNWTPEMDKFATTIN

SEQ ID NO: 2022401 - protein, 24 aa, Staphylococcus
KIVRRLSKDLSIGVITNDIYTKED

SEQ ID NO: 2022402 - protein, 25 aa, Staphylococcus
KIVYSTKNLDLWYGENHALKNINLD

SEQ ID NO: 2022403 - protein, 22 aa, Staphylococcus
KIWGGSRLKEFGYDLPSDYIGE

SEQ ID NO: 2022404 - protein, 19 aa, Staphylococcus
KIYFICGTQDIPEHQTIQG

SEQ ID NO: 2022405 - protein, 20 aa, Staphylococcus
KIYFSRRHIDSLKMNNRQAQ

SEQ ID NO: 2022406 - protein, 19 aa, Staphylococcus
KIYGTHLWSGYRTGTIYSR

SEQ ID NO: 2022407 - protein, 21 aa, Staphylococcus
KIYKGDFLAIVGPNGAGKSTL

SEQ ID NO: 2022408 - protein, 22 aa, Staphylococcus
KIYKQLLREGVDFMTMGNHTYG

SEQ ID NO: 2022409 - protein, 23 aa, Staphylococcus
KIYKQLLREGVDFMTMGNHTYGQ

SEQ ID NO: 2022410 - protein, 22 aa, Staphylococcus
KIYYKQGFNAKEYVNQNEADFK

SEQ ID NO: 2022411 - protein, 22 aa, Staphylococcus
KKAAEKIGMISEIIHLAEDTSE

SEQ ID NO: 2022412 - protein, 21 aa, Staphylococcus
KKAAEKIGMISEIVHLAEDTS

SEQ ID NO: 2022413 - protein, 21 aa, Staphylococcus
KKAAEKIGMISEIVHLDESTS

SEQ ID NO: 2022414 - protein, 20 aa, Staphylococcus
KKAALPDDVVFHFIGSLQSR

SEQ ID NO: 2022415 - protein, 18 aa, Staphylococcus
KKAEHDLLTMIQHGVLGV

SEQ ID NO: 2022416 - protein, 18 aa, Staphylococcus
KKAETLLTREEYAQCEDM

SEQ ID NO: 2022417 - protein, 18 aa, Staphylococcus
KKAFDIAKRILKLDPTNN

SEQ ID NO: 2022418 - protein, 17 aa, Staphylococcus
KKAFDILEEAMPRVSYH

SEQ ID NO: 2022419 - protein, 23 aa, Staphylococcus
KKAFKRNHIHFQPKKVIDTVELF

SEQ ID NO: 2022420 - protein, 24 aa, Staphylococcus
KKAGLKGGGYYVEYRTDDARLTIE

SEQ ID NO: 2022421 - protein, 17 aa, Staphylococcus
KKAGREITTSEFIVEMK

SEQ ID NO: 2022422 - protein, 23 aa, Staphylococcus
KKAHQLVSIIYIKLYININQNEG

SEQ ID NO: 2022423 - protein, 22 aa, Staphylococcus
KKAHRIGIFLSMPHEINTYNII

SEQ ID NO: 2022424 - protein, 19 aa, Staphylococcus
KKAILVKNAYVFTGEKVPK

SEQ ID NO: 2022425 - protein, 17 aa, Staphylococcus
KKAIVIYTIGGSEWFNL

SEQ ID NO: 2022426 - protein, 19 aa, Staphylococcus
KKAKAGDQVIFYQVQTDSG

SEQ ID NO: 2022427 - protein, 19 aa, Staphylococcus
KKAKAGDQVIFYQVQTDTG

SEQ ID NO: 2022428 - protein, 19 aa, Staphylococcus
KKAKDFIALSIKYTPEIGQ

SEQ ID NO: 2022429 - protein, 20 aa, Staphylococcus
KKAKELKEEYGYYEPQQFEN

SEQ ID NO: 2022430 - protein, 20 aa, Staphylococcus
KKAKELLATTVQRLAADHTT

SEQ ID NO: 2022431 - protein, 21 aa, Staphylococcus
KKAKLAGILHDYAKYEDLGTM

SEQ ID NO: 2022432 - protein, 20 aa, Staphylococcus
KKAKLKSNADISHINLSEKL

SEQ ID NO: 2022433 - protein, 21 aa, Staphylococcus
KKAKQVIAFEIDQRLIPVLDY

SEQ ID NO: 2022434 - protein, 21 aa, Staphylococcus
KKAKRELKLKTFTFTMNTEDT

SEQ ID NO: 2022435 - protein, 17 aa, Staphylococcus
KKALAIYMVHPEKINEI

SEQ ID NO: 2022436 - protein, 20 aa, Staphylococcus
KKALFIVYANPLALGLLTPP

SEQ ID NO: 2022437 - protein, 17 aa, Staphylococcus
KKALKLTETLEMPKPDK

SEQ ID NO: 2022438 - protein, 20 aa, Staphylococcus
KKALWSNDMLVPFDEESEKR

SEQ ID NO: 2022439 - protein, 18 aa, Staphylococcus
KKAQQKRKFKEALQNKRQ

SEQ ID NO: 2022440 - protein, 20 aa, Staphylococcus
KKAREIWYLCRQYNAQEALE

SEQ ID NO: 2022441 - protein, 20 aa, Staphylococcus
KKARSGEIKEFTGISASYEA

SEQ ID NO: 2022442 - protein, 24 aa, Staphylococcus
KKASLHPAICFTMLGHHLGVDIET

SEQ ID NO: 2022443 - protein, 19 aa, Staphylococcus
KKAYQEIADIFISVEKDIY

SEQ ID NO: 2022444 - protein, 21 aa, Staphylococcus
KKAYYKWRIDETYIKIKGKWR

SEQ ID NO: 2022445 - protein, 19 aa, Staphylococcus
KKDAIVYACDRILKGELDE

SEQ ID NO: 2022446 - protein, 18 aa, Staphylococcus
KKDFAFKTNILEVLTNEQ

SEQ ID NO: 2022447 - protein, 19 aa, Staphylococcus
KKDFKRLGVNGDFNDPYIT

SEQ ID NO: 2022448 - protein, 23 aa, Staphylococcus
KKDFKRLGVRGDFDNPYITLTPE

SEQ ID NO: 2022449 - protein, 21 aa, Staphylococcus
KKDGIVSLILFSTAMYHYRRG

SEQ ID NO: 2022450 - protein, 23 aa, Staphylococcus
KKDGYWWCRFKFDNKGEYFYVAL

SEQ ID NO: 2022451 - protein, 21 aa, Staphylococcus
KKDIFPVFKSLGLDEYINIIV

SEQ ID NO: 2022452 - protein, 20 aa, Staphylococcus
KKDILDGKFLVIANKDNSSH

SEQ ID NO: 2022453 - protein, 22 aa, Staphylococcus
KKDIQFEAVMNFIRSDLYMTIT

SEQ ID NO: 2022454 - protein, 21 aa, Staphylococcus
KKDIRTVIHFHLSSSPSNYLQ

SEQ ID NO: 2022455 - protein, 22 aa, Staphylococcus
KKDIRTVIHFHLSSSPSNYLQE

SEQ ID NO: 2022456 - protein, 22 aa, Staphylococcus
KKDIRTVIHFHLSTSPSNYLQE

SEQ ID NO: 2022457 - protein, 18 aa, Staphylococcus
KKDLCTEAQEAPVAKSPY

SEQ ID NO: 2022458 - protein, 17 aa, Staphylococcus
KKDLDAFSKKMDYSEYG

SEQ ID NO: 2022459 - protein, 17 aa, Staphylococcus
KKDLHLLNMSKDITINK

SEQ ID NO: 2022460 - protein, 19 aa, Staphylococcus
KKDLPGPIFTDPHQLAESL

SEQ ID NO: 2022461 - protein, 22 aa, Staphylococcus
KKDLSDFNVHFDNWFSETSLYE

SEQ ID NO: 2022462 - protein, 17 aa, Staphylococcus
KKDSFDWYRKVIESNGE

SEQ ID NO: 2022463 - protein, 23 aa, Staphylococcus
KKEALPDDAIMHFIGTLQSRKVK

SEQ ID NO: 2022464 - protein, 17 aa, Staphylococcus
KKEALSFTKEDREKVEN

SEQ ID NO: 2022465 - protein, 23 aa, Staphylococcus
KKEEGYNLTFFAFFVKAAAEALK

SEQ ID NO: 2022466 - protein, 18 aa, Staphylococcus
KKEELRSEVEFAGVGTYI

SEQ ID NO: 2022467 - protein, 20 aa, Staphylococcus
KKEIEAWARDKGAYTIESTV

SEQ ID NO: 2022468 - protein, 23 aa, Staphylococcus
KKEIKRLMPQVIEFSELGEFIYQ

SEQ ID NO: 2022469 - protein, 25 aa, Staphylococcus
KKEIPRFPKKIAVLTASTGAAIRDI

SEQ ID NO: 2022470 - protein, 18 aa, Staphylococcus
KKEIWEDGAEWQGHQRGS

SEQ ID NO: 2022471 - protein, 24 aa, Staphylococcus
KKEIYFRLTPKGQQVYHTHQQLHA

SEQ ID NO: 2022472 - protein, 19 aa, Staphylococcus
KKEKIEALVHAMNQLPVEG

SEQ ID NO: 2022473 - protein, 18 aa, Staphylococcus
KKELAWMRAGVKARSTKQ

SEQ ID NO: 2022474 - protein, 27 aa, Staphylococcus
KKELREIRRTKINMVFQNFGLFPKRTV

SEQ ID NO: 2022475 - protein, 17 aa, Staphylococcus
KKEMAPYVDEFIVNHMG

SEQ ID NO: 2022476 - protein, 19 aa, Staphylococcus
KKENVDFYLAKGIIDAIAE

SEQ ID NO: 2022477 - protein, 22 aa, Staphylococcus
KKERFKPLYFNEVPVPEYWEIK

SEQ ID NO: 2022478 - protein, 20 aa, Staphylococcus
KKERLRLGMTQEALSEYLNT

SEQ ID NO: 2022479 - protein, 23 aa, Staphylococcus
KKERRLLFWVVMNIIRGQRHYDN

SEQ ID NO: 2022480 - protein, 32 aa, Staphylococcus
KKESAQMNVRWGVGVVHHIAWSVPTDKVQREW

SEQ ID NO: 2022481 - protein, 21 aa, Staphylococcus
KKESVDFYLAKGVVDRVAEKL

SEQ ID NO: 2022482 - protein, 22 aa, Staphylococcus
KKEVKKVGSHVLIIAPHGGNIE

SEQ ID NO: 2022483 - protein, 18 aa, Staphylococcus
KKEVKSLVGSIDAHDAKV

SEQ ID NO: 2022484 - protein, 18 aa, Staphylococcus
KKFADGIFDYTQDELGET

SEQ ID NO: 2022485 - protein, 24 aa, Staphylococcus
KKFENKEKIMGFGHRVYKNGDPRA

SEQ ID NO: 2022486 - protein, 28 aa, Staphylococcus
KKFFRPEFLNRFDGIVEFTHLDKDALQD

SEQ ID NO: 2022487 - protein, 19 aa, Staphylococcus
KKFGKIQIDRCGQEMLERT

SEQ ID NO: 2022488 - protein, 23 aa, Staphylococcus
KKFGKSEAGTVWLDAEKTSPYEL

SEQ ID NO: 2022489 - protein, 22 aa, Staphylococcus
KKFKAQGGTLIYPSWKDGMKDI

SEQ ID NO: 2022490 - protein, 19 aa, Staphylococcus
KKFKDGIFEYTRDELGETI

SEQ ID NO: 2022491 - protein, 17 aa, Staphylococcus
KKFKSKNVFILDKSSPQ

SEQ ID NO: 2022492 - protein, 19 aa, Staphylococcus
KKFPKPVISAPPFGYTQHF

SEQ ID NO: 2022493 - protein, 31 aa, Staphylococcus
KKFQPCPGVVKRLHLPQGFNVRVDSLLYSGY

SEQ ID NO: 2022494 - protein, 19 aa, Staphylococcus
KKFSEEKVLTFSEFIDVAN

SEQ ID NO: 2022495 - protein, 19 aa, Staphylococcus
KKFSENLEYPFKQDNRRKK

SEQ ID NO: 2022496 - protein, 20 aa, Staphylococcus
KKGALSYIHDIWGYIAPNSK

SEQ ID NO: 2022497 - protein, 19 aa, Staphylococcus
KKGASRAVLARELSLEEII

SEQ ID NO: 2022498 - protein, 21 aa, Staphylococcus
KKGDRVTSHMFTKWLDGKPKS

SEQ ID NO: 2022499 - protein, 20 aa, Staphylococcus
KKGELCIVGCSTSEVIGERI

SEQ ID NO: 2022500 - protein, 19 aa, Staphylococcus
KKGFAEKMAPRFTSNPKLE

SEQ ID NO: 2022501 - protein, 19 aa, Staphylococcus
KKGIAVTFVNPIEMDYIRQ

SEQ ID NO: 2022502 - protein, 17 aa, Staphylococcus
KKGIFSVMNYLLPMQDI

SEQ ID NO: 2022503 - protein, 23 aa, Staphylococcus
KKGKFAVLLMAGGQGTRLGYKGP

SEQ ID NO: 2022504 - protein, 23 aa, Staphylococcus
KKGKMAFRVYPSWVTHLNSTALK

SEQ ID NO: 2022505 - protein, 25 aa, Staphylococcus
KKGLLRHLVIRTGYYSDDKMVVFVT

SEQ ID NO: 2022506 - protein, 20 aa, Staphylococcus
KKGLLRHVVIRTSHYTNEVM

SEQ ID NO: 2022507 - protein, 25 aa, Staphylococcus
KKGLRDRVVIELLYATGIRVSELVN

SEQ ID NO: 2022508 - protein, 20 aa, Staphylococcus
KKGNLQFVILEMLKEEPRHG

SEQ ID NO: 2022509 - protein, 20 aa, Staphylococcus
KKGQYLFDLKIDLDNLYQQI

SEQ ID NO: 2022510 - protein, 23 aa, Staphylococcus
KKGRKIEWLEFTFDAEKRIHSKR

SEQ ID NO: 2022511 - protein, 20 aa, Staphylococcus
KKGRYAYSLPKKEIDNGAVE

SEQ ID NO: 2022512 - protein, 17 aa, Staphylococcus
KKGRYAYSLPQSDIEDI

SEQ ID NO: 2022513 - protein, 18 aa, Staphylococcus
KKGSIAYLKEAEKISDFL

SEQ ID NO: 2022514 - protein, 25 aa, Staphylococcus
KKGSQLPQLFGFQAAGAAPIVHNKV

SEQ ID NO: 2022515 - protein, 26 aa, Staphylococcus
KKGSQLPRLFGFQAEGASPIVQNKVI

SEQ ID NO: 2022516 - protein, 18 aa, Staphylococcus
KKGYVRLRVDGEVVDVNE

SEQ ID NO: 2022517 - protein, 18 aa, Staphylococcus
KKHACTVITMYPHLDGVL

SEQ ID NO: 2022518 - protein, 18 aa, Staphylococcus
KKHGFKFREKPYFEDMQK

SEQ ID NO: 2022519 - protein, 20 aa, Staphylococcus
KKHINKGVIVTIFPDGSDRY

SEQ ID NO: 2022520 - protein, 22 aa, Staphylococcus
KKHIPEVFVIAGNVGTPEGVRE

SEQ ID NO: 2022521 - protein, 26 aa, Staphylococcus
KKHLEHLSSYYKFKQPSLLYDQQIQK

SEQ ID NO: 2022522 - protein, 20 aa, Staphylococcus
KKHRDTCCIAPKIKYHEDKF

SEQ ID NO: 2022523 - protein, 24 aa, Staphylococcus
KKHTKAYYKWRIDETYIKIKGKWS

SEQ ID NO: 2022524 - protein, 30 aa, Staphylococcus
KKHYPQCYSTAFKILKLIQMEFDITINEAE

SEQ ID NO: 2022525 - protein, 18 aa, Staphylococcus
KKHYRVIVYDVRGHGKST

SEQ ID NO: 2022526 - protein, 18 aa, Staphylococcus
KKIADYILRRPQQIVDMT

SEQ ID NO: 2022527 - protein, 17 aa, Staphylococcus
KKIDRWQKIVKEAAEQS

SEQ ID NO: 2022528 - protein, 18 aa, Staphylococcus
KKIEDLNIAKGHEAMKSY

SEQ ID NO: 2022529 - protein, 17 aa, Staphylococcus
KKIELLNNIKFLKGADV

SEQ ID NO: 2022530 - protein, 18 aa, Staphylococcus
KKIESFSNYQFVQLDENS

SEQ ID NO: 2022531 - protein, 19 aa, Staphylococcus
KKIFQYFKAHFEHIEAIVR

SEQ ID NO: 2022532 - protein, 18 aa, Staphylococcus
KKIGYPVIIKATAGGGGK

SEQ ID NO: 2022533 - protein, 19 aa, Staphylococcus
KKIGYPVIIKATAGGGGKG

SEQ ID NO: 2022534 - protein, 17 aa, Staphylococcus
KKIIADEGIVCPVSGTA

SEQ ID NO: 2022535 - protein, 25 aa, Staphylococcus
KKIIFKDKFPLTANGKLDRKQIAED

SEQ ID NO: 2022536 - protein, 24 aa, Staphylococcus
KKIIPHRQPFLLIDRIVEYEEGKR

SEQ ID NO: 2022537 - protein, 24 aa, Staphylococcus
KKIIPHRQPFLLIDRVVEYEEGKR

SEQ ID NO: 2022538 - protein, 21 aa, Staphylococcus
KKIISVITCYPNFEGTKKLDL

SEQ ID NO: 2022539 - protein, 22 aa, Staphylococcus
KKIKKLILASGKMFIDLKERLQ

SEQ ID NO: 2022540 - protein, 17 aa, Staphylococcus
KKILSLVGRSTILDIIG

SEQ ID NO: 2022541 - protein, 27 aa, Staphylococcus
KKIPKLPFTLCYVSRGFVADYNDRDVL

SEQ ID NO: 2022542 - protein, 27 aa, Staphylococcus
KKIPKLPFTLCYVSRGFVTDYSDKAAL

SEQ ID NO: 2022543 - protein, 27 aa, Staphylococcus
KKIPKLPFTLCYVSRGFVTEYDNKDAL

SEQ ID NO: 2022544 - protein, 19 aa, Staphylococcus
KKIPRVNLTEVYRQQDGSS

SEQ ID NO: 2022545 - protein, 20 aa, Staphylococcus
KKIQPRLSLISSGKHNKYKL

SEQ ID NO: 2022546 - protein, 19 aa, Staphylococcus
KKIREEAAIMMSCKKSIKA

SEQ ID NO: 2022547 - protein, 20 aa, Staphylococcus
KKIRESNVLINYFKRQKVVN

SEQ ID NO: 2022548 - protein, 19 aa, Staphylococcus
KKIRKVSLEDWIFEAENSK

SEQ ID NO: 2022549 - protein, 25 aa, Staphylococcus
KKIVLARKRLVMFDKNINIPYILQK

SEQ ID NO: 2022550 - protein, 32 aa, Staphylococcus
KKIVLARRRMIKFDKPISIPYVLNRALQSERN

SEQ ID NO: 2022551 - protein, 23 aa, Staphylococcus
KKIYLEKLLLYEYVQLHTQLKRI

SEQ ID NO: 2022552 - protein, 23 aa, Staphylococcus
KKKAAEKIGMISEIVHLDEDTSE

SEQ ID NO: 2022553 - protein, 22 aa, Staphylococcus
KKKAAEKIGMISEIVHLDESTS

SEQ ID NO: 2022554 - protein, 22 aa, Staphylococcus
KKKAAEKIGMISEIVHLSEDTS

SEQ ID NO: 2022555 - protein, 20 aa, Staphylococcus
KKKAEGYSENEIFVISESKL

SEQ ID NO: 2022556 - protein, 20 aa, Staphylococcus
KKKAEGYSENELVVVSKSKL

SEQ ID NO: 2022557 - protein, 17 aa, Staphylococcus
KKKAIVIGGGLLGLECA

SEQ ID NO: 2022558 - protein, 20 aa, Staphylococcus
KKKAPNFYMLPGGKYEGTEN

SEQ ID NO: 2022559 - protein, 17 aa, Staphylococcus
KKKGMELSDSVMIDKVY

SEQ ID NO: 2022560 - protein, 27 aa, Staphylococcus
KKKHLEHVASYYKFKQPSLLYDQQIQK

SEQ ID NO: 2022561 - protein, 18 aa, Staphylococcus
KKKLLEIRDDINVHYEDF

SEQ ID NO: 2022562 - protein, 19 aa, Staphylococcus
KKKPTLIVGGGRGGSLLIR

SEQ ID NO: 2022563 - protein, 17 aa, Staphylococcus
KKKRERDKTGLALIEGY

SEQ ID NO: 2022564 - protein, 23 aa, Staphylococcus
KKKRSRNVLDFADYEHFALQILT

SEQ ID NO: 2022565 - protein, 19 aa, Staphylococcus
KKKYILYCPTWRRNERETI

SEQ ID NO: 2022566 - protein, 18 aa, Staphylococcus
KKKYLDLLSQRFDSAEKL

SEQ ID NO: 2022567 - protein, 25 aa, Staphylococcus
KKKYNLSYEEIFILNYILKSESNEI

SEQ ID NO: 2022568 - protein, 23 aa, Staphylococcus
KKKYVAKLKGYLMRDEVKALEKG

SEQ ID NO: 2022569 - protein, 23 aa, Staphylococcus
KKKYVAKLKGYLMREEVKALEKG

SEQ ID NO: 2022570 - protein, 21 aa, Staphylococcus
KKKYVAKLKGYLMREQVKELE

SEQ ID NO: 2022571 - protein, 17 aa, Staphylococcus
KKLAELDMDTAIETKVG

SEQ ID NO: 2022572 - protein, 30 aa, Staphylococcus
KKLASELGVDLIMCGTSGLNAVERFIVGSV

SEQ ID NO: 2022573 - protein, 21 aa, Staphylococcus
KKLASEMGIEADIVIGVPDSS

SEQ ID NO: 2022574 - protein, 20 aa, Staphylococcus
KKLASFYVACELYKEMSCQP

SEQ ID NO: 2022575 - protein, 19 aa, Staphylococcus
KKLDAGNIISQRAIAIEQD

SEQ ID NO: 2022576 - protein, 22 aa, Staphylococcus
KKLDIALSEVVAFGDSSNDISM

SEQ ID NO: 2022577 - protein, 23 aa, Staphylococcus
KKLDMKGFIAYFHFLNDDELQRN

SEQ ID NO: 2022578 - protein, 20 aa, Staphylococcus
KKLEALGVHAVMPLASPIGT

SEQ ID NO: 2022579 - protein, 21 aa, Staphylococcus
KKLESFGIKQIAQRSAGFDDY

SEQ ID NO: 2022580 - protein, 19 aa, Staphylococcus
KKLGKGFMLQRYKGLGEMN

SEQ ID NO: 2022581 - protein, 23 aa, Staphylococcus
KKLGKGFSLQRYKGLGEMNPDQL

SEQ ID NO: 2022582 - protein, 25 aa, Staphylococcus
KKLGLDYLDLYLVHWPGKDEAVMID

SEQ ID NO: 2022583 - protein, 17 aa, Staphylococcus
KKLGLNNVHAFQHDATQ

SEQ ID NO: 2022584 - protein, 20 aa, Staphylococcus
KKLHGVKGINIMKLDQSDVV

SEQ ID NO: 2022585 - protein, 19 aa, Staphylococcus
KKLHSHRKQIKKGQVISSG

SEQ ID NO: 2022586 - protein, 26 aa, Staphylococcus
KKLIDEPLELIGLMGNISHIDEQPFA

SEQ ID NO: 2022587 - protein, 24 aa, Staphylococcus
KKLIVSKAKLYGRVTLSNNHLTIT

SEQ ID NO: 2022588 - protein, 17 aa, Staphylococcus
KKLKGLFQQNVQYVNAH

SEQ ID NO: 2022589 - protein, 24 aa, Staphylococcus
KKLKLLCDIGERFGGAAKTSGAGG

SEQ ID NO: 2022590 - protein, 23 aa, Staphylococcus
KKLKPEHFEDIVAVTSLYRPGPM

SEQ ID NO: 2022591 - protein, 22 aa, Staphylococcus
KKLKVIFTGAGSSAYVGDIARM

SEQ ID NO: 2022592 - protein, 22 aa, Staphylococcus
KKLLDCFFLDIEFEQVTPYTVK

SEQ ID NO: 2022593 - protein, 18 aa, Staphylococcus
KKLLEIRDDINIHYEGYP

SEQ ID NO: 2022594 - protein, 17 aa, Staphylococcus
KKLMLAIEQFIHEQGYS

SEQ ID NO: 2022595 - protein, 19 aa, Staphylococcus
KKLNTSFGEKQRASVTNEI

SEQ ID NO: 2022596 - protein, 20 aa, Staphylococcus
KKLPNFVLGLGAKFNKEAKE

SEQ ID NO: 2022597 - protein, 46 aa, Staphylococcus
KKLQHLSLLSGGERALSAIALLFALLKVRSAPFVILDEVEAALDEA

SEQ ID NO: 2022598 - protein, 20 aa, Staphylococcus
KKLREDAAIMMSCKKSIKAN

SEQ ID NO: 2022599 - protein, 25 aa, Staphylococcus
KKLSADSIIAYAFYLSRYEYNIYKN

SEQ ID NO: 2022600 - protein, 25 aa, Staphylococcus
KKLSEHRTSLIIAHRLSTIKDVDRI

SEQ ID NO: 2022601 - protein, 24 aa, Staphylococcus
KKLSEIHPLFYLLAVKKETLKRHI

SEQ ID NO: 2022602 - protein, 20 aa, Staphylococcus
KKLSEIHPLVNLLKQPTHLQ

SEQ ID NO: 2022603 - protein, 18 aa, Staphylococcus
KKLSKEGYFDNSNKKTIP

SEQ ID NO: 2022604 - protein, 18 aa, Staphylococcus
KKLSRFILNSPHKVISMS

SEQ ID NO: 2022605 - protein, 19 aa, Staphylococcus
KKLSRSKITVVPSRNEGFG

SEQ ID NO: 2022606 - protein, 19 aa, Staphylococcus
KKLWLHAKIDSGMGRLGMK

SEQ ID NO: 2022607 - protein, 18 aa, Staphylococcus
KKMHSRAKGALNNANEAL

SEQ ID NO: 2022608 - protein, 23 aa, Staphylococcus
KKMKEKYPEITIVAGNVATAEAT

SEQ ID NO: 2022609 - protein, 18 aa, Staphylococcus
KKMMLLGYSMGGMIATRL

SEQ ID NO: 2022610 - protein, 21 aa, Staphylococcus
KKMNPMVFCGLFPIDNKDYND

SEQ ID NO: 2022611 - protein, 18 aa, Staphylococcus
KKMNVEVSNHMQALEPNE

SEQ ID NO: 2022612 - protein, 29 aa, Staphylococcus
KKMRSIEMYIKYLIERKAYVEKLIDCLTL

SEQ ID NO: 2022613 - protein, 18 aa, Staphylococcus
KKMRVKVTEKRVFDTFQK

SEQ ID NO: 2022614 - protein, 25 aa, Staphylococcus
KKMSKGGMLDLYFNGEKVGEYSCYS

SEQ ID NO: 2022615 - protein, 19 aa, Staphylococcus
KKMVESIQFLVSGRIHKIN

SEQ ID NO: 2022616 - protein, 26 aa, Staphylococcus
KKNFDLIVDFCREHNFLILTYQDGHI

SEQ ID NO: 2022617 - protein, 21 aa, Staphylococcus
KKNGYKYKVLVLNYSPNLRLF

SEQ ID NO: 2022618 - protein, 23 aa, Staphylococcus
KKNHPKTLFVWRSNLISSSAKGQ

SEQ ID NO: 2022619 - protein, 18 aa, Staphylococcus
KKNHVNIVACENAIMATD

SEQ ID NO: 2022620 - protein, 19 aa, Staphylococcus
KKNIKIIMDLVVNHTSDEH

SEQ ID NO: 2022621 - protein, 25 aa, Staphylococcus
KKNKLPEGWKIVLNRPSTVPRKGWI

SEQ ID NO: 2022622 - protein, 24 aa, Staphylococcus
KKNKRKADIWLMKQLIENEKFKKA

SEQ ID NO: 2022623 - protein, 20 aa, Staphylococcus
KKNNIYICRTKVKSREILDE

SEQ ID NO: 2022624 - protein, 20 aa, Staphylococcus
KKNPERYAKEQQDRQNYKQQ

SEQ ID NO: 2022625 - protein, 17 aa, Staphylococcus
KKNRRSLQIYGFSPCHE

SEQ ID NO: 2022626 - protein, 18 aa, Staphylococcus
KKNRRSLQIYGFSPCHEI

SEQ ID NO: 2022627 - protein, 23 aa, Staphylococcus
KKNRRSLQIYGFSPCHEIRDMLA

SEQ ID NO: 2022628 - protein, 23 aa, Staphylococcus
KKNRRSLQIYGFSPCHEISIMLA

SEQ ID NO: 2022629 - protein, 23 aa, Staphylococcus
KKNRRSLQIYGFSPCHEISIMLT

SEQ ID NO: 2022630 - protein, 17 aa, Staphylococcus
KKNRRSLQIYGFSPCQE

SEQ ID NO: 2022631 - protein, 18 aa, Staphylococcus
KKNRRSLQIYGFSPCQEI

SEQ ID NO: 2022632 - protein, 24 aa, Staphylococcus
KKNSLKYWFHLATAKYFIQNTNMP

SEQ ID NO: 2022633 - protein, 23 aa, Staphylococcus
KKNVKRLIFVAAPGIYDELPDKF

SEQ ID NO: 2022634 - protein, 19 aa, Staphylococcus
KKPACTVITMYPHLDGVLS

SEQ ID NO: 2022635 - protein, 19 aa, Staphylococcus
KKPILKTYVDRQGKEVLYE

SEQ ID NO: 2022636 - protein, 26 aa, Staphylococcus
KKPIPKFPKRIAVLTASTGAAIRDIH

SEQ ID NO: 2022637 - protein, 25 aa, Staphylococcus
KKPIPRFPKKIAILTASTGAAIRDI

SEQ ID NO: 2022638 - protein, 21 aa, Staphylococcus
KKPKYDWEVLLPKVTATLSDE

SEQ ID NO: 2022639 - protein, 23 aa, Staphylococcus
KKPNRLVIDLPIDYYGQAETIGI

SEQ ID NO: 2022640 - protein, 22 aa, Staphylococcus
KKPRPLENGVIKRQDDSEEGTQ

SEQ ID NO: 2022641 - protein, 21 aa, Staphylococcus
KKPSIMLVMKIAKALNVEIDQ

SEQ ID NO: 2022642 - protein, 21 aa, Staphylococcus
KKPVILYGHMSPFMVVGMIAG

SEQ ID NO: 2022643 - protein, 21 aa, Staphylococcus
KKPVITPIIEYKNFYPAETYH

SEQ ID NO: 2022644 - protein, 20 aa, Staphylococcus
KKPVVIDDMIAIRNMVNLCI

SEQ ID NO: 2022645 - protein, 19 aa, Staphylococcus
KKPVVYCLDKVPASDLTCA

SEQ ID NO: 2022646 - protein, 25 aa, Staphylococcus
KKQELNEAFYYFNVPAEVQNVTEGP

SEQ ID NO: 2022647 - protein, 26 aa, Staphylococcus
KKQFDLRKKRMMEIRDDINTHYEDFP

SEQ ID NO: 2022648 - protein, 17 aa, Staphylococcus
KKQIYSFIRKSITGQYV

SEQ ID NO: 2022649 - protein, 33 aa, Staphylococcus
KKQLAINLKRKCERYHVPFIVNDDIELAKDIDA

SEQ ID NO: 2022650 - protein, 19 aa, Staphylococcus
KKQLEALSYIGLNYLTLAR

SEQ ID NO: 2022651 - protein, 17 aa, Staphylococcus
KKQLEKVLEERDTNIKS

SEQ ID NO: 2022652 - protein, 19 aa, Staphylococcus
KKQLFKYTFDVTTPEYEIL

SEQ ID NO: 2022653 - protein, 25 aa, Staphylococcus
KKQLKKTFPGYVLVELVMTDESWYV

SEQ ID NO: 2022654 - protein, 26 aa, Staphylococcus
KKQLKKVLIMPTWRDWLNSNEAFEKS

SEQ ID NO: 2022655 - protein, 19 aa, Staphylococcus
KKQNCAPSREHPHGSLIEQ

SEQ ID NO: 2022656 - protein, 18 aa, Staphylococcus
KKQPERYAKEQQDRENYK

SEQ ID NO: 2022657 - protein, 22 aa, Staphylococcus
KKQPYRAVFRCTVIQSTNGMPR

SEQ ID NO: 2022658 - protein, 20 aa, Staphylococcus
KKQREAFGKMIEKYISQREE

SEQ ID NO: 2022659 - protein, 19 aa, Staphylococcus
KKQSMYWNSNNYIWVTPTD

SEQ ID NO: 2022660 - protein, 23 aa, Staphylococcus
KKRALDILNLVGLPNADKRFNAY

SEQ ID NO: 2022661 - protein, 19 aa, Staphylococcus
KKRCTRCLNYKIKVSDECL

SEQ ID NO: 2022662 - protein, 18 aa, Staphylococcus
KKRHLRFKITTYERDAWL

SEQ ID NO: 2022663 - protein, 21 aa, Staphylococcus
KKRIENESVLFLNVDDKGIKT

SEQ ID NO: 2022664 - protein, 20 aa, Staphylococcus
KKRKVSLVILSEDASARTEK

SEQ ID NO: 2022665 - protein, 19 aa, Staphylococcus
KKRLFSISDLLLYEDIRKI

SEQ ID NO: 2022666 - protein, 17 aa, Staphylococcus
KKRLPRFDIDANETHSI

SEQ ID NO: 2022667 - protein, 19 aa, Staphylococcus
KKRMHIILQKIIKKDENIF

SEQ ID NO: 2022668 - protein, 24 aa, Staphylococcus
KKRTGGKRSETWSQQIAGFLSSKQ

SEQ ID NO: 2022669 - protein, 20 aa, Staphylococcus
KKRVGLSRTAYKEVRDIIEV

SEQ ID NO: 2022670 - protein, 19 aa, Staphylococcus
KKRVREIAEEQDLATAKKK

SEQ ID NO: 2022671 - protein, 18 aa, Staphylococcus
KKSARIVGDVMGKYHPHG

SEQ ID NO: 2022672 - protein, 19 aa, Staphylococcus
KKSARIVGDVMGKYHPHGD

SEQ ID NO: 2022673 - protein, 23 aa, Staphylococcus
KKSAYLLSLFDWSRPQIKNKLID

SEQ ID NO: 2022674 - protein, 17 aa, Staphylococcus
KKSFGSRTVIQDINLTI

SEQ ID NO: 2022675 - protein, 17 aa, Staphylococcus
KKSFIIYKIHTHQDEIE

SEQ ID NO: 2022676 - protein, 19 aa, Staphylococcus
KKSFIIYKVQFYREEIENN

SEQ ID NO: 2022677 - protein, 26 aa, Staphylococcus
KKSFIKNINELLPIFQNIIHMVDEHF

SEQ ID NO: 2022678 - protein, 18 aa, Staphylococcus
KKSFYWYQNVIKTNGNSL

SEQ ID NO: 2022679 - protein, 20 aa, Staphylococcus
KKSKIPVEIFGIMPGGVTTD

SEQ ID NO: 2022680 - protein, 20 aa, Staphylococcus
KKSKVTFGLVDSGREINVPD

SEQ ID NO: 2022681 - protein, 25 aa, Staphylococcus
KKSLQPRMDICFVREKGSGTRFYQE

SEQ ID NO: 2022682 - protein, 19 aa, Staphylococcus
KKSLSVAVYNHYKRIQQLG

SEQ ID NO: 2022683 - protein, 18 aa, Staphylococcus
KKSTPLKIYINGDFSNIS

SEQ ID NO: 2022684 - protein, 19 aa, Staphylococcus
KKSVDRNAVDFSQINILDY

SEQ ID NO: 2022685 - protein, 25 aa, Staphylococcus
KKSVVSPKFSGLFSLNDDFDSILSK

SEQ ID NO: 2022686 - protein, 27 aa, Staphylococcus
KKTDKALREIMSYGVLTVESKSGYGLD

SEQ ID NO: 2022687 - protein, 26 aa, Staphylococcus
KKTEFPRIQLFMRSYTGTSHWESEFK

SEQ ID NO: 2022688 - protein, 25 aa, Staphylococcus
KKTGAFIRKFTKNWLKKPNAKLTID

SEQ ID NO: 2022689 - protein, 19 aa, Staphylococcus
KKTGHFVRNFTKNWLKKPE

SEQ ID NO: 2022690 - protein, 19 aa, Staphylococcus
KKTGYPLKMISGGNSSALP

SEQ ID NO: 2022691 - protein, 19 aa, Staphylococcus
KKTIMLYIASDWFRDRHFD

SEQ ID NO: 2022692 - protein, 25 aa, Staphylococcus
KKTIPRFPKKIAVLTASTGAAIRDI

SEQ ID NO: 2022693 - protein, 20 aa, Staphylococcus
KKTKDGSAFVIDKHTAETNV

SEQ ID NO: 2022694 - protein, 21 aa, Staphylococcus
KKTKEGHSFIYSEHTAETNIY

SEQ ID NO: 2022695 - protein, 21 aa, Staphylococcus
KKTKSRLDIMNNLPASATVTH

SEQ ID NO: 2022696 - protein, 19 aa, Staphylococcus
KKTNSYELAFEELEKENDF

SEQ ID NO: 2022697 - protein, 20 aa, Staphylococcus
KKTVSLRLRYQVDKMAQVTH

SEQ ID NO: 2022698 - protein, 19 aa, Staphylococcus
KKTYYKWRIDETYIKIKGQ

SEQ ID NO: 2022699 - protein, 17 aa, Staphylococcus
KKVACYSERAMQQYEGQ

SEQ ID NO: 2022700 - protein, 17 aa, Staphylococcus
KKVAPKLEIHLSTQQSL

SEQ ID NO: 2022701 - protein, 18 aa, Staphylococcus
KKVDVGFLPPTAYTLAHD

SEQ ID NO: 2022702 - protein, 24 aa, Staphylococcus
KKVEMEFQDSLYLLKDAQNGQIYP

SEQ ID NO: 2022703 - protein, 24 aa, Staphylococcus
KKVERCAPWPPSEDFAYYAKELPS

SEQ ID NO: 2022704 - protein, 18 aa, Staphylococcus
KKVEREVPVKTARKILAD

SEQ ID NO: 2022705 - protein, 19 aa, Staphylococcus
KKVEREVPVKTARKILADE

SEQ ID NO: 2022706 - protein, 19 aa, Staphylococcus
KKVEREVPVKTARKILTDE

SEQ ID NO: 2022707 - protein, 18 aa, Staphylococcus
KKVEREVPVKTARNILAD

SEQ ID NO: 2022708 - protein, 18 aa, Staphylococcus
KKVEYAWTDDELDKLQKQ

SEQ ID NO: 2022709 - protein, 17 aa, Staphylococcus
KKVEYAWTDDELEKLQK

SEQ ID NO: 2022710 - protein, 19 aa, Staphylococcus
KKVFEAFDKVLLGHLHHPF

SEQ ID NO: 2022711 - protein, 24 aa, Staphylococcus
KKVHDIQSADEWGIHTSNLTIDAA

SEQ ID NO: 2022712 - protein, 19 aa, Staphylococcus
KKVIDKMAAVFILQGYLDS

SEQ ID NO: 2022713 - protein, 25 aa, Staphylococcus
KKVIPKFPQKIAVLTAGTGAAIRDI

SEQ ID NO: 2022714 - protein, 17 aa, Staphylococcus
KKVKFAVWEKYDDNHRV

SEQ ID NO: 2022715 - protein, 19 aa, Staphylococcus
KKVKGIIGMTFLDQRKQMV

SEQ ID NO: 2022716 - protein, 25 aa, Staphylococcus
KKVLKGLASESVFPKFIETRKSSLR

SEQ ID NO: 2022717 - protein, 18 aa, Staphylococcus
KKVLLVMGGSLGSKKLNS

SEQ ID NO: 2022718 - protein, 20 aa, Staphylococcus
KKVMMAKFNNMIDLRQTIRL

SEQ ID NO: 2022719 - protein, 21 aa, Staphylococcus
KKVRELERQYLVSLFADQGLT

SEQ ID NO: 2022720 - protein, 25 aa, Staphylococcus
KKVSHSLMSFFFIKISRTELQTFLY

SEQ ID NO: 2022721 - protein, 19 aa, Staphylococcus
KKVSSKAFLDQIHQRLYLE

SEQ ID NO: 2022722 - protein, 24 aa, Staphylococcus
KKVTRLGAILDEFLEADKYVFVSP

SEQ ID NO: 2022723 - protein, 32 aa, Staphylococcus
KKVVLARRRLIKFDKPISIPYVLNRALNNEKN

SEQ ID NO: 2022724 - protein, 19 aa, Staphylococcus
KKWMMGAVARIYQPGIKYD

SEQ ID NO: 2022725 - protein, 17 aa, Staphylococcus
KKWQLWYDMDIIADNDK

SEQ ID NO: 2022726 - protein, 21 aa, Staphylococcus
KKYEISEVDYIFCTFDTDMYY

SEQ ID NO: 2022727 - protein, 21 aa, Staphylococcus
KKYGLRSGVGLAAPQINVSKR

SEQ ID NO: 2022728 - protein, 22 aa, Staphylococcus
KKYGLRSGVGLAAPQINVSKRM

SEQ ID NO: 2022729 - protein, 19 aa, Staphylococcus
KKYGNKIAVDDVSFKINEG

SEQ ID NO: 2022730 - protein, 17 aa, Staphylococcus
KKYIDELKNNKEQHDEL

SEQ ID NO: 2022731 - protein, 25 aa, Staphylococcus
KKYIIKTWLEDGGIDPRRRGETLSI

SEQ ID NO: 2022732 - protein, 17 aa, Staphylococcus
KKYKVLHDVAGKTMIEH

SEQ ID NO: 2022733 - protein, 19 aa, Staphylococcus
KKYKVLHEVAGKPMVEHVL

SEQ ID NO: 2022734 - protein, 18 aa, Staphylococcus
KKYKVLHEVAGKSMIEHV

SEQ ID NO: 2022735 - protein, 17 aa, Staphylococcus
KKYPQKEVIAVFQPHTF

SEQ ID NO: 2022736 - protein, 20 aa, Staphylococcus
KKYQAQHVLTDILPTIDNIE

SEQ ID NO: 2022737 - protein, 22 aa, Staphylococcus
KKYRKYTHKWVVDNEATLNFYK

SEQ ID NO: 2022738 - protein, 17 aa, Staphylococcus
KKYVAKLKGYLMREEVK

SEQ ID NO: 2022739 - protein, 19 aa, Staphylococcus
KLADFVRYEVGEGMEKREE

SEQ ID NO: 2022740 - protein, 17 aa, Staphylococcus
KLADLGYQPGVQPYSEG

SEQ ID NO: 2022741 - protein, 23 aa, Staphylococcus
KLAEERHHFMLQFLKQFLHEWNF

SEQ ID NO: 2022742 - protein, 24 aa, Staphylococcus
KLAEFKIKAVDIMGPLMNILLDQI

SEQ ID NO: 2022743 - protein, 17 aa, Staphylococcus
KLAHFILDKNIELSEEI

SEQ ID NO: 2022744 - protein, 20 aa, Staphylococcus
KLAHHPRLILQSNIQTQVLR

SEQ ID NO: 2022745 - protein, 32 aa, Staphylococcus
KLAIEDSLKRLIMPSIEREIRADLTEKAEQHA

SEQ ID NO: 2022746 - protein, 25 aa, Staphylococcus
KLAIEYKLAFPLHPEFRTMPMVWYC

SEQ ID NO: 2022747 - protein, 24 aa, Staphylococcus
KLAIEYKLAFPLHPEYRTLPMVWY

SEQ ID NO: 2022748 - protein, 17 aa, Staphylococcus
KLAKAFDMKVIGVSKSG

SEQ ID NO: 2022749 - protein, 24 aa, Staphylococcus
KLALAKGRGAKVWDIEDNCYIDCI

SEQ ID NO: 2022750 - protein, 25 aa, Staphylococcus
KLAMHRAIEGLRIKPTHLLVDAMTL

SEQ ID NO: 2022751 - protein, 25 aa, Staphylococcus
KLAMVLVQFPPWFDCNAQNINYILY

SEQ ID NO: 2022752 - protein, 25 aa, Staphylococcus
KLAMVLVQFPPWFDCSSQNIKYILY

SEQ ID NO: 2022753 - protein, 25 aa, Staphylococcus
KLAPKSKADFAFIQHMVHYLDDEGT

SEQ ID NO: 2022754 - protein, 30 aa, Staphylococcus; identical to SEQ ID NO: 1808128

SEQ ID NO: 2022755 - protein, 20 aa, Staphylococcus
KLCDEFEKKVIIFDLPLFFP

SEQ ID NO: 2022756 - protein, 19 aa, Staphylococcus
KLCGLEHTIMKKLVIPQVI

SEQ ID NO: 2022757 - protein, 20 aa, Staphylococcus
KLCQEIPEIDLILGSHTHHH

SEQ ID NO: 2022758 - protein, 20 aa, Staphylococcus
KLCQEIPEIDLILGSHTHHY

SEQ ID NO: 2022759 - protein, 20 aa, Staphylococcus
KLCQEIPEIDVIFGSHTHHY

SEQ ID NO: 2022760 - protein, 17 aa, Staphylococcus
KLCRICFRELAYKGQIP

SEQ ID NO: 2022761 - protein, 19 aa, Staphylococcus
KLDALDLFKDNPFMQHHIE

SEQ ID NO: 2022762 - protein, 17 aa, Staphylococcus
KLDELSLVELLEDEYFK

SEQ ID NO: 2022763 - protein, 19 aa, Staphylococcus
KLDEWLGSTSTDFNVKLGG

SEQ ID NO: 2022764 - protein, 21 aa, Staphylococcus
KLDFPESVVSYFKGDIGQPVN

SEQ ID NO: 2022765 - protein, 19 aa, Staphylococcus
KLDIYELIDDVYELRESRV

SEQ ID NO: 2022766 - protein, 19 aa, Staphylococcus
KLDKAFKPKMPEAEREKLY

SEQ ID NO: 2022767 - protein, 21 aa, Staphylococcus
KLDKSEVAMVGDLYDTDIMSG

SEQ ID NO: 2022768 - protein, 27 aa, Staphylococcus
KLDKSIFKRGILKAASYKYQRLAKKYD

SEQ ID NO: 2022769 - protein, 23 aa, Staphylococcus
KLDLKKVYYGLQMQMMTYMDIVL

SEQ ID NO: 2022770 - protein, 18 aa, Staphylococcus
KLDLLIKNIEELSVECHF

SEQ ID NO: 2022771 - protein, 20 aa, Staphylococcus
KLDMSEYMDRTAVSKLIGTS

SEQ ID NO: 2022772 - protein, 20 aa, Staphylococcus
KLDRDIQCAVLTVSDTRTPE

SEQ ID NO: 2022773 - protein, 22 aa, Staphylococcus
KLDTLESIMLIKRVDNQSIVRL

SEQ ID NO: 2022774 - protein, 18 aa, Staphylococcus
KLDVYKGDVMLIVNTASE

SEQ ID NO: 2022775 - protein, 23 aa, Staphylococcus
KLDYELKELYALERYMKEYQKQQ

SEQ ID NO: 2022776 - protein, 21 aa, Staphylococcus
KLEECKQCSNCIQENKTYDMT

SEQ ID NO: 2022777 - protein, 18 aa, Staphylococcus
KLEEKISLLIKQNMNRYM

SEQ ID NO: 2022778 - protein, 21 aa, Staphylococcus
KLEEYKGKVMLIVNTASECGF

SEQ ID NO: 2022779 - protein, 19 aa, Staphylococcus
KLEFERNYERYQFLNWATK

SEQ ID NO: 2022780 - protein, 22 aa, Staphylococcus
KLEGVKSIFYVMDFLAIDKQPK

SEQ ID NO: 2022781 - protein, 21 aa, Staphylococcus
KLEHFQEEFDFILDNIVGNNN

SEQ ID NO: 2022782 - protein, 18 aa, Staphylococcus
KLEIHLIAFDEAHCISKW

SEQ ID NO: 2022783 - protein, 26 aa, Staphylococcus
KLEKFYCEDCGFKIFQYRNTDKGKIV

SEQ ID NO: 2022784 - protein, 19 aa, Staphylococcus
KLEKMVSPFYTDWDSQAFK

SEQ ID NO: 2022785 - protein, 24 aa, Staphylococcus
KLEKRGRNYIGLCPFHDEKTPSFT

SEQ ID NO: 2022786 - protein, 25 aa, Staphylococcus
KLEKRGRNYIGLCPFHDEKTPSFTV

SEQ ID NO: 2022787 - protein, 22 aa, Staphylococcus
KLEQCHQDLLSIESFYQDIKAQ

SEQ ID NO: 2022788 - protein, 19 aa, Staphylococcus
KLEQVHVFIQPEFSQEIIE

SEQ ID NO: 2022789 - protein, 19 aa, Staphylococcus
KLETAVLIGVHAQNDNEFN

SEQ ID NO: 2022790 - protein, 19 aa, Staphylococcus
KLETAVLIGVHAQTDNQFN

SEQ ID NO: 2022791 - protein, 27 aa, Staphylococcus
KLETYLTPHFIPLDVLYESVDIMAELE

SEQ ID NO: 2022792 - protein, 23 aa, Staphylococcus
KLFEKNIRLAVTIKNNQEFKMIY

SEQ ID NO: 2022793 - protein, 19 aa, Staphylococcus
KLFFKDEYLKENKRIEIVG

SEQ ID NO: 2022794 - protein, 20 aa, Staphylococcus
KLFGQDAFKHSVNIHQHIAY

SEQ ID NO: 2022795 - protein, 18 aa, Staphylococcus
KLFKGNSIVNGRKSPFTL

SEQ ID NO: 2022796 - protein, 25 aa, Staphylococcus
KLFKRFAGDTPFNFLQNYRLEQSAK

SEQ ID NO: 2022797 - protein, 21 aa, Staphylococcus
KLFKRYVGMTPFQYLLHYRLE

SEQ ID NO: 2022798 - protein, 17 aa, Staphylococcus
KLFLKRNTNPFIAALSA

SEQ ID NO: 2022799 - protein, 19 aa, Staphylococcus
KLFLLILELPERLTRQEFS

SEQ ID NO: 2022800 - protein, 18 aa, Staphylococcus
KLFNEKFKNVTYVLNYMA

SEQ ID NO: 2022801 - protein, 29 aa, Staphylococcus
KLFSPLLEPEIMFKLTADLPKDADNLTIL

SEQ ID NO: 2022802 - protein, 19 aa, Staphylococcus
KLGDIIDLFTFKLGDTESR

SEQ ID NO: 2022803 - protein, 18 aa, Staphylococcus
KLGFKRVIIPESNIGGWQ

SEQ ID NO: 2022804 - protein, 19 aa, Staphylococcus
KLGGGYLSELAKIDISNLD

SEQ ID NO: 2022805 - protein, 20 aa, Staphylococcus
KLGICTYPNYYGETFNIGNF

SEQ ID NO: 2022806 - protein, 24 aa, Staphylococcus
KLGKDYRMAFAVRDLGGSRIDLPS

SEQ ID NO: 2022807 - protein, 23 aa, Staphylococcus
KLGKGFSLQRYKGLGEMNADQLW

SEQ ID NO: 2022808 - protein, 24 aa, Staphylococcus
KLGKYPPYYFLINFTISHRDMKKV

SEQ ID NO: 2022809 - protein, 24 aa, Staphylococcus
KLGLDYLDLYLVHWPGMDEEVMID

SEQ ID NO: 2022810 - protein, 24 aa, Staphylococcus
KLGLDYLDLYLVHWPGTNEAIMID

SEQ ID NO: 2022811 - protein, 24 aa, Staphylococcus
KLGLDYLDLYLVHWPGTNEAVMID

SEQ ID NO: 2022812 - protein, 27 aa, Staphylococcus
KLGMQEMKFDMCGSANVLGMIEAAHRL

SEQ ID NO: 2022813 - protein, 19 aa, Staphylococcus
KLGPMGDAVIKGYINKNEK

SEQ ID NO: 2022814 - protein, 18 aa, Staphylococcus
KLGQPIDITQRFHDRSFI

SEQ ID NO: 2022815 - protein, 25 aa, Staphylococcus
KLGRKSASSISEWEKGKYTPKMSTL

SEQ ID NO: 2022816 - protein, 30 aa, Staphylococcus
KLGYPFMVKTRFGGYDGKGQILVRDENDLN

SEQ ID NO: 2022817 - protein, 24 aa, Staphylococcus
KLHDNNIYPIARIVTFKDTKLANE

SEQ ID NO: 2022818 - protein, 19 aa, Staphylococcus
KLHRFKAKSNRNMQQLKQV

SEQ ID NO: 2022819 - protein, 26 aa, Staphylococcus
KLHSIFLEVVIAPSFTEEALEVLTKK

SEQ ID NO: 2022820 - protein, 24 aa, Staphylococcus
KLIDLRLQTRLSYTESQIKFYKTK

SEQ ID NO: 2022821 - protein, 17 aa, Staphylococcus
KLIDQYDFLYAIIGWHP

SEQ ID NO: 2022822 - protein, 17 aa, Staphylococcus
KLIELRDTLLPKLMSGE

SEQ ID NO: 2022823 - protein, 19 aa, Staphylococcus
KLIFMRDGHILLQEDKHIL

SEQ ID NO: 2022824 - protein, 18 aa, Staphylococcus
KLIGRTEANFELKEENST

SEQ ID NO: 2022825 - protein, 24 aa, Staphylococcus
KLIKRVHGLDVMGFEDLKVSIDPN

SEQ ID NO: 2022826 - protein, 19 aa, Staphylococcus
KLIPEEEEAFYGFYAITHT

SEQ ID NO: 2022827 - protein, 18 aa, Staphylococcus
KLIPLTYFVQKFKQAKSS

SEQ ID NO: 2022828 - protein, 20 aa, Staphylococcus
KLIQELNHDYPLGSHERQEH

SEQ ID NO: 2022829 - protein, 20 aa, Staphylococcus
KLISETFVADGQKGADGKNG

SEQ ID NO: 2022830 - protein, 30 aa, Staphylococcus
KLIVPKNHFDLLGRVGFKENFTATRIRGHS

SEQ ID NO: 2022831 - protein, 18 aa, Staphylococcus
KLIYETRHSANIETYSIF

SEQ ID NO: 2022832 - protein, 23 aa, Staphylococcus
KLKAEHFDAVIAIGQAGGRYNLT

SEQ ID NO: 2022833 - protein, 25 aa, Staphylococcus
KLKASIKQLRMWASQSNPPNAAMYR

SEQ ID NO: 2022834 - protein, 23 aa, Staphylococcus
KLKAYQLQYSKAYKGYMEASQKN

SEQ ID NO: 2022835 - protein, 22 aa, Staphylococcus
KLKDILMEWQLGIYEGGGWNAI

SEQ ID NO: 2022836 - protein, 22 aa, Staphylococcus
KLKDVRFQVMSDFDSKLYGKHS

SEQ ID NO: 2022837 - protein, 22 aa, Staphylococcus
KLKEFKEKGLIDYQLTPMNTLI

SEQ ID NO: 2022838 - protein, 20 aa, Staphylococcus
KLKEILNYVSEGEIIDVLPI

SEQ ID NO: 2022839 - protein, 17 aa, Staphylococcus
KLKEKYSLFDITHQPEL

SEQ ID NO: 2022840 - protein, 25 aa, Staphylococcus
KLKERLKHLNVNFSFNRDEDTLRIA

SEQ ID NO: 2022841 - protein, 22 aa, Staphylococcus
KLKETFPQVEFKFIKKAKNIPN

SEQ ID NO: 2022842 - protein, 18 aa, Staphylococcus
KLKGKVALITGGDSGIGR

SEQ ID NO: 2022843 - protein, 26 aa, Staphylococcus
KLKGLFPKIELHLYGFGPEESKLKTL

SEQ ID NO: 2022844 - protein, 18 aa, Staphylococcus
KLKHCLLSGDFISVGLAK

SEQ ID NO: 2022845 - protein, 19 aa, Staphylococcus
KLKHKKCGYEWRGTPSHFM

SEQ ID NO: 2022846 - protein, 24 aa, Staphylococcus
KLKHWLPVDLYIGGVEHAVLHLLY

SEQ ID NO: 2022847 - protein, 32 aa, Staphylococcus
KLKKELPAIMKWCVEGYLEWQKIGLSEPQSVK

SEQ ID NO: 2022848 - protein, 25 aa, Staphylococcus
KLKLIGHYIGMSFQIIDDVLDFTSS

SEQ ID NO: 2022849 - protein, 25 aa, Staphylococcus
KLKMIGHYIGMSFQIIDDILDFTSS

SEQ ID NO: 2022850 - protein, 29 aa, Staphylococcus
KLKMNGREVFKFAVRIMGDASTRVVDKAG

SEQ ID NO: 2022851 - protein, 29 aa, Staphylococcus
KLKMNGREVFKFAVRIMGDASTRVVEKAG

SEQ ID NO: 2022852 - protein, 21 aa, Staphylococcus
KLKMPFNKYISVISYQEAENL

SEQ ID NO: 2022853 - protein, 19 aa, Staphylococcus
KLKQGGALYVVIQKKQGMP

SEQ ID NO: 2022854 - protein, 25 aa, Staphylococcus
KLKQLSKRMPVFFSANMSYGVHALT

SEQ ID NO: 2022855 - protein, 19 aa, Staphylococcus
KLKQQYRPTVTIVNAENAA

SEQ ID NO: 2022856 - protein, 23 aa, Staphylococcus
KLKQRALNIISEIVEVPIEKSEQ

SEQ ID NO: 2022857 - protein, 22 aa, Staphylococcus
KLKRGRAQIFLINSLREVADIQ

SEQ ID NO: 2022858 - protein, 21 aa, Staphylococcus
KLKSGIFKTFCEKAIKTQNNN

SEQ ID NO: 2022859 - protein, 21 aa, Staphylococcus
KLKSIFGERDMYFISENGAVI

SEQ ID NO: 2022860 - protein, 20 aa, Staphylococcus
KLKSRIDSLATQEEDYTYFF

SEQ ID NO: 2022861 - protein, 21 aa, Staphylococcus
KLKSSLPLTDLNSFEELDTTD

SEQ ID NO: 2022862 - protein, 20 aa, Staphylococcus
KLKTLIPRQQFEVPVQAAVG

SEQ ID NO: 2022863 - protein, 19 aa, Staphylococcus
KLKVCADATRLEILDLLSC

SEQ ID NO: 2022864 - protein, 20 aa, Staphylococcus
KLKVKSNMVFSGYVDDAHQS

SEQ ID NO: 2022865 - protein, 24 aa, Staphylococcus
KLKVTLSFYFKAPKSWSNRKKLLA

SEQ ID NO: 2022866 - protein, 18 aa, Staphylococcus
KLKYDYYGDISIPLISRG

SEQ ID NO: 2022867 - protein, 25 aa, Staphylococcus
KLLAAKFKNLCVVGDSDQSIYGWRG

SEQ ID NO: 2022868 - protein, 18 aa, Staphylococcus
KLLAKHDLYHPVVTKSVR

SEQ ID NO: 2022869 - protein, 23 aa, Staphylococcus
KLLARGPVFKGLLTANSIDVLDS

SEQ ID NO: 2022870 - protein, 21 aa, Staphylococcus
KLLDEGFGFTSPQTFVDNTGE

SEQ ID NO: 2022871 - protein, 18 aa, Staphylococcus
KLLDEVYLLPFSKFQKYW

SEQ ID NO: 2022872 - protein, 18 aa, Staphylococcus
KLLEDIRIFNEIKLQRPS

SEQ ID NO: 2022873 - protein, 21 aa, Staphylococcus
KLLEDQRILNAIARQRPSIQP

SEQ ID NO: 2022874 - protein, 17 aa, Staphylococcus
KLLESLILVGAFDSLGH

SEQ ID NO: 2022875 - protein, 18 aa, Staphylococcus
KLLESLILVGAFDTFGKT

SEQ ID NO: 2022876 - protein, 19 aa, Staphylococcus
KLLGERGANVVVNYYSSPD

SEQ ID NO: 2022877 - protein, 18 aa, Staphylococcus
KLLIKLGANVTVNDGKDL

SEQ ID NO: 2022878 - protein, 18 aa, Staphylococcus
KLLKDVYHQGQLVTTKKK

SEQ ID NO: 2022879 - protein, 17 aa, Staphylococcus
KLLKIQIDLGLEQRQIV

SEQ ID NO: 2022880 - protein, 21 aa, Staphylococcus
KLLKLELFTGEKGLHKPIKNT

SEQ ID NO: 2022881 - protein, 17 aa, Staphylococcus
KLLKLKSLMHTSTGRKL

SEQ ID NO: 2022882 - protein, 18 aa, Staphylococcus
KLLLHKREIIKLGERTRE

SEQ ID NO: 2022883 - protein, 17 aa, Staphylococcus
KLLMGVPGRSNAFDISR

SEQ ID NO: 2022884 - protein, 19 aa, Staphylococcus
KLLNDLKSSFNLNFDIEVD

SEQ ID NO: 2022885 - protein, 21 aa, Staphylococcus
KLLNDLSLKPLHEFHQGTILV

SEQ ID NO: 2022886 - protein, 20 aa, Staphylococcus
KLLNLPENVLFYPITGEVNG

SEQ ID NO: 2022887 - protein, 24 aa, Staphylococcus
KLLNSEPYLKYQILTMAQQLNQSF

SEQ ID NO: 2022888 - protein, 17 aa, Staphylococcus
KLLREINQPAKFIFLDF

SEQ ID NO: 2022889 - protein, 23 aa, Staphylococcus
KLLSETYDLVFLDINLMDESGID

SEQ ID NO: 2022890 - protein, 18 aa, Staphylococcus
KLLSTAGAYWRGDSDNKM

SEQ ID NO: 2022891 - protein, 18 aa, Staphylococcus
KLLSTAGAYWRGDSNNKM

SEQ ID NO: 2022892 - protein, 28 aa, Staphylococcus
KLMIESKLKVSLLFCFEPPKSWSKKKKT

SEQ ID NO: 2022893 - protein, 25 aa, Staphylococcus
KLMKENFKFIYLDFIQKENIQTLTE

SEQ ID NO: 2022894 - protein, 23 aa, Staphylococcus
KLMKLKYVRHIDGSPYRFLKKTY

SEQ ID NO: 2022895 - protein, 17 aa, Staphylococcus
KLMNYWCNHQIRVEGMK

SEQ ID NO: 2022896 - protein, 18 aa, Staphylococcus
KLMPFYQYDAMSKDSYKI

SEQ ID NO: 2022897 - protein, 19 aa, Staphylococcus
KLNDEYFKRIKAIEYSVKY

SEQ ID NO: 2022898 - protein, 18 aa, Staphylococcus
KLNDLRSRVRLETDGKLL

SEQ ID NO: 2022899 - protein, 28 aa, Staphylococcus
KLNFNYLYHCFEFSNNLVKARVNGNRGY

SEQ ID NO: 2022900 - protein, 22 aa, Staphylococcus
KLNGEHAVCCIHSGMDNTEKRQ

SEQ ID NO: 2022901 - protein, 20 aa, Staphylococcus
KLNGGDNIGLFSYGSGSVGE

SEQ ID NO: 2022902 - protein, 18 aa, Staphylococcus
KLNHLLKEMQSVVIAYSG

SEQ ID NO: 2022903 - protein, 20 aa, Staphylococcus
KLNHLRSRVRLETDGKLMTG

SEQ ID NO: 2022904 - protein, 19 aa, Staphylococcus
KLNIDFEIVPGVTSASAAA

SEQ ID NO: 2022905 - protein, 23 aa, Staphylococcus
KLNIKKLGERVFLDSGTLTPLLK

SEQ ID NO: 2022906 - protein, 25 aa, Staphylococcus
KLNNRITSIIFEYLENNGLKSHFIK

SEQ ID NO: 2022907 - protein, 18 aa, Staphylococcus
KLNPYLVEINNIKIIKQM

SEQ ID NO: 2022908 - protein, 20 aa, Staphylococcus
KLNQLHVFINTDFSIMPNFT

SEQ ID NO: 2022909 - protein, 18 aa, Staphylococcus
KLNRGLGVIGELDNQITL

SEQ ID NO: 2022910 - protein, 21 aa, Staphylococcus
KLNYPEAVAIISFELLEGARD

SEQ ID NO: 2022911 - protein, 20 aa, Staphylococcus
KLPDVFNHWLATPLAQSLNC

SEQ ID NO: 2022912 - protein, 17 aa, Staphylococcus
KLPEKRFKHSLRVADTA

SEQ ID NO: 2022913 - protein, 17 aa, Staphylococcus
KLPEKRFKHSLRVAETA

SEQ ID NO: 2022914 - protein, 17 aa, Staphylococcus
KLPEKRFNHSLRVAETA

SEQ ID NO: 2022915 - protein, 18 aa, Staphylococcus
KLPHLSERERKVISKHTK

SEQ ID NO: 2022916 - protein, 25 aa, Staphylococcus
KLPIEVDKFNWLLVSKKIEAYHDIS

SEQ ID NO: 2022917 - protein, 20 aa, Staphylococcus
KLPIGVHSWGYVAETDEQAK

SEQ ID NO: 2022918 - protein, 26 aa, Staphylococcus
KLPKLPFTLCYISRGFVTDYNNKEAL

SEQ ID NO: 2022919 - protein, 17 aa, Staphylococcus
KLPLSMEEVRTYSPEFE

SEQ ID NO: 2022920 - protein, 18 aa, Staphylococcus
KLPNLSERERTVISKHTK

SEQ ID NO: 2022921 - protein, 20 aa, Staphylococcus
KLPQYDFKYEVGEEESNLVG

SEQ ID NO: 2022922 - protein, 19 aa, Staphylococcus
KLPSELRNELKLYIEDCKL

SEQ ID NO: 2022923 - protein, 19 aa, Staphylococcus
KLPSSIKRGDYLAILSTGA

SEQ ID NO: 2022924 - protein, 22 aa, Staphylococcus
KLPTRQMILNFAHYRFTDLKES

SEQ ID NO: 2022925 - protein, 28 aa, Staphylococcus
KLPVEVDKFNWLLVAKRIKAYDELKVTR

SEQ ID NO: 2022926 - protein, 25 aa, Staphylococcus
KLPVEVDKFNWLLVSKKITKDTQAV

SEQ ID NO: 2022927 - protein, 26 aa, Staphylococcus
KLPWGDLDIDVVLECTGFYTDKDKAQ

SEQ ID NO: 2022928 - protein, 26 aa, Staphylococcus
KLPWGDLDIDVVLECTGFYTDKEKAE

SEQ ID NO: 2022929 - protein, 26 aa, Staphylococcus
KLPWGDLDIDVVLECTGFYTEKEKAE

SEQ ID NO: 2022930 - protein, 21 aa, Staphylococcus
KLQAIYRRVYEFGAEEKRTLN

SEQ ID NO: 2022931 - protein, 25 aa, Staphylococcus
KLQAIYRRVYEFGVEEKRILNWQKA

SEQ ID NO: 2022932 - protein, 25 aa, Staphylococcus
KLQAIYRRVYEFGVEEKRTLNWQDT

SEQ ID NO: 2022933 - protein, 24 aa, Staphylococcus
KLQAIYRRVYQFSLDEKRVLSWQD

SEQ ID NO: 2022934 - protein, 20 aa, Staphylococcus
KLQAVCAICGSSSSRTQRLI

SEQ ID NO: 2022935 - protein, 20 aa, Staphylococcus
KLQAVCAVCGSPSSRTQRLI

SEQ ID NO: 2022936 - protein, 20 aa, Staphylococcus
KLQAVCAVCGSSSSRTQRLI

SEQ ID NO: 2022937 - protein, 24 aa, Staphylococcus
KLQAVYRRVYEFGVEEKRTLNWQD

SEQ ID NO: 2022938 - protein, 21 aa, Staphylococcus
KLQDLEFLKDITLNKRIKSYD

SEQ ID NO: 2022939 - protein, 24 aa, Staphylococcus
KLQEEFDNAFLLRTFSKAYGLAGL

SEQ ID NO: 2022940 - protein, 19 aa, Staphylococcus
KLQERRPAEPHSFGKVTIT

SEQ ID NO: 2022941 - protein, 20 aa, Staphylococcus
KLQHPSLYLDIGDHVDLSAP

SEQ ID NO: 2022942 - protein, 23 aa, Staphylococcus
KLQHPTFLIGFGGIPEEKLEKHV

SEQ ID NO: 2022943 - protein, 18 aa, Staphylococcus
KLQKERGITFLFIAHDLS

SEQ ID NO: 2022944 - protein, 20 aa, Staphylococcus
KLQKMLYYAQAWCVTLSNET

SEQ ID NO: 2022945 - protein, 19 aa, Staphylococcus
KLQLESFMHKVLESNYYEG

SEQ ID NO: 2022946 - protein, 19 aa, Staphylococcus
KLQPEHFEDIVAVTSLYRP

SEQ ID NO: 2022947 - protein, 24 aa, Staphylococcus
KLQSHELRTCFALTEPDHGSDVAG

SEQ ID NO: 2022948 - protein, 24 aa, Staphylococcus
KLQSHELRTCFALTEPEHGSDVAG

SEQ ID NO: 2022949 - protein, 27 aa, Staphylococcus
KLRAEKKRMGFSFRFEDLFSEEELLNM

SEQ ID NO: 2022950 - protein, 33 aa, Staphylococcus
KLRAQKILQDRAFKNEKMDFIWNHTLAAINEEN

SEQ ID NO: 2022951 - protein, 25 aa, Staphylococcus
KLRDIKGKIIVPGFFGYSKKGNIVT

SEQ ID NO: 2022952 - protein, 25 aa, Staphylococcus
KLREIEGKIIIPGFFGVSKHNYVVT

SEQ ID NO: 2022953 - protein, 18 aa, Staphylococcus
KLREKLGIFDGDVEENED

SEQ ID NO: 2022954 - protein, 18 aa, Staphylococcus
KLREKLGIFDGDVEETDA

SEQ ID NO: 2022955 - protein, 18 aa, Staphylococcus
KLRERTRQLAAIYLASGI

SEQ ID NO: 2022956 - protein, 19 aa, Staphylococcus
KLRFQRFEDEWKKKRLKDI

SEQ ID NO: 2022957 - protein, 19 aa, Staphylococcus
KLRIADFFIPTYSYVSVVE

SEQ ID NO: 2022958 - protein, 21 aa, Staphylococcus
KLRKGMSAKENIHYSSEYGQE

SEQ ID NO: 2022959 - protein, 23 aa, Staphylococcus
KLRKKYLEAFRKGFKQQIESTKV

SEQ ID NO: 2022960 - protein, 23 aa, Staphylococcus
KLRKQIKQLAAIYLASGIDPDKS

SEQ ID NO: 2022961 - protein, 22 aa, Staphylococcus
KLRKQIRQLAAIYLASGIDPDK

SEQ ID NO: 2022962 - protein, 20 aa, Staphylococcus
KLRKQIRQLAAIYLASGINP

SEQ ID NO: 2022963 - protein, 21 aa, Staphylococcus
KLRSNMRSEIIKIHKEMNATT

SEQ ID NO: 2022964 - protein, 20 aa, Staphylococcus
KLRSTEWYNQVSYKNNIIPT

SEQ ID NO: 2022965 - protein, 24 aa, Staphylococcus
KLRYCENCGDVIRPDIVLYGEMLD

SEQ ID NO: 2022966 - protein, 18 aa, Staphylococcus
KLRYEHVGYLGQPLVVVC

SEQ ID NO: 2022967 - protein, 18 aa, Staphylococcus
KLSEDKRVEIGMKVKEKF

SEQ ID NO: 2022968 - protein, 19 aa, Staphylococcus
KLSIKGARSNNLKNVDVDI

SEQ ID NO: 2022969 - protein, 20 aa, Staphylococcus
KLSKNKARYGKAISKNSLIH

SEQ ID NO: 2022970 - protein, 22 aa, Staphylococcus
KLSKRETEVLKEMVKGKTNKEI

SEQ ID NO: 2022971 - protein, 19 aa, Staphylococcus
KLSLNRDVKGIITMCAPMD

SEQ ID NO: 2022972 - protein, 19 aa, Staphylococcus
KLSLNRPVKGIITMCAPAE

SEQ ID NO: 2022973 - protein, 18 aa, Staphylococcus
KLSLPVNIVGVIVSAENM

SEQ ID NO: 2022974 - protein, 17 aa, Staphylococcus
KLSMIYVDTGAMYRAIT

SEQ ID NO: 2022975 - protein, 25 aa, Staphylococcus
KLSPERFVKAMAFNGVEIEVSDAIS

SEQ ID NO: 2022976 - protein, 27 aa, Staphylococcus
KLSPKFAGICAISFFMKSSASVIHQFR

SEQ ID NO: 2022977 - protein, 17 aa, Staphylococcus
KLSQLAEELLRDINKET

SEQ ID NO: 2022978 - protein, 21 aa, Staphylococcus
KLSRSEGFGKEVKRRILLGTF

SEQ ID NO: 2022979 - protein, 25 aa, Staphylococcus
KLSSARLVQISSFISDYFNRQRTFN

SEQ ID NO: 2022980 - protein, 29 aa, Staphylococcus
KLSSYLFIRLNYYLIDIFRKENKKIPTIN

SEQ ID NO: 2022981 - protein, 19 aa, Staphylococcus
KLSTESWGGIDRGTLILSE

SEQ ID NO: 2022982 - protein, 17 aa, Staphylococcus
KLSTKLIIRESCSFNKT

SEQ ID NO: 2022983 - protein, 21 aa, Staphylococcus
KLSTLLGLRVVDILKPEYKES

SEQ ID NO: 2022984 - protein, 20 aa, Staphylococcus
KLSTLPVVPAKIGVAAHSDK

SEQ ID NO: 2022985 - protein, 25 aa, Staphylococcus
KLSVVPFEPGCYLMKDRNNQVIYVG

SEQ ID NO: 2022986 - protein, 17 aa, Staphylococcus
KLSYIYDYPHNKLYKAI

SEQ ID NO: 2022987 - protein, 20 aa, Staphylococcus
KLTAHAALGMASDDFSKNAF

SEQ ID NO: 2022988 - protein, 22 aa, Staphylococcus
KLTCVEAAPKMLPMFSDELVNY

SEQ ID NO: 2022989 - protein, 19 aa, Staphylococcus
KLTDFVRYEVGEGMEKREE

SEQ ID NO: 2022990 - protein, 18 aa, Staphylococcus
KLTGRTEANFTIKEEHDT

SEQ ID NO: 2022991 - protein, 17 aa, Staphylococcus
KLTIANRTMSRFEDWNL

SEQ ID NO: 2022992 - protein, 17 aa, Staphylococcus
KLTIGNIPGDKGIEQVK

SEQ ID NO: 2022993 - protein, 25 aa, Staphylococcus
KLTLTEYYYRMWAREYERLDQIQQM

SEQ ID NO: 2022994 - protein, 24 aa, Staphylococcus
KLTQSDIYQAHWGGLAQAIKSDYR

SEQ ID NO: 2022995 - protein, 19 aa, Staphylococcus
KLTTELLLDLGSLKPEHII

SEQ ID NO: 2022996 - protein, 18 aa, Staphylococcus
KLTTELLQMMKLLKDDQI

SEQ ID NO: 2022997 - protein, 20 aa, Staphylococcus
KLTTNISEVIAWLNANTFES

SEQ ID NO: 2022998 - protein, 21 aa, Staphylococcus
KLTYPQFLVLTILWADSPVNV

SEQ ID NO: 2022999 - protein, 20 aa, Staphylococcus
KLTYPQFLVLTILWEDSPVN

SEQ ID NO: 2023000 - protein, 20 aa, Staphylococcus
KLVATELLWFIKGDTNIKYL

SEQ ID NO: 2023001 - protein, 19 aa, Staphylococcus
KLVDKRVPIIAGTGTNNTQ

SEQ ID NO: 2023002 - protein, 19 aa, Staphylococcus
KLVEDLRSEIQKMRDERHM

SEQ ID NO: 2023003 - protein, 17 aa, Staphylococcus
KLVFSIKKGTNFSHSDP

SEQ ID NO: 2023004 - protein, 17 aa, Staphylococcus
KLVFSIKKGTNFSPDDP

SEQ ID NO: 2023005 - protein, 17 aa, Staphylococcus
KLVFTIKKGVNFSEEDP

SEQ ID NO: 2023006 - protein, 17 aa, Staphylococcus
KLVGAKFVKLFTDVDLK

SEQ ID NO: 2023007 - protein, 19 aa, Staphylococcus
KLVKAPIVVTGGFRSAEGM

SEQ ID NO: 2023008 - protein, 24 aa, Staphylococcus
KLVKDKLEFPVFVKPANLGSSVGI

SEQ ID NO: 2023009 - protein, 19 aa, Staphylococcus
KLVKHLCVELGYIQRKHRQ

SEQ ID NO: 2023010 - protein, 18 aa, Staphylococcus
KLVKNELGNDFLKVTPGI

SEQ ID NO: 2023011 - protein, 29 aa, Staphylococcus
KLVMNGREVFKFAVRIMGEASKRVVEKAG

SEQ ID NO: 2023012 - protein, 29 aa, Staphylococcus
KLVMNGREVFKFAVRIMGEASTRVVDKAG

SEQ ID NO: 2023013 - protein, 29 aa, Staphylococcus
KLVMNGREVFKFAVRIMGEASTRVVEKAG

SEQ ID NO: 2023014 - protein, 25 aa, Staphylococcus
KLVNFKAPKSMIGKIVNVYIDEAKQ

SEQ ID NO: 2023015 - protein, 27 aa, Staphylococcus
KLVRENRMSGAHGRTLLALKDVNTMKR

SEQ ID NO: 2023016 - protein, 20 aa, Staphylococcus
KLVRRFLNDIIMEKYSIAPI

SEQ ID NO: 2023017 - protein, 21 aa, Staphylococcus
KLVWMGGTFLTRGNVEEPEHD

SEQ ID NO: 2023018 - protein, 21 aa, Staphylococcus
KLWNIKPLNKFWGINKRTEKK

SEQ ID NO: 2023019 - protein, 19 aa, Staphylococcus
KLWREEKYRVLLHDQNAYN

SEQ ID NO: 2023020 - protein, 25 aa, Staphylococcus
KLYECDDCSECPLKNQCMNFNSKIN

SEQ ID NO: 2023021 - protein, 17 aa, Staphylococcus
KLYFPKELIYNIEDDVI

SEQ ID NO: 2023022 - protein, 25 aa, Staphylococcus
KLYGFCLTHQIPVRNKMLIFSGRIS

SEQ ID NO: 2023023 - protein, 20 aa, Staphylococcus
KLYGVSSLKALAATIDTNDK

SEQ ID NO: 2023024 - protein, 24 aa, Staphylococcus
KLYIMGEGPIRVQLEQQIKRLKLE

SEQ ID NO: 2023025 - protein, 19 aa, Staphylococcus
KLYKGNAIVNGRQSPYTLY

SEQ ID NO: 2023026 - protein, 18 aa, Staphylococcus
KLYLHEIETNITIEKEIQ

SEQ ID NO: 2023027 - protein, 25 aa, Staphylococcus
KLYLKHGHCKVLLGVARGKKKYDKR

SEQ ID NO: 2023028 - protein, 24 aa, Staphylococcus
KLYLKHGQCKVLLGIARGKKKYDK

SEQ ID NO: 2023029 - protein, 25 aa, Staphylococcus
KLYLKHGQCKVLLGIARGKKLHDKR

SEQ ID NO: 2023030 - protein, 19 aa, Staphylococcus
KLYLTYLIKELKLVKLDFI

SEQ ID NO: 2023031 - protein, 19 aa, Staphylococcus
KLYLYKLSKNKARYGKAIS

SEQ ID NO: 2023032 - protein, 20 aa, Staphylococcus
KLYNKKRYTAARVISQVSRF

SEQ ID NO: 2023033 - protein, 19 aa, Staphylococcus
KLYNYKSLLEIDGRLDPKS

SEQ ID NO: 2023034 - protein, 20 aa, Staphylococcus
KLYPELKEGDLVYKSIFRHR

SEQ ID NO: 2023035 - protein, 18 aa, Staphylococcus
KLYVGLKHIHPYIEDALK

SEQ ID NO: 2023036 - protein, 17 aa, Staphylococcus
KLYYHFDSLKKKGLIEV

SEQ ID NO: 2023037 - protein, 24 aa, Staphylococcus
KMAEEKHGFSFRDEPYFEQLQKDY

SEQ ID NO: 2023038 - protein, 17 aa, Staphylococcus
KMAETLQSMGFNEATPI

SEQ ID NO: 2023039 - protein, 18 aa, Staphylococcus
KMAPRFTKGGKIEQLEGF

SEQ ID NO: 2023040 - protein, 22 aa, Staphylococcus
KMAWRNSNRCIGRLFWESLNVE

SEQ ID NO: 2023041 - protein, 33 aa, Staphylococcus
KMDIKPKEIYNLVVYQLGALNGFCKIHGTRINH

SEQ ID NO: 2023042 - protein, 23 aa, Staphylococcus
KMDLPHGIHALGYTNVPVKLDKE

SEQ ID NO: 2023043 - protein, 24 aa, Staphylococcus
KMEETIKGVVLFHETLKSLNVKHE

SEQ ID NO: 2023044 - protein, 17 aa, Staphylococcus
KMEVPLPEIRRLIQSDE

SEQ ID NO: 2023045 - protein, 17 aa, Staphylococcus
KMFKEITTAQGYITPEN

SEQ ID NO: 2023046 - protein, 17 aa, Staphylococcus
KMFKSTLLSSFKNKMAA

SEQ ID NO: 2023047 - protein, 17 aa, Staphylococcus
KMGAPFLLFGDPRLEGG

SEQ ID NO: 2023048 - protein, 19 aa, Staphylococcus
KMGIQIRHYTVQAIKLLKT

SEQ ID NO: 2023049 - protein, 17 aa, Staphylococcus
KMGLKMDVISFFQDPTI

SEQ ID NO: 2023050 - protein, 18 aa, Staphylococcus
KMGLQIRHYTVQALRLLK

SEQ ID NO: 2023051 - protein, 26 aa, Staphylococcus
KMGMQTMKFDMCGAANVVGMIDAASK

SEQ ID NO: 2023052 - protein, 17 aa, Staphylococcus
KMHITLTKSKQWLDNLK

SEQ ID NO: 2023053 - protein, 17 aa, Staphylococcus
KMHYLQHEWKGVHLQPF

SEQ ID NO: 2023054 - protein, 25 aa, Staphylococcus
KMIKEDVCELEIKLDTGRTHQIRVH

SEQ ID NO: 2023055 - protein, 20 aa, Staphylococcus
KMINDYKWMLNIIESQVYDA

SEQ ID NO: 2023056 - protein, 26 aa, Staphylococcus
KMINGRYTHKWNLKVIFSLYDEFDKL

SEQ ID NO: 2023057 - protein, 17 aa, Staphylococcus
KMIQGFWRANEWQYTDQ

SEQ ID NO: 2023058 - protein, 17 aa, Staphylococcus
KMKHPPYIIFATAHDTF

SEQ ID NO: 2023059 - protein, 19 aa, Staphylococcus
KMKHPPYIIFATAHDTFAV

SEQ ID NO: 2023060 - protein, 19 aa, Staphylococcus
KMKLGLSTCHDGYLIRFEP

SEQ ID NO: 2023061 - protein, 22 aa, Staphylococcus
KMKVVYRKKRDVLITAISKHFP

SEQ ID NO: 2023062 - protein, 25 aa, Staphylococcus
KMLAKEILNDLGILKEGIFTHEIDP

SEQ ID NO: 2023063 - protein, 19 aa, Staphylococcus
KMLDHREFTLILYVNDIVG

SEQ ID NO: 2023064 - protein, 17 aa, Staphylococcus
KMLEALDDFLVQIPETA

SEQ ID NO: 2023065 - protein, 18 aa, Staphylococcus
KMLEEKGILYAPDYIVNS

SEQ ID NO: 2023066 - protein, 19 aa, Staphylococcus
KMMDYGEGLALKTRDELRK

SEQ ID NO: 2023067 - protein, 25 aa, Staphylococcus
KMNAVELRRSIGYVIQQIGLMPHMT

SEQ ID NO: 2023068 - protein, 24 aa, Staphylococcus
KMNDDFKKLLSLKEVYKDKNIDVL

SEQ ID NO: 2023069 - protein, 19 aa, Staphylococcus
KMNHFYSEVLGFSIKKKTD

SEQ ID NO: 2023070 - protein, 18 aa, Staphylococcus
KMNLPGITLYPETERFYP

SEQ ID NO: 2023071 - protein, 19 aa, Staphylococcus
KMNLSEFRQYMDLLEAIGL

SEQ ID NO: 2023072 - protein, 23 aa, Staphylococcus
KMNNGGLFGFGGMHGNHWGGQAE

SEQ ID NO: 2023073 - protein, 27 aa, Staphylococcus
KMPDKLCLYYHIGQCMGPCVYDVDQQV

SEQ ID NO: 2023074 - protein, 23 aa, Staphylococcus
KMPRVSGTSGLALFDYKFGQTGV

SEQ ID NO: 2023075 - protein, 20 aa, Staphylococcus
KMPSHWKDKVGVRELDYFNE

SEQ ID NO: 2023076 - protein, 17 aa, Staphylococcus
KMQKLAPQYLKLAVMPN

SEQ ID NO: 2023077 - protein, 24 aa, Staphylococcus
KMRGENFGALIITHYQRLLNYITP

SEQ ID NO: 2023078 - protein, 18 aa, Staphylococcus
KMRKVAMEKGFKHCQAGP

SEQ ID NO: 2023079 - protein, 21 aa, Staphylococcus
KMRLNDIGFIFQASHLIPYLT

SEQ ID NO: 2023080 - protein, 24 aa, Staphylococcus
KMRRIYKNKLTFILEKLTPYKEQL

SEQ ID NO: 2023081 - protein, 23 aa, Staphylococcus
KMSDLKGTLELLAKELFGADREI

SEQ ID NO: 2023082 - protein, 30 aa, Staphylococcus
KMSKEEILILLTLWKEGSMTLKEMDDFVHI

SEQ ID NO: 2023083 - protein, 21 aa, Staphylococcus
KMSNTMPFAATEIAGVAEAAG

SEQ ID NO: 2023084 - protein, 18 aa, Staphylococcus
KMSRPAVLNVERRIKELV

SEQ ID NO: 2023085 - protein, 18 aa, Staphylococcus
KMSRPAVLNVERRVKELV

SEQ ID NO: 2023086 - protein, 21 aa, Staphylococcus
KMSRRKKTAAKKLLEVSNNTA

SEQ ID NO: 2023087 - protein, 20 aa, Staphylococcus
KMSRRKKTAAKKLLEVSNQT

SEQ ID NO: 2023088 - protein, 33 aa, Staphylococcus
KMSRSEGFGEEVKRRIFLGTFALSSGYYDAFYK

SEQ ID NO: 2023089 - protein, 18 aa, Staphylococcus
KMTEGIKHLPAKKITIET

SEQ ID NO: 2023090 - protein, 24 aa, Staphylococcus
KMTFPHQMMRVILIEQVYRAFKIM

SEQ ID NO: 2023091 - protein, 24 aa, Staphylococcus
KMTFPHQMMRVVLIEQIYRAFKIM

SEQ ID NO: 2023092 - protein, 24 aa, Staphylococcus
KMTFPHQMMRVVLIEQVYRAFKIM

SEQ ID NO: 2023093 - protein, 18 aa, Staphylococcus
KMTLFDRQKRYLVLTDAG

SEQ ID NO: 2023094 - protein, 20 aa, Staphylococcus
KMTRCQDGIILLFPIEGQLI

SEQ ID NO: 2023095 - protein, 22 aa, Staphylococcus
KMVADLERPYILITDKKISSFQ

SEQ ID NO: 2023096 - protein, 17 aa, Staphylococcus
KMVELAPYNGLPHLVSP

SEQ ID NO: 2023097 - protein, 19 aa, Staphylococcus
KMVGIKIGSTIVILIENKH

SEQ ID NO: 2023098 - protein, 25 aa, Staphylococcus
KMVIDKATHHILGIFAAGPNATDVV

SEQ ID NO: 2023099 - protein, 24 aa, Staphylococcus
KMVKEAGYELNVWTVNKPARANQL

SEQ ID NO: 2023100 - protein, 17 aa, Staphylococcus
KMWKITPLRDFWGINKK

SEQ ID NO: 2023101 - protein, 17 aa, Staphylococcus
KMYKFFLLVASYIKRRE

SEQ ID NO: 2023102 - protein, 20 aa, Staphylococcus
KMYNDPSIELRYFETGYIKT

SEQ ID NO: 2023103 - protein, 19 aa, Staphylococcus
KMYRRFSILTTISKNQPVG

SEQ ID NO: 2023104 - protein, 18 aa, Staphylococcus
KMYRRFSILTTISNNEPV

SEQ ID NO: 2023105 - protein, 18 aa, Staphylococcus
KMYRRFSILTTISQNQPV

SEQ ID NO: 2023106 - protein, 20 aa, Staphylococcus
KNAAIAIAIGHELGLKYETI

SEQ ID NO: 2023107 - protein, 19 aa, Staphylococcus
KNAAIAIAVGQELGLSYKT

SEQ ID NO: 2023108 - protein, 26 aa, Staphylococcus
KNADFKKARSFKVPFKAIGKAVIEDA

SEQ ID NO: 2023109 - protein, 23 aa, Staphylococcus
KNAEIPALLGAYILEGSKAGATA

SEQ ID NO: 2023110 - protein, 21 aa, Staphylococcus
KNAIPRVGDVVKVIDDLMGLN

SEQ ID NO: 2023111 - protein, 17 aa, Staphylococcus
KNAITLQIKQWLEDNEN

SEQ ID NO: 2023112 - protein, 22 aa, Staphylococcus
KNAKFPVLLAGMRSSSQAETEA

SEQ ID NO: 2023113 - protein, 17 aa, Staphylococcus
KNAMLPITLDKEAREHL

SEQ ID NO: 2023114 - protein, 18 aa, Staphylococcus
KNAMLPIVLDKEAREYLA

SEQ ID NO: 2023115 - protein, 18 aa, Staphylococcus
KNANDIIEEMTIESLDEL

SEQ ID NO: 2023116 - protein, 21 aa, Staphylococcus
KNANIETCWFNPRNKTNDTEI

SEQ ID NO: 2023117 - protein, 22 aa, Staphylococcus
KNARFKYTVDRLGEAWVKEELN

SEQ ID NO: 2023118 - protein, 22 aa, Staphylococcus
KNARFKYTVDRLGEAWVTEELN

SEQ ID NO: 2023119 - protein, 25 aa, Staphylococcus
KNARFKYTVDRLGLERVKTELNQRL

SEQ ID NO: 2023120 - protein, 23 aa, Staphylococcus
KNARFKYTVDRLGVDKVVEELNT

SEQ ID NO: 2023121 - protein, 20 aa, Staphylococcus
KNATIAIAIGHELGLDYNTI

SEQ ID NO: 2023122 - protein, 24 aa, Staphylococcus
KNAVKFFLPYMHVVNFKKIAVVGE

SEQ ID NO: 2023123 - protein, 18 aa, Staphylococcus
KNAYREIAQVFIDVEQEI

SEQ ID NO: 2023124 - protein, 33 aa, Staphylococcus
KNCNIKYRPKRVLDTLELFKIAFPTDKSYQLSE

SEQ ID NO: 2023125 - protein, 28 aa, Staphylococcus
KNCTFRKSDILEGFNVAIGNHYSVHNIY

SEQ ID NO: 2023126 - protein, 18 aa, Staphylococcus
KNDARFQGITFKVDEAEG

SEQ ID NO: 2023127 - protein, 23 aa, Staphylococcus
KNDEAIILTSLSFNANWLNQKYS

SEQ ID NO: 2023128 - protein, 21 aa, Staphylococcus
KNDEAILLEGFMDVIKSDSSG

SEQ ID NO: 2023129 - protein, 20 aa, Staphylococcus
KNDECPVCENHQYDLLETKQ

SEQ ID NO: 2023130 - protein, 19 aa, Staphylococcus
KNDFEEILKLSGERPTIIR

SEQ ID NO: 2023131 - protein, 20 aa, Staphylococcus
KNDFYSFSVGSVFKTIFKGD

SEQ ID NO: 2023132 - protein, 19 aa, Staphylococcus
KNDINILPDYAMFGENLTL

SEQ ID NO: 2023133 - protein, 18 aa, Staphylococcus
KNDKLVDVFDKWLDSELA

SEQ ID NO: 2023134 - protein, 24 aa, Staphylococcus
KNDMSHCISELVTINEVGVIEEIV

SEQ ID NO: 2023135 - protein, 19 aa, Staphylococcus
KNDPSELFKDLGKQVYNQF

SEQ ID NO: 2023136 - protein, 26 aa, Staphylococcus
KNDVPGTEIINVFPSKFILDGNNEVS

SEQ ID NO: 2023137 - protein, 24 aa, Staphylococcus
KNDYEHMLFYFAYKTFTLTANEII

SEQ ID NO: 2023138 - protein, 19 aa, Staphylococcus
KNEALEMAERVGLDVVIMA

SEQ ID NO: 2023139 - protein, 18 aa, Staphylococcus
KNEEELMHILNRAKELNA

SEQ ID NO: 2023140 - protein, 26 aa, Staphylococcus
KNEEIIWLYQYFTDIKIAPTSVTVDE

SEQ ID NO: 2023141 - protein, 19 aa, Staphylococcus
KNEFARWHGRYWKSSDDDV

SEQ ID NO: 2023142 - protein, 25 aa, Staphylococcus
KNEFKSCNGGIRFLGVKDGKNAADP

SEQ ID NO: 2023143 - protein, 17 aa, Staphylococcus
KNEFYYFIEKTFLDYYV

SEQ ID NO: 2023144 - protein, 17 aa, Staphylococcus
KNEIKATHIYNLISGQR

SEQ ID NO: 2023145 - protein, 23 aa, Staphylococcus
KNEIKRPPVSNVDHLIIVMSAVE

SEQ ID NO: 2023146 - protein, 20 aa, Staphylococcus
KNEILSRIGNYYFGSDDISI

SEQ ID NO: 2023147 - protein, 20 aa, Staphylococcus
KNEKVDFIWSHTLKTINEKD

SEQ ID NO: 2023148 - protein, 18 aa, Staphylococcus
KNELYVDNNFVFTDVNGY

SEQ ID NO: 2023149 - protein, 17 aa, Staphylococcus
KNERLKSKMKAAFVDKA

SEQ ID NO: 2023150 - protein, 22 aa, Staphylococcus
KNETDRLISVEWVKSKDSTQRY

SEQ ID NO: 2023151 - protein, 22 aa, Staphylococcus
KNETERLIAVEWVKSKDSTQRY

SEQ ID NO: 2023152 - protein, 20 aa, Staphylococcus
KNEVLGYFIDRHFSFSRTNN

SEQ ID NO: 2023153 - protein, 19 aa, Staphylococcus
KNFDLQCYLTLLDVLDSHN

SEQ ID NO: 2023154 - protein, 26 aa, Staphylococcus
KNFDWKEVEKAFSWYDTGKVNMAYEC

SEQ ID NO: 2023155 - protein, 20 aa, Staphylococcus
KNFFHFFRNFFTQKWEREVD

SEQ ID NO: 2023156 - protein, 18 aa, Staphylococcus
KNFIIKVITMMRQHIHKQ

SEQ ID NO: 2023157 - protein, 23 aa, Staphylococcus
KNFKAFTVDGLDARMEALNERVR

SEQ ID NO: 2023158 - protein, 26 aa, Staphylococcus
KNFKAVELNLFFAICSLLKHCGSERM

SEQ ID NO: 2023159 - protein, 17 aa, Staphylococcus
KNFKVFEVPGLEGRMSA

SEQ ID NO: 2023160 - protein, 24 aa, Staphylococcus
KNFRDIFNKIAWLNKGKMEEALKG

SEQ ID NO: 2023161 - protein, 20 aa, Staphylococcus
KNFYPAEGYHQDYYKKNPMH

SEQ ID NO: 2023162 - protein, 23 aa, Staphylococcus
KNGCPKCRPAINYYLNMIYPYEH

SEQ ID NO: 2023163 - protein, 25 aa, Staphylococcus
KNGCPKCRPAINYYLNMVYPFEHQD

SEQ ID NO: 2023164 - protein, 24 aa, Staphylococcus
KNGCPKCRPAINYYLNMVYPHDHQ

SEQ ID NO: 2023165 - protein, 24 aa, Staphylococcus
KNGCPKCRPAINYYLNMVYPHEHA

SEQ ID NO: 2023166 - protein, 24 aa, Staphylococcus
KNGCPKCRPAINYYLNMVYPHEHQ

SEQ ID NO: 2023167 - protein, 23 aa, Staphylococcus
KNGCQYCKAKGQPTGSLKDEKSS

SEQ ID NO: 2023168 - protein, 21 aa, Staphylococcus
KNGDPRAKYLKTMSKKITDET

SEQ ID NO: 2023169 - protein, 17 aa, Staphylococcus
KNGDWSLQQLVEYLTIK

SEQ ID NO: 2023170 - protein, 17 aa, Staphylococcus
KNGDWTLQQLVDYLTIK

SEQ ID NO: 2023171 - protein, 24 aa, Staphylococcus
KNGDYSSNIAMVLTKIAKRNPREI

SEQ ID NO: 2023172 - protein, 24 aa, Staphylococcus
KNGDYSTNIAMVLTKIAKRNPHEI

SEQ ID NO: 2023173 - protein, 24 aa, Staphylococcus
KNGDYSTNIAMVLTKIAKRNPRDI

SEQ ID NO: 2023174 - protein, 24 aa, Staphylococcus
KNGDYSTNIAMVLTKIAKRNPREI

SEQ ID NO: 2023175 - protein, 23 aa, Staphylococcus
KNGDYSTNIAMVLTKLAKRNPRE

SEQ ID NO: 2023176 - protein, 24 aa, Staphylococcus
KNGDYSTNIAMVLTKVAKRNPREI

SEQ ID NO: 2023177 - protein, 24 aa, Staphylococcus
KNGEDFYMFAPHTVYNEYGVTLDD

SEQ ID NO: 2023178 - protein, 21 aa, Staphylococcus
KNGEGHSMDGFLIKGTQAKIL

SEQ ID NO: 2023179 - protein, 17 aa, Staphylococcus
KNGFMFVLSGVSIDKHE

SEQ ID NO: 2023180 - protein, 18 aa, Staphylococcus
KNGGPWLKNVLREIECAI

SEQ ID NO: 2023181 - protein, 21 aa, Staphylococcus
KNGGYKVIRKAHLTRIDLNDE

SEQ ID NO: 2023182 - protein, 17 aa, Staphylococcus
KNGIPIVEDGVYSDLWF

SEQ ID NO: 2023183 - protein, 17 aa, Staphylococcus
KNGIPIVEDSIYSDLWF

SEQ ID NO: 2023184 - protein, 25 aa, Staphylococcus
KNGKIRISHKMDMIFTHFGISGPAA

SEQ ID NO: 2023185 - protein, 24 aa, Staphylococcus
KNGKKRISHQMDMIFTHFGVSGPA

SEQ ID NO: 2023186 - protein, 25 aa, Staphylococcus
KNGKPRITHRMDMLFTHFGVSGPGA

SEQ ID NO: 2023187 - protein, 19 aa, Staphylococcus
KNGKPYIFYHEYRGNGHIH

SEQ ID NO: 2023188 - protein, 19 aa, Staphylococcus
KNGLKGTQIHLDFPSVGAT

SEQ ID NO: 2023189 - protein, 19 aa, Staphylococcus
KNGQLKPGYNLQIATNSQF

SEQ ID NO: 2023190 - protein, 21 aa, Staphylococcus
KNGQLKPGYNLQIATNSQFVL

SEQ ID NO: 2023191 - protein, 18 aa, Staphylococcus
KNGQLLKRTLREYPSLEH

SEQ ID NO: 2023192 - protein, 27 aa, Staphylococcus
KNGSAKFKQYGFKPVISKAQPLSLDEG

SEQ ID NO: 2023193 - protein, 19 aa, Staphylococcus
KNGVKISVLSYTYGTNDMV

SEQ ID NO: 2023194 - protein, 26 aa, Staphylococcus
KNGVKLLWASCREVFNVIQANEIGAD

SEQ ID NO: 2023195 - protein, 17 aa, Staphylococcus
KNGYLFVLSGVSVEKYD

SEQ ID NO: 2023196 - protein, 17 aa, Staphylococcus
KNGYMFVLSGVAVEKYE

SEQ ID NO: 2023197 - protein, 22 aa, Staphylococcus
KNGYYDGVTFHRVINDFMIQGG

SEQ ID NO: 2023198 - protein, 22 aa, Staphylococcus
KNGYYNGVTFHRVINDFMVQGG

SEQ ID NO: 2023199 - protein, 17 aa, Staphylococcus
KNHACVVMWSIANEPAS

SEQ ID NO: 2023200 - protein, 26 aa, Staphylococcus
KNHLGFSPKQFRSMISKISLNPVMDF

SEQ ID NO: 2023201 - protein, 18 aa, Staphylococcus
KNHMAGPVALQITEKMIE

SEQ ID NO: 2023202 - protein, 26 aa, Staphylococcus
KNHPEELKLLLIDPKMVELAPYNGLP

SEQ ID NO: 2023203 - protein, 17 aa, Staphylococcus
KNHVVFLGFDYGYRGNS

SEQ ID NO: 2023204 - protein, 17 aa, Staphylococcus
KNIALIFEKDSTRTRCA

SEQ ID NO: 2023205 - protein, 24 aa, Staphylococcus
KNIDASDELLNFVVKEDANGTKES

SEQ ID NO: 2023206 - protein, 27 aa, Staphylococcus
KNIEALSDEKYRTWDWNYGKNPKYNFE

SEQ ID NO: 2023207 - protein, 27 aa, Staphylococcus
KNIEALSNEKYRTWDWNYGRNPKYNFE

SEQ ID NO: 2023208 - protein, 20 aa, Staphylococcus
KNIEELSVECHFKRTSRKLF

SEQ ID NO: 2023209 - protein, 28 aa, Staphylococcus
KNIFYKRYWTSNGWADWSKFTNSIFYTQ

SEQ ID NO: 2023210 - protein, 18 aa, Staphylococcus
KNIHPTYSLEEFVNSLER

SEQ ID NO: 2023211 - protein, 26 aa, Staphylococcus
KNIILAAGRLEYEKGFDLLLESVRLI

SEQ ID NO: 2023212 - protein, 17 aa, Staphylococcus
KNIKLFVVIGQLNQLIK

SEQ ID NO: 2023213 - protein, 21 aa, Staphylococcus
KNIKSILVFHSSHLEGDSIKS

SEQ ID NO: 2023214 - protein, 23 aa, Staphylococcus
KNILEIGTAIGYSSMQFASVSND

SEQ ID NO: 2023215 - protein, 23 aa, Staphylococcus
KNILEIGTAIGYSSMQFASVSPD

SEQ ID NO: 2023216 - protein, 24 aa, Staphylococcus
KNILEIGTAIGYSSMQFSSVANDI

SEQ ID NO: 2023217 - protein, 19 aa, Staphylococcus
KNILNEHFNTVGVGVDFND

SEQ ID NO: 2023218 - protein, 17 aa, Staphylococcus
KNILPVRLDGATKEFFA

SEQ ID NO: 2023219 - protein, 21 aa, Staphylococcus
KNINYKLVIDKIIEISLTYKL

SEQ ID NO: 2023220 - protein, 17 aa, Staphylococcus
KNIRIPVLIINGEYDVE

SEQ ID NO: 2023221 - protein, 23 aa, Staphylococcus
KNIVIKQSWIFKGTLNSSIIHPR

SEQ ID NO: 2023222 - protein, 35 aa, Staphylococcus
KNIYGEVIAACLLTEARVLKIFKYFYSHRGPVMDY

SEQ ID NO: 2023223 - protein, 25 aa, Staphylococcus
KNKAKAIHALFLWLDQHHFDYNGIV

SEQ ID NO: 2023224 - protein, 24 aa, Staphylococcus
KNKAKTILALLSWLHQYDFDYKAI

SEQ ID NO: 2023225 - protein, 23 aa, Staphylococcus
KNKANDIWPEFEIEGDVELQYTF

SEQ ID NO: 2023226 - protein, 21 aa, Staphylococcus
KNKDVHSFEEWQALLNTLNHC

SEQ ID NO: 2023227 - protein, 19 aa, Staphylococcus
KNKEFSRVKNGLEPTEVAN

SEQ ID NO: 2023228 - protein, 17 aa, Staphylococcus
KNKEFTKVKNGLEPAEV

SEQ ID NO: 2023229 - protein, 29 aa, Staphylococcus
KNKEWNRKAFKGVELYQKVLGVIGAGRIG

SEQ ID NO: 2023230 - protein, 19 aa, Staphylococcus
KNKFISIMAGLPISYIREK

SEQ ID NO: 2023231 - protein, 24 aa, Staphylococcus
KNKFKCTKCGFIHQNNDIVAASNI

SEQ ID NO: 2023232 - protein, 20 aa, Staphylococcus
KNKFSPVVGDIVDFEVQNNT

SEQ ID NO: 2023233 - protein, 20 aa, Staphylococcus
KNKGIKILPFNADNIKEGMV

SEQ ID NO: 2023234 - protein, 19 aa, Staphylococcus
KNKKGQITFEFKSEDEFKR

SEQ ID NO: 2023235 - protein, 19 aa, Staphylococcus
KNKKGVNLPGVRVNLPGIT

SEQ ID NO: 2023236 - protein, 17 aa, Staphylococcus
KNKKPFEEQEFRNDMSE

SEQ ID NO: 2023237 - protein, 27 aa, Staphylococcus
KNKKPPYRFEIEMLKSQIFDPKLKEKI

SEQ ID NO: 2023238 - protein, 20 aa, Staphylococcus
KNKKRAWELTGGKVNHNETM

SEQ ID NO: 2023239 - protein, 30 aa, Staphylococcus
KNKKVICYMPTWRGSVGKVKKSSHTQELLN

SEQ ID NO: 2023240 - protein, 20 aa, Staphylococcus
KNKLKLVIIATDASDNTIKV

SEQ ID NO: 2023241 - protein, 20 aa, Staphylococcus
KNKLPTIGVLGFGHSYHYPK

SEQ ID NO: 2023242 - protein, 18 aa, Staphylococcus
KNKLRGFYFDFEKEAPGP

SEQ ID NO: 2023243 - protein, 20 aa, Staphylococcus
KNKLTVQWFNRETMSLQMML

SEQ ID NO: 2023244 - protein, 23 aa, Staphylococcus
KNKRMTFKRLLSLNDIEKDEKGI

SEQ ID NO: 2023245 - protein, 24 aa, Staphylococcus
KNKRVALIGGGRIGFRKFKQLAKA

SEQ ID NO: 2023246 - protein, 18 aa, Staphylococcus
KNKRYAYINFECDDYVVS

SEQ ID NO: 2023247 - protein, 27 aa, Staphylococcus
KNKTHFFKSQEAFVIYYLKQLNVDLDV

SEQ ID NO: 2023248 - protein, 29 aa, Staphylococcus
KNKVAPPFRVAEVDIMYGKGISKEGELID

SEQ ID NO: 2023249 - protein, 29 aa, Staphylococcus
KNKVAPPFRVAEVDIMYGQGISKEGEVID

SEQ ID NO: 2023250 - protein, 19 aa, Staphylococcus
KNLAYRAAELMTHTYGIQQ

SEQ ID NO: 2023251 - protein, 21 aa, Staphylococcus
KNLDVQYGHFFDIPFDQPFDY

SEQ ID NO: 2023252 - protein, 18 aa, Staphylococcus
KNLIGAFHRPNAVVYDLD

SEQ ID NO: 2023253 - protein, 25 aa, Staphylococcus
KNLIGAFYRPSAVLYDLDFLTTLPY

SEQ ID NO: 2023254 - protein, 24 aa, Staphylococcus
KNLIHRYHLKYIVDDDFNYASNLS

SEQ ID NO: 2023255 - protein, 17 aa, Staphylococcus
KNLIKYTNWLNQLFHGI

SEQ ID NO: 2023256 - protein, 18 aa, Staphylococcus
KNLKAILNEIDFVKEKMI

SEQ ID NO: 2023257 - protein, 21 aa, Staphylococcus
KNLKAVICMSEACREGFIKLY

SEQ ID NO: 2023258 - protein, 17 aa, Staphylococcus
KNLKLNYAPCEYLSMGM

SEQ ID NO: 2023259 - protein, 21 aa, Staphylococcus
KNLKVSFFIEDGEIQAVRNVD

SEQ ID NO: 2023260 - protein, 24 aa, Staphylococcus
KNLKYDLYHILFEMVRQYKNALPG

SEQ ID NO: 2023261 - protein, 20 aa, Staphylococcus
KNLLEHLATLIAKRINSHYN

SEQ ID NO: 2023262 - protein, 18 aa, Staphylococcus
KNLLENCEKHWSKYGYKK

SEQ ID NO: 2023263 - protein, 20 aa, Staphylococcus
KNLLERKGKTQTDMAKDLNL

SEQ ID NO: 2023264 - protein, 17 aa, Staphylococcus
KNLLNMYQEFLRYPPKN

SEQ ID NO: 2023265 - protein, 46 aa, Staphylococcus
KNLQHLSLLSGGERALSAIALLFAILKVRSAPFVILDEVEAALDEA

SEQ ID NO: 2023266 - protein, 21 aa, Staphylococcus
KNLRDKFMIQLLYETGLRIGE

SEQ ID NO: 2023267 - protein, 17 aa, Staphylococcus
KNLRNIKSIDEIEKIKH

SEQ ID NO: 2023268 - protein, 20 aa, Staphylococcus
KNLSLADKWILTRLNETIKT

SEQ ID NO: 2023269 - protein, 26 aa, Staphylococcus
KNLSLEDIKAFPFILYDRNFYKKNIQ

SEQ ID NO: 2023270 - protein, 19 aa, Staphylococcus
KNLSTGLVFAQLPSDITPV

SEQ ID NO: 2023271 - protein, 20 aa, Staphylococcus
KNLVFARARYDYEDLLEFFN

SEQ ID NO: 2023272 - protein, 25 aa, Staphylococcus
KNLVGAFYRPTAVLYDLDFLNTLPY

SEQ ID NO: 2023273 - protein, 23 aa, Staphylococcus
KNLYEKGIGRLLVEAGPTVTSEF

SEQ ID NO: 2023274 - protein, 18 aa, Staphylococcus
KNLYHYTTYEAFEKILSS

SEQ ID NO: 2023275 - protein, 26 aa, Staphylococcus
KNLYPQCFNTAYKILKMIQRQFDVII

SEQ ID NO: 2023276 - protein, 25 aa, Staphylococcus
KNMLYRLGAFGLNVGSKISIKQKCL

SEQ ID NO: 2023277 - protein, 25 aa, Staphylococcus
KNNAFDMLLELGFSRNVMSLSPFQM

SEQ ID NO: 2023278 - protein, 17 aa, Staphylococcus
KNNAYRDYYIWKDGDDG

SEQ ID NO: 2023279 - protein, 19 aa, Staphylococcus
KNNFDSIGKLNVWYITTIE

SEQ ID NO: 2023280 - protein, 18 aa, Staphylococcus
KNNFKRITVHGFRHTHCS

SEQ ID NO: 2023281 - protein, 20 aa, Staphylococcus
KNNGIEYVFGIPGAKIDYLF

SEQ ID NO: 2023282 - protein, 21 aa, Staphylococcus
KNNGIKILPFDANNIQSDMVV

SEQ ID NO: 2023283 - protein, 24 aa, Staphylococcus
KNNGRFSPVVFKLASENNIDLTQV

SEQ ID NO: 2023284 - protein, 23 aa, Staphylococcus
KNNGRYSPVVFKLASENDIDLSQ

SEQ ID NO: 2023285 - protein, 21 aa, Staphylococcus
KNNGVEYVFGIPGAKIDYLFN

SEQ ID NO: 2023286 - protein, 31 aa, Staphylococcus
KNNNGRFSPVVFKLAAEHQVDLTQVIGTGFE

SEQ ID NO: 2023287 - protein, 20 aa, Staphylococcus
KNNPYAYILLGYNETTNNSF

SEQ ID NO: 2023288 - protein, 26 aa, Staphylococcus
KNNVKEVIAGFDFTFGKFGKGNMMIL

SEQ ID NO: 2023289 - protein, 26 aa, Staphylococcus
KNNVKEVIAGFDFTFGKFGKGNMTVL

SEQ ID NO: 2023290 - protein, 27 aa, Staphylococcus
KNNVKFLKDRYEAMRNFPMFDNIEYTE

SEQ ID NO: 2023291 - protein, 24 aa, Staphylococcus
KNNVKKAWWQKFITQSPFNVGIDA

SEQ ID NO: 2023292 - protein, 23 aa, Staphylococcus
KNNWRYRISLGKNAETGKYEYIS

SEQ ID NO: 2023293 - protein, 20 aa, Staphylococcus
KNNWRYRISLGKNPQTGKYE

SEQ ID NO: 2023294 - protein, 23 aa, Staphylococcus
KNPEKYDSYFIGDWYVSGDSAYK

SEQ ID NO: 2023295 - protein, 23 aa, Staphylococcus
KNPEKYDSYFIGDWYVSGDSAYQ

SEQ ID NO: 2023296 - protein, 23 aa, Staphylococcus
KNPELLYEKVLWIKSNYRNPLMT

SEQ ID NO: 2023297 - protein, 17 aa, Staphylococcus
KNPELYAKEQQDRANYY

SEQ ID NO: 2023298 - protein, 17 aa, Staphylococcus
KNPERYAKEQQDRANYQ

SEQ ID NO: 2023299 - protein, 18 aa, Staphylococcus
KNPFLIETKQLYSESYQI

SEQ ID NO: 2023300 - protein, 23 aa, Staphylococcus
KNPGIPYHLPILIEAQKRGLKIV

SEQ ID NO: 2023301 - protein, 18 aa, Staphylococcus
KNPHRVVAGYVVKDESMY

SEQ ID NO: 2023302 - protein, 20 aa, Staphylococcus
KNPIAHILLGYDDTKNHSFL

SEQ ID NO: 2023303 - protein, 20 aa, Staphylococcus
KNPISIIIPCHRVVGKDGSL

SEQ ID NO: 2023304 - protein, 24 aa, Staphylococcus
KNPKRMIISGLWTHFGYADEFGVT

SEQ ID NO: 2023305 - protein, 24 aa, Staphylococcus
KNPKTCPLLDISEVGEVNFSKYGK

SEQ ID NO: 2023306 - protein, 20 aa, Staphylococcus
KNPMFAWDLNMGGLMNALKT

SEQ ID NO: 2023307 - protein, 18 aa, Staphylococcus
KNPTAIHGLLAPRIDTMF

SEQ ID NO: 2023308 - protein, 21 aa, Staphylococcus
KNPYLSESEWGWPVDPQGLRY

SEQ ID NO: 2023309 - protein, 37 aa, Staphylococcus
KNPYVRHIAHPTGRIIGRRPGYKPNIEKLMKLAEETN

SEQ ID NO: 2023310 - protein, 21 aa, Staphylococcus
KNQGAWLFVYPYLKSIVGHQY

SEQ ID NO: 2023311 - protein, 21 aa, Staphylococcus
KNQGAWLFVYPYLKSLVGNQF

SEQ ID NO: 2023312 - protein, 25 aa, Staphylococcus
KNQGAWLFVYPYLRALVADRYDLSY

SEQ ID NO: 2023313 - protein, 25 aa, Staphylococcus
KNQGAWLFVYPYLRALVGDKYDLSY

SEQ ID NO: 2023314 - protein, 21 aa, Staphylococcus
KNQIIDYVWQFESASENTLNA

SEQ ID NO: 2023315 - protein, 36 aa, Staphylococcus
KNQRISDEAYKEFLENEIARWIKIQEEIGLDVLVHG

SEQ ID NO: 2023316 - protein, 23 aa, Staphylococcus
KNQTEIFNEWTILGISPEIIDDS

SEQ ID NO: 2023317 - protein, 26 aa, Staphylococcus
KNQTSVKFILGFGGIPFSKLNDHTNA

SEQ ID NO: 2023318 - protein, 19 aa, Staphylococcus
KNRANRFSHDMSFVALEDN

SEQ ID NO: 2023319 - protein, 24 aa, Staphylococcus
KNRKTFKVIDHIGAGTVSHKTVGE

SEQ ID NO: 2023320 - protein, 18 aa, Staphylococcus
KNRVEQGEQLIVVVSAMG

SEQ ID NO: 2023321 - protein, 22 aa, Staphylococcus
KNSDLQIAYNFNMVAISDGRPK

SEQ ID NO: 2023322 - protein, 18 aa, Staphylococcus
KNSFNFKGSNEYLTKNKR

SEQ ID NO: 2023323 - protein, 26 aa, Staphylococcus
KNSLEHLLFGLGIRHLGVKASQVIAE

SEQ ID NO: 2023324 - protein, 19 aa, Staphylococcus
KNSLRGMIEERYLNFILEQ

SEQ ID NO: 2023325 - protein, 26 aa, Staphylococcus
KNSRLTGRLSGNIGYVASKVAQEVSS

SEQ ID NO: 2023326 - protein, 24 aa, Staphylococcus
KNTFLKERLGTVITTAGASGGVTY

SEQ ID NO: 2023327 - protein, 19 aa, Staphylococcus
KNTLFKEHVFKTVYDQTMG

SEQ ID NO: 2023328 - protein, 23 aa, Staphylococcus
KNTLKGIEFIYGLYKKNRRSLQI

SEQ ID NO: 2023329 - protein, 18 aa, Staphylococcus
KNTLPCQFCSYQSVCHVD

SEQ ID NO: 2023330 - protein, 19 aa, Staphylococcus
KNTMMRRAAEQAGLEGLDE

SEQ ID NO: 2023331 - protein, 20 aa, Staphylococcus
KNTMVRRAAEKAGIEGLDEF

SEQ ID NO: 2023332 - protein, 20 aa, Staphylococcus
KNTMVRRAAQQAGIDGLDEF

SEQ ID NO: 2023333 - protein, 22 aa, Staphylococcus
KNTRGGSVGFLVVHIPHIAETE

SEQ ID NO: 2023334 - protein, 37 aa, Staphylococcus
KNTSTIIPMCHPLPLTGIDVQFNWQINDNTTYTLNIT

SEQ ID NO: 2023335 - protein, 37 aa, Staphylococcus
KNTSTIIPMCHPLPLTGIDVSFEWNTTSSNHFELNIQ

SEQ ID NO: 2023336 - protein, 27 aa, Staphylococcus
KNTTWNWKGHIHFTTLMKVRKKPGLTG

SEQ ID NO: 2023337 - protein, 17 aa, Staphylococcus
KNTYRNIRFFPENFETY

SEQ ID NO: 2023338 - protein, 19 aa, Staphylococcus
KNVEAYLNVSWEGGSQRKV

SEQ ID NO: 2023339 - protein, 19 aa, Staphylococcus
KNVIIGISCDKGFSVINIK

SEQ ID NO: 2023340 - protein, 24 aa, Staphylococcus
KNVIRKMSFIYADAVSHRIVDVVA

SEQ ID NO: 2023341 - protein, 17 aa, Staphylococcus
KNVKPDVIVEFHLDAAS

SEQ ID NO: 2023342 - protein, 19 aa, Staphylococcus
KNVKPVVVKSELFRNEEFN

SEQ ID NO: 2023343 - protein, 17 aa, Staphylococcus
KNVLVFHNSHLEGQQIN

SEQ ID NO: 2023344 - protein, 24 aa, Staphylococcus
KNVPFRTAHEIVGKIVFECIQQGI

SEQ ID NO: 2023345 - protein, 19 aa, Staphylococcus
KNVSLIIDAMSSFGGIPIK

SEQ ID NO: 2023346 - protein, 17 aa, Staphylococcus
KNWNFAFAYSVQLVEAY

SEQ ID NO: 2023347 - protein, 25 aa, Staphylococcus
KNWNYSFAHSIKLSDEFSSEKIIQR

SEQ ID NO: 2023348 - protein, 18 aa, Staphylococcus
KNYFPKDRARLVIYPAAM

SEQ ID NO: 2023349 - protein, 18 aa, Staphylococcus
KNYGCTHFIVGRDHAGVG

SEQ ID NO: 2023350 - protein, 19 aa, Staphylococcus
KNYKVSFKAIGKAMIESTG

SEQ ID NO: 2023351 - protein, 18 aa, Staphylococcus
KNYNHFKILFLEEYLETE

SEQ ID NO: 2023352 - protein, 17 aa, Staphylococcus
KNYVKEIIIMGGEYWKR

SEQ ID NO: 2023353 - protein, 21 aa, Staphylococcus
KPADLYRQFIDTVIRATERCE

SEQ ID NO: 2023354 - protein, 19 aa, Staphylococcus
KPAHYDRSLIFDHIDHQNS

SEQ ID NO: 2023355 - protein, 19 aa, Staphylococcus
KPAKAKKGTDILVESLFYN

SEQ ID NO: 2023356 - protein, 25 aa, Staphylococcus
KPAKAKRGTDILVESLFYNTPARLK

SEQ ID NO: 2023357 - protein, 20 aa, Staphylococcus
KPAKRIKVGNTLSFGNGKII

SEQ ID NO: 2023358 - protein, 19 aa, Staphylococcus
KPALCSLASRIPYGEALSF

SEQ ID NO: 2023359 - protein, 18 aa, Staphylococcus
KPALCSLASRIPYGETLS

SEQ ID NO: 2023360 - protein, 26 aa, Staphylococcus
KPAQTFDLPFGRLEEGYLADLTVINL

SEQ ID NO: 2023361 - protein, 18 aa, Staphylococcus
KPAQTFDLPYGKLEEGCF

SEQ ID NO: 2023362 - protein, 20 aa, Staphylococcus
KPCYQIIEDMIAQGLYFNPL

SEQ ID NO: 2023363 - protein, 20 aa, Staphylococcus
KPDAELFVLLVGERPEEVTD

SEQ ID NO: 2023364 - protein, 19 aa, Staphylococcus
KPDKLRITEIMNEQAKNHL

SEQ ID NO: 2023365 - protein, 18 aa, Staphylococcus
KPDKRGYRKYKIKTVEGP

SEQ ID NO: 2023366 - protein, 19 aa, Staphylococcus
KPDLAIAVDVAVAYDTPGM

SEQ ID NO: 2023367 - protein, 27 aa, Staphylococcus
KPDLAIAVDVCVPYDIPGMSGQTSETA

SEQ ID NO: 2023368 - protein, 20 aa, Staphylococcus
KPDLILLTFPTPVMSVLTEQ

SEQ ID NO: 2023369 - protein, 26 aa, Staphylococcus
KPDPEIFKASTTFSFQTLSERLQESA

SEQ ID NO: 2023370 - protein, 23 aa, Staphylococcus
KPDPEIFKSATSFNYDVLSERLQ

SEQ ID NO: 2023371 - protein, 27 aa, Staphylococcus
KPDQGLTYKIYFGFESRTAYEDFKASS

SEQ ID NO: 2023372 - protein, 21 aa, Staphylococcus
KPEAQLFILLVGERPEEVTDI

SEQ ID NO: 2023373 - protein, 23 aa, Staphylococcus
KPEDCKAQLIILPFTDIAKELGN

SEQ ID NO: 2023374 - protein, 22 aa, Staphylococcus
KPEELIGALLFLVSEQASSFVN

SEQ ID NO: 2023375 - protein, 29 aa, Staphylococcus
KPEFSGKGYAKFAFEKAISYAFDILNMHK

SEQ ID NO: 2023376 - protein, 20 aa, Staphylococcus
KPEGIFCFQESDAINGGTGA

SEQ ID NO: 2023377 - protein, 22 aa, Staphylococcus
KPEIRMPKVGGRVMSLQDPTKK

SEQ ID NO: 2023378 - protein, 20 aa, Staphylococcus
KPEMKKRTGVKQIINTIKSM

SEQ ID NO: 2023379 - protein, 28 aa, Staphylococcus
KPEPVIMDIALDILKLDKSDVAMVGDLY

SEQ ID NO: 2023380 - protein, 20 aa, Staphylococcus
KPEQEFDFDFDILDPTKLWP

SEQ ID NO: 2023381 - protein, 21 aa, Staphylococcus
KPESKLFVLLVGERPEEVTDI

SEQ ID NO: 2023382 - protein, 20 aa, Staphylococcus
KPETDASFYSDDYNRNDSTQ

SEQ ID NO: 2023383 - protein, 28 aa, Staphylococcus
KPEVFSKLIQFIACRNIDILSATYKTRA

SEQ ID NO: 2023384 - protein, 20 aa, Staphylococcus
KPFDFKKDVTIFGKNIILSQ

SEQ ID NO: 2023385 - protein, 27 aa, Staphylococcus
KPFDPMELYYRVSLHLKDDSNDFYQLG

SEQ ID NO: 2023386 - protein, 23 aa, Staphylococcus
KPFEFKQNVKLLGKNVILSQSGY

SEQ ID NO: 2023387 - protein, 23 aa, Staphylococcus
KPFEFKQNVTIFGKNVILSQSGY

SEQ ID NO: 2023388 - protein, 26 aa, Staphylococcus
KPFFEQGGAMIDDWMGFTPMGRPGLP

SEQ ID NO: 2023389 - protein, 20 aa, Staphylococcus
KPFRMGGIDHVIKLIHKLQR

SEQ ID NO: 2023390 - protein, 18 aa, Staphylococcus
KPFSPRELVIRAKNILSR

SEQ ID NO: 2023391 - protein, 21 aa, Staphylococcus
KPFSPREVVARVKAILRRSAI

SEQ ID NO: 2023392 - protein, 21 aa, Staphylococcus
KPFSPREVVARVKAILRRSQI

SEQ ID NO: 2023393 - protein, 21 aa, Staphylococcus
KPFSPREVVARVKAILRRSQQ

SEQ ID NO: 2023394 - protein, 25 aa, Staphylococcus
KPFTTCRLTHEMLKEVIINPKSQKN

SEQ ID NO: 2023395 - protein, 17 aa, Staphylococcus
KPFYGNFGIYLRAYTYI

SEQ ID NO: 2023396 - protein, 19 aa, Staphylococcus
KPGDIAVWTYGWAGHTAIV

SEQ ID NO: 2023397 - protein, 20 aa, Staphylococcus
KPGLLASVLNTFALFNINLS

SEQ ID NO: 2023398 - protein, 23 aa, Staphylococcus
KPGMSKDDYWAHLAHGPETLCVY

SEQ ID NO: 2023399 - protein, 18 aa, Staphylococcus
KPGQDIESFILKRLETYQ

SEQ ID NO: 2023400 - protein, 21 aa, Staphylococcus
KPGTDLVWLGAATKYIIDHDL

SEQ ID NO: 2023401 - protein, 21 aa, Staphylococcus
KPGTDLVWLGAATKYIIDNDL

SEQ ID NO: 2023402 - protein, 25 aa, Staphylococcus
KPGTDLVWLSAVTKYIIDEDLHDKA

SEQ ID NO: 2023403 - protein, 25 aa, Staphylococcus
KPGTDLVWLSAVTKYIIDHHLHDIE

SEQ ID NO: 2023404 - protein, 18 aa, Staphylococcus
KPGVGYPKRWEDQEHYKG

SEQ ID NO: 2023405 - protein, 17 aa, Staphylococcus
KPGVGYPKRWEDQEQYK

SEQ ID NO: 2023406 - protein, 18 aa, Staphylococcus
KPGVGYPKRWEDQSHYKG

SEQ ID NO: 2023407 - protein, 17 aa, Staphylococcus
KPHLFKVKQKHTRSKYL

SEQ ID NO: 2023408 - protein, 22 aa, Staphylococcus
KPHPFINLLNYILLESIGADIA

SEQ ID NO: 2023409 - protein, 17 aa, Staphylococcus
KPHQLSYEVEKTLAALS

SEQ ID NO: 2023410 - protein, 23 aa, Staphylococcus
KPHRASYLKALRMLNVNYSEAIL

SEQ ID NO: 2023411 - protein, 19 aa, Staphylococcus
KPHSGFTLETQFLPNDINY

SEQ ID NO: 2023412 - protein, 17 aa, Staphylococcus
KPHVFELGVEFLQSEIE

SEQ ID NO: 2023413 - protein, 27 aa, Staphylococcus
KPIAAICGAVDYLARQGHLNTYRHTGN

SEQ ID NO: 2023414 - protein, 35 aa, Staphylococcus
KPIDVPEIFKVLSPMIRRRLYHFAIHPNDQEDLCQ

SEQ ID NO: 2023415 - protein, 21 aa, Staphylococcus
KPIEDLRIISCHIGNGASIAA

SEQ ID NO: 2023416 - protein, 21 aa, Staphylococcus
KPIEELRIISCHIGNGASIAA

SEQ ID NO: 2023417 - protein, 21 aa, Staphylococcus
KPIEELRIITCHIGNGASIAA

SEQ ID NO: 2023418 - protein, 21 aa, Staphylococcus
KPIEELRLISCHIGNGASIAA

SEQ ID NO: 2023419 - protein, 19 aa, Staphylococcus
KPIEYKWKDEAVVGVMLAS

SEQ ID NO: 2023420 - protein, 26 aa, Staphylococcus
KPIHEIREGQSFTQFVSNEFFTVEKW

SEQ ID NO: 2023421 - protein, 25 aa, Staphylococcus
KPILDRFDLHSGQWLVLKDIAKQQP

SEQ ID NO: 2023422 - protein, 18 aa, Staphylococcus
KPILLKRGLSATIEEFTY

SEQ ID NO: 2023423 - protein, 19 aa, Staphylococcus
KPIQRLWISSVTKKAIQNG

SEQ ID NO: 2023424 - protein, 19 aa, Staphylococcus
KPIQRLWISSVTKKAIQQG

SEQ ID NO: 2023425 - protein, 21 aa, Staphylococcus
KPIRHAILWNDTRNSEQCAQI

SEQ ID NO: 2023426 - protein, 23 aa, Staphylococcus
KPISRPWIQDFTASYLGAGNYID

SEQ ID NO: 2023427 - protein, 24 aa, Staphylococcus
KPITARTSYGLGEMINTALDNGSK

SEQ ID NO: 2023428 - protein, 20 aa, Staphylococcus
KPIVEVLVLCSMRERMRTNK

SEQ ID NO: 2023429 - protein, 19 aa, Staphylococcus
KPKDLKKVEDLFIVTATHG

SEQ ID NO: 2023430 - protein, 20 aa, Staphylococcus
KPKEGLSYAANFLYMLRGEV

SEQ ID NO: 2023431 - protein, 21 aa, Staphylococcus
KPKEQACCSVEIEEKKEKIEE

SEQ ID NO: 2023432 - protein, 22 aa, Staphylococcus
KPKGTVIAHRGIDRLVHQPNYV

SEQ ID NO: 2023433 - protein, 22 aa, Staphylococcus
KPKQLHDIKEVIAFDDLPNGID

SEQ ID NO: 2023434 - protein, 27 aa, Staphylococcus
KPKSLSFSHEFMFARPLNQTDDMIKHH

SEQ ID NO: 2023435 - protein, 27 aa, Staphylococcus
KPKSLTLTHEFMFARPVFNTDDMIKHQ

SEQ ID NO: 2023436 - protein, 23 aa, Staphylococcus
KPKSVNFTHEFMFARPVNRTNDM

SEQ ID NO: 2023437 - protein, 20 aa, Staphylococcus
KPLEKMSAIIDKLVPGDYKI

SEQ ID NO: 2023438 - protein, 20 aa, Staphylococcus
KPLFEETYHIYVPKDDVIAL

SEQ ID NO: 2023439 - protein, 20 aa, Staphylococcus
KPLGKREWQAVIDPVGGSHV

SEQ ID NO: 2023440 - protein, 20 aa, Staphylococcus
KPLLERKYPDIQFEYTYIDF

SEQ ID NO: 2023441 - protein, 20 aa, Staphylococcus
KPLLKGLAGLEVFPEYIETR

SEQ ID NO: 2023442 - protein, 19 aa, Staphylococcus
KPLLKSLSEQGVYPKYIET

SEQ ID NO: 2023443 - protein, 25 aa, Staphylococcus
KPLLYKLCLISPMLDATMTNPQITE

SEQ ID NO: 2023444 - protein, 25 aa, Staphylococcus
KPLNNGRFSPVVFKLASEHQIDLTQ

SEQ ID NO: 2023445 - protein, 19 aa, Staphylococcus
KPLPNRKNVVLTRDNNFKP

SEQ ID NO: 2023446 - protein, 17 aa, Staphylococcus
KPLPNRRNVVLTNNPSF

SEQ ID NO: 2023447 - protein, 22 aa, Staphylococcus
KPLPNRRNVVLTSDTTFNVDGV

SEQ ID NO: 2023448 - protein, 22 aa, Staphylococcus
KPLPNRRNVVLTSNSAFHPEGV

SEQ ID NO: 2023449 - protein, 20 aa, Staphylococcus
KPLQFPLIALIVSGGHTELV

SEQ ID NO: 2023450 - protein, 18 aa, Staphylococcus
KPLRFTVKGNPYISRMKK

SEQ ID NO: 2023451 - protein, 23 aa, Staphylococcus
KPLSRQGIWKMIKQNGIKANINK

SEQ ID NO: 2023452 - protein, 23 aa, Staphylococcus
KPLSRQGIWKMMKQNGLKANINK

SEQ ID NO: 2023453 - protein, 20 aa, Staphylococcus
KPLYVKFLLDQLSEYPHGKL

SEQ ID NO: 2023454 - protein, 19 aa, Staphylococcus
KPMKGTMPRGKTSVEDQLN

SEQ ID NO: 2023455 - protein, 17 aa, Staphylococcus
KPMKGTMPRSINKDEDL

SEQ ID NO: 2023456 - protein, 27 aa, Staphylococcus
KPMLVAADIYRPAAIDQLQTVGKQIDI

SEQ ID NO: 2023457 - protein, 27 aa, Staphylococcus
KPMLVAGDIYRPAAIDQLQTVGKQIDI

SEQ ID NO: 2023458 - protein, 23 aa, Staphylococcus
KPMPGRFKDYIAMPKQNMYQSLH

SEQ ID NO: 2023459 - protein, 18 aa, Staphylococcus
KPNEEVMQILAKYDNNTM

SEQ ID NO: 2023460 - protein, 18 aa, Staphylococcus
KPNFTIVSAPHFKADPDI

SEQ ID NO: 2023461 - protein, 18 aa, Staphylococcus
KPNFTIVSAPHFKADPEV

SEQ ID NO: 2023462 - protein, 18 aa, Staphylococcus
KPNKKGYRKYKIKTVDGP

SEQ ID NO: 2023463 - protein, 18 aa, Staphylococcus
KPNNDFVKSNTWKNNKAV

SEQ ID NO: 2023464 - protein, 20 aa, Staphylococcus
KPNPEVLKPLFDHYDVKPED

SEQ ID NO: 2023465 - protein, 22 aa, Staphylococcus
KPNSRYMVFYNDGLNLYTKTSN

SEQ ID NO: 2023466 - protein, 21 aa, Staphylococcus
KPNYIEYLDFFATLEGDKDPN

SEQ ID NO: 2023467 - protein, 17 aa, Staphylococcus
KPPFQRVTIKGIDLNGS

SEQ ID NO: 2023468 - protein, 17 aa, Staphylococcus
KPPMLSFTIPTIKEQME

SEQ ID NO: 2023469 - protein, 18 aa, Staphylococcus
KPPSSKMKPNLPILDEVI

SEQ ID NO: 2023470 - protein, 19 aa, Staphylococcus
KPPVARIMDYGKFKFEQQK

SEQ ID NO: 2023471 - protein, 22 aa, Staphylococcus
KPPYKFEIEMLKAQKFDSDLKN

SEQ ID NO: 2023472 - protein, 22 aa, Staphylococcus
KPPYKFEIEMLKAQQFDSELKD

SEQ ID NO: 2023473 - protein, 18 aa, Staphylococcus
KPRGHIATIVAFENDQDL

SEQ ID NO: 2023474 - protein, 27 aa, Staphylococcus
KPRGLFRKKKFSPIVGDIVDFEIENVT

SEQ ID NO: 2023475 - protein, 27 aa, Staphylococcus
KPRGLFRKKKFSPIVGDIVDFEIQNTS

SEQ ID NO: 2023476 - protein, 17 aa, Staphylococcus
KPRGLFRKNKFSPVVGD

SEQ ID NO: 2023477 - protein, 21 aa, Staphylococcus
KPRGSGLGFYGMRERAELVNG

SEQ ID NO: 2023478 - protein, 21 aa, Staphylococcus
KPRGSGLGLYGMKERSELVGG

SEQ ID NO: 2023479 - protein, 19 aa, Staphylococcus
KPRMYRLIEDDALINRMGF

SEQ ID NO: 2023480 - protein, 19 aa, Staphylococcus
KPRMYRLVEDQALINRMGF

SEQ ID NO: 2023481 - protein, 22 aa, Staphylococcus
KPRTRIPLSEDILAEFEKIRRG

SEQ ID NO: 2023482 - protein, 21 aa, Staphylococcus
KPSFFMDNFLRIVKEQGGRLV

SEQ ID NO: 2023483 - protein, 20 aa, Staphylococcus
KPSFLSCGIQSYLEDISPSL

SEQ ID NO: 2023484 - protein, 22 aa, Staphylococcus
KPSFLSCGIQSYLEDVSPSLDS

SEQ ID NO: 2023485 - protein, 22 aa, Staphylococcus
KPSGYRSYHVIIEYPIETLNGQ

SEQ ID NO: 2023486 - protein, 19 aa, Staphylococcus
KPSLSFLDIIRDVRERTNV

SEQ ID NO: 2023487 - protein, 25 aa, Staphylococcus
KPSNEFIISSWLGTMGCALPGAMAS

SEQ ID NO: 2023488 - protein, 21 aa, Staphylococcus
KPSPASYALILKYYPVKRDEV

SEQ ID NO: 2023489 - protein, 19 aa, Staphylococcus
KPSQYPGIEKMIVDQLKEE

SEQ ID NO: 2023490 - protein, 18 aa, Staphylococcus
KPSRMNPPYQQLRELKAI

SEQ ID NO: 2023491 - protein, 24 aa, Staphylococcus
KPTASQVVDWAKWMAKNHKGVDID

SEQ ID NO: 2023492 - protein, 23 aa, Staphylococcus
KPTFYKDRTVYLPNAYHPLLNKD

SEQ ID NO: 2023493 - protein, 20 aa, Staphylococcus
KPTGICACTDLSRDQIVTQI

SEQ ID NO: 2023494 - protein, 18 aa, Staphylococcus
KPTKPEQCRAQLIELPFT

SEQ ID NO: 2023495 - protein, 20 aa, Staphylococcus
KPTKRLWISSVTNKAIKEGF

SEQ ID NO: 2023496 - protein, 17 aa, Staphylococcus
KPTLGVPSLQDIKDVIT

SEQ ID NO: 2023497 - protein, 19 aa, Staphylococcus
KPTQLVGGYAQISYHFNYY

SEQ ID NO: 2023498 - protein, 17 aa, Staphylococcus
KPVALRMVYEVRKAIDI

SEQ ID NO: 2023499 - protein, 21 aa, Staphylococcus
KPVEIKHMYIDIGVANKEEAE

SEQ ID NO: 2023500 - protein, 19 aa, Staphylococcus
KPVLLKRGLSATIEEFIFA

SEQ ID NO: 2023501 - protein, 21 aa, Staphylococcus
KPVMEALILLSMRQRMQQDIE

SEQ ID NO: 2023502 - protein, 17 aa, Staphylococcus
KPVMIIGMGTQHAKDEL

SEQ ID NO: 2023503 - protein, 22 aa, Staphylococcus
KPVQIKDMFIDIGVRSKEDAEN

SEQ ID NO: 2023504 - protein, 18 aa, Staphylococcus
KPVVIDDMIAIRSMVNLC

SEQ ID NO: 2023505 - protein, 19 aa, Staphylococcus
KPYGNIVCYRNLKENTDKA

SEQ ID NO: 2023506 - protein, 18 aa, Staphylococcus
KPYKNFYPAEGYHQDYYK

SEQ ID NO: 2023507 - protein, 19 aa, Staphylococcus
KPYLTRDQHRLYKLIWERF

SEQ ID NO: 2023508 - protein, 20 aa, Staphylococcus
KPYMIVCLNTIVTETDKEAE

SEQ ID NO: 2023509 - protein, 21 aa, Staphylococcus
KQAAIDLKVILEYGESAPKIF

SEQ ID NO: 2023510 - protein, 22 aa, Staphylococcus
KQAEDWLRKTLQQINRELYHYA

SEQ ID NO: 2023511 - protein, 33 aa, Staphylococcus
KQAGDRFYLRLNDNMSSFFGYHAIQRFKNNFEN

SEQ ID NO: 2023512 - protein, 22 aa, Staphylococcus
KQAGGLHKFMNWDGPILTDSGG

SEQ ID NO: 2023513 - protein, 20 aa, Staphylococcus
KQAGGLHKFMNWNGPILTDS

SEQ ID NO: 2023514 - protein, 17 aa, Staphylococcus
KQAIKDTIKKASIASGV

SEQ ID NO: 2023515 - protein, 20 aa, Staphylococcus
KQAISMGLSSIMRAKRIILL

SEQ ID NO: 2023516 - protein, 18 aa, Staphylococcus
KQALVSFREIYEMIESNN

SEQ ID NO: 2023517 - protein, 23 aa, Staphylococcus
KQAMAGLGRLNVDLVNVHAAGGT

SEQ ID NO: 2023518 - protein, 20 aa, Staphylococcus
KQARGMGGHVRSNWKDVTDI

SEQ ID NO: 2023519 - protein, 18 aa, Staphylococcus
KQATLKFIPMTAEGELRV

SEQ ID NO: 2023520 - protein, 19 aa, Staphylococcus
KQAYWEFYQSLKAQGKKAK

SEQ ID NO: 2023521 - protein, 23 aa, Staphylococcus
KQDFKRLGVRGDFNNPYITLKPE

SEQ ID NO: 2023522 - protein, 19 aa, Staphylococcus
KQDIEAIIVTGTRAEELQL

SEQ ID NO: 2023523 - protein, 21 aa, Staphylococcus
KQDIRELLPRVLSAGGNAGYL

SEQ ID NO: 2023524 - protein, 24 aa, Staphylococcus
KQDIRFDDIYNFIASDLYQLIAES

SEQ ID NO: 2023525 - protein, 26 aa, Staphylococcus
KQDLLTIFLNRYVDMIQRGQYAPMRL

SEQ ID NO: 2023526 - protein, 18 aa, Staphylococcus
KQDLSFKNKIHILLKKDL

SEQ ID NO: 2023527 - protein, 25 aa, Staphylococcus
KQDPELCVLKVIPKSIKLMNDDELD

SEQ ID NO: 2023528 - protein, 27 aa, Staphylococcus
KQDYIYLIEYARLFAIGAAKATDLNMM

SEQ ID NO: 2023529 - protein, 19 aa, Staphylococcus
KQEALEMAERVDLDLVIVA

SEQ ID NO: 2023530 - protein, 22 aa, Staphylococcus
KQEGIIKAYGISSIRPNVIDYY

SEQ ID NO: 2023531 - protein, 19 aa, Staphylococcus
KQEGIIRAYGISSIRPNVI

SEQ ID NO: 2023532 - protein, 22 aa, Staphylococcus
KQEGIVRAYGISSIRPNVIDYY

SEQ ID NO: 2023533 - protein, 23 aa, Staphylococcus
KQEGYNLTFFAFFVKAVAEALKS

SEQ ID NO: 2023534 - protein, 18 aa, Staphylococcus
KQEHGLDMIVIDYLQLIS

SEQ ID NO: 2023535 - protein, 22 aa, Staphylococcus
KQEILRTLFNTNRFETLQQMLV

SEQ ID NO: 2023536 - protein, 20 aa, Staphylococcus
KQELEKMVLFLGDRPTIVKQ

SEQ ID NO: 2023537 - protein, 19 aa, Staphylococcus
KQELSWMRAGAKARSTKQQ

SEQ ID NO: 2023538 - protein, 20 aa, Staphylococcus
KQESRHETTIEFYRKELQER

SEQ ID NO: 2023539 - protein, 17 aa, Staphylococcus
KQESVQALLGYYYNSLV

SEQ ID NO: 2023540 - protein, 25 aa, Staphylococcus
KQETVEAMQGYLMRSILSELEEMRS

SEQ ID NO: 2023541 - protein, 24 aa, Staphylococcus
KQEVMIESLSIMYLKTVSIETELE

SEQ ID NO: 2023542 - protein, 18 aa, Staphylococcus
KQEVRLHIIQLDTPLFER

SEQ ID NO: 2023543 - protein, 19 aa, Staphylococcus
KQFAARLVALVQAGDLVLL

SEQ ID NO: 2023544 - protein, 25 aa, Staphylococcus
KQFDLRKKRFMEIRDDINSHFEDYP

SEQ ID NO: 2023545 - protein, 19 aa, Staphylococcus
KQFICDYSKENHDTTYNDK

SEQ ID NO: 2023546 - protein, 18 aa, Staphylococcus
KQFKDELKHFIVNMGSNK

SEQ ID NO: 2023547 - protein, 23 aa, Staphylococcus
KQFKIVKSLILNKDVKNIIIATD

SEQ ID NO: 2023548 - protein, 17 aa, Staphylococcus
KQGAVAFDYGNNIRQVA

SEQ ID NO: 2023549 - protein, 24 aa, Staphylococcus
KQGDASNHWYEWLASNLMLEGYNV

SEQ ID NO: 2023550 - protein, 20 aa, Staphylococcus
KQGDFENVISLIDLYDASQS

SEQ ID NO: 2023551 - protein, 19 aa, Staphylococcus
KQGGLGMIGAGYFDSHQLS

SEQ ID NO: 2023552 - protein, 21 aa, Staphylococcus
KQGILRTLFNSERFEEIEKRL

SEQ ID NO: 2023553 - protein, 26 aa, Staphylococcus
KQGILRTLFNSIRFEEIQKLLQSEVK

SEQ ID NO: 2023554 - protein, 22 aa, Staphylococcus
KQGIPVCLDTSGKVLNYTVTHS

SEQ ID NO: 2023555 - protein, 19 aa, Staphylococcus
KQGISPILMKTEVEYKVPI

SEQ ID NO: 2023556 - protein, 19 aa, Staphylococcus
KQGKEIIKNVSWQINEGEK

SEQ ID NO: 2023557 - protein, 20 aa, Staphylococcus
KQGLPPIIMFGGGKEIYYPD

SEQ ID NO: 2023558 - protein, 24 aa, Staphylococcus
KQGLQLEGLCFDRQGNLLLCEVFG

SEQ ID NO: 2023559 - protein, 19 aa, Staphylococcus
KQGLSILGYLEKLAADISI

SEQ ID NO: 2023560 - protein, 20 aa, Staphylococcus
KQGVIRLFLKYGQNNERVIT

SEQ ID NO: 2023561 - protein, 19 aa, Staphylococcus
KQGVLRLFLKYGQNNERVI

SEQ ID NO: 2023562 - protein, 20 aa, Staphylococcus
KQGVLRLFLKYGQNNERVIT

SEQ ID NO: 2023563 - protein, 28 aa, Staphylococcus
KQGVTRFRIVPLLIFRAMHYIGDIPEIL

SEQ ID NO: 2023564 - protein, 19 aa, Staphylococcus
KQHCATLLGLQSARAIYQF

SEQ ID NO: 2023565 - protein, 19 aa, Staphylococcus
KQHKAIILNNFVKDNDEVI

SEQ ID NO: 2023566 - protein, 23 aa, Staphylococcus
KQHKESILSWLEKANIDPRRRGE

SEQ ID NO: 2023567 - protein, 21 aa, Staphylococcus
KQHLPQAFVIAGNVGTPEGVR

SEQ ID NO: 2023568 - protein, 24 aa, Staphylococcus
KQHNCLYVRVDPYLPYQYLNHDGE

SEQ ID NO: 2023569 - protein, 24 aa, Staphylococcus
KQHSQRDYLLLSFAIHTGVKLSTL

SEQ ID NO: 2023570 - protein, 17 aa, Staphylococcus
KQHVAIVALYLANGHKA

SEQ ID NO: 2023571 - protein, 17 aa, Staphylococcus
KQIAALLQRIFQNIESM

SEQ ID NO: 2023572 - protein, 18 aa, Staphylococcus
KQIAQRSAGFDMYDLEKA

SEQ ID NO: 2023573 - protein, 26 aa, Staphylococcus
KQIESRYSRIQILWEDIETFENDELI

SEQ ID NO: 2023574 - protein, 18 aa, Staphylococcus
KQIFKEFEQNSGYNSYQV

SEQ ID NO: 2023575 - protein, 27 aa, Staphylococcus
KQIHEEWCIPIIFVTHSNYEAEVLADE

SEQ ID NO: 2023576 - protein, 23 aa, Staphylococcus
KQIKKSFPERNFVTQVNKQNANL

SEQ ID NO: 2023577 - protein, 23 aa, Staphylococcus
KQIKRCNANTFGILLGTNDMAAS

SEQ ID NO: 2023578 - protein, 18 aa, Staphylococcus
KQIKWYANSGHVITIDKE

SEQ ID NO: 2023579 - protein, 25 aa, Staphylococcus
KQINREFENIFSIRKRDSLLVLTIM

SEQ ID NO: 2023580 - protein, 18 aa, Staphylococcus
KQIRLNINLENWNKDKLY

SEQ ID NO: 2023581 - protein, 18 aa, Staphylococcus
KQIYELWLEQYRNTVKES

SEQ ID NO: 2023582 - protein, 26 aa, Staphylococcus
KQKALARIRIQEIGFILQSTNLVPFL

SEQ ID NO: 2023583 - protein, 18 aa, Staphylococcus
KQKDMPLMLLNWNTLTGN

SEQ ID NO: 2023584 - protein, 19 aa, Staphylococcus
KQKEIPELLIMCGTEDDLY

SEQ ID NO: 2023585 - protein, 23 aa, Staphylococcus
KQKGLTPRAIRAMIVGIPNVGKS

SEQ ID NO: 2023586 - protein, 23 aa, Staphylococcus
KQKKLRDAYRLMIYYDKDNHIKL

SEQ ID NO: 2023587 - protein, 27 aa, Staphylococcus
KQKREALEMAERVGLDLVVVAPNAKPP

SEQ ID NO: 2023588 - protein, 21 aa, Staphylococcus
KQKVEAFYGLCAKNDSYVSYK

SEQ ID NO: 2023589 - protein, 20 aa, Staphylococcus
KQKVMHGWVRLASVDEDNHW

SEQ ID NO: 2023590 - protein, 20 aa, Staphylococcus
KQKYLLLEFGNFEQEANEKQ

SEQ ID NO: 2023591 - protein, 28 aa, Staphylococcus
KQLAKRFGFSEGLVFKQAVTKGVDPTML

SEQ ID NO: 2023592 - protein, 17 aa, Staphylococcus
KQLARTIHFSFGYTEGG

SEQ ID NO: 2023593 - protein, 19 aa, Staphylococcus
KQLCFLFYVSSKEIIKKYS

SEQ ID NO: 2023594 - protein, 19 aa, Staphylococcus
KQLCFLFYVSSKEIIKKYT

SEQ ID NO: 2023595 - protein, 22 aa, Staphylococcus
KQLEIFEGKSIMFTASHNINDD

SEQ ID NO: 2023596 - protein, 17 aa, Staphylococcus
KQLEKWGVDVIEAGFPA

SEQ ID NO: 2023597 - protein, 22 aa, Staphylococcus
KQLEPFILNLLDFESSKSDKLQ

SEQ ID NO: 2023598 - protein, 24 aa, Staphylococcus
KQLEREGFHILAIKDMAGLLKPKA

SEQ ID NO: 2023599 - protein, 17 aa, Staphylococcus
KQLETWGVDILEAGFPA

SEQ ID NO: 2023600 - protein, 20 aa, Staphylococcus
KQLFEQAGFNKIKIRSFTGG

SEQ ID NO: 2023601 - protein, 24 aa, Staphylococcus
KQLFKEFEKSSGYNSYKVVQEVNK

SEQ ID NO: 2023602 - protein, 19 aa, Staphylococcus
KQLFMPIRVAVTGQMHGPE

SEQ ID NO: 2023603 - protein, 20 aa, Staphylococcus
KQLGEMVGIIKIIKNKEFNA

SEQ ID NO: 2023604 - protein, 19 aa, Staphylococcus
KQLGIKYPIIQAGMAGNTM

SEQ ID NO: 2023605 - protein, 18 aa, Staphylococcus
KQLIRIHHSKQILEIGTA

SEQ ID NO: 2023606 - protein, 18 aa, Staphylococcus
KQLIRIHRAKNILEIGTA

SEQ ID NO: 2023607 - protein, 24 aa, Staphylococcus
KQLKDGKAYLSLYRAALARSEADW

SEQ ID NO: 2023608 - protein, 19 aa, Staphylococcus
KQLLDRIVEEYKNRKQDII

SEQ ID NO: 2023609 - protein, 23 aa, Staphylococcus
KQLLEDGWHVRAFTRNKNNEKLT

SEQ ID NO: 2023610 - protein, 22 aa, Staphylococcus
KQLLHEGWQVRAYTRNKQNDKL

SEQ ID NO: 2023611 - protein, 17 aa, Staphylococcus
KQLLKNVYGMRTIMNEE

SEQ ID NO: 2023612 - protein, 17 aa, Staphylococcus
KQLLYLNDRFKQIEQSL

SEQ ID NO: 2023613 - protein, 28 aa, Staphylococcus
KQLMIYETFGWEAPRFAHMSLIVNEERK

SEQ ID NO: 2023614 - protein, 24 aa, Staphylococcus
KQLMQAIDILDHFDGIKVTQVSPI

SEQ ID NO: 2023615 - protein, 18 aa, Staphylococcus
KQLNCTYDEFSINTYMNQ

SEQ ID NO: 2023616 - protein, 21 aa, Staphylococcus
KQLNHRVTAVFSQFCETSTGV

SEQ ID NO: 2023617 - protein, 17 aa, Staphylococcus
KQLPDYFVESMLKAQKD

SEQ ID NO: 2023618 - protein, 17 aa, Staphylococcus
KQLPEIYIDKMLEAQKE

SEQ ID NO: 2023619 - protein, 18 aa, Staphylococcus
KQLPEVYIDSMLAAQKDD

SEQ ID NO: 2023620 - protein, 17 aa, Staphylococcus
KQLPFKQRIALETKMNY

SEQ ID NO: 2023621 - protein, 25 aa, Staphylococcus
KQLPKGRKTIMTSWAKHEQYEQVLT

SEQ ID NO: 2023622 - protein, 17 aa, Staphylococcus
KQLRLTKGIHVVIDQSK

SEQ ID NO: 2023623 - protein, 23 aa, Staphylococcus
KQLTELHGAPGFEDEVRDYMKQK

SEQ ID NO: 2023624 - protein, 21 aa, Staphylococcus
KQLVECGADIVGFNCHHGPHH

SEQ ID NO: 2023625 - protein, 17 aa, Staphylococcus
KQLYSPVQFIKSTEWLI

SEQ ID NO: 2023626 - protein, 21 aa, Staphylococcus
KQMVEAGNGFAIISKSALHPE

SEQ ID NO: 2023627 - protein, 17 aa, Staphylococcus
KQNGATITEVWVNSHEI

SEQ ID NO: 2023628 - protein, 17 aa, Staphylococcus
KQNYGVSLREFYVLHEL

SEQ ID NO: 2023629 - protein, 18 aa, Staphylococcus
KQNYRLLLNYTNLNSDLE

SEQ ID NO: 2023630 - protein, 26 aa, Staphylococcus
KQPIQFKWKKDAVVGVMLASKGYPGT

SEQ ID NO: 2023631 - protein, 24 aa, Staphylococcus
KQPTDIRVLDWVRQVEYLGAGELL

SEQ ID NO: 2023632 - protein, 18 aa, Staphylococcus
KQPTYNYELEVIAKKEDG

SEQ ID NO: 2023633 - protein, 24 aa, Staphylococcus
KQQEDYCIIIAYFVDGEPKLSYIY

SEQ ID NO: 2023634 - protein, 24 aa, Staphylococcus
KQQEDYCIILAYFENGQPKLSYIY

SEQ ID NO: 2023635 - protein, 24 aa, Staphylococcus
KQQEDYCIILGYFVEGEPMLSYIY

SEQ ID NO: 2023636 - protein, 19 aa, Staphylococcus
KQQHEIIGLLLGNPESSTA

SEQ ID NO: 2023637 - protein, 18 aa, Staphylococcus
KQQKKGYMQKIFSQEIKF

SEQ ID NO: 2023638 - protein, 25 aa, Staphylococcus
KQQKPMLGICLGAQLIAQVLGATIY

SEQ ID NO: 2023639 - protein, 22 aa, Staphylococcus
KQQLPYLISFLSFHNYAIYQIL

SEQ ID NO: 2023640 - protein, 25 aa, Staphylococcus
KQQPGESYISYLLRVKNSKLWQSKD

SEQ ID NO: 2023641 - protein, 24 aa, Staphylococcus
KQQTDYCIILSYFADGEAQLSYIY

SEQ ID NO: 2023642 - protein, 22 aa, Staphylococcus
KQRCMFNGPCVIEISGQQVSIR

SEQ ID NO: 2023643 - protein, 17 aa, Staphylococcus
KQRCNRQPQLIIGTPTR

SEQ ID NO: 2023644 - protein, 20 aa, Staphylococcus
KQRFEAYGWNHILVKDGNDL

SEQ ID NO: 2023645 - protein, 20 aa, Staphylococcus
KQRFESYGWNHILVKDGNNL

SEQ ID NO: 2023646 - protein, 18 aa, Staphylococcus
KQRHKTCIIVTHDERLTK

SEQ ID NO: 2023647 - protein, 20 aa, Staphylococcus
KQRIAKDVIPDFEEVTTDLT

SEQ ID NO: 2023648 - protein, 19 aa, Staphylococcus
KQRINSNARFVRNFNDEII

SEQ ID NO: 2023649 - protein, 20 aa, Staphylococcus
KQRKRPATAKPVLLGITKAS

SEQ ID NO: 2023650 - protein, 29 aa, Staphylococcus
KQRNELRYRWEYLGEAIGSGVVPFNNLRI

SEQ ID NO: 2023651 - protein, 18 aa, Staphylococcus
KQRNRLTIWHAIGRDEVD

SEQ ID NO: 2023652 - protein, 20 aa, Staphylococcus
KQRQSILEILAQVEVNIDYP

SEQ ID NO: 2023653 - protein, 25 aa, Staphylococcus
KQRRHAEPIKDGRIKLEETMDKALK

SEQ ID NO: 2023654 - protein, 21 aa, Staphylococcus
KQRVREVLQEVRLEGYEKRKI

SEQ ID NO: 2023655 - protein, 21 aa, Staphylococcus
KQSEFDLIVSLGKGGTKIPRY

SEQ ID NO: 2023656 - protein, 36 aa, Staphylococcus
KQSFIEYLLFHYEFKSRISVWVLNYLKASPKKLQYI

SEQ ID NO: 2023657 - protein, 32 aa, Staphylococcus
KQSILRTLFNSIRFEEMQNLLLNQVKDEKKQI

SEQ ID NO: 2023658 - protein, 25 aa, Staphylococcus
KQSIYSLRFDEMQQWLVEQGQQKFR

SEQ ID NO: 2023659 - protein, 20 aa, Staphylococcus
KQSKLKRFFKRTKASINEVF

SEQ ID NO: 2023660 - protein, 20 aa, Staphylococcus
KQSKRGTLRVGASHAPIYSI

SEQ ID NO: 2023661 - protein, 20 aa, Staphylococcus
KQSLELALEMDIDHISSYGL

SEQ ID NO: 2023662 - protein, 25 aa, Staphylococcus
KQSLLKARRTYAFTELFMFELRMQW

SEQ ID NO: 2023663 - protein, 25 aa, Staphylococcus
KQSNLPVRPCIKMELSEMQDETLLK

SEQ ID NO: 2023664 - protein, 37 aa, Staphylococcus
KQSRIKRIFRRTKASINEVFSRMQSVSSQIDRITIQL

SEQ ID NO: 2023665 - protein, 20 aa, Staphylococcus
KQSYIEYALFHYHFKSRISV

SEQ ID NO: 2023666 - protein, 30 aa, Staphylococcus
KQTDITFMLTWRPWDLVGEISSNSYIDRYL

SEQ ID NO: 2023667 - protein, 24 aa, Staphylococcus
KQTKGMVKREVVKVVTPGTMMEQG

SEQ ID NO: 2023668 - protein, 26 aa, Staphylococcus
KQTKGMVKREVVRIVTPGTVMDQGGV

SEQ ID NO: 2023669 - protein, 25 aa, Staphylococcus
KQTKGMVKREVVRVVTPGTVMEQGG

SEQ ID NO: 2023670 - protein, 27 aa, Staphylococcus
KQTLERAGAHIVPFLSINNIDDLYNAI

SEQ ID NO: 2023671 - protein, 24 aa, Staphylococcus
KQTLKRLFFEAGFNDITVRSFTGG

SEQ ID NO: 2023672 - protein, 18 aa, Staphylococcus
KQTLPCQFCSYQSVCHVD

SEQ ID NO: 2023673 - protein, 19 aa, Staphylococcus
KQTNSYDLAFEELEKEKDF

SEQ ID NO: 2023674 - protein, 21 aa, Staphylococcus
KQTPMFARFSTVAGERGAADA

SEQ ID NO: 2023675 - protein, 26 aa, Staphylococcus
KQTRSWLDTYFKGERPQETIPIQPSG

SEQ ID NO: 2023676 - protein, 24 aa, Staphylococcus
KQTVWNWKGKFTADRTIKVRKSPG

SEQ ID NO: 2023677 - protein, 20 aa, Staphylococcus
KQVDILICDTAGRLQNKSNL

SEQ ID NO: 2023678 - protein, 19 aa, Staphylococcus
KQVHAPTLIIAGEYGERTT

SEQ ID NO: 2023679 - protein, 32 aa, Staphylococcus
KQVIKELRQATGLKGYEAFRMLDKQKQKEAMA

SEQ ID NO: 2023680 - protein, 26 aa, Staphylococcus
KQVIKELRQSIGLKQHEVFHLMDKQH

SEQ ID NO: 2023681 - protein, 23 aa, Staphylococcus
KQVIKTWSRRSTIFPDFIGHTFA

SEQ ID NO: 2023682 - protein, 22 aa, Staphylococcus
KQVIKTWSRRSTVFPNFIGHTF

SEQ ID NO: 2023683 - protein, 19 aa, Staphylococcus
KQVKELMELLPRYKYDNIF

SEQ ID NO: 2023684 - protein, 17 aa, Staphylococcus
KQVKFMLIFDSASMTPH

SEQ ID NO: 2023685 - protein, 27 aa, Staphylococcus
KQVLEKFKSLTFISGTLTFNHSFEAFK

SEQ ID NO: 2023686 - protein, 24 aa, Staphylococcus
KQVREFCTKIAWIEAGKLKQFGEL

SEQ ID NO: 2023687 - protein, 17 aa, Staphylococcus
KQVRKIVQHLEERGYQL

SEQ ID NO: 2023688 - protein, 21 aa, Staphylococcus
KQVRMKHSPIRDVIEGKRVVV

SEQ ID NO: 2023689 - protein, 26 aa, Staphylococcus
KQVYKLYFKFVMPIFGKLFAKSREEY

SEQ ID NO: 2023690 - protein, 20 aa, Staphylococcus
KQYAELLVKVGMNVQQNQPV

SEQ ID NO: 2023691 - protein, 17 aa, Staphylococcus
KQYCKWLENLSNAIESG

SEQ ID NO: 2023692 - protein, 24 aa, Staphylococcus
KQYFRMLQKPILYTGLTRAKQSLV

SEQ ID NO: 2023693 - protein, 37 aa, Staphylococcus
KQYFRMLQRPILYTGLTRAKQSLVLLGDPKAFDIALN

SEQ ID NO: 2023694 - protein, 36 aa, Staphylococcus
KQYFRMLQRPILYTGLTRAKQSLVLLGDSTAFEIGL

SEQ ID NO: 2023695 - protein, 17 aa, Staphylococcus
KQYFSTVVPAADNKFSA

SEQ ID NO: 2023696 - protein, 17 aa, Staphylococcus
KQYIGQEVTIGAWLTNK

SEQ ID NO: 2023697 - protein, 20 aa, Staphylococcus
KQYLDEVFTHGWAYGSKGDA

SEQ ID NO: 2023698 - protein, 20 aa, Staphylococcus
KQYPDRFVGFATLPINEPEA

SEQ ID NO: 2023699 - protein, 24 aa, Staphylococcus
KQYTEIVEPLALDEAYLDITHLVK

SEQ ID NO: 2023700 - protein, 25 aa, Staphylococcus
KQYYPIKGGFFRRTVGHVKAVDGIS

SEQ ID NO: 2023701 - protein, 21 aa, Staphylococcus
KRAAHHDTFILGTVGGFRGVR

SEQ ID NO: 2023702 - protein, 18 aa, Staphylococcus
KRADIKPGSTVVIMGMGP

SEQ ID NO: 2023703 - protein, 23 aa, Staphylococcus
KRAEHKIKCFVQVNVSGESSKQG

SEQ ID NO: 2023704 - protein, 21 aa, Staphylococcus
KRAGDAYVESGADYFVVDPVM

SEQ ID NO: 2023705 - protein, 22 aa, Staphylococcus
KRAKTAGFTILEYDLHAPHILG

SEQ ID NO: 2023706 - protein, 21 aa, Staphylococcus
KRANHTISCFLQVNVSGEASK

SEQ ID NO: 2023707 - protein, 44 aa, Staphylococcus
KRAPKLFIKLNIEWVYRLLIDWKRIGRMRSIPKFMFKVFKVQRK

SEQ ID NO: 2023708 - protein, 36 aa, Staphylococcus
KRAPRLFRNLNMEWVYRLLIDWKRIGRIKSIPKFMF

SEQ ID NO: 2023709 - protein, 21 aa, Staphylococcus
KRAQKLFGQKMHVFDIRKHEM

SEQ ID NO: 2023710 - protein, 22 aa, Staphylococcus
KRAQKLFGQRSHVFDIRKHEMA

SEQ ID NO: 2023711 - protein, 21 aa, Staphylococcus
KRAQRGITLLKELKKAPHRIV

SEQ ID NO: 2023712 - protein, 21 aa, Staphylococcus
KRAQRGITLLKELKKSPHRIV

SEQ ID NO: 2023713 - protein, 20 aa, Staphylococcus
KRAQSFGMQILAFDPYLTED

SEQ ID NO: 2023714 - protein, 18 aa, Staphylococcus
KRARPSHITILVQNQDGL

SEQ ID NO: 2023715 - protein, 20 aa, Staphylococcus
KRASIPRDDVATVLKEVVTS

SEQ ID NO: 2023716 - protein, 21 aa, Staphylococcus
KRATHTISCFIQVNVSGEETK

SEQ ID NO: 2023717 - protein, 21 aa, Staphylococcus
KRAYEMLPVVMDYKSKEVELQ

SEQ ID NO: 2023718 - protein, 24 aa, Staphylococcus
KRDIKVGLLPSINPHNIKKIEETE

SEQ ID NO: 2023719 - protein, 19 aa, Staphylococcus
KRDIMISGLGFITLEAGAK

SEQ ID NO: 2023720 - protein, 21 aa, Staphylococcus
KRDISCNLGSLNIVNVMESGK

SEQ ID NO: 2023721 - protein, 31 aa, Staphylococcus
KRDLCPSTMALPMSSSLFEFISTQHHSDITK

SEQ ID NO: 2023722 - protein, 19 aa, Staphylococcus
KRDLGVIGVDLHLHANGID

SEQ ID NO: 2023723 - protein, 25 aa, Staphylococcus
KRDMQRLAPRVNILADIVKDVITAF

SEQ ID NO: 2023724 - protein, 25 aa, Staphylococcus
KRDRKKRVYDLLETVGLSKEHANRY

SEQ ID NO: 2023725 - protein, 23 aa, Staphylococcus
KRDYTSRHRKLFENLAHQRTTSW

SEQ ID NO: 2023726 - protein, 18 aa, Staphylococcus
KREGQGCVSLKSIAEENK

SEQ ID NO: 2023727 - protein, 18 aa, Staphylococcus
KREGQGCVSLKTIAEENN

SEQ ID NO: 2023728 - protein, 19 aa, Staphylococcus
KREGQVIGFARAMSDGVFN

SEQ ID NO: 2023729 - protein, 22 aa, Staphylococcus
KREHLKLKPAYFPVKDEEGDVS

SEQ ID NO: 2023730 - protein, 20 aa, Staphylococcus
KREIFSSGKSICRINNQTIT

SEQ ID NO: 2023731 - protein, 18 aa, Staphylococcus
KREIGRKAAQLIEDNDYI

SEQ ID NO: 2023732 - protein, 22 aa, Staphylococcus
KREKALAEKEKQFKLRELKADV

SEQ ID NO: 2023733 - protein, 19 aa, Staphylococcus
KRELNECFDKVSQLYPQLV

SEQ ID NO: 2023734 - protein, 19 aa, Staphylococcus
KRELVKIHILQNNFDDKND

SEQ ID NO: 2023735 - protein, 22 aa, Staphylococcus
KREMDRGVCLFGPHRDDLGFNV

SEQ ID NO: 2023736 - protein, 18 aa, Staphylococcus
KREPELHKALQYLDDYYH

SEQ ID NO: 2023737 - protein, 18 aa, Staphylococcus
KREPELLTALQYLDDYYH

SEQ ID NO: 2023738 - protein, 19 aa, Staphylococcus
KREQEMDKLLGIYKSNTKN

SEQ ID NO: 2023739 - protein, 23 aa, Staphylococcus
KRESLKLVIQLVDLRHNPTEDDV

SEQ ID NO: 2023740 - protein, 23 aa, Staphylococcus
KRESYRLSSLIINTLIQINSLLS

SEQ ID NO: 2023741 - protein, 17 aa, Staphylococcus
KRFAILLQHQHEYYIHY

SEQ ID NO: 2023742 - protein, 19 aa, Staphylococcus
KRFAKDIERVVSQHACPSC

SEQ ID NO: 2023743 - protein, 24 aa, Staphylococcus
KRFAPNSWAPVSIAWSKDNRSAGY

SEQ ID NO: 2023744 - protein, 18 aa, Staphylococcus
KRFDSWTLDVNKISLETA

SEQ ID NO: 2023745 - protein, 21 aa, Staphylococcus
KRFDTTPSIVLLTCYMLTLEK

SEQ ID NO: 2023746 - protein, 26 aa, Staphylococcus
KRFEHTRHNIGFEVVDYLLDKYNFNL

SEQ ID NO: 2023747 - protein, 17 aa, Staphylococcus
KRFEPRMFIGAISNLKN

SEQ ID NO: 2023748 - protein, 25 aa, Staphylococcus
KRFEQTRHNIGFEVIDFMLEQNRFS

SEQ ID NO: 2023749 - protein, 17 aa, Staphylococcus
KRFESWDLDVNQISLDQ

SEQ ID NO: 2023750 - protein, 17 aa, Staphylococcus
KRFKEDIDRVVSKHDCP

SEQ ID NO: 2023751 - protein, 17 aa, Staphylococcus
KRFKTERLSSIEAEIAE

SEQ ID NO: 2023752 - protein, 19 aa, Staphylococcus
KRFMHHYNFPNFSVGETGP

SEQ ID NO: 2023753 - protein, 19 aa, Staphylococcus
KRFMKMTNNRYILKRSDVV

SEQ ID NO: 2023754 - protein, 18 aa, Staphylococcus
KRFNVPEEVYEIFQQSML

SEQ ID NO: 2023755 - protein, 18 aa, Staphylococcus
KRFNVPQEVYDIFNSTML

SEQ ID NO: 2023756 - protein, 21 aa, Staphylococcus
KRFSINPLWQVYKIVRFPKVF

SEQ ID NO: 2023757 - protein, 18 aa, Staphylococcus
KRFTPKSKLREFNVEEMP

SEQ ID NO: 2023758 - protein, 17 aa, Staphylococcus
KRFTYTHIQRVLMQILL

SEQ ID NO: 2023759 - protein, 20 aa, Staphylococcus
KRFVEEGATVIISDLKEDVV

SEQ ID NO: 2023760 - protein, 20 aa, Staphylococcus
KRFVKEYHNTTTIEVKESEL

SEQ ID NO: 2023761 - protein, 18 aa, Staphylococcus
KRGDAFKGERIPTFDEVL

SEQ ID NO: 2023762 - protein, 20 aa, Staphylococcus
KRGGLGKVPHDRTFYISTDG

SEQ ID NO: 2023763 - protein, 25 aa, Staphylococcus
KRGIDEYLIRLSIGIEDYEDIEQDI

SEQ ID NO: 2023764 - protein, 25 aa, Staphylococcus
KRGINKARGIKCVKQYLNVADERVI

SEQ ID NO: 2023765 - protein, 20 aa, Staphylococcus
KRGIPQYDLKVIGETEHNGT

SEQ ID NO: 2023766 - protein, 21 aa, Staphylococcus
KRGIQAYDELMLYYIKALNGL

SEQ ID NO: 2023767 - protein, 22 aa, Staphylococcus
KRGKEILNESGLAIEPAATMAE

SEQ ID NO: 2023768 - protein, 23 aa, Staphylococcus
KRGMAEMQKGGVIMDVVNAEQAK

SEQ ID NO: 2023769 - protein, 18 aa, Staphylococcus
KRGMKLILDLVVNHTSDE

SEQ ID NO: 2023770 - protein, 20 aa, Staphylococcus
KRGMKLILDLVVNHTSDEHP

SEQ ID NO: 2023771 - protein, 18 aa, Staphylococcus
KRGTYYFRITYYDRTNKR

SEQ ID NO: 2023772 - protein, 20 aa, Staphylococcus
KRGVYSGGVGYINCNHDLDF

SEQ ID NO: 2023773 - protein, 19 aa, Staphylococcus
KRHGGGISETFTVRKISSG

SEQ ID NO: 2023774 - protein, 18 aa, Staphylococcus
KRHGHARGPMAHGSHFHR

SEQ ID NO: 2023775 - protein, 30 aa, Staphylococcus
KRHHKSLSDFAALCFHVPFTKMGQKALDSI

SEQ ID NO: 2023776 - protein, 19 aa, Staphylococcus
KRHIKEFVEKNITPENIQG

SEQ ID NO: 2023777 - protein, 22 aa, Staphylococcus
KRHYIIRDGLRLALNALDLELL

SEQ ID NO: 2023778 - protein, 19 aa, Staphylococcus
KRIDVEKFLLYDDFSKVKV

SEQ ID NO: 2023779 - protein, 20 aa, Staphylococcus
KRIEDCARQLFAEEGVENVS

SEQ ID NO: 2023780 - protein, 25 aa, Staphylococcus
KRIEKGDMITLDFGAYYRGYCSDIT

SEQ ID NO: 2023781 - protein, 20 aa, Staphylococcus
KRIEWKEVLAGQKAYDNTGE

SEQ ID NO: 2023782 - protein, 18 aa, Staphylococcus
KRIFISPLARKMAEDKNF

SEQ ID NO: 2023783 - protein, 25 aa, Staphylococcus
KRIFQEWQIPIIFVTHSNYEAETLA

SEQ ID NO: 2023784 - protein, 17 aa, Staphylococcus
KRIGAELNESFDYNVYV

SEQ ID NO: 2023785 - protein, 25 aa, Staphylococcus
KRIGKQAIKEGWSVRYLEKVVSEIQ

SEQ ID NO: 2023786 - protein, 17 aa, Staphylococcus
KRIHTRFNQTLAQTGRL

SEQ ID NO: 2023787 - protein, 17 aa, Staphylococcus
KRIIYHRVVEMLEEGKA

SEQ ID NO: 2023788 - protein, 21 aa, Staphylococcus
KRIIYHRVVEMLKEGQAISKI

SEQ ID NO: 2023789 - protein, 17 aa, Staphylococcus
KRIKAIEYSVKYDDGKH

SEQ ID NO: 2023790 - protein, 19 aa, Staphylococcus
KRIKEIRLKIGKTQTQFGD

SEQ ID NO: 2023791 - protein, 19 aa, Staphylococcus
KRIKLKYSNQLISDINKLK

SEQ ID NO: 2023792 - protein, 22 aa, Staphylococcus
KRIKRILASYDIKVLDLPLETG

SEQ ID NO: 2023793 - protein, 27 aa, Staphylococcus
KRIKTRKLLEALICVGAFDSFGKTRST

SEQ ID NO: 2023794 - protein, 24 aa, Staphylococcus
KRILHPNDILDWILTESPELDNEA

SEQ ID NO: 2023795 - protein, 17 aa, Staphylococcus
KRILMFHSNHIQGNKVC

SEQ ID NO: 2023796 - protein, 20 aa, Staphylococcus
KRINDSLARLEMPKIDEDVL

SEQ ID NO: 2023797 - protein, 20 aa, Staphylococcus
KRINNSLARLEMPEVDEEVL

SEQ ID NO: 2023798 - protein, 27 aa, Staphylococcus
KRIPKLPFTLCYVSRGFVVDYEDTAAL

SEQ ID NO: 2023799 - protein, 19 aa, Staphylococcus
KRIPQNVSVALKGTLNYSK

SEQ ID NO: 2023800 - protein, 24 aa, Staphylococcus
KRIRSSSAALGFLFNETAWESKLS

SEQ ID NO: 2023801 - protein, 17 aa, Staphylococcus
KRISDEAYNNFLESEIA

SEQ ID NO: 2023802 - protein, 21 aa, Staphylococcus
KRISKLQQMGFVIKQAGHDKR

SEQ ID NO: 2023803 - protein, 25 aa, Staphylococcus
KRISKSGFGPFAFDEWRYLDDGSDN

SEQ ID NO: 2023804 - protein, 30 aa, Staphylococcus
KRISKTGFGPFAFDEWRYLPDGSDNPDFNP

SEQ ID NO: 2023805 - protein, 30 aa, Staphylococcus
KRISKTGFGPFAFDEWRYLPDGSDNPEFNP

SEQ ID NO: 2023806 - protein, 21 aa, Staphylococcus
KRISVLEAMLPSAIKAKYNKA

SEQ ID NO: 2023807 - protein, 21 aa, Staphylococcus
KRISVLEAMLPSAIKAKYQKA

SEQ ID NO: 2023808 - protein, 18 aa, Staphylococcus
KRITEFITDDQLSYIQSE

SEQ ID NO: 2023809 - protein, 29 aa, Staphylococcus
KRITKSGFGPFAFDEWRYLPDGTNNPDFN

SEQ ID NO: 2023810 - protein, 30 aa, Staphylococcus
KRITKTGFGPFAFDEWRYLPDGSDNPDFNL

SEQ ID NO: 2023811 - protein, 25 aa, Staphylococcus
KRITKTGFGPFAFDEWRYLSDGTDN

SEQ ID NO: 2023812 - protein, 19 aa, Staphylococcus
KRIVDLHEVNPMLGHRGCR

SEQ ID NO: 2023813 - protein, 19 aa, Staphylococcus
KRIVEWFNKNQREMPWRET

SEQ ID NO: 2023814 - protein, 19 aa, Staphylococcus
KRIVTWTKRNYDIPVVAQL

SEQ ID NO: 2023815 - protein, 26 aa, Staphylococcus
KRIYGDVKFGVGPVIEGGFYYDFDMD

SEQ ID NO: 2023816 - protein, 21 aa, Staphylococcus
KRIYGGEAYQMYVKLLFDKWQ

SEQ ID NO: 2023817 - protein, 17 aa, Staphylococcus
KRKARKLKYIQDYVTGY

SEQ ID NO: 2023818 - protein, 21 aa, Staphylococcus
KRKASSLLLIDIAVPRDIEPN

SEQ ID NO: 2023819 - protein, 22 aa, Staphylococcus
KRKHSSRVLSFIEQCVNYWNFK

SEQ ID NO: 2023820 - protein, 19 aa, Staphylococcus
KRKIIGNEFIYVFDDEASK

SEQ ID NO: 2023821 - protein, 19 aa, Staphylococcus
KRKIKGQMKQANRVGAEYT

SEQ ID NO: 2023822 - protein, 21 aa, Staphylococcus
KRKITVPCYVVSTKLNDIPRL

SEQ ID NO: 2023823 - protein, 18 aa, Staphylococcus
KRKLEFLSGRFATKEAFS

SEQ ID NO: 2023824 - protein, 20 aa, Staphylococcus
KRKLIDMIFVIEYDENQDEE

SEQ ID NO: 2023825 - protein, 18 aa, Staphylococcus
KRKLIILYKEIFKKDKEK

SEQ ID NO: 2023826 - protein, 18 aa, Staphylococcus
KRKMVFEGVIPNINRRYH

SEQ ID NO: 2023827 - protein, 21 aa, Staphylococcus
KRKNQLPTLAFERVTHKEEKA

SEQ ID NO: 2023828 - protein, 19 aa, Staphylococcus
KRKQGTLVYDPQREKEMIN

SEQ ID NO: 2023829 - protein, 24 aa, Staphylococcus
KRKRVLYHCWAYVPQWKMTELQQA

SEQ ID NO: 2023830 - protein, 19 aa, Staphylococcus
KRKVEREVPVKTARKILAD

SEQ ID NO: 2023831 - protein, 18 aa, Staphylococcus
KRLAELDDLFDGRVNTIM

SEQ ID NO: 2023832 - protein, 28 aa, Staphylococcus
KRLAKEGKPVLGVCNGFQILTEIGLLPG

SEQ ID NO: 2023833 - protein, 28 aa, Staphylococcus
KRLASEGKPVLGVCNGFQILTEIGLLPG

SEQ ID NO: 2023834 - protein, 18 aa, Staphylococcus
KRLDEIPNLRTLSITGGE

SEQ ID NO: 2023835 - protein, 24 aa, Staphylococcus
KRLDIPAGAAVRFEPGDEKEVQLV

SEQ ID NO: 2023836 - protein, 20 aa, Staphylococcus
KRLDLNAATVKKYPNIKLTI

SEQ ID NO: 2023837 - protein, 19 aa, Staphylococcus
KRLEELREICRNLKVENLK

SEQ ID NO: 2023838 - protein, 18 aa, Staphylococcus
KRLELNEIIHPIVRTIME

SEQ ID NO: 2023839 - protein, 20 aa, Staphylococcus
KRLFDDPLMLAMDKSHPLAL

SEQ ID NO: 2023840 - protein, 21 aa, Staphylococcus
KRLFIDHGMGVVIGETCTIGD

SEQ ID NO: 2023841 - protein, 18 aa, Staphylococcus
KRLFSMNDLDRLLEIKSL

SEQ ID NO: 2023842 - protein, 18 aa, Staphylococcus
KRLFSMNDLERLLEIKAL

SEQ ID NO: 2023843 - protein, 19 aa, Staphylococcus
KRLGINATIRREQGADIDA

SEQ ID NO: 2023844 - protein, 19 aa, Staphylococcus
KRLGVNATIRREQGSDIDA

SEQ ID NO: 2023845 - protein, 22 aa, Staphylococcus
KRLHLKGIHFHIGSQIEGTEAM

SEQ ID NO: 2023846 - protein, 20 aa, Staphylococcus
KRLIEEMNKSISLEIQLIEQ

SEQ ID NO: 2023847 - protein, 22 aa, Staphylococcus
KRLKLEKHVFLLGQRKNPYYIM

SEQ ID NO: 2023848 - protein, 22 aa, Staphylococcus
KRLKQPLPQRIPGIELLEECLK

SEQ ID NO: 2023849 - protein, 18 aa, Staphylococcus
KRLLKRKKFADISVKDIC

SEQ ID NO: 2023850 - protein, 17 aa, Staphylococcus
KRLLYSKLEALRAQLNF

SEQ ID NO: 2023851 - protein, 21 aa, Staphylococcus
KRLNLKGIHFHIGSQIEGTDA

SEQ ID NO: 2023852 - protein, 23 aa, Staphylococcus
KRLNLTLKKTIRVESEMKKQDWT

SEQ ID NO: 2023853 - protein, 22 aa, Staphylococcus
KRLNNMFKLLDTVSVPRGIVLD

SEQ ID NO: 2023854 - protein, 18 aa, Staphylococcus
KRLNPTRLTLDEWITQAA

SEQ ID NO: 2023855 - protein, 20 aa, Staphylococcus
KRLNQKKAFQVEFGQKGTDL

SEQ ID NO: 2023856 - protein, 20 aa, Staphylococcus
KRLNQVAMHMRKYERLIVEI

SEQ ID NO: 2023857 - protein, 27 aa, Staphylococcus
KRLNYAGFYRLHHSYKKEVMMAKFNNL

SEQ ID NO: 2023858 - protein, 21 aa, Staphylococcus
KRLNYVGFYRLHHAYHKKVMM

SEQ ID NO: 2023859 - protein, 20 aa, Staphylococcus
KRLQDSIQHFTQIESKDILQ

SEQ ID NO: 2023860 - protein, 25 aa, Staphylococcus
KRLQECGRVLGIELLDHIIIGDAKY

SEQ ID NO: 2023861 - protein, 20 aa, Staphylococcus
KRLQSFGMTVLAYDPFLTKE

SEQ ID NO: 2023862 - protein, 17 aa, Staphylococcus
KRLREITELCKNLNVEV

SEQ ID NO: 2023863 - protein, 19 aa, Staphylococcus
KRLRHRLNQLKATIEIQTV

SEQ ID NO: 2023864 - protein, 25 aa, Staphylococcus
KRLSEICGLLIKYGKPIDTPVALIH

SEQ ID NO: 2023865 - protein, 19 aa, Staphylococcus
KRLTAHIKVSDVFQKTKAW

SEQ ID NO: 2023866 - protein, 21 aa, Staphylococcus
KRLTENITWADNRSSRYADLI

SEQ ID NO: 2023867 - protein, 17 aa, Staphylococcus
KRLTLKAIANKVFISQS

SEQ ID NO: 2023868 - protein, 26 aa, Staphylococcus
KRMEQRYKGPIAFEYNHINNNKERTW

SEQ ID NO: 2023869 - protein, 26 aa, Staphylococcus
KRMGYHVLKYPLNLAGIYNISTYHLD

SEQ ID NO: 2023870 - protein, 19 aa, Staphylococcus
KRMIENICYNNAYNYFKLI

SEQ ID NO: 2023871 - protein, 19 aa, Staphylococcus
KRMIFDYAQTALKVKSLNY

SEQ ID NO: 2023872 - protein, 17 aa, Staphylococcus
KRMPRFDIDVNETYQVF

SEQ ID NO: 2023873 - protein, 17 aa, Staphylococcus
KRMQEQLFLVAEEDEEI

SEQ ID NO: 2023874 - protein, 19 aa, Staphylococcus
KRNLHKTINIFDGPLSAIK

SEQ ID NO: 2023875 - protein, 21 aa, Staphylococcus
KRNPYIIQFQYKGYRIVSFKG

SEQ ID NO: 2023876 - protein, 23 aa, Staphylococcus
KRNRSKVRLALRRGTQVEHAGRE

SEQ ID NO: 2023877 - protein, 21 aa, Staphylococcus
KRNTQFESCTSFKQYYENKKQ

SEQ ID NO: 2023878 - protein, 20 aa, Staphylococcus
KRPAFFTSNFFRMLQNNVRF

SEQ ID NO: 2023879 - protein, 26 aa, Staphylococcus
KRPEVVEKIKIARSFGDLSENSEYDA

SEQ ID NO: 2023880 - protein, 19 aa, Staphylococcus
KRPGKELENLIPDHLSGLL

SEQ ID NO: 2023881 - protein, 19 aa, Staphylococcus
KRPGKELENLVPDHLSGLL

SEQ ID NO: 2023882 - protein, 20 aa, Staphylococcus
KRPGKELENLVPDHLSGLLF

SEQ ID NO: 2023883 - protein, 20 aa, Staphylococcus
KRPGKELENLVPNYLQRLLF

SEQ ID NO: 2023884 - protein, 21 aa, Staphylococcus
KRPIAEIQFADFILPAVNQII

SEQ ID NO: 2023885 - protein, 17 aa, Staphylococcus
KRPLKKLIRSVIPNDVS

SEQ ID NO: 2023886 - protein, 19 aa, Staphylococcus
KRPPYKHEIEMLETETFNP

SEQ ID NO: 2023887 - protein, 21 aa, Staphylococcus
KRPTSGAIFLNGIDIFQHHNI

SEQ ID NO: 2023888 - protein, 18 aa, Staphylococcus
KRPVMLLGTGAKHAKDEV

SEQ ID NO: 2023889 - protein, 19 aa, Staphylococcus
KRPVMTEAQLNVIEESRFN

SEQ ID NO: 2023890 - protein, 24 aa, Staphylococcus
KRQDLQARLSLITNDEAIALIKHL

SEQ ID NO: 2023891 - protein, 17 aa, Staphylococcus
KRQGQSMIYSLDDQHVS

SEQ ID NO: 2023892 - protein, 23 aa, Staphylococcus
KRQKELIEGFGVETFGDIDGTIK

SEQ ID NO: 2023893 - protein, 20 aa, Staphylococcus
KRQLKEFTDNGWGKYPICMA

SEQ ID NO: 2023894 - protein, 26 aa, Staphylococcus
KRQLTWFKNKMNVHWLDRENMSLQMM

SEQ ID NO: 2023895 - protein, 19 aa, Staphylococcus
KRQPLGDPIVLIAPTQSTF

SEQ ID NO: 2023896 - protein, 21 aa, Staphylococcus
KRQRQSILEILAQVEVNIDYP

SEQ ID NO: 2023897 - protein, 25 aa, Staphylococcus
KRQSELWRYRVQDMKNIIDHLDQIT

SEQ ID NO: 2023898 - protein, 35 aa, Staphylococcus
KRQSKIFRSRFRMLVEAQLDLLKNDDWDYLLNYDF

SEQ ID NO: 2023899 - protein, 35 aa, Staphylococcus
KRQSKIFRSRFRMLVEAQLDLLKNDDWDYLLNYDI

SEQ ID NO: 2023900 - protein, 35 aa, Staphylococcus
KRQSKIFRSRFRMLVEAQLDLLKNDDWDYLLNYDL

SEQ ID NO: 2023901 - protein, 35 aa, Staphylococcus
KRQSKIFRSRFRMLVEAQLDLLKSEDWDYLLNYDL

SEQ ID NO: 2023902 - protein, 35 aa, Staphylococcus
KRQSKVFRSRFRMLVEAQLDLLKNDDWDYLLNYDL

SEQ ID NO: 2023903 - protein, 40 aa, Staphylococcus; identical to SEQ ID NO: 1650317

SEQ ID NO: 2023904 - protein, 40 aa, Staphylococcus; identical to SEQ ID NO: 1795651

SEQ ID NO: 2023905 - protein, 26 aa, Staphylococcus
KRRDNDFWKSIAFGVSTGNRNQTLTS

SEQ ID NO: 2023906 - protein, 19 aa, Staphylococcus
KRRGGGISETFTVRKISSG

SEQ ID NO: 2023907 - protein, 17 aa, Staphylococcus
KRRGIDINEAFNQVMRY

SEQ ID NO: 2023908 - protein, 17 aa, Staphylococcus
KRRGKLTIEKKWDVTTA

SEQ ID NO: 2023909 - protein, 17 aa, Staphylococcus
KRRGRPTISKKWDQTTA

SEQ ID NO: 2023910 - protein, 20 aa, Staphylococcus
KRRKRCSLCNGKFKKTTKQF

SEQ ID NO: 2023911 - protein, 20 aa, Staphylococcus
KRRLGEKVIGFASNEAAKYD

SEQ ID NO: 2023912 - protein, 20 aa, Staphylococcus
KRRLGEKVIGFSSSEASKYD

SEQ ID NO: 2023913 - protein, 24 aa, Staphylococcus
KRRPSFEMEDRLVLEHVDYDNLTY

SEQ ID NO: 2023914 - protein, 19 aa, Staphylococcus
KRSEELVGEVVKEYPREKV

SEQ ID NO: 2023915 - protein, 22 aa, Staphylococcus
KRSEQFYQSLGFEIKHNPDMLD

SEQ ID NO: 2023916 - protein, 25 aa, Staphylococcus
KRSGLGKVAHPRTFYIGTDGYVREG

SEQ ID NO: 2023917 - protein, 23 aa, Staphylococcus
KRSKTLSKWKKWFDVTILEEGDN

SEQ ID NO: 2023918 - protein, 24 aa, Staphylococcus
KRSKTLTKWQSWFNMDIIEENENY

SEQ ID NO: 2023919 - protein, 19 aa, Staphylococcus
KRSLQWGNDAYTMILDRLN

SEQ ID NO: 2023920 - protein, 20 aa, Staphylococcus
KRSLQWGNDAYTMILDRLNI

SEQ ID NO: 2023921 - protein, 19 aa, Staphylococcus
KRSLQWGNDAYTMILERLN

SEQ ID NO: 2023922 - protein, 29 aa, Staphylococcus
KRSNGLLHIGYRLIWIIPNPYYDKLRHIL

SEQ ID NO: 2023923 - protein, 20 aa, Staphylococcus
KRSNSGTCYNQRPIVATGDI

SEQ ID NO: 2023924 - protein, 20 aa, Staphylococcus
KRSNSGTCYNQRPIVSIGDV

SEQ ID NO: 2023925 - protein, 20 aa, Staphylococcus
KRSNSGTCYNQRPIVSVGDV

SEQ ID NO: 2023926 - protein, 20 aa, Staphylococcus
KRSRNILDFSDYEHFALKIL

SEQ ID NO: 2023927 - protein, 21 aa, Staphylococcus
KRSRNLLDFSDYEHFALRILM

SEQ ID NO: 2023928 - protein, 19 aa, Staphylococcus
KRSRQIFELAQQGKVDEAY

SEQ ID NO: 2023929 - protein, 23 aa, Staphylococcus
KRSSGKIAFLQLRDGTGFIQGVV

SEQ ID NO: 2023930 - protein, 23 aa, Staphylococcus
KRSSGKIAFLQLRDGTGFMQGVV

SEQ ID NO: 2023931 - protein, 27 aa, Staphylococcus
KRSSGKIAFLQLRDGTGFMQGVVVKSA

SEQ ID NO: 2023932 - protein, 24 aa, Staphylococcus
KRTARAAIKIAVDLVDEGVIKKEE

SEQ ID NO: 2023933 - protein, 23 aa, Staphylococcus
KRTARAAIKVAVDLVNEGLITKE

SEQ ID NO: 2023934 - protein, 22 aa, Staphylococcus
KRTARAAIQIAVDLVNEDIITK

SEQ ID NO: 2023935 - protein, 25 aa, Staphylococcus
KRTEEYKNTIGLFIEFLPVLDKKSN

SEQ ID NO: 2023936 - protein, 17 aa, Staphylococcus
KRTHCRLEVITRKGKSP

SEQ ID NO: 2023937 - protein, 24 aa, Staphylococcus
KRTLHYYDEIALLKVKKNESNHRI

SEQ ID NO: 2023938 - protein, 18 aa, Staphylococcus
KRTNFPVEVLKKVQQVAS

SEQ ID NO: 2023939 - protein, 26 aa, Staphylococcus
KRTQMKIQQRCIGYLFQDYQLFPHLT

SEQ ID NO: 2023940 - protein, 19 aa, Staphylococcus
KRTRLSSCKAFVNQITLLK

SEQ ID NO: 2023941 - protein, 19 aa, Staphylococcus
KRTSFLIGDGTGLGIPQSE

SEQ ID NO: 2023942 - protein, 18 aa, Staphylococcus
KRTSRKLFTEKIKAVQYD

SEQ ID NO: 2023943 - protein, 27 aa, Staphylococcus
KRTVQTYSCIFPYDIPTTLTPLLRERS

SEQ ID NO: 2023944 - protein, 22 aa, Staphylococcus
KRVDIMLRHGLFNEVQHLVEQG

SEQ ID NO: 2023945 - protein, 21 aa, Staphylococcus
KRVKDELDIEISIIPEKEEAY

SEQ ID NO: 2023946 - protein, 26 aa, Staphylococcus
KRVKSRKLLEALILVGAFDHFGKNRA

SEQ ID NO: 2023947 - protein, 25 aa, Staphylococcus
KRVLEVACNMCTTSIELAQKYNCHI

SEQ ID NO: 2023948 - protein, 18 aa, Staphylococcus
KRVLIQFDEEIHCEIVNR

SEQ ID NO: 2023949 - protein, 20 aa, Staphylococcus
KRVPAGSVIIEGKKCGIVTT

SEQ ID NO: 2023950 - protein, 20 aa, Staphylococcus
KRVSGSTILFLGTGAIAQAA

SEQ ID NO: 2023951 - protein, 26 aa, Staphylococcus
KRVSPDIFTKRFNHYDFIMLNSDGLT

SEQ ID NO: 2023952 - protein, 20 aa, Staphylococcus
KRVTDGILLLFPLKDAVEVQ

SEQ ID NO: 2023953 - protein, 17 aa, Staphylococcus
KRVYDWVQEVEALGAGE

SEQ ID NO: 2023954 - protein, 24 aa, Staphylococcus
KRVYEMNQAKDWGIFANHIELDIN

SEQ ID NO: 2023955 - protein, 28 aa, Staphylococcus
KRWAEGVPLTDKRVSPIYGPIEGLPPVY

SEQ ID NO: 2023956 - protein, 27 aa, Staphylococcus
KRYDKTPAQIVLRWHLAHNRMIIPKSK

SEQ ID NO: 2023957 - protein, 22 aa, Staphylococcus
KRYDVGEKIGFVKTTIDFALNN

SEQ ID NO: 2023958 - protein, 20 aa, Staphylococcus
KRYESHPEKATGYFYQICKR

SEQ ID NO: 2023959 - protein, 19 aa, Staphylococcus
KRYFAEFERFPSYETALQY

SEQ ID NO: 2023960 - protein, 26 aa, Staphylococcus
KRYFDEALSALTLYRSRRYWYQVNQN

SEQ ID NO: 2023961 - protein, 20 aa, Staphylococcus
KRYGDKTAVDDISFNIQKGE

SEQ ID NO: 2023962 - protein, 20 aa, Staphylococcus
KRYGQNIAVHDLSFKINEGE

SEQ ID NO: 2023963 - protein, 19 aa, Staphylococcus
KRYGTNVAVDDVSFKINEG

SEQ ID NO: 2023964 - protein, 31 aa, Staphylococcus
KRYIEPLGLKLDRYRVMIVHPWQYKHVIAKF

SEQ ID NO: 2023965 - protein, 20 aa, Staphylococcus
KRYILKSVIDQIKRDYDFDY

SEQ ID NO: 2023966 - protein, 22 aa, Staphylococcus
KRYLENQIRDAFGFEGTPIHII

SEQ ID NO: 2023967 - protein, 22 aa, Staphylococcus
KRYPIRALMMSHMFVEVDDEVH

SEQ ID NO: 2023968 - protein, 22 aa, Staphylococcus
KRYPIRALMMSHMFVEVDDSVN

SEQ ID NO: 2023969 - protein, 17 aa, Staphylococcus
KRYPVKMEHNKIIPTKP

SEQ ID NO: 2023970 - protein, 19 aa, Staphylococcus
KRYPVKMEHNQIIPTKPIP

SEQ ID NO: 2023971 - protein, 31 aa, Staphylococcus
KRYQKTPAQIVLRWHLAHNRIIIPKSKTPSR

SEQ ID NO: 2023972 - protein, 19 aa, Staphylococcus
KRYSNCKEEHDINENNLLV

SEQ ID NO: 2023973 - protein, 19 aa, Staphylococcus
KRYTAARVISQVSRFFTGI

SEQ ID NO: 2023974 - protein, 17 aa, Staphylococcus
KRYVAAHHPFTSPKDED

SEQ ID NO: 2023975 - protein, 18 aa, Staphylococcus
KSAFPQQQTHILNCGYPR

SEQ ID NO: 2023976 - protein, 19 aa, Staphylococcus
KSAGLGSYFEDVDYTEAGA

SEQ ID NO: 2023977 - protein, 18 aa, Staphylococcus
KSAHHFIKEVVRVSENLD

SEQ ID NO: 2023978 - protein, 21 aa, Staphylococcus
KSAKKVLSFEIDQRLIPVLKE

SEQ ID NO: 2023979 - protein, 19 aa, Staphylococcus
KSALPNDVTMHFIGSLQSR

SEQ ID NO: 2023980 - protein, 22 aa, Staphylococcus
KSAMSGMNIAVFYLDPNKNSAK

SEQ ID NO: 2023981 - protein, 27 aa, Staphylococcus
KSARGMGGHVRASWKDVTDIIAAQLLY

SEQ ID NO: 2023982 - protein, 21 aa, Staphylococcus
KSAYDFCGLVLDYDEQTQLAT

SEQ ID NO: 2023983 - protein, 18 aa, Staphylococcus
KSAYLEIYNELNLLIDSL

SEQ ID NO: 2023984 - protein, 26 aa, Staphylococcus
KSDADVVRFGKEILAKGAHAVIVSLG

SEQ ID NO: 2023985 - protein, 27 aa, Staphylococcus
KSDAFDLLMQLGFPRNIMSLSPFQMSG

SEQ ID NO: 2023986 - protein, 17 aa, Staphylococcus
KSDDHFIIIDAEGNEYT

SEQ ID NO: 2023987 - protein, 22 aa, Staphylococcus
KSDELYFKAWDGLYHEIHNEPE

SEQ ID NO: 2023988 - protein, 27 aa, Staphylococcus
KSDGYRIGYGGGFYDRFLSKFKPNTIS

SEQ ID NO: 2023989 - protein, 17 aa, Staphylococcus
KSDIVPIDVGAKGNLNK

SEQ ID NO: 2023990 - protein, 17 aa, Staphylococcus
KSDKLICHVRPHGGKSD

SEQ ID NO: 2023991 - protein, 18 aa, Staphylococcus
KSDLKLGENISEIEKIKE

SEQ ID NO: 2023992 - protein, 19 aa, Staphylococcus
KSDQLIILTAVDYIYINFG

SEQ ID NO: 2023993 - protein, 18 aa, Staphylococcus
KSDVDDFMDHITSQMDIT

SEQ ID NO: 2023994 - protein, 20 aa, Staphylococcus
KSDVPLYLVVIGKHLDAIEL

SEQ ID NO: 2023995 - protein, 26 aa, Staphylococcus
KSEAERIALALLEKVGLISVKDQRPH

SEQ ID NO: 2023996 - protein, 20 aa, Staphylococcus
KSEASTVLNRIKWQNEAYRY

SEQ ID NO: 2023997 - protein, 18 aa, Staphylococcus
KSEDKLWHLIRYRKADGR

SEQ ID NO: 2023998 - protein, 17 aa, Staphylococcus
KSEEILNLYSTIPAEMK

SEQ ID NO: 2023999 - protein, 19 aa, Staphylococcus
KSEHSMLVDLGRNDIHRIC

SEQ ID NO: 2024000 - protein, 20 aa, Staphylococcus
KSEILNNKMLVVAERDDSSH

SEQ ID NO: 2024001 - protein, 19 aa, Staphylococcus
KSEIRTCRKDIEDLNSNNN

SEQ ID NO: 2024002 - protein, 27 aa, Staphylococcus
KSEITIGLKSDGTFIYDGDEPLLKPHV

SEQ ID NO: 2024003 - protein, 21 aa, Staphylococcus
KSEIYRGYKNFKFETIEQAFQ

SEQ ID NO: 2024004 - protein, 22 aa, Staphylococcus
KSEKEFTYWADKPGAYWVGEGR

SEQ ID NO: 2024005 - protein, 23 aa, Staphylococcus
KSEKKHIFLYLMYVYKQMMIDDI

SEQ ID NO: 2024006 - protein, 21 aa, Staphylococcus
KSELESLWQLRNMFTDSTDFT

SEQ ID NO: 2024007 - protein, 20 aa, Staphylococcus
KSELRVTIGPIERGGAGGGI

SEQ ID NO: 2024008 - protein, 19 aa, Staphylococcus
KSELVDAFVERRNGKATKE

SEQ ID NO: 2024009 - protein, 25 aa, Staphylococcus
KSENDSICCVIDIPYDSYLRIANNS

SEQ ID NO: 2024010 - protein, 21 aa, Staphylococcus
KSEPRLGEKVNVRVIGHNDKG

SEQ ID NO: 2024011 - protein, 19 aa, Staphylococcus
KSERLMIGQIVFDDVSDTD

SEQ ID NO: 2024012 - protein, 20 aa, Staphylococcus
KSESIISGYIVAYEKKNVIY

SEQ ID NO: 2024013 - protein, 28 aa, Staphylococcus
KSETRHIIQFIKNYVQSHSFIKSLTLGI

SEQ ID NO: 2024014 - protein, 30 aa, Staphylococcus
KSEVNRPKWLHALLKLYQLAPRTIEKTFPA

SEQ ID NO: 2024015 - protein, 21 aa, Staphylococcus
KSEVSKLPFIEFQADPIYINQ

SEQ ID NO: 2024016 - protein, 20 aa, Staphylococcus
KSEYFKRITNPMMTLKKIKI

SEQ ID NO: 2024017 - protein, 18 aa, Staphylococcus
KSEYLRRAKVQEMFVNDF

SEQ ID NO: 2024018 - protein, 25 aa, Staphylococcus
KSFADRTNVQFDRGVTAIVGPNGSG

SEQ ID NO: 2024019 - protein, 18 aa, Staphylococcus
KSFGKKTVLNNISLDIEE

SEQ ID NO: 2024020 - protein, 25 aa, Staphylococcus
KSFIHHPRLGYIYLTGDLGIYTEHN

SEQ ID NO: 2024021 - protein, 17 aa, Staphylococcus
KSFKEFIYNRNENNIDF

SEQ ID NO: 2024022 - protein, 23 aa, Staphylococcus
KSFKEVTNVTGIVLTKLDGTAKG

SEQ ID NO: 2024023 - protein, 20 aa, Staphylococcus
KSFKNVVLTPHIGNATFEAR

SEQ ID NO: 2024024 - protein, 25 aa, Staphylococcus
KSFQRKRLGYMRILGYKNLDQCRRN

SEQ ID NO: 2024025 - protein, 20 aa, Staphylococcus
KSFSDFLWSYVNHQPINMGY

SEQ ID NO: 2024026 - protein, 27 aa, Staphylococcus
KSFTALPVVAGFGIRTTDHIKDLVKDV

SEQ ID NO: 2024027 - protein, 18 aa, Staphylococcus
KSFTEYKDDLTVTALVGA

SEQ ID NO: 2024028 - protein, 22 aa, Staphylococcus
KSGDEILVSFDLYGGTFRLFDF

SEQ ID NO: 2024029 - protein, 20 aa, Staphylococcus
KSGDEKFGLLNVASPFTEKY

SEQ ID NO: 2024030 - protein, 19 aa, Staphylococcus
KSGDIIGYVEAMKVMNEVT

SEQ ID NO: 2024031 - protein, 20 aa, Staphylococcus
KSGDITQELQKGYKLKDRVL

SEQ ID NO: 2024032 - protein, 17 aa, Staphylococcus
KSGGFDWFKKKPNKQAH

SEQ ID NO: 2024033 - protein, 17 aa, Staphylococcus
KSGIEFKVRGKNVSYKP

SEQ ID NO: 2024034 - protein, 17 aa, Staphylococcus
KSGLKQAVKRLAGVKGI

SEQ ID NO: 2024035 - protein, 21 aa, Staphylococcus
KSGNEVVHFRDYRLHLQKDTT

SEQ ID NO: 2024036 - protein, 17 aa, Staphylococcus
KSGRITGAQAWIGTMLK

SEQ ID NO: 2024037 - protein, 17 aa, Staphylococcus
KSGRITGAQAWVGTLLK

SEQ ID NO: 2024038 - protein, 27 aa, Staphylococcus
KSGWTDIFIYPGFEYKAIDGLITNFHL

SEQ ID NO: 2024039 - protein, 19 aa, Staphylococcus
KSGYLCPKVTGGLNSIAVR

SEQ ID NO: 2024040 - protein, 21 aa, Staphylococcus
KSHAFLLPLIDKIDVENKEPQ

SEQ ID NO: 2024041 - protein, 21 aa, Staphylococcus
KSHAFLLPLIDLINTDIKEPQ

SEQ ID NO: 2024042 - protein, 23 aa, Staphylococcus
KSHAFLLPLMHLIDIDLQEPQVI

SEQ ID NO: 2024043 - protein, 17 aa, Staphylococcus
KSHAGLFKTTRYTKPLV

SEQ ID NO: 2024044 - protein, 20 aa, Staphylococcus
KSHDFRWEPSILSQSISDLK

SEQ ID NO: 2024045 - protein, 17 aa, Staphylococcus
KSHDIYMYGQFDLIDAE

SEQ ID NO: 2024046 - protein, 21 aa, Staphylococcus
KSHEKIGIVGRNGAGKSTLMK

SEQ ID NO: 2024047 - protein, 24 aa, Staphylococcus
KSHFKHCDFSEGIFKNVSTISNSK

SEQ ID NO: 2024048 - protein, 17 aa, Staphylococcus
KSHRLIVHLDNRQIEFY

SEQ ID NO: 2024049 - protein, 17 aa, Staphylococcus
KSIAGFDIESFNVSHDA

SEQ ID NO: 2024050 - protein, 31 aa, Staphylococcus
KSIAYPRQIAMYLSRELTDFSLPKIGEEFGG

SEQ ID NO: 2024051 - protein, 18 aa, Staphylococcus
KSIEDLNITKGHEAMEKY

SEQ ID NO: 2024052 - protein, 20 aa, Staphylococcus
KSIEGKTLFEHVTQIIQNGQ

SEQ ID NO: 2024053 - protein, 21 aa, Staphylococcus
KSIEPLRELEVIEGDYDDVIE

SEQ ID NO: 2024054 - protein, 17 aa, Staphylococcus
KSIFPNDNVIGISELIK

SEQ ID NO: 2024055 - protein, 19 aa, Staphylococcus
KSIGNKGIKLLLNADDPFV

SEQ ID NO: 2024056 - protein, 18 aa, Staphylococcus
KSIIEIMHNQLLLDYPQS

SEQ ID NO: 2024057 - protein, 19 aa, Staphylococcus
KSIIMFGEGCFYRKIFEDW

SEQ ID NO: 2024058 - protein, 17 aa, Staphylococcus
KSIKANHYLRNHEMADL

SEQ ID NO: 2024059 - protein, 17 aa, Staphylococcus
KSIKNIVKPLLKYAKDR

SEQ ID NO: 2024060 - protein, 26 aa, Staphylococcus
KSIKSELEGFAWFWHTTFNHTNESPR

SEQ ID NO: 2024061 - protein, 17 aa, Staphylococcus
KSIKVCPLIYWTEDNVW

SEQ ID NO: 2024062 - protein, 20 aa, Staphylococcus
KSILESPKFKNTESKLTVAM

SEQ ID NO: 2024063 - protein, 17 aa, Staphylococcus
KSIPAPKTEFKSILETF

SEQ ID NO: 2024064 - protein, 20 aa, Staphylococcus
KSIPTEGAQLIIDYLQAHPE

SEQ ID NO: 2024065 - protein, 19 aa, Staphylococcus
KSITCKAIVGLNDDRLKVQ

SEQ ID NO: 2024066 - protein, 18 aa, Staphylococcus
KSIYRIILKIQHKTQQFS

SEQ ID NO: 2024067 - protein, 28 aa, Staphylococcus
KSKAGMQTMKFDMCGAANVVGMLHAIER

SEQ ID NO: 2024068 - protein, 19 aa, Staphylococcus
KSKCVFVYADIETYSPSKD

SEQ ID NO: 2024069 - protein, 19 aa, Staphylococcus
KSKEFTRVKNGLEPTEVAN

SEQ ID NO: 2024070 - protein, 20 aa, Staphylococcus
KSKEKFLYDKIIYLYENRED

SEQ ID NO: 2024071 - protein, 23 aa, Staphylococcus
KSKEKRVEFHLHTAMSQMDGIPN

SEQ ID NO: 2024072 - protein, 18 aa, Staphylococcus
KSKFGVSSTLSFAKISDI

SEQ ID NO: 2024073 - protein, 19 aa, Staphylococcus
KSKFWLQLQADVFNMKVKK

SEQ ID NO: 2024074 - protein, 19 aa, Staphylococcus
KSKGLHSIMYGHEPINLIG

SEQ ID NO: 2024075 - protein, 18 aa, Staphylococcus
KSKGYAFRSMKRKLPKLD

SEQ ID NO: 2024076 - protein, 20 aa, Staphylococcus
KSKHAQREWERVPQPTRAEH

SEQ ID NO: 2024077 - protein, 17 aa, Staphylococcus
KSKIGTFAEYISVNAEE

SEQ ID NO: 2024078 - protein, 19 aa, Staphylococcus
KSKISRITIGYTRDRKPIT

SEQ ID NO: 2024079 - protein, 20 aa, Staphylococcus
KSKKEAIHIAEEHLRMVNLI

SEQ ID NO: 2024080 - protein, 19 aa, Staphylococcus
KSKKLYPDMLVIADTCLCE

SEQ ID NO: 2024081 - protein, 21 aa, Staphylococcus
KSKKPVVLFGVGAQHAKDELR

SEQ ID NO: 2024082 - protein, 17 aa, Staphylococcus
KSKKVEYAWTDDELDKL

SEQ ID NO: 2024083 - protein, 17 aa, Staphylococcus
KSKLEAYLVLKANNEDQ

SEQ ID NO: 2024084 - protein, 25 aa, Staphylococcus
KSKMAKKDFRLILVGGDCPKVKAKP

SEQ ID NO: 2024085 - protein, 19 aa, Staphylococcus
KSKPDVVVASFRQAHTKTL

SEQ ID NO: 2024086 - protein, 20 aa, Staphylococcus
KSKQAQLEWEKTPEPTRADH

SEQ ID NO: 2024087 - protein, 21 aa, Staphylococcus
KSKREALEMAEHVELDLVVVA

SEQ ID NO: 2024088 - protein, 23 aa, Staphylococcus
KSKREALEMAERVDLDLVVVAPN

SEQ ID NO: 2024089 - protein, 22 aa, Staphylococcus
KSKREALEMAERVELDLVVVAP

SEQ ID NO: 2024090 - protein, 18 aa, Staphylococcus
KSKYWLFNTLNNVRKKIK

SEQ ID NO: 2024091 - protein, 31 aa, Staphylococcus
KSLAEVLHGIFLEVVIAPKFTQEALEVLGKK

SEQ ID NO: 2024092 - protein, 17 aa, Staphylococcus
KSLAIAAASIISRYAFV

SEQ ID NO: 2024093 - protein, 17 aa, Staphylococcus
KSLARFISTIRSFHQFA

SEQ ID NO: 2024094 - protein, 21 aa, Staphylococcus
KSLDNWRIISHSNLSIVNFRY

SEQ ID NO: 2024095 - protein, 22 aa, Staphylococcus
KSLEGALSFVVETAVNQVGVDV

SEQ ID NO: 2024096 - protein, 19 aa, Staphylococcus
KSLEGVSIFGDAFSEPTEE

SEQ ID NO: 2024097 - protein, 22 aa, Staphylococcus
KSLESALDFVVETAVNQVGVDV

SEQ ID NO: 2024098 - protein, 17 aa, Staphylococcus
KSLFQSWFDICKKTKKE

SEQ ID NO: 2024099 - protein, 19 aa, Staphylococcus
KSLGNFILVHDIIKEIDPD

SEQ ID NO: 2024100 - protein, 18 aa, Staphylococcus
KSLGNFILVHDIIKEVDP

SEQ ID NO: 2024101 - protein, 29 aa, Staphylococcus
KSLGYDETTKWLSVLPIYHISGLSVLLRS

SEQ ID NO: 2024102 - protein, 23 aa, Staphylococcus
KSLIMSGDVLKVMVSNDVERNHF

SEQ ID NO: 2024103 - protein, 24 aa, Staphylococcus
KSLKDHFYRYSLKLRQKVKTITID

SEQ ID NO: 2024104 - protein, 23 aa, Staphylococcus
KSLKDQSWYKLNVRPNTDLSSTD

SEQ ID NO: 2024105 - protein, 17 aa, Staphylococcus
KSLKRKQISALSGGQLQ

SEQ ID NO: 2024106 - protein, 23 aa, Staphylococcus
KSLKTGFSLSPFRITIMDHDGET

SEQ ID NO: 2024107 - protein, 19 aa, Staphylococcus
KSLLCTGFVEVYLKTKENV

SEQ ID NO: 2024108 - protein, 26 aa, Staphylococcus
KSLLGGTCLHKGCIPTKALLKSAEVL

SEQ ID NO: 2024109 - protein, 26 aa, Staphylococcus
KSLLGGTCLHKGCIPTKALLKSAEVT

SEQ ID NO: 2024110 - protein, 26 aa, Staphylococcus
KSLLGGTCLHKGCIPTKSLLKSAEIH

SEQ ID NO: 2024111 - protein, 18 aa, Staphylococcus
KSLLLMRRNIGMIFQHFN

SEQ ID NO: 2024112 - protein, 26 aa, Staphylococcus
KSLLSKKIEAVIDNKAQYSFLNLLKY

SEQ ID NO: 2024113 - protein, 17 aa, Staphylococcus
KSLMLKDDFMNHQIELD

SEQ ID NO: 2024114 - protein, 18 aa, Staphylococcus
KSLMLRLEKELSKLHEAF

SEQ ID NO: 2024115 - protein, 19 aa, Staphylococcus
KSLMLYITSDWFKNHDYVF

SEQ ID NO: 2024116 - protein, 23 aa, Staphylococcus
KSLNINGTIHWFHDESGGFGVKD

SEQ ID NO: 2024117 - protein, 22 aa, Staphylococcus
KSLNKTTIFRVFIIDSQALNRS

SEQ ID NO: 2024118 - protein, 22 aa, Staphylococcus
KSLNTLTIFRVFIIDSQALSRS

SEQ ID NO: 2024119 - protein, 17 aa, Staphylococcus
KSLPLLVKTAISQVEAG

SEQ ID NO: 2024120 - protein, 17 aa, Staphylococcus
KSLQKGVQMVHESLLRA

SEQ ID NO: 2024121 - protein, 18 aa, Staphylococcus
KSLREIFQNLNLPKKDLH

SEQ ID NO: 2024122 - protein, 20 aa, Staphylococcus
KSLRFEFLKYIWDFPKNHFP

SEQ ID NO: 2024123 - protein, 17 aa, Staphylococcus
KSLSEKRRKVARELRDH

SEQ ID NO: 2024124 - protein, 23 aa, Staphylococcus
KSLTELHGAPGFEEDVRNYMKKE

SEQ ID NO: 2024125 - protein, 25 aa, Staphylococcus
KSLTGGCPMGPFIVTKDELPTPENV

SEQ ID NO: 2024126 - protein, 25 aa, Staphylococcus
KSLTGGCPMGPYIVTKDELPTPEDV

SEQ ID NO: 2024127 - protein, 24 aa, Staphylococcus
KSLTGGCPVGPYIVTKDELPTPED

SEQ ID NO: 2024128 - protein, 24 aa, Staphylococcus
KSLVGPEKVKAKPFQFAKDLTNAR

SEQ ID NO: 2024129 - protein, 19 aa, Staphylococcus
KSLWPQSGDYVLVTLRIDR

SEQ ID NO: 2024130 - protein, 19 aa, Staphylococcus
KSLWPQTGDYVLVTLRIDR

SEQ ID NO: 2024131 - protein, 23 aa, Staphylococcus
KSLYPSCRIAYIVLPKEILSKYK

SEQ ID NO: 2024132 - protein, 22 aa, Staphylococcus
KSLYPSCRIAYIVLPQKLLQSY

SEQ ID NO: 2024133 - protein, 23 aa, Staphylococcus
KSMAKEALLPYFINGENTIFSEL

SEQ ID NO: 2024134 - protein, 17 aa, Staphylococcus
KSMIKGTVDAILFQNND

SEQ ID NO: 2024135 - protein, 18 aa, Staphylococcus
KSMNVEVSNHMQALEDDQ

SEQ ID NO: 2024136 - protein, 17 aa, Staphylococcus
KSMTHRAIMLSSLAKGK

SEQ ID NO: 2024137 - protein, 19 aa, Staphylococcus
KSMVTRFIDNTGVEEPLLV

SEQ ID NO: 2024138 - protein, 17 aa, Staphylococcus
KSNCTAVFINQIREKVG

SEQ ID NO: 2024139 - protein, 18 aa, Staphylococcus
KSNFTGIIIENGKVLACF

SEQ ID NO: 2024140 - protein, 17 aa, Staphylococcus
KSNIEKISRKNLNKNLK

SEQ ID NO: 2024141 - protein, 23 aa, Staphylococcus
KSNKRVPYHLTIYLNKIDDEIQH

SEQ ID NO: 2024142 - protein, 24 aa, Staphylococcus
KSNKYKVLHKVAGKSMVEHVLTNV

SEQ ID NO: 2024143 - protein, 17 aa, Staphylococcus
KSNLYRDKWDEMRGKDT

SEQ ID NO: 2024144 - protein, 22 aa, Staphylococcus
KSNNLKGRILVSTEGINGTLSG

SEQ ID NO: 2024145 - protein, 25 aa, Staphylococcus
KSNSALRVEIMMGKFPKQLIHEKVN

SEQ ID NO: 2024146 - protein, 28 aa, Staphylococcus
KSNYILKYVFANGISRDIIYPLLEKMNL

SEQ ID NO: 2024147 - protein, 28 aa, Staphylococcus
KSNYILKYVFANGISRDIIYPLLVKMNL

SEQ ID NO: 2024148 - protein, 23 aa, Staphylococcus
KSNYLPSYRYAEIFYEDNDIAII

SEQ ID NO: 2024149 - protein, 21 aa, Staphylococcus
KSNYLPSYRYAQIAYEDNDLA

SEQ ID NO: 2024150 - protein, 21 aa, Staphylococcus
KSNYYAFIVFNIMFGGDPSSV

SEQ ID NO: 2024151 - protein, 21 aa, Staphylococcus
KSPDFKAIAKIANYINPNYSI

SEQ ID NO: 2024152 - protein, 26 aa, Staphylococcus
KSPFFGICLGHQLFALSQGATSFKMK

SEQ ID NO: 2024153 - protein, 17 aa, Staphylococcus
KSPGASVYMLGGEGLHT

SEQ ID NO: 2024154 - protein, 23 aa, Staphylococcus
KSPHPSPLSAYRGFFGSKPYSKA

SEQ ID NO: 2024155 - protein, 23 aa, Staphylococcus
KSPHPSPLSAYRGFFGSKPYSKT

SEQ ID NO: 2024156 - protein, 17 aa, Staphylococcus
KSPIFPLFGNGNNLMQP

SEQ ID NO: 2024157 - protein, 20 aa, Staphylococcus
KSPLLIGVGEDFNVVASDAL

SEQ ID NO: 2024158 - protein, 18 aa, Staphylococcus
KSPLLVGVGEGFNVIASD

SEQ ID NO: 2024159 - protein, 19 aa, Staphylococcus
KSPMVGTFFLQDSKELTEP

SEQ ID NO: 2024160 - protein, 19 aa, Staphylococcus
KSPTIEIQQWFKRANELGI

SEQ ID NO: 2024161 - protein, 20 aa, Staphylococcus
KSPTVKAVFNYYLQGYGYKK

SEQ ID NO: 2024162 - protein, 21 aa, Staphylococcus
KSPVKEVGWNKVYRESSIIPN

SEQ ID NO: 2024163 - protein, 21 aa, Staphylococcus
KSPYDFCGLVIDYDETTQIAT

SEQ ID NO: 2024164 - protein, 21 aa, Staphylococcus
KSPYDFCGLVLDYDEETQIAT

SEQ ID NO: 2024165 - protein, 22 aa, Staphylococcus
KSPYHILDVIFWLGHLDILSAH

SEQ ID NO: 2024166 - protein, 19 aa, Staphylococcus
KSQAAIRHAFIDLLHKYEL

SEQ ID NO: 2024167 - protein, 26 aa, Staphylococcus
KSQFCSYDDGNACQRLIKAIFNTSFK

SEQ ID NO: 2024168 - protein, 19 aa, Staphylococcus
KSQGVSIVDHLTASKQFEL

SEQ ID NO: 2024169 - protein, 19 aa, Staphylococcus
KSQGVSIVDHLTASKQFQL

SEQ ID NO: 2024170 - protein, 19 aa, Staphylococcus
KSQHIVFICGHYEGYDERI

SEQ ID NO: 2024171 - protein, 24 aa, Staphylococcus
KSQLKALYLTVIDRIDIRKDENHK

SEQ ID NO: 2024172 - protein, 19 aa, Staphylococcus
KSQLRRSATTQALKKTTTN

SEQ ID NO: 2024173 - protein, 25 aa, Staphylococcus
KSQPFGRKKLNGIIKKHKNKLIKIK

SEQ ID NO: 2024174 - protein, 19 aa, Staphylococcus
KSRAVPIYQTSSYVFDDTQ

SEQ ID NO: 2024175 - protein, 19 aa, Staphylococcus
KSRAVPIYQTSSYVFDNTQ

SEQ ID NO: 2024176 - protein, 26 aa, Staphylococcus
KSRGVRLSSTYGVVFLQAEQSRIYTR

SEQ ID NO: 2024177 - protein, 25 aa, Staphylococcus
KSRHRFGEGIGRQYGFDINLISYYQ

SEQ ID NO: 2024178 - protein, 29 aa, Staphylococcus
KSRKSAMERYEFYGAISYIKSKVETEIAS

SEQ ID NO: 2024179 - protein, 23 aa, Staphylococcus
KSRLDSRLLEAFNQLKEIQNDVA

SEQ ID NO: 2024180 - protein, 18 aa, Staphylococcus
KSRLEQLVVQALSKQTKS

SEQ ID NO: 2024181 - protein, 23 aa, Staphylococcus
KSRLPEYMIPRKFVWMEQLPLTS

SEQ ID NO: 2024182 - protein, 25 aa, Staphylococcus
KSRLTGRLSGNIGYVASKVAQDTHP

SEQ ID NO: 2024183 - protein, 18 aa, Staphylococcus
KSRMHIFHSSEDESLKEI

SEQ ID NO: 2024184 - protein, 18 aa, Staphylococcus
KSRQQLFLDKEMVEQLER

SEQ ID NO: 2024185 - protein, 17 aa, Staphylococcus
KSRRLGISLSGTGKELE

SEQ ID NO: 2024186 - protein, 21 aa, Staphylococcus
KSRSIPIFVFLNDNYEQETVW

SEQ ID NO: 2024187 - protein, 21 aa, Staphylococcus
KSRTPIKQVMVVNTDAKKFTV

SEQ ID NO: 2024188 - protein, 26 aa, Staphylococcus
KSSEAKLKLDDYFALIEQYFKQINHI

SEQ ID NO: 2024189 - protein, 20 aa, Staphylococcus
KSSFSTCYMKNADKNYVDRV

SEQ ID NO: 2024190 - protein, 24 aa, Staphylococcus
KSSKAFIRFENFNKLFQFVFNEYY

SEQ ID NO: 2024191 - protein, 20 aa, Staphylococcus
KSSLITAGFEREQEAIFIDQ

SEQ ID NO: 2024192 - protein, 17 aa, Staphylococcus
KSSTEILEFYKTKEECL

SEQ ID NO: 2024193 - protein, 24 aa, Staphylococcus
KSSTRLMLTAALAPLKVQENRGNS

SEQ ID NO: 2024194 - protein, 24 aa, Staphylococcus
KSSTVPRPIGWISTVSKDGEDNLA

SEQ ID NO: 2024195 - protein, 24 aa, Staphylococcus
KSSTVPRPIGWISTVSKDGKDNLA

SEQ ID NO: 2024196 - protein, 19 aa, Staphylococcus
KSTAIEYVKGFSVDKPKSL

SEQ ID NO: 2024197 - protein, 17 aa, Staphylococcus
KSTFYLRISTLPLSLGI

SEQ ID NO: 2024198 - protein, 19 aa, Staphylococcus
KSTGMCLMSNIGGASGPLY

SEQ ID NO: 2024199 - protein, 19 aa, Staphylococcus
KSTIAKLMMGMMQYQEGRI

SEQ ID NO: 2024200 - protein, 24 aa, Staphylococcus
KSTKDVNGAMSFIYCDSITHDIID

SEQ ID NO: 2024201 - protein, 23 aa, Staphylococcus
KSTLLLQICASLSQSKNVLYITG

SEQ ID NO: 2024202 - protein, 20 aa, Staphylococcus
KSTREFTSFEMASKELSTIL

SEQ ID NO: 2024203 - protein, 19 aa, Staphylococcus
KSTYIKALNRMVELVPSVK

SEQ ID NO: 2024204 - protein, 25 aa, Staphylococcus
KSVAHLKTLIDFGADAFVIGEQKFG

SEQ ID NO: 2024205 - protein, 19 aa, Staphylococcus
KSVDFTFDYVIPKRLAAFV

SEQ ID NO: 2024206 - protein, 22 aa, Staphylococcus
KSVFNQRILPLLLDDDSHYRLY

SEQ ID NO: 2024207 - protein, 21 aa, Staphylococcus
KSVLIDLGLIIGKDARRKREI

SEQ ID NO: 2024208 - protein, 21 aa, Staphylococcus
KSVLIDLGLIIGKDARRRREI

SEQ ID NO: 2024209 - protein, 25 aa, Staphylococcus
KSVLLELGLIIGKDARRKREVIGRK

SEQ ID NO: 2024210 - protein, 18 aa, Staphylococcus
KSVMSIISPIAFKNNVAP

SEQ ID NO: 2024211 - protein, 23 aa, Staphylococcus
KSVNNQAWLAAFMLKQNGITPTL

SEQ ID NO: 2024212 - protein, 19 aa, Staphylococcus
KSVSELTQFPEIMDGRVKT

SEQ ID NO: 2024213 - protein, 21 aa, Staphylococcus
KSVYVKAPFNALIELQSIPNG

SEQ ID NO: 2024214 - protein, 18 aa, Staphylococcus
KSYDARFTPDEVVNYQRH

SEQ ID NO: 2024215 - protein, 17 aa, Staphylococcus
KSYDLWGSYTPDDEQEN

SEQ ID NO: 2024216 - protein, 32 aa, Staphylococcus
KSYDSSLFFEKRSQLIKVLKDKGMRIIDVEDP

SEQ ID NO: 2024217 - protein, 19 aa, Staphylococcus
KSYFKNCDFSEGIFKNVHT

SEQ ID NO: 2024218 - protein, 19 aa, Staphylococcus
KSYFKRYALTANGVSPRPI

SEQ ID NO: 2024219 - protein, 21 aa, Staphylococcus
KSYFKRYALTTSGISQRPIPG

SEQ ID NO: 2024220 - protein, 27 aa, Staphylococcus
KSYIFKSTRLDSSIIYPPYKGKFKYIR

SEQ ID NO: 2024221 - protein, 27 aa, Staphylococcus
KSYIFKSTRLDSSMIYPPYKGKLKYIK

SEQ ID NO: 2024222 - protein, 32 aa, Staphylococcus
KSYKELSVDCHFYRTSKKLFNEKLKAVNYDLN

SEQ ID NO: 2024223 - protein, 23 aa, Staphylococcus
KSYKRKHIFEQLNMQFADNQLTV

SEQ ID NO: 2024224 - protein, 23 aa, Staphylococcus
KSYKRLPLTLFQIQSKFRDEKRP

SEQ ID NO: 2024225 - protein, 23 aa, Staphylococcus
KSYKRLPLTLFQIQSKFRDEQRP

SEQ ID NO: 2024226 - protein, 23 aa, Staphylococcus
KSYKRLPLTLFQIQSKYRDEKRP

SEQ ID NO: 2024227 - protein, 29 aa, Staphylococcus
KSYLNDCRYFGLETIDFIDWVKNINHYPN

SEQ ID NO: 2024228 - protein, 20 aa, Staphylococcus
KSYLPETFVIAGNVGTPEGV

SEQ ID NO: 2024229 - protein, 18 aa, Staphylococcus
KSYMGMTPNEYRSCNKYE

SEQ ID NO: 2024230 - protein, 19 aa, Staphylococcus
KSYNVPFIVNDDVALAEEI

SEQ ID NO: 2024231 - protein, 17 aa, Staphylococcus
KSYPNPFIKGLDIIIPQ

SEQ ID NO: 2024232 - protein, 22 aa, Staphylococcus
KSYRTAHGFRHRQVSIVKGVSF

SEQ ID NO: 2024233 - protein, 22 aa, Staphylococcus
KSYTPQELSAMILQNLKNTAES

SEQ ID NO: 2024234 - protein, 23 aa, Staphylococcus
KSYVGQFLEILGFDIPLDQKDAN

SEQ ID NO: 2024235 - protein, 25 aa, Staphylococcus
KSYVQSHSFIKSLVLGISGGQDSTL

SEQ ID NO: 2024236 - protein, 20 aa, Staphylococcus
KSYWKLFLKPFETLEAFNYR

SEQ ID NO: 2024237 - protein, 18 aa, Staphylococcus
KTADDFVLDTHIIQSHKE

SEQ ID NO: 2024238 - protein, 22 aa, Staphylococcus
KTAEMELRILTRIKEALEDGKP

SEQ ID NO: 2024239 - protein, 18 aa, Staphylococcus
KTAEMEMRILSRIKEALE

SEQ ID NO: 2024240 - protein, 17 aa, Staphylococcus
KTAETLGNMGFEEPTPI

SEQ ID NO: 2024241 - protein, 27 aa, Staphylococcus
KTAHLDSPFFIGIMPITSYRNAQFLHN

SEQ ID NO: 2024242 - protein, 20 aa, Staphylococcus
KTAQELADFLQLPLNAIVKS

SEQ ID NO: 2024243 - protein, 18 aa, Staphylococcus
KTAQELGMDVILTDHHEI

SEQ ID NO: 2024244 - protein, 18 aa, Staphylococcus
KTAVIACMNRLLKTIHYL

SEQ ID NO: 2024245 - protein, 28 aa, Staphylococcus
KTAVNAKLGLSIGVLTGIAKREELHEAD

SEQ ID NO: 2024246 - protein, 19 aa, Staphylococcus
KTAYEKKGVATLILPNNLL

SEQ ID NO: 2024247 - protein, 21 aa, Staphylococcus
KTAYLAQAFGMKVIGVSKSGH

SEQ ID NO: 2024248 - protein, 21 aa, Staphylococcus
KTCSYCKGSGRTSVEQNTILG

SEQ ID NO: 2024249 - protein, 31 aa, Staphylococcus
KTDDRIDFVPARFEKTFNRWMEEIRDWTISR

SEQ ID NO: 2024250 - protein, 24 aa, Staphylococcus
KTDDTFCKPQEAIEYIGKITNGEA

SEQ ID NO: 2024251 - protein, 23 aa, Staphylococcus
KTDEDFRIGRVIVVKAYRKNKLG

SEQ ID NO: 2024252 - protein, 20 aa, Staphylococcus
KTDEGLDEVIEWIERDTLLK

SEQ ID NO: 2024253 - protein, 18 aa, Staphylococcus
KTDEGLDEVIQWIEQDVF

SEQ ID NO: 2024254 - protein, 26 aa, Staphylococcus
KTDELYEIWCYINIIEILKSSGFIPV

SEQ ID NO: 2024255 - protein, 18 aa, Staphylococcus
KTDGSMTRDHIVRYIYKN

SEQ ID NO: 2024256 - protein, 17 aa, Staphylococcus
KTDIINNVHLIRANSSI

SEQ ID NO: 2024257 - protein, 21 aa, Staphylococcus
KTDLEIPPFIQALTSIEDQML

SEQ ID NO: 2024258 - protein, 20 aa, Staphylococcus
KTDLEIPPFIQALTSIEEDM

SEQ ID NO: 2024259 - protein, 22 aa, Staphylococcus
KTDLLEQVWGYDYYEDMNTLNV

SEQ ID NO: 2024260 - protein, 20 aa, Staphylococcus
KTDLSEIVKDFLINFQEKYN

SEQ ID NO: 2024261 - protein, 25 aa, Staphylococcus
KTDMQRLAPRVAYLAQVTADVIEQF

SEQ ID NO: 2024262 - protein, 18 aa, Staphylococcus
KTDNRGLFAYSLESMSQF

SEQ ID NO: 2024263 - protein, 18 aa, Staphylococcus
KTDSSFWKNVYNSIINQL

SEQ ID NO: 2024264 - protein, 17 aa, Staphylococcus
KTDVLLATYGYQLMDEF

SEQ ID NO: 2024265 - protein, 24 aa, Staphylococcus
KTDYKICVLLDMHIGHLKSVMALL

SEQ ID NO: 2024266 - protein, 20 aa, Staphylococcus
KTEKGRVAFATKIVQDNFKQ

SEQ ID NO: 2024267 - protein, 27 aa, Staphylococcus
KTELNQRLGWEIQEPKAFKFEHNGDRL

SEQ ID NO: 2024268 - protein, 25 aa, Staphylococcus
KTESAKDIFSFLAPVKTILTDIEYS

SEQ ID NO: 2024269 - protein, 18 aa, Staphylococcus
KTEYDLLYVLAENRNHVL

SEQ ID NO: 2024270 - protein, 18 aa, Staphylococcus
KTEYDLLYVLAENRNHVM

SEQ ID NO: 2024271 - protein, 23 aa, Staphylococcus
KTEYKSCVLLDMHIGHLKSILDL

SEQ ID NO: 2024272 - protein, 20 aa, Staphylococcus
KTFAEKWLLDLGIKNDSIRL

SEQ ID NO: 2024273 - protein, 24 aa, Staphylococcus
KTFAMYYDYVEPIKNVANHRVLAM

SEQ ID NO: 2024274 - protein, 18 aa, Staphylococcus
KTFASQWLKDLNLSEEAT

SEQ ID NO: 2024275 - protein, 21 aa, Staphylococcus
KTFFTAKMVQRSHLVKESIIV

SEQ ID NO: 2024276 - protein, 22 aa, Staphylococcus
KTFNGESVFEPEVLVKMRNRMK

SEQ ID NO: 2024277 - protein, 28 aa, Staphylococcus
KTFQIRLPRYRLLIGGYFRIIDNERGIK

SEQ ID NO: 2024278 - protein, 24 aa, Staphylococcus
KTFRLENELNVFPSHFSKGMKQKV

SEQ ID NO: 2024279 - protein, 28 aa, Staphylococcus
KTFSEAMPILGVCLGFQQIVTYFGGDII

SEQ ID NO: 2024280 - protein, 25 aa, Staphylococcus
KTFYFPYRLIIRFNPTPSLNIEVDL

SEQ ID NO: 2024281 - protein, 17 aa, Staphylococcus
KTGEFGTDMLVDIANDG

SEQ ID NO: 2024282 - protein, 18 aa, Staphylococcus
KTGFNRPNKLYLHEIETN

SEQ ID NO: 2024283 - protein, 35 aa, Staphylococcus
KTGIKESKHIGGFPVSGLFLRCKNPDVIKQHHAKV

SEQ ID NO: 2024284 - protein, 31 aa, Staphylococcus
KTGIKESKHIGGFPVSGLFLRCKNPDVINRH

SEQ ID NO: 2024285 - protein, 33 aa, Staphylococcus
KTGIKESKHIGGFPVSGLFLVCRDEAITKKHLA

SEQ ID NO: 2024286 - protein, 19 aa, Staphylococcus
KTGKILLNKERIMLIAYLE

SEQ ID NO: 2024287 - protein, 27 aa, Staphylococcus
KTGKWSYKLDYTFSWELYISKENITNV

SEQ ID NO: 2024288 - protein, 23 aa, Staphylococcus
KTGLMPAREIVLVITGAEKAELV

SEQ ID NO: 2024289 - protein, 27 aa, Staphylococcus
KTGMLSLRLNKDFSVAKFLENLEICIF

SEQ ID NO: 2024290 - protein, 22 aa, Staphylococcus
KTGQFRAIFETPTTYLLQKLEE

SEQ ID NO: 2024291 - protein, 26 aa, Staphylococcus
KTHELGIPVMIIFEGIPASGKTRLSN

SEQ ID NO: 2024292 - protein, 18 aa, Staphylococcus
KTHIPAIVKEMTEADMME

SEQ ID NO: 2024293 - protein, 19 aa, Staphylococcus
KTIDARNALPDTFSHEKAV

SEQ ID NO: 2024294 - protein, 33 aa, Staphylococcus
KTIDRICDLFKCAETIFIYGYGASFVVATDLYQ

SEQ ID NO: 2024295 - protein, 20 aa, Staphylococcus
KTIHASYNFTDYYLEAQKDL

SEQ ID NO: 2024296 - protein, 17 aa, Staphylococcus
KTIHKLKMIGHYIGMSF

SEQ ID NO: 2024297 - protein, 19 aa, Staphylococcus
KTIIRWCELLLTNRSMALI

SEQ ID NO: 2024298 - protein, 19 aa, Staphylococcus
KTIKEWSKTAFILPETLKQ

SEQ ID NO: 2024299 - protein, 18 aa, Staphylococcus
KTIKHSKHTLYFKQVARD

SEQ ID NO: 2024300 - protein, 17 aa, Staphylococcus
KTIKTHVSHIFNKLQVT

SEQ ID NO: 2024301 - protein, 21 aa, Staphylococcus
KTIKTHVSHIFNKLSVTDRTQ

SEQ ID NO: 2024302 - protein, 20 aa, Staphylococcus
KTIKTHVSHIFSKLQVTDRT

SEQ ID NO: 2024303 - protein, 17 aa, Staphylococcus
KTINRVRNSSARESIVI

SEQ ID NO: 2024304 - protein, 17 aa, Staphylococcus
KTINRVRSSFARDSIVI

SEQ ID NO: 2024305 - protein, 20 aa, Staphylococcus
KTIPTTFEFTDIAGIVKGAS

SEQ ID NO: 2024306 - protein, 18 aa, Staphylococcus
KTIRLKEVKNFYLKYFGL

SEQ ID NO: 2024307 - protein, 17 aa, Staphylococcus
KTIRVESEMKKQDWTEV

SEQ ID NO: 2024308 - protein, 25 aa, Staphylococcus
KTITCKNCGYTEFYKQDRNRSRDFI

SEQ ID NO: 2024309 - protein, 17 aa, Staphylococcus
KTIYLPIMLVHQDKIKT

SEQ ID NO: 2024310 - protein, 20 aa, Staphylococcus
KTKAWFDIGNTFRKKEQEIY

SEQ ID NO: 2024311 - protein, 21 aa, Staphylococcus
KTKEFYQKQAFLLLSMDMSGI

SEQ ID NO: 2024312 - protein, 26 aa, Staphylococcus
KTKELSLRLSKELIDTVHEYFNGLYL

SEQ ID NO: 2024313 - protein, 25 aa, Staphylococcus
KTKHNIEIGGGFRWVTVTEKDSTNP

SEQ ID NO: 2024314 - protein, 24 aa, Staphylococcus
KTKIEVTESVIGRQLINTQNHDLW

SEQ ID NO: 2024315 - protein, 20 aa, Staphylococcus
KTKIGHWFKDIFVSEQTGYQ

SEQ ID NO: 2024316 - protein, 23 aa, Staphylococcus
KTKISMITAYDFPSAKQAQDANI

SEQ ID NO: 2024317 - protein, 18 aa, Staphylococcus
KTKKCLEATIVHYFEPNA

SEQ ID NO: 2024318 - protein, 18 aa, Staphylococcus
KTKKCLEATLVHYFEPNE

SEQ ID NO: 2024319 - protein, 18 aa, Staphylococcus
KTKKCLEATVVHYFEPNE

SEQ ID NO: 2024320 - protein, 20 aa, Staphylococcus
KTKKKAVVIGGGLLGLECAR

SEQ ID NO: 2024321 - protein, 25 aa, Staphylococcus
KTKLKRLFEQAGFSHVKVRSFTGGV

SEQ ID NO: 2024322 - protein, 22 aa, Staphylococcus
KTKRKIKGLKYELGKDQSEVHY

SEQ ID NO: 2024323 - protein, 19 aa, Staphylococcus
KTKRYTYTHIQRLLMNILL

SEQ ID NO: 2024324 - protein, 19 aa, Staphylococcus
KTKSAIKRAFTDLLKKKDL

SEQ ID NO: 2024325 - protein, 22 aa, Staphylococcus
KTKSAIKYAFIQLLKERSLENI

SEQ ID NO: 2024326 - protein, 19 aa, Staphylococcus
KTKSRFDIINTLPTTKTVT

SEQ ID NO: 2024327 - protein, 19 aa, Staphylococcus
KTKSRLDIINTLPTSNQVS

SEQ ID NO: 2024328 - protein, 20 aa, Staphylococcus
KTKSRLDIINTLPTTNQISH

SEQ ID NO: 2024329 - protein, 19 aa, Staphylococcus
KTKSRLEIMHTLPNTSVAT

SEQ ID NO: 2024330 - protein, 20 aa, Staphylococcus
KTKSRLEVMHTLPTTVKAAN

SEQ ID NO: 2024331 - protein, 26 aa, Staphylococcus
KTKVNAKLGLAIGVLSGIAKKEELVD

SEQ ID NO: 2024332 - protein, 19 aa, Staphylococcus
KTKVNHFYGLASKDDSYVS

SEQ ID NO: 2024333 - protein, 25 aa, Staphylococcus
KTLCHEYKVPFLINDDVDLAEKIDA

SEQ ID NO: 2024334 - protein, 23 aa, Staphylococcus
KTLDGVIFPNVFKQIENILEDND

SEQ ID NO: 2024335 - protein, 18 aa, Staphylococcus
KTLEELLVLNALHIPLHA

SEQ ID NO: 2024336 - protein, 24 aa, Staphylococcus
KTLEREGFHILAIKDMAGLLKPKA

SEQ ID NO: 2024337 - protein, 20 aa, Staphylococcus
KTLFTRSVGILKEMQNKISH

SEQ ID NO: 2024338 - protein, 19 aa, Staphylococcus
KTLGARVFLDSGTLTPLLK

SEQ ID NO: 2024339 - protein, 27 aa, Staphylococcus
KTLGELTDIAWKYNVQVMIEGPGHIPM

SEQ ID NO: 2024340 - protein, 17 aa, Staphylococcus
KTLGELTEIAWKHDVQV

SEQ ID NO: 2024341 - protein, 17 aa, Staphylococcus
KTLGFNSVFKFRNDKNE

SEQ ID NO: 2024342 - protein, 19 aa, Staphylococcus
KTLIARGLVEAKVEDNSRS

SEQ ID NO: 2024343 - protein, 23 aa, Staphylococcus
KTLKELIWNPLIIDEQFNENYVA

SEQ ID NO: 2024344 - protein, 18 aa, Staphylococcus
KTLLDLIRYFVLFQDDGK

SEQ ID NO: 2024345 - protein, 17 aa, Staphylococcus
KTLLSEAEFREYYDKFP

SEQ ID NO: 2024346 - protein, 17 aa, Staphylococcus
KTLLSEAEFREYYDKYP

SEQ ID NO: 2024347 - protein, 30 aa, Staphylococcus
KTLMIYIASDWFKEEGFNFFDYKYSINLVK

SEQ ID NO: 2024348 - protein, 19 aa, Staphylococcus
KTLRHVKNVLLRRKNKDRS

SEQ ID NO: 2024349 - protein, 20 aa, Staphylococcus
KTLSKAFALAGLRIGIVIST

SEQ ID NO: 2024350 - protein, 17 aa, Staphylococcus
KTLTATMPLYLNGLTGK

SEQ ID NO: 2024351 - protein, 18 aa, Staphylococcus
KTLTATMPVYLNALTGRG

SEQ ID NO: 2024352 - protein, 20 aa, Staphylococcus
KTLTELHGAPGFEEEVRDYM

SEQ ID NO: 2024353 - protein, 18 aa, Staphylococcus
KTLTELHGAPGFENDVKA

SEQ ID NO: 2024354 - protein, 18 aa, Staphylococcus
KTMGDLALLMLKDLDTAF

SEQ ID NO: 2024355 - protein, 17 aa, Staphylococcus
KTMMSKIQPGLFLCGEV

SEQ ID NO: 2024356 - protein, 17 aa, Staphylococcus
KTMQGYYAPFVPGWDTH

SEQ ID NO: 2024357 - protein, 17 aa, Staphylococcus
KTMSIVFECHIYTLRQV

SEQ ID NO: 2024358 - protein, 19 aa, Staphylococcus
KTNIPFLINVMRNDKFRSG

SEQ ID NO: 2024359 - protein, 19 aa, Staphylococcus
KTNIPFLINVMRNDQFRSG

SEQ ID NO: 2024360 - protein, 19 aa, Staphylococcus
KTNIPFLINVMRNKKFRSG

SEQ ID NO: 2024361 - protein, 19 aa, Staphylococcus
KTNIPFLVNVMRNEKFRSG

SEQ ID NO: 2024362 - protein, 19 aa, Staphylococcus
KTNSIGIAHGCTGKGNDQV

SEQ ID NO: 2024363 - protein, 24 aa, Staphylococcus
KTNVSVICAGAKSILDLPKTMEYL

SEQ ID NO: 2024364 - protein, 34 aa, Staphylococcus
KTNYKACVLLDMHIGHLKSIMGLLKQYNIECYIH

SEQ ID NO: 2024365 - protein, 22 aa, Staphylococcus
KTPESYTGEQFVEFLLQDQSIL

SEQ ID NO: 2024366 - protein, 18 aa, Staphylococcus
KTPFGFKIYNDPFDMVYV

SEQ ID NO: 2024367 - protein, 21 aa, Staphylococcus
KTPLLACASWSTQGLHNRGSF

SEQ ID NO: 2024368 - protein, 17 aa, Staphylococcus
KTPMGARRLKQWIDRPL

SEQ ID NO: 2024369 - protein, 18 aa, Staphylococcus
KTPMGARRLKQWIDRPLI

SEQ ID NO: 2024370 - protein, 24 aa, Staphylococcus
KTPPELSEQFPLIRQLLDAYQIKH

SEQ ID NO: 2024371 - protein, 17 aa, Staphylococcus
KTPRVKFEKVFADHFMS

SEQ ID NO: 2024372 - protein, 18 aa, Staphylococcus
KTPSRRVPYMEIVGQVHG

SEQ ID NO: 2024373 - protein, 23 aa, Staphylococcus
KTPTKSGYFVVFWTKDHDNNNRP

SEQ ID NO: 2024374 - protein, 18 aa, Staphylococcus
KTPVFLVLNKIDLVHPDA

SEQ ID NO: 2024375 - protein, 18 aa, Staphylococcus
KTQRAVKIIQGYHPDEVL

SEQ ID NO: 2024376 - protein, 18 aa, Staphylococcus
KTQRAVRVVEGYNPDDIL

SEQ ID NO: 2024377 - protein, 22 aa, Staphylococcus
KTQRLPMGLLHTKAIIEEDSAQ

SEQ ID NO: 2024378 - protein, 18 aa, Staphylococcus
KTRAKLNKILAERTGQSI

SEQ ID NO: 2024379 - protein, 18 aa, Staphylococcus
KTRAKLNQILAERTGQSI

SEQ ID NO: 2024380 - protein, 21 aa, Staphylococcus
KTRLRPGGKKATDWLITQGQF

SEQ ID NO: 2024381 - protein, 19 aa, Staphylococcus
KTRSGKIMRRVLKAWELDL

SEQ ID NO: 2024382 - protein, 18 aa, Staphylococcus
KTRVEQGEELIVVVSAMG

SEQ ID NO: 2024383 - protein, 17 aa, Staphylococcus
KTSDGLYVTANQSFVKV

SEQ ID NO: 2024384 - protein, 26 aa, Staphylococcus
KTSDLISRYAGIRVPKNKAIVGQNAF

SEQ ID NO: 2024385 - protein, 33 aa, Staphylococcus; identical to SEQ ID NO: 1663744

SEQ ID NO: 2024386 - protein, 17 aa, Staphylococcus
KTSFLTKPIKTFNKSPY

SEQ ID NO: 2024387 - protein, 22 aa, Staphylococcus
KTSHAKTLFSTHYHELTDLDQE

SEQ ID NO: 2024388 - protein, 20 aa, Staphylococcus
KTSIALRYEMINARLRHTND

SEQ ID NO: 2024389 - protein, 20 aa, Staphylococcus
KTSIATMIHLIYRGLDKNSA

SEQ ID NO: 2024390 - protein, 21 aa, Staphylococcus
KTSIATMIHLIYRGLGKGSAY

SEQ ID NO: 2024391 - protein, 19 aa, Staphylococcus
KTSIATMIHLIYRKLHKNS

SEQ ID NO: 2024392 - protein, 19 aa, Staphylococcus
KTSIATMIHLIYRKLNKNS

SEQ ID NO: 2024393 - protein, 19 aa, Staphylococcus
KTSIATMIHLIYRKLNKSS

SEQ ID NO: 2024394 - protein, 25 aa, Staphylococcus
KTSLMKVILGYSIYQEGNFEVIENK

SEQ ID NO: 2024395 - protein, 20 aa, Staphylococcus
KTSPYEFYQFWINQSDDDVI

SEQ ID NO: 2024396 - protein, 21 aa, Staphylococcus
KTSPYEFYQFWINQSDDDVIK

SEQ ID NO: 2024397 - protein, 20 aa, Staphylococcus
KTSPYEFYQFWINQSDEDVI

SEQ ID NO: 2024398 - protein, 18 aa, Staphylococcus
KTTALRMINRMIEATDGQ

SEQ ID NO: 2024399 - protein, 18 aa, Staphylococcus
KTTALRMINRMIEATDGT

SEQ ID NO: 2024400 - protein, 20 aa, Staphylococcus
KTTFLKHYIEQLLKKDEKIT

SEQ ID NO: 2024401 - protein, 23 aa, Staphylococcus
KTTFLSNYVKYLLRKNENPSIIV

SEQ ID NO: 2024402 - protein, 18 aa, Staphylococcus
KTTICGTDLHIIKGDTPE

SEQ ID NO: 2024403 - protein, 21 aa, Staphylococcus
KTTIFGAMKCSNFGKEISKDE

SEQ ID NO: 2024404 - protein, 24 aa, Staphylococcus
KTTLIRLIMNLIRPDSGNIEMLGF

SEQ ID NO: 2024405 - protein, 19 aa, Staphylococcus
KTTLLRTLNALALAKSGTI

SEQ ID NO: 2024406 - protein, 34 aa, Staphylococcus
KTTSGFYYYDINAIPFPAGISFVKVFSTTVSILG

SEQ ID NO: 2024407 - protein, 17 aa, Staphylococcus
KTTTNFNIAGAFNPNVR

SEQ ID NO: 2024408 - protein, 17 aa, Staphylococcus
KTTYTDLIFLYLEKSFL

SEQ ID NO: 2024409 - protein, 19 aa, Staphylococcus
KTVAIIGGSGIGFEFDAIN

SEQ ID NO: 2024410 - protein, 25 aa, Staphylococcus
KTVAPAIRIGWIIAPEKIIERLADI

SEQ ID NO: 2024411 - protein, 25 aa, Staphylococcus
KTVGIAISDLMGWTAQGLDTLRIDE

SEQ ID NO: 2024412 - protein, 25 aa, Staphylococcus
KTVGIAISDLMGWTAQGLDTLRINE

SEQ ID NO: 2024413 - protein, 29 aa, Staphylococcus
KTVHIHLPLDWLKDKIIVDSLGLHSNNQR

SEQ ID NO: 2024414 - protein, 26 aa, Staphylococcus
KTVHLKLPIEWLQDKIIVDSLGLHSN

SEQ ID NO: 2024415 - protein, 21 aa, Staphylococcus
KTVIIELLYIPTFSSSRTRQT

SEQ ID NO: 2024416 - protein, 24 aa, Staphylococcus
KTVSELYAPISGKIVEVNDELEDS

SEQ ID NO: 2024417 - protein, 23 aa, Staphylococcus
KTVSELYAPVSGKIIETNEELED

SEQ ID NO: 2024418 - protein, 23 aa, Staphylococcus
KTVSELYAPVSGKIVETNDELED

SEQ ID NO: 2024419 - protein, 23 aa, Staphylococcus
KTVSELYAPVSGKVLESNEELED

SEQ ID NO: 2024420 - protein, 23 aa, Staphylococcus
KTVSELYAPVSGKVVESNEELED

SEQ ID NO: 2024421 - protein, 22 aa, Staphylococcus
KTVSELYAPVSGSVVEINEELE

SEQ ID NO: 2024422 - protein, 35 aa, Staphylococcus
KTVVLPAFRPDDVFKVGEPAFLEFVQKLERTTHNI

SEQ ID NO: 2024423 - protein, 20 aa, Staphylococcus
KTWRYSISYVDDEGNRKKVQ

SEQ ID NO: 2024424 - protein, 25 aa, Staphylococcus
KTYEKNLCCPVEYDTKYLKIIPDEI

SEQ ID NO: 2024425 - protein, 21 aa, Staphylococcus
KTYEMILPFHIKKIVIYYLEQ

SEQ ID NO: 2024426 - protein, 22 aa, Staphylococcus
KTYHGESVFEPEVLVKMRNRMK

SEQ ID NO: 2024427 - protein, 19 aa, Staphylococcus
KTYILYQLYETYVIDQSMA

SEQ ID NO: 2024428 - protein, 22 aa, Staphylococcus
KTYRGESVFEPEVLVKMRNRMK

SEQ ID NO: 2024429 - protein, 23 aa, Staphylococcus
KTYYPNCYSTAYKISKVIQKNLD

SEQ ID NO: 2024430 - protein, 20 aa, Staphylococcus
KVADRLGKTIGILLDTKGPE

SEQ ID NO: 2024431 - protein, 19 aa, Staphylococcus
KVAELLLERAKRLVEIGKD

SEQ ID NO: 2024432 - protein, 21 aa, Staphylococcus
KVAEVDIMYGQGISKEGELID

SEQ ID NO: 2024433 - protein, 17 aa, Staphylococcus
KVAEVLGGGDIPRNTYI

SEQ ID NO: 2024434 - protein, 20 aa, Staphylococcus
KVAGELLCQYYYEKFGVDTR

SEQ ID NO: 2024435 - protein, 21 aa, Staphylococcus
KVAGELLCQYYYVKFGVDTRS

SEQ ID NO: 2024436 - protein, 20 aa, Staphylococcus
KVAKKLGKTIGILLDTKGPE

SEQ ID NO: 2024437 - protein, 24 aa, Staphylococcus
KVAPNEVYGLLGINGAGKSTLLKI

SEQ ID NO: 2024438 - protein, 27 aa, Staphylococcus
KVAPPFRIAEVDIMYGQGISKEGELID

SEQ ID NO: 2024439 - protein, 24 aa, Staphylococcus
KVAQIFNYLWGYIISHLSKKSKVT

SEQ ID NO: 2024440 - protein, 20 aa, Staphylococcus
KVAQVLRLLATHVDNLETQK

SEQ ID NO: 2024441 - protein, 18 aa, Staphylococcus
KVASLILGATFPVILTSR

SEQ ID NO: 2024442 - protein, 20 aa, Staphylococcus
KVATILRIFVIDSHALNRSI

SEQ ID NO: 2024443 - protein, 21 aa, Staphylococcus
KVCENCSFTKAAQELNYVQSN

SEQ ID NO: 2024444 - protein, 19 aa, Staphylococcus
KVDALSFIVHKEFAYDRGK

SEQ ID NO: 2024445 - protein, 19 aa, Staphylococcus
KVDALSFIVHKEFAYERGK

SEQ ID NO: 2024446 - protein, 19 aa, Staphylococcus
KVDDFSLKAVDIMGPLMTL

SEQ ID NO: 2024447 - protein, 21 aa, Staphylococcus
KVDEAYNFLKQVSEDGGKVLF

SEQ ID NO: 2024448 - protein, 20 aa, Staphylococcus
KVDELHPIATAAIRQSKNRD

SEQ ID NO: 2024449 - protein, 21 aa, Staphylococcus
KVDEVEFIKVIREVGRNGVID

SEQ ID NO: 2024450 - protein, 19 aa, Staphylococcus
KVDGEFMMFLVRGHHELND

SEQ ID NO: 2024451 - protein, 19 aa, Staphylococcus
KVDIEYDGEPGLEKALNND

SEQ ID NO: 2024452 - protein, 18 aa, Staphylococcus
KVDIKKIREEAAIMMSCK

SEQ ID NO: 2024453 - protein, 26 aa, Staphylococcus
KVDMKRLAPRIQYLVQIVKDIINGFA

SEQ ID NO: 2024454 - protein, 18 aa, Staphylococcus
KVDQLAIHSGEWITITGQ

SEQ ID NO: 2024455 - protein, 20 aa, Staphylococcus
KVDWGKTRIYNMIRDRGEWV

SEQ ID NO: 2024456 - protein, 23 aa, Staphylococcus
KVDWSVYARFIAKFDENTNQLVK

SEQ ID NO: 2024457 - protein, 26 aa, Staphylococcus
KVEAEEIIKDMIELVLNHKKIDVKKM

SEQ ID NO: 2024458 - protein, 20 aa, Staphylococcus
KVEEALRLVKLSGYEDRNIN

SEQ ID NO: 2024459 - protein, 18 aa, Staphylococcus
KVEGAGHALFFEKKDEVN

SEQ ID NO: 2024460 - protein, 20 aa, Staphylococcus
KVEGELGQDIPLVIDGKKIS

SEQ ID NO: 2024461 - protein, 24 aa, Staphylococcus
KVEHIWEHIDRVILMNYNGEIIAD

SEQ ID NO: 2024462 - protein, 20 aa, Staphylococcus
KVEKYEGVFNFDDMVQTAVD

SEQ ID NO: 2024463 - protein, 21 aa, Staphylococcus
KVEKYEIGYDFEPLVQQAVDG

SEQ ID NO: 2024464 - protein, 24 aa, Staphylococcus
KVELLNLGGGFGIKYVEGDVSFPI

SEQ ID NO: 2024465 - protein, 24 aa, Staphylococcus
KVENGEIMIPEFINQDVKFAMISS

SEQ ID NO: 2024466 - protein, 17 aa, Staphylococcus
KVESLRASYYMMGAMLG

SEQ ID NO: 2024467 - protein, 20 aa, Staphylococcus
KVFADAGADVVLGTHPHVIQ

SEQ ID NO: 2024468 - protein, 17 aa, Staphylococcus
KVFGEWKAILAGDALLT

SEQ ID NO: 2024469 - protein, 20 aa, Staphylococcus
KVFHIKRFNSELFVFKANGW

SEQ ID NO: 2024470 - protein, 18 aa, Staphylococcus
KVFLKDGEVVGVVLYGNT

SEQ ID NO: 2024471 - protein, 17 aa, Staphylococcus
KVFSGKYARGIHNEFID

SEQ ID NO: 2024472 - protein, 31 aa, Staphylococcus
KVFYKEGFVQTGRAYFKLTVHGKGGHGSSPH

SEQ ID NO: 2024473 - protein, 20 aa, Staphylococcus
KVFYKEGYVQTGRAYFKLVV

SEQ ID NO: 2024474 - protein, 18 aa, Staphylococcus
KVFYREGFVQTGRAYFKL

SEQ ID NO: 2024475 - protein, 23 aa, Staphylococcus
KVGDEIVIRFGQRVVTIKVTGLN

SEQ ID NO: 2024476 - protein, 17 aa, Staphylococcus
KVGDKVTITAGHMPGMK

SEQ ID NO: 2024477 - protein, 19 aa, Staphylococcus
KVGFKKVLVGVYGKDGQTV

SEQ ID NO: 2024478 - protein, 18 aa, Staphylococcus
KVGNALPLQDIPVGTVIH

SEQ ID NO: 2024479 - protein, 19 aa, Staphylococcus
KVGNALPLQNIPVGTIIHN

SEQ ID NO: 2024480 - protein, 19 aa, Staphylococcus
KVGNALPLQNIPVGTVIHN

SEQ ID NO: 2024481 - protein, 18 aa, Staphylococcus
KVGNDWNAMMEEMASYRP

SEQ ID NO: 2024482 - protein, 19 aa, Staphylococcus
KVGNGPLLILIPGANGTGD

SEQ ID NO: 2024483 - protein, 22 aa, Staphylococcus
KVHGPNHPFLIQLQDLYRQYRD

SEQ ID NO: 2024484 - protein, 19 aa, Staphylococcus
KVHIKFRVNDRLETYEIFS

SEQ ID NO: 2024485 - protein, 24 aa, Staphylococcus
KVHIRARYGVILATGGFGANTKML

SEQ ID NO: 2024486 - protein, 17 aa, Staphylococcus
KVHLKGVSKTGLGPFAF

SEQ ID NO: 2024487 - protein, 18 aa, Staphylococcus
KVHYKKAKSISVSSFTDM

SEQ ID NO: 2024488 - protein, 19 aa, Staphylococcus
KVIAEHLVTLNISRVGLYL

SEQ ID NO: 2024489 - protein, 18 aa, Staphylococcus
KVIARAGVGVDNINIEAA

SEQ ID NO: 2024490 - protein, 23 aa, Staphylococcus
KVIDEMADRFVVIADENKVVNYL

SEQ ID NO: 2024491 - protein, 22 aa, Staphylococcus
KVIDEMAEKFVVIADENKIVDY

SEQ ID NO: 2024492 - protein, 22 aa, Staphylococcus
KVIDEMAHRFVVLADESKLVNY

SEQ ID NO: 2024493 - protein, 23 aa, Staphylococcus
KVIDTRAVFKLGGIGLAFKKGKF

SEQ ID NO: 2024494 - protein, 26 aa, Staphylococcus
KVIEIKGSELVRGRGGPRCMSQPLFR

SEQ ID NO: 2024495 - protein, 26 aa, Staphylococcus
KVIEIRGSELVRGRGGPRCMSQPLYR

SEQ ID NO: 2024496 - protein, 28 aa, Staphylococcus
KVIEQSECKRAIILPNNKNILMASEQAA

SEQ ID NO: 2024497 - protein, 25 aa, Staphylococcus
KVIEQSECQRAIILPNNKNIRMSSD

SEQ ID NO: 2024498 - protein, 26 aa, Staphylococcus
KVIERFKEVFQIFSDVLGIPLKGKQQ

SEQ ID NO: 2024499 - protein, 20 aa, Staphylococcus
KVIHTYDVEHRWTIEYKATS

SEQ ID NO: 2024500 - protein, 26 aa, Staphylococcus
KVIIFPKRGAAILLNKIRIINTPGYI

SEQ ID NO: 2024501 - protein, 18 aa, Staphylococcus
KVIIRDMAKRAAAKQTKW

SEQ ID NO: 2024502 - protein, 22 aa, Staphylococcus
KVIIVTTFKRPGYFERAVANDV

SEQ ID NO: 2024503 - protein, 27 aa, Staphylococcus
KVILEYGESAPKIFRKVTDLVKEQVKY

SEQ ID NO: 2024504 - protein, 17 aa, Staphylococcus
KVILPLEGLIDMDKEIE

SEQ ID NO: 2024505 - protein, 21 aa, Staphylococcus
KVISLILKIGIMTKLTMNTFL

SEQ ID NO: 2024506 - protein, 28 aa, Staphylococcus
KVIVAGGAWSTQLLKDYAIPRQVIGVKG

SEQ ID NO: 2024507 - protein, 18 aa, Staphylococcus
KVIYEKAKSINISSFTEM

SEQ ID NO: 2024508 - protein, 22 aa, Staphylococcus
KVKDDGIYCFSEDPTDGLEEVG

SEQ ID NO: 2024509 - protein, 21 aa, Staphylococcus
KVKDDGIYCYSDDPTDGLEEV

SEQ ID NO: 2024510 - protein, 19 aa, Staphylococcus
KVKDDGIYCYTDKSTEGLK

SEQ ID NO: 2024511 - protein, 20 aa, Staphylococcus
KVKDELRYLATLKGMPRIDF

SEQ ID NO: 2024512 - protein, 22 aa, Staphylococcus
KVKDFIETLPFELTDAQKKSVN

SEQ ID NO: 2024513 - protein, 31 aa, Staphylococcus
KVKDYTLEELLKFDFGVKHDKSFQNTKISTF

SEQ ID NO: 2024514 - protein, 22 aa, Staphylococcus
KVKEALKLVKLEGYEYRNIDEM

SEQ ID NO: 2024515 - protein, 19 aa, Staphylococcus
KVKEYIFKKIKNHSLKPGD

SEQ ID NO: 2024516 - protein, 18 aa, Staphylococcus
KVKEYILKQIKEQSLKPG

SEQ ID NO: 2024517 - protein, 25 aa, Staphylococcus
KVKFEKEYICLAYGRTQSEGVIEAP

SEQ ID NO: 2024518 - protein, 17 aa, Staphylococcus
KVKGAFEKFDVNVEGDI

SEQ ID NO: 2024519 - protein, 24 aa, Staphylococcus
KVKGELGQNIPLFINGEKIDKSDK

SEQ ID NO: 2024520 - protein, 21 aa, Staphylococcus
KVKHQYGHAFFESASDQDIFT

SEQ ID NO: 2024521 - protein, 27 aa, Staphylococcus
KVKIPSFKGEIVFKINGPLPFLQLVYF

SEQ ID NO: 2024522 - protein, 25 aa, Staphylococcus
KVKKLHLPQGFNIRVDSLLYPGYQV

SEQ ID NO: 2024523 - protein, 25 aa, Staphylococcus
KVKKLHLPQGFNIRVDSLLYSGYQV

SEQ ID NO: 2024524 - protein, 26 aa, Staphylococcus
KVKKNIGMIFQHFNLLNSKTVFSNVA

SEQ ID NO: 2024525 - protein, 26 aa, Staphylococcus
KVKLIKRLSFASGHLGMVGGQTLDMQ

SEQ ID NO: 2024526 - protein, 18 aa, Staphylococcus
KVKLKGLRKQYEISEHSS

SEQ ID NO: 2024527 - protein, 20 aa, Staphylococcus
KVKNGFLEKGYQVYFDSPTN

SEQ ID NO: 2024528 - protein, 17 aa, Staphylococcus
KVKNRKIDIAVIAEKGF

SEQ ID NO: 2024529 - protein, 21 aa, Staphylococcus
KVKPENIVLIGMRDLDEGERK

SEQ ID NO: 2024530 - protein, 22 aa, Staphylococcus
KVKPENIVLIGMRDLDVGERQY

SEQ ID NO: 2024531 - protein, 19 aa, Staphylococcus
KVKPGDFFYVPAGTVHAIG

SEQ ID NO: 2024532 - protein, 19 aa, Staphylococcus
KVKPGDFYFIPAGTIHSIG

SEQ ID NO: 2024533 - protein, 19 aa, Staphylococcus
KVKPYKLGFGPFAPEVYQA

SEQ ID NO: 2024534 - protein, 24 aa, Staphylococcus
KVKRLQENPLVIAMDKRHPLASKT

SEQ ID NO: 2024535 - protein, 20 aa, Staphylococcus
KVKRYLQGRKTRLVGPNCPG

SEQ ID NO: 2024536 - protein, 24 aa, Staphylococcus
KVKSASGRLGIYFTESGYAQRANR

SEQ ID NO: 2024537 - protein, 24 aa, Staphylococcus
KVKSREILDELGILKDGVFTHAID

SEQ ID NO: 2024538 - protein, 21 aa, Staphylococcus
KVKVLKSLHPLGAEDVRTNFV

SEQ ID NO: 2024539 - protein, 25 aa, Staphylococcus
KVKYSECLVSLGIGSKAEHLFYESI

SEQ ID NO: 2024540 - protein, 18 aa, Staphylococcus
KVKYWIFTTLDKVRKKIK

SEQ ID NO: 2024541 - protein, 18 aa, Staphylococcus
KVKYWLFTTLDRIRRKVK

SEQ ID NO: 2024542 - protein, 19 aa, Staphylococcus
KVLDHDPWLLSDMQKAIDR

SEQ ID NO: 2024543 - protein, 20 aa, Staphylococcus
KVLDTDFSFQTMKRLAAESD

SEQ ID NO: 2024544 - protein, 17 aa, Staphylococcus
KVLEFKPDVLLMDLSMP

SEQ ID NO: 2024545 - protein, 22 aa, Staphylococcus
KVLEGLEFMGIYWDPKKNETIR

SEQ ID NO: 2024546 - protein, 23 aa, Staphylococcus
KVLESKPGIKMLGASMAGLHDDV

SEQ ID NO: 2024547 - protein, 17 aa, Staphylococcus
KVLETGADFGLAFDGDG

SEQ ID NO: 2024548 - protein, 26 aa, Staphylococcus
KVLHPQLKICACLGLTNEEQAEKLKE

SEQ ID NO: 2024549 - protein, 27 aa, Staphylococcus
KVLIYRLPNLFGKWCKPNYNSVIATFC

SEQ ID NO: 2024550 - protein, 23 aa, Staphylococcus
KVLKEKYPNIEIVAIEPEASPVL

SEQ ID NO: 2024551 - protein, 23 aa, Staphylococcus
KVLKENYPDINLVAIEPEDSPVL

SEQ ID NO: 2024552 - protein, 18 aa, Staphylococcus
KVLKLKLFTGEKGLNKTI

SEQ ID NO: 2024553 - protein, 17 aa, Staphylococcus
KVLKRKNLLNMYQEFLR

SEQ ID NO: 2024554 - protein, 31 aa, Staphylococcus
KVLKSHVIVYKFKHPIPWKQHDVKLVFFLAI

SEQ ID NO: 2024555 - protein, 19 aa, Staphylococcus
KVLLCDEATSALDPQTTDE

SEQ ID NO: 2024556 - protein, 24 aa, Staphylococcus
KVLLGHLHHPFSIKDDIIDYSGSL

SEQ ID NO: 2024557 - protein, 18 aa, Staphylococcus
KVLLNVLFEKCIIDKKIV

SEQ ID NO: 2024558 - protein, 19 aa, Staphylococcus
KVLLPGAHVVFEIGYNQGQ

SEQ ID NO: 2024559 - protein, 30 aa, Staphylococcus
KVLMFGGGGYNIWRVVPRAWSHVFLSLIGE

SEQ ID NO: 2024560 - protein, 24 aa, Staphylococcus
KVLNHGIVSYGYRVEAPTTPGKIN

SEQ ID NO: 2024561 - protein, 18 aa, Staphylococcus
KVLPDLFYPELISVGNNS

SEQ ID NO: 2024562 - protein, 32 aa, Staphylococcus
KVLQFYVRYGGEFQLKQGFSPAFRVENEDDID

SEQ ID NO: 2024563 - protein, 23 aa, Staphylococcus
KVLSCKINGLDIADFTNLPIDEA

SEQ ID NO: 2024564 - protein, 23 aa, Staphylococcus
KVLSCKINGLNIAEFTDLPIDEA

SEQ ID NO: 2024565 - protein, 33 aa, Staphylococcus
KVLSCKSKRDYLFFKFAIHTGVKLSELLNLCVS

SEQ ID NO: 2024566 - protein, 20 aa, Staphylococcus
KVLWDKGYIDGDWDGEKVDN

SEQ ID NO: 2024567 - protein, 23 aa, Staphylococcus
KVLYKAIKGVGAFENETPLPTVV

SEQ ID NO: 2024568 - protein, 20 aa, Staphylococcus
KVMAKMGISTVQSYQGAQIF

SEQ ID NO: 2024569 - protein, 17 aa, Staphylococcus
KVMFSRQDTILNAYGLT

SEQ ID NO: 2024570 - protein, 19 aa, Staphylococcus
KVMIPGFERQVVDTTGAGD

SEQ ID NO: 2024571 - protein, 17 aa, Staphylococcus
KVMKCYHKINQKYKKNK

SEQ ID NO: 2024572 - protein, 26 aa, Staphylococcus
KVMMFGGGGYNIWKVVPRAWSHVFLA

SEQ ID NO: 2024573 - protein, 34 aa, Staphylococcus
KVMMFGGGGYNIWRVVPRAWSHVFLSLMDQPIQH

SEQ ID NO: 2024574 - protein, 25 aa, Staphylococcus
KVNADRLLDFKARLSEELKDADQDV

SEQ ID NO: 2024575 - protein, 24 aa, Staphylococcus
KVNAELGLAIGVLTGIAKKEELVD

SEQ ID NO: 2024576 - protein, 34 aa, Staphylococcus
KVNARNAYDVVYEWKDFMNQIGIFDNQMLCLIAD

SEQ ID NO: 2024577 - protein, 23 aa, Staphylococcus
KVNDIEAVYKLSQNRSKQEKVNI

SEQ ID NO: 2024578 - protein, 20 aa, Staphylococcus
KVNEAMKLFSEDRFNVDVLK

SEQ ID NO: 2024579 - protein, 25 aa, Staphylococcus
KVNEAMKLFSQERFNVDVLKVEVPV

SEQ ID NO: 2024580 - protein, 22 aa, Staphylococcus
KVNELLVTTSIFKNVFNLTHYA

SEQ ID NO: 2024581 - protein, 30 aa, Staphylococcus
KVNFYGGPYAERKRAIIAPSYYEAQVEDFE

SEQ ID NO: 2024582 - protein, 22 aa, Staphylococcus
KVNGLHLPQGFNVRVDSLLYPG

SEQ ID NO: 2024583 - protein, 21 aa, Staphylococcus
KVNIPSIKVLNPVGSGDSTVA

SEQ ID NO: 2024584 - protein, 21 aa, Staphylococcus
KVNLAELFVAFSEERSDGRLF

SEQ ID NO: 2024585 - protein, 18 aa, Staphylococcus
KVNLIELNSAKQLFMNGP

SEQ ID NO: 2024586 - protein, 19 aa, Staphylococcus
KVNLLDFRKTMDYLEGIGL

SEQ ID NO: 2024587 - protein, 24 aa, Staphylococcus
KVNNCVTIEPGIYVDGLGGVRIED

SEQ ID NO: 2024588 - protein, 18 aa, Staphylococcus
KVNPHLQTTVPHIYAAGD

SEQ ID NO: 2024589 - protein, 25 aa, Staphylococcus
KVNPSFKLESMFDGYDDLMELVFNT

SEQ ID NO: 2024590 - protein, 18 aa, Staphylococcus
KVNPSWLNFYGHNVNSEW

SEQ ID NO: 2024591 - protein, 19 aa, Staphylococcus
KVNWGKTRIYNMIRDRGEW

SEQ ID NO: 2024592 - protein, 20 aa, Staphylococcus
KVNYHLSGYGIYYNEALASF

SEQ ID NO: 2024593 - protein, 23 aa, Staphylococcus
KVPEFARALKIPQIAVSLGGIQT

SEQ ID NO: 2024594 - protein, 27 aa, Staphylococcus
KVPGYERDRLPILLNKQGEIVAVGTLF

SEQ ID NO: 2024595 - protein, 20 aa, Staphylococcus
KVPKAVVYFRYKVFCERGGY

SEQ ID NO: 2024596 - protein, 23 aa, Staphylococcus
KVPKEKRKILSTSEIKELIKASN

SEQ ID NO: 2024597 - protein, 26 aa, Staphylococcus
KVPKLPYTLCYISRGFVTDYSNKLAL

SEQ ID NO: 2024598 - protein, 26 aa, Staphylococcus
KVPKLPYTLCYVSRGFVADYNDKPVL

SEQ ID NO: 2024599 - protein, 25 aa, Staphylococcus
KVPLRREAIVLLGMIEDRQILPYIY

SEQ ID NO: 2024600 - protein, 25 aa, Staphylococcus
KVPMKIFPAVHYSMGGLYVDYDQNT

SEQ ID NO: 2024601 - protein, 23 aa, Staphylococcus
KVPTLKGHVMLSVPEGTQNGKQF

SEQ ID NO: 2024602 - protein, 20 aa, Staphylococcus
KVPYICLNGAEVRDESFDIM

SEQ ID NO: 2024603 - protein, 25 aa, Staphylococcus
KVQAKEILDALGILKNGIFTYDIDK

SEQ ID NO: 2024604 - protein, 21 aa, Staphylococcus
KVQFSDIEFLPPVTPPNNVIA

SEQ ID NO: 2024605 - protein, 21 aa, Staphylococcus
KVQFSDIEFLPPVTPTNNVIA

SEQ ID NO: 2024606 - protein, 20 aa, Staphylococcus
KVQKDWRNKVNFIRQMGYIE

SEQ ID NO: 2024607 - protein, 20 aa, Staphylococcus
KVQKDWRNKVNFIRQMGYLE

SEQ ID NO: 2024608 - protein, 20 aa, Staphylococcus
KVQKDWRNKVNFIRQMGYVE

SEQ ID NO: 2024609 - protein, 23 aa, Staphylococcus
KVQKIIERSCKFYGNNYLSKKAE

SEQ ID NO: 2024610 - protein, 23 aa, Staphylococcus
KVQRIGIRMADLLEKETFERRLK

SEQ ID NO: 2024611 - protein, 18 aa, Staphylococcus
KVQRIIERSCKFYGNSYL

SEQ ID NO: 2024612 - protein, 25 aa, Staphylococcus
KVQRVKFEKVFAEHFMKLYDKTKNM

SEQ ID NO: 2024613 - protein, 20 aa, Staphylococcus
KVRDILKFNGTVVSLQNGIP

SEQ ID NO: 2024614 - protein, 18 aa, Staphylococcus
KVRITNLLLNPKKCLQKS

SEQ ID NO: 2024615 - protein, 22 aa, Staphylococcus
KVRNNFYGFSFQDIDGHYFNII

SEQ ID NO: 2024616 - protein, 23 aa, Staphylococcus
KVRRAKLYYLRNLRGKAARIQEI

SEQ ID NO: 2024617 - protein, 24 aa, Staphylococcus
KVRYRLCPCKIKYDEERLSSQLIT

SEQ ID NO: 2024618 - protein, 19 aa, Staphylococcus
KVSAMDFIFKDDPNQLKTR

SEQ ID NO: 2024619 - protein, 23 aa, Staphylococcus
KVSATCPFAKSVIEKHDEYQDVY

SEQ ID NO: 2024620 - protein, 18 aa, Staphylococcus
KVSAYRKAAQSLEIDERP

SEQ ID NO: 2024621 - protein, 18 aa, Staphylococcus
KVSDLGVHCTVVGGAITR

SEQ ID NO: 2024622 - protein, 24 aa, Staphylococcus
KVSEMDAFGSIYFVNLYSNITTPI

SEQ ID NO: 2024623 - protein, 17 aa, Staphylococcus
KVSEPMGHRVHDIKVEG

SEQ ID NO: 2024624 - protein, 20 aa, Staphylococcus
KVSETRANLVAEIGSGSPIL

SEQ ID NO: 2024625 - protein, 18 aa, Staphylococcus
KVSEWIKEGLEIHNMQSK

SEQ ID NO: 2024626 - protein, 18 aa, Staphylococcus
KVSGFTLDNSYFVSGLTK

SEQ ID NO: 2024627 - protein, 19 aa, Staphylococcus
KVSHLFKIKVSPMEITFIP

SEQ ID NO: 2024628 - protein, 23 aa, Staphylococcus
KVSKDARFKIGITAQDLTRNEEV

SEQ ID NO: 2024629 - protein, 22 aa, Staphylococcus
KVSKKLGKTIGILLDTKGPEIR

SEQ ID NO: 2024630 - protein, 26 aa, Staphylococcus
KVSKPVTCKMRIGWDEDHIYAVENAK

SEQ ID NO: 2024631 - protein, 17 aa, Staphylococcus
KVSLLNIGTEAAKGNTL

SEQ ID NO: 2024632 - protein, 25 aa, Staphylococcus
KVSMRSEIPLARGLGSSASALVGAL

SEQ ID NO: 2024633 - protein, 19 aa, Staphylococcus
KVSPTHYVKSWLLDERAPK

SEQ ID NO: 2024634 - protein, 21 aa, Staphylococcus
KVSQLAFRPDIAIDANESLSK

SEQ ID NO: 2024635 - protein, 18 aa, Staphylococcus
KVSVLKFRQENHLSYRET

SEQ ID NO: 2024636 - protein, 19 aa, Staphylococcus
KVTCGKGTYIRTLATDIGK

SEQ ID NO: 2024637 - protein, 23 aa, Staphylococcus
KVTHTYDADHRWTIQYEAESTKR

SEQ ID NO: 2024638 - protein, 19 aa, Staphylococcus
KVTILRAAVLTPYMNDKEK

SEQ ID NO: 2024639 - protein, 19 aa, Staphylococcus
KVTPDLFYPELISIGDNCV

SEQ ID NO: 2024640 - protein, 18 aa, Staphylococcus
KVTYEVMEGGGKIVENLT

SEQ ID NO: 2024641 - protein, 29 aa, Staphylococcus
KVVEDYTVLRGFKPFYIEHGAFSGALGSV

SEQ ID NO: 2024642 - protein, 18 aa, Staphylococcus
KVVGHAVAMGNATDDLKA

SEQ ID NO: 2024643 - protein, 23 aa, Staphylococcus
KVVKKTFPGYVLVELIMTDESWY

SEQ ID NO: 2024644 - protein, 23 aa, Staphylococcus
KVVKQRATALVNECMAVNPDYQI

SEQ ID NO: 2024645 - protein, 18 aa, Staphylococcus
KVVKRLSQEMSIGVITND

SEQ ID NO: 2024646 - protein, 19 aa, Staphylococcus
KVVLAKWIATAPHVLILDE

SEQ ID NO: 2024647 - protein, 19 aa, Staphylococcus
KVVLKEHLHKVTFVHNNFR

SEQ ID NO: 2024648 - protein, 19 aa, Staphylococcus
KVVLLCGSGIGTSQLLKNK

SEQ ID NO: 2024649 - protein, 18 aa, Staphylococcus
KVVNVKAKHAIKVTQTNI

SEQ ID NO: 2024650 - protein, 24 aa, Staphylococcus
KVWILKEYLLINGQIYTESQKIEQ

SEQ ID NO: 2024651 - protein, 17 aa, Staphylococcus
KVYEDDYVYAFLDISQV

SEQ ID NO: 2024652 - protein, 30 aa, Staphylococcus
KVYEREMRKVFGHSQFDYAIDFSGYSMFWA

SEQ ID NO: 2024653 - protein, 17 aa, Staphylococcus
KVYGEWKALLAGDALLT

SEQ ID NO: 2024654 - protein, 18 aa, Staphylococcus
KVYHCICNGKLENTSKIV

SEQ ID NO: 2024655 - protein, 19 aa, Staphylococcus
KVYKEGKPNFIFLNTQYLV

SEQ ID NO: 2024656 - protein, 22 aa, Staphylococcus
KVYLELWVKVQRDWRNKVNFIR

SEQ ID NO: 2024657 - protein, 27 aa, Staphylococcus
KVYLKREDLQWVRSFKLRGAYNAIIAL

SEQ ID NO: 2024658 - protein, 26 aa, Staphylococcus
KVYLKREDLQWVRSFKLRGAYNAISV

SEQ ID NO: 2024659 - protein, 23 aa, Staphylococcus
KVYPNDRIVLLTFNKAVNQDMIS

SEQ ID NO: 2024660 - protein, 22 aa, Staphylococcus
KVYRGMGSLGAMERGSNDRYFQ

SEQ ID NO: 2024661 - protein, 23 aa, Staphylococcus
KVYRGMGSLGAMERGSNDRYFQE

SEQ ID NO: 2024662 - protein, 25 aa, Staphylococcus
KVYWKNEYYYGFGAGASGYVDGVRY

SEQ ID NO: 2024663 - protein, 31 aa, Staphylococcus
KWAVEEMEKRYKLFAQYHVRNITAFNKKAPY

SEQ ID NO: 2024664 - protein, 20 aa, Staphylococcus
KWCKNKFQVTNQVSVEDTYK

SEQ ID NO: 2024665 - protein, 29 aa, Staphylococcus
KWELEDIALRYIDSVQYFRIVNLMKKKRS

SEQ ID NO: 2024666 - protein, 18 aa, Staphylococcus
KWEMSPSELMAFGDANND

SEQ ID NO: 2024667 - protein, 19 aa, Staphylococcus
KWIIHIAYDKFIIMANYDV

SEQ ID NO: 2024668 - protein, 23 aa, Staphylococcus
KWIKNKIGFVYSEVYFNQQWTAK

SEQ ID NO: 2024669 - protein, 19 aa, Staphylococcus
KWIREVRDIDMYPNHASIH

SEQ ID NO: 2024670 - protein, 20 aa, Staphylococcus
KWIVDHWVTHYGLAQTHRIG

SEQ ID NO: 2024671 - protein, 25 aa, Staphylococcus
KWLARFDWCKPKSIHFKSAYHILDM

SEQ ID NO: 2024672 - protein, 25 aa, Staphylococcus
KWLENRNAPTWKRSKSVVFGNYKVK

SEQ ID NO: 2024673 - protein, 20 aa, Staphylococcus
KWLMDAGLHRPFYIEKILLG

SEQ ID NO: 2024674 - protein, 20 aa, Staphylococcus
KWLVDHWVTHYGLEQTEAIA

SEQ ID NO: 2024675 - protein, 19 aa, Staphylococcus
KWLVNHWVTHYGLVTTEEI

SEQ ID NO: 2024676 - protein, 19 aa, Staphylococcus
KWLYYGEMTIDEWAEMSIE

SEQ ID NO: 2024677 - protein, 25 aa, Staphylococcus
KWNIIRPPFNVTRLSEYAAVAALED

SEQ ID NO: 2024678 - protein, 20 aa, Staphylococcus
KWNRELEALYHIKSQLNSST

SEQ ID NO: 2024679 - protein, 19 aa, Staphylococcus
KWNVPDIEPDYLLEYQNVK

SEQ ID NO: 2024680 - protein, 24 aa, Staphylococcus
KWRFIEARLDELMEVYNYQEIRTP

SEQ ID NO: 2024681 - protein, 18 aa, Staphylococcus
KWSAEDEFATFVKTVHIN

SEQ ID NO: 2024682 - protein, 20 aa, Staphylococcus
KWTEQYDIWFSIYSTPSESL

SEQ ID NO: 2024683 - protein, 20 aa, Staphylococcus
KWTKIRKQIRLKRTKIKKYK

SEQ ID NO: 2024684 - protein, 26 aa, Staphylococcus
KWVAEASIDWYTYNIISLREQKVGNA

SEQ ID NO: 2024685 - protein, 25 aa, Staphylococcus
KWVYKRMPTLNSWKLDMAYQQFMHK

SEQ ID NO: 2024686 - protein, 19 aa, Staphylococcus
KWYAEKDFASLLHEDLKIR

SEQ ID NO: 2024687 - protein, 19 aa, Staphylococcus
KWYFPLQPFQKFIVPFIFL

SEQ ID NO: 2024688 - protein, 27 aa, Staphylococcus
KWYINSFKYFRNMYKAFYYSQPDQLDK

SEQ ID NO: 2024689 - protein, 26 aa, Staphylococcus
KWYINSFKYFRNMYKNFYYSRPDELD

SEQ ID NO: 2024690 - protein, 18 aa, Staphylococcus
KYAGLDRFECRKQLVEDL

SEQ ID NO: 2024691 - protein, 21 aa, Staphylococcus
KYAGLRFDEDVVFCEEHTFIV

SEQ ID NO: 2024692 - protein, 27 aa, Staphylococcus
KYAGQERLKLIHQWVDGRIPVIGVGSV

SEQ ID NO: 2024693 - protein, 22 aa, Staphylococcus
KYARLLKRIHGLEKMRFEDLKI

SEQ ID NO: 2024694 - protein, 23 aa, Staphylococcus
KYASRELKMLFSQVEEEMVDTFI

SEQ ID NO: 2024695 - protein, 24 aa, Staphylococcus
KYASRELKMLFSQVEEEMVENFIK

SEQ ID NO: 2024696 - protein, 17 aa, Staphylococcus
KYAYSFDKKQGCLKSVL

SEQ ID NO: 2024697 - protein, 17 aa, Staphylococcus
KYDATWTDLPVKFEAGT

SEQ ID NO: 2024698 - protein, 20 aa, Staphylococcus
KYDAVYFTGGHGVMYDFPEN

SEQ ID NO: 2024699 - protein, 40 aa, Staphylococcus
KYDDIRTAMRMILPRKWTLSYLVDYFMKWLNDTRGTFMHT

SEQ ID NO: 2024700 - protein, 17 aa, Staphylococcus
KYDDVRSALSIQLPMNW

SEQ ID NO: 2024701 - protein, 25 aa, Staphylococcus
KYDDVRTAMKMVLPKKWTLNQLVDY

SEQ ID NO: 2024702 - protein, 22 aa, Staphylococcus
KYDGCPVHSGLGPVIGSGKFSP

SEQ ID NO: 2024703 - protein, 25 aa, Staphylococcus
KYDHYRFGIHIALHYLSFKKRTEKE

SEQ ID NO: 2024704 - protein, 26 aa, Staphylococcus
KYDLFKFNNAFIIGLKYKSGFIRGFN

SEQ ID NO: 2024705 - protein, 25 aa, Staphylococcus
KYDLLKLLIRKLIFRVREKHFSTLN

SEQ ID NO: 2024706 - protein, 21 aa, Staphylococcus
KYDLVYKYQIEIMKKIQPILE

SEQ ID NO: 2024707 - protein, 17 aa, Staphylococcus
KYDRLNNIISFEQHKTW

SEQ ID NO: 2024708 - protein, 25 aa, Staphylococcus
KYEDGFAELHFTYDYTAENTKTTSG

SEQ ID NO: 2024709 - protein, 25 aa, Staphylococcus
KYEHFRFGLHLAIQYLSYRKRTEQE

SEQ ID NO: 2024710 - protein, 25 aa, Staphylococcus
KYEHYRLGINMAIQYLSYKKRTEKE

SEQ ID NO: 2024711 - protein, 23 aa, Staphylococcus
KYERISDNILSYFTKITTLDHEF

SEQ ID NO: 2024712 - protein, 22 aa, Staphylococcus
KYESALSRYEFDGPIIYINHQH

SEQ ID NO: 2024713 - protein, 18 aa, Staphylococcus
KYEWLLQHFPFLDPQHFV

SEQ ID NO: 2024714 - protein, 19 aa, Staphylococcus
KYFERYNFKSIGKVGKDNE

SEQ ID NO: 2024715 - protein, 17 aa, Staphylococcus
KYFHSYVAGATISTVKF

SEQ ID NO: 2024716 - protein, 23 aa, Staphylococcus
KYFNEVTEALGISELADKYPSEI

SEQ ID NO: 2024717 - protein, 22 aa, Staphylococcus
KYFRKEDKPGVIINTASVHDTI

SEQ ID NO: 2024718 - protein, 28 aa, Staphylococcus
KYFSSHTDYRFMGIAFDLLSYALQYTFS

SEQ ID NO: 2024719 - protein, 19 aa, Staphylococcus
KYFTENYFIFGGYEPMIYI

SEQ ID NO: 2024720 - protein, 26 aa, Staphylococcus
KYGKRIFRLYRNCFYYKEIDKEIQNI

SEQ ID NO: 2024721 - protein, 30 aa, Staphylococcus
KYGKSIAQVVLRWLVERDIVVLAKSVNPER

SEQ ID NO: 2024722 - protein, 17 aa, Staphylococcus
KYGLGIDYFDLEQNVTY

SEQ ID NO: 2024723 - protein, 32 aa, Staphylococcus
KYGNATNHWYEWLKHNLTLEGYHVTLFNLEAD

SEQ ID NO: 2024724 - protein, 31 aa, Staphylococcus
KYGNEAFLNFVAKDKKAFVLFKVESHQDEIN

SEQ ID NO: 2024725 - protein, 25 aa, Staphylococcus
KYGVGRRISLHYTRQMVNQAISGKL

SEQ ID NO: 2024726 - protein, 26 aa, Staphylococcus
KYGVGRRISLHYTRQMVNQAISGKLK

SEQ ID NO: 2024727 - protein, 25 aa, Staphylococcus
KYGVGRRISLHYTRQMVNQAITGQL

SEQ ID NO: 2024728 - protein, 26 aa, Staphylococcus
KYGVGRRISLHYTRYMVDQAIKGKLK

SEQ ID NO: 2024729 - protein, 26 aa, Staphylococcus
KYGVGRRISLHYTRYMVDQAISGKLK

SEQ ID NO: 2024730 - protein, 28 aa, Staphylococcus
KYGVGRRISLKYTRRMVDAAIKGELKNA

SEQ ID NO: 2024731 - protein, 26 aa, Staphylococcus
KYGVGRRISLNYTRQMVNQAITGKLR

SEQ ID NO: 2024732 - protein, 17 aa, Staphylococcus
KYGYDYQTMAVLTAIDE

SEQ ID NO: 2024733 - protein, 22 aa, Staphylococcus
KYHMVKQLYSPVQFIKSTEWLI

SEQ ID NO: 2024734 - protein, 21 aa, Staphylococcus
KYIAEIQMKLESFKQEGKIDY

SEQ ID NO: 2024735 - protein, 17 aa, Staphylococcus
KYICLAGLAFNFMCFQD

SEQ ID NO: 2024736 - protein, 23 aa, Staphylococcus
KYIDLRLITRLTFTESQINVYKT

SEQ ID NO: 2024737 - protein, 24 aa, Staphylococcus
KYIKEFLDKLGVEYDCPLETGAIA

SEQ ID NO: 2024738 - protein, 25 aa, Staphylococcus
KYIKGPDFPTGGIIQGVDGIKKAYE

SEQ ID NO: 2024739 - protein, 21 aa, Staphylococcus
KYIKKGVLYPLSYYDGDWYGK

SEQ ID NO: 2024740 - protein, 17 aa, Staphylococcus
KYIKYASDDVMCRRIYK

SEQ ID NO: 2024741 - protein, 17 aa, Staphylococcus
KYILPGMIDSHVHIIEE

SEQ ID NO: 2024742 - protein, 18 aa, Staphylococcus
KYINICLELEQVEQHFEF

SEQ ID NO: 2024743 - protein, 20 aa, Staphylococcus
KYIPNERIKVYVNKVEQTTK

SEQ ID NO: 2024744 - protein, 20 aa, Staphylococcus
KYIVTWALGHLVTNATPEQY

SEQ ID NO: 2024745 - protein, 17 aa, Staphylococcus
KYKEMYQLFDIYEASFE

SEQ ID NO: 2024746 - protein, 17 aa, Staphylococcus
KYKEYFGSASEFQKGEH

SEQ ID NO: 2024747 - protein, 20 aa, Staphylococcus
KYKFNAEAFAKMKTDAIFIN

SEQ ID NO: 2024748 - protein, 22 aa, Staphylococcus
KYKGLNYIVDFARILKKNKQNV

SEQ ID NO: 2024749 - protein, 30 aa, Staphylococcus
KYKHPLADETLRFADSWLVTTKFKLPKWMY

SEQ ID NO: 2024750 - protein, 19 aa, Staphylococcus
KYKKAFRNMIALDREVMIM

SEQ ID NO: 2024751 - protein, 18 aa, Staphylococcus
KYKKRAVLEDSFVINMTP

SEQ ID NO: 2024752 - protein, 24 aa, Staphylococcus
KYKLFGLEQVRAIKERLFKKGLMK

SEQ ID NO: 2024753 - protein, 22 aa, Staphylococcus
KYKSYWKLFLKPFETLEAFNYH

SEQ ID NO: 2024754 - protein, 22 aa, Staphylococcus
KYKSYWKLFLKPFETLEAFNYR

SEQ ID NO: 2024755 - protein, 18 aa, Staphylococcus
KYKYSLYEKQEQPLPGLQ

SEQ ID NO: 2024756 - protein, 17 aa, Staphylococcus
KYLKDQKQLLLVTNNLY

SEQ ID NO: 2024757 - protein, 21 aa, Staphylococcus
KYLKDSLEKLGFNTGESETPI

SEQ ID NO: 2024758 - protein, 26 aa, Staphylococcus
KYLKKYFALDYKRVFGNLDPDIMIDY

SEQ ID NO: 2024759 - protein, 21 aa, Staphylococcus
KYLPLLHRYTRLRQELLGIDD

SEQ ID NO: 2024760 - protein, 28 aa, Staphylococcus
KYLPNEAGALYFREGFITELMPKTDRSY

SEQ ID NO: 2024761 - protein, 28 aa, Staphylococcus
KYLQDVPGFKALRFLRPQTKHRHYIILT

SEQ ID NO: 2024762 - protein, 23 aa, Staphylococcus
KYLRPETLFGTKFEGYLNQQPQP

SEQ ID NO: 2024763 - protein, 22 aa, Staphylococcus
KYMDFTEIVPISALEGLNVDHF

SEQ ID NO: 2024764 - protein, 26 aa, Staphylococcus
KYMFKSEAYRYLAIGQIENIARITNE

SEQ ID NO: 2024765 - protein, 25 aa, Staphylococcus
KYMKGPDFPTGGIIQGLDGIKKAYE

SEQ ID NO: 2024766 - protein, 18 aa, Staphylococcus
KYMNCVFTQFHSRLDALN

SEQ ID NO: 2024767 - protein, 40 aa, Staphylococcus
KYNDIRTALRMILPRKWSLEQLVAYFFKWLNDTRGTFLHT

SEQ ID NO: 2024768 - protein, 18 aa, Staphylococcus
KYNFDMSVIPSKLPGLEH

SEQ ID NO: 2024769 - protein, 19 aa, Staphylococcus
KYNGLKPSQIIDMKGLMGD

SEQ ID NO: 2024770 - protein, 20 aa, Staphylococcus
KYNGLTMCSGSLGADRRNDF

SEQ ID NO: 2024771 - protein, 27 aa, Staphylococcus
KYNISYASKAFTCIQMVKLVQEEDLQL

SEQ ID NO: 2024772 - protein, 29 aa, Staphylococcus
KYNKKNIIFSPEFLREGNALYDNLYPTRI

SEQ ID NO: 2024773 - protein, 19 aa, Staphylococcus
KYNNEFFVYPAASSIHHNF

SEQ ID NO: 2024774 - protein, 21 aa, Staphylococcus
KYNNNIWNEWAFEKYVQSNDY

SEQ ID NO: 2024775 - protein, 18 aa, Staphylococcus
KYNVPVILFGVGASHLAD

SEQ ID NO: 2024776 - protein, 25 aa, Staphylococcus
KYNYDEFYQLLLIKLWQLSKNYNKN

SEQ ID NO: 2024777 - protein, 17 aa, Staphylococcus
KYPDAFDRFNVQDRALF

SEQ ID NO: 2024778 - protein, 17 aa, Staphylococcus
KYPDIAQGLILTGTGQY

SEQ ID NO: 2024779 - protein, 19 aa, Staphylococcus
KYPDISFSFYDKADNIPDN

SEQ ID NO: 2024780 - protein, 30 aa, Staphylococcus
KYPDMNRPTGLWLGEVVHFADVLYKNGYDI

SEQ ID NO: 2024781 - protein, 18 aa, Staphylococcus
KYPELTIVAGNVATAEAT

SEQ ID NO: 2024782 - protein, 19 aa, Staphylococcus
KYPEYTWDLTTIFENDEVF

SEQ ID NO: 2024783 - protein, 19 aa, Staphylococcus
KYPEYTWDLTTIFESDEAF

SEQ ID NO: 2024784 - protein, 20 aa, Staphylococcus
KYPEYTWDLTTIFPSDDAFE

SEQ ID NO: 2024785 - protein, 17 aa, Staphylococcus
KYPFIKNEEELMHILNR

SEQ ID NO: 2024786 - protein, 27 aa, Staphylococcus
KYPFKELPFYEIGWRLIPEVWGNGLAT

SEQ ID NO: 2024787 - protein, 17 aa, Staphylococcus
KYPKLDVKVIKDINGNE

SEQ ID NO: 2024788 - protein, 24 aa, Staphylococcus
KYPKQRLEQSVAIVGSGPAGLSAA

SEQ ID NO: 2024789 - protein, 17 aa, Staphylococcus
KYPLNLVGISNIKKFYI

SEQ ID NO: 2024790 - protein, 19 aa, Staphylococcus
KYPNCVLMGEGAKGSTLSI

SEQ ID NO: 2024791 - protein, 19 aa, Staphylococcus
KYPNETWDLTTIFESDEAF

SEQ ID NO: 2024792 - protein, 17 aa, Staphylococcus
KYPNGYRKIFDNLNIEI

SEQ ID NO: 2024793 - protein, 26 aa, Staphylococcus
KYPNLMFHFLPIAVRYDGQKADTEHG

SEQ ID NO: 2024794 - protein, 19 aa, Staphylococcus
KYPTEPILDILVGVENLHQ

SEQ ID NO: 2024795 - protein, 19 aa, Staphylococcus
KYPYIRGKLLDLWNTALEE

SEQ ID NO: 2024796 - protein, 18 aa, Staphylococcus
KYPYIRGKLLDLWTEALE

SEQ ID NO: 2024797 - protein, 18 aa, Staphylococcus
KYPYIRGKLLDLWTQALE

SEQ ID NO: 2024798 - protein, 18 aa, Staphylococcus
KYQFCLQLIIQEEVCVEI

SEQ ID NO: 2024799 - protein, 25 aa, Staphylococcus
KYQFEYGTDVPKIFDLAEEGNEEAL

SEQ ID NO: 2024800 - protein, 18 aa, Staphylococcus
KYQKAFEVLKGDDIPELL

SEQ ID NO: 2024801 - protein, 19 aa, Staphylococcus
KYQLDVCALNEYHETVDFL

SEQ ID NO: 2024802 - protein, 26 aa, Staphylococcus
KYQNKRPDYISAFWNVVNWEKVDELY

SEQ ID NO: 2024803 - protein, 17 aa, Staphylococcus
KYQSLSLNKYKGHIQTI

SEQ ID NO: 2024804 - protein, 18 aa, Staphylococcus
KYQVPLLMKFEVQGTQND

SEQ ID NO: 2024805 - protein, 25 aa, Staphylococcus
KYRDARIKLQLILKYLEKYSLKCFA

SEQ ID NO: 2024806 - protein, 34 aa, Staphylococcus
KYRDEKRPRFGLLRGREFIMKDAYSFHADEDSLD

SEQ ID NO: 2024807 - protein, 34 aa, Staphylococcus
KYRDEKRPRFGLLRGREFIMKDAYSFHADEESLD

SEQ ID NO: 2024808 - protein, 24 aa, Staphylococcus
KYRDGEIEGTIDLNQYFYKNRSQA

SEQ ID NO: 2024809 - protein, 25 aa, Staphylococcus
KYRHFAGSYAIQWTMINYAIDHGID

SEQ ID NO: 2024810 - protein, 24 aa, Staphylococcus
KYRHFAGSYAVQWTMINYAIDHGI

SEQ ID NO: 2024811 - protein, 25 aa, Staphylococcus
KYRHFAGSYAVQWTMINYAIEHGID

SEQ ID NO: 2024812 - protein, 25 aa, Staphylococcus
KYRHFAGSYAVQWTMINYALDHGID

SEQ ID NO: 2024813 - protein, 21 aa, Staphylococcus
KYRMPSLSGLSKVSPLLHRAK

SEQ ID NO: 2024814 - protein, 18 aa, Staphylococcus
KYRTIRNGVQISRVGRLN

SEQ ID NO: 2024815 - protein, 17 aa, Staphylococcus
KYSEARIPNSGLVDRFY

SEQ ID NO: 2024816 - protein, 20 aa, Staphylococcus
KYSGKMWLTHTGFAEDEQEY

SEQ ID NO: 2024817 - protein, 18 aa, Staphylococcus
KYSLGRALAHNEMLNALA

SEQ ID NO: 2024818 - protein, 18 aa, Staphylococcus
KYSNWLNQLFHGIEYRMQ

SEQ ID NO: 2024819 - protein, 21 aa, Staphylococcus
KYSRKDFLRIMNWEKDESSTV

SEQ ID NO: 2024820 - protein, 22 aa, Staphylococcus
KYSRSGLHKKVDFTEKINTNFF

SEQ ID NO: 2024821 - protein, 37 aa, Staphylococcus
KYTAPNFFLLERIRKAFPDKLILSGFDEMLVQAAVSG

SEQ ID NO: 2024822 - protein, 36 aa, Staphylococcus
KYTAPNFFLLERIRKAFPDKLILSGFDEMLVQAVIS

SEQ ID NO: 2024823 - protein, 26 aa, Staphylococcus
KYTGPDFPMLFKAFKDMGMVSNEVNI

SEQ ID NO: 2024824 - protein, 19 aa, Staphylococcus
KYTIAKFYKLYMERSNDGQ

SEQ ID NO: 2024825 - protein, 17 aa, Staphylococcus
KYTKARRPVVLVYQEMY

SEQ ID NO: 2024826 - protein, 18 aa, Staphylococcus
KYTLDFYLKPFLKTKIKG

SEQ ID NO: 2024827 - protein, 30 aa, Staphylococcus
KYTNIKWIIPHCGALLPVIAQRVAMGNKMF

SEQ ID NO: 2024828 - protein, 18 aa, Staphylococcus
KYTVAKFYKLYMERSNEG

SEQ ID NO: 2024829 - protein, 18 aa, Staphylococcus
KYTVAKFYKLYMERSNSG

SEQ ID NO: 2024830 - protein, 17 aa, Staphylococcus
KYVDAGVRLGLDKEEVE

SEQ ID NO: 2024831 - protein, 20 aa, Staphylococcus
KYVETLRIGLSLEYLNATDD

SEQ ID NO: 2024832 - protein, 20 aa, Staphylococcus
KYVIATPMWNLSFPPAVKRY

SEQ ID NO: 2024833 - protein, 17 aa, Staphylococcus
KYVIISINKKTVNKKPT

SEQ ID NO: 2024834 - protein, 20 aa, Staphylococcus
KYVKKGVLYPLSYYDGDWYG

SEQ ID NO: 2024835 - protein, 21 aa, Staphylococcus
KYVKQGVLYPLSYYDGDWFGK

SEQ ID NO: 2024836 - protein, 18 aa, Staphylococcus
KYVPEGIEGRIAYKGLLQ

SEQ ID NO: 2024837 - protein, 19 aa, Staphylococcus
KYVSRRAADILGRPIEDLR

SEQ ID NO: 2024838 - protein, 19 aa, Staphylococcus
KYWFNYTSDDLVAFEPQDT

SEQ ID NO: 2024839 - protein, 19 aa, Staphylococcus
KYWFNYTSDDLVHFEPQGV

SEQ ID NO: 2024840 - protein, 20 aa, Staphylococcus
KYWFNYTSKDLVSFTPHGPI

SEQ ID NO: 2024841 - protein, 18 aa, Staphylococcus
KYWGKADETLIIPMNNSI

SEQ ID NO: 2024842 - protein, 20 aa, Staphylococcus
KYWPKRLGQAPEHMIQGVPD

SEQ ID NO: 2024843 - protein, 21 aa, Staphylococcus
KYYEEGYINFVNLNIHRIDSL

SEQ ID NO: 2024844 - protein, 17 aa, Staphylococcus
KYYETTNEKIVFVNKEG

SEQ ID NO: 2024845 - protein, 17 aa, Staphylococcus
KYYGATWQDKVKIDWPM

SEQ ID NO: 2024846 - protein, 18 aa, Staphylococcus
KYYHGHAITIGMEHMNLN

SEQ ID NO: 2024847 - protein, 20 aa, Staphylococcus
KYYLYCFGGDISLITKDFKA

SEQ ID NO: 2024848 - protein, 21 aa, Staphylococcus
LAAAGLRRMGWSDDIVTEYLD

SEQ ID NO: 2024849 - protein, 17 aa, Staphylococcus
LAAAIYIYNDYEVYYLS

SEQ ID NO: 2024850 - protein, 18 aa, Staphylococcus
LAAALFIYNNHEMYYLSS

SEQ ID NO: 2024851 - protein, 18 aa, Staphylococcus
LAACSGFMYSMINAKQFV

SEQ ID NO: 2024852 - protein, 18 aa, Staphylococcus
LAACSGFMYSMITAKQYI

SEQ ID NO: 2024853 - protein, 23 aa, Staphylococcus
LAAESLPLNIGFTGKGQAVNHTA

SEQ ID NO: 2024854 - protein, 19 aa, Staphylococcus
LAAILECINVLKEQNIPHG

SEQ ID NO: 2024855 - protein, 21 aa, Staphylococcus
LAAIRYTLSYLVGEAAVKYGV

SEQ ID NO: 2024856 - protein, 18 aa, Staphylococcus
LAAKDIRIEAPIPGTSLV

SEQ ID NO: 2024857 - protein, 23 aa, Staphylococcus
LAAKKGLPFVIAHMGQSHANLTH

SEQ ID NO: 2024858 - protein, 24 aa, Staphylococcus
LAALKRGSAVLITGGFNTSEEIIQ

SEQ ID NO: 2024859 - protein, 24 aa, Staphylococcus
LAALKRSGKLIFIVYHDLSKTEAY

SEQ ID NO: 2024860 - protein, 20 aa, Staphylococcus
LAALLEILSEPFNTYVESPY

SEQ ID NO: 2024861 - protein, 20 aa, Staphylococcus
LAALLSGISVKAIIDSLTSF

SEQ ID NO: 2024862 - protein, 18 aa, Staphylococcus
LAALRPFYEDVIGFQVVT

SEQ ID NO: 2024863 - protein, 17 aa, Staphylococcus
LAAMVEGGYVLKAIEMI

SEQ ID NO: 2024864 - protein, 21 aa, Staphylococcus
LAAQCEVQLAYAIGVAEPVSI

SEQ ID NO: 2024865 - protein, 21 aa, Staphylococcus
LAARHYQYFASFIDTDEGTVN

SEQ ID NO: 2024866 - protein, 17 aa, Staphylococcus
LAARMALLNKGEVEESY

SEQ ID NO: 2024867 - protein, 25 aa, Staphylococcus
LAASARFLSWGLYGTAKHWFHSSQL

SEQ ID NO: 2024868 - protein, 17 aa, Staphylococcus
LACEAWSELGYIPKEDV

SEQ ID NO: 2024869 - protein, 22 aa, Staphylococcus
LADAIGFVRAQWVFPIQTHENR

SEQ ID NO: 2024870 - protein, 17 aa, Staphylococcus
LADALKPIEEWAQNNIN

SEQ ID NO: 2024871 - protein, 17 aa, Staphylococcus
LADEFKLAISGKLPKNY

SEQ ID NO: 2024872 - protein, 25 aa, Staphylococcus
LADEFYFKAWKGFYHEIHNEPERDQ

SEQ ID NO: 2024873 - protein, 19 aa, Staphylococcus
LADFKRKFIELDDDEDHDK

SEQ ID NO: 2024874 - protein, 26 aa, Staphylococcus
LADGGWPEPIVKAYAETGGTPWLDQK

SEQ ID NO: 2024875 - protein, 24 aa, Staphylococcus
LADGGWPEPIVKAYGENGGTPWLD

SEQ ID NO: 2024876 - protein, 19 aa, Staphylococcus
LADHGIELRLSEQIIGTSA

SEQ ID NO: 2024877 - protein, 20 aa, Staphylococcus
LADKCIDIGVSFLSEGVTER

SEQ ID NO: 2024878 - protein, 23 aa, Staphylococcus
LADKCIEIGVSFLRVGVKERDVV

SEQ ID NO: 2024879 - protein, 23 aa, Staphylococcus
LADKGIVPFLKVDKGLAEQQNGV

SEQ ID NO: 2024880 - protein, 17 aa, Staphylococcus
LADKICIMSEGRVIQFD

SEQ ID NO: 2024881 - protein, 23 aa, Staphylococcus
LADLLSGVVSFHFNNNDVKDNTK

SEQ ID NO: 2024882 - protein, 19 aa, Staphylococcus
LADSLIRKTMEPTRQALKD

SEQ ID NO: 2024883 - protein, 18 aa, Staphylococcus
LADTIAKERHYTFVEDSG

SEQ ID NO: 2024884 - protein, 23 aa, Staphylococcus
LAEALKPMEEWAQKYVELENNQA

SEQ ID NO: 2024885 - protein, 19 aa, Staphylococcus
LAEDIVKGIITRKVEINKP

SEQ ID NO: 2024886 - protein, 22 aa, Staphylococcus
LAEEGYKVAVNYAGNKEKADAV

SEQ ID NO: 2024887 - protein, 18 aa, Staphylococcus
LAEEKGHEIVGVIEPMNS

SEQ ID NO: 2024888 - protein, 19 aa, Staphylococcus
LAEHLDRYDELVAFLNEHH

SEQ ID NO: 2024889 - protein, 23 aa, Staphylococcus
LAEIYQCPVIVLSDLQLSLGKQT

SEQ ID NO: 2024890 - protein, 21 aa, Staphylococcus
LAEKCEVQLAYAIGVAEPVSI

SEQ ID NO: 2024891 - protein, 17 aa, Staphylococcus
LAEKVGLNEAIILQQIH

SEQ ID NO: 2024892 - protein, 27 aa, Staphylococcus
LAEKVLETESDFGLAFDGDGDRLIAVD

SEQ ID NO: 2024893 - protein, 19 aa, Staphylococcus
LAEKYGLDMRHTFLGPHAV

SEQ ID NO: 2024894 - protein, 19 aa, Staphylococcus
LAEKYSNIATNCYDTAEII

SEQ ID NO: 2024895 - protein, 18 aa, Staphylococcus
LAELLYFDGQYLRATREY

SEQ ID NO: 2024896 - protein, 22 aa, Staphylococcus
LAENGHRVIVAGLDMDFKGEPF

SEQ ID NO: 2024897 - protein, 23 aa, Staphylococcus
LAENVELNRIVVMSAPSEKTEAG

SEQ ID NO: 2024898 - protein, 25 aa, Staphylococcus
LAEPGEYTKRAFLNGRIDLSQAEAV

SEQ ID NO: 2024899 - protein, 23 aa, Staphylococcus
LAEQYQCPVIVLSDLQLSLGKQT

SEQ ID NO: 2024900 - protein, 18 aa, Staphylococcus
LAERCKVSSAIDEVLYSG

SEQ ID NO: 2024901 - protein, 24 aa, Staphylococcus
LAERILAVGGHPVGTLKECLDMSI

SEQ ID NO: 2024902 - protein, 17 aa, Staphylococcus
LAERQALHYTIFTVEEH

SEQ ID NO: 2024903 - protein, 21 aa, Staphylococcus
LAESERLVLVDSLNDVLALAE

SEQ ID NO: 2024904 - protein, 21 aa, Staphylococcus
LAESERLVLVDSLSDVLALVE

SEQ ID NO: 2024905 - protein, 19 aa, Staphylococcus
LAETLNYKPGWAYYQGKHL

SEQ ID NO: 2024906 - protein, 19 aa, Staphylococcus
LAFDGEIRAYAALTTESVQ

SEQ ID NO: 2024907 - protein, 19 aa, Staphylococcus
LAFPGIFRGALDTEATHIN

SEQ ID NO: 2024908 - protein, 20 aa, Staphylococcus
LAFPGIFRGALDTESTHINE

SEQ ID NO: 2024909 - protein, 22 aa, Staphylococcus
LAFTLFKDGRMNVHGITEETDV

SEQ ID NO: 2024910 - protein, 18 aa, Staphylococcus
LAFTLMLATARRIVEAEK

SEQ ID NO: 2024911 - protein, 25 aa, Staphylococcus
LAFYLTRPALDVVIPGAKHAEQVVQ

SEQ ID NO: 2024912 - protein, 26 aa, Staphylococcus
LAFYLTRPSLDVVIPGAKRAEQVVEN

SEQ ID NO: 2024913 - protein, 17 aa, Staphylococcus
LAGAYSSNVLKRLINDI

SEQ ID NO: 2024914 - protein, 17 aa, Staphylococcus
LAGAYSSNVLKRLVNDI

SEQ ID NO: 2024915 - protein, 17 aa, Staphylococcus
LAGAYSTNVLKRLVNDI

SEQ ID NO: 2024916 - protein, 18 aa, Staphylococcus
LAGFAGSVADAFTLFEKF

SEQ ID NO: 2024917 - protein, 20 aa, Staphylococcus
LAGFAGSVADAFTLFEKFET

SEQ ID NO: 2024918 - protein, 20 aa, Staphylococcus
LAGIKSREIYETPGAEVILK

SEQ ID NO: 2024919 - protein, 18 aa, Staphylococcus
LAGLEVFPEYIETRKTSL

SEQ ID NO: 2024920 - protein, 19 aa, Staphylococcus
LAGMHFTLTVKNGYSMDQC

SEQ ID NO: 2024921 - protein, 17 aa, Staphylococcus
LAGQLYSEFKEFFPENR

SEQ ID NO: 2024922 - protein, 20 aa, Staphylococcus
LAGQLYSEFKEFFPENRVEY

SEQ ID NO: 2024923 - protein, 22 aa, Staphylococcus
LAGSRPVILVADGDDTAKDMYI

SEQ ID NO: 2024924 - protein, 24 aa, Staphylococcus
LAGVKGEVLVNAFSKNDIMLSTTS

SEQ ID NO: 2024925 - protein, 19 aa, Staphylococcus
LAHAGWRGTYGEIVKEMVR

SEQ ID NO: 2024926 - protein, 20 aa, Staphylococcus
LAHAGWRGTYGQIVVEMLKY

SEQ ID NO: 2024927 - protein, 19 aa, Staphylococcus
LAHDFKHDGKSIGFVPTMG

SEQ ID NO: 2024928 - protein, 19 aa, Staphylococcus
LAHHPRLILQSNIQTETLR

SEQ ID NO: 2024929 - protein, 26 aa, Staphylococcus
LAHHYLWRFAKEMPKSGHIEIFDRSW

SEQ ID NO: 2024930 - protein, 26 aa, Staphylococcus
LAHIQIPMFVCASWSTQGLHNRGTFE

SEQ ID NO: 2024931 - protein, 18 aa, Staphylococcus
LAHKAGLDGVVCSPLEAE

SEQ ID NO: 2024932 - protein, 22 aa, Staphylococcus
LAHKFKEGLIFKDSITIGVEPT

SEQ ID NO: 2024933 - protein, 28 aa, Staphylococcus
LAHQYLWRFARDMPRTGHIEMFDRSWYG

SEQ ID NO: 2024934 - protein, 20 aa, Staphylococcus
LAHSRLGKQVFELEDLSKSI

SEQ ID NO: 2024935 - protein, 24 aa, Staphylococcus
LAHTELKRSFCVVFKKDNKKVDIF

SEQ ID NO: 2024936 - protein, 17 aa, Staphylococcus
LAICIGFTEVYIKLGDQ

SEQ ID NO: 2024937 - protein, 20 aa, Staphylococcus
LAIDQHIPYQVLRDNIYTHP

SEQ ID NO: 2024938 - protein, 20 aa, Staphylococcus
LAIDQHIPYQVLRDTIYTHP

SEQ ID NO: 2024939 - protein, 18 aa, Staphylococcus
LAIERSAAYFDLHDEEIS

SEQ ID NO: 2024940 - protein, 21 aa, Staphylococcus
LAIGWELGYLLTLSNQGIDVR

SEQ ID NO: 2024941 - protein, 19 aa, Staphylococcus
LAIHSGEWITITGQNGTGK

SEQ ID NO: 2024942 - protein, 19 aa, Staphylococcus
LAIHTGIRLTDLLKLEVKD

SEQ ID NO: 2024943 - protein, 18 aa, Staphylococcus
LAIHTGIRLTDLLNLKVK

SEQ ID NO: 2024944 - protein, 18 aa, Staphylococcus
LAIHTGMRLTDLLHLKVE

SEQ ID NO: 2024945 - protein, 26 aa, Staphylococcus
LAIISYWRSGYIHSISGYIKHLDTQQ

SEQ ID NO: 2024946 - protein, 19 aa, Staphylococcus
LAIKKGIVMDGRDIGTVVL

SEQ ID NO: 2024947 - protein, 17 aa, Staphylococcus
LAILMIVGEGMHRIVGT

SEQ ID NO: 2024948 - protein, 25 aa, Staphylococcus
LAIRNELRIPVKYVGLGEKLDDLQP

SEQ ID NO: 2024949 - protein, 18 aa, Staphylococcus
LAIVFDIGHGCTRELPIL

SEQ ID NO: 2024950 - protein, 18 aa, Staphylococcus
LAIVFGRTKRRVDELTSA

SEQ ID NO: 2024951 - protein, 17 aa, Staphylococcus
LAKADCGEVTVISKAFW

SEQ ID NO: 2024952 - protein, 17 aa, Staphylococcus
LAKDLGILDAVMFLGKQ

SEQ ID NO: 2024953 - protein, 19 aa, Staphylococcus
LAKDLKPKQLHDIKEVIAF

SEQ ID NO: 2024954 - protein, 24 aa, Staphylococcus
LAKDLRVSLITTKRAYEDLEKDGF

SEQ ID NO: 2024955 - protein, 18 aa, Staphylococcus
LAKDMSIGVITNDIYTKE

SEQ ID NO: 2024956 - protein, 24 aa, Staphylococcus
LAKEGMQLCQFLNIQPSMLKFILK

SEQ ID NO: 2024957 - protein, 19 aa, Staphylococcus
LAKEHGIEITDHMTYGHIL

SEQ ID NO: 2024958 - protein, 20 aa, Staphylococcus
LAKEKHVDWIAKAVVKAKKE

SEQ ID NO: 2024959 - protein, 19 aa, Staphylococcus
LAKELDKTIVVVIHDINFA

SEQ ID NO: 2024960 - protein, 23 aa, Staphylococcus
LAKERPDALLILGDTNSCLAAVS

SEQ ID NO: 2024961 - protein, 17 aa, Staphylococcus
LAKFDLALHRMLSGEPI

SEQ ID NO: 2024962 - protein, 19 aa, Staphylococcus
LAKHFKLWYHMTPGDYRKE

SEQ ID NO: 2024963 - protein, 17 aa, Staphylococcus
LAKKAKQVIAFEIDQRL

SEQ ID NO: 2024964 - protein, 22 aa, Staphylococcus
LAKKFKNLCVVGDSDQSIYGWR

SEQ ID NO: 2024965 - protein, 23 aa, Staphylococcus
LAKLEGGSHAFAYASGIAAISAV

SEQ ID NO: 2024966 - protein, 24 aa, Staphylococcus
LAKLKVLYEMFGLKMIDNELSDYL

SEQ ID NO: 2024967 - protein, 24 aa, Staphylococcus
LAKLKVLYEMFGLKMVDNELSDYL

SEQ ID NO: 2024968 - protein, 34 aa, Staphylococcus; identical to SEQ ID NO: 1808762

SEQ ID NO: 2024969 - protein, 17 aa, Staphylococcus
LAKRIGEELTEIFDYNV

SEQ ID NO: 2024970 - protein, 21 aa, Staphylococcus
LAKRLEELGVHAVMPLASPIG

SEQ ID NO: 2024971 - protein, 17 aa, Staphylococcus
LAKSLNCHCEAFNCLGP

SEQ ID NO: 2024972 - protein, 20 aa, Staphylococcus
LAKVKEEWIVPLPKGLTLEE

SEQ ID NO: 2024973 - protein, 17 aa, Staphylococcus
LALAKKVIASQRYESMD

SEQ ID NO: 2024974 - protein, 19 aa, Staphylococcus
LALARARQVNKDGYLSNKN

SEQ ID NO: 2024975 - protein, 17 aa, Staphylococcus
LALDFERDKAYGKHLDI

SEQ ID NO: 2024976 - protein, 18 aa, Staphylococcus
LALDVFASRIHKYIGSYA

SEQ ID NO: 2024977 - protein, 19 aa, Staphylococcus
LALDVFASRIHKYIGSYAT

SEQ ID NO: 2024978 - protein, 22 aa, Staphylococcus
LALELTEAITLIASAGVPDALY

SEQ ID NO: 2024979 - protein, 19 aa, Staphylococcus
LALESRECFPELCETLQDE

SEQ ID NO: 2024980 - protein, 21 aa, Staphylococcus
LALGGTFAHVLAIQYSLDPVI

SEQ ID NO: 2024981 - protein, 20 aa, Staphylococcus
LALHTFDFSTDVPFEHYLNC

SEQ ID NO: 2024982 - protein, 17 aa, Staphylococcus
LALKHNNKFIGQPLWGS

SEQ ID NO: 2024983 - protein, 17 aa, Staphylococcus
LALKRDIFFHHPYESFE

SEQ ID NO: 2024984 - protein, 21 aa, Staphylococcus
LALLKEEWQMFSNAVNTFVEE

SEQ ID NO: 2024985 - protein, 24 aa, Staphylococcus
LALLKRLAKVQGIDMVDVEWHNHL

SEQ ID NO: 2024986 - protein, 34 aa, Staphylococcus
LALNQGADIIKVFPVSSMGPSYIKDILAPLNNTQ

SEQ ID NO: 2024987 - protein, 20 aa, Staphylococcus
LALQQDESWMRGMVREEEPQ

SEQ ID NO: 2024988 - protein, 21 aa, Staphylococcus
LALSPELRDKIQLISKCGIIL

SEQ ID NO: 2024989 - protein, 27 aa, Staphylococcus
LALVDFFFQPDFDRPWNYLNVLAQSAL

SEQ ID NO: 2024990 - protein, 18 aa, Staphylococcus
LALVELDSLIDIDVLIDV

SEQ ID NO: 2024991 - protein, 20 aa, Staphylococcus
LAMAPQFFGPISDYLKASGL

SEQ ID NO: 2024992 - protein, 18 aa, Staphylococcus
LAMAPQFFGVISDYLKSS

SEQ ID NO: 2024993 - protein, 17 aa, Staphylococcus
LAMELYDAPWIQWYHEQ

SEQ ID NO: 2024994 - protein, 19 aa, Staphylococcus
LAMELYDSPWIKWYHQQMK

SEQ ID NO: 2024995 - protein, 27 aa, Staphylococcus
LAMLYAEGFHICKGELFGKHRQGEDCL

SEQ ID NO: 2024996 - protein, 20 aa, Staphylococcus
LAMVLVQFPPWFDCKTQNIN

SEQ ID NO: 2024997 - protein, 20 aa, Staphylococcus
LAMVMHIYQSFGLKHLKLVI

SEQ ID NO: 2024998 - protein, 20 aa, Staphylococcus
LANAHIIKQWSGVRPYTDGE

SEQ ID NO: 2024999 - protein, 26 aa, Staphylococcus
LANEGKPVLGVCNGFQILTEIGLLPG

SEQ ID NO: 2025000 - protein, 22 aa, Staphylococcus
LANENVDFIFGYPGGAVLPLYD

SEQ ID NO: 2025001 - protein, 17 aa, Staphylococcus
LANEPIFVFEIDHKVAG

SEQ ID NO: 2025002 - protein, 25 aa, Staphylococcus
LANGKAEMSFEEFLGKAAQSSSNIV

SEQ ID NO: 2025003 - protein, 20 aa, Staphylococcus
LANHHIKYYIQQCRRQNSVL

SEQ ID NO: 2025004 - protein, 26 aa, Staphylococcus
LANKECKATNIWQVNFIRASDGLFGG

SEQ ID NO: 2025005 - protein, 23 aa, Staphylococcus
LANKFKNLCVVGDSDQSIYGWRG

SEQ ID NO: 2025006 - protein, 26 aa, Staphylococcus
LANKISLKFAKKIYTTFEDTLNYLPK

SEQ ID NO: 2025007 - protein, 27 aa, Staphylococcus
LANKISLKFSKKIYTTFEDTLKYLPKD

SEQ ID NO: 2025008 - protein, 29 aa, Staphylococcus
LANPHRRNILLIGDGSFQLTVQELSTMIR

SEQ ID NO: 2025009 - protein, 17 aa, Staphylococcus
LAPEWDIKLYERLDRPG

SEQ ID NO: 2025010 - protein, 19 aa, Staphylococcus
LAPEYKYPTPLVQMDQAVS

SEQ ID NO: 2025011 - protein, 23 aa, Staphylococcus
LAPKMRKDEIIVITVSGRGDKDM

SEQ ID NO: 2025012 - protein, 23 aa, Staphylococcus
LAPKSKADFAFIQHMIYHLDDNG

SEQ ID NO: 2025013 - protein, 17 aa, Staphylococcus
LAPLSHLALALIGEGDV

SEQ ID NO: 2025014 - protein, 18 aa, Staphylococcus
LAPLSHLALALIGEGKVY

SEQ ID NO: 2025015 - protein, 18 aa, Staphylococcus
LAPLSHLALALIGEGLVY

SEQ ID NO: 2025016 - protein, 18 aa, Staphylococcus
LAPLSHLALALIGEGNVF

SEQ ID NO: 2025017 - protein, 17 aa, Staphylococcus
LAPMKARGIRFAFCTGK

SEQ ID NO: 2025018 - protein, 25 aa, Staphylococcus
LAPMYRGSAGIKRLNKVLQDILNPK

SEQ ID NO: 2025019 - protein, 17 aa, Staphylococcus
LAPQYLKLAVMPNNKED

SEQ ID NO: 2025020 - protein, 21 aa, Staphylococcus
LAPSKFEAWFLTTEHTDEDIE

SEQ ID NO: 2025021 - protein, 17 aa, Staphylococcus
LAPSYVFLATQADSSYI

SEQ ID NO: 2025022 - protein, 18 aa, Staphylococcus
LAQEEIFGPVIVVEKFED

SEQ ID NO: 2025023 - protein, 19 aa, Staphylococcus
LAQEEIFGPVLVVEKFEDE

SEQ ID NO: 2025024 - protein, 19 aa, Staphylococcus
LAQEERGLFIVPLNGLKKW

SEQ ID NO: 2025025 - protein, 25 aa, Staphylococcus
LAQFKPGDVIQFKWISVDEANAMLK

SEQ ID NO: 2025026 - protein, 26 aa, Staphylococcus
LAQFKPGEEILFKWITIEQAIKNLKH

SEQ ID NO: 2025027 - protein, 23 aa, Staphylococcus
LAQFRKTDLGFIFQDYSVLPTLT

SEQ ID NO: 2025028 - protein, 17 aa, Staphylococcus
LAQFRYDHYIQLYNEIS

SEQ ID NO: 2025029 - protein, 25 aa, Staphylococcus
LAQGCHNEPFIPFAFTQAKDVCHIF

SEQ ID NO: 2025030 - protein, 37 aa, Staphylococcus
LAQGQRGLFIVPLNGFKKWLTPVDMWKNHQMTLKVGE

SEQ ID NO: 2025031 - protein, 24 aa, Staphylococcus
LAQHARGTARLFFIFSDDDLIGTI

SEQ ID NO: 2025032 - protein, 19 aa, Staphylococcus
LAQKGEYDAVITLGCVIRG

SEQ ID NO: 2025033 - protein, 24 aa, Staphylococcus
LAQKIKNLEMIKEYQSIESQIHNN

SEQ ID NO: 2025034 - protein, 17 aa, Staphylococcus
LAQNFSACRALVSEGIQ

SEQ ID NO: 2025035 - protein, 17 aa, Staphylococcus
LAQQEGLLVGSSSGAAL

SEQ ID NO: 2025036 - protein, 18 aa, Staphylococcus
LAQQHFDAVLAIGQAGGR

SEQ ID NO: 2025037 - protein, 23 aa, Staphylococcus
LAQQLKDTFTIVAVDRRGYGESE

SEQ ID NO: 2025038 - protein, 18 aa, Staphylococcus
LAQRLGFNRDKEWDDVIN

SEQ ID NO: 2025039 - protein, 23 aa, Staphylococcus
LAQRLNRKVSFLGRSLESSFNIA

SEQ ID NO: 2025040 - protein, 20 aa, Staphylococcus
LAQSESLAISSSSRGNIEIT

SEQ ID NO: 2025041 - protein, 33 aa, Staphylococcus
LAQSRIGLHINNRIESLILIHACWLANIEIAMI

SEQ ID NO: 2025042 - protein, 17 aa, Staphylococcus
LAQSRMTVVPSRNEGFG

SEQ ID NO: 2025043 - protein, 20 aa, Staphylococcus
LAQVRIQLVSDFASKMYGKQ

SEQ ID NO: 2025044 - protein, 18 aa, Staphylococcus
LAREKGWLDEKMPPMSST

SEQ ID NO: 2025045 - protein, 17 aa, Staphylococcus
LARGELQAIGATTLDEY

SEQ ID NO: 2025046 - protein, 19 aa, Staphylococcus
LARGYRREEVDAFLDDIIA

SEQ ID NO: 2025047 - protein, 24 aa, Staphylococcus
LARKLLALCHDYAVPFIVNDDVAL

SEQ ID NO: 2025048 - protein, 18 aa, Staphylococcus
LARMMIKESMPEGTVVKV

SEQ ID NO: 2025049 - protein, 22 aa, Staphylococcus
LARNELNYLLTQNGNFEVIDEA

SEQ ID NO: 2025050 - protein, 17 aa, Staphylococcus
LASDRAKYITGQTIHVN

SEQ ID NO: 2025051 - protein, 19 aa, Staphylococcus
LASDYVAIELLKLIKDKPD

SEQ ID NO: 2025052 - protein, 21 aa, Staphylococcus
LASEKHVDWIAKAVIKAKKKV

SEQ ID NO: 2025053 - protein, 22 aa, Staphylococcus
LASEKHVDWIALAVIKAKQAVP

SEQ ID NO: 2025054 - protein, 18 aa, Staphylococcus
LASFEHLSRTSAMLYQIF

SEQ ID NO: 2025055 - protein, 17 aa, Staphylococcus
LASFSNWVGINHGTTSF

SEQ ID NO: 2025056 - protein, 17 aa, Staphylococcus
LASGGYIHYCEYPKLTH

SEQ ID NO: 2025057 - protein, 18 aa, Staphylococcus
LASGIFFANSYEVNYFSG

SEQ ID NO: 2025058 - protein, 17 aa, Staphylococcus
LASGPRAGLAEISIPEN

SEQ ID NO: 2025059 - protein, 19 aa, Staphylococcus
LASHAKRKFIFLHSDMKAD

SEQ ID NO: 2025060 - protein, 18 aa, Staphylococcus
LASKYGSNVDKLYNIAQI

SEQ ID NO: 2025061 - protein, 17 aa, Staphylococcus
LASLAHDLGEKYLNSDL

SEQ ID NO: 2025062 - protein, 20 aa, Staphylococcus
LASLDVIRYVTAHHPNLPIM

SEQ ID NO: 2025063 - protein, 17 aa, Staphylococcus
LASRIPYGETLSFAKVN

SEQ ID NO: 2025064 - protein, 17 aa, Staphylococcus
LASSLRHIISENFGSNA

SEQ ID NO: 2025065 - protein, 20 aa, Staphylococcus
LASVAGHVVFPGSAVYCGTK

SEQ ID NO: 2025066 - protein, 17 aa, Staphylococcus
LASVIAVVGEVITTMSI

SEQ ID NO: 2025067 - protein, 25 aa, Staphylococcus
LASVICCRDDIMVYLMYNGLEPSLA

SEQ ID NO: 2025068 - protein, 20 aa, Staphylococcus
LASVPGFRALRFLRPNEQGQ

SEQ ID NO: 2025069 - protein, 17 aa, Staphylococcus
LASVVGVVGEVITTMSI

SEQ ID NO: 2025070 - protein, 27 aa, Staphylococcus
LATDIGKALGFPAHMSRLTRTSSGGFN

SEQ ID NO: 2025071 - protein, 18 aa, Staphylococcus
LATDLKPEQLHTIKNIID

SEQ ID NO: 2025072 - protein, 19 aa, Staphylococcus
LATEAIEMISRWMKQFDAV

SEQ ID NO: 2025073 - protein, 17 aa, Staphylococcus
LATEFKFKEFSRRRENL

SEQ ID NO: 2025074 - protein, 18 aa, Staphylococcus
LATEIGLNEAIVLQQIHY

SEQ ID NO: 2025075 - protein, 17 aa, Staphylococcus
LATEYVLLTTTKDQFQL

SEQ ID NO: 2025076 - protein, 17 aa, Staphylococcus
LATILALTATAPPHLTS

SEQ ID NO: 2025077 - protein, 20 aa, Staphylococcus
LATKHGINFQEMAFKEEKQC

SEQ ID NO: 2025078 - protein, 17 aa, Staphylococcus
LATKHGVNYNTLESLPT

SEQ ID NO: 2025079 - protein, 20 aa, Staphylococcus
LATLSFKPQILVTYRTESQG

SEQ ID NO: 2025080 - protein, 30 aa, Staphylococcus
LATQIICYDLRFPELLRYPAKNGAKIAFYV

SEQ ID NO: 2025081 - protein, 40 aa, Staphylococcus
LATQIICYDLRFPELLRYPARSGAKVAFYVAQWPTVRLNH

SEQ ID NO: 2025082 - protein, 34 aa, Staphylococcus
LATQIICYDLRFPELLRYPSREGAQIAFYVAEWP

SEQ ID NO: 2025083 - protein, 17 aa, Staphylococcus
LATSSVRDDTQIHTHMC

SEQ ID NO: 2025084 - protein, 18 aa, Staphylococcus
LAVALHLLQGTPYIYQGE

SEQ ID NO: 2025085 - protein, 29 aa, Staphylococcus
LAVATGRPRTETIVPFKSFSLLQWFDQSH

SEQ ID NO: 2025086 - protein, 27 aa, Staphylococcus
LAVEGFRPVMEIQFLGFVFEVFDSVAG

SEQ ID NO: 2025087 - protein, 22 aa, Staphylococcus
LAVRHVDAIFSIAWNLQDGQQF

SEQ ID NO: 2025088 - protein, 18 aa, Staphylococcus
LAVSGPFHSSMMNVIEED

SEQ ID NO: 2025089 - protein, 18 aa, Staphylococcus
LAVSGPFHSSMMQVIEED

SEQ ID NO: 2025090 - protein, 18 aa, Staphylococcus
LAVSGPFHSSMMQVIEKD

SEQ ID NO: 2025091 - protein, 17 aa, Staphylococcus
LAVSGPFHSSMMQVIKD

SEQ ID NO: 2025092 - protein, 18 aa, Staphylococcus
LAVSGPFHSSMMSVIEED

SEQ ID NO: 2025093 - protein, 24 aa, Staphylococcus
LAVSRTSFNWGVSVPSNPKHVVYV

SEQ ID NO: 2025094 - protein, 22 aa, Staphylococcus
LAWPENTEFIFTPYQIQAVTGE

SEQ ID NO: 2025095 - protein, 18 aa, Staphylococcus
LAYASGHLGMVGGQTLDM

SEQ ID NO: 2025096 - protein, 18 aa, Staphylococcus
LAYPTLKTQSAFLSDYYY

SEQ ID NO: 2025097 - protein, 19 aa, Staphylococcus
LAYQIKAKHIITGVCETDF

SEQ ID NO: 2025098 - protein, 17 aa, Staphylococcus
LAYSRLGKQVFELDHLT

SEQ ID NO: 2025099 - protein, 24 aa, Staphylococcus
LCCTPTEYRIMAKLQNLDHFDLSH

SEQ ID NO: 2025100 - protein, 24 aa, Staphylococcus
LCCTPTEYRLMAKLPNLTDYNLEH

SEQ ID NO: 2025101 - protein, 26 aa, Staphylococcus
LCDEGLWKAVIFEIGLGKTNEIPIVD

SEQ ID NO: 2025102 - protein, 18 aa, Staphylococcus
LCGGGRYNGLLELLDGPK

SEQ ID NO: 2025103 - protein, 19 aa, Staphylococcus
LCGIKNILVNFLMHDEDTK

SEQ ID NO: 2025104 - protein, 17 aa, Staphylococcus
LCHLEMFEAAVAQLDKV

SEQ ID NO: 2025105 - protein, 26 aa, Staphylococcus
LCHMIKEVYDLPVIMLTARDALSDKE

SEQ ID NO: 2025106 - protein, 21 aa, Staphylococcus
LCKNAEWLAIVFDIGHGCTRE

SEQ ID NO: 2025107 - protein, 21 aa, Staphylococcus
LCLPLAKKGGQFIALKSSKGE

SEQ ID NO: 2025108 - protein, 22 aa, Staphylococcus
LCLYYHIGQCLGPCVYDVDQKE

SEQ ID NO: 2025109 - protein, 22 aa, Staphylococcus
LCLYYHIGQCLGPCVYDVDQQQ

SEQ ID NO: 2025110 - protein, 19 aa, Staphylococcus
LCNHYEIHAPLKSYHEHNK

SEQ ID NO: 2025111 - protein, 26 aa, Staphylococcus
LCNMRCSHCAVGYTLQTKDPDALPMD

SEQ ID NO: 2025112 - protein, 26 aa, Staphylococcus
LCNMRCSHCAVGYTLQTKDPDPLPMD

SEQ ID NO: 2025113 - protein, 26 aa, Staphylococcus
LCNMRCSHCAVGYTLQTKDPDPLPMN

SEQ ID NO: 2025114 - protein, 26 aa, Staphylococcus
LCNMRCSHCAVGYTLQTKDSESLPMD

SEQ ID NO: 2025115 - protein, 25 aa, Staphylococcus
LCNMRCSHCAVGYTLQTQDPDPLPM

SEQ ID NO: 2025116 - protein, 25 aa, Staphylococcus
LCNMRCSHCAVGYTLQTQDPEPLPM

SEQ ID NO: 2025117 - protein, 25 aa, Staphylococcus
LCNMRCSHCAVGYTLQTTDPDPLPM

SEQ ID NO: 2025118 - protein, 20 aa, Staphylococcus
LCPHMEFMATPPYDGAFCEY

SEQ ID NO: 2025119 - protein, 22 aa, Staphylococcus
LCPNGYYVRARFDAYREASAVI

SEQ ID NO: 2025120 - protein, 23 aa, Staphylococcus
LCPNGYYVRARFDVYREVSSKIM

SEQ ID NO: 2025121 - protein, 19 aa, Staphylococcus
LCPNGYYVTPRFEAYKTAS

SEQ ID NO: 2025122 - protein, 19 aa, Staphylococcus
LCPNGYYVTSRFDAYREAS

SEQ ID NO: 2025123 - protein, 20 aa, Staphylococcus
LCPNGYYVTSRFGAYREVSQ

SEQ ID NO: 2025124 - protein, 19 aa, Staphylococcus
LCQEIPEIDVIFGSHTHHH

SEQ ID NO: 2025125 - protein, 17 aa, Staphylococcus
LCQEIPEIDVILGSHTH

SEQ ID NO: 2025126 - protein, 20 aa, Staphylococcus
LCQSRRKVYYHLKKINQSLP

SEQ ID NO: 2025127 - protein, 26 aa, Staphylococcus
LCRDCGHVPQCPNCDISLTYHKSSDQ

SEQ ID NO: 2025128 - protein, 17 aa, Staphylococcus
LCRHGQSVWNAENLFTG

SEQ ID NO: 2025129 - protein, 17 aa, Staphylococcus
LCSDSQCSVNCCPYIQF

SEQ ID NO: 2025130 - protein, 24 aa, Staphylococcus
LCTNSSAFSLKAFKNVIKKTLDEE

SEQ ID NO: 2025131 - protein, 24 aa, Staphylococcus
LCTNSSAFSLKAFKNVIKKTLEQA

SEQ ID NO: 2025132 - protein, 22 aa, Staphylococcus
LCTNSSVFSLKAFKNVIKTTLE

SEQ ID NO: 2025133 - protein, 28 aa, Staphylococcus
LCVSIREFFPFIELKAFDDYSKNIDIES

SEQ ID NO: 2025134 - protein, 24 aa, Staphylococcus
LDACSAPGGKACHIAEILSPEGHV

SEQ ID NO: 2025135 - protein, 24 aa, Staphylococcus
LDACSAPGGKACHMAEILSPEGQI

SEQ ID NO: 2025136 - protein, 30 aa, Staphylococcus
LDACSAPGGKACHMAELLASTGHVDATDIH

SEQ ID NO: 2025137 - protein, 23 aa, Staphylococcus
LDACSAPGGKACQTAELLDGTGH

SEQ ID NO: 2025138 - protein, 18 aa, Staphylococcus
LDAEDVILISAEKNEGIE

SEQ ID NO: 2025139 - protein, 22 aa, Staphylococcus
LDAEQLVICGMMTHMCIDSTTR

SEQ ID NO: 2025140 - protein, 19 aa, Staphylococcus
LDAGLMFPEDEMLGVDIVI

SEQ ID NO: 2025141 - protein, 17 aa, Staphylococcus
LDAGNIISQKAINIEDN

SEQ ID NO: 2025142 - protein, 26 aa, Staphylococcus
LDAHMIKWSKLYLDDFQSSWTMPQRD

SEQ ID NO: 2025143 - protein, 17 aa, Staphylococcus
LDAICMSNTDAIIIGGT

SEQ ID NO: 2025144 - protein, 23 aa, Staphylococcus
LDAKRALSVVKMIKKEIINNDMC

SEQ ID NO: 2025145 - protein, 25 aa, Staphylococcus
LDAKRAVQVVDMIKTQIKSNHMMGI

SEQ ID NO: 2025146 - protein, 18 aa, Staphylococcus
LDALCMSDTDAIMIGGTD

SEQ ID NO: 2025147 - protein, 24 aa, Staphylococcus
LDALNLWLIRINYLKQPKVYPSIE

SEQ ID NO: 2025148 - protein, 19 aa, Staphylococcus
LDAMPELKEAFNNLTPGRQ

SEQ ID NO: 2025149 - protein, 19 aa, Staphylococcus
LDAPVPKLPSLEEFNGPAG

SEQ ID NO: 2025150 - protein, 24 aa, Staphylococcus
LDAREGAQMIKFIRHIDISGLPST

SEQ ID NO: 2025151 - protein, 18 aa, Staphylococcus
LDASELMAFGDANNDLDM

SEQ ID NO: 2025152 - protein, 23 aa, Staphylococcus
LDCALPKGIDPYEMHEFLIHITG

SEQ ID NO: 2025153 - protein, 17 aa, Staphylococcus
LDCELKSKIDPYQLHEF

SEQ ID NO: 2025154 - protein, 18 aa, Staphylococcus
LDDAGFKDAKIIASNDLD

SEQ ID NO: 2025155 - protein, 23 aa, Staphylococcus
LDDDALCFYDLGSSEMNLDLAIE

SEQ ID NO: 2025156 - protein, 19 aa, Staphylococcus
LDDEVRFSKRFTHNTEITG

SEQ ID NO: 2025157 - protein, 23 aa, Staphylococcus
LDDFRIIKDQLFGNGERSTQNRG

SEQ ID NO: 2025158 - protein, 25 aa, Staphylococcus
LDDGESYSYLIFVQETWSLLHENRD

SEQ ID NO: 2025159 - protein, 19 aa, Staphylococcus
LDDGKKYTHCIVESKEDDA

SEQ ID NO: 2025160 - protein, 21 aa, Staphylococcus
LDDHDVRIALDRAIEDSDRGL

SEQ ID NO: 2025161 - protein, 21 aa, Staphylococcus
LDDIDGLILPGGESTTLRRLM

SEQ ID NO: 2025162 - protein, 25 aa, Staphylococcus
LDDIRIKEFVKDVAKYDEVYGLTNK

SEQ ID NO: 2025163 - protein, 23 aa, Staphylococcus
LDDKASVAMIIEFLKTIKNENLT

SEQ ID NO: 2025164 - protein, 17 aa, Staphylococcus
LDDKVAIVTGGAMGLGQ

SEQ ID NO: 2025165 - protein, 26 aa, Staphylococcus
LDDLKRGRVKLGYSVLPQAVKTNTDA

SEQ ID NO: 2025166 - protein, 20 aa, Staphylococcus
LDDTESFLFAYEESYGYLAD

SEQ ID NO: 2025167 - protein, 22 aa, Staphylococcus
LDDYLQCFDEILKVLQTKDSLK

SEQ ID NO: 2025168 - protein, 18 aa, Staphylococcus
LDDYRRLLASLTDVDNWN

SEQ ID NO: 2025169 - protein, 17 aa, Staphylococcus
LDEAFYGFYAIINSTDI

SEQ ID NO: 2025170 - protein, 25 aa, Staphylococcus
LDEAHCISEWGYDFRPHYALISKIT

SEQ ID NO: 2025171 - protein, 18 aa, Staphylococcus
LDEALHFSGKESYKEGIK

SEQ ID NO: 2025172 - protein, 18 aa, Staphylococcus
LDEALKLGATTTINVKDE

SEQ ID NO: 2025173 - protein, 26 aa, Staphylococcus
LDEANVIRYAQFLKELSIQTQFIVIT

SEQ ID NO: 2025174 - protein, 23 aa, Staphylococcus
LDEANVIRYAQYLKELSDQTQFI

SEQ ID NO: 2025175 - protein, 23 aa, Staphylococcus
LDEANVIRYAQYLNELSDQTQFI

SEQ ID NO: 2025176 - protein, 23 aa, Staphylococcus
LDEANVIRYAQYLNELSEQTQFI

SEQ ID NO: 2025177 - protein, 18 aa, Staphylococcus
LDEAVTYEKLAIATLAVR

SEQ ID NO: 2025178 - protein, 19 aa, Staphylococcus
LDEEIKEAYDLGIRGVMFF

SEQ ID NO: 2025179 - protein, 18 aa, Staphylococcus
LDEETFGYLVYFFELACA

SEQ ID NO: 2025180 - protein, 18 aa, Staphylococcus
LDEETFGYVVYFFELACA

SEQ ID NO: 2025181 - protein, 19 aa, Staphylococcus
LDEETFGYVVYFFELACAM

SEQ ID NO: 2025182 - protein, 18 aa, Staphylococcus
LDEETFGYVVYFFELACS

SEQ ID NO: 2025183 - protein, 19 aa, Staphylococcus
LDEEVTYEKLAVATLGVRN

SEQ ID NO: 2025184 - protein, 24 aa, Staphylococcus
LDEEYRKSLMIKVFEHTTQYDEAI

SEQ ID NO: 2025185 - protein, 18 aa, Staphylococcus
LDEGFGLIHAVGKGSENP

SEQ ID NO: 2025186 - protein, 23 aa, Staphylococcus
LDEGKKSVAIRLYYLDTENTLTD

SEQ ID NO: 2025187 - protein, 17 aa, Staphylococcus
LDEIAGIHFYNSKDHST

SEQ ID NO: 2025188 - protein, 23 aa, Staphylococcus
LDEIKALEFELGIMELYAIEPQH

SEQ ID NO: 2025189 - protein, 23 aa, Staphylococcus
LDEITHPIKVIFLNIKSHHFSEI

SEQ ID NO: 2025190 - protein, 32 aa, Staphylococcus
LDEKRLNYEGFYRLHHSYKKKVIMAQFNNLID

SEQ ID NO: 2025191 - protein, 24 aa, Staphylococcus
LDELERLSKIYIKAAYHTLLEAEN

SEQ ID NO: 2025192 - protein, 24 aa, Staphylococcus
LDELKRSDLTHVDYIGVGPIYQTP

SEQ ID NO: 2025193 - protein, 17 aa, Staphylococcus
LDELKSIVVATRRKYEI

SEQ ID NO: 2025194 - protein, 23 aa, Staphylococcus
LDELPSMYQGFFLAPHVVSQSLK

SEQ ID NO: 2025195 - protein, 24 aa, Staphylococcus
LDENGNRVLIGWMGLPEINYPTDE

SEQ ID NO: 2025196 - protein, 28 aa, Staphylococcus
LDENGRFIADEVVCRFRGNNTVMAKEKM

SEQ ID NO: 2025197 - protein, 19 aa, Staphylococcus
LDENVTYEKLAIATLAVRN

SEQ ID NO: 2025198 - protein, 18 aa, Staphylococcus
LDENVTYEKLAVATLAVR

SEQ ID NO: 2025199 - protein, 17 aa, Staphylococcus
LDEPTKIVIWRAPTDND

SEQ ID NO: 2025200 - protein, 24 aa, Staphylococcus
LDEQGQRILIGWMGLPEINYPTDE

SEQ ID NO: 2025201 - protein, 23 aa, Staphylococcus
LDERFFRCHNSFVVNRHNIDSID

SEQ ID NO: 2025202 - protein, 23 aa, Staphylococcus
LDESLRPTVDIKIAQFEELSIED

SEQ ID NO: 2025203 - protein, 17 aa, Staphylococcus
LDEVIQWIEQDVFLKGL

SEQ ID NO: 2025204 - protein, 19 aa, Staphylococcus
LDEYIDLLVERNIIESDAK

SEQ ID NO: 2025205 - protein, 22 aa, Staphylococcus
LDEYTVGNAYVFPVKVEYDYEV

SEQ ID NO: 2025206 - protein, 21 aa, Staphylococcus
LDFAKGGPFIISNKGCYEEIL

SEQ ID NO: 2025207 - protein, 25 aa, Staphylococcus
LDFDDLIMKTIRLFERVPDALEYYQ

SEQ ID NO: 2025208 - protein, 22 aa, Staphylococcus
LDFDDLIMVTIRLFERVPDVLD

SEQ ID NO: 2025209 - protein, 20 aa, Staphylococcus
LDFESVIVMGHEAYYPKFGF

SEQ ID NO: 2025210 - protein, 20 aa, Staphylococcus
LDFFLQAKFDLERLESELMK

SEQ ID NO: 2025211 - protein, 17 aa, Staphylococcus
LDFIPKAHIVKISDEEL

SEQ ID NO: 2025212 - protein, 18 aa, Staphylococcus
LDFITHSYPHDWRTKKPV

SEQ ID NO: 2025213 - protein, 19 aa, Staphylococcus
LDFKDEFFEQYGLNVENPK

SEQ ID NO: 2025214 - protein, 17 aa, Staphylococcus
LDFKDKLTVELNQADKD

SEQ ID NO: 2025215 - protein, 18 aa, Staphylococcus
LDFKFDMTEITGLDDLHH

SEQ ID NO: 2025216 - protein, 22 aa, Staphylococcus
LDFKKVTNMTVGYKMQEKDDDD

SEQ ID NO: 2025217 - protein, 21 aa, Staphylococcus
LDFLLPERFDLAYIGKDGEEH

SEQ ID NO: 2025218 - protein, 19 aa, Staphylococcus
LDFLLPERFDLSYIGSDGE

SEQ ID NO: 2025219 - protein, 17 aa, Staphylococcus
LDFLTKRVGQIAQGAAV

SEQ ID NO: 2025220 - protein, 21 aa, Staphylococcus
LDFPESVVSFFKGEIGQPVNG

SEQ ID NO: 2025221 - protein, 17 aa, Staphylococcus
LDFPVVYASAVNGTASV

SEQ ID NO: 2025222 - protein, 22 aa, Staphylococcus
LDFVKAELSGYIIGTAERPGDI

SEQ ID NO: 2025223 - protein, 25 aa, Staphylococcus
LDGDTRGGAALSIRAVTHKPIKFVG

SEQ ID NO: 2025224 - protein, 25 aa, Staphylococcus
LDGDTRGGAALSIRSVTQKPIKFVG

SEQ ID NO: 2025225 - protein, 24 aa, Staphylococcus
LDGEMKFRIACMNHHHHHFICENC

SEQ ID NO: 2025226 - protein, 20 aa, Staphylococcus
LDGEMKFRIACTDHHHHHFI

SEQ ID NO: 2025227 - protein, 23 aa, Staphylococcus
LDGFDGVLIPGGFSFGDYLRSGA

SEQ ID NO: 2025228 - protein, 19 aa, Staphylococcus
LDGFGELFRYLSYAEDVGT

SEQ ID NO: 2025229 - protein, 25 aa, Staphylococcus
LDGGKAANIIPDFTHARFYTRATTR

SEQ ID NO: 2025230 - protein, 23 aa, Staphylococcus
LDGIKYGVAVMDARFRMGSMGSV

SEQ ID NO: 2025231 - protein, 19 aa, Staphylococcus
LDGLNYLAGKTIDEVNTKA

SEQ ID NO: 2025232 - protein, 17 aa, Staphylococcus
LDGRYFVSGLNKVDQHY

SEQ ID NO: 2025233 - protein, 26 aa, Staphylococcus
LDGSRRFLDRIWRLLITEDGSISNKV

SEQ ID NO: 2025234 - protein, 27 aa, Staphylococcus
LDGSRRFLDRVWRLFINEDDSLSQKFV

SEQ ID NO: 2025235 - protein, 26 aa, Staphylococcus
LDGSRRFLDRVWRLIVKEDGSLSDKI

SEQ ID NO: 2025236 - protein, 26 aa, Staphylococcus
LDGSRRFLDRVWRLIVTEDGSLNNKI

SEQ ID NO: 2025237 - protein, 27 aa, Staphylococcus
LDGSRRFLDRVWRLLINEDGSLTSKVV

SEQ ID NO: 2025238 - protein, 17 aa, Staphylococcus
LDHGSSFEKCKEAIDAG

SEQ ID NO: 2025239 - protein, 23 aa, Staphylococcus
LDHHMKGCIMHKVEDGHAEEAME

SEQ ID NO: 2025240 - protein, 20 aa, Staphylococcus
LDHHMKSCIMDKVEQGHEQE

SEQ ID NO: 2025241 - protein, 23 aa, Staphylococcus
LDHHMKSCIMDKVNNGAQEEAME

SEQ ID NO: 2025242 - protein, 23 aa, Staphylococcus
LDHHMKSCIMNKVNNGAQEEAME

SEQ ID NO: 2025243 - protein, 18 aa, Staphylococcus
LDHLDLYQLHGGTIDDPL

SEQ ID NO: 2025244 - protein, 24 aa, Staphylococcus
LDHNLKTALIINEFGKMSVDSQLI

SEQ ID NO: 2025245 - protein, 19 aa, Staphylococcus
LDHQIPRYNFYGITGDFSK

SEQ ID NO: 2025246 - protein, 21 aa, Staphylococcus
LDHVHEIGSLVMATTHYPELK

SEQ ID NO: 2025247 - protein, 17 aa, Staphylococcus
LDHVLLFGPPGLGKTTL

SEQ ID NO: 2025248 - protein, 23 aa, Staphylococcus
LDHVRDIGSLVMATTHYPELKAY

SEQ ID NO: 2025249 - protein, 19 aa, Staphylococcus
LDIAIKHIVFDVMLASYII

SEQ ID NO: 2025250 - protein, 21 aa, Staphylococcus
LDIDMYIIVSYGVKISEVANN

SEQ ID NO: 2025251 - protein, 21 aa, Staphylococcus
LDIEIPGMTGLEVLSQLRENK

SEQ ID NO: 2025252 - protein, 23 aa, Staphylococcus
LDIEMPGMTGLEILRNIKEQQLD

SEQ ID NO: 2025253 - protein, 17 aa, Staphylococcus
LDIEQQLHRVREIRWGP

SEQ ID NO: 2025254 - protein, 20 aa, Staphylococcus
LDIESGEFIAFIGTSGSGKT

SEQ ID NO: 2025255 - protein, 28 aa, Staphylococcus
LDIESKLGLVEGWKRDGLTDEQIAKNLG

SEQ ID NO: 2025256 - protein, 17 aa, Staphylococcus
LDIGFDLNYLYKDAKQS

SEQ ID NO: 2025257 - protein, 18 aa, Staphylococcus
LDIIAIKFKCCDKYYPCY

SEQ ID NO: 2025258 - protein, 30 aa, Staphylococcus
LDIIKRHRLLELFLIEILKYNWEEVHQEAE

SEQ ID NO: 2025259 - protein, 29 aa, Staphylococcus
LDIIKRHRLLELFLIEILQYNWEEVHQEA

SEQ ID NO: 2025260 - protein, 30 aa, Staphylococcus
LDIIKRHRLLELFLIEVLKYNWEEVHQEAE

SEQ ID NO: 2025261 - protein, 29 aa, Staphylococcus
LDIIKRHRLLELFLIEVLQYNWEEVHQEA

SEQ ID NO: 2025262 - protein, 26 aa, Staphylococcus
LDIIKRHRLLELFLIKILQYNWEEVH

SEQ ID NO: 2025263 - protein, 17 aa, Staphylococcus
LDIKMPYSDGFEVAQSL

SEQ ID NO: 2025264 - protein, 18 aa, Staphylococcus
LDIKPEHFNETFKTNIFG

SEQ ID NO: 2025265 - protein, 26 aa, Staphylococcus
LDIKRMPFIGLQWIFARKGAAASNHF

SEQ ID NO: 2025266 - protein, 22 aa, Staphylococcus
LDIKSIQPFIDYYKSHIGIKLR

SEQ ID NO: 2025267 - protein, 23 aa, Staphylococcus
LDIKSYILHQLFDTFVIDHSMAS

SEQ ID NO: 2025268 - protein, 22 aa, Staphylococcus
LDILKKEWDLFSKAVNQFIEES

SEQ ID NO: 2025269 - protein, 28 aa, Staphylococcus
LDINEKVCTVGYWLNYELHQKYGVMNEH

SEQ ID NO: 2025270 - protein, 17 aa, Staphylococcus
LDINHDLLRGVAASGNR

SEQ ID NO: 2025271 - protein, 17 aa, Staphylococcus
LDIPQTQFEYIGTVVGQ

SEQ ID NO: 2025272 - protein, 22 aa, Staphylococcus
LDIQLLRRIHFKLNDNLRDLFY

SEQ ID NO: 2025273 - protein, 19 aa, Staphylococcus
LDIQPKLGRSIYINYLKKR

SEQ ID NO: 2025274 - protein, 21 aa, Staphylococcus
LDIQVPGAFPKFGTTDGTITK

SEQ ID NO: 2025275 - protein, 21 aa, Staphylococcus
LDIQVSGAFPKFGATDGTITK

SEQ ID NO: 2025276 - protein, 28 aa, Staphylococcus
LDIRHDDVWMLFGTLPIYPCINDEDDQL

SEQ ID NO: 2025277 - protein, 28 aa, Staphylococcus
LDISPKGIHKWAALKMLGIDKGDYIAFG

SEQ ID NO: 2025278 - protein, 17 aa, Staphylococcus
LDITKPQLIELIDNYSS

SEQ ID NO: 2025279 - protein, 22 aa, Staphylococcus
LDIYYQFSLPFGKKYAEQSVKN

SEQ ID NO: 2025280 - protein, 22 aa, Staphylococcus
LDKDDEVCILYGTKNGLVGLPN

SEQ ID NO: 2025281 - protein, 17 aa, Staphylococcus
LDKDSVILLEQIRTLDK

SEQ ID NO: 2025282 - protein, 18 aa, Staphylococcus
LDKDSVILLEQIRTLDKK

SEQ ID NO: 2025283 - protein, 18 aa, Staphylococcus
LDKDSVILLEQIRTVDKK

SEQ ID NO: 2025284 - protein, 28 aa, Staphylococcus
LDKDVKLPVIFWMHGGGFIAGDKQYKNP

SEQ ID NO: 2025285 - protein, 18 aa, Staphylococcus
LDKDVVRRRIKLMKEAGI

SEQ ID NO: 2025286 - protein, 22 aa, Staphylococcus
LDKEDEVCILYGTKNGLVALPT

SEQ ID NO: 2025287 - protein, 24 aa, Staphylococcus
LDKEIIRKHLIDILNYTVEEKSFL

SEQ ID NO: 2025288 - protein, 22 aa, Staphylococcus
LDKEVIEKVTWITPNESESELL

SEQ ID NO: 2025289 - protein, 24 aa, Staphylococcus
LDKFKACYKALLAKNEVNLKQDGM

SEQ ID NO: 2025290 - protein, 19 aa, Staphylococcus
LDKGFYCTAKFRYRQKDTK

SEQ ID NO: 2025291 - protein, 17 aa, Staphylococcus
LDKGISFTEFAYQILQS

SEQ ID NO: 2025292 - protein, 23 aa, Staphylococcus
LDKKLRLASFAEIDNTLVGQPGD

SEQ ID NO: 2025293 - protein, 20 aa, Staphylococcus
LDKKRLKEKLTYLSDEKMQE

SEQ ID NO: 2025294 - protein, 18 aa, Staphylococcus
LDKKRLKEKLTYLSEDKM

SEQ ID NO: 2025295 - protein, 24 aa, Staphylococcus
LDKKRLKEKLTYLSEDKMKEVDHA

SEQ ID NO: 2025296 - protein, 24 aa, Staphylococcus
LDKKRLKEKLTYLSESKMKEVDNA

SEQ ID NO: 2025297 - protein, 30 aa, Staphylococcus
LDKLAKRFSKLIIVPMFLYDGRLVNKVKKL

SEQ ID NO: 2025298 - protein, 24 aa, Staphylococcus
LDKLYGFCIQNHIPVRNKVLIFSG

SEQ ID NO: 2025299 - protein, 27 aa, Staphylococcus
LDKLYGFCLKRRIPVRDKILIFSGRIS

SEQ ID NO: 2025300 - protein, 22 aa, Staphylococcus
LDKMKRVIGRAVPGAPHEALLC

SEQ ID NO: 2025301 - protein, 17 aa, Staphylococcus
LDKMLGITIGQTIVILI

SEQ ID NO: 2025302 - protein, 27 aa, Staphylococcus
LDKNGCPVRHAILWNDTRNSAQCEQII

SEQ ID NO: 2025303 - protein, 24 aa, Staphylococcus
LDKNGQRILIGWMGLPETTYPTDE

SEQ ID NO: 2025304 - protein, 25 aa, Staphylococcus
LDKPFILCEYAHAMGNSPGDLNAYQ

SEQ ID NO: 2025305 - protein, 31 aa, Staphylococcus
LDKPLHFETFISLSCHKCPDVVQALNLMSVL

SEQ ID NO: 2025306 - protein, 24 aa, Staphylococcus
LDKPYMIVCLNVIVAESDEEAEYL

SEQ ID NO: 2025307 - protein, 24 aa, Staphylococcus
LDKQGNRILIGWMGMPDTHYPTDD

SEQ ID NO: 2025308 - protein, 21 aa, Staphylococcus
LDKRQKRQWKELSIEDKRKLI

SEQ ID NO: 2025309 - protein, 23 aa, Staphylococcus
LDKSMVIGETYLLSKSGGKSGHY

SEQ ID NO: 2025310 - protein, 23 aa, Staphylococcus
LDKTLERKAVWDKWMEQDKNNNK

SEQ ID NO: 2025311 - protein, 25 aa, Staphylococcus
LDKTLKRKAVWDKWMEKDMNNTSAP

SEQ ID NO: 2025312 - protein, 17 aa, Staphylococcus
LDKTMAFLDIDENMAQR

SEQ ID NO: 2025313 - protein, 17 aa, Staphylococcus
LDKVETLRANWIQTNGG

SEQ ID NO: 2025314 - protein, 18 aa, Staphylococcus
LDKVIKWNQPMYTHHGTY

SEQ ID NO: 2025315 - protein, 19 aa, Staphylococcus
LDKVVYAICEWGDLFKDEI

SEQ ID NO: 2025316 - protein, 17 aa, Staphylococcus
LDKYDFIVGDFGYDQLR

SEQ ID NO: 2025317 - protein, 31 aa, Staphylococcus
LDKYLHHHQCLYVKLDPYWIYQIYDKDVNPL

SEQ ID NO: 2025318 - protein, 17 aa, Staphylococcus
LDLAAAIYIYNDYEVYY

SEQ ID NO: 2025319 - protein, 18 aa, Staphylococcus
LDLAKERISKISFDTFVK

SEQ ID NO: 2025320 - protein, 21 aa, Staphylococcus
LDLDFPINVEKVILSGCYQTI

SEQ ID NO: 2025321 - protein, 23 aa, Staphylococcus
LDLDFPINVEKVILSGCYQTIGW

SEQ ID NO: 2025322 - protein, 23 aa, Staphylococcus
LDLDYLDLYLMHWPGMNEALMID

SEQ ID NO: 2025323 - protein, 17 aa, Staphylococcus
LDLEVFIIGKDELSHIL

SEQ ID NO: 2025324 - protein, 24 aa, Staphylococcus
LDLEVIDYPTFLGHVIEQYISIAV

SEQ ID NO: 2025325 - protein, 17 aa, Staphylococcus
LDLEWLSFQFVDDDFVE

SEQ ID NO: 2025326 - protein, 25 aa, Staphylococcus
LDLFKKGLERYSLEYEYDAKTKTFH

SEQ ID NO: 2025327 - protein, 18 aa, Staphylococcus
LDLIERCGYRLTAPGIGR

SEQ ID NO: 2025328 - protein, 25 aa, Staphylococcus
LDLIKSHAPWSFTIGSAFFDNKFDG

SEQ ID NO: 2025329 - protein, 24 aa, Staphylococcus
LDLIPEFSHLGIFPVGRLDKDTEG

SEQ ID NO: 2025330 - protein, 21 aa, Staphylococcus
LDLKGGQKMYFEQKLETYVPV

SEQ ID NO: 2025331 - protein, 19 aa, Staphylococcus
LDLLQRCYGNEFKNWIPKI

SEQ ID NO: 2025332 - protein, 17 aa, Staphylococcus
LDLPQEVIIASRIRHGQ

SEQ ID NO: 2025333 - protein, 18 aa, Staphylococcus
LDLQLAWDSIALHTTLGV

SEQ ID NO: 2025334 - protein, 18 aa, Staphylococcus
LDLRGYRYDEAMVAVDQY

SEQ ID NO: 2025335 - protein, 25 aa, Staphylococcus
LDLSKRMKWYTVIQAIGLVEWNEEQ

SEQ ID NO: 2025336 - protein, 24 aa, Staphylococcus
LDLSRTKLLVSIRRLIDKEKLSKQ

SEQ ID NO: 2025337 - protein, 22 aa, Staphylococcus
LDLYFKYLISILRLQNWIPPLQ

SEQ ID NO: 2025338 - protein, 27 aa, Staphylococcus
LDLYLIHWPCEADGLFIETYKAMEELY

SEQ ID NO: 2025339 - protein, 22 aa, Staphylococcus
LDLYLSKAIQLAKMVKGQTGVN

SEQ ID NO: 2025340 - protein, 18 aa, Staphylococcus
LDMAKRLLDFGVHPPTIY

SEQ ID NO: 2025341 - protein, 21 aa, Staphylococcus
LDMDYGWNVKLGKNIFVNSNC

SEQ ID NO: 2025342 - protein, 19 aa, Staphylococcus
LDMGKSCIRMRNINYIPYE

SEQ ID NO: 2025343 - protein, 33 aa, Staphylococcus
LDMKVIKNFCKKYKISLSSLFSSVWSLVVSAYT

SEQ ID NO: 2025344 - protein, 18 aa, Staphylococcus
LDNAFAYEGPALIEVRIS

SEQ ID NO: 2025345 - protein, 29 aa, Staphylococcus
LDNAMKSYIKFCIKPLIKKIEDELNAKLL

SEQ ID NO: 2025346 - protein, 18 aa, Staphylococcus
LDNCDIFFIGGGSDREQA

SEQ ID NO: 2025347 - protein, 18 aa, Staphylococcus
LDNCDIFFIGGGSDREQS

SEQ ID NO: 2025348 - protein, 25 aa, Staphylococcus
LDNEALKARILEEFQDWDEELLKYI

SEQ ID NO: 2025349 - protein, 25 aa, Staphylococcus
LDNFKFNELMVGIQTPFLFDEEDET

SEQ ID NO: 2025350 - protein, 17 aa, Staphylococcus
LDNGLEIFVGVPSDRYP

SEQ ID NO: 2025351 - protein, 21 aa, Staphylococcus
LDNGLRLFIIPKKGFQKTFVT

SEQ ID NO: 2025352 - protein, 24 aa, Staphylococcus
LDNISSLMLRYKLKEEESYRDKYF

SEQ ID NO: 2025353 - protein, 26 aa, Staphylococcus
LDNITICGMGGPLIAKILKEGQQKLQ

SEQ ID NO: 2025354 - protein, 20 aa, Staphylococcus
LDNLCTTIWEIDEGRITEYK

SEQ ID NO: 2025355 - protein, 18 aa, Staphylococcus
LDNLEDWYNKGAYAVGIG

SEQ ID NO: 2025356 - protein, 19 aa, Staphylococcus
LDNLKQVTGYIRGGCSPVG

SEQ ID NO: 2025357 - protein, 18 aa, Staphylococcus
LDNLLPIRLDGATKEFFA

SEQ ID NO: 2025358 - protein, 34 aa, Staphylococcus
LDNMGLDYFDLFLIHWPCEQNGRYIETYKALEDL

SEQ ID NO: 2025359 - protein, 18 aa, Staphylococcus
LDNNETFVTCYLKNPEEN

SEQ ID NO: 2025360 - protein, 18 aa, Staphylococcus
LDPALIPYIMEKTGKNAD

SEQ ID NO: 2025361 - protein, 25 aa, Staphylococcus
LDPDEPFSAFAFKERAQKLITEITE

SEQ ID NO: 2025362 - protein, 25 aa, Staphylococcus
LDPDIFYPLIKKLKENNDYVVVNVD

SEQ ID NO: 2025363 - protein, 20 aa, Staphylococcus
LDPDKKFYVPEEVYEIFQTT

SEQ ID NO: 2025364 - protein, 19 aa, Staphylococcus
LDPEKRFNVPQEVYDIFNS

SEQ ID NO: 2025365 - protein, 23 aa, Staphylococcus
LDPEVDGVLPICLGNATRVSDYV

SEQ ID NO: 2025366 - protein, 24 aa, Staphylococcus
LDPEVSGVLPICIGSATKVSDYIM

SEQ ID NO: 2025367 - protein, 24 aa, Staphylococcus
LDPEVSGVLPICIGSATRVSDYVM

SEQ ID NO: 2025368 - protein, 24 aa, Staphylococcus
LDPEVSGVLPICIGTATRVSDYVM

SEQ ID NO: 2025369 - protein, 24 aa, Staphylococcus
LDPEVSGVLPVCIGTATRVSDYVM

SEQ ID NO: 2025370 - protein, 17 aa, Staphylococcus
LDPGMAFGTGDHPTTSM

SEQ ID NO: 2025371 - protein, 21 aa, Staphylococcus
LDPNSSCPCQYVANEFINAAY

SEQ ID NO: 2025372 - protein, 19 aa, Staphylococcus
LDPSLLLAPWEVIEERLKD

SEQ ID NO: 2025373 - protein, 17 aa, Staphylococcus
LDPSNSVARNILKETAK

SEQ ID NO: 2025374 - protein, 37 aa, Staphylococcus
LDQAKLNIGFRFPTYYGRPDYYTFVVFNTMFGGDPSS

SEQ ID NO: 2025375 - protein, 20 aa, Staphylococcus
LDQFTQYTVHDWWNDVLNGY

SEQ ID NO: 2025376 - protein, 19 aa, Staphylococcus
LDQHVRAYIVLKLKAKPNR

SEQ ID NO: 2025377 - protein, 24 aa, Staphylococcus
LDQHVRAYIVLKLRSKPNRLHQAA

SEQ ID NO: 2025378 - protein, 20 aa, Staphylococcus
LDQICLSPQCGFASTEEGNQ

SEQ ID NO: 2025379 - protein, 23 aa, Staphylococcus
LDQIKAQLLKLEENINLYTKLSK

SEQ ID NO: 2025380 - protein, 17 aa, Staphylococcus
LDQINWVGFYLIENEEL

SEQ ID NO: 2025381 - protein, 17 aa, Staphylococcus
LDQLIYAVGTRREYYIF

SEQ ID NO: 2025382 - protein, 23 aa, Staphylococcus
LDQMMRMLHPFMPFVTEEIWQSL

SEQ ID NO: 2025383 - protein, 19 aa, Staphylococcus
LDQRLMIVSEYSIPYYAGL

SEQ ID NO: 2025384 - protein, 17 aa, Staphylococcus
LDQRRLIICLSAVQHEK

SEQ ID NO: 2025385 - protein, 19 aa, Staphylococcus
LDQSFKMIVGLSPSNYAQA

SEQ ID NO: 2025386 - protein, 17 aa, Staphylococcus
LDQSFKMIVGQSPTEYA

SEQ ID NO: 2025387 - protein, 17 aa, Staphylococcus
LDQSFLKAGLDKQYGPP

SEQ ID NO: 2025388 - protein, 23 aa, Staphylococcus
LDQTHFYSAIFIPSSDDHVHQLE

SEQ ID NO: 2025389 - protein, 20 aa, Staphylococcus
LDQTLRLFTNYQIYLHGYSM

SEQ ID NO: 2025390 - protein, 26 aa, Staphylococcus
LDRDKVSRIGSTFGKTNRVIIDTDDH

SEQ ID NO: 2025391 - protein, 20 aa, Staphylococcus
LDRIKDLILKQTNLSQVHIT

SEQ ID NO: 2025392 - protein, 23 aa, Staphylococcus
LDRIKRGKYYGATWQDKVKIDWD

SEQ ID NO: 2025393 - protein, 20 aa, Staphylococcus
LDRKLSISFDETLGYLTTCP

SEQ ID NO: 2025394 - protein, 18 aa, Staphylococcus
LDRLFEMLQLNKSFSEKN

SEQ ID NO: 2025395 - protein, 17 aa, Staphylococcus
LDRRKIDEIMEVLETNA

SEQ ID NO: 2025396 - protein, 17 aa, Staphylococcus
LDRRKLDEIMDVLESNA

SEQ ID NO: 2025397 - protein, 17 aa, Staphylococcus
LDRRKLDEIMEVLETNA

SEQ ID NO: 2025398 - protein, 25 aa, Staphylococcus
LDSAKARGAEIYAEIVGYGYTGDAY

SEQ ID NO: 2025399 - protein, 17 aa, Staphylococcus
LDSALANYHDMIEKAYH

SEQ ID NO: 2025400 - protein, 21 aa, Staphylococcus
LDSARLRYLISNELNVAPASV

SEQ ID NO: 2025401 - protein, 22 aa, Staphylococcus
LDSASHFMLIFARKNVTSQSPY

SEQ ID NO: 2025402 - protein, 23 aa, Staphylococcus
LDSDRFVPVVAIAVGKGAQEAHE

SEQ ID NO: 2025403 - protein, 21 aa, Staphylococcus
LDSEFGLEGNRLFYLAMAPNF

SEQ ID NO: 2025404 - protein, 21 aa, Staphylococcus
LDSEMRRSNANFKHSEKNMQS

SEQ ID NO: 2025405 - protein, 17 aa, Staphylococcus
LDSFTALTFSYVVNHNK

SEQ ID NO: 2025406 - protein, 24 aa, Staphylococcus
LDSGTKKRGYAFTKLDSQKQPKQI

SEQ ID NO: 2025407 - protein, 17 aa, Staphylococcus
LDSHNTFNLIKLFQQRI

SEQ ID NO: 2025408 - protein, 19 aa, Staphylococcus
LDSHNTFNLLSLFQKRVAQ

SEQ ID NO: 2025409 - protein, 20 aa, Staphylococcus
LDSIFKIERILMDYLDQLPY

SEQ ID NO: 2025410 - protein, 17 aa, Staphylococcus
LDSIRVIKGQFGAHINT

SEQ ID NO: 2025411 - protein, 17 aa, Staphylococcus
LDSIVDWIYQGKINTHG

SEQ ID NO: 2025412 - protein, 17 aa, Staphylococcus
LDSKFVAIDSFKQKVSK

SEQ ID NO: 2025413 - protein, 18 aa, Staphylococcus
LDSKIAYSVEEVGNVIHF

SEQ ID NO: 2025414 - protein, 18 aa, Staphylococcus
LDSLWQLRNMFTDSTDFT

SEQ ID NO: 2025415 - protein, 21 aa, Staphylococcus
LDSNYYYAVHFDEKVEQEDIN

SEQ ID NO: 2025416 - protein, 24 aa, Staphylococcus
LDSPKLGAINVHASLLPKYRGGAP

SEQ ID NO: 2025417 - protein, 24 aa, Staphylococcus
LDSPVKFTQHIGGTKHFSYPTEPI

SEQ ID NO: 2025418 - protein, 18 aa, Staphylococcus
LDSRLVEAYEQLKHIQSD

SEQ ID NO: 2025419 - protein, 25 aa, Staphylococcus
LDSTHLLKLKRWHDIQLQESRKKAQ

SEQ ID NO: 2025420 - protein, 22 aa, Staphylococcus
LDSTYIDAEFGYAVDASQPVGT

SEQ ID NO: 2025421 - protein, 17 aa, Staphylococcus
LDTAIETRVGKGYIAND

SEQ ID NO: 2025422 - protein, 24 aa, Staphylococcus
LDTARFKYELAEEFGVSDRSVHGQ

SEQ ID NO: 2025423 - protein, 24 aa, Staphylococcus
LDTARYKTFIAEALHLSVQDITGL

SEQ ID NO: 2025424 - protein, 20 aa, Staphylococcus
LDTASRFVVILARKNVTAQS

SEQ ID NO: 2025425 - protein, 18 aa, Staphylococcus
LDTEAEIAYIKESMQPPK

SEQ ID NO: 2025426 - protein, 20 aa, Staphylococcus
LDTESLLGFKTIQTNEDGQQ

SEQ ID NO: 2025427 - protein, 25 aa, Staphylococcus
LDTLKELLPIPVIGVIEPGSRTAIM

SEQ ID NO: 2025428 - protein, 21 aa, Staphylococcus
LDTPLFIGIMPIASYNNALFL

SEQ ID NO: 2025429 - protein, 29 aa, Staphylococcus
LDTQFGLKGNRLFYLAMAPQFFGVISDYL

SEQ ID NO: 2025430 - protein, 19 aa, Staphylococcus
LDTRIDCHQLVYALLNVVQ

SEQ ID NO: 2025431 - protein, 19 aa, Staphylococcus
LDTSLLFNIIPERFQGQEV

SEQ ID NO: 2025432 - protein, 20 aa, Staphylococcus
LDTSLLFNIIPKRFQGREVD

SEQ ID NO: 2025433 - protein, 23 aa, Staphylococcus
LDTSVAVKWLIDKGYDVVACCLD

SEQ ID NO: 2025434 - protein, 23 aa, Staphylococcus
LDTSVAVKWLIDKGYDVVAVCLD

SEQ ID NO: 2025435 - protein, 24 aa, Staphylococcus
LDTSVAVKWLLDKGYDVVACCLDV

SEQ ID NO: 2025436 - protein, 18 aa, Staphylococcus
LDTVKICVAYELDGEEIT

SEQ ID NO: 2025437 - protein, 25 aa, Staphylococcus
LDTVWDFADKIIFPYVEDDELDGVV

SEQ ID NO: 2025438 - protein, 25 aa, Staphylococcus
LDTVWKFAEKVIFPYVEDDELVGVV

SEQ ID NO: 2025439 - protein, 25 aa, Staphylococcus
LDTWFSSALWPFSTLGWPDVEADDF

SEQ ID NO: 2025440 - protein, 25 aa, Staphylococcus
LDTWFSSALWPFSTLGWPNEEAKDY

SEQ ID NO: 2025441 - protein, 25 aa, Staphylococcus
LDTWFSSGLWPFSTLGWPDVESEDY

SEQ ID NO: 2025442 - protein, 25 aa, Staphylococcus
LDVDLIMCGASGLNAVERFMIGSVS

SEQ ID NO: 2025443 - protein, 22 aa, Staphylococcus
LDVDMYIIVSYGVKISEVANNV

SEQ ID NO: 2025444 - protein, 25 aa, Staphylococcus
LDVIKLEKFKCEKMIEGNVINFEEI

SEQ ID NO: 2025445 - protein, 23 aa, Staphylococcus
LDVLKEVVRGFGYSYRDYQKLVN

SEQ ID NO: 2025446 - protein, 18 aa, Staphylococcus
LDVLPEEIMYVGDDALND

SEQ ID NO: 2025447 - protein, 17 aa, Staphylococcus
LDVLQVIMFLRKMEVPL

SEQ ID NO: 2025448 - protein, 19 aa, Staphylococcus
LDVNYDWLIFSSKKAVEYF

SEQ ID NO: 2025449 - protein, 27 aa, Staphylococcus
LDVPNREGIEFVEFLISPNKGEPLKSL

SEQ ID NO: 2025450 - protein, 20 aa, Staphylococcus
LDVRTSEIFDLEGYDSYTDE

SEQ ID NO: 2025451 - protein, 17 aa, Staphylococcus
LDVSVAVGRERILKNQR

SEQ ID NO: 2025452 - protein, 18 aa, Staphylococcus
LDVVLKDMIHKSRSIAKQ

SEQ ID NO: 2025453 - protein, 24 aa, Staphylococcus
LDWDDEVLDLLGISRDQLPQLVST

SEQ ID NO: 2025454 - protein, 24 aa, Staphylococcus
LDWDKEALELLGITEAQLPQLVPT

SEQ ID NO: 2025455 - protein, 25 aa, Staphylococcus
LDYFSYEEMMEMSALGAGVLETRSV

SEQ ID NO: 2025456 - protein, 25 aa, Staphylococcus
LDYGCGTGLVGLQFADDVDQLILAD

SEQ ID NO: 2025457 - protein, 17 aa, Staphylococcus
LDYKEAMINLAKNPAGM

SEQ ID NO: 2025458 - protein, 20 aa, Staphylococcus
LDYLPSGSVFQWRQQGQHHV

SEQ ID NO: 2025459 - protein, 18 aa, Staphylococcus
LDYMYKIAQRDGFSTHDV

SEQ ID NO: 2025460 - protein, 23 aa, Staphylococcus
LDYPETCPHGGIIPRNQHFEEKF

SEQ ID NO: 2025461 - protein, 20 aa, Staphylococcus
LDYQKFCIAQGKTPQTVRQW

SEQ ID NO: 2025462 - protein, 25 aa, Staphylococcus
LDYRKKVDAALVFANIVGYAAENNY

SEQ ID NO: 2025463 - protein, 21 aa, Staphylococcus
LDYTIIRPAWLTFKNESDYEI

SEQ ID NO: 2025464 - protein, 19 aa, Staphylococcus
LDYTLSVTILKDLNDALTI

SEQ ID NO: 2025465 - protein, 24 aa, Staphylococcus
LDYTRALGALVMATTHYPELKAYS

SEQ ID NO: 2025466 - protein, 19 aa, Staphylococcus
LDYTYCRNEVKSLEMYFSG

SEQ ID NO: 2025467 - protein, 18 aa, Staphylococcus
LDYVPNLVAMQLRSNKSY

SEQ ID NO: 2025468 - protein, 18 aa, Staphylococcus
LDYWKFNPEESWHGFNGY

SEQ ID NO: 2025469 - protein, 21 aa, Staphylococcus
LDYYLFKGIETKLHIVVEDEK

SEQ ID NO: 2025470 - protein, 33 aa, Staphylococcus
LDYYPFQLSGGMAQRIALIMSIVREAKFLIADE

SEQ ID NO: 2025471 - protein, 21 aa, Staphylococcus
LEAAAKLSHRYVSDRFLPDKA

SEQ ID NO: 2025472 - protein, 23 aa, Staphylococcus
LEAAYQREVYKLVDQGESLTAPL

SEQ ID NO: 2025473 - protein, 24 aa, Staphylococcus
LEACEKSDAILLGAIGGPKWNDHP

SEQ ID NO: 2025474 - protein, 25 aa, Staphylococcus
LEADFKRWGINLVLLGDKLAIHAAA

SEQ ID NO: 2025475 - protein, 21 aa, Staphylococcus
LEADMLFKYVQKAISKDESGL

SEQ ID NO: 2025476 - protein, 25 aa, Staphylococcus
LEAEIAGRMRFFFPDVQVRGYYPGY

SEQ ID NO: 2025477 - protein, 29 aa, Staphylococcus
LEAFNYHKVYLFKEWKTEKGIINYLLGVD

SEQ ID NO: 2025478 - protein, 28 aa, Staphylococcus
LEAGNALAFAHGFNIHFGVIQPPADVDV

SEQ ID NO: 2025479 - protein, 41 aa, Staphylococcus
LEAGRSDYFWDLFIQMPAALMFPSGNPFYDWRYQTEEEPHM

SEQ ID NO: 2025480 - protein, 23 aa, Staphylococcus
LEAHITFLKEMVLDESFKVDVYV

SEQ ID NO: 2025481 - protein, 28 aa, Staphylococcus
LEAHNALAFAHGFNIHFGVITPPENVDV

SEQ ID NO: 2025482 - protein, 25 aa, Staphylococcus
LEAILPVVKEIAYKHCALQVPPAGY

SEQ ID NO: 2025483 - protein, 20 aa, Staphylococcus
LEAITYKELVGIQDMGAAGL

SEQ ID NO: 2025484 - protein, 17 aa, Staphylococcus
LEALAKLNIYPKYIETR

SEQ ID NO: 2025485 - protein, 20 aa, Staphylococcus
LEALCREYGILIAVDDIQQG

SEQ ID NO: 2025486 - protein, 18 aa, Staphylococcus
LEALDYSDNYTFQTLIFQ

SEQ ID NO: 2025487 - protein, 18 aa, Staphylococcus
LEALKEFGHVINFEEVVF

SEQ ID NO: 2025488 - protein, 17 aa, Staphylococcus
LEALLAQVSIKPMINQV

SEQ ID NO: 2025489 - protein, 18 aa, Staphylococcus
LEALPKSLAIIGGGVIGL

SEQ ID NO: 2025490 - protein, 18 aa, Staphylococcus
LEALREHPKIFSGYSDST

SEQ ID NO: 2025491 - protein, 17 aa, Staphylococcus
LEAMFTLMLQHKYPEHD

SEQ ID NO: 2025492 - protein, 17 aa, Staphylococcus
LEAMGFKEPTPIQKDSI

SEQ ID NO: 2025493 - protein, 20 aa, Staphylococcus
LEAMTIHRLIGWNQDTQPED

SEQ ID NO: 2025494 - protein, 19 aa, Staphylococcus
LEARIYPVGRLDYDTSGLL

SEQ ID NO: 2025495 - protein, 19 aa, Staphylococcus
LEASMKYIDEHGGMIIYLP

SEQ ID NO: 2025496 - protein, 19 aa, Staphylococcus
LEASMKYINDHGGLIIYLP

SEQ ID NO: 2025497 - protein, 18 aa, Staphylococcus
LEASRNGKSWLAELQAKE

SEQ ID NO: 2025498 - protein, 22 aa, Staphylococcus
LEATFGVTCELDYHDDYPALYN

SEQ ID NO: 2025499 - protein, 17 aa, Staphylococcus
LEATPFYAVSGGQVADQ

SEQ ID NO: 2025500 - protein, 18 aa, Staphylococcus
LEAVKSQRVHFVSRDDWA

SEQ ID NO: 2025501 - protein, 23 aa, Staphylococcus
LEAVPSDLAALISERLDIPVIGI

SEQ ID NO: 2025502 - protein, 18 aa, Staphylococcus
LEAVRKRPGMYIGSTSEK

SEQ ID NO: 2025503 - protein, 18 aa, Staphylococcus
LEAVWDYSYDKVGYLGTN

SEQ ID NO: 2025504 - protein, 36 aa, Staphylococcus
LECEKILGSYGIPVSTLRAGLIIGAKGSSYPILKRL

SEQ ID NO: 2025505 - protein, 18 aa, Staphylococcus
LECGACGGAASGFNAKLL

SEQ ID NO: 2025506 - protein, 18 aa, Staphylococcus
LECGACGGASSGFNAKLL

SEQ ID NO: 2025507 - protein, 21 aa, Staphylococcus
LECGCDILMGTVFFDSINDFC

SEQ ID NO: 2025508 - protein, 20 aa, Staphylococcus
LECHPDVNILIGENAQGKTN

SEQ ID NO: 2025509 - protein, 23 aa, Staphylococcus
LEDCFKIRKEVFVKEQHVAEDHE

SEQ ID NO: 2025510 - protein, 24 aa, Staphylococcus
LEDFKFNELMVAIQSPFLLDDEDD

SEQ ID NO: 2025511 - protein, 23 aa, Staphylococcus
LEDGCIYREVYHLKRITESSKEL

SEQ ID NO: 2025512 - protein, 17 aa, Staphylococcus
LEDGRINLMSNPRTQKA

SEQ ID NO: 2025513 - protein, 21 aa, Staphylococcus
LEDHFFGRVGLFRNQVGDELL

SEQ ID NO: 2025514 - protein, 21 aa, Staphylococcus
LEDIDGLILPGGESTTLRRLM

SEQ ID NO: 2025515 - protein, 25 aa, Staphylococcus
LEDIEVVAALLLKQADVKLLKRKDY

SEQ ID NO: 2025516 - protein, 19 aa, Staphylococcus
LEDIFTIMLRNSYPDHDIE

SEQ ID NO: 2025517 - protein, 22 aa, Staphylococcus
LEDIQSIPMCLMYGKDDKIVET

SEQ ID NO: 2025518 - protein, 17 aa, Staphylococcus
LEDKVPFLTQSKLEEQG

SEQ ID NO: 2025519 - protein, 21 aa, Staphylococcus
LEDLKGLLSIESVREDDKASA

SEQ ID NO: 2025520 - protein, 25 aa, Staphylococcus
LEDLNSKLYHYWALGHIHERQQLSD

SEQ ID NO: 2025521 - protein, 25 aa, Staphylococcus
LEDLNSRLYHYWALGHIHEREQLSD

SEQ ID NO: 2025522 - protein, 24 aa, Staphylococcus
LEDLRIVLWKGHCSVHEKFHKAHI

SEQ ID NO: 2025523 - protein, 20 aa, Staphylococcus
LEDLRYEFKNSLSAIQNGDE

SEQ ID NO: 2025524 - protein, 19 aa, Staphylococcus
LEDMDLYTAKQFLYAEPDD

SEQ ID NO: 2025525 - protein, 32 aa, Staphylococcus
LEDMEIEILHVLKRFKAMLIQKNETVEAMQGY

SEQ ID NO: 2025526 - protein, 17 aa, Staphylococcus
LEDMELIPLKKRQISEL

SEQ ID NO: 2025527 - protein, 26 aa, Staphylococcus
LEDQPRYIYCGTLGILMPDDKMIFNV

SEQ ID NO: 2025528 - protein, 24 aa, Staphylococcus
LEDSFAINMTPFFKITEPKDNATA

SEQ ID NO: 2025529 - protein, 24 aa, Staphylococcus
LEDSFAINMTPFFKNAEPLESATT

SEQ ID NO: 2025530 - protein, 25 aa, Staphylococcus
LEDSHPIIQTWKKAYQEIADVFIQV

SEQ ID NO: 2025531 - protein, 19 aa, Staphylococcus
LEEAARVSVQLSNDEKPNF

SEQ ID NO: 2025532 - protein, 22 aa, Staphylococcus
LEEARFGIGVFGGRVEAVETFE

SEQ ID NO: 2025533 - protein, 17 aa, Staphylococcus
LEEARQLLNEAIENGSA

SEQ ID NO: 2025534 - protein, 18 aa, Staphylococcus
LEEARRKLKQAIQDGTAL

SEQ ID NO: 2025535 - protein, 25 aa, Staphylococcus
LEECKNLKWIAWYATGVNNLPLDYI

SEQ ID NO: 2025536 - protein, 21 aa, Staphylococcus
LEEDALCFYDLGSADMNLDLA

SEQ ID NO: 2025537 - protein, 17 aa, Staphylococcus
LEEESRHGYQIIKDLEE

SEQ ID NO: 2025538 - protein, 17 aa, Staphylococcus
LEEETGYIAKDLELIAD

SEQ ID NO: 2025539 - protein, 19 aa, Staphylococcus
LEEFRGVYINSPKDSAPQI

SEQ ID NO: 2025540 - protein, 23 aa, Staphylococcus
LEEGLRIVLVLNGMMKVINGDSV

SEQ ID NO: 2025541 - protein, 19 aa, Staphylococcus
LEEGLRSLTSIGIDEEKVE

SEQ ID NO: 2025542 - protein, 17 aa, Staphylococcus
LEEGYEVIIHYNRSDIT

SEQ ID NO: 2025543 - protein, 17 aa, Staphylococcus
LEEIHALNMRRQNMKQH

SEQ ID NO: 2025544 - protein, 28 aa, Staphylococcus
LEEIPRHVYCGTIGLLLPNGKAIFNVAI

SEQ ID NO: 2025545 - protein, 23 aa, Staphylococcus
LEEKPWNAKEMTIKDLDGHLLTL

SEQ ID NO: 2025546 - protein, 23 aa, Staphylococcus
LEELKKKLTKEGLFDQQYKKSIP

SEQ ID NO: 2025547 - protein, 30 aa, Staphylococcus
LEELKLPYRRVILCTGDIGFSAAKTYDLEV

SEQ ID NO: 2025548 - protein, 23 aa, Staphylococcus
LEELLRNGSQEEIEYQKTHGGDI

SEQ ID NO: 2025549 - protein, 20 aa, Staphylococcus
LEELYILGLLIINNEPSTYK

SEQ ID NO: 2025550 - protein, 24 aa, Staphylococcus
LEEMSRANVAAVFGDLFQLLDRDN

SEQ ID NO: 2025551 - protein, 20 aa, Staphylococcus
LEEPHLKFKSDKIVGNYHKL

SEQ ID NO: 2025552 - protein, 24 aa, Staphylococcus
LEEPLTFPLITLIVSGGHTELVYM

SEQ ID NO: 2025553 - protein, 20 aa, Staphylococcus
LEEPPAHAIFILATTEPHKI

SEQ ID NO: 2025554 - protein, 19 aa, Staphylococcus
LEEPPENTIAILLSTKPEQ

SEQ ID NO: 2025555 - protein, 21 aa, Staphylococcus
LEEPPSHAIFILATTEPHKIP

SEQ ID NO: 2025556 - protein, 19 aa, Staphylococcus
LEEREAGQLFKLVDSNRKY

SEQ ID NO: 2025557 - protein, 34 aa, Staphylococcus
LEERGYQLSKTEYRGREATDFKEEDIELFQDIAE

SEQ ID NO: 2025558 - protein, 19 aa, Staphylococcus
LEERLPVWIKRSKRTIRQD

SEQ ID NO: 2025559 - protein, 27 aa, Staphylococcus
LEERMGCGIGACYACVCHTPESDTSYV

SEQ ID NO: 2025560 - protein, 21 aa, Staphylococcus
LEESLALYQRGMTLSAACDTT

SEQ ID NO: 2025561 - protein, 25 aa, Staphylococcus
LEEVCGACSMVINGHARQACSAIVD

SEQ ID NO: 2025562 - protein, 24 aa, Staphylococcus
LEEVCGACSMVINGQARQSCSAIV

SEQ ID NO: 2025563 - protein, 25 aa, Staphylococcus
LEEVCGACSMVINGRARQACSAIVD

SEQ ID NO: 2025564 - protein, 24 aa, Staphylococcus
LEEVDRYLAAFVYMHYKYTNHAMT

SEQ ID NO: 2025565 - protein, 17 aa, Staphylococcus
LEEVVAFGDSLNDQSML

SEQ ID NO: 2025566 - protein, 17 aa, Staphylococcus
LEEYKLHRIKVIVENDA

SEQ ID NO: 2025567 - protein, 24 aa, Staphylococcus
LEFESGHFYTLLGPSGCGKTTILK

SEQ ID NO: 2025568 - protein, 19 aa, Staphylococcus
LEFFPFLDPQQFVFCGRKN

SEQ ID NO: 2025569 - protein, 29 aa, Staphylococcus
LEFGPAIKGARGYIFFGHPLDIEMVAGSY

SEQ ID NO: 2025570 - protein, 29 aa, Staphylococcus
LEFKYICLKFIVTEYWSLSSLFNSGAVHI

SEQ ID NO: 2025571 - protein, 27 aa, Staphylococcus
LEFKYICLKLITTEYWSLNSLFNGGAV

SEQ ID NO: 2025572 - protein, 23 aa, Staphylococcus
LEFLGDAVLELTVSRYLFDKYPE

SEQ ID NO: 2025573 - protein, 17 aa, Staphylococcus
LEFNIGNVMFKENDHYF

SEQ ID NO: 2025574 - protein, 21 aa, Staphylococcus
LEGALPYPPGIFCVVPGEKWS

SEQ ID NO: 2025575 - protein, 21 aa, Staphylococcus
LEGALTRLLAYSKLQGRPITT

SEQ ID NO: 2025576 - protein, 21 aa, Staphylococcus
LEGALTRLLAYSQLQGKPITT

SEQ ID NO: 2025577 - protein, 21 aa, Staphylococcus
LEGALTRLLAYSQLQGRPITT

SEQ ID NO: 2025578 - protein, 20 aa, Staphylococcus
LEGALTRVIAYSRLQNEAIT

SEQ ID NO: 2025579 - protein, 21 aa, Staphylococcus
LEGANRFYIYDPFGNRIEIIE

SEQ ID NO: 2025580 - protein, 24 aa, Staphylococcus
LEGEPGICILGAIVDYIDKDKVLK

SEQ ID NO: 2025581 - protein, 17 aa, Staphylococcus
LEGEYGFSDICLGVPTV

SEQ ID NO: 2025582 - protein, 22 aa, Staphylococcus
LEGFDGVLIPGGFSFGDYLRSG

SEQ ID NO: 2025583 - protein, 23 aa, Staphylococcus
LEGFDGVLIPGGFSFGDYLRSGA

SEQ ID NO: 2025584 - protein, 21 aa, Staphylococcus
LEGFKELGFETYFAIPRSKEE

SEQ ID NO: 2025585 - protein, 18 aa, Staphylococcus
LEGFNIYNIEEIQLLNQI

SEQ ID NO: 2025586 - protein, 20 aa, Staphylococcus
LEGHSVALLAQDYYYKDQSH

SEQ ID NO: 2025587 - protein, 17 aa, Staphylococcus
LEGIAKFNLLKENGIIV

SEQ ID NO: 2025588 - protein, 26 aa, Staphylococcus
LEGISGFLKGEWPDINVLMSILSNHA

SEQ ID NO: 2025589 - protein, 18 aa, Staphylococcus
LEGLGILDFYTESREDRL

SEQ ID NO: 2025590 - protein, 20 aa, Staphylococcus
LEGLSPLLYYIDAQSKEKEN

SEQ ID NO: 2025591 - protein, 21 aa, Staphylococcus
LEGNRLFYLAMAPNFFGVVTD

SEQ ID NO: 2025592 - protein, 25 aa, Staphylococcus
LEGNTYKLYFGFANRSAYEDFKSSD

SEQ ID NO: 2025593 - protein, 19 aa, Staphylococcus
LEGPFGEAMAQQFEDLAKS

SEQ ID NO: 2025594 - protein, 21 aa, Staphylococcus
LEGRMGYGIHFAMDYLTEQTR

SEQ ID NO: 2025595 - protein, 19 aa, Staphylococcus
LEGSFNFETYVSLTCQKCP

SEQ ID NO: 2025596 - protein, 17 aa, Staphylococcus
LEGTGAIEFQRVDGKVT

SEQ ID NO: 2025597 - protein, 23 aa, Staphylococcus
LEGVKSIFYVIDFLAIDKTPKAD

SEQ ID NO: 2025598 - protein, 19 aa, Staphylococcus
LEHARELNVRNALLHTDSK

SEQ ID NO: 2025599 - protein, 25 aa, Staphylococcus
LEHFKALSVGKWVRAQGRIEEDTFV

SEQ ID NO: 2025600 - protein, 20 aa, Staphylococcus
LEHFNKYTLIECQLETGRTH

SEQ ID NO: 2025601 - protein, 23 aa, Staphylococcus
LEHHMKSCIMDKINDGQEVEAME

SEQ ID NO: 2025602 - protein, 21 aa, Staphylococcus
LEHHMKSCIMEKINQGTEEEA

SEQ ID NO: 2025603 - protein, 17 aa, Staphylococcus
LEHKVLPIYGVQYHPES

SEQ ID NO: 2025604 - protein, 19 aa, Staphylococcus
LEHLLYASFDAVFLDINLM

SEQ ID NO: 2025605 - protein, 20 aa, Staphylococcus
LEHLNNITFIPAGNKYIVKH

SEQ ID NO: 2025606 - protein, 21 aa, Staphylococcus
LEHRRQFLYEHEFEKQEEIDY

SEQ ID NO: 2025607 - protein, 19 aa, Staphylococcus
LEHVDYIGVGPMYETSSKS

SEQ ID NO: 2025608 - protein, 24 aa, Staphylococcus
LEHVEGYVAAFVYLFFQQSQQKVT

SEQ ID NO: 2025609 - protein, 18 aa, Staphylococcus
LEIAGVARTEAKKRALEL

SEQ ID NO: 2025610 - protein, 23 aa, Staphylococcus
LEIASNWKKLGIKTAKEAYNYAL

SEQ ID NO: 2025611 - protein, 22 aa, Staphylococcus
LEIEAGEFIAFIGTSGSGKTTA

SEQ ID NO: 2025612 - protein, 24 aa, Staphylococcus
LEIEAIQGFIFRQAKSHNVNTPHL

SEQ ID NO: 2025613 - protein, 17 aa, Staphylococcus
LEIFLDSNFLKEDVVIV

SEQ ID NO: 2025614 - protein, 24 aa, Staphylococcus
LEIFPKTRLDLELDINDTITDKIP

SEQ ID NO: 2025615 - protein, 23 aa, Staphylococcus
LEIGPGKVLSGLIRKINKNVKVT

SEQ ID NO: 2025616 - protein, 20 aa, Staphylococcus
LEIGSGSFIPGFEEQLEGLK

SEQ ID NO: 2025617 - protein, 26 aa, Staphylococcus
LEIHFPKSKLYLYAPVTGQHAFNRID

SEQ ID NO: 2025618 - protein, 30 aa, Staphylococcus
LEIIKRHRLLELFLIEILKYNWEEVHQEAE

SEQ ID NO: 2025619 - protein, 17 aa, Staphylococcus
LEIKKGEVLAIIGPSGS

SEQ ID NO: 2025620 - protein, 20 aa, Staphylococcus
LEILDLLSCDELCADNILKY

SEQ ID NO: 2025621 - protein, 20 aa, Staphylococcus
LEILDLLSCGELCACDLLEH

SEQ ID NO: 2025622 - protein, 27 aa, Staphylococcus
LEILNRLYIPLIGFKAIGVYHFMNQFI

SEQ ID NO: 2025623 - protein, 17 aa, Staphylococcus
LEIMPLLSEWYEEDKSN

SEQ ID NO: 2025624 - protein, 22 aa, Staphylococcus
LEINFADGLTVLSGETGAGKSI

SEQ ID NO: 2025625 - protein, 17 aa, Staphylococcus
LEIPHKVKDVAVGLTKV

SEQ ID NO: 2025626 - protein, 17 aa, Staphylococcus
LEIPNKVKDVAVGSTKV

SEQ ID NO: 2025627 - protein, 19 aa, Staphylococcus
LEIQRIYFYKTYQGGGRGQ

SEQ ID NO: 2025628 - protein, 18 aa, Staphylococcus
LEISRETFSSALFKNQIF

SEQ ID NO: 2025629 - protein, 17 aa, Staphylococcus
LEISRRILEKKEHFATV

SEQ ID NO: 2025630 - protein, 17 aa, Staphylococcus
LEIVESITLESVNETSK

SEQ ID NO: 2025631 - protein, 27 aa, Staphylococcus
LEIVKAEEGFVRYIIPEYITKHVGQMQ

SEQ ID NO: 2025632 - protein, 17 aa, Staphylococcus
LEIVQTISRNHCAYPKH

SEQ ID NO: 2025633 - protein, 18 aa, Staphylococcus
LEIVQTISRNHCAYPNHS

SEQ ID NO: 2025634 - protein, 18 aa, Staphylococcus
LEIYEYVHQILPLSKKRE

SEQ ID NO: 2025635 - protein, 20 aa, Staphylococcus
LEKALFERGVRSYRLDGDNI

SEQ ID NO: 2025636 - protein, 18 aa, Staphylococcus
LEKALTFVVETAVNQVGV

SEQ ID NO: 2025637 - protein, 20 aa, Staphylococcus
LEKDGPRIMALEPQDDNRDG

SEQ ID NO: 2025638 - protein, 17 aa, Staphylococcus
LEKDPFWYKGLISNYTI

SEQ ID NO: 2025639 - protein, 20 aa, Staphylococcus
LEKEAAYIEEWCHTHPQHFN

SEQ ID NO: 2025640 - protein, 17 aa, Staphylococcus
LEKEGTFANTERRIQRL

SEQ ID NO: 2025641 - protein, 31 aa, Staphylococcus
LEKEHPDGIYLSGALLMFAGNKSYYLYGASS

SEQ ID NO: 2025642 - protein, 27 aa, Staphylococcus
LEKEINALPIVEEFRSAQFEANELLQL

SEQ ID NO: 2025643 - protein, 19 aa, Staphylococcus
LEKEKDFLQVLVKEDNSQL

SEQ ID NO: 2025644 - protein, 20 aa, Staphylococcus
LEKELASIIGNGFAVIYLIS

SEQ ID NO: 2025645 - protein, 21 aa, Staphylococcus
LEKELASIIGNGFSVIYLISQ

SEQ ID NO: 2025646 - protein, 17 aa, Staphylococcus
LEKFISMIFDDEHLDNT

SEQ ID NO: 2025647 - protein, 18 aa, Staphylococcus
LEKFPAIGGNTIRTGGQV

SEQ ID NO: 2025648 - protein, 17 aa, Staphylococcus
LEKGIYIAEYEKVGSVK

SEQ ID NO: 2025649 - protein, 19 aa, Staphylococcus
LEKGKSFILTSEDLDNIFK

SEQ ID NO: 2025650 - protein, 19 aa, Staphylococcus
LEKHVDFLLDNGVKAIIVN

SEQ ID NO: 2025651 - protein, 18 aa, Staphylococcus
LEKIFIKRLEELREICRN

SEQ ID NO: 2025652 - protein, 20 aa, Staphylococcus
LEKKEFNNGNVIRYYDGETY

SEQ ID NO: 2025653 - protein, 21 aa, Staphylococcus
LEKKSLLSEAEFREYYDKYPG

SEQ ID NO: 2025654 - protein, 22 aa, Staphylococcus
LEKKSLLSEAEFREYYDKYQDQ

SEQ ID NO: 2025655 - protein, 23 aa, Staphylococcus
LEKLDIPPIDVFGLKSHITDIHE

SEQ ID NO: 2025656 - protein, 18 aa, Staphylococcus
LEKLGRYLMDSFVNIEGT

SEQ ID NO: 2025657 - protein, 19 aa, Staphylococcus
LEKLGRYLMDSFVNIEGTG

SEQ ID NO: 2025658 - protein, 19 aa, Staphylococcus
LEKLIKRKPYQLSSEVEEV

SEQ ID NO: 2025659 - protein, 18 aa, Staphylococcus
LEKMSSQFNISVEDIKQT

SEQ ID NO: 2025660 - protein, 24 aa, Staphylococcus
LEKNWPGLHIEPLQAPENMEVIIG

SEQ ID NO: 2025661 - protein, 18 aa, Staphylococcus
LEKPKYGAINVHASLLPK

SEQ ID NO: 2025662 - protein, 19 aa, Staphylococcus
LEKQKLFFDYYLKKEDNDW

SEQ ID NO: 2025663 - protein, 21 aa, Staphylococcus
LEKQLKLSLNLKIKNQQQQLQ

SEQ ID NO: 2025664 - protein, 21 aa, Staphylococcus
LEKRELIKIHVLQNNFDDKNE

SEQ ID NO: 2025665 - protein, 22 aa, Staphylococcus
LEKRELIKIHVLQNNFDDKNEL

SEQ ID NO: 2025666 - protein, 25 aa, Staphylococcus
LEKSLLKFYLIKNVFFKSLPNIEKE

SEQ ID NO: 2025667 - protein, 21 aa, Staphylococcus
LEKTPAFLKWFDDVSKSIDTL

SEQ ID NO: 2025668 - protein, 30 aa, Staphylococcus
LEKVKDYAYRLLMQLGFERDIMEKSPFQMS

SEQ ID NO: 2025669 - protein, 20 aa, Staphylococcus
LEKVKRVIGRAVPDAPHEAL

SEQ ID NO: 2025670 - protein, 20 aa, Staphylococcus
LEKVKRVISRAVPEAPHEVL

SEQ ID NO: 2025671 - protein, 17 aa, Staphylococcus
LEKYPYLYTIAVNPNSE

SEQ ID NO: 2025672 - protein, 18 aa, Staphylococcus
LELAYIKNKGFMITGDEE

SEQ ID NO: 2025673 - protein, 20 aa, Staphylococcus
LELCECLFVGDSFKNDYEAS

SEQ ID NO: 2025674 - protein, 26 aa, Staphylococcus
LELDRGFDFYAPQTFLDKNGQRILIG

SEQ ID NO: 2025675 - protein, 18 aa, Staphylococcus
LELFIKGYFSEYQTFVNG

SEQ ID NO: 2025676 - protein, 17 aa, Staphylococcus
LELFIKGYINDYDTYLD

SEQ ID NO: 2025677 - protein, 21 aa, Staphylococcus
LELFIKGYITHYFDFISEDGF

SEQ ID NO: 2025678 - protein, 19 aa, Staphylococcus
LELFIKGYLTDYHSFLIHK

SEQ ID NO: 2025679 - protein, 18 aa, Staphylococcus
LELGDDVVRTIAMDSTDG

SEQ ID NO: 2025680 - protein, 17 aa, Staphylococcus
LELHLGMAAKNLGIHVA

SEQ ID NO: 2025681 - protein, 17 aa, Staphylococcus
LELIDAIPEDENVTLYS

SEQ ID NO: 2025682 - protein, 17 aa, Staphylococcus
LELIDAIPEDENVTLYT

SEQ ID NO: 2025683 - protein, 17 aa, Staphylococcus
LELILPKVQFNLLNSTA

SEQ ID NO: 2025684 - protein, 17 aa, Staphylococcus
LELKEIIVRTAEVLGTS

SEQ ID NO: 2025685 - protein, 20 aa, Staphylococcus
LELKFPEYTFVKGRLLVGQH

SEQ ID NO: 2025686 - protein, 21 aa, Staphylococcus
LELKINIVGVIAAAENMVSEI

SEQ ID NO: 2025687 - protein, 24 aa, Staphylococcus
LELKKHIKKGVIVTIFPDGSDRYM

SEQ ID NO: 2025688 - protein, 17 aa, Staphylococcus
LELLKSLVKEFEFSGHL

SEQ ID NO: 2025689 - protein, 17 aa, Staphylococcus
LELLVGEKGLNKQIKNT

SEQ ID NO: 2025690 - protein, 25 aa, Staphylococcus
LELPYRRVILCTGDLGFSSSKTYDL

SEQ ID NO: 2025691 - protein, 17 aa, Staphylococcus
LELSANRQSDGFKDIRD

SEQ ID NO: 2025692 - protein, 17 aa, Staphylococcus
LELSDGLVKPAQLEIIE

SEQ ID NO: 2025693 - protein, 17 aa, Staphylococcus
LELSNLYIYKLAVISNM

SEQ ID NO: 2025694 - protein, 23 aa, Staphylococcus
LELSRTKLLVSIRRLIDKEKLSK

SEQ ID NO: 2025695 - protein, 25 aa, Staphylococcus
LELTSGLRKLCFKNQKYNKHSREDQ

SEQ ID NO: 2025696 - protein, 19 aa, Staphylococcus
LELTVSRYLFDKHPDLPEG

SEQ ID NO: 2025697 - protein, 19 aa, Staphylococcus
LELTVSRYLFDKHPHLPEG

SEQ ID NO: 2025698 - protein, 17 aa, Staphylococcus
LELVGVGYRAQMQGNDL

SEQ ID NO: 2025699 - protein, 17 aa, Staphylococcus
LEMIGLVAEVQELKANP

SEQ ID NO: 2025700 - protein, 21 aa, Staphylococcus
LEMIKYAKFGVAMDNGLDELK

SEQ ID NO: 2025701 - protein, 19 aa, Staphylococcus
LEMILEFANKRFMKMTNNR

SEQ ID NO: 2025702 - protein, 22 aa, Staphylococcus
LEMLFIKPEFFNNGYGTEIIRY

SEQ ID NO: 2025703 - protein, 20 aa, Staphylococcus
LEMLRILYNYKKLSQYDLTM

SEQ ID NO: 2025704 - protein, 25 aa, Staphylococcus
LEMLRRLDHRGGIGADGITGDGAGI

SEQ ID NO: 2025705 - protein, 25 aa, Staphylococcus
LEMLRRLDHRGGIGADGMTGDGAGI

SEQ ID NO: 2025706 - protein, 25 aa, Staphylococcus
LEMLRRLDHRGGIGADGVTGDGAGI

SEQ ID NO: 2025707 - protein, 21 aa, Staphylococcus
LEMPMSYVRSKSKSHGKQNQI

SEQ ID NO: 2025708 - protein, 20 aa, Staphylococcus
LEMREYTGALVVVDDLKNLQ

SEQ ID NO: 2025709 - protein, 17 aa, Staphylococcus
LEMRRNIGMIFQNFNLV

SEQ ID NO: 2025710 - protein, 19 aa, Staphylococcus
LEMSIPLIMINGNHDSKER

SEQ ID NO: 2025711 - protein, 32 aa, Staphylococcus
LENAFDFPGFVPAYIRPLFCEGKGPFRFAALS

SEQ ID NO: 2025712 - protein, 20 aa, Staphylococcus
LENCKVLIDHGYLEGQLTAD

SEQ ID NO: 2025713 - protein, 26 aa, Staphylococcus
LENEIKAKLIIIDEMSMVDSWLFHQF

SEQ ID NO: 2025714 - protein, 20 aa, Staphylococcus
LENELGSPLFDRSKRHLTLT

SEQ ID NO: 2025715 - protein, 24 aa, Staphylococcus
LENELSGRVRILFQASEELGHGAI

SEQ ID NO: 2025716 - protein, 23 aa, Staphylococcus
LENESLYCLMPFANSIKKKLEQL

SEQ ID NO: 2025717 - protein, 18 aa, Staphylococcus
LENGISYTEFTYMILQAI

SEQ ID NO: 2025718 - protein, 26 aa, Staphylococcus
LENGKIKFIPCHEVNAVGPMGGITSM

SEQ ID NO: 2025719 - protein, 21 aa, Staphylococcus
LENHFFGRVGLFRNQVGDELL

SEQ ID NO: 2025720 - protein, 18 aa, Staphylococcus
LENIASIMFTSGTTGPQK

SEQ ID NO: 2025721 - protein, 24 aa, Staphylococcus
LENILPVVKEIAYKHCALQVPPAG

SEQ ID NO: 2025722 - protein, 26 aa, Staphylococcus
LENKARLKGIFLTHGHEHAIGAVSYI

SEQ ID NO: 2025723 - protein, 17 aa, Staphylococcus
LENKCGYISLTERGKVI

SEQ ID NO: 2025724 - protein, 32 aa, Staphylococcus
LENKKAVQWEIMYVDRGFIFTSHRGNSLPLTS

SEQ ID NO: 2025725 - protein, 21 aa, Staphylococcus
LENLFGGAIPNFGNNQEDEEE

SEQ ID NO: 2025726 - protein, 22 aa, Staphylococcus
LENLFGGAIPNFGQNNEEEEEP

SEQ ID NO: 2025727 - protein, 18 aa, Staphylococcus
LENLKVVLNEAGADFNSV

SEQ ID NO: 2025728 - protein, 21 aa, Staphylococcus
LENVSIPLIYNGMSSKDRKAK

SEQ ID NO: 2025729 - protein, 17 aa, Staphylococcus
LEPGGKINFFVQTYGSS

SEQ ID NO: 2025730 - protein, 21 aa, Staphylococcus
LEPGRYLSYEQIETMYFIQHN

SEQ ID NO: 2025731 - protein, 28 aa, Staphylococcus
LEPHVKKIKHAKCLSVGLKQDNALVCEV

SEQ ID NO: 2025732 - protein, 19 aa, Staphylococcus
LEPLFSAGIDSFKIDGILQ

SEQ ID NO: 2025733 - protein, 22 aa, Staphylococcus
LEPNDPIIHFALAEILYYDGQY

SEQ ID NO: 2025734 - protein, 23 aa, Staphylococcus
LEPNDPIIHFALAEMLYFDGQYL

SEQ ID NO: 2025735 - protein, 29 aa, Staphylococcus
LEPNDPILHFALAELLYFDGQYLRATTEY

SEQ ID NO: 2025736 - protein, 29 aa, Staphylococcus
LEPNDPVLHFALAELMYFDGQYLRASAEY

SEQ ID NO: 2025737 - protein, 32 aa, Staphylococcus
LEPNYCIPGPFDKRVAPSVAREVAKAAMESGV

SEQ ID NO: 2025738 - protein, 19 aa, Staphylococcus
LEPPYYLPQWDKVDRDILK

SEQ ID NO: 2025739 - protein, 22 aa, Staphylococcus
LEPSMKLTYGFVGTNLKVGRYR

SEQ ID NO: 2025740 - protein, 18 aa, Staphylococcus
LEPVYRIKEGIKQKQMRD

SEQ ID NO: 2025741 - protein, 19 aa, Staphylococcus
LEQALTFVVETAVNQVGVD

SEQ ID NO: 2025742 - protein, 17 aa, Staphylococcus
LEQDILANMAFRPILSD

SEQ ID NO: 2025743 - protein, 25 aa, Staphylococcus
LEQDLKNWHGAFIIVSHDRAFLDNL

SEQ ID NO: 2025744 - protein, 19 aa, Staphylococcus
LEQEKDFLQVLVKEDNSKL

SEQ ID NO: 2025745 - protein, 24 aa, Staphylococcus
LEQFPNKLIVTLGHQGAVYHNGNI

SEQ ID NO: 2025746 - protein, 22 aa, Staphylococcus
LEQGLNDWMFKLSEHTSLEPTK

SEQ ID NO: 2025747 - protein, 17 aa, Staphylococcus
LEQIAEFNLLKENGIII

SEQ ID NO: 2025748 - protein, 19 aa, Staphylococcus
LEQICNSFAEMSEDFQNNR

SEQ ID NO: 2025749 - protein, 24 aa, Staphylococcus
LEQLKDIQIMPVIRATSFDKKTKE

SEQ ID NO: 2025750 - protein, 24 aa, Staphylococcus
LEQLKNLYLSRISRYNEIAFMKVN

SEQ ID NO: 2025751 - protein, 19 aa, Staphylococcus
LEQLKQVTGYVRGGCSPIG

SEQ ID NO: 2025752 - protein, 23 aa, Staphylococcus
LEQLKSQCLIIMTTHHLDEVEVL

SEQ ID NO: 2025753 - protein, 17 aa, Staphylococcus
LEQLNKARLISVGLGNS

SEQ ID NO: 2025754 - protein, 17 aa, Staphylococcus
LEQPFDYIFFTGSEKVG

SEQ ID NO: 2025755 - protein, 17 aa, Staphylococcus
LEQREAPLLFKLVDSNR

SEQ ID NO: 2025756 - protein, 17 aa, Staphylococcus
LEQSFKMIVGLSPEAYA

SEQ ID NO: 2025757 - protein, 17 aa, Staphylococcus
LEQYKGDVMLIVNTASE

SEQ ID NO: 2025758 - protein, 17 aa, Staphylococcus
LEQYSEVLYEFLKHWYE

SEQ ID NO: 2025759 - protein, 18 aa, Staphylococcus
LERAFKDTIKLVSSGHDS

SEQ ID NO: 2025760 - protein, 22 aa, Staphylococcus
LERDEFDKFLDLYRETEARTGF

SEQ ID NO: 2025761 - protein, 26 aa, Staphylococcus
LERDKGRFTDSLKRIDISPLGAAALS

SEQ ID NO: 2025762 - protein, 21 aa, Staphylococcus
LEREIWQYFTVLPGIQSVGVM

SEQ ID NO: 2025763 - protein, 22 aa, Staphylococcus
LEREIWQYFTVLPGIQSVGVMG

SEQ ID NO: 2025764 - protein, 31 aa, Staphylococcus
LEREIWQYFTVLPGMRSVGVMGDYRTYDYTI

SEQ ID NO: 2025765 - protein, 18 aa, Staphylococcus
LEREQIFVYICHGNHDPL

SEQ ID NO: 2025766 - protein, 18 aa, Staphylococcus
LERIAVMSAPHKKGESGI

SEQ ID NO: 2025767 - protein, 22 aa, Staphylococcus
LERIKEALEAGDPVRSLEFNEE

SEQ ID NO: 2025768 - protein, 20 aa, Staphylococcus
LERIKRETGVSFAFQGCEHI

SEQ ID NO: 2025769 - protein, 25 aa, Staphylococcus
LERIMPVVKEIAYKHCALQVPPAGY

SEQ ID NO: 2025770 - protein, 23 aa, Staphylococcus
LERISELCGVHISIFSVGPDREQ

SEQ ID NO: 2025771 - protein, 24 aa, Staphylococcus
LERISELCGVRISIFSVGPDREQT

SEQ ID NO: 2025772 - protein, 26 aa, Staphylococcus
LERKKAIDIGNAMLKDGYKEGDVIPI

SEQ ID NO: 2025773 - protein, 17 aa, Staphylococcus
LERKKKASFDWYRNVIK

SEQ ID NO: 2025774 - protein, 19 aa, Staphylococcus
LERKKLIYRYIDAKDSRSK

SEQ ID NO: 2025775 - protein, 23 aa, Staphylococcus
LERKLTEMGIYPAVDPLASTSRA

SEQ ID NO: 2025776 - protein, 19 aa, Staphylococcus
LERLFKVEPELLYQAWTDE

SEQ ID NO: 2025777 - protein, 25 aa, Staphylococcus
LERLRKAIPNILFQILLRASNAVGY

SEQ ID NO: 2025778 - protein, 17 aa, Staphylococcus
LERMGAKVLQFGDQEKK

SEQ ID NO: 2025779 - protein, 17 aa, Staphylococcus
LERMGARVLEFGEQEKK

SEQ ID NO: 2025780 - protein, 19 aa, Staphylococcus
LERNMKLEFERNYERYQFL

SEQ ID NO: 2025781 - protein, 24 aa, Staphylococcus
LERRIAVIPCDYYVEKADIDLNDK

SEQ ID NO: 2025782 - protein, 23 aa, Staphylococcus
LERRIAVIPCEYYVEKADPDLIE

SEQ ID NO: 2025783 - protein, 24 aa, Staphylococcus
LERRIAVIPCEYYVEKADPDLIEK

SEQ ID NO: 2025784 - protein, 21 aa, Staphylococcus
LERRRQFLYEHQFEKQSEIDY

SEQ ID NO: 2025785 - protein, 17 aa, Staphylococcus
LERTKKASFDWYRKVIK

SEQ ID NO: 2025786 - protein, 22 aa, Staphylococcus
LERTKKDSFEWYRNVIESNGEW

SEQ ID NO: 2025787 - protein, 19 aa, Staphylococcus
LERTVAWLSGVEHVRETAP

SEQ ID NO: 2025788 - protein, 20 aa, Staphylococcus
LERVPEYFITLIYQLLDDTA

SEQ ID NO: 2025789 - protein, 17 aa, Staphylococcus
LERVPSHIPVLIDEAYV

SEQ ID NO: 2025790 - protein, 17 aa, Staphylococcus
LERWSTGHLPYLLELGA

SEQ ID NO: 2025791 - protein, 19 aa, Staphylococcus
LESAMKYINEHGGMIIYLP

SEQ ID NO: 2025792 - protein, 20 aa, Staphylococcus
LESDHAFPQVFIAGNDMIAI

SEQ ID NO: 2025793 - protein, 26 aa, Staphylococcus
LESDLKEGADMMIVKPALSYLDIVRD

SEQ ID NO: 2025794 - protein, 25 aa, Staphylococcus
LESDWKRLHIVDAVKEATGVNFYNV

SEQ ID NO: 2025795 - protein, 25 aa, Staphylococcus
LESEILCPFHYFGVSDYIQDGISVD

SEQ ID NO: 2025796 - protein, 20 aa, Staphylococcus
LESIGVHAAIVGKAAHNATF

SEQ ID NO: 2025797 - protein, 20 aa, Staphylococcus
LESIIKRINPDMVLVHGDTA

SEQ ID NO: 2025798 - protein, 21 aa, Staphylococcus
LESKKFIFAVAGGKSKGEAIK

SEQ ID NO: 2025799 - protein, 20 aa, Staphylococcus
LESLLGGAIPNFGNNDDEEE

SEQ ID NO: 2025800 - protein, 17 aa, Staphylococcus
LESQHAGLSWLTILKKK

SEQ ID NO: 2025801 - protein, 22 aa, Staphylococcus
LESQHAGLSWLTILKKKQSYEQ

SEQ ID NO: 2025802 - protein, 24 aa, Staphylococcus
LESRFPYENIDWLVKEGYTKLTLP

SEQ ID NO: 2025803 - protein, 19 aa, Staphylococcus
LESRMNLLNNLKRKYGKNI

SEQ ID NO: 2025804 - protein, 19 aa, Staphylococcus
LESSRKTPFGFKIYNDPFD

SEQ ID NO: 2025805 - protein, 25 aa, Staphylococcus
LESTFGVTCDFEFNKDYPALYNDPE

SEQ ID NO: 2025806 - protein, 26 aa, Staphylococcus
LESTFGVTCEFEFKKDYPALYNDPEF

SEQ ID NO: 2025807 - protein, 20 aa, Staphylococcus
LESTISIVFECHIYTLRQVY

SEQ ID NO: 2025808 - protein, 22 aa, Staphylococcus
LESVAFQIGSAIKRIMLTDKEK

SEQ ID NO: 2025809 - protein, 18 aa, Staphylococcus
LESVLRQEDEFVITDEHI

SEQ ID NO: 2025810 - protein, 20 aa, Staphylococcus
LETAENWDNVGLLIGNHESE

SEQ ID NO: 2025811 - protein, 22 aa, Staphylococcus
LETDGKLLTGRDVALACALGAE

SEQ ID NO: 2025812 - protein, 20 aa, Staphylococcus
LETFLFYSGFYYPLYLAGQG

SEQ ID NO: 2025813 - protein, 23 aa, Staphylococcus
LETFSRSKVDGIILMATTLTDEH

SEQ ID NO: 2025814 - protein, 17 aa, Staphylococcus
LETGADFGLAFDGDGDR

SEQ ID NO: 2025815 - protein, 19 aa, Staphylococcus
LETGGFLLGKILNVEFDLE

SEQ ID NO: 2025816 - protein, 25 aa, Staphylococcus
LETILNKRVNGYLYFFQFGEMSIED

SEQ ID NO: 2025817 - protein, 17 aa, Staphylococcus
LETIMQFDHLVSVQDFI

SEQ ID NO: 2025818 - protein, 19 aa, Staphylococcus
LETIRIGLYAALEAIVESG

SEQ ID NO: 2025819 - protein, 22 aa, Staphylococcus
LETKGFKVFRMSATVHQPNGNY

SEQ ID NO: 2025820 - protein, 28 aa, Staphylococcus
LETKLKKIREVRPLHQIIENISAHSKKL

SEQ ID NO: 2025821 - protein, 26 aa, Staphylococcus
LETLKEDFSALDFRINEEYVKISLIG

SEQ ID NO: 2025822 - protein, 25 aa, Staphylococcus
LETLRRYRFDKVFLGMNGIDLKYGL

SEQ ID NO: 2025823 - protein, 18 aa, Staphylococcus
LETLSLRMERHVENAEKV

SEQ ID NO: 2025824 - protein, 33 aa, Staphylococcus; identical to SEQ ID NO: 1798080

SEQ ID NO: 2025825 - protein, 33 aa, Staphylococcus
LETRPELSFPADLYFEGSDQYRGWFNSSITTSV

SEQ ID NO: 2025826 - protein, 22 aa, Staphylococcus
LETRPELSFPADLYLEGSDQYR

SEQ ID NO: 2025827 - protein, 32 aa, Staphylococcus; identical to SEQ ID NO: 1808975

SEQ ID NO: 2025828 - protein, 32 aa, Staphylococcus; identical to SEQ ID NO: 1647459

SEQ ID NO: 2025829 - protein, 21 aa, Staphylococcus
LETVEIEYDVALFSYNKLLEI

SEQ ID NO: 2025830 - protein, 20 aa, Staphylococcus
LETVKRSLSLYEQQTVHFSL

SEQ ID NO: 2025831 - protein, 24 aa, Staphylococcus
LETYKMRIPQLFTFNEVLVTSDGI

SEQ ID NO: 2025832 - protein, 20 aa, Staphylococcus
LETYVLIYYLERIIAQANLR

SEQ ID NO: 2025833 - protein, 25 aa, Staphylococcus
LEVAKYLQKWFDKYGIESELDEVSE

SEQ ID NO: 2025834 - protein, 23 aa, Staphylococcus
LEVDGPKLLLERTEDGWDGMPDN

SEQ ID NO: 2025835 - protein, 26 aa, Staphylococcus
LEVEAIQGFIYRKARTHHLSTPSLDT

SEQ ID NO: 2025836 - protein, 24 aa, Staphylococcus
LEVEGAELPKVFHYFKEAHPYFNQ

SEQ ID NO: 2025837 - protein, 24 aa, Staphylococcus
LEVEGAKLPKVFHYFKEAHPYFDQ

SEQ ID NO: 2025838 - protein, 20 aa, Staphylococcus
LEVGSGSFIPGFEEQLEGMK

SEQ ID NO: 2025839 - protein, 19 aa, Staphylococcus
LEVHFGDGLTVLSGETGAG

SEQ ID NO: 2025840 - protein, 20 aa, Staphylococcus
LEVHKGEVVSIIGPSGSGKS

SEQ ID NO: 2025841 - protein, 17 aa, Staphylococcus
LEVIRYHDFLGHIINQY

SEQ ID NO: 2025842 - protein, 21 aa, Staphylococcus
LEVKDRVGLDTVLVQDLVNDT

SEQ ID NO: 2025843 - protein, 17 aa, Staphylococcus
LEVKEVIEKAGQRAVLL

SEQ ID NO: 2025844 - protein, 17 aa, Staphylococcus
LEVLKEWRTQQRVLSLK

SEQ ID NO: 2025845 - protein, 19 aa, Staphylococcus
LEVPIPVYAIGGITTDTIR

SEQ ID NO: 2025846 - protein, 24 aa, Staphylococcus
LEVPSGLLVPHLSEIYVRNYEKGQ

SEQ ID NO: 2025847 - protein, 21 aa, Staphylococcus
LEVYNRNGVVTARAVTSHRMP

SEQ ID NO: 2025848 - protein, 19 aa, Staphylococcus
LEWLKRYDKNLIIIFKDID

SEQ ID NO: 2025849 - protein, 18 aa, Staphylococcus
LEWLRIASEYKLPTFLMG

SEQ ID NO: 2025850 - protein, 19 aa, Staphylococcus
LEWRGLIYQQTDAEGLENI

SEQ ID NO: 2025851 - protein, 25 aa, Staphylococcus
LEYAPCTELSMGMSNDYEIATEEGA

SEQ ID NO: 2025852 - protein, 18 aa, Staphylococcus
LEYARELNVTNALLYTDS

SEQ ID NO: 2025853 - protein, 19 aa, Staphylococcus
LEYCNFGCAYFVLRRIPER

SEQ ID NO: 2025854 - protein, 18 aa, Staphylococcus
LEYDIIKHLVKYAKKVTV

SEQ ID NO: 2025855 - protein, 31 aa, Staphylococcus
LEYEVIDLSILYKCDLSHCLKDIPQKIEIDK

SEQ ID NO: 2025856 - protein, 26 aa, Staphylococcus
LEYGFDGICAISFFMNASLKEIKELR

SEQ ID NO: 2025857 - protein, 17 aa, Staphylococcus
LEYIASLTRQLSIHYKY

SEQ ID NO: 2025858 - protein, 18 aa, Staphylococcus
LEYIKGYLPVHNHPQAYA

SEQ ID NO: 2025859 - protein, 18 aa, Staphylococcus
LEYLKYAKDYGFSDKVTA

SEQ ID NO: 2025860 - protein, 20 aa, Staphylococcus
LEYRNKISPYVGRTINAQVT

SEQ ID NO: 2025861 - protein, 17 aa, Staphylococcus
LEYVLYKAINLDFGKFI

SEQ ID NO: 2025862 - protein, 17 aa, Staphylococcus
LEYYFDINIKNITQKGK

SEQ ID NO: 2025863 - protein, 17 aa, Staphylococcus
LEYYFDINIKNITQKGN

SEQ ID NO: 2025864 - protein, 19 aa, Staphylococcus
LFAEGAYLYYLGRFIDSDS

SEQ ID NO: 2025865 - protein, 18 aa, Staphylococcus
LFAGCGIVKDSDPDSEIA

SEQ ID NO: 2025866 - protein, 18 aa, Staphylococcus
LFAGCGIVKNSDPDSEVA

SEQ ID NO: 2025867 - protein, 22 aa, Staphylococcus
LFAGVGGFRLGLENTKEKIFDV

SEQ ID NO: 2025868 - protein, 19 aa, Staphylococcus
LFANMQIPTSEDWKSLQQQ

SEQ ID NO: 2025869 - protein, 18 aa, Staphylococcus
LFANTVIEEYSYKIVDEK

SEQ ID NO: 2025870 - protein, 18 aa, Staphylococcus
LFANTVIEEYSYKVIDEK

SEQ ID NO: 2025871 - protein, 18 aa, Staphylococcus
LFANTVIEEYSYKVIEEK

SEQ ID NO: 2025872 - protein, 36 aa, Staphylococcus
LFASFKLGAVYLPINWRLKTQEIESVIADSDVKLIF

SEQ ID NO: 2025873 - protein, 23 aa, Staphylococcus
LFAVGVTPATEWLDGKIELGEKG

SEQ ID NO: 2025874 - protein, 18 aa, Staphylococcus
LFAYKRIKQHQFIKNPFL

SEQ ID NO: 2025875 - protein, 24 aa, Staphylococcus
LFAYSLESMSQFGMYFTKMNLNLH

SEQ ID NO: 2025876 - protein, 26 aa, Staphylococcus
LFAYSLESMSTFGMYFTKINLNLHEE

SEQ ID NO: 2025877 - protein, 18 aa, Staphylococcus
LFDAVLMTVKHVVRESGM

SEQ ID NO: 2025878 - protein, 19 aa, Staphylococcus
LFDDGFKVAIVDFNGEGAI

SEQ ID NO: 2025879 - protein, 23 aa, Staphylococcus
LFDGETPGGIAWDNELQQKTSAF

SEQ ID NO: 2025880 - protein, 18 aa, Staphylococcus
LFDITGLKDLMHVNEGTE

SEQ ID NO: 2025881 - protein, 17 aa, Staphylococcus
LFDKDERVVLVDNPEKN

SEQ ID NO: 2025882 - protein, 17 aa, Staphylococcus
LFDMELIVFMGKEDIQR

SEQ ID NO: 2025883 - protein, 17 aa, Staphylococcus
LFDMLVTMAEGKNEHLP

SEQ ID NO: 2025884 - protein, 23 aa, Staphylococcus
LFDQIKATLSYYVETVSSEDADR

SEQ ID NO: 2025885 - protein, 17 aa, Staphylococcus
LFDRKGRHIYLNRYGEL

SEQ ID NO: 2025886 - protein, 18 aa, Staphylococcus
LFDSISQARYCLVDTQDN

SEQ ID NO: 2025887 - protein, 17 aa, Staphylococcus
LFDTCQLEHGAFYESTL

SEQ ID NO: 2025888 - protein, 17 aa, Staphylococcus
LFEAGGINPDYYFVSEA

SEQ ID NO: 2025889 - protein, 17 aa, Staphylococcus
LFEAGGINPDYYFVSES

SEQ ID NO: 2025890 - protein, 19 aa, Staphylococcus
LFEALKSWLEEEAVADTWL

SEQ ID NO: 2025891 - protein, 20 aa, Staphylococcus
LFEALRAWLDDEIVADTWID

SEQ ID NO: 2025892 - protein, 19 aa, Staphylococcus
LFEEATYIYYLGRFIDSDS

SEQ ID NO: 2025893 - protein, 19 aa, Staphylococcus
LFEEKRLIKLQPQLSELIQ

SEQ ID NO: 2025894 - protein, 24 aa, Staphylococcus
LFEELKQRYDFILIDTPPVNTVTD

SEQ ID NO: 2025895 - protein, 18 aa, Staphylococcus
LFEIRSPLWEIAQEVYQE

SEQ ID NO: 2025896 - protein, 18 aa, Staphylococcus
LFEKCIIDKKIVRLLDSI

SEQ ID NO: 2025897 - protein, 17 aa, Staphylococcus
LFEKLKGVGPYTKAAVM

SEQ ID NO: 2025898 - protein, 17 aa, Staphylococcus
LFEKYAIEVGEEVSYDD

SEQ ID NO: 2025899 - protein, 17 aa, Staphylococcus
LFEKYALEVGEDVSHDD

SEQ ID NO: 2025900 - protein, 19 aa, Staphylococcus
LFELKSLYSSRVSRYNEIA

SEQ ID NO: 2025901 - protein, 18 aa, Staphylococcus
LFELQARQLLHLKNETGH

SEQ ID NO: 2025902 - protein, 25 aa, Staphylococcus
LFFGEQHFTTDFLYQTEWQEWLDDG

SEQ ID NO: 2025903 - protein, 18 aa, Staphylococcus
LFFIETYHTVHQMTSMVT

SEQ ID NO: 2025904 - protein, 18 aa, Staphylococcus
LFGASAIEKMMKVIQALN

SEQ ID NO: 2025905 - protein, 18 aa, Staphylococcus
LFGGPLYTFHKIFSIITL

SEQ ID NO: 2025906 - protein, 19 aa, Staphylococcus
LFGGPLYTFHKIFSLITLS

SEQ ID NO: 2025907 - protein, 26 aa, Staphylococcus
LFGLGIRHLGVKASQVIAEKYGTIDE

SEQ ID NO: 2025908 - protein, 18 aa, Staphylococcus
LFGTLPIYPCINDENDQH

SEQ ID NO: 2025909 - protein, 18 aa, Staphylococcus
LFGTLPIYPCINDENDQV

SEQ ID NO: 2025910 - protein, 18 aa, Staphylococcus
LFGTLPIYPCIQDEDDKA

SEQ ID NO: 2025911 - protein, 18 aa, Staphylococcus
LFGTMVFEGSMTLDEMRE

SEQ ID NO: 2025912 - protein, 19 aa, Staphylococcus
LFHAEKRMHIVEGLMKALS

SEQ ID NO: 2025913 - protein, 19 aa, Staphylococcus
LFHDLGWKTVVGFQTRNPV

SEQ ID NO: 2025914 - protein, 19 aa, Staphylococcus
LFHMYGWDNVDTEYNMRLN

SEQ ID NO: 2025915 - protein, 17 aa, Staphylococcus
LFHSWITSKGFDAYMIS

SEQ ID NO: 2025916 - protein, 30 aa, Staphylococcus
LFHYHFKSRISVWILNYIKSHTELLEHVHF

SEQ ID NO: 2025917 - protein, 29 aa, Staphylococcus
LFHYHFKSRISVWLLNYLKASPPKLNCSH

SEQ ID NO: 2025918 - protein, 27 aa, Staphylococcus
LFHYQFKSRISVWVLNLIKSSPNLLQQ

SEQ ID NO: 2025919 - protein, 18 aa, Staphylococcus
LFIDELHTLIGAGGAEGA

SEQ ID NO: 2025920 - protein, 19 aa, Staphylococcus
LFIDHGMGVVIGETCTIGD

SEQ ID NO: 2025921 - protein, 28 aa, Staphylococcus
LFIFMSEGLLKGYLYLQVFENTKKAEIK

SEQ ID NO: 2025922 - protein, 22 aa, Staphylococcus
LFIGAMADEVYSVFSVKEVGQH

SEQ ID NO: 2025923 - protein, 17 aa, Staphylococcus
LFIICFDEMNLARIEHY

SEQ ID NO: 2025924 - protein, 18 aa, Staphylococcus
LFIKTLPILFSRDEDKTI

SEQ ID NO: 2025925 - protein, 25 aa, Staphylococcus
LFILGETLYNFGLMPQGLEVFRTLY

SEQ ID NO: 2025926 - protein, 24 aa, Staphylococcus
LFILGETLYNYGLMPQGLEVFRTL

SEQ ID NO: 2025927 - protein, 17 aa, Staphylococcus
LFIMYGIMHEGKNKEER

SEQ ID NO: 2025928 - protein, 17 aa, Staphylococcus
LFIQAGIDPTYYFVSEA

SEQ ID NO: 2025929 - protein, 17 aa, Staphylococcus
LFISYTISGQIGVILYW

SEQ ID NO: 2025930 - protein, 17 aa, Staphylococcus
LFITYGDIEARGFSRED

SEQ ID NO: 2025931 - protein, 25 aa, Staphylococcus
LFIYRRNYQATSWLVVANFSQQPVR

SEQ ID NO: 2025932 - protein, 18 aa, Staphylococcus
LFKDAGYDRVEFDTNADV

SEQ ID NO: 2025933 - protein, 18 aa, Staphylococcus
LFKEIFKASIDLQKADHE

SEQ ID NO: 2025934 - protein, 23 aa, Staphylococcus
LFKGQRATLSIGYIGLYEAATVF

SEQ ID NO: 2025935 - protein, 21 aa, Staphylococcus
LFKGSLAGVDGRLQSRSYENQ

SEQ ID NO: 2025936 - protein, 23 aa, Staphylococcus
LFKHRRATISMGYIGLYEAATVF

SEQ ID NO: 2025937 - protein, 27 aa, Staphylococcus
LFKKYWPADLHLMAKEIVRFHSIVWPI

SEQ ID NO: 2025938 - protein, 18 aa, Staphylococcus
LFKLIKKYKIEGHGIDIS

SEQ ID NO: 2025939 - protein, 24 aa, Staphylococcus
LFKNKRATISMGYIGLYETATVFY

SEQ ID NO: 2025940 - protein, 25 aa, Staphylococcus
LFKQQGEAILHFSNLVAAKVTTKYG

SEQ ID NO: 2025941 - protein, 17 aa, Staphylococcus
LFKSAGFQIEGELKDKL

SEQ ID NO: 2025942 - protein, 24 aa, Staphylococcus
LFKSEHARKSILILQKKKPHVTKS

SEQ ID NO: 2025943 - protein, 20 aa, Staphylococcus
LFKSLKAYGIHTCIDTSAGC

SEQ ID NO: 2025944 - protein, 18 aa, Staphylococcus
LFKSMGATHIISGGQTMN

SEQ ID NO: 2025945 - protein, 18 aa, Staphylococcus
LFLGAGIGVTPLVPMFKQ

SEQ ID NO: 2025946 - protein, 19 aa, Staphylococcus
LFLGLGYEIVDGFEVEQDY

SEQ ID NO: 2025947 - protein, 24 aa, Staphylococcus
LFLLGETLYNYGLTPQGLEVFRAL

SEQ ID NO: 2025948 - protein, 17 aa, Staphylococcus
LFLQIASISVRIPQINM

SEQ ID NO: 2025949 - protein, 20 aa, Staphylococcus
LFLYKEVKSTGFVGFTKQAQ

SEQ ID NO: 2025950 - protein, 18 aa, Staphylococcus
LFMDGARLGYGLMSNETD

SEQ ID NO: 2025951 - protein, 19 aa, Staphylococcus
LFMDGARLGYGVMSDATDV

SEQ ID NO: 2025952 - protein, 24 aa, Staphylococcus
LFMFELRMQWLNRLEKAADNAIEI

SEQ ID NO: 2025953 - protein, 25 aa, Staphylococcus
LFMFELRMQWLNRLEKASDDAIEID

SEQ ID NO: 2025954 - protein, 26 aa, Staphylococcus
LFMFELRMQWLNRLEKASDEAIEINY

SEQ ID NO: 2025955 - protein, 26 aa, Staphylococcus
LFMFELRMQWLNRLEKSSDEAIEINY

SEQ ID NO: 2025956 - protein, 25 aa, Staphylococcus
LFMFELRMQWLNRLEKTSDEAIDVD

SEQ ID NO: 2025957 - protein, 22 aa, Staphylococcus
LFMKEILNKICDSFQEEELLLN

SEQ ID NO: 2025958 - protein, 17 aa, Staphylococcus
LFNDYGDIFGRMIKSNL

SEQ ID NO: 2025959 - protein, 24 aa, Staphylococcus
LFNELNWKTVVGFQTRNPVHRAHE

SEQ ID NO: 2025960 - protein, 35 aa, Staphylococcus
LFNKFIYQHRGGFCYEMNHFFGSYLETKGFKVFRM

SEQ ID NO: 2025961 - protein, 24 aa, Staphylococcus
LFNLKSPLWNLARAIYQEWYLGTT

SEQ ID NO: 2025962 - protein, 18 aa, Staphylococcus
LFNQTGFKLLDKKPQQSD

SEQ ID NO: 2025963 - protein, 18 aa, Staphylococcus
LFNSERFEEIQKYLIESV

SEQ ID NO: 2025964 - protein, 19 aa, Staphylococcus
LFPEDWGGDTIFVPLSALS

SEQ ID NO: 2025965 - protein, 18 aa, Staphylococcus
LFPLPLVMGCEGVSAAML

SEQ ID NO: 2025966 - protein, 18 aa, Staphylococcus
LFPLVSKEKGVLVRPGHT

SEQ ID NO: 2025967 - protein, 18 aa, Staphylococcus
LFPPHNIIGTFGRELYGK

SEQ ID NO: 2025968 - protein, 23 aa, Staphylococcus
LFQEQLGGFFLEYDDERSGDFEP

SEQ ID NO: 2025969 - protein, 18 aa, Staphylococcus
LFQFCDSQFPTGAFSHSF

SEQ ID NO: 2025970 - protein, 18 aa, Staphylococcus
LFQNAILLEAEIIEIKPR

SEQ ID NO: 2025971 - protein, 17 aa, Staphylococcus
LFQNEGKFVNRTALIEK

SEQ ID NO: 2025972 - protein, 20 aa, Staphylococcus
LFQTSFSYRIIGSCGLDSIR

SEQ ID NO: 2025973 - protein, 28 aa, Staphylococcus
LFQYKFKSRISVWLLNLIKSDVERLDDI

SEQ ID NO: 2025974 - protein, 17 aa, Staphylococcus
LFREYFASVIPAADNKF

SEQ ID NO: 2025975 - protein, 19 aa, Staphylococcus
LFREYFASVVPAADNKFAA

SEQ ID NO: 2025976 - protein, 19 aa, Staphylococcus
LFREYFATVIPAADNKFAA

SEQ ID NO: 2025977 - protein, 31 aa, Staphylococcus
LFRKMNLEWVYRLLIDWKRIGRIKAIPKFLY

SEQ ID NO: 2025978 - protein, 17 aa, Staphylococcus
LFRKPSEVLTHLEDIAN

SEQ ID NO: 2025979 - protein, 17 aa, Staphylococcus
LFRKPSEVLTHLEDIAQ

SEQ ID NO: 2025980 - protein, 18 aa, Staphylococcus
LFRKPSEVLTHLKEIAKD

SEQ ID NO: 2025981 - protein, 18 aa, Staphylococcus
LFRLALESRECFPELCET

SEQ ID NO: 2025982 - protein, 24 aa, Staphylococcus
LFRLALESRSLFPQLCQDLEAETG

SEQ ID NO: 2025983 - protein, 17 aa, Staphylococcus
LFRSMLANLGRNGKNDR

SEQ ID NO: 2025984 - protein, 17 aa, Staphylococcus
LFRSMLANLGRNGKNER

SEQ ID NO: 2025985 - protein, 17 aa, Staphylococcus
LFRVGNVNFISRLLEGH

SEQ ID NO: 2025986 - protein, 39 aa, Staphylococcus
LFSAVKISGTFKKMHVRMMPGQEPPYTRLINSANRQPEQ

SEQ ID NO: 2025987 - protein, 19 aa, Staphylococcus
LFSAVKISGVFKKMHVRMM

SEQ ID NO: 2025988 - protein, 24 aa, Staphylococcus
LFSDDLYFNISMHAVEMALKIKKA

SEQ ID NO: 2025989 - protein, 19 aa, Staphylococcus
LFSEARFGVDTLKVELPVN

SEQ ID NO: 2025990 - protein, 25 aa, Staphylococcus
LFSGELDKALAAFIIANGARAAGRE

SEQ ID NO: 2025991 - protein, 17 aa, Staphylococcus
LFSTLLGLFRLYASKHF

SEQ ID NO: 2025992 - protein, 26 aa, Staphylococcus
LFSYLAIRIAMEWAIVEPYLPVSQPE

SEQ ID NO: 2025993 - protein, 18 aa, Staphylococcus
LFTNYQIYLHGYSMGGRI

SEQ ID NO: 2025994 - protein, 18 aa, Staphylococcus
LFTSMGATHIISGGQTMN

SEQ ID NO: 2025995 - protein, 25 aa, Staphylococcus
LFTVLKRFKGIMVKKQEKLENMQGY

SEQ ID NO: 2025996 - protein, 25 aa, Staphylococcus
LFTVLKRFKGIMVKKQETVEAMQGY

SEQ ID NO: 2025997 - protein, 17 aa, Staphylococcus
LFVKGKKPITARTSYGL

SEQ ID NO: 2025998 - protein, 17 aa, Staphylococcus
LFYAIDWTTFRLVPEDD

SEQ ID NO: 2025999 - protein, 19 aa, Staphylococcus
LFYINRPSIIIGKNQNTIE

SEQ ID NO: 2026000 - protein, 17 aa, Staphylococcus
LFYPLVTMDDMLVADGF

SEQ ID NO: 2026001 - protein, 34 aa, Staphylococcus
LFYQFILRLPDNVLRLKGYVKFRDMPHETYEFQY

SEQ ID NO: 2026002 - protein, 32 aa, Staphylococcus
LFYQFILRLPDNVLRLKGYVQFRDTPNETYEF

SEQ ID NO: 2026003 - protein, 18 aa, Staphylococcus
LGACCKECAEHERNRYVA

SEQ ID NO: 2026004 - protein, 19 aa, Staphylococcus
LGACVLGLKALDEIDDFSI

SEQ ID NO: 2026005 - protein, 19 aa, Staphylococcus
LGAEVGWYIPNRFSEGYGP

SEQ ID NO: 2026006 - protein, 19 aa, Staphylococcus
LGAHDGVGIVYGRNIVGKK

SEQ ID NO: 2026007 - protein, 19 aa, Staphylococcus
LGAHDGVGVVYGRDIQGKK

SEQ ID NO: 2026008 - protein, 28 aa, Staphylococcus
LGAIPYEHPLFLGMGGMHGSYASNMALT

SEQ ID NO: 2026009 - protein, 18 aa, Staphylococcus
LGAIWKKDKLLSYATSKW

SEQ ID NO: 2026010 - protein, 23 aa, Staphylococcus
LGAKPGSLGPVFDKEIKVYADNF

SEQ ID NO: 2026011 - protein, 17 aa, Staphylococcus
LGAKVVGISDAYGALHD

SEQ ID NO: 2026012 - protein, 20 aa, Staphylococcus
LGALSDVITYEFENISANQL

SEQ ID NO: 2026013 - protein, 19 aa, Staphylococcus
LGANHFISVGMDRSVVKLQ

SEQ ID NO: 2026014 - protein, 17 aa, Staphylococcus
LGANVMFASPDEWVDDT

SEQ ID NO: 2026015 - protein, 25 aa, Staphylococcus
LGAQAITCYYGGHVIQGEKVMHGKV

SEQ ID NO: 2026016 - protein, 21 aa, Staphylococcus
LGAQALTCYYGGKVIQGEKVM

SEQ ID NO: 2026017 - protein, 19 aa, Staphylococcus
LGAQVGWYIPNRFTEGYGP

SEQ ID NO: 2026018 - protein, 22 aa, Staphylococcus
LGARFKYHRHFFVPDNVGHDGF

SEQ ID NO: 2026019 - protein, 24 aa, Staphylococcus
LGCDFKGNNAITFLLQNIQPHQKL

SEQ ID NO: 2026020 - protein, 21 aa, Staphylococcus
LGDFVICGEPTQLGIGYQAKG

SEQ ID NO: 2026021 - protein, 17 aa, Staphylococcus
LGDGVEELGGLAVIGTE

SEQ ID NO: 2026022 - protein, 17 aa, Staphylococcus
LGDGWPHVNSQWLRAWR

SEQ ID NO: 2026023 - protein, 21 aa, Staphylococcus
LGDILLQVLLHASIGKKEGYF

SEQ ID NO: 2026024 - protein, 22 aa, Staphylococcus
LGDILLQVLLHASIGKKEGYMD

SEQ ID NO: 2026025 - protein, 18 aa, Staphylococcus
LGDITFRAIETLKQVDII

SEQ ID NO: 2026026 - protein, 17 aa, Staphylococcus
LGDNVLFHPKNPNDTEL

SEQ ID NO: 2026027 - protein, 19 aa, Staphylococcus
LGDRVNLVNSLFLLNEQNV

SEQ ID NO: 2026028 - protein, 24 aa, Staphylococcus
LGDTCPICGNEITSLGQHIDFDSI

SEQ ID NO: 2026029 - protein, 18 aa, Staphylococcus
LGDVSAETQFALDHFNVN

SEQ ID NO: 2026030 - protein, 18 aa, Staphylococcus
LGEDELPIFRSFMEDTSE

SEQ ID NO: 2026031 - protein, 17 aa, Staphylococcus
LGEGVEELGGLAVIGTE

SEQ ID NO: 2026032 - protein, 22 aa, Staphylococcus
LGEGYPVVLIHTAYDNYTVFND

SEQ ID NO: 2026033 - protein, 17 aa, Staphylococcus
LGEKGCLLVEGDDLKLN

SEQ ID NO: 2026034 - protein, 17 aa, Staphylococcus
LGEKICRIIEHCTENRL

SEQ ID NO: 2026035 - protein, 20 aa, Staphylococcus
LGEKQGKKLFVYSGAEHPHA

SEQ ID NO: 2026036 - protein, 23 aa, Staphylococcus
LGEKSDVITYEFENISAEQLIRL

SEQ ID NO: 2026037 - protein, 23 aa, Staphylococcus
LGEKSDVITYEFENISAQQLKTL

SEQ ID NO: 2026038 - protein, 23 aa, Staphylococcus
LGEMPLPPYIKARLDDPDRYQTV

SEQ ID NO: 2026039 - protein, 17 aa, Staphylococcus
LGEQGIRVNCVAPGPFW

SEQ ID NO: 2026040 - protein, 20 aa, Staphylococcus
LGEQVFNQFSSKSFPTNIYN

SEQ ID NO: 2026041 - protein, 18 aa, Staphylococcus
LGEVVHFADEFYKAGYEI

SEQ ID NO: 2026042 - protein, 28 aa, Staphylococcus
LGEYVKAHGFLPRIYKEPLLSEAVRYSI

SEQ ID NO: 2026043 - protein, 17 aa, Staphylococcus
LGFEKGHTFETPLVEFF

SEQ ID NO: 2026044 - protein, 19 aa, Staphylococcus
LGFGEICQIELERKGQSYT

SEQ ID NO: 2026045 - protein, 18 aa, Staphylococcus
LGFGEPYPISGSHGLGLG

SEQ ID NO: 2026046 - protein, 17 aa, Staphylococcus
LGFGKICTSELDRKGQS

SEQ ID NO: 2026047 - protein, 17 aa, Staphylococcus
LGFGNICYAELERKGQS

SEQ ID NO: 2026048 - protein, 17 aa, Staphylococcus
LGFGQSFKHKSKNVKYH

SEQ ID NO: 2026049 - protein, 17 aa, Staphylococcus
LGFGRICLNEIERRGQS

SEQ ID NO: 2026050 - protein, 17 aa, Staphylococcus
LGFKSVFKFRNDKQQVL

SEQ ID NO: 2026051 - protein, 18 aa, Staphylococcus
LGFNSVFKFRNDKNEVLM

SEQ ID NO: 2026052 - protein, 26 aa, Staphylococcus
LGFPGVKGEVLVNAFSKQDIMVSTTS

SEQ ID NO: 2026053 - protein, 17 aa, Staphylococcus
LGFPRLGRKREWKKAIE

SEQ ID NO: 2026054 - protein, 25 aa, Staphylococcus
LGFQFECLRKGFIFENDQWTDHYVY

SEQ ID NO: 2026055 - protein, 24 aa, Staphylococcus
LGFRGEALASISSVAKVTLRTCTD

SEQ ID NO: 2026056 - protein, 24 aa, Staphylococcus
LGFRGEALASISSVAKVTLSTCTD

SEQ ID NO: 2026057 - protein, 24 aa, Staphylococcus
LGFRGEALASISSVAKVTLTTCTD

SEQ ID NO: 2026058 - protein, 24 aa, Staphylococcus
LGFRGEALASISSVSKVTLKTCTD

SEQ ID NO: 2026059 - protein, 24 aa, Staphylococcus
LGFRGEALASISSVSKVTLRTCTD

SEQ ID NO: 2026060 - protein, 25 aa, Staphylococcus
LGFSEKELFEFIRYIQNTPMLILNH

SEQ ID NO: 2026061 - protein, 17 aa, Staphylococcus
LGFYEIDEWRDWLKHVF

SEQ ID NO: 2026062 - protein, 20 aa, Staphylococcus
LGGEITFGANLQIGYYDQKQ

SEQ ID NO: 2026063 - protein, 21 aa, Staphylococcus
LGGELKGYIIGTAEKPGDIKK

SEQ ID NO: 2026064 - protein, 19 aa, Staphylococcus
LGGEVEAFFASKLPIINFR

SEQ ID NO: 2026065 - protein, 27 aa, Staphylococcus
LGGFNFPNKRAKLYPLTFDNFFKQDEE

SEQ ID NO: 2026066 - protein, 19 aa, Staphylococcus
LGGGERFGTLVLGRVKDDF

SEQ ID NO: 2026067 - protein, 24 aa, Staphylococcus
LGGHSLRATLVVNRIEEQLQKRLK

SEQ ID NO: 2026068 - protein, 25 aa, Staphylococcus
LGGHSLRATLVVNRIESQLKKRLKV

SEQ ID NO: 2026069 - protein, 20 aa, Staphylococcus
LGGIDSFDGGIGMMQALGAQ

SEQ ID NO: 2026070 - protein, 25 aa, Staphylococcus
LGGIFSLKLAEQFEVGRVVGMSIPY

SEQ ID NO: 2026071 - protein, 24 aa, Staphylococcus
LGGKNAGITTCWFNYRNKENNSDI

SEQ ID NO: 2026072 - protein, 18 aa, Staphylococcus
LGGKWKGIIINTLYDEAY

SEQ ID NO: 2026073 - protein, 17 aa, Staphylococcus
LGGLAVIINEHMENSRV

SEQ ID NO: 2026074 - protein, 21 aa, Staphylococcus
LGGLFTLKLAETVDVAKIAVM

SEQ ID NO: 2026075 - protein, 27 aa, Staphylococcus
LGGLFTLRLAEQFDLERIAVMSAPHKK

SEQ ID NO: 2026076 - protein, 17 aa, Staphylococcus
LGGLLVMIVKRDPRQKE

SEQ ID NO: 2026077 - protein, 31 aa, Staphylococcus
LGGRGVSYCAVCDGAFFKGKKLFVIGGGDSA

SEQ ID NO: 2026078 - protein, 32 aa, Staphylococcus
LGGRGVSYCAVCDGAFFKGKKLFVIGGGDSAV

SEQ ID NO: 2026079 - protein, 28 aa, Staphylococcus
LGGRGVSYCAVCDGAFFKNKNIFVIGGG

SEQ ID NO: 2026080 - protein, 29 aa, Staphylococcus
LGGRGVSYCAVCDGAFFKNKNLFVIGGGD

SEQ ID NO: 2026081 - protein, 25 aa, Staphylococcus
LGGYKLDREGFFYAPTILDHVKTTD

SEQ ID NO: 2026082 - protein, 20 aa, Staphylococcus
LGHACGHNIIGTASTLGGIA

SEQ ID NO: 2026083 - protein, 20 aa, Staphylococcus
LGHACGHNIIGTASVLAGVA

SEQ ID NO: 2026084 - protein, 20 aa, Staphylococcus
LGHACGHNIIGTASVLGGTA

SEQ ID NO: 2026085 - protein, 20 aa, Staphylococcus
LGHDMGGIIGREFTETYQYR

SEQ ID NO: 2026086 - protein, 19 aa, Staphylococcus
LGHDMGGLIGKRFTEKYPF

SEQ ID NO: 2026087 - protein, 18 aa, Staphylococcus
LGHFRGAVRPDITRFRDL

SEQ ID NO: 2026088 - protein, 17 aa, Staphylococcus
LGHKSYEEYKLKNLKNG

SEQ ID NO: 2026089 - protein, 22 aa, Staphylococcus
LGHSMGSIIARRFVEQYPDVAD

SEQ ID NO: 2026090 - protein, 24 aa, Staphylococcus
LGHTELKRSFCVVFKKDNKKVDIL

SEQ ID NO: 2026091 - protein, 18 aa, Staphylococcus
LGIAQAILHRPKFLVLDE

SEQ ID NO: 2026092 - protein, 24 aa, Staphylococcus
LGIDQYKPHIAIITNIYSAHLDYH

SEQ ID NO: 2026093 - protein, 19 aa, Staphylococcus
LGIDWPSVNADLALVKDNL

SEQ ID NO: 2026094 - protein, 17 aa, Staphylococcus
LGIEIGDTIVPNTELTQ

SEQ ID NO: 2026095 - protein, 26 aa, Staphylococcus
LGIELGIPEHLVWRQPFPGPGLGIRV

SEQ ID NO: 2026096 - protein, 18 aa, Staphylococcus
LGIEQYKPHIAIITNIYS

SEQ ID NO: 2026097 - protein, 20 aa, Staphylococcus
LGIEVGDFISFDPRTQITSS

SEQ ID NO: 2026098 - protein, 17 aa, Staphylococcus
LGIEVGDFVSFDPRTEI

SEQ ID NO: 2026099 - protein, 27 aa, Staphylococcus
LGINIMKFEHAFYCTKCENMATAKTCP

SEQ ID NO: 2026100 - protein, 17 aa, Staphylococcus
LGIPASDYFAFEACEYR

SEQ ID NO: 2026101 - protein, 23 aa, Staphylococcus
LGIPEHLVWRQPFPGPGLGIRVL

SEQ ID NO: 2026102 - protein, 23 aa, Staphylococcus
LGIPLTIITESVFARFISSIKAE

SEQ ID NO: 2026103 - protein, 23 aa, Staphylococcus
LGIPLTIITESVFARFISSIKEE

SEQ ID NO: 2026104 - protein, 22 aa, Staphylococcus
LGISSADVFKALDLDDAHHVDT

SEQ ID NO: 2026105 - protein, 22 aa, Staphylococcus
LGISSPDVFKALDLNFTHEVFT

SEQ ID NO: 2026106 - protein, 22 aa, Staphylococcus
LGISSPDVFKALNLNEKHVVNN

SEQ ID NO: 2026107 - protein, 23 aa, Staphylococcus
LGIVADCKLVLEALSSENVTTAH

SEQ ID NO: 2026108 - protein, 23 aa, Staphylococcus
LGIVADCKLVLESLLNESNHYTD

SEQ ID NO: 2026109 - protein, 22 aa, Staphylococcus
LGIVMPLYVKYGIALEAHLQNS

SEQ ID NO: 2026110 - protein, 19 aa, Staphylococcus
LGIYEGGGWNAIFWCNHDQ

SEQ ID NO: 2026111 - protein, 20 aa, Staphylococcus
LGIYEGGGWNAIFWCNHDQP

SEQ ID NO: 2026112 - protein, 21 aa, Staphylococcus
LGIYESRIEPIIDHIIKNINS

SEQ ID NO: 2026113 - protein, 18 aa, Staphylococcus
LGIYRFIQKQDKIYARTL

SEQ ID NO: 2026114 - protein, 24 aa, Staphylococcus
LGKEAFSIISQGRVDEILNAKPAD

SEQ ID NO: 2026115 - protein, 23 aa, Staphylococcus
LGKEAFSIISQGRVDEILNAKPI

SEQ ID NO: 2026116 - protein, 24 aa, Staphylococcus
LGKEAFSIISQGRVDEILNAKPVD

SEQ ID NO: 2026117 - protein, 19 aa, Staphylococcus
LGKGFSLQRYKGLGEMNPE

SEQ ID NO: 2026118 - protein, 20 aa, Staphylococcus
LGKGSAYLGTNGFQINEDKS

SEQ ID NO: 2026119 - protein, 21 aa, Staphylococcus
LGKKLVNSVVEYARNNNLKII

SEQ ID NO: 2026120 - protein, 17 aa, Staphylococcus
LGKKLVYKVVDYARENN

SEQ ID NO: 2026121 - protein, 19 aa, Staphylococcus
LGKKMPVFFSANMSYGVHA

SEQ ID NO: 2026122 - protein, 22 aa, Staphylococcus
LGKKYKVIASMGHVRDLPRSQM

SEQ ID NO: 2026123 - protein, 21 aa, Staphylococcus
LGKPNPFCYIATLYGNNKENY

SEQ ID NO: 2026124 - protein, 24 aa, Staphylococcus
LGKRLPDDLKLIGYDGTQLMRYMH

SEQ ID NO: 2026125 - protein, 18 aa, Staphylococcus
LGKRTWQGVIDPVGGESL

SEQ ID NO: 2026126 - protein, 23 aa, Staphylococcus
LGKSRPYIANMLRLLHLPTSLKD

SEQ ID NO: 2026127 - protein, 25 aa, Staphylococcus
LGKSRPYIANMLRLLNLPKDISNQV

SEQ ID NO: 2026128 - protein, 24 aa, Staphylococcus
LGKSRPYIANMLRLLNLPSDIAKL

SEQ ID NO: 2026129 - protein, 17 aa, Staphylococcus
LGKSYRLIDEAMLEELK

SEQ ID NO: 2026130 - protein, 19 aa, Staphylococcus
LGKSYRLIDESMLKQLNAT

SEQ ID NO: 2026131 - protein, 18 aa, Staphylococcus
LGKSYRLIDESMLKQMNI

SEQ ID NO: 2026132 - protein, 18 aa, Staphylococcus
LGKSYRLIEESMLETLNM

SEQ ID NO: 2026133 - protein, 21 aa, Staphylococcus
LGKTFSKGLLMGARGNSGVIL

SEQ ID NO: 2026134 - protein, 19 aa, Staphylococcus
LGKYHKLFIDKKELSTDTP

SEQ ID NO: 2026135 - protein, 23 aa, Staphylococcus
LGKYRFMLSGGQLERVYIASVLM

SEQ ID NO: 2026136 - protein, 19 aa, Staphylococcus
LGLDVIFKEAGFEWREPGC

SEQ ID NO: 2026137 - protein, 17 aa, Staphylococcus
LGLDWRTSINQADQMGV

SEQ ID NO: 2026138 - protein, 17 aa, Staphylococcus
LGLDWRTSIQQAQQMGV

SEQ ID NO: 2026139 - protein, 21 aa, Staphylococcus
LGLDYLDLYLMHWPGTNEAVM

SEQ ID NO: 2026140 - protein, 18 aa, Staphylococcus
LGLEGLKILKNVKEKFGL

SEQ ID NO: 2026141 - protein, 21 aa, Staphylococcus
LGLEPWRFVVIENEDLKEKLK

SEQ ID NO: 2026142 - protein, 22 aa, Staphylococcus
LGLEPWRFVVIESQELKDKLKP

SEQ ID NO: 2026143 - protein, 22 aa, Staphylococcus
LGLEPWRFVVIQNREIRDKLKA

SEQ ID NO: 2026144 - protein, 18 aa, Staphylococcus
LGLFRLYASKHFNKETLS

SEQ ID NO: 2026145 - protein, 17 aa, Staphylococcus
LGLGCMSLGTDFNKAQP

SEQ ID NO: 2026146 - protein, 20 aa, Staphylococcus
LGLIKGSKKPVAILCTSGTA

SEQ ID NO: 2026147 - protein, 25 aa, Staphylococcus
LGLKLYLERKFPEKNIYATGEAEPS

SEQ ID NO: 2026148 - protein, 17 aa, Staphylococcus
LGLNNVHAFQHDATQPY

SEQ ID NO: 2026149 - protein, 21 aa, Staphylococcus
LGLPDIDGFTLIKQIRTDIDT

SEQ ID NO: 2026150 - protein, 23 aa, Staphylococcus
LGLPQTRLRKLLKKMDYYIKFED

SEQ ID NO: 2026151 - protein, 25 aa, Staphylococcus
LGLPYRRVILCTGDIGFGSSKTYDL

SEQ ID NO: 2026152 - protein, 23 aa, Staphylococcus
LGLYCIAAPILNDAGHVIGAISC

SEQ ID NO: 2026153 - protein, 18 aa, Staphylococcus
LGMAGGFFVVDKLEDISV

SEQ ID NO: 2026154 - protein, 26 aa, Staphylococcus
LGMQTMKYDMCGSANVVAMIDAARKL

SEQ ID NO: 2026155 - protein, 17 aa, Staphylococcus
LGNHEFNYGLPYLQNTL

SEQ ID NO: 2026156 - protein, 25 aa, Staphylococcus
LGNIIAEVFNRFSITDTSMMLDRMK

SEQ ID NO: 2026157 - protein, 17 aa, Staphylococcus
LGNKLMAAIGIGGGMGI

SEQ ID NO: 2026158 - protein, 19 aa, Staphylococcus
LGNSLRRILLSSLPGSAVK

SEQ ID NO: 2026159 - protein, 18 aa, Staphylococcus
LGNVDWTGNLFITAINAK

SEQ ID NO: 2026160 - protein, 24 aa, Staphylococcus
LGPDAIRYAGIVARIEAIGLTVKD

SEQ ID NO: 2026161 - protein, 24 aa, Staphylococcus
LGPDAIRYAGLLSRLKKMGLDVID

SEQ ID NO: 2026162 - protein, 25 aa, Staphylococcus
LGPEFMKVTPGIRPKGAAQNDQQRI

SEQ ID NO: 2026163 - protein, 19 aa, Staphylococcus
LGPGPKAALDYMYQLAERD

SEQ ID NO: 2026164 - protein, 17 aa, Staphylococcus
LGPKRMNHLLAISSPEA

SEQ ID NO: 2026165 - protein, 17 aa, Staphylococcus
LGPSVYRVKNGVCNIIF

SEQ ID NO: 2026166 - protein, 22 aa, Staphylococcus
LGQAGVNIMGFCKEFNARTQED

SEQ ID NO: 2026167 - protein, 20 aa, Staphylococcus
LGQIRNAFFLAQEEDTTGTI

SEQ ID NO: 2026168 - protein, 22 aa, Staphylococcus
LGQLLLKYAMNYVQTKCDVMSL

SEQ ID NO: 2026169 - protein, 24 aa, Staphylococcus
LGQLLLKYGMTYAAHTCDTMSLEV

SEQ ID NO: 2026170 - protein, 24 aa, Staphylococcus
LGQLLLKYVMDYASHSCEVMSLEV

SEQ ID NO: 2026171 - protein, 26 aa, Staphylococcus
LGQLLLKYVMNYARHRCEVMSLEVRV

SEQ ID NO: 2026172 - protein, 22 aa, Staphylococcus
LGQNASFIFAVCEYLKKHNNER

SEQ ID NO: 2026173 - protein, 27 aa, Staphylococcus
LGQNASFIFAVCEYLKYENNPKYLEAA

SEQ ID NO: 2026174 - protein, 28 aa, Staphylococcus
LGQNASFIFAVCEYLKYGQFNKRYLNVA

SEQ ID NO: 2026175 - protein, 24 aa, Staphylococcus
LGQVTFPDSFKVFGSENSKVIFCE

SEQ ID NO: 2026176 - protein, 19 aa, Staphylococcus
LGRGGGSIEDLWNFNEEEV

SEQ ID NO: 2026177 - protein, 20 aa, Staphylococcus
LGRKFKRAGIKHITVQLYKF

SEQ ID NO: 2026178 - protein, 17 aa, Staphylococcus
LGRKIYINYLKKRKHSE

SEQ ID NO: 2026179 - protein, 19 aa, Staphylococcus
LGRKSAGLDTTRKAVLTAV

SEQ ID NO: 2026180 - protein, 24 aa, Staphylococcus
LGRPIEDLRIISCHIGNGASIAAI

SEQ ID NO: 2026181 - protein, 23 aa, Staphylococcus
LGRPYIRYEGFKVHVSITHTENY

SEQ ID NO: 2026182 - protein, 21 aa, Staphylococcus
LGRRKRLKWVNQLVYKSFNKR

SEQ ID NO: 2026183 - protein, 17 aa, Staphylococcus
LGRRLPRIYQVDDEMHV

SEQ ID NO: 2026184 - protein, 20 aa, Staphylococcus
LGSELRKFDTVGNIVFVTSY

SEQ ID NO: 2026185 - protein, 22 aa, Staphylococcus
LGSGHAAWHSALTLNKAGKSVA

SEQ ID NO: 2026186 - protein, 23 aa, Staphylococcus
LGSGKSLAYLLAALMYNIETGRH

SEQ ID NO: 2026187 - protein, 18 aa, Staphylococcus
LGSGPIRIGQGVEFDYAT

SEQ ID NO: 2026188 - protein, 19 aa, Staphylococcus
LGSHDGVGIVYGRDIAGKK

SEQ ID NO: 2026189 - protein, 20 aa, Staphylococcus
LGSHVAELLARMGAHHLAIV

SEQ ID NO: 2026190 - protein, 17 aa, Staphylococcus
LGSLVMATTHYPELKAY

SEQ ID NO: 2026191 - protein, 18 aa, Staphylococcus
LGSNFLKVTPGIRPQGAA

SEQ ID NO: 2026192 - protein, 19 aa, Staphylococcus
LGSQIGTDVSFCIYNKTAY

SEQ ID NO: 2026193 - protein, 18 aa, Staphylococcus
LGTAFANFGSEVTILEGA

SEQ ID NO: 2026194 - protein, 20 aa, Staphylococcus
LGTCFSRNGLNTSPYFNPDY

SEQ ID NO: 2026195 - protein, 19 aa, Staphylococcus
LGTEAMRPLIVMSPKSLLR

SEQ ID NO: 2026196 - protein, 23 aa, Staphylococcus
LGTFDAIVGRRVLMYLPEPMQAL

SEQ ID NO: 2026197 - protein, 20 aa, Staphylococcus
LGTGDAFSVGIIYGIMKQWD

SEQ ID NO: 2026198 - protein, 19 aa, Staphylococcus
LGTGDAFSVGVIYGIMQKW

SEQ ID NO: 2026199 - protein, 17 aa, Staphylococcus
LGTHNMRNAAIAISIGK

SEQ ID NO: 2026200 - protein, 18 aa, Staphylococcus
LGTKLDIIDIEFTSKLTP

SEQ ID NO: 2026201 - protein, 19 aa, Staphylococcus
LGTKYSEAMNAKFIDNQGK

SEQ ID NO: 2026202 - protein, 17 aa, Staphylococcus
LGTLVLGRVKDDFNEND

SEQ ID NO: 2026203 - protein, 18 aa, Staphylococcus
LGTLVLGRVTEDFSENDL

SEQ ID NO: 2026204 - protein, 24 aa, Staphylococcus
LGTMGCALPGAMASKIAYPNRQAV

SEQ ID NO: 2026205 - protein, 21 aa, Staphylococcus
LGTMGCALPGAMASNVAFPNR

SEQ ID NO: 2026206 - protein, 26 aa, Staphylococcus
LGTMGCGLPGAIAAKIAYPKRQAIAI

SEQ ID NO: 2026207 - protein, 28 aa, Staphylococcus
LGTMGCGLPGALASNIAYPGRQAIAITG

SEQ ID NO: 2026208 - protein, 24 aa, Staphylococcus
LGTMNCLRYLIDDLKAIDRDALAG

SEQ ID NO: 2026209 - protein, 25 aa, Staphylococcus
LGTSGCGKTTLLRLIAGLETPDNGV

SEQ ID NO: 2026210 - protein, 19 aa, Staphylococcus
LGVELVIDEALRLERKKQL

SEQ ID NO: 2026211 - protein, 19 aa, Staphylococcus
LGVGLTCRNVSTSVTLTTG

SEQ ID NO: 2026212 - protein, 18 aa, Staphylococcus
LGVGQFASISGRYYAMDR

SEQ ID NO: 2026213 - protein, 18 aa, Staphylococcus
LGVGVSFNKERQPFWTED

SEQ ID NO: 2026214 - protein, 18 aa, Staphylococcus
LGVKEGKMHITLTKSKQW

SEQ ID NO: 2026215 - protein, 18 aa, Staphylococcus
LGVKRIKALDVDEMAVRV

SEQ ID NO: 2026216 - protein, 17 aa, Staphylococcus
LGVLEGKTLVIGDDVPV

SEQ ID NO: 2026217 - protein, 20 aa, Staphylococcus
LGVPKYKLIAVEGHNKVPER

SEQ ID NO: 2026218 - protein, 17 aa, Staphylococcus
LGVPLTIITESVFARFI

SEQ ID NO: 2026219 - protein, 23 aa, Staphylococcus
LGVRPSHQYKLLIILSPSGAYYG

SEQ ID NO: 2026220 - protein, 23 aa, Staphylococcus
LGVRPSYSYKLLIILSPSGSYYG

SEQ ID NO: 2026221 - protein, 19 aa, Staphylococcus
LGVVMKRNGIHHITVQLYR

SEQ ID NO: 2026222 - protein, 20 aa, Staphylococcus
LGYGDMLYLGSGMNKPIRVQ

SEQ ID NO: 2026223 - protein, 21 aa, Staphylococcus
LGYGDMLYLGSGMNKPIRVQG

SEQ ID NO: 2026224 - protein, 25 aa, Staphylococcus
LGYGERAKMGLALNKLVRDGEISAP

SEQ ID NO: 2026225 - protein, 24 aa, Staphylococcus
LGYKEIKGTFLTPEIYSTMSEEEQ

SEQ ID NO: 2026226 - protein, 18 aa, Staphylococcus
LGYKGPKGSFEIEDTSLF

SEQ ID NO: 2026227 - protein, 18 aa, Staphylococcus
LGYKGPKGSFEIEGISLF

SEQ ID NO: 2026228 - protein, 18 aa, Staphylococcus
LGYKGPKGSFEIEGVSLF

SEQ ID NO: 2026229 - protein, 25 aa, Staphylococcus
LGYKVIKYPLNLVGIYNIKRFYIDN

SEQ ID NO: 2026230 - protein, 17 aa, Staphylococcus
LGYSEIDEWRDWLRHVF

SEQ ID NO: 2026231 - protein, 24 aa, Staphylococcus
LGYTGCPIAGFKKNNIEKLLELDH

SEQ ID NO: 2026232 - protein, 20 aa, Staphylococcus
LHAFFKPEILNRMDDIVLFK

SEQ ID NO: 2026233 - protein, 18 aa, Staphylococcus
LHALDVWLLGKRQFAEFD

SEQ ID NO: 2026234 - protein, 18 aa, Staphylococcus
LHALISRFEAESHIESPI

SEQ ID NO: 2026235 - protein, 19 aa, Staphylococcus
LHANFPFENIEWLIKEGYS

SEQ ID NO: 2026236 - protein, 20 aa, Staphylococcus
LHCEKCGRDYDYYEFDNGQV

SEQ ID NO: 2026237 - protein, 27 aa, Staphylococcus
LHCGLRRKKVDFGWIYSTTPATATGVY

SEQ ID NO: 2026238 - protein, 17 aa, Staphylococcus
LHDEFKVGDDINLTAPV

SEQ ID NO: 2026239 - protein, 18 aa, Staphylococcus
LHDLAFLLLVYPLSEVEG

SEQ ID NO: 2026240 - protein, 19 aa, Staphylococcus
LHDLFHLFMKASKESMQDN

SEQ ID NO: 2026241 - protein, 25 aa, Staphylococcus
LHDLGFGPKLAMAIYQAYLGETLNV

SEQ ID NO: 2026242 - protein, 26 aa, Staphylococcus
LHDLGFGPKLSMAIYQFYMGDTLKIL

SEQ ID NO: 2026243 - protein, 25 aa, Staphylococcus
LHDLGFGPKLSMAIYQFYQSETINV

SEQ ID NO: 2026244 - protein, 25 aa, Staphylococcus
LHDLGFGPKLSMAIYQFYQSETLKV

SEQ ID NO: 2026245 - protein, 25 aa, Staphylococcus
LHDLGFGPKLSMAIYQFYQSETLNV

SEQ ID NO: 2026246 - protein, 25 aa, Staphylococcus
LHDLGFGPKLSMNIYQVYQVETLTE

SEQ ID NO: 2026247 - protein, 19 aa, Staphylococcus
LHDSLRYAFNNNITCVNVP

SEQ ID NO: 2026248 - protein, 20 aa, Staphylococcus
LHDSRKLFELMALESQHAGL

SEQ ID NO: 2026249 - protein, 18 aa, Staphylococcus
LHEAPSYVLNYFDPKDKT

SEQ ID NO: 2026250 - protein, 17 aa, Staphylococcus
LHEEMYDIAGLRMMCQF

SEQ ID NO: 2026251 - protein, 18 aa, Staphylococcus
LHEIRPEHFVFATEAEAE

SEQ ID NO: 2026252 - protein, 19 aa, Staphylococcus
LHEKYKLFVVSSKKTDVLK

SEQ ID NO: 2026253 - protein, 18 aa, Staphylococcus
LHELDLKELVLPLIVLDY

SEQ ID NO: 2026254 - protein, 18 aa, Staphylococcus
LHESHFGEKMGMKFHTDV

SEQ ID NO: 2026255 - protein, 24 aa, Staphylococcus
LHESSKMCLFEPRVFSDTQDIADE

SEQ ID NO: 2026256 - protein, 30 aa, Staphylococcus
LHEVNPMLGHRGCRLAITYPELYEMQVEAI

SEQ ID NO: 2026257 - protein, 30 aa, Staphylococcus
LHEVNPMLGHRGCRLAVTYPELYEMQVEAI

SEQ ID NO: 2026258 - protein, 28 aa, Staphylococcus
LHEYLHGRKAPKLEGVRFSVLALGDQSY

SEQ ID NO: 2026259 - protein, 17 aa, Staphylococcus
LHFDDIYQFMLLDKKNN

SEQ ID NO: 2026260 - protein, 19 aa, Staphylococcus
LHFHIPYDVQVIGYDDIPL

SEQ ID NO: 2026261 - protein, 17 aa, Staphylococcus
LHFLLKLMENIRQAIRE

SEQ ID NO: 2026262 - protein, 32 aa, Staphylococcus
LHGAIMTYRIMTMFEPYFREYKMIFINCPSRG

SEQ ID NO: 2026263 - protein, 17 aa, Staphylococcus
LHGAPGFEDDIKAYMKD

SEQ ID NO: 2026264 - protein, 18 aa, Staphylococcus
LHGAPGFEEEVRDYMKKE

SEQ ID NO: 2026265 - protein, 17 aa, Staphylococcus
LHGAPGFENDVKAYMKA

SEQ ID NO: 2026266 - protein, 22 aa, Staphylococcus
LHGDLWKGNILFQKNGDPILCD

SEQ ID NO: 2026267 - protein, 25 aa, Staphylococcus
LHGLIEERYLIFALEHANINDDMTG

SEQ ID NO: 2026268 - protein, 24 aa, Staphylococcus
LHGPVCAALMKADYGIEDEEILLA

SEQ ID NO: 2026269 - protein, 19 aa, Staphylococcus
LHGSIELAGLILESTSPGI

SEQ ID NO: 2026270 - protein, 17 aa, Staphylococcus
LHHEYSIITNMGFEDYF

SEQ ID NO: 2026271 - protein, 19 aa, Staphylococcus
LHHPYKKKVMMAKFDNMIN

SEQ ID NO: 2026272 - protein, 19 aa, Staphylococcus
LHHPYKKKVMMAKFNNMID

SEQ ID NO: 2026273 - protein, 28 aa, Staphylococcus
LHHQCIPCILDYRWSEEQIKTLIDHYGI

SEQ ID NO: 2026274 - protein, 18 aa, Staphylococcus
LHIGGLGVAKGYIGDQQL

SEQ ID NO: 2026275 - protein, 17 aa, Staphylococcus
LHIGILIFGSGHHQAAW

SEQ ID NO: 2026276 - protein, 17 aa, Staphylococcus
LHIHLRVNNSDSVINDI

SEQ ID NO: 2026277 - protein, 26 aa, Staphylococcus
LHIPSPLWKVMDFMILDKAEEHRKYE

SEQ ID NO: 2026278 - protein, 17 aa, Staphylococcus
LHIPSTYLGIAQAARDY

SEQ ID NO: 2026279 - protein, 18 aa, Staphylococcus
LHITKMIKNQARYGETST

SEQ ID NO: 2026280 - protein, 26 aa, Staphylococcus
LHKAVTLKAAFELGERINKRNSIEKV

SEQ ID NO: 2026281 - protein, 17 aa, Staphylococcus
LHKDLLIVADTCLCEYT

SEQ ID NO: 2026282 - protein, 25 aa, Staphylococcus
LHKGEIFGFSGLMGAGRSEIMRVLF

SEQ ID NO: 2026283 - protein, 18 aa, Staphylococcus
LHKGLEIGTQYDKWMERM

SEQ ID NO: 2026284 - protein, 19 aa, Staphylococcus
LHKGNSFVQLAKFFEESGE

SEQ ID NO: 2026285 - protein, 18 aa, Staphylococcus
LHKPRKVIISGQCPVDNN

SEQ ID NO: 2026286 - protein, 19 aa, Staphylococcus
LHKRPDLLEKYQLSDKDKE

SEQ ID NO: 2026287 - protein, 17 aa, Staphylococcus
LHLAEWLMEMQLDRKAG

SEQ ID NO: 2026288 - protein, 17 aa, Staphylococcus
LHLEHIYGVQFNQAEVT

SEQ ID NO: 2026289 - protein, 17 aa, Staphylococcus
LHLEKEFSGQVNLDDYQ

SEQ ID NO: 2026290 - protein, 17 aa, Staphylococcus
LHLFPQLKIAKEPYGLH

SEQ ID NO: 2026291 - protein, 24 aa, Staphylococcus
LHLGAPFDSFAGFKSYRLLKPLEG

SEQ ID NO: 2026292 - protein, 17 aa, Staphylococcus
LHLMNNHAILFYPLDIE

SEQ ID NO: 2026293 - protein, 20 aa, Staphylococcus
LHLPGLSIMKRMNRIAQTIN

SEQ ID NO: 2026294 - protein, 17 aa, Staphylococcus
LHLPGWGLDALKYLFEE

SEQ ID NO: 2026295 - protein, 19 aa, Staphylococcus
LHLPNDIMGALDVIINGHT

SEQ ID NO: 2026296 - protein, 22 aa, Staphylococcus
LHLQNVFCLTVLPKSIKEKLPS

SEQ ID NO: 2026297 - protein, 18 aa, Staphylococcus
LHLRMERHSANALKVAQF

SEQ ID NO: 2026298 - protein, 20 aa, Staphylococcus
LHMGGRIGVLSVVEGSTDEE

SEQ ID NO: 2026299 - protein, 21 aa, Staphylococcus
LHMGGRIGVLTVIEGTTDEAA

SEQ ID NO: 2026300 - protein, 19 aa, Staphylococcus
LHMGGRIGVLTVVEGSTDA

SEQ ID NO: 2026301 - protein, 19 aa, Staphylococcus
LHMGGRIGVLTVVEGTTDE

SEQ ID NO: 2026302 - protein, 18 aa, Staphylococcus
LHNEIKEAYDLGIRAIMF

SEQ ID NO: 2026303 - protein, 24 aa, Staphylococcus
LHNVAGLKSSEVWTKSKSDDVEYV

SEQ ID NO: 2026304 - protein, 18 aa, Staphylococcus
LHPEYRTMPMVWYCPPLS

SEQ ID NO: 2026305 - protein, 22 aa, Staphylococcus
LHPEYRTMPMVWYCPPLSPIMS

SEQ ID NO: 2026306 - protein, 26 aa, Staphylococcus
LHPFDSWQEYWAFESRFVKLNYLDQP

SEQ ID NO: 2026307 - protein, 27 aa, Staphylococcus
LHPGAKLRKGLTPEMNLLYSSEFHQPQ

SEQ ID NO: 2026308 - protein, 23 aa, Staphylococcus
LHQIQGLGPIIIKVNELPVTASI

SEQ ID NO: 2026309 - protein, 22 aa, Staphylococcus
LHQKYLDTFREGFKQQIENTKV

SEQ ID NO: 2026310 - protein, 17 aa, Staphylococcus
LHRENEEVMKYAAENDI

SEQ ID NO: 2026311 - protein, 17 aa, Staphylococcus
LHRENEEVMKYAAENNI

SEQ ID NO: 2026312 - protein, 27 aa, Staphylococcus
LHRLERVCALTMLYVLGKYLDKKQSYM

SEQ ID NO: 2026313 - protein, 17 aa, Staphylococcus
LHSFCIKLMKEIYDKTQ

SEQ ID NO: 2026314 - protein, 23 aa, Staphylococcus
LHSFFDKMNELFIANYKTNHIQV

SEQ ID NO: 2026315 - protein, 22 aa, Staphylococcus
LHTAEIKSIFSSGAKLSKEQFR

SEQ ID NO: 2026316 - protein, 37 aa, Staphylococcus
LHTEPTYLIYMLGFMPGFPYLGGLDERLYTPRRDEPR

SEQ ID NO: 2026317 - protein, 19 aa, Staphylococcus
LHVDGAYGLSHILSDKAQH

SEQ ID NO: 2026318 - protein, 18 aa, Staphylococcus
LHWQYGHVLTVFEEALAM

SEQ ID NO: 2026319 - protein, 19 aa, Staphylococcus
LHYISGKYVLDFKEDDVYW

SEQ ID NO: 2026320 - protein, 23 aa, Staphylococcus
LIADFYSSGLIEIIRRWVENNYN

SEQ ID NO: 2026321 - protein, 21 aa, Staphylococcus
LIADIKFALKEAFNESISQPV

SEQ ID NO: 2026322 - protein, 18 aa, Staphylococcus
LIADVYTSPGFANEKISI

SEQ ID NO: 2026323 - protein, 27 aa, Staphylococcus
LIAKRHPVDVCFIPIGDNFTMGIDDAA

SEQ ID NO: 2026324 - protein, 25 aa, Staphylococcus
LIALRVTMDVAFHIADDKAFAKLTG

SEQ ID NO: 2026325 - protein, 24 aa, Staphylococcus
LIAMKKGEIIACGATEDVLTKDIL

SEQ ID NO: 2026326 - protein, 18 aa, Staphylococcus
LIAVEGHNKVPERAEEIK

SEQ ID NO: 2026327 - protein, 18 aa, Staphylococcus
LICDSMRAADLFESAYPM

SEQ ID NO: 2026328 - protein, 17 aa, Staphylococcus
LICTPKNPLCLFCPIQS

SEQ ID NO: 2026329 - protein, 17 aa, Staphylococcus
LICTPKSPLCLFCPVQS

SEQ ID NO: 2026330 - protein, 17 aa, Staphylococcus
LIDAAAYNVARKNDNVF

SEQ ID NO: 2026331 - protein, 18 aa, Staphylococcus
LIDAFGVQSFGDIDQTIK

SEQ ID NO: 2026332 - protein, 18 aa, Staphylococcus
LIDEARTPLIISGEAEKS

SEQ ID NO: 2026333 - protein, 17 aa, Staphylococcus
LIDEFMLHIPVQNHELR

SEQ ID NO: 2026334 - protein, 23 aa, Staphylococcus
LIDESKLNFLWVTDWPLLEYDDE

SEQ ID NO: 2026335 - protein, 23 aa, Staphylococcus
LIDESKLNFLWVTDWPLLEYDED

SEQ ID NO: 2026336 - protein, 25 aa, Staphylococcus
LIDETLCTFWQGFNYTIDMNQAPFN

SEQ ID NO: 2026337 - protein, 25 aa, Staphylococcus
LIDEYRLSIHPVVLGTGKPLFENIH

SEQ ID NO: 2026338 - protein, 18 aa, Staphylococcus
LIDRSIRIIQDICDISYN

SEQ ID NO: 2026339 - protein, 22 aa, Staphylococcus
LIDRVDHRYVYVNLGRTEAVLS

SEQ ID NO: 2026340 - protein, 33 aa, Staphylococcus
LIDSSNKDKFIWRGEVINSFDIYNNIDVLLLTS

SEQ ID NO: 2026341 - protein, 17 aa, Staphylococcus
LIDTAFIYGPKRSEELV

SEQ ID NO: 2026342 - protein, 24 aa, Staphylococcus
LIDTEKYVPLGLEMNGNHIGSTTE

SEQ ID NO: 2026343 - protein, 19 aa, Staphylococcus
LIDVEAGEISKLLSQGSTG

SEQ ID NO: 2026344 - protein, 24 aa, Staphylococcus
LIDYDWYDYSGFAIAGPNAQVANT

SEQ ID NO: 2026345 - protein, 21 aa, Staphylococcus
LIDYIRYVNRFVRIFDFPFYF

SEQ ID NO: 2026346 - protein, 18 aa, Staphylococcus
LIEAAAYNVARKNKDVKL

SEQ ID NO: 2026347 - protein, 25 aa, Staphylococcus
LIEAAHYGCKIFAYETDVTKEVLKN

SEQ ID NO: 2026348 - protein, 19 aa, Staphylococcus
LIEDNDCIFMDAGSSTIEM

SEQ ID NO: 2026349 - protein, 17 aa, Staphylococcus
LIEDVDYIAARLDENAN

SEQ ID NO: 2026350 - protein, 25 aa, Staphylococcus
LIEDYRYLDLFPVGRLDKDTEGLLL

SEQ ID NO: 2026351 - protein, 26 aa, Staphylococcus
LIEFDHSWEKIGVRLVNSFLETFPVA

SEQ ID NO: 2026352 - protein, 25 aa, Staphylococcus
LIEFDKSWEKIGIRLVDKLLDTFPV

SEQ ID NO: 2026353 - protein, 25 aa, Staphylococcus
LIEFDKSWEKIGIRLVDSLLEEYPV

SEQ ID NO: 2026354 - protein, 21 aa, Staphylococcus
LIEFDKSWEKIGVRLVDKLLE

SEQ ID NO: 2026355 - protein, 30 aa, Staphylococcus
LIEFDKSWKKIGLRLVDQFLETFPVAHKET

SEQ ID NO: 2026356 - protein, 25 aa, Staphylococcus
LIEFFRDKKIEMIFASPYKRVIETV

SEQ ID NO: 2026357 - protein, 26 aa, Staphylococcus
LIEHEGLEALSHFNGHPGHLALPRKQ

SEQ ID NO: 2026358 - protein, 23 aa, Staphylococcus
LIEKEVYAAAYAFNQPLNSDNNK

SEQ ID NO: 2026359 - protein, 26 aa, Staphylococcus
LIEKLTFMHAYNCICANVPAQHACIA

SEQ ID NO: 2026360 - protein, 25 aa, Staphylococcus
LIEKLTFMHAYNCICANVPAQIACI

SEQ ID NO: 2026361 - protein, 17 aa, Staphylococcus
LIEKSIAGFKEIEYEVM

SEQ ID NO: 2026362 - protein, 28 aa, Staphylococcus
LIENAKFCPECGFKIASINNNSQKIEEV

SEQ ID NO: 2026363 - protein, 18 aa, Staphylococcus
LIEPLAYYVSLALLKPIN

SEQ ID NO: 2026364 - protein, 18 aa, Staphylococcus
LIERERITVASIPLQVCN

SEQ ID NO: 2026365 - protein, 26 aa, Staphylococcus
LIESKAFPRVNLTEVYRQQDGSSIID

SEQ ID NO: 2026366 - protein, 23 aa, Staphylococcus
LIEVMGTAILPGRLKEELQQVKT

SEQ ID NO: 2026367 - protein, 23 aa, Staphylococcus
LIEVMGTAILPGRLKKELLEVER

SEQ ID NO: 2026368 - protein, 24 aa, Staphylococcus
LIEYLCKNHEDIFVRLFELLSATQ

SEQ ID NO: 2026369 - protein, 26 aa, Staphylococcus
LIFDECLPFAFPHIILDFAGWQFQME

SEQ ID NO: 2026370 - protein, 26 aa, Staphylococcus
LIFDEFDFNIAIKFNLYKTALVFATY

SEQ ID NO: 2026371 - protein, 25 aa, Staphylococcus
LIFKFKKYKQIYIIGPYMEQRPNER

SEQ ID NO: 2026372 - protein, 17 aa, Staphylococcus
LIFNTRHGAELQTYSIF

SEQ ID NO: 2026373 - protein, 17 aa, Staphylococcus
LIFSTNAILNFPPEHAK

SEQ ID NO: 2026374 - protein, 17 aa, Staphylococcus
LIFVQSLPRETRVGAKQ

SEQ ID NO: 2026375 - protein, 24 aa, Staphylococcus
LIGELRAAVDMPIHLHTHDTSGNG

SEQ ID NO: 2026376 - protein, 19 aa, Staphylococcus
LIGGCFEVLNNLRGTEVFP

SEQ ID NO: 2026377 - protein, 18 aa, Staphylococcus
LIGGKGRRANLYGLINKA

SEQ ID NO: 2026378 - protein, 19 aa, Staphylococcus
LIGGRGRRANLYGLFNKTI

SEQ ID NO: 2026379 - protein, 19 aa, Staphylococcus
LIGHKTRLTMLIELSSGIS

SEQ ID NO: 2026380 - protein, 23 aa, Staphylococcus
LIGHLRAAVDMPIHLHTHDTSGN

SEQ ID NO: 2026381 - protein, 23 aa, Staphylococcus
LIGHSMGGYAVTLFGTKYPNKVD

SEQ ID NO: 2026382 - protein, 18 aa, Staphylococcus
LIGLSFNFMCFKSGTPIE

SEQ ID NO: 2026383 - protein, 18 aa, Staphylococcus
LIGQIGIKEKQLNVLKQR

SEQ ID NO: 2026384 - protein, 17 aa, Staphylococcus
LIGYDGTQLMRYMHPYL

SEQ ID NO: 2026385 - protein, 23 aa, Staphylococcus
LIGYFCLKIVIIKFEINVSKNIK

SEQ ID NO: 2026386 - protein, 18 aa, Staphylococcus
LIHGDCLTVTGKTVAENL

SEQ ID NO: 2026387 - protein, 18 aa, Staphylococcus
LIHIGDNCVIGYNTTILT

SEQ ID NO: 2026388 - protein, 25 aa, Staphylococcus
LIIAEPSDGFVFYASKGSMGLKVTS

SEQ ID NO: 2026389 - protein, 20 aa, Staphylococcus
LIIETCKAVAPKLEIHLSTQ

SEQ ID NO: 2026390 - protein, 19 aa, Staphylococcus
LIIPDEIKGYHPIEKLKNV

SEQ ID NO: 2026391 - protein, 25 aa, Staphylococcus
LIIPKYKGSLLFTKHKIRGIEFPGG

SEQ ID NO: 2026392 - protein, 17 aa, Staphylococcus
LIITGSLYFISEVKSKV

SEQ ID NO: 2026393 - protein, 22 aa, Staphylococcus
LIITKQRFSAFTGSNLDVLLSG

SEQ ID NO: 2026394 - protein, 20 aa, Staphylococcus
LIIVPLFLFDGRLVNKVKRL

SEQ ID NO: 2026395 - protein, 17 aa, Staphylococcus
LIKAGAFNNYPIEAVFG

SEQ ID NO: 2026396 - protein, 21 aa, Staphylococcus
LIKDCEVRKTFEIASEKHTEK

SEQ ID NO: 2026397 - protein, 25 aa, Staphylococcus
LIKDLRRLGLRVYFNIENALVSLSD

SEQ ID NO: 2026398 - protein, 28 aa, Staphylococcus
LIKDLRRLGLRVYFNIKNALVSLSEEKR

SEQ ID NO: 2026399 - protein, 25 aa, Staphylococcus
LIKDYKYLDLFPVGRLDKDTEGLLL

SEQ ID NO: 2026400 - protein, 17 aa, Staphylococcus
LIKEGKFEAALKALFEN

SEQ ID NO: 2026401 - protein, 24 aa, Staphylococcus
LIKEKPDLILLTFPTPVMSVLTEQ

SEQ ID NO: 2026402 - protein, 22 aa, Staphylococcus
LIKGENVMNGYLYPENLTNTFE

SEQ ID NO: 2026403 - protein, 22 aa, Staphylococcus
LIKGENVMNGYLYPSNLTDTFE

SEQ ID NO: 2026404 - protein, 21 aa, Staphylococcus
LIKGGRIGRAKGMIGNIMRLK

SEQ ID NO: 2026405 - protein, 17 aa, Staphylococcus
LIKKEFYNFTIVFTEYY

SEQ ID NO: 2026406 - protein, 21 aa, Staphylococcus
LIKLQNIKAGVVINPGTPVEL

SEQ ID NO: 2026407 - protein, 24 aa, Staphylococcus
LIKRAGGLHQFMNWDGPILTDSGG

SEQ ID NO: 2026408 - protein, 18 aa, Staphylococcus
LIKSETFESGALGLNYQV

SEQ ID NO: 2026409 - protein, 25 aa, Staphylococcus
LIKYAKCYRLAFQLYSADYSTIIDT

SEQ ID NO: 2026410 - protein, 20 aa, Staphylococcus
LILCATGCYHFRRGNCKGAS

SEQ ID NO: 2026411 - protein, 18 aa, Staphylococcus
LILDELDHTLSHVDDTSY

SEQ ID NO: 2026412 - protein, 19 aa, Staphylococcus
LILDELDHTLSHVRDNEAE

SEQ ID NO: 2026413 - protein, 17 aa, Staphylococcus
LILDLVVNHTSDEHPWF

SEQ ID NO: 2026414 - protein, 19 aa, Staphylococcus
LILEELDRTLSHVQDEQYD

SEQ ID NO: 2026415 - protein, 20 aa, Staphylococcus
LILEELERTLSHVQDEQYDR

SEQ ID NO: 2026416 - protein, 18 aa, Staphylococcus
LILFATGCYHFRRENDKG

SEQ ID NO: 2026417 - protein, 27 aa, Staphylococcus
LILKGELDGHFPLVVWQTGSGTQSNMN

SEQ ID NO: 2026418 - protein, 23 aa, Staphylococcus
LILRPHIIISNALHLDASLDEFV

SEQ ID NO: 2026419 - protein, 23 aa, Staphylococcus
LILRPHIIISNALNLSESLKDFV

SEQ ID NO: 2026420 - protein, 20 aa, Staphylococcus
LIMMPRAIATYELYIAALKL

SEQ ID NO: 2026421 - protein, 25 aa, Staphylococcus
LIMMPRAIITYELYIAALKLGIAII

SEQ ID NO: 2026422 - protein, 20 aa, Staphylococcus
LINACWLANVEIAMLNTRLT

SEQ ID NO: 2026423 - protein, 27 aa, Staphylococcus
LINDFAYKHHIPWIYGGVVQSTYAEAT

SEQ ID NO: 2026424 - protein, 24 aa, Staphylococcus
LINEDVAMAFGFFDGMHKGHLKVF

SEQ ID NO: 2026425 - protein, 24 aa, Staphylococcus
LINENVAMAFGFFDGMHRGHDKVF

SEQ ID NO: 2026426 - protein, 23 aa, Staphylococcus
LINERYAELVIPYRDLKNINDVK

SEQ ID NO: 2026427 - protein, 27 aa, Staphylococcus
LINEVCHKLNIPWIYGAAVGSKGTVYG

SEQ ID NO: 2026428 - protein, 17 aa, Staphylococcus
LINIGALSQLTASSLTG

SEQ ID NO: 2026429 - protein, 19 aa, Staphylococcus
LINQEFKDQVIIENGYQTV

SEQ ID NO: 2026430 - protein, 19 aa, Staphylococcus
LINQYGFNVNILFSSMSDI

SEQ ID NO: 2026431 - protein, 19 aa, Staphylococcus
LINRDAFEMGKEVVVQVRK

SEQ ID NO: 2026432 - protein, 17 aa, Staphylococcus
LINSGAFSQLTSASLMG

SEQ ID NO: 2026433 - protein, 21 aa, Staphylococcus
LIPAARVGHVGLYRDPETLEA

SEQ ID NO: 2026434 - protein, 17 aa, Staphylococcus
LIPEIGKTLTLQQFPED

SEQ ID NO: 2026435 - protein, 22 aa, Staphylococcus
LIPETKRATILSTKKIGDKVHL

SEQ ID NO: 2026436 - protein, 21 aa, Staphylococcus
LIPRLKDAFESVKVGDPTDEN

SEQ ID NO: 2026437 - protein, 22 aa, Staphylococcus
LIPYLSVIEQLTLVGKEAGQSH

SEQ ID NO: 2026438 - protein, 25 aa, Staphylococcus
LIQELYVPDSFFIVKSLWTQYYCHQ

SEQ ID NO: 2026439 - protein, 20 aa, Staphylococcus
LIQGECSVGHIAHTLNLSQS

SEQ ID NO: 2026440 - protein, 25 aa, Staphylococcus
LIQIPTMYYAMLVADNFDLKNFANI

SEQ ID NO: 2026441 - protein, 27 aa, Staphylococcus
LIQLEMVTKILLKRLKNIKLKTMNLEE

SEQ ID NO: 2026442 - protein, 18 aa, Staphylococcus
LIQNKVLLSISVSNSSRY

SEQ ID NO: 2026443 - protein, 19 aa, Staphylococcus
LIQRKSYQLSPAVEETLAT

SEQ ID NO: 2026444 - protein, 20 aa, Staphylococcus
LIQRLNISHLMNQFPPTLSG

SEQ ID NO: 2026445 - protein, 24 aa, Staphylococcus
LIQRLPSIGPFEYVYDALKRAYHN

SEQ ID NO: 2026446 - protein, 27 aa, Staphylococcus
LIQYQGYSGFEIQTWFEQMGIYVELAD

SEQ ID NO: 2026447 - protein, 17 aa, Staphylococcus
LIRAYGISSIRPNVINY

SEQ ID NO: 2026448 - protein, 23 aa, Staphylococcus
LIRFKESKLRPLGRTAAGVKGIT

SEQ ID NO: 2026449 - protein, 27 aa, Staphylococcus
LIRGAKILSLMGLELLTNQALFDEIIE

SEQ ID NO: 2026450 - protein, 18 aa, Staphylococcus
LIRGGRISKTKGLIGNIM

SEQ ID NO: 2026451 - protein, 17 aa, Staphylococcus
LIRIEFGNLNLKGLNAG

SEQ ID NO: 2026452 - protein, 24 aa, Staphylococcus
LIRLRYWECPIGCYEWEDIANYFG

SEQ ID NO: 2026453 - protein, 19 aa, Staphylococcus
LIRLYEKVIDRLDYTSKKK

SEQ ID NO: 2026454 - protein, 18 aa, Staphylococcus
LIRNPQCLILDEPTSALD

SEQ ID NO: 2026455 - protein, 18 aa, Staphylococcus
LIRRLQKGEIIQVNDEFG

SEQ ID NO: 2026456 - protein, 23 aa, Staphylococcus
LIRTVLARMHFRGDAVYKKIAVL

SEQ ID NO: 2026457 - protein, 21 aa, Staphylococcus
LISCPQCSASMSASTTVNTLK

SEQ ID NO: 2026458 - protein, 19 aa, Staphylococcus
LISDPRIEGGAFYLGSEDY

SEQ ID NO: 2026459 - protein, 18 aa, Staphylococcus
LISEMDIHCNLHITPSIN

SEQ ID NO: 2026460 - protein, 22 aa, Staphylococcus
LISGDRLNLEWGPNWEDDLAGG

SEQ ID NO: 2026461 - protein, 17 aa, Staphylococcus
LISGHMDEVGFLVTKID

SEQ ID NO: 2026462 - protein, 18 aa, Staphylococcus
LISIGAEVMRLGIISTPG

SEQ ID NO: 2026463 - protein, 19 aa, Staphylococcus
LISKMAWHGDHHLEHIRIA

SEQ ID NO: 2026464 - protein, 17 aa, Staphylococcus
LISLIAMTTSEERIKNI

SEQ ID NO: 2026465 - protein, 18 aa, Staphylococcus
LISLKKQRFQDFELILVN

SEQ ID NO: 2026466 - protein, 19 aa, Staphylococcus
LISNFKGDNLIIINKDNTP

SEQ ID NO: 2026467 - protein, 17 aa, Staphylococcus
LISPIAIEDGTRFSIRE

SEQ ID NO: 2026468 - protein, 30 aa, Staphylococcus
LISPSPYASACFKTAFDFQKEILEVGYPRN

SEQ ID NO: 2026469 - protein, 24 aa, Staphylococcus
LISQSIRKKHKWSKRFLRKLDYLI

SEQ ID NO: 2026470 - protein, 23 aa, Staphylococcus
LISRLRRALNYNYELEVIAKNEA

SEQ ID NO: 2026471 - protein, 17 aa, Staphylococcus
LITDAMRAKGMPESEYD

SEQ ID NO: 2026472 - protein, 17 aa, Staphylococcus
LITDAMRAKGMSDGEYD

SEQ ID NO: 2026473 - protein, 24 aa, Staphylococcus
LITHEMHVIRRICDEVAVMESGKV

SEQ ID NO: 2026474 - protein, 25 aa, Staphylococcus
LITLEVMPFKQLVEITNIEKIKTTE

SEQ ID NO: 2026475 - protein, 27 aa, Staphylococcus
LITLIFGKRSRLEWVNQFVYKSFNKKI

SEQ ID NO: 2026476 - protein, 19 aa, Staphylococcus
LITNETWLTADEAINKGFA

SEQ ID NO: 2026477 - protein, 17 aa, Staphylococcus
LITPKYDKAGLLASILT

SEQ ID NO: 2026478 - protein, 19 aa, Staphylococcus
LITRRIREMGVYSELHDHE

SEQ ID NO: 2026479 - protein, 25 aa, Staphylococcus
LIVAHPFHPVYILPLVEIVPGKATT

SEQ ID NO: 2026480 - protein, 20 aa, Staphylococcus
LIVDYCRKNNLFILTYEDGH

SEQ ID NO: 2026481 - protein, 19 aa, Staphylococcus
LIVKLENGYKIIMENHHLI

SEQ ID NO: 2026482 - protein, 19 aa, Staphylococcus
LIVPHPRMLERSFVLIPLN

SEQ ID NO: 2026483 - protein, 18 aa, Staphylococcus
LIVRIPKNLIEYLSKNNE

SEQ ID NO: 2026484 - protein, 26 aa, Staphylococcus
LIVSNYLAAHGWRVLHIMQNNKGDII

SEQ ID NO: 2026485 - protein, 17 aa, Staphylococcus
LIVTAAFGQLLPESLLK

SEQ ID NO: 2026486 - protein, 19 aa, Staphylococcus
LIYKEVRKTGYIGLTEHYQ

SEQ ID NO: 2026487 - protein, 21 aa, Staphylococcus
LIYNPLESVGIYVPGGKAAYP

SEQ ID NO: 2026488 - protein, 19 aa, Staphylococcus
LIYSQRVLLALINKGLARE

SEQ ID NO: 2026489 - protein, 18 aa, Staphylococcus
LIYSQRVLLALINKGMVR

SEQ ID NO: 2026490 - protein, 17 aa, Staphylococcus
LIYSQRVLLSLINKGMV

SEQ ID NO: 2026491 - protein, 17 aa, Staphylococcus
LKAAERLVTKPKGYYTF

SEQ ID NO: 2026492 - protein, 19 aa, Staphylococcus
LKAAFNVTQSVIPQFIEKQ

SEQ ID NO: 2026493 - protein, 17 aa, Staphylococcus
LKAAFNVVQSVVPQFIE

SEQ ID NO: 2026494 - protein, 24 aa, Staphylococcus
LKADNGLEILVHIGLDTVQLDGQG

SEQ ID NO: 2026495 - protein, 23 aa, Staphylococcus
LKADNGLELLVHIGLDTVQLDGE

SEQ ID NO: 2026496 - protein, 19 aa, Staphylococcus
LKADTVLQDRLRSLSNVDI

SEQ ID NO: 2026497 - protein, 20 aa, Staphylococcus
LKADTVLQERLRSFPNVDIH

SEQ ID NO: 2026498 - protein, 20 aa, Staphylococcus
LKADTVLQERLRSLSNVDIT

SEQ ID NO: 2026499 - protein, 19 aa, Staphylococcus
LKADVPIYYYGLSKNDDVY

SEQ ID NO: 2026500 - protein, 23 aa, Staphylococcus
LKAEEIYESIGMDVLHVRHEIEG

SEQ ID NO: 2026501 - protein, 18 aa, Staphylococcus
LKAEFKELDIPFHERRDD

SEQ ID NO: 2026502 - protein, 19 aa, Staphylococcus
LKAEGAHLVNFIKKSTQIG

SEQ ID NO: 2026503 - protein, 21 aa, Staphylococcus
LKAELRKIIEIKPLSQLYNQR

SEQ ID NO: 2026504 - protein, 20 aa, Staphylococcus
LKAEVFLREQFKRLEREQIF

SEQ ID NO: 2026505 - protein, 20 aa, Staphylococcus
LKAFLKFRQMYLNTISMDCV

SEQ ID NO: 2026506 - protein, 19 aa, Staphylococcus
LKAGDVLLVQNTRFEDLDG

SEQ ID NO: 2026507 - protein, 18 aa, Staphylococcus
LKAGIAEAFQFDRKLVIE

SEQ ID NO: 2026508 - protein, 21 aa, Staphylococcus
LKAHGETGVDCGVDEDNVFIF

SEQ ID NO: 2026509 - protein, 28 aa, Staphylococcus
LKAHTDIPVVAGFGIRTKEHIKDLATVA

SEQ ID NO: 2026510 - protein, 27 aa, Staphylococcus
LKAHYPLCYNIAVKIIKMMQQHLDVEV

SEQ ID NO: 2026511 - protein, 17 aa, Staphylococcus
LKAIDQGWIRQVDHLQQ

SEQ ID NO: 2026512 - protein, 19 aa, Staphylococcus
LKAIICIHDTTLGPALGGC

SEQ ID NO: 2026513 - protein, 19 aa, Staphylococcus
LKAIKDGLELKGVELKQSR

SEQ ID NO: 2026514 - protein, 17 aa, Staphylococcus
LKAINSYDFDIEVDGGI

SEQ ID NO: 2026515 - protein, 25 aa, Staphylococcus
LKAISPRTTLPILTGIKIDAKDNNV

SEQ ID NO: 2026516 - protein, 25 aa, Staphylococcus
LKAISPRTTLPILTGIKIDAKENEV

SEQ ID NO: 2026517 - protein, 25 aa, Staphylococcus
LKAISPRTTLPILTGIKIEVKNNEV

SEQ ID NO: 2026518 - protein, 19 aa, Staphylococcus
LKAIYRMILKIQHKTNRFS

SEQ ID NO: 2026519 - protein, 21 aa, Staphylococcus
LKAKMKEAFVDKAVAINDISE

SEQ ID NO: 2026520 - protein, 20 aa, Staphylococcus
LKAKVVEMLQNRATYQAQIK

SEQ ID NO: 2026521 - protein, 20 aa, Staphylococcus
LKALDLKLLVTKDSYASPTV

SEQ ID NO: 2026522 - protein, 18 aa, Staphylococcus
LKALEPMGEEYLDVVKEG

SEQ ID NO: 2026523 - protein, 21 aa, Staphylococcus
LKALFPCGSITGAPKLNTMSY

SEQ ID NO: 2026524 - protein, 22 aa, Staphylococcus
LKALKDNIIFSIGHTVATFDEA

SEQ ID NO: 2026525 - protein, 26 aa, Staphylococcus
LKALSTDMPVFFSANMSYGVHALTKI

SEQ ID NO: 2026526 - protein, 20 aa, Staphylococcus
LKALVKQGVYVKAKGFGRIE

SEQ ID NO: 2026527 - protein, 18 aa, Staphylococcus
LKANHSALRIRVKDDSYE

SEQ ID NO: 2026528 - protein, 20 aa, Staphylococcus
LKAQMLEQIPLAKFGEDSDI

SEQ ID NO: 2026529 - protein, 24 aa, Staphylococcus
LKARLIHLNVDFKFDREEETLRIY

SEQ ID NO: 2026530 - protein, 37 aa, Staphylococcus
LKARRTYAFTELFLFELRMQWLNRLEKASDEAIEINY

SEQ ID NO: 2026531 - protein, 27 aa, Staphylococcus
LKARYKIQMYYYRSALETILQKEVKGY

SEQ ID NO: 2026532 - protein, 19 aa, Staphylococcus
LKASELRQTDGAILDLAAG

SEQ ID NO: 2026533 - protein, 18 aa, Staphylococcus
LKASIANITIGYTRDRKP

SEQ ID NO: 2026534 - protein, 18 aa, Staphylococcus
LKASQFNYGQAFKGYMEG

SEQ ID NO: 2026535 - protein, 18 aa, Staphylococcus
LKATGTSFREQVWQILLE

SEQ ID NO: 2026536 - protein, 19 aa, Staphylococcus
LKATLKSHRHPFLKRSTTY

SEQ ID NO: 2026537 - protein, 21 aa, Staphylococcus
LKAVVKQVDGRVPVIAGTGTN

SEQ ID NO: 2026538 - protein, 26 aa, Staphylococcus
LKAYAPEFEKVIPLKIMLIEKNHIVT

SEQ ID NO: 2026539 - protein, 20 aa, Staphylococcus
LKAYDLKASSQFYKQMGFQI

SEQ ID NO: 2026540 - protein, 20 aa, Staphylococcus
LKAYPRKLIITQGAKGALFY

SEQ ID NO: 2026541 - protein, 18 aa, Staphylococcus
LKAYSYNREGVMNASVEF

SEQ ID NO: 2026542 - protein, 19 aa, Staphylococcus
LKAYSYNREGVMNASVEFN

SEQ ID NO: 2026543 - protein, 19 aa, Staphylococcus
LKCDSHLAISGSIKARGGI

SEQ ID NO: 2026544 - protein, 17 aa, Staphylococcus
LKDADLLTVQRGVGTTE

SEQ ID NO: 2026545 - protein, 18 aa, Staphylococcus
LKDAIPNNAPILYKSGAF

SEQ ID NO: 2026546 - protein, 18 aa, Staphylococcus
LKDALAYTKQHHMTFIDP

SEQ ID NO: 2026547 - protein, 21 aa, Staphylococcus
LKDAMPKAIITYHITLQSDLP

SEQ ID NO: 2026548 - protein, 17 aa, Staphylococcus
LKDARELLEASIQSGKA

SEQ ID NO: 2026549 - protein, 22 aa, Staphylococcus
LKDDILKFALYDGSNHVVIDAD

SEQ ID NO: 2026550 - protein, 23 aa, Staphylococcus
LKDELKHKFEVIVYDVRGHGKST

SEQ ID NO: 2026551 - protein, 20 aa, Staphylococcus
LKDEYICMIVKVDNESGNIN

SEQ ID NO: 2026552 - protein, 21 aa, Staphylococcus
LKDFDDVIVRREWNHIDILLI

SEQ ID NO: 2026553 - protein, 22 aa, Staphylococcus
LKDFHPEAGHKLYLVGETRDDF

SEQ ID NO: 2026554 - protein, 17 aa, Staphylococcus
LKDGAKVSHLSYIGDAV

SEQ ID NO: 2026555 - protein, 19 aa, Staphylococcus
LKDGLSHKLVKDDLSIIKN

SEQ ID NO: 2026556 - protein, 21 aa, Staphylococcus
LKDHVVFIGFDYGYRGNSKYL

SEQ ID NO: 2026557 - protein, 17 aa, Staphylococcus
LKDITFYDVFLAIEGRG

SEQ ID NO: 2026558 - protein, 26 aa, Staphylococcus
LKDKFYEHHRWIAGHLDEEYYEELNQ

SEQ ID NO: 2026559 - protein, 18 aa, Staphylococcus
LKDKGMRIIDVEDPLKLN

SEQ ID NO: 2026560 - protein, 20 aa, Staphylococcus
LKDKILKFGLYAQNQYIVIS

SEQ ID NO: 2026561 - protein, 17 aa, Staphylococcus
LKDKLQAFLKPLDLDIN

SEQ ID NO: 2026562 - protein, 21 aa, Staphylococcus
LKDKMKKAFVDKAVAINDISD

SEQ ID NO: 2026563 - protein, 18 aa, Staphylococcus
LKDKPARLYDAIVSCGED

SEQ ID NO: 2026564 - protein, 22 aa, Staphylococcus
LKDKQFKVVRQGAFIKEGNKNP

SEQ ID NO: 2026565 - protein, 23 aa, Staphylococcus
LKDLFKLSSAIKMKEKVETPIEW

SEQ ID NO: 2026566 - protein, 23 aa, Staphylococcus
LKDLGRKKAIVVYGANGMDEATL

SEQ ID NO: 2026567 - protein, 19 aa, Staphylococcus
LKDLLGIQLLRNSDSETVA

SEQ ID NO: 2026568 - protein, 18 aa, Staphylococcus
LKDLMLLHHFKYDTNVPK

SEQ ID NO: 2026569 - protein, 18 aa, Staphylococcus
LKDLRAGKEREDVFHYED

SEQ ID NO: 2026570 - protein, 20 aa, Staphylococcus
LKDNEMEIGLGHHGEPGIEK

SEQ ID NO: 2026571 - protein, 25 aa, Staphylococcus
LKDNILKFGLYTGEHHVVINADEIK

SEQ ID NO: 2026572 - protein, 20 aa, Staphylococcus
LKDNYDWLIFSSKNAVKFFL

SEQ ID NO: 2026573 - protein, 26 aa, Staphylococcus
LKDQKRVLPTIAFLDGEYGYRDICLG

SEQ ID NO: 2026574 - protein, 17 aa, Staphylococcus
LKDQTPLFEHGLDLLNE

SEQ ID NO: 2026575 - protein, 20 aa, Staphylococcus
LKDRFGSFIRYNYTSKNWMF

SEQ ID NO: 2026576 - protein, 19 aa, Staphylococcus
LKDSAKRMDNVIVNFDELK

SEQ ID NO: 2026577 - protein, 22 aa, Staphylococcus
LKDSLIERGVEFFEDCQLSEEN

SEQ ID NO: 2026578 - protein, 24 aa, Staphylococcus
LKDTLDRVVPIWTDRISQHLLDGE

SEQ ID NO: 2026579 - protein, 20 aa, Staphylococcus
LKDTLERVVPIWTDQISQHL

SEQ ID NO: 2026580 - protein, 17 aa, Staphylococcus
LKDVLRNIECAIINQEI

SEQ ID NO: 2026581 - protein, 17 aa, Staphylococcus
LKDVMALGDNLNDVSML

SEQ ID NO: 2026582 - protein, 19 aa, Staphylococcus
LKDYFIKQIRAYMKGDTPK

SEQ ID NO: 2026583 - protein, 30 aa, Staphylococcus
LKEAGYQLAIATGRPRTETLVPFEDKGLAS

SEQ ID NO: 2026584 - protein, 26 aa, Staphylococcus
LKEAIKKLYGVNGISIMKLDQSDVVR

SEQ ID NO: 2026585 - protein, 20 aa, Staphylococcus
LKEALIKLLGQQNFEEITVN

SEQ ID NO: 2026586 - protein, 19 aa, Staphylococcus
LKEALIYTEQNHMTFIDPF

SEQ ID NO: 2026587 - protein, 21 aa, Staphylococcus
LKEDKVVLCDRYIDSSLAYQG

SEQ ID NO: 2026588 - protein, 17 aa, Staphylococcus
LKEEGHEVAGFTTSEHG

SEQ ID NO: 2026589 - protein, 19 aa, Staphylococcus
LKEEGYKVILVNSNPATIM

SEQ ID NO: 2026590 - protein, 17 aa, Staphylococcus
LKEERVAGTDFVIVREL

SEQ ID NO: 2026591 - protein, 19 aa, Staphylococcus
LKEESRHGYQIIKDLEERF

SEQ ID NO: 2026592 - protein, 19 aa, Staphylococcus
LKEEVKIGPLIDNQAVEKV

SEQ ID NO: 2026593 - protein, 18 aa, Staphylococcus
LKEEYGYYEPQQFENPAN

SEQ ID NO: 2026594 - protein, 19 aa, Staphylococcus
LKEGDLVYKSIFRHREARD

SEQ ID NO: 2026595 - protein, 17 aa, Staphylococcus
LKEHGIIICEFSNQEKI

SEQ ID NO: 2026596 - protein, 24 aa, Staphylococcus
LKEHPEVVKQIAFHEPPINTFLPD

SEQ ID NO: 2026597 - protein, 22 aa, Staphylococcus
LKEIGIRYVDVSGRGGTNFVNI

SEQ ID NO: 2026598 - protein, 20 aa, Staphylococcus
LKEIIIRTAEVLGTDIDEES

SEQ ID NO: 2026599 - protein, 26 aa, Staphylococcus
LKEIISRLTFLYNVGLEYLTLNRASG

SEQ ID NO: 2026600 - protein, 17 aa, Staphylococcus
LKEIMKIAEDLAEPFPF

SEQ ID NO: 2026601 - protein, 17 aa, Staphylococcus
LKEISYIQAEGFAGGEL

SEQ ID NO: 2026602 - protein, 21 aa, Staphylococcus
LKEKISRITIGYTRDRKPVTV

SEQ ID NO: 2026603 - protein, 17 aa, Staphylococcus
LKEKLFEFMTLNERVYK

SEQ ID NO: 2026604 - protein, 18 aa, Staphylococcus
LKEKLTYLSDEKMQEVDE

SEQ ID NO: 2026605 - protein, 21 aa, Staphylococcus
LKEKMKKAFVDKAVAINDISD

SEQ ID NO: 2026606 - protein, 18 aa, Staphylococcus
LKEKSWKNSKLIERSNIP

SEQ ID NO: 2026607 - protein, 18 aa, Staphylococcus
LKELCHNYQVPFIVNDNV

SEQ ID NO: 2026608 - protein, 18 aa, Staphylococcus
LKELGAREVIDRISEDSN

SEQ ID NO: 2026609 - protein, 18 aa, Staphylococcus
LKELGKEMEQISEENDED

SEQ ID NO: 2026610 - protein, 19 aa, Staphylococcus
LKELKELGQTYGFDLSRPA

SEQ ID NO: 2026611 - protein, 26 aa, Staphylococcus
LKELLRQEADSFIEIAERSNSASKYQ

SEQ ID NO: 2026612 - protein, 18 aa, Staphylococcus
LKEMNFKQLLSLNRLEKD

SEQ ID NO: 2026613 - protein, 18 aa, Staphylococcus
LKENPWKRLERLRKEIPN

SEQ ID NO: 2026614 - protein, 18 aa, Staphylococcus
LKEPIKKRIDIIELDNLD

SEQ ID NO: 2026615 - protein, 17 aa, Staphylococcus
LKEQGFDDIEWGDDFGA

SEQ ID NO: 2026616 - protein, 23 aa, Staphylococcus
LKEQSILVAPGIPFGENGRHYVR

SEQ ID NO: 2026617 - protein, 27 aa, Staphylococcus
LKEQYPLCFNIALKIMRLLQQELKIKV

SEQ ID NO: 2026618 - protein, 18 aa, Staphylococcus
LKERFKDSSVKIISLIAM

SEQ ID NO: 2026619 - protein, 23 aa, Staphylococcus
LKERGYHLAIATGRPRTETLVPF

SEQ ID NO: 2026620 - protein, 20 aa, Staphylococcus
LKERIVEELSQIGIEVKEAP

SEQ ID NO: 2026621 - protein, 17 aa, Staphylococcus
LKERKLRIEDALNSTRA

SEQ ID NO: 2026622 - protein, 19 aa, Staphylococcus
LKERYEKMKDFPMFDDIEY

SEQ ID NO: 2026623 - protein, 17 aa, Staphylococcus
LKESEKIIGKILEADDV

SEQ ID NO: 2026624 - protein, 17 aa, Staphylococcus
LKEVKNFYLKYFGLEES

SEQ ID NO: 2026625 - protein, 20 aa, Staphylococcus
LKEYAEKLGVNYSYDDEALL

SEQ ID NO: 2026626 - protein, 26 aa, Staphylococcus
LKFDDQLPCQFCNFQSVCHVDTIIDS

SEQ ID NO: 2026627 - protein, 18 aa, Staphylococcus
LKFDKCATKHLTISGGDV

SEQ ID NO: 2026628 - protein, 19 aa, Staphylococcus
LKFEPCATKYLKISGGDVG

SEQ ID NO: 2026629 - protein, 17 aa, Staphylococcus
LKFESWLAAQNFDELGN

SEQ ID NO: 2026630 - protein, 20 aa, Staphylococcus
LKFGEVYANCEAEEAINSYH

SEQ ID NO: 2026631 - protein, 19 aa, Staphylococcus
LKFGEVYANCEAEEVVNGY

SEQ ID NO: 2026632 - protein, 18 aa, Staphylococcus
LKFIDYYIELLLTYLNEN

SEQ ID NO: 2026633 - protein, 25 aa, Staphylococcus
LKFITDMYGCPGFTNEKLTIYFSNN

SEQ ID NO: 2026634 - protein, 22 aa, Staphylococcus
LKFKDRTHVAGYKVSMTSATTQ

SEQ ID NO: 2026635 - protein, 17 aa, Staphylococcus
LKFLKANMEVQIQTYEG

SEQ ID NO: 2026636 - protein, 17 aa, Staphylococcus
LKFLSSLPVGGLGLDFV

SEQ ID NO: 2026637 - protein, 20 aa, Staphylococcus
LKFNTLPISHLIYLNSAAKI

SEQ ID NO: 2026638 - protein, 19 aa, Staphylococcus
LKFNTLPITHLVYLNSAAR

SEQ ID NO: 2026639 - protein, 19 aa, Staphylococcus
LKFNYEFDKKQLILYEGKD

SEQ ID NO: 2026640 - protein, 25 aa, Staphylococcus
LKFTQKNAFLLPFVNKLFTYEHPSL

SEQ ID NO: 2026641 - protein, 22 aa, Staphylococcus
LKFVKKGVLYPLSYYDGDWFGK

SEQ ID NO: 2026642 - protein, 22 aa, Staphylococcus
LKFVKKGVLYPLSYYDGDWYGK

SEQ ID NO: 2026643 - protein, 22 aa, Staphylococcus
LKFYCKETHWFGSKETETIQAL

SEQ ID NO: 2026644 - protein, 26 aa, Staphylococcus
LKFYVDYPLEDWLYRTHLHSMHIKAM

SEQ ID NO: 2026645 - protein, 22 aa, Staphylococcus
LKGDELTPFATITKFEADESYE

SEQ ID NO: 2026646 - protein, 19 aa, Staphylococcus
LKGDTCIAGGGSDGNIMNR

SEQ ID NO: 2026647 - protein, 21 aa, Staphylococcus
LKGEILRIGHMGKVSPFDILS

SEQ ID NO: 2026648 - protein, 21 aa, Staphylococcus
LKGEILRIGHMGQISPFDILQ

SEQ ID NO: 2026649 - protein, 21 aa, Staphylococcus
LKGENTFKVSAYRKAAQSLEI

SEQ ID NO: 2026650 - protein, 21 aa, Staphylococcus
LKGENTFKVSAYRKAAQSLEM

SEQ ID NO: 2026651 - protein, 23 aa, Staphylococcus
LKGERITKNMIKLMREYLQKGDR

SEQ ID NO: 2026652 - protein, 17 aa, Staphylococcus
LKGFYSAHIAKLMDKLA

SEQ ID NO: 2026653 - protein, 18 aa, Staphylococcus
LKGGDPAIFGRVQEEVEA

SEQ ID NO: 2026654 - protein, 18 aa, Staphylococcus
LKGGDPAIFGRVTEEINT

SEQ ID NO: 2026655 - protein, 17 aa, Staphylococcus
LKGGDPAIFGRVTEEVN

SEQ ID NO: 2026656 - protein, 19 aa, Staphylococcus
LKGGDPAIFGRVYEELEAL

SEQ ID NO: 2026657 - protein, 20 aa, Staphylococcus
LKGHVAVIGPTAMRYQNVIQ

SEQ ID NO: 2026658 - protein, 28 aa, Staphylococcus
LKGIAFDLLEYALKYAFEHYTIHKVYFK

SEQ ID NO: 2026659 - protein, 23 aa, Staphylococcus
LKGIECIYALYKKNRRSLQIYGF

SEQ ID NO: 2026660 - protein, 22 aa, Staphylococcus
LKGIECIYGLYKKNRRSLQIYG

SEQ ID NO: 2026661 - protein, 23 aa, Staphylococcus
LKGIKCIYALYKKNRRSLQIYGF

SEQ ID NO: 2026662 - protein, 17 aa, Staphylococcus
LKGKDLQPVIIGNGNTI

SEQ ID NO: 2026663 - protein, 18 aa, Staphylococcus
LKGKIAFNEFTKQIECLG

SEQ ID NO: 2026664 - protein, 20 aa, Staphylococcus
LKGKKAILYFYPRDNTPGCT

SEQ ID NO: 2026665 - protein, 27 aa, Staphylococcus
LKGKKLREARKGFQMVFQDPYASLNPL

SEQ ID NO: 2026666 - protein, 19 aa, Staphylococcus
LKGKPVIVGGKASGRGVVS

SEQ ID NO: 2026667 - protein, 19 aa, Staphylococcus
LKGKQILVYSGLFKEARKK

SEQ ID NO: 2026668 - protein, 21 aa, Staphylococcus
LKGKQVLVYSGLFKDARKRLK

SEQ ID NO: 2026669 - protein, 19 aa, Staphylococcus
LKGKTVLVRADFNVPMKDG

SEQ ID NO: 2026670 - protein, 17 aa, Staphylococcus
LKGKVALITGGDSGIGR

SEQ ID NO: 2026671 - protein, 20 aa, Staphylococcus
LKGKVTGIKKFGAFVELPEG

SEQ ID NO: 2026672 - protein, 17 aa, Staphylococcus
LKGLFQQNVQYVNAHNQ

SEQ ID NO: 2026673 - protein, 18 aa, Staphylococcus
LKGLITIKDIEKVHEYPF

SEQ ID NO: 2026674 - protein, 18 aa, Staphylococcus
LKGLITIKDIEKVLEFPH

SEQ ID NO: 2026675 - protein, 20 aa, Staphylococcus
LKGLKEWHFGVFEGESIELL

SEQ ID NO: 2026676 - protein, 18 aa, Staphylococcus
LKGLLSIESVRDDSKASD

SEQ ID NO: 2026677 - protein, 18 aa, Staphylococcus
LKGLLSIESVRDDSKASE

SEQ ID NO: 2026678 - protein, 35 aa, Staphylococcus
LKGLNRAKETYKFAGGKGINVSRVLKTLDVDSTAL

SEQ ID NO: 2026679 - protein, 25 aa, Staphylococcus
LKGMKKRYATLMGIDENTPIIVGAS

SEQ ID NO: 2026680 - protein, 25 aa, Staphylococcus
LKGMKKRYATLMGIDENTPVIVGAS

SEQ ID NO: 2026681 - protein, 25 aa, Staphylococcus
LKGMKKRYATLMGIDENTPVVVGAS

SEQ ID NO: 2026682 - protein, 25 aa, Staphylococcus
LKGMKKRYATLMGVDENTPVVIGAS

SEQ ID NO: 2026683 - protein, 25 aa, Staphylococcus
LKGMKRRYAALMGIDENTPVVVGAS

SEQ ID NO: 2026684 - protein, 34 aa, Staphylococcus
LKGMPRIDFDKALDYWLNRFKIMENKDKKIESLS

SEQ ID NO: 2026685 - protein, 17 aa, Staphylococcus
LKGPDGLQFRFNFIKVE

SEQ ID NO: 2026686 - protein, 20 aa, Staphylococcus
LKGQIAVIGPTAMHYQNVIQ

SEQ ID NO: 2026687 - protein, 20 aa, Staphylococcus
LKGREELYFAGQMTGVEGYV

SEQ ID NO: 2026688 - protein, 17 aa, Staphylococcus
LKGRSLLKECDFTKEEF

SEQ ID NO: 2026689 - protein, 20 aa, Staphylococcus
LKGRVKFIFQPAEETGYGAK

SEQ ID NO: 2026690 - protein, 28 aa, Staphylococcus
LKGSDVLVCTVIGFPLGASTTETKIFET

SEQ ID NO: 2026691 - protein, 19 aa, Staphylococcus
LKGSLFGLSLQTKHEDIYR

SEQ ID NO: 2026692 - protein, 21 aa, Staphylococcus
LKGTLYVLQAALPHLLNQSSG

SEQ ID NO: 2026693 - protein, 19 aa, Staphylococcus
LKHEYDIITNMGFEDYFLI

SEQ ID NO: 2026694 - protein, 21 aa, Staphylococcus
LKHGSAVLITGGFNTTPEIKK

SEQ ID NO: 2026695 - protein, 27 aa, Staphylococcus
LKHHYLWRFAKDMPRSGHIELFDRSWY

SEQ ID NO: 2026696 - protein, 38 aa, Staphylococcus
LKHHYLWRFAKEMPRTGHIELFDRSWYGRVLVERVEGF

SEQ ID NO: 2026697 - protein, 21 aa, Staphylococcus
LKHIKVIGLAFNFMSFKSEAP

SEQ ID NO: 2026698 - protein, 23 aa, Staphylococcus
LKHLKLVINSVGDFDSRKEYNKA

SEQ ID NO: 2026699 - protein, 19 aa, Staphylococcus
LKHNNKFIGQPLWGSIGYT

SEQ ID NO: 2026700 - protein, 21 aa, Staphylococcus
LKHQVILMVDWKDGREGVLTY

SEQ ID NO: 2026701 - protein, 21 aa, Staphylococcus
LKHRETYEIITPQLVGVSTTE

SEQ ID NO: 2026702 - protein, 21 aa, Staphylococcus
LKHTFLRQVMERYIPFDDITK

SEQ ID NO: 2026703 - protein, 17 aa, Staphylococcus
LKHVFKQDIANLSIHLR

SEQ ID NO: 2026704 - protein, 20 aa, Staphylococcus
LKHYEHLLSEYGVWHPNAWH

SEQ ID NO: 2026705 - protein, 31 aa, Staphylococcus
LKIADKVLIGGGMSYTFFKAQGKEIGLSLLE

SEQ ID NO: 2026706 - protein, 25 aa, Staphylococcus
LKIAELLRASTIPAGLVQILPGTGE

SEQ ID NO: 2026707 - protein, 20 aa, Staphylococcus
LKIAETYPVAKIAVMSAPHQ

SEQ ID NO: 2026708 - protein, 20 aa, Staphylococcus
LKIATIPTLFNKIIPKALST

SEQ ID NO: 2026709 - protein, 21 aa, Staphylococcus
LKICNRCYERGVVIIAVAGNV

SEQ ID NO: 2026710 - protein, 17 aa, Staphylococcus
LKIDCLDIAALPHSLTY

SEQ ID NO: 2026711 - protein, 19 aa, Staphylococcus
LKIEGRMKSIHYIATVVSV

SEQ ID NO: 2026712 - protein, 26 aa, Staphylococcus
LKIEIPYYAGLSFRTLMPKFPSTLPH

SEQ ID NO: 2026713 - protein, 19 aa, Staphylococcus
LKIKCQDYGIELRQVDRFY

SEQ ID NO: 2026714 - protein, 18 aa, Staphylococcus
LKIKEIDVAIGDIGNMAI

SEQ ID NO: 2026715 - protein, 17 aa, Staphylococcus
LKIKELCNLKEIQHTKI

SEQ ID NO: 2026716 - protein, 21 aa, Staphylococcus
LKIKLKGLRKIYDLEQDASPI

SEQ ID NO: 2026717 - protein, 20 aa, Staphylococcus
LKIKSKDPFEKPSIVFNYLS

SEQ ID NO: 2026718 - protein, 20 aa, Staphylococcus
LKIKVYEAEVIYLTLHVYHF

SEQ ID NO: 2026719 - protein, 18 aa, Staphylococcus
LKILKNVKDKFGLNVVSE

SEQ ID NO: 2026720 - protein, 24 aa, Staphylococcus
LKILKQARLVKSLRQGQSKIYSID

SEQ ID NO: 2026721 - protein, 17 aa, Staphylococcus
LKILKVFGTENIYRKTF

SEQ ID NO: 2026722 - protein, 18 aa, Staphylococcus
LKILTEVELSYLISEAPI

SEQ ID NO: 2026723 - protein, 20 aa, Staphylococcus
LKILTEVELSYLISEAPIIA

SEQ ID NO: 2026724 - protein, 20 aa, Staphylococcus
LKIMPVMRAASFEKETKEGH

SEQ ID NO: 2026725 - protein, 20 aa, Staphylococcus
LKINLLDFRKQMDYLEAIGL

SEQ ID NO: 2026726 - protein, 22 aa, Staphylococcus
LKINPLFEENFHIYVPKDDPIT

SEQ ID NO: 2026727 - protein, 20 aa, Staphylococcus
LKIPAEVGLMEYNFETRVVP

SEQ ID NO: 2026728 - protein, 17 aa, Staphylococcus
LKIPSFVVDPVVVDELI

SEQ ID NO: 2026729 - protein, 19 aa, Staphylococcus
LKITLKDLRAGKEREDVFH

SEQ ID NO: 2026730 - protein, 25 aa, Staphylococcus
LKITMRSEIPLARGLGSSASALVAG

SEQ ID NO: 2026731 - protein, 19 aa, Staphylococcus
LKIYEEIGYNTQFVGKHTS

SEQ ID NO: 2026732 - protein, 19 aa, Staphylococcus
LKIYSAHIVSGKKGEPGTI

SEQ ID NO: 2026733 - protein, 18 aa, Staphylococcus
LKKAHLMDEFHSIIHEGA

SEQ ID NO: 2026734 - protein, 23 aa, Staphylococcus
LKKDLADFNVHFDNWFSETSLYE

SEQ ID NO: 2026735 - protein, 22 aa, Staphylococcus
LKKEFPSIKILVLTSYADDEHV

SEQ ID NO: 2026736 - protein, 19 aa, Staphylococcus
LKKELKKQGLFDTKHKKEI

SEQ ID NO: 2026737 - protein, 18 aa, Staphylococcus
LKKELLEVERYVLGDINA

SEQ ID NO: 2026738 - protein, 23 aa, Staphylococcus
LKKELQEPLSFYYFFTEDDDIVG

SEQ ID NO: 2026739 - protein, 21 aa, Staphylococcus
LKKELSHRGVTFYENIQLDEN

SEQ ID NO: 2026740 - protein, 21 aa, Staphylococcus
LKKETGHLINWYIMTSDINHE

SEQ ID NO: 2026741 - protein, 21 aa, Staphylococcus
LKKGDLFLLKEGMEVSYTASK

SEQ ID NO: 2026742 - protein, 20 aa, Staphylococcus
LKKGEFFIARTLSPKAPELK

SEQ ID NO: 2026743 - protein, 20 aa, Staphylococcus
LKKGETVAIVGPSGSGKSTL

SEQ ID NO: 2026744 - protein, 17 aa, Staphylococcus
LKKGGILIIDLMNPAFF

SEQ ID NO: 2026745 - protein, 25 aa, Staphylococcus
LKKGHLKIGIPTIINIRRLIGLISE

SEQ ID NO: 2026746 - protein, 21 aa, Staphylococcus
LKKGNLADVDGRIQSRSYENK

SEQ ID NO: 2026747 - protein, 18 aa, Staphylococcus
LKKGRLVIGVNPILAAHT

SEQ ID NO: 2026748 - protein, 22 aa, Staphylococcus
LKKHDIHVIPLSITIDGNSYTD

SEQ ID NO: 2026749 - protein, 17 aa, Staphylococcus
LKKHLSIYGSWNDPDGS

SEQ ID NO: 2026750 - protein, 19 aa, Staphylococcus
LKKILQRQVPNADNQFLEY

SEQ ID NO: 2026751 - protein, 19 aa, Staphylococcus
LKKKLEAVNDNKSQLAFLK

SEQ ID NO: 2026752 - protein, 21 aa, Staphylococcus
LKKKLTKEGYFDSSVKKPIPK

SEQ ID NO: 2026753 - protein, 20 aa, Staphylococcus
LKKKLVDKVQSWFDESGGDG

SEQ ID NO: 2026754 - protein, 18 aa, Staphylococcus
LKKKPTLIVGAGRGGSLL

SEQ ID NO: 2026755 - protein, 26 aa, Staphylococcus
LKKKSDRDYLLFKLAIHTGIRLTDLL

SEQ ID NO: 2026756 - protein, 23 aa, Staphylococcus
LKKLEIEGKALLKKVGLEEKANA

SEQ ID NO: 2026757 - protein, 21 aa, Staphylococcus
LKKLGGAWFSDSLVSVTGKEA

SEQ ID NO: 2026758 - protein, 21 aa, Staphylococcus
LKKLIKGINVAQSFNQMKEID

SEQ ID NO: 2026759 - protein, 35 aa, Staphylococcus
LKKLKSLGLNSNWDMLYIVFSLHYIQILKALPSDE

SEQ ID NO: 2026760 - protein, 29 aa, Staphylococcus
LKKLREVVSSLKISHFKTMIIDENQNAVF

SEQ ID NO: 2026761 - protein, 23 aa, Staphylococcus
LKKLTNNITLMFDGDYAGREATL

SEQ ID NO: 2026762 - protein, 23 aa, Staphylococcus
LKKLTSNITLMFDGDFAGQEATL

SEQ ID NO: 2026763 - protein, 24 aa, Staphylococcus
LKKLTSNVTLMFDGDFAGREAALK

SEQ ID NO: 2026764 - protein, 20 aa, Staphylococcus
LKKMDVEVSNHMQALEDDQI

SEQ ID NO: 2026765 - protein, 21 aa, Staphylococcus
LKKNEVIGLFSASGINTQTNE

SEQ ID NO: 2026766 - protein, 27 aa, Staphylococcus
LKKNGKKRISHKMDMIFTHFGISGPAA

SEQ ID NO: 2026767 - protein, 19 aa, Staphylococcus
LKKNRGYVLAPQYALLKEN

SEQ ID NO: 2026768 - protein, 24 aa, Staphylococcus
LKKNRPEALIGVCGCMSQEESVVN

SEQ ID NO: 2026769 - protein, 24 aa, Staphylococcus
LKKNRPETLIGVCGCMSQEESVVN

SEQ ID NO: 2026770 - protein, 17 aa, Staphylococcus
LKKQGLFDTKHKKEIPR

SEQ ID NO: 2026771 - protein, 20 aa, Staphylococcus
LKKQNCLFVLVDPYILENLR

SEQ ID NO: 2026772 - protein, 20 aa, Staphylococcus
LKKRLEEQLFLVAEDNDEII

SEQ ID NO: 2026773 - protein, 27 aa, Staphylococcus
LKKRVPEGLIPLLKIQGLGSKKIAKLY

SEQ ID NO: 2026774 - protein, 17 aa, Staphylococcus
LKKSEIKQIEELQTQLD

SEQ ID NO: 2026775 - protein, 17 aa, Staphylococcus
LKKSLIGINPNWLTKPQ

SEQ ID NO: 2026776 - protein, 20 aa, Staphylococcus
LKKVTYHWYNLINEMMKETM

SEQ ID NO: 2026777 - protein, 17 aa, Staphylococcus
LKKWDASYTDFSNTNIS

SEQ ID NO: 2026778 - protein, 17 aa, Staphylococcus
LKKYCPRCNAHTLHKES

SEQ ID NO: 2026779 - protein, 20 aa, Staphylococcus
LKKYIEYAGDDVLLRRIYKL

SEQ ID NO: 2026780 - protein, 18 aa, Staphylococcus
LKLAEAYNVKGYLVENPS

SEQ ID NO: 2026781 - protein, 19 aa, Staphylococcus
LKLCINIAKTLGVTLNDLF

SEQ ID NO: 2026782 - protein, 21 aa, Staphylococcus
LKLDGLPAKVFLTDSTGVKYI

SEQ ID NO: 2026783 - protein, 18 aa, Staphylococcus
LKLDITFVPTQYIRFDEV

SEQ ID NO: 2026784 - protein, 19 aa, Staphylococcus
LKLDKVVFSICNWEDEFLD

SEQ ID NO: 2026785 - protein, 19 aa, Staphylococcus
LKLDNIHAFQHDATEPYDG

SEQ ID NO: 2026786 - protein, 19 aa, Staphylococcus
LKLDVIRYHDFLGHVIDQY

SEQ ID NO: 2026787 - protein, 19 aa, Staphylococcus
LKLDVIRYHDFLGHVINQY

SEQ ID NO: 2026788 - protein, 30 aa, Staphylococcus
LKLENAELSWHLGLIWRRDAYLNFVTREWI

SEQ ID NO: 2026789 - protein, 29 aa, Staphylococcus
LKLENARLSWHLGVIWRKDTYLSHVTREW

SEQ ID NO: 2026790 - protein, 18 aa, Staphylococcus
LKLFHPVHTYKMKFIKSF

SEQ ID NO: 2026791 - protein, 18 aa, Staphylococcus
LKLFTGEKGLNKTIKNID

SEQ ID NO: 2026792 - protein, 25 aa, Staphylococcus
LKLGLPRLTKYFKLDLKTEQKNLKK

SEQ ID NO: 2026793 - protein, 19 aa, Staphylococcus
LKLIDYIYSVFGFEYSIEL

SEQ ID NO: 2026794 - protein, 19 aa, Staphylococcus
LKLISIKQIIEYRHQHDIQ

SEQ ID NO: 2026795 - protein, 22 aa, Staphylococcus
LKLKDYFIKQIRAYMAGKQPTS

SEQ ID NO: 2026796 - protein, 21 aa, Staphylococcus
LKLKDYFIKQIRAYMDGKKPT

SEQ ID NO: 2026797 - protein, 18 aa, Staphylococcus
LKLKGVVHDTFYQLDEGH

SEQ ID NO: 2026798 - protein, 17 aa, Staphylococcus
LKLKHFFNSDVPVHRGA

SEQ ID NO: 2026799 - protein, 17 aa, Staphylococcus
LKLKHWHDMQLQLTQQR

SEQ ID NO: 2026800 - protein, 21 aa, Staphylococcus
LKLKIINELAWHNLFAQNMFI

SEQ ID NO: 2026801 - protein, 18 aa, Staphylococcus
LKLLKSTHLVKSKRQGQT

SEQ ID NO: 2026802 - protein, 19 aa, Staphylococcus
LKLLNKMYGVDVAKYQPFY

SEQ ID NO: 2026803 - protein, 25 aa, Staphylococcus
LKLLSKRVPDHIYRVVVLVNPTLDL

SEQ ID NO: 2026804 - protein, 20 aa, Staphylococcus
LKLNDLLFLKHLLACDSTCI

SEQ ID NO: 2026805 - protein, 19 aa, Staphylococcus
LKLNINQVNQWGGAIASGH

SEQ ID NO: 2026806 - protein, 19 aa, Staphylococcus
LKLNKGDIVPVEIELLPSG

SEQ ID NO: 2026807 - protein, 20 aa, Staphylococcus
LKLNPKRIVYISCNPSTQQR

SEQ ID NO: 2026808 - protein, 23 aa, Staphylococcus
LKLNYAPCEYLSMGMSNDYTIAV

SEQ ID NO: 2026809 - protein, 32 aa, Staphylococcus
LKLPQNVFRLKGFVRFRDCADVIYEFQYAHGL

SEQ ID NO: 2026810 - protein, 21 aa, Staphylococcus
LKLQAKEGLALINGTQAMTAQ

SEQ ID NO: 2026811 - protein, 19 aa, Staphylococcus
LKLQERLYIKLTTTERAPY

SEQ ID NO: 2026812 - protein, 19 aa, Staphylococcus
LKLQQERGITFLFIAHDLS

SEQ ID NO: 2026813 - protein, 20 aa, Staphylococcus
LKLRKQIRQLAAIYLASGID

SEQ ID NO: 2026814 - protein, 20 aa, Staphylococcus
LKLRKQIRQLAAIYLATGID

SEQ ID NO: 2026815 - protein, 26 aa, Staphylococcus
LKLSLHKGFIDRSLVHQGHHVPKLLI

SEQ ID NO: 2026816 - protein, 20 aa, Staphylococcus
LKLSLNRDVKGIITMCAPMD

SEQ ID NO: 2026817 - protein, 19 aa, Staphylococcus
LKLSVSIGPLLDGELTISE

SEQ ID NO: 2026818 - protein, 20 aa, Staphylococcus
LKLTTELLIDAGLLTPDQII

SEQ ID NO: 2026819 - protein, 17 aa, Staphylococcus
LKLTVINELAWHNLFAQ

SEQ ID NO: 2026820 - protein, 17 aa, Staphylococcus
LKLTVVNELAWHNLFAQ

SEQ ID NO: 2026821 - protein, 17 aa, Staphylococcus
LKLVAKHLISSELIKQP

SEQ ID NO: 2026822 - protein, 24 aa, Staphylococcus
LKLVKLDFIHRGMLALYENETLRH

SEQ ID NO: 2026823 - protein, 17 aa, Staphylococcus
LKLVRFEFIPFEADIVK

SEQ ID NO: 2026824 - protein, 21 aa, Staphylococcus
LKLYKQLGFKWVEDINLYGHD

SEQ ID NO: 2026825 - protein, 20 aa, Staphylococcus
LKLYLFSFRNHGDFHEDCMN

SEQ ID NO: 2026826 - protein, 26 aa, Staphylococcus
LKLYLKHGHCKVLLGVARGKKKYDKR

SEQ ID NO: 2026827 - protein, 17 aa, Staphylococcus
LKLYNLTMKVSREKLLK

SEQ ID NO: 2026828 - protein, 22 aa, Staphylococcus
LKLYQKMGFEIVGEINKKPYYL

SEQ ID NO: 2026829 - protein, 22 aa, Staphylococcus
LKMALAAKDIRIEAPIPGTSLV

SEQ ID NO: 2026830 - protein, 24 aa, Staphylococcus
LKMFRANGLFDRYFRNKEKNTYKI

SEQ ID NO: 2026831 - protein, 19 aa, Staphylococcus
LKMHLIELNENRSLFMNGP

SEQ ID NO: 2026832 - protein, 22 aa, Staphylococcus
LKMIGHYIGMSFQIVDDILDFT

SEQ ID NO: 2026833 - protein, 24 aa, Staphylococcus
LKMIKHLCVELGSMSHLYRAKTQN

SEQ ID NO: 2026834 - protein, 17 aa, Staphylococcus
LKMIRDYNVELIAIGNG

SEQ ID NO: 2026835 - protein, 19 aa, Staphylococcus
LKMITIESLVNYQKDKDTS

SEQ ID NO: 2026836 - protein, 18 aa, Staphylococcus
LKMKLPIEDLEKMKKKKE

SEQ ID NO: 2026837 - protein, 17 aa, Staphylococcus
LKMLFSQVEQDMVDTFI

SEQ ID NO: 2026838 - protein, 29 aa, Staphylococcus
LKMVLNKTVPEDLFFIISLSGETYQLTEV

SEQ ID NO: 2026839 - protein, 27 aa, Staphylococcus
LKMVLNKTVPQDLFFIISLSGETYQLK

SEQ ID NO: 2026840 - protein, 18 aa, Staphylococcus
LKMYLLNRQHFLLNDTPI

SEQ ID NO: 2026841 - protein, 19 aa, Staphylococcus
LKNAEFEKDEVFGLSVPKD

SEQ ID NO: 2026842 - protein, 18 aa, Staphylococcus
LKNAMGPDREFQATADKI

SEQ ID NO: 2026843 - protein, 30 aa, Staphylococcus
LKNFGYMWECPDYFKLDSKDILLFSPQGIE

SEQ ID NO: 2026844 - protein, 18 aa, Staphylococcus
LKNGEFDYYIALVLQGSD

SEQ ID NO: 2026845 - protein, 17 aa, Staphylococcus
LKNGELTTVSILIEGQH

SEQ ID NO: 2026846 - protein, 19 aa, Staphylococcus
LKNGHVWSVPITLPVSQTE

SEQ ID NO: 2026847 - protein, 18 aa, Staphylococcus
LKNGKAFDHCMIKETDSY

SEQ ID NO: 2026848 - protein, 21 aa, Staphylococcus
LKNGKPYIFYHEYRGNSHIHI

SEQ ID NO: 2026849 - protein, 17 aa, Staphylococcus
LKNGRKFLEKGDKCKVS

SEQ ID NO: 2026850 - protein, 24 aa, Staphylococcus
LKNGRRFKSYYGYNGNSHIHIAGG

SEQ ID NO: 2026851 - protein, 21 aa, Staphylococcus
LKNHCNTIICHHPLIFKGIKQ

SEQ ID NO: 2026852 - protein, 22 aa, Staphylococcus
LKNHVVFLGFDYGYRGNSKYLF

SEQ ID NO: 2026853 - protein, 21 aa, Staphylococcus
LKNIPNYEGILSYGEGLDFQV

SEQ ID NO: 2026854 - protein, 21 aa, Staphylococcus
LKNISKRLKGKIIGQDQAVEM

SEQ ID NO: 2026855 - protein, 19 aa, Staphylococcus
LKNKEIVDLQYKRYNELID

SEQ ID NO: 2026856 - protein, 26 aa, Staphylococcus
LKNKGPRRVSPFFVPMLIPDMATGQV

SEQ ID NO: 2026857 - protein, 17 aa, Staphylococcus
LKNKTVTVIGRIEHITI

SEQ ID NO: 2026858 - protein, 17 aa, Staphylococcus
LKNLFKIVSESLVTYYY

SEQ ID NO: 2026859 - protein, 27 aa, Staphylococcus
LKNLGLDYLDLYLIHWPGTDNDLMIDT

SEQ ID NO: 2026860 - protein, 20 aa, Staphylococcus
LKNNELFLISGKTGSGKSML

SEQ ID NO: 2026861 - protein, 25 aa, Staphylococcus
LKNNIKQAWWKKFISQSPYNVGLDA

SEQ ID NO: 2026862 - protein, 31 aa, Staphylococcus
LKNQCRTAFKFHGEVAIQLFLNELFELPSKV

SEQ ID NO: 2026863 - protein, 20 aa, Staphylococcus
LKNQLLRNIQELAELDKNIF

SEQ ID NO: 2026864 - protein, 19 aa, Staphylococcus
LKNQYGIQGKLAVYMPTYR

SEQ ID NO: 2026865 - protein, 20 aa, Staphylococcus
LKNREGRRIAVIVNDMSEVN

SEQ ID NO: 2026866 - protein, 17 aa, Staphylococcus
LKNREYYTPKATSKTEQ

SEQ ID NO: 2026867 - protein, 21 aa, Staphylococcus
LKNRRATLVNLQRIDKVSAKR

SEQ ID NO: 2026868 - protein, 17 aa, Staphylococcus
LKNTNIFTDRISELVKE

SEQ ID NO: 2026869 - protein, 17 aa, Staphylococcus
LKPDCYCTSKYLNNLIE

SEQ ID NO: 2026870 - protein, 22 aa, Staphylococcus
LKPDIPTCRVIFTPHQKEWERL

SEQ ID NO: 2026871 - protein, 21 aa, Staphylococcus
LKPDLILMDLLMDDMDGVEAT

SEQ ID NO: 2026872 - protein, 20 aa, Staphylococcus
LKPELVDAFVERRKGKATKE

SEQ ID NO: 2026873 - protein, 20 aa, Staphylococcus
LKPELVKSFVERRKGKATEE

SEQ ID NO: 2026874 - protein, 21 aa, Staphylococcus
LKPENCLKRRKSYGSTGQESV

SEQ ID NO: 2026875 - protein, 21 aa, Staphylococcus
LKPENCLSRRKSYGSTGQDAV

SEQ ID NO: 2026876 - protein, 21 aa, Staphylococcus
LKPFLEEKGHEFVILTDNEAD

SEQ ID NO: 2026877 - protein, 18 aa, Staphylococcus
LKPFLKTDGMLIFQESDA

SEQ ID NO: 2026878 - protein, 32 aa, Staphylococcus
LKPFVKTKIKGWVRQLLWMSIYQYVYLDKVPD

SEQ ID NO: 2026879 - protein, 17 aa, Staphylococcus
LKPFVQTRIKGWMRHLL

SEQ ID NO: 2026880 - protein, 19 aa, Staphylococcus
LKPHFGHRANLINALVLLK

SEQ ID NO: 2026881 - protein, 18 aa, Staphylococcus
LKPIEEWAQNNINLESEA

SEQ ID NO: 2026882 - protein, 22 aa, Staphylococcus
LKPIMHLYQFVAAFMNEPIEIT

SEQ ID NO: 2026883 - protein, 17 aa, Staphylococcus
LKPISDEGIGFYNMDIN

SEQ ID NO: 2026884 - protein, 20 aa, Staphylococcus
LKPKELRAQINHLFNRNDIE

SEQ ID NO: 2026885 - protein, 17 aa, Staphylococcus
LKPKKAIKVVAEERQMK

SEQ ID NO: 2026886 - protein, 25 aa, Staphylococcus
LKPKLVSKHNLVWRKDHTFSKAAQL

SEQ ID NO: 2026887 - protein, 20 aa, Staphylococcus
LKPKRFMEVAEFNDINIDTQ

SEQ ID NO: 2026888 - protein, 18 aa, Staphylococcus
LKPKSITFTHEFMSARPI

SEQ ID NO: 2026889 - protein, 19 aa, Staphylococcus
LKPLCQNSGFVEIEQSEDV

SEQ ID NO: 2026890 - protein, 19 aa, Staphylococcus
LKPLEGFHIKGKRDRMYIE

SEQ ID NO: 2026891 - protein, 22 aa, Staphylococcus
LKPLRELEVVEGEYDEVIQGHI

SEQ ID NO: 2026892 - protein, 19 aa, Staphylococcus
LKPMEAWAQKYVELEANSS

SEQ ID NO: 2026893 - protein, 22 aa, Staphylococcus
LKPPIHEWEKKGLLTIVDEPTI

SEQ ID NO: 2026894 - protein, 22 aa, Staphylococcus
LKPQIPTCRVIFTPHQKEWERL

SEQ ID NO: 2026895 - protein, 23 aa, Staphylococcus
LKPQLPSCRVIFTPHQKEWERLS

SEQ ID NO: 2026896 - protein, 25 aa, Staphylococcus
LKPSEMTPFAAIILAEIFDKVGVPK

SEQ ID NO: 2026897 - protein, 17 aa, Staphylococcus
LKPSQIIDMKGLMGDTS

SEQ ID NO: 2026898 - protein, 18 aa, Staphylococcus
LKPTLSVIATDLYEDALE

SEQ ID NO: 2026899 - protein, 20 aa, Staphylococcus
LKPTQLVGGYAQISYSFNYY

SEQ ID NO: 2026900 - protein, 18 aa, Staphylococcus
LKPVVKWNQPMYTYNETF

SEQ ID NO: 2026901 - protein, 17 aa, Staphylococcus
LKPVVVITAQHREMLDS

SEQ ID NO: 2026902 - protein, 17 aa, Staphylococcus
LKQASILIDGQHIKEIN

SEQ ID NO: 2026903 - protein, 17 aa, Staphylococcus
LKQCQSYISNAYIDTVF

SEQ ID NO: 2026904 - protein, 23 aa, Staphylococcus
LKQDLAERVNLINALVLLNEQGV

SEQ ID NO: 2026905 - protein, 19 aa, Staphylococcus
LKQEARVTLAECPEVLQSI

SEQ ID NO: 2026906 - protein, 20 aa, Staphylococcus
LKQEYKLTFAECKTKHTPIS

SEQ ID NO: 2026907 - protein, 17 aa, Staphylococcus
LKQFFNSSVPVFKGASR

SEQ ID NO: 2026908 - protein, 18 aa, Staphylococcus
LKQFIKFLRNNIKEDDDI

SEQ ID NO: 2026909 - protein, 17 aa, Staphylococcus
LKQGFSPAFRVEPREDV

SEQ ID NO: 2026910 - protein, 17 aa, Staphylococcus
LKQGFSPAFSVDRRDDV

SEQ ID NO: 2026911 - protein, 19 aa, Staphylococcus
LKQGIEYEPNLTLYDYFKT

SEQ ID NO: 2026912 - protein, 20 aa, Staphylococcus
LKQGYIYKGFCYQVVKENIK

SEQ ID NO: 2026913 - protein, 24 aa, Staphylococcus
LKQHESFNFFSLFNFTEPIEMVVT

SEQ ID NO: 2026914 - protein, 26 aa, Staphylococcus
LKQHHIPMAIATSSYRQDIMPTVHQL

SEQ ID NO: 2026915 - protein, 19 aa, Staphylococcus
LKQHNCLYVLLDPYILENL

SEQ ID NO: 2026916 - protein, 19 aa, Staphylococcus
LKQIFSRKQSEFLFVDGPF

SEQ ID NO: 2026917 - protein, 26 aa, Staphylococcus
LKQIRKRIGVVFQFPESQLFEDSVER

SEQ ID NO: 2026918 - protein, 23 aa, Staphylococcus
LKQLIEEGLEWVLIQGQMGIELW

SEQ ID NO: 2026919 - protein, 22 aa, Staphylococcus
LKQLMLKIAINYINQMPITSNE

SEQ ID NO: 2026920 - protein, 17 aa, Staphylococcus
LKQLQSYGHQVIFASAR

SEQ ID NO: 2026921 - protein, 18 aa, Staphylococcus
LKQMIIFIVVNREKNIQK

SEQ ID NO: 2026922 - protein, 17 aa, Staphylococcus
LKQNQIISNPFAMETKH

SEQ ID NO: 2026923 - protein, 19 aa, Staphylococcus
LKQNVLRHPVDFSQINIFD

SEQ ID NO: 2026924 - protein, 20 aa, Staphylococcus
LKQPLIHFHYPKAIHEDRIK

SEQ ID NO: 2026925 - protein, 20 aa, Staphylococcus
LKQPLVYDVLKAEGDLNENY

SEQ ID NO: 2026926 - protein, 27 aa, Staphylococcus
LKQQYCLYVRIDPYLPYQYRNHDGDIT

SEQ ID NO: 2026927 - protein, 20 aa, Staphylococcus
LKQRIEIIPDTFIVAEENNQ

SEQ ID NO: 2026928 - protein, 21 aa, Staphylococcus
LKQRLAHLNVDFKFDREEETL

SEQ ID NO: 2026929 - protein, 20 aa, Staphylococcus
LKQSKFVFDHKLMSWIEQRG

SEQ ID NO: 2026930 - protein, 17 aa, Staphylococcus
LKQVDIIACEDTRVTKK

SEQ ID NO: 2026931 - protein, 19 aa, Staphylococcus
LKQVLNIRKHLPIVINDAT

SEQ ID NO: 2026932 - protein, 18 aa, Staphylococcus
LKQVPSCEFFPMEAVKTN

SEQ ID NO: 2026933 - protein, 21 aa, Staphylococcus
LKQVRPDLDIEIKEIVTKGDR

SEQ ID NO: 2026934 - protein, 23 aa, Staphylococcus
LKRAGLDYWKFVNITYHESIESF

SEQ ID NO: 2026935 - protein, 21 aa, Staphylococcus
LKRAPFFELYPEGDTQDDNYI

SEQ ID NO: 2026936 - protein, 17 aa, Staphylococcus
LKRAYYSKEFQKWYEKQ

SEQ ID NO: 2026937 - protein, 19 aa, Staphylococcus
LKRDIFFHHPYESFEPIVD

SEQ ID NO: 2026938 - protein, 24 aa, Staphylococcus
LKRDRPDCLIGVCGCMSQEESVVN

SEQ ID NO: 2026939 - protein, 20 aa, Staphylococcus
LKRDTAILITGGFQPSKEVV

SEQ ID NO: 2026940 - protein, 17 aa, Staphylococcus
LKREVMEETGLNAKIGD

SEQ ID NO: 2026941 - protein, 24 aa, Staphylococcus
LKRGHRLNNVYLVFQDVNNQLFAE

SEQ ID NO: 2026942 - protein, 22 aa, Staphylococcus
LKRGLNCYDDLMIYYIKSLNGL

SEQ ID NO: 2026943 - protein, 17 aa, Staphylococcus
LKRGLSATIEEFIFAAE

SEQ ID NO: 2026944 - protein, 17 aa, Staphylococcus
LKRGLSATIEEFTFAAE

SEQ ID NO: 2026945 - protein, 21 aa, Staphylococcus
LKRGMSATIEEFIFAAEYIAS

SEQ ID NO: 2026946 - protein, 19 aa, Staphylococcus
LKRHMTFLMQKGTLYLPYN

SEQ ID NO: 2026947 - protein, 26 aa, Staphylococcus
LKRIEGYESARWILIDLVNVVVHVFH

SEQ ID NO: 2026948 - protein, 23 aa, Staphylococcus
LKRKYGKDVPELIAYQSKLENEI

SEQ ID NO: 2026949 - protein, 23 aa, Staphylococcus
LKRKYGKDVSELIAYQGKLENEI

SEQ ID NO: 2026950 - protein, 22 aa, Staphylococcus
LKRLCRDFNKTIVIVLHDINFA

SEQ ID NO: 2026951 - protein, 25 aa, Staphylococcus
LKRLDKKIIKIGVFGTFSAGKSSLI

SEQ ID NO: 2026952 - protein, 21 aa, Staphylococcus
LKRLDSRVHVISKFSYTNRNI

SEQ ID NO: 2026953 - protein, 23 aa, Staphylococcus
LKRLKMEHIDLYQLHGGTIDDPI

SEQ ID NO: 2026954 - protein, 27 aa, Staphylococcus
LKRMEKRYKGSIAFEYNHINNNKERTW

SEQ ID NO: 2026955 - protein, 21 aa, Staphylococcus
LKRPGKELENLVPEYLGELLF

SEQ ID NO: 2026956 - protein, 23 aa, Staphylococcus
LKRPIEGFFSIAGFKEDAQDIDE

SEQ ID NO: 2026957 - protein, 20 aa, Staphylococcus
LKRQGIKKGVPVVFSDESPI

SEQ ID NO: 2026958 - protein, 17 aa, Staphylococcus
LKRSDLFITSKLWLDDY

SEQ ID NO: 2026959 - protein, 17 aa, Staphylococcus
LKRTDAANVDGHDNTNE

SEQ ID NO: 2026960 - protein, 23 aa, Staphylococcus
LKRTDKTRVILMCPQGRPFSQAI

SEQ ID NO: 2026961 - protein, 18 aa, Staphylococcus
LKRTYVFELNYEEMMNVS

SEQ ID NO: 2026962 - protein, 20 aa, Staphylococcus
LKRVIDFMDNFGFSETDIEY

SEQ ID NO: 2026963 - protein, 23 aa, Staphylococcus
LKRWKKYVVPHVLYLKKLIKQGH

SEQ ID NO: 2026964 - protein, 21 aa, Staphylococcus
LKSADQPLIIAGHEINSFNLH

SEQ ID NO: 2026965 - protein, 18 aa, Staphylococcus
LKSAESLNKQIRRSFKEE

SEQ ID NO: 2026966 - protein, 18 aa, Staphylococcus
LKSATWVDLTHTFDETIP

SEQ ID NO: 2026967 - protein, 19 aa, Staphylococcus
LKSDIEFKSFDDVYEKYDQ

SEQ ID NO: 2026968 - protein, 21 aa, Staphylococcus
LKSDRIILRMSTFEMLHSSTP

SEQ ID NO: 2026969 - protein, 23 aa, Staphylococcus
LKSEDGYELMKFVDLSQTSVIVV

SEQ ID NO: 2026970 - protein, 20 aa, Staphylococcus
LKSEDGYQLLKYIDLNDTAV

SEQ ID NO: 2026971 - protein, 29 aa, Staphylococcus
LKSELKPTPKWSISRYKGLGEMDADQLWE

SEQ ID NO: 2026972 - protein, 17 aa, Staphylococcus
LKSFGMTVLAYDPFLTK

SEQ ID NO: 2026973 - protein, 23 aa, Staphylococcus
LKSFHACGVYGMVAVTSIVAQNT

SEQ ID NO: 2026974 - protein, 20 aa, Staphylococcus
LKSFHSCGVYGMAAITSIVA

SEQ ID NO: 2026975 - protein, 19 aa, Staphylococcus
LKSFLYDNYEIEIGEIASK

SEQ ID NO: 2026976 - protein, 20 aa, Staphylococcus
LKSGDLILLNGDLGAGKTTL

SEQ ID NO: 2026977 - protein, 19 aa, Staphylococcus
LKSGGAILMPKTEMPPFRE

SEQ ID NO: 2026978 - protein, 23 aa, Staphylococcus
LKSGIKEAFQFDRKLVIEQGVNA

SEQ ID NO: 2026979 - protein, 18 aa, Staphylococcus
LKSGKPDAILSISDEQAI

SEQ ID NO: 2026980 - protein, 22 aa, Staphylococcus
LKSGQALLQQGFNVFVVQLPKN

SEQ ID NO: 2026981 - protein, 23 aa, Staphylococcus
LKSIGLKVYWIINDVKKRGDFIE

SEQ ID NO: 2026982 - protein, 17 aa, Staphylococcus
LKSIIPDNIIKVDEPLK

SEQ ID NO: 2026983 - protein, 19 aa, Staphylococcus
LKSIVTRFVDKHHIEDPLL

SEQ ID NO: 2026984 - protein, 20 aa, Staphylococcus
LKSKHAVIVGAGEMSELSLL

SEQ ID NO: 2026985 - protein, 19 aa, Staphylococcus
LKSKLDTIKTFAKVPVVAG

SEQ ID NO: 2026986 - protein, 24 aa, Staphylococcus
LKSLEFPFDIVIDANESLDINQYQ

SEQ ID NO: 2026987 - protein, 24 aa, Staphylococcus
LKSLIEEGLEWVLIQGQLGIEMWT

SEQ ID NO: 2026988 - protein, 23 aa, Staphylococcus
LKSLIKEQLNNIGIKASEAPSHI

SEQ ID NO: 2026989 - protein, 18 aa, Staphylococcus
LKSLIPEDIIKVNEPLKR

SEQ ID NO: 2026990 - protein, 25 aa, Staphylococcus
LKSLKDHFYRYSLKLRQKVKTITID

SEQ ID NO: 2026991 - protein, 26 aa, Staphylococcus
LKSLKDSRFPFSIMWIEELGEFKTED

SEQ ID NO: 2026992 - protein, 17 aa, Staphylococcus
LKSLMHTSTGRKLAEER

SEQ ID NO: 2026993 - protein, 17 aa, Staphylococcus
LKSLPLVSIDHLGLSKE

SEQ ID NO: 2026994 - protein, 20 aa, Staphylococcus
LKSLYLTRVSRYNEIAFIKV

SEQ ID NO: 2026995 - protein, 22 aa, Staphylococcus
LKSNLQALLRGHYYLRELSTPD

SEQ ID NO: 2026996 - protein, 17 aa, Staphylococcus
LKSNPLLNSSWDGEEII

SEQ ID NO: 2026997 - protein, 21 aa, Staphylococcus
LKSRFNITIAGGQGHLKGEIL

SEQ ID NO: 2026998 - protein, 20 aa, Staphylococcus
LKSRFNITIAGGQGHLKGHI

SEQ ID NO: 2026999 - protein, 19 aa, Staphylococcus
LKSRIDSLATQEEDYTYFF

SEQ ID NO: 2027000 - protein, 20 aa, Staphylococcus
LKSRLLLGTGKFDNEDIQTK

SEQ ID NO: 2027001 - protein, 20 aa, Staphylococcus
LKSRLLLGTGKFEDEETQSK

SEQ ID NO: 2027002 - protein, 18 aa, Staphylococcus
LKSSFNLNFDIEVDGGIN

SEQ ID NO: 2027003 - protein, 18 aa, Staphylococcus
LKSSYKISIEEFVVLFKV

SEQ ID NO: 2027004 - protein, 18 aa, Staphylococcus
LKSTIAYISKLVNEVEAL

SEQ ID NO: 2027005 - protein, 17 aa, Staphylococcus
LKSVIVGTGDQKINLTS

SEQ ID NO: 2027006 - protein, 21 aa, Staphylococcus
LKTALHIPVLFVPGNHDYWKV

SEQ ID NO: 2027007 - protein, 19 aa, Staphylococcus
LKTELAFMPDFTQICDVCN

SEQ ID NO: 2027008 - protein, 18 aa, Staphylococcus
LKTFIAGFNGPVYGTALE

SEQ ID NO: 2027009 - protein, 20 aa, Staphylococcus
LKTFRQLGVDYEMDKLKRDL

SEQ ID NO: 2027010 - protein, 17 aa, Staphylococcus
LKTHSKIALVVKRMNNK

SEQ ID NO: 2027011 - protein, 21 aa, Staphylococcus
LKTKDGRGFYGANVENASYPA

SEQ ID NO: 2027012 - protein, 22 aa, Staphylococcus
LKTKKVEVFLLNSLREVADVTI

SEQ ID NO: 2027013 - protein, 25 aa, Staphylococcus
LKTKNGLEILVHIGLDTVQLDGEGF

SEQ ID NO: 2027014 - protein, 25 aa, Staphylococcus
LKTKRFTYTHLQRILMQILLNVKKE

SEQ ID NO: 2027015 - protein, 17 aa, Staphylococcus
LKTLGKEMEQISEENDE

SEQ ID NO: 2027016 - protein, 17 aa, Staphylococcus
LKTLHLRIDRSQENAQR

SEQ ID NO: 2027017 - protein, 20 aa, Staphylococcus
LKTLHLRMDRSEYNAKLLSE

SEQ ID NO: 2027018 - protein, 19 aa, Staphylococcus
LKTLHVRWNQSVQNTQKII

SEQ ID NO: 2027019 - protein, 19 aa, Staphylococcus
LKTLPLDNFELHFQKKVKQ

SEQ ID NO: 2027020 - protein, 21 aa, Staphylococcus
LKTMGKLALLMLEDLNTAVKN

SEQ ID NO: 2027021 - protein, 17 aa, Staphylococcus
LKTPPGYESESFEQFLL

SEQ ID NO: 2027022 - protein, 19 aa, Staphylococcus
LKTPVPIFHKNHETGKEDF

SEQ ID NO: 2027023 - protein, 17 aa, Staphylococcus
LKTQLGMYHFFVQADTS

SEQ ID NO: 2027024 - protein, 18 aa, Staphylococcus
LKTSIIGINPNWLTKPIM

SEQ ID NO: 2027025 - protein, 17 aa, Staphylococcus
LKTSLWSSEVLKNNPTQ

SEQ ID NO: 2027026 - protein, 19 aa, Staphylococcus
LKTTIKWNQPMFTDHGTFI

SEQ ID NO: 2027027 - protein, 19 aa, Staphylococcus
LKTTLERVIPIWTDHISQH

SEQ ID NO: 2027028 - protein, 20 aa, Staphylococcus
LKTTLERVVPIWTDKISQHL

SEQ ID NO: 2027029 - protein, 26 aa, Staphylococcus
LKTYQAQCVLTDILPTIDNIERALQI

SEQ ID NO: 2027030 - protein, 22 aa, Staphylococcus
LKTYVDRQGKEVLYENFVTKDI

SEQ ID NO: 2027031 - protein, 20 aa, Staphylococcus
LKVAKSICDIYPLLNRSLLY

SEQ ID NO: 2027032 - protein, 29 aa, Staphylococcus
LKVALEQPIFEGIEWIIVSLGSKGAFAKH

SEQ ID NO: 2027033 - protein, 24 aa, Staphylococcus
LKVANLKPSIMFTDLSRQQIINHL

SEQ ID NO: 2027034 - protein, 17 aa, Staphylococcus
LKVAVIGTGRIGSIVAK

SEQ ID NO: 2027035 - protein, 17 aa, Staphylococcus
LKVDRLIFVQSLPRETR

SEQ ID NO: 2027036 - protein, 19 aa, Staphylococcus
LKVEGCDIVSINHKGHQLK

SEQ ID NO: 2027037 - protein, 20 aa, Staphylococcus
LKVGDIFKIKVTEIDKQGRV

SEQ ID NO: 2027038 - protein, 19 aa, Staphylococcus
LKVGQTVKIAYFKQTEETL

SEQ ID NO: 2027039 - protein, 24 aa, Staphylococcus
LKVGRYRFGDGINECGVAISNHYF

SEQ ID NO: 2027040 - protein, 27 aa, Staphylococcus
LKVGRYRFGDGINEHGVAISNHYFTGE

SEQ ID NO: 2027041 - protein, 26 aa, Staphylococcus
LKVGRYRFGDGINEQGLAISNHYFTG

SEQ ID NO: 2027042 - protein, 27 aa, Staphylococcus
LKVHIPKCNLPYFISFLSFHNYPIYQV

SEQ ID NO: 2027043 - protein, 19 aa, Staphylococcus
LKVIEQFHLIDKLSHQRVD

SEQ ID NO: 2027044 - protein, 17 aa, Staphylococcus
LKVIFSLYDEFDKLVSV

SEQ ID NO: 2027045 - protein, 17 aa, Staphylococcus
LKVIRPVYLNGSNIPTF

SEQ ID NO: 2027046 - protein, 19 aa, Staphylococcus
LKVKHIYKDCEPPIPGDLT

SEQ ID NO: 2027047 - protein, 18 aa, Staphylococcus
LKVKLEMRKHIFTEALKE

SEQ ID NO: 2027048 - protein, 28 aa, Staphylococcus
LKVKYPTYKLCRDLLHLLDHSSQFEEIY

SEQ ID NO: 2027049 - protein, 18 aa, Staphylococcus
LKVLQDAFGLSRVAYTTY

SEQ ID NO: 2027050 - protein, 25 aa, Staphylococcus
LKVNNCVTIEPGIYVEGLGGVRIED

SEQ ID NO: 2027051 - protein, 19 aa, Staphylococcus
LKVPAEVGLTEYNFNVPLE

SEQ ID NO: 2027052 - protein, 17 aa, Staphylococcus
LKVQGFLGSLGEKKGFA

SEQ ID NO: 2027053 - protein, 18 aa, Staphylococcus
LKVQGFLGSLGEKKGFAY

SEQ ID NO: 2027054 - protein, 18 aa, Staphylococcus
LKVQGFLGSLGEKQGFAY

SEQ ID NO: 2027055 - protein, 26 aa, Staphylococcus
LKVRARRNGDMFKLNGRNGHKKVSRL

SEQ ID NO: 2027056 - protein, 18 aa, Staphylococcus
LKVRRRVMELLLLIEEKT

SEQ ID NO: 2027057 - protein, 20 aa, Staphylococcus
LKVRSEMTFSGYVGEEQISN

SEQ ID NO: 2027058 - protein, 17 aa, Staphylococcus
LKVTIVDSLNKRIQFLN

SEQ ID NO: 2027059 - protein, 21 aa, Staphylococcus
LKVVLNEAGADFNSVIKSTIF

SEQ ID NO: 2027060 - protein, 19 aa, Staphylococcus
LKVWGERVGVDVVSQSEGS

SEQ ID NO: 2027061 - protein, 25 aa, Staphylococcus
LKWFRDELDLEPGDKINFYVQTYVH

SEQ ID NO: 2027062 - protein, 21 aa, Staphylococcus
LKWLMDAGLNKPYSIEKILLG

SEQ ID NO: 2027063 - protein, 27 aa, Staphylococcus
LKWNIIKDGKLLYNLEIMFLSMNDIEN

SEQ ID NO: 2027064 - protein, 17 aa, Staphylococcus
LKWRGLIYQQTDEEGIE

SEQ ID NO: 2027065 - protein, 29 aa, Staphylococcus
LKYAEHFVRIVNFPFYYRGEVYDPFNGNT

SEQ ID NO: 2027066 - protein, 17 aa, Staphylococcus
LKYAITAGIGSDHVDIE

SEQ ID NO: 2027067 - protein, 17 aa, Staphylococcus
LKYAKEEHLDFVIIDTA

SEQ ID NO: 2027068 - protein, 24 aa, Staphylococcus
LKYDKELLYITSLFHDLGLTETYS

SEQ ID NO: 2027069 - protein, 19 aa, Staphylococcus
LKYDYVRLQNDLEKRESLN

SEQ ID NO: 2027070 - protein, 27 aa, Staphylococcus
LKYEEGPCMGAAMLAIVGLSWYESLED

SEQ ID NO: 2027071 - protein, 17 aa, Staphylococcus
LKYIDFNSGKISKQLLN

SEQ ID NO: 2027072 - protein, 19 aa, Staphylococcus
LKYKELKPYLIPDSFDTNE

SEQ ID NO: 2027073 - protein, 23 aa, Staphylococcus
LKYKSNHDYLEFLEVERKKGNIE

SEQ ID NO: 2027074 - protein, 26 aa, Staphylococcus
LKYLAELKLSATVIMTSHEFHHHNHI

SEQ ID NO: 2027075 - protein, 37 aa, Staphylococcus
LKYLEKYSLKCFAHLFKMIIHKPIWLISERKDSASDN

SEQ ID NO: 2027076 - protein, 22 aa, Staphylococcus
LKYNNNIWNEWAFENYVNSEDY

SEQ ID NO: 2027077 - protein, 20 aa, Staphylococcus
LKYPGYDFEKNVGYGTKSHL

SEQ ID NO: 2027078 - protein, 23 aa, Staphylococcus
LKYQGTFSKFRPQAFEKSFRKNP

SEQ ID NO: 2027079 - protein, 17 aa, Staphylococcus
LKYRTGFYSENPEHLKE

SEQ ID NO: 2027080 - protein, 22 aa, Staphylococcus
LKYSPSLVYQAWTTASLLKQWF

SEQ ID NO: 2027081 - protein, 20 aa, Staphylococcus
LKYVDFYNQQGFRFAQLLYD

SEQ ID NO: 2027082 - protein, 21 aa, Staphylococcus
LKYYEIPTFVVATKEDKIAKG

SEQ ID NO: 2027083 - protein, 24 aa, Staphylococcus
LLAFGEKKIDAIQRLAAGNVSEDL

SEQ ID NO: 2027084 - protein, 22 aa, Staphylococcus
LLAGLLSGVGIQSVLSGDISIG

SEQ ID NO: 2027085 - protein, 19 aa, Staphylococcus
LLAGLPWQSVMAADNKIYH

SEQ ID NO: 2027086 - protein, 19 aa, Staphylococcus
LLAGLPWQSVMAGDNKIYH

SEQ ID NO: 2027087 - protein, 18 aa, Staphylococcus
LLAHASPEMTLRYAKLLD

SEQ ID NO: 2027088 - protein, 23 aa, Staphylococcus
LLAKGRLTGIQFLELFTDDLYFK

SEQ ID NO: 2027089 - protein, 21 aa, Staphylococcus
LLAKGRLVGIQFLELFTDNLY

SEQ ID NO: 2027090 - protein, 22 aa, Staphylococcus
LLAKGRLVGIQFLELFTNNLYF

SEQ ID NO: 2027091 - protein, 22 aa, Staphylococcus
LLAKGRLVGVQFLELFTNNLYL

SEQ ID NO: 2027092 - protein, 18 aa, Staphylococcus
LLAKSRLVGVQFSALFSD

SEQ ID NO: 2027093 - protein, 27 aa, Staphylococcus
LLANCKLCNALRLGISLYGYYPSEYVR

SEQ ID NO: 2027094 - protein, 24 aa, Staphylococcus
LLANKFKNLCVVGDSDQSIYGWRG

SEQ ID NO: 2027095 - protein, 20 aa, Staphylococcus
LLANYLIPRIDILKVGHHGS

SEQ ID NO: 2027096 - protein, 21 aa, Staphylococcus
LLASLIHRPELLILDEPFSGL

SEQ ID NO: 2027097 - protein, 26 aa, Staphylococcus
LLASSRLNYTYIRMAMYMDPLKPYLP

SEQ ID NO: 2027098 - protein, 25 aa, Staphylococcus
LLCGCQGVNGGGWAHYVGQEKCRPI

SEQ ID NO: 2027099 - protein, 23 aa, Staphylococcus
LLDALHLWLLRINYLNQPKSYPS

SEQ ID NO: 2027100 - protein, 25 aa, Staphylococcus
LLDAPKLGAINVHASLLPKYRGGAP

SEQ ID NO: 2027101 - protein, 23 aa, Staphylococcus
LLDDLELPLARILSEMEETGIYT

SEQ ID NO: 2027102 - protein, 23 aa, Staphylococcus
LLDEFKALARFEGEDTKIVDKQG

SEQ ID NO: 2027103 - protein, 17 aa, Staphylococcus
LLDEGFPKQNIFVTGSP

SEQ ID NO: 2027104 - protein, 17 aa, Staphylococcus
LLDELDVELDLYQLRLH

SEQ ID NO: 2027105 - protein, 19 aa, Staphylococcus
LLDELRIQNALKELETDLQ

SEQ ID NO: 2027106 - protein, 18 aa, Staphylococcus
LLDEPFVGIDFHSEQIIM

SEQ ID NO: 2027107 - protein, 19 aa, Staphylococcus
LLDHREFTLILYVNDIVGM

SEQ ID NO: 2027108 - protein, 26 aa, Staphylococcus
LLDIGLDLPFVMKIAQQLEVSNRYIT

SEQ ID NO: 2027109 - protein, 18 aa, Staphylococcus
LLDIYKKRGYEIYNEHES

SEQ ID NO: 2027110 - protein, 17 aa, Staphylococcus
LLDKNGITFKETIEDIY

SEQ ID NO: 2027111 - protein, 17 aa, Staphylococcus
LLDLIEPWQSFVLNVKE

SEQ ID NO: 2027112 - protein, 20 aa, Staphylococcus
LLDLWAQVYLIDRGERLETA

SEQ ID NO: 2027113 - protein, 17 aa, Staphylococcus
LLDRAGDQIVLPVDCKV

SEQ ID NO: 2027114 - protein, 23 aa, Staphylococcus
LLDRFKYAQSINVNAHPVIVGPI

SEQ ID NO: 2027115 - protein, 19 aa, Staphylococcus
LLDRFNYAKSINVNAHPVI

SEQ ID NO: 2027116 - protein, 25 aa, Staphylococcus
LLDSPVKFAQHIGGTSHFNYATEPI

SEQ ID NO: 2027117 - protein, 17 aa, Staphylococcus
LLDTPGILWPKFEDEEV

SEQ ID NO: 2027118 - protein, 18 aa, Staphylococcus
LLDTPGILWPKFEDEEVG

SEQ ID NO: 2027119 - protein, 22 aa, Staphylococcus
LLDTPGILWPKFEDEIVGKKLS

SEQ ID NO: 2027120 - protein, 22 aa, Staphylococcus
LLDTPGILWPKFEDELVGKKLS

SEQ ID NO: 2027121 - protein, 18 aa, Staphylococcus
LLDTPGILWPKFEDETVG

SEQ ID NO: 2027122 - protein, 21 aa, Staphylococcus
LLDTPGILWPKFEDQLVGKKL

SEQ ID NO: 2027123 - protein, 19 aa, Staphylococcus
LLDTPGILWPKFEDQTVGK

SEQ ID NO: 2027124 - protein, 19 aa, Staphylococcus
LLDTPTFFFGMNVGETVEV

SEQ ID NO: 2027125 - protein, 21 aa, Staphylococcus
LLDTPTFFFGMRSNETVEIEI

SEQ ID NO: 2027126 - protein, 35 aa, Staphylococcus
LLDVIVEPFYEWVIEKDAWFGPELDHIKYVDNLTP

SEQ ID NO: 2027127 - protein, 20 aa, Staphylococcus
LLDVLYKLPIEKMNELNIHQ

SEQ ID NO: 2027128 - protein, 18 aa, Staphylococcus
LLDVWEMQPSELMAFGDA

SEQ ID NO: 2027129 - protein, 18 aa, Staphylococcus
LLDWARKQTYIALGNMMT

SEQ ID NO: 2027130 - protein, 18 aa, Staphylococcus
LLDYCTFGRINDLRIGES

SEQ ID NO: 2027131 - protein, 18 aa, Staphylococcus
LLEDANIHPGMRVLDVGC

SEQ ID NO: 2027132 - protein, 18 aa, Staphylococcus
LLEEAHVAIVPGSSFTDI

SEQ ID NO: 2027133 - protein, 18 aa, Staphylococcus
LLEFYKQYKALSEYIDQK

SEQ ID NO: 2027134 - protein, 18 aa, Staphylococcus
LLEGIGLIKTFVKHDSNQ

SEQ ID NO: 2027135 - protein, 23 aa, Staphylococcus
LLEIEPFSSITVHKICENAGIHR

SEQ ID NO: 2027136 - protein, 18 aa, Staphylococcus
LLEKACERKGIPFEPKEL

SEQ ID NO: 2027137 - protein, 19 aa, Staphylococcus
LLEKACERKGIPFEPKELD

SEQ ID NO: 2027138 - protein, 18 aa, Staphylococcus
LLEKGFNIKAIKQIILDD

SEQ ID NO: 2027139 - protein, 18 aa, Staphylococcus
LLEKRSFESLSVNEICES

SEQ ID NO: 2027140 - protein, 20 aa, Staphylococcus
LLEKVAEAFEFDTLKNNSFN

SEQ ID NO: 2027141 - protein, 17 aa, Staphylococcus
LLEKWIKDGVIQPFSPR

SEQ ID NO: 2027142 - protein, 25 aa, Staphylococcus
LLELPHEVKSTFIAMQPLRELEVIE

SEQ ID NO: 2027143 - protein, 20 aa, Staphylococcus
LLELREIVELATVKKAAELG

SEQ ID NO: 2027144 - protein, 18 aa, Staphylococcus
LLEMIGLVAEVQELKANP

SEQ ID NO: 2027145 - protein, 23 aa, Staphylococcus
LLENHPGVFAFIGSNSEYDLHHP

SEQ ID NO: 2027146 - protein, 17 aa, Staphylococcus
LLEPEIIFELTADLPED

SEQ ID NO: 2027147 - protein, 18 aa, Staphylococcus
LLEQEMFTPLTVNKICKH

SEQ ID NO: 2027148 - protein, 22 aa, Staphylococcus
LLEQHMKSCIAEKVNQGHQEEA

SEQ ID NO: 2027149 - protein, 17 aa, Staphylococcus
LLERALMNYMLTKHTTQ

SEQ ID NO: 2027150 - protein, 19 aa, Staphylococcus
LLEREEQYFYAVYQGDEAV

SEQ ID NO: 2027151 - protein, 20 aa, Staphylococcus
LLERIKAQGVNIAFITLHVG

SEQ ID NO: 2027152 - protein, 24 aa, Staphylococcus
LLERKYPNIHFEYTYIDFQKETEN

SEQ ID NO: 2027153 - protein, 20 aa, Staphylococcus
LLESIYVLALAKSHRTANDK

SEQ ID NO: 2027154 - protein, 17 aa, Staphylococcus
LLESLKIDLGKGSVEAY

SEQ ID NO: 2027155 - protein, 17 aa, Staphylococcus
LLESVRLIQDYLRRLNY

SEQ ID NO: 2027156 - protein, 24 aa, Staphylococcus
LLETGDHAFNWDKIYLTHITEENL

SEQ ID NO: 2027157 - protein, 25 aa, Staphylococcus
LLETIKENMNWIWNSLSLQDQEAFM

SEQ ID NO: 2027158 - protein, 26 aa, Staphylococcus
LLETKITEVLSRLSIEPSEELEQEFQ

SEQ ID NO: 2027159 - protein, 17 aa, Staphylococcus
LLETLLFTDMITMEDVE

SEQ ID NO: 2027160 - protein, 18 aa, Staphylococcus
LLEVHGFKIVDADVASRE

SEQ ID NO: 2027161 - protein, 17 aa, Staphylococcus
LLEYAKEAYEINMKVAE

SEQ ID NO: 2027162 - protein, 28 aa, Staphylococcus
LLEYCNFGCPYFILRRIPESEIKTQLDE

SEQ ID NO: 2027163 - protein, 23 aa, Staphylococcus
LLEYIKELEEILADEEVLLQLVR

SEQ ID NO: 2027164 - protein, 17 aa, Staphylococcus
LLFDIVDAFIKAEYKPT

SEQ ID NO: 2027165 - protein, 21 aa, Staphylococcus
LLFENEIEIVPGIKMIHTGGH

SEQ ID NO: 2027166 - protein, 28 aa, Staphylococcus
LLFGTIDSWLVWKLSGGQAHITDYTNAS

SEQ ID NO: 2027167 - protein, 26 aa, Staphylococcus
LLFGTIDSWLVWKLSGKEAHVTDYTN

SEQ ID NO: 2027168 - protein, 27 aa, Staphylococcus
LLFGTIDTWLVWKLSGGEAHITDYSNA

SEQ ID NO: 2027169 - protein, 17 aa, Staphylococcus
LLFLMNHQIHLSIRLRL

SEQ ID NO: 2027170 - protein, 17 aa, Staphylococcus
LLFNECYNTIVNHLELT

SEQ ID NO: 2027171 - protein, 21 aa, Staphylococcus
LLFVLERQWRKLGKTLDPDDF

SEQ ID NO: 2027172 - protein, 26 aa, Staphylococcus
LLGDFKAPMGCRSFLPAWKDKDGHYE

SEQ ID NO: 2027173 - protein, 27 aa, Staphylococcus
LLGDFKAPMGCRSFLPSWKDATGNFEN

SEQ ID NO: 2027174 - protein, 26 aa, Staphylococcus
LLGDFKAPMGCRSFLPSWRNEQGENE

SEQ ID NO: 2027175 - protein, 26 aa, Staphylococcus
LLGEDCKRTMNIFRLLGVSITEEEDR

SEQ ID NO: 2027176 - protein, 30 aa, Staphylococcus
LLGEDCLRTIEIFKLLGVEIEIEEHRLIVN

SEQ ID NO: 2027177 - protein, 29 aa, Staphylococcus
LLGEDCLRTVEIFKLLGVQIEVNEDKIEI

SEQ ID NO: 2027178 - protein, 26 aa, Staphylococcus
LLGEDCRRTMEIFELLGVKITEHEET

SEQ ID NO: 2027179 - protein, 18 aa, Staphylococcus
LLGEETFETLTVQKIVDT

SEQ ID NO: 2027180 - protein, 24 aa, Staphylococcus
LLGFLEAFGLIDFEMKGGATPSIN

SEQ ID NO: 2027181 - protein, 17 aa, Staphylococcus
LLGGASCVLMNHEHESV

SEQ ID NO: 2027182 - protein, 18 aa, Staphylococcus
LLGHDFFVFADRETEGTS

SEQ ID NO: 2027183 - protein, 26 aa, Staphylococcus
LLGIDEYKPHIAIITNIYSAHLDYHE

SEQ ID NO: 2027184 - protein, 25 aa, Staphylococcus
LLGIEHYRPHIAIITNIYSAHLDYH

SEQ ID NO: 2027185 - protein, 19 aa, Staphylococcus
LLGKKIEAMIDNKAQYSFL

SEQ ID NO: 2027186 - protein, 23 aa, Staphylococcus
LLGLECARGLLDQGMEVTVLHLA

SEQ ID NO: 2027187 - protein, 23 aa, Staphylococcus
LLGLQSARAIYQFDHYKSNKRVP

SEQ ID NO: 2027188 - protein, 25 aa, Staphylococcus
LLGVEQYRPHIAIITNIYSAHLDYH

SEQ ID NO: 2027189 - protein, 17 aa, Staphylococcus
LLGVKDLLTILVTEKIR

SEQ ID NO: 2027190 - protein, 24 aa, Staphylococcus
LLGYGDMLYLGGGMNKPIRVQGTF

SEQ ID NO: 2027191 - protein, 24 aa, Staphylococcus
LLGYGDMLYLGNGMNKPIRVQGSF

SEQ ID NO: 2027192 - protein, 24 aa, Staphylococcus
LLGYGDMLYLGSGMNKPIRVQGTF

SEQ ID NO: 2027193 - protein, 18 aa, Staphylococcus
LLHDFNFQVVLLDLNLHA

SEQ ID NO: 2027194 - protein, 27 aa, Staphylococcus
LLHDLKITVPVAIHLDHGSSFEKCKEA

SEQ ID NO: 2027195 - protein, 31 aa, Staphylococcus
LLHDSIRLAYNYQISCVHIPRNGEEGLDGVI

SEQ ID NO: 2027196 - protein, 20 aa, Staphylococcus
LLHEDVDFIFGYPGGAVLPL

SEQ ID NO: 2027197 - protein, 20 aa, Staphylococcus
LLHEEIKDAYDLGIRAIMFF

SEQ ID NO: 2027198 - protein, 25 aa, Staphylococcus
LLHEIFKEYGVLFLDAQFTELRKME

SEQ ID NO: 2027199 - protein, 20 aa, Staphylococcus
LLHIVFKEYGVLLIDAQDPK

SEQ ID NO: 2027200 - protein, 20 aa, Staphylococcus
LLHKALKQYGHMINFEEVML

SEQ ID NO: 2027201 - protein, 18 aa, Staphylococcus
LLHLEAIKNQHPFELSMG

SEQ ID NO: 2027202 - protein, 20 aa, Staphylococcus
LLHLGAPFDTFGGFKSYRLL

SEQ ID NO: 2027203 - protein, 20 aa, Staphylococcus
LLHRENEEVMAYAAENNITF

SEQ ID NO: 2027204 - protein, 17 aa, Staphylococcus
LLHRRRYIPDINSRNFN

SEQ ID NO: 2027205 - protein, 19 aa, Staphylococcus
LLHRSGLRSLDEFKEVLKD

SEQ ID NO: 2027206 - protein, 26 aa, Staphylococcus
LLIAIHRLKGKFSFDVPSEQAETLKQ

SEQ ID NO: 2027207 - protein, 25 aa, Staphylococcus
LLIAIPDVFWSFEISLATHINKIND

SEQ ID NO: 2027208 - protein, 18 aa, Staphylococcus
LLIEIKVPHQYPGIEEAV

SEQ ID NO: 2027209 - protein, 17 aa, Staphylococcus
LLIPEPWLYNKENDDNV

SEQ ID NO: 2027210 - protein, 17 aa, Staphylococcus
LLIPEPWLYNKSNNKDV

SEQ ID NO: 2027211 - protein, 17 aa, Staphylococcus
LLIPKLAERIHKEQLNI

SEQ ID NO: 2027212 - protein, 19 aa, Staphylococcus
LLIREGLRMDTSLVALSGE

SEQ ID NO: 2027213 - protein, 23 aa, Staphylococcus
LLISDPRIQGGAFYLGSDTYENG

SEQ ID NO: 2027214 - protein, 17 aa, Staphylococcus
LLISSIRSNDPVVYLEH

SEQ ID NO: 2027215 - protein, 18 aa, Staphylococcus
LLITMAVVTWKVVKIEKT

SEQ ID NO: 2027216 - protein, 19 aa, Staphylococcus
LLITPKFDKPGLLASILNT

SEQ ID NO: 2027217 - protein, 18 aa, Staphylococcus
LLITPSLNFDPLLKDIIS

SEQ ID NO: 2027218 - protein, 18 aa, Staphylococcus
LLIYGSRITNCNFTNSDL

SEQ ID NO: 2027219 - protein, 23 aa, Staphylococcus
LLIYYNQTWYKFSHFKANELQAL

SEQ ID NO: 2027220 - protein, 17 aa, Staphylococcus
LLKAMESPQKFFDLSDK

SEQ ID NO: 2027221 - protein, 18 aa, Staphylococcus
LLKDVYHKGQIVSAKKKK

SEQ ID NO: 2027222 - protein, 17 aa, Staphylococcus
LLKDVYYQGKIVTTKKK

SEQ ID NO: 2027223 - protein, 24 aa, Staphylococcus
LLKEKPDLILLTFPTPVMSVLTEQ

SEQ ID NO: 2027224 - protein, 24 aa, Staphylococcus
LLKEKSILVAPGIPFGENGKHYVR

SEQ ID NO: 2027225 - protein, 22 aa, Staphylococcus
LLKESDFVICTAPLTPQTENQF

SEQ ID NO: 2027226 - protein, 27 aa, Staphylococcus
LLKEVERLVLKGGIDQIVIESTGISEP

SEQ ID NO: 2027227 - protein, 17 aa, Staphylococcus
LLKFHGSYMQDDRDIRD

SEQ ID NO: 2027228 - protein, 20 aa, Staphylococcus
LLKFNTLPISHLVYLNSAAR

SEQ ID NO: 2027229 - protein, 20 aa, Staphylococcus
LLKFNTLPISHLVYLSSAAK

SEQ ID NO: 2027230 - protein, 20 aa, Staphylococcus
LLKHCLDIEQQLHRVREIRW

SEQ ID NO: 2027231 - protein, 19 aa, Staphylococcus
LLKKACERKGIPFEPEALD

SEQ ID NO: 2027232 - protein, 17 aa, Staphylococcus
LLKKGADNIKLMASGGV

SEQ ID NO: 2027233 - protein, 17 aa, Staphylococcus
LLKKYGFIIYFKDPEDM

SEQ ID NO: 2027234 - protein, 23 aa, Staphylococcus
LLKLEFITHSYPHDWRTKKPVIF

SEQ ID NO: 2027235 - protein, 25 aa, Staphylococcus
LLKLKELPKSIVIVGGGVIGMEFAS

SEQ ID NO: 2027236 - protein, 31 aa, Staphylococcus
LLKLLKEEDVEWIVLAGYMRLIGADLLDAYE

SEQ ID NO: 2027237 - protein, 17 aa, Staphylococcus
LLKMFLRPTEDDGETTS

SEQ ID NO: 2027238 - protein, 27 aa, Staphylococcus
LLKNDDWDYLLNYDFDAEQVTQENIQH

SEQ ID NO: 2027239 - protein, 26 aa, Staphylococcus
LLKNDDWDYLLNYDIDAEKVTQENFQ

SEQ ID NO: 2027240 - protein, 19 aa, Staphylococcus
LLKNDDWDYLLNYDLDAEQ

SEQ ID NO: 2027241 - protein, 19 aa, Staphylococcus
LLKNDDWDYLLNYDLDAQQ

SEQ ID NO: 2027242 - protein, 29 aa, Staphylococcus
LLKNEGHAILEFSNYVAAIVTTQYGAIES

SEQ ID NO: 2027243 - protein, 26 aa, Staphylococcus
LLKNKGIECYIHIDLIKGLSHDEYSC

SEQ ID NO: 2027244 - protein, 18 aa, Staphylococcus
LLKQARHAIQDAIDAAES

SEQ ID NO: 2027245 - protein, 18 aa, Staphylococcus
LLKQARNAIQDAIDAAEA

SEQ ID NO: 2027246 - protein, 18 aa, Staphylococcus
LLKQARNAIQDAIDAAES

SEQ ID NO: 2027247 - protein, 20 aa, Staphylococcus
LLKQQGIELGIDYPEPMVNH

SEQ ID NO: 2027248 - protein, 22 aa, Staphylococcus
LLKQRLDKFEAYYAKIEANIHR

SEQ ID NO: 2027249 - protein, 17 aa, Staphylococcus
LLKRCLETEQALHRVRK

SEQ ID NO: 2027250 - protein, 19 aa, Staphylococcus
LLKRCYKDEFEGWEEKIKE

SEQ ID NO: 2027251 - protein, 20 aa, Staphylococcus
LLKSEDWDYLLNYDLDSEQV

SEQ ID NO: 2027252 - protein, 26 aa, Staphylococcus
LLKTFRLEDELNIFPSHFSKGMKQKV

SEQ ID NO: 2027253 - protein, 27 aa, Staphylococcus
LLKTFRLENELQIFPSHFSKGMKQKVM

SEQ ID NO: 2027254 - protein, 17 aa, Staphylococcus
LLLEKQLSHADIIDKEE

SEQ ID NO: 2027255 - protein, 25 aa, Staphylococcus
LLLKEKPDLILLTFPTPVMSVLTEQ

SEQ ID NO: 2027256 - protein, 26 aa, Staphylococcus
LLLKEKPDLILLTFPTPVMSVLTEQF

SEQ ID NO: 2027257 - protein, 17 aa, Staphylococcus
LLLNYVMDYARHTCDVM

SEQ ID NO: 2027258 - protein, 22 aa, Staphylococcus
LLLSDIILGMKFRNASKDYSNF

SEQ ID NO: 2027259 - protein, 18 aa, Staphylococcus
LLMHINRNEIVNWEGQIR

SEQ ID NO: 2027260 - protein, 18 aa, Staphylococcus
LLMIKSKLLLPQHDVDDN

SEQ ID NO: 2027261 - protein, 18 aa, Staphylococcus
LLMIKSKLLLPQSDDHVE

SEQ ID NO: 2027262 - protein, 17 aa, Staphylococcus
LLMIKSKLLLPQSEEDV

SEQ ID NO: 2027263 - protein, 18 aa, Staphylococcus
LLMRGFEIDCRIKHFQGR

SEQ ID NO: 2027264 - protein, 21 aa, Staphylococcus
LLNALKNNGLEKIETEGQQFD

SEQ ID NO: 2027265 - protein, 26 aa, Staphylococcus
LLNAPRLGAINVHASLLPKYRGGAPI

SEQ ID NO: 2027266 - protein, 25 aa, Staphylococcus
LLNEFKVPYLIVGKSLNYENIIHID

SEQ ID NO: 2027267 - protein, 18 aa, Staphylococcus
LLNEHGSLTINEIAEAQG

SEQ ID NO: 2027268 - protein, 18 aa, Staphylococcus
LLNEKIINSPVQFIDEVS

SEQ ID NO: 2027269 - protein, 18 aa, Staphylococcus
LLNELPIFDDYVILTQQQ

SEQ ID NO: 2027270 - protein, 19 aa, Staphylococcus
LLNKVGRLIATIYMDEDLD

SEQ ID NO: 2027271 - protein, 18 aa, Staphylococcus
LLNLFRLHLSLFEKYSSD

SEQ ID NO: 2027272 - protein, 20 aa, Staphylococcus
LLNNEIFRSGEFNTKFLEKY

SEQ ID NO: 2027273 - protein, 24 aa, Staphylococcus
LLNNGRYSPVVFKIASENDIDLSS

SEQ ID NO: 2027274 - protein, 25 aa, Staphylococcus
LLNNLKRKYGKDINELITYKDKLQN

SEQ ID NO: 2027275 - protein, 25 aa, Staphylococcus
LLNNLKRKYGKDIQDLIQYQDKLIN

SEQ ID NO: 2027276 - protein, 25 aa, Staphylococcus
LLNNLKRKYGKNIDELITYQSKLEN

SEQ ID NO: 2027277 - protein, 23 aa, Staphylococcus
LLNNLRFSKMFFSSNGVKDGVAM

SEQ ID NO: 2027278 - protein, 17 aa, Staphylococcus
LLNQLNLKVEDVGSETL

SEQ ID NO: 2027279 - protein, 26 aa, Staphylococcus
LLNRAGKIPFVISCQGQEAAQIGMAF

SEQ ID NO: 2027280 - protein, 25 aa, Staphylococcus
LLNRAGKIPFVISCQGQEATQIGMA

SEQ ID NO: 2027281 - protein, 18 aa, Staphylococcus
LLNRRKFAGYDTHVTDIL

SEQ ID NO: 2027282 - protein, 18 aa, Staphylococcus
LLNSSAYYRYMSVRIGAI

SEQ ID NO: 2027283 - protein, 17 aa, Staphylococcus
LLNSSWQDSEIVMHKDV

SEQ ID NO: 2027284 - protein, 20 aa, Staphylococcus
LLNTWQLDASELMAFGDANN

SEQ ID NO: 2027285 - protein, 23 aa, Staphylococcus
LLNVKSNMIFSGYVNQSVVLPET

SEQ ID NO: 2027286 - protein, 20 aa, Staphylococcus
LLNWSDTVSDLFTLIHEFGH

SEQ ID NO: 2027287 - protein, 27 aa, Staphylococcus
LLNYPETCPHGGVIPRNYIYKEKYNDS

SEQ ID NO: 2027288 - protein, 21 aa, Staphylococcus
LLPDMSNPFFTIVAKGVEDTA

SEQ ID NO: 2027289 - protein, 22 aa, Staphylococcus
LLPEELREVAPLTEDFFAVYGG

SEQ ID NO: 2027290 - protein, 19 aa, Staphylococcus
LLPEGRMIFNIPIRTIEYR

SEQ ID NO: 2027291 - protein, 17 aa, Staphylococcus
LLPEIPHVAVFDTSFHQ

SEQ ID NO: 2027292 - protein, 30 aa, Staphylococcus
LLPESERRAVWAVYAVCRIIDDSIDEEQNP

SEQ ID NO: 2027293 - protein, 18 aa, Staphylococcus
LLPIIPNIHNYRSALYIK

SEQ ID NO: 2027294 - protein, 23 aa, Staphylococcus
LLPKGFPDTFGYRKSDGKFIAIE

SEQ ID NO: 2027295 - protein, 25 aa, Staphylococcus
LLPSILAYNFAMLWNGNNVAYESSP

SEQ ID NO: 2027296 - protein, 17 aa, Staphylococcus
LLPTATYQIEYKAQSSG

SEQ ID NO: 2027297 - protein, 18 aa, Staphylococcus
LLPTHNWGNYKLVFNTRH

SEQ ID NO: 2027298 - protein, 25 aa, Staphylococcus
LLQFFRIQFKYIYRYQRFFHAVFIS

SEQ ID NO: 2027299 - protein, 19 aa, Staphylococcus
LLQHYDDLATMLSIYGKNL

SEQ ID NO: 2027300 - protein, 22 aa, Staphylococcus
LLQKCTELGASHFIPVQMDRSI

SEQ ID NO: 2027301 - protein, 24 aa, Staphylococcus
LLQKEYRRDASIIKSEYPRLSDSE

SEQ ID NO: 2027302 - protein, 19 aa, Staphylococcus
LLQLEGVNMSALYRPKYST

SEQ ID NO: 2027303 - protein, 19 aa, Staphylococcus
LLQLLQFISDLNMHPIFKV

SEQ ID NO: 2027304 - protein, 25 aa, Staphylococcus
LLQLPKLGAINVHASLLPKYRGGAP

SEQ ID NO: 2027305 - protein, 22 aa, Staphylococcus
LLQLYGFVPLKIVKLLYDKYFD

SEQ ID NO: 2027306 - protein, 18 aa, Staphylococcus
LLQNFKINVLCCTPTEYR

SEQ ID NO: 2027307 - protein, 24 aa, Staphylococcus
LLQRAKVVVIVLDLKQVLTTGQIW

SEQ ID NO: 2027308 - protein, 25 aa, Staphylococcus
LLQRGEIQGEFVLRQQIAHYLFNSR

SEQ ID NO: 2027309 - protein, 25 aa, Staphylococcus
LLRELRPLIFRKIGYITSNQFDIED

SEQ ID NO: 2027310 - protein, 23 aa, Staphylococcus
LLREVIEDYTVLRGFKPYYIENG

SEQ ID NO: 2027311 - protein, 31 aa, Staphylococcus
LLREVIENYTVLRGFKPYYIENGAFSGALGA

SEQ ID NO: 2027312 - protein, 18 aa, Staphylococcus
LLRGNMKPYSGYRQIDSE

SEQ ID NO: 2027313 - protein, 18 aa, Staphylococcus
LLRGVAREDVQRGQVLAA

SEQ ID NO: 2027314 - protein, 17 aa, Staphylococcus
LLRKLQLKLEIINNSIG

SEQ ID NO: 2027315 - protein, 20 aa, Staphylococcus
LLRMHYLIANALDLHGYDDF

SEQ ID NO: 2027316 - protein, 22 aa, Staphylococcus
LLRMHYLIANALDLSGYEDFAI

SEQ ID NO: 2027317 - protein, 22 aa, Staphylococcus
LLRMHYLIANALDLTGYDDFAI

SEQ ID NO: 2027318 - protein, 20 aa, Staphylococcus
LLRMYQRYGEQQGFKIETID

SEQ ID NO: 2027319 - protein, 20 aa, Staphylococcus
LLRMYQRYGEQQGFKVETVD

SEQ ID NO: 2027320 - protein, 25 aa, Staphylococcus
LLRNKSDIFFSKWHRELTALKHIKK

SEQ ID NO: 2027321 - protein, 18 aa, Staphylococcus
LLRQLNRNIKFIFLDFIS

SEQ ID NO: 2027322 - protein, 25 aa, Staphylococcus
LLRQLNYPIKFVFLDFIQSENIQTL

SEQ ID NO: 2027323 - protein, 20 aa, Staphylococcus
LLRRYFESTNEKIVFVNNSG

SEQ ID NO: 2027324 - protein, 28 aa, Staphylococcus
LLRTFSKAYGLAGLRVGYVIATNEAIDK

SEQ ID NO: 2027325 - protein, 28 aa, Staphylococcus
LLRTFSKAYGLAGLRVGYVVATNEAIEK

SEQ ID NO: 2027326 - protein, 18 aa, Staphylococcus
LLSAVLMLEHLGWQEAAD

SEQ ID NO: 2027327 - protein, 18 aa, Staphylococcus
LLSGGERALSAIALLFAI

SEQ ID NO: 2027328 - protein, 39 aa, Staphylococcus
LLSGGERALSAIALLFAILKVRSAPFVILDEVEAALDEA

SEQ ID NO: 2027329 - protein, 18 aa, Staphylococcus
LLSGISITNQDNMQETVE

SEQ ID NO: 2027330 - protein, 17 aa, Staphylococcus
LLSGLGIPAELHDKKMS

SEQ ID NO: 2027331 - protein, 17 aa, Staphylococcus
LLSGLGISADLHDKQMS

SEQ ID NO: 2027332 - protein, 17 aa, Staphylococcus
LLSGLGISTDLHDKKMA

SEQ ID NO: 2027333 - protein, 17 aa, Staphylococcus
LLSGLGITPDLHDKQMS

SEQ ID NO: 2027334 - protein, 19 aa, Staphylococcus
LLSGLPWQSVMAGDNETYH

SEQ ID NO: 2027335 - protein, 18 aa, Staphylococcus
LLSKDNPVEFIAIASGKG

SEQ ID NO: 2027336 - protein, 19 aa, Staphylococcus
LLSKDNPVEFIAIASGKGG

SEQ ID NO: 2027337 - protein, 18 aa, Staphylococcus
LLSKDNPVEFIAVASGKG

SEQ ID NO: 2027338 - protein, 20 aa, Staphylococcus
LLSPACASWDQYNTFEERGE

SEQ ID NO: 2027339 - protein, 20 aa, Staphylococcus
LLSPACASWDQYNTFEERGN

SEQ ID NO: 2027340 - protein, 20 aa, Staphylococcus
LLSPACASWDQYQTFEERGD

SEQ ID NO: 2027341 - protein, 23 aa, Staphylococcus
LLSREQIDAMRIIKNEGKVTINE

SEQ ID NO: 2027342 - protein, 29 aa, Staphylococcus
LLSTKFKLPKWMFKPFKNHSLKKHREISY

SEQ ID NO: 2027343 - protein, 17 aa, Staphylococcus
LLSTLSCDVNPIPIKAL

SEQ ID NO: 2027344 - protein, 19 aa, Staphylococcus
LLSYRRSALDMKQMQKNIT

SEQ ID NO: 2027345 - protein, 24 aa, Staphylococcus
LLTDARIFKVFKYFYTHRGPVMDF

SEQ ID NO: 2027346 - protein, 24 aa, Staphylococcus
LLTDLSRIFLRAAQEALSKSYEIF

SEQ ID NO: 2027347 - protein, 25 aa, Staphylococcus
LLTEFGVWHPHAWDYAPKPITFPSN

SEQ ID NO: 2027348 - protein, 18 aa, Staphylococcus
LLTEIYKVTGIYKDCTIS

SEQ ID NO: 2027349 - protein, 17 aa, Staphylococcus
LLTGKDVAYACALGAEE

SEQ ID NO: 2027350 - protein, 19 aa, Staphylococcus
LLTGLPWQSVMSADNKMYH

SEQ ID NO: 2027351 - protein, 20 aa, Staphylococcus
LLTHFPVAYFTLFTSSMTVK

SEQ ID NO: 2027352 - protein, 17 aa, Staphylococcus
LLTHYTIMNELKVNLLD

SEQ ID NO: 2027353 - protein, 45 aa, Staphylococcus
LLTKKLESMVDNKSQFAFLNLMKHMFKNEAYRFLATGQLEQIDQV

SEQ ID NO: 2027354 - protein, 24 aa, Staphylococcus
LLTKLKETFSLLVNDTAKSVEINK

SEQ ID NO: 2027355 - protein, 18 aa, Staphylococcus
LLTMSGNRYQLIRREAIS

SEQ ID NO: 2027356 - protein, 18 aa, Staphylococcus
LLTNDIFQSGLFNTKFLE

SEQ ID NO: 2027357 - protein, 19 aa, Staphylococcus
LLTPLVSVVPLQLISYYAA

SEQ ID NO: 2027358 - protein, 20 aa, Staphylococcus
LLTRLRANKDLKNIPIHFAI

SEQ ID NO: 2027359 - protein, 23 aa, Staphylococcus
LLTVNTGHAFLAYAGHFENKATI

SEQ ID NO: 2027360 - protein, 23 aa, Staphylococcus
LLTVNTGHAFLAYAGYNDNKATV

SEQ ID NO: 2027361 - protein, 24 aa, Staphylococcus
LLVAVERLYPFPADEIDALLSELP

SEQ ID NO: 2027362 - protein, 24 aa, Staphylococcus
LLVAVERLYPFPVEEVREVINSLP

SEQ ID NO: 2027363 - protein, 23 aa, Staphylococcus
LLVDYKPSLSILKNVVVGLQNSI

SEQ ID NO: 2027364 - protein, 18 aa, Staphylococcus
LLVPSYIDDNGYRYYHSQ

SEQ ID NO: 2027365 - protein, 25 aa, Staphylococcus
LLVQGRTTAYFNIGGLWIALNEEQN

SEQ ID NO: 2027366 - protein, 19 aa, Staphylococcus
LLVQWYSKGIYKFKFEILQ

SEQ ID NO: 2027367 - protein, 24 aa, Staphylococcus
LLVYKAAGAAADFGYDLEEVRRIA

SEQ ID NO: 2027368 - protein, 19 aa, Staphylococcus
LLVYMKFKSGLDVSTQQLA

SEQ ID NO: 2027369 - protein, 22 aa, Staphylococcus
LLWASCREVINVIQADEIGADI

SEQ ID NO: 2027370 - protein, 22 aa, Staphylococcus
LLWASCREVINVIQADEVGADI

SEQ ID NO: 2027371 - protein, 20 aa, Staphylococcus
LLWEDIEAFDDEQLIQFKQI

SEQ ID NO: 2027372 - protein, 23 aa, Staphylococcus
LLYAIDWSSLRLVPTEERQTIVD

SEQ ID NO: 2027373 - protein, 18 aa, Staphylococcus
LLYATGIRVSELVHIKTQ

SEQ ID NO: 2027374 - protein, 21 aa, Staphylococcus
LLYDFGYKYLETVEDFKYTSL

SEQ ID NO: 2027375 - protein, 23 aa, Staphylococcus
LLYKGEASVGHITHTLKLTQSNV

SEQ ID NO: 2027376 - protein, 21 aa, Staphylococcus
LLYNRRFQVDKAVILAATDKT

SEQ ID NO: 2027377 - protein, 25 aa, Staphylococcus
LLYQHLIKGFSVYTVIRAECSKSAR

SEQ ID NO: 2027378 - protein, 19 aa, Staphylococcus
LLYQYDKIHLVPMLDEHLF

SEQ ID NO: 2027379 - protein, 30 aa, Staphylococcus
LMAAAFKTGIIFLPINWRLNPKEIAGIVED

SEQ ID NO: 2027380 - protein, 18 aa, Staphylococcus
LMAAIGIGGGMGIASLFE

SEQ ID NO: 2027381 - protein, 26 aa, Staphylococcus
LMASGLPSYIYTFLGFLPRKSKEKTA

SEQ ID NO: 2027382 - protein, 24 aa, Staphylococcus
LMCAQLWPHFDLFSQFLNDKIILT

SEQ ID NO: 2027383 - protein, 18 aa, Staphylococcus
LMCDIIEAFIDAKYKPTE

SEQ ID NO: 2027384 - protein, 18 aa, Staphylococcus
LMDAKKFKKSNKVTVPEL

SEQ ID NO: 2027385 - protein, 31 aa, Staphylococcus
LMDYGKSRLKGEHFGDFVIRSGVVAKVHDGR

SEQ ID NO: 2027386 - protein, 26 aa, Staphylococcus
LMEAFWPGPISFILPLKSGYLCPKVT

SEQ ID NO: 2027387 - protein, 23 aa, Staphylococcus
LMEDFKKANPFTRFIRSKATLNG

SEQ ID NO: 2027388 - protein, 26 aa, Staphylococcus
LMEFTGASLEEVWRTTSLNQAIALDI

SEQ ID NO: 2027389 - protein, 19 aa, Staphylococcus
LMEKEIKYIGGVVENPDKP

SEQ ID NO: 2027390 - protein, 17 aa, Staphylococcus
LMFNTLRAMYEKHPIRV

SEQ ID NO: 2027391 - protein, 18 aa, Staphylococcus
LMFQHGVTVYELSMQSAN

SEQ ID NO: 2027392 - protein, 17 aa, Staphylococcus
LMFSNLIIRHKGLLNTW

SEQ ID NO: 2027393 - protein, 25 aa, Staphylococcus
LMGAGRSEIMRVLFGLDKGQMQVTL

SEQ ID NO: 2027394 - protein, 17 aa, Staphylococcus
LMGCYGIGVSRTLSAIV

SEQ ID NO: 2027395 - protein, 17 aa, Staphylococcus
LMGLELIENQPLFEAIV

SEQ ID NO: 2027396 - protein, 32 aa, Staphylococcus
LMGLTLDFDKFPGFKCYRFLKPDKGTTYKIYF

SEQ ID NO: 2027397 - protein, 18 aa, Staphylococcus
LMHYHHRISEAEMKKAQD

SEQ ID NO: 2027398 - protein, 25 aa, Staphylococcus
LMHYLFEIIDPYSLNKQGVDKGPKY

SEQ ID NO: 2027399 - protein, 23 aa, Staphylococcus
LMIATGRPYRASQIYYHELNMDT

SEQ ID NO: 2027400 - protein, 21 aa, Staphylococcus
LMIIEKLKLFLKEDNYLNDFI

SEQ ID NO: 2027401 - protein, 25 aa, Staphylococcus
LMIRFGSERLQKMMGRLGMDDSTPI

SEQ ID NO: 2027402 - protein, 19 aa, Staphylococcus
LMKAFKILKPHGTVVSING

SEQ ID NO: 2027403 - protein, 22 aa, Staphylococcus
LMKELGDYVIPHFPPNITKEEQ

SEQ ID NO: 2027404 - protein, 23 aa, Staphylococcus
LMKKNFIEYLLFQYKFKSRISVW

SEQ ID NO: 2027405 - protein, 18 aa, Staphylococcus
LMKSTAYLINAGRGPIVN

SEQ ID NO: 2027406 - protein, 19 aa, Staphylococcus
LMKTHIFSAFSTLKIGIDL

SEQ ID NO: 2027407 - protein, 32 aa, Staphylococcus
LMKYLKQRHIPMAIATSSYKKDIFPVFKSLGL

SEQ ID NO: 2027408 - protein, 25 aa, Staphylococcus
LMKYREIMYQFTLSEIKAIYTDTFD

SEQ ID NO: 2027409 - protein, 19 aa, Staphylococcus
LMLANEVRSIRAYENKKQQ

SEQ ID NO: 2027410 - protein, 24 aa, Staphylococcus
LMLEFQKNGAVAFDYGNNIRQVAY

SEQ ID NO: 2027411 - protein, 19 aa, Staphylococcus
LMLEFQKQGAVAFDYGNNI

SEQ ID NO: 2027412 - protein, 18 aa, Staphylococcus
LMLGKADIAFSLNKGRAA

SEQ ID NO: 2027413 - protein, 23 aa, Staphylococcus
LMLKKVSYKWFNIINETMRDTSQ

SEQ ID NO: 2027414 - protein, 22 aa, Staphylococcus
LMLKKVTYRWYNLIVEKMKETM

SEQ ID NO: 2027415 - protein, 17 aa, Staphylococcus
LMLPEEVIKQAIEESDV

SEQ ID NO: 2027416 - protein, 26 aa, Staphylococcus
LMLRLIRPKFFMPIHGEYRMLKAHSQ

SEQ ID NO: 2027417 - protein, 27 aa, Staphylococcus
LMLRLLRPKFFLPIHGEYRMLKAHGQS

SEQ ID NO: 2027418 - protein, 18 aa, Staphylococcus
LMMEGNLIVTLQFLFIPP

SEQ ID NO: 2027419 - protein, 25 aa, Staphylococcus
LMMQEAMKGLRVFNQNTKLIAVTQL

SEQ ID NO: 2027420 - protein, 17 aa, Staphylococcus
LMNALKTARTYDLHFFT

SEQ ID NO: 2027421 - protein, 18 aa, Staphylococcus
LMNEESWMSAQDAVDLGF

SEQ ID NO: 2027422 - protein, 21 aa, Staphylococcus
LMNGHITLPVLLEMKKDPVFK

SEQ ID NO: 2027423 - protein, 24 aa, Staphylococcus
LMNHLRLAKYQDIMLITNDTDWHV

SEQ ID NO: 2027424 - protein, 17 aa, Staphylococcus
LMNHLVSISIDYVVAQV

SEQ ID NO: 2027425 - protein, 25 aa, Staphylococcus
LMNHPNELIPLTFFVKKFKQAKSSI

SEQ ID NO: 2027426 - protein, 25 aa, Staphylococcus
LMNHPNKLIPLTFFVKKFKQAKSSI

SEQ ID NO: 2027427 - protein, 20 aa, Staphylococcus
LMNIKKWCQNTFQVTNQVSV

SEQ ID NO: 2027428 - protein, 22 aa, Staphylococcus
LMNLKHVVITAVARDDLRDQGS

SEQ ID NO: 2027429 - protein, 17 aa, Staphylococcus
LMNQLYCNYQYKGVVKQ

SEQ ID NO: 2027430 - protein, 27 aa, Staphylococcus
LMNRLTGRRICEKCGTTYHLVFNPPKV

SEQ ID NO: 2027431 - protein, 29 aa, Staphylococcus
LMPHEMREKIRVYLESRVKTFKVGGLFNK

SEQ ID NO: 2027432 - protein, 18 aa, Staphylococcus
LMPKCVYTYPEIASIGMN

SEQ ID NO: 2027433 - protein, 18 aa, Staphylococcus
LMPQSVGVMGYRLQGSTK

SEQ ID NO: 2027434 - protein, 17 aa, Staphylococcus
LMPSGTVIHDWRMLTTF

SEQ ID NO: 2027435 - protein, 21 aa, Staphylococcus
LMQFSDPYTLVIGPYYRGSNG

SEQ ID NO: 2027436 - protein, 26 aa, Staphylococcus
LMQHLNQRGGPWVKDVLRQIECAVIT

SEQ ID NO: 2027437 - protein, 24 aa, Staphylococcus
LMQYAERTLKRFIGPLRARTAGPA

SEQ ID NO: 2027438 - protein, 21 aa, Staphylococcus
LMRINPELIYQAWTDADVMRR

SEQ ID NO: 2027439 - protein, 18 aa, Staphylococcus
LMRQRYILGKAYVINEES

SEQ ID NO: 2027440 - protein, 18 aa, Staphylococcus
LMRYMHPYLTTIIQPISQ

SEQ ID NO: 2027441 - protein, 19 aa, Staphylococcus
LMSGYLIAYPEYIRRSELH

SEQ ID NO: 2027442 - protein, 19 aa, Staphylococcus
LMSHLFKAKEYIQIDTKIQ

SEQ ID NO: 2027443 - protein, 25 aa, Staphylococcus
LMSRVRRYPLPLALEVSNVESVMPG

SEQ ID NO: 2027444 - protein, 24 aa, Staphylococcus
LMSRVRRYPLPLVLEISNLESVMP

SEQ ID NO: 2027445 - protein, 25 aa, Staphylococcus
LMSRVRRYPLPLVLEVSNLDSVMPG

SEQ ID NO: 2027446 - protein, 25 aa, Staphylococcus
LMTEARALKVFKYFYTHRGPVMDYS

SEQ ID NO: 2027447 - protein, 17 aa, Staphylococcus
LMTHASIPKDIREKEGI

SEQ ID NO: 2027448 - protein, 17 aa, Staphylococcus
LMTKYQFEYGTDVPKIF

SEQ ID NO: 2027449 - protein, 26 aa, Staphylococcus
LMTNELYRFPIMYLEYSGEYGDVEKV

SEQ ID NO: 2027450 - protein, 20 aa, Staphylococcus
LMTPDYYALLDFSKCNSLKN

SEQ ID NO: 2027451 - protein, 24 aa, Staphylococcus
LMTVKHVVRESGMRKEDIKLISFS

SEQ ID NO: 2027452 - protein, 20 aa, Staphylococcus
LMVNYCLQVADILAEDGINV

SEQ ID NO: 2027453 - protein, 20 aa, Staphylococcus
LMVVHPWQFEHILLSQYQQE

SEQ ID NO: 2027454 - protein, 18 aa, Staphylococcus
LMYGLPWQSVMAGDNEMY

SEQ ID NO: 2027455 - protein, 22 aa, Staphylococcus
LMYPNEAMIKLSYINLDDYKNQ

SEQ ID NO: 2027456 - protein, 18 aa, Staphylococcus
LNAARYGEHTVYIPSGTY

SEQ ID NO: 2027457 - protein, 19 aa, Staphylococcus
LNAGDVIKGKVARLTNFGA

SEQ ID NO: 2027458 - protein, 19 aa, Staphylococcus
LNALDLRMEPKFVSDIIPV

SEQ ID NO: 2027459 - protein, 23 aa, Staphylococcus
LNALKRGESIIVVDDEDRENEGD

SEQ ID NO: 2027460 - protein, 17 aa, Staphylococcus
LNALVTLAQFGHATEML

SEQ ID NO: 2027461 - protein, 21 aa, Staphylococcus
LNANIQKSEWVQNYIYGKDVI

SEQ ID NO: 2027462 - protein, 25 aa, Staphylococcus
LNANYIKARLKDHFEIPYDQYCKHE

SEQ ID NO: 2027463 - protein, 26 aa, Staphylococcus
LNANYIKARLKDHFEIPYPQYCKHEF

SEQ ID NO: 2027464 - protein, 18 aa, Staphylococcus
LNAPKLGAINVHASLLPK

SEQ ID NO: 2027465 - protein, 21 aa, Staphylococcus
LNARLAHSMDFLKENEHERHN

SEQ ID NO: 2027466 - protein, 18 aa, Staphylococcus
LNASFLPLAHERLDDDGQ

SEQ ID NO: 2027467 - protein, 25 aa, Staphylococcus
LNASGIKVGMIHGGLTPRERKQQMK

SEQ ID NO: 2027468 - protein, 19 aa, Staphylococcus
LNAVDAWALNHNIRRLEAV

SEQ ID NO: 2027469 - protein, 22 aa, Staphylococcus
LNAVLWLIKKLHSHRKQIKKGQ

SEQ ID NO: 2027470 - protein, 20 aa, Staphylococcus
LNCGYPRVRYLMDKQSDKHY

SEQ ID NO: 2027471 - protein, 27 aa, Staphylococcus
LNDAKACAMITFRLLKHYDDLPSMLNI

SEQ ID NO: 2027472 - protein, 25 aa, Staphylococcus
LNDAKACAMITFRLLKNYDSLNDML

SEQ ID NO: 2027473 - protein, 25 aa, Staphylococcus
LNDAVRRILGLKAKIHLPKKQAQGT

SEQ ID NO: 2027474 - protein, 20 aa, Staphylococcus
LNDAWAIVGNTGWYDYSYAS

SEQ ID NO: 2027475 - protein, 17 aa, Staphylococcus
LNDCRYFGKTYINFEDW

SEQ ID NO: 2027476 - protein, 19 aa, Staphylococcus
LNDELKVNLIELNSAKQLF

SEQ ID NO: 2027477 - protein, 25 aa, Staphylococcus
LNDERRLVPAITYLDGEYGFKDICL

SEQ ID NO: 2027478 - protein, 24 aa, Staphylococcus
LNDFAFKGTESMTIEPTKDEVASF

SEQ ID NO: 2027479 - protein, 17 aa, Staphylococcus
LNDFLGINYYMSDWMRG

SEQ ID NO: 2027480 - protein, 22 aa, Staphylococcus
LNDFPDLHIILFGDEKQCNIKH

SEQ ID NO: 2027481 - protein, 24 aa, Staphylococcus
LNDIKVIFENGGLIAIPTETVYGL

SEQ ID NO: 2027482 - protein, 25 aa, Staphylococcus
LNDLFIKKFIEIYLNKSSVEMDDSF

SEQ ID NO: 2027483 - protein, 23 aa, Staphylococcus
LNDNDIYRLLSLLENDIDTMQFS

SEQ ID NO: 2027484 - protein, 18 aa, Staphylococcus
LNDQLFLVAEEDGEIVGF

SEQ ID NO: 2027485 - protein, 23 aa, Staphylococcus
LNDRVSLSIKNNWIDDNGDIYFI

SEQ ID NO: 2027486 - protein, 24 aa, Staphylococcus
LNDRVSLSIKNNWIDQNGDIYFIF

SEQ ID NO: 2027487 - protein, 25 aa, Staphylococcus
LNDRYKMIILRKGRGLAGMVMKTGK

SEQ ID NO: 2027488 - protein, 24 aa, Staphylococcus
LNDVDKLCEFASLVEVLAATDSDS

SEQ ID NO: 2027489 - protein, 19 aa, Staphylococcus
LNDYAKIIMSHNVTSQVRR

SEQ ID NO: 2027490 - protein, 19 aa, Staphylococcus
LNDYATCFMYTVPFENINV

SEQ ID NO: 2027491 - protein, 19 aa, Staphylococcus
LNDYGKIIMSHNVTSQVRR

SEQ ID NO: 2027492 - protein, 25 aa, Staphylococcus
LNEALKFKINASLIKSKNDYISLGL

SEQ ID NO: 2027493 - protein, 22 aa, Staphylococcus
LNEANYSIAEWSNVNAQTTQLI

SEQ ID NO: 2027494 - protein, 18 aa, Staphylococcus
LNEDKAWMQEMIKGDTPP

SEQ ID NO: 2027495 - protein, 22 aa, Staphylococcus
LNEFDKIIGVDRIKVVHVNDSK

SEQ ID NO: 2027496 - protein, 17 aa, Staphylococcus
LNEGEAILAKKGAVKLI

SEQ ID NO: 2027497 - protein, 18 aa, Staphylococcus
LNEGRIHLANGPRLILQS

SEQ ID NO: 2027498 - protein, 20 aa, Staphylococcus
LNEIGVRYVDVSGRGGTNFV

SEQ ID NO: 2027499 - protein, 22 aa, Staphylococcus
LNEIYDLPGHVFIFGGQTLFEE

SEQ ID NO: 2027500 - protein, 19 aa, Staphylococcus
LNEKIKWNFTKFLVDREGN

SEQ ID NO: 2027501 - protein, 23 aa, Staphylococcus
LNELKELGQMYGFDLSRPATNFK

SEQ ID NO: 2027502 - protein, 17 aa, Staphylococcus
LNELKKYRGQLVDQEAF

SEQ ID NO: 2027503 - protein, 24 aa, Staphylococcus
LNELRDEIIFSMGHTVATFEEANE

SEQ ID NO: 2027504 - protein, 22 aa, Staphylococcus
LNELRQKMGMVFQNFNLFPHKT

SEQ ID NO: 2027505 - protein, 26 aa, Staphylococcus
LNELSHNMPVFFSANMSYGVHALTKI

SEQ ID NO: 2027506 - protein, 22 aa, Staphylococcus
LNELSIPVCIIVGERDEKFVNI

SEQ ID NO: 2027507 - protein, 18 aa, Staphylococcus
LNELSQVRPLRIMSQHAV

SEQ ID NO: 2027508 - protein, 21 aa, Staphylococcus
LNELVRAGAYIIPNNKKIHAS

SEQ ID NO: 2027509 - protein, 18 aa, Staphylococcus
LNEQGLSIAVLYYSGEAS

SEQ ID NO: 2027510 - protein, 21 aa, Staphylococcus
LNERFVITRGLDKCLFGYTLE

SEQ ID NO: 2027511 - protein, 18 aa, Staphylococcus
LNESELIALFLTLQESQS

SEQ ID NO: 2027512 - protein, 22 aa, Staphylococcus
LNESGLAFVLPSSMKKYVPKDC

SEQ ID NO: 2027513 - protein, 33 aa, Staphylococcus
LNEVNPMLGHRGCRLAITYPELYIMQAEAIIES

SEQ ID NO: 2027514 - protein, 22 aa, Staphylococcus
LNFELGQNVSFGIHSKDAHYFH

SEQ ID NO: 2027515 - protein, 17 aa, Staphylococcus
LNFKESVLKNMKASIIA

SEQ ID NO: 2027516 - protein, 17 aa, Staphylococcus
LNFKSIGSFNIRNSVKR

SEQ ID NO: 2027517 - protein, 18 aa, Staphylococcus
LNFLSVLFDNNFLKNKLQ

SEQ ID NO: 2027518 - protein, 17 aa, Staphylococcus
LNFSSTDILHFCSVDLV

SEQ ID NO: 2027519 - protein, 19 aa, Staphylococcus
LNFTEFSTQVIKSFESSAA

SEQ ID NO: 2027520 - protein, 24 aa, Staphylococcus
LNFTPRRVKAPSTVQVQHIDFGIE

SEQ ID NO: 2027521 - protein, 17 aa, Staphylococcus
LNFVNTKIDAVVIQLST

SEQ ID NO: 2027522 - protein, 24 aa, Staphylococcus
LNFVQENKIEWVVVGPEQPLIDGL

SEQ ID NO: 2027523 - protein, 24 aa, Staphylococcus
LNGAAIKSGMQFDFYETVNGNLGY

SEQ ID NO: 2027524 - protein, 18 aa, Staphylococcus
LNGAMGVEKIFNSYLNGT

SEQ ID NO: 2027525 - protein, 17 aa, Staphylococcus
LNGDQALAVARTRHQDS

SEQ ID NO: 2027526 - protein, 18 aa, Staphylococcus
LNGFKTTKAIDWSSITTD

SEQ ID NO: 2027527 - protein, 20 aa, Staphylococcus
LNGKIFKVKDMIPGVNAPPM

SEQ ID NO: 2027528 - protein, 17 aa, Staphylococcus
LNGKLHGIALRVPTQNV

SEQ ID NO: 2027529 - protein, 17 aa, Staphylococcus
LNGKRIIHPDAKHVIDS

SEQ ID NO: 2027530 - protein, 20 aa, Staphylococcus
LNGKVFKVKDMVPGINAPPM

SEQ ID NO: 2027531 - protein, 26 aa, Staphylococcus
LNGLKKWLTPVELWKHHQMTLEVGDD

SEQ ID NO: 2027532 - protein, 25 aa, Staphylococcus
LNGLKRNIVHMGHFNAGEAINTVPS

SEQ ID NO: 2027533 - protein, 26 aa, Staphylococcus
LNGPKARLKLLIGLSNHMNHKELKEY

SEQ ID NO: 2027534 - protein, 26 aa, Staphylococcus
LNGPKARLKLLVGLSNDLTFKQLKRY

SEQ ID NO: 2027535 - protein, 24 aa, Staphylococcus
LNGPLDLTFIFGLVDHLSHKLKYL

SEQ ID NO: 2027536 - protein, 24 aa, Staphylococcus
LNGPLDLTFIFGLVDHLSHKLNYL

SEQ ID NO: 2027537 - protein, 24 aa, Staphylococcus
LNGPLDLTFLFGLVDHLSNKLKYL

SEQ ID NO: 2027538 - protein, 19 aa, Staphylococcus
LNGQGKLDVRRAVGTNGSI

SEQ ID NO: 2027539 - protein, 26 aa, Staphylococcus
LNGQKARLKLLVAISNHLNKNQLKSY

SEQ ID NO: 2027540 - protein, 17 aa, Staphylococcus
LNHEVQRLYVFTKAASS

SEQ ID NO: 2027541 - protein, 37 aa, Staphylococcus
LNHFKSLGLNSNWDMLFIVFSIHFIHILKELSKGDRE

SEQ ID NO: 2027542 - protein, 19 aa, Staphylococcus
LNHGYRVAIGEGEMDEAPM

SEQ ID NO: 2027543 - protein, 17 aa, Staphylococcus
LNHIRSRVKLETDGKLL

SEQ ID NO: 2027544 - protein, 24 aa, Staphylococcus
LNHMKTLIELGADAFVIGEQKFGL

SEQ ID NO: 2027545 - protein, 22 aa, Staphylococcus
LNHPVLCANILDSKQQPFTGEG

SEQ ID NO: 2027546 - protein, 20 aa, Staphylococcus
LNHREGRRIAVIVNDMSEVN

SEQ ID NO: 2027547 - protein, 29 aa, Staphylococcus
LNIADKILIGGGMAYTFLKAQGKEIGLSL

SEQ ID NO: 2027548 - protein, 17 aa, Staphylococcus
LNIAFTPNLPKSLKESV

SEQ ID NO: 2027549 - protein, 37 aa, Staphylococcus
LNICRRMLLLMLAWDKGYKFDFQVNFGKSFKYLPNYL

SEQ ID NO: 2027550 - protein, 26 aa, Staphylococcus
LNIDPARILFGAGLDEVILMISRAVL

SEQ ID NO: 2027551 - protein, 19 aa, Staphylococcus
LNIDVELRLLKYKFQDETV

SEQ ID NO: 2027552 - protein, 20 aa, Staphylococcus
LNIDVELRLLKYQKESSELV

SEQ ID NO: 2027553 - protein, 21 aa, Staphylococcus
LNIEAGEFVAFIGTSGSGKTT

SEQ ID NO: 2027554 - protein, 18 aa, Staphylococcus
LNIEQCVKDSDLVIGAVL

SEQ ID NO: 2027555 - protein, 17 aa, Staphylococcus
LNIHPSLLPKYKGKDAI

SEQ ID NO: 2027556 - protein, 17 aa, Staphylococcus
LNIIGLINIQFVIAHDG

SEQ ID NO: 2027557 - protein, 18 aa, Staphylococcus
LNIIQLIWNDGRYNMVEF

SEQ ID NO: 2027558 - protein, 18 aa, Staphylococcus
LNIKDKYLLMNYEVLSED

SEQ ID NO: 2027559 - protein, 20 aa, Staphylococcus
LNIMFPMVATIKEFRDAKAM

SEQ ID NO: 2027560 - protein, 31 aa, Staphylococcus
LNIMFPMVATIQEFRDAKALLEEERANLKNE

SEQ ID NO: 2027561 - protein, 32 aa, Staphylococcus
LNIMFPMVATIQEFRDAKALLLEEKDNLTNEG

SEQ ID NO: 2027562 - protein, 17 aa, Staphylococcus
LNIMGINTAEEFNERLN

SEQ ID NO: 2027563 - protein, 18 aa, Staphylococcus
LNIMGINTAEEFSERLND

SEQ ID NO: 2027564 - protein, 18 aa, Staphylococcus
LNIMGINTAEEFSERLNE

SEQ ID NO: 2027565 - protein, 18 aa, Staphylococcus
LNINKALDVMAFNNDLPN

SEQ ID NO: 2027566 - protein, 25 aa, Staphylococcus
LNIPELRKRIKLVAEQNYGQIRSIE

SEQ ID NO: 2027567 - protein, 25 aa, Staphylococcus
LNIPELRKRVKLVAEHNYDQIKSIE

SEQ ID NO: 2027568 - protein, 23 aa, Staphylococcus
LNIPELRTRIKTVAKENYESIRS

SEQ ID NO: 2027569 - protein, 17 aa, Staphylococcus
LNIPFIANHEINIVGIF

SEQ ID NO: 2027570 - protein, 17 aa, Staphylococcus
LNIPSWQLLYDTLLVIE

SEQ ID NO: 2027571 - protein, 17 aa, Staphylococcus
LNISAPVGGFKLENTEN

SEQ ID NO: 2027572 - protein, 17 aa, Staphylococcus
LNISRVGLYLTNSINSV

SEQ ID NO: 2027573 - protein, 24 aa, Staphylococcus
LNITIPVAIHLDHGSSFDKCKEAI

SEQ ID NO: 2027574 - protein, 23 aa, Staphylococcus
LNITIPVAIHLDHGSSFEKCKEA

SEQ ID NO: 2027575 - protein, 22 aa, Staphylococcus
LNKAFEKWLYPKKVYERDFRKV

SEQ ID NO: 2027576 - protein, 25 aa, Staphylococcus
LNKAFSEKQYHEWFHQISNQIAQFE

SEQ ID NO: 2027577 - protein, 17 aa, Staphylococcus
LNKARLISVGLGNSNTL

SEQ ID NO: 2027578 - protein, 19 aa, Staphylococcus
LNKCLDSVEGTGCYISVSD

SEQ ID NO: 2027579 - protein, 27 aa, Staphylococcus
LNKDELRHLPSYFGLDFGYVNDPSAFI

SEQ ID NO: 2027580 - protein, 25 aa, Staphylococcus
LNKEGIKVGMIHGGLTPRERKQQMK

SEQ ID NO: 2027581 - protein, 23 aa, Staphylococcus
LNKESKAANWGIPNHILGDIDNA

SEQ ID NO: 2027582 - protein, 17 aa, Staphylococcus
LNKFEMEEALKGLTSTE

SEQ ID NO: 2027583 - protein, 19 aa, Staphylococcus
LNKIAFYQVCPIHKITALI

SEQ ID NO: 2027584 - protein, 17 aa, Staphylococcus
LNKIFNLEVSLKEFVQF

SEQ ID NO: 2027585 - protein, 22 aa, Staphylococcus
LNKKSLKFGPILLNNKNGIFIK

SEQ ID NO: 2027586 - protein, 18 aa, Staphylococcus
LNKLDFIHKGMLMLYDIE

SEQ ID NO: 2027587 - protein, 22 aa, Staphylococcus
LNKLNFSLSYIVNFNGFSNEDK

SEQ ID NO: 2027588 - protein, 18 aa, Staphylococcus
LNKLYIRDFEGLRIDTER

SEQ ID NO: 2027589 - protein, 24 aa, Staphylococcus
LNKNWPGLHIEPLQPPENMEVLIG

SEQ ID NO: 2027590 - protein, 18 aa, Staphylococcus
LNKQVNIAGTFNGVLNMN

SEQ ID NO: 2027591 - protein, 19 aa, Staphylococcus
LNKQWRYHYQIDPKLVPYI

SEQ ID NO: 2027592 - protein, 18 aa, Staphylococcus
LNKRQGRQLLKYLNAPKH

SEQ ID NO: 2027593 - protein, 24 aa, Staphylococcus
LNKSFSEKNYNEWFEQIESKQSQI

SEQ ID NO: 2027594 - protein, 19 aa, Staphylococcus
LNKTGNWLDSLKFLTKSLE

SEQ ID NO: 2027595 - protein, 20 aa, Staphylococcus
LNKVCGSGLKAIQLAYQSIV

SEQ ID NO: 2027596 - protein, 21 aa, Staphylococcus
LNKVGKLIASIYMDEKLDAVV

SEQ ID NO: 2027597 - protein, 21 aa, Staphylococcus
LNKVGKLIASIYMEEDLDAVV

SEQ ID NO: 2027598 - protein, 21 aa, Staphylococcus
LNKVGKLIASIYMEEQLDAVV

SEQ ID NO: 2027599 - protein, 18 aa, Staphylococcus
LNKVLKIKEDLLVYNDYF

SEQ ID NO: 2027600 - protein, 24 aa, Staphylococcus
LNKYKTLYLPTSDHWGVVVKKGDP

SEQ ID NO: 2027601 - protein, 18 aa, Staphylococcus
LNLAAALYIYNDHEMYYL

SEQ ID NO: 2027602 - protein, 19 aa, Staphylococcus
LNLAYSRLGKQVYELDHVT

SEQ ID NO: 2027603 - protein, 19 aa, Staphylococcus
LNLAYSRLGKQVYELDSLT

SEQ ID NO: 2027604 - protein, 21 aa, Staphylococcus
LNLDVRIASSLVFTSLNDFKN

SEQ ID NO: 2027605 - protein, 26 aa, Staphylococcus
LNLDYAPCHYLSMGMSNDYAIAVEEG

SEQ ID NO: 2027606 - protein, 19 aa, Staphylococcus
LNLDYLDLYLMHWPGTDEA

SEQ ID NO: 2027607 - protein, 19 aa, Staphylococcus
LNLEGAPFADIERTILKES

SEQ ID NO: 2027608 - protein, 21 aa, Staphylococcus
LNLELPLARILSEMEETGIYT

SEQ ID NO: 2027609 - protein, 18 aa, Staphylococcus
LNLERAFLSQNFYDVPSI

SEQ ID NO: 2027610 - protein, 19 aa, Staphylococcus
LNLFFSYRLEEGHTGRMLA

SEQ ID NO: 2027611 - protein, 19 aa, Staphylococcus
LNLGRKLGFELSTAKESRI

SEQ ID NO: 2027612 - protein, 17 aa, Staphylococcus
LNLILSRKLNVIKTSMN

SEQ ID NO: 2027613 - protein, 21 aa, Staphylococcus
LNLIQCLLKQADIYILDEPFS

SEQ ID NO: 2027614 - protein, 20 aa, Staphylococcus
LNLKKAHLLGHDMGGVIARE

SEQ ID NO: 2027615 - protein, 21 aa, Staphylococcus
LNLKRMVRPVHGIRNLSKKDM

SEQ ID NO: 2027616 - protein, 24 aa, Staphylococcus
LNLKTSGRMVGIISHVSELKQRIP

SEQ ID NO: 2027617 - protein, 17 aa, Staphylococcus
LNLLKQHFEVEMYNDEG

SEQ ID NO: 2027618 - protein, 17 aa, Staphylococcus
LNLLMAVLEKKESYLLQ

SEQ ID NO: 2027619 - protein, 24 aa, Staphylococcus
LNLNRIANFLTVYFNKHNQDMQHE

SEQ ID NO: 2027620 - protein, 18 aa, Staphylococcus
LNLQFFAEDGEGDSVKDN

SEQ ID NO: 2027621 - protein, 25 aa, Staphylococcus
LNLRRPGFLYYEFDVARRAIGYAKY

SEQ ID NO: 2027622 - protein, 17 aa, Staphylococcus
LNLYEKFEQRRKIYDDM

SEQ ID NO: 2027623 - protein, 17 aa, Staphylococcus
LNLYFPFIDVETMLTLL

SEQ ID NO: 2027624 - protein, 20 aa, Staphylococcus
LNLYQRGMKLSATCDETLKD

SEQ ID NO: 2027625 - protein, 17 aa, Staphylococcus
LNLYRKRGEGVYLDGPE

SEQ ID NO: 2027626 - protein, 17 aa, Staphylococcus
LNMHPIFKVSTSRPDVF

SEQ ID NO: 2027627 - protein, 19 aa, Staphylococcus
LNMMLNIASQGYKTSFFSL

SEQ ID NO: 2027628 - protein, 20 aa, Staphylococcus
LNNEYYYAIHFDDNVGEEVI

SEQ ID NO: 2027629 - protein, 19 aa, Staphylococcus
LNNGLKLFIIPKKGFQKTF

SEQ ID NO: 2027630 - protein, 18 aa, Staphylococcus
LNNIISFEQHKIWRKHVM

SEQ ID NO: 2027631 - protein, 18 aa, Staphylococcus
LNNIISFEQHKTWRKRVM

SEQ ID NO: 2027632 - protein, 18 aa, Staphylococcus
LNNIISFEQHKVWRKHVM

SEQ ID NO: 2027633 - protein, 18 aa, Staphylococcus
LNNIISFEQHKVWRKRVM

SEQ ID NO: 2027634 - protein, 17 aa, Staphylococcus
LNNIKAFDHDATKPYKD

SEQ ID NO: 2027635 - protein, 18 aa, Staphylococcus
LNNKAIDVLYTYGDEARF

SEQ ID NO: 2027636 - protein, 23 aa, Staphylococcus
LNNKEKFKGFVIDYENPLESDTG

SEQ ID NO: 2027637 - protein, 22 aa, Staphylococcus
LNNLELPLARILADMEETGIYT

SEQ ID NO: 2027638 - protein, 30 aa, Staphylococcus
LNNLKRKYGKDIPSLITYQSKLEHEISKIE

SEQ ID NO: 2027639 - protein, 19 aa, Staphylococcus
LNNNAYLWDNIRLDKDGNW

SEQ ID NO: 2027640 - protein, 17 aa, Staphylococcus
LNNQIFKIHREAPFIKE

SEQ ID NO: 2027641 - protein, 24 aa, Staphylococcus
LNNQILIKLAFAFLEKQYEIANIN

SEQ ID NO: 2027642 - protein, 17 aa, Staphylococcus
LNNRIYGGYSLLLDVDY

SEQ ID NO: 2027643 - protein, 18 aa, Staphylococcus
LNNRYKLIVLRKGRGLAG

SEQ ID NO: 2027644 - protein, 25 aa, Staphylococcus
LNNSSFKILSEFKLNTPSLPINTYD

SEQ ID NO: 2027645 - protein, 18 aa, Staphylococcus
LNNVNYFGTMLVYAGHAE

SEQ ID NO: 2027646 - protein, 18 aa, Staphylococcus
LNNVNYFGTMLVYAGKAD

SEQ ID NO: 2027647 - protein, 18 aa, Staphylococcus
LNPAGAVSKEISYEAYLE

SEQ ID NO: 2027648 - protein, 18 aa, Staphylococcus
LNPDYIFVGMGFPKQDEW

SEQ ID NO: 2027649 - protein, 19 aa, Staphylococcus
LNPEFFKFSYTDQIDSIKN

SEQ ID NO: 2027650 - protein, 17 aa, Staphylococcus
LNPELADKDILPATLSK

SEQ ID NO: 2027651 - protein, 26 aa, Staphylococcus
LNPELKVFAPVRAWGWSREEEIDYAI

SEQ ID NO: 2027652 - protein, 17 aa, Staphylococcus
LNPGRLLLVDFEKHEVV

SEQ ID NO: 2027653 - protein, 17 aa, Staphylococcus
LNPKLAYKNLAQVIDVY

SEQ ID NO: 2027654 - protein, 26 aa, Staphylococcus
LNPKLKTFAPVREWAWSREEEIDYAL

SEQ ID NO: 2027655 - protein, 18 aa, Staphylococcus
LNPKRYAELLGQLIDKHE

SEQ ID NO: 2027656 - protein, 17 aa, Staphylococcus
LNPKYLSVASLIQYIQA

SEQ ID NO: 2027657 - protein, 20 aa, Staphylococcus
LNPLLKMNANICGVEGNYTP

SEQ ID NO: 2027658 - protein, 17 aa, Staphylococcus
LNPLLSEGTVTAGNCCM

SEQ ID NO: 2027659 - protein, 18 aa, Staphylococcus
LNPNSFFHPFSYIATKSP

SEQ ID NO: 2027660 - protein, 25 aa, Staphylococcus
LNPSHLKAMIPWEGLNDMYREAAFH

SEQ ID NO: 2027661 - protein, 17 aa, Staphylococcus
LNPTIKIFKAIPADKYL

SEQ ID NO: 2027662 - protein, 25 aa, Staphylococcus
LNPVMDFSQTHFWDYKDLINQFEFN

SEQ ID NO: 2027663 - protein, 19 aa, Staphylococcus
LNPYKWLYNLYFEARTDAI

SEQ ID NO: 2027664 - protein, 26 aa, Staphylococcus
LNQALEFKINALLIKSKSEYISLGLI

SEQ ID NO: 2027665 - protein, 20 aa, Staphylococcus
LNQECKVFTSLIVREDAQLL

SEQ ID NO: 2027666 - protein, 19 aa, Staphylococcus
LNQFYKELMLSTGKIEIDH

SEQ ID NO: 2027667 - protein, 33 aa, Staphylococcus; identical to SEQ ID NO: 1795889

SEQ ID NO: 2027668 - protein, 21 aa, Staphylococcus
LNQKGGPWLKDVLRNIECAII

SEQ ID NO: 2027669 - protein, 18 aa, Staphylococcus
LNQLKAFNYIPYFQNFEM

SEQ ID NO: 2027670 - protein, 19 aa, Staphylococcus
LNQLMELFRRYYKETETLY

SEQ ID NO: 2027671 - protein, 18 aa, Staphylococcus
LNQLPPIFIAHAEKDIDV

SEQ ID NO: 2027672 - protein, 25 aa, Staphylococcus
LNQLPRYIEKTIKGKKVLFIHYEIP

SEQ ID NO: 2027673 - protein, 24 aa, Staphylococcus
LNQRPDVAQSWDIEYGDRNTQFVI

SEQ ID NO: 2027674 - protein, 19 aa, Staphylococcus
LNQYDFSERYGWVQDQYDV

SEQ ID NO: 2027675 - protein, 19 aa, Staphylococcus
LNRETFCNHAHKCINNELE

SEQ ID NO: 2027676 - protein, 22 aa, Staphylococcus
LNRKGRHSNVIDMRKNNRNLLI

SEQ ID NO: 2027677 - protein, 21 aa, Staphylococcus
LNRKRIAFYIDNRLDSALIIY

SEQ ID NO: 2027678 - protein, 35 aa, Staphylococcus
LNRLKSMGLNSNWDMLFVVFCIHFIHLMKEFTVQE

SEQ ID NO: 2027679 - protein, 23 aa, Staphylococcus
LNRLLENQQILALESNKKIQKLE

SEQ ID NO: 2027680 - protein, 25 aa, Staphylococcus
LNRLNYPVLCANIFENGELLTHQGI

SEQ ID NO: 2027681 - protein, 26 aa, Staphylococcus
LNRMGVKLTPILGWAERGGASASGHG

SEQ ID NO: 2027682 - protein, 17 aa, Staphylococcus
LNRNIKFIFLDFISSEN

SEQ ID NO: 2027683 - protein, 27 aa, Staphylococcus
LNRPSTVPRKGWIAVFTDGTYWEYGHI

SEQ ID NO: 2027684 - protein, 25 aa, Staphylococcus
LNRRLSELYGAYVNSFVSKFKDKHV

SEQ ID NO: 2027685 - protein, 20 aa, Staphylococcus
LNRRRLQGIGNNAGSLNPYK

SEQ ID NO: 2027686 - protein, 18 aa, Staphylococcus
LNSADSFRDLIKVLVELE

SEQ ID NO: 2027687 - protein, 27 aa, Staphylococcus
LNSALHGARGYIAFGQPINVPLIANSY

SEQ ID NO: 2027688 - protein, 17 aa, Staphylococcus
LNSCGYPSLSDELEWLP

SEQ ID NO: 2027689 - protein, 25 aa, Staphylococcus
LNSEIKYRKRAVLEDSFAINMTPFF

SEQ ID NO: 2027690 - protein, 24 aa, Staphylococcus
LNSEKLDFSHLIKRIQSQLQQENN

SEQ ID NO: 2027691 - protein, 24 aa, Staphylococcus
LNSFLELREEAIVLLKRGIQAYDE

SEQ ID NO: 2027692 - protein, 17 aa, Staphylococcus
LNSIKFVIADKETIIKF

SEQ ID NO: 2027693 - protein, 19 aa, Staphylococcus
LNSKIKSFDVLKVNDTYAL

SEQ ID NO: 2027694 - protein, 18 aa, Staphylococcus
LNSLPGRISNNIEELVAN

SEQ ID NO: 2027695 - protein, 17 aa, Staphylococcus
LNSNFYFSKDQIYDSIN

SEQ ID NO: 2027696 - protein, 22 aa, Staphylococcus
LNSRARHPQIINGYGPTENTTF

SEQ ID NO: 2027697 - protein, 17 aa, Staphylococcus
LNSRLLLGTGKFDNEEI

SEQ ID NO: 2027698 - protein, 17 aa, Staphylococcus
LNSSAYYRYLSRRIGAI

SEQ ID NO: 2027699 - protein, 21 aa, Staphylococcus
LNSYYKFKQPSLLYDQQIQKR

SEQ ID NO: 2027700 - protein, 21 aa, Staphylococcus
LNTASRFVIILARKNVTADSE

SEQ ID NO: 2027701 - protein, 19 aa, Staphylococcus
LNTFALFNINLSWIESRPL

SEQ ID NO: 2027702 - protein, 21 aa, Staphylococcus
LNTKISLIGTRTHRITTRSFN

SEQ ID NO: 2027703 - protein, 23 aa, Staphylococcus
LNTKRSLALFLMAEVDISILSMV

SEQ ID NO: 2027704 - protein, 20 aa, Staphylococcus
LNTKTCVVTEKFDQTTVTMA

SEQ ID NO: 2027705 - protein, 20 aa, Staphylococcus
LNTMGKLALLMLKDLNDAVR

SEQ ID NO: 2027706 - protein, 24 aa, Staphylococcus
LNTMKRERLIILTTHHLDEVEALA

SEQ ID NO: 2027707 - protein, 18 aa, Staphylococcus
LNTTTGFRLVNKTTGDIF

SEQ ID NO: 2027708 - protein, 19 aa, Staphylococcus
LNTTTVFRVFVLDSHALRR

SEQ ID NO: 2027709 - protein, 26 aa, Staphylococcus
LNVAFLTYRKCIIINLEKQIFSRSSI

SEQ ID NO: 2027710 - protein, 24 aa, Staphylococcus
LNVAKAIRTGRIWINTYNQIPAGA

SEQ ID NO: 2027711 - protein, 24 aa, Staphylococcus
LNVAKAIRTGRIWVNTYNQIPAGA

SEQ ID NO: 2027712 - protein, 24 aa, Staphylococcus
LNVAKAMRTGRIWINTYNQFPAGA

SEQ ID NO: 2027713 - protein, 24 aa, Staphylococcus
LNVAKAMRTGRIWINTYNQIPAGA

SEQ ID NO: 2027714 - protein, 17 aa, Staphylococcus
LNVDFKFDREEETLRIY

SEQ ID NO: 2027715 - protein, 25 aa, Staphylococcus
LNVDFLKKRVKALKENILFQKMEIT

SEQ ID NO: 2027716 - protein, 24 aa, Staphylococcus
LNVFDLYTCDDWITGYDVYFKSMI

SEQ ID NO: 2027717 - protein, 18 aa, Staphylococcus
LNVFKPVILHNILQSIYL

SEQ ID NO: 2027718 - protein, 19 aa, Staphylococcus
LNVGCIPSKALLHASHRFV

SEQ ID NO: 2027719 - protein, 19 aa, Staphylococcus
LNVGCIPSKALLHASHRYD

SEQ ID NO: 2027720 - protein, 20 aa, Staphylococcus
LNVGCIPSKALLHVSHVFQE

SEQ ID NO: 2027721 - protein, 18 aa, Staphylococcus
LNVGCIPSKTLLEHGKKV

SEQ ID NO: 2027722 - protein, 18 aa, Staphylococcus
LNVGRFMIIDDEIAQSDI

SEQ ID NO: 2027723 - protein, 19 aa, Staphylococcus
LNVGVGLGTPTFESAVNPL

SEQ ID NO: 2027724 - protein, 20 aa, Staphylococcus
LNVKISYQHNVSRKTQVLYL

SEQ ID NO: 2027725 - protein, 20 aa, Staphylococcus
LNVKVHPRFTYDSLNNTFKC

SEQ ID NO: 2027726 - protein, 25 aa, Staphylococcus
LNVPFKELKYFYAQSKLNVVGIKAS

SEQ ID NO: 2027727 - protein, 19 aa, Staphylococcus
LNVPIYLHPAIPPDNVIDT

SEQ ID NO: 2027728 - protein, 24 aa, Staphylococcus
LNVSKAMRTGRIWINTYNQIPAGA

SEQ ID NO: 2027729 - protein, 20 aa, Staphylococcus
LNVSLFKRSGRNIILTSEGK

SEQ ID NO: 2027730 - protein, 20 aa, Staphylococcus
LNVVQGLIIQAARLRVMLDY

SEQ ID NO: 2027731 - protein, 19 aa, Staphylococcus
LNVYDVFTILYLLNPNQYH

SEQ ID NO: 2027732 - protein, 17 aa, Staphylococcus
LNWVYKYFFEHGEDMKG

SEQ ID NO: 2027733 - protein, 18 aa, Staphylococcus
LNYARLAHKAGLDGVVCS

SEQ ID NO: 2027734 - protein, 18 aa, Staphylococcus
LNYFKSKAIASQRSIALV

SEQ ID NO: 2027735 - protein, 28 aa, Staphylococcus
LNYGAKMAWRNSNRCIGRFFWDSLTVSD

SEQ ID NO: 2027736 - protein, 27 aa, Staphylococcus
LNYGAKMAWRNSNRCVGRLFWESLNVV

SEQ ID NO: 2027737 - protein, 25 aa, Staphylococcus
LNYGSKWFEKSHMYIRTDLNDMNKP

SEQ ID NO: 2027738 - protein, 28 aa, Staphylococcus
LNYGVDRYAKFVKQFGDFSVGIDAIKHY

SEQ ID NO: 2027739 - protein, 26 aa, Staphylococcus
LNYGVERYAKFVKQFADLSVGIDGMK

SEQ ID NO: 2027740 - protein, 17 aa, Staphylococcus
LNYKPGWAYYQGKHLGF

SEQ ID NO: 2027741 - protein, 18 aa, Staphylococcus
LNYLVDHFYVIKTMDNAY

SEQ ID NO: 2027742 - protein, 23 aa, Staphylococcus
LNYMKPREFCLISVLEGNGKIII

SEQ ID NO: 2027743 - protein, 23 aa, Staphylococcus
LNYMKPREFCLVSVLNGDGQIII

SEQ ID NO: 2027744 - protein, 23 aa, Staphylococcus
LNYMKPREFCLVTILDGEGTLVT

SEQ ID NO: 2027745 - protein, 24 aa, Staphylococcus
LNYMKPREFVLISVLKGEGQVIID

SEQ ID NO: 2027746 - protein, 18 aa, Staphylococcus
LNYPEAVAIISYEMLEGA

SEQ ID NO: 2027747 - protein, 30 aa, Staphylococcus
LNYPLEVIQSFEFNSLYGLMLKDKKNDQQG

SEQ ID NO: 2027748 - protein, 17 aa, Staphylococcus
LNYQLPIYNSFGMTETC

SEQ ID NO: 2027749 - protein, 18 aa, Staphylococcus
LPADAAVNVLGHIEDADL

SEQ ID NO: 2027750 - protein, 20 aa, Staphylococcus
LPADDSYFLFYVNEPSIIVG

SEQ ID NO: 2027751 - protein, 26 aa, Staphylococcus
LPALRIDMRSDIPLARGLGSSASALV

SEQ ID NO: 2027752 - protein, 34 aa, Staphylococcus
LPANLFFGTNIPTCILVFKKCREESDDVLFIDAS

SEQ ID NO: 2027753 - protein, 20 aa, Staphylococcus
LPASEARNKECGLLLAYEKT

SEQ ID NO: 2027754 - protein, 18 aa, Staphylococcus
LPAYYYAIVAPYKRHPMI

SEQ ID NO: 2027755 - protein, 20 aa, Staphylococcus
LPCLRELFDNNHLESFFFIK

SEQ ID NO: 2027756 - protein, 19 aa, Staphylococcus
LPCQFCSYQSVCHVDGMID

SEQ ID NO: 2027757 - protein, 19 aa, Staphylococcus
LPCQFCSYQSVCHVDSMID

SEQ ID NO: 2027758 - protein, 25 aa, Staphylococcus
LPDAELKVFMIASVEERAERRQKEN

SEQ ID NO: 2027759 - protein, 24 aa, Staphylococcus
LPDAVIRFRQGLGRLIRNENDRGI

SEQ ID NO: 2027760 - protein, 26 aa, Staphylococcus
LPDAVTRFRQGLGRLIRHENDKGLIV

SEQ ID NO: 2027761 - protein, 25 aa, Staphylococcus
LPDAVTRFRQGLGRLIRNEDDQGLI

SEQ ID NO: 2027762 - protein, 25 aa, Staphylococcus
LPDAVTRFRQGLGRLIRNEEDQGLI

SEQ ID NO: 2027763 - protein, 25 aa, Staphylococcus
LPDAVTRFRQGLGRLIRSENDKGII

SEQ ID NO: 2027764 - protein, 17 aa, Staphylococcus
LPDGAYLSCYPNASLLD

SEQ ID NO: 2027765 - protein, 18 aa, Staphylococcus
LPDIKATMLEKAKNDEHF

SEQ ID NO: 2027766 - protein, 17 aa, Staphylococcus
LPDKALDILDITAAHLA

SEQ ID NO: 2027767 - protein, 24 aa, Staphylococcus
LPDLDYSKIYLFNPNLDKITTFRD

SEQ ID NO: 2027768 - protein, 23 aa, Staphylococcus
LPDNEVPLEYSLDLINGIHKRWA

SEQ ID NO: 2027769 - protein, 18 aa, Staphylococcus
LPDNMTLEEAMIYGTAGY

SEQ ID NO: 2027770 - protein, 17 aa, Staphylococcus
LPDNVMTPYQFFANYKR

SEQ ID NO: 2027771 - protein, 22 aa, Staphylococcus
LPDQKLDILIVVDMFLTGFDSK

SEQ ID NO: 2027772 - protein, 17 aa, Staphylococcus
LPEALAIVHPMHPDFDY

SEQ ID NO: 2027773 - protein, 17 aa, Staphylococcus
LPEDGSLELTAGWTGDV

SEQ ID NO: 2027774 - protein, 17 aa, Staphylococcus
LPEDGSLELTAGWTSDV

SEQ ID NO: 2027775 - protein, 33 aa, Staphylococcus
LPEDGSLKLTAGWTGDVKYHLGGVKTTSSYGIE

SEQ ID NO: 2027776 - protein, 18 aa, Staphylococcus
LPEDGSLQLTSGWTGDVK

SEQ ID NO: 2027777 - protein, 26 aa, Staphylococcus
LPEDITSAVALEFSFVDALVALDIDV

SEQ ID NO: 2027778 - protein, 18 aa, Staphylococcus
LPEDLLITTHICRGNYQS

SEQ ID NO: 2027779 - protein, 21 aa, Staphylococcus
LPEEARFILKQMGMKEKTIDV

SEQ ID NO: 2027780 - protein, 24 aa, Staphylococcus
LPEERLFRKYAHTIRNWDDEKQDK

SEQ ID NO: 2027781 - protein, 24 aa, Staphylococcus
LPEGARFDPTLTEFVYELQHGDLR

SEQ ID NO: 2027782 - protein, 34 aa, Staphylococcus
LPEGDKVLQFFVRYGGEFQLKQGFSPAFSVDKKE

SEQ ID NO: 2027783 - protein, 18 aa, Staphylococcus
LPEGSIIGTSSLRRGAQI

SEQ ID NO: 2027784 - protein, 25 aa, Staphylococcus
LPEGYRLTLIDRMPFHGLKPEFYAL

SEQ ID NO: 2027785 - protein, 17 aa, Staphylococcus
LPEKKRYSITAMFDDKG

SEQ ID NO: 2027786 - protein, 19 aa, Staphylococcus
LPEKKRYSITAMFDDKGNP

SEQ ID NO: 2027787 - protein, 25 aa, Staphylococcus
LPEKYSLDQTVGWFTKTCPVEVDCT

SEQ ID NO: 2027788 - protein, 18 aa, Staphylococcus
LPENERKAVWAIYAVCRM

SEQ ID NO: 2027789 - protein, 20 aa, Staphylococcus
LPENFKAYCAEMSIKSSSIQ

SEQ ID NO: 2027790 - protein, 18 aa, Staphylococcus
LPEQQRRAIWAIYAVCRI

SEQ ID NO: 2027791 - protein, 21 aa, Staphylococcus
LPEVEGKLHGMALRVPTKNVS

SEQ ID NO: 2027792 - protein, 20 aa, Staphylococcus
LPEVTYEFQYAMGLPDYGII

SEQ ID NO: 2027793 - protein, 24 aa, Staphylococcus
LPFAQKRWCAANGLDNVITLSDHK

SEQ ID NO: 2027794 - protein, 24 aa, Staphylococcus
LPFAQKRWCAASGLDNVILLSDYQ

SEQ ID NO: 2027795 - protein, 24 aa, Staphylococcus
LPFAQKRWCASNGLDNVITLSDHK

SEQ ID NO: 2027796 - protein, 24 aa, Staphylococcus
LPFAQKRWCASNGLDNVVTLSDHR

SEQ ID NO: 2027797 - protein, 17 aa, Staphylococcus
LPFIAQAYDPKKDEFKE

SEQ ID NO: 2027798 - protein, 21 aa, Staphylococcus
LPFISGFIGTCSFDLVRHEFP

SEQ ID NO: 2027799 - protein, 22 aa, Staphylococcus
LPFKQRIALETKMNYEASLSGW

SEQ ID NO: 2027800 - protein, 19 aa, Staphylococcus
LPFRIRKPLPNVTFHQVEV

SEQ ID NO: 2027801 - protein, 17 aa, Staphylococcus
LPFTWVYDQNGITDTMK

SEQ ID NO: 2027802 - protein, 17 aa, Staphylococcus
LPFVDVETMLTLLDLSN

SEQ ID NO: 2027803 - protein, 20 aa, Staphylococcus
LPFVHSKGGIYSWLQTPPGY

SEQ ID NO: 2027804 - protein, 20 aa, Staphylococcus
LPGEHCMYALQLFETDRHGV

SEQ ID NO: 2027805 - protein, 17 aa, Staphylococcus
LPGLSIMKRMNRIAQTI

SEQ ID NO: 2027806 - protein, 17 aa, Staphylococcus
LPGPVVHHIEDVITAIK

SEQ ID NO: 2027807 - protein, 20 aa, Staphylococcus
LPGRSLELGDYFKSELEKID

SEQ ID NO: 2027808 - protein, 20 aa, Staphylococcus
LPGRSLELGEYFKGELQKIE

SEQ ID NO: 2027809 - protein, 24 aa, Staphylococcus
LPGRSLELGGYFKSELQKIEHPSI

SEQ ID NO: 2027810 - protein, 26 aa, Staphylococcus
LPHAGGVLPYLEWRIDETLKTEQYIL

SEQ ID NO: 2027811 - protein, 19 aa, Staphylococcus
LPHAIKTGMIASKEMMQLI

SEQ ID NO: 2027812 - protein, 18 aa, Staphylococcus
LPHAIKTGMIATKETMEL

SEQ ID NO: 2027813 - protein, 18 aa, Staphylococcus
LPHAPTMKQLITKSEPIH

SEQ ID NO: 2027814 - protein, 26 aa, Staphylococcus
LPHGFKGICAISFFMNASLQQIELLR

SEQ ID NO: 2027815 - protein, 19 aa, Staphylococcus
LPHIKVVMLTSFIEDKEVY

SEQ ID NO: 2027816 - protein, 18 aa, Staphylococcus
LPHRSSFSYIVMDKNLNH

SEQ ID NO: 2027817 - protein, 18 aa, Staphylococcus
LPHSIAIIGAGVIGLEFA

SEQ ID NO: 2027818 - protein, 20 aa, Staphylococcus
LPIDEAIAFLEQIDSTKAKY

SEQ ID NO: 2027819 - protein, 17 aa, Staphylococcus
LPIDINRSGRVIINQYH

SEQ ID NO: 2027820 - protein, 22 aa, Staphylococcus
LPIEGMLLLSPLLEFKRNNKTR

SEQ ID NO: 2027821 - protein, 17 aa, Staphylococcus
LPIEISIQLLDALNQRV

SEQ ID NO: 2027822 - protein, 19 aa, Staphylococcus
LPIGAPFDYYIYFTAITHS

SEQ ID NO: 2027823 - protein, 17 aa, Staphylococcus
LPIGYYPLDERSHEMQL

SEQ ID NO: 2027824 - protein, 20 aa, Staphylococcus
LPIIPKHMKTIVIGKTSKQF

SEQ ID NO: 2027825 - protein, 19 aa, Staphylococcus
LPIKDEWLIYWGGDNELFN

SEQ ID NO: 2027826 - protein, 22 aa, Staphylococcus
LPILGICLGAQALTCYYGGKVI

SEQ ID NO: 2027827 - protein, 20 aa, Staphylococcus
LPISHLIYLNSAAKITPDGS

SEQ ID NO: 2027828 - protein, 19 aa, Staphylococcus
LPISHLVYLNSAARITPNQ

SEQ ID NO: 2027829 - protein, 20 aa, Staphylococcus
LPISHLVYLSSAAKITPNTS

SEQ ID NO: 2027830 - protein, 21 aa, Staphylococcus
LPKDEVEAFSEFIEEIMDNAL

SEQ ID NO: 2027831 - protein, 22 aa, Staphylococcus
LPKDIAYDMNIHILAFEPGASH

SEQ ID NO: 2027832 - protein, 22 aa, Staphylococcus
LPKDIEGPIIWVDDTLQALQDL

SEQ ID NO: 2027833 - protein, 27 aa, Staphylococcus
LPKEMALELFKPFIMKELVQREIATNI

SEQ ID NO: 2027834 - protein, 23 aa, Staphylococcus
LPKGRKPIITHWAKHEQYDQVLA

SEQ ID NO: 2027835 - protein, 23 aa, Staphylococcus
LPKGRKPIITNWAKHEQYEQVLS

SEQ ID NO: 2027836 - protein, 17 aa, Staphylococcus
LPKKEVVEIKKEYDRLI

SEQ ID NO: 2027837 - protein, 17 aa, Staphylococcus
LPKKEVVELKKEYDRLI

SEQ ID NO: 2027838 - protein, 17 aa, Staphylococcus
LPKKNIKAIQIDTKEEN

SEQ ID NO: 2027839 - protein, 22 aa, Staphylococcus
LPKKVFAHGWILMKDGKMSKSK

SEQ ID NO: 2027840 - protein, 19 aa, Staphylococcus
LPKNKKKVIYYSYWGDQYS

SEQ ID NO: 2027841 - protein, 20 aa, Staphylococcus
LPKNKLIVMTGLSGSGKSSL

SEQ ID NO: 2027842 - protein, 22 aa, Staphylococcus
LPKNVMRLKGYVQFRDQPNETI

SEQ ID NO: 2027843 - protein, 21 aa, Staphylococcus
LPKSYIFEIASNWKKKGIKTA

SEQ ID NO: 2027844 - protein, 21 aa, Staphylococcus
LPKSYIFEIASNWKKKGITTA

SEQ ID NO: 2027845 - protein, 17 aa, Staphylococcus
LPKTILYNLNPIYNDIV

SEQ ID NO: 2027846 - protein, 18 aa, Staphylococcus
LPKTILYNLNPIYNDIVG

SEQ ID NO: 2027847 - protein, 17 aa, Staphylococcus
LPKTRSGKIMRRVLKAW

SEQ ID NO: 2027848 - protein, 21 aa, Staphylococcus
LPKTTAYHEIWLDGEKVVDTK

SEQ ID NO: 2027849 - protein, 19 aa, Staphylococcus
LPKVRDAWIEAREDVEHYE

SEQ ID NO: 2027850 - protein, 20 aa, Staphylococcus
LPKYDGFYWCRKIRQVSNVP

SEQ ID NO: 2027851 - protein, 21 aa, Staphylococcus
LPKYDGFYWCRKMRQESNVPI

SEQ ID NO: 2027852 - protein, 20 aa, Staphylococcus
LPKYEVSSFTVSPFLALNIN

SEQ ID NO: 2027853 - protein, 20 aa, Staphylococcus
LPKYIPLLLQVKFDLEKIQS

SEQ ID NO: 2027854 - protein, 17 aa, Staphylococcus
LPLALAHKSLKAMQNGR

SEQ ID NO: 2027855 - protein, 23 aa, Staphylococcus
LPLDDARVSPIYGELTDLPPIYM

SEQ ID NO: 2027856 - protein, 17 aa, Staphylococcus
LPLEGRMGYGIHFAMDY

SEQ ID NO: 2027857 - protein, 23 aa, Staphylococcus
LPLEGRMGYGIHFAMDYLTEQTQ

SEQ ID NO: 2027858 - protein, 20 aa, Staphylococcus
LPLEYFKEKSILLTNASGVH

SEQ ID NO: 2027859 - protein, 18 aa, Staphylococcus
LPLGKLSGKHAFAEKLTA

SEQ ID NO: 2027860 - protein, 26 aa, Staphylococcus
LPLGLPRLSQYLKFNLKAEQERLKKH

SEQ ID NO: 2027861 - protein, 20 aa, Staphylococcus
LPLHQTAIQWIWQTVAQEGG

SEQ ID NO: 2027862 - protein, 25 aa, Staphylococcus
LPLLDEGFELPLVIATTGEKEKLIQ

SEQ ID NO: 2027863 - protein, 19 aa, Staphylococcus
LPLMLQFLQTIEWRGDERA

SEQ ID NO: 2027864 - protein, 18 aa, Staphylococcus
LPLPDLIIVDGGKGHMNG

SEQ ID NO: 2027865 - protein, 23 aa, Staphylococcus
LPLPKRVFAHGWILMKDGKMSKS

SEQ ID NO: 2027866 - protein, 21 aa, Staphylococcus
LPLQKGEIFVEGKMYRGNKTS

SEQ ID NO: 2027867 - protein, 24 aa, Staphylococcus
LPLRKEYHEEYLKQALRSFRLATS

SEQ ID NO: 2027868 - protein, 22 aa, Staphylococcus
LPLRRQAIVLFGMIESKEILPY

SEQ ID NO: 2027869 - protein, 17 aa, Staphylococcus
LPLRSEYHEQYLADAVN

SEQ ID NO: 2027870 - protein, 34 aa, Staphylococcus
LPLTDKRVSPLYGELRGLPPVYMYGGGKEIQNPD

SEQ ID NO: 2027871 - protein, 18 aa, Staphylococcus
LPLTGVGVVSRLITDLAV

SEQ ID NO: 2027872 - protein, 18 aa, Staphylococcus
LPLTVLLRALGFSNDQEI

SEQ ID NO: 2027873 - protein, 17 aa, Staphylococcus
LPLTVLLRALGYSTDQS

SEQ ID NO: 2027874 - protein, 23 aa, Staphylococcus
LPLVKKGGQFIALKSAKGEEELA

SEQ ID NO: 2027875 - protein, 17 aa, Staphylococcus
LPLVVFTGQVATPGIGK

SEQ ID NO: 2027876 - protein, 19 aa, Staphylococcus
LPLVVITGQVATPGIGKDA

SEQ ID NO: 2027877 - protein, 17 aa, Staphylococcus
LPLYFKKGKHFNLTEAG

SEQ ID NO: 2027878 - protein, 17 aa, Staphylococcus
LPMAVSMAKAINNAMKQ

SEQ ID NO: 2027879 - protein, 23 aa, Staphylococcus
LPMDLIYRRLDEIPDLKTMSITG

SEQ ID NO: 2027880 - protein, 21 aa, Staphylococcus
LPMFGTCAGLIVLAKHVEGET

SEQ ID NO: 2027881 - protein, 20 aa, Staphylococcus
LPMFGTCAGLIVLASDVEGE

SEQ ID NO: 2027882 - protein, 19 aa, Staphylococcus
LPMGHEFNSLVLALLQVSG

SEQ ID NO: 2027883 - protein, 22 aa, Staphylococcus
LPMLKARKAIIDMNQLALKKEW

SEQ ID NO: 2027884 - protein, 18 aa, Staphylococcus
LPMLRADFVIDEEYQDMN

SEQ ID NO: 2027885 - protein, 19 aa, Staphylococcus
LPMNLIYQRLDEIPNLRTM

SEQ ID NO: 2027886 - protein, 18 aa, Staphylococcus
LPMNPSISLYVTVEDVME

SEQ ID NO: 2027887 - protein, 25 aa, Staphylococcus
LPNAELKVYMIASVEERAERRQKEN

SEQ ID NO: 2027888 - protein, 18 aa, Staphylococcus
LPNAPKEKGIMVLDDSYE

SEQ ID NO: 2027889 - protein, 19 aa, Staphylococcus
LPNAPKEKGIMVLSDEYQV

SEQ ID NO: 2027890 - protein, 23 aa, Staphylococcus
LPNEGDYAVGLFFSNEKIQGTKH

SEQ ID NO: 2027891 - protein, 17 aa, Staphylococcus
LPNFEKQSIYSLRYDEM

SEQ ID NO: 2027892 - protein, 18 aa, Staphylococcus
LPNFEKQSIYSLRYDEMQ

SEQ ID NO: 2027893 - protein, 26 aa, Staphylococcus
LPNGFAGICAISYFMSASLQQIQHLR

SEQ ID NO: 2027894 - protein, 21 aa, Staphylococcus
LPNGKRITGRVNSHGKYEIKL

SEQ ID NO: 2027895 - protein, 23 aa, Staphylococcus
LPNGVELKNKFVLAPLTHISSND

SEQ ID NO: 2027896 - protein, 19 aa, Staphylococcus
LPNHAPLIVAEQFGTLATL

SEQ ID NO: 2027897 - protein, 19 aa, Staphylococcus
LPNHAPLIVAEQFGTMATL

SEQ ID NO: 2027898 - protein, 17 aa, Staphylococcus
LPNIKVVMLTSYIEDNE

SEQ ID NO: 2027899 - protein, 24 aa, Staphylococcus
LPNKEFQLLFLLASNEKQIFSRTH

SEQ ID NO: 2027900 - protein, 21 aa, Staphylococcus
LPNKESHKILNLKQAKEISKQ

SEQ ID NO: 2027901 - protein, 18 aa, Staphylococcus
LPNKKFTDNFVRIDKKNS

SEQ ID NO: 2027902 - protein, 21 aa, Staphylococcus
LPNKLHALGFEFKFNNLKNAL

SEQ ID NO: 2027903 - protein, 18 aa, Staphylococcus
LPNKLLKLFREMQYVESN

SEQ ID NO: 2027904 - protein, 18 aa, Staphylococcus
LPNLKLQRLDTMDQQSKM

SEQ ID NO: 2027905 - protein, 20 aa, Staphylococcus
LPNLKYPSFERFMAQNVNND

SEQ ID NO: 2027906 - protein, 18 aa, Staphylococcus
LPNLKYPSFERYSNNFNI

SEQ ID NO: 2027907 - protein, 24 aa, Staphylococcus
LPNLKYPTFERFILQKDDFNHKLD

SEQ ID NO: 2027908 - protein, 19 aa, Staphylococcus
LPNMTLKRLDMMDQQNKMK

SEQ ID NO: 2027909 - protein, 18 aa, Staphylococcus
LPNNMKWMNLDEKEDYNF

SEQ ID NO: 2027910 - protein, 19 aa, Staphylococcus
LPNRLEQIGIDPKDVDIVV

SEQ ID NO: 2027911 - protein, 20 aa, Staphylococcus
LPPANIVAGSVEFGATFEGP

SEQ ID NO: 2027912 - protein, 24 aa, Staphylococcus
LPPFFYPLNELISITEMIKSAGYQ

SEQ ID NO: 2027913 - protein, 23 aa, Staphylococcus
LPPNINYSHWFYKATKKGIYLSI

SEQ ID NO: 2027914 - protein, 19 aa, Staphylococcus
LPPNLWKQFDQGFYPLPRK

SEQ ID NO: 2027915 - protein, 31 aa, Staphylococcus
LPPRALEGLMSCLNKGIPVILVSRSFNGIVG

SEQ ID NO: 2027916 - protein, 18 aa, Staphylococcus
LPQALFMSTNQYYHHLAT

SEQ ID NO: 2027917 - protein, 26 aa, Staphylococcus
LPQEFLKEHDIHVIPLNLTIDGKSYI

SEQ ID NO: 2027918 - protein, 20 aa, Staphylococcus
LPQFTPEIFMKVSAKNVMKQ

SEQ ID NO: 2027919 - protein, 21 aa, Staphylococcus
LPQFTPELFMKVSAKNVMKQK

SEQ ID NO: 2027920 - protein, 18 aa, Staphylococcus
LPQHEAHNYKEIAQDESP

SEQ ID NO: 2027921 - protein, 18 aa, Staphylococcus
LPQKEIKKPYNYIREIGL

SEQ ID NO: 2027922 - protein, 18 aa, Staphylococcus
LPQYDFKYEVGEEESNLV

SEQ ID NO: 2027923 - protein, 19 aa, Staphylococcus
LPRMKKWDYLLVSSDLNKK

SEQ ID NO: 2027924 - protein, 18 aa, Staphylococcus
LPRPFFVLAPMEDVTDVV

SEQ ID NO: 2027925 - protein, 20 aa, Staphylococcus
LPRPIGEDIVHYSDYFEGAQ

SEQ ID NO: 2027926 - protein, 20 aa, Staphylococcus
LPRREVVNIEDFEAAVSEWS

SEQ ID NO: 2027927 - protein, 20 aa, Staphylococcus
LPRVWLRTARYLNDNDADTI

SEQ ID NO: 2027928 - protein, 30 aa, Staphylococcus
LPRYLEKTICGKKCLFIHYEIENQRLEEGI

SEQ ID NO: 2027929 - protein, 20 aa, Staphylococcus
LPSDEYKLWYKKEPVNNDIQ

SEQ ID NO: 2027930 - protein, 28 aa, Staphylococcus
LPSEESYFLFYVNRPSIIVGKNQNTIEE

SEQ ID NO: 2027931 - protein, 29 aa, Staphylococcus
LPSEESYFLFYVNRPSIIVGKNQNTIEEV

SEQ ID NO: 2027932 - protein, 22 aa, Staphylococcus
LPSEINSLYGLETGHMDIGLSA

SEQ ID NO: 2027933 - protein, 27 aa, Staphylococcus
LPSIQEAFKKYGINIINGYGLTEAPMV

SEQ ID NO: 2027934 - protein, 19 aa, Staphylococcus
LPSKARLRGTIEIPMTLAT

SEQ ID NO: 2027935 - protein, 23 aa, Staphylococcus
LPSKQMVLNFAHYRFTDLPESGC

SEQ ID NO: 2027936 - protein, 18 aa, Staphylococcus
LPSKVDICVERKKLIDVV

SEQ ID NO: 2027937 - protein, 17 aa, Staphylococcus
LPSLEIIMWDERLSTMA

SEQ ID NO: 2027938 - protein, 23 aa, Staphylococcus
LPSPLNRFVRIMPFTNITQLTQL

SEQ ID NO: 2027939 - protein, 24 aa, Staphylococcus
LPSQFHRFTLIGGNGSIVSDNNEI

SEQ ID NO: 2027940 - protein, 17 aa, Staphylococcus
LPSQPFWEFPARPYTHH

SEQ ID NO: 2027941 - protein, 23 aa, Staphylococcus
LPSSKFRSSGFDGFMQDYVFMDH

SEQ ID NO: 2027942 - protein, 25 aa, Staphylococcus
LPSSMKKYVPKDCIFISLCENQRDV

SEQ ID NO: 2027943 - protein, 17 aa, Staphylococcus
LPSSRLGEKQGKKLFVY

SEQ ID NO: 2027944 - protein, 17 aa, Staphylococcus
LPSTFIYSGAKPRKGKA

SEQ ID NO: 2027945 - protein, 19 aa, Staphylococcus
LPTAGGYGVMICYHQNDLQ

SEQ ID NO: 2027946 - protein, 19 aa, Staphylococcus
LPTAGGYGVMICYNDEDLE

SEQ ID NO: 2027947 - protein, 19 aa, Staphylococcus
LPTAGGYGVMICYNDQDLE

SEQ ID NO: 2027948 - protein, 19 aa, Staphylococcus
LPTAGGYGVMICYNEEDLD

SEQ ID NO: 2027949 - protein, 22 aa, Staphylococcus
LPTEINSLYGLETGHINISMSA

SEQ ID NO: 2027950 - protein, 20 aa, Staphylococcus
LPTFVMGVGLGGLIILNLLE

SEQ ID NO: 2027951 - protein, 25 aa, Staphylococcus
LPTHVYRLKGFMRFADKPYTYLVQC

SEQ ID NO: 2027952 - protein, 25 aa, Staphylococcus
LPTIELKAGRLASVLEGAERPGHFD

SEQ ID NO: 2027953 - protein, 18 aa, Staphylococcus
LPTIKYIIEQGGKVVLFS

SEQ ID NO: 2027954 - protein, 19 aa, Staphylococcus
LPTIVRRLLVISFEDVGLA

SEQ ID NO: 2027955 - protein, 17 aa, Staphylococcus
LPTQFSRPEVAEVLIRG

SEQ ID NO: 2027956 - protein, 17 aa, Staphylococcus
LPTRIARNGTCMTSEGR

SEQ ID NO: 2027957 - protein, 18 aa, Staphylococcus
LPTRIARNGTCMTSIGRL

SEQ ID NO: 2027958 - protein, 17 aa, Staphylococcus
LPTRIARNGTCMTSNGR

SEQ ID NO: 2027959 - protein, 18 aa, Staphylococcus
LPTRIARNGTCMTSNGRL

SEQ ID NO: 2027960 - protein, 18 aa, Staphylococcus
LPTRIARNGTCMTSQGRL

SEQ ID NO: 2027961 - protein, 19 aa, Staphylococcus
LPTSFAESLIHLEDAEQIN

SEQ ID NO: 2027962 - protein, 23 aa, Staphylococcus
LPVDCKVAKEFSNDAEITEVSVD

SEQ ID NO: 2027963 - protein, 22 aa, Staphylococcus
LPVDCKVAKEFSNDAKITEVSI

SEQ ID NO: 2027964 - protein, 23 aa, Staphylococcus
LPVDCKVAKEFSNDAKITEVSID

SEQ ID NO: 2027965 - protein, 18 aa, Staphylococcus
LPVHPNIEHVIGDFTTLT

SEQ ID NO: 2027966 - protein, 22 aa, Staphylococcus
LPVIAICGSLGKNYQAVYQHGI

SEQ ID NO: 2027967 - protein, 17 aa, Staphylococcus
LPVLTISAKKGWLNQKE

SEQ ID NO: 2027968 - protein, 18 aa, Staphylococcus
LPVMYIEYSGVYGETNLV

SEQ ID NO: 2027969 - protein, 26 aa, Staphylococcus
LPVNHVPRILGFDAAGIVEQVGEDVT

SEQ ID NO: 2027970 - protein, 23 aa, Staphylococcus
LPVPGVWNLFGYDQIQYVNIKYP

SEQ ID NO: 2027971 - protein, 25 aa, Staphylococcus
LPVQNEVLIIYALVNGFLDDIPVED

SEQ ID NO: 2027972 - protein, 26 aa, Staphylococcus
LPVSHSPRILGFDAVGIVESIGKNVS

SEQ ID NO: 2027973 - protein, 19 aa, Staphylococcus
LPVTLLFTGPLTDLAKALK

SEQ ID NO: 2027974 - protein, 17 aa, Staphylococcus
LPVTSYIIWGGVSDINL

SEQ ID NO: 2027975 - protein, 19 aa, Staphylococcus
LPVVETFQGAGVISRELED

SEQ ID NO: 2027976 - protein, 27 aa, Staphylococcus
LPVVNRRAVDWAMRASMALNMDIATNS

SEQ ID NO: 2027977 - protein, 27 aa, Staphylococcus
LPVVNRRAVDWAMRASMALNMEIATES

SEQ ID NO: 2027978 - protein, 28 aa, Staphylococcus
LPVVNRRAVDWAMRASMALNMEIATESK

SEQ ID NO: 2027979 - protein, 17 aa, Staphylococcus
LPVVPANMQTVMNESLA

SEQ ID NO: 2027980 - protein, 17 aa, Staphylococcus
LPVVPANMQTVMSEELA

SEQ ID NO: 2027981 - protein, 25 aa, Staphylococcus
LPWKDLDIDVVLECTGFFADKEKAE

SEQ ID NO: 2027982 - protein, 25 aa, Staphylococcus
LPWKDLDIDVVLECTGFYTDKDKAQ

SEQ ID NO: 2027983 - protein, 26 aa, Staphylococcus
LPWKDLDIDVVLECTGFYTSEEKAKA

SEQ ID NO: 2027984 - protein, 17 aa, Staphylococcus
LPYGKLEEGCFADLTII

SEQ ID NO: 2027985 - protein, 17 aa, Staphylococcus
LPYGKPFAIESVNNARQ

SEQ ID NO: 2027986 - protein, 19 aa, Staphylococcus
LPYGTLLFATGRRPNLQAF

SEQ ID NO: 2027987 - protein, 18 aa, Staphylococcus
LPYHLAVKKLKQLDEDFG

SEQ ID NO: 2027988 - protein, 20 aa, Staphylococcus
LPYSIRVLLESVLRQEDEFV

SEQ ID NO: 2027989 - protein, 20 aa, Staphylococcus
LPYSIRVLLESVLRQEDGFV

SEQ ID NO: 2027990 - protein, 18 aa, Staphylococcus
LPYVSRSERPEWNTVGLI

SEQ ID NO: 2027991 - protein, 18 aa, Staphylococcus
LPYYKVIGQYIFVHAGID

SEQ ID NO: 2027992 - protein, 21 aa, Staphylococcus
LQADMSLAIVIGSEGQGMSRL

SEQ ID NO: 2027993 - protein, 19 aa, Staphylococcus
LQAEGFGLIHAVGKGSEFG

SEQ ID NO: 2027994 - protein, 18 aa, Staphylococcus
LQAEKVLLQAKERISSML

SEQ ID NO: 2027995 - protein, 28 aa, Staphylococcus
LQAIKEFTELGSGFKIAMRDLNIRGAGN

SEQ ID NO: 2027996 - protein, 17 aa, Staphylococcus
LQAIYRRVYQFGVEERR

SEQ ID NO: 2027997 - protein, 17 aa, Staphylococcus
LQAKERISSMLSIGQKT

SEQ ID NO: 2027998 - protein, 17 aa, Staphylococcus
LQALDVWLLGKRYFAEF

SEQ ID NO: 2027999 - protein, 18 aa, Staphylococcus
LQALKKGESIIVVDDENR

SEQ ID NO: 2028000 - protein, 24 aa, Staphylococcus
LQALLKRKYPDINFEYTYIDFQKD

SEQ ID NO: 2028001 - protein, 28 aa, Staphylococcus
LQARSQRDYLFFKFAIHTGIKLTDLLNM

SEQ ID NO: 2028002 - protein, 18 aa, Staphylococcus
LQCYKVKFIHPIYNKEIE

SEQ ID NO: 2028003 - protein, 27 aa, Staphylococcus
LQDAHEFCPYSKATRGNIDVDLNVQVV

SEQ ID NO: 2028004 - protein, 19 aa, Staphylococcus
LQDAKDCLQKGAFVSDKDG

SEQ ID NO: 2028005 - protein, 21 aa, Staphylococcus
LQDAKDCLQKGAFVSDKDGDM

SEQ ID NO: 2028006 - protein, 24 aa, Staphylococcus
LQDAKDCLQKGAFVSDKDGDMHYD

SEQ ID NO: 2028007 - protein, 22 aa, Staphylococcus
LQDEHVWVGYDWEGQRYYLPIR

SEQ ID NO: 2028008 - protein, 20 aa, Staphylococcus
LQDELKVFPSHFSKGMKQKV

SEQ ID NO: 2028009 - protein, 17 aa, Staphylococcus
LQDELMIRFGSERLQKM

SEQ ID NO: 2028010 - protein, 17 aa, Staphylococcus
LQDIFLRICRSIDRYKL

SEQ ID NO: 2028011 - protein, 25 aa, Staphylococcus
LQDKGEIITSHFYKRMFKQHPELKN

SEQ ID NO: 2028012 - protein, 20 aa, Staphylococcus
LQDKGINLLLTFGDEAVHIY

SEQ ID NO: 2028013 - protein, 25 aa, Staphylococcus
LQDKGVEITSNFYARMFKQHPELKN

SEQ ID NO: 2028014 - protein, 24 aa, Staphylococcus
LQDLCKEHGILLAVDDIQQGLGRT

SEQ ID NO: 2028015 - protein, 19 aa, Staphylococcus
LQDLGLTKVNGGFVVTGGS

SEQ ID NO: 2028016 - protein, 18 aa, Staphylococcus
LQDLGYERVLLRNETQLK

SEQ ID NO: 2028017 - protein, 28 aa, Staphylococcus
LQDLKDRYEFIGGLSPLAGTTDRQAEAL

SEQ ID NO: 2028018 - protein, 27 aa, Staphylococcus
LQDLKDRYEFIGGLSPLAKTTNKQAEA

SEQ ID NO: 2028019 - protein, 27 aa, Staphylococcus
LQDLKNRYEFIGGLSPLAGTTDRQAEA

SEQ ID NO: 2028020 - protein, 28 aa, Staphylococcus
LQDLKNRYEFIGGLSPLAGTTNRQAEAL

SEQ ID NO: 2028021 - protein, 28 aa, Staphylococcus
LQDLKQRYEFIGGLSPLAGTTDRQAEAL

SEQ ID NO: 2028022 - protein, 17 aa, Staphylococcus
LQDRAFKNDKVNFIWSH

SEQ ID NO: 2028023 - protein, 26 aa, Staphylococcus
LQDSPFFRRRVRGIVSKAQRVSEETS

SEQ ID NO: 2028024 - protein, 24 aa, Staphylococcus
LQDTILKFGFYDGVDHVVIDSDQL

SEQ ID NO: 2028025 - protein, 29 aa, Staphylococcus
LQDVKDNKIEIVLSWKLNRISRSMRDVFN

SEQ ID NO: 2028026 - protein, 30 aa, Staphylococcus
LQDVKDNKIEMVLSWKLNRISRSMRDVFNI

SEQ ID NO: 2028027 - protein, 18 aa, Staphylococcus
LQEATGLEAMTIHRLIGW

SEQ ID NO: 2028028 - protein, 17 aa, Staphylococcus
LQEIKPEHYVFVTDKEA

SEQ ID NO: 2028029 - protein, 18 aa, Staphylococcus
LQEIRPNHYVFVTDEEAV

SEQ ID NO: 2028030 - protein, 20 aa, Staphylococcus
LQEKERLLPGGYLFLSDLMG

SEQ ID NO: 2028031 - protein, 23 aa, Staphylococcus
LQEKGTEITSYFYNRMFNQHPEL

SEQ ID NO: 2028032 - protein, 24 aa, Staphylococcus
LQEKSILVAPGIPFGKNGKHYVRI

SEQ ID NO: 2028033 - protein, 17 aa, Staphylococcus
LQELRKKDFLTLQELIE

SEQ ID NO: 2028034 - protein, 24 aa, Staphylococcus
LQEMHRVLKPGGMVVCLETSQPTL

SEQ ID NO: 2028035 - protein, 19 aa, Staphylococcus
LQEMIEANIAKGYEYMVIT

SEQ ID NO: 2028036 - protein, 18 aa, Staphylococcus
LQERGTEITSYFYNRMFQ

SEQ ID NO: 2028037 - protein, 20 aa, Staphylococcus
LQETCFLELTSPNLAQGFQR

SEQ ID NO: 2028038 - protein, 24 aa, Staphylococcus
LQEYREVENIKEFHGIFNEPIACS

SEQ ID NO: 2028039 - protein, 17 aa, Staphylococcus
LQFKKAHHWSLEEYHIK

SEQ ID NO: 2028040 - protein, 17 aa, Staphylococcus
LQFSDPNTLVFGPYYRG

SEQ ID NO: 2028041 - protein, 17 aa, Staphylococcus
LQFTDILGTIKNVEVPV

SEQ ID NO: 2028042 - protein, 19 aa, Staphylococcus
LQFVQKFPHYFAGSNADLP

SEQ ID NO: 2028043 - protein, 19 aa, Staphylococcus
LQFYVRYGGEFQLKQGFSP

SEQ ID NO: 2028044 - protein, 21 aa, Staphylococcus
LQFYVRYGGEFQLKQGFSPAF

SEQ ID NO: 2028045 - protein, 29 aa, Staphylococcus
LQFYVRYGGEFQLKQGFSPAFRVEPSNDV

SEQ ID NO: 2028046 - protein, 26 aa, Staphylococcus
LQGAHTVVWNGPMGVFEFSNFAKGTI

SEQ ID NO: 2028047 - protein, 24 aa, Staphylococcus
LQGEIPDTLTIEWVTKDKLEDYLT

SEQ ID NO: 2028048 - protein, 49 aa, Staphylococcus
LQGENGLAYLRKAQCMFGWDWGIKLPDFGIWKSIAIEYGDYMNIPPFLF

SEQ ID NO: 2028049 - protein, 19 aa, Staphylococcus
LQGFDKIVFSVGSGGSTGA

SEQ ID NO: 2028050 - protein, 18 aa, Staphylococcus
LQHLAAKHGIDFDEIAFK

SEQ ID NO: 2028051 - protein, 18 aa, Staphylococcus
LQHLATKHGIDFQNVAFQ

SEQ ID NO: 2028052 - protein, 17 aa, Staphylococcus
LQHLATKHGINFHEVAF

SEQ ID NO: 2028053 - protein, 18 aa, Staphylococcus
LQHLATKHGINFQEMAFK

SEQ ID NO: 2028054 - protein, 22 aa, Staphylococcus
LQHLATKHGINFQEMAFQEEKR

SEQ ID NO: 2028055 - protein, 37 aa, Staphylococcus
LQHLKEAGYHLAIATGRPRTETIIPFESLGLKSYFDD

SEQ ID NO: 2028056 - protein, 18 aa, Staphylococcus
LQHPSLYLDIGDHVDLST

SEQ ID NO: 2028057 - protein, 17 aa, Staphylococcus
LQHQTGHLIHWYIMTSD

SEQ ID NO: 2028058 - protein, 18 aa, Staphylococcus
LQHYDFSRAIPFKRYLYF

SEQ ID NO: 2028059 - protein, 17 aa, Staphylococcus
LQIDEALAFLKKIKSGK

SEQ ID NO: 2028060 - protein, 27 aa, Staphylococcus
LQIEERLMKLYGVFKVSTDIEEGAIFV

SEQ ID NO: 2028061 - protein, 23 aa, Staphylococcus
LQIEMRSDIPLARGLGSSASALV

SEQ ID NO: 2028062 - protein, 17 aa, Staphylococcus
LQIIKMLFDNQGKYVSR

SEQ ID NO: 2028063 - protein, 17 aa, Staphylococcus
LQIKYRKSIFYPEKVTI

SEQ ID NO: 2028064 - protein, 18 aa, Staphylococcus
LQILKMLFQNEGKYVSRT

SEQ ID NO: 2028065 - protein, 19 aa, Staphylococcus
LQIPDYLKRGIKVSLIDDQ

SEQ ID NO: 2028066 - protein, 17 aa, Staphylococcus
LQIPKCTPLTEGYIYVA

SEQ ID NO: 2028067 - protein, 23 aa, Staphylococcus
LQIPSVRYVGCSNTTINKVAMIG

SEQ ID NO: 2028068 - protein, 20 aa, Staphylococcus
LQIPVCPYSQALKMAHLTVR

SEQ ID NO: 2028069 - protein, 24 aa, Staphylococcus
LQISEVNVGYAPWVLEESKYTFEQ

SEQ ID NO: 2028070 - protein, 20 aa, Staphylococcus
LQISLKRQHYVLWRMKVEGE

SEQ ID NO: 2028071 - protein, 22 aa, Staphylococcus
LQKAPFIFPIVKKLFVYEDPSL

SEQ ID NO: 2028072 - protein, 23 aa, Staphylococcus
LQKCQSFMISVAFITESGLASLK

SEQ ID NO: 2028073 - protein, 20 aa, Staphylococcus
LQKCVLKAIDQGWIRQVDHL

SEQ ID NO: 2028074 - protein, 20 aa, Staphylococcus
LQKEMEQVERFIKMFKPSDI

SEQ ID NO: 2028075 - protein, 18 aa, Staphylococcus
LQKEVDFAANLGLIDIEM

SEQ ID NO: 2028076 - protein, 17 aa, Staphylococcus
LQKEVDFAVKLGLVDKE

SEQ ID NO: 2028077 - protein, 17 aa, Staphylococcus
LQKEVDFAVQLGLVDKE

SEQ ID NO: 2028078 - protein, 18 aa, Staphylococcus
LQKEVDFAVQLGLVDKED

SEQ ID NO: 2028079 - protein, 18 aa, Staphylococcus
LQKEVDFAVQLGLVDREV

SEQ ID NO: 2028080 - protein, 18 aa, Staphylococcus
LQKEVDFAVQLGLVEKED

SEQ ID NO: 2028081 - protein, 23 aa, Staphylococcus
LQKFKLNIMQQWFMKKDKKNFHH

SEQ ID NO: 2028082 - protein, 22 aa, Staphylococcus
LQKGEIVGLIGLNGAGKSTTIK

SEQ ID NO: 2028083 - protein, 25 aa, Staphylococcus
LQKGHIRIGLSPMMNVQMFTDSLNQ

SEQ ID NO: 2028084 - protein, 27 aa, Staphylococcus
LQKKVPMKVVYDIEDFEVPKGIEDHLF

SEQ ID NO: 2028085 - protein, 20 aa, Staphylococcus
LQKNIKLFVVIGQLNQLIKG

SEQ ID NO: 2028086 - protein, 19 aa, Staphylococcus
LQKNIKLYVVIGQLNQLIK

SEQ ID NO: 2028087 - protein, 24 aa, Staphylococcus
LQKPMDRLLCGDVGYGKTEVAIRA

SEQ ID NO: 2028088 - protein, 25 aa, Staphylococcus
LQKRINHYHMRNGVTIIDPDSTFIG

SEQ ID NO: 2028089 - protein, 18 aa, Staphylococcus
LQKSPAFFDKKKLAWVNN

SEQ ID NO: 2028090 - protein, 18 aa, Staphylococcus
LQKTVDVYRDYKQTKEDI

SEQ ID NO: 2028091 - protein, 17 aa, Staphylococcus
LQKTVDVYREYKNKKEE

SEQ ID NO: 2028092 - protein, 17 aa, Staphylococcus
LQKTVDVYRSYKSKKEE

SEQ ID NO: 2028093 - protein, 17 aa, Staphylococcus
LQKTVEVYRSYKSKKEE

SEQ ID NO: 2028094 - protein, 25 aa, Staphylococcus
LQLAKRAQRGITLLKELKKNPHRIV

SEQ ID NO: 2028095 - protein, 18 aa, Staphylococcus
LQLDKDVKDIPGAGAAGG

SEQ ID NO: 2028096 - protein, 21 aa, Staphylococcus
LQLEANGLIRMYLKNLDDDYT

SEQ ID NO: 2028097 - protein, 17 aa, Staphylococcus
LQLEQHKTIILVTHDMN

SEQ ID NO: 2028098 - protein, 20 aa, Staphylococcus
LQLIEACFDPVLANHVNPPQ

SEQ ID NO: 2028099 - protein, 17 aa, Staphylococcus
LQLKAFFNSDVPVHQGA

SEQ ID NO: 2028100 - protein, 20 aa, Staphylococcus
LQLKDIAYVINLFKKPVSKD

SEQ ID NO: 2028101 - protein, 17 aa, Staphylococcus
LQLKYGSSHLKIIQCDL

SEQ ID NO: 2028102 - protein, 17 aa, Staphylococcus
LQLLKRVNETFEVTILL

SEQ ID NO: 2028103 - protein, 20 aa, Staphylococcus
LQLLKRYGFIIYFKNPNDMY

SEQ ID NO: 2028104 - protein, 19 aa, Staphylococcus
LQLLTLAAVNAFFEDIMHA

SEQ ID NO: 2028105 - protein, 19 aa, Staphylococcus
LQLLTLAAVNGFFEDIMHA

SEQ ID NO: 2028106 - protein, 19 aa, Staphylococcus
LQLLTLAAVNGFFEDMMHA

SEQ ID NO: 2028107 - protein, 17 aa, Staphylococcus
LQLMADLVEHSRQEKGN

SEQ ID NO: 2028108 - protein, 24 aa, Staphylococcus
LQLMMLEPKFAILDEIDSGLDIDA

SEQ ID NO: 2028109 - protein, 18 aa, Staphylococcus
LQLMSDFSSRLYGKQSEI

SEQ ID NO: 2028110 - protein, 22 aa, Staphylococcus
LQLWLKSDIDVIITTGGTGIAP

SEQ ID NO: 2028111 - protein, 18 aa, Staphylococcus
LQMFKNEIGNFVVEAPVI

SEQ ID NO: 2028112 - protein, 20 aa, Staphylococcus
LQMNAASILGEYGSDIQETA

SEQ ID NO: 2028113 - protein, 24 aa, Staphylococcus
LQNCGVCSSGLYALVNGDIVEGDS

SEQ ID NO: 2028114 - protein, 18 aa, Staphylococcus
LQNHLWSNITINKSEDDT

SEQ ID NO: 2028115 - protein, 19 aa, Staphylococcus
LQNHPRLILQSNIQTITLR

SEQ ID NO: 2028116 - protein, 19 aa, Staphylococcus
LQNILPIPVIGVIEPGART

SEQ ID NO: 2028117 - protein, 18 aa, Staphylococcus
LQNINSFKDIARVLYSTR

SEQ ID NO: 2028118 - protein, 19 aa, Staphylococcus
LQNNPIRTFMCDDCKSRLD

SEQ ID NO: 2028119 - protein, 19 aa, Staphylococcus
LQNNVRFRNEECMVVGDDT

SEQ ID NO: 2028120 - protein, 24 aa, Staphylococcus
LQNREGLRIAVIVNDMSEVNIDKD

SEQ ID NO: 2028121 - protein, 17 aa, Staphylococcus
LQPAAGAHGEWTALMIF

SEQ ID NO: 2028122 - protein, 18 aa, Staphylococcus
LQPAAVIVGKPLINVGTI

SEQ ID NO: 2028123 - protein, 23 aa, Staphylococcus
LQPGEAFAEFSAAIKLGRYQEPR

SEQ ID NO: 2028124 - protein, 25 aa, Staphylococcus
LQPHFSRMPTIVGIGSQSAFLTQAS

SEQ ID NO: 2028125 - protein, 26 aa, Staphylococcus
LQPIILRKTVRGYHIVVGERRFRASQ

SEQ ID NO: 2028126 - protein, 25 aa, Staphylococcus
LQPLLKRKFPEHHFEFTYIDINRDT

SEQ ID NO: 2028127 - protein, 22 aa, Staphylococcus
LQPLLKRKYPQIDFQFTYIDFE

SEQ ID NO: 2028128 - protein, 25 aa, Staphylococcus
LQPLYKDRIPVVIKNTNRPNDKGTY

SEQ ID NO: 2028129 - protein, 24 aa, Staphylococcus
LQPLYKHRIPVVIKNTNHPEDKGT

SEQ ID NO: 2028130 - protein, 19 aa, Staphylococcus
LQPNFSRLRQQLETYVDQM

SEQ ID NO: 2028131 - protein, 24 aa, Staphylococcus
LQPNMPAMHSLFIGNPGTGKTTVA

SEQ ID NO: 2028132 - protein, 17 aa, Staphylococcus
LQPPLKGKQILGVDPAF

SEQ ID NO: 2028133 - protein, 19 aa, Staphylococcus
LQPPMKGKQILGIDPAFRT

SEQ ID NO: 2028134 - protein, 17 aa, Staphylococcus
LQPRFSPTRPFIMVIHI

SEQ ID NO: 2028135 - protein, 26 aa, Staphylococcus
LQPSPFHWRFMDKLALSTLYEVVLPI

SEQ ID NO: 2028136 - protein, 26 aa, Staphylococcus
LQPSPFHWRLMDKLALNTLYEVVLPI

SEQ ID NO: 2028137 - protein, 26 aa, Staphylococcus
LQPSPFHWRLMDKLTLATLYEVVLPI

SEQ ID NO: 2028138 - protein, 17 aa, Staphylococcus
LQQEFENAFLLRTFSKA

SEQ ID NO: 2028139 - protein, 18 aa, Staphylococcus
LQQEGFRIVSGGTDNHLV

SEQ ID NO: 2028140 - protein, 17 aa, Staphylococcus
LQQFYAGLINNMMKVEE

SEQ ID NO: 2028141 - protein, 26 aa, Staphylococcus
LQQLVEIFKGFKFKVNGTLPIDKAFV

SEQ ID NO: 2028142 - protein, 18 aa, Staphylococcus
LQQLWKNRANRFSHDMSF

SEQ ID NO: 2028143 - protein, 24 aa, Staphylococcus
LQQPEAWGGRYLLSGHSYSMPELA

SEQ ID NO: 2028144 - protein, 23 aa, Staphylococcus
LQQREVKKSAYLVITSDKGLAGA

SEQ ID NO: 2028145 - protein, 24 aa, Staphylococcus
LQQRLEENPSWILQPYPIAIPHMK

SEQ ID NO: 2028146 - protein, 21 aa, Staphylococcus
LQRAIEYSKEFELQNIEIEAI

SEQ ID NO: 2028147 - protein, 25 aa, Staphylococcus
LQREKDRGVCLFGPHRDDLGFNVNG

SEQ ID NO: 2028148 - protein, 18 aa, Staphylococcus
LQRHSRDALLKNGKKFGF

SEQ ID NO: 2028149 - protein, 23 aa, Staphylococcus
LQRLKLAKRLLAINKLVPLYISD

SEQ ID NO: 2028150 - protein, 22 aa, Staphylococcus
LQRLKPQHFEDIVAVTSLYRPG

SEQ ID NO: 2028151 - protein, 20 aa, Staphylococcus
LQRMIENICYNNAYHYFKLI

SEQ ID NO: 2028152 - protein, 24 aa, Staphylococcus
LQRQAKVISELDCLQSFAEIAQKY

SEQ ID NO: 2028153 - protein, 17 aa, Staphylococcus
LQRQFAYTKEEMNKYIV

SEQ ID NO: 2028154 - protein, 19 aa, Staphylococcus
LQSCKNCYLDTSKPNDINF

SEQ ID NO: 2028155 - protein, 18 aa, Staphylococcus
LQSDAKLVYCLEQDDQGV

SEQ ID NO: 2028156 - protein, 23 aa, Staphylococcus
LQSECVQTLIIYYAPKVIGGSGK

SEQ ID NO: 2028157 - protein, 21 aa, Staphylococcus
LQSEGYIPIIAHPERNKEISQ

SEQ ID NO: 2028158 - protein, 19 aa, Staphylococcus
LQSIFGERDMFFISENGAV

SEQ ID NO: 2028159 - protein, 19 aa, Staphylococcus
LQSKVKFAIWEKYDDTHRV

SEQ ID NO: 2028160 - protein, 18 aa, Staphylococcus
LQSLGKWLVPQTKHYSWL

SEQ ID NO: 2028161 - protein, 18 aa, Staphylococcus
LQSLKLNKKLLVTYRTSN

SEQ ID NO: 2028162 - protein, 23 aa, Staphylococcus
LQSLPKRLAVIGGGVIATELASS

SEQ ID NO: 2028163 - protein, 31 aa, Staphylococcus
LQSMEALILPYGFYRCHRSYIINLQKVKEII

SEQ ID NO: 2028164 - protein, 18 aa, Staphylococcus
LQSRLLLGTGKFDNEDIQ

SEQ ID NO: 2028165 - protein, 18 aa, Staphylococcus
LQSRLLLGTGKFENEDVQ

SEQ ID NO: 2028166 - protein, 18 aa, Staphylococcus
LQSVELLEAQALQIHVNS

SEQ ID NO: 2028167 - protein, 17 aa, Staphylococcus
LQSYFAIDFGYVNDPSA

SEQ ID NO: 2028168 - protein, 23 aa, Staphylococcus
LQTKIIIVTTFKRPGYFEKAVAN

SEQ ID NO: 2028169 - protein, 20 aa, Staphylococcus
LQTMKLPYKFYVGGKLGSGR

SEQ ID NO: 2028170 - protein, 19 aa, Staphylococcus
LQTPFEMIHKAYLESTAFG

SEQ ID NO: 2028171 - protein, 24 aa, Staphylococcus
LQTRLYGVSSLKALAATIKDEHRL

SEQ ID NO: 2028172 - protein, 25 aa, Staphylococcus
LQVLNVMHQFYIPKIITGGATSTPS

SEQ ID NO: 2028173 - protein, 23 aa, Staphylococcus
LQVNLIRSHACGIGKPFSEEVAL

SEQ ID NO: 2028174 - protein, 21 aa, Staphylococcus
LQVPVEWLKGKIVVDSLGLHS

SEQ ID NO: 2028175 - protein, 19 aa, Staphylococcus
LQVVKGHYGKVDIVVNSAG

SEQ ID NO: 2028176 - protein, 19 aa, Staphylococcus
LQWRGLIYQQTDEQGIEDL

SEQ ID NO: 2028177 - protein, 19 aa, Staphylococcus
LQWRGLIYQQTDESSIEEL

SEQ ID NO: 2028178 - protein, 21 aa, Staphylococcus
LQWTSYRVKYIETVGINELIQ

SEQ ID NO: 2028179 - protein, 37 aa, Staphylococcus
LQYHGRVLTAYVLRKSMLERYVFDGAFTYQCGDERIQ

SEQ ID NO: 2028180 - protein, 17 aa, Staphylococcus
LQYLVAAALEVTDVTIF

SEQ ID NO: 2028181 - protein, 17 aa, Staphylococcus
LQYNNNIWNEWAFEKFV

SEQ ID NO: 2028182 - protein, 17 aa, Staphylococcus
LQYNNNIWNEWAFEKYI

SEQ ID NO: 2028183 - protein, 18 aa, Staphylococcus
LQYNNNIWNEWAFENYIN

SEQ ID NO: 2028184 - protein, 17 aa, Staphylococcus
LRAAGLPADELTIIDPH

SEQ ID NO: 2028185 - protein, 17 aa, Staphylococcus
LRAENKLLEAQRLEQRT

SEQ ID NO: 2028186 - protein, 20 aa, Staphylococcus
LRAEVFLKEQFERLEKEQIF

SEQ ID NO: 2028187 - protein, 21 aa, Staphylococcus
LRAEVFLKEQFMRLEKEQIFV

SEQ ID NO: 2028188 - protein, 17 aa, Staphylococcus
LRAGREIKSDMYINLGI

SEQ ID NO: 2028189 - protein, 18 aa, Staphylococcus
LRAHLEFLNEQRNLISTH

SEQ ID NO: 2028190 - protein, 18 aa, Staphylococcus
LRAIGSGLAEVFGVDIET

SEQ ID NO: 2028191 - protein, 33 aa, Staphylococcus
LRAIQRIYEAYPFKRGIYSGGVGYINCNHNLDF

SEQ ID NO: 2028192 - protein, 21 aa, Staphylococcus
LRAIRRIYETYPYKRGLYSGG

SEQ ID NO: 2028193 - protein, 25 aa, Staphylococcus
LRALQSRLGITFIFVTHDQEEALAL

SEQ ID NO: 2028194 - protein, 22 aa, Staphylococcus
LRALYKRDVLDFYKDGKMAYYY

SEQ ID NO: 2028195 - protein, 20 aa, Staphylococcus
LRALYKRDVLNFYKDEKMVY

SEQ ID NO: 2028196 - protein, 19 aa, Staphylococcus
LRALYRGKADHVVNFMHFI

SEQ ID NO: 2028197 - protein, 20 aa, Staphylococcus
LRANYTLQRDVDYMVVDGEV

SEQ ID NO: 2028198 - protein, 18 aa, Staphylococcus
LRAQSILQDRAFKNDKID

SEQ ID NO: 2028199 - protein, 18 aa, Staphylococcus
LRARGCRNGDIVRILGGE

SEQ ID NO: 2028200 - protein, 18 aa, Staphylococcus
LRAVSDFEYELRLTSMNK

SEQ ID NO: 2028201 - protein, 19 aa, Staphylococcus
LRDAIPTTVTINYDLTGKL

SEQ ID NO: 2028202 - protein, 19 aa, Staphylococcus
LRDALKILIGKQIPTKLTY

SEQ ID NO: 2028203 - protein, 20 aa, Staphylococcus
LRDEPLDHVLLFGPPGLGKT

SEQ ID NO: 2028204 - protein, 26 aa, Staphylococcus
LRDETSLRTGVRIVIDVRKDANASVI

SEQ ID NO: 2028205 - protein, 21 aa, Staphylococcus
LRDFIKQYCIDASHMPSVIIT

SEQ ID NO: 2028206 - protein, 21 aa, Staphylococcus
LRDKIQLISKCGIILPTDRLE

SEQ ID NO: 2028207 - protein, 27 aa, Staphylococcus
LRDKTWSVHVPRRIKEIGPRIKKISDE

SEQ ID NO: 2028208 - protein, 27 aa, Staphylococcus
LRDKTWSVHVPRRIKEIGPRIKKTTDE

SEQ ID NO: 2028209 - protein, 27 aa, Staphylococcus
LRDKTWSVHVPRRIKEIGPRIKKVGDE

SEQ ID NO: 2028210 - protein, 27 aa, Staphylococcus
LRDKTWSVHVPRRIKEIGPRIKKVTDE

SEQ ID NO: 2028211 - protein, 23 aa, Staphylococcus
LRDLNEIYDFILIDTPPVISVTD

SEQ ID NO: 2028212 - protein, 20 aa, Staphylococcus
LRDLNITFTLLRPTTEFETM

SEQ ID NO: 2028213 - protein, 23 aa, Staphylococcus
LRDPDLYKSFLFSSQNTEFNRMF

SEQ ID NO: 2028214 - protein, 21 aa, Staphylococcus
LRDRVILELLYGTGIRVSELV

SEQ ID NO: 2028215 - protein, 24 aa, Staphylococcus
LRDVLDRFGTWVGHKTIVGTPEQV

SEQ ID NO: 2028216 - protein, 19 aa, Staphylococcus
LRDVYRMVMELKNNTDYQV

SEQ ID NO: 2028217 - protein, 21 aa, Staphylococcus
LREAQKALAENVTRFIHGQDA

SEQ ID NO: 2028218 - protein, 26 aa, Staphylococcus
LREAQKALAENVVRFIHGEGALNDAI

SEQ ID NO: 2028219 - protein, 17 aa, Staphylococcus
LREATRIGDIELQKYYL

SEQ ID NO: 2028220 - protein, 26 aa, Staphylococcus
LREDFNINIPERWSIAQLFQSAMETE

SEQ ID NO: 2028221 - protein, 29 aa, Staphylococcus
LREDMRLLIQRLVKQYGMTAIFVTHDQYE

SEQ ID NO: 2028222 - protein, 20 aa, Staphylococcus
LREEPLDHVLLFGPPGLGKT

SEQ ID NO: 2028223 - protein, 17 aa, Staphylococcus
LREGFKDVPQAEVSNAT

SEQ ID NO: 2028224 - protein, 23 aa, Staphylococcus
LREGLPLRSEYHADYLDKAVRSF

SEQ ID NO: 2028225 - protein, 23 aa, Staphylococcus
LREGLPLRSEYHAQYLKDAVHSF

SEQ ID NO: 2028226 - protein, 19 aa, Staphylococcus
LREGMPIGAKVTLRGDRMY

SEQ ID NO: 2028227 - protein, 18 aa, Staphylococcus
LREHFKLRTDKSTIMLYI

SEQ ID NO: 2028228 - protein, 25 aa, Staphylococcus
LREHNHRTAFEFRFEDLFTKEEWLE

SEQ ID NO: 2028229 - protein, 18 aa, Staphylococcus
LREKGAMTNVLFMTATPI

SEQ ID NO: 2028230 - protein, 17 aa, Staphylococcus
LREKLGIFDGDVDEKEE

SEQ ID NO: 2028231 - protein, 17 aa, Staphylococcus
LREKLGIFDGDVEEKEA

SEQ ID NO: 2028232 - protein, 18 aa, Staphylococcus
LREPGFFRRLKVMPHAQD

SEQ ID NO: 2028233 - protein, 17 aa, Staphylococcus
LRESAYKNVYKAYGSHN

SEQ ID NO: 2028234 - protein, 17 aa, Staphylococcus
LRETLNFIDSKSEAQSE

SEQ ID NO: 2028235 - protein, 28 aa, Staphylococcus
LREVRKKELKLLIDEALVNKDEKAFNEY

SEQ ID NO: 2028236 - protein, 24 aa, Staphylococcus
LREYNEKLIIPGFFGVSRQNYIVT

SEQ ID NO: 2028237 - protein, 21 aa, Staphylococcus
LRFADDYIRQKGYKFSSIERK

SEQ ID NO: 2028238 - protein, 17 aa, Staphylococcus
LRFAGLSTQQIHRLLRF

SEQ ID NO: 2028239 - protein, 17 aa, Staphylococcus
LRFDEDVVFCEEHTFMV

SEQ ID NO: 2028240 - protein, 17 aa, Staphylococcus
LRFDEDVVFCEEHTFVT

SEQ ID NO: 2028241 - protein, 22 aa, Staphylococcus
LRFGDAELNSGTRIHFVEIPKY

SEQ ID NO: 2028242 - protein, 25 aa, Staphylococcus
LRFGDANLSPGTRIHFVEIPNKDYS

SEQ ID NO: 2028243 - protein, 25 aa, Staphylococcus
LRFGDANLSPGTRLHFVEVPHSDYR

SEQ ID NO: 2028244 - protein, 19 aa, Staphylococcus
LRFKGFLNEHDEILTCDNS

SEQ ID NO: 2028245 - protein, 20 aa, Staphylococcus
LRFKGFLNEHNEILICDQSV

SEQ ID NO: 2028246 - protein, 20 aa, Staphylococcus
LRFKGFLNEYNEILTCDESV

SEQ ID NO: 2028247 - protein, 23 aa, Staphylococcus
LRFPTDHELYILKKVKRWLDDYF

SEQ ID NO: 2028248 - protein, 20 aa, Staphylococcus
LRFVTHRTRLEGGEIQTANY

SEQ ID NO: 2028249 - protein, 17 aa, Staphylococcus
LRGKHKATYTPHVDSGD

SEQ ID NO: 2028250 - protein, 20 aa, Staphylococcus
LRGMLRRMIGHPVKDAQSYK

SEQ ID NO: 2028251 - protein, 20 aa, Staphylococcus
LRGMLRRMVGHPKKDKDAYE

SEQ ID NO: 2028252 - protein, 19 aa, Staphylococcus
LRGMLRRMVGHPSKNKESY

SEQ ID NO: 2028253 - protein, 21 aa, Staphylococcus
LRGRHPYEFVKDLRKDTGATT

SEQ ID NO: 2028254 - protein, 20 aa, Staphylococcus
LRGSAFGVLVNIAFHEYLLP

SEQ ID NO: 2028255 - protein, 17 aa, Staphylococcus
LRGYDSVIDFLLHDQEV

SEQ ID NO: 2028256 - protein, 20 aa, Staphylococcus
LRHLEKPILKEMLKKHDEVD

SEQ ID NO: 2028257 - protein, 17 aa, Staphylococcus
LRHNIDLSLQLNDREQF

SEQ ID NO: 2028258 - protein, 18 aa, Staphylococcus
LRIADFFIQTYSYVSVIE

SEQ ID NO: 2028259 - protein, 28 aa, Staphylococcus
LRIASEYKLPTFLMGVGLGGLITLNLLE

SEQ ID NO: 2028260 - protein, 17 aa, Staphylococcus
LRICRSIDRYKLSARIP

SEQ ID NO: 2028261 - protein, 21 aa, Staphylococcus
LRIDQWESHHHELLMKNLSLL

SEQ ID NO: 2028262 - protein, 19 aa, Staphylococcus
LRIEYKQYISIRHILNPSL

SEQ ID NO: 2028263 - protein, 27 aa, Staphylococcus
LRIGDTCPICGNEIESLNQHIDFETIN

SEQ ID NO: 2028264 - protein, 18 aa, Staphylococcus
LRIGLSLEYLNATDDTIS

SEQ ID NO: 2028265 - protein, 21 aa, Staphylococcus
LRILRGLRFKSQLRFEIDSDT

SEQ ID NO: 2028266 - protein, 17 aa, Staphylococcus
LRINAFEEVLTVKKINN

SEQ ID NO: 2028267 - protein, 23 aa, Staphylococcus
LRIPENQKYGAFHGKESFKEAIV

SEQ ID NO: 2028268 - protein, 17 aa, Staphylococcus
LRISQLSGELAIQLLDD

SEQ ID NO: 2028269 - protein, 29 aa, Staphylococcus
LRISTLPLSLGIESCVIRIVPQYFQKGSD

SEQ ID NO: 2028270 - protein, 18 aa, Staphylococcus
LRITEIMNEQAKNHLEAN

SEQ ID NO: 2028271 - protein, 17 aa, Staphylococcus
LRIVANMAVGYDNIDIS

SEQ ID NO: 2028272 - protein, 19 aa, Staphylococcus
LRKAGAKHFDIMTADVTNR

SEQ ID NO: 2028273 - protein, 19 aa, Staphylococcus
LRKGEIQFLYVAPERFDNV

SEQ ID NO: 2028274 - protein, 22 aa, Staphylococcus
LRKIAHKIAWLKGKASKGSLVY

SEQ ID NO: 2028275 - protein, 25 aa, Staphylococcus
LRKIYLEEFRKGFKQQIEHTKVMDP

SEQ ID NO: 2028276 - protein, 19 aa, Staphylococcus
LRKKLSEIGMDSAIETKVG

SEQ ID NO: 2028277 - protein, 22 aa, Staphylococcus
LRKKLSEIGMETEIETKVGKGY

SEQ ID NO: 2028278 - protein, 20 aa, Staphylococcus
LRKKYTFPVVTFTATAIVGG

SEQ ID NO: 2028279 - protein, 27 aa, Staphylococcus
LRKLIAIKLGSRIKVSRLNKVIRDEIN

SEQ ID NO: 2028280 - protein, 22 aa, Staphylococcus
LRKLLAEPTINMLFNAINTKIA

SEQ ID NO: 2028281 - protein, 20 aa, Staphylococcus
LRKPDWLKIKLNTNENYIGL

SEQ ID NO: 2028282 - protein, 18 aa, Staphylococcus
LRKQYEISEHSSPIEFVT

SEQ ID NO: 2028283 - protein, 22 aa, Staphylococcus
LRKREIEGLVVIGGDGSYRGAQ

SEQ ID NO: 2028284 - protein, 17 aa, Staphylococcus
LRKSEAFVPDLSLVAVN

SEQ ID NO: 2028285 - protein, 20 aa, Staphylococcus
LRKSVIRWCELILSNKPMAM

SEQ ID NO: 2028286 - protein, 17 aa, Staphylococcus
LRKSWIDARQDVESYKG

SEQ ID NO: 2028287 - protein, 26 aa, Staphylococcus
LRKVIEDYTVLRGCHPFYIENGAFSG

SEQ ID NO: 2028288 - protein, 22 aa, Staphylococcus
LRKVILHWCDLLLTNKPMALIG

SEQ ID NO: 2028289 - protein, 20 aa, Staphylococcus
LRKVIVHWCELLLTNKPMAL

SEQ ID NO: 2028290 - protein, 19 aa, Staphylococcus
LRKYARVRLSNNIEINAYI

SEQ ID NO: 2028291 - protein, 18 aa, Staphylococcus
LRLAEALFKDQKRVKQLI

SEQ ID NO: 2028292 - protein, 17 aa, Staphylococcus
LRLDCAHIIEQQGRKEG

SEQ ID NO: 2028293 - protein, 19 aa, Staphylococcus
LRLERKKQLVTLIDEALVN

SEQ ID NO: 2028294 - protein, 20 aa, Staphylococcus
LRLKFLKSETSGVAVWGKIF

SEQ ID NO: 2028295 - protein, 20 aa, Staphylococcus
LRLKNIKAYQHDATKPYNNQ

SEQ ID NO: 2028296 - protein, 35 aa, Staphylococcus
LRLKRQKVSMVFQHFNLLWSRTVLNNIKFPLEIAG

SEQ ID NO: 2028297 - protein, 18 aa, Staphylococcus
LRLLEMVETPFFSKETVD

SEQ ID NO: 2028298 - protein, 18 aa, Staphylococcus
LRLLKYKFQDETVVESTQ

SEQ ID NO: 2028299 - protein, 21 aa, Staphylococcus
LRLLYKNDVLDFWKDGKMAYY

SEQ ID NO: 2028300 - protein, 21 aa, Staphylococcus
LRLLYKNEVLDFYKDGKMAYY

SEQ ID NO: 2028301 - protein, 23 aa, Staphylococcus
LRLMKQAEKFNRPIFSFIDTKGA

SEQ ID NO: 2028302 - protein, 19 aa, Staphylococcus
LRLNVTFIPTQQIRFEEAT

SEQ ID NO: 2028303 - protein, 23 aa, Staphylococcus
LRLPENQKYGAFHGKETFKQAIV

SEQ ID NO: 2028304 - protein, 18 aa, Staphylococcus
LRLQYGFVGTNLKVGRYR

SEQ ID NO: 2028305 - protein, 19 aa, Staphylococcus
LRLRDIRPTADFLVDILGY

SEQ ID NO: 2028306 - protein, 17 aa, Staphylococcus
LRLSEQIIGTSAGSQVG

SEQ ID NO: 2028307 - protein, 18 aa, Staphylococcus
LRLTDLGYELGMISEERY

SEQ ID NO: 2028308 - protein, 18 aa, Staphylococcus
LRLTKGIHVVIDQSKFPL

SEQ ID NO: 2028309 - protein, 18 aa, Staphylococcus
LRLVLLTRHSRSQRAEAL

SEQ ID NO: 2028310 - protein, 27 aa, Staphylococcus
LRLVNEEDYRFTLKNQFDFTNAEDSLI

SEQ ID NO: 2028311 - protein, 20 aa, Staphylococcus
LRLYPTKNLEDFYDKEGFRD

SEQ ID NO: 2028312 - protein, 18 aa, Staphylococcus
LRLYQSQVKYYGFSEKLY

SEQ ID NO: 2028313 - protein, 25 aa, Staphylococcus
LRMHGIKAKILILGVIPPKDINKAI

SEQ ID NO: 2028314 - protein, 19 aa, Staphylococcus
LRMHYLIANALDLNGYEDF

SEQ ID NO: 2028315 - protein, 17 aa, Staphylococcus
LRMHYLISNAIDLTGFE

SEQ ID NO: 2028316 - protein, 17 aa, Staphylococcus
LRMHYLISNALDLRGYE

SEQ ID NO: 2028317 - protein, 21 aa, Staphylococcus
LRMHYLISNALDLTGYENFAV

SEQ ID NO: 2028318 - protein, 17 aa, Staphylococcus
LRMMCQFVDDIDIVVNI

SEQ ID NO: 2028319 - protein, 17 aa, Staphylococcus
LRMMCQFVDDIDVVVKM

SEQ ID NO: 2028320 - protein, 21 aa, Staphylococcus
LRMVYEVRKAIDIPIIAMGGV

SEQ ID NO: 2028321 - protein, 19 aa, Staphylococcus
LRMYQRYAEQQGFKVEFAD

SEQ ID NO: 2028322 - protein, 19 aa, Staphylococcus
LRMYQRYCEQKGFNVEIAD

SEQ ID NO: 2028323 - protein, 20 aa, Staphylococcus
LRNAFPTTVTISYDLTGKLE

SEQ ID NO: 2028324 - protein, 19 aa, Staphylococcus
LRNAIPTTVTINYDLTGKF

SEQ ID NO: 2028325 - protein, 18 aa, Staphylococcus
LRNDRINVSYIMDLVRQI

SEQ ID NO: 2028326 - protein, 18 aa, Staphylococcus
LRNGHAVEVPTYDYTNHT

SEQ ID NO: 2028327 - protein, 18 aa, Staphylococcus
LRNGKAVEVPTYDYASHT

SEQ ID NO: 2028328 - protein, 18 aa, Staphylococcus
LRNIMTFLGVPSYETIII

SEQ ID NO: 2028329 - protein, 18 aa, Staphylococcus
LRNKGIKILPFNPDNIEK

SEQ ID NO: 2028330 - protein, 28 aa, Staphylococcus
LRNKGVAYCPHCDGPLFEGKDVAVVGGG

SEQ ID NO: 2028331 - protein, 26 aa, Staphylococcus
LRNLGFKVYYSIECAVASLSKEDRNY

SEQ ID NO: 2028332 - protein, 24 aa, Staphylococcus
LRNPDCPLCGNGEYERLGIAQPKW

SEQ ID NO: 2028333 - protein, 27 aa, Staphylococcus
LRNPDMIESFRIARQVNPEGVIFSNVG

SEQ ID NO: 2028334 - protein, 20 aa, Staphylococcus
LRNRIILCTRLFSSNPKKEI

SEQ ID NO: 2028335 - protein, 21 aa, Staphylococcus
LRNTIKEMYYFSVANPNPLNW

SEQ ID NO: 2028336 - protein, 26 aa, Staphylococcus
LRNVKKDIGMIFQHFNLLNSKTVFKN

SEQ ID NO: 2028337 - protein, 25 aa, Staphylococcus
LRNYKEKLIIPGFFGISKQNYIVTF

SEQ ID NO: 2028338 - protein, 18 aa, Staphylococcus
LRPEIKFDGIDPLVEQMN

SEQ ID NO: 2028339 - protein, 21 aa, Staphylococcus
LRPEKFSKLQKGSIYSEGKVI

SEQ ID NO: 2028340 - protein, 20 aa, Staphylococcus
LRPFGTDFSSPCFELEGVIV

SEQ ID NO: 2028341 - protein, 19 aa, Staphylococcus
LRPFLLRDGGDCSLVDVED

SEQ ID NO: 2028342 - protein, 20 aa, Staphylococcus
LRPFNPEIIGINRSNSLVDY

SEQ ID NO: 2028343 - protein, 20 aa, Staphylococcus
LRPFYETILGFEVITETNHS

SEQ ID NO: 2028344 - protein, 20 aa, Staphylococcus
LRPKKELIGNIAGTIQLLSE

SEQ ID NO: 2028345 - protein, 17 aa, Staphylococcus
LRPLLTLDKEDIIKKAR

SEQ ID NO: 2028346 - protein, 19 aa, Staphylococcus
LRPLLTLDKEDIVIKAKEY

SEQ ID NO: 2028347 - protein, 17 aa, Staphylococcus
LRPLTGLDDLVYNYVMK

SEQ ID NO: 2028348 - protein, 23 aa, Staphylococcus
LRPPHRKEVLKAREEDIKDKVKN

SEQ ID NO: 2028349 - protein, 23 aa, Staphylococcus
LRPPHRKEVLKARENDIKGKVQN

SEQ ID NO: 2028350 - protein, 20 aa, Staphylococcus
LRPRQVQRSGYLVITSDKGL

SEQ ID NO: 2028351 - protein, 20 aa, Staphylococcus
LRPYDVMKINDEYALNFVGL

SEQ ID NO: 2028352 - protein, 27 aa, Staphylococcus
LRQELKKACAEHDIKLSIPSPKLCTDN

SEQ ID NO: 2028353 - protein, 22 aa, Staphylococcus
LRQIELKSGQVLSFEQITALSI

SEQ ID NO: 2028354 - protein, 19 aa, Staphylococcus
LRQKMGMVFQNFNLFPHKK

SEQ ID NO: 2028355 - protein, 19 aa, Staphylococcus
LRQKMGMVFQNFNLFPHKT

SEQ ID NO: 2028356 - protein, 20 aa, Staphylococcus
LRQLFKDKLMHAGMPEKYAD

SEQ ID NO: 2028357 - protein, 18 aa, Staphylococcus
LRQLMSIINACAETDYKL

SEQ ID NO: 2028358 - protein, 25 aa, Staphylococcus
LRQLPTYIRKHFDDIKVLAITLYGE

SEQ ID NO: 2028359 - protein, 19 aa, Staphylococcus
LRQVNVIKEAVVVPIYKNS

SEQ ID NO: 2028360 - protein, 18 aa, Staphylococcus
LRRFKRTVSKSGTIQEVR

SEQ ID NO: 2028361 - protein, 27 aa, Staphylococcus
LRRFTSTEVDLFFTLCNKLKEQDTRKV

SEQ ID NO: 2028362 - protein, 18 aa, Staphylococcus
LRRINRKTALLIQLATEL

SEQ ID NO: 2028363 - protein, 18 aa, Staphylococcus
LRRINRKTALLIQLATEV

SEQ ID NO: 2028364 - protein, 19 aa, Staphylococcus
LRRINRKTALLIQLSTEVG

SEQ ID NO: 2028365 - protein, 22 aa, Staphylococcus
LRRLCKDLNKTIVIVLHDINFA

SEQ ID NO: 2028366 - protein, 21 aa, Staphylococcus
LRRPEMTYDLILEILDESHQL

SEQ ID NO: 2028367 - protein, 19 aa, Staphylococcus
LRRSEIYDIKYGIYSHWHP

SEQ ID NO: 2028368 - protein, 23 aa, Staphylococcus
LRRSHQQRFLIIFSDGEPSAYNY

SEQ ID NO: 2028369 - protein, 26 aa, Staphylococcus
LRRYISWDNIKDIFKVLKGVLDARSV

SEQ ID NO: 2028370 - protein, 26 aa, Staphylococcus
LRSANEIGLDLGYTVDELIDLVRQLL

SEQ ID NO: 2028371 - protein, 24 aa, Staphylococcus
LRSASEIQIDLGYTVEELTDIVRQ

SEQ ID NO: 2028372 - protein, 20 aa, Staphylococcus
LRSFAKEFIESEGNLELKIV

SEQ ID NO: 2028373 - protein, 21 aa, Staphylococcus
LRSFFPDKVDNITFVAENGAV

SEQ ID NO: 2028374 - protein, 17 aa, Staphylococcus
LRSGAMASVAPIINEVK

SEQ ID NO: 2028375 - protein, 18 aa, Staphylococcus
LRSGAMASVAPVIDEVKR

SEQ ID NO: 2028376 - protein, 18 aa, Staphylococcus
LRSGAMASVAPVINEVKR

SEQ ID NO: 2028377 - protein, 19 aa, Staphylococcus
LRSGEVRMILSTCRATVGQ

SEQ ID NO: 2028378 - protein, 17 aa, Staphylococcus
LRSIIELLKKHDIEAYI

SEQ ID NO: 2028379 - protein, 20 aa, Staphylococcus
LRSLQAIALKAANSIFVGDY

SEQ ID NO: 2028380 - protein, 21 aa, Staphylococcus
LRSLQAIALKAANSIFVGDYL

SEQ ID NO: 2028381 - protein, 17 aa, Staphylococcus
LRSLTSIGIDEEKVELF

SEQ ID NO: 2028382 - protein, 17 aa, Staphylococcus
LRSRLFVEQIVSFAESR

SEQ ID NO: 2028383 - protein, 32 aa, Staphylococcus
LRSRSQRDYLLFKFAIHTGIKLSELLNMSVQR

SEQ ID NO: 2028384 - protein, 18 aa, Staphylococcus
LRSSATMRSLVRENHVRK

SEQ ID NO: 2028385 - protein, 25 aa, Staphylococcus
LRSYKDLPLRMAEFGQVHRHEFSGA

SEQ ID NO: 2028386 - protein, 26 aa, Staphylococcus
LRTADQIPVVYCLDKIAKQNLTCTDY

SEQ ID NO: 2028387 - protein, 25 aa, Staphylococcus
LRTFSKAYGLAGLRVGYVVASSDAI

SEQ ID NO: 2028388 - protein, 26 aa, Staphylococcus
LRTFSKAYGLAGMRIGYVIAAKEAIE

SEQ ID NO: 2028389 - protein, 20 aa, Staphylococcus
LRTLNALALAKSGTITIGDT

SEQ ID NO: 2028390 - protein, 17 aa, Staphylococcus
LRTNDFFDVDNYPEVKF

SEQ ID NO: 2028391 - protein, 18 aa, Staphylococcus
LRTPAEMKEFLTRDQYRL

SEQ ID NO: 2028392 - protein, 18 aa, Staphylococcus
LRTQTGLNHHTLDDIYIH

SEQ ID NO: 2028393 - protein, 18 aa, Staphylococcus
LRTSEYENALAYCRNTTV

SEQ ID NO: 2028394 - protein, 18 aa, Staphylococcus
LRTYLKAQRIPMESWSPL

SEQ ID NO: 2028395 - protein, 19 aa, Staphylococcus
LRVCSFLKEGTLADIGSDH

SEQ ID NO: 2028396 - protein, 18 aa, Staphylococcus
LRVEELDPANNRVILSRK

SEQ ID NO: 2028397 - protein, 18 aa, Staphylococcus
LRVGEDIDVDEFLNKLVN

SEQ ID NO: 2028398 - protein, 17 aa, Staphylococcus
LRVKALQMVPMYHNVKR

SEQ ID NO: 2028399 - protein, 22 aa, Staphylococcus
LRVKNSKLWQSKDNGFYDLTRD

SEQ ID NO: 2028400 - protein, 25 aa, Staphylococcus
LRVNNCVTIEPGIYVDGLGGVRIED

SEQ ID NO: 2028401 - protein, 24 aa, Staphylococcus
LRVNPKLSMPTVRSIIAIAVGYPN

SEQ ID NO: 2028402 - protein, 23 aa, Staphylococcus
LRVPHGAGGIVLDVKVFNREDGD

SEQ ID NO: 2028403 - protein, 24 aa, Staphylococcus
LRVPSDAAIEYWADRFDKLNIEHS

SEQ ID NO: 2028404 - protein, 17 aa, Staphylococcus
LRVSGADIKAAIERSAE

SEQ ID NO: 2028405 - protein, 19 aa, Staphylococcus
LRVSNRLAEKYGLDMRHTF

SEQ ID NO: 2028406 - protein, 26 aa, Staphylococcus
LRVTQELRKKGVVGKFIEFFGPGVAD

SEQ ID NO: 2028407 - protein, 27 aa, Staphylococcus
LRVTQELRKKGVVGKFVEFFGPGVQHL

SEQ ID NO: 2028408 - protein, 26 aa, Staphylococcus
LRVTQELRKKGVVGKFVEFFGPGVTD

SEQ ID NO: 2028409 - protein, 27 aa, Staphylococcus
LRVTQELRKKGVVGKFVEFFGPGVTDL

SEQ ID NO: 2028410 - protein, 17 aa, Staphylococcus
LRVVDILKPEYKESDNQ

SEQ ID NO: 2028411 - protein, 17 aa, Staphylococcus
LRYDEMQEWLVEHGQQK

SEQ ID NO: 2028412 - protein, 19 aa, Staphylococcus
LRYEKLADRALTYLDNYKQ

SEQ ID NO: 2028413 - protein, 20 aa, Staphylococcus
LRYIQKSIIKAIDMAWIEQV

SEQ ID NO: 2028414 - protein, 23 aa, Staphylococcus
LRYKILKADAFRSSNKLQEKIGV

SEQ ID NO: 2028415 - protein, 18 aa, Staphylococcus
LRYLATLKGMPRIDFDKA

SEQ ID NO: 2028416 - protein, 27 aa, Staphylococcus
LRYLIEGTDFTTGWIFFIDDVGQHELV

SEQ ID NO: 2028417 - protein, 22 aa, Staphylococcus
LRYLTPHGKWNIHSMYQDNKHM

SEQ ID NO: 2028418 - protein, 21 aa, Staphylococcus
LRYLTPHGKWNIHSTYQDNQH

SEQ ID NO: 2028419 - protein, 18 aa, Staphylococcus
LRYLYGMTERQFRNTFEI

SEQ ID NO: 2028420 - protein, 19 aa, Staphylococcus
LRYPEGFEFDDAIKRFANE

SEQ ID NO: 2028421 - protein, 17 aa, Staphylococcus
LRYQFLQKYWNTLPAKG

SEQ ID NO: 2028422 - protein, 17 aa, Staphylococcus
LRYSGIQAPQFQRLIHA

SEQ ID NO: 2028423 - protein, 19 aa, Staphylococcus
LRYTPRAKKVIELSMDEAR

SEQ ID NO: 2028424 - protein, 19 aa, Staphylococcus
LSAEGVQWIVLAGYMRLIG

SEQ ID NO: 2028425 - protein, 23 aa, Staphylococcus
LSAEVLRPVHDIMVTINTDAHHI

SEQ ID NO: 2028426 - protein, 20 aa, Staphylococcus
LSAGRLEYEKGYDILIESVQ

SEQ ID NO: 2028427 - protein, 20 aa, Staphylococcus
LSAGSRFMAAYPITPASEIM

SEQ ID NO: 2028428 - protein, 17 aa, Staphylococcus
LSAGTPVLASDIIANRY

SEQ ID NO: 2028429 - protein, 17 aa, Staphylococcus
LSAHYVRPASQRKGYGT

SEQ ID NO: 2028430 - protein, 20 aa, Staphylococcus
LSAIAQRIPVTKRFLAYGEK

SEQ ID NO: 2028431 - protein, 20 aa, Staphylococcus
LSAKENLTFFGNLKGLSGKK

SEQ ID NO: 2028432 - protein, 19 aa, Staphylococcus
LSALIKRYGMSHEYVEFDG

SEQ ID NO: 2028433 - protein, 19 aa, Staphylococcus
LSAQDSWTLTKHLKTLHVR

SEQ ID NO: 2028434 - protein, 22 aa, Staphylococcus
LSARGFLWSTARIYNESPDAPV

SEQ ID NO: 2028435 - protein, 25 aa, Staphylococcus
LSARMRHDMTWDFIYNNGLDVAYLS

SEQ ID NO: 2028436 - protein, 22 aa, Staphylococcus
LSARRHARVKECVTASTDSVEF

SEQ ID NO: 2028437 - protein, 17 aa, Staphylococcus
LSASIKIINRFSKQKLD

SEQ ID NO: 2028438 - protein, 33 aa, Staphylococcus
LSASMLSASIYRASEKWCHGFSDVPAETYIQSV

SEQ ID NO: 2028439 - protein, 17 aa, Staphylococcus
LSAYKRIEAISDEGTFN

SEQ ID NO: 2028440 - protein, 22 aa, Staphylococcus
LSCGELCACDLLAYFQFSQPTL

SEQ ID NO: 2028441 - protein, 18 aa, Staphylococcus
LSCGELCACDLLEHFQFS

SEQ ID NO: 2028442 - protein, 23 aa, Staphylococcus
LSDACSLNTLEVLVEADMLSDVL

SEQ ID NO: 2028443 - protein, 20 aa, Staphylococcus
LSDAEFRRIMIDISDKSVFD

SEQ ID NO: 2028444 - protein, 17 aa, Staphylococcus
LSDALGLSEDQKLKLFM

SEQ ID NO: 2028445 - protein, 22 aa, Staphylococcus
LSDEEITIFKSVGVAIVDIVVA

SEQ ID NO: 2028446 - protein, 27 aa, Staphylococcus
LSDEIIEFWKDYGLGTFFDGFMKSINP

SEQ ID NO: 2028447 - protein, 24 aa, Staphylococcus
LSDELKLRYLNFARLFQRQYFQNL

SEQ ID NO: 2028448 - protein, 24 aa, Staphylococcus
LSDFKFNELMVSIQSAFIYNDEDE

SEQ ID NO: 2028449 - protein, 18 aa, Staphylococcus
LSDFNRRYLSGFTGTSGA

SEQ ID NO: 2028450 - protein, 21 aa, Staphylococcus
LSDHRIGMMLAIGSLLSSEPL

SEQ ID NO: 2028451 - protein, 19 aa, Staphylococcus
LSDIKIVLNGAGAAGIAIC

SEQ ID NO: 2028452 - protein, 18 aa, Staphylococcus
LSDIKVVLNGAGAAGIAI

SEQ ID NO: 2028453 - protein, 20 aa, Staphylococcus
LSDIKVVLNGAGAAGIAIVK

SEQ ID NO: 2028454 - protein, 21 aa, Staphylococcus
LSDIRKGHVGQIPDHLKDGHY

SEQ ID NO: 2028455 - protein, 18 aa, Staphylococcus
LSDIRKGLVGQIPDYLKD

SEQ ID NO: 2028456 - protein, 18 aa, Staphylococcus
LSDIVNWLEFELSCVEQD

SEQ ID NO: 2028457 - protein, 24 aa, Staphylococcus
LSDKEIIELITFITFTNAQQQFGA

SEQ ID NO: 2028458 - protein, 22 aa, Staphylococcus
LSDKQRLALAFYADEAGQYTLT

SEQ ID NO: 2028459 - protein, 24 aa, Staphylococcus
LSDLLRQHGFKVFGPNQDAAQIEG

SEQ ID NO: 2028460 - protein, 23 aa, Staphylococcus
LSDLRQHIGIVFQNPENQFVGST

SEQ ID NO: 2028461 - protein, 23 aa, Staphylococcus
LSDLVGLDIAIAVIKGLQQIPEE

SEQ ID NO: 2028462 - protein, 24 aa, Staphylococcus
LSDNYIKIWEFYATLADNNYDMVL

SEQ ID NO: 2028463 - protein, 19 aa, Staphylococcus
LSDRLNARYEVKFSKASID

SEQ ID NO: 2028464 - protein, 25 aa, Staphylococcus
LSDSIMRRGLVSYNMDGLLISHESY

SEQ ID NO: 2028465 - protein, 19 aa, Staphylococcus
LSDYLPLMLQFLQTIEWRG

SEQ ID NO: 2028466 - protein, 20 aa, Staphylococcus
LSDYLPLMLQFLQVARWEND

SEQ ID NO: 2028467 - protein, 21 aa, Staphylococcus
LSEAEALCELLSLYESDKLSD

SEQ ID NO: 2028468 - protein, 25 aa, Staphylococcus
LSEAKFSILMLLSYEENMTLSPSDL

SEQ ID NO: 2028469 - protein, 24 aa, Staphylococcus
LSEARALKIFKYFYSHKGPVLDYN

SEQ ID NO: 2028470 - protein, 18 aa, Staphylococcus
LSEAVGVYQLKKSFGKES

SEQ ID NO: 2028471 - protein, 19 aa, Staphylococcus
LSEDELPIFRSFMEDTSES

SEQ ID NO: 2028472 - protein, 19 aa, Staphylococcus
LSEDELPIFRSFMEDTTET

SEQ ID NO: 2028473 - protein, 17 aa, Staphylococcus
LSEEIIHEQELPQPSLT

SEQ ID NO: 2028474 - protein, 25 aa, Staphylococcus
LSEGLKLHIIPAINRLNANIETYNP

SEQ ID NO: 2028475 - protein, 17 aa, Staphylococcus
LSEHSMLVDLGRNDIHR

SEQ ID NO: 2028476 - protein, 17 aa, Staphylococcus
LSEKAGLNVEAYKIQQD

SEQ ID NO: 2028477 - protein, 30 aa, Staphylococcus
LSEKFGVNGIRISIAWSRIFPDGYGEVNQK

SEQ ID NO: 2028478 - protein, 31 aa, Staphylococcus
LSEKFGVNGIRISIAWSRIFPKGYGEVNPKG

SEQ ID NO: 2028479 - protein, 32 aa, Staphylococcus
LSEKFGVNGIRISIAWSRIFPKGYGEVNPKGV

SEQ ID NO: 2028480 - protein, 31 aa, Staphylococcus
LSEKFGVNGIRISIAWSRIFPTGYGEVNQKG

SEQ ID NO: 2028481 - protein, 23 aa, Staphylococcus
LSEKHKIIMFILAQIEYFSSEDY

SEQ ID NO: 2028482 - protein, 19 aa, Staphylococcus
LSEKIKWNFTKFLVDREGN

SEQ ID NO: 2028483 - protein, 17 aa, Staphylococcus
LSELCLPLVKKGGQFIA

SEQ ID NO: 2028484 - protein, 18 aa, Staphylococcus
LSELLAIHRNEVIFGGHT

SEQ ID NO: 2028485 - protein, 26 aa, Staphylococcus
LSEMKRLGLPVPDGFTITTAACIEYL

SEQ ID NO: 2028486 - protein, 26 aa, Staphylococcus
LSEMKRLGLPVPDGFTITTEACIEYL

SEQ ID NO: 2028487 - protein, 26 aa, Staphylococcus
LSEMKRLGLPVPDGFTITTTACIEYL

SEQ ID NO: 2028488 - protein, 20 aa, Staphylococcus
LSENLNVCFNCDHHLSLTAY

SEQ ID NO: 2028489 - protein, 19 aa, Staphylococcus
LSEQFPYIRQLLDAYHIKR

SEQ ID NO: 2028490 - protein, 19 aa, Staphylococcus
LSEQFPYIRQLLDAYHIKY

SEQ ID NO: 2028491 - protein, 18 aa, Staphylococcus
LSEQFPYIRQLLDTYHIK

SEQ ID NO: 2028492 - protein, 17 aa, Staphylococcus
LSEQGVYPKYIETRKSS

SEQ ID NO: 2028493 - protein, 18 aa, Staphylococcus
LSERFVNYFNRFGQTVNG

SEQ ID NO: 2028494 - protein, 17 aa, Staphylococcus
LSERLSDRYRVITYDVR

SEQ ID NO: 2028495 - protein, 18 aa, Staphylococcus
LSESHLDIAIVDRDVPGK

SEQ ID NO: 2028496 - protein, 18 aa, Staphylococcus
LSESHLNYPITYIEINQQ

SEQ ID NO: 2028497 - protein, 24 aa, Staphylococcus
LSEVSLKVFGEFDIDVNEAKELIN

SEQ ID NO: 2028498 - protein, 20 aa, Staphylococcus
LSEYGVWHPNAWHYAPEPKY

SEQ ID NO: 2028499 - protein, 17 aa, Staphylococcus
LSFELYINFLNEMFQSV

SEQ ID NO: 2028500 - protein, 17 aa, Staphylococcus
LSFLGADLLKKTLPEII

SEQ ID NO: 2028501 - protein, 22 aa, Staphylococcus
LSFLNSLPIRGIGLDFVHDHGF

SEQ ID NO: 2028502 - protein, 25 aa, Staphylococcus
LSFNFMCFKSGTPIEDDVFMINKFV

SEQ ID NO: 2028503 - protein, 22 aa, Staphylococcus
LSFPPVLKAYIDAISIAGKTFK

SEQ ID NO: 2028504 - protein, 17 aa, Staphylococcus
LSFPSLVFDLTYFAIKQ

SEQ ID NO: 2028505 - protein, 19 aa, Staphylococcus
LSFSGQMHGLVVLNKEGQP

SEQ ID NO: 2028506 - protein, 20 aa, Staphylococcus
LSFSIPQGFVTGFIGANGAG

SEQ ID NO: 2028507 - protein, 19 aa, Staphylococcus
LSFSIPQGFVTGFIGSNGA

SEQ ID NO: 2028508 - protein, 19 aa, Staphylococcus
LSFVVSEIIELSDTTLDEL

SEQ ID NO: 2028509 - protein, 18 aa, Staphylococcus
LSGAHGRTLLGIKDKQRM

SEQ ID NO: 2028510 - protein, 19 aa, Staphylococcus
LSGAHGRTLLGLKSPQKMK

SEQ ID NO: 2028511 - protein, 18 aa, Staphylococcus
LSGAVAWISGLRRAQSPT

SEQ ID NO: 2028512 - protein, 18 aa, Staphylococcus
LSGAVAWVSGLRRAQSPT

SEQ ID NO: 2028513 - protein, 17 aa, Staphylococcus
LSGDEFEDFIVLTTEYY

SEQ ID NO: 2028514 - protein, 26 aa, Staphylococcus
LSGDFISVGLAKLFYKELPNVNLHSL

SEQ ID NO: 2028515 - protein, 17 aa, Staphylococcus
LSGEKILFIGTGSIAQQ

SEQ ID NO: 2028516 - protein, 18 aa, Staphylococcus
LSGELAIQLIEGAPREIK

SEQ ID NO: 2028517 - protein, 22 aa, Staphylococcus
LSGELEEGGTIFIDVDNENEIT

SEQ ID NO: 2028518 - protein, 23 aa, Staphylococcus
LSGERIVLRFGSVTHHAKVYIDG

SEQ ID NO: 2028519 - protein, 17 aa, Staphylococcus
LSGGEAHITDYSNASRT

SEQ ID NO: 2028520 - protein, 22 aa, Staphylococcus
LSGGEKIRLRWAQIVHTDYNLL

SEQ ID NO: 2028521 - protein, 25 aa, Staphylococcus
LSGGQKRLLDFVLTLIGKPQFLILD

SEQ ID NO: 2028522 - protein, 21 aa, Staphylococcus
LSGGQRQRAYIAMTIAQDTDY

SEQ ID NO: 2028523 - protein, 22 aa, Staphylococcus
LSGGQRQRAYIAMTIAQDTEYI

SEQ ID NO: 2028524 - protein, 26 aa, Staphylococcus
LSGGQRQRAYIAMTIAQNTEYILLDE

SEQ ID NO: 2028525 - protein, 29 aa, Staphylococcus
LSGGQRQRVWIAMALAQKTDIIFLDEPTT

SEQ ID NO: 2028526 - protein, 30 aa, Staphylococcus
LSGGQRQRVWIAMALAQKTDIIFLDEPTTY

SEQ ID NO: 2028527 - protein, 17 aa, Staphylococcus
LSGHGAFLVTTNDYLAE

SEQ ID NO: 2028528 - protein, 17 aa, Staphylococcus
LSGHSDLIAGIVVTNNA

SEQ ID NO: 2028529 - protein, 17 aa, Staphylococcus
LSGKAAHITDYTNASRT

SEQ ID NO: 2028530 - protein, 17 aa, Staphylococcus
LSGKAINACQQYDVNQL

SEQ ID NO: 2028531 - protein, 18 aa, Staphylococcus
LSGKKLAFVPILRAGLGM

SEQ ID NO: 2028532 - protein, 20 aa, Staphylococcus
LSGKYPIKYKNLIQTVAEKL

SEQ ID NO: 2028533 - protein, 25 aa, Staphylococcus
LSGNTWLFFGEQYFTTDFLYQTEWQ

SEQ ID NO: 2028534 - protein, 24 aa, Staphylococcus
LSGPKRPQDLIFLSDMKKEFEKSV

SEQ ID NO: 2028535 - protein, 20 aa, Staphylococcus
LSGPKRPQDLIFLSDMKSEF

SEQ ID NO: 2028536 - protein, 20 aa, Staphylococcus
LSGPKRPQDLIFLSDMKTEF

SEQ ID NO: 2028537 - protein, 21 aa, Staphylococcus
LSGPKRPQDLIKLGDMKESFE

SEQ ID NO: 2028538 - protein, 29 aa, Staphylococcus
LSGRVGYHPTWKMVLGLFPKEDKIKAMHA

SEQ ID NO: 2028539 - protein, 29 aa, Staphylococcus
LSGRVGYHPTWKMVLGLFPKEDKIKAMNA

SEQ ID NO: 2028540 - protein, 29 aa, Staphylococcus
LSGRVGYHPTWKMVLGLFPKEDKVKAMDA

SEQ ID NO: 2028541 - protein, 23 aa, Staphylococcus
LSGTVTPQGFFAVIEKPHYNDTE

SEQ ID NO: 2028542 - protein, 23 aa, Staphylococcus
LSGTVTPQGFFAVIEKPIYESNN

SEQ ID NO: 2028543 - protein, 17 aa, Staphylococcus
LSGTWKFKLVQHQEEID

SEQ ID NO: 2028544 - protein, 28 aa, Staphylococcus
LSHALDVAGEFDIQIALHADTLNEAGFM

SEQ ID NO: 2028545 - protein, 23 aa, Staphylococcus
LSHHMKVLVTYQFVTTRKVGNKR

SEQ ID NO: 2028546 - protein, 22 aa, Staphylococcus
LSHKTIVYKGWLRSDQIKGLYL

SEQ ID NO: 2028547 - protein, 23 aa, Staphylococcus
LSHKTIVYKGWLRSDQIKKLYLD

SEQ ID NO: 2028548 - protein, 23 aa, Staphylococcus
LSHKTIVYKGWLRSDQIKTLYLD

SEQ ID NO: 2028549 - protein, 20 aa, Staphylococcus
LSHLRPAFKKNGSVTAGNAS

SEQ ID NO: 2028550 - protein, 20 aa, Staphylococcus
LSHLRVIIRSLLGIAVPTQI

SEQ ID NO: 2028551 - protein, 20 aa, Staphylococcus
LSHLRVIVRSLLGIAVPTQI

SEQ ID NO: 2028552 - protein, 19 aa, Staphylococcus
LSHMKRVGFNIVSINHDNG

SEQ ID NO: 2028553 - protein, 17 aa, Staphylococcus
LSHRIFQEVGGYTEQKL

SEQ ID NO: 2028554 - protein, 17 aa, Staphylococcus
LSHRVFQEVGGLSEERL

SEQ ID NO: 2028555 - protein, 20 aa, Staphylococcus
LSHSFIKSLVLGISGGQDST

SEQ ID NO: 2028556 - protein, 26 aa, Staphylococcus
LSHSLSLFVCVFALYTGRTFIGQQQF

SEQ ID NO: 2028557 - protein, 23 aa, Staphylococcus
LSHYPKHAFNMARYVDDNQANIT

SEQ ID NO: 2028558 - protein, 19 aa, Staphylococcus
LSIAETWNELGMRATESHD

SEQ ID NO: 2028559 - protein, 27 aa, Staphylococcus
LSIDIDEDFLLVKREIFSSGKSICRIN

SEQ ID NO: 2028560 - protein, 20 aa, Staphylococcus
LSIEAGEFVAIMGPSGSGKT

SEQ ID NO: 2028561 - protein, 17 aa, Staphylococcus
LSIESDLAILMVVGLGM

SEQ ID NO: 2028562 - protein, 18 aa, Staphylococcus
LSIFKNVFEYTRRIYKLQ

SEQ ID NO: 2028563 - protein, 17 aa, Staphylococcus
LSIFTVPVDLIFFQGKE

SEQ ID NO: 2028564 - protein, 20 aa, Staphylococcus
LSIFTVPVDLIFLDEKEMHR

SEQ ID NO: 2028565 - protein, 23 aa, Staphylococcus
LSIFTVPVDLIFLNGKEMHRQGR

SEQ ID NO: 2028566 - protein, 23 aa, Staphylococcus
LSIFTVPVDLIFMNGKEMHRQAR

SEQ ID NO: 2028567 - protein, 20 aa, Staphylococcus
LSILGGEPFCNLDVTLRLVQ

SEQ ID NO: 2028568 - protein, 27 aa, Staphylococcus
LSILYMHYDYWFTYEFQHKIHTVSLKS

SEQ ID NO: 2028569 - protein, 17 aa, Staphylococcus
LSINCYHKLALYYIKKD

SEQ ID NO: 2028570 - protein, 25 aa, Staphylococcus
LSIPELRKRIKLVAEQNYEQIRALE

SEQ ID NO: 2028571 - protein, 24 aa, Staphylococcus
LSIQGFGRARIVDIGGKTKKEKVH

SEQ ID NO: 2028572 - protein, 17 aa, Staphylococcus
LSISEAINFIKDDHPDL

SEQ ID NO: 2028573 - protein, 17 aa, Staphylococcus
LSIVNHFAGKKHSILDI

SEQ ID NO: 2028574 - protein, 17 aa, Staphylococcus
LSIYIVTGFLGSGKTSF

SEQ ID NO: 2028575 - protein, 20 aa, Staphylococcus
LSIYLAYGVLDIIQIFNDLL

SEQ ID NO: 2028576 - protein, 25 aa, Staphylococcus
LSKAAEYFDRIILLNRTLRYFGPSQ

SEQ ID NO: 2028577 - protein, 18 aa, Staphylococcus
LSKAKAFTLDILKSMKAY

SEQ ID NO: 2028578 - protein, 30 aa, Staphylococcus
LSKEKRVSVKRAFIGSFLFGGRYSSSKFKI

SEQ ID NO: 2028579 - protein, 18 aa, Staphylococcus
LSKELIDTVHEYFNGLYI

SEQ ID NO: 2028580 - protein, 18 aa, Staphylococcus
LSKENVFETLSNVKVDYA

SEQ ID NO: 2028581 - protein, 18 aa, Staphylococcus
LSKFGTSMDKVFGETINN

SEQ ID NO: 2028582 - protein, 18 aa, Staphylococcus
LSKHLKYDLFNILFEMVR

SEQ ID NO: 2028583 - protein, 23 aa, Staphylococcus
LSKIGGGVAINLSKLRARGEAIK

SEQ ID NO: 2028584 - protein, 18 aa, Staphylococcus
LSKIYIRDFEGLRIDETQ

SEQ ID NO: 2028585 - protein, 19 aa, Staphylococcus
LSKKDCHYMTNGSCWCVKA

SEQ ID NO: 2028586 - protein, 21 aa, Staphylococcus
LSKKLAESFQVVLIDLRGHGY

SEQ ID NO: 2028587 - protein, 20 aa, Staphylococcus
LSKKVKFTCWEKYDDNHKIV

SEQ ID NO: 2028588 - protein, 17 aa, Staphylococcus
LSKLGYKSVAYWSKAQE

SEQ ID NO: 2028589 - protein, 22 aa, Staphylococcus
LSKNQKGMVVQDDWKGKKHKFH

SEQ ID NO: 2028590 - protein, 18 aa, Staphylococcus
LSKRCFKYTNNGSLPLQL

SEQ ID NO: 2028591 - protein, 27 aa, Staphylococcus
LSKRIKSVEAYFNCHLFYRTSKGIFLN

SEQ ID NO: 2028592 - protein, 18 aa, Staphylococcus
LSKRLPRIYHHNEEQVVT

SEQ ID NO: 2028593 - protein, 23 aa, Staphylococcus
LSKRMISDLVHYARTGTMPYEPY

SEQ ID NO: 2028594 - protein, 18 aa, Staphylococcus
LSKSPAMFDRQKLAWVNN

SEQ ID NO: 2028595 - protein, 25 aa, Staphylococcus
LSKSRPYIANMLRLLKLPSDVAKMV

SEQ ID NO: 2028596 - protein, 17 aa, Staphylococcus
LSKTEMIILEMLIQKQN

SEQ ID NO: 2028597 - protein, 17 aa, Staphylococcus
LSKTGLTYMTLGQPLST

SEQ ID NO: 2028598 - protein, 27 aa, Staphylococcus
LSKYPHLKIKWIRGNIDTRLNKLETED

SEQ ID NO: 2028599 - protein, 17 aa, Staphylococcus
LSLADKWILTRLNETIE

SEQ ID NO: 2028600 - protein, 17 aa, Staphylococcus
LSLADKWILTRLNETIK

SEQ ID NO: 2028601 - protein, 19 aa, Staphylococcus
LSLAMCLRESFKEIEAANE

SEQ ID NO: 2028602 - protein, 19 aa, Staphylococcus
LSLDYAIEVTLDMLMDAHS

SEQ ID NO: 2028603 - protein, 22 aa, Staphylococcus
LSLEKGKMLGFLGRNGAGKTTT

SEQ ID NO: 2028604 - protein, 17 aa, Staphylococcus
LSLIGGYQALLKFEDVR

SEQ ID NO: 2028605 - protein, 19 aa, Staphylococcus
LSLIKSEIRTCRKDIEDLN

SEQ ID NO: 2028606 - protein, 21 aa, Staphylococcus
LSLKPGASYKHFDPSESDTFI

SEQ ID NO: 2028607 - protein, 23 aa, Staphylococcus
LSLLDTPTFFFGMRHGETVEIEI

SEQ ID NO: 2028608 - protein, 18 aa, Staphylococcus
LSLLKLKEHVNFSEEGHY

SEQ ID NO: 2028609 - protein, 20 aa, Staphylococcus
LSLLLRRPPGREAYPGDVFY

SEQ ID NO: 2028610 - protein, 21 aa, Staphylococcus
LSLLLRRPPGREAYPGDVFYL

SEQ ID NO: 2028611 - protein, 28 aa, Staphylococcus
LSLLRWSEELKRVGIESIHLDITTMPPK

SEQ ID NO: 2028612 - protein, 18 aa, Staphylococcus
LSLNEEYDLISLRKTIIR

SEQ ID NO: 2028613 - protein, 19 aa, Staphylococcus
LSLNLNRVGLYIKNDIASI

SEQ ID NO: 2028614 - protein, 18 aa, Staphylococcus
LSLNRDVKGIVTMCAPME

SEQ ID NO: 2028615 - protein, 18 aa, Staphylococcus
LSLNRPVKGIITMCAPAE

SEQ ID NO: 2028616 - protein, 17 aa, Staphylococcus
LSLPGWDSSYTKEDLNQ

SEQ ID NO: 2028617 - protein, 18 aa, Staphylococcus
LSLSRNLPQHEAHNYKEI

SEQ ID NO: 2028618 - protein, 19 aa, Staphylococcus
LSLTAYKRIEAISDEGTFK

SEQ ID NO: 2028619 - protein, 20 aa, Staphylococcus
LSLVKFFFKHLTRYLKKQRG

SEQ ID NO: 2028620 - protein, 20 aa, Staphylococcus
LSLYACIYALFTGRTFVGQI

SEQ ID NO: 2028621 - protein, 18 aa, Staphylococcus
LSLYNVFVEKDCSIVEIN

SEQ ID NO: 2028622 - protein, 18 aa, Staphylococcus
LSLYPTKNLEDFYDKEGF

SEQ ID NO: 2028623 - protein, 21 aa, Staphylococcus
LSLYTCIYALYSGRTFIGQRQ

SEQ ID NO: 2028624 - protein, 21 aa, Staphylococcus
LSLYTCIYALYTGRTFIGQTR

SEQ ID NO: 2028625 - protein, 17 aa, Staphylococcus
LSMDPRLMEAIRLSSKQ

SEQ ID NO: 2028626 - protein, 25 aa, Staphylococcus
LSMGQKRRLSVAIALSASSDLILLD

SEQ ID NO: 2028627 - protein, 23 aa, Staphylococcus
LSMKSHYATLVVRPKHSEEMINN

SEQ ID NO: 2028628 - protein, 23 aa, Staphylococcus
LSMKSQYATLVVRPNHNQDIINN

SEQ ID NO: 2028629 - protein, 17 aa, Staphylococcus
LSNAGAHVVDESVVVDN

SEQ ID NO: 2028630 - protein, 18 aa, Staphylococcus
LSNALTFVVETAVNQVGV

SEQ ID NO: 2028631 - protein, 19 aa, Staphylococcus
LSNCDAFVLSSNYEGLGLV

SEQ ID NO: 2028632 - protein, 17 aa, Staphylococcus
LSNDLLLQLDAKYTNFI

SEQ ID NO: 2028633 - protein, 24 aa, Staphylococcus
LSNFKFNELMVSIQSAFLYNDEDE

SEQ ID NO: 2028634 - protein, 17 aa, Staphylococcus
LSNFSVNEIKIIKPVLL

SEQ ID NO: 2028635 - protein, 17 aa, Staphylococcus
LSNKRYVMLSNIVNGVD

SEQ ID NO: 2028636 - protein, 17 aa, Staphylococcus
LSNKTFYLLDILQKLPI

SEQ ID NO: 2028637 - protein, 21 aa, Staphylococcus
LSNRDDYTFPVSMSKIYDFII

SEQ ID NO: 2028638 - protein, 27 aa, Staphylococcus
LSNSLRERICEAAIQLMENIKYVNAGT

SEQ ID NO: 2028639 - protein, 23 aa, Staphylococcus
LSPDAIITYAIYLSRYEYSVFKD

SEQ ID NO: 2028640 - protein, 23 aa, Staphylococcus
LSPDMTYAYIFGMFDQNELVAAA

SEQ ID NO: 2028641 - protein, 21 aa, Staphylococcus
LSPDYCIPAPFDRRVAPSVAR

SEQ ID NO: 2028642 - protein, 26 aa, Staphylococcus
LSPEYFHYLSRAKYWINNQNFPYYLA

SEQ ID NO: 2028643 - protein, 23 aa, Staphylococcus
LSPMHLDQSFKMIVGQSPSEYAK

SEQ ID NO: 2028644 - protein, 17 aa, Staphylococcus
LSPQCGFASTEEGNQLT

SEQ ID NO: 2028645 - protein, 17 aa, Staphylococcus
LSPQIAQNIIAYREENG

SEQ ID NO: 2028646 - protein, 25 aa, Staphylococcus
LSPTKCLRILALFRLINPTKEIRIA

SEQ ID NO: 2028647 - protein, 26 aa, Staphylococcus
LSPVLKKLEQVHIFIQPELNINIEIS

SEQ ID NO: 2028648 - protein, 19 aa, Staphylococcus
LSQEIYLDLAPVVTTGKNR

SEQ ID NO: 2028649 - protein, 18 aa, Staphylococcus
LSQEMSIGVITNDIYTKE

SEQ ID NO: 2028650 - protein, 18 aa, Staphylococcus
LSQKEIDDLAALVYYPEE

SEQ ID NO: 2028651 - protein, 18 aa, Staphylococcus
LSQLEASFISEIYSLFDA

SEQ ID NO: 2028652 - protein, 17 aa, Staphylococcus
LSQLFPTHIVVETSSGI

SEQ ID NO: 2028653 - protein, 17 aa, Staphylococcus
LSQLFPTHVVVETNGVG

SEQ ID NO: 2028654 - protein, 23 aa, Staphylococcus
LSQLNMKAPLLVSGTDGVGTKLK

SEQ ID NO: 2028655 - protein, 22 aa, Staphylococcus
LSQLNMKAPVLVSGTDGVGTKL

SEQ ID NO: 2028656 - protein, 23 aa, Staphylococcus
LSQLNMKAPVLVSGTDGVGTKLK

SEQ ID NO: 2028657 - protein, 22 aa, Staphylococcus
LSQQYLKCLIQYDETYHSSQKY

SEQ ID NO: 2028658 - protein, 19 aa, Staphylococcus
LSQRFTNKTSHEHWVNHCI

SEQ ID NO: 2028659 - protein, 22 aa, Staphylococcus
LSRGCSTEDVYNLSIITAAQSL

SEQ ID NO: 2028660 - protein, 25 aa, Staphylococcus
LSRKIKGKWLVHGHVPTRRYGAKKN

SEQ ID NO: 2028661 - protein, 20 aa, Staphylococcus
LSRNLIEQALSYDLPIYNSF

SEQ ID NO: 2028662 - protein, 26 aa, Staphylococcus
LSRQGIWKMIKQYGIKSNITKTLTPH

SEQ ID NO: 2028663 - protein, 20 aa, Staphylococcus
LSRSKVDAIILMATDITDKH

SEQ ID NO: 2028664 - protein, 25 aa, Staphylococcus
LSRSYEFISKLAIKYQVDVIAGSVS

SEQ ID NO: 2028665 - protein, 26 aa, Staphylococcus
LSRVELADFLTLKGLNAGEGRVLTPH

SEQ ID NO: 2028666 - protein, 20 aa, Staphylococcus
LSSDLFKGIGKKTAENIVDT

SEQ ID NO: 2028667 - protein, 21 aa, Staphylococcus
LSSDLFKGIGKKTAQNIVNTL

SEQ ID NO: 2028668 - protein, 22 aa, Staphylococcus
LSSDLFKGIGKKTAQNIVNTLG

SEQ ID NO: 2028669 - protein, 18 aa, Staphylococcus
LSSDRLIAISNFISNNNI

SEQ ID NO: 2028670 - protein, 23 aa, Staphylococcus
LSSELYKELELIINQNQSLADAG

SEQ ID NO: 2028671 - protein, 19 aa, Staphylococcus
LSSEMKKSDVIVTVHDIDQ

SEQ ID NO: 2028672 - protein, 20 aa, Staphylococcus
LSSEPTYHRSSFKTSEVPSA

SEQ ID NO: 2028673 - protein, 18 aa, Staphylococcus
LSSFQLLGIEQYKPHIAI

SEQ ID NO: 2028674 - protein, 18 aa, Staphylococcus
LSSFQLLGVEQYRPHIAI

SEQ ID NO: 2028675 - protein, 17 aa, Staphylococcus
LSSGEIQTKHAIEQGYY

SEQ ID NO: 2028676 - protein, 23 aa, Staphylococcus
LSSGEKQTMYAIENNQYEVEDAE

SEQ ID NO: 2028677 - protein, 25 aa, Staphylococcus
LSSGGKRVRPAFVILSSQFGKEEGV

SEQ ID NO: 2028678 - protein, 25 aa, Staphylococcus
LSSGGKRVRPAFVILSSQFGKSKQS

SEQ ID NO: 2028679 - protein, 25 aa, Staphylococcus
LSSGGKRVRPAFVILSSQFGPQKKT

SEQ ID NO: 2028680 - protein, 25 aa, Staphylococcus
LSSGGKRVRPAFVLLSSQFGPKKIT

SEQ ID NO: 2028681 - protein, 25 aa, Staphylococcus
LSSGGKRVRPVFVILSSQFGTSEGT

SEQ ID NO: 2028682 - protein, 19 aa, Staphylococcus
LSSGISLPAGELAKLAGVK

SEQ ID NO: 2028683 - protein, 23 aa, Staphylococcus
LSSGMKMKLSLALALSHHAELFV

SEQ ID NO: 2028684 - protein, 17 aa, Staphylococcus
LSSKAFKNMIKKTLSEA

SEQ ID NO: 2028685 - protein, 23 aa, Staphylococcus
LSSKMIKEGVCQLDIKLDTGRTH

SEQ ID NO: 2028686 - protein, 20 aa, Staphylococcus
LSSKTIVYKGWLRSDQIKSL

SEQ ID NO: 2028687 - protein, 19 aa, Staphylococcus
LSSLPVGGLGLDFVHDHGY

SEQ ID NO: 2028688 - protein, 24 aa, Staphylococcus
LSSLQEMYQGFFLAPHVVSQSLKG

SEQ ID NO: 2028689 - protein, 20 aa, Staphylococcus
LSSMCKHFSIQLSENEGDIK

SEQ ID NO: 2028690 - protein, 24 aa, Staphylococcus
LSSQFHTLIGMGFKKYVDTLKISK

SEQ ID NO: 2028691 - protein, 19 aa, Staphylococcus
LSSQMKKLFGKDANVTIVN

SEQ ID NO: 2028692 - protein, 30 aa, Staphylococcus
LSSSDYFATFAIKVAHYLDIDTIAFGSEIN

SEQ ID NO: 2028693 - protein, 20 aa, Staphylococcus
LSSSLFKRVAETFQHANIIE

SEQ ID NO: 2028694 - protein, 17 aa, Staphylococcus
LSSVIGVVGEVITTMAI

SEQ ID NO: 2028695 - protein, 20 aa, Staphylococcus
LSSYYKFKQPTLLYEQQIQR

SEQ ID NO: 2028696 - protein, 17 aa, Staphylococcus
LSTDERVLWVTETTTNR

SEQ ID NO: 2028697 - protein, 23 aa, Staphylococcus
LSTEESFQQFIYFIGEHKKVFKH

SEQ ID NO: 2028698 - protein, 23 aa, Staphylococcus
LSTILKAHRIILLAFGEKKRAAI

SEQ ID NO: 2028699 - protein, 27 aa, Staphylococcus
LSTKISSNWPKNVSVFSNQVETYQAIT

SEQ ID NO: 2028700 - protein, 17 aa, Staphylococcus
LSTLGFKHEGFHNGFDP

SEQ ID NO: 2028701 - protein, 24 aa, Staphylococcus
LSTLYRWNKSYKEQGLKGLIYATR

SEQ ID NO: 2028702 - protein, 17 aa, Staphylococcus
LSTQVVESCKAHDYETI

SEQ ID NO: 2028703 - protein, 19 aa, Staphylococcus
LSTSVLKCKINNLDIADFT

SEQ ID NO: 2028704 - protein, 25 aa, Staphylococcus
LSVAERLFYEYGFKGVGLKQIIQEA

SEQ ID NO: 2028705 - protein, 19 aa, Staphylococcus
LSVDCKWTIYPGGHIEVDM

SEQ ID NO: 2028706 - protein, 25 aa, Staphylococcus
LSVELRPASLDDLGLEAAFKSYFKQ

SEQ ID NO: 2028707 - protein, 25 aa, Staphylococcus
LSVELRPSSLDDLGLDAAFRSYFKQ

SEQ ID NO: 2028708 - protein, 22 aa, Staphylococcus
LSVELSERIKLNIPVISAGMDT

SEQ ID NO: 2028709 - protein, 18 aa, Staphylococcus
LSVERPFNLVYSILAKHL

SEQ ID NO: 2028710 - protein, 28 aa, Staphylococcus
LSVETLKLFKGIDVYTFIAGRSLTEAED

SEQ ID NO: 2028711 - protein, 19 aa, Staphylococcus
LSVGDLHFSQGDVNVATST

SEQ ID NO: 2028712 - protein, 17 aa, Staphylococcus
LSVGLKQDNALVCEVEH

SEQ ID NO: 2028713 - protein, 21 aa, Staphylococcus
LSVIQRICHRIIVLKDGAIVD

SEQ ID NO: 2028714 - protein, 17 aa, Staphylococcus
LSVTLKVGRLAEVLEGA

SEQ ID NO: 2028715 - protein, 24 aa, Staphylococcus
LSVVPFEPGCYLMKDRNDQIIYVG

SEQ ID NO: 2028716 - protein, 24 aa, Staphylococcus
LSVVPFEPGCYLMKDRNDQVIYVG

SEQ ID NO: 2028717 - protein, 19 aa, Staphylococcus
LSVWHDMSFFIKQDSTHYT

SEQ ID NO: 2028718 - protein, 23 aa, Staphylococcus
LSWIKKNMDGLMFYPQPFQKQKA

SEQ ID NO: 2028719 - protein, 20 aa, Staphylococcus
LSWKDLFSDFEMHFYRYVFP

SEQ ID NO: 2028720 - protein, 20 aa, Staphylococcus
LSYEAGRIPIKYTAQASSPT

SEQ ID NO: 2028721 - protein, 17 aa, Staphylococcus
LSYELQDMLHLFPQLKI

SEQ ID NO: 2028722 - protein, 19 aa, Staphylococcus
LSYHPDYAIMTNIDFDHPD

SEQ ID NO: 2028723 - protein, 20 aa, Staphylococcus
LSYHPDYAIMTNIDFDHPDY

SEQ ID NO: 2028724 - protein, 19 aa, Staphylococcus
LSYHPDYAIMTNIDYDHPD

SEQ ID NO: 2028725 - protein, 17 aa, Staphylococcus
LSYIGLNYLTLARETTS

SEQ ID NO: 2028726 - protein, 17 aa, Staphylococcus
LSYKQLSQMVHLSQPVV

SEQ ID NO: 2028727 - protein, 25 aa, Staphylococcus
LSYLIKELKFESAIYDLVSSYSHGM

SEQ ID NO: 2028728 - protein, 18 aa, Staphylococcus
LSYPFLTTYSFKEEIVNY

SEQ ID NO: 2028729 - protein, 19 aa, Staphylococcus
LSYPGGPAIDALALEGKDT

SEQ ID NO: 2028730 - protein, 24 aa, Staphylococcus
LSYPRLFSQVGMFSPMFNEVVDVL

SEQ ID NO: 2028731 - protein, 25 aa, Staphylococcus
LSYRHGKMPLTMFITKKGKKVKVNH

SEQ ID NO: 2028732 - protein, 18 aa, Staphylococcus
LSYSRFMTHLKFFSQRLI

SEQ ID NO: 2028733 - protein, 30 aa, Staphylococcus
LSYVLKRLDYGGSLALIGLTGGHHFDSTVF

SEQ ID NO: 2028734 - protein, 25 aa, Staphylococcus
LTAEEQKAIILYALIQSKIPIKQYS

SEQ ID NO: 2028735 - protein, 23 aa, Staphylococcus
LTAEHPFELIYGILSKHKSYELT

SEQ ID NO: 2028736 - protein, 24 aa, Staphylococcus
LTAGWTGDVKYHLGGVKTTDSYGI

SEQ ID NO: 2028737 - protein, 24 aa, Staphylococcus
LTAGWTGDVKYHLGGVKTTSSYGI

SEQ ID NO: 2028738 - protein, 24 aa, Staphylococcus
LTAHKFGGPKGVGVLLVRDKTPIE

SEQ ID NO: 2028739 - protein, 20 aa, Staphylococcus
LTALAHGEKGLFIVPLNGLK

SEQ ID NO: 2028740 - protein, 17 aa, Staphylococcus
LTAMVAIPLCYNNQVYG

SEQ ID NO: 2028741 - protein, 17 aa, Staphylococcus
LTAPVGAFRLHEESKPQ

SEQ ID NO: 2028742 - protein, 19 aa, Staphylococcus
LTAPVRQIAENAGLEGSII

SEQ ID NO: 2028743 - protein, 25 aa, Staphylococcus
LTARENLLFFGRLAGLKGESLTDNM

SEQ ID NO: 2028744 - protein, 18 aa, Staphylococcus
LTASSLLGDFGRSVQKLS

SEQ ID NO: 2028745 - protein, 17 aa, Staphylococcus
LTCLHVNHNIRPIAKEE

SEQ ID NO: 2028746 - protein, 23 aa, Staphylococcus
LTCPITFGNIKFYTMPYATVSEV

SEQ ID NO: 2028747 - protein, 23 aa, Staphylococcus
LTDDFAPLVVMCGHGSQSANNPY

SEQ ID NO: 2028748 - protein, 17 aa, Staphylococcus
LTDEKLAICIGFTEVYI

SEQ ID NO: 2028749 - protein, 23 aa, Staphylococcus
LTDEKYFGGSFERLQTLTQLTHL

SEQ ID NO: 2028750 - protein, 28 aa, Staphylococcus
LTDETSQLFSFFISYHFNQFDLSFQQLF

SEQ ID NO: 2028751 - protein, 22 aa, Staphylococcus
LTDEYYFGGSYERLNKLTKETD

SEQ ID NO: 2028752 - protein, 23 aa, Staphylococcus
LTDFPGFSFPSLTPIEKEGFETI

SEQ ID NO: 2028753 - protein, 24 aa, Staphylococcus
LTDFTYQSQCRWYSESEKLKLQLE

SEQ ID NO: 2028754 - protein, 18 aa, Staphylococcus
LTDFVRYEVGEGMEKREE

SEQ ID NO: 2028755 - protein, 17 aa, Staphylococcus
LTDGSYYTGLRRNSMAC

SEQ ID NO: 2028756 - protein, 24 aa, Staphylococcus
LTDHHIPFVFIDRINNEHNGISTN

SEQ ID NO: 2028757 - protein, 24 aa, Staphylococcus
LTDHPVKGMLTGPVTILNWSFERV

SEQ ID NO: 2028758 - protein, 18 aa, Staphylococcus
LTDILKALFPCGSITGAP

SEQ ID NO: 2028759 - protein, 21 aa, Staphylococcus
LTDILKNLGIEKVDGIYYDLG

SEQ ID NO: 2028760 - protein, 24 aa, Staphylococcus
LTDKEIRRLFDMIHNLKAKGVSFV

SEQ ID NO: 2028761 - protein, 19 aa, Staphylococcus
LTDKGRIAFDIHEQLHKEF

SEQ ID NO: 2028762 - protein, 18 aa, Staphylococcus
LTDKGVIFSNGLNGPKAR

SEQ ID NO: 2028763 - protein, 17 aa, Staphylococcus
LTDKVHTGDTAFIPTPD

SEQ ID NO: 2028764 - protein, 17 aa, Staphylococcus
LTDLLAITDTVVSRAGS

SEQ ID NO: 2028765 - protein, 24 aa, Staphylococcus
LTDLPPIYMFGGAYEIYLPDMQRF

SEQ ID NO: 2028766 - protein, 24 aa, Staphylococcus
LTDMIKYKYPRLFDNVSKALRIVW

SEQ ID NO: 2028767 - protein, 17 aa, Staphylococcus
LTDREKFVNINLEEIGK

SEQ ID NO: 2028768 - protein, 18 aa, Staphylococcus
LTDTRANLVAEIGSGSPV

SEQ ID NO: 2028769 - protein, 20 aa, Staphylococcus
LTDVQYSYFIGRKKELSHHN

SEQ ID NO: 2028770 - protein, 24 aa, Staphylococcus
LTDYLKKRNCLYVLVDPYLLENLR

SEQ ID NO: 2028771 - protein, 27 aa, Staphylococcus
LTEAPALRFFKYFYTHRGPVMDYSNIE

SEQ ID NO: 2028772 - protein, 28 aa, Staphylococcus
LTEARSLKFFKYFYTHRGPVMDYNNQSL

SEQ ID NO: 2028773 - protein, 25 aa, Staphylococcus
LTEARTLKFFKYFYTHRGPVMDYNN

SEQ ID NO: 2028774 - protein, 20 aa, Staphylococcus
LTEDLILKEDMTIFESVQAF

SEQ ID NO: 2028775 - protein, 17 aa, Staphylococcus
LTEDVKAALGLDNDVAV

SEQ ID NO: 2028776 - protein, 18 aa, Staphylococcus
LTEEALELILPKVQFNLL

SEQ ID NO: 2028777 - protein, 24 aa, Staphylococcus
LTEFGVWHPYAWDYAPIRTDLTPQ

SEQ ID NO: 2028778 - protein, 24 aa, Staphylococcus
LTEGCICCAMKADVSDQLHQLYLD

SEQ ID NO: 2028779 - protein, 20 aa, Staphylococcus
LTEIAWKHDVQVMIEGPGHI

SEQ ID NO: 2028780 - protein, 18 aa, Staphylococcus
LTEIGLDLPFSIRMARTL

SEQ ID NO: 2028781 - protein, 19 aa, Staphylococcus
LTEITNFLKDVPIETSTSS

SEQ ID NO: 2028782 - protein, 18 aa, Staphylococcus
LTELALRFNQGINTDGDA

SEQ ID NO: 2028783 - protein, 21 aa, Staphylococcus
LTELALRFNQGINVDGDALKK

SEQ ID NO: 2028784 - protein, 22 aa, Staphylococcus
LTELIMAYQRIKTRTSFNTPKS

SEQ ID NO: 2028785 - protein, 19 aa, Staphylococcus
LTELIVAYQRVKNRVELNT

SEQ ID NO: 2028786 - protein, 21 aa, Staphylococcus
LTELLKPYRDVVFIVDKNVEF

SEQ ID NO: 2028787 - protein, 18 aa, Staphylococcus
LTEMFDALNFYKKPVKMC

SEQ ID NO: 2028788 - protein, 25 aa, Staphylococcus
LTEMIKYKYPRLFDIVHKAIDQTWP

SEQ ID NO: 2028789 - protein, 18 aa, Staphylococcus
LTENLNVCFNCDHHIALP

SEQ ID NO: 2028790 - protein, 26 aa, Staphylococcus
LTEQFPRMTYAEAMSRYGSDKPDTRF

SEQ ID NO: 2028791 - protein, 23 aa, Staphylococcus
LTESGKLFLHYAKIICQNYKDLS

SEQ ID NO: 2028792 - protein, 18 aa, Staphylococcus
LTESITWADNRASKYAEL

SEQ ID NO: 2028793 - protein, 26 aa, Staphylococcus
LTEVKSSPRILGFDAVGTVQKTGTEV

SEQ ID NO: 2028794 - protein, 18 aa, Staphylococcus
LTEVPGFHAKGYIFEHDQ

SEQ ID NO: 2028795 - protein, 24 aa, Staphylococcus
LTEYGVWHPHAWDYAPKSTLSSDT

SEQ ID NO: 2028796 - protein, 18 aa, Staphylococcus
LTEYGVWHPKAWHSAPKA

SEQ ID NO: 2028797 - protein, 20 aa, Staphylococcus
LTEYGVWHPKAWNYAPRPIK

SEQ ID NO: 2028798 - protein, 19 aa, Staphylococcus
LTFDFLKNQIAAILNNKNS

SEQ ID NO: 2028799 - protein, 19 aa, Staphylococcus
LTFDIPENYFIKMGETKHE

SEQ ID NO: 2028800 - protein, 25 aa, Staphylococcus
LTFNHSFEAFKNWFKEDVEFNTYEV

SEQ ID NO: 2028801 - protein, 25 aa, Staphylococcus
LTFNRSFESFKNWFKEDEHFNTFII

SEQ ID NO: 2028802 - protein, 37 aa, Staphylococcus
LTFSDEVIEKIAGIAAREVQGILSLKGNLVDSLSNQF

SEQ ID NO: 2028803 - protein, 18 aa, Staphylococcus
LTGDIFHSQRCDCGAQLE

SEQ ID NO: 2028804 - protein, 19 aa, Staphylococcus
LTGDIFHSQRCDCGAQLES

SEQ ID NO: 2028805 - protein, 20 aa, Staphylococcus
LTGDIFHSQRCDCGEQLAAS

SEQ ID NO: 2028806 - protein, 18 aa, Staphylococcus
LTGGALSLLSLIDRNGIV

SEQ ID NO: 2028807 - protein, 19 aa, Staphylococcus
LTGGHHFDSTVFPFILRGA

SEQ ID NO: 2028808 - protein, 18 aa, Staphylococcus
LTGGTGFLGAYLINELQD

SEQ ID NO: 2028809 - protein, 17 aa, Staphylococcus
LTGGVAVIKVGAASETE

SEQ ID NO: 2028810 - protein, 25 aa, Staphylococcus
LTGHLLSLPGWAGMMYYRAEKHEHE

SEQ ID NO: 2028811 - protein, 18 aa, Staphylococcus
LTGIQLASIIKMSGKPLS

SEQ ID NO: 2028812 - protein, 18 aa, Staphylococcus
LTGKELKEGFKDVPQVSL

SEQ ID NO: 2028813 - protein, 23 aa, Staphylococcus
LTGKRLSDEKVLILGTGSLAQQT

SEQ ID NO: 2028814 - protein, 26 aa, Staphylococcus
LTGLAEGQRGFFIIPLNGLKKLQTPV

SEQ ID NO: 2028815 - protein, 17 aa, Staphylococcus
LTGLFGRPVGDRENSMT

SEQ ID NO: 2028816 - protein, 26 aa, Staphylococcus
LTGLPMKRVEDIKSYINHDVPKVMGV

SEQ ID NO: 2028817 - protein, 26 aa, Staphylococcus
LTGLPMKRVEDIKSYITHSVPKVMGV

SEQ ID NO: 2028818 - protein, 18 aa, Staphylococcus
LTGMHFTIRVINGLTMEQ

SEQ ID NO: 2028819 - protein, 18 aa, Staphylococcus
LTGMHFTLVVKNNLTINE

SEQ ID NO: 2028820 - protein, 22 aa, Staphylococcus
LTGNFLLALGLEHLSEIRDNRI

SEQ ID NO: 2028821 - protein, 17 aa, Staphylococcus
LTGSMRAGKAVYKNAAD

SEQ ID NO: 2028822 - protein, 17 aa, Staphylococcus
LTHHIIRKSLTYLEEHI

SEQ ID NO: 2028823 - protein, 18 aa, Staphylococcus
LTHHVVRKALTYLEDHIP

SEQ ID NO: 2028824 - protein, 18 aa, Staphylococcus
LTHHVVRKALTYLEEHIP

SEQ ID NO: 2028825 - protein, 25 aa, Staphylococcus
LTHKNLDLFLGIPYAYPPIGHRRFK

SEQ ID NO: 2028826 - protein, 18 aa, Staphylococcus
LTHLEDWLDTEITTLPEP

SEQ ID NO: 2028827 - protein, 24 aa, Staphylococcus
LTIARAVRTGRMWVNTYDQVPEGA

SEQ ID NO: 2028828 - protein, 18 aa, Staphylococcus
LTICSDVLDFAFNPGGPV

SEQ ID NO: 2028829 - protein, 23 aa, Staphylococcus
LTIDEYKNVYSLFHSDKEAMQEY

SEQ ID NO: 2028830 - protein, 19 aa, Staphylococcus
LTIDISQPIVITGAMRSSN

SEQ ID NO: 2028831 - protein, 17 aa, Staphylococcus
LTIEAFNLAEEYQCPVI

SEQ ID NO: 2028832 - protein, 19 aa, Staphylococcus
LTIEKKWDVTTAILTGNFL

SEQ ID NO: 2028833 - protein, 17 aa, Staphylococcus
LTIKEAINFIKDDYPDL

SEQ ID NO: 2028834 - protein, 24 aa, Staphylococcus
LTIKLRKNAKWSNGDPVTAHDFVF

SEQ ID NO: 2028835 - protein, 18 aa, Staphylococcus
LTIKSNEVIADMHVIGTY

SEQ ID NO: 2028836 - protein, 19 aa, Staphylococcus
LTILEAMKYGTPVITTKLY

SEQ ID NO: 2028837 - protein, 22 aa, Staphylococcus
LTIRKDYDLIFYRSYTNALMPY

SEQ ID NO: 2028838 - protein, 18 aa, Staphylococcus
LTISEISDAYGFSSSASY

SEQ ID NO: 2028839 - protein, 24 aa, Staphylococcus
LTIYEWPEKLLVKELKKLALQQKV

SEQ ID NO: 2028840 - protein, 26 aa, Staphylococcus
LTIYKHFALPFGHRFADESVKRTRIH

SEQ ID NO: 2028841 - protein, 26 aa, Staphylococcus
LTKAEIVELFAFISFTNCQQQFGALM

SEQ ID NO: 2028842 - protein, 19 aa, Staphylococcus
LTKDPEFRTTPSGVDVATF

SEQ ID NO: 2028843 - protein, 19 aa, Staphylococcus
LTKDPEYRSTPSGVSVATF

SEQ ID NO: 2028844 - protein, 22 aa, Staphylococcus
LTKDPKYLIGRIIARPYIGEPG

SEQ ID NO: 2028845 - protein, 22 aa, Staphylococcus
LTKDPKYLIGRVIARPYVGEPG

SEQ ID NO: 2028846 - protein, 23 aa, Staphylococcus
LTKDPKYLIGRVIARPYVGEPGN

SEQ ID NO: 2028847 - protein, 21 aa, Staphylococcus
LTKEEFDLIVALGQGQEKLPR

SEQ ID NO: 2028848 - protein, 22 aa, Staphylococcus
LTKEEIYLIGSHLDKEIEDLNQ

SEQ ID NO: 2028849 - protein, 29 aa, Staphylococcus
LTKEEVLILLTLWDKGSMTLKEMDSYVNI

SEQ ID NO: 2028850 - protein, 27 aa, Staphylococcus
LTKEIKLLLLSCFVREDFEKFMYQLMN

SEQ ID NO: 2028851 - protein, 22 aa, Staphylococcus
LTKELNFDAGVDYKKDDFAQTL

SEQ ID NO: 2028852 - protein, 21 aa, Staphylococcus
LTKEMDAELGVMISASHNPVA

SEQ ID NO: 2028853 - protein, 22 aa, Staphylococcus
LTKEMGAELGVMISASHNPVAD

SEQ ID NO: 2028854 - protein, 17 aa, Staphylococcus
LTKEMKESDVIVTVYDI

SEQ ID NO: 2028855 - protein, 24 aa, Staphylococcus
LTKEYGETVVPVFWIAGEDHDFDE

SEQ ID NO: 2028856 - protein, 17 aa, Staphylococcus
LTKFAIAAMKLENVVKY

SEQ ID NO: 2028857 - protein, 23 aa, Staphylococcus
LTKFPGIGKKTARQIILDLKGKV

SEQ ID NO: 2028858 - protein, 21 aa, Staphylococcus
LTKGRIKFLATTGEEMEQLGS

SEQ ID NO: 2028859 - protein, 25 aa, Staphylococcus
LTKGRLQKNLINWFIDDQYKLFYKK

SEQ ID NO: 2028860 - protein, 26 aa, Staphylococcus
LTKGRLQKNLLNWFIDDQYKLFYKKQ

SEQ ID NO: 2028861 - protein, 24 aa, Staphylococcus
LTKGRLQRDLTNWFIDDQYKLFYK

SEQ ID NO: 2028862 - protein, 25 aa, Staphylococcus
LTKGRLQRNLTNWFIDDQYKLFYKK

SEQ ID NO: 2028863 - protein, 21 aa, Staphylococcus
LTKGTGIFVNVLRSFSHFSHQ

SEQ ID NO: 2028864 - protein, 24 aa, Staphylococcus
LTKKEFIDIPVLFDDEGNFRKKQV

SEQ ID NO: 2028865 - protein, 23 aa, Staphylococcus
LTKKTFPGYVLVELVMTDESWYI

SEQ ID NO: 2028866 - protein, 23 aa, Staphylococcus
LTKKTFPGYVLVELVMTDESWYV

SEQ ID NO: 2028867 - protein, 36 aa, Staphylococcus
LTKLKSLGLNSNWDMLFVVLAIHFIEICKTLPSEDV

SEQ ID NO: 2028868 - protein, 18 aa, Staphylococcus
LTKLPIIPGSSIKGKMRS

SEQ ID NO: 2028869 - protein, 24 aa, Staphylococcus
LTKMHIKTTLNFSGQEAIETLEKD

SEQ ID NO: 2028870 - protein, 24 aa, Staphylococcus
LTKNEILTGFYLAIAPAGEYHYKL

SEQ ID NO: 2028871 - protein, 17 aa, Staphylococcus
LTKRRILNPNTQRELQE

SEQ ID NO: 2028872 - protein, 24 aa, Staphylococcus
LTKSEKKIADFILITPHKMINMSV

SEQ ID NO: 2028873 - protein, 22 aa, Staphylococcus
LTKSFDGEDIFNNVDFEVKTGE

SEQ ID NO: 2028874 - protein, 17 aa, Staphylococcus
LTKSRYAERSNWIKLKE

SEQ ID NO: 2028875 - protein, 27 aa, Staphylococcus
LTKTAVCGLARCKKSDIDAVYEATKDA

SEQ ID NO: 2028876 - protein, 26 aa, Staphylococcus
LTKVAKLPYSIRVLLESVLRQEDGFV

SEQ ID NO: 2028877 - protein, 17 aa, Staphylococcus
LTKVFKFHSTNEKGHSV

SEQ ID NO: 2028878 - protein, 20 aa, Staphylococcus
LTKVNGGFVVTGGSANLLGV

SEQ ID NO: 2028879 - protein, 17 aa, Staphylococcus
LTKVWYKDDYPLIEVGE

SEQ ID NO: 2028880 - protein, 23 aa, Staphylococcus
LTKYLKKHRTLFASLDPYILENI

SEQ ID NO: 2028881 - protein, 17 aa, Staphylococcus
LTLCNVLSYKEHRERLR

SEQ ID NO: 2028882 - protein, 19 aa, Staphylococcus
LTLDLIKQLIRIHKPQSIL

SEQ ID NO: 2028883 - protein, 27 aa, Staphylococcus
LTLEERLKLSAAYVRDFYQTEISISLL

SEQ ID NO: 2028884 - protein, 18 aa, Staphylococcus
LTLEGYKVSLFNLEANTP

SEQ ID NO: 2028885 - protein, 25 aa, Staphylococcus
LTLEKPHPYCLVSVIEGDGQLTVDD

SEQ ID NO: 2028886 - protein, 23 aa, Staphylococcus
LTLESKALLSIFLSNSDNWNLHM

SEQ ID NO: 2028887 - protein, 17 aa, Staphylococcus
LTLGTGIGGAFYNRDIG

SEQ ID NO: 2028888 - protein, 24 aa, Staphylococcus
LTLKEVVKTFAMVTGKPTEIKGSF

SEQ ID NO: 2028889 - protein, 18 aa, Staphylococcus
LTLNEGYKQYVLMVEDVV

SEQ ID NO: 2028890 - protein, 17 aa, Staphylococcus
LTLPKTNLIRFIFENGF

SEQ ID NO: 2028891 - protein, 19 aa, Staphylococcus
LTLPQTRVRKLLKKMDYYI

SEQ ID NO: 2028892 - protein, 18 aa, Staphylococcus
LTLRRDKHVDYVVIGLDE

SEQ ID NO: 2028893 - protein, 17 aa, Staphylococcus
LTLRSTRQLSYIFITHD

SEQ ID NO: 2028894 - protein, 17 aa, Staphylococcus
LTLSGGGGVNWSFFEQG

SEQ ID NO: 2028895 - protein, 17 aa, Staphylococcus
LTLSSMFEAVGAFKDGS

SEQ ID NO: 2028896 - protein, 18 aa, Staphylococcus
LTLYNQWLFHYFKIEGMH

SEQ ID NO: 2028897 - protein, 25 aa, Staphylococcus
LTMCYADCVPIYFYSESHDFVGLAH

SEQ ID NO: 2028898 - protein, 24 aa, Staphylococcus
LTMCYADCVPVYFYSEKHGYVGLA

SEQ ID NO: 2028899 - protein, 25 aa, Staphylococcus
LTMCYADCVPVYFYSEKHHFIALAH

SEQ ID NO: 2028900 - protein, 24 aa, Staphylococcus
LTMCYADCVPVYFYSEKHHYIGLA

SEQ ID NO: 2028901 - protein, 23 aa, Staphylococcus
LTMCYADCVPVYFYSEKHHYVGL

SEQ ID NO: 2028902 - protein, 17 aa, Staphylococcus
LTMEAFNLAEEYQCPVI

SEQ ID NO: 2028903 - protein, 24 aa, Staphylococcus
LTNAPSVEWHIENLRNYAFLSPTK

SEQ ID NO: 2028904 - protein, 17 aa, Staphylococcus
LTNCCLIDAESMLSHGF

SEQ ID NO: 2028905 - protein, 18 aa, Staphylococcus
LTNFLKQRNCLYVLVDPY

SEQ ID NO: 2028906 - protein, 27 aa, Staphylococcus
LTNGEYFRAGIIFKQLLDINEKVCTVG

SEQ ID NO: 2028907 - protein, 25 aa, Staphylococcus
LTNKKAHKSHLWFHTKDIPGSHVVI

SEQ ID NO: 2028908 - protein, 25 aa, Staphylococcus
LTNKKARKGYLWFHTKDIPGSHVVI

SEQ ID NO: 2028909 - protein, 19 aa, Staphylococcus
LTNKWRRTSVVLNKNGKQS

SEQ ID NO: 2028910 - protein, 25 aa, Staphylococcus
LTNPPIRAGKEVVHRIFEEAYQQLN

SEQ ID NO: 2028911 - protein, 22 aa, Staphylococcus
LTNRSMALIGIIDLLKQAKNRK

SEQ ID NO: 2028912 - protein, 20 aa, Staphylococcus
LTNWIQKRIDAWKYQNNSNS

SEQ ID NO: 2028913 - protein, 23 aa, Staphylococcus
LTPEAMKRIILKSITSAQELSFE

SEQ ID NO: 2028914 - protein, 25 aa, Staphylococcus
LTPELAFKLGRYGGYVLAHNKGEKN

SEQ ID NO: 2028915 - protein, 18 aa, Staphylococcus
LTPELSNLRYDPYTPQVP

SEQ ID NO: 2028916 - protein, 19 aa, Staphylococcus
LTPENKVVFVKQYRKPVEK

SEQ ID NO: 2028917 - protein, 24 aa, Staphylococcus
LTPEQQHWLSGYLLNPATTSVSDN

SEQ ID NO: 2028918 - protein, 17 aa, Staphylococcus
LTPFMNVSEDVWEFEKF

SEQ ID NO: 2028919 - protein, 25 aa, Staphylococcus
LTPMKCLRIIAIFRLVNPTKEIRIA

SEQ ID NO: 2028920 - protein, 25 aa, Staphylococcus
LTPMKCLRILSIFRLINPTKEIRVA

SEQ ID NO: 2028921 - protein, 22 aa, Staphylococcus
LTPNLERQEWLTSYSKKLPHYQ

SEQ ID NO: 2028922 - protein, 19 aa, Staphylococcus
LTPQEGRDIFFNKDLRKKK

SEQ ID NO: 2028923 - protein, 20 aa, Staphylococcus
LTPRAVIVGKPLVNIGRIAE

SEQ ID NO: 2028924 - protein, 17 aa, Staphylococcus
LTPRLKTSDGLYVTANQ

SEQ ID NO: 2028925 - protein, 25 aa, Staphylococcus
LTPRRFTEVMALYDIYVKPHDVQSA

SEQ ID NO: 2028926 - protein, 18 aa, Staphylococcus
LTPYVGVRVIEFADVPAG

SEQ ID NO: 2028927 - protein, 40 aa, Staphylococcus
LTQFDFLFNFERLNINKGFFCCSGISVAHGVTDFSFEEVE

SEQ ID NO: 2028928 - protein, 19 aa, Staphylococcus
LTQKIVEKWSMLINEVLHD

SEQ ID NO: 2028929 - protein, 20 aa, Staphylococcus
LTQLCKHLSIQLSENEGNIE

SEQ ID NO: 2028930 - protein, 18 aa, Staphylococcus
LTQLDDWLYGRGVSDMKG

SEQ ID NO: 2028931 - protein, 27 aa, Staphylococcus
LTQLMKYGGGICYRLFEDDSLDIALFN

SEQ ID NO: 2028932 - protein, 18 aa, Staphylococcus
LTQLPFEVGGGIRTLETI

SEQ ID NO: 2028933 - protein, 23 aa, Staphylococcus
LTQQKAFEVEPIFLKEKLASSKW

SEQ ID NO: 2028934 - protein, 21 aa, Staphylococcus
LTRANSLIVHSVFQKLSEVTQ

SEQ ID NO: 2028935 - protein, 22 aa, Staphylococcus
LTREMGAELGVMISASHNPVAD

SEQ ID NO: 2028936 - protein, 22 aa, Staphylococcus
LTREMGAQLGIMISASHNPVAD

SEQ ID NO: 2028937 - protein, 23 aa, Staphylococcus
LTRFKGEIQSLGFSIELGKNQTP

SEQ ID NO: 2028938 - protein, 17 aa, Staphylococcus
LTRGVAHDEYGCEYIIQ

SEQ ID NO: 2028939 - protein, 22 aa, Staphylococcus
LTRHNIGFEVIDYILERHRFTL

SEQ ID NO: 2028940 - protein, 22 aa, Staphylococcus
LTRHNIGFEVIDYILERNQFTL

SEQ ID NO: 2028941 - protein, 24 aa, Staphylococcus
LTRILPVVKEIAFKHCALQVPPAG

SEQ ID NO: 2028942 - protein, 24 aa, Staphylococcus
LTRIQFGPLDLKGLNAGEGRVLTP

SEQ ID NO: 2028943 - protein, 25 aa, Staphylococcus
LTRIQFGPLDLKGLNAGEGRVLTPH

SEQ ID NO: 2028944 - protein, 18 aa, Staphylococcus
LTRKFEVDHIYVGEESII

SEQ ID NO: 2028945 - protein, 19 aa, Staphylococcus
LTRQIPMIFLDPAPGQELE

SEQ ID NO: 2028946 - protein, 20 aa, Staphylococcus
LTRYLKKQRGLFVLIDPYIL

SEQ ID NO: 2028947 - protein, 24 aa, Staphylococcus
LTSDWFTEQGFSFFEFQYTSNLIK

SEQ ID NO: 2028948 - protein, 25 aa, Staphylococcus
LTSGLKLHLIPAINRLNANIETHNP

SEQ ID NO: 2028949 - protein, 17 aa, Staphylococcus
LTSGLYFGEPRHIDNQS

SEQ ID NO: 2028950 - protein, 24 aa, Staphylococcus
LTSGWTGDVKYHLGGVKTTDSYGT

SEQ ID NO: 2028951 - protein, 19 aa, Staphylococcus
LTSHPKQVFLRDTLIEKVW

SEQ ID NO: 2028952 - protein, 19 aa, Staphylococcus
LTSICKKWYINSFKYFRNM

SEQ ID NO: 2028953 - protein, 21 aa, Staphylococcus
LTSNPQFCWLNLSDRNQFNFP

SEQ ID NO: 2028954 - protein, 17 aa, Staphylococcus
LTSPLLTAEWEEKLTQI

SEQ ID NO: 2028955 - protein, 24 aa, Staphylococcus
LTSQLSIILAYGIIDIKQIVTQLL

SEQ ID NO: 2028956 - protein, 19 aa, Staphylococcus
LTSQLSIYLAYGVLDIIQI

SEQ ID NO: 2028957 - protein, 24 aa, Staphylococcus
LTSTECPNCGKFMIKVKTKNGQML

SEQ ID NO: 2028958 - protein, 25 aa, Staphylococcus
LTSTECPTCGKFMIRVKTKNGQMLV

SEQ ID NO: 2028959 - protein, 19 aa, Staphylococcus
LTSYYYVILHLSKHPLIPI

SEQ ID NO: 2028960 - protein, 17 aa, Staphylococcus
LTTEALETILPKVQFNL

SEQ ID NO: 2028961 - protein, 23 aa, Staphylococcus
LTTEEIVELIAFITFTNAQQNFG

SEQ ID NO: 2028962 - protein, 17 aa, Staphylococcus
LTTEIEEVIQWLNQQDC

SEQ ID NO: 2028963 - protein, 17 aa, Staphylococcus
LTTELLLDAQFLTNENI

SEQ ID NO: 2028964 - protein, 20 aa, Staphylococcus
LTTFCRHLSIQLSENEGDII

SEQ ID NO: 2028965 - protein, 34 aa, Staphylococcus
LTTKAIHACKAYNVKRLIVAGGVASNRGLRESIS

SEQ ID NO: 2028966 - protein, 18 aa, Staphylococcus
LTTKEINDLAALVYYPEE

SEQ ID NO: 2028967 - protein, 23 aa, Staphylococcus
LTTLDQLLPCLKNVHVAANEYKG

SEQ ID NO: 2028968 - protein, 25 aa, Staphylococcus
LTTLSRLVAPFVPFISEKIHYNLTG

SEQ ID NO: 2028969 - protein, 23 aa, Staphylococcus
LTTQFYPTQFIKFEEATIDTNHT

SEQ ID NO: 2028970 - protein, 18 aa, Staphylococcus
LTTQFYPTQSIKFEEATI

SEQ ID NO: 2028971 - protein, 28 aa, Staphylococcus
LTTTAVCGLARCIKSDIDAVYEATKHAA

SEQ ID NO: 2028972 - protein, 26 aa, Staphylococcus
LTTTAVCGLARCVKKDIDAVYESTKA

SEQ ID NO: 2028973 - protein, 17 aa, Staphylococcus
LTTYHNLHFLLKLMENI

SEQ ID NO: 2028974 - protein, 23 aa, Staphylococcus
LTTYHNLYFLLKLMEDIRQAIRE

SEQ ID NO: 2028975 - protein, 32 aa, Staphylococcus
LTVDRLTGIVSRGGSIMAQWCLAHHEESFLYE

SEQ ID NO: 2028976 - protein, 19 aa, Staphylococcus
LTVINELAWHNLFAHNMFI

SEQ ID NO: 2028977 - protein, 19 aa, Staphylococcus
LTVINELAWHNLFAQNMFI

SEQ ID NO: 2028978 - protein, 21 aa, Staphylococcus
LTVLSELCLPLAKKGGQFIAL

SEQ ID NO: 2028979 - protein, 24 aa, Staphylococcus
LTVPSKAWLKEAIRNIPEKNEKKL

SEQ ID NO: 2028980 - protein, 24 aa, Staphylococcus
LTVPSQFWLERAIHYIEDNSDHVY

SEQ ID NO: 2028981 - protein, 18 aa, Staphylococcus
LTVQEYIDTIYLMNKKSI

SEQ ID NO: 2028982 - protein, 30 aa, Staphylococcus
LTVQVKRKSAMERYVFKGDIMYGCGQKSQP

SEQ ID NO: 2028983 - protein, 18 aa, Staphylococcus
LTVREQLMIVAKEAGIKR

SEQ ID NO: 2028984 - protein, 20 aa, Staphylococcus
LTVVNELAWHNLFAQNMFIR

SEQ ID NO: 2028985 - protein, 18 aa, Staphylococcus
LTWGVDYIKPEIVLMYDL

SEQ ID NO: 2028986 - protein, 25 aa, Staphylococcus
LTWKDLFHDFEMHFYRYVFPYYDTL

SEQ ID NO: 2028987 - protein, 20 aa, Staphylococcus
LTWKDLFNDFEMHFYRYVFP

SEQ ID NO: 2028988 - protein, 20 aa, Staphylococcus
LTYAERYFLMKFFNIPTDED

SEQ ID NO: 2028989 - protein, 22 aa, Staphylococcus
LTYEHVKLAIIYAVKQLQEQQL

SEQ ID NO: 2028990 - protein, 27 aa, Staphylococcus
LTYGAKMAWRNSNRCIGRLFWESLNVI

SEQ ID NO: 2028991 - protein, 19 aa, Staphylococcus
LTYHSFLALYKAILKDEGE

SEQ ID NO: 2028992 - protein, 37 aa, Staphylococcus
LTYKNIRSNCGIGFKGFWDRENGFNYAFFEAVDKDLP

SEQ ID NO: 2028993 - protein, 24 aa, Staphylococcus
LTYQFPFNDEWFVYWGGDNELFNY

SEQ ID NO: 2028994 - protein, 24 aa, Staphylococcus
LTYVKDCELPIVIKKDGLAAGKGV

SEQ ID NO: 2028995 - protein, 23 aa, Staphylococcus
LTYVKGRYDGYLGGGINIQKFEQ

SEQ ID NO: 2028996 - protein, 19 aa, Staphylococcus
LTYVKTCELPVVIKKDGLA

SEQ ID NO: 2028997 - protein, 17 aa, Staphylococcus
LVADADLPGALQREQCQ

SEQ ID NO: 2028998 - protein, 17 aa, Staphylococcus
LVADNFDLKNFANIEFL

SEQ ID NO: 2028999 - protein, 17 aa, Staphylococcus
LVAFLKEREEIAEVYYP

SEQ ID NO: 2029000 - protein, 17 aa, Staphylococcus
LVAFVANGSILPRKSGV

SEQ ID NO: 2029001 - protein, 17 aa, Staphylococcus
LVAKHLISPELIKQPAS

SEQ ID NO: 2029002 - protein, 18 aa, Staphylococcus
LVAKHLISPELIRQPASA

SEQ ID NO: 2029003 - protein, 18 aa, Staphylococcus
LVAPMPIDVCNAESQGFI

SEQ ID NO: 2029004 - protein, 18 aa, Staphylococcus
LVASHAFTGSILPSIAEE

SEQ ID NO: 2029005 - protein, 17 aa, Staphylococcus
LVASLRNSDEFIPDLSL

SEQ ID NO: 2029006 - protein, 22 aa, Staphylococcus
LVCPVCNARLTLNSHKKKSNSG

SEQ ID NO: 2029007 - protein, 27 aa, Staphylococcus
LVCTPKNTLCMFCPVQEHCEAFLNGTV

SEQ ID NO: 2029008 - protein, 19 aa, Staphylococcus
LVDALRFNNRMKYMVETNE

SEQ ID NO: 2029009 - protein, 20 aa, Staphylococcus
LVDAPCSGLGVLKHKPEIKY

SEQ ID NO: 2029010 - protein, 17 aa, Staphylococcus
LVDCFFKGLTKYLKKHR

SEQ ID NO: 2029011 - protein, 25 aa, Staphylococcus
LVDDEFKLSNAVGIYRLKKSFGKEN

SEQ ID NO: 2029012 - protein, 19 aa, Staphylococcus
LVDEDFQLSKAIGVYQLKK

SEQ ID NO: 2029013 - protein, 18 aa, Staphylococcus
LVDELLKQSGIFRENEHV

SEQ ID NO: 2029014 - protein, 18 aa, Staphylococcus
LVDEVGMLMAYEVTRDLQ

SEQ ID NO: 2029015 - protein, 22 aa, Staphylococcus
LVDEYRYGPVYIGDHTLIGANS

SEQ ID NO: 2029016 - protein, 18 aa, Staphylococcus
LVDFKVEFGKTSDGKILL

SEQ ID NO: 2029017 - protein, 19 aa, Staphylococcus
LVDHCYRINVKSLIQLTRG

SEQ ID NO: 2029018 - protein, 24 aa, Staphylococcus
LVDKEEKRLHAIFKDIPQEKQNVV

SEQ ID NO: 2029019 - protein, 29 aa, Staphylococcus
LVDQLKYFINERIIPVIPQQGSLGASGDL

SEQ ID NO: 2029020 - protein, 21 aa, Staphylococcus
LVDRTKVVLGRMYKLNDGSDQ

SEQ ID NO: 2029021 - protein, 17 aa, Staphylococcus
LVEAGADAIKFLLYYDV

SEQ ID NO: 2029022 - protein, 18 aa, Staphylococcus
LVEAGPKVTSLFLQQQLV

SEQ ID NO: 2029023 - protein, 17 aa, Staphylococcus
LVEAGRVFIALPPLYKL

SEQ ID NO: 2029024 - protein, 19 aa, Staphylococcus
LVEAVLPYHPFFIKPNKDE

SEQ ID NO: 2029025 - protein, 17 aa, Staphylococcus
LVEAVRNNFDLRPAGII

SEQ ID NO: 2029026 - protein, 29 aa, Staphylococcus
LVEEGRTNYALHFKDGRKITVNTKQQLDT

SEQ ID NO: 2029027 - protein, 18 aa, Staphylococcus
LVEELRTEIQKMREDRQM

SEQ ID NO: 2029028 - protein, 19 aa, Staphylococcus
LVEFAEWMVSLNGAGQGQE

SEQ ID NO: 2029029 - protein, 26 aa, Staphylococcus
LVEGYKLAEFDKIIVYRNEKDLTQLQ

SEQ ID NO: 2029030 - protein, 17 aa, Staphylococcus
LVEHLRHNIDLSLQLND

SEQ ID NO: 2029031 - protein, 24 aa, Staphylococcus
LVELSLPLQLFFEKDTCLSTSYFD

SEQ ID NO: 2029032 - protein, 24 aa, Staphylococcus
LVEMSASLIHEWNKIIQKLRHFFD

SEQ ID NO: 2029033 - protein, 19 aa, Staphylococcus
LVENGKLKGLITIKDIEKV

SEQ ID NO: 2029034 - protein, 25 aa, Staphylococcus
LVENRISDILSRLSIAPSEELDAQF

SEQ ID NO: 2029035 - protein, 24 aa, Staphylococcus
LVERLKTLIPRQQFEVPVQAAVGQ

SEQ ID NO: 2029036 - protein, 25 aa, Staphylococcus
LVEVTRQDLVAGFVGQTAIKTEKIL

SEQ ID NO: 2029037 - protein, 18 aa, Staphylococcus
LVEYRKGQKVKFVKYTFG

SEQ ID NO: 2029038 - protein, 17 aa, Staphylococcus
LVFKRYFDEALSALTLY

SEQ ID NO: 2029039 - protein, 23 aa, Staphylococcus
LVFPDNVAIVLGIAQAVGIDSET

SEQ ID NO: 2029040 - protein, 26 aa, Staphylococcus
LVGGDCPKVKAKPCIAQMKYTLEFIG

SEQ ID NO: 2029041 - protein, 26 aa, Staphylococcus
LVGGDCPKVKAKPCIKQLEYSLDFLG

SEQ ID NO: 2029042 - protein, 26 aa, Staphylococcus
LVGGDCPKVKAKPCITQMKYSVEFLG

SEQ ID NO: 2029043 - protein, 18 aa, Staphylococcus
LVGKAIKACETYNVHQLI

SEQ ID NO: 2029044 - protein, 26 aa, Staphylococcus
LVGKRLQYPGAPGLGGIAIAKTMIEA

SEQ ID NO: 2029045 - protein, 18 aa, Staphylococcus
LVGMSGFEYRTINYQLFL

SEQ ID NO: 2029046 - protein, 27 aa, Staphylococcus
LVGNDIPVFFVQDAIKFPDVIHAVKPE

SEQ ID NO: 2029047 - protein, 20 aa, Staphylococcus
LVGVGEGFNVIASDALAMLQ

SEQ ID NO: 2029048 - protein, 20 aa, Staphylococcus
LVGYSFKFDGAISEEVLYQD

SEQ ID NO: 2029049 - protein, 17 aa, Staphylococcus
LVHCPERVLPGKILEEL

SEQ ID NO: 2029050 - protein, 22 aa, Staphylococcus
LVHITCRDRNLIGLQSHLLGLS

SEQ ID NO: 2029051 - protein, 32 aa, Staphylococcus
LVHLKKWNYSYAYSMRLVDEFSSINIIHQINQ

SEQ ID NO: 2029052 - protein, 18 aa, Staphylococcus
LVIDKIIEISLTYKLSDY

SEQ ID NO: 2029053 - protein, 17 aa, Staphylococcus
LVIEQGIIAREVEVAVL

SEQ ID NO: 2029054 - protein, 18 aa, Staphylococcus
LVIKGNSVSLGYLDNKEK

SEQ ID NO: 2029055 - protein, 18 aa, Staphylococcus
LVIKGTSVSLGYLKNKEK

SEQ ID NO: 2029056 - protein, 18 aa, Staphylococcus
LVIKKLQLWIKAILKKTD

SEQ ID NO: 2029057 - protein, 21 aa, Staphylococcus
LVILKRGYKVKAHFAHRSHSL

SEQ ID NO: 2029058 - protein, 17 aa, Staphylococcus
LVILSGMSGTGKSKLIK

SEQ ID NO: 2029059 - protein, 23 aa, Staphylococcus
LVINARLTTHIDLIRGGNTHHEI

SEQ ID NO: 2029060 - protein, 25 aa, Staphylococcus
LVIPVLQARGVFRKEYESHMLKDHL

SEQ ID NO: 2029061 - protein, 17 aa, Staphylococcus
LVISLGGLDCFDGGIGM

SEQ ID NO: 2029062 - protein, 23 aa, Staphylococcus
LVKCPPCHVADGDVTLPLKEVIR

SEQ ID NO: 2029063 - protein, 18 aa, Staphylococcus
LVKEEGPAHHRLFTSEVI

SEQ ID NO: 2029064 - protein, 19 aa, Staphylococcus
LVKEENLWKTNLENGNPEV

SEQ ID NO: 2029065 - protein, 26 aa, Staphylococcus
LVKEQLCLRNNDLLCHVVRSRSVDGK

SEQ ID NO: 2029066 - protein, 26 aa, Staphylococcus
LVKFVYKADEGFKSFNKRNDLLGDVL

SEQ ID NO: 2029067 - protein, 22 aa, Staphylococcus
LVKGHNAYGYLKAEKGVHRLVR

SEQ ID NO: 2029068 - protein, 18 aa, Staphylococcus
LVKHFEPVIGDFCSDCQS

SEQ ID NO: 2029069 - protein, 24 aa, Staphylococcus
LVKHKFPLVLGSDFAGVIEKVGKD

SEQ ID NO: 2029070 - protein, 17 aa, Staphylococcus
LVKKFKESAAVAVKHMN

SEQ ID NO: 2029071 - protein, 21 aa, Staphylococcus
LVKKLKRKGLDISAQSARDHI

SEQ ID NO: 2029072 - protein, 23 aa, Staphylococcus
LVKKTFPGYVLVELVMTDESWYV

SEQ ID NO: 2029073 - protein, 23 aa, Staphylococcus
LVKKTFPGYVLVELVMTDQSWYV

SEQ ID NO: 2029074 - protein, 24 aa, Staphylococcus
LVKLSGSIELACLVEMVDGIVDIV

SEQ ID NO: 2029075 - protein, 17 aa, Staphylococcus
LVKPDIRMSHFEFNDQG

SEQ ID NO: 2029076 - protein, 22 aa, Staphylococcus
LVKRAFIGSFLFGGNYMSEKFK

SEQ ID NO: 2029077 - protein, 17 aa, Staphylococcus
LVKRSERTIAIHGCKGE

SEQ ID NO: 2029078 - protein, 17 aa, Staphylococcus
LVKSERQGQSKIYMLND

SEQ ID NO: 2029079 - protein, 24 aa, Staphylococcus
LVKTLRKSDDYNYELEVIAKNEQN

SEQ ID NO: 2029080 - protein, 19 aa, Staphylococcus
LVLGDAVAYATQFQPQVIL

SEQ ID NO: 2029081 - protein, 20 aa, Staphylococcus
LVLKCRKLYGKNNVLATDIK

SEQ ID NO: 2029082 - protein, 27 aa, Staphylococcus
LVLQYHVPVCSFTFGIPNQEIIERLKA

SEQ ID NO: 2029083 - protein, 17 aa, Staphylococcus
LVLSDVLVFIESDVLID

SEQ ID NO: 2029084 - protein, 19 aa, Staphylococcus
LVMACYQMFHVLESLNVPY

SEQ ID NO: 2029085 - protein, 26 aa, Staphylococcus
LVMKQLFEHRGLPQLPYISFLRSEFE

SEQ ID NO: 2029086 - protein, 19 aa, Staphylococcus
LVMMVLRLNTLLKGHSGAT

SEQ ID NO: 2029087 - protein, 22 aa, Staphylococcus
LVMPSIPVFYFYSEDENFFKCY

SEQ ID NO: 2029088 - protein, 18 aa, Staphylococcus
LVNELIIFYEQFHINSAY

SEQ ID NO: 2029089 - protein, 18 aa, Staphylococcus
LVNFAIKLVDKSAQSNLI

SEQ ID NO: 2029090 - protein, 18 aa, Staphylococcus
LVNFAIKSVDKASQSNLI

SEQ ID NO: 2029091 - protein, 22 aa, Staphylococcus
LVNFKAPKEMIGKLVDVKIDEA

SEQ ID NO: 2029092 - protein, 21 aa, Staphylococcus
LVNFKAPKEMVGKLVDVKIDE

SEQ ID NO: 2029093 - protein, 38 aa, Staphylococcus
LVNKEGQSYFVKFHWKPKQGLESLVWDEAQILHGKDID

SEQ ID NO: 2029094 - protein, 20 aa, Staphylococcus
LVPAARVGHIGLYRDPKTLK

SEQ ID NO: 2029095 - protein, 18 aa, Staphylococcus
LVPEGFKVDGIISSNGTT

SEQ ID NO: 2029096 - protein, 28 aa, Staphylococcus
LVPGYEAPCYIAWSGKNRSPLIRVPSSR

SEQ ID NO: 2029097 - protein, 23 aa, Staphylococcus
LVPKEFSGIAAISYFREQDLETI

SEQ ID NO: 2029098 - protein, 18 aa, Staphylococcus
LVPKGFKVDGVISSNGTR

SEQ ID NO: 2029099 - protein, 18 aa, Staphylococcus
LVPNTSWISDAVELNGRG

SEQ ID NO: 2029100 - protein, 24 aa, Staphylococcus
LVQASKLKWVFKFEIASGDKVHCV

SEQ ID NO: 2029101 - protein, 24 aa, Staphylococcus
LVQELKEKYSIIIVTHNMQQAARV

SEQ ID NO: 2029102 - protein, 23 aa, Staphylococcus
LVQELKKDYSIIMVTHNMQQAAR

SEQ ID NO: 2029103 - protein, 17 aa, Staphylococcus
LVQESYDAMAVVHQCRE

SEQ ID NO: 2029104 - protein, 19 aa, Staphylococcus
LVQEWGKGLIVLSGQSGVG

SEQ ID NO: 2029105 - protein, 19 aa, Staphylococcus
LVQIIGSMIVLYKESNENK

SEQ ID NO: 2029106 - protein, 24 aa, Staphylococcus
LVQKEIFKTFEYKNARYRDLTTFF

SEQ ID NO: 2029107 - protein, 29 aa, Staphylococcus
LVQKIFDEWKIPIIFVTHSNYEAKKMAHE

SEQ ID NO: 2029108 - protein, 18 aa, Staphylococcus
LVQLCKMNDIPYKVDIYP

SEQ ID NO: 2029109 - protein, 20 aa, Staphylococcus
LVQMRRFILASSKEERVDAL

SEQ ID NO: 2029110 - protein, 25 aa, Staphylococcus
LVQNAIEIFGRVDVLINNAGLIPQS

SEQ ID NO: 2029111 - protein, 24 aa, Staphylococcus
LVQQEIQPVFSLGDFDSVNEQERA

SEQ ID NO: 2029112 - protein, 17 aa, Staphylococcus
LVQRIFEKWQIPIIFVT

SEQ ID NO: 2029113 - protein, 17 aa, Staphylococcus
LVQYKIPGISGVDTRSI

SEQ ID NO: 2029114 - protein, 19 aa, Staphylococcus
LVRKDGQFHEVEWEEALDV

SEQ ID NO: 2029115 - protein, 17 aa, Staphylococcus
LVRKGGIDQIVIESTGI

SEQ ID NO: 2029116 - protein, 17 aa, Staphylococcus
LVRRLSKDMSIGVITND

SEQ ID NO: 2029117 - protein, 21 aa, Staphylococcus
LVSAVKRYCELIGVQPEIQVE

SEQ ID NO: 2029118 - protein, 22 aa, Staphylococcus
LVSDIQKAAKWYEKTLGFNSVF

SEQ ID NO: 2029119 - protein, 23 aa, Staphylococcus
LVSDSYEAMSLVHDCREAGIPAY

SEQ ID NO: 2029120 - protein, 19 aa, Staphylococcus
LVSFNLMYQILRPKLVKHA

SEQ ID NO: 2029121 - protein, 18 aa, Staphylococcus
LVSFQYVFQYLLTQQRFE

SEQ ID NO: 2029122 - protein, 25 aa, Staphylococcus
LVSKKSGTIGLIWPSVDRVAVTHLI

SEQ ID NO: 2029123 - protein, 27 aa, Staphylococcus
LVSKVVPFRTAHEIVGKIVLNCIHKGI

SEQ ID NO: 2029124 - protein, 25 aa, Staphylococcus
LVTENPKAEAWGFKAQTTKHTNHTL

SEQ ID NO: 2029125 - protein, 24 aa, Staphylococcus
LVTKYEGWEFLGIVKDHDGAARGI

SEQ ID NO: 2029126 - protein, 18 aa, Staphylococcus
LVTPELNGSILPGITRKT

SEQ ID NO: 2029127 - protein, 23 aa, Staphylococcus
LVTYKLAENHFLLIVNAANTDKD

SEQ ID NO: 2029128 - protein, 25 aa, Staphylococcus
LVVAHPFHPVYILPLVEIVPGAQTS

SEQ ID NO: 2029129 - protein, 17 aa, Staphylococcus
LVVCSSGIGTSRLLATR

SEQ ID NO: 2029130 - protein, 19 aa, Staphylococcus
LVVDYGYPIGYSYKKDARG

SEQ ID NO: 2029131 - protein, 17 aa, Staphylococcus
LVVSLGFESETFGIKGM

SEQ ID NO: 2029132 - protein, 17 aa, Staphylococcus
LVVWAIKEGRGVAKSVH

SEQ ID NO: 2029133 - protein, 27 aa, Staphylococcus
LVWATAAPGWQKWVWTPFLSIMGSGAT

SEQ ID NO: 2029134 - protein, 20 aa, Staphylococcus
LVWMGGTFLEKGNVEEPEHD

SEQ ID NO: 2029135 - protein, 30 aa, Staphylococcus
LVYIDLFLIHWPCEKDGLYIESYKALEKLY

SEQ ID NO: 2029136 - protein, 20 aa, Staphylococcus
LVYMKSHLNFEVIGETRDDA

SEQ ID NO: 2029137 - protein, 21 aa, Staphylococcus
LVYRQDFKTAYERLSETNNFP

SEQ ID NO: 2029138 - protein, 26 aa, Staphylococcus
LVYYRAVVKHHQLRINAFEEVLTVKK

SEQ ID NO: 2029139 - protein, 18 aa, Staphylococcus
LVYYREVVKHHQLNIHAF

SEQ ID NO: 2029140 - protein, 18 aa, Staphylococcus
LVYYREVVKHHQLNIHPF

SEQ ID NO: 2029141 - protein, 18 aa, Staphylococcus
LVYYREVVKHHQLNVRAF

SEQ ID NO: 2029142 - protein, 18 aa, Staphylococcus
LWATKLNVGRFMIIDDEI

SEQ ID NO: 2029143 - protein, 19 aa, Staphylococcus
LWDNIRLDKDGNWTVNYRN

SEQ ID NO: 2029144 - protein, 24 aa, Staphylococcus
LWDSGKFLVGFGGEHGVTYPILKA
